United States Patent 11,492,591 (UNIVERSAL DONOR STEM CELLS AND RELATED METHODS) - sequence listing, part 16

SEQ ID NO: 503344 - DNA, 20 bp, Artificial
  CRISPR gRNA sequence
ggtctgcaggtgtgtaccac

SEQ ID NO: 503345 - DNA, 20 bp, Artificial
  CRISPR gRNA sequence
caggtgtgtaccactgcacc

SEQ ID NO: 503346 - DNA, 20 bp, Artificial
  CRISPR gRNA sequence
cacccagctgtattttctta

SEQ ID NO: 503347 - DNA, 20 bp, Artificial
  CRISPR gRNA sequence
tattttcttactaaatctca

SEQ ID NO: 503348 - DNA, 20 bp, Artificial
  CRISPR gRNA sequence
tcttactaaatctcacataa

SEQ ID NO: 503349 - DNA, 20 bp, Artificial
  CRISPR gRNA sequence
cttactaaatctcacataac

SEQ ID NO: 503350 - DNA, 20 bp, Artificial
  CRISPR gRNA sequence
ttactaaatctcacataaca

SEQ ID NO: 503351 - DNA, 20 bp, Artificial
  CRISPR gRNA sequence
actaaatctcacataacagc

SEQ ID NO: 503352 - DNA, 20 bp, Artificial
  CRISPR gRNA sequence
ctaaatctcacataacagcc

SEQ ID NO: 503353 - DNA, 20 bp, Artificial
  CRISPR gRNA sequence
aatctcacataacagcctca

SEQ ID NO: 503354 - DNA, 20 bp, Artificial
  CRISPR gRNA sequence
acataacagcctcatgaaaa

SEQ ID NO: 503355 - DNA, 20 bp, Artificial
  CRISPR gRNA sequence
atgaaaatagttctaatact

SEQ ID NO: 503356 - DNA, 20 bp, Artificial
  CRISPR gRNA sequence
taatactttagatgtggtct

SEQ ID NO: 503357 - DNA, 20 bp, Artificial
  CRISPR gRNA sequence
atactttagatgtggtctac

SEQ ID NO: 503358 - DNA, 20 bp, Artificial
  CRISPR gRNA sequence
tagatgtggtctacattcca

SEQ ID NO: 503359 - DNA, 20 bp, Artificial
  CRISPR gRNA sequence
agatgtggtctacattccat

SEQ ID NO: 503360 - DNA, 20 bp, Artificial
  CRISPR gRNA sequence
gatgtggtctacattccata

SEQ ID NO: 503361 - DNA, 20 bp, Artificial
  CRISPR gRNA sequence
cattccatatcacaatgagg

SEQ ID NO: 503362 - DNA, 20 bp, Artificial
  CRISPR gRNA sequence
catatcacaatgaggaaacc

SEQ ID NO: 503363 - DNA, 20 bp, Artificial
  CRISPR gRNA sequence
aggtcaactgatatctcaag

SEQ ID NO: 503364 - DNA, 20 bp, Artificial
  CRISPR gRNA sequence
atatctcaaggctacatagc

SEQ ID NO: 503365 - DNA, 20 bp, Artificial
  CRISPR gRNA sequence
aaggctacatagctaggtag

SEQ ID NO: 503366 - DNA, 20 bp, Artificial
  CRISPR gRNA sequence
catagctaggtagtggcaga

SEQ ID NO: 503367 - DNA, 20 bp, Artificial
  CRISPR gRNA sequence
ggtagtggcagagctgagcc

SEQ ID NO: 503368 - DNA, 20 bp, Artificial
  CRISPR gRNA sequence
agccaaagggtttctgagtc

SEQ ID NO: 503369 - DNA, 20 bp, Artificial
  CRISPR gRNA sequence
ctgagtctccattgcacctc

SEQ ID NO: 503370 - DNA, 20 bp, Artificial
  CRISPR gRNA sequence
tgagtctccattgcacctcc

SEQ ID NO: 503371 - DNA, 20 bp, Artificial
  CRISPR gRNA sequence
agtctccattgcacctcctc

SEQ ID NO: 503372 - DNA, 20 bp, Artificial
  CRISPR gRNA sequence
cattgcacctcctcatactc

SEQ ID NO: 503373 - DNA, 20 bp, Artificial
  CRISPR gRNA sequence
cacctcctcatactccacct

SEQ ID NO: 503374 - DNA, 20 bp, Artificial
  CRISPR gRNA sequence
ctcatactccacctcttata

SEQ ID NO: 503375 - DNA, 20 bp, Artificial
  CRISPR gRNA sequence
atactccacctcttatattc

SEQ ID NO: 503376 - DNA, 20 bp, Artificial
  CRISPR gRNA sequence
cacctcttatattctgggat

SEQ ID NO: 503377 - DNA, 20 bp, Artificial
  CRISPR gRNA sequence
ttatattctgggattacaga

SEQ ID NO: 503378 - DNA, 20 bp, Artificial
  CRISPR gRNA sequence
atattctgggattacagaaa

SEQ ID NO: 503379 - DNA, 20 bp, Artificial
  CRISPR gRNA sequence
tattctgggattacagaaat

SEQ ID NO: 503380 - DNA, 20 bp, Artificial
  CRISPR gRNA sequence
tgggattacagaaattcact

SEQ ID NO: 503381 - DNA, 20 bp, Artificial
  CRISPR gRNA sequence
ggattacagaaattcactca

SEQ ID NO: 503382 - DNA, 20 bp, Artificial
  CRISPR gRNA sequence
cagaaattcactcataaact

SEQ ID NO: 503383 - DNA, 20 bp, Artificial
  CRISPR gRNA sequence
actcataaactggagaagca

SEQ ID NO: 503384 - DNA, 20 bp, Artificial
  CRISPR gRNA sequence
ataaactggagaagcatcct

SEQ ID NO: 503385 - DNA, 20 bp, Artificial
  CRISPR gRNA sequence
gagaagcatcctttaatact

SEQ ID NO: 503386 - DNA, 20 bp, Artificial
  CRISPR gRNA sequence
taatactgatggctaaaatg

SEQ ID NO: 503387 - DNA, 20 bp, Artificial
  CRISPR gRNA sequence
aatactgatggctaaaatga

SEQ ID NO: 503388 - DNA, 20 bp, Artificial
  CRISPR gRNA sequence
atactgatggctaaaatgac

SEQ ID NO: 503389 - DNA, 20 bp, Artificial
  CRISPR gRNA sequence
atggctaaaatgacattgat

SEQ ID NO: 503390 - DNA, 20 bp, Artificial
  CRISPR gRNA sequence
aaatgacattgataacccag

SEQ ID NO: 503391 - DNA, 20 bp, Artificial
  CRISPR gRNA sequence
ataacccaggctgggacatc

SEQ ID NO: 503392 - DNA, 20 bp, Artificial
  CRISPR gRNA sequence
ggacatctctcccaagggaa

SEQ ID NO: 503393 - DNA, 20 bp, Artificial
  CRISPR gRNA sequence
tcccaagggaaacactgcct

SEQ ID NO: 503394 - DNA, 20 bp, Artificial
  CRISPR gRNA sequence
ccaagggaaacactgcctcc

SEQ ID NO: 503395 - DNA, 20 bp, Artificial
  CRISPR gRNA sequence
cctcctggtggccagtaata

SEQ ID NO: 503396 - DNA, 20 bp, Artificial
  CRISPR gRNA sequence
ctggtggccagtaataaaag

SEQ ID NO: 503397 - DNA, 20 bp, Artificial
  CRISPR gRNA sequence
gtggccagtaataaaagact

SEQ ID NO: 503398 - DNA, 20 bp, Artificial
  CRISPR gRNA sequence
tctgataaaaatggctttaa

SEQ ID NO: 503399 - DNA, 20 bp, Artificial
  CRISPR gRNA sequence
ctgataaaaatggctttaaa

SEQ ID NO: 503400 - DNA, 20 bp, Artificial
  CRISPR gRNA sequence
tgataaaaatggctttaaaa

SEQ ID NO: 503401 - DNA, 20 bp, Artificial
  CRISPR gRNA sequence
ataaaaatggctttaaaaaa

SEQ ID NO: 503402 - DNA, 20 bp, Artificial
  CRISPR gRNA sequence
taaaaaaaagaaaaaaaaaa

SEQ ID NO: 503403 - DNA, 20 bp, Artificial
  CRISPR gRNA sequence
aaaaaaaagaaaaaaaaaat

SEQ ID NO: 503404 - DNA, 20 bp, Artificial
  CRISPR gRNA sequence
aaaaaaagaaaaaaaaaatt

SEQ ID NO: 503405 - DNA, 20 bp, Artificial
  CRISPR gRNA sequence
agcaccatcttcagtttggt

SEQ ID NO: 503406 - DNA, 20 bp, Artificial
  CRISPR gRNA sequence
cagtttggtggctgagctgt

SEQ ID NO: 503407 - DNA, 20 bp, Artificial
  CRISPR gRNA sequence
agtttggtggctgagctgtg

SEQ ID NO: 503408 - DNA, 20 bp, Artificial
  CRISPR gRNA sequence
ggtggctgagctgtggggca

SEQ ID NO: 503409 - DNA, 20 bp, Artificial
  CRISPR gRNA sequence
gtggctgagctgtggggcaa

SEQ ID NO: 503410 - DNA, 20 bp, Artificial
  CRISPR gRNA sequence
agctgtggggcaaagaaaat

SEQ ID NO: 503411 - DNA, 20 bp, Artificial
  CRISPR gRNA sequence
tggggcaaagaaaatctgat

SEQ ID NO: 503412 - DNA, 20 bp, Artificial
  CRISPR gRNA sequence
attataagagcggttgatat

SEQ ID NO: 503413 - DNA, 20 bp, Artificial
  CRISPR gRNA sequence
taagagcggttgatatctgc

SEQ ID NO: 503414 - DNA, 20 bp, Artificial
  CRISPR gRNA sequence
atatctgccagttctctagt

SEQ ID NO: 503415 - DNA, 20 bp, Artificial
  CRISPR gRNA sequence
ccagttctctagtttcagcc

SEQ ID NO: 503416 - DNA, 20 bp, Artificial
  CRISPR gRNA sequence
tctagtttcagccacattga

SEQ ID NO: 503417 - DNA, 20 bp, Artificial
  CRISPR gRNA sequence
tagtttcagccacattgaac

SEQ ID NO: 503418 - DNA, 20 bp, Artificial
  CRISPR gRNA sequence
gtttcagccacattgaactc

SEQ ID NO: 503419 - DNA, 20 bp, Artificial
  CRISPR gRNA sequence
cagccacattgaactccaat

SEQ ID NO: 503420 - DNA, 20 bp, Artificial
  CRISPR gRNA sequence
agccacattgaactccaatg

SEQ ID NO: 503421 - DNA, 20 bp, Artificial
  CRISPR gRNA sequence
aactccaatgagaggaattt

SEQ ID NO: 503422 - DNA, 20 bp, Artificial
  CRISPR gRNA sequence
caatgagaggaatttctatc

SEQ ID NO: 503423 - DNA, 20 bp, Artificial
  CRISPR gRNA sequence
ctatcagtgcaagaaagagg

SEQ ID NO: 503424 - DNA, 20 bp, Artificial
  CRISPR gRNA sequence
tatcagtgcaagaaagaggt

SEQ ID NO: 503425 - DNA, 20 bp, Artificial
  CRISPR gRNA sequence
tcagtgcaagaaagaggtcc

SEQ ID NO: 503426 - DNA, 20 bp, Artificial
  CRISPR gRNA sequence
aaactatggtgttgggtgag

SEQ ID NO: 503427 - DNA, 20 bp, Artificial
  CRISPR gRNA sequence
tggtgttgggtgagaatgac

SEQ ID NO: 503428 - DNA, 20 bp, Artificial
  CRISPR gRNA sequence
ggtgagaatgacagtcctcc

SEQ ID NO: 503429 - DNA, 20 bp, Artificial
  CRISPR gRNA sequence
ctctggagcatcttaaaagg

SEQ ID NO: 503430 - DNA, 20 bp, Artificial
  CRISPR gRNA sequence
tggagcatcttaaaaggaga

SEQ ID NO: 503431 - DNA, 20 bp, Artificial
  CRISPR gRNA sequence
gagcatcttaaaaggagaat

SEQ ID NO: 503432 - DNA, 20 bp, Artificial
  CRISPR gRNA sequence
aaaaggagaatgtttacctg

SEQ ID NO: 503433 - DNA, 20 bp, Artificial
  CRISPR gRNA sequence
aaaggagaatgtttacctga

SEQ ID NO: 503434 - DNA, 20 bp, Artificial
  CRISPR gRNA sequence
acctgatttagaggacacct

SEQ ID NO: 503435 - DNA, 20 bp, Artificial
  CRISPR gRNA sequence
cctgatttagaggacacctg

SEQ ID NO: 503436 - DNA, 20 bp, Artificial
  CRISPR gRNA sequence
atttagaggacacctggttc

SEQ ID NO: 503437 - DNA, 20 bp, Artificial
  CRISPR gRNA sequence
agaggacacctggttccagt

SEQ ID NO: 503438 - DNA, 20 bp, Artificial
  CRISPR gRNA sequence
gaggacacctggttccagtc

SEQ ID NO: 503439 - DNA, 20 bp, Artificial
  CRISPR gRNA sequence
gttccagtccagggaaggga

SEQ ID NO: 503440 - DNA, 20 bp, Artificial
  CRISPR gRNA sequence
cagtccagggaagggaggca

SEQ ID NO: 503441 - DNA, 20 bp, Artificial
  CRISPR gRNA sequence
ccaaagggaggcattgaggt

SEQ ID NO: 503442 - DNA, 20 bp, Artificial
  CRISPR gRNA sequence
aggtgttgaggaaagagccc

SEQ ID NO: 503443 - DNA, 20 bp, Artificial
  CRISPR gRNA sequence
aggaaagagccctggagagt

SEQ ID NO: 503444 - DNA, 20 bp, Artificial
  CRISPR gRNA sequence
gagagtcttgggtttgaatt

SEQ ID NO: 503445 - DNA, 20 bp, Artificial
  CRISPR gRNA sequence
gggtttgaattctgcttcta

SEQ ID NO: 503446 - DNA, 20 bp, Artificial
  CRISPR gRNA sequence
ggtttgaattctgcttctac

SEQ ID NO: 503447 - DNA, 20 bp, Artificial
  CRISPR gRNA sequence
gaattctgcttctactgtgt

SEQ ID NO: 503448 - DNA, 20 bp, Artificial
  CRISPR gRNA sequence
aattctgcttctactgtgta

SEQ ID NO: 503449 - DNA, 20 bp, Artificial
  CRISPR gRNA sequence
tgcttctactgtgtacgcac

SEQ ID NO: 503450 - DNA, 20 bp, Artificial
  CRISPR gRNA sequence
cttctactgtgtacgcactg

SEQ ID NO: 503451 - DNA, 20 bp, Artificial
  CRISPR gRNA sequence
ctactgtgtacgcactgcct

SEQ ID NO: 503452 - DNA, 20 bp, Artificial
  CRISPR gRNA sequence
tactgtgtacgcactgcctg

SEQ ID NO: 503453 - DNA, 20 bp, Artificial
  CRISPR gRNA sequence
ctgtgtacgcactgcctgac

SEQ ID NO: 503454 - DNA, 20 bp, Artificial
  CRISPR gRNA sequence
tgtacgcactgcctgacttg

SEQ ID NO: 503455 - DNA, 20 bp, Artificial
  CRISPR gRNA sequence
cctgacttgggctatttatc

SEQ ID NO: 503456 - DNA, 20 bp, Artificial
  CRISPR gRNA sequence
acttgggctatttatccttt

SEQ ID NO: 503457 - DNA, 20 bp, Artificial
  CRISPR gRNA sequence
gggctatttatccttttgga

SEQ ID NO: 503458 - DNA, 20 bp, Artificial
  CRISPR gRNA sequence
ggctatttatccttttggag

SEQ ID NO: 503459 - DNA, 20 bp, Artificial
  CRISPR gRNA sequence
tttatccttttggagcctca

SEQ ID NO: 503460 - DNA, 20 bp, Artificial
  CRISPR gRNA sequence
atccttttggagcctcattt

SEQ ID NO: 503461 - DNA, 20 bp, Artificial
  CRISPR gRNA sequence
tccttttggagcctcatttg

SEQ ID NO: 503462 - DNA, 20 bp, Artificial
  CRISPR gRNA sequence
ttggagcctcatttgtggca

SEQ ID NO: 503463 - DNA, 20 bp, Artificial
  CRISPR gRNA sequence
tggagcctcatttgtggcat

SEQ ID NO: 503464 - DNA, 20 bp, Artificial
  CRISPR gRNA sequence
ggagcctcatttgtggcatg

SEQ ID NO: 503465 - DNA, 20 bp, Artificial
  CRISPR gRNA sequence
gagcctcatttgtggcatgg

SEQ ID NO: 503466 - DNA, 20 bp, Artificial
  CRISPR gRNA sequence
atttgtggcatggggcaaat

SEQ ID NO: 503467 - DNA, 20 bp, Artificial
  CRISPR gRNA sequence
gtggcatggggcaaattatg

SEQ ID NO: 503468 - DNA, 20 bp, Artificial
  CRISPR gRNA sequence
tggcatggggcaaattatga

SEQ ID NO: 503469 - DNA, 20 bp, Artificial
  CRISPR gRNA sequence
tgatcattcttattttatag

SEQ ID NO: 503470 - DNA, 20 bp, Artificial
  CRISPR gRNA sequence
ttattttataggagtgttaa

SEQ ID NO: 503471 - DNA, 20 bp, Artificial
  CRISPR gRNA sequence
attttataggagtgttaaaa

SEQ ID NO: 503472 - DNA, 20 bp, Artificial
  CRISPR gRNA sequence
ttttataggagtgttaaaag

SEQ ID NO: 503473 - DNA, 20 bp, Artificial
  CRISPR gRNA sequence
tataggagtgttaaaagagt

SEQ ID NO: 503474 - DNA, 20 bp, Artificial
  CRISPR gRNA sequence
ataggagtgttaaaagagtt

SEQ ID NO: 503475 - DNA, 20 bp, Artificial
  CRISPR gRNA sequence
taggagtgttaaaagagtta

SEQ ID NO: 503476 - DNA, 20 bp, Artificial
  CRISPR gRNA sequence
aaagagttagagaagaggcc

SEQ ID NO: 503477 - DNA, 20 bp, Artificial
  CRISPR gRNA sequence
gagaagaggccaggcgcggt

SEQ ID NO: 503478 - DNA, 20 bp, Artificial
  CRISPR gRNA sequence
atgcctgtaatcccaacact

SEQ ID NO: 503479 - DNA, 20 bp, Artificial
  CRISPR gRNA sequence
taatcccaacactttgggag

SEQ ID NO: 503480 - DNA, 20 bp, Artificial
  CRISPR gRNA sequence
tgggaggccgaggcgggcgg

SEQ ID NO: 503481 - DNA, 20 bp, Artificial
  CRISPR gRNA sequence
gggaggccgaggcgggcgga

SEQ ID NO: 503482 - DNA, 20 bp, Artificial
  CRISPR gRNA sequence
ggaggccgaggcgggcggat

SEQ ID NO: 503483 - DNA, 20 bp, Artificial
  CRISPR gRNA sequence
gagaccagcctggcccacat

SEQ ID NO: 503484 - DNA, 20 bp, Artificial
  CRISPR gRNA sequence
agaccagcctggcccacatg

SEQ ID NO: 503485 - DNA, 20 bp, Artificial
  CRISPR gRNA sequence
gcccacatggtgaaaccctg

SEQ ID NO: 503486 - DNA, 20 bp, Artificial
  CRISPR gRNA sequence
tctctaaaaatacaaaaatt

SEQ ID NO: 503487 - DNA, 20 bp, Artificial
  CRISPR gRNA sequence
taaaaatacaaaaattagct

SEQ ID NO: 503488 - DNA, 20 bp, Artificial
  CRISPR gRNA sequence
aaaatacaaaaattagctgg

SEQ ID NO: 503489 - DNA, 20 bp, Artificial
  CRISPR gRNA sequence
gctgggcatgatggcaggca

SEQ ID NO: 503490 - DNA, 20 bp, Artificial
  CRISPR gRNA sequence
ggcatgatggcaggcacctg

SEQ ID NO: 503491 - DNA, 20 bp, Artificial
  CRISPR gRNA sequence
taatcccagctactcaggag

SEQ ID NO: 503492 - DNA, 20 bp, Artificial
  CRISPR gRNA sequence
ctcaggaggctggggcagga

SEQ ID NO: 503493 - DNA, 20 bp, Artificial
  CRISPR gRNA sequence
aggaggctggggcaggagaa

SEQ ID NO: 503494 - DNA, 20 bp, Artificial
  CRISPR gRNA sequence
gggcaggagaattgcctgaa

SEQ ID NO: 503495 - DNA, 20 bp, Artificial
  CRISPR gRNA sequence
cctgaacccaggaggcagag

SEQ ID NO: 503496 - DNA, 20 bp, Artificial
  CRISPR gRNA sequence
aacccaggaggcagaggttg

SEQ ID NO: 503497 - DNA, 20 bp, Artificial
  CRISPR gRNA sequence
cggtgagccaagatcgagac

SEQ ID NO: 503498 - DNA, 20 bp, Artificial
  CRISPR gRNA sequence
cactccagcccaggcaatag

SEQ ID NO: 503499 - DNA, 20 bp, Artificial
  CRISPR gRNA sequence
cagcccaggcaatagagcga

SEQ ID NO: 503500 - DNA, 20 bp, Artificial
  CRISPR gRNA sequence
ttgtctcaaaaacaaataaa

SEQ ID NO: 503501 - DNA, 20 bp, Artificial
  CRISPR gRNA sequence
gtctcaaaaacaaataaaca

SEQ ID NO: 503502 - DNA, 20 bp, Artificial
  CRISPR gRNA sequence
tctcaaaaacaaataaacaa

SEQ ID NO: 503503 - DNA, 20 bp, Artificial
  CRISPR gRNA sequence
aaaaacaaataaacaaaaaa

SEQ ID NO: 503504 - DNA, 20 bp, Artificial
  CRISPR gRNA sequence
gaggagaatacatgtataag

SEQ ID NO: 503505 - DNA, 20 bp, Artificial
  CRISPR gRNA sequence
aacaaatagaagctttcatt

SEQ ID NO: 503506 - DNA, 20 bp, Artificial
  CRISPR gRNA sequence
tcattaatgacagagcgaga

SEQ ID NO: 503507 - DNA, 20 bp, Artificial
  CRISPR gRNA sequence
cattaatgacagagcgagac

SEQ ID NO: 503508 - DNA, 20 bp, Artificial
  CRISPR gRNA sequence
attaatgacagagcgagact

SEQ ID NO: 503509 - DNA, 20 bp, Artificial
  CRISPR gRNA sequence
atgacagagcgagactagca

SEQ ID NO: 503510 - DNA, 20 bp, Artificial
  CRISPR gRNA sequence
gcactcaggttgtctgacct

SEQ ID NO: 503511 - DNA, 20 bp, Artificial
  CRISPR gRNA sequence
aggttgtctgacctcctggc

SEQ ID NO: 503512 - DNA, 20 bp, Artificial
  CRISPR gRNA sequence
tctgacctcctggctagtcc

SEQ ID NO: 503513 - DNA, 20 bp, Artificial
  CRISPR gRNA sequence
acctcctggctagtccaggg

SEQ ID NO: 503514 - DNA, 20 bp, Artificial
  CRISPR gRNA sequence
ctggctagtccagggctctt

SEQ ID NO: 503515 - DNA, 20 bp, Artificial
  CRISPR gRNA sequence
gctagtccagggctcttttc

SEQ ID NO: 503516 - DNA, 20 bp, Artificial
  CRISPR gRNA sequence
gtccagggctcttttcacta

SEQ ID NO: 503517 - DNA, 20 bp, Artificial
  CRISPR gRNA sequence
ttttcactaacacttgaagc

SEQ ID NO: 503518 - DNA, 20 bp, Artificial
  CRISPR gRNA sequence
ttcactaacacttgaagctt

SEQ ID NO: 503519 - DNA, 20 bp, Artificial
  CRISPR gRNA sequence
tcactaacacttgaagcttc

SEQ ID NO: 503520 - DNA, 20 bp, Artificial
  CRISPR gRNA sequence
cactaacacttgaagcttcc

SEQ ID NO: 503521 - DNA, 20 bp, Artificial
  CRISPR gRNA sequence
actaacacttgaagcttcca

SEQ ID NO: 503522 - DNA, 20 bp, Artificial
  CRISPR gRNA sequence
acacttgaagcttccatctg

SEQ ID NO: 503523 - DNA, 20 bp, Artificial
  CRISPR gRNA sequence
gaagcttccatctgggcagg

SEQ ID NO: 503524 - DNA, 20 bp, Artificial
  CRISPR gRNA sequence
aagcttccatctgggcaggg

SEQ ID NO: 503525 - DNA, 20 bp, Artificial
  CRISPR gRNA sequence
ccatctgggcagggttgagg

SEQ ID NO: 503526 - DNA, 20 bp, Artificial
  CRISPR gRNA sequence
catctgggcagggttgagga

SEQ ID NO: 503527 - DNA, 20 bp, Artificial
  CRISPR gRNA sequence
ggcagggttgaggaggagaa

SEQ ID NO: 503528 - DNA, 20 bp, Artificial
  CRISPR gRNA sequence
aggaggagaaacggaagaga

SEQ ID NO: 503529 - DNA, 20 bp, Artificial
  CRISPR gRNA sequence
tgtaagattgtgctggatct

SEQ ID NO: 503530 - DNA, 20 bp, Artificial
  CRISPR gRNA sequence
gtaagattgtgctggatctg

SEQ ID NO: 503531 - DNA, 20 bp, Artificial
  CRISPR gRNA sequence
taagattgtgctggatctgt

SEQ ID NO: 503532 - DNA, 20 bp, Artificial
  CRISPR gRNA sequence
tgctggatctgtgcttctga

SEQ ID NO: 503533 - DNA, 20 bp, Artificial
  CRISPR gRNA sequence
gatctgtgcttctgaaatga

SEQ ID NO: 503534 - DNA, 20 bp, Artificial
  CRISPR gRNA sequence
tgcttctgaaatgattttat

SEQ ID NO: 503535 - DNA, 20 bp, Artificial
  CRISPR gRNA sequence
ctgaaatgattttatttctc

SEQ ID NO: 503536 - DNA, 20 bp, Artificial
  CRISPR gRNA sequence
tgaaatgattttatttctct

SEQ ID NO: 503537 - DNA, 20 bp, Artificial
  CRISPR gRNA sequence
aaatgattttatttctcttc

SEQ ID NO: 503538 - DNA, 20 bp, Artificial
  CRISPR gRNA sequence
tatttctcttctcattagtc

SEQ ID NO: 503539 - DNA, 20 bp, Artificial
  CRISPR gRNA sequence
atttctcttctcattagtct

SEQ ID NO: 503540 - DNA, 20 bp, Artificial
  CRISPR gRNA sequence
tttctcttctcattagtctt

SEQ ID NO: 503541 - DNA, 20 bp, Artificial
  CRISPR gRNA sequence
ctcttctcattagtcttctg

SEQ ID NO: 503542 - DNA, 20 bp, Artificial
  CRISPR gRNA sequence
tcttctcattagtcttctgc

SEQ ID NO: 503543 - DNA, 20 bp, Artificial
  CRISPR gRNA sequence
ttctcattagtcttctgctc

SEQ ID NO: 503544 - DNA, 20 bp, Artificial
  CRISPR gRNA sequence
ctcattagtcttctgctccc

SEQ ID NO: 503545 - DNA, 20 bp, Artificial
  CRISPR gRNA sequence
tcattagtcttctgctccca

SEQ ID NO: 503546 - DNA, 20 bp, Artificial
  CRISPR gRNA sequence
attagtcttctgctcccacg

SEQ ID NO: 503547 - DNA, 20 bp, Artificial
  CRISPR gRNA sequence
gtcttctgctcccacgtcac

SEQ ID NO: 503548 - DNA, 20 bp, Artificial
  CRISPR gRNA sequence
ctgctcccacgtcacaagaa

SEQ ID NO: 503549 - DNA, 20 bp, Artificial
  CRISPR gRNA sequence
tgctcccacgtcacaagaac

SEQ ID NO: 503550 - DNA, 20 bp, Artificial
  CRISPR gRNA sequence
ctcccacgtcacaagaacct

SEQ ID NO: 503551 - DNA, 20 bp, Artificial
  CRISPR gRNA sequence
ccacgtcacaagaacctgca

SEQ ID NO: 503552 - DNA, 20 bp, Artificial
  CRISPR gRNA sequence
catatacattatattcatta

SEQ ID NO: 503553 - DNA, 20 bp, Artificial
  CRISPR gRNA sequence
tattcattaattcagccttc

SEQ ID NO: 503554 - DNA, 20 bp, Artificial
  CRISPR gRNA sequence
attaattcagccttccagga

SEQ ID NO: 503555 - DNA, 20 bp, Artificial
  CRISPR gRNA sequence
attcagccttccaggaaggt

SEQ ID NO: 503556 - DNA, 20 bp, Artificial
  CRISPR gRNA sequence
agccttccaggaaggtgagc

SEQ ID NO: 503557 - DNA, 20 bp, Artificial
  CRISPR gRNA sequence
ccaggaaggtgagcctcttc

SEQ ID NO: 503558 - DNA, 20 bp, Artificial
  CRISPR gRNA sequence
caggaaggtgagcctcttcc

SEQ ID NO: 503559 - DNA, 20 bp, Artificial
  CRISPR gRNA sequence
ttcccgtggtggtggtgggg

SEQ ID NO: 503560 - DNA, 20 bp, Artificial
  CRISPR gRNA sequence
cccgtggtggtggtggggtg

SEQ ID NO: 503561 - DNA, 20 bp, Artificial
  CRISPR gRNA sequence
ccgtggtggtggtggggtgt

SEQ ID NO: 503562 - DNA, 20 bp, Artificial
  CRISPR gRNA sequence
ttgatgtagatgtgtatttt

SEQ ID NO: 503563 - DNA, 20 bp, Artificial
  CRISPR gRNA sequence
atgtagatgtgtattttgca

SEQ ID NO: 503564 - DNA, 20 bp, Artificial
  CRISPR gRNA sequence
tgcatgtgtttgcagtgaga

SEQ ID NO: 503565 - DNA, 20 bp, Artificial
  CRISPR gRNA sequence
gcatgtgtttgcagtgagag

SEQ ID NO: 503566 - DNA, 20 bp, Artificial
  CRISPR gRNA sequence
catgtgtttgcagtgagagt

SEQ ID NO: 503567 - DNA, 20 bp, Artificial
  CRISPR gRNA sequence
gcagtgagagtgtgtgtgca

SEQ ID NO: 503568 - DNA, 20 bp, Artificial
  CRISPR gRNA sequence
cagtgagagtgtgtgtgcac

SEQ ID NO: 503569 - DNA, 20 bp, Artificial
  CRISPR gRNA sequence
gcaagttgttctttattgtg

SEQ ID NO: 503570 - DNA, 20 bp, Artificial
  CRISPR gRNA sequence
ttctttattgtgtgtatctg

SEQ ID NO: 503571 - DNA, 20 bp, Artificial
  CRISPR gRNA sequence
tttattgtgtgtatctgagt

SEQ ID NO: 503572 - DNA, 20 bp, Artificial
  CRISPR gRNA sequence
tattgtgtgtatctgagtag

SEQ ID NO: 503573 - DNA, 20 bp, Artificial
  CRISPR gRNA sequence
attgtgtgtatctgagtagc

SEQ ID NO: 503574 - DNA, 20 bp, Artificial
  CRISPR gRNA sequence
ttgtgtgtatctgagtagct

SEQ ID NO: 503575 - DNA, 20 bp, Artificial
  CRISPR gRNA sequence
tgtgtatctgagtagcttct

SEQ ID NO: 503576 - DNA, 20 bp, Artificial
  CRISPR gRNA sequence
agtagcttctgttaaatgac

SEQ ID NO: 503577 - DNA, 20 bp, Artificial
  CRISPR gRNA sequence
ctgttaaatgactgtattta

SEQ ID NO: 503578 - DNA, 20 bp, Artificial
  CRISPR gRNA sequence
tgttaaatgactgtatttaa

SEQ ID NO: 503579 - DNA, 20 bp, Artificial
  CRISPR gRNA sequence
ttaaatgactgtatttaaat

SEQ ID NO: 503580 - DNA, 20 bp, Artificial
  CRISPR gRNA sequence
aatgactgtatttaaatgtc

SEQ ID NO: 503581 - DNA, 20 bp, Artificial
  CRISPR gRNA sequence
tatttaaatgtcaatgggcc

SEQ ID NO: 503582 - DNA, 20 bp, Artificial
  CRISPR gRNA sequence
aaatgtcaatgggccaatga

SEQ ID NO: 503583 - DNA, 20 bp, Artificial
  CRISPR gRNA sequence
aatgtcaatgggccaatgag

SEQ ID NO: 503584 - DNA, 20 bp, Artificial
  CRISPR gRNA sequence
actggttctgtctggagaaa

SEQ ID NO: 503585 - DNA, 20 bp, Artificial
  CRISPR gRNA sequence
ctggttctgtctggagaaaa

SEQ ID NO: 503586 - DNA, 20 bp, Artificial
  CRISPR gRNA sequence
gttctgtctggagaaaaata

SEQ ID NO: 503587 - DNA, 20 bp, Artificial
  CRISPR gRNA sequence
tgtctggagaaaaataacag

SEQ ID NO: 503588 - DNA, 20 bp, Artificial
  CRISPR gRNA sequence
tctggagaaaaataacagct

SEQ ID NO: 503589 - DNA, 20 bp, Artificial
  CRISPR gRNA sequence
gagaaaaataacagcttcta

SEQ ID NO: 503590 - DNA, 20 bp, Artificial
  CRISPR gRNA sequence
ctagactaagagaacagtag

SEQ ID NO: 503591 - DNA, 20 bp, Artificial
  CRISPR gRNA sequence
tagactaagagaacagtaga

SEQ ID NO: 503592 - DNA, 20 bp, Artificial
  CRISPR gRNA sequence
gactaagagaacagtagact

SEQ ID NO: 503593 - DNA, 20 bp, Artificial
  CRISPR gRNA sequence
agagaacagtagactagatg

SEQ ID NO: 503594 - DNA, 20 bp, Artificial
  CRISPR gRNA sequence
gatgagtttttgggagtttc

SEQ ID NO: 503595 - DNA, 20 bp, Artificial
  CRISPR gRNA sequence
ttgggagtttctgtgggagg

SEQ ID NO: 503596 - DNA, 20 bp, Artificial
  CRISPR gRNA sequence
tgggagtttctgtgggaggt

SEQ ID NO: 503597 - DNA, 20 bp, Artificial
  CRISPR gRNA sequence
gggagtttctgtgggaggta

SEQ ID NO: 503598 - DNA, 20 bp, Artificial
  CRISPR gRNA sequence
ggagtttctgtgggaggtaa

SEQ ID NO: 503599 - DNA, 20 bp, Artificial
  CRISPR gRNA sequence
ctgtgggaggtaaaggacag

SEQ ID NO: 503600 - DNA, 20 bp, Artificial
  CRISPR gRNA sequence
tgtgggaggtaaaggacagt

SEQ ID NO: 503601 - DNA, 20 bp, Artificial
  CRISPR gRNA sequence
tgggaggtaaaggacagtca

SEQ ID NO: 503602 - DNA, 20 bp, Artificial
  CRISPR gRNA sequence
tgcacagagagactacgggg

SEQ ID NO: 503603 - DNA, 20 bp, Artificial
  CRISPR gRNA sequence
gcacagagagactacggggt

SEQ ID NO: 503604 - DNA, 20 bp, Artificial
  CRISPR gRNA sequence
cacagagagactacggggta

SEQ ID NO: 503605 - DNA, 20 bp, Artificial
  CRISPR gRNA sequence
cggggtacttagtaggtcag

SEQ ID NO: 503606 - DNA, 20 bp, Artificial
  CRISPR gRNA sequence
agtaggtcagctgaggctat

SEQ ID NO: 503607 - DNA, 20 bp, Artificial
  CRISPR gRNA sequence
gtaggtcagctgaggctatg

SEQ ID NO: 503608 - DNA, 20 bp, Artificial
  CRISPR gRNA sequence
aggctatggtgagagatact

SEQ ID NO: 503609 - DNA, 20 bp, Artificial
  CRISPR gRNA sequence
tggtgagagatactggaggg

SEQ ID NO: 503610 - DNA, 20 bp, Artificial
  CRISPR gRNA sequence
gaggggtttgcaaggcaggg

SEQ ID NO: 503611 - DNA, 20 bp, Artificial
  CRISPR gRNA sequence
gcaaggcagggcatattgcc

SEQ ID NO: 503612 - DNA, 20 bp, Artificial
  CRISPR gRNA sequence
caaggcagggcatattgcct

SEQ ID NO: 503613 - DNA, 20 bp, Artificial
  CRISPR gRNA sequence
cctggagctggaggagtaga

SEQ ID NO: 503614 - DNA, 20 bp, Artificial
  CRISPR gRNA sequence
gagctggaggagtagactgg

SEQ ID NO: 503615 - DNA, 20 bp, Artificial
  CRISPR gRNA sequence
gaggagtagactggatctag

SEQ ID NO: 503616 - DNA, 20 bp, Artificial
  CRISPR gRNA sequence
gatctagagagacacaatct

SEQ ID NO: 503617 - DNA, 20 bp, Artificial
  CRISPR gRNA sequence
gagagacacaatcttgacct

SEQ ID NO: 503618 - DNA, 20 bp, Artificial
  CRISPR gRNA sequence
gaccttcagagaccagagaa

SEQ ID NO: 503619 - DNA, 20 bp, Artificial
  CRISPR gRNA sequence
accttcagagaccagagaaa

SEQ ID NO: 503620 - DNA, 20 bp, Artificial
  CRISPR gRNA sequence
cagagaccagagaaaggtcc

SEQ ID NO: 503621 - DNA, 20 bp, Artificial
  CRISPR gRNA sequence
agagaccagagaaaggtcct

SEQ ID NO: 503622 - DNA, 20 bp, Artificial
  CRISPR gRNA sequence
gccagtcagtcacctgctgg

SEQ ID NO: 503623 - DNA, 20 bp, Artificial
  CRISPR gRNA sequence
ctggtggaggcctctggact

SEQ ID NO: 503624 - DNA, 20 bp, Artificial
  CRISPR gRNA sequence
gtggaggcctctggactgag

SEQ ID NO: 503625 - DNA, 20 bp, Artificial
  CRISPR gRNA sequence
tggactgaggcaacccatcc

SEQ ID NO: 503626 - DNA, 20 bp, Artificial
  CRISPR gRNA sequence
gactgaggcaacccatcctt

SEQ ID NO: 503627 - DNA, 20 bp, Artificial
  CRISPR gRNA sequence
aggcaacccatccttttgca

SEQ ID NO: 503628 - DNA, 20 bp, Artificial
  CRISPR gRNA sequence
ttgcactgaaatccttctcc

SEQ ID NO: 503629 - DNA, 20 bp, Artificial
  CRISPR gRNA sequence
tgcactgaaatccttctcca

SEQ ID NO: 503630 - DNA, 20 bp, Artificial
  CRISPR gRNA sequence
gcactgaaatccttctccaa

SEQ ID NO: 503631 - DNA, 20 bp, Artificial
  CRISPR gRNA sequence
cactgaaatccttctccaag

SEQ ID NO: 503632 - DNA, 20 bp, Artificial
  CRISPR gRNA sequence
aaatccttctccaagctgag

SEQ ID NO: 503633 - DNA, 20 bp, Artificial
  CRISPR gRNA sequence
ctccaagctgagttcgtagc

SEQ ID NO: 503634 - DNA, 20 bp, Artificial
  CRISPR gRNA sequence
tccaagctgagttcgtagct

SEQ ID NO: 503635 - DNA, 20 bp, Artificial
  CRISPR gRNA sequence
caagctgagttcgtagctct

SEQ ID NO: 503636 - DNA, 20 bp, Artificial
  CRISPR gRNA sequence
agttcgtagctctcttgtgt

SEQ ID NO: 503637 - DNA, 20 bp, Artificial
  CRISPR gRNA sequence
gtagctctcttgtgtacttg

SEQ ID NO: 503638 - DNA, 20 bp, Artificial
  CRISPR gRNA sequence
tcttgtgtacttggaaacag

SEQ ID NO: 503639 - DNA, 20 bp, Artificial
  CRISPR gRNA sequence
ttgtgtacttggaaacagag

SEQ ID NO: 503640 - DNA, 20 bp, Artificial
  CRISPR gRNA sequence
gtgtacttggaaacagagtt

SEQ ID NO: 503641 - DNA, 20 bp, Artificial
  CRISPR gRNA sequence
tgtacttggaaacagagttg

SEQ ID NO: 503642 - DNA, 20 bp, Artificial
  CRISPR gRNA sequence
ggaaacagagttgggtatcc

SEQ ID NO: 503643 - DNA, 20 bp, Artificial
  CRISPR gRNA sequence
gaaacagagttgggtatcct

SEQ ID NO: 503644 - DNA, 20 bp, Artificial
  CRISPR gRNA sequence
ggtatcctggtacacatggt

SEQ ID NO: 503645 - DNA, 20 bp, Artificial
  CRISPR gRNA sequence
gtacacatggtcattgtttt

SEQ ID NO: 503646 - DNA, 20 bp, Artificial
  CRISPR gRNA sequence
tttttctcttgtatggaagg

SEQ ID NO: 503647 - DNA, 20 bp, Artificial
  CRISPR gRNA sequence
ttctcttgtatggaagggga

SEQ ID NO: 503648 - DNA, 20 bp, Artificial
  CRISPR gRNA sequence
tctcttgtatggaaggggat

SEQ ID NO: 503649 - DNA, 20 bp, Artificial
  CRISPR gRNA sequence
ctcttgtatggaaggggatg

SEQ ID NO: 503650 - DNA, 20 bp, Artificial
  CRISPR gRNA sequence
tcttgtatggaaggggatgg

SEQ ID NO: 503651 - DNA, 20 bp, Artificial
  CRISPR gRNA sequence
ttgtatggaaggggatggga

SEQ ID NO: 503652 - DNA, 20 bp, Artificial
  CRISPR gRNA sequence
gtatggaaggggatgggaag

SEQ ID NO: 503653 - DNA, 20 bp, Artificial
  CRISPR gRNA sequence
tatggaaggggatgggaaga

SEQ ID NO: 503654 - DNA, 20 bp, Artificial
  CRISPR gRNA sequence
ccaaggctggagccacagtg

SEQ ID NO: 503655 - DNA, 20 bp, Artificial
  CRISPR gRNA sequence
gagccacagtgtgaagccag

SEQ ID NO: 503656 - DNA, 20 bp, Artificial
  CRISPR gRNA sequence
aacatggtagtatgggaatt

SEQ ID NO: 503657 - DNA, 20 bp, Artificial
  CRISPR gRNA sequence
acatggtagtatgggaattt

SEQ ID NO: 503658 - DNA, 20 bp, Artificial
  CRISPR gRNA sequence
gggagtccacacaactgtgg

SEQ ID NO: 503659 - DNA, 20 bp, Artificial
  CRISPR gRNA sequence
ggagtccacacaactgtgga

SEQ ID NO: 503660 - DNA, 20 bp, Artificial
  CRISPR gRNA sequence
tggaagtccatgcaggtcag

SEQ ID NO: 503661 - DNA, 20 bp, Artificial
  CRISPR gRNA sequence
gaaggggtttaggacagatt

SEQ ID NO: 503662 - DNA, 20 bp, Artificial
  CRISPR gRNA sequence
aaggggtttaggacagattt

SEQ ID NO: 503663 - DNA, 20 bp, Artificial
  CRISPR gRNA sequence
aggacagattttcagacttt

SEQ ID NO: 503664 - DNA, 20 bp, Artificial
  CRISPR gRNA sequence
ggacagattttcagactttt

SEQ ID NO: 503665 - DNA, 20 bp, Artificial
  CRISPR gRNA sequence
tcagacttttcattcaacct

SEQ ID NO: 503666 - DNA, 20 bp, Artificial
  CRISPR gRNA sequence
cagacttttcattcaacctc

SEQ ID NO: 503667 - DNA, 20 bp, Artificial
  CRISPR gRNA sequence
agacttttcattcaacctcc

SEQ ID NO: 503668 - DNA, 20 bp, Artificial
  CRISPR gRNA sequence
ttcattcaacctccttccaa

SEQ ID NO: 503669 - DNA, 20 bp, Artificial
  CRISPR gRNA sequence
tcattcaacctccttccaat

SEQ ID NO: 503670 - DNA, 20 bp, Artificial
  CRISPR gRNA sequence
cattcaacctccttccaata

SEQ ID NO: 503671 - DNA, 20 bp, Artificial
  CRISPR gRNA sequence
attcaacctccttccaataa

SEQ ID NO: 503672 - DNA, 20 bp, Artificial
  CRISPR gRNA sequence
aacctccttccaataagcca

SEQ ID NO: 503673 - DNA, 20 bp, Artificial
  CRISPR gRNA sequence
cttccaataagccattcaac

SEQ ID NO: 503674 - DNA, 20 bp, Artificial
  CRISPR gRNA sequence
ccaataagccattcaaccta

SEQ ID NO: 503675 - DNA, 20 bp, Artificial
  CRISPR gRNA sequence
caataagccattcaacctac

SEQ ID NO: 503676 - DNA, 20 bp, Artificial
  CRISPR gRNA sequence
aacctacttggatcccatcg

SEQ ID NO: 503677 - DNA, 20 bp, Artificial
  CRISPR gRNA sequence
cttggatcccatcgtgagag

SEQ ID NO: 503678 - DNA, 20 bp, Artificial
  CRISPR gRNA sequence
ggatcccatcgtgagagaga

SEQ ID NO: 503679 - DNA, 20 bp, Artificial
  CRISPR gRNA sequence
gatcccatcgtgagagagat

SEQ ID NO: 503680 - DNA, 20 bp, Artificial
  CRISPR gRNA sequence
gtttttaattatatgctaca

SEQ ID NO: 503681 - DNA, 20 bp, Artificial
  CRISPR gRNA sequence
tttttaattatatgctacaa

SEQ ID NO: 503682 - DNA, 20 bp, Artificial
  CRISPR gRNA sequence
ttaattatatgctacaatat

SEQ ID NO: 503683 - DNA, 20 bp, Artificial
  CRISPR gRNA sequence
taattatatgctacaatata

SEQ ID NO: 503684 - DNA, 20 bp, Artificial
  CRISPR gRNA sequence
aattatatgctacaatataa

SEQ ID NO: 503685 - DNA, 20 bp, Artificial
  CRISPR gRNA sequence
attatatgctacaatataag

SEQ ID NO: 503686 - DNA, 20 bp, Artificial
  CRISPR gRNA sequence
tatgctacaatataaggcca

SEQ ID NO: 503687 - DNA, 20 bp, Artificial
  CRISPR gRNA sequence
caatataaggccatatagat

SEQ ID NO: 503688 - DNA, 20 bp, Artificial
  CRISPR gRNA sequence
acaggcaccatgttcacctg

SEQ ID NO: 503689 - DNA, 20 bp, Artificial
  CRISPR gRNA sequence
acctgctttggtgtatgtaa

SEQ ID NO: 503690 - DNA, 20 bp, Artificial
  CRISPR gRNA sequence
ctttggtgtatgtaaactct

SEQ ID NO: 503691 - DNA, 20 bp, Artificial
  CRISPR gRNA sequence
tggtgtatgtaaactctata

SEQ ID NO: 503692 - DNA, 20 bp, Artificial
  CRISPR gRNA sequence
ggtgtatgtaaactctatat

SEQ ID NO: 503693 - DNA, 20 bp, Artificial
  CRISPR gRNA sequence
gtgtatgtaaactctatatg

SEQ ID NO: 503694 - DNA, 20 bp, Artificial
  CRISPR gRNA sequence
tatatgctactgaatgtgcc

SEQ ID NO: 503695 - DNA, 20 bp, Artificial
  CRISPR gRNA sequence
tatgctactgaatgtgcctc

SEQ ID NO: 503696 - DNA, 20 bp, Artificial
  CRISPR gRNA sequence
ctgaatgtgcctctgaattc

SEQ ID NO: 503697 - DNA, 20 bp, Artificial
  CRISPR gRNA sequence
aatgtgcctctgaattctag

SEQ ID NO: 503698 - DNA, 20 bp, Artificial
  CRISPR gRNA sequence
tgaattctagtgtccttggg

SEQ ID NO: 503699 - DNA, 20 bp, Artificial
  CRISPR gRNA sequence
aattctagtgtccttgggtt

SEQ ID NO: 503700 - DNA, 20 bp, Artificial
  CRISPR gRNA sequence
tagtgtccttgggttggcaa

SEQ ID NO: 503701 - DNA, 20 bp, Artificial
  CRISPR gRNA sequence
gtgtccttgggttggcaatt

SEQ ID NO: 503702 - DNA, 20 bp, Artificial
  CRISPR gRNA sequence
gggttggcaattatttatat

SEQ ID NO: 503703 - DNA, 20 bp, Artificial
  CRISPR gRNA sequence
ggttggcaattatttatatg

SEQ ID NO: 503704 - DNA, 20 bp, Artificial
  CRISPR gRNA sequence
gcaattatttatatgcctgg

SEQ ID NO: 503705 - DNA, 20 bp, Artificial
  CRISPR gRNA sequence
tttatatgcctggattgttt

SEQ ID NO: 503706 - DNA, 20 bp, Artificial
  CRISPR gRNA sequence
atatgcctggattgtttaca

SEQ ID NO: 503707 - DNA, 20 bp, Artificial
  CRISPR gRNA sequence
tatgcctggattgtttacat

SEQ ID NO: 503708 - DNA, 20 bp, Artificial
  CRISPR gRNA sequence
gattgtttacattaagggtg

SEQ ID NO: 503709 - DNA, 20 bp, Artificial
  CRISPR gRNA sequence
tttacattaagggtgtgtgt

SEQ ID NO: 503710 - DNA, 20 bp, Artificial
  CRISPR gRNA sequence
acattaagggtgtgtgtatg

SEQ ID NO: 503711 - DNA, 20 bp, Artificial
  CRISPR gRNA sequence
cattaagggtgtgtgtatgc

SEQ ID NO: 503712 - DNA, 20 bp, Artificial
  CRISPR gRNA sequence
agggtgtgtgtatgcatgcg

SEQ ID NO: 503713 - DNA, 20 bp, Artificial
  CRISPR gRNA sequence
aagagatacatggtttgggg

SEQ ID NO: 503714 - DNA, 20 bp, Artificial
  CRISPR gRNA sequence
ggggcagtatttgcattagg

SEQ ID NO: 503715 - DNA, 20 bp, Artificial
  CRISPR gRNA sequence
gggcagtatttgcattagga

SEQ ID NO: 503716 - DNA, 20 bp, Artificial
  CRISPR gRNA sequence
gcattaggattgcctgaggg

SEQ ID NO: 503717 - DNA, 20 bp, Artificial
  CRISPR gRNA sequence
cattaggattgcctgaggga

SEQ ID NO: 503718 - DNA, 20 bp, Artificial
  CRISPR gRNA sequence
ggattgcctgagggatatgt

SEQ ID NO: 503719 - DNA, 20 bp, Artificial
  CRISPR gRNA sequence
cctgagggatatgtgtgtat

SEQ ID NO: 503720 - DNA, 20 bp, Artificial
  CRISPR gRNA sequence
agggatatgtgtgtatgtgt

SEQ ID NO: 503721 - DNA, 20 bp, Artificial
  CRISPR gRNA sequence
tgggaatgtgtgtgtgtata

SEQ ID NO: 503722 - DNA, 20 bp, Artificial
  CRISPR gRNA sequence
ggaatgtgtgtgtgtatata

SEQ ID NO: 503723 - DNA, 20 bp, Artificial
  CRISPR gRNA sequence
taggtgtatgtgggtatgga

SEQ ID NO: 503724 - DNA, 20 bp, Artificial
  CRISPR gRNA sequence
aggtgtatgtgggtatggaa

SEQ ID NO: 503725 - DNA, 20 bp, Artificial
  CRISPR gRNA sequence
ggtgtatgtgggtatggaac

SEQ ID NO: 503726 - DNA, 20 bp, Artificial
  CRISPR gRNA sequence
tgattttggttcagaaatat

SEQ ID NO: 503727 - DNA, 20 bp, Artificial
  CRISPR gRNA sequence
attttggttcagaaatatca

SEQ ID NO: 503728 - DNA, 20 bp, Artificial
  CRISPR gRNA sequence
tggttcagaaatatcatatt

SEQ ID NO: 503729 - DNA, 20 bp, Artificial
  CRISPR gRNA sequence
ggttcagaaatatcatatta

SEQ ID NO: 503730 - DNA, 20 bp, Artificial
  CRISPR gRNA sequence
gttcagaaatatcatattat

SEQ ID NO: 503731 - DNA, 20 bp, Artificial
  CRISPR gRNA sequence
agaaatatcatattataggc

SEQ ID NO: 503732 - DNA, 20 bp, Artificial
  CRISPR gRNA sequence
taggcaaatactgtatatat

SEQ ID NO: 503733 - DNA, 20 bp, Artificial
  CRISPR gRNA sequence
tatatattgtgtcttccctg

SEQ ID NO: 503734 - DNA, 20 bp, Artificial
  CRISPR gRNA sequence
tgtcttccctggagaccata

SEQ ID NO: 503735 - DNA, 20 bp, Artificial
  CRISPR gRNA sequence
ccctggagaccataaacacc

SEQ ID NO: 503736 - DNA, 20 bp, Artificial
  CRISPR gRNA sequence
cctggagaccataaacacca

SEQ ID NO: 503737 - DNA, 20 bp, Artificial
  CRISPR gRNA sequence
gagaccataaacaccattgt

SEQ ID NO: 503738 - DNA, 20 bp, Artificial
  CRISPR gRNA sequence
ttttgctcctagggtgacag

SEQ ID NO: 503739 - DNA, 20 bp, Artificial
  CRISPR gRNA sequence
tgctcctagggtgacagatt

SEQ ID NO: 503740 - DNA, 20 bp, Artificial
  CRISPR gRNA sequence
gctcctagggtgacagattc

SEQ ID NO: 503741 - DNA, 20 bp, Artificial
  CRISPR gRNA sequence
ctcctagggtgacagattct

SEQ ID NO: 503742 - DNA, 20 bp, Artificial
  CRISPR gRNA sequence
ctagggtgacagattctatt

SEQ ID NO: 503743 - DNA, 20 bp, Artificial
  CRISPR gRNA sequence
gggtgacagattctattcat

SEQ ID NO: 503744 - DNA, 20 bp, Artificial
  CRISPR gRNA sequence
tattcattttctggctgaga

SEQ ID NO: 503745 - DNA, 20 bp, Artificial
  CRISPR gRNA sequence
ttcattttctggctgagagt

SEQ ID NO: 503746 - DNA, 20 bp, Artificial
  CRISPR gRNA sequence
attttctggctgagagtgcc

SEQ ID NO: 503747 - DNA, 20 bp, Artificial
  CRISPR gRNA sequence
tctggctgagagtgcctcag

SEQ ID NO: 503748 - DNA, 20 bp, Artificial
  CRISPR gRNA sequence
ctggctgagagtgcctcaga

SEQ ID NO: 503749 - DNA, 20 bp, Artificial
  CRISPR gRNA sequence
tggctgagagtgcctcagaa

SEQ ID NO: 503750 - DNA, 20 bp, Artificial
  CRISPR gRNA sequence
gctgagagtgcctcagaatt

SEQ ID NO: 503751 - DNA, 20 bp, Artificial
  CRISPR gRNA sequence
agagtgcctcagaatttttc

SEQ ID NO: 503752 - DNA, 20 bp, Artificial
  CRISPR gRNA sequence
agaatttttctgggccctga

SEQ ID NO: 503753 - DNA, 20 bp, Artificial
  CRISPR gRNA sequence
ttctgggccctgagtctctt

SEQ ID NO: 503754 - DNA, 20 bp, Artificial
  CRISPR gRNA sequence
tctgggccctgagtctcttt

SEQ ID NO: 503755 - DNA, 20 bp, Artificial
  CRISPR gRNA sequence
ctgggccctgagtctctttt

SEQ ID NO: 503756 - DNA, 20 bp, Artificial
  CRISPR gRNA sequence
tgggccctgagtctcttttg

SEQ ID NO: 503757 - DNA, 20 bp, Artificial
  CRISPR gRNA sequence
ggccctgagtctcttttggg

SEQ ID NO: 503758 - DNA, 20 bp, Artificial
  CRISPR gRNA sequence
agtctcttttgggacctctc

SEQ ID NO: 503759 - DNA, 20 bp, Artificial
  CRISPR gRNA sequence
ttttgggacctctcacatca

SEQ ID NO: 503760 - DNA, 20 bp, Artificial
  CRISPR gRNA sequence
ttgggacctctcacatcact

SEQ ID NO: 503761 - DNA, 20 bp, Artificial
  CRISPR gRNA sequence
tgggacctctcacatcactt

SEQ ID NO: 503762 - DNA, 20 bp, Artificial
  CRISPR gRNA sequence
gggacctctcacatcactta

SEQ ID NO: 503763 - DNA, 20 bp, Artificial
  CRISPR gRNA sequence
ggacctctcacatcacttag

SEQ ID NO: 503764 - DNA, 20 bp, Artificial
  CRISPR gRNA sequence
tcacatcacttaggagtggg

SEQ ID NO: 503765 - DNA, 20 bp, Artificial
  CRISPR gRNA sequence
acatcacttaggagtgggag

SEQ ID NO: 503766 - DNA, 20 bp, Artificial
  CRISPR gRNA sequence
aggagtgggagagcacttat

SEQ ID NO: 503767 - DNA, 20 bp, Artificial
  CRISPR gRNA sequence
ggagtgggagagcacttatc

SEQ ID NO: 503768 - DNA, 20 bp, Artificial
  CRISPR gRNA sequence
atctcgaagttaagtattct

SEQ ID NO: 503769 - DNA, 20 bp, Artificial
  CRISPR gRNA sequence
tctcgaagttaagtattctt

SEQ ID NO: 503770 - DNA, 20 bp, Artificial
  CRISPR gRNA sequence
gaagttaagtattctttacc

SEQ ID NO: 503771 - DNA, 20 bp, Artificial
  CRISPR gRNA sequence
agtattctttaccttctgaa

SEQ ID NO: 503772 - DNA, 20 bp, Artificial
  CRISPR gRNA sequence
tttaccttctgaatttctag

SEQ ID NO: 503773 - DNA, 20 bp, Artificial
  CRISPR gRNA sequence
taccttctgaatttctagtc

SEQ ID NO: 503774 - DNA, 20 bp, Artificial
  CRISPR gRNA sequence
accttctgaatttctagtct

SEQ ID NO: 503775 - DNA, 20 bp, Artificial
  CRISPR gRNA sequence
ccttctgaatttctagtctg

SEQ ID NO: 503776 - DNA, 20 bp, Artificial
  CRISPR gRNA sequence
ctgaatttctagtctggatc

SEQ ID NO: 503777 - DNA, 20 bp, Artificial
  CRISPR gRNA sequence
tgaatttctagtctggatcc

SEQ ID NO: 503778 - DNA, 20 bp, Artificial
  CRISPR gRNA sequence
aatttctagtctggatccag

SEQ ID NO: 503779 - DNA, 20 bp, Artificial
  CRISPR gRNA sequence
ctagtctggatccaggaaga

SEQ ID NO: 503780 - DNA, 20 bp, Artificial
  CRISPR gRNA sequence
tagtctggatccaggaagag

SEQ ID NO: 503781 - DNA, 20 bp, Artificial
  CRISPR gRNA sequence
gtctggatccaggaagagga

SEQ ID NO: 503782 - DNA, 20 bp, Artificial
  CRISPR gRNA sequence
gatccaggaagaggaaccac

SEQ ID NO: 503783 - DNA, 20 bp, Artificial
  CRISPR gRNA sequence
ccttcaatagcactatctat

SEQ ID NO: 503784 - DNA, 20 bp, Artificial
  CRISPR gRNA sequence
cttcaatagcactatctatg

SEQ ID NO: 503785 - DNA, 20 bp, Artificial
  CRISPR gRNA sequence
caatagcactatctatgaag

SEQ ID NO: 503786 - DNA, 20 bp, Artificial
  CRISPR gRNA sequence
aatagcactatctatgaagt

SEQ ID NO: 503787 - DNA, 20 bp, Artificial
  CRISPR gRNA sequence
tctatgaagtggtaagattc

SEQ ID NO: 503788 - DNA, 20 bp, Artificial
  CRISPR gRNA sequence
tgaagtggtaagattctgga

SEQ ID NO: 503789 - DNA, 20 bp, Artificial
  CRISPR gRNA sequence
tggaactcctcaatgggttt

SEQ ID NO: 503790 - DNA, 20 bp, Artificial
  CRISPR gRNA sequence
gaactcctcaatgggtttac

SEQ ID NO: 503791 - DNA, 20 bp, Artificial
  CRISPR gRNA sequence
ctcaatgggtttactgtctg

SEQ ID NO: 503792 - DNA, 20 bp, Artificial
  CRISPR gRNA sequence
aatgggtttactgtctgttg

SEQ ID NO: 503793 - DNA, 20 bp, Artificial
  CRISPR gRNA sequence
actgtctgttgcatagccct

SEQ ID NO: 503794 - DNA, 20 bp, Artificial
  CRISPR gRNA sequence
ctgtctgttgcatagccctg

SEQ ID NO: 503795 - DNA, 20 bp, Artificial
  CRISPR gRNA sequence
tctgttgcatagccctgaaa

SEQ ID NO: 503796 - DNA, 20 bp, Artificial
  CRISPR gRNA sequence
ttgcatagccctgaaatcta

SEQ ID NO: 503797 - DNA, 20 bp, Artificial
  CRISPR gRNA sequence
catagccctgaaatctagcc

SEQ ID NO: 503798 - DNA, 20 bp, Artificial
  CRISPR gRNA sequence
aaatctagccatgaaagggt

SEQ ID NO: 503799 - DNA, 20 bp, Artificial
  CRISPR gRNA sequence
gccatgaaagggtacactta

SEQ ID NO: 503800 - DNA, 20 bp, Artificial
  CRISPR gRNA sequence
aggaaaagatcattcacaca

SEQ ID NO: 503801 - DNA, 20 bp, Artificial
  CRISPR gRNA sequence
ggaaaagatcattcacacag

SEQ ID NO: 503802 - DNA, 20 bp, Artificial
  CRISPR gRNA sequence
acacagtctcagagttgtag

SEQ ID NO: 503803 - DNA, 20 bp, Artificial
  CRISPR gRNA sequence
agagttgtagggaatttaga

SEQ ID NO: 503804 - DNA, 20 bp, Artificial
  CRISPR gRNA sequence
tagggaatttagagatcttc

SEQ ID NO: 503805 - DNA, 20 bp, Artificial
  CRISPR gRNA sequence
agagatcttctaatgcaagt

SEQ ID NO: 503806 - DNA, 20 bp, Artificial
  CRISPR gRNA sequence
gagatcttctaatgcaagtc

SEQ ID NO: 503807 - DNA, 20 bp, Artificial
  CRISPR gRNA sequence
ctaatgcaagtctttgtttt

SEQ ID NO: 503808 - DNA, 20 bp, Artificial
  CRISPR gRNA sequence
taatgcaagtctttgtttta

SEQ ID NO: 503809 - DNA, 20 bp, Artificial
  CRISPR gRNA sequence
atgcaagtctttgttttaga

SEQ ID NO: 503810 - DNA, 20 bp, Artificial
  CRISPR gRNA sequence
tgttttagagatgaagacac

SEQ ID NO: 503811 - DNA, 20 bp, Artificial
  CRISPR gRNA sequence
gttttagagatgaagacact

SEQ ID NO: 503812 - DNA, 20 bp, Artificial
  CRISPR gRNA sequence
ttttagagatgaagacactg

SEQ ID NO: 503813 - DNA, 20 bp, Artificial
  CRISPR gRNA sequence
tagagatgaagacactgaag

SEQ ID NO: 503814 - DNA, 20 bp, Artificial
  CRISPR gRNA sequence
agagatgaagacactgaagc

SEQ ID NO: 503815 - DNA, 20 bp, Artificial
  CRISPR gRNA sequence
gagatgaagacactgaagcc

SEQ ID NO: 503816 - DNA, 20 bp, Artificial
  CRISPR gRNA sequence
aagcccaaggagagtgaggg

SEQ ID NO: 503817 - DNA, 20 bp, Artificial
  CRISPR gRNA sequence
acccaagatcatattgcgtg

SEQ ID NO: 503818 - DNA, 20 bp, Artificial
  CRISPR gRNA sequence
cgtgtttagatatgatactt

SEQ ID NO: 503819 - DNA, 20 bp, Artificial
  CRISPR gRNA sequence
agatatgatacttactgggc

SEQ ID NO: 503820 - DNA, 20 bp, Artificial
  CRISPR gRNA sequence
gatatgatacttactgggca

SEQ ID NO: 503821 - DNA, 20 bp, Artificial
  CRISPR gRNA sequence
actgggcagcttgggtttta

SEQ ID NO: 503822 - DNA, 20 bp, Artificial
  CRISPR gRNA sequence
ctgggcagcttgggttttaa

SEQ ID NO: 503823 - DNA, 20 bp, Artificial
  CRISPR gRNA sequence
ggcagcttgggttttaaatt

SEQ ID NO: 503824 - DNA, 20 bp, Artificial
  CRISPR gRNA sequence
gggttttaaattagggccgt

SEQ ID NO: 503825 - DNA, 20 bp, Artificial
  CRISPR gRNA sequence
ggttttaaattagggccgtc

SEQ ID NO: 503826 - DNA, 20 bp, Artificial
  CRISPR gRNA sequence
taaattagggccgtccccga

SEQ ID NO: 503827 - DNA, 20 bp, Artificial
  CRISPR gRNA sequence
aaattagggccgtccccgag

SEQ ID NO: 503828 - DNA, 20 bp, Artificial
  CRISPR gRNA sequence
aattagggccgtccccgagc

SEQ ID NO: 503829 - DNA, 20 bp, Artificial
  CRISPR gRNA sequence
gggccgtccccgagctagtt

SEQ ID NO: 503830 - DNA, 20 bp, Artificial
  CRISPR gRNA sequence
gttcccaggctgtgggccac

SEQ ID NO: 503831 - DNA, 20 bp, Artificial
  CRISPR gRNA sequence
ccaggctgtgggccacaaac

SEQ ID NO: 503832 - DNA, 20 bp, Artificial
  CRISPR gRNA sequence
tgggccacaaactggacatc

SEQ ID NO: 503833 - DNA, 20 bp, Artificial
  CRISPR gRNA sequence
gacatctctcctttccaaga

SEQ ID NO: 503834 - DNA, 20 bp, Artificial
  CRISPR gRNA sequence
tcctttccaagagtgttcgg

SEQ ID NO: 503835 - DNA, 20 bp, Artificial
  CRISPR gRNA sequence
ctttccaagagtgttcggag

SEQ ID NO: 503836 - DNA, 20 bp, Artificial
  CRISPR gRNA sequence
tccaagagtgttcggaggag

SEQ ID NO: 503837 - DNA, 20 bp, Artificial
  CRISPR gRNA sequence
ccaagagtgttcggaggagg

SEQ ID NO: 503838 - DNA, 20 bp, Artificial
  CRISPR gRNA sequence
caagagtgttcggaggaggg

SEQ ID NO: 503839 - DNA, 20 bp, Artificial
  CRISPR gRNA sequence
ggaggaggggtcagagaggg

SEQ ID NO: 503840 - DNA, 20 bp, Artificial
  CRISPR gRNA sequence
taaatgattttctaaaatta

SEQ ID NO: 503841 - DNA, 20 bp, Artificial
  CRISPR gRNA sequence
aatgattttctaaaattagc

SEQ ID NO: 503842 - DNA, 20 bp, Artificial
  CRISPR gRNA sequence
tctaaaattagcaagtcttt

SEQ ID NO: 503843 - DNA, 20 bp, Artificial
  CRISPR gRNA sequence
ctaaaattagcaagtctttg

SEQ ID NO: 503844 - DNA, 20 bp, Artificial
  CRISPR gRNA sequence
taaaattagcaagtctttgg

SEQ ID NO: 503845 - DNA, 20 bp, Artificial
  CRISPR gRNA sequence
aaattagcaagtctttggga

SEQ ID NO: 503846 - DNA, 20 bp, Artificial
  CRISPR gRNA sequence
gcaagtctttgggagccatt

SEQ ID NO: 503847 - DNA, 20 bp, Artificial
  CRISPR gRNA sequence
tgggagccattccaggacat

SEQ ID NO: 503848 - DNA, 20 bp, Artificial
  CRISPR gRNA sequence
gggagccattccaggacata

SEQ ID NO: 503849 - DNA, 20 bp, Artificial
  CRISPR gRNA sequence
ggagccattccaggacatag

SEQ ID NO: 503850 - DNA, 20 bp, Artificial
  CRISPR gRNA sequence
caggacataggtgagcttaa

SEQ ID NO: 503851 - DNA, 20 bp, Artificial
  CRISPR gRNA sequence
aatcttcttcaggggtcaac

SEQ ID NO: 503852 - DNA, 20 bp, Artificial
  CRISPR gRNA sequence
atcttcttcaggggtcaaca

SEQ ID NO: 503853 - DNA, 20 bp, Artificial
  CRISPR gRNA sequence
cttcaggggtcaacactgtt

SEQ ID NO: 503854 - DNA, 20 bp, Artificial
  CRISPR gRNA sequence
ttcaggggtcaacactgttc

SEQ ID NO: 503855 - DNA, 20 bp, Artificial
  CRISPR gRNA sequence
caggggtcaacactgttcag

SEQ ID NO: 503856 - DNA, 20 bp, Artificial
  CRISPR gRNA sequence
aggggtcaacactgttcaga

SEQ ID NO: 503857 - DNA, 20 bp, Artificial
  CRISPR gRNA sequence
ttcagagatgaccactgagc

SEQ ID NO: 503858 - DNA, 20 bp, Artificial
  CRISPR gRNA sequence
agagatgaccactgagcctg

SEQ ID NO: 503859 - DNA, 20 bp, Artificial
  CRISPR gRNA sequence
agcctggtggttgaattgat

SEQ ID NO: 503860 - DNA, 20 bp, Artificial
  CRISPR gRNA sequence
gtggttgaattgattcccat

SEQ ID NO: 503861 - DNA, 20 bp, Artificial
  CRISPR gRNA sequence
aattgattcccatcagagca

SEQ ID NO: 503862 - DNA, 20 bp, Artificial
  CRISPR gRNA sequence
attcccatcagagcatttag

SEQ ID NO: 503863 - DNA, 20 bp, Artificial
  CRISPR gRNA sequence
ccatcagagcatttagggac

SEQ ID NO: 503864 - DNA, 20 bp, Artificial
  CRISPR gRNA sequence
agggactggaaaggagggac

SEQ ID NO: 503865 - DNA, 20 bp, Artificial
  CRISPR gRNA sequence
gggactggaaaggagggact

SEQ ID NO: 503866 - DNA, 20 bp, Artificial
  CRISPR gRNA sequence
gaaaggagggactcaacatt

SEQ ID NO: 503867 - DNA, 20 bp, Artificial
  CRISPR gRNA sequence
aacatttcttgggggtttat

SEQ ID NO: 503868 - DNA, 20 bp, Artificial
  CRISPR gRNA sequence
cttgggggtttattatggat

SEQ ID NO: 503869 - DNA, 20 bp, Artificial
  CRISPR gRNA sequence
ttgggggtttattatggata

SEQ ID NO: 503870 - DNA, 20 bp, Artificial
  CRISPR gRNA sequence
gggggtttattatggataag

SEQ ID NO: 503871 - DNA, 20 bp, Artificial
  CRISPR gRNA sequence
ggggtttattatggataagg

SEQ ID NO: 503872 - DNA, 20 bp, Artificial
  CRISPR gRNA sequence
attatggataaggtagcctg

SEQ ID NO: 503873 - DNA, 20 bp, Artificial
  CRISPR gRNA sequence
ttatggataaggtagcctgc

SEQ ID NO: 503874 - DNA, 20 bp, Artificial
  CRISPR gRNA sequence
tggataaggtagcctgccag

SEQ ID NO: 503875 - DNA, 20 bp, Artificial
  CRISPR gRNA sequence
ccagtgtcttcacatggatt

SEQ ID NO: 503876 - DNA, 20 bp, Artificial
  CRISPR gRNA sequence
cacatggattattttattta

SEQ ID NO: 503877 - DNA, 20 bp, Artificial
  CRISPR gRNA sequence
acatggattattttatttag

SEQ ID NO: 503878 - DNA, 20 bp, Artificial
  CRISPR gRNA sequence
ttttatttagtcctcacaga

SEQ ID NO: 503879 - DNA, 20 bp, Artificial
  CRISPR gRNA sequence
tatttagtcctcacagaatg

SEQ ID NO: 503880 - DNA, 20 bp, Artificial
  CRISPR gRNA sequence
atttagtcctcacagaatgc

SEQ ID NO: 503881 - DNA, 20 bp, Artificial
  CRISPR gRNA sequence
tttagtcctcacagaatgct

SEQ ID NO: 503882 - DNA, 20 bp, Artificial
  CRISPR gRNA sequence
agtcctcacagaatgctaca

SEQ ID NO: 503883 - DNA, 20 bp, Artificial
  CRISPR gRNA sequence
gtcctcacagaatgctacaa

SEQ ID NO: 503884 - DNA, 20 bp, Artificial
  CRISPR gRNA sequence
acagaatgctacaagatagg

SEQ ID NO: 503885 - DNA, 20 bp, Artificial
  CRISPR gRNA sequence
caagataggtataattatac

SEQ ID NO: 503886 - DNA, 20 bp, Artificial
  CRISPR gRNA sequence
tactttccatttatactcag

SEQ ID NO: 503887 - DNA, 20 bp, Artificial
  CRISPR gRNA sequence
tccatttatactcagagaaa

SEQ ID NO: 503888 - DNA, 20 bp, Artificial
  CRISPR gRNA sequence
ccatttatactcagagaaat

SEQ ID NO: 503889 - DNA, 20 bp, Artificial
  CRISPR gRNA sequence
catttatactcagagaaatt

SEQ ID NO: 503890 - DNA, 20 bp, Artificial
  CRISPR gRNA sequence
atactcagagaaattaaggc

SEQ ID NO: 503891 - DNA, 20 bp, Artificial
  CRISPR gRNA sequence
tactcagagaaattaaggca

SEQ ID NO: 503892 - DNA, 20 bp, Artificial
  CRISPR gRNA sequence
agagaaattaaggcatggag

SEQ ID NO: 503893 - DNA, 20 bp, Artificial
  CRISPR gRNA sequence
aggcatggagagcatccccc

SEQ ID NO: 503894 - DNA, 20 bp, Artificial
  CRISPR gRNA sequence
ccccactacccattagcctc

SEQ ID NO: 503895 - DNA, 20 bp, Artificial
  CRISPR gRNA sequence
cccattagcctcatactaca

SEQ ID NO: 503896 - DNA, 20 bp, Artificial
  CRISPR gRNA sequence
gcctcatactacacctgagc

SEQ ID NO: 503897 - DNA, 20 bp, Artificial
  CRISPR gRNA sequence
atactacacctgagcctccc

SEQ ID NO: 503898 - DNA, 20 bp, Artificial
  CRISPR gRNA sequence
cacctgagcctccccacctg

SEQ ID NO: 503899 - DNA, 20 bp, Artificial
  CRISPR gRNA sequence
agcctccccacctgtggtcc

SEQ ID NO: 503900 - DNA, 20 bp, Artificial
  CRISPR gRNA sequence
cccacctgtggtccaataaa

SEQ ID NO: 503901 - DNA, 20 bp, Artificial
  CRISPR gRNA sequence
tggtccaataaagatgctgc

SEQ ID NO: 503902 - DNA, 20 bp, Artificial
  CRISPR gRNA sequence
ccattggtcagaagggaggg

SEQ ID NO: 503903 - DNA, 20 bp, Artificial
  CRISPR gRNA sequence
gtcagaagggagggatgggt

SEQ ID NO: 503904 - DNA, 20 bp, Artificial
  CRISPR gRNA sequence
cctgctggaattcctggcac

SEQ ID NO: 503905 - DNA, 20 bp, Artificial
  CRISPR gRNA sequence
ctggaattcctggcacttca

SEQ ID NO: 503906 - DNA, 20 bp, Artificial
  CRISPR gRNA sequence
gaattcctggcacttcagct

SEQ ID NO: 503907 - DNA, 20 bp, Artificial
  CRISPR gRNA sequence
ctggcacttcagctatcacc

SEQ ID NO: 503908 - DNA, 20 bp, Artificial
  CRISPR gRNA sequence
gcacttcagctatcacccaa

SEQ ID NO: 503909 - DNA, 20 bp, Artificial
  CRISPR gRNA sequence
cagctatcacccaacattaa

SEQ ID NO: 503910 - DNA, 20 bp, Artificial
  CRISPR gRNA sequence
agctatcacccaacattaaa

SEQ ID NO: 503911 - DNA, 20 bp, Artificial
  CRISPR gRNA sequence
tcacccaacattaaagccaa

SEQ ID NO: 503912 - DNA, 20 bp, Artificial
  CRISPR gRNA sequence
aagccaactggacaacccag

SEQ ID NO: 503913 - DNA, 20 bp, Artificial
  CRISPR gRNA sequence
gacaacccagggtcatagag

SEQ ID NO: 503914 - DNA, 20 bp, Artificial
  CRISPR gRNA sequence
tgtagacccaggtagcttgt

SEQ ID NO: 503915 - DNA, 20 bp, Artificial
  CRISPR gRNA sequence
gtgaggtcatgaaaaagcat

SEQ ID NO: 503916 - DNA, 20 bp, Artificial
  CRISPR gRNA sequence
tgaggtcatgaaaaagcata

SEQ ID NO: 503917 - DNA, 20 bp, Artificial
  CRISPR gRNA sequence
agagagtactggaattggag

SEQ ID NO: 503918 - DNA, 20 bp, Artificial
  CRISPR gRNA sequence
gaattggagccagaagaact

SEQ ID NO: 503919 - DNA, 20 bp, Artificial
  CRISPR gRNA sequence
gagccagaagaactagattc

SEQ ID NO: 503920 - DNA, 20 bp, Artificial
  CRISPR gRNA sequence
gattcaagtccctcctgcac

SEQ ID NO: 503921 - DNA, 20 bp, Artificial
  CRISPR gRNA sequence
aagtccctcctgcacttcac

SEQ ID NO: 503922 - DNA, 20 bp, Artificial
  CRISPR gRNA sequence
ctgcacttcacactagtcgt

SEQ ID NO: 503923 - DNA, 20 bp, Artificial
  CRISPR gRNA sequence
cacttcacactagtcgtgga

SEQ ID NO: 503924 - DNA, 20 bp, Artificial
  CRISPR gRNA sequence
cacactagtcgtggatcctg

SEQ ID NO: 503925 - DNA, 20 bp, Artificial
  CRISPR gRNA sequence
acactagtcgtggatcctga

SEQ ID NO: 503926 - DNA, 20 bp, Artificial
  CRISPR gRNA sequence
gtcgtggatcctgagtaatt

SEQ ID NO: 503927 - DNA, 20 bp, Artificial
  CRISPR gRNA sequence
agtaatttgttttgtcactc

SEQ ID NO: 503928 - DNA, 20 bp, Artificial
  CRISPR gRNA sequence
gttttgtcactctgagcttc

SEQ ID NO: 503929 - DNA, 20 bp, Artificial
  CRISPR gRNA sequence
ttttgtcactctgagcttca

SEQ ID NO: 503930 - DNA, 20 bp, Artificial
  CRISPR gRNA sequence
tgtcactctgagcttcattt

SEQ ID NO: 503931 - DNA, 20 bp, Artificial
  CRISPR gRNA sequence
gtcactctgagcttcatttt

SEQ ID NO: 503932 - DNA, 20 bp, Artificial
  CRISPR gRNA sequence
tcactctgagcttcattttt

SEQ ID NO: 503933 - DNA, 20 bp, Artificial
  CRISPR gRNA sequence
tgagcttcattttttaaatc

SEQ ID NO: 503934 - DNA, 20 bp, Artificial
  CRISPR gRNA sequence
agcttcattttttaaatctg

SEQ ID NO: 503935 - DNA, 20 bp, Artificial
  CRISPR gRNA sequence
cattttttaaatctgtaaaa

SEQ ID NO: 503936 - DNA, 20 bp, Artificial
  CRISPR gRNA sequence
attttttaaatctgtaaaat

SEQ ID NO: 503937 - DNA, 20 bp, Artificial
  CRISPR gRNA sequence
tttaaatctgtaaaatgggg

SEQ ID NO: 503938 - DNA, 20 bp, Artificial
  CRISPR gRNA sequence
ttaaatctgtaaaatgggga

SEQ ID NO: 503939 - DNA, 20 bp, Artificial
  CRISPR gRNA sequence
taaatctgtaaaatggggat

SEQ ID NO: 503940 - DNA, 20 bp, Artificial
  CRISPR gRNA sequence
aaatctgtaaaatggggatg

SEQ ID NO: 503941 - DNA, 20 bp, Artificial
  CRISPR gRNA sequence
aatctgtaaaatggggatgg

SEQ ID NO: 503942 - DNA, 20 bp, Artificial
  CRISPR gRNA sequence
taaaatggggatggcaagtc

SEQ ID NO: 503943 - DNA, 20 bp, Artificial
  CRISPR gRNA sequence
acaggattgtgataaggacc

SEQ ID NO: 503944 - DNA, 20 bp, Artificial
  CRISPR gRNA sequence
tgataaggacctcccagtgc

SEQ ID NO: 503945 - DNA, 20 bp, Artificial
  CRISPR gRNA sequence
ccagtgcaagggtctgaagt

SEQ ID NO: 503946 - DNA, 20 bp, Artificial
  CRISPR gRNA sequence
aagtttctccttttcttttg

SEQ ID NO: 503947 - DNA, 20 bp, Artificial
  CRISPR gRNA sequence
ctccttttcttttgcagatt

SEQ ID NO: 503948 - DNA, 20 bp, Artificial
  CRISPR gRNA sequence
tccttttcttttgcagattg

SEQ ID NO: 503949 - DNA, 20 bp, Artificial
  CRISPR gRNA sequence
cttttcttttgcagattgga

SEQ ID NO: 503950 - DNA, 20 bp, Artificial
  CRISPR gRNA sequence
ttcttttgcagattggaaag

SEQ ID NO: 503951 - DNA, 20 bp, Artificial
  CRISPR gRNA sequence
tcttttgcagattggaaaga

SEQ ID NO: 503952 - DNA, 20 bp, Artificial
  CRISPR gRNA sequence
cttttgcagattggaaagag

SEQ ID NO: 503953 - DNA, 20 bp, Artificial
  CRISPR gRNA sequence
ttttgcagattggaaagagt

SEQ ID NO: 503954 - DNA, 20 bp, Artificial
  CRISPR gRNA sequence
ttgcagattggaaagagtca

SEQ ID NO: 503955 - DNA, 20 bp, Artificial
  CRISPR gRNA sequence
tgcagattggaaagagtcaa

SEQ ID NO: 503956 - DNA, 20 bp, Artificial
  CRISPR gRNA sequence
gcagattggaaagagtcaac

SEQ ID NO: 503957 - DNA, 20 bp, Artificial
  CRISPR gRNA sequence
cagattggaaagagtcaacc

SEQ ID NO: 503958 - DNA, 20 bp, Artificial
  CRISPR gRNA sequence
gaaagagtcaacctaaagcc

SEQ ID NO: 503959 - DNA, 20 bp, Artificial
  CRISPR gRNA sequence
aagcccagaaccctgctcga

SEQ ID NO: 503960 - DNA, 20 bp, Artificial
  CRISPR gRNA sequence
ctcgattgagccgcaaagag

SEQ ID NO: 503961 - DNA, 20 bp, Artificial
  CRISPR gRNA sequence
gattgagccgcaaagagctg

SEQ ID NO: 503962 - DNA, 20 bp, Artificial
  CRISPR gRNA sequence
agccgcaaagagctggagaa

SEQ ID NO: 503963 - DNA, 20 bp, Artificial
  CRISPR gRNA sequence
gagaactttgatgtttattc

SEQ ID NO: 503964 - DNA, 20 bp, Artificial
  CRISPR gRNA sequence
tgatgtttattcctagttgc

SEQ ID NO: 503965 - DNA, 20 bp, Artificial
  CRISPR gRNA sequence
gatgtttattcctagttgct

SEQ ID NO: 503966 - DNA, 20 bp, Artificial
  CRISPR gRNA sequence
atgtttattcctagttgctg

SEQ ID NO: 503967 - DNA, 20 bp, Artificial
  CRISPR gRNA sequence
attcctagttgctgcagcaa

SEQ ID NO: 503968 - DNA, 20 bp, Artificial
  CRISPR gRNA sequence
ttcctagttgctgcagcaat

SEQ ID NO: 503969 - DNA, 20 bp, Artificial
  CRISPR gRNA sequence
ctagttgctgcagcaattct

SEQ ID NO: 503970 - DNA, 20 bp, Artificial
  CRISPR gRNA sequence
gttgctgcagcaattctcac

SEQ ID NO: 503971 - DNA, 20 bp, Artificial
  CRISPR gRNA sequence
ctgcagcaattctcaccttt

SEQ ID NO: 503972 - DNA, 20 bp, Artificial
  CRISPR gRNA sequence
cagcaattctcacctttctt

SEQ ID NO: 503973 - DNA, 20 bp, Artificial
  CRISPR gRNA sequence
tcacctttcttgcacatcag

SEQ ID NO: 503974 - DNA, 20 bp, Artificial
  CRISPR gRNA sequence
acctttcttgcacatcagca

SEQ ID NO: 503975 - DNA, 20 bp, Artificial
  CRISPR gRNA sequence
tcttgcacatcagcatctgc

SEQ ID NO: 503976 - DNA, 20 bp, Artificial
  CRISPR gRNA sequence
cttgcacatcagcatctgct

SEQ ID NO: 503977 - DNA, 20 bp, Artificial
  CRISPR gRNA sequence
ttgcacatcagcatctgctt

SEQ ID NO: 503978 - DNA, 20 bp, Artificial
  CRISPR gRNA sequence
gcacatcagcatctgctttg

SEQ ID NO: 503979 - DNA, 20 bp, Artificial
  CRISPR gRNA sequence
cacatcagcatctgctttgg

SEQ ID NO: 503980 - DNA, 20 bp, Artificial
  CRISPR gRNA sequence
ctttgggaattggcacagtg

SEQ ID NO: 503981 - DNA, 20 bp, Artificial
  CRISPR gRNA sequence
tgggaattggcacagtggat

SEQ ID NO: 503982 - DNA, 20 bp, Artificial
  CRISPR gRNA sequence
gggaattggcacagtggatg

SEQ ID NO: 503983 - DNA, 20 bp, Artificial
  CRISPR gRNA sequence
ggaattggcacagtggatga

SEQ ID NO: 503984 - DNA, 20 bp, Artificial
  CRISPR gRNA sequence
gcacagtggatgacggcaca

SEQ ID NO: 503985 - DNA, 20 bp, Artificial
  CRISPR gRNA sequence
tatagaacagttcctagtct

SEQ ID NO: 503986 - DNA, 20 bp, Artificial
  CRISPR gRNA sequence
tagaacagttcctagtctgg

SEQ ID NO: 503987 - DNA, 20 bp, Artificial
  CRISPR gRNA sequence
ctagtctggagaggatatgg

SEQ ID NO: 503988 - DNA, 20 bp, Artificial
  CRISPR gRNA sequence
gtctggagaggatatggaaa

SEQ ID NO: 503989 - DNA, 20 bp, Artificial
  CRISPR gRNA sequence
gagaggatatggaaatttgt

SEQ ID NO: 503990 - DNA, 20 bp, Artificial
  CRISPR gRNA sequence
gttcttgttctatattttgt

SEQ ID NO: 503991 - DNA, 20 bp, Artificial
  CRISPR gRNA sequence
ttcttgttctatattttgtt

SEQ ID NO: 503992 - DNA, 20 bp, Artificial
  CRISPR gRNA sequence
ttgttctatattttgttttg

SEQ ID NO: 503993 - DNA, 20 bp, Artificial
  CRISPR gRNA sequence
gttctatattttgttttgaa

SEQ ID NO: 503994 - DNA, 20 bp, Artificial
  CRISPR gRNA sequence
ttctatattttgttttgaaa

SEQ ID NO: 503995 - DNA, 20 bp, Artificial
  CRISPR gRNA sequence
tatattttgttttgaaaatg

SEQ ID NO: 503996 - DNA, 20 bp, Artificial
  CRISPR gRNA sequence
tattttgttttgaaaatgat

SEQ ID NO: 503997 - DNA, 20 bp, Artificial
  CRISPR gRNA sequence
tgttttgaaaatgatgtcta

SEQ ID NO: 503998 - DNA, 20 bp, Artificial
  CRISPR gRNA sequence
gttttgaaaatgatgtctaa

SEQ ID NO: 503999 - DNA, 20 bp, Artificial
  CRISPR gRNA sequence
ttttgaaaatgatgtctaac

SEQ ID NO: 504000 - DNA, 20 bp, Artificial
  CRISPR gRNA sequence
tgaaaatgatgtctaacaac

SEQ ID NO: 504001 - DNA, 20 bp, Artificial
  CRISPR gRNA sequence
gaaaatgatgtctaacaacc

SEQ ID NO: 504002 - DNA, 20 bp, Artificial
  CRISPR gRNA sequence
aaaatgatgtctaacaacca

SEQ ID NO: 504003 - DNA, 20 bp, Artificial
  CRISPR gRNA sequence
acaaccatgataagagcaag

SEQ ID NO: 504004 - DNA, 20 bp, Artificial
  CRISPR gRNA sequence
ttaaataatatcttccaatt

SEQ ID NO: 504005 - DNA, 20 bp, Artificial
  CRISPR gRNA sequence
aataatatcttccaatttac

SEQ ID NO: 504006 - DNA, 20 bp, Artificial
  CRISPR gRNA sequence
ccaatttacagatcagacat

SEQ ID NO: 504007 - DNA, 20 bp, Artificial
  CRISPR gRNA sequence
caatttacagatcagacatg

SEQ ID NO: 504008 - DNA, 20 bp, Artificial
  CRISPR gRNA sequence
acagatcagacatgaatggg

SEQ ID NO: 504009 - DNA, 20 bp, Artificial
  CRISPR gRNA sequence
cagatcagacatgaatgggt

SEQ ID NO: 504010 - DNA, 20 bp, Artificial
  CRISPR gRNA sequence
ggttgttcacaaaaggccac

SEQ ID NO: 504011 - DNA, 20 bp, Artificial
  CRISPR gRNA sequence
ttcacaaaaggccacattcc

SEQ ID NO: 504012 - DNA, 20 bp, Artificial
  CRISPR gRNA sequence
acaaaaggccacattccaag

SEQ ID NO: 504013 - DNA, 20 bp, Artificial
  CRISPR gRNA sequence
caagtatttgtaatctagaa

SEQ ID NO: 504014 - DNA, 20 bp, Artificial
  CRISPR gRNA sequence
gtaatctagaaagtgttatg

SEQ ID NO: 504015 - DNA, 20 bp, Artificial
  CRISPR gRNA sequence
taatctagaaagtgttatgt

SEQ ID NO: 504016 - DNA, 20 bp, Artificial
  CRISPR gRNA sequence
gaaagtgttatgtaagtgat

SEQ ID NO: 504017 - DNA, 20 bp, Artificial
  CRISPR gRNA sequence
tgtaagtgatgttattagca

SEQ ID NO: 504018 - DNA, 20 bp, Artificial
  CRISPR gRNA sequence
ttagcatcgagattccctcc

SEQ ID NO: 504019 - DNA, 20 bp, Artificial
  CRISPR gRNA sequence
gcatcgagattccctccacc

SEQ ID NO: 504020 - DNA, 20 bp, Artificial
  CRISPR gRNA sequence
cctccacctgattttcaagc

SEQ ID NO: 504021 - DNA, 20 bp, Artificial
  CRISPR gRNA sequence
cacctgattttcaagctgtc

SEQ ID NO: 504022 - DNA, 20 bp, Artificial
  CRISPR gRNA sequence
attttcaagctgtcacttgt

SEQ ID NO: 504023 - DNA, 20 bp, Artificial
  CRISPR gRNA sequence
tcaagctgtcacttgtttcc

SEQ ID NO: 504024 - DNA, 20 bp, Artificial
  CRISPR gRNA sequence
caagctgtcacttgtttcct

SEQ ID NO: 504025 - DNA, 20 bp, Artificial
  CRISPR gRNA sequence
aagctgtcacttgtttcctt

SEQ ID NO: 504026 - DNA, 20 bp, Artificial
  CRISPR gRNA sequence
tcacttgtttccttttctcc

SEQ ID NO: 504027 - DNA, 20 bp, Artificial
  CRISPR gRNA sequence
gtttccttttctcccctctc

SEQ ID NO: 504028 - DNA, 20 bp, Artificial
  CRISPR gRNA sequence
tttccttttctcccctctct

SEQ ID NO: 504029 - DNA, 20 bp, Artificial
  CRISPR gRNA sequence
ccttttctcccctctctggg

SEQ ID NO: 504030 - DNA, 20 bp, Artificial
  CRISPR gRNA sequence
cttttctcccctctctgggt

SEQ ID NO: 504031 - DNA, 20 bp, Artificial
  CRISPR gRNA sequence
ttctcccctctctgggttga

SEQ ID NO: 504032 - DNA, 20 bp, Artificial
  CRISPR gRNA sequence
tctcccctctctgggttgac

SEQ ID NO: 504033 - DNA, 20 bp, Artificial
  CRISPR gRNA sequence
ctcccctctctgggttgact

SEQ ID NO: 504034 - DNA, 20 bp, Artificial
  CRISPR gRNA sequence
tcccctctctgggttgactg

SEQ ID NO: 504035 - DNA, 20 bp, Artificial
  CRISPR gRNA sequence
ccctctctgggttgactgca

SEQ ID NO: 504036 - DNA, 20 bp, Artificial
  CRISPR gRNA sequence
tctgggttgactgcatttct

SEQ ID NO: 504037 - DNA, 20 bp, Artificial
  CRISPR gRNA sequence
tgggttgactgcatttctag

SEQ ID NO: 504038 - DNA, 20 bp, Artificial
  CRISPR gRNA sequence
ggttgactgcatttctagac

SEQ ID NO: 504039 - DNA, 20 bp, Artificial
  CRISPR gRNA sequence
actgcatttctagactctcg

SEQ ID NO: 504040 - DNA, 20 bp, Artificial
  CRISPR gRNA sequence
catttctagactctcgccgg

SEQ ID NO: 504041 - DNA, 20 bp, Artificial
  CRISPR gRNA sequence
ctagactctcgccggcccag

SEQ ID NO: 504042 - DNA, 20 bp, Artificial
  CRISPR gRNA sequence
tagactctcgccggcccagg

SEQ ID NO: 504043 - DNA, 20 bp, Artificial
  CRISPR gRNA sequence
gactctcgccggcccaggcc

SEQ ID NO: 504044 - DNA, 20 bp, Artificial
  CRISPR gRNA sequence
tcgccggcccaggcccatct

SEQ ID NO: 504045 - DNA, 20 bp, Artificial
  CRISPR gRNA sequence
gccggcccaggcccatcttc

SEQ ID NO: 504046 - DNA, 20 bp, Artificial
  CRISPR gRNA sequence
ccaaagcaagaggaaggaat

SEQ ID NO: 504047 - DNA, 20 bp, Artificial
  CRISPR gRNA sequence
caaagcaagaggaaggaatg

SEQ ID NO: 504048 - DNA, 20 bp, Artificial
  CRISPR gRNA sequence
aggggaagaagaaacagccc

SEQ ID NO: 504049 - DNA, 20 bp, Artificial
  CRISPR gRNA sequence
ctctgaaagcctggactgtc

SEQ ID NO: 504050 - DNA, 20 bp, Artificial
  CRISPR gRNA sequence
tgaaagcctggactgtccgg

SEQ ID NO: 504051 - DNA, 20 bp, Artificial
  CRISPR gRNA sequence
aaagcctggactgtccggct

SEQ ID NO: 504052 - DNA, 20 bp, Artificial
  CRISPR gRNA sequence
gactgtccggctgtgaactg

SEQ ID NO: 504053 - DNA, 20 bp, Artificial
  CRISPR gRNA sequence
tccggctgtgaactggctgg

SEQ ID NO: 504054 - DNA, 20 bp, Artificial
  CRISPR gRNA sequence
tgaactggctggcaggttct

SEQ ID NO: 504055 - DNA, 20 bp, Artificial
  CRISPR gRNA sequence
gctggcaggttctgcacgtg

SEQ ID NO: 504056 - DNA, 20 bp, Artificial
  CRISPR gRNA sequence
gcaggttctgcacgtgggtg

SEQ ID NO: 504057 - DNA, 20 bp, Artificial
  CRISPR gRNA sequence
tgcacgtgggtgggggccag

SEQ ID NO: 504058 - DNA, 20 bp, Artificial
  CRISPR gRNA sequence
cacgtgggtgggggccaggg

SEQ ID NO: 504059 - DNA, 20 bp, Artificial
  CRISPR gRNA sequence
ggctttactcaattgcagag

SEQ ID NO: 504060 - DNA, 20 bp, Artificial
  CRISPR gRNA sequence
tactcaattgcagagaaaaa

SEQ ID NO: 504061 - DNA, 20 bp, Artificial
  CRISPR gRNA sequence
actcaattgcagagaaaaaa

SEQ ID NO: 504062 - DNA, 20 bp, Artificial
  CRISPR gRNA sequence
ctcaattgcagagaaaaaac

SEQ ID NO: 504063 - DNA, 20 bp, Artificial
  CRISPR gRNA sequence
aattgcagagaaaaaacttt

SEQ ID NO: 504064 - DNA, 20 bp, Artificial
  CRISPR gRNA sequence
cagagaaaaaactttctccc

SEQ ID NO: 504065 - DNA, 20 bp, Artificial
  CRISPR gRNA sequence
tctccctgcatctcatacct

SEQ ID NO: 504066 - DNA, 20 bp, Artificial
  CRISPR gRNA sequence
ctccctgcatctcatacctt

SEQ ID NO: 504067 - DNA, 20 bp, Artificial
  CRISPR gRNA sequence
tccctgcatctcataccttt

SEQ ID NO: 504068 - DNA, 20 bp, Artificial
  CRISPR gRNA sequence
cctgcatctcatacctttac

SEQ ID NO: 504069 - DNA, 20 bp, Artificial
  CRISPR gRNA sequence
catctcatacctttacctct

SEQ ID NO: 504070 - DNA, 20 bp, Artificial
  CRISPR gRNA sequence
atacctttacctctggccag

SEQ ID NO: 504071 - DNA, 20 bp, Artificial
  CRISPR gRNA sequence
tacctctggccagttggcca

SEQ ID NO: 504072 - DNA, 20 bp, Artificial
  CRISPR gRNA sequence
acctctggccagttggccac

SEQ ID NO: 504073 - DNA, 20 bp, Artificial
  CRISPR gRNA sequence
cctctggccagttggccacc

SEQ ID NO: 504074 - DNA, 20 bp, Artificial
  CRISPR gRNA sequence
tggccagttggccaccaggg

SEQ ID NO: 504075 - DNA, 20 bp, Artificial
  CRISPR gRNA sequence
gccagttggccaccaggggg

SEQ ID NO: 504076 - DNA, 20 bp, Artificial
  CRISPR gRNA sequence
gccaccagggggagtgggct

SEQ ID NO: 504077 - DNA, 20 bp, Artificial
  CRISPR gRNA sequence
aagggagagtagatggtgca

SEQ ID NO: 504078 - DNA, 20 bp, Artificial
  CRISPR gRNA sequence
taagtagaaaaatcacccag

SEQ ID NO: 504079 - DNA, 20 bp, Artificial
  CRISPR gRNA sequence
agtagaaaaatcacccagag

SEQ ID NO: 504080 - DNA, 20 bp, Artificial
  CRISPR gRNA sequence
acctgataactggggtgttg

SEQ ID NO: 504081 - DNA, 20 bp, Artificial
  CRISPR gRNA sequence
ataactggggtgttgagacc

SEQ ID NO: 504082 - DNA, 20 bp, Artificial
  CRISPR gRNA sequence
gggtgttgagaccagctttg

SEQ ID NO: 504083 - DNA, 20 bp, Artificial
  CRISPR gRNA sequence
agaccagctttgtccatggt

SEQ ID NO: 504084 - DNA, 20 bp, Artificial
  CRISPR gRNA sequence
tgtccatggtatgatgtttg

SEQ ID NO: 504085 - DNA, 20 bp, Artificial
  CRISPR gRNA sequence
gtccatggtatgatgtttga

SEQ ID NO: 504086 - DNA, 20 bp, Artificial
  CRISPR gRNA sequence
tccatggtatgatgtttgat

SEQ ID NO: 504087 - DNA, 20 bp, Artificial
  CRISPR gRNA sequence
gatttatgaagacgcattgt

SEQ ID NO: 504088 - DNA, 20 bp, Artificial
  CRISPR gRNA sequence
atttatgaagacgcattgtt

SEQ ID NO: 504089 - DNA, 20 bp, Artificial
  CRISPR gRNA sequence
atgaagacgcattgttagaa

SEQ ID NO: 504090 - DNA, 20 bp, Artificial
  CRISPR gRNA sequence
tgaagacgcattgttagaaa

SEQ ID NO: 504091 - DNA, 20 bp, Artificial
  CRISPR gRNA sequence
ttagaaatccatttggcttc

SEQ ID NO: 504092 - DNA, 20 bp, Artificial
  CRISPR gRNA sequence
gaaatccatttggcttcttc

SEQ ID NO: 504093 - DNA, 20 bp, Artificial
  CRISPR gRNA sequence
ggcttcttcatagaagtggc

SEQ ID NO: 504094 - DNA, 20 bp, Artificial
  CRISPR gRNA sequence
gcttcttcatagaagtggct

SEQ ID NO: 504095 - DNA, 20 bp, Artificial
  CRISPR gRNA sequence
cttcatagaagtggcttccc

SEQ ID NO: 504096 - DNA, 20 bp, Artificial
  CRISPR gRNA sequence
ttcatagaagtggcttccca

SEQ ID NO: 504097 - DNA, 20 bp, Artificial
  CRISPR gRNA sequence
catagaagtggcttcccaga

SEQ ID NO: 504098 - DNA, 20 bp, Artificial
  CRISPR gRNA sequence
atagaagtggcttcccagag

SEQ ID NO: 504099 - DNA, 20 bp, Artificial
  CRISPR gRNA sequence
cccagaggaagaggcctctc

SEQ ID NO: 504100 - DNA, 20 bp, Artificial
  CRISPR gRNA sequence
ccagaggaagaggcctctca

SEQ ID NO: 504101 - DNA, 20 bp, Artificial
  CRISPR gRNA sequence
tcagaaaccatgttctattt

SEQ ID NO: 504102 - DNA, 20 bp, Artificial
  CRISPR gRNA sequence
agaaaccatgttctatttaa

SEQ ID NO: 504103 - DNA, 20 bp, Artificial
  CRISPR gRNA sequence
tatttaagttctgagtcctg

SEQ ID NO: 504104 - DNA, 20 bp, Artificial
  CRISPR gRNA sequence
tttaagttctgagtcctgat

SEQ ID NO: 504105 - DNA, 20 bp, Artificial
  CRISPR gRNA sequence
aagttctgagtcctgatgag

SEQ ID NO: 504106 - DNA, 20 bp, Artificial
  CRISPR gRNA sequence
agttctgagtcctgatgagt

SEQ ID NO: 504107 - DNA, 20 bp, Artificial
  CRISPR gRNA sequence
tgagtcctgatgagtgttcc

SEQ ID NO: 504108 - DNA, 20 bp, Artificial
  CRISPR gRNA sequence
agtcctgatgagtgttcccc

SEQ ID NO: 504109 - DNA, 20 bp, Artificial
  CRISPR gRNA sequence
atgagtgttccccaggatgc

SEQ ID NO: 504110 - DNA, 20 bp, Artificial
  CRISPR gRNA sequence
cccaggatgcacattgaagg

SEQ ID NO: 504111 - DNA, 20 bp, Artificial
  CRISPR gRNA sequence
aagggagggctcaggcagct

SEQ ID NO: 504112 - DNA, 20 bp, Artificial
  CRISPR gRNA sequence
aggcagctgagggctgagaa

SEQ ID NO: 504113 - DNA, 20 bp, Artificial
  CRISPR gRNA sequence
agggctgagaatgaggcagt

SEQ ID NO: 504114 - DNA, 20 bp, Artificial
  CRISPR gRNA sequence
agaatgaggcagttggaatc

SEQ ID NO: 504115 - DNA, 20 bp, Artificial
  CRISPR gRNA sequence
gaatctagacactatgctgg

SEQ ID NO: 504116 - DNA, 20 bp, Artificial
  CRISPR gRNA sequence
gacactatgctgggttccct

SEQ ID NO: 504117 - DNA, 20 bp, Artificial
  CRISPR gRNA sequence
tgctgggttccctgagtcgt

SEQ ID NO: 504118 - DNA, 20 bp, Artificial
  CRISPR gRNA sequence
ggttccctgagtcgtcaggc

SEQ ID NO: 504119 - DNA, 20 bp, Artificial
  CRISPR gRNA sequence
cctgagtcgtcaggccagac

SEQ ID NO: 504120 - DNA, 20 bp, Artificial
  CRISPR gRNA sequence
agtcgtcaggccagacattt

SEQ ID NO: 504121 - DNA, 20 bp, Artificial
  CRISPR gRNA sequence
caacaaggctgtggggagca

SEQ ID NO: 504122 - DNA, 20 bp, Artificial
  CRISPR gRNA sequence
aacaaggctgtggggagcag

SEQ ID NO: 504123 - DNA, 20 bp, Artificial
  CRISPR gRNA sequence
tggggagcagggctgtgact

SEQ ID NO: 504124 - DNA, 20 bp, Artificial
  CRISPR gRNA sequence
tgactctggctgagcccagg

SEQ ID NO: 504125 - DNA, 20 bp, Artificial
  CRISPR gRNA sequence
tggctgagcccaggaaagcg

SEQ ID NO: 504126 - DNA, 20 bp, Artificial
  CRISPR gRNA sequence
gctgagcccaggaaagcgac

SEQ ID NO: 504127 - DNA, 20 bp, Artificial
  CRISPR gRNA sequence
agcccaggaaagcgacaagg

SEQ ID NO: 504128 - DNA, 20 bp, Artificial
  CRISPR gRNA sequence
ggagaggacttactcagaga

SEQ ID NO: 504129 - DNA, 20 bp, Artificial
  CRISPR gRNA sequence
actcagagaccccaacaggt

SEQ ID NO: 504130 - DNA, 20 bp, Artificial
  CRISPR gRNA sequence
ctcagagaccccaacaggtg

SEQ ID NO: 504131 - DNA, 20 bp, Artificial
  CRISPR gRNA sequence
agagaccccaacaggtgata

SEQ ID NO: 504132 - DNA, 20 bp, Artificial
  CRISPR gRNA sequence
cacaaagcctggttcttcaa

SEQ ID NO: 504133 - DNA, 20 bp, Artificial
  CRISPR gRNA sequence
gttcttcaattttcctaccc

SEQ ID NO: 504134 - DNA, 20 bp, Artificial
  CRISPR gRNA sequence
ttcaattttcctaccctgta

SEQ ID NO: 504135 - DNA, 20 bp, Artificial
  CRISPR gRNA sequence
caattttcctaccctgtatc

SEQ ID NO: 504136 - DNA, 20 bp, Artificial
  CRISPR gRNA sequence
aattttcctaccctgtatct

SEQ ID NO: 504137 - DNA, 20 bp, Artificial
  CRISPR gRNA sequence
tcctaccctgtatctaacat

SEQ ID NO: 504138 - DNA, 20 bp, Artificial
  CRISPR gRNA sequence
cctaccctgtatctaacata

SEQ ID NO: 504139 - DNA, 20 bp, Artificial
  CRISPR gRNA sequence
ctaccctgtatctaacatag

SEQ ID NO: 504140 - DNA, 20 bp, Artificial
  CRISPR gRNA sequence
ccctgtatctaacataggag

SEQ ID NO: 504141 - DNA, 20 bp, Artificial
  CRISPR gRNA sequence
tatctaacataggagtttca

SEQ ID NO: 504142 - DNA, 20 bp, Artificial
  CRISPR gRNA sequence
acataggagtttcatataaa

SEQ ID NO: 504143 - DNA, 20 bp, Artificial
  CRISPR gRNA sequence
catataaaacggtgatatca

SEQ ID NO: 504144 - DNA, 20 bp, Artificial
  CRISPR gRNA sequence
atataaaacggtgatatcat

SEQ ID NO: 504145 - DNA, 20 bp, Artificial
  CRISPR gRNA sequence
aattccttgcctgaattaaa

SEQ ID NO: 504146 - DNA, 20 bp, Artificial
  CRISPR gRNA sequence
cttgcctgaattaaatttat

SEQ ID NO: 504147 - DNA, 20 bp, Artificial
  CRISPR gRNA sequence
gcctgaattaaatttatgta

SEQ ID NO: 504148 - DNA, 20 bp, Artificial
  CRISPR gRNA sequence
cctgaattaaatttatgtat

SEQ ID NO: 504149 - DNA, 20 bp, Artificial
  CRISPR gRNA sequence
aattaaatttatgtatcctc

SEQ ID NO: 504150 - DNA, 20 bp, Artificial
  CRISPR gRNA sequence
aatttatgtatcctctccat

SEQ ID NO: 504151 - DNA, 20 bp, Artificial
  CRISPR gRNA sequence
atgtatcctctccataccct

SEQ ID NO: 504152 - DNA, 20 bp, Artificial
  CRISPR gRNA sequence
tgtatcctctccataccctg

SEQ ID NO: 504153 - DNA, 20 bp, Artificial
  CRISPR gRNA sequence
tccataccctgcatttttat

SEQ ID NO: 504154 - DNA, 20 bp, Artificial
  CRISPR gRNA sequence
cataccctgcatttttattc

SEQ ID NO: 504155 - DNA, 20 bp, Artificial
  CRISPR gRNA sequence
catttttattctctatagca

SEQ ID NO: 504156 - DNA, 20 bp, Artificial
  CRISPR gRNA sequence
ttattctctatagcagccga

SEQ ID NO: 504157 - DNA, 20 bp, Artificial
  CRISPR gRNA sequence
tattctctatagcagccgaa

SEQ ID NO: 504158 - DNA, 20 bp, Artificial
  CRISPR gRNA sequence
attctctatagcagccgaag

SEQ ID NO: 504159 - DNA, 20 bp, Artificial
  CRISPR gRNA sequence
ttctctatagcagccgaagg

SEQ ID NO: 504160 - DNA, 20 bp, Artificial
  CRISPR gRNA sequence
tctatagcagccgaagggca

SEQ ID NO: 504161 - DNA, 20 bp, Artificial
  CRISPR gRNA sequence
tatagcagccgaagggcact

SEQ ID NO: 504162 - DNA, 20 bp, Artificial
  CRISPR gRNA sequence
tagcagccgaagggcacttg

SEQ ID NO: 504163 - DNA, 20 bp, Artificial
  CRISPR gRNA sequence
gtgggccatcaacaaacaca

SEQ ID NO: 504164 - DNA, 20 bp, Artificial
  CRISPR gRNA sequence
tgggccatcaacaaacacat

SEQ ID NO: 504165 - DNA, 20 bp, Artificial
  CRISPR gRNA sequence
tttgaacactgctgtagagg

SEQ ID NO: 504166 - DNA, 20 bp, Artificial
  CRISPR gRNA sequence
gaacactgctgtagagggtc

SEQ ID NO: 504167 - DNA, 20 bp, Artificial
  CRISPR gRNA sequence
aacactgctgtagagggtct

SEQ ID NO: 504168 - DNA, 20 bp, Artificial
  CRISPR gRNA sequence
ctgtagagggtctgacttcc

SEQ ID NO: 504169 - DNA, 20 bp, Artificial
  CRISPR gRNA sequence
tagagggtctgacttcctgg

SEQ ID NO: 504170 - DNA, 20 bp, Artificial
  CRISPR gRNA sequence
aagccagctgtgtgcctgtg

SEQ ID NO: 504171 - DNA, 20 bp, Artificial
  CRISPR gRNA sequence
agctgtgtgcctgtgtggca

SEQ ID NO: 504172 - DNA, 20 bp, Artificial
  CRISPR gRNA sequence
gctgtgtgcctgtgtggcaa

SEQ ID NO: 504173 - DNA, 20 bp, Artificial
  CRISPR gRNA sequence
tgtgcctgtgtggcaaaggt

SEQ ID NO: 504174 - DNA, 20 bp, Artificial
  CRISPR gRNA sequence
gcctgtgtggcaaaggtcag

SEQ ID NO: 504175 - DNA, 20 bp, Artificial
  CRISPR gRNA sequence
cctgtgtggcaaaggtcagc

SEQ ID NO: 504176 - DNA, 20 bp, Artificial
  CRISPR gRNA sequence
gtgtggcaaaggtcagcggg

SEQ ID NO: 504177 - DNA, 20 bp, Artificial
  CRISPR gRNA sequence
tgtggcaaaggtcagcgggc

SEQ ID NO: 504178 - DNA, 20 bp, Artificial
  CRISPR gRNA sequence
gcaaaggtcagcgggcagga

SEQ ID NO: 504179 - DNA, 20 bp, Artificial
  CRISPR gRNA sequence
caaaggtcagcgggcaggac

SEQ ID NO: 504180 - DNA, 20 bp, Artificial
  CRISPR gRNA sequence
aaaggtcagcgggcaggaca

SEQ ID NO: 504181 - DNA, 20 bp, Artificial
  CRISPR gRNA sequence
ggacagggcccacgtgtgcc

SEQ ID NO: 504182 - DNA, 20 bp, Artificial
  CRISPR gRNA sequence
cgtgtgcctggccaccttgc

SEQ ID NO: 504183 - DNA, 20 bp, Artificial
  CRISPR gRNA sequence
tgcctggccaccttgccagt

SEQ ID NO: 504184 - DNA, 20 bp, Artificial
  CRISPR gRNA sequence
gcctggccaccttgccagtc

SEQ ID NO: 504185 - DNA, 20 bp, Artificial
  CRISPR gRNA sequence
cctggccaccttgccagtcg

SEQ ID NO: 504186 - DNA, 20 bp, Artificial
  CRISPR gRNA sequence
ctggccaccttgccagtcgg

SEQ ID NO: 504187 - DNA, 20 bp, Artificial
  CRISPR gRNA sequence
ccttgccagtcgggggaata

SEQ ID NO: 504188 - DNA, 20 bp, Artificial
  CRISPR gRNA sequence
tgccagtcgggggaatacag

SEQ ID NO: 504189 - DNA, 20 bp, Artificial
  CRISPR gRNA sequence
tcgggggaatacagcggaca

SEQ ID NO: 504190 - DNA, 20 bp, Artificial
  CRISPR gRNA sequence
aatacagcggacacagtgcc

SEQ ID NO: 504191 - DNA, 20 bp, Artificial
  CRISPR gRNA sequence
gacacagtgcccagtttcca

SEQ ID NO: 504192 - DNA, 20 bp, Artificial
  CRISPR gRNA sequence
cagtgcccagtttccatgga

SEQ ID NO: 504193 - DNA, 20 bp, Artificial
  CRISPR gRNA sequence
tccatggacagcctgtattg

SEQ ID NO: 504194 - DNA, 20 bp, Artificial
  CRISPR gRNA sequence
ttgattaacaatataattaa

SEQ ID NO: 504195 - DNA, 20 bp, Artificial
  CRISPR gRNA sequence
tgattaacaatataattaat

SEQ ID NO: 504196 - DNA, 20 bp, Artificial
  CRISPR gRNA sequence
atgtcattttataccctgac

SEQ ID NO: 504197 - DNA, 20 bp, Artificial
  CRISPR gRNA sequence
aagtttaaatgtaaataaat

SEQ ID NO: 504198 - DNA, 20 bp, Artificial
  CRISPR gRNA sequence
aaattggcaccacctttaat

SEQ ID NO: 504199 - DNA, 20 bp, Artificial
  CRISPR gRNA sequence
gactgatgtcctgacttgca

SEQ ID NO: 504200 - DNA, 20 bp, Artificial
  CRISPR gRNA sequence
actgatgtcctgacttgcac

SEQ ID NO: 504201 - DNA, 20 bp, Artificial
  CRISPR gRNA sequence
cacctaacctcaccaacctc

SEQ ID NO: 504202 - DNA, 20 bp, Artificial
  CRISPR gRNA sequence
acctcaagccctccctcctc

SEQ ID NO: 504203 - DNA, 20 bp, Artificial
  CRISPR gRNA sequence
cctcctcaagtctccatgca

SEQ ID NO: 504204 - DNA, 20 bp, Artificial
  CRISPR gRNA sequence
tctccatgcaaagactgtgc

SEQ ID NO: 504205 - DNA, 20 bp, Artificial
  CRISPR gRNA sequence
catgcaaagactgtgccagt

SEQ ID NO: 504206 - DNA, 20 bp, Artificial
  CRISPR gRNA sequence
tgcaaagactgtgccagtca

SEQ ID NO: 504207 - DNA, 20 bp, Artificial
  CRISPR gRNA sequence
aaagactgtgccagtcagag

SEQ ID NO: 504208 - DNA, 20 bp, Artificial
  CRISPR gRNA sequence
agactgtgccagtcagagtg

SEQ ID NO: 504209 - DNA, 20 bp, Artificial
  CRISPR gRNA sequence
agtggagctgtccccccgac

SEQ ID NO: 504210 - DNA, 20 bp, Artificial
  CRISPR gRNA sequence
ctgtccccccgacgagcccc

SEQ ID NO: 504211 - DNA, 20 bp, Artificial
  CRISPR gRNA sequence
tccccccgacgagcccccag

SEQ ID NO: 504212 - DNA, 20 bp, Artificial
  CRISPR gRNA sequence
gacgagcccccagaagcacc

SEQ ID NO: 504213 - DNA, 20 bp, Artificial
  CRISPR gRNA sequence
agcccccagaagcacccggc

SEQ ID NO: 504214 - DNA, 20 bp, Artificial
  CRISPR gRNA sequence
cagaagcacccggccggcca

SEQ ID NO: 504215 - DNA, 20 bp, Artificial
  CRISPR gRNA sequence
ccggccatggctgtcatttt

SEQ ID NO: 504216 - DNA, 20 bp, Artificial
  CRISPR gRNA sequence
cggccatggctgtcattttg

SEQ ID NO: 504217 - DNA, 20 bp, Artificial
  CRISPR gRNA sequence
ggccatggctgtcattttga

SEQ ID NO: 504218 - DNA, 20 bp, Artificial
  CRISPR gRNA sequence
catggctgtcattttgaggg

SEQ ID NO: 504219 - DNA, 20 bp, Artificial
  CRISPR gRNA sequence
ttttgagggcggaaaataac

SEQ ID NO: 504220 - DNA, 20 bp, Artificial
  CRISPR gRNA sequence
gcggaaaataactggatttc

SEQ ID NO: 504221 - DNA, 20 bp, Artificial
  CRISPR gRNA sequence
taactggatttctggttaat

SEQ ID NO: 504222 - DNA, 20 bp, Artificial
  CRISPR gRNA sequence
ggttaattggtgacatcctc

SEQ ID NO: 504223 - DNA, 20 bp, Artificial
  CRISPR gRNA sequence
ttaattggtgacatcctcaa

SEQ ID NO: 504224 - DNA, 20 bp, Artificial
  CRISPR gRNA sequence
ggtgacatcctcaagagctg

SEQ ID NO: 504225 - DNA, 20 bp, Artificial
  CRISPR gRNA sequence
acatcctcaagagctgtggc

SEQ ID NO: 504226 - DNA, 20 bp, Artificial
  CRISPR gRNA sequence
agctgtggcaagccatgtct

SEQ ID NO: 504227 - DNA, 20 bp, Artificial
  CRISPR gRNA sequence
gccatgtctcggccgcgtga

SEQ ID NO: 504228 - DNA, 20 bp, Artificial
  CRISPR gRNA sequence
ccatgtctcggccgcgtgat

SEQ ID NO: 504229 - DNA, 20 bp, Artificial
  CRISPR gRNA sequence
catgtctcggccgcgtgatg

SEQ ID NO: 504230 - DNA, 20 bp, Artificial
  CRISPR gRNA sequence
gtctcggccgcgtgatgggg

SEQ ID NO: 504231 - DNA, 20 bp, Artificial
  CRISPR gRNA sequence
gccgcgtgatggggcagaca

SEQ ID NO: 504232 - DNA, 20 bp, Artificial
  CRISPR gRNA sequence
gcgtgatggggcagacatgg

SEQ ID NO: 504233 - DNA, 20 bp, Artificial
  CRISPR gRNA sequence
cgtgatggggcagacatggt

SEQ ID NO: 504234 - DNA, 20 bp, Artificial
  CRISPR gRNA sequence
gcagacatggtgggtcctga

SEQ ID NO: 504235 - DNA, 20 bp, Artificial
  CRISPR gRNA sequence
ctgacggccttgtcttcacc

SEQ ID NO: 504236 - DNA, 20 bp, Artificial
  CRISPR gRNA sequence
caccaagtgctcctaactct

SEQ ID NO: 504237 - DNA, 20 bp, Artificial
  CRISPR gRNA sequence
ctcctaactctcagcaaact

SEQ ID NO: 504238 - DNA, 20 bp, Artificial
  CRISPR gRNA sequence
tcctaactctcagcaaactt

SEQ ID NO: 504239 - DNA, 20 bp, Artificial
  CRISPR gRNA sequence
cctaactctcagcaaacttg

SEQ ID NO: 504240 - DNA, 20 bp, Artificial
  CRISPR gRNA sequence
cttggggttcatgaccgtcg

SEQ ID NO: 504241 - DNA, 20 bp, Artificial
  CRISPR gRNA sequence
ggggttcatgaccgtcgtgg

SEQ ID NO: 504242 - DNA, 20 bp, Artificial
  CRISPR gRNA sequence
gtcgtggtggcgctcttgaa

SEQ ID NO: 504243 - DNA, 20 bp, Artificial
  CRISPR gRNA sequence
tcgtggtggcgctcttgaaa

SEQ ID NO: 504244 - DNA, 20 bp, Artificial
  CRISPR gRNA sequence
cgtggtggcgctcttgaaaa

SEQ ID NO: 504245 - DNA, 20 bp, Artificial
  CRISPR gRNA sequence
gtggtggcgctcttgaaaag

SEQ ID NO: 504246 - DNA, 20 bp, Artificial
  CRISPR gRNA sequence
tcttgaaaaggggattatcc

SEQ ID NO: 504247 - DNA, 20 bp, Artificial
  CRISPR gRNA sequence
tgaaaaggggattatcctgg

SEQ ID NO: 504248 - DNA, 20 bp, Artificial
  CRISPR gRNA sequence
gaaaaggggattatcctggt

SEQ ID NO: 504249 - DNA, 20 bp, Artificial
  CRISPR gRNA sequence
atcctggtgggaaatgcaaa

SEQ ID NO: 504250 - DNA, 20 bp, Artificial
  CRISPR gRNA sequence
tcctggtgggaaatgcaaac

SEQ ID NO: 504251 - DNA, 20 bp, Artificial
  CRISPR gRNA sequence
cctggtgggaaatgcaaaca

SEQ ID NO: 504252 - DNA, 20 bp, Artificial
  CRISPR gRNA sequence
ctggtgggaaatgcaaacag

SEQ ID NO: 504253 - DNA, 20 bp, Artificial
  CRISPR gRNA sequence
aaatgcaaacaggggcttgt

SEQ ID NO: 504254 - DNA, 20 bp, Artificial
  CRISPR gRNA sequence
caaacaggggcttgtgagtg

SEQ ID NO: 504255 - DNA, 20 bp, Artificial
  CRISPR gRNA sequence
aaacaggggcttgtgagtgt

SEQ ID NO: 504256 - DNA, 20 bp, Artificial
  CRISPR gRNA sequence
acaggggcttgtgagtgtgg

SEQ ID NO: 504257 - DNA, 20 bp, Artificial
  CRISPR gRNA sequence
caggggcttgtgagtgtggg

SEQ ID NO: 504258 - DNA, 20 bp, Artificial
  CRISPR gRNA sequence
ttgtgagtgtgggaggtttt

SEQ ID NO: 504259 - DNA, 20 bp, Artificial
  CRISPR gRNA sequence
gtgagtgtgggaggttttca

SEQ ID NO: 504260 - DNA, 20 bp, Artificial
  CRISPR gRNA sequence
agtgtgggaggttttcagag

SEQ ID NO: 504261 - DNA, 20 bp, Artificial
  CRISPR gRNA sequence
agagcagaatctttctccct

SEQ ID NO: 504262 - DNA, 20 bp, Artificial
  CRISPR gRNA sequence
gagcagaatctttctccctg

SEQ ID NO: 504263 - DNA, 20 bp, Artificial
  CRISPR gRNA sequence
ccctgaggacactccccgca

SEQ ID NO: 504264 - DNA, 20 bp, Artificial
  CRISPR gRNA sequence
tgaggacactccccgcatgg

SEQ ID NO: 504265 - DNA, 20 bp, Artificial
  CRISPR gRNA sequence
cgcatggaagccgtcacttt

SEQ ID NO: 504266 - DNA, 20 bp, Artificial
  CRISPR gRNA sequence
gcatggaagccgtcactttg

SEQ ID NO: 504267 - DNA, 20 bp, Artificial
  CRISPR gRNA sequence
tggaagccgtcactttgagg

SEQ ID NO: 504268 - DNA, 20 bp, Artificial
  CRISPR gRNA sequence
gaagccgtcactttgaggaa

SEQ ID NO: 504269 - DNA, 20 bp, Artificial
  CRISPR gRNA sequence
ccgtcactttgaggaagagc

SEQ ID NO: 504270 - DNA, 20 bp, Artificial
  CRISPR gRNA sequence
ctttgaggaagagctagacg

SEQ ID NO: 504271 - DNA, 20 bp, Artificial
  CRISPR gRNA sequence
tttgaggaagagctagacgt

SEQ ID NO: 504272 - DNA, 20 bp, Artificial
  CRISPR gRNA sequence
ttgaggaagagctagacgtg

SEQ ID NO: 504273 - DNA, 20 bp, Artificial
  CRISPR gRNA sequence
aggaagagctagacgtgggg

SEQ ID NO: 504274 - DNA, 20 bp, Artificial
  CRISPR gRNA sequence
tagacgtggggcagcccccc

SEQ ID NO: 504275 - DNA, 20 bp, Artificial
  CRISPR gRNA sequence
agacgtggggcagccccccc

SEQ ID NO: 504276 - DNA, 20 bp, Artificial
  CRISPR gRNA sequence
gacgtggggcagccccccca

SEQ ID NO: 504277 - DNA, 20 bp, Artificial
  CRISPR gRNA sequence
gggcagcccccccagggtcc

SEQ ID NO: 504278 - DNA, 20 bp, Artificial
  CRISPR gRNA sequence
cccccccagggtcccagcac

SEQ ID NO: 504279 - DNA, 20 bp, Artificial
  CRISPR gRNA sequence
ccccagggtcccagcaccgg

SEQ ID NO: 504280 - DNA, 20 bp, Artificial
  CRISPR gRNA sequence
gggtcccagcaccggcagcc

SEQ ID NO: 504281 - DNA, 20 bp, Artificial
  CRISPR gRNA sequence
ccggcagccaagctcaccca

SEQ ID NO: 504282 - DNA, 20 bp, Artificial
  CRISPR gRNA sequence
gcagccaagctcacccacag

SEQ ID NO: 504283 - DNA, 20 bp, Artificial
  CRISPR gRNA sequence
gccaagctcacccacagcgg

SEQ ID NO: 504284 - DNA, 20 bp, Artificial
  CRISPR gRNA sequence
cacccacagcggcggacgcc

SEQ ID NO: 504285 - DNA, 20 bp, Artificial
  CRISPR gRNA sequence
cccacagcggcggacgccca

SEQ ID NO: 504286 - DNA, 20 bp, Artificial
  CRISPR gRNA sequence
ccacagcggcggacgcccag

SEQ ID NO: 504287 - DNA, 20 bp, Artificial
  CRISPR gRNA sequence
gcggcggacgcccagaggac

SEQ ID NO: 504288 - DNA, 20 bp, Artificial
  CRISPR gRNA sequence
cgcccagaggacaagctgcc

SEQ ID NO: 504289 - DNA, 20 bp, Artificial
  CRISPR gRNA sequence
gcccagaggacaagctgcct

SEQ ID NO: 504290 - DNA, 20 bp, Artificial
  CRISPR gRNA sequence
cccagaggacaagctgcctg

SEQ ID NO: 504291 - DNA, 20 bp, Artificial
  CRISPR gRNA sequence
cagaggacaagctgcctggg

SEQ ID NO: 504292 - DNA, 20 bp, Artificial
  CRISPR gRNA sequence
agaggacaagctgcctgggg

SEQ ID NO: 504293 - DNA, 20 bp, Artificial
  CRISPR gRNA sequence
gacaagctgcctggggaggc

SEQ ID NO: 504294 - DNA, 20 bp, Artificial
  CRISPR gRNA sequence
acaagctgcctggggaggcc

SEQ ID NO: 504295 - DNA, 20 bp, Artificial
  CRISPR gRNA sequence
caagctgcctggggaggccg

SEQ ID NO: 504296 - DNA, 20 bp, Artificial
  CRISPR gRNA sequence
tgcctggggaggccggggtg

SEQ ID NO: 504297 - DNA, 20 bp, Artificial
  CRISPR gRNA sequence
ggccggggtgcagccacaca

SEQ ID NO: 504298 - DNA, 20 bp, Artificial
  CRISPR gRNA sequence
gccggggtgcagccacacac

SEQ ID NO: 504299 - DNA, 20 bp, Artificial
  CRISPR gRNA sequence
cagccacacacgggtgtcca

SEQ ID NO: 504300 - DNA, 20 bp, Artificial
  CRISPR gRNA sequence
cgggtgtccacggcctcccg

SEQ ID NO: 504301 - DNA, 20 bp, Artificial
  CRISPR gRNA sequence
gtgtccacggcctcccgcag

SEQ ID NO: 504302 - DNA, 20 bp, Artificial
  CRISPR gRNA sequence
tgtccacggcctcccgcagc

SEQ ID NO: 504303 - DNA, 20 bp, Artificial
  CRISPR gRNA sequence
tccacggcctcccgcagcag

SEQ ID NO: 504304 - DNA, 20 bp, Artificial
  CRISPR gRNA sequence
ccacggcctcccgcagcagg

SEQ ID NO: 504305 - DNA, 20 bp, Artificial
  CRISPR gRNA sequence
tcccgcagcaggaggtcgca

SEQ ID NO: 504306 - DNA, 20 bp, Artificial
  CRISPR gRNA sequence
cagcaggaggtcgcatagtg

SEQ ID NO: 504307 - DNA, 20 bp, Artificial
  CRISPR gRNA sequence
agcaggaggtcgcatagtgt

SEQ ID NO: 504308 - DNA, 20 bp, Artificial
  CRISPR gRNA sequence
gacgcacgtgcccctctgcg

SEQ ID NO: 504309 - DNA, 20 bp, Artificial
  CRISPR gRNA sequence
acgcacgtgcccctctgcgt

SEQ ID NO: 504310 - DNA, 20 bp, Artificial
  CRISPR gRNA sequence
cccctctgcgtgggaccccc

SEQ ID NO: 504311 - DNA, 20 bp, Artificial
  CRISPR gRNA sequence
ccctctgcgtgggaccccca

SEQ ID NO: 504312 - DNA, 20 bp, Artificial
  CRISPR gRNA sequence
ctgcgtgggacccccaagga

SEQ ID NO: 504313 - DNA, 20 bp, Artificial
  CRISPR gRNA sequence
ggccacttacattgttccac

SEQ ID NO: 504314 - DNA, 20 bp, Artificial
  CRISPR gRNA sequence
gccacttacattgttccact

SEQ ID NO: 504315 - DNA, 20 bp, Artificial
  CRISPR gRNA sequence
acattgttccactgggactt

SEQ ID NO: 504316 - DNA, 20 bp, Artificial
  CRISPR gRNA sequence
acttgagcttctccttctca

SEQ ID NO: 504317 - DNA, 20 bp, Artificial
  CRISPR gRNA sequence
tctcaaagcgcctgtactcc

SEQ ID NO: 504318 - DNA, 20 bp, Artificial
  CRISPR gRNA sequence
tcaaagcgcctgtactcccg

SEQ ID NO: 504319 - DNA, 20 bp, Artificial
  CRISPR gRNA sequence
caaagcgcctgtactcccgg

SEQ ID NO: 504320 - DNA, 20 bp, Artificial
  CRISPR gRNA sequence
ctgtactcccggaggtcgct

SEQ ID NO: 504321 - DNA, 20 bp, Artificial
  CRISPR gRNA sequence
tgtactcccggaggtcgctc

SEQ ID NO: 504322 - DNA, 20 bp, Artificial
  CRISPR gRNA sequence
actcccggaggtcgctcagg

SEQ ID NO: 504323 - DNA, 20 bp, Artificial
  CRISPR gRNA sequence
cggaggtcgctcaggtggat

SEQ ID NO: 504324 - DNA, 20 bp, Artificial
  CRISPR gRNA sequence
gaggtcgctcaggtggatca

SEQ ID NO: 504325 - DNA, 20 bp, Artificial
  CRISPR gRNA sequence
tcaggtggatcagagccttc

SEQ ID NO: 504326 - DNA, 20 bp, Artificial
  CRISPR gRNA sequence
atcagagccttccagatgac

SEQ ID NO: 504327 - DNA, 20 bp, Artificial
  CRISPR gRNA sequence
agagccttccagatgaccag

SEQ ID NO: 504328 - DNA, 20 bp, Artificial
  CRISPR gRNA sequence
gagccttccagatgaccagc

SEQ ID NO: 504329 - DNA, 20 bp, Artificial
  CRISPR gRNA sequence
gccttccagatgaccagcag

SEQ ID NO: 504330 - DNA, 20 bp, Artificial
  CRISPR gRNA sequence
accagcaggagaatgccgat

SEQ ID NO: 504331 - DNA, 20 bp, Artificial
  CRISPR gRNA sequence
gatcagcacgatgcctgcca

SEQ ID NO: 504332 - DNA, 20 bp, Artificial
  CRISPR gRNA sequence
tgccacggtgcccccgacga

SEQ ID NO: 504333 - DNA, 20 bp, Artificial
  CRISPR gRNA sequence
cacggtgcccccgacgatgg

SEQ ID NO: 504334 - DNA, 20 bp, Artificial
  CRISPR gRNA sequence
cccgacgatggcggcgatgt

SEQ ID NO: 504335 - DNA, 20 bp, Artificial
  CRISPR gRNA sequence
ccgacgatggcggcgatgtt

SEQ ID NO: 504336 - DNA, 20 bp, Artificial
  CRISPR gRNA sequence
cgacgatggcggcgatgttg

SEQ ID NO: 504337 - DNA, 20 bp, Artificial
  CRISPR gRNA sequence
ttggggcctgccacacactc

SEQ ID NO: 504338 - DNA, 20 bp, Artificial
  CRISPR gRNA sequence
tggggcctgccacacactct

SEQ ID NO: 504339 - DNA, 20 bp, Artificial
  CRISPR gRNA sequence
ggggcctgccacacactcta

SEQ ID NO: 504340 - DNA, 20 bp, Artificial
  CRISPR gRNA sequence
gcctgccacacactctaggg

SEQ ID NO: 504341 - DNA, 20 bp, Artificial
  CRISPR gRNA sequence
tgccacacactctagggaag

SEQ ID NO: 504342 - DNA, 20 bp, Artificial
  CRISPR gRNA sequence
cacacactctagggaagaag

SEQ ID NO: 504343 - DNA, 20 bp, Artificial
  CRISPR gRNA sequence
agggaagaagcagcacacct

SEQ ID NO: 504344 - DNA, 20 bp, Artificial
  CRISPR gRNA sequence
gaagcagcacacctgagcgt

SEQ ID NO: 504345 - DNA, 20 bp, Artificial
  CRISPR gRNA sequence
agcacacctgagcgtcagtc

SEQ ID NO: 504346 - DNA, 20 bp, Artificial
  CRISPR gRNA sequence
cagtccagccccatctcact

SEQ ID NO: 504347 - DNA, 20 bp, Artificial
  CRISPR gRNA sequence
ctcactgagccgtgtgccca

SEQ ID NO: 504348 - DNA, 20 bp, Artificial
  CRISPR gRNA sequence
tcactgagccgtgtgcccac

SEQ ID NO: 504349 - DNA, 20 bp, Artificial
  CRISPR gRNA sequence
agccgtgtgcccacaggtcc

SEQ ID NO: 504350 - DNA, 20 bp, Artificial
  CRISPR gRNA sequence
gccgtgtgcccacaggtccg

SEQ ID NO: 504351 - DNA, 20 bp, Artificial
  CRISPR gRNA sequence
tccgaggtcaccccacaaca

SEQ ID NO: 504352 - DNA, 20 bp, Artificial
  CRISPR gRNA sequence
tcaccccacaacacagcact

SEQ ID NO: 504353 - DNA, 20 bp, Artificial
  CRISPR gRNA sequence
accccacaacacagcactta

SEQ ID NO: 504354 - DNA, 20 bp, Artificial
  CRISPR gRNA sequence
cccacaacacagcacttaga

SEQ ID NO: 504355 - DNA, 20 bp, Artificial
  CRISPR gRNA sequence
caacacagcacttagagaga

SEQ ID NO: 504356 - DNA, 20 bp, Artificial
  CRISPR gRNA sequence
acacagcacttagagagacg

SEQ ID NO: 504357 - DNA, 20 bp, Artificial
  CRISPR gRNA sequence
cacagcacttagagagacgg

SEQ ID NO: 504358 - DNA, 20 bp, Artificial
  CRISPR gRNA sequence
cttagagagacggaggttcc

SEQ ID NO: 504359 - DNA, 20 bp, Artificial
  CRISPR gRNA sequence
ttagagagacggaggttccc

SEQ ID NO: 504360 - DNA, 20 bp, Artificial
  CRISPR gRNA sequence
tagagagacggaggttccca

SEQ ID NO: 504361 - DNA, 20 bp, Artificial
  CRISPR gRNA sequence
gacggaggttcccagggccc

SEQ ID NO: 504362 - DNA, 20 bp, Artificial
  CRISPR gRNA sequence
cggctcaccatccatcacca

SEQ ID NO: 504363 - DNA, 20 bp, Artificial
  CRISPR gRNA sequence
tcaccatccatcaccatggc

SEQ ID NO: 504364 - DNA, 20 bp, Artificial
  CRISPR gRNA sequence
caccatccatcaccatggcc

SEQ ID NO: 504365 - DNA, 20 bp, Artificial
  CRISPR gRNA sequence
accatccatcaccatggcca

SEQ ID NO: 504366 - DNA, 20 bp, Artificial
  CRISPR gRNA sequence
ccatccatcaccatggccag

SEQ ID NO: 504367 - DNA, 20 bp, Artificial
  CRISPR gRNA sequence
ccatcaccatggccaggggt

SEQ ID NO: 504368 - DNA, 20 bp, Artificial
  CRISPR gRNA sequence
caccatggccaggggtcagt

SEQ ID NO: 504369 - DNA, 20 bp, Artificial
  CRISPR gRNA sequence
gccaggggtcagtgagaacc

SEQ ID NO: 504370 - DNA, 20 bp, Artificial
  CRISPR gRNA sequence
gggtcagtgagaacctggcc

SEQ ID NO: 504371 - DNA, 20 bp, Artificial
  CRISPR gRNA sequence
gaacctggcccagcccctgc

SEQ ID NO: 504372 - DNA, 20 bp, Artificial
  CRISPR gRNA sequence
gcccagcccctgctggattc

SEQ ID NO: 504373 - DNA, 20 bp, Artificial
  CRISPR gRNA sequence
cccagcccctgctggattcc

SEQ ID NO: 504374 - DNA, 20 bp, Artificial
  CRISPR gRNA sequence
gcccctgctggattccaggc

SEQ ID NO: 504375 - DNA, 20 bp, Artificial
  CRISPR gRNA sequence
cccctgctggattccaggcc

SEQ ID NO: 504376 - DNA, 20 bp, Artificial
  CRISPR gRNA sequence
ggattccaggccaggccctg

SEQ ID NO: 504377 - DNA, 20 bp, Artificial
  CRISPR gRNA sequence
tgtggttccaaatgaaacct

SEQ ID NO: 504378 - DNA, 20 bp, Artificial
  CRISPR gRNA sequence
gtggttccaaatgaaaccta

SEQ ID NO: 504379 - DNA, 20 bp, Artificial
  CRISPR gRNA sequence
tggttccaaatgaaacctaa

SEQ ID NO: 504380 - DNA, 20 bp, Artificial
  CRISPR gRNA sequence
attgccaccacccctgctga

SEQ ID NO: 504381 - DNA, 20 bp, Artificial
  CRISPR gRNA sequence
tgccaccacccctgctgaca

SEQ ID NO: 504382 - DNA, 20 bp, Artificial
  CRISPR gRNA sequence
caccacccctgctgacagag

SEQ ID NO: 504383 - DNA, 20 bp, Artificial
  CRISPR gRNA sequence
cacccctgctgacagagaag

SEQ ID NO: 504384 - DNA, 20 bp, Artificial
  CRISPR gRNA sequence
acccctgctgacagagaaga

SEQ ID NO: 504385 - DNA, 20 bp, Artificial
  CRISPR gRNA sequence
cctgctgacagagaagaagg

SEQ ID NO: 504386 - DNA, 20 bp, Artificial
  CRISPR gRNA sequence
ctgctgacagagaagaaggc

SEQ ID NO: 504387 - DNA, 20 bp, Artificial
  CRISPR gRNA sequence
tgctgacagagaagaaggca

SEQ ID NO: 504388 - DNA, 20 bp, Artificial
  CRISPR gRNA sequence
gacagagaagaaggcagggc

SEQ ID NO: 504389 - DNA, 20 bp, Artificial
  CRISPR gRNA sequence
acagagaagaaggcagggcc

SEQ ID NO: 504390 - DNA, 20 bp, Artificial
  CRISPR gRNA sequence
cagagaagaaggcagggcca

SEQ ID NO: 504391 - DNA, 20 bp, Artificial
  CRISPR gRNA sequence
agaaggcagggccagggtac

SEQ ID NO: 504392 - DNA, 20 bp, Artificial
  CRISPR gRNA sequence
gaaggcagggccagggtacc

SEQ ID NO: 504393 - DNA, 20 bp, Artificial
  CRISPR gRNA sequence
ggcagggccagggtaccggg

SEQ ID NO: 504394 - DNA, 20 bp, Artificial
  CRISPR gRNA sequence
gggccagggtaccgggcagc

SEQ ID NO: 504395 - DNA, 20 bp, Artificial
  CRISPR gRNA sequence
ggccagggtaccgggcagcc

SEQ ID NO: 504396 - DNA, 20 bp, Artificial
  CRISPR gRNA sequence
agggtaccgggcagccagga

SEQ ID NO: 504397 - DNA, 20 bp, Artificial
  CRISPR gRNA sequence
ggtaccgggcagccaggaca

SEQ ID NO: 504398 - DNA, 20 bp, Artificial
  CRISPR gRNA sequence
ccaggacagagtgctaatac

SEQ ID NO: 504399 - DNA, 20 bp, Artificial
  CRISPR gRNA sequence
caggacagagtgctaatact

SEQ ID NO: 504400 - DNA, 20 bp, Artificial
  CRISPR gRNA sequence
aggacagagtgctaatactg

SEQ ID NO: 504401 - DNA, 20 bp, Artificial
  CRISPR gRNA sequence
ggacagagtgctaatactgg

SEQ ID NO: 504402 - DNA, 20 bp, Artificial
  CRISPR gRNA sequence
gacagagtgctaatactggg

SEQ ID NO: 504403 - DNA, 20 bp, Artificial
  CRISPR gRNA sequence
agagtgctaatactgggggg

SEQ ID NO: 504404 - DNA, 20 bp, Artificial
  CRISPR gRNA sequence
gagtgctaatactggggggt

SEQ ID NO: 504405 - DNA, 20 bp, Artificial
  CRISPR gRNA sequence
taatactggggggtaggaca

SEQ ID NO: 504406 - DNA, 20 bp, Artificial
  CRISPR gRNA sequence
tggggggtaggacacagtgc

SEQ ID NO: 504407 - DNA, 20 bp, Artificial
  CRISPR gRNA sequence
ggggggtaggacacagtgcg

SEQ ID NO: 504408 - DNA, 20 bp, Artificial
  CRISPR gRNA sequence
gggggtaggacacagtgcga

SEQ ID NO: 504409 - DNA, 20 bp, Artificial
  CRISPR gRNA sequence
cgagggaccccgctctccta

SEQ ID NO: 504410 - DNA, 20 bp, Artificial
  CRISPR gRNA sequence
gggaccccgctctcctacag

SEQ ID NO: 504411 - DNA, 20 bp, Artificial
  CRISPR gRNA sequence
gaccccgctctcctacagca

SEQ ID NO: 504412 - DNA, 20 bp, Artificial
  CRISPR gRNA sequence
cgctctcctacagcagagtt

SEQ ID NO: 504413 - DNA, 20 bp, Artificial
  CRISPR gRNA sequence
cctacagcagagttcagaac

SEQ ID NO: 504414 - DNA, 20 bp, Artificial
  CRISPR gRNA sequence
ctacagcagagttcagaacc

SEQ ID NO: 504415 - DNA, 20 bp, Artificial
  CRISPR gRNA sequence
gcagagttcagaaccaggct

SEQ ID NO: 504416 - DNA, 20 bp, Artificial
  CRISPR gRNA sequence
cagagttcagaaccaggctc

SEQ ID NO: 504417 - DNA, 20 bp, Artificial
  CRISPR gRNA sequence
agagttcagaaccaggctca

SEQ ID NO: 504418 - DNA, 20 bp, Artificial
  CRISPR gRNA sequence
accaggctcagggtccctgc

SEQ ID NO: 504419 - DNA, 20 bp, Artificial
  CRISPR gRNA sequence
caggctcagggtccctgctg

SEQ ID NO: 504420 - DNA, 20 bp, Artificial
  CRISPR gRNA sequence
gttcactccccatactgtga

SEQ ID NO: 504421 - DNA, 20 bp, Artificial
  CRISPR gRNA sequence
catactgtgaaagtgatttg

SEQ ID NO: 504422 - DNA, 20 bp, Artificial
  CRISPR gRNA sequence
gaaagtgatttgtggtcgtc

SEQ ID NO: 504423 - DNA, 20 bp, Artificial
  CRISPR gRNA sequence
aaagtgatttgtggtcgtca

SEQ ID NO: 504424 - DNA, 20 bp, Artificial
  CRISPR gRNA sequence
gatttgtggtcgtcaaggac

SEQ ID NO: 504425 - DNA, 20 bp, Artificial
  CRISPR gRNA sequence
gtggtcgtcaaggacaagac

SEQ ID NO: 504426 - DNA, 20 bp, Artificial
  CRISPR gRNA sequence
ggtcgtcaaggacaagacca

SEQ ID NO: 504427 - DNA, 20 bp, Artificial
  CRISPR gRNA sequence
tcaaggacaagaccagagac

SEQ ID NO: 504428 - DNA, 20 bp, Artificial
  CRISPR gRNA sequence
aaggacaagaccagagacca

SEQ ID NO: 504429 - DNA, 20 bp, Artificial
  CRISPR gRNA sequence
caagaccagagaccagagct

SEQ ID NO: 504430 - DNA, 20 bp, Artificial
  CRISPR gRNA sequence
gaccagagaccagagctcag

SEQ ID NO: 504431 - DNA, 20 bp, Artificial
  CRISPR gRNA sequence
accagagaccagagctcagc

SEQ ID NO: 504432 - DNA, 20 bp, Artificial
  CRISPR gRNA sequence
gagaccagagctcagcaggt

SEQ ID NO: 504433 - DNA, 20 bp, Artificial
  CRISPR gRNA sequence
agaccagagctcagcaggtg

SEQ ID NO: 504434 - DNA, 20 bp, Artificial
  CRISPR gRNA sequence
cagagctcagcaggtgaggc

SEQ ID NO: 504435 - DNA, 20 bp, Artificial
  CRISPR gRNA sequence
tcagcaggtgaggccggtgc

SEQ ID NO: 504436 - DNA, 20 bp, Artificial
  CRISPR gRNA sequence
cagcaggtgaggccggtgcc

SEQ ID NO: 504437 - DNA, 20 bp, Artificial
  CRISPR gRNA sequence
ggtgaggccggtgccaggat

SEQ ID NO: 504438 - DNA, 20 bp, Artificial
  CRISPR gRNA sequence
ggtgccaggatgagcaacgc

SEQ ID NO: 504439 - DNA, 20 bp, Artificial
  CRISPR gRNA sequence
gtgccaggatgagcaacgca

SEQ ID NO: 504440 - DNA, 20 bp, Artificial
  CRISPR gRNA sequence
ggatgagcaacgcaaggtcc

SEQ ID NO: 504441 - DNA, 20 bp, Artificial
  CRISPR gRNA sequence
acgcaaggtcctggttccca

SEQ ID NO: 504442 - DNA, 20 bp, Artificial
  CRISPR gRNA sequence
caaggtcctggttcccacgg

SEQ ID NO: 504443 - DNA, 20 bp, Artificial
  CRISPR gRNA sequence
ggcagctgtgcccacctcct

SEQ ID NO: 504444 - DNA, 20 bp, Artificial
  CRISPR gRNA sequence
ctgtgcccacctcctgagca

SEQ ID NO: 504445 - DNA, 20 bp, Artificial
  CRISPR gRNA sequence
tgtgcccacctcctgagcat

SEQ ID NO: 504446 - DNA, 20 bp, Artificial
  CRISPR gRNA sequence
gtgcccacctcctgagcatg

SEQ ID NO: 504447 - DNA, 20 bp, Artificial
  CRISPR gRNA sequence
cctcctgagcatggggactg

SEQ ID NO: 504448 - DNA, 20 bp, Artificial
  CRISPR gRNA sequence
ctcctgagcatggggactgt

SEQ ID NO: 504449 - DNA, 20 bp, Artificial
  CRISPR gRNA sequence
agcatggggactgtgggcca

SEQ ID NO: 504450 - DNA, 20 bp, Artificial
  CRISPR gRNA sequence
atggggactgtgggccatag

SEQ ID NO: 504451 - DNA, 20 bp, Artificial
  CRISPR gRNA sequence
tggggactgtgggccatagt

SEQ ID NO: 504452 - DNA, 20 bp, Artificial
  CRISPR gRNA sequence
gactgtgggccatagtgggc

SEQ ID NO: 504453 - DNA, 20 bp, Artificial
  CRISPR gRNA sequence
actgtgggccatagtgggcc

SEQ ID NO: 504454 - DNA, 20 bp, Artificial
  CRISPR gRNA sequence
gccatagtgggccaggccca

SEQ ID NO: 504455 - DNA, 20 bp, Artificial
  CRISPR gRNA sequence
aggcccacagctgctgaccc

SEQ ID NO: 504456 - DNA, 20 bp, Artificial
  CRISPR gRNA sequence
ggcccacagctgctgaccct

SEQ ID NO: 504457 - DNA, 20 bp, Artificial
  CRISPR gRNA sequence
cacagctgctgaccctggga

SEQ ID NO: 504458 - DNA, 20 bp, Artificial
  CRISPR gRNA sequence
gctgaccctgggacagacac

SEQ ID NO: 504459 - DNA, 20 bp, Artificial
  CRISPR gRNA sequence
ctgggacagacactagcgtt

SEQ ID NO: 504460 - DNA, 20 bp, Artificial
  CRISPR gRNA sequence
acagacactagcgttcagtg

SEQ ID NO: 504461 - DNA, 20 bp, Artificial
  CRISPR gRNA sequence
ctagcgttcagtgcagtccc

SEQ ID NO: 504462 - DNA, 20 bp, Artificial
  CRISPR gRNA sequence
gttcagtgcagtccctggcc

SEQ ID NO: 504463 - DNA, 20 bp, Artificial
  CRISPR gRNA sequence
gtgcagtccctggcctggtc

SEQ ID NO: 504464 - DNA, 20 bp, Artificial
  CRISPR gRNA sequence
acctgcaccctcactccctg

SEQ ID NO: 504465 - DNA, 20 bp, Artificial
  CRISPR gRNA sequence
tcctgccatcctgcctttcc

SEQ ID NO: 504466 - DNA, 20 bp, Artificial
  CRISPR gRNA sequence
cctgccatcctgcctttcct

SEQ ID NO: 504467 - DNA, 20 bp, Artificial
  CRISPR gRNA sequence
ctgccatcctgcctttcctg

SEQ ID NO: 504468 - DNA, 20 bp, Artificial
  CRISPR gRNA sequence
tgccatcctgcctttcctgg

SEQ ID NO: 504469 - DNA, 20 bp, Artificial
  CRISPR gRNA sequence
ccttccttcacctgtcctca

SEQ ID NO: 504470 - DNA, 20 bp, Artificial
  CRISPR gRNA sequence
cttccttcacctgtcctcaa

SEQ ID NO: 504471 - DNA, 20 bp, Artificial
  CRISPR gRNA sequence
ttcacctgtcctcaaaggtg

SEQ ID NO: 504472 - DNA, 20 bp, Artificial
  CRISPR gRNA sequence
tcctcaaaggtgaagtgact

SEQ ID NO: 504473 - DNA, 20 bp, Artificial
  CRISPR gRNA sequence
caaaggtgaagtgacttggc

SEQ ID NO: 504474 - DNA, 20 bp, Artificial
  CRISPR gRNA sequence
aaaggtgaagtgacttggcc

SEQ ID NO: 504475 - DNA, 20 bp, Artificial
  CRISPR gRNA sequence
ttggccaggattgcacaaac

SEQ ID NO: 504476 - DNA, 20 bp, Artificial
  CRISPR gRNA sequence
gcacaaaccagacgtgaccc

SEQ ID NO: 504477 - DNA, 20 bp, Artificial
  CRISPR gRNA sequence
tgacccaagtctgtccctca

SEQ ID NO: 504478 - DNA, 20 bp, Artificial
  CRISPR gRNA sequence
cccaagtctgtccctcaaag

SEQ ID NO: 504479 - DNA, 20 bp, Artificial
  CRISPR gRNA sequence
ctgtccctcaaagtggcccg

SEQ ID NO: 504480 - DNA, 20 bp, Artificial
  CRISPR gRNA sequence
tgtccctcaaagtggcccgc

SEQ ID NO: 504481 - DNA, 20 bp, Artificial
  CRISPR gRNA sequence
gtccctcaaagtggcccgca

SEQ ID NO: 504482 - DNA, 20 bp, Artificial
  CRISPR gRNA sequence
tccctcaaagtggcccgcag

SEQ ID NO: 504483 - DNA, 20 bp, Artificial
  CRISPR gRNA sequence
gcccgcaggggttcctgccc

SEQ ID NO: 504484 - DNA, 20 bp, Artificial
  CRISPR gRNA sequence
cgcaggggttcctgccctgg

SEQ ID NO: 504485 - DNA, 20 bp, Artificial
  CRISPR gRNA sequence
gcaggggttcctgccctggc

SEQ ID NO: 504486 - DNA, 20 bp, Artificial
  CRISPR gRNA sequence
ggggttcctgccctggcagg

SEQ ID NO: 504487 - DNA, 20 bp, Artificial
  CRISPR gRNA sequence
gggttcctgccctggcaggt

SEQ ID NO: 504488 - DNA, 20 bp, Artificial
  CRISPR gRNA sequence
ggttcctgccctggcaggtg

SEQ ID NO: 504489 - DNA, 20 bp, Artificial
  CRISPR gRNA sequence
gttcctgccctggcaggtgg

SEQ ID NO: 504490 - DNA, 20 bp, Artificial
  CRISPR gRNA sequence
ccctggcaggtgggggtctg

SEQ ID NO: 504491 - DNA, 20 bp, Artificial
  CRISPR gRNA sequence
caggtgggggtctgcagccc

SEQ ID NO: 504492 - DNA, 20 bp, Artificial
  CRISPR gRNA sequence
aggtgggggtctgcagcccc

SEQ ID NO: 504493 - DNA, 20 bp, Artificial
  CRISPR gRNA sequence
tgcagccccaggcccacatg

SEQ ID NO: 504494 - DNA, 20 bp, Artificial
  CRISPR gRNA sequence
gcagccccaggcccacatgt

SEQ ID NO: 504495 - DNA, 20 bp, Artificial
  CRISPR gRNA sequence
caggcccacatgtgggttgt

SEQ ID NO: 504496 - DNA, 20 bp, Artificial
  CRISPR gRNA sequence
cacatgtgggttgtgagctc

SEQ ID NO: 504497 - DNA, 20 bp, Artificial
  CRISPR gRNA sequence
acatgtgggttgtgagctcc

SEQ ID NO: 504498 - DNA, 20 bp, Artificial
  CRISPR gRNA sequence
agctccaggcatgtcaccta

SEQ ID NO: 504499 - DNA, 20 bp, Artificial
  CRISPR gRNA sequence
gctccaggcatgtcacctac

SEQ ID NO: 504500 - DNA, 20 bp, Artificial
  CRISPR gRNA sequence
aggcatgtcacctacaggct

SEQ ID NO: 504501 - DNA, 20 bp, Artificial
  CRISPR gRNA sequence
gcatgtcacctacaggctca

SEQ ID NO: 504502 - DNA, 20 bp, Artificial
  CRISPR gRNA sequence
gagacccccgccgcctgcct

SEQ ID NO: 504503 - DNA, 20 bp, Artificial
  CRISPR gRNA sequence
agacccccgccgcctgcctc

SEQ ID NO: 504504 - DNA, 20 bp, Artificial
  CRISPR gRNA sequence
gcctgcctcgggtcccttcc

SEQ ID NO: 504505 - DNA, 20 bp, Artificial
  CRISPR gRNA sequence
gcctcgggtcccttcctggt

SEQ ID NO: 504506 - DNA, 20 bp, Artificial
  CRISPR gRNA sequence
cctcgggtcccttcctggtg

SEQ ID NO: 504507 - DNA, 20 bp, Artificial
  CRISPR gRNA sequence
ctcgggtcccttcctggtga

SEQ ID NO: 504508 - DNA, 20 bp, Artificial
  CRISPR gRNA sequence
cgggtcccttcctggtgagg

SEQ ID NO: 504509 - DNA, 20 bp, Artificial
  CRISPR gRNA sequence
gggtcccttcctggtgaggg

SEQ ID NO: 504510 - DNA, 20 bp, Artificial
  CRISPR gRNA sequence
gtcccttcctggtgagggag

SEQ ID NO: 504511 - DNA, 20 bp, Artificial
  CRISPR gRNA sequence
cctggtgagggaggagctcc

SEQ ID NO: 504512 - DNA, 20 bp, Artificial
  CRISPR gRNA sequence
ctggtgagggaggagctccc

SEQ ID NO: 504513 - DNA, 20 bp, Artificial
  CRISPR gRNA sequence
agggaggagctcccaggtct

SEQ ID NO: 504514 - DNA, 20 bp, Artificial
  CRISPR gRNA sequence
ctcccaggtctcagttctgc

SEQ ID NO: 504515 - DNA, 20 bp, Artificial
  CRISPR gRNA sequence
cccaggtctcagttctgcaa

SEQ ID NO: 504516 - DNA, 20 bp, Artificial
  CRISPR gRNA sequence
tctcagttctgcaagagtcc

SEQ ID NO: 504517 - DNA, 20 bp, Artificial
  CRISPR gRNA sequence
agttctgcaagagtcctggc

SEQ ID NO: 504518 - DNA, 20 bp, Artificial
  CRISPR gRNA sequence
caagagtcctggccggctgc

SEQ ID NO: 504519 - DNA, 20 bp, Artificial
  CRISPR gRNA sequence
cggctgctggccatgcctga

SEQ ID NO: 504520 - DNA, 20 bp, Artificial
  CRISPR gRNA sequence
gctgctggccatgcctgatg

SEQ ID NO: 504521 - DNA, 20 bp, Artificial
  CRISPR gRNA sequence
ccatgcctgatggagtccgc

SEQ ID NO: 504522 - DNA, 20 bp, Artificial
  CRISPR gRNA sequence
tgcctgatggagtccgccag

SEQ ID NO: 504523 - DNA, 20 bp, Artificial
  CRISPR gRNA sequence
ggagtccgccagcggccccc

SEQ ID NO: 504524 - DNA, 20 bp, Artificial
  CRISPR gRNA sequence
cgccagcggccccccagccc

SEQ ID NO: 504525 - DNA, 20 bp, Artificial
  CRISPR gRNA sequence
gccccagcccctctgcctct

SEQ ID NO: 504526 - DNA, 20 bp, Artificial
  CRISPR gRNA sequence
ccccagcccctctgcctctc

SEQ ID NO: 504527 - DNA, 20 bp, Artificial
  CRISPR gRNA sequence
ccagcccctctgcctctcag

SEQ ID NO: 504528 - DNA, 20 bp, Artificial
  CRISPR gRNA sequence
ctctgcctctcaggagcctg

SEQ ID NO: 504529 - DNA, 20 bp, Artificial
  CRISPR gRNA sequence
ctcaggagcctgtggaacat

SEQ ID NO: 504530 - DNA, 20 bp, Artificial
  CRISPR gRNA sequence
cctgtggaacatgagacctg

SEQ ID NO: 504531 - DNA, 20 bp, Artificial
  CRISPR gRNA sequence
gtggaacatgagacctgaag

SEQ ID NO: 504532 - DNA, 20 bp, Artificial
  CRISPR gRNA sequence
gaacatgagacctgaagaag

SEQ ID NO: 504533 - DNA, 20 bp, Artificial
  CRISPR gRNA sequence
aacatgagacctgaagaagc

SEQ ID NO: 504534 - DNA, 20 bp, Artificial
  CRISPR gRNA sequence
acatgagacctgaagaagca

SEQ ID NO: 504535 - DNA, 20 bp, Artificial
  CRISPR gRNA sequence
gagacctgaagaagcagggc

SEQ ID NO: 504536 - DNA, 20 bp, Artificial
  CRISPR gRNA sequence
gaagcagggccagtgtcacc

SEQ ID NO: 504537 - DNA, 20 bp, Artificial
  CRISPR gRNA sequence
aagcagggccagtgtcacca

SEQ ID NO: 504538 - DNA, 20 bp, Artificial
  CRISPR gRNA sequence
cagtgtcaccaaggtcaccg

SEQ ID NO: 504539 - DNA, 20 bp, Artificial
  CRISPR gRNA sequence
agtgtcaccaaggtcaccgt

SEQ ID NO: 504540 - DNA, 20 bp, Artificial
  CRISPR gRNA sequence
gtgtcaccaaggtcaccgtg

SEQ ID NO: 504541 - DNA, 20 bp, Artificial
  CRISPR gRNA sequence
caccaaggtcaccgtggggc

SEQ ID NO: 504542 - DNA, 20 bp, Artificial
  CRISPR gRNA sequence
accaaggtcaccgtggggct

SEQ ID NO: 504543 - DNA, 20 bp, Artificial
  CRISPR gRNA sequence
ggtcaccgtggggctgggcc

SEQ ID NO: 504544 - DNA, 20 bp, Artificial
  CRISPR gRNA sequence
gggctgggcctggttccaac

SEQ ID NO: 504545 - DNA, 20 bp, Artificial
  CRISPR gRNA sequence
gctgggcctggttccaactg

SEQ ID NO: 504546 - DNA, 20 bp, Artificial
  CRISPR gRNA sequence
ggttccaactggagctgaat

SEQ ID NO: 504547 - DNA, 20 bp, Artificial
  CRISPR gRNA sequence
ccaactggagctgaatgaga

SEQ ID NO: 504548 - DNA, 20 bp, Artificial
  CRISPR gRNA sequence
caactggagctgaatgagac

SEQ ID NO: 504549 - DNA, 20 bp, Artificial
  CRISPR gRNA sequence
aactggagctgaatgagaca

SEQ ID NO: 504550 - DNA, 20 bp, Artificial
  CRISPR gRNA sequence
ggagctgaatgagacagggt

SEQ ID NO: 504551 - DNA, 20 bp, Artificial
  CRISPR gRNA sequence
gagacagggtcagtgccacc

SEQ ID NO: 504552 - DNA, 20 bp, Artificial
  CRISPR gRNA sequence
agacagggtcagtgccacca

SEQ ID NO: 504553 - DNA, 20 bp, Artificial
  CRISPR gRNA sequence
cagtgccaccaaggtcactg

SEQ ID NO: 504554 - DNA, 20 bp, Artificial
  CRISPR gRNA sequence
agtgccaccaaggtcactgt

SEQ ID NO: 504555 - DNA, 20 bp, Artificial
  CRISPR gRNA sequence
gtgccaccaaggtcactgtg

SEQ ID NO: 504556 - DNA, 20 bp, Artificial
  CRISPR gRNA sequence
caccaaggtcactgtggggc

SEQ ID NO: 504557 - DNA, 20 bp, Artificial
  CRISPR gRNA sequence
accaaggtcactgtggggct

SEQ ID NO: 504558 - DNA, 20 bp, Artificial
  CRISPR gRNA sequence
ggtcactgtggggctgggac

SEQ ID NO: 504559 - DNA, 20 bp, Artificial
  CRISPR gRNA sequence
gggctgggactggttccgac

SEQ ID NO: 504560 - DNA, 20 bp, Artificial
  CRISPR gRNA sequence
gctgggactggttccgactg

SEQ ID NO: 504561 - DNA, 20 bp, Artificial
  CRISPR gRNA sequence
ggttccgactggagccgaat

SEQ ID NO: 504562 - DNA, 20 bp, Artificial
  CRISPR gRNA sequence
ccgactggagccgaatgaga

SEQ ID NO: 504563 - DNA, 20 bp, Artificial
  CRISPR gRNA sequence
cgactggagccgaatgagac

SEQ ID NO: 504564 - DNA, 20 bp, Artificial
  CRISPR gRNA sequence
gactggagccgaatgagaca

SEQ ID NO: 504565 - DNA, 20 bp, Artificial
  CRISPR gRNA sequence
ggagccgaatgagacagggt

SEQ ID NO: 504566 - DNA, 20 bp, Artificial
  CRISPR gRNA sequence
gagacagggtcagtgccacc

SEQ ID NO: 504567 - DNA, 20 bp, Artificial
  CRISPR gRNA sequence
agacagggtcagtgccacca

SEQ ID NO: 504568 - DNA, 20 bp, Artificial
  CRISPR gRNA sequence
cagtgccaccaaggtcactg

SEQ ID NO: 504569 - DNA, 20 bp, Artificial
  CRISPR gRNA sequence
agtgccaccaaggtcactgt

SEQ ID NO: 504570 - DNA, 20 bp, Artificial
  CRISPR gRNA sequence
gtgccaccaaggtcactgtg

SEQ ID NO: 504571 - DNA, 20 bp, Artificial
  CRISPR gRNA sequence
caccaaggtcactgtggggc

SEQ ID NO: 504572 - DNA, 20 bp, Artificial
  CRISPR gRNA sequence
accaaggtcactgtggggct

SEQ ID NO: 504573 - DNA, 20 bp, Artificial
  CRISPR gRNA sequence
ggtcactgtggggctgggac

SEQ ID NO: 504574 - DNA, 20 bp, Artificial
  CRISPR gRNA sequence
gggctgggactggttccgac

SEQ ID NO: 504575 - DNA, 20 bp, Artificial
  CRISPR gRNA sequence
gggactggttccgactggac

SEQ ID NO: 504576 - DNA, 20 bp, Artificial
  CRISPR gRNA sequence
gactggttccgactggactg

SEQ ID NO: 504577 - DNA, 20 bp, Artificial
  CRISPR gRNA sequence
cgactggactggagccgaac

SEQ ID NO: 504578 - DNA, 20 bp, Artificial
  CRISPR gRNA sequence
gactggagccgaacgagtga

SEQ ID NO: 504579 - DNA, 20 bp, Artificial
  CRISPR gRNA sequence
actggagccgaacgagtgat

SEQ ID NO: 504580 - DNA, 20 bp, Artificial
  CRISPR gRNA sequence
ctggagccgaacgagtgatg

SEQ ID NO: 504581 - DNA, 20 bp, Artificial
  CRISPR gRNA sequence
agccgaacgagtgatgggga

SEQ ID NO: 504582 - DNA, 20 bp, Artificial
  CRISPR gRNA sequence
cgaacgagtgatggggacgg

SEQ ID NO: 504583 - DNA, 20 bp, Artificial
  CRISPR gRNA sequence
gtgatggggacggtggtgcc

SEQ ID NO: 504584 - DNA, 20 bp, Artificial
  CRISPR gRNA sequence
atggggacggtggtgcctgg

SEQ ID NO: 504585 - DNA, 20 bp, Artificial
  CRISPR gRNA sequence
acggtggtgcctggtggccc

SEQ ID NO: 504586 - DNA, 20 bp, Artificial
  CRISPR gRNA sequence
cggtggtgcctggtggccct

SEQ ID NO: 504587 - DNA, 20 bp, Artificial
  CRISPR gRNA sequence
ctggtggccctgggcccctc

SEQ ID NO: 504588 - DNA, 20 bp, Artificial
  CRISPR gRNA sequence
tggtggccctgggcccctcc

SEQ ID NO: 504589 - DNA, 20 bp, Artificial
  CRISPR gRNA sequence
ggtggccctgggcccctcca

SEQ ID NO: 504590 - DNA, 20 bp, Artificial
  CRISPR gRNA sequence
ccctgggcccctccagggct

SEQ ID NO: 504591 - DNA, 20 bp, Artificial
  CRISPR gRNA sequence
ctgggcccctccagggctga

SEQ ID NO: 504592 - DNA, 20 bp, Artificial
  CRISPR gRNA sequence
cccctccagggctgagagcc

SEQ ID NO: 504593 - DNA, 20 bp, Artificial
  CRISPR gRNA sequence
cagggctgagagccgagcac

SEQ ID NO: 504594 - DNA, 20 bp, Artificial
  CRISPR gRNA sequence
agggctgagagccgagcacc

SEQ ID NO: 504595 - DNA, 20 bp, Artificial
  CRISPR gRNA sequence
aggatctcccaatcccctca

SEQ ID NO: 504596 - DNA, 20 bp, Artificial
  CRISPR gRNA sequence
ggatctcccaatcccctcaa

SEQ ID NO: 504597 - DNA, 20 bp, Artificial
  CRISPR gRNA sequence
atctcccaatcccctcaaag

SEQ ID NO: 504598 - DNA, 20 bp, Artificial
  CRISPR gRNA sequence
cccctcaaaggagcctcacg

SEQ ID NO: 504599 - DNA, 20 bp, Artificial
  CRISPR gRNA sequence
ctcacgcagcaacctgaccg

SEQ ID NO: 504600 - DNA, 20 bp, Artificial
  CRISPR gRNA sequence
tcacgcagcaacctgaccgc

SEQ ID NO: 504601 - DNA, 20 bp, Artificial
  CRISPR gRNA sequence
acctgaccgcgggccacccc

SEQ ID NO: 504602 - DNA, 20 bp, Artificial
  CRISPR gRNA sequence
cctgaccgcgggccacccct

SEQ ID NO: 504603 - DNA, 20 bp, Artificial
  CRISPR gRNA sequence
ctgaccgcgggccacccctg

SEQ ID NO: 504604 - DNA, 20 bp, Artificial
  CRISPR gRNA sequence
ccctggggacctgcaactgc

SEQ ID NO: 504605 - DNA, 20 bp, Artificial
  CRISPR gRNA sequence
aactgcaagccttgccccat

SEQ ID NO: 504606 - DNA, 20 bp, Artificial
  CRISPR gRNA sequence
actgcaagccttgccccatg

SEQ ID NO: 504607 - DNA, 20 bp, Artificial
  CRISPR gRNA sequence
gccttgccccatgaggcatc

SEQ ID NO: 504608 - DNA, 20 bp, Artificial
  CRISPR gRNA sequence
ttgccccatgaggcatccag

SEQ ID NO: 504609 - DNA, 20 bp, Artificial
  CRISPR gRNA sequence
tgccccatgaggcatccagc

SEQ ID NO: 504610 - DNA, 20 bp, Artificial
  CRISPR gRNA sequence
ccccatgaggcatccagcgg

SEQ ID NO: 504611 - DNA, 20 bp, Artificial
  CRISPR gRNA sequence
atgaggcatccagcgggaga

SEQ ID NO: 504612 - DNA, 20 bp, Artificial
  CRISPR gRNA sequence
gcatccagcgggagatggcc

SEQ ID NO: 504613 - DNA, 20 bp, Artificial
  CRISPR gRNA sequence
catccagcgggagatggccc

SEQ ID NO: 504614 - DNA, 20 bp, Artificial
  CRISPR gRNA sequence
gggagatggcccgggccgtg

SEQ ID NO: 504615 - DNA, 20 bp, Artificial
  CRISPR gRNA sequence
gcccgggccgtgtggcatgc

SEQ ID NO: 504616 - DNA, 20 bp, Artificial
  CRISPR gRNA sequence
cgggccgtgtggcatgctgg

SEQ ID NO: 504617 - DNA, 20 bp, Artificial
  CRISPR gRNA sequence
gggccgtgtggcatgctggt

SEQ ID NO: 504618 - DNA, 20 bp, Artificial
  CRISPR gRNA sequence
ggcatgctggtgggcctgcc

SEQ ID NO: 504619 - DNA, 20 bp, Artificial
  CRISPR gRNA sequence
gctggtgggcctgcccggtg

SEQ ID NO: 504620 - DNA, 20 bp, Artificial
  CRISPR gRNA sequence
tggtgggcctgcccggtgtg

SEQ ID NO: 504621 - DNA, 20 bp, Artificial
  CRISPR gRNA sequence
tgggcctgcccggtgtggag

SEQ ID NO: 504622 - DNA, 20 bp, Artificial
  CRISPR gRNA sequence
gcctgcccggtgtggagcag

SEQ ID NO: 504623 - DNA, 20 bp, Artificial
  CRISPR gRNA sequence
gtgtggagcagtggtgcccc

SEQ ID NO: 504624 - DNA, 20 bp, Artificial
  CRISPR gRNA sequence
tgtggagcagtggtgccccc

SEQ ID NO: 504625 - DNA, 20 bp, Artificial
  CRISPR gRNA sequence
gtggagcagtggtgccccca

SEQ ID NO: 504626 - DNA, 20 bp, Artificial
  CRISPR gRNA sequence
ggagcagtggtgcccccagg

SEQ ID NO: 504627 - DNA, 20 bp, Artificial
  CRISPR gRNA sequence
gcagtggtgcccccagggag

SEQ ID NO: 504628 - DNA, 20 bp, Artificial
  CRISPR gRNA sequence
cagtggtgcccccagggagc

SEQ ID NO: 504629 - DNA, 20 bp, Artificial
  CRISPR gRNA sequence
ggagcaggccgtctgctgcc

SEQ ID NO: 504630 - DNA, 20 bp, Artificial
  CRISPR gRNA sequence
gtctgctgcccagcttgatg

SEQ ID NO: 504631 - DNA, 20 bp, Artificial
  CRISPR gRNA sequence
tctgctgcccagcttgatgt

SEQ ID NO: 504632 - DNA, 20 bp, Artificial
  CRISPR gRNA sequence
ctgctgcccagcttgatgtg

SEQ ID NO: 504633 - DNA, 20 bp, Artificial
  CRISPR gRNA sequence
tgcccagcttgatgtggggt

SEQ ID NO: 504634 - DNA, 20 bp, Artificial
  CRISPR gRNA sequence
gcccagcttgatgtggggtc

SEQ ID NO: 504635 - DNA, 20 bp, Artificial
  CRISPR gRNA sequence
agcttgatgtggggtcaggt

SEQ ID NO: 504636 - DNA, 20 bp, Artificial
  CRISPR gRNA sequence
gcttgatgtggggtcaggtg

SEQ ID NO: 504637 - DNA, 20 bp, Artificial
  CRISPR gRNA sequence
ttgatgtggggtcaggtgag

SEQ ID NO: 504638 - DNA, 20 bp, Artificial
  CRISPR gRNA sequence
tgatgtggggtcaggtgagg

SEQ ID NO: 504639 - DNA, 20 bp, Artificial
  CRISPR gRNA sequence
gatgtggggtcaggtgagga

SEQ ID NO: 504640 - DNA, 20 bp, Artificial
  CRISPR gRNA sequence
atgtggggtcaggtgaggag

SEQ ID NO: 504641 - DNA, 20 bp, Artificial
  CRISPR gRNA sequence
gtggggtcaggtgaggaggg

SEQ ID NO: 504642 - DNA, 20 bp, Artificial
  CRISPR gRNA sequence
tggggtcaggtgaggagggg

SEQ ID NO: 504643 - DNA, 20 bp, Artificial
  CRISPR gRNA sequence
ggggtcaggtgaggagggga

SEQ ID NO: 504644 - DNA, 20 bp, Artificial
  CRISPR gRNA sequence
tcaggtgaggaggggaggga

SEQ ID NO: 504645 - DNA, 20 bp, Artificial
  CRISPR gRNA sequence
caggtgaggaggggagggaa

SEQ ID NO: 504646 - DNA, 20 bp, Artificial
  CRISPR gRNA sequence
aggtgaggaggggagggaaa

SEQ ID NO: 504647 - DNA, 20 bp, Artificial
  CRISPR gRNA sequence
ggtgaggaggggagggaaag

SEQ ID NO: 504648 - DNA, 20 bp, Artificial
  CRISPR gRNA sequence
tgaggaggggagggaaaggg

SEQ ID NO: 504649 - DNA, 20 bp, Artificial
  CRISPR gRNA sequence
gaggaggggagggaaagggg

SEQ ID NO: 504650 - DNA, 20 bp, Artificial
  CRISPR gRNA sequence
ggagggaaaggggaggctgc

SEQ ID NO: 504651 - DNA, 20 bp, Artificial
  CRISPR gRNA sequence
gagggaaaggggaggctgct

SEQ ID NO: 504652 - DNA, 20 bp, Artificial
  CRISPR gRNA sequence
agggaaaggggaggctgctg

SEQ ID NO: 504653 - DNA, 20 bp, Artificial
  CRISPR gRNA sequence
gggaaaggggaggctgctgg

SEQ ID NO: 504654 - DNA, 20 bp, Artificial
  CRISPR gRNA sequence
aaggggaggctgctgggggt

SEQ ID NO: 504655 - DNA, 20 bp, Artificial
  CRISPR gRNA sequence
aggggaggctgctgggggtg

SEQ ID NO: 504656 - DNA, 20 bp, Artificial
  CRISPR gRNA sequence
ggggaggctgctgggggtga

SEQ ID NO: 504657 - DNA, 20 bp, Artificial
  CRISPR gRNA sequence
gggaggctgctgggggtgag

SEQ ID NO: 504658 - DNA, 20 bp, Artificial
  CRISPR gRNA sequence
gctgctgggggtgaggggac

SEQ ID NO: 504659 - DNA, 20 bp, Artificial
  CRISPR gRNA sequence
ggggtgaggggaccggcctc

SEQ ID NO: 504660 - DNA, 20 bp, Artificial
  CRISPR gRNA sequence
tctggcctccttgcaatgcc

SEQ ID NO: 504661 - DNA, 20 bp, Artificial
  CRISPR gRNA sequence
ctggcctccttgcaatgcca

SEQ ID NO: 504662 - DNA, 20 bp, Artificial
  CRISPR gRNA sequence
tggcctccttgcaatgccaa

SEQ ID NO: 504663 - DNA, 20 bp, Artificial
  CRISPR gRNA sequence
aatgccaagggcatcccgca

SEQ ID NO: 504664 - DNA, 20 bp, Artificial
  CRISPR gRNA sequence
gcatggctcatccaccctgc

SEQ ID NO: 504665 - DNA, 20 bp, Artificial
  CRISPR gRNA sequence
catggctcatccaccctgct

SEQ ID NO: 504666 - DNA, 20 bp, Artificial
  CRISPR gRNA sequence
ccctgctgggcccacaacac

SEQ ID NO: 504667 - DNA, 20 bp, Artificial
  CRISPR gRNA sequence
ctgctgggcccacaacactg

SEQ ID NO: 504668 - DNA, 20 bp, Artificial
  CRISPR gRNA sequence
tgctgggcccacaacactgg

SEQ ID NO: 504669 - DNA, 20 bp, Artificial
  CRISPR gRNA sequence
gggcccacaacactggaggt

SEQ ID NO: 504670 - DNA, 20 bp, Artificial
  CRISPR gRNA sequence
ccgcaccaccctcgcctctg

SEQ ID NO: 504671 - DNA, 20 bp, Artificial
  CRISPR gRNA sequence
gcaccaccctcgcctctgcg

SEQ ID NO: 504672 - DNA, 20 bp, Artificial
  CRISPR gRNA sequence
tcgcctctgcggagaccccg

SEQ ID NO: 504673 - DNA, 20 bp, Artificial
  CRISPR gRNA sequence
ctctgcggagaccccgcagc

SEQ ID NO: 504674 - DNA, 20 bp, Artificial
  CRISPR gRNA sequence
ctgcggagaccccgcagccg

SEQ ID NO: 504675 - DNA, 20 bp, Artificial
  CRISPR gRNA sequence
agaccccgcagccggagctc

SEQ ID NO: 504676 - DNA, 20 bp, Artificial
  CRISPR gRNA sequence
accccgcagccggagctctg

SEQ ID NO: 504677 - DNA, 20 bp, Artificial
  CRISPR gRNA sequence
cgcagccggagctctggagc

SEQ ID NO: 504678 - DNA, 20 bp, Artificial
  CRISPR gRNA sequence
agccggtccccgctgcaccc

SEQ ID NO: 504679 - DNA, 20 bp, Artificial
  CRISPR gRNA sequence
cggtccccgctgcaccccag

SEQ ID NO: 504680 - DNA, 20 bp, Artificial
  CRISPR gRNA sequence
gcaccccagcggcctcacct

SEQ ID NO: 504681 - DNA, 20 bp, Artificial
  CRISPR gRNA sequence
cacctcggctctcatccaca

SEQ ID NO: 504682 - DNA, 20 bp, Artificial
  CRISPR gRNA sequence
cggctctcatccacatagat

SEQ ID NO: 504683 - DNA, 20 bp, Artificial
  CRISPR gRNA sequence
ggctctcatccacatagatg

SEQ ID NO: 504684 - DNA, 20 bp, Artificial
  CRISPR gRNA sequence
tctcatccacatagatgagg

SEQ ID NO: 504685 - DNA, 20 bp, Artificial
  CRISPR gRNA sequence
catccacatagatgaggtag

SEQ ID NO: 504686 - DNA, 20 bp, Artificial
  CRISPR gRNA sequence
tccatcccgtcctgctgctc

SEQ ID NO: 504687 - DNA, 20 bp, Artificial
  CRISPR gRNA sequence
cgtcctgctgctccagcgtg

SEQ ID NO: 504688 - DNA, 20 bp, Artificial
  CRISPR gRNA sequence
gtcctgctgctccagcgtgt

SEQ ID NO: 504689 - DNA, 20 bp, Artificial
  CRISPR gRNA sequence
gctccagcgtgtaggccacc

SEQ ID NO: 504690 - DNA, 20 bp, Artificial
  CRISPR gRNA sequence
ccagcgtgtaggccacccag

SEQ ID NO: 504691 - DNA, 20 bp, Artificial
  CRISPR gRNA sequence
aggccacccagcagccctct

SEQ ID NO: 504692 - DNA, 20 bp, Artificial
  CRISPR gRNA sequence
cctctgagtccctctccttg

SEQ ID NO: 504693 - DNA, 20 bp, Artificial
  CRISPR gRNA sequence
ctctgagtccctctccttgc

SEQ ID NO: 504694 - DNA, 20 bp, Artificial
  CRISPR gRNA sequence
cttgcaggtcctgcccttca

SEQ ID NO: 504695 - DNA, 20 bp, Artificial
  CRISPR gRNA sequence
ttgcaggtcctgcccttcac

SEQ ID NO: 504696 - DNA, 20 bp, Artificial
  CRISPR gRNA sequence
tgcaggtcctgcccttcacg

SEQ ID NO: 504697 - DNA, 20 bp, Artificial
  CRISPR gRNA sequence
cccttcacggggttgttcga

SEQ ID NO: 504698 - DNA, 20 bp, Artificial
  CRISPR gRNA sequence
acggggttgttcgacagctg

SEQ ID NO: 504699 - DNA, 20 bp, Artificial
  CRISPR gRNA sequence
cggggttgttcgacagctgc

SEQ ID NO: 504700 - DNA, 20 bp, Artificial
  CRISPR gRNA sequence
ttgttcgacagctgcaggcc

SEQ ID NO: 504701 - DNA, 20 bp, Artificial
  CRISPR gRNA sequence
ggcccggacacgccgcgctg

SEQ ID NO: 504702 - DNA, 20 bp, Artificial
  CRISPR gRNA sequence
ccgcgctgcagttcttccca

SEQ ID NO: 504703 - DNA, 20 bp, Artificial
  CRISPR gRNA sequence
cgcgctgcagttcttcccaa

SEQ ID NO: 504704 - DNA, 20 bp, Artificial
  CRISPR gRNA sequence
gcgctgcagttcttcccaaa

SEQ ID NO: 504705 - DNA, 20 bp, Artificial
  CRISPR gRNA sequence
cgctgcagttcttcccaaag

SEQ ID NO: 504706 - DNA, 20 bp, Artificial
  CRISPR gRNA sequence
aaggggcccttttcgaactt

SEQ ID NO: 504707 - DNA, 20 bp, Artificial
  CRISPR gRNA sequence
aggggcccttttcgaacttc

SEQ ID NO: 504708 - DNA, 20 bp, Artificial
  CRISPR gRNA sequence
cttttcgaacttcaggcact

SEQ ID NO: 504709 - DNA, 20 bp, Artificial
  CRISPR gRNA sequence
cgaacttcaggcactcggcg

SEQ ID NO: 504710 - DNA, 20 bp, Artificial
  CRISPR gRNA sequence
gaacttcaggcactcggcgc

SEQ ID NO: 504711 - DNA, 20 bp, Artificial
  CRISPR gRNA sequence
acttcaggcactcggcgcag

SEQ ID NO: 504712 - DNA, 20 bp, Artificial
  CRISPR gRNA sequence
ggcactcggcgcaggagctg

SEQ ID NO: 504713 - DNA, 20 bp, Artificial
  CRISPR gRNA sequence
gcactcggcgcaggagctgc

SEQ ID NO: 504714 - DNA, 20 bp, Artificial
  CRISPR gRNA sequence
cactcggcgcaggagctgcg

SEQ ID NO: 504715 - DNA, 20 bp, Artificial
  CRISPR gRNA sequence
ctcggcgcaggagctgcggg

SEQ ID NO: 504716 - DNA, 20 bp, Artificial
  CRISPR gRNA sequence
gcgcaggagctgcggggagc

SEQ ID NO: 504717 - DNA, 20 bp, Artificial
  CRISPR gRNA sequence
cgcaggagctgcggggagcc

SEQ ID NO: 504718 - DNA, 20 bp, Artificial
  CRISPR gRNA sequence
agctgcggggagccaggtgt

SEQ ID NO: 504719 - DNA, 20 bp, Artificial
  CRISPR gRNA sequence
ggggagccaggtgtgagcat

SEQ ID NO: 504720 - DNA, 20 bp, Artificial
  CRISPR gRNA sequence
ccaggtgtgagcatcggtgc

SEQ ID NO: 504721 - DNA, 20 bp, Artificial
  CRISPR gRNA sequence
caggtgtgagcatcggtgcc

SEQ ID NO: 504722 - DNA, 20 bp, Artificial
  CRISPR gRNA sequence
aggtgtgagcatcggtgcca

SEQ ID NO: 504723 - DNA, 20 bp, Artificial
  CRISPR gRNA sequence
agcatcggtgccagggtgtg

SEQ ID NO: 504724 - DNA, 20 bp, Artificial
  CRISPR gRNA sequence
gcatcggtgccagggtgtgc

SEQ ID NO: 504725 - DNA, 20 bp, Artificial
  CRISPR gRNA sequence
catcggtgccagggtgtgcg

SEQ ID NO: 504726 - DNA, 20 bp, Artificial
  CRISPR gRNA sequence
atcggtgccagggtgtgcgg

SEQ ID NO: 504727 - DNA, 20 bp, Artificial
  CRISPR gRNA sequence
gccagggtgtgcgggggctc

SEQ ID NO: 504728 - DNA, 20 bp, Artificial
  CRISPR gRNA sequence
gtgtgcgggggctccggcaa

SEQ ID NO: 504729 - DNA, 20 bp, Artificial
  CRISPR gRNA sequence
tgtgcgggggctccggcaac

SEQ ID NO: 504730 - DNA, 20 bp, Artificial
  CRISPR gRNA sequence
gtgcgggggctccggcaacg

SEQ ID NO: 504731 - DNA, 20 bp, Artificial
  CRISPR gRNA sequence
tgcgggggctccggcaacgg

SEQ ID NO: 504732 - DNA, 20 bp, Artificial
  CRISPR gRNA sequence
gggctccggcaacgggggct

SEQ ID NO: 504733 - DNA, 20 bp, Artificial
  CRISPR gRNA sequence
ggctccggcaacgggggctc

SEQ ID NO: 504734 - DNA, 20 bp, Artificial
  CRISPR gRNA sequence
cggcaacgggggctcgggct

SEQ ID NO: 504735 - DNA, 20 bp, Artificial
  CRISPR gRNA sequence
ggcaacgggggctcgggctt

SEQ ID NO: 504736 - DNA, 20 bp, Artificial
  CRISPR gRNA sequence
gggcttgggtgtgtgtccac

SEQ ID NO: 504737 - DNA, 20 bp, Artificial
  CRISPR gRNA sequence
ggcttgggtgtgtgtccacc

SEQ ID NO: 504738 - DNA, 20 bp, Artificial
  CRISPR gRNA sequence
gcttgggtgtgtgtccacca

SEQ ID NO: 504739 - DNA, 20 bp, Artificial
  CRISPR gRNA sequence
cttgggtgtgtgtccaccag

SEQ ID NO: 504740 - DNA, 20 bp, Artificial
  CRISPR gRNA sequence
ttgggtgtgtgtccaccagg

SEQ ID NO: 504741 - DNA, 20 bp, Artificial
  CRISPR gRNA sequence
tgggtgtgtgtccaccaggg

SEQ ID NO: 504742 - DNA, 20 bp, Artificial
  CRISPR gRNA sequence
gggtgtgtgtccaccagggg

SEQ ID NO: 504743 - DNA, 20 bp, Artificial
  CRISPR gRNA sequence
tgtgtgtccaccaggggggg

SEQ ID NO: 504744 - DNA, 20 bp, Artificial
  CRISPR gRNA sequence
gtgtgtccaccagggggggc

SEQ ID NO: 504745 - DNA, 20 bp, Artificial
  CRISPR gRNA sequence
tgtccaccagggggggcagg

SEQ ID NO: 504746 - DNA, 20 bp, Artificial
  CRISPR gRNA sequence
gtccaccagggggggcaggt

SEQ ID NO: 504747 - DNA, 20 bp, Artificial
  CRISPR gRNA sequence
tccaccagggggggcaggtg

SEQ ID NO: 504748 - DNA, 20 bp, Artificial
  CRISPR gRNA sequence
ccagggggggcaggtggggt

SEQ ID NO: 504749 - DNA, 20 bp, Artificial
  CRISPR gRNA sequence
cagggggggcaggtggggtt

SEQ ID NO: 504750 - DNA, 20 bp, Artificial
  CRISPR gRNA sequence
agggggggcaggtggggttg

SEQ ID NO: 504751 - DNA, 20 bp, Artificial
  CRISPR gRNA sequence
aggtggggttggggcgccct

SEQ ID NO: 504752 - DNA, 20 bp, Artificial
  CRISPR gRNA sequence
ggtggggttggggcgccctc

SEQ ID NO: 504753 - DNA, 20 bp, Artificial
  CRISPR gRNA sequence
ggttggggcgccctcaggcc

SEQ ID NO: 504754 - DNA, 20 bp, Artificial
  CRISPR gRNA sequence
gttggggcgccctcaggcca

SEQ ID NO: 504755 - DNA, 20 bp, Artificial
  CRISPR gRNA sequence
tggggcgccctcaggccaag

SEQ ID NO: 504756 - DNA, 20 bp, Artificial
  CRISPR gRNA sequence
ggggcgccctcaggccaagg

SEQ ID NO: 504757 - DNA, 20 bp, Artificial
  CRISPR gRNA sequence
gggcgccctcaggccaagga

SEQ ID NO: 504758 - DNA, 20 bp, Artificial
  CRISPR gRNA sequence
ggcgccctcaggccaaggag

SEQ ID NO: 504759 - DNA, 20 bp, Artificial
  CRISPR gRNA sequence
gcgccctcaggccaaggagg

SEQ ID NO: 504760 - DNA, 20 bp, Artificial
  CRISPR gRNA sequence
tcaggccaaggagggggccc

SEQ ID NO: 504761 - DNA, 20 bp, Artificial
  CRISPR gRNA sequence
ggccaaggagggggcccaag

SEQ ID NO: 504762 - DNA, 20 bp, Artificial
  CRISPR gRNA sequence
gccaaggagggggcccaagt

SEQ ID NO: 504763 - DNA, 20 bp, Artificial
  CRISPR gRNA sequence
ccaaggagggggcccaagtg

SEQ ID NO: 504764 - DNA, 20 bp, Artificial
  CRISPR gRNA sequence
aggagggggcccaagtgggg

SEQ ID NO: 504765 - DNA, 20 bp, Artificial
  CRISPR gRNA sequence
gggcccaagtggggcagatg

SEQ ID NO: 504766 - DNA, 20 bp, Artificial
  CRISPR gRNA sequence
ggcccaagtggggcagatgc

SEQ ID NO: 504767 - DNA, 20 bp, Artificial
  CRISPR gRNA sequence
aagtggggcagatgcgggtg

SEQ ID NO: 504768 - DNA, 20 bp, Artificial
  CRISPR gRNA sequence
tggggcagatgcgggtgcag

SEQ ID NO: 504769 - DNA, 20 bp, Artificial
  CRISPR gRNA sequence
ggggcagatgcgggtgcagc

SEQ ID NO: 504770 - DNA, 20 bp, Artificial
  CRISPR gRNA sequence
tgcgggtgcagcgggtgaac

SEQ ID NO: 504771 - DNA, 20 bp, Artificial
  CRISPR gRNA sequence
gggtgcagcgggtgaactgg

SEQ ID NO: 504772 - DNA, 20 bp, Artificial
  CRISPR gRNA sequence
gtgaactggaagcctgatcc

SEQ ID NO: 504773 - DNA, 20 bp, Artificial
  CRISPR gRNA sequence
tgaactggaagcctgatccc

SEQ ID NO: 504774 - DNA, 20 bp, Artificial
  CRISPR gRNA sequence
gaactggaagcctgatccca

SEQ ID NO: 504775 - DNA, 20 bp, Artificial
  CRISPR gRNA sequence
aagcctgatcccagggcccg

SEQ ID NO: 504776 - DNA, 20 bp, Artificial
  CRISPR gRNA sequence
cctgatcccagggcccgcgg

SEQ ID NO: 504777 - DNA, 20 bp, Artificial
  CRISPR gRNA sequence
ctgatcccagggcccgcggc

SEQ ID NO: 504778 - DNA, 20 bp, Artificial
  CRISPR gRNA sequence
gggcccgcggcaggtgcgca

SEQ ID NO: 504779 - DNA, 20 bp, Artificial
  CRISPR gRNA sequence
ggcccgcggcaggtgcgcac

SEQ ID NO: 504780 - DNA, 20 bp, Artificial
  CRISPR gRNA sequence
cccgcggcaggtgcgcacag

SEQ ID NO: 504781 - DNA, 20 bp, Artificial
  CRISPR gRNA sequence
ccgcggcaggtgcgcacagg

SEQ ID NO: 504782 - DNA, 20 bp, Artificial
  CRISPR gRNA sequence
cgcggcaggtgcgcacagga

SEQ ID NO: 504783 - DNA, 20 bp, Artificial
  CRISPR gRNA sequence
cggcaggtgcgcacaggagg

SEQ ID NO: 504784 - DNA, 20 bp, Artificial
  CRISPR gRNA sequence
ggcaggtgcgcacaggaggg

SEQ ID NO: 504785 - DNA, 20 bp, Artificial
  CRISPR gRNA sequence
caggtgcgcacaggagggag

SEQ ID NO: 504786 - DNA, 20 bp, Artificial
  CRISPR gRNA sequence
aggtgcgcacaggagggagg

SEQ ID NO: 504787 - DNA, 20 bp, Artificial
  CRISPR gRNA sequence
ggtgcgcacaggagggagga

SEQ ID NO: 504788 - DNA, 20 bp, Artificial
  CRISPR gRNA sequence
cacaggagggaggagggaca

SEQ ID NO: 504789 - DNA, 20 bp, Artificial
  CRISPR gRNA sequence
acaggagggaggagggacac

SEQ ID NO: 504790 - DNA, 20 bp, Artificial
  CRISPR gRNA sequence
caggagggaggagggacaca

SEQ ID NO: 504791 - DNA, 20 bp, Artificial
  CRISPR gRNA sequence
aggagggaggagggacacag

SEQ ID NO: 504792 - DNA, 20 bp, Artificial
  CRISPR gRNA sequence
ggaggagggacacaggggca

SEQ ID NO: 504793 - DNA, 20 bp, Artificial
  CRISPR gRNA sequence
ggagggacacaggggcacgg

SEQ ID NO: 504794 - DNA, 20 bp, Artificial
  CRISPR gRNA sequence
acacaggggcacggcggccg

SEQ ID NO: 504795 - DNA, 20 bp, Artificial
  CRISPR gRNA sequence
acaggggcacggcggccgcg

SEQ ID NO: 504796 - DNA, 20 bp, Artificial
  CRISPR gRNA sequence
caggggcacggcggccgcgg

SEQ ID NO: 504797 - DNA, 20 bp, Artificial
  CRISPR gRNA sequence
aggggcacggcggccgcgga

SEQ ID NO: 504798 - DNA, 20 bp, Artificial
  CRISPR gRNA sequence
ggcggccgcggagggcccct

SEQ ID NO: 504799 - DNA, 20 bp, Artificial
  CRISPR gRNA sequence
ccgcggagggcccctcagtc

SEQ ID NO: 504800 - DNA, 20 bp, Artificial
  CRISPR gRNA sequence
cctcagtccagacgcacccg

SEQ ID NO: 504801 - DNA, 20 bp, Artificial
  CRISPR gRNA sequence
tcagtccagacgcacccgca

SEQ ID NO: 504802 - DNA, 20 bp, Artificial
  CRISPR gRNA sequence
cgcacccgcagagaaccccg

SEQ ID NO: 504803 - DNA, 20 bp, Artificial
  CRISPR gRNA sequence
ccgcagagaaccccgcggtg

SEQ ID NO: 504804 - DNA, 20 bp, Artificial
  CRISPR gRNA sequence
gcagagaaccccgcggtgca

SEQ ID NO: 504805 - DNA, 20 bp, Artificial
  CRISPR gRNA sequence
cagagaaccccgcggtgcag

SEQ ID NO: 504806 - DNA, 20 bp, Artificial
  CRISPR gRNA sequence
cgcggtgcagaggtgctcac

SEQ ID NO: 504807 - DNA, 20 bp, Artificial
  CRISPR gRNA sequence
gcggtgcagaggtgctcact

SEQ ID NO: 504808 - DNA, 20 bp, Artificial
  CRISPR gRNA sequence
cggtgcagaggtgctcactg

SEQ ID NO: 504809 - DNA, 20 bp, Artificial
  CRISPR gRNA sequence
aggtgctcactggggtcccc

SEQ ID NO: 504810 - DNA, 20 bp, Artificial
  CRISPR gRNA sequence
gctcactggggtccccgagt

SEQ ID NO: 504811 - DNA, 20 bp, Artificial
  CRISPR gRNA sequence
ctggggtccccgagtgagcc

SEQ ID NO: 504812 - DNA, 20 bp, Artificial
  CRISPR gRNA sequence
ccccgagtgagcccggctgc

SEQ ID NO: 504813 - DNA, 20 bp, Artificial
  CRISPR gRNA sequence
cccgagtgagcccggctgct

SEQ ID NO: 504814 - DNA, 20 bp, Artificial
  CRISPR gRNA sequence
gagtgagcccggctgctggg

SEQ ID NO: 504815 - DNA, 20 bp, Artificial
  CRISPR gRNA sequence
agtgagcccggctgctgggt

SEQ ID NO: 504816 - DNA, 20 bp, Artificial
  CRISPR gRNA sequence
gagcccggctgctgggtagg

SEQ ID NO: 504817 - DNA, 20 bp, Artificial
  CRISPR gRNA sequence
ccggctgctgggtaggtggc

SEQ ID NO: 504818 - DNA, 20 bp, Artificial
  CRISPR gRNA sequence
cggctgctgggtaggtggcc

SEQ ID NO: 504819 - DNA, 20 bp, Artificial
  CRISPR gRNA sequence
ggctgctgggtaggtggccg

SEQ ID NO: 504820 - DNA, 20 bp, Artificial
  CRISPR gRNA sequence
ctgctgggtaggtggccggg

SEQ ID NO: 504821 - DNA, 20 bp, Artificial
  CRISPR gRNA sequence
ctgggtaggtggccggggag

SEQ ID NO: 504822 - DNA, 20 bp, Artificial
  CRISPR gRNA sequence
tgggtaggtggccggggagt

SEQ ID NO: 504823 - DNA, 20 bp, Artificial
  CRISPR gRNA sequence
gggtaggtggccggggagtg

SEQ ID NO: 504824 - DNA, 20 bp, Artificial
  CRISPR gRNA sequence
gcactcacatgtacttgcca

SEQ ID NO: 504825 - DNA, 20 bp, Artificial
  CRISPR gRNA sequence
cactcacatgtacttgccac

SEQ ID NO: 504826 - DNA, 20 bp, Artificial
  CRISPR gRNA sequence
actcacatgtacttgccaca

SEQ ID NO: 504827 - DNA, 20 bp, Artificial
  CRISPR gRNA sequence
acatgtacttgccacagggt

SEQ ID NO: 504828 - DNA, 20 bp, Artificial
  CRISPR gRNA sequence
catgtacttgccacagggtg

SEQ ID NO: 504829 - DNA, 20 bp, Artificial
  CRISPR gRNA sequence
atgtacttgccacagggtga

SEQ ID NO: 504830 - DNA, 20 bp, Artificial
  CRISPR gRNA sequence
tgtacttgccacagggtgag

SEQ ID NO: 504831 - DNA, 20 bp, Artificial
  CRISPR gRNA sequence
acttgccacagggtgagggg

SEQ ID NO: 504832 - DNA, 20 bp, Artificial
  CRISPR gRNA sequence
gccacagggtgaggggcagc

SEQ ID NO: 504833 - DNA, 20 bp, Artificial
  CRISPR gRNA sequence
ccacagggtgaggggcagcc

SEQ ID NO: 504834 - DNA, 20 bp, Artificial
  CRISPR gRNA sequence
cacagggtgaggggcagccg

SEQ ID NO: 504835 - DNA, 20 bp, Artificial
  CRISPR gRNA sequence
aggggcagccggggcactcc

SEQ ID NO: 504836 - DNA, 20 bp, Artificial
  CRISPR gRNA sequence
cagccggggcactcctggca

SEQ ID NO: 504837 - DNA, 20 bp, Artificial
  CRISPR gRNA sequence
gccggggcactcctggcaca

SEQ ID NO: 504838 - DNA, 20 bp, Artificial
  CRISPR gRNA sequence
ccggggcactcctggcacag

SEQ ID NO: 504839 - DNA, 20 bp, Artificial
  CRISPR gRNA sequence
gggcactcctggcacagagg

SEQ ID NO: 504840 - DNA, 20 bp, Artificial
  CRISPR gRNA sequence
actcctggcacagaggcagc

SEQ ID NO: 504841 - DNA, 20 bp, Artificial
  CRISPR gRNA sequence
cctggcacagaggcagctgg

SEQ ID NO: 504842 - DNA, 20 bp, Artificial
  CRISPR gRNA sequence
gaggcagctggtagcctgaa

SEQ ID NO: 504843 - DNA, 20 bp, Artificial
  CRISPR gRNA sequence
aatggcactcgcatacgttg

SEQ ID NO: 504844 - DNA, 20 bp, Artificial
  CRISPR gRNA sequence
ggcactcgcatacgttgcag

SEQ ID NO: 504845 - DNA, 20 bp, Artificial
  CRISPR gRNA sequence
cgcatacgttgcagcggcac

SEQ ID NO: 504846 - DNA, 20 bp, Artificial
  CRISPR gRNA sequence
ccactacactcaacacgccg

SEQ ID NO: 504847 - DNA, 20 bp, Artificial
  CRISPR gRNA sequence
cactacactcaacacgccgc

SEQ ID NO: 504848 - DNA, 20 bp, Artificial
  CRISPR gRNA sequence
cactcaacacgccgcgggtt

SEQ ID NO: 504849 - DNA, 20 bp, Artificial
  CRISPR gRNA sequence
actcaacacgccgcgggttc

SEQ ID NO: 504850 - DNA, 20 bp, Artificial
  CRISPR gRNA sequence
caacacgccgcgggttcagg

SEQ ID NO: 504851 - DNA, 20 bp, Artificial
  CRISPR gRNA sequence
ccgcgggttcaggcagccct

SEQ ID NO: 504852 - DNA, 20 bp, Artificial
  CRISPR gRNA sequence
cgggttcaggcagccctcag

SEQ ID NO: 504853 - DNA, 20 bp, Artificial
  CRISPR gRNA sequence
cctcagtggtcctctcgcac

SEQ ID NO: 504854 - DNA, 20 bp, Artificial
  CRISPR gRNA sequence
tcctctcgcactggcacgct

SEQ ID NO: 504855 - DNA, 20 bp, Artificial
  CRISPR gRNA sequence
actggcacgctgagccctca

SEQ ID NO: 504856 - DNA, 20 bp, Artificial
  CRISPR gRNA sequence
cacgctgagccctcaaagcc

SEQ ID NO: 504857 - DNA, 20 bp, Artificial
  CRISPR gRNA sequence
acgctgagccctcaaagccc

SEQ ID NO: 504858 - DNA, 20 bp, Artificial
  CRISPR gRNA sequence
ctgagccctcaaagcccggg

SEQ ID NO: 504859 - DNA, 20 bp, Artificial
  CRISPR gRNA sequence
agccctcaaagcccgggtgg

SEQ ID NO: 504860 - DNA, 20 bp, Artificial
  CRISPR gRNA sequence
cctcaaagcccgggtggcag

SEQ ID NO: 504861 - DNA, 20 bp, Artificial
  CRISPR gRNA sequence
ggtggcagcggcacttcccg

SEQ ID NO: 504862 - DNA, 20 bp, Artificial
  CRISPR gRNA sequence
ggcagcggcacttcccgcag

SEQ ID NO: 504863 - DNA, 20 bp, Artificial
  CRISPR gRNA sequence
agcggcacttcccgcagaag

SEQ ID NO: 504864 - DNA, 20 bp, Artificial
  CRISPR gRNA sequence
cggcacttcccgcagaagca

SEQ ID NO: 504865 - DNA, 20 bp, Artificial
  CRISPR gRNA sequence
cagaagcagagccccctccc

SEQ ID NO: 504866 - DNA, 20 bp, Artificial
  CRISPR gRNA sequence
aagcagagccccctccctgg

SEQ ID NO: 504867 - DNA, 20 bp, Artificial
  CRISPR gRNA sequence
agagccccctccctggaaga

SEQ ID NO: 504868 - DNA, 20 bp, Artificial
  CRISPR gRNA sequence
gagccccctccctggaagac

SEQ ID NO: 504869 - DNA, 20 bp, Artificial
  CRISPR gRNA sequence
agccccctccctggaagacg

SEQ ID NO: 504870 - DNA, 20 bp, Artificial
  CRISPR gRNA sequence
cccctccctggaagacgggg

SEQ ID NO: 504871 - DNA, 20 bp, Artificial
  CRISPR gRNA sequence
ccctggaagacggggcagca

SEQ ID NO: 504872 - DNA, 20 bp, Artificial
  CRISPR gRNA sequence
gaagacggggcagcacggct

SEQ ID NO: 504873 - DNA, 20 bp, Artificial
  CRISPR gRNA sequence
agcacggctaagctcctgct

SEQ ID NO: 504874 - DNA, 20 bp, Artificial
  CRISPR gRNA sequence
ggctaagctcctgcttggcc

SEQ ID NO: 504875 - DNA, 20 bp, Artificial
  CRISPR gRNA sequence
gctaagctcctgcttggcct

SEQ ID NO: 504876 - DNA, 20 bp, Artificial
  CRISPR gRNA sequence
tcctgcttggcctgggaacc

SEQ ID NO: 504877 - DNA, 20 bp, Artificial
  CRISPR gRNA sequence
acccgcccgaaaccccactg

SEQ ID NO: 504878 - DNA, 20 bp, Artificial
  CRISPR gRNA sequence
cccactgcggttgctccctc

SEQ ID NO: 504879 - DNA, 20 bp, Artificial
  CRISPR gRNA sequence
tccggcccgcctgcctcctc

SEQ ID NO: 504880 - DNA, 20 bp, Artificial
  CRISPR gRNA sequence
cccgcctgcctcctccagcc

SEQ ID NO: 504881 - DNA, 20 bp, Artificial
  CRISPR gRNA sequence
ccgcctgcctcctccagcct

SEQ ID NO: 504882 - DNA, 20 bp, Artificial
  CRISPR gRNA sequence
cgcctgcctcctccagcctg

SEQ ID NO: 504883 - DNA, 20 bp, Artificial
  CRISPR gRNA sequence
gcctgcctcctccagcctgg

SEQ ID NO: 504884 - DNA, 20 bp, Artificial
  CRISPR gRNA sequence
ccagcctgggggatgttcct

SEQ ID NO: 504885 - DNA, 20 bp, Artificial
  CRISPR gRNA sequence
tgggggatgttcctgagcaa

SEQ ID NO: 504886 - DNA, 20 bp, Artificial
  CRISPR gRNA sequence
gggggatgttcctgagcaaa

SEQ ID NO: 504887 - DNA, 20 bp, Artificial
  CRISPR gRNA sequence
atgttcctgagcaaaaggca

SEQ ID NO: 504888 - DNA, 20 bp, Artificial
  CRISPR gRNA sequence
tgttcctgagcaaaaggcat

SEQ ID NO: 504889 - DNA, 20 bp, Artificial
  CRISPR gRNA sequence
gttcctgagcaaaaggcatg

SEQ ID NO: 504890 - DNA, 20 bp, Artificial
  CRISPR gRNA sequence
agcaaaaggcatggggccac

SEQ ID NO: 504891 - DNA, 20 bp, Artificial
  CRISPR gRNA sequence
aaaggcatggggccactagc

SEQ ID NO: 504892 - DNA, 20 bp, Artificial
  CRISPR gRNA sequence
aaggcatggggccactagcc

SEQ ID NO: 504893 - DNA, 20 bp, Artificial
  CRISPR gRNA sequence
ccaggcccttctgcccccgc

SEQ ID NO: 504894 - DNA, 20 bp, Artificial
  CRISPR gRNA sequence
ttctgcccccgccagccacg

SEQ ID NO: 504895 - DNA, 20 bp, Artificial
  CRISPR gRNA sequence
ccagccacgtggccgcctcc

SEQ ID NO: 504896 - DNA, 20 bp, Artificial
  CRISPR gRNA sequence
ccacgtggccgcctcctggc

SEQ ID NO: 504897 - DNA, 20 bp, Artificial
  CRISPR gRNA sequence
tggccgcctcctggccagtc

SEQ ID NO: 504898 - DNA, 20 bp, Artificial
  CRISPR gRNA sequence
ctcccctgccctgctgtgaa

SEQ ID NO: 504899 - DNA, 20 bp, Artificial
  CRISPR gRNA sequence
tcccctgccctgctgtgaat

SEQ ID NO: 504900 - DNA, 20 bp, Artificial
  CRISPR gRNA sequence
tgctgtgaatgggacctcaa

SEQ ID NO: 504901 - DNA, 20 bp, Artificial
  CRISPR gRNA sequence
gctgtgaatgggacctcaat

SEQ ID NO: 504902 - DNA, 20 bp, Artificial
  CRISPR gRNA sequence
ctgtgaatgggacctcaata

SEQ ID NO: 504903 - DNA, 20 bp, Artificial
  CRISPR gRNA sequence
ggctatgaccgttcctcctg

SEQ ID NO: 504904 - DNA, 20 bp, Artificial
  CRISPR gRNA sequence
gctatgaccgttcctcctgt

SEQ ID NO: 504905 - DNA, 20 bp, Artificial
  CRISPR gRNA sequence
ctcctgtgggccctccccac

SEQ ID NO: 504906 - DNA, 20 bp, Artificial
  CRISPR gRNA sequence
tcctgtgggccctccccaca

SEQ ID NO: 504907 - DNA, 20 bp, Artificial
  CRISPR gRNA sequence
acaaggacgccttgtcctca

SEQ ID NO: 504908 - DNA, 20 bp, Artificial
  CRISPR gRNA sequence
acgccttgtcctcatggaca

SEQ ID NO: 504909 - DNA, 20 bp, Artificial
  CRISPR gRNA sequence
tcctcatggacacagaaact

SEQ ID NO: 504910 - DNA, 20 bp, Artificial
  CRISPR gRNA sequence
cctcatggacacagaaactg

SEQ ID NO: 504911 - DNA, 20 bp, Artificial
  CRISPR gRNA sequence
catggacacagaaactgagg

SEQ ID NO: 504912 - DNA, 20 bp, Artificial
  CRISPR gRNA sequence
atggacacagaaactgaggc

SEQ ID NO: 504913 - DNA, 20 bp, Artificial
  CRISPR gRNA sequence
tggacacagaaactgaggca

SEQ ID NO: 504914 - DNA, 20 bp, Artificial
  CRISPR gRNA sequence
acacagaaactgaggcaggg

SEQ ID NO: 504915 - DNA, 20 bp, Artificial
  CRISPR gRNA sequence
cacagaaactgaggcagggc

SEQ ID NO: 504916 - DNA, 20 bp, Artificial
  CRISPR gRNA sequence
acagaaactgaggcagggcg

SEQ ID NO: 504917 - DNA, 20 bp, Artificial
  CRISPR gRNA sequence
aactgaggcagggcggggtg

SEQ ID NO: 504918 - DNA, 20 bp, Artificial
  CRISPR gRNA sequence
actgaggcagggcggggtgc

SEQ ID NO: 504919 - DNA, 20 bp, Artificial
  CRISPR gRNA sequence
ctgaggcagggcggggtgca

SEQ ID NO: 504920 - DNA, 20 bp, Artificial
  CRISPR gRNA sequence
ggcggggtgcagggccatcc

SEQ ID NO: 504921 - DNA, 20 bp, Artificial
  CRISPR gRNA sequence
tccaagttcctgctgacgcc

SEQ ID NO: 504922 - DNA, 20 bp, Artificial
  CRISPR gRNA sequence
aagttcctgctgacgcccgg

SEQ ID NO: 504923 - DNA, 20 bp, Artificial
  CRISPR gRNA sequence
tcctgctgacgcccggtggc

SEQ ID NO: 504924 - DNA, 20 bp, Artificial
  CRISPR gRNA sequence
cctgctgacgcccggtggct

SEQ ID NO: 504925 - DNA, 20 bp, Artificial
  CRISPR gRNA sequence
ctgacgcccggtggctgggc

SEQ ID NO: 504926 - DNA, 20 bp, Artificial
  CRISPR gRNA sequence
agacttgcactgtctgtcct

SEQ ID NO: 504927 - DNA, 20 bp, Artificial
  CRISPR gRNA sequence
gacttgcactgtctgtcctc

SEQ ID NO: 504928 - DNA, 20 bp, Artificial
  CRISPR gRNA sequence
tttctgttccactcgttgaa

SEQ ID NO: 504929 - DNA, 20 bp, Artificial
  CRISPR gRNA sequence
gttccactcgttgaatggtc

SEQ ID NO: 504930 - DNA, 20 bp, Artificial
  CRISPR gRNA sequence
agaacgcaccccccaacacc

SEQ ID NO: 504931 - DNA, 20 bp, Artificial
  CRISPR gRNA sequence
ccaacaccaagtctgtgccg

SEQ ID NO: 504932 - DNA, 20 bp, Artificial
  CRISPR gRNA sequence
caacaccaagtctgtgccgc

SEQ ID NO: 504933 - DNA, 20 bp, Artificial
  CRISPR gRNA sequence
accaagtctgtgccgcagga

SEQ ID NO: 504934 - DNA, 20 bp, Artificial
  CRISPR gRNA sequence
gccgcaggacggccgttgtc

SEQ ID NO: 504935 - DNA, 20 bp, Artificial
  CRISPR gRNA sequence
gcaggacggccgttgtccag

SEQ ID NO: 504936 - DNA, 20 bp, Artificial
  CRISPR gRNA sequence
caggacggccgttgtccagc

SEQ ID NO: 504937 - DNA, 20 bp, Artificial
  CRISPR gRNA sequence
aggacggccgttgtccagca

SEQ ID NO: 504938 - DNA, 20 bp, Artificial
  CRISPR gRNA sequence
cgttgtccagcagggaccca

SEQ ID NO: 504939 - DNA, 20 bp, Artificial
  CRISPR gRNA sequence
gttgtccagcagggacccac

SEQ ID NO: 504940 - DNA, 20 bp, Artificial
  CRISPR gRNA sequence
cagggacccacgggctcacc

SEQ ID NO: 504941 - DNA, 20 bp, Artificial
  CRISPR gRNA sequence
agggacccacgggctcaccc

SEQ ID NO: 504942 - DNA, 20 bp, Artificial
  CRISPR gRNA sequence
cgggctcacccgggccgccg

SEQ ID NO: 504943 - DNA, 20 bp, Artificial
  CRISPR gRNA sequence
cacccgggccgccgcagacc

SEQ ID NO: 504944 - DNA, 20 bp, Artificial
  CRISPR gRNA sequence
cgccgcagacctggccgttg

SEQ ID NO: 504945 - DNA, 20 bp, Artificial
  CRISPR gRNA sequence
cctggccgttgtagcgctca

SEQ ID NO: 504946 - DNA, 20 bp, Artificial
  CRISPR gRNA sequence
gttgtagcgctcacagttga

SEQ ID NO: 504947 - DNA, 20 bp, Artificial
  CRISPR gRNA sequence
agttgatggtgtcacactcg

SEQ ID NO: 504948 - DNA, 20 bp, Artificial
  CRISPR gRNA sequence
tcgcagtactgcccgtatat

SEQ ID NO: 504949 - DNA, 20 bp, Artificial
  CRISPR gRNA sequence
ctgcccgtatatcagcttgc

SEQ ID NO: 504950 - DNA, 20 bp, Artificial
  CRISPR gRNA sequence
tgcccgtatatcagcttgcc

SEQ ID NO: 504951 - DNA, 20 bp, Artificial
  CRISPR gRNA sequence
gcccgtatatcagcttgccg

SEQ ID NO: 504952 - DNA, 20 bp, Artificial
  CRISPR gRNA sequence
cagcttgccggggacgtcgc

SEQ ID NO: 504953 - DNA, 20 bp, Artificial
  CRISPR gRNA sequence
tgccggggacgtcgctggtg

SEQ ID NO: 504954 - DNA, 20 bp, Artificial
  CRISPR gRNA sequence
gggacgtcgctggtgtggca

SEQ ID NO: 504955 - DNA, 20 bp, Artificial
  CRISPR gRNA sequence
ggacgtcgctggtgtggcac

SEQ ID NO: 504956 - DNA, 20 bp, Artificial
  CRISPR gRNA sequence
tgtggcacaggcactgcccg

SEQ ID NO: 504957 - DNA, 20 bp, Artificial
  CRISPR gRNA sequence
acaggcactgcccgcagaca

SEQ ID NO: 504958 - DNA, 20 bp, Artificial
  CRISPR gRNA sequence
tgcccgcagacacagtcccc

SEQ ID NO: 504959 - DNA, 20 bp, Artificial
  CRISPR gRNA sequence
agacacagtcccccagccct

SEQ ID NO: 504960 - DNA, 20 bp, Artificial
  CRISPR gRNA sequence
cacagtcccccagccctgag

SEQ ID NO: 504961 - DNA, 20 bp, Artificial
  CRISPR gRNA sequence
ccccagccctgagcagatga

SEQ ID NO: 504962 - DNA, 20 bp, Artificial
  CRISPR gRNA sequence
ccagccctgagcagatgatg

SEQ ID NO: 504963 - DNA, 20 bp, Artificial
  CRISPR gRNA sequence
tgatggagttgttgtccttc

SEQ ID NO: 504964 - DNA, 20 bp, Artificial
  CRISPR gRNA sequence
tggagttgttgtccttccgg

SEQ ID NO: 504965 - DNA, 20 bp, Artificial
  CRISPR gRNA sequence
tccttccggcagcttccttc

SEQ ID NO: 504966 - DNA, 20 bp, Artificial
  CRISPR gRNA sequence
ggcagcttccttccagctcc

SEQ ID NO: 504967 - DNA, 20 bp, Artificial
  CRISPR gRNA sequence
cttccagctcctggctgctc

SEQ ID NO: 504968 - DNA, 20 bp, Artificial
  CRISPR gRNA sequence
ggctgctccggccctgtgtc

SEQ ID NO: 504969 - DNA, 20 bp, Artificial
  CRISPR gRNA sequence
ggccctgtgtctggcactca

SEQ ID NO: 504970 - DNA, 20 bp, Artificial
  CRISPR gRNA sequence
actcacagtttttcccaatg

SEQ ID NO: 504971 - DNA, 20 bp, Artificial
  CRISPR gRNA sequence
acagtttttcccaatgtagc

SEQ ID NO: 504972 - DNA, 20 bp, Artificial
  CRISPR gRNA sequence
aatgtagccagtgtcacacc

SEQ ID NO: 504973 - DNA, 20 bp, Artificial
  CRISPR gRNA sequence
atgtagccagtgtcacacct

SEQ ID NO: 504974 - DNA, 20 bp, Artificial
  CRISPR gRNA sequence
tgtagccagtgtcacacctg

SEQ ID NO: 504975 - DNA, 20 bp, Artificial
  CRISPR gRNA sequence
gccagtgtcacacctgggga

SEQ ID NO: 504976 - DNA, 20 bp, Artificial
  CRISPR gRNA sequence
ccagtgtcacacctggggac

SEQ ID NO: 504977 - DNA, 20 bp, Artificial
  CRISPR gRNA sequence
agtgtcacacctggggacag

SEQ ID NO: 504978 - DNA, 20 bp, Artificial
  CRISPR gRNA sequence
gtgtcacacctggggacagg

SEQ ID NO: 504979 - DNA, 20 bp, Artificial
  CRISPR gRNA sequence
tgtcacacctggggacagga

SEQ ID NO: 504980 - DNA, 20 bp, Artificial
  CRISPR gRNA sequence
gtcacacctggggacaggag

SEQ ID NO: 504981 - DNA, 20 bp, Artificial
  CRISPR gRNA sequence
ctggggacaggaggggcccc

SEQ ID NO: 504982 - DNA, 20 bp, Artificial
  CRISPR gRNA sequence
tggggacaggaggggcccca

SEQ ID NO: 504983 - DNA, 20 bp, Artificial
  CRISPR gRNA sequence
gacaggaggggccccaaggt

SEQ ID NO: 504984 - DNA, 20 bp, Artificial
  CRISPR gRNA sequence
acaggaggggccccaaggtc

SEQ ID NO: 504985 - DNA, 20 bp, Artificial
  CRISPR gRNA sequence
ccccaaggtcaggctccccc

SEQ ID NO: 504986 - DNA, 20 bp, Artificial
  CRISPR gRNA sequence
tcaggctccccccagtgatg

SEQ ID NO: 504987 - DNA, 20 bp, Artificial
  CRISPR gRNA sequence
caggctccccccagtgatgt

SEQ ID NO: 504988 - DNA, 20 bp, Artificial
  CRISPR gRNA sequence
tccccccagtgatgtgggac

SEQ ID NO: 504989 - DNA, 20 bp, Artificial
  CRISPR gRNA sequence
ccccccagtgatgtgggaca

SEQ ID NO: 504990 - DNA, 20 bp, Artificial
  CRISPR gRNA sequence
cccccagtgatgtgggacaa

SEQ ID NO: 504991 - DNA, 20 bp, Artificial
  CRISPR gRNA sequence
cagtgatgtgggacaaggga

SEQ ID NO: 504992 - DNA, 20 bp, Artificial
  CRISPR gRNA sequence
gggacagccgccctgtcctc

SEQ ID NO: 504993 - DNA, 20 bp, Artificial
  CRISPR gRNA sequence
ggacagccgccctgtcctcc

SEQ ID NO: 504994 - DNA, 20 bp, Artificial
  CRISPR gRNA sequence
tcctccaggccccttgccct

SEQ ID NO: 504995 - DNA, 20 bp, Artificial
  CRISPR gRNA sequence
tccaggccccttgcccttgg

SEQ ID NO: 504996 - DNA, 20 bp, Artificial
  CRISPR gRNA sequence
caggccccttgcccttggtg

SEQ ID NO: 504997 - DNA, 20 bp, Artificial
  CRISPR gRNA sequence
cttggtggagaacaccccta

SEQ ID NO: 504998 - DNA, 20 bp, Artificial
  CRISPR gRNA sequence
tggcacattttgctttcctc

SEQ ID NO: 504999 - DNA, 20 bp, Artificial
  CRISPR gRNA sequence
ggcacattttgctttcctcg

SEQ ID NO: 505000 - DNA, 20 bp, Artificial
  CRISPR gRNA sequence
tgctttcctcgaggcctact

SEQ ID NO: 505001 - DNA, 20 bp, Artificial
  CRISPR gRNA sequence
ggcctactgagcacttgcca

SEQ ID NO: 505002 - DNA, 20 bp, Artificial
  CRISPR gRNA sequence
ctaaatgtgctcaaaacgtg

SEQ ID NO: 505003 - DNA, 20 bp, Artificial
  CRISPR gRNA sequence
taaatgtgctcaaaacgtgc

SEQ ID NO: 505004 - DNA, 20 bp, Artificial
  CRISPR gRNA sequence
aaatgtgctcaaaacgtgca

SEQ ID NO: 505005 - DNA, 20 bp, Artificial
  CRISPR gRNA sequence
aatgtgctcaaaacgtgcag

SEQ ID NO: 505006 - DNA, 20 bp, Artificial
  CRISPR gRNA sequence
ggggccccgcgttccctccc

SEQ ID NO: 505007 - DNA, 20 bp, Artificial
  CRISPR gRNA sequence
gggccccgcgttccctcccc

SEQ ID NO: 505008 - DNA, 20 bp, Artificial
  CRISPR gRNA sequence
ttccctccccaggatgtccc

SEQ ID NO: 505009 - DNA, 20 bp, Artificial
  CRISPR gRNA sequence
tccctccccaggatgtcccg

SEQ ID NO: 505010 - DNA, 20 bp, Artificial
  CRISPR gRNA sequence
ccctccccaggatgtcccga

SEQ ID NO: 505011 - DNA, 20 bp, Artificial
  CRISPR gRNA sequence
cctccccaggatgtcccgag

SEQ ID NO: 505012 - DNA, 20 bp, Artificial
  CRISPR gRNA sequence
cccaggatgtcccgagggga

SEQ ID NO: 505013 - DNA, 20 bp, Artificial
  CRISPR gRNA sequence
aggatgtcccgaggggaaag

SEQ ID NO: 505014 - DNA, 20 bp, Artificial
  CRISPR gRNA sequence
ccgaggggaaagcagacacc

SEQ ID NO: 505015 - DNA, 20 bp, Artificial
  CRISPR gRNA sequence
ggaaagcagacacctggcct

SEQ ID NO: 505016 - DNA, 20 bp, Artificial
  CRISPR gRNA sequence
ctggccttggcctgcgcatg

SEQ ID NO: 505017 - DNA, 20 bp, Artificial
  CRISPR gRNA sequence
gccttggcctgcgcatgcag

SEQ ID NO: 505018 - DNA, 20 bp, Artificial
  CRISPR gRNA sequence
ggcctgcgcatgcagtggct

SEQ ID NO: 505019 - DNA, 20 bp, Artificial
  CRISPR gRNA sequence
ctgcgcatgcagtggctcgg

SEQ ID NO: 505020 - DNA, 20 bp, Artificial
  CRISPR gRNA sequence
tgcgcatgcagtggctcggc

SEQ ID NO: 505021 - DNA, 20 bp, Artificial
  CRISPR gRNA sequence
gtggctcggcaggctcactg

SEQ ID NO: 505022 - DNA, 20 bp, Artificial
  CRISPR gRNA sequence
ggctcggcaggctcactgtg

SEQ ID NO: 505023 - DNA, 20 bp, Artificial
  CRISPR gRNA sequence
ctcactgtggagctgtgttg

SEQ ID NO: 505024 - DNA, 20 bp, Artificial
  CRISPR gRNA sequence
ctgtgttgcagccatgcaca

SEQ ID NO: 505025 - DNA, 20 bp, Artificial
  CRISPR gRNA sequence
catggcctgtgctgcgatac

SEQ ID NO: 505026 - DNA, 20 bp, Artificial
  CRISPR gRNA sequence
ctgcgataccggtgctctgt

SEQ ID NO: 505027 - DNA, 20 bp, Artificial
  CRISPR gRNA sequence
cgataccggtgctctgtgag

SEQ ID NO: 505028 - DNA, 20 bp, Artificial
  CRISPR gRNA sequence
accggtgctctgtgagtggc

SEQ ID NO: 505029 - DNA, 20 bp, Artificial
  CRISPR gRNA sequence
ctgctcctgcgtgccccaca

SEQ ID NO: 505030 - DNA, 20 bp, Artificial
  CRISPR gRNA sequence
ctcctgcgtgccccacatgg

SEQ ID NO: 505031 - DNA, 20 bp, Artificial
  CRISPR gRNA sequence
tgcgtgccccacatggtggc

SEQ ID NO: 505032 - DNA, 20 bp, Artificial
  CRISPR gRNA sequence
gtgccccacatggtggccag

SEQ ID NO: 505033 - DNA, 20 bp, Artificial
  CRISPR gRNA sequence
tgccccacatggtggccagt

SEQ ID NO: 505034 - DNA, 20 bp, Artificial
  CRISPR gRNA sequence
gccccacatggtggccagtg

SEQ ID NO: 505035 - DNA, 20 bp, Artificial
  CRISPR gRNA sequence
catggtggccagtggggact

SEQ ID NO: 505036 - DNA, 20 bp, Artificial
  CRISPR gRNA sequence
ctcggcactgcctcctgcca

SEQ ID NO: 505037 - DNA, 20 bp, Artificial
  CRISPR gRNA sequence
ctcctgcgttcgtgcactga

SEQ ID NO: 505038 - DNA, 20 bp, Artificial
  CRISPR gRNA sequence
tcctgcgttcgtgcactgac

SEQ ID NO: 505039 - DNA, 20 bp, Artificial
  CRISPR gRNA sequence
gcgttcgtgcactgacaggc

SEQ ID NO: 505040 - DNA, 20 bp, Artificial
  CRISPR gRNA sequence
cgttcgtgcactgacaggcc

SEQ ID NO: 505041 - DNA, 20 bp, Artificial
  CRISPR gRNA sequence
tgcactgacaggccaggttg

SEQ ID NO: 505042 - DNA, 20 bp, Artificial
  CRISPR gRNA sequence
gcactgacaggccaggttgt

SEQ ID NO: 505043 - DNA, 20 bp, Artificial
  CRISPR gRNA sequence
actgacaggccaggttgtgg

SEQ ID NO: 505044 - DNA, 20 bp, Artificial
  CRISPR gRNA sequence
ggccaggttgtgggagaatg

SEQ ID NO: 505045 - DNA, 20 bp, Artificial
  CRISPR gRNA sequence
gccaggttgtgggagaatgc

SEQ ID NO: 505046 - DNA, 20 bp, Artificial
  CRISPR gRNA sequence
ccaggttgtgggagaatgca

SEQ ID NO: 505047 - DNA, 20 bp, Artificial
  CRISPR gRNA sequence
ttgtgggagaatgcagggac

SEQ ID NO: 505048 - DNA, 20 bp, Artificial
  CRISPR gRNA sequence
tgtgggagaatgcagggaca

SEQ ID NO: 505049 - DNA, 20 bp, Artificial
  CRISPR gRNA sequence
gtgggagaatgcagggacaa

SEQ ID NO: 505050 - DNA, 20 bp, Artificial
  CRISPR gRNA sequence
tgggagaatgcagggacaag

SEQ ID NO: 505051 - DNA, 20 bp, Artificial
  CRISPR gRNA sequence
gcagggacaaggggttttta

SEQ ID NO: 505052 - DNA, 20 bp, Artificial
  CRISPR gRNA sequence
acaaggggtttttacagatg

SEQ ID NO: 505053 - DNA, 20 bp, Artificial
  CRISPR gRNA sequence
aggggtttttacagatgtgg

SEQ ID NO: 505054 - DNA, 20 bp, Artificial
  CRISPR gRNA sequence
gtttttacagatgtggaagc

SEQ ID NO: 505055 - DNA, 20 bp, Artificial
  CRISPR gRNA sequence
cagatgtggaagctggcatc

SEQ ID NO: 505056 - DNA, 20 bp, Artificial
  CRISPR gRNA sequence
ggaagctggcatcaagccgc

SEQ ID NO: 505057 - DNA, 20 bp, Artificial
  CRISPR gRNA sequence
agctggcatcaagccgctgg

SEQ ID NO: 505058 - DNA, 20 bp, Artificial
  CRISPR gRNA sequence
gctggcatcaagccgctggc

SEQ ID NO: 505059 - DNA, 20 bp, Artificial
  CRISPR gRNA sequence
ggcatcaagccgctggcagg

SEQ ID NO: 505060 - DNA, 20 bp, Artificial
  CRISPR gRNA sequence
gcatcaagccgctggcaggc

SEQ ID NO: 505061 - DNA, 20 bp, Artificial
  CRISPR gRNA sequence
atcaagccgctggcaggcag

SEQ ID NO: 505062 - DNA, 20 bp, Artificial
  CRISPR gRNA sequence
gcaggagccacacacaccct

SEQ ID NO: 505063 - DNA, 20 bp, Artificial
  CRISPR gRNA sequence
caggagccacacacaccctg

SEQ ID NO: 505064 - DNA, 20 bp, Artificial
  CRISPR gRNA sequence
cacacaccctgaggcatcct

SEQ ID NO: 505065 - DNA, 20 bp, Artificial
  CRISPR gRNA sequence
cacaccctgaggcatcctca

SEQ ID NO: 505066 - DNA, 20 bp, Artificial
  CRISPR gRNA sequence
ccctgaggcatcctcagaga

SEQ ID NO: 505067 - DNA, 20 bp, Artificial
  CRISPR gRNA sequence
cctcagagacggcactgcca

SEQ ID NO: 505068 - DNA, 20 bp, Artificial
  CRISPR gRNA sequence
ctcagagacggcactgccac

SEQ ID NO: 505069 - DNA, 20 bp, Artificial
  CRISPR gRNA sequence
ccacgggctctcctgctccc

SEQ ID NO: 505070 - DNA, 20 bp, Artificial
  CRISPR gRNA sequence
acgggctctcctgctcccca

SEQ ID NO: 505071 - DNA, 20 bp, Artificial
  CRISPR gRNA sequence
cgggctctcctgctccccag

SEQ ID NO: 505072 - DNA, 20 bp, Artificial
  CRISPR gRNA sequence
ggctctcctgctccccagag

SEQ ID NO: 505073 - DNA, 20 bp, Artificial
  CRISPR gRNA sequence
gctctcctgctccccagagg

SEQ ID NO: 505074 - DNA, 20 bp, Artificial
  CRISPR gRNA sequence
ctcctgctccccagaggagg

SEQ ID NO: 505075 - DNA, 20 bp, Artificial
  CRISPR gRNA sequence
ctccccagaggaggaagctg

SEQ ID NO: 505076 - DNA, 20 bp, Artificial
  CRISPR gRNA sequence
tccccagaggaggaagctgc

SEQ ID NO: 505077 - DNA, 20 bp, Artificial
  CRISPR gRNA sequence
gaggaggaagctgcaggacc

SEQ ID NO: 505078 - DNA, 20 bp, Artificial
  CRISPR gRNA sequence
agctgcaggaccgagtgtct

SEQ ID NO: 505079 - DNA, 20 bp, Artificial
  CRISPR gRNA sequence
accgagtgtctgagtacctg

SEQ ID NO: 505080 - DNA, 20 bp, Artificial
  CRISPR gRNA sequence
gagtgtctgagtacctgtgg

SEQ ID NO: 505081 - DNA, 20 bp, Artificial
  CRISPR gRNA sequence
agtgtctgagtacctgtggc

SEQ ID NO: 505082 - DNA, 20 bp, Artificial
  CRISPR gRNA sequence
gtgtctgagtacctgtggca

SEQ ID NO: 505083 - DNA, 20 bp, Artificial
  CRISPR gRNA sequence
ggcaccccccgacacctgcc

SEQ ID NO: 505084 - DNA, 20 bp, Artificial
  CRISPR gRNA sequence
acctgccaagtgttccgact

SEQ ID NO: 505085 - DNA, 20 bp, Artificial
  CRISPR gRNA sequence
ttccgactgagtcaccccta

SEQ ID NO: 505086 - DNA, 20 bp, Artificial
  CRISPR gRNA sequence
gtcacccctacagtcccgtg

SEQ ID NO: 505087 - DNA, 20 bp, Artificial
  CRISPR gRNA sequence
cacccctacagtcccgtgaa

SEQ ID NO: 505088 - DNA, 20 bp, Artificial
  CRISPR gRNA sequence
acccctacagtcccgtgaag

SEQ ID NO: 505089 - DNA, 20 bp, Artificial
  CRISPR gRNA sequence
gtcccgtgaagaggccgccc

SEQ ID NO: 505090 - DNA, 20 bp, Artificial
  CRISPR gRNA sequence
tcccgtgaagaggccgcccc

SEQ ID NO: 505091 - DNA, 20 bp, Artificial
  CRISPR gRNA sequence
cccgtgaagaggccgcccca

SEQ ID NO: 505092 - DNA, 20 bp, Artificial
  CRISPR gRNA sequence
ccgccccagggctgcacacc

SEQ ID NO: 505093 - DNA, 20 bp, Artificial
  CRISPR gRNA sequence
cgccccagggctgcacaccc

SEQ ID NO: 505094 - DNA, 20 bp, Artificial
  CRISPR gRNA sequence
ccagggctgcacacccagga

SEQ ID NO: 505095 - DNA, 20 bp, Artificial
  CRISPR gRNA sequence
gggctgcacacccaggacag

SEQ ID NO: 505096 - DNA, 20 bp, Artificial
  CRISPR gRNA sequence
ggctgcacacccaggacagt

SEQ ID NO: 505097 - DNA, 20 bp, Artificial
  CRISPR gRNA sequence
tgcacacccaggacagtggg

SEQ ID NO: 505098 - DNA, 20 bp, Artificial
  CRISPR gRNA sequence
gcacacccaggacagtgggc

SEQ ID NO: 505099 - DNA, 20 bp, Artificial
  CRISPR gRNA sequence
cacacccaggacagtgggcg

SEQ ID NO: 505100 - DNA, 20 bp, Artificial
  CRISPR gRNA sequence
acccaggacagtgggcgggg

SEQ ID NO: 505101 - DNA, 20 bp, Artificial
  CRISPR gRNA sequence
cagtgggcggggtggccact

SEQ ID NO: 505102 - DNA, 20 bp, Artificial
  CRISPR gRNA sequence
agtgggcggggtggccactg

SEQ ID NO: 505103 - DNA, 20 bp, Artificial
  CRISPR gRNA sequence
cggggtggccactgaggcac

SEQ ID NO: 505104 - DNA, 20 bp, Artificial
  CRISPR gRNA sequence
ggggtggccactgaggcacg

SEQ ID NO: 505105 - DNA, 20 bp, Artificial
  CRISPR gRNA sequence
tggccactgaggcacgagga

SEQ ID NO: 505106 - DNA, 20 bp, Artificial
  CRISPR gRNA sequence
ctgaggcacgaggacagcaa

SEQ ID NO: 505107 - DNA, 20 bp, Artificial
  CRISPR gRNA sequence
gaggcacgaggacagcaaca

SEQ ID NO: 505108 - DNA, 20 bp, Artificial
  CRISPR gRNA sequence
ggacagcaacagagaccacc

SEQ ID NO: 505109 - DNA, 20 bp, Artificial
  CRISPR gRNA sequence
aacagagaccaccaagacca

SEQ ID NO: 505110 - DNA, 20 bp, Artificial
  CRISPR gRNA sequence
cagagaccaccaagaccaca

SEQ ID NO: 505111 - DNA, 20 bp, Artificial
  CRISPR gRNA sequence
acagagaccatcattgtcct

SEQ ID NO: 505112 - DNA, 20 bp, Artificial
  CRISPR gRNA sequence
accatcattgtcctgagata

SEQ ID NO: 505113 - DNA, 20 bp, Artificial
  CRISPR gRNA sequence
ccatcattgtcctgagatat

SEQ ID NO: 505114 - DNA, 20 bp, Artificial
  CRISPR gRNA sequence
atcattgtcctgagatatgg

SEQ ID NO: 505115 - DNA, 20 bp, Artificial
  CRISPR gRNA sequence
tcattgtcctgagatatggg

SEQ ID NO: 505116 - DNA, 20 bp, Artificial
  CRISPR gRNA sequence
attgtcctgagatatgggag

SEQ ID NO: 505117 - DNA, 20 bp, Artificial
  CRISPR gRNA sequence
ttgtcctgagatatgggagg

SEQ ID NO: 505118 - DNA, 20 bp, Artificial
  CRISPR gRNA sequence
cctgagatatgggaggaggc

SEQ ID NO: 505119 - DNA, 20 bp, Artificial
  CRISPR gRNA sequence
ctgagatatgggaggaggct

SEQ ID NO: 505120 - DNA, 20 bp, Artificial
  CRISPR gRNA sequence
tgagatatgggaggaggctg

SEQ ID NO: 505121 - DNA, 20 bp, Artificial
  CRISPR gRNA sequence
gagatatgggaggaggctgg

SEQ ID NO: 505122 - DNA, 20 bp, Artificial
  CRISPR gRNA sequence
atatgggaggaggctggggg

SEQ ID NO: 505123 - DNA, 20 bp, Artificial
  CRISPR gRNA sequence
tgggaggaggctgggggcag

SEQ ID NO: 505124 - DNA, 20 bp, Artificial
  CRISPR gRNA sequence
gggaggaggctgggggcagc

SEQ ID NO: 505125 - DNA, 20 bp, Artificial
  CRISPR gRNA sequence
ggaggaggctgggggcagca

SEQ ID NO: 505126 - DNA, 20 bp, Artificial
  CRISPR gRNA sequence
ctgggggcagcagggacctg

SEQ ID NO: 505127 - DNA, 20 bp, Artificial
  CRISPR gRNA sequence
tgggggcagcagggacctga

SEQ ID NO: 505128 - DNA, 20 bp, Artificial
  CRISPR gRNA sequence
ggcagcagggacctgaaggt

SEQ ID NO: 505129 - DNA, 20 bp, Artificial
  CRISPR gRNA sequence
gcagcagggacctgaaggtg

SEQ ID NO: 505130 - DNA, 20 bp, Artificial
  CRISPR gRNA sequence
gcagggacctgaaggtgagg

SEQ ID NO: 505131 - DNA, 20 bp, Artificial
  CRISPR gRNA sequence
cagggacctgaaggtgagga

SEQ ID NO: 505132 - DNA, 20 bp, Artificial
  CRISPR gRNA sequence
agggacctgaaggtgaggaa

SEQ ID NO: 505133 - DNA, 20 bp, Artificial
  CRISPR gRNA sequence
gtgaggaagggcactgccac

SEQ ID NO: 505134 - DNA, 20 bp, Artificial
  CRISPR gRNA sequence
tgaggaagggcactgccacc

SEQ ID NO: 505135 - DNA, 20 bp, Artificial
  CRISPR gRNA sequence
agggcactgccaccaggacg

SEQ ID NO: 505136 - DNA, 20 bp, Artificial
  CRISPR gRNA sequence
actgccaccaggacgtggat

SEQ ID NO: 505137 - DNA, 20 bp, Artificial
  CRISPR gRNA sequence
caggacgtggattggcactg

SEQ ID NO: 505138 - DNA, 20 bp, Artificial
  CRISPR gRNA sequence
acgtggattggcactgcggt

SEQ ID NO: 505139 - DNA, 20 bp, Artificial
  CRISPR gRNA sequence
cgtggattggcactgcggtc

SEQ ID NO: 505140 - DNA, 20 bp, Artificial
  CRISPR gRNA sequence
gattggcactgcggtcagga

SEQ ID NO: 505141 - DNA, 20 bp, Artificial
  CRISPR gRNA sequence
attggcactgcggtcaggac

SEQ ID NO: 505142 - DNA, 20 bp, Artificial
  CRISPR gRNA sequence
ttggcactgcggtcaggaca

SEQ ID NO: 505143 - DNA, 20 bp, Artificial
  CRISPR gRNA sequence
tggcactgcggtcaggacag

SEQ ID NO: 505144 - DNA, 20 bp, Artificial
  CRISPR gRNA sequence
gcactgcggtcaggacaggg

SEQ ID NO: 505145 - DNA, 20 bp, Artificial
  CRISPR gRNA sequence
cactgcggtcaggacagggg

SEQ ID NO: 505146 - DNA, 20 bp, Artificial
  CRISPR gRNA sequence
ctgcggtcaggacaggggag

SEQ ID NO: 505147 - DNA, 20 bp, Artificial
  CRISPR gRNA sequence
tgcggtcaggacaggggagg

SEQ ID NO: 505148 - DNA, 20 bp, Artificial
  CRISPR gRNA sequence
aggacaggggaggaggtgac

SEQ ID NO: 505149 - DNA, 20 bp, Artificial
  CRISPR gRNA sequence
gacaggggaggaggtgacca

SEQ ID NO: 505150 - DNA, 20 bp, Artificial
  CRISPR gRNA sequence
gggaggaggtgaccagagca

SEQ ID NO: 505151 - DNA, 20 bp, Artificial
  CRISPR gRNA sequence
ggaggaggtgaccagagcaa

SEQ ID NO: 505152 - DNA, 20 bp, Artificial
  CRISPR gRNA sequence
gaggaggtgaccagagcaaa

SEQ ID NO: 505153 - DNA, 20 bp, Artificial
  CRISPR gRNA sequence
aggaggtgaccagagcaaag

SEQ ID NO: 505154 - DNA, 20 bp, Artificial
  CRISPR gRNA sequence
ggaggtgaccagagcaaagg

SEQ ID NO: 505155 - DNA, 20 bp, Artificial
  CRISPR gRNA sequence
ggtgaccagagcaaaggggg

SEQ ID NO: 505156 - DNA, 20 bp, Artificial
  CRISPR gRNA sequence
tgaccagagcaaagggggca

SEQ ID NO: 505157 - DNA, 20 bp, Artificial
  CRISPR gRNA sequence
gagcaaagggggcagagtcc

SEQ ID NO: 505158 - DNA, 20 bp, Artificial
  CRISPR gRNA sequence
agcaaagggggcagagtcct

SEQ ID NO: 505159 - DNA, 20 bp, Artificial
  CRISPR gRNA sequence
caaagggggcagagtcctgg

SEQ ID NO: 505160 - DNA, 20 bp, Artificial
  CRISPR gRNA sequence
aaagggggcagagtcctggg

SEQ ID NO: 505161 - DNA, 20 bp, Artificial
  CRISPR gRNA sequence
ggggcagagtcctgggaggt

SEQ ID NO: 505162 - DNA, 20 bp, Artificial
  CRISPR gRNA sequence
agagtcctgggaggtcagcc

SEQ ID NO: 505163 - DNA, 20 bp, Artificial
  CRISPR gRNA sequence
gtcctgggaggtcagcctag

SEQ ID NO: 505164 - DNA, 20 bp, Artificial
  CRISPR gRNA sequence
ggaggtcagcctagcagctc

SEQ ID NO: 505165 - DNA, 20 bp, Artificial
  CRISPR gRNA sequence
gtcagcctagcagctctggc

SEQ ID NO: 505166 - DNA, 20 bp, Artificial
  CRISPR gRNA sequence
tcagcctagcagctctggcc

SEQ ID NO: 505167 - DNA, 20 bp, Artificial
  CRISPR gRNA sequence
cctagcagctctggccaggc

SEQ ID NO: 505168 - DNA, 20 bp, Artificial
  CRISPR gRNA sequence
gcagctctggccaggcaagc

SEQ ID NO: 505169 - DNA, 20 bp, Artificial
  CRISPR gRNA sequence
cagctctggccaggcaagca

SEQ ID NO: 505170 - DNA, 20 bp, Artificial
  CRISPR gRNA sequence
tctggccaggcaagcaagga

SEQ ID NO: 505171 - DNA, 20 bp, Artificial
  CRISPR gRNA sequence
ctggccaggcaagcaaggaa

SEQ ID NO: 505172 - DNA, 20 bp, Artificial
  CRISPR gRNA sequence
tggccaggcaagcaaggaaa

SEQ ID NO: 505173 - DNA, 20 bp, Artificial
  CRISPR gRNA sequence
ggccaggcaagcaaggaaag

SEQ ID NO: 505174 - DNA, 20 bp, Artificial
  CRISPR gRNA sequence
gccaggcaagcaaggaaagg

SEQ ID NO: 505175 - DNA, 20 bp, Artificial
  CRISPR gRNA sequence
ggcaagcaaggaaaggggga

SEQ ID NO: 505176 - DNA, 20 bp, Artificial
  CRISPR gRNA sequence
aggaaagggggacagccatc

SEQ ID NO: 505177 - DNA, 20 bp, Artificial
  CRISPR gRNA sequence
ggggacagccatccagcccc

SEQ ID NO: 505178 - DNA, 20 bp, Artificial
  CRISPR gRNA sequence
gggacagccatccagccccc

SEQ ID NO: 505179 - DNA, 20 bp, Artificial
  CRISPR gRNA sequence
acagccatccagcccccggg

SEQ ID NO: 505180 - DNA, 20 bp, Artificial
  CRISPR gRNA sequence
cagccatccagcccccgggc

SEQ ID NO: 505181 - DNA, 20 bp, Artificial
  CRISPR gRNA sequence
cagcccccgggcaggccgcc

SEQ ID NO: 505182 - DNA, 20 bp, Artificial
  CRISPR gRNA sequence
cccgggcaggccgcctggct

SEQ ID NO: 505183 - DNA, 20 bp, Artificial
  CRISPR gRNA sequence
tgccatgtgaacctccccac

SEQ ID NO: 505184 - DNA, 20 bp, Artificial
  CRISPR gRNA sequence
gccatgtgaacctccccact

SEQ ID NO: 505185 - DNA, 20 bp, Artificial
  CRISPR gRNA sequence
cctgtcccccacttctccct

SEQ ID NO: 505186 - DNA, 20 bp, Artificial
  CRISPR gRNA sequence
ctgtcccccacttctccctg

SEQ ID NO: 505187 - DNA, 20 bp, Artificial
  CRISPR gRNA sequence
tcccccacttctccctgagg

SEQ ID NO: 505188 - DNA, 20 bp, Artificial
  CRISPR gRNA sequence
cccccacttctccctgaggt

SEQ ID NO: 505189 - DNA, 20 bp, Artificial
  CRISPR gRNA sequence
ccccacttctccctgaggtg

SEQ ID NO: 505190 - DNA, 20 bp, Artificial
  CRISPR gRNA sequence
tgaggtggggtgcccacgcc

SEQ ID NO: 505191 - DNA, 20 bp, Artificial
  CRISPR gRNA sequence
ggtggggtgcccacgcctgg

SEQ ID NO: 505192 - DNA, 20 bp, Artificial
  CRISPR gRNA sequence
gtggggtgcccacgcctggc

SEQ ID NO: 505193 - DNA, 20 bp, Artificial
  CRISPR gRNA sequence
tggggtgcccacgcctggca

SEQ ID NO: 505194 - DNA, 20 bp, Artificial
  CRISPR gRNA sequence
ggggtgcccacgcctggcag

SEQ ID NO: 505195 - DNA, 20 bp, Artificial
  CRISPR gRNA sequence
gggtgcccacgcctggcagg

SEQ ID NO: 505196 - DNA, 20 bp, Artificial
  CRISPR gRNA sequence
ggcagggggtgtgcacgccc

SEQ ID NO: 505197 - DNA, 20 bp, Artificial
  CRISPR gRNA sequence
cagggggtgtgcacgcccaa

SEQ ID NO: 505198 - DNA, 20 bp, Artificial
  CRISPR gRNA sequence
agggggtgtgcacgcccaag

SEQ ID NO: 505199 - DNA, 20 bp, Artificial
  CRISPR gRNA sequence
gggtgtgcacgcccaagagg

SEQ ID NO: 505200 - DNA, 20 bp, Artificial
  CRISPR gRNA sequence
cacgcccaagaggtggccta

SEQ ID NO: 505201 - DNA, 20 bp, Artificial
  CRISPR gRNA sequence
acgcccaagaggtggcctat

SEQ ID NO: 505202 - DNA, 20 bp, Artificial
  CRISPR gRNA sequence
cgcccaagaggtggcctatg

SEQ ID NO: 505203 - DNA, 20 bp, Artificial
  CRISPR gRNA sequence
aagaggtggcctatggggcc

SEQ ID NO: 505204 - DNA, 20 bp, Artificial
  CRISPR gRNA sequence
agaggtggcctatggggccc

SEQ ID NO: 505205 - DNA, 20 bp, Artificial
  CRISPR gRNA sequence
gcctatggggcccaggctcc

SEQ ID NO: 505206 - DNA, 20 bp, Artificial
  CRISPR gRNA sequence
tatggggcccaggctcccag

SEQ ID NO: 505207 - DNA, 20 bp, Artificial
  CRISPR gRNA sequence
ccagaagccatcacctgtcc

SEQ ID NO: 505208 - DNA, 20 bp, Artificial
  CRISPR gRNA sequence
cagaagccatcacctgtccc

SEQ ID NO: 505209 - DNA, 20 bp, Artificial
  CRISPR gRNA sequence
gaagccatcacctgtcccag

SEQ ID NO: 505210 - DNA, 20 bp, Artificial
  CRISPR gRNA sequence
aagccatcacctgtcccagg

SEQ ID NO: 505211 - DNA, 20 bp, Artificial
  CRISPR gRNA sequence
acctgtcccaggaggctctc

SEQ ID NO: 505212 - DNA, 20 bp, Artificial
  CRISPR gRNA sequence
ctctctagccacccatgccc

SEQ ID NO: 505213 - DNA, 20 bp, Artificial
  CRISPR gRNA sequence
tctctagccacccatgcccc

SEQ ID NO: 505214 - DNA, 20 bp, Artificial
  CRISPR gRNA sequence
ctctagccacccatgcccca

SEQ ID NO: 505215 - DNA, 20 bp, Artificial
  CRISPR gRNA sequence
cacccatgccccagggctgc

SEQ ID NO: 505216 - DNA, 20 bp, Artificial
  CRISPR gRNA sequence
ccccagggctgccagcctga

SEQ ID NO: 505217 - DNA, 20 bp, Artificial
  CRISPR gRNA sequence
ggctgccagcctgatggcct

SEQ ID NO: 505218 - DNA, 20 bp, Artificial
  CRISPR gRNA sequence
gctgccagcctgatggcctt

SEQ ID NO: 505219 - DNA, 20 bp, Artificial
  CRISPR gRNA sequence
cctgatggccttgggtcccc

SEQ ID NO: 505220 - DNA, 20 bp, Artificial
  CRISPR gRNA sequence
ctgatggccttgggtcccca

SEQ ID NO: 505221 - DNA, 20 bp, Artificial
  CRISPR gRNA sequence
tggccttgggtccccaaggt

SEQ ID NO: 505222 - DNA, 20 bp, Artificial
  CRISPR gRNA sequence
gccttgggtccccaaggtca

SEQ ID NO: 505223 - DNA, 20 bp, Artificial
  CRISPR gRNA sequence
cttgggtccccaaggtcaga

SEQ ID NO: 505224 - DNA, 20 bp, Artificial
  CRISPR gRNA sequence
gggtccccaaggtcagagag

SEQ ID NO: 505225 - DNA, 20 bp, Artificial
  CRISPR gRNA sequence
ccccaaggtcagagagaagc

SEQ ID NO: 505226 - DNA, 20 bp, Artificial
  CRISPR gRNA sequence
gtcagagagaagccagctcc

SEQ ID NO: 505227 - DNA, 20 bp, Artificial
  CRISPR gRNA sequence
tcagagagaagccagctcct

SEQ ID NO: 505228 - DNA, 20 bp, Artificial
  CRISPR gRNA sequence
cagagagaagccagctccta

SEQ ID NO: 505229 - DNA, 20 bp, Artificial
  CRISPR gRNA sequence
agaagccagctcctagggtc

SEQ ID NO: 505230 - DNA, 20 bp, Artificial
  CRISPR gRNA sequence
gaagccagctcctagggtca

SEQ ID NO: 505231 - DNA, 20 bp, Artificial
  CRISPR gRNA sequence
gccagctcctagggtcaagg

SEQ ID NO: 505232 - DNA, 20 bp, Artificial
  CRISPR gRNA sequence
ccagctcctagggtcaagga

SEQ ID NO: 505233 - DNA, 20 bp, Artificial
  CRISPR gRNA sequence
ctcctagggtcaaggaaggt

SEQ ID NO: 505234 - DNA, 20 bp, Artificial
  CRISPR gRNA sequence
tcctagggtcaaggaaggtc

SEQ ID NO: 505235 - DNA, 20 bp, Artificial
  CRISPR gRNA sequence
tagggtcaaggaaggtcggg

SEQ ID NO: 505236 - DNA, 20 bp, Artificial
  CRISPR gRNA sequence
gggtcaaggaaggtcgggca

SEQ ID NO: 505237 - DNA, 20 bp, Artificial
  CRISPR gRNA sequence
caaggaaggtcgggcagaga

SEQ ID NO: 505238 - DNA, 20 bp, Artificial
  CRISPR gRNA sequence
gcagagaaagtgacccactc

SEQ ID NO: 505239 - DNA, 20 bp, Artificial
  CRISPR gRNA sequence
cagagaaagtgacccactca

SEQ ID NO: 505240 - DNA, 20 bp, Artificial
  CRISPR gRNA sequence
aagtgacccactcaaggcca

SEQ ID NO: 505241 - DNA, 20 bp, Artificial
  CRISPR gRNA sequence
agtgacccactcaaggccat

SEQ ID NO: 505242 - DNA, 20 bp, Artificial
  CRISPR gRNA sequence
ctcaaggccatgggcacgcc

SEQ ID NO: 505243 - DNA, 20 bp, Artificial
  CRISPR gRNA sequence
aaggccatgggcacgcccag

SEQ ID NO: 505244 - DNA, 20 bp, Artificial
  CRISPR gRNA sequence
aggccatgggcacgcccagc

SEQ ID NO: 505245 - DNA, 20 bp, Artificial
  CRISPR gRNA sequence
ggccatgggcacgcccagcg

SEQ ID NO: 505246 - DNA, 20 bp, Artificial
  CRISPR gRNA sequence
cggggactccttgtgcccct

SEQ ID NO: 505247 - DNA, 20 bp, Artificial
  CRISPR gRNA sequence
gactccttgtgcccctgaga

SEQ ID NO: 505248 - DNA, 20 bp, Artificial
  CRISPR gRNA sequence
actccttgtgcccctgagat

SEQ ID NO: 505249 - DNA, 20 bp, Artificial
  CRISPR gRNA sequence
tgagatgggcctccatcctc

SEQ ID NO: 505250 - DNA, 20 bp, Artificial
  CRISPR gRNA sequence
atgggcctccatcctctggt

SEQ ID NO: 505251 - DNA, 20 bp, Artificial
  CRISPR gRNA sequence
tgggcctccatcctctggtg

SEQ ID NO: 505252 - DNA, 20 bp, Artificial
  CRISPR gRNA sequence
gggcctccatcctctggtga

SEQ ID NO: 505253 - DNA, 20 bp, Artificial
  CRISPR gRNA sequence
ggcctccatcctctggtgag

SEQ ID NO: 505254 - DNA, 20 bp, Artificial
  CRISPR gRNA sequence
gcctccatcctctggtgagg

SEQ ID NO: 505255 - DNA, 20 bp, Artificial
  CRISPR gRNA sequence
gagggggtcctcctgcccac

SEQ ID NO: 505256 - DNA, 20 bp, Artificial
  CRISPR gRNA sequence
tgcccacaagtcccctgcct

SEQ ID NO: 505257 - DNA, 20 bp, Artificial
  CRISPR gRNA sequence
gcccacaagtcccctgcctt

SEQ ID NO: 505258 - DNA, 20 bp, Artificial
  CRISPR gRNA sequence
cccctgccttgggtcctcca

SEQ ID NO: 505259 - DNA, 20 bp, Artificial
  CRISPR gRNA sequence
tgccttgggtcctccatggc

SEQ ID NO: 505260 - DNA, 20 bp, Artificial
  CRISPR gRNA sequence
ccttgggtcctccatggcca

SEQ ID NO: 505261 - DNA, 20 bp, Artificial
  CRISPR gRNA sequence
ttgggtcctccatggccaga

SEQ ID NO: 505262 - DNA, 20 bp, Artificial
  CRISPR gRNA sequence
tcctccatggccagagagtg

SEQ ID NO: 505263 - DNA, 20 bp, Artificial
  CRISPR gRNA sequence
ctccatggccagagagtgta

SEQ ID NO: 505264 - DNA, 20 bp, Artificial
  CRISPR gRNA sequence
tggccagagagtgtagagta

SEQ ID NO: 505265 - DNA, 20 bp, Artificial
  CRISPR gRNA sequence
ggccagagagtgtagagtac

SEQ ID NO: 505266 - DNA, 20 bp, Artificial
  CRISPR gRNA sequence
agagagtgtagagtacaggc

SEQ ID NO: 505267 - DNA, 20 bp, Artificial
  CRISPR gRNA sequence
agagtacaggctggcattgc

SEQ ID NO: 505268 - DNA, 20 bp, Artificial
  CRISPR gRNA sequence
ggctggcattgctggtgccc

SEQ ID NO: 505269 - DNA, 20 bp, Artificial
  CRISPR gRNA sequence
gcattgctggtgccctggct

SEQ ID NO: 505270 - DNA, 20 bp, Artificial
  CRISPR gRNA sequence
cattgctggtgccctggctc

SEQ ID NO: 505271 - DNA, 20 bp, Artificial
  CRISPR gRNA sequence
ttgctggtgccctggctcag

SEQ ID NO: 505272 - DNA, 20 bp, Artificial
  CRISPR gRNA sequence
ggtgccctggctcaggagca

SEQ ID NO: 505273 - DNA, 20 bp, Artificial
  CRISPR gRNA sequence
gtgccctggctcaggagcac

SEQ ID NO: 505274 - DNA, 20 bp, Artificial
  CRISPR gRNA sequence
cctggctcaggagcacgggt

SEQ ID NO: 505275 - DNA, 20 bp, Artificial
  CRISPR gRNA sequence
ctggctcaggagcacgggtg

SEQ ID NO: 505276 - DNA, 20 bp, Artificial
  CRISPR gRNA sequence
tggctcaggagcacgggtga

SEQ ID NO: 505277 - DNA, 20 bp, Artificial
  CRISPR gRNA sequence
agcacgggtgagggcttgcc

SEQ ID NO: 505278 - DNA, 20 bp, Artificial
  CRISPR gRNA sequence
gcacgggtgagggcttgccg

SEQ ID NO: 505279 - DNA, 20 bp, Artificial
  CRISPR gRNA sequence
cacgggtgagggcttgccga

SEQ ID NO: 505280 - DNA, 20 bp, Artificial
  CRISPR gRNA sequence
acgggtgagggcttgccgag

SEQ ID NO: 505281 - DNA, 20 bp, Artificial
  CRISPR gRNA sequence
gagggcttgccgaggggttc

SEQ ID NO: 505282 - DNA, 20 bp, Artificial
  CRISPR gRNA sequence
agggcttgccgaggggttct

SEQ ID NO: 505283 - DNA, 20 bp, Artificial
  CRISPR gRNA sequence
ccaaatctccccacctcctg

SEQ ID NO: 505284 - DNA, 20 bp, Artificial
  CRISPR gRNA sequence
aatctccccacctcctgcag

SEQ ID NO: 505285 - DNA, 20 bp, Artificial
  CRISPR gRNA sequence
atctccccacctcctgcaga

SEQ ID NO: 505286 - DNA, 20 bp, Artificial
  CRISPR gRNA sequence
tctccccacctcctgcagaa

SEQ ID NO: 505287 - DNA, 20 bp, Artificial
  CRISPR gRNA sequence
ctccccacctcctgcagaag

SEQ ID NO: 505288 - DNA, 20 bp, Artificial
  CRISPR gRNA sequence
tccccacctcctgcagaagg

SEQ ID NO: 505289 - DNA, 20 bp, Artificial
  CRISPR gRNA sequence
ctcctgcagaagggggcccc

SEQ ID NO: 505290 - DNA, 20 bp, Artificial
  CRISPR gRNA sequence
tcctgcagaagggggccccc

SEQ ID NO: 505291 - DNA, 20 bp, Artificial
  CRISPR gRNA sequence
cccccaggatgcctgctccg

SEQ ID NO: 505292 - DNA, 20 bp, Artificial
  CRISPR gRNA sequence
ccccaggatgcctgctccgt

SEQ ID NO: 505293 - DNA, 20 bp, Artificial
  CRISPR gRNA sequence
cccaggatgcctgctccgtg

SEQ ID NO: 505294 - DNA, 20 bp, Artificial
  CRISPR gRNA sequence
aggatgcctgctccgtgggg

SEQ ID NO: 505295 - DNA, 20 bp, Artificial
  CRISPR gRNA sequence
ggatgcctgctccgtggggt

SEQ ID NO: 505296 - DNA, 20 bp, Artificial
  CRISPR gRNA sequence
gatgcctgctccgtggggtg

SEQ ID NO: 505297 - DNA, 20 bp, Artificial
  CRISPR gRNA sequence
atgcctgctccgtggggtgg

SEQ ID NO: 505298 - DNA, 20 bp, Artificial
  CRISPR gRNA sequence
cctgctccgtggggtggggg

SEQ ID NO: 505299 - DNA, 20 bp, Artificial
  CRISPR gRNA sequence
ctgctccgtggggtggggga

SEQ ID NO: 505300 - DNA, 20 bp, Artificial
  CRISPR gRNA sequence
tgctccgtggggtgggggaa

SEQ ID NO: 505301 - DNA, 20 bp, Artificial
  CRISPR gRNA sequence
ccgtggggtgggggaaggga

SEQ ID NO: 505302 - DNA, 20 bp, Artificial
  CRISPR gRNA sequence
gtggggtgggggaagggatg

SEQ ID NO: 505303 - DNA, 20 bp, Artificial
  CRISPR gRNA sequence
acctgccgacacctgccctg

SEQ ID NO: 505304 - DNA, 20 bp, Artificial
  CRISPR gRNA sequence
cctgccgacacctgccctgt

SEQ ID NO: 505305 - DNA, 20 bp, Artificial
  CRISPR gRNA sequence
ctgccgacacctgccctgtg

SEQ ID NO: 505306 - DNA, 20 bp, Artificial
  CRISPR gRNA sequence
ccgacacctgccctgtgggg

SEQ ID NO: 505307 - DNA, 20 bp, Artificial
  CRISPR gRNA sequence
cgacacctgccctgtggggt

SEQ ID NO: 505308 - DNA, 20 bp, Artificial
  CRISPR gRNA sequence
gacacctgccctgtggggtg

SEQ ID NO: 505309 - DNA, 20 bp, Artificial
  CRISPR gRNA sequence
ctgccctgtggggtggggct

SEQ ID NO: 505310 - DNA, 20 bp, Artificial
  CRISPR gRNA sequence
tgccctgtggggtggggctc

SEQ ID NO: 505311 - DNA, 20 bp, Artificial
  CRISPR gRNA sequence
gccctgtggggtggggctcg

SEQ ID NO: 505312 - DNA, 20 bp, Artificial
  CRISPR gRNA sequence
tgtggggtggggctcgggga

SEQ ID NO: 505313 - DNA, 20 bp, Artificial
  CRISPR gRNA sequence
ggggctcggggatggttcaa

SEQ ID NO: 505314 - DNA, 20 bp, Artificial
  CRISPR gRNA sequence
gggctcggggatggttcaac

SEQ ID NO: 505315 - DNA, 20 bp, Artificial
  CRISPR gRNA sequence
ggctcggggatggttcaaca

SEQ ID NO: 505316 - DNA, 20 bp, Artificial
  CRISPR gRNA sequence
acctgcgcccgcctcacctg

SEQ ID NO: 505317 - DNA, 20 bp, Artificial
  CRISPR gRNA sequence
acctgcagatgccgcactcc

SEQ ID NO: 505318 - DNA, 20 bp, Artificial
  CRISPR gRNA sequence
tgcagatgccgcactccaag

SEQ ID NO: 505319 - DNA, 20 bp, Artificial
  CRISPR gRNA sequence
actccaagaagcccttgcca

SEQ ID NO: 505320 - DNA, 20 bp, Artificial
  CRISPR gRNA sequence
ccaagaagcccttgccatgg

SEQ ID NO: 505321 - DNA, 20 bp, Artificial
  CRISPR gRNA sequence
aagaagcccttgccatggca

SEQ ID NO: 505322 - DNA, 20 bp, Artificial
  CRISPR gRNA sequence
agaagcccttgccatggcag

SEQ ID NO: 505323 - DNA, 20 bp, Artificial
  CRISPR gRNA sequence
ccttgccatggcagaggctg

SEQ ID NO: 505324 - DNA, 20 bp, Artificial
  CRISPR gRNA sequence
agaggctgcggtctctgctc

SEQ ID NO: 505325 - DNA, 20 bp, Artificial
  CRISPR gRNA sequence
tgcggtctctgctctggtcc

SEQ ID NO: 505326 - DNA, 20 bp, Artificial
  CRISPR gRNA sequence
ctctgctctggtcccggcac

SEQ ID NO: 505327 - DNA, 20 bp, Artificial
  CRISPR gRNA sequence
cccggcaccggcactcacac

SEQ ID NO: 505328 - DNA, 20 bp, Artificial
  CRISPR gRNA sequence
ccggcaccggcactcacact

SEQ ID NO: 505329 - DNA, 20 bp, Artificial
  CRISPR gRNA sequence
cggcaccggcactcacactg

SEQ ID NO: 505330 - DNA, 20 bp, Artificial
  CRISPR gRNA sequence
caccggcactcacactgggg

SEQ ID NO: 505331 - DNA, 20 bp, Artificial
  CRISPR gRNA sequence
acactggggaagaacctgca

SEQ ID NO: 505332 - DNA, 20 bp, Artificial
  CRISPR gRNA sequence
gcacggtcactatgtccgtg

SEQ ID NO: 505333 - DNA, 20 bp, Artificial
  CRISPR gRNA sequence
gtcactatgtccgtgaagcc

SEQ ID NO: 505334 - DNA, 20 bp, Artificial
  CRISPR gRNA sequence
tgtccgtgaagcccagcgcc

SEQ ID NO: 505335 - DNA, 20 bp, Artificial
  CRISPR gRNA sequence
ggatgacaaacgactgctcc

SEQ ID NO: 505336 - DNA, 20 bp, Artificial
  CRISPR gRNA sequence
ctgctcctggatgcactctg

SEQ ID NO: 505337 - DNA, 20 bp, Artificial
  CRISPR gRNA sequence
ctgtggccgtgaccttcacc

SEQ ID NO: 505338 - DNA, 20 bp, Artificial
  CRISPR gRNA sequence
tggccgtgaccttcacctgg

SEQ ID NO: 505339 - DNA, 20 bp, Artificial
  CRISPR gRNA sequence
ggccgtgaccttcacctgga

SEQ ID NO: 505340 - DNA, 20 bp, Artificial
  CRISPR gRNA sequence
ttcacctggaaggtgatctg

SEQ ID NO: 505341 - DNA, 20 bp, Artificial
  CRISPR gRNA sequence
tcacctggaaggtgatctgc

SEQ ID NO: 505342 - DNA, 20 bp, Artificial
  CRISPR gRNA sequence
cacctggaaggtgatctgca

SEQ ID NO: 505343 - DNA, 20 bp, Artificial
  CRISPR gRNA sequence
ctggaaggtgatctgcaggg

SEQ ID NO: 505344 - DNA, 20 bp, Artificial
  CRISPR gRNA sequence
ggtgatctgcagggcagtgc

SEQ ID NO: 505345 - DNA, 20 bp, Artificial
  CRISPR gRNA sequence
gtgatctgcagggcagtgct

SEQ ID NO: 505346 - DNA, 20 bp, Artificial
  CRISPR gRNA sequence
ctgcagggcagtgctgggct

SEQ ID NO: 505347 - DNA, 20 bp, Artificial
  CRISPR gRNA sequence
tgcagggcagtgctgggctc

SEQ ID NO: 505348 - DNA, 20 bp, Artificial
  CRISPR gRNA sequence
agggcagtgctgggctcagg

SEQ ID NO: 505349 - DNA, 20 bp, Artificial
  CRISPR gRNA sequence
gggcagtgctgggctcaggt

SEQ ID NO: 505350 - DNA, 20 bp, Artificial
  CRISPR gRNA sequence
ggcagtgctgggctcaggtg

SEQ ID NO: 505351 - DNA, 20 bp, Artificial
  CRISPR gRNA sequence
tgggctcaggtggggaccct

SEQ ID NO: 505352 - DNA, 20 bp, Artificial
  CRISPR gRNA sequence
gctcaggtggggaccctcgg

SEQ ID NO: 505353 - DNA, 20 bp, Artificial
  CRISPR gRNA sequence
aggtggggaccctcggtggc

SEQ ID NO: 505354 - DNA, 20 bp, Artificial
  CRISPR gRNA sequence
ggtggggaccctcggtggcc

SEQ ID NO: 505355 - DNA, 20 bp, Artificial
  CRISPR gRNA sequence
gtggggaccctcggtggcca

SEQ ID NO: 505356 - DNA, 20 bp, Artificial
  CRISPR gRNA sequence
gggaccctcggtggccaggg

SEQ ID NO: 505357 - DNA, 20 bp, Artificial
  CRISPR gRNA sequence
accctcggtggccagggtgg

SEQ ID NO: 505358 - DNA, 20 bp, Artificial
  CRISPR gRNA sequence
cggtggccagggtggcagcc

SEQ ID NO: 505359 - DNA, 20 bp, Artificial
  CRISPR gRNA sequence
agctcccaaccctcacctcc

SEQ ID NO: 505360 - DNA, 20 bp, Artificial
  CRISPR gRNA sequence
ccctcacctcctggcctctg

SEQ ID NO: 505361 - DNA, 20 bp, Artificial
  CRISPR gRNA sequence
cctcacctcctggcctctgc

SEQ ID NO: 505362 - DNA, 20 bp, Artificial
  CRISPR gRNA sequence
ctcacctcctggcctctgca

SEQ ID NO: 505363 - DNA, 20 bp, Artificial
  CRISPR gRNA sequence
tcacctcctggcctctgcag

SEQ ID NO: 505364 - DNA, 20 bp, Artificial
  CRISPR gRNA sequence
cctggcctctgcaggggtcc

SEQ ID NO: 505365 - DNA, 20 bp, Artificial
  CRISPR gRNA sequence
ctggcctctgcaggggtcct

SEQ ID NO: 505366 - DNA, 20 bp, Artificial
  CRISPR gRNA sequence
tggcctctgcaggggtcctg

SEQ ID NO: 505367 - DNA, 20 bp, Artificial
  CRISPR gRNA sequence
ggcctctgcaggggtcctgg

SEQ ID NO: 505368 - DNA, 20 bp, Artificial
  CRISPR gRNA sequence
gcctctgcaggggtcctggg

SEQ ID NO: 505369 - DNA, 20 bp, Artificial
  CRISPR gRNA sequence
tgcaggggtcctggggggtt

SEQ ID NO: 505370 - DNA, 20 bp, Artificial
  CRISPR gRNA sequence
gggtcctggggggttcagcg

SEQ ID NO: 505371 - DNA, 20 bp, Artificial
  CRISPR gRNA sequence
ggtcctggggggttcagcgt

SEQ ID NO: 505372 - DNA, 20 bp, Artificial
  CRISPR gRNA sequence
gtcctggggggttcagcgtg

SEQ ID NO: 505373 - DNA, 20 bp, Artificial
  CRISPR gRNA sequence
cctggggggttcagcgtggg

SEQ ID NO: 505374 - DNA, 20 bp, Artificial
  CRISPR gRNA sequence
ctggggggttcagcgtgggg

SEQ ID NO: 505375 - DNA, 20 bp, Artificial
  CRISPR gRNA sequence
gggggttcagcgtggggagg

SEQ ID NO: 505376 - DNA, 20 bp, Artificial
  CRISPR gRNA sequence
ggggttcagcgtggggagga

SEQ ID NO: 505377 - DNA, 20 bp, Artificial
  CRISPR gRNA sequence
gggttcagcgtggggaggaa

SEQ ID NO: 505378 - DNA, 20 bp, Artificial
  CRISPR gRNA sequence
ggttcagcgtggggaggaag

SEQ ID NO: 505379 - DNA, 20 bp, Artificial
  CRISPR gRNA sequence
cgtggggaggaaggggtgac

SEQ ID NO: 505380 - DNA, 20 bp, Artificial
  CRISPR gRNA sequence
gtggggaggaaggggtgacc

SEQ ID NO: 505381 - DNA, 20 bp, Artificial
  CRISPR gRNA sequence
ggggaggaaggggtgaccag

SEQ ID NO: 505382 - DNA, 20 bp, Artificial
  CRISPR gRNA sequence
gaggaaggggtgaccaggag

SEQ ID NO: 505383 - DNA, 20 bp, Artificial
  CRISPR gRNA sequence
aggaaggggtgaccaggagc

SEQ ID NO: 505384 - DNA, 20 bp, Artificial
  CRISPR gRNA sequence
aaggggtgaccaggagcagg

SEQ ID NO: 505385 - DNA, 20 bp, Artificial
  CRISPR gRNA sequence
ggggtgaccaggagcaggaa

SEQ ID NO: 505386 - DNA, 20 bp, Artificial
  CRISPR gRNA sequence
gagcaggaagagctgatgct

SEQ ID NO: 505387 - DNA, 20 bp, Artificial
  CRISPR gRNA sequence
aagagctgatgctcagatcc

SEQ ID NO: 505388 - DNA, 20 bp, Artificial
  CRISPR gRNA sequence
gagctgatgctcagatccga

SEQ ID NO: 505389 - DNA, 20 bp, Artificial
  CRISPR gRNA sequence
atgctcagatccgagagcca

SEQ ID NO: 505390 - DNA, 20 bp, Artificial
  CRISPR gRNA sequence
tcagatccgagagccaaagt

SEQ ID NO: 505391 - DNA, 20 bp, Artificial
  CRISPR gRNA sequence
atccgagagccaaagtcagc

SEQ ID NO: 505392 - DNA, 20 bp, Artificial
  CRISPR gRNA sequence
gagagccaaagtcagccggc

SEQ ID NO: 505393 - DNA, 20 bp, Artificial
  CRISPR gRNA sequence
agagccaaagtcagccggca

SEQ ID NO: 505394 - DNA, 20 bp, Artificial
  CRISPR gRNA sequence
agccaaagtcagccggcaag

SEQ ID NO: 505395 - DNA, 20 bp, Artificial
  CRISPR gRNA sequence
gccaaagtcagccggcaagg

SEQ ID NO: 505396 - DNA, 20 bp, Artificial
  CRISPR gRNA sequence
ctctgcccgcactcccgcac

SEQ ID NO: 505397 - DNA, 20 bp, Artificial
  CRISPR gRNA sequence
gcccgcactcccgcactggc

SEQ ID NO: 505398 - DNA, 20 bp, Artificial
  CRISPR gRNA sequence
actcccgcactggccggcac

SEQ ID NO: 505399 - DNA, 20 bp, Artificial
  CRISPR gRNA sequence
ctcccgcactggccggcacc

SEQ ID NO: 505400 - DNA, 20 bp, Artificial
  CRISPR gRNA sequence
ggccggcaccaggatctccc

SEQ ID NO: 505401 - DNA, 20 bp, Artificial
  CRISPR gRNA sequence
ggatctccccggccacacat

SEQ ID NO: 505402 - DNA, 20 bp, Artificial
  CRISPR gRNA sequence
tctccccggccacacatcag

SEQ ID NO: 505403 - DNA, 20 bp, Artificial
  CRISPR gRNA sequence
tccccggccacacatcagca

SEQ ID NO: 505404 - DNA, 20 bp, Artificial
  CRISPR gRNA sequence
cagcagagacatgtgacacg

SEQ ID NO: 505405 - DNA, 20 bp, Artificial
  CRISPR gRNA sequence
agagacatgtgacacgcaga

SEQ ID NO: 505406 - DNA, 20 bp, Artificial
  CRISPR gRNA sequence
gtgacacgcagacagcaaat

SEQ ID NO: 505407 - DNA, 20 bp, Artificial
  CRISPR gRNA sequence
tgacacgcagacagcaaatc

SEQ ID NO: 505408 - DNA, 20 bp, Artificial
  CRISPR gRNA sequence
acacgcagacagcaaatcag

SEQ ID NO: 505409 - DNA, 20 bp, Artificial
  CRISPR gRNA sequence
cgcagacagcaaatcaggag

SEQ ID NO: 505410 - DNA, 20 bp, Artificial
  CRISPR gRNA sequence
acagcaaatcaggagaagct

SEQ ID NO: 505411 - DNA, 20 bp, Artificial
  CRISPR gRNA sequence
aagctgagcacactcccact

SEQ ID NO: 505412 - DNA, 20 bp, Artificial
  CRISPR gRNA sequence
ccactcagaccacccaacat

SEQ ID NO: 505413 - DNA, 20 bp, Artificial
  CRISPR gRNA sequence
cactcagaccacccaacatg

SEQ ID NO: 505414 - DNA, 20 bp, Artificial
  CRISPR gRNA sequence
actcagaccacccaacatga

SEQ ID NO: 505415 - DNA, 20 bp, Artificial
  CRISPR gRNA sequence
ccaacatgagggaaacgttc

SEQ ID NO: 505416 - DNA, 20 bp, Artificial
  CRISPR gRNA sequence
catgagggaaacgttctggt

SEQ ID NO: 505417 - DNA, 20 bp, Artificial
  CRISPR gRNA sequence
aacgttctggtgagaatcca

SEQ ID NO: 505418 - DNA, 20 bp, Artificial
  CRISPR gRNA sequence
acgttctggtgagaatccat

SEQ ID NO: 505419 - DNA, 20 bp, Artificial
  CRISPR gRNA sequence
tctggtgagaatccatggga

SEQ ID NO: 505420 - DNA, 20 bp, Artificial
  CRISPR gRNA sequence
gtgagaatccatgggacagc

SEQ ID NO: 505421 - DNA, 20 bp, Artificial
  CRISPR gRNA sequence
tgagaatccatgggacagct

SEQ ID NO: 505422 - DNA, 20 bp, Artificial
  CRISPR gRNA sequence
catgggacagctgggcgccg

SEQ ID NO: 505423 - DNA, 20 bp, Artificial
  CRISPR gRNA sequence
gcggctcacgcctgtaatcc

SEQ ID NO: 505424 - DNA, 20 bp, Artificial
  CRISPR gRNA sequence
cgcctgtaatcccagcactg

SEQ ID NO: 505425 - DNA, 20 bp, Artificial
  CRISPR gRNA sequence
gcctgtaatcccagcactgt

SEQ ID NO: 505426 - DNA, 20 bp, Artificial
  CRISPR gRNA sequence
ctgtaatcccagcactgtgg

SEQ ID NO: 505427 - DNA, 20 bp, Artificial
  CRISPR gRNA sequence
tgtaatcccagcactgtggg

SEQ ID NO: 505428 - DNA, 20 bp, Artificial
  CRISPR gRNA sequence
tcccagcactgtgggaggcc

SEQ ID NO: 505429 - DNA, 20 bp, Artificial
  CRISPR gRNA sequence
cccagcactgtgggaggccg

SEQ ID NO: 505430 - DNA, 20 bp, Artificial
  CRISPR gRNA sequence
agcactgtgggaggccgagg

SEQ ID NO: 505431 - DNA, 20 bp, Artificial
  CRISPR gRNA sequence
gcactgtgggaggccgaggc

SEQ ID NO: 505432 - DNA, 20 bp, Artificial
  CRISPR gRNA sequence
ctgtgggaggccgaggcggg

SEQ ID NO: 505433 - DNA, 20 bp, Artificial
  CRISPR gRNA sequence
ccgaggcgggtagatcatct

SEQ ID NO: 505434 - DNA, 20 bp, Artificial
  CRISPR gRNA sequence
cgaggcgggtagatcatctg

SEQ ID NO: 505435 - DNA, 20 bp, Artificial
  CRISPR gRNA sequence
gaggcgggtagatcatctga

SEQ ID NO: 505436 - DNA, 20 bp, Artificial
  CRISPR gRNA sequence
cgggtagatcatctgagggc

SEQ ID NO: 505437 - DNA, 20 bp, Artificial
  CRISPR gRNA sequence
ggtagatcatctgagggcaa

SEQ ID NO: 505438 - DNA, 20 bp, Artificial
  CRISPR gRNA sequence
tcatctgagggcaagagttt

SEQ ID NO: 505439 - DNA, 20 bp, Artificial
  CRISPR gRNA sequence
tgagggcaagagtttgagac

SEQ ID NO: 505440 - DNA, 20 bp, Artificial
  CRISPR gRNA sequence
gcaagagtttgagaccagcc

SEQ ID NO: 505441 - DNA, 20 bp, Artificial
  CRISPR gRNA sequence
tgagaccagcctggccaaca

SEQ ID NO: 505442 - DNA, 20 bp, Artificial
  CRISPR gRNA sequence
tctactaaaaatacaaaaat

SEQ ID NO: 505443 - DNA, 20 bp, Artificial
  CRISPR gRNA sequence
taaaaatacaaaaattagcc

SEQ ID NO: 505444 - DNA, 20 bp, Artificial
  CRISPR gRNA sequence
atacaaaaattagccgagcg

SEQ ID NO: 505445 - DNA, 20 bp, Artificial
  CRISPR gRNA sequence
caaaaattagccgagcgtgg

SEQ ID NO: 505446 - DNA, 20 bp, Artificial
  CRISPR gRNA sequence
agcgtggtggcacacgcctg

SEQ ID NO: 505447 - DNA, 20 bp, Artificial
  CRISPR gRNA sequence
gtggcacacgcctgtagtcc

SEQ ID NO: 505448 - DNA, 20 bp, Artificial
  CRISPR gRNA sequence
cgcctgtagtcccagctact

SEQ ID NO: 505449 - DNA, 20 bp, Artificial
  CRISPR gRNA sequence
gcctgtagtcccagctactc

SEQ ID NO: 505450 - DNA, 20 bp, Artificial
  CRISPR gRNA sequence
ctgtagtcccagctactcag

SEQ ID NO: 505451 - DNA, 20 bp, Artificial
  CRISPR gRNA sequence
tgtagtcccagctactcagg

SEQ ID NO: 505452 - DNA, 20 bp, Artificial
  CRISPR gRNA sequence
tcccagctactcaggaggct

SEQ ID NO: 505453 - DNA, 20 bp, Artificial
  CRISPR gRNA sequence
agctactcaggaggctgagt

SEQ ID NO: 505454 - DNA, 20 bp, Artificial
  CRISPR gRNA sequence
gctactcaggaggctgagtc

SEQ ID NO: 505455 - DNA, 20 bp, Artificial
  CRISPR gRNA sequence
tactcaggaggctgagtcag

SEQ ID NO: 505456 - DNA, 20 bp, Artificial
  CRISPR gRNA sequence
gctgagtcaggagaatcact

SEQ ID NO: 505457 - DNA, 20 bp, Artificial
  CRISPR gRNA sequence
caggagaatcacttggattg

SEQ ID NO: 505458 - DNA, 20 bp, Artificial
  CRISPR gRNA sequence
agaatcacttggattgtagt

SEQ ID NO: 505459 - DNA, 20 bp, Artificial
  CRISPR gRNA sequence
cacttggattgtagtgagcc

SEQ ID NO: 505460 - DNA, 20 bp, Artificial
  CRISPR gRNA sequence
gtagtgagccaagatcgcac

SEQ ID NO: 505461 - DNA, 20 bp, Artificial
  CRISPR gRNA sequence
aagatcgcaccagtgcactc

SEQ ID NO: 505462 - DNA, 20 bp, Artificial
  CRISPR gRNA sequence
cgcaccagtgcactccagcc

SEQ ID NO: 505463 - DNA, 20 bp, Artificial
  CRISPR gRNA sequence
gcaccagtgcactccagcct

SEQ ID NO: 505464 - DNA, 20 bp, Artificial
  CRISPR gRNA sequence
gtgcactccagcctgggcga

SEQ ID NO: 505465 - DNA, 20 bp, Artificial
  CRISPR gRNA sequence
gcactccagcctgggcgaca

SEQ ID NO: 505466 - DNA, 20 bp, Artificial
  CRISPR gRNA sequence
aaaaaaaaaaaaaaaatcca

SEQ ID NO: 505467 - DNA, 20 bp, Artificial
  CRISPR gRNA sequence
aaaaaaaaaaaaaaatccac

SEQ ID NO: 505468 - DNA, 20 bp, Artificial
  CRISPR gRNA sequence
atccacaggcaacatttacc

SEQ ID NO: 505469 - DNA, 20 bp, Artificial
  CRISPR gRNA sequence
tttaccaagaaacatgtttg

SEQ ID NO: 505470 - DNA, 20 bp, Artificial
  CRISPR gRNA sequence
ttaccaagaaacatgtttga

SEQ ID NO: 505471 - DNA, 20 bp, Artificial
  CRISPR gRNA sequence
acatgtttgaaggaattcca

SEQ ID NO: 505472 - DNA, 20 bp, Artificial
  CRISPR gRNA sequence
aggaattccaaagtcatatt

SEQ ID NO: 505473 - DNA, 20 bp, Artificial
  CRISPR gRNA sequence
atattaagaaaatgcaatga

SEQ ID NO: 505474 - DNA, 20 bp, Artificial
  CRISPR gRNA sequence
taagaaaatgcaatgaaagc

SEQ ID NO: 505475 - DNA, 20 bp, Artificial
  CRISPR gRNA sequence
tcttgctgaatattatttca

SEQ ID NO: 505476 - DNA, 20 bp, Artificial
  CRISPR gRNA sequence
gctgaatattatttcacagc

SEQ ID NO: 505477 - DNA, 20 bp, Artificial
  CRISPR gRNA sequence
aacaaaaaacaaaaaacaaa

SEQ ID NO: 505478 - DNA, 20 bp, Artificial
  CRISPR gRNA sequence
aaaaagaaacaacaaatgat

SEQ ID NO: 505479 - DNA, 20 bp, Artificial
  CRISPR gRNA sequence
gataataaacttaaacctga

SEQ ID NO: 505480 - DNA, 20 bp, Artificial
  CRISPR gRNA sequence
taaacttaaacctgaaagat

SEQ ID NO: 505481 - DNA, 20 bp, Artificial
  CRISPR gRNA sequence
aacttaaacctgaaagatta

SEQ ID NO: 505482 - DNA, 20 bp, Artificial
  CRISPR gRNA sequence
ttaaacctgaaagattagag

SEQ ID NO: 505483 - DNA, 20 bp, Artificial
  CRISPR gRNA sequence
taaacctgaaagattagaga

SEQ ID NO: 505484 - DNA, 20 bp, Artificial
  CRISPR gRNA sequence
gaaagattagagaaggaact

SEQ ID NO: 505485 - DNA, 20 bp, Artificial
  CRISPR gRNA sequence
tccattcctaaccacctgtg

SEQ ID NO: 505486 - DNA, 20 bp, Artificial
  CRISPR gRNA sequence
taatgtttctgtcaaaaaaa

SEQ ID NO: 505487 - DNA, 20 bp, Artificial
  CRISPR gRNA sequence
aaaaaacagaatgaaacacg

SEQ ID NO: 505488 - DNA, 20 bp, Artificial
  CRISPR gRNA sequence
tcatgacaactaaccctacc

SEQ ID NO: 505489 - DNA, 20 bp, Artificial
  CRISPR gRNA sequence
catgacaactaaccctaccc

SEQ ID NO: 505490 - DNA, 20 bp, Artificial
  CRISPR gRNA sequence
ttgcgcctgttctgtgtgtc

SEQ ID NO: 505491 - DNA, 20 bp, Artificial
  CRISPR gRNA sequence
gtgtgtccggcgtctgcccc

SEQ ID NO: 505492 - DNA, 20 bp, Artificial
  CRISPR gRNA sequence
tgtgtccggcgtctgccccc

SEQ ID NO: 505493 - DNA, 20 bp, Artificial
  CRISPR gRNA sequence
gtgtccggcgtctgccccca

SEQ ID NO: 505494 - DNA, 20 bp, Artificial
  CRISPR gRNA sequence
tgtccggcgtctgcccccag

SEQ ID NO: 505495 - DNA, 20 bp, Artificial
  CRISPR gRNA sequence
gtccggcgtctgcccccagg

SEQ ID NO: 505496 - DNA, 20 bp, Artificial
  CRISPR gRNA sequence
gcgtctgcccccagggggcg

SEQ ID NO: 505497 - DNA, 20 bp, Artificial
  CRISPR gRNA sequence
gcagccatcactccatccct

SEQ ID NO: 505498 - DNA, 20 bp, Artificial
  CRISPR gRNA sequence
tcactccatccctcagtctg

SEQ ID NO: 505499 - DNA, 20 bp, Artificial
  CRISPR gRNA sequence
ctccatccctcagtctgcag

SEQ ID NO: 505500 - DNA, 20 bp, Artificial
  CRISPR gRNA sequence
cagtctgcagtggcctgacc

SEQ ID NO: 505501 - DNA, 20 bp, Artificial
  CRISPR gRNA sequence
agtctgcagtggcctgaccc

SEQ ID NO: 505502 - DNA, 20 bp, Artificial
  CRISPR gRNA sequence
gtctgcagtggcctgaccca

SEQ ID NO: 505503 - DNA, 20 bp, Artificial
  CRISPR gRNA sequence
agtggcctgacccagggatt

SEQ ID NO: 505504 - DNA, 20 bp, Artificial
  CRISPR gRNA sequence
gtggcctgacccagggattt

SEQ ID NO: 505505 - DNA, 20 bp, Artificial
  CRISPR gRNA sequence
tgacccagggatttgggctc

SEQ ID NO: 505506 - DNA, 20 bp, Artificial
  CRISPR gRNA sequence
gacccagggatttgggctcc

SEQ ID NO: 505507 - DNA, 20 bp, Artificial
  CRISPR gRNA sequence
gatttgggctccaggttgat

SEQ ID NO: 505508 - DNA, 20 bp, Artificial
  CRISPR gRNA sequence
ttgggctccaggttgatgag

SEQ ID NO: 505509 - DNA, 20 bp, Artificial
  CRISPR gRNA sequence
tgggctccaggttgatgagt

SEQ ID NO: 505510 - DNA, 20 bp, Artificial
  CRISPR gRNA sequence
aggttgatgagtaggactct

SEQ ID NO: 505511 - DNA, 20 bp, Artificial
  CRISPR gRNA sequence
ggttgatgagtaggactctt

SEQ ID NO: 505512 - DNA, 20 bp, Artificial
  CRISPR gRNA sequence
gttgatgagtaggactcttg

SEQ ID NO: 505513 - DNA, 20 bp, Artificial
  CRISPR gRNA sequence
ttgatgagtaggactcttgg

SEQ ID NO: 505514 - DNA, 20 bp, Artificial
  CRISPR gRNA sequence
gagtaggactcttgggggcc

SEQ ID NO: 505515 - DNA, 20 bp, Artificial
  CRISPR gRNA sequence
agtaggactcttgggggcca

SEQ ID NO: 505516 - DNA, 20 bp, Artificial
  CRISPR gRNA sequence
tgggggccaaggcgtgtgtg

SEQ ID NO: 505517 - DNA, 20 bp, Artificial
  CRISPR gRNA sequence
gcgtgtgtgaagaaccctcc

SEQ ID NO: 505518 - DNA, 20 bp, Artificial
  CRISPR gRNA sequence
cctcccagcaccctctcact

SEQ ID NO: 505519 - DNA, 20 bp, Artificial
  CRISPR gRNA sequence
cccagcaccctctcactgag

SEQ ID NO: 505520 - DNA, 20 bp, Artificial
  CRISPR gRNA sequence
ctcactgagaagcaccctct

SEQ ID NO: 505521 - DNA, 20 bp, Artificial
  CRISPR gRNA sequence
ctcactgacgttcctgacat

SEQ ID NO: 505522 - DNA, 20 bp, Artificial
  CRISPR gRNA sequence
gttcctgacatcagcttcac

SEQ ID NO: 505523 - DNA, 20 bp, Artificial
  CRISPR gRNA sequence
ttcctgacatcagcttcaca

SEQ ID NO: 505524 - DNA, 20 bp, Artificial
  CRISPR gRNA sequence
tgacatcagcttcacaagga

SEQ ID NO: 505525 - DNA, 20 bp, Artificial
  CRISPR gRNA sequence
agcttcacaaggaaagcgtc

SEQ ID NO: 505526 - DNA, 20 bp, Artificial
  CRISPR gRNA sequence
acaaggaaagcgtctggcct

SEQ ID NO: 505527 - DNA, 20 bp, Artificial
  CRISPR gRNA sequence
aggaaagcgtctggcctcgg

SEQ ID NO: 505528 - DNA, 20 bp, Artificial
  CRISPR gRNA sequence
gaaagcgtctggcctcggca

SEQ ID NO: 505529 - DNA, 20 bp, Artificial
  CRISPR gRNA sequence
aagcgtctggcctcggcaga

SEQ ID NO: 505530 - DNA, 20 bp, Artificial
  CRISPR gRNA sequence
agcgtctggcctcggcagag

SEQ ID NO: 505531 - DNA, 20 bp, Artificial
  CRISPR gRNA sequence
gcctcggcagagaggatgtg

SEQ ID NO: 505532 - DNA, 20 bp, Artificial
  CRISPR gRNA sequence
cctcggcagagaggatgtga

SEQ ID NO: 505533 - DNA, 20 bp, Artificial
  CRISPR gRNA sequence
ggcagagaggatgtgaagga

SEQ ID NO: 505534 - DNA, 20 bp, Artificial
  CRISPR gRNA sequence
gaggatgtgaaggaaagaaa

SEQ ID NO: 505535 - DNA, 20 bp, Artificial
  CRISPR gRNA sequence
aggatgtgaaggaaagaaac

SEQ ID NO: 505536 - DNA, 20 bp, Artificial
  CRISPR gRNA sequence
ggatgtgaaggaaagaaaca

SEQ ID NO: 505537 - DNA, 20 bp, Artificial
  CRISPR gRNA sequence
ggaaagaaacagggtccttc

SEQ ID NO: 505538 - DNA, 20 bp, Artificial
  CRISPR gRNA sequence
aagaaacagggtccttccag

SEQ ID NO: 505539 - DNA, 20 bp, Artificial
  CRISPR gRNA sequence
cagtggatgctgcctgctcc

SEQ ID NO: 505540 - DNA, 20 bp, Artificial
  CRISPR gRNA sequence
ggatgctgcctgctcccaga

SEQ ID NO: 505541 - DNA, 20 bp, Artificial
  CRISPR gRNA sequence
gtgcccctccctgcccccgt

SEQ ID NO: 505542 - DNA, 20 bp, Artificial
  CRISPR gRNA sequence
gcccctccctgcccccgtca

SEQ ID NO: 505543 - DNA, 20 bp, Artificial
  CRISPR gRNA sequence
ccctgcccccgtcagagtgc

SEQ ID NO: 505544 - DNA, 20 bp, Artificial
  CRISPR gRNA sequence
cctgcccccgtcagagtgct

SEQ ID NO: 505545 - DNA, 20 bp, Artificial
  CRISPR gRNA sequence
cccccgtcagagtgctggga

SEQ ID NO: 505546 - DNA, 20 bp, Artificial
  CRISPR gRNA sequence
ccccgtcagagtgctgggat

SEQ ID NO: 505547 - DNA, 20 bp, Artificial
  CRISPR gRNA sequence
cccgtcagagtgctgggatg

SEQ ID NO: 505548 - DNA, 20 bp, Artificial
  CRISPR gRNA sequence
gagtgctgggatggggaccc

SEQ ID NO: 505549 - DNA, 20 bp, Artificial
  CRISPR gRNA sequence
atggggaccctggctccttc

SEQ ID NO: 505550 - DNA, 20 bp, Artificial
  CRISPR gRNA sequence
tggctccttctggctgtccc

SEQ ID NO: 505551 - DNA, 20 bp, Artificial
  CRISPR gRNA sequence
ggctccttctggctgtcccc

SEQ ID NO: 505552 - DNA, 20 bp, Artificial
  CRISPR gRNA sequence
tggctgtccccaggacccct

SEQ ID NO: 505553 - DNA, 20 bp, Artificial
  CRISPR gRNA sequence
cccaggacccctcagtgtgc

SEQ ID NO: 505554 - DNA, 20 bp, Artificial
  CRISPR gRNA sequence
ccaggacccctcagtgtgct

SEQ ID NO: 505555 - DNA, 20 bp, Artificial
  CRISPR gRNA sequence
gacccctcagtgtgctggga

SEQ ID NO: 505556 - DNA, 20 bp, Artificial
  CRISPR gRNA sequence
acccctcagtgtgctgggat

SEQ ID NO: 505557 - DNA, 20 bp, Artificial
  CRISPR gRNA sequence
cccctcagtgtgctgggatg

SEQ ID NO: 505558 - DNA, 20 bp, Artificial
  CRISPR gRNA sequence
gtgtgctgggatggggaccc

SEQ ID NO: 505559 - DNA, 20 bp, Artificial
  CRISPR gRNA sequence
atggggaccctggctccttc

SEQ ID NO: 505560 - DNA, 20 bp, Artificial
  CRISPR gRNA sequence
tggctccttctggctgtccc

SEQ ID NO: 505561 - DNA, 20 bp, Artificial
  CRISPR gRNA sequence
gctccttctggctgtcccca

SEQ ID NO: 505562 - DNA, 20 bp, Artificial
  CRISPR gRNA sequence
tggctgtccccagagcccct

SEQ ID NO: 505563 - DNA, 20 bp, Artificial
  CRISPR gRNA sequence
tgtccccagagcccctcagc

SEQ ID NO: 505564 - DNA, 20 bp, Artificial
  CRISPR gRNA sequence
cccagagcccctcagcaagc

SEQ ID NO: 505565 - DNA, 20 bp, Artificial
  CRISPR gRNA sequence
ccagagcccctcagcaagct

SEQ ID NO: 505566 - DNA, 20 bp, Artificial
  CRISPR gRNA sequence
agcccctcagcaagctggga

SEQ ID NO: 505567 - DNA, 20 bp, Artificial
  CRISPR gRNA sequence
gcccctcagcaagctgggat

SEQ ID NO: 505568 - DNA, 20 bp, Artificial
  CRISPR gRNA sequence
cccctcagcaagctgggatg

SEQ ID NO: 505569 - DNA, 20 bp, Artificial
  CRISPR gRNA sequence
agctgggatggggacccttg

SEQ ID NO: 505570 - DNA, 20 bp, Artificial
  CRISPR gRNA sequence
gggatggggacccttgtggc

SEQ ID NO: 505571 - DNA, 20 bp, Artificial
  CRISPR gRNA sequence
ggatggggacccttgtggcc

SEQ ID NO: 505572 - DNA, 20 bp, Artificial
  CRISPR gRNA sequence
acccttgtggccaggctcac

SEQ ID NO: 505573 - DNA, 20 bp, Artificial
  CRISPR gRNA sequence
cccttgtggccaggctcacc

SEQ ID NO: 505574 - DNA, 20 bp, Artificial
  CRISPR gRNA sequence
cattgatctgcacgccatca

SEQ ID NO: 505575 - DNA, 20 bp, Artificial
  CRISPR gRNA sequence
cacgccatcacagtcacctc

SEQ ID NO: 505576 - DNA, 20 bp, Artificial
  CRISPR gRNA sequence
acgccatcacagtcacctct

SEQ ID NO: 505577 - DNA, 20 bp, Artificial
  CRISPR gRNA sequence
catcacagtcacctctgggc

SEQ ID NO: 505578 - DNA, 20 bp, Artificial
  CRISPR gRNA sequence
tgtgcgtcactccattgctg

SEQ ID NO: 505579 - DNA, 20 bp, Artificial
  CRISPR gRNA sequence
gcgtcactccattgctgcag

SEQ ID NO: 505580 - DNA, 20 bp, Artificial
  CRISPR gRNA sequence
cgtcactccattgctgcaga

SEQ ID NO: 505581 - DNA, 20 bp, Artificial
  CRISPR gRNA sequence
tcactccattgctgcagaag

SEQ ID NO: 505582 - DNA, 20 bp, Artificial
  CRISPR gRNA sequence
cattgctgcagaaggagtcg

SEQ ID NO: 505583 - DNA, 20 bp, Artificial
  CRISPR gRNA sequence
attgctgcagaaggagtcgt

SEQ ID NO: 505584 - DNA, 20 bp, Artificial
  CRISPR gRNA sequence
aaggagtcgtaggtgacttt

SEQ ID NO: 505585 - DNA, 20 bp, Artificial
  CRISPR gRNA sequence
aggagtcgtaggtgactttc

SEQ ID NO: 505586 - DNA, 20 bp, Artificial
  CRISPR gRNA sequence
ggagtcgtaggtgactttca

SEQ ID NO: 505587 - DNA, 20 bp, Artificial
  CRISPR gRNA sequence
gtaggtgactttcagggtgt

SEQ ID NO: 505588 - DNA, 20 bp, Artificial
  CRISPR gRNA sequence
taggtgactttcagggtgtc

SEQ ID NO: 505589 - DNA, 20 bp, Artificial
  CRISPR gRNA sequence
aggtgactttcagggtgtcg

SEQ ID NO: 505590 - DNA, 20 bp, Artificial
  CRISPR gRNA sequence
gtgactttcagggtgtcggg

SEQ ID NO: 505591 - DNA, 20 bp, Artificial
  CRISPR gRNA sequence
tgactttcagggtgtcgggg

SEQ ID NO: 505592 - DNA, 20 bp, Artificial
  CRISPR gRNA sequence
gactttcagggtgtcgggga

SEQ ID NO: 505593 - DNA, 20 bp, Artificial
  CRISPR gRNA sequence
tcggggagggcgttgtgatc

SEQ ID NO: 505594 - DNA, 20 bp, Artificial
  CRISPR gRNA sequence
cggggagggcgttgtgatcc

SEQ ID NO: 505595 - DNA, 20 bp, Artificial
  CRISPR gRNA sequence
ggagggcgttgtgatccagg

SEQ ID NO: 505596 - DNA, 20 bp, Artificial
  CRISPR gRNA sequence
gttgtgatccaggaagaccc

SEQ ID NO: 505597 - DNA, 20 bp, Artificial
  CRISPR gRNA sequence
tgtgatccaggaagaccctg

SEQ ID NO: 505598 - DNA, 20 bp, Artificial
  CRISPR gRNA sequence
gtgatccaggaagaccctgg

SEQ ID NO: 505599 - DNA, 20 bp, Artificial
  CRISPR gRNA sequence
gatccaggaagaccctggag

SEQ ID NO: 505600 - DNA, 20 bp, Artificial
  CRISPR gRNA sequence
tccaggaagaccctggagga

SEQ ID NO: 505601 - DNA, 20 bp, Artificial
  CRISPR gRNA sequence
accctggaggagagtttctg

SEQ ID NO: 505602 - DNA, 20 bp, Artificial
  CRISPR gRNA sequence
ccctggaggagagtttctgc

SEQ ID NO: 505603 - DNA, 20 bp, Artificial
  CRISPR gRNA sequence
tggaggagagtttctgcggg

SEQ ID NO: 505604 - DNA, 20 bp, Artificial
  CRISPR gRNA sequence
gaggagagtttctgcgggca

SEQ ID NO: 505605 - DNA, 20 bp, Artificial
  CRISPR gRNA sequence
ggagagtttctgcgggcaga

SEQ ID NO: 505606 - DNA, 20 bp, Artificial
  CRISPR gRNA sequence
gagtttctgcgggcagagag

SEQ ID NO: 505607 - DNA, 20 bp, Artificial
  CRISPR gRNA sequence
gggcagagagcggttactct

SEQ ID NO: 505608 - DNA, 20 bp, Artificial
  CRISPR gRNA sequence
ggcagagagcggttactctt

SEQ ID NO: 505609 - DNA, 20 bp, Artificial
  CRISPR gRNA sequence
gcagagagcggttactcttg

SEQ ID NO: 505610 - DNA, 20 bp, Artificial
  CRISPR gRNA sequence
cagagagcggttactcttgg

SEQ ID NO: 505611 - DNA, 20 bp, Artificial
  CRISPR gRNA sequence
gagcggttactcttgggggc

SEQ ID NO: 505612 - DNA, 20 bp, Artificial
  CRISPR gRNA sequence
ggcgagtgtttctgttgtcc

SEQ ID NO: 505613 - DNA, 20 bp, Artificial
  CRISPR gRNA sequence
tctgttgtcctggccctgcc

SEQ ID NO: 505614 - DNA, 20 bp, Artificial
  CRISPR gRNA sequence
tgtcctggccctgcctggcc

SEQ ID NO: 505615 - DNA, 20 bp, Artificial
  CRISPR gRNA sequence
cctggccctgcctggcccag

SEQ ID NO: 505616 - DNA, 20 bp, Artificial
  CRISPR gRNA sequence
ccctgcctggcccagcggtt

SEQ ID NO: 505617 - DNA, 20 bp, Artificial
  CRISPR gRNA sequence
cccgtctccacttctcctct

SEQ ID NO: 505618 - DNA, 20 bp, Artificial
  CRISPR gRNA sequence
tccacttctcctctcagtgc

SEQ ID NO: 505619 - DNA, 20 bp, Artificial
  CRISPR gRNA sequence
ctcctctcagtgcaagtccc

SEQ ID NO: 505620 - DNA, 20 bp, Artificial
  CRISPR gRNA sequence
tcagtgcaagtccccagtgt

SEQ ID NO: 505621 - DNA, 20 bp, Artificial
  CRISPR gRNA sequence
cccagtgtcagctaatgaca

SEQ ID NO: 505622 - DNA, 20 bp, Artificial
  CRISPR gRNA sequence
cagtgtcagctaatgacaca

SEQ ID NO: 505623 - DNA, 20 bp, Artificial
  CRISPR gRNA sequence
agtgtcagctaatgacacag

SEQ ID NO: 505624 - DNA, 20 bp, Artificial
  CRISPR gRNA sequence
tgtcagctaatgacacagag

SEQ ID NO: 505625 - DNA, 20 bp, Artificial
  CRISPR gRNA sequence
tcagctaatgacacagagga

SEQ ID NO: 505626 - DNA, 20 bp, Artificial
  CRISPR gRNA sequence
taatgacacagaggagagca

SEQ ID NO: 505627 - DNA, 20 bp, Artificial
  CRISPR gRNA sequence
tgacacagaggagagcacag

SEQ ID NO: 505628 - DNA, 20 bp, Artificial
  CRISPR gRNA sequence
gacacagaggagagcacagc

SEQ ID NO: 505629 - DNA, 20 bp, Artificial
  CRISPR gRNA sequence
agagcacagcaggatgtgct

SEQ ID NO: 505630 - DNA, 20 bp, Artificial
  CRISPR gRNA sequence
gagcacagcaggatgtgctg

SEQ ID NO: 505631 - DNA, 20 bp, Artificial
  CRISPR gRNA sequence
acagcaggatgtgctgagga

SEQ ID NO: 505632 - DNA, 20 bp, Artificial
  CRISPR gRNA sequence
gcaggatgtgctgaggatgg

SEQ ID NO: 505633 - DNA, 20 bp, Artificial
  CRISPR gRNA sequence
caggatgtgctgaggatggc

SEQ ID NO: 505634 - DNA, 20 bp, Artificial
  CRISPR gRNA sequence
aggatgtgctgaggatggca

SEQ ID NO: 505635 - DNA, 20 bp, Artificial
  CRISPR gRNA sequence
gctgaggatggcagggctgc

SEQ ID NO: 505636 - DNA, 20 bp, Artificial
  CRISPR gRNA sequence
ctgaggatggcagggctgcc

SEQ ID NO: 505637 - DNA, 20 bp, Artificial
  CRISPR gRNA sequence
tgaggatggcagggctgcca

SEQ ID NO: 505638 - DNA, 20 bp, Artificial
  CRISPR gRNA sequence
tggcagggctgccagggcca

SEQ ID NO: 505639 - DNA, 20 bp, Artificial
  CRISPR gRNA sequence
agggccacagtcctgccctc

SEQ ID NO: 505640 - DNA, 20 bp, Artificial
  CRISPR gRNA sequence
ccacagtcctgccctcgaga

SEQ ID NO: 505641 - DNA, 20 bp, Artificial
  CRISPR gRNA sequence
ccctcgagacagcctgacca

SEQ ID NO: 505642 - DNA, 20 bp, Artificial
  CRISPR gRNA sequence
cctcgagacagcctgaccac

SEQ ID NO: 505643 - DNA, 20 bp, Artificial
  CRISPR gRNA sequence
ctcgagacagcctgaccaca

SEQ ID NO: 505644 - DNA, 20 bp, Artificial
  CRISPR gRNA sequence
gacagcctgaccacagggac

SEQ ID NO: 505645 - DNA, 20 bp, Artificial
  CRISPR gRNA sequence
cctgaccacagggactagca

SEQ ID NO: 505646 - DNA, 20 bp, Artificial
  CRISPR gRNA sequence
tgaccacagggactagcatg

SEQ ID NO: 505647 - DNA, 20 bp, Artificial
  CRISPR gRNA sequence
cacagggactagcatggagc

SEQ ID NO: 505648 - DNA, 20 bp, Artificial
  CRISPR gRNA sequence
acagggactagcatggagcc

SEQ ID NO: 505649 - DNA, 20 bp, Artificial
  CRISPR gRNA sequence
cagggactagcatggagcca

SEQ ID NO: 505650 - DNA, 20 bp, Artificial
  CRISPR gRNA sequence
ctagcatggagccagggtgt

SEQ ID NO: 505651 - DNA, 20 bp, Artificial
  CRISPR gRNA sequence
tggagccagggtgtgagcct

SEQ ID NO: 505652 - DNA, 20 bp, Artificial
  CRISPR gRNA sequence
ggagccagggtgtgagcctc

SEQ ID NO: 505653 - DNA, 20 bp, Artificial
  CRISPR gRNA sequence
gagccagggtgtgagcctca

SEQ ID NO: 505654 - DNA, 20 bp, Artificial
  CRISPR gRNA sequence
agccagggtgtgagcctcag

SEQ ID NO: 505655 - DNA, 20 bp, Artificial
  CRISPR gRNA sequence
cagggtgtgagcctcagggg

SEQ ID NO: 505656 - DNA, 20 bp, Artificial
  CRISPR gRNA sequence
agggtgtgagcctcaggggt

SEQ ID NO: 505657 - DNA, 20 bp, Artificial
  CRISPR gRNA sequence
ggtgtgagcctcaggggtgg

SEQ ID NO: 505658 - DNA, 20 bp, Artificial
  CRISPR gRNA sequence
tgggagcttctgctgctcct

SEQ ID NO: 505659 - DNA, 20 bp, Artificial
  CRISPR gRNA sequence
ttctgctgctcctcagcctt

SEQ ID NO: 505660 - DNA, 20 bp, Artificial
  CRISPR gRNA sequence
gctcctcagccttgagtccc

SEQ ID NO: 505661 - DNA, 20 bp, Artificial
  CRISPR gRNA sequence
ctcctcagccttgagtcccc

SEQ ID NO: 505662 - DNA, 20 bp, Artificial
  CRISPR gRNA sequence
agccttgagtccccaggacc

SEQ ID NO: 505663 - DNA, 20 bp, Artificial
  CRISPR gRNA sequence
tgagtccccaggacctagca

SEQ ID NO: 505664 - DNA, 20 bp, Artificial
  CRISPR gRNA sequence
gagtccccaggacctagcac

SEQ ID NO: 505665 - DNA, 20 bp, Artificial
  CRISPR gRNA sequence
agtccccaggacctagcaca

SEQ ID NO: 505666 - DNA, 20 bp, Artificial
  CRISPR gRNA sequence
ccccaggacctagcacaggg

SEQ ID NO: 505667 - DNA, 20 bp, Artificial
  CRISPR gRNA sequence
cccaggacctagcacagggc

SEQ ID NO: 505668 - DNA, 20 bp, Artificial
  CRISPR gRNA sequence
caggacctagcacagggcag

SEQ ID NO: 505669 - DNA, 20 bp, Artificial
  CRISPR gRNA sequence
aggagctgcataaattgttc

SEQ ID NO: 505670 - DNA, 20 bp, Artificial
  CRISPR gRNA sequence
gcataaattgttcaagcgat

SEQ ID NO: 505671 - DNA, 20 bp, Artificial
  CRISPR gRNA sequence
ataaattgttcaagcgataa

SEQ ID NO: 505672 - DNA, 20 bp, Artificial
  CRISPR gRNA sequence
aaattgttcaagcgataaga

SEQ ID NO: 505673 - DNA, 20 bp, Artificial
  CRISPR gRNA sequence
tgttcaagcgataagagaga

SEQ ID NO: 505674 - DNA, 20 bp, Artificial
  CRISPR gRNA sequence
gttcaagcgataagagagat

SEQ ID NO: 505675 - DNA, 20 bp, Artificial
  CRISPR gRNA sequence
ttcaagcgataagagagatg

SEQ ID NO: 505676 - DNA, 20 bp, Artificial
  CRISPR gRNA sequence
caagcgataagagagatggg

SEQ ID NO: 505677 - DNA, 20 bp, Artificial
  CRISPR gRNA sequence
ataagagagatggggagaaa

SEQ ID NO: 505678 - DNA, 20 bp, Artificial
  CRISPR gRNA sequence
aagagagatggggagaaaca

SEQ ID NO: 505679 - DNA, 20 bp, Artificial
  CRISPR gRNA sequence
gagagatggggagaaacaga

SEQ ID NO: 505680 - DNA, 20 bp, Artificial
  CRISPR gRNA sequence
gagatggggagaaacagaga

SEQ ID NO: 505681 - DNA, 20 bp, Artificial
  CRISPR gRNA sequence
agatggggagaaacagagag

SEQ ID NO: 505682 - DNA, 20 bp, Artificial
  CRISPR gRNA sequence
tggggagaaacagagagagg

SEQ ID NO: 505683 - DNA, 20 bp, Artificial
  CRISPR gRNA sequence
gggagaaacagagagaggca

SEQ ID NO: 505684 - DNA, 20 bp, Artificial
  CRISPR gRNA sequence
gaaacagagagaggcagaga

SEQ ID NO: 505685 - DNA, 20 bp, Artificial
  CRISPR gRNA sequence
cagagagaggcagagacaga

SEQ ID NO: 505686 - DNA, 20 bp, Artificial
  CRISPR gRNA sequence
gagagaggcagagacagaca

SEQ ID NO: 505687 - DNA, 20 bp, Artificial
  CRISPR gRNA sequence
gaggcagagacagacagaga

SEQ ID NO: 505688 - DNA, 20 bp, Artificial
  CRISPR gRNA sequence
aggcagagacagacagagat

SEQ ID NO: 505689 - DNA, 20 bp, Artificial
  CRISPR gRNA sequence
cagagacagacagagatggg

SEQ ID NO: 505690 - DNA, 20 bp, Artificial
  CRISPR gRNA sequence
gagacagacagagatgggca

SEQ ID NO: 505691 - DNA, 20 bp, Artificial
  CRISPR gRNA sequence
cagacagagatgggcagagc

SEQ ID NO: 505692 - DNA, 20 bp, Artificial
  CRISPR gRNA sequence
gacagagatgggcagagcca

SEQ ID NO: 505693 - DNA, 20 bp, Artificial
  CRISPR gRNA sequence
gagatgggcagagccagagc

SEQ ID NO: 505694 - DNA, 20 bp, Artificial
  CRISPR gRNA sequence
gatgggcagagccagagcca

SEQ ID NO: 505695 - DNA, 20 bp, Artificial
  CRISPR gRNA sequence
ggcagagccagagccagaga

SEQ ID NO: 505696 - DNA, 20 bp, Artificial
  CRISPR gRNA sequence
cagagccagagccagagaca

SEQ ID NO: 505697 - DNA, 20 bp, Artificial
  CRISPR gRNA sequence
gagccagagccagagacaga

SEQ ID NO: 505698 - DNA, 20 bp, Artificial
  CRISPR gRNA sequence
cagagccagagacagagaga

SEQ ID NO: 505699 - DNA, 20 bp, Artificial
  CRISPR gRNA sequence
gagccagagacagagagatg

SEQ ID NO: 505700 - DNA, 20 bp, Artificial
  CRISPR gRNA sequence
gccagagacagagagatgga

SEQ ID NO: 505701 - DNA, 20 bp, Artificial
  CRISPR gRNA sequence
gacagagagatggagagaaa

SEQ ID NO: 505702 - DNA, 20 bp, Artificial
  CRISPR gRNA sequence
cagagagatggagagaaaca

SEQ ID NO: 505703 - DNA, 20 bp, Artificial
  CRISPR gRNA sequence
gagagatggagagaaacaga

SEQ ID NO: 505704 - DNA, 20 bp, Artificial
  CRISPR gRNA sequence
gagatggagagaaacagaga

SEQ ID NO: 505705 - DNA, 20 bp, Artificial
  CRISPR gRNA sequence
agatggagagaaacagagag

SEQ ID NO: 505706 - DNA, 20 bp, Artificial
  CRISPR gRNA sequence
tggagagaaacagagagagg

SEQ ID NO: 505707 - DNA, 20 bp, Artificial
  CRISPR gRNA sequence
gagagaaacagagagaggca

SEQ ID NO: 505708 - DNA, 20 bp, Artificial
  CRISPR gRNA sequence
gaaacagagagaggcagaga

SEQ ID NO: 505709 - DNA, 20 bp, Artificial
  CRISPR gRNA sequence
aacagagagaggcagagaca

SEQ ID NO: 505710 - DNA, 20 bp, Artificial
  CRISPR gRNA sequence
gagagaggcagagacagaga

SEQ ID NO: 505711 - DNA, 20 bp, Artificial
  CRISPR gRNA sequence
gaggcagagacagagacaga

SEQ ID NO: 505712 - DNA, 20 bp, Artificial
  CRISPR gRNA sequence
ggcagagacagagacagaca

SEQ ID NO: 505713 - DNA, 20 bp, Artificial
  CRISPR gRNA sequence
gagacagagacagacagaga

SEQ ID NO: 505714 - DNA, 20 bp, Artificial
  CRISPR gRNA sequence
agacagagacagacagagat

SEQ ID NO: 505715 - DNA, 20 bp, Artificial
  CRISPR gRNA sequence
gacagagacagacagagatg

SEQ ID NO: 505716 - DNA, 20 bp, Artificial
  CRISPR gRNA sequence
agagacagacagagatgggg

SEQ ID NO: 505717 - DNA, 20 bp, Artificial
  CRISPR gRNA sequence
agacagacagagatggggca

SEQ ID NO: 505718 - DNA, 20 bp, Artificial
  CRISPR gRNA sequence
agacagagatggggcagaga

SEQ ID NO: 505719 - DNA, 20 bp, Artificial
  CRISPR gRNA sequence
acagagatggggcagagaca

SEQ ID NO: 505720 - DNA, 20 bp, Artificial
  CRISPR gRNA sequence
agagatggggcagagacaga

SEQ ID NO: 505721 - DNA, 20 bp, Artificial
  CRISPR gRNA sequence
agatggggcagagacagaga

SEQ ID NO: 505722 - DNA, 20 bp, Artificial
  CRISPR gRNA sequence
ggggcagagacagagagaga

SEQ ID NO: 505723 - DNA, 20 bp, Artificial
  CRISPR gRNA sequence
cagagacagagagagacaga

SEQ ID NO: 505724 - DNA, 20 bp, Artificial
  CRISPR gRNA sequence
gagacagagagagacagaca

SEQ ID NO: 505725 - DNA, 20 bp, Artificial
  CRISPR gRNA sequence
gacagagagagacagacaga

SEQ ID NO: 505726 - DNA, 20 bp, Artificial
  CRISPR gRNA sequence
cagagagagacagacagaga

SEQ ID NO: 505727 - DNA, 20 bp, Artificial
  CRISPR gRNA sequence
gagagacagacagagagaga

SEQ ID NO: 505728 - DNA, 20 bp, Artificial
  CRISPR gRNA sequence
gagacagacagagagagaca

SEQ ID NO: 505729 - DNA, 20 bp, Artificial
  CRISPR gRNA sequence
cagacagagagagacagaga

SEQ ID NO: 505730 - DNA, 20 bp, Artificial
  CRISPR gRNA sequence
gacagagagagacagagaaa

SEQ ID NO: 505731 - DNA, 20 bp, Artificial
  CRISPR gRNA sequence
cagagagagacagagaaaga

SEQ ID NO: 505732 - DNA, 20 bp, Artificial
  CRISPR gRNA sequence
gagacagagaaagagagaca

SEQ ID NO: 505733 - DNA, 20 bp, Artificial
  CRISPR gRNA sequence
gagaaagagagacaaagact

SEQ ID NO: 505734 - DNA, 20 bp, Artificial
  CRISPR gRNA sequence
gaaagagagacaaagactga

SEQ ID NO: 505735 - DNA, 20 bp, Artificial
  CRISPR gRNA sequence
gagagacaaagactgagaga

SEQ ID NO: 505736 - DNA, 20 bp, Artificial
  CRISPR gRNA sequence
gacaaagactgagagacaga

SEQ ID NO: 505737 - DNA, 20 bp, Artificial
  CRISPR gRNA sequence
ctgagagacagacggaaatt

SEQ ID NO: 505738 - DNA, 20 bp, Artificial
  CRISPR gRNA sequence
gagagacagacggaaattga

SEQ ID NO: 505739 - DNA, 20 bp, Artificial
  CRISPR gRNA sequence
agagacagacggaaattgag

SEQ ID NO: 505740 - DNA, 20 bp, Artificial
  CRISPR gRNA sequence
agacagacggaaattgagag

SEQ ID NO: 505741 - DNA, 20 bp, Artificial
  CRISPR gRNA sequence
gacagacggaaattgagagg

SEQ ID NO: 505742 - DNA, 20 bp, Artificial
  CRISPR gRNA sequence
agacggaaattgagaggagg

SEQ ID NO: 505743 - DNA, 20 bp, Artificial
  CRISPR gRNA sequence
acggaaattgagaggaggca

SEQ ID NO: 505744 - DNA, 20 bp, Artificial
  CRISPR gRNA sequence
cggaaattgagaggaggcag

SEQ ID NO: 505745 - DNA, 20 bp, Artificial
  CRISPR gRNA sequence
ggaaattgagaggaggcaga

SEQ ID NO: 505746 - DNA, 20 bp, Artificial
  CRISPR gRNA sequence
attgagaggaggcagaggga

SEQ ID NO: 505747 - DNA, 20 bp, Artificial
  CRISPR gRNA sequence
ttgagaggaggcagagggac

SEQ ID NO: 505748 - DNA, 20 bp, Artificial
  CRISPR gRNA sequence
gaggcagagggacaggttca

SEQ ID NO: 505749 - DNA, 20 bp, Artificial
  CRISPR gRNA sequence
aggcagagggacaggttcat

SEQ ID NO: 505750 - DNA, 20 bp, Artificial
  CRISPR gRNA sequence
ggcagagggacaggttcata

SEQ ID NO: 505751 - DNA, 20 bp, Artificial
  CRISPR gRNA sequence
gcagagggacaggttcatag

SEQ ID NO: 505752 - DNA, 20 bp, Artificial
  CRISPR gRNA sequence
ggacaggttcataggggcat

SEQ ID NO: 505753 - DNA, 20 bp, Artificial
  CRISPR gRNA sequence
gacaggttcataggggcatc

SEQ ID NO: 505754 - DNA, 20 bp, Artificial
  CRISPR gRNA sequence
tcataggggcatcgggtgaa

SEQ ID NO: 505755 - DNA, 20 bp, Artificial
  CRISPR gRNA sequence
aggggcatcgggtgaatggc

SEQ ID NO: 505756 - DNA, 20 bp, Artificial
  CRISPR gRNA sequence
ggggcatcgggtgaatggcc

SEQ ID NO: 505757 - DNA, 20 bp, Artificial
  CRISPR gRNA sequence
gggcatcgggtgaatggcca

SEQ ID NO: 505758 - DNA, 20 bp, Artificial
  CRISPR gRNA sequence
catcgggtgaatggccaggg

SEQ ID NO: 505759 - DNA, 20 bp, Artificial
  CRISPR gRNA sequence
cgggtgaatggccagggcag

SEQ ID NO: 505760 - DNA, 20 bp, Artificial
  CRISPR gRNA sequence
gtcacctgcatcctctgtgt

SEQ ID NO: 505761 - DNA, 20 bp, Artificial
  CRISPR gRNA sequence
tcacctgcatcctctgtgta

SEQ ID NO: 505762 - DNA, 20 bp, Artificial
  CRISPR gRNA sequence
ctgcatcctctgtgtaagga

SEQ ID NO: 505763 - DNA, 20 bp, Artificial
  CRISPR gRNA sequence
gtgtaaggacagaaacacct

SEQ ID NO: 505764 - DNA, 20 bp, Artificial
  CRISPR gRNA sequence
tgtaaggacagaaacacctc

SEQ ID NO: 505765 - DNA, 20 bp, Artificial
  CRISPR gRNA sequence
aaggacagaaacacctcggg

SEQ ID NO: 505766 - DNA, 20 bp, Artificial
  CRISPR gRNA sequence
gacagaaacacctcgggcag

SEQ ID NO: 505767 - DNA, 20 bp, Artificial
  CRISPR gRNA sequence
gaaacacctcgggcagtggc

SEQ ID NO: 505768 - DNA, 20 bp, Artificial
  CRISPR gRNA sequence
ctcgggcagtggctggcacc

SEQ ID NO: 505769 - DNA, 20 bp, Artificial
  CRISPR gRNA sequence
tcgggcagtggctggcaccc

SEQ ID NO: 505770 - DNA, 20 bp, Artificial
  CRISPR gRNA sequence
gggcagtggctggcacccag

SEQ ID NO: 505771 - DNA, 20 bp, Artificial
  CRISPR gRNA sequence
ggcagtggctggcacccagg

SEQ ID NO: 505772 - DNA, 20 bp, Artificial
  CRISPR gRNA sequence
gcagtggctggcacccagga

SEQ ID NO: 505773 - DNA, 20 bp, Artificial
  CRISPR gRNA sequence
gcacccaggagggtctgctc

SEQ ID NO: 505774 - DNA, 20 bp, Artificial
  CRISPR gRNA sequence
cacccaggagggtctgctct

SEQ ID NO: 505775 - DNA, 20 bp, Artificial
  CRISPR gRNA sequence
acccaggagggtctgctctg

SEQ ID NO: 505776 - DNA, 20 bp, Artificial
  CRISPR gRNA sequence
cccaggagggtctgctctgg

SEQ ID NO: 505777 - DNA, 20 bp, Artificial
  CRISPR gRNA sequence
gagggtctgctctgggggtt

SEQ ID NO: 505778 - DNA, 20 bp, Artificial
  CRISPR gRNA sequence
agggtctgctctgggggttt

SEQ ID NO: 505779 - DNA, 20 bp, Artificial
  CRISPR gRNA sequence
gggtctgctctgggggtttg

SEQ ID NO: 505780 - DNA, 20 bp, Artificial
  CRISPR gRNA sequence
ctctgggggtttggggctca

SEQ ID NO: 505781 - DNA, 20 bp, Artificial
  CRISPR gRNA sequence
tctgggggtttggggctcac

SEQ ID NO: 505782 - DNA, 20 bp, Artificial
  CRISPR gRNA sequence
tgggggtttggggctcacgg

SEQ ID NO: 505783 - DNA, 20 bp, Artificial
  CRISPR gRNA sequence
gggggtttggggctcacggg

SEQ ID NO: 505784 - DNA, 20 bp, Artificial
  CRISPR gRNA sequence
tggggctcacgggaggctac

SEQ ID NO: 505785 - DNA, 20 bp, Artificial
  CRISPR gRNA sequence
ggctcacgggaggctacgag

SEQ ID NO: 505786 - DNA, 20 bp, Artificial
  CRISPR gRNA sequence
gggaggctacgagaagcaaa

SEQ ID NO: 505787 - DNA, 20 bp, Artificial
  CRISPR gRNA sequence
agcaaatggcacctcctcca

SEQ ID NO: 505788 - DNA, 20 bp, Artificial
  CRISPR gRNA sequence
gcaaatggcacctcctccac

SEQ ID NO: 505789 - DNA, 20 bp, Artificial
  CRISPR gRNA sequence
gcacctcctccacgggcctt

SEQ ID NO: 505790 - DNA, 20 bp, Artificial
  CRISPR gRNA sequence
ttcaatgacccaacgtttgt

SEQ ID NO: 505791 - DNA, 20 bp, Artificial
  CRISPR gRNA sequence
caatgacccaacgtttgtcg

SEQ ID NO: 505792 - DNA, 20 bp, Artificial
  CRISPR gRNA sequence
aatgacccaacgtttgtcgg

SEQ ID NO: 505793 - DNA, 20 bp, Artificial
  CRISPR gRNA sequence
gtcggaggcgctaacgtgct

SEQ ID NO: 505794 - DNA, 20 bp, Artificial
  CRISPR gRNA sequence
ctaacgtgctgagctccctc

SEQ ID NO: 505795 - DNA, 20 bp, Artificial
  CRISPR gRNA sequence
cgtgctgagctccctcaagc

SEQ ID NO: 505796 - DNA, 20 bp, Artificial
  CRISPR gRNA sequence
gctgagctccctcaagccag

SEQ ID NO: 505797 - DNA, 20 bp, Artificial
  CRISPR gRNA sequence
ctgagctccctcaagccagc

SEQ ID NO: 505798 - DNA, 20 bp, Artificial
  CRISPR gRNA sequence
cctcaagccagcaggacctt

SEQ ID NO: 505799 - DNA, 20 bp, Artificial
  CRISPR gRNA sequence
agccagcaggacctttggcc

SEQ ID NO: 505800 - DNA, 20 bp, Artificial
  CRISPR gRNA sequence
cagcaggacctttggcctag

SEQ ID NO: 505801 - DNA, 20 bp, Artificial
  CRISPR gRNA sequence
agcaggacctttggcctaga

SEQ ID NO: 505802 - DNA, 20 bp, Artificial
  CRISPR gRNA sequence
acctttggcctagaaggatc

SEQ ID NO: 505803 - DNA, 20 bp, Artificial
  CRISPR gRNA sequence
cctttggcctagaaggatcc

SEQ ID NO: 505804 - DNA, 20 bp, Artificial
  CRISPR gRNA sequence
tggcctagaaggatccaggc

SEQ ID NO: 505805 - DNA, 20 bp, Artificial
  CRISPR gRNA sequence
aggatccaggccagaattct

SEQ ID NO: 505806 - DNA, 20 bp, Artificial
  CRISPR gRNA sequence
ttctgagaacatctctcacc

SEQ ID NO: 505807 - DNA, 20 bp, Artificial
  CRISPR gRNA sequence
tctgagaacatctctcacct

SEQ ID NO: 505808 - DNA, 20 bp, Artificial
  CRISPR gRNA sequence
ctgagaacatctctcacctg

SEQ ID NO: 505809 - DNA, 20 bp, Artificial
  CRISPR gRNA sequence
tgagaacatctctcacctgg

SEQ ID NO: 505810 - DNA, 20 bp, Artificial
  CRISPR gRNA sequence
gaacatctctcacctggggg

SEQ ID NO: 505811 - DNA, 20 bp, Artificial
  CRISPR gRNA sequence
ctcacctgggggtagatttc

SEQ ID NO: 505812 - DNA, 20 bp, Artificial
  CRISPR gRNA sequence
cacctgggggtagatttcca

SEQ ID NO: 505813 - DNA, 20 bp, Artificial
  CRISPR gRNA sequence
ctgggggtagatttccagag

SEQ ID NO: 505814 - DNA, 20 bp, Artificial
  CRISPR gRNA sequence
gggtagatttccagagcagt

SEQ ID NO: 505815 - DNA, 20 bp, Artificial
  CRISPR gRNA sequence
ggtagatttccagagcagtc

SEQ ID NO: 505816 - DNA, 20 bp, Artificial
  CRISPR gRNA sequence
tccagagcagtcgggacctc

SEQ ID NO: 505817 - DNA, 20 bp, Artificial
  CRISPR gRNA sequence
cagtcgggacctctggtgcc

SEQ ID NO: 505818 - DNA, 20 bp, Artificial
  CRISPR gRNA sequence
agtcgggacctctggtgcct

SEQ ID NO: 505819 - DNA, 20 bp, Artificial
  CRISPR gRNA sequence
gtcgggacctctggtgcctg

SEQ ID NO: 505820 - DNA, 20 bp, Artificial
  CRISPR gRNA sequence
ctggtgcctggggccctgaa

SEQ ID NO: 505821 - DNA, 20 bp, Artificial
  CRISPR gRNA sequence
ctggggccctgaatggcacc

SEQ ID NO: 505822 - DNA, 20 bp, Artificial
  CRISPR gRNA sequence
ctatgcctacctatgcccac

SEQ ID NO: 505823 - DNA, 20 bp, Artificial
  CRISPR gRNA sequence
tatgcctacctatgcccacc

SEQ ID NO: 505824 - DNA, 20 bp, Artificial
  CRISPR gRNA sequence
atgcctacctatgcccacca

SEQ ID NO: 505825 - DNA, 20 bp, Artificial
  CRISPR gRNA sequence
acctatgcccaccagggcca

SEQ ID NO: 505826 - DNA, 20 bp, Artificial
  CRISPR gRNA sequence
cctatgcccaccagggccat

SEQ ID NO: 505827 - DNA, 20 bp, Artificial
  CRISPR gRNA sequence
caccagggccatgggctccc

SEQ ID NO: 505828 - DNA, 20 bp, Artificial
  CRISPR gRNA sequence
accagggccatgggctcccc

SEQ ID NO: 505829 - DNA, 20 bp, Artificial
  CRISPR gRNA sequence
ccagggccatgggctcccca

SEQ ID NO: 505830 - DNA, 20 bp, Artificial
  CRISPR gRNA sequence
cagggccatgggctccccag

SEQ ID NO: 505831 - DNA, 20 bp, Artificial
  CRISPR gRNA sequence
gggccatgggctccccaggg

SEQ ID NO: 505832 - DNA, 20 bp, Artificial
  CRISPR gRNA sequence
ccatgggctccccaggggag

SEQ ID NO: 505833 - DNA, 20 bp, Artificial
  CRISPR gRNA sequence
ggctccccaggggagcagcc

SEQ ID NO: 505834 - DNA, 20 bp, Artificial
  CRISPR gRNA sequence
gctccccaggggagcagccc

SEQ ID NO: 505835 - DNA, 20 bp, Artificial
  CRISPR gRNA sequence
ctccccaggggagcagccca

SEQ ID NO: 505836 - DNA, 20 bp, Artificial
  CRISPR gRNA sequence
caggggagcagcccagggtg

SEQ ID NO: 505837 - DNA, 20 bp, Artificial
  CRISPR gRNA sequence
cagcccagggtgcagctcga

SEQ ID NO: 505838 - DNA, 20 bp, Artificial
  CRISPR gRNA sequence
agcccagggtgcagctcgat

SEQ ID NO: 505839 - DNA, 20 bp, Artificial
  CRISPR gRNA sequence
cagctcgatgggccgtgcac

SEQ ID NO: 505840 - DNA, 20 bp, Artificial
  CRISPR gRNA sequence
agctcgatgggccgtgcacc

SEQ ID NO: 505841 - DNA, 20 bp, Artificial
  CRISPR gRNA sequence
gctcgatgggccgtgcacca

SEQ ID NO: 505842 - DNA, 20 bp, Artificial
  CRISPR gRNA sequence
tcgatgggccgtgcaccagg

SEQ ID NO: 505843 - DNA, 20 bp, Artificial
  CRISPR gRNA sequence
ccgtgcaccagggagaaatt

SEQ ID NO: 505844 - DNA, 20 bp, Artificial
  CRISPR gRNA sequence
cgtgcaccagggagaaattc

SEQ ID NO: 505845 - DNA, 20 bp, Artificial
  CRISPR gRNA sequence
gtgcaccagggagaaattca

SEQ ID NO: 505846 - DNA, 20 bp, Artificial
  CRISPR gRNA sequence
tgcaccagggagaaattcag

SEQ ID NO: 505847 - DNA, 20 bp, Artificial
  CRISPR gRNA sequence
cagggagaaattcaggggtt

SEQ ID NO: 505848 - DNA, 20 bp, Artificial
  CRISPR gRNA sequence
agggagaaattcaggggtta

SEQ ID NO: 505849 - DNA, 20 bp, Artificial
  CRISPR gRNA sequence
gggagaaattcaggggttaa

SEQ ID NO: 505850 - DNA, 20 bp, Artificial
  CRISPR gRNA sequence
tcaggggttaagggcttctc

SEQ ID NO: 505851 - DNA, 20 bp, Artificial
  CRISPR gRNA sequence
aggggttaagggcttctctg

SEQ ID NO: 505852 - DNA, 20 bp, Artificial
  CRISPR gRNA sequence
gggcttctctggagcttgcc

SEQ ID NO: 505853 - DNA, 20 bp, Artificial
  CRISPR gRNA sequence
ggcttctctggagcttgccc

SEQ ID NO: 505854 - DNA, 20 bp, Artificial
  CRISPR gRNA sequence
tctctggagcttgcccagga

SEQ ID NO: 505855 - DNA, 20 bp, Artificial
  CRISPR gRNA sequence
ctctggagcttgcccaggac

SEQ ID NO: 505856 - DNA, 20 bp, Artificial
  CRISPR gRNA sequence
gcttgcccaggacaggtgaa

SEQ ID NO: 505857 - DNA, 20 bp, Artificial
  CRISPR gRNA sequence
ttgcccaggacaggtgaaca

SEQ ID NO: 505858 - DNA, 20 bp, Artificial
  CRISPR gRNA sequence
ccaggacaggtgaacagagc

SEQ ID NO: 505859 - DNA, 20 bp, Artificial
  CRISPR gRNA sequence
aggacaggtgaacagagcaa

SEQ ID NO: 505860 - DNA, 20 bp, Artificial
  CRISPR gRNA sequence
ggacaggtgaacagagcaag

SEQ ID NO: 505861 - DNA, 20 bp, Artificial
  CRISPR gRNA sequence
gcaagaggaattccaccccc

SEQ ID NO: 505862 - DNA, 20 bp, Artificial
  CRISPR gRNA sequence
caagaggaattccacccccc

SEQ ID NO: 505863 - DNA, 20 bp, Artificial
  CRISPR gRNA sequence
aagaggaattccacccccca

SEQ ID NO: 505864 - DNA, 20 bp, Artificial
  CRISPR gRNA sequence
caccccccagggtgtcttcc

SEQ ID NO: 505865 - DNA, 20 bp, Artificial
  CRISPR gRNA sequence
accccccagggtgtcttccc

SEQ ID NO: 505866 - DNA, 20 bp, Artificial
  CRISPR gRNA sequence
ccccccagggtgtcttccca

SEQ ID NO: 505867 - DNA, 20 bp, Artificial
  CRISPR gRNA sequence
agggtgtcttcccagggccc

SEQ ID NO: 505868 - DNA, 20 bp, Artificial
  CRISPR gRNA sequence
cccagggcccaagtccactg

SEQ ID NO: 505869 - DNA, 20 bp, Artificial
  CRISPR gRNA sequence
ccagggcccaagtccactgt

SEQ ID NO: 505870 - DNA, 20 bp, Artificial
  CRISPR gRNA sequence
cagggcccaagtccactgtg

SEQ ID NO: 505871 - DNA, 20 bp, Artificial
  CRISPR gRNA sequence
agggcccaagtccactgtgg

SEQ ID NO: 505872 - DNA, 20 bp, Artificial
  CRISPR gRNA sequence
tccactgtgggggtttcctg

SEQ ID NO: 505873 - DNA, 20 bp, Artificial
  CRISPR gRNA sequence
cctgtggcctcctcctgccc

SEQ ID NO: 505874 - DNA, 20 bp, Artificial
  CRISPR gRNA sequence
ccagctgcactgtttgccac

SEQ ID NO: 505875 - DNA, 20 bp, Artificial
  CRISPR gRNA sequence
agctgcactgtttgccacca

SEQ ID NO: 505876 - DNA, 20 bp, Artificial
  CRISPR gRNA sequence
ctgtccacctcccttctcca

SEQ ID NO: 505877 - DNA, 20 bp, Artificial
  CRISPR gRNA sequence
gtccacctcccttctccata

SEQ ID NO: 505878 - DNA, 20 bp, Artificial
  CRISPR gRNA sequence
cccttctccatagagacccg

SEQ ID NO: 505879 - DNA, 20 bp, Artificial
  CRISPR gRNA sequence
cttctccatagagacccgca

SEQ ID NO: 505880 - DNA, 20 bp, Artificial
  CRISPR gRNA sequence
ctccatagagacccgcagag

SEQ ID NO: 505881 - DNA, 20 bp, Artificial
  CRISPR gRNA sequence
ccatagagacccgcagagaa

SEQ ID NO: 505882 - DNA, 20 bp, Artificial
  CRISPR gRNA sequence
gagacccgcagagaagagtc

SEQ ID NO: 505883 - DNA, 20 bp, Artificial
  CRISPR gRNA sequence
gcagagaagagtctggaatg

SEQ ID NO: 505884 - DNA, 20 bp, Artificial
  CRISPR gRNA sequence
agagaagagtctggaatgaa

SEQ ID NO: 505885 - DNA, 20 bp, Artificial
  CRISPR gRNA sequence
agagtctggaatgaagagtc

SEQ ID NO: 505886 - DNA, 20 bp, Artificial
  CRISPR gRNA sequence
agtctggaatgaagagtccg

SEQ ID NO: 505887 - DNA, 20 bp, Artificial
  CRISPR gRNA sequence
ggaatgaagagtccggagct

SEQ ID NO: 505888 - DNA, 20 bp, Artificial
  CRISPR gRNA sequence
gaatgaagagtccggagctc

SEQ ID NO: 505889 - DNA, 20 bp, Artificial
  CRISPR gRNA sequence
agagtccggagctcaggttt

SEQ ID NO: 505890 - DNA, 20 bp, Artificial
  CRISPR gRNA sequence
gagtccggagctcaggtttc

SEQ ID NO: 505891 - DNA, 20 bp, Artificial
  CRISPR gRNA sequence
agtccggagctcaggtttca

SEQ ID NO: 505892 - DNA, 20 bp, Artificial
  CRISPR gRNA sequence
tccggagctcaggtttcagg

SEQ ID NO: 505893 - DNA, 20 bp, Artificial
  CRISPR gRNA sequence
gcatcgcccacaacatcaac

SEQ ID NO: 505894 - DNA, 20 bp, Artificial
  CRISPR gRNA sequence
atcgcccacaacatcaacga

SEQ ID NO: 505895 - DNA, 20 bp, Artificial
  CRISPR gRNA sequence
cgcccacaacatcaacgaga

SEQ ID NO: 505896 - DNA, 20 bp, Artificial
  CRISPR gRNA sequence
gcccacaacatcaacgagag

SEQ ID NO: 505897 - DNA, 20 bp, Artificial
  CRISPR gRNA sequence
aacatcaacgagagaggacc

SEQ ID NO: 505898 - DNA, 20 bp, Artificial
  CRISPR gRNA sequence
catcaacgagagaggaccca

SEQ ID NO: 505899 - DNA, 20 bp, Artificial
  CRISPR gRNA sequence
agaggacccagagctccccg

SEQ ID NO: 505900 - DNA, 20 bp, Artificial
  CRISPR gRNA sequence
ggacccagagctccccgtgg

SEQ ID NO: 505901 - DNA, 20 bp, Artificial
  CRISPR gRNA sequence
agagctccccgtggaagtgc

SEQ ID NO: 505902 - DNA, 20 bp, Artificial
  CRISPR gRNA sequence
gagctccccgtggaagtgcc

SEQ ID NO: 505903 - DNA, 20 bp, Artificial
  CRISPR gRNA sequence
tccccgtggaagtgccgggc

SEQ ID NO: 505904 - DNA, 20 bp, Artificial
  CRISPR gRNA sequence
ccccgtggaagtgccgggcc

SEQ ID NO: 505905 - DNA, 20 bp, Artificial
  CRISPR gRNA sequence
cccgtggaagtgccgggcca

SEQ ID NO: 505906 - DNA, 20 bp, Artificial
  CRISPR gRNA sequence
agtgccgggccagggtgtcc

SEQ ID NO: 505907 - DNA, 20 bp, Artificial
  CRISPR gRNA sequence
tgccgggccagggtgtcctg

SEQ ID NO: 505908 - DNA, 20 bp, Artificial
  CRISPR gRNA sequence
gccgggccagggtgtcctgg

SEQ ID NO: 505909 - DNA, 20 bp, Artificial
  CRISPR gRNA sequence
ccagggtgtcctggaggcct

SEQ ID NO: 505910 - DNA, 20 bp, Artificial
  CRISPR gRNA sequence
cagggtgtcctggaggcctg

SEQ ID NO: 505911 - DNA, 20 bp, Artificial
  CRISPR gRNA sequence
agggtgtcctggaggcctga

SEQ ID NO: 505912 - DNA, 20 bp, Artificial
  CRISPR gRNA sequence
gtgtcctggaggcctgaggg

SEQ ID NO: 505913 - DNA, 20 bp, Artificial
  CRISPR gRNA sequence
tgtcctggaggcctgagggc

SEQ ID NO: 505914 - DNA, 20 bp, Artificial
  CRISPR gRNA sequence
ctggaggcctgagggcaggt

SEQ ID NO: 505915 - DNA, 20 bp, Artificial
  CRISPR gRNA sequence
tggaggcctgagggcaggtc

SEQ ID NO: 505916 - DNA, 20 bp, Artificial
  CRISPR gRNA sequence
gaggcctgagggcaggtcgg

SEQ ID NO: 505917 - DNA, 20 bp, Artificial
  CRISPR gRNA sequence
aggcctgagggcaggtcggg

SEQ ID NO: 505918 - DNA, 20 bp, Artificial
  CRISPR gRNA sequence
gagggcaggtcgggaggctg

SEQ ID NO: 505919 - DNA, 20 bp, Artificial
  CRISPR gRNA sequence
gcaggtcgggaggctgcagc

SEQ ID NO: 505920 - DNA, 20 bp, Artificial
  CRISPR gRNA sequence
gggaggctgcagctggccca

SEQ ID NO: 505921 - DNA, 20 bp, Artificial
  CRISPR gRNA sequence
ggaggctgcagctggcccac

SEQ ID NO: 505922 - DNA, 20 bp, Artificial
  CRISPR gRNA sequence
gaggctgcagctggcccacg

SEQ ID NO: 505923 - DNA, 20 bp, Artificial
  CRISPR gRNA sequence
gctgcagctggcccacgggg

SEQ ID NO: 505924 - DNA, 20 bp, Artificial
  CRISPR gRNA sequence
ctgcagctggcccacggggc

SEQ ID NO: 505925 - DNA, 20 bp, Artificial
  CRISPR gRNA sequence
tgcagctggcccacggggca

SEQ ID NO: 505926 - DNA, 20 bp, Artificial
  CRISPR gRNA sequence
gcagctggcccacggggcag

SEQ ID NO: 505927 - DNA, 20 bp, Artificial
  CRISPR gRNA sequence
cggggcaggggctttcctcc

SEQ ID NO: 505928 - DNA, 20 bp, Artificial
  CRISPR gRNA sequence
accaccctcctgctgacctg

SEQ ID NO: 505929 - DNA, 20 bp, Artificial
  CRISPR gRNA sequence
accctcctgctgacctgcag

SEQ ID NO: 505930 - DNA, 20 bp, Artificial
  CRISPR gRNA sequence
ccctcctgctgacctgcagc

SEQ ID NO: 505931 - DNA, 20 bp, Artificial
  CRISPR gRNA sequence
ctcctgctgacctgcagcag

SEQ ID NO: 505932 - DNA, 20 bp, Artificial
  CRISPR gRNA sequence
ctgcagcaggagctgacctg

SEQ ID NO: 505933 - DNA, 20 bp, Artificial
  CRISPR gRNA sequence
cagcaggagctgacctgcag

SEQ ID NO: 505934 - DNA, 20 bp, Artificial
  CRISPR gRNA sequence
agcaggagctgacctgcagt

SEQ ID NO: 505935 - DNA, 20 bp, Artificial
  CRISPR gRNA sequence
gcaggagctgacctgcagtg

SEQ ID NO: 505936 - DNA, 20 bp, Artificial
  CRISPR gRNA sequence
aggagctgacctgcagtggg

SEQ ID NO: 505937 - DNA, 20 bp, Artificial
  CRISPR gRNA sequence
acctgcagtggggagattgc

SEQ ID NO: 505938 - DNA, 20 bp, Artificial
  CRISPR gRNA sequence
ggagattgctggccacccca

SEQ ID NO: 505939 - DNA, 20 bp, Artificial
  CRISPR gRNA sequence
gagattgctggccaccccat

SEQ ID NO: 505940 - DNA, 20 bp, Artificial
  CRISPR gRNA sequence
gctggccaccccatgggtcc

SEQ ID NO: 505941 - DNA, 20 bp, Artificial
  CRISPR gRNA sequence
ccaccccatgggtcccagct

SEQ ID NO: 505942 - DNA, 20 bp, Artificial
  CRISPR gRNA sequence
ccccatgggtcccagctgag

SEQ ID NO: 505943 - DNA, 20 bp, Artificial
  CRISPR gRNA sequence
tgggtcccagctgagtggtg

SEQ ID NO: 505944 - DNA, 20 bp, Artificial
  CRISPR gRNA sequence
gggtcccagctgagtggtgc

SEQ ID NO: 505945 - DNA, 20 bp, Artificial
  CRISPR gRNA sequence
gtcccagctgagtggtgcgg

SEQ ID NO: 505946 - DNA, 20 bp, Artificial
  CRISPR gRNA sequence
gtgcgggagactcacattgt

SEQ ID NO: 505947 - DNA, 20 bp, Artificial
  CRISPR gRNA sequence
acattgtaagcattcttaat

SEQ ID NO: 505948 - DNA, 20 bp, Artificial
  CRISPR gRNA sequence
tgtaagcattcttaatgaga

SEQ ID NO: 505949 - DNA, 20 bp, Artificial
  CRISPR gRNA sequence
aatgagatggaccacattgc

SEQ ID NO: 505950 - DNA, 20 bp, Artificial
  CRISPR gRNA sequence
tgagatggaccacattgctg

SEQ ID NO: 505951 - DNA, 20 bp, Artificial
  CRISPR gRNA sequence
gaccacattgctggagtcct

SEQ ID NO: 505952 - DNA, 20 bp, Artificial
  CRISPR gRNA sequence
acattgctggagtcctcaga

SEQ ID NO: 505953 - DNA, 20 bp, Artificial
  CRISPR gRNA sequence
gtcctcagacagctccccca

SEQ ID NO: 505954 - DNA, 20 bp, Artificial
  CRISPR gRNA sequence
cagctcccccacggctgact

SEQ ID NO: 505955 - DNA, 20 bp, Artificial
  CRISPR gRNA sequence
agctcccccacggctgactt

SEQ ID NO: 505956 - DNA, 20 bp, Artificial
  CRISPR gRNA sequence
gctcccccacggctgacttg

SEQ ID NO: 505957 - DNA, 20 bp, Artificial
  CRISPR gRNA sequence
ggctgacttggggatgatct

SEQ ID NO: 505958 - DNA, 20 bp, Artificial
  CRISPR gRNA sequence
gacttggggatgatctcggt

SEQ ID NO: 505959 - DNA, 20 bp, Artificial
  CRISPR gRNA sequence
tgatctcggtgagtttctgt

SEQ ID NO: 505960 - DNA, 20 bp, Artificial
  CRISPR gRNA sequence
gatctcggtgagtttctgtt

SEQ ID NO: 505961 - DNA, 20 bp, Artificial
  CRISPR gRNA sequence
tcggtgagtttctgttgggc

SEQ ID NO: 505962 - DNA, 20 bp, Artificial
  CRISPR gRNA sequence
gtgagtttctgttgggcaag

SEQ ID NO: 505963 - DNA, 20 bp, Artificial
  CRISPR gRNA sequence
tttctgttgggcaagaagac

SEQ ID NO: 505964 - DNA, 20 bp, Artificial
  CRISPR gRNA sequence
ttgggcaagaagaccagaca

SEQ ID NO: 505965 - DNA, 20 bp, Artificial
  CRISPR gRNA sequence
caagaagaccagacatggca

SEQ ID NO: 505966 - DNA, 20 bp, Artificial
  CRISPR gRNA sequence
aagaccagacatggcacggc

SEQ ID NO: 505967 - DNA, 20 bp, Artificial
  CRISPR gRNA sequence
agaccagacatggcacggct

SEQ ID NO: 505968 - DNA, 20 bp, Artificial
  CRISPR gRNA sequence
cacggctaggacctgtgcca

SEQ ID NO: 505969 - DNA, 20 bp, Artificial
  CRISPR gRNA sequence
gccacggcatctccacgcac

SEQ ID NO: 505970 - DNA, 20 bp, Artificial
  CRISPR gRNA sequence
ccacggcatctccacgcact

SEQ ID NO: 505971 - DNA, 20 bp, Artificial
  CRISPR gRNA sequence
tccacgcactgggctcaccc

SEQ ID NO: 505972 - DNA, 20 bp, Artificial
  CRISPR gRNA sequence
ccacgcactgggctcacccc

SEQ ID NO: 505973 - DNA, 20 bp, Artificial
  CRISPR gRNA sequence
cacgcactgggctcacccca

SEQ ID NO: 505974 - DNA, 20 bp, Artificial
  CRISPR gRNA sequence
acgcactgggctcaccccag

SEQ ID NO: 505975 - DNA, 20 bp, Artificial
  CRISPR gRNA sequence
gggcttctgcacctgcaaaa

SEQ ID NO: 505976 - DNA, 20 bp, Artificial
  CRISPR gRNA sequence
ttctgcacctgcaaaatggc

SEQ ID NO: 505977 - DNA, 20 bp, Artificial
  CRISPR gRNA sequence
tctgcacctgcaaaatggct

SEQ ID NO: 505978 - DNA, 20 bp, Artificial
  CRISPR gRNA sequence
cacctgcaaaatggctggga

SEQ ID NO: 505979 - DNA, 20 bp, Artificial
  CRISPR gRNA sequence
ggctgggacggtcctcaacg

SEQ ID NO: 505980 - DNA, 20 bp, Artificial
  CRISPR gRNA sequence
cctcaacgcagttttgcact

SEQ ID NO: 505981 - DNA, 20 bp, Artificial
  CRISPR gRNA sequence
gcagttttgcacttggtccc

SEQ ID NO: 505982 - DNA, 20 bp, Artificial
  CRISPR gRNA sequence
agttttgcacttggtcccca

SEQ ID NO: 505983 - DNA, 20 bp, Artificial
  CRISPR gRNA sequence
cacttggtccccagagtgtg

SEQ ID NO: 505984 - DNA, 20 bp, Artificial
  CRISPR gRNA sequence
tggtccccagagtgtgtggt

SEQ ID NO: 505985 - DNA, 20 bp, Artificial
  CRISPR gRNA sequence
agtgtgtggtcagtgatgtg

SEQ ID NO: 505986 - DNA, 20 bp, Artificial
  CRISPR gRNA sequence
tgtggtcagtgatgtgtggt

SEQ ID NO: 505987 - DNA, 20 bp, Artificial
  CRISPR gRNA sequence
tggtcagtgatgtgtggtaa

SEQ ID NO: 505988 - DNA, 20 bp, Artificial
  CRISPR gRNA sequence
ggtcagtgatgtgtggtaag

SEQ ID NO: 505989 - DNA, 20 bp, Artificial
  CRISPR gRNA sequence
gatgtgtggtaagaggttct

SEQ ID NO: 505990 - DNA, 20 bp, Artificial
  CRISPR gRNA sequence
atgtgtggtaagaggttctt

SEQ ID NO: 505991 - DNA, 20 bp, Artificial
  CRISPR gRNA sequence
tgtgtggtaagaggttcttg

SEQ ID NO: 505992 - DNA, 20 bp, Artificial
  CRISPR gRNA sequence
gtgtggtaagaggttcttgg

SEQ ID NO: 505993 - DNA, 20 bp, Artificial
  CRISPR gRNA sequence
aagaggttcttgggggtaaa

SEQ ID NO: 505994 - DNA, 20 bp, Artificial
  CRISPR gRNA sequence
tcttgggggtaaaaagccct

SEQ ID NO: 505995 - DNA, 20 bp, Artificial
  CRISPR gRNA sequence
gtaaaaagccctgagctgcc

SEQ ID NO: 505996 - DNA, 20 bp, Artificial
  CRISPR gRNA sequence
taaaaagccctgagctgccc

SEQ ID NO: 505997 - DNA, 20 bp, Artificial
  CRISPR gRNA sequence
aaaaagccctgagctgccca

SEQ ID NO: 505998 - DNA, 20 bp, Artificial
  CRISPR gRNA sequence
aaaagccctgagctgcccag

SEQ ID NO: 505999 - DNA, 20 bp, Artificial
  CRISPR gRNA sequence
agctgcccaggggccacgcc

SEQ ID NO: 506000 - DNA, 20 bp, Artificial
  CRISPR gRNA sequence
aggggccacgcctggaatac

SEQ ID NO: 506001 - DNA, 20 bp, Artificial
  CRISPR gRNA sequence
acgcctggaataccagtact

SEQ ID NO: 506002 - DNA, 20 bp, Artificial
  CRISPR gRNA sequence
cgcctggaataccagtactc

SEQ ID NO: 506003 - DNA, 20 bp, Artificial
  CRISPR gRNA sequence
cctggaataccagtactcgg

SEQ ID NO: 506004 - DNA, 20 bp, Artificial
  CRISPR gRNA sequence
ctggaataccagtactcggg

SEQ ID NO: 506005 - DNA, 20 bp, Artificial
  CRISPR gRNA sequence
cagtactcgggaggccgatg

SEQ ID NO: 506006 - DNA, 20 bp, Artificial
  CRISPR gRNA sequence
agtactcgggaggccgatgt

SEQ ID NO: 506007 - DNA, 20 bp, Artificial
  CRISPR gRNA sequence
actcgggaggccgatgtggg

SEQ ID NO: 506008 - DNA, 20 bp, Artificial
  CRISPR gRNA sequence
ccgatgtgggaagattgcct

SEQ ID NO: 506009 - DNA, 20 bp, Artificial
  CRISPR gRNA sequence
gtgggaagattgcctgagcc

SEQ ID NO: 506010 - DNA, 20 bp, Artificial
  CRISPR gRNA sequence
tgggaagattgcctgagccc

SEQ ID NO: 506011 - DNA, 20 bp, Artificial
  CRISPR gRNA sequence
ggaagattgcctgagcccag

SEQ ID NO: 506012 - DNA, 20 bp, Artificial
  CRISPR gRNA sequence
attgcctgagcccaggagtt

SEQ ID NO: 506013 - DNA, 20 bp, Artificial
  CRISPR gRNA sequence
ttgcctgagcccaggagttc

SEQ ID NO: 506014 - DNA, 20 bp, Artificial
  CRISPR gRNA sequence
tgagcccaggagttcaggac

SEQ ID NO: 506015 - DNA, 20 bp, Artificial
  CRISPR gRNA sequence
ccaggagttcaggaccagcc

SEQ ID NO: 506016 - DNA, 20 bp, Artificial
  CRISPR gRNA sequence
caggagttcaggaccagcct

SEQ ID NO: 506017 - DNA, 20 bp, Artificial
  CRISPR gRNA sequence
aggaccagcctgggcaacat

SEQ ID NO: 506018 - DNA, 20 bp, Artificial
  CRISPR gRNA sequence
accagcctgggcaacataag

SEQ ID NO: 506019 - DNA, 20 bp, Artificial
  CRISPR gRNA sequence
gaagaccccatctctacaaa

SEQ ID NO: 506020 - DNA, 20 bp, Artificial
  CRISPR gRNA sequence
tctacaaaaagtacaaatat

SEQ ID NO: 506021 - DNA, 20 bp, Artificial
  CRISPR gRNA sequence
tacaaaaagtacaaatatta

SEQ ID NO: 506022 - DNA, 20 bp, Artificial
  CRISPR gRNA sequence
aaaaagtacaaatattagag

SEQ ID NO: 506023 - DNA, 20 bp, Artificial
  CRISPR gRNA sequence
gtacaaatattagagtggtg

SEQ ID NO: 506024 - DNA, 20 bp, Artificial
  CRISPR gRNA sequence
ggtgtggcgtcacatgcctg

SEQ ID NO: 506025 - DNA, 20 bp, Artificial
  CRISPR gRNA sequence
gcgtcacatgcctgtagtac

SEQ ID NO: 506026 - DNA, 20 bp, Artificial
  CRISPR gRNA sequence
tgcctgtagtaccagatact

SEQ ID NO: 506027 - DNA, 20 bp, Artificial
  CRISPR gRNA sequence
gcctgtagtaccagatactc

SEQ ID NO: 506028 - DNA, 20 bp, Artificial
  CRISPR gRNA sequence
ctgtagtaccagatactcgg

SEQ ID NO: 506029 - DNA, 20 bp, Artificial
  CRISPR gRNA sequence
tgtagtaccagatactcggg

SEQ ID NO: 506030 - DNA, 20 bp, Artificial
  CRISPR gRNA sequence
taccagatactcgggaggct

SEQ ID NO: 506031 - DNA, 20 bp, Artificial
  CRISPR gRNA sequence
accagatactcgggaggctg

SEQ ID NO: 506032 - DNA, 20 bp, Artificial
  CRISPR gRNA sequence
agatactcgggaggctgagg

SEQ ID NO: 506033 - DNA, 20 bp, Artificial
  CRISPR gRNA sequence
gatactcgggaggctgaggc

SEQ ID NO: 506034 - DNA, 20 bp, Artificial
  CRISPR gRNA sequence
tactcgggaggctgaggcag

SEQ ID NO: 506035 - DNA, 20 bp, Artificial
  CRISPR gRNA sequence
actcgggaggctgaggcagg

SEQ ID NO: 506036 - DNA, 20 bp, Artificial
  CRISPR gRNA sequence
gcaggaggatcacttaaacc

SEQ ID NO: 506037 - DNA, 20 bp, Artificial
  CRISPR gRNA sequence
caggaggatcacttaaaccc

SEQ ID NO: 506038 - DNA, 20 bp, Artificial
  CRISPR gRNA sequence
ggaggatcacttaaacccag

SEQ ID NO: 506039 - DNA, 20 bp, Artificial
  CRISPR gRNA sequence
gaggatcacttaaacccagg

SEQ ID NO: 506040 - DNA, 20 bp, Artificial
  CRISPR gRNA sequence
gatcacttaaacccaggagg

SEQ ID NO: 506041 - DNA, 20 bp, Artificial
  CRISPR gRNA sequence
tcacttaaacccaggaggtg

SEQ ID NO: 506042 - DNA, 20 bp, Artificial
  CRISPR gRNA sequence
cacttaaacccaggaggtgg

SEQ ID NO: 506043 - DNA, 20 bp, Artificial
  CRISPR gRNA sequence
aacccaggaggtggaggttg

SEQ ID NO: 506044 - DNA, 20 bp, Artificial
  CRISPR gRNA sequence
caggaggtggaggttgcagt

SEQ ID NO: 506045 - DNA, 20 bp, Artificial
  CRISPR gRNA sequence
ggtggaggttgcagtgagct

SEQ ID NO: 506046 - DNA, 20 bp, Artificial
  CRISPR gRNA sequence
gagatcgcaccactgcactc

SEQ ID NO: 506047 - DNA, 20 bp, Artificial
  CRISPR gRNA sequence
cgcaccactgcactccagcc

SEQ ID NO: 506048 - DNA, 20 bp, Artificial
  CRISPR gRNA sequence
gcaccactgcactccagcct

SEQ ID NO: 506049 - DNA, 20 bp, Artificial
  CRISPR gRNA sequence
ctgcactccagcctgggcga

SEQ ID NO: 506050 - DNA, 20 bp, Artificial
  CRISPR gRNA sequence
gcactccagcctgggcgaca

SEQ ID NO: 506051 - DNA, 20 bp, Artificial
  CRISPR gRNA sequence
tccagcctgggcgacagagc

SEQ ID NO: 506052 - DNA, 20 bp, Artificial
  CRISPR gRNA sequence
aaaacaaaacaaaaaaaacc

SEQ ID NO: 506053 - DNA, 20 bp, Artificial
  CRISPR gRNA sequence
aaacaaaacaaaaaaaaccc

SEQ ID NO: 506054 - DNA, 20 bp, Artificial
  CRISPR gRNA sequence
aaaacaaaaaaaacccaggc

SEQ ID NO: 506055 - DNA, 20 bp, Artificial
  CRISPR gRNA sequence
aaacaaaaaaaacccaggcc

SEQ ID NO: 506056 - DNA, 20 bp, Artificial
  CRISPR gRNA sequence
aaaacccaggccaggcatga

SEQ ID NO: 506057 - DNA, 20 bp, Artificial
  CRISPR gRNA sequence
atggctcacgcctgtgatcc

SEQ ID NO: 506058 - DNA, 20 bp, Artificial
  CRISPR gRNA sequence
cgcctgtgatcccagcactt

SEQ ID NO: 506059 - DNA, 20 bp, Artificial
  CRISPR gRNA sequence
gcctgtgatcccagcacttt

SEQ ID NO: 506060 - DNA, 20 bp, Artificial
  CRISPR gRNA sequence
ctgtgatcccagcactttgg

SEQ ID NO: 506061 - DNA, 20 bp, Artificial
  CRISPR gRNA sequence
tgtgatcccagcactttggg

SEQ ID NO: 506062 - DNA, 20 bp, Artificial
  CRISPR gRNA sequence
cccagcactttgggaggcca

SEQ ID NO: 506063 - DNA, 20 bp, Artificial
  CRISPR gRNA sequence
agcactttgggaggccaaag

SEQ ID NO: 506064 - DNA, 20 bp, Artificial
  CRISPR gRNA sequence
gcactttgggaggccaaagt

SEQ ID NO: 506065 - DNA, 20 bp, Artificial
  CRISPR gRNA sequence
ctttgggaggccaaagtggg

SEQ ID NO: 506066 - DNA, 20 bp, Artificial
  CRISPR gRNA sequence
gccaaagtgggtggatcact

SEQ ID NO: 506067 - DNA, 20 bp, Artificial
  CRISPR gRNA sequence
ccaaagtgggtggatcactg

SEQ ID NO: 506068 - DNA, 20 bp, Artificial
  CRISPR gRNA sequence
agtgggtggatcactgaggt

SEQ ID NO: 506069 - DNA, 20 bp, Artificial
  CRISPR gRNA sequence
gtgggtggatcactgaggtc

SEQ ID NO: 506070 - DNA, 20 bp, Artificial
  CRISPR gRNA sequence
gggtggatcactgaggtcag

SEQ ID NO: 506071 - DNA, 20 bp, Artificial
  CRISPR gRNA sequence
atcactgaggtcaggagttt

SEQ ID NO: 506072 - DNA, 20 bp, Artificial
  CRISPR gRNA sequence
tgaggtcaggagtttgagac

SEQ ID NO: 506073 - DNA, 20 bp, Artificial
  CRISPR gRNA sequence
tcaggagtttgagaccagcc

SEQ ID NO: 506074 - DNA, 20 bp, Artificial
  CRISPR gRNA sequence
tgagaccagcctggccaaca

SEQ ID NO: 506075 - DNA, 20 bp, Artificial
  CRISPR gRNA sequence
tctactaaaaatacaaaaat

SEQ ID NO: 506076 - DNA, 20 bp, Artificial
  CRISPR gRNA sequence
ctaaaaatacaaaaattagc

SEQ ID NO: 506077 - DNA, 20 bp, Artificial
  CRISPR gRNA sequence
taaaaatacaaaaattagct

SEQ ID NO: 506078 - DNA, 20 bp, Artificial
  CRISPR gRNA sequence
atacaaaaattagctgggcg

SEQ ID NO: 506079 - DNA, 20 bp, Artificial
  CRISPR gRNA sequence
caaaaattagctgggcgtgg

SEQ ID NO: 506080 - DNA, 20 bp, Artificial
  CRISPR gRNA sequence
aaattagctgggcgtggtgg

SEQ ID NO: 506081 - DNA, 20 bp, Artificial
  CRISPR gRNA sequence
aattagctgggcgtggtggt

SEQ ID NO: 506082 - DNA, 20 bp, Artificial
  CRISPR gRNA sequence
gcgtggtggtgggcacctgt

SEQ ID NO: 506083 - DNA, 20 bp, Artificial
  CRISPR gRNA sequence
gtggtgggcacctgtaagcc

SEQ ID NO: 506084 - DNA, 20 bp, Artificial
  CRISPR gRNA sequence
cacctgtaagcccagctact

SEQ ID NO: 506085 - DNA, 20 bp, Artificial
  CRISPR gRNA sequence
acctgtaagcccagctactc

SEQ ID NO: 506086 - DNA, 20 bp, Artificial
  CRISPR gRNA sequence
ctgtaagcccagctactcag

SEQ ID NO: 506087 - DNA, 20 bp, Artificial
  CRISPR gRNA sequence
gcccagctactcaggagact

SEQ ID NO: 506088 - DNA, 20 bp, Artificial
  CRISPR gRNA sequence
cccagctactcaggagactg

SEQ ID NO: 506089 - DNA, 20 bp, Artificial
  CRISPR gRNA sequence
agctactcaggagactgagg

SEQ ID NO: 506090 - DNA, 20 bp, Artificial
  CRISPR gRNA sequence
gctactcaggagactgaggc

SEQ ID NO: 506091 - DNA, 20 bp, Artificial
  CRISPR gRNA sequence
tactcaggagactgaggcag

SEQ ID NO: 506092 - DNA, 20 bp, Artificial
  CRISPR gRNA sequence
gagactgaggcaggagaacc

SEQ ID NO: 506093 - DNA, 20 bp, Artificial
  CRISPR gRNA sequence
agactgaggcaggagaaccc

SEQ ID NO: 506094 - DNA, 20 bp, Artificial
  CRISPR gRNA sequence
actgaggcaggagaacccag

SEQ ID NO: 506095 - DNA, 20 bp, Artificial
  CRISPR gRNA sequence
ctgaggcaggagaacccagg

SEQ ID NO: 506096 - DNA, 20 bp, Artificial
  CRISPR gRNA sequence
aggcaggagaacccaggagg

SEQ ID NO: 506097 - DNA, 20 bp, Artificial
  CRISPR gRNA sequence
gcaggagaacccaggaggcg

SEQ ID NO: 506098 - DNA, 20 bp, Artificial
  CRISPR gRNA sequence
caggagaacccaggaggcgg

SEQ ID NO: 506099 - DNA, 20 bp, Artificial
  CRISPR gRNA sequence
caggaggcggaggtcgcaat

SEQ ID NO: 506100 - DNA, 20 bp, Artificial
  CRISPR gRNA sequence
ggcggaggtcgcaatgagct

SEQ ID NO: 506101 - DNA, 20 bp, Artificial
  CRISPR gRNA sequence
aatgagctgagatcacacca

SEQ ID NO: 506102 - DNA, 20 bp, Artificial
  CRISPR gRNA sequence
gagatcacaccatggcactc

SEQ ID NO: 506103 - DNA, 20 bp, Artificial
  CRISPR gRNA sequence
cacaccatggcactccagcc

SEQ ID NO: 506104 - DNA, 20 bp, Artificial
  CRISPR gRNA sequence
acaccatggcactccagcct

SEQ ID NO: 506105 - DNA, 20 bp, Artificial
  CRISPR gRNA sequence
ggcactccagcctgggcaac

SEQ ID NO: 506106 - DNA, 20 bp, Artificial
  CRISPR gRNA sequence
cactccagcctgggcaacaa

SEQ ID NO: 506107 - DNA, 20 bp, Artificial
  CRISPR gRNA sequence
aaaaattactgttgcatcat

SEQ ID NO: 506108 - DNA, 20 bp, Artificial
  CRISPR gRNA sequence
aaaattactgttgcatcatg

SEQ ID NO: 506109 - DNA, 20 bp, Artificial
  CRISPR gRNA sequence
tactgttgcatcatgaggat

SEQ ID NO: 506110 - DNA, 20 bp, Artificial
  CRISPR gRNA sequence
ttgcatcatgaggataagaa

SEQ ID NO: 506111 - DNA, 20 bp, Artificial
  CRISPR gRNA sequence
atcatgaggataagaaaaga

SEQ ID NO: 506112 - DNA, 20 bp, Artificial
  CRISPR gRNA sequence
gaggataagaaaagaaagca

SEQ ID NO: 506113 - DNA, 20 bp, Artificial
  CRISPR gRNA sequence
agaaaagaaagcaaagccct

SEQ ID NO: 506114 - DNA, 20 bp, Artificial
  CRISPR gRNA sequence
gaaagcaaagccctgagctg

SEQ ID NO: 506115 - DNA, 20 bp, Artificial
  CRISPR gRNA sequence
ccctgagctgcagcattgtc

SEQ ID NO: 506116 - DNA, 20 bp, Artificial
  CRISPR gRNA sequence
cctgagctgcagcattgtcc

SEQ ID NO: 506117 - DNA, 20 bp, Artificial
  CRISPR gRNA sequence
ttgtccaggcctgcccgtgt

SEQ ID NO: 506118 - DNA, 20 bp, Artificial
  CRISPR gRNA sequence
cgtgtgagtcctcctgcctg

SEQ ID NO: 506119 - DNA, 20 bp, Artificial
  CRISPR gRNA sequence
agtcctcctgcctgcggtgt

SEQ ID NO: 506120 - DNA, 20 bp, Artificial
  CRISPR gRNA sequence
ggtgtgagtgatcccgcctg

SEQ ID NO: 506121 - DNA, 20 bp, Artificial
  CRISPR gRNA sequence
agtgatcccgcctgcggtgt

SEQ ID NO: 506122 - DNA, 20 bp, Artificial
  CRISPR gRNA sequence
ggtgtgagtgctcccgcctg

SEQ ID NO: 506123 - DNA, 20 bp, Artificial
  CRISPR gRNA sequence
agtgctcccgcctgcggtgt

SEQ ID NO: 506124 - DNA, 20 bp, Artificial
  CRISPR gRNA sequence
ggtgtgagtgatcccgcctg

SEQ ID NO: 506125 - DNA, 20 bp, Artificial
  CRISPR gRNA sequence
agtgatcccgcctgcagtgt

SEQ ID NO: 506126 - DNA, 20 bp, Artificial
  CRISPR gRNA sequence
agtgtgagtgatcctgcctg

SEQ ID NO: 506127 - DNA, 20 bp, Artificial
  CRISPR gRNA sequence
ggtgtgactgctcccgcctg

SEQ ID NO: 506128 - DNA, 20 bp, Artificial
  CRISPR gRNA sequence
actgctcccgcctgtggtgt

SEQ ID NO: 506129 - DNA, 20 bp, Artificial
  CRISPR gRNA sequence
ggtgtgagtactcctgcctg

SEQ ID NO: 506130 - DNA, 20 bp, Artificial
  CRISPR gRNA sequence
agtactcctgcctgtggtgt

SEQ ID NO: 506131 - DNA, 20 bp, Artificial
  CRISPR gRNA sequence
gtggtgtgagtgatcctgcc

SEQ ID NO: 506132 - DNA, 20 bp, Artificial
  CRISPR gRNA sequence
gtgtgagtgatcctgcctgg

SEQ ID NO: 506133 - DNA, 20 bp, Artificial
  CRISPR gRNA sequence
gatcctgcctggtggatttc

SEQ ID NO: 506134 - DNA, 20 bp, Artificial
  CRISPR gRNA sequence
tttcaagctcgcaatatcac

SEQ ID NO: 506135 - DNA, 20 bp, Artificial
  CRISPR gRNA sequence
ttcaagctcgcaatatcact

SEQ ID NO: 506136 - DNA, 20 bp, Artificial
  CRISPR gRNA sequence
agctcgcaatatcactgggt

SEQ ID NO: 506137 - DNA, 20 bp, Artificial
  CRISPR gRNA sequence
gctcgcaatatcactgggtt

SEQ ID NO: 506138 - DNA, 20 bp, Artificial
  CRISPR gRNA sequence
tcgcaatatcactgggttgg

SEQ ID NO: 506139 - DNA, 20 bp, Artificial
  CRISPR gRNA sequence
cgcaatatcactgggttggg

SEQ ID NO: 506140 - DNA, 20 bp, Artificial
  CRISPR gRNA sequence
ctgggttgggaggacgtgca

SEQ ID NO: 506141 - DNA, 20 bp, Artificial
  CRISPR gRNA sequence
ggttgggaggacgtgcatgg

SEQ ID NO: 506142 - DNA, 20 bp, Artificial
  CRISPR gRNA sequence
gggaggacgtgcatggtggc

SEQ ID NO: 506143 - DNA, 20 bp, Artificial
  CRISPR gRNA sequence
acgtgcatggtggccagtgt

SEQ ID NO: 506144 - DNA, 20 bp, Artificial
  CRISPR gRNA sequence
gcatggtggccagtgttggc

SEQ ID NO: 506145 - DNA, 20 bp, Artificial
  CRISPR gRNA sequence
tggccagaatttccaccaca

SEQ ID NO: 506146 - DNA, 20 bp, Artificial
  CRISPR gRNA sequence
ggccagaatttccaccacac

SEQ ID NO: 506147 - DNA, 20 bp, Artificial
  CRISPR gRNA sequence
cagaatttccaccacacagg

SEQ ID NO: 506148 - DNA, 20 bp, Artificial
  CRISPR gRNA sequence
agaatttccaccacacaggt

SEQ ID NO: 506149 - DNA, 20 bp, Artificial
  CRISPR gRNA sequence
gaatttccaccacacaggta

SEQ ID NO: 506150 - DNA, 20 bp, Artificial
  CRISPR gRNA sequence
agggaattcctaccaccaca

SEQ ID NO: 506151 - DNA, 20 bp, Artificial
  CRISPR gRNA sequence
aattcctaccaccacacaga

SEQ ID NO: 506152 - DNA, 20 bp, Artificial
  CRISPR gRNA sequence
tcctaccaccacacagatgg

SEQ ID NO: 506153 - DNA, 20 bp, Artificial
  CRISPR gRNA sequence
cctaccaccacacagatggt

SEQ ID NO: 506154 - DNA, 20 bp, Artificial
  CRISPR gRNA sequence
accaccacacagatggtagg

SEQ ID NO: 506155 - DNA, 20 bp, Artificial
  CRISPR gRNA sequence
accacacagatggtaggcgg

SEQ ID NO: 506156 - DNA, 20 bp, Artificial
  CRISPR gRNA sequence
acacagatggtaggcggaag

SEQ ID NO: 506157 - DNA, 20 bp, Artificial
  CRISPR gRNA sequence
gtaggcggaagtagccccac

SEQ ID NO: 506158 - DNA, 20 bp, Artificial
  CRISPR gRNA sequence
taggcggaagtagccccacg

SEQ ID NO: 506159 - DNA, 20 bp, Artificial
  CRISPR gRNA sequence
aggcggaagtagccccacga

SEQ ID NO: 506160 - DNA, 20 bp, Artificial
  CRISPR gRNA sequence
cggaagtagccccacgaggg

SEQ ID NO: 506161 - DNA, 20 bp, Artificial
  CRISPR gRNA sequence
agccccacgagggtggatca

SEQ ID NO: 506162 - DNA, 20 bp, Artificial
  CRISPR gRNA sequence
gtggatcacagtaaaatcac

SEQ ID NO: 506163 - DNA, 20 bp, Artificial
  CRISPR gRNA sequence
tggatcacagtaaaatcacc

SEQ ID NO: 506164 - DNA, 20 bp, Artificial
  CRISPR gRNA sequence
atcacagtaaaatcaccagg

SEQ ID NO: 506165 - DNA, 20 bp, Artificial
  CRISPR gRNA sequence
taaaatcaccaggaagccat

SEQ ID NO: 506166 - DNA, 20 bp, Artificial
  CRISPR gRNA sequence
accaggaagccatcggctct

SEQ ID NO: 506167 - DNA, 20 bp, Artificial
  CRISPR gRNA sequence
tcggctcttggcactctact

SEQ ID NO: 506168 - DNA, 20 bp, Artificial
  CRISPR gRNA sequence
ggcactctactgagtttcca

SEQ ID NO: 506169 - DNA, 20 bp, Artificial
  CRISPR gRNA sequence
gcactctactgagtttccat

SEQ ID NO: 506170 - DNA, 20 bp, Artificial
  CRISPR gRNA sequence
gagtttccatgggtgttaaa

SEQ ID NO: 506171 - DNA, 20 bp, Artificial
  CRISPR gRNA sequence
tccatgggtgttaaacagcc

SEQ ID NO: 506172 - DNA, 20 bp, Artificial
  CRISPR gRNA sequence
gttaaacagcccggtgacat

SEQ ID NO: 506173 - DNA, 20 bp, Artificial
  CRISPR gRNA sequence
cagcccggtgacatcggttc

SEQ ID NO: 506174 - DNA, 20 bp, Artificial
  CRISPR gRNA sequence
ccggtgacatcggttctggc

SEQ ID NO: 506175 - DNA, 20 bp, Artificial
  CRISPR gRNA sequence
tgacatcggttctggccggc

SEQ ID NO: 506176 - DNA, 20 bp, Artificial
  CRISPR gRNA sequence
gttctggccggccagatgca

SEQ ID NO: 506177 - DNA, 20 bp, Artificial
  CRISPR gRNA sequence
ttctggccggccagatgcac

SEQ ID NO: 506178 - DNA, 20 bp, Artificial
  CRISPR gRNA sequence
tctggccggccagatgcaca

SEQ ID NO: 506179 - DNA, 20 bp, Artificial
  CRISPR gRNA sequence
ctggccggccagatgcacag

SEQ ID NO: 506180 - DNA, 20 bp, Artificial
  CRISPR gRNA sequence
cggccagatgcacaggggcg

SEQ ID NO: 506181 - DNA, 20 bp, Artificial
  CRISPR gRNA sequence
cagatgcacaggggcgcagc

SEQ ID NO: 506182 - DNA, 20 bp, Artificial
  CRISPR gRNA sequence
cccccatgctcacacatgct

SEQ ID NO: 506183 - DNA, 20 bp, Artificial
  CRISPR gRNA sequence
cacatgctcagcttctttca

SEQ ID NO: 506184 - DNA, 20 bp, Artificial
  CRISPR gRNA sequence
atgctcagcttctttcatgg

SEQ ID NO: 506185 - DNA, 20 bp, Artificial
  CRISPR gRNA sequence
gcttctttcatggaagattg

SEQ ID NO: 506186 - DNA, 20 bp, Artificial
  CRISPR gRNA sequence
tgcggcatcatttcaccttc

SEQ ID NO: 506187 - DNA, 20 bp, Artificial
  CRISPR gRNA sequence
gcggcatcatttcaccttcc

SEQ ID NO: 506188 - DNA, 20 bp, Artificial
  CRISPR gRNA sequence
catttcaccttccaggaaca

SEQ ID NO: 506189 - DNA, 20 bp, Artificial
  CRISPR gRNA sequence
tttcaccttccaggaacacg

SEQ ID NO: 506190 - DNA, 20 bp, Artificial
  CRISPR gRNA sequence
caccttccaggaacacggag

SEQ ID NO: 506191 - DNA, 20 bp, Artificial
  CRISPR gRNA sequence
ttccaggaacacggagcaga

SEQ ID NO: 506192 - DNA, 20 bp, Artificial
  CRISPR gRNA sequence
aggaacacggagcagatggt

SEQ ID NO: 506193 - DNA, 20 bp, Artificial
  CRISPR gRNA sequence
ggaacacggagcagatggtc

SEQ ID NO: 506194 - DNA, 20 bp, Artificial
  CRISPR gRNA sequence
cctcccatgactgccctgca

SEQ ID NO: 506195 - DNA, 20 bp, Artificial
  CRISPR gRNA sequence
ctcccatgactgccctgcat

SEQ ID NO: 506196 - DNA, 20 bp, Artificial
  CRISPR gRNA sequence
atgactgccctgcatgggcc

SEQ ID NO: 506197 - DNA, 20 bp, Artificial
  CRISPR gRNA sequence
catgggcccagtcccttcca

SEQ ID NO: 506198 - DNA, 20 bp, Artificial
  CRISPR gRNA sequence
tgggcccagtcccttccatg

SEQ ID NO: 506199 - DNA, 20 bp, Artificial
  CRISPR gRNA sequence
agtcccttccatggagctcc

SEQ ID NO: 506200 - DNA, 20 bp, Artificial
  CRISPR gRNA sequence
gtcccttccatggagctcct

SEQ ID NO: 506201 - DNA, 20 bp, Artificial
  CRISPR gRNA sequence
tcccttccatggagctcctg

SEQ ID NO: 506202 - DNA, 20 bp, Artificial
  CRISPR gRNA sequence
ttccatggagctcctggggc

SEQ ID NO: 506203 - DNA, 20 bp, Artificial
  CRISPR gRNA sequence
ggagctcctggggccggtca

SEQ ID NO: 506204 - DNA, 20 bp, Artificial
  CRISPR gRNA sequence
tcctggggccggtcacagcc

SEQ ID NO: 506205 - DNA, 20 bp, Artificial
  CRISPR gRNA sequence
ccgcccacttccatccgtcc

SEQ ID NO: 506206 - DNA, 20 bp, Artificial
  CRISPR gRNA sequence
cacttccatccgtcccagtc

SEQ ID NO: 506207 - DNA, 20 bp, Artificial
  CRISPR gRNA sequence
acttccatccgtcccagtct

SEQ ID NO: 506208 - DNA, 20 bp, Artificial
  CRISPR gRNA sequence
cttccatccgtcccagtctg

SEQ ID NO: 506209 - DNA, 20 bp, Artificial
  CRISPR gRNA sequence
gtctggggccatccctgtct

SEQ ID NO: 506210 - DNA, 20 bp, Artificial
  CRISPR gRNA sequence
tctggggccatccctgtctt

SEQ ID NO: 506211 - DNA, 20 bp, Artificial
  CRISPR gRNA sequence
tggggccatccctgtcttgg

SEQ ID NO: 506212 - DNA, 20 bp, Artificial
  CRISPR gRNA sequence
gggccatccctgtcttggga

SEQ ID NO: 506213 - DNA, 20 bp, Artificial
  CRISPR gRNA sequence
catccctgtcttgggagagc

SEQ ID NO: 506214 - DNA, 20 bp, Artificial
  CRISPR gRNA sequence
atccctgtcttgggagagct

SEQ ID NO: 506215 - DNA, 20 bp, Artificial
  CRISPR gRNA sequence
ctcccacatcctgtcctgct

SEQ ID NO: 506216 - DNA, 20 bp, Artificial
  CRISPR gRNA sequence
tgctgagcctgctgtgcgct

SEQ ID NO: 506217 - DNA, 20 bp, Artificial
  CRISPR gRNA sequence
agcctgctgtgcgcttggtg

SEQ ID NO: 506218 - DNA, 20 bp, Artificial
  CRISPR gRNA sequence
gcttggtgcagaaacacact

SEQ ID NO: 506219 - DNA, 20 bp, Artificial
  CRISPR gRNA sequence
ttggtgcagaaacacactcg

SEQ ID NO: 506220 - DNA, 20 bp, Artificial
  CRISPR gRNA sequence
tggtgcagaaacacactcgg

SEQ ID NO: 506221 - DNA, 20 bp, Artificial
  CRISPR gRNA sequence
ggtgcagaaacacactcgga

SEQ ID NO: 506222 - DNA, 20 bp, Artificial
  CRISPR gRNA sequence
gtgcagaaacacactcggag

SEQ ID NO: 506223 - DNA, 20 bp, Artificial
  CRISPR gRNA sequence
tgcagaaacacactcggagg

SEQ ID NO: 506224 - DNA, 20 bp, Artificial
  CRISPR gRNA sequence
aaacacactcggagggggcg

SEQ ID NO: 506225 - DNA, 20 bp, Artificial
  CRISPR gRNA sequence
tgttgccttgaccacccccg

SEQ ID NO: 506226 - DNA, 20 bp, Artificial
  CRISPR gRNA sequence
gttgccttgaccacccccga

SEQ ID NO: 506227 - DNA, 20 bp, Artificial
  CRISPR gRNA sequence
tgaccacccccgaaggtgac

SEQ ID NO: 506228 - DNA, 20 bp, Artificial
  CRISPR gRNA sequence
gaccacccccgaaggtgacc

SEQ ID NO: 506229 - DNA, 20 bp, Artificial
  CRISPR gRNA sequence
acccccgaaggtgaccagga

SEQ ID NO: 506230 - DNA, 20 bp, Artificial
  CRISPR gRNA sequence
cccccgaaggtgaccaggaa

SEQ ID NO: 506231 - DNA, 20 bp, Artificial
  CRISPR gRNA sequence
gaaggtgaccaggaaaggct

SEQ ID NO: 506232 - DNA, 20 bp, Artificial
  CRISPR gRNA sequence
aaggtgaccaggaaaggctg

SEQ ID NO: 506233 - DNA, 20 bp, Artificial
  CRISPR gRNA sequence
gtgaccaggaaaggctgagg

SEQ ID NO: 506234 - DNA, 20 bp, Artificial
  CRISPR gRNA sequence
tgaccaggaaaggctgagga

SEQ ID NO: 506235 - DNA, 20 bp, Artificial
  CRISPR gRNA sequence
gaggaaggcttgtgtgcccc

SEQ ID NO: 506236 - DNA, 20 bp, Artificial
  CRISPR gRNA sequence
aggaaggcttgtgtgcccca

SEQ ID NO: 506237 - DNA, 20 bp, Artificial
  CRISPR gRNA sequence
ggcttgtgtgccccaaggct

SEQ ID NO: 506238 - DNA, 20 bp, Artificial
  CRISPR gRNA sequence
ttgtgtgccccaaggctcag

SEQ ID NO: 506239 - DNA, 20 bp, Artificial
  CRISPR gRNA sequence
tgtgccccaaggctcagcag

SEQ ID NO: 506240 - DNA, 20 bp, Artificial
  CRISPR gRNA sequence
gtgccccaaggctcagcagt

SEQ ID NO: 506241 - DNA, 20 bp, Artificial
  CRISPR gRNA sequence
ccaaggctcagcagtaggca

SEQ ID NO: 506242 - DNA, 20 bp, Artificial
  CRISPR gRNA sequence
caaggctcagcagtaggcat

SEQ ID NO: 506243 - DNA, 20 bp, Artificial
  CRISPR gRNA sequence
aaggctcagcagtaggcatg

SEQ ID NO: 506244 - DNA, 20 bp, Artificial
  CRISPR gRNA sequence
gggtgcactctacctgcctc

SEQ ID NO: 506245 - DNA, 20 bp, Artificial
  CRISPR gRNA sequence
ctctacctgcctccagtgcc

SEQ ID NO: 506246 - DNA, 20 bp, Artificial
  CRISPR gRNA sequence
ctgcctccagtgcctggccc

SEQ ID NO: 506247 - DNA, 20 bp, Artificial
  CRISPR gRNA sequence
cctggtgccacaccatcgcc

SEQ ID NO: 506248 - DNA, 20 bp, Artificial
  CRISPR gRNA sequence
tggtgccacaccatcgcctg

SEQ ID NO: 506249 - DNA, 20 bp, Artificial
  CRISPR gRNA sequence
ccacaccatcgcctggagtc

SEQ ID NO: 506250 - DNA, 20 bp, Artificial
  CRISPR gRNA sequence
agtctggctgccatgacaaa

SEQ ID NO: 506251 - DNA, 20 bp, Artificial
  CRISPR gRNA sequence
ggctgccatgacaaatggca

SEQ ID NO: 506252 - DNA, 20 bp, Artificial
  CRISPR gRNA sequence
gctgccatgacaaatggcaa

SEQ ID NO: 506253 - DNA, 20 bp, Artificial
  CRISPR gRNA sequence
catgacaaatggcaaaggat

SEQ ID NO: 506254 - DNA, 20 bp, Artificial
  CRISPR gRNA sequence
atgacaaatggcaaaggatt

SEQ ID NO: 506255 - DNA, 20 bp, Artificial
  CRISPR gRNA sequence
ggattgggacctgctactgc

SEQ ID NO: 506256 - DNA, 20 bp, Artificial
  CRISPR gRNA sequence
tgggacctgctactgctggt

SEQ ID NO: 506257 - DNA, 20 bp, Artificial
  CRISPR gRNA sequence
gggacctgctactgctggtg

SEQ ID NO: 506258 - DNA, 20 bp, Artificial
  CRISPR gRNA sequence
gacctgctactgctggtgag

SEQ ID NO: 506259 - DNA, 20 bp, Artificial
  CRISPR gRNA sequence
acctgctactgctggtgagg

SEQ ID NO: 506260 - DNA, 20 bp, Artificial
  CRISPR gRNA sequence
cctgctactgctggtgagga

SEQ ID NO: 506261 - DNA, 20 bp, Artificial
  CRISPR gRNA sequence
ctgctactgctggtgaggag

SEQ ID NO: 506262 - DNA, 20 bp, Artificial
  CRISPR gRNA sequence
tggtgaggaggggaccgtca

SEQ ID NO: 506263 - DNA, 20 bp, Artificial
  CRISPR gRNA sequence
gggaccgtcatggccaccta

SEQ ID NO: 506264 - DNA, 20 bp, Artificial
  CRISPR gRNA sequence
ccgtcatggccacctacaga

SEQ ID NO: 506265 - DNA, 20 bp, Artificial
  CRISPR gRNA sequence
cgtcatggccacctacagat

SEQ ID NO: 506266 - DNA, 20 bp, Artificial
  CRISPR gRNA sequence
ggccacctacagatgggaca

SEQ ID NO: 506267 - DNA, 20 bp, Artificial
  CRISPR gRNA sequence
gccacctacagatgggacac

SEQ ID NO: 506268 - DNA, 20 bp, Artificial
  CRISPR gRNA sequence
ccacctacagatgggacaca

SEQ ID NO: 506269 - DNA, 20 bp, Artificial
  CRISPR gRNA sequence
cagggctgtgacatcctgac

SEQ ID NO: 506270 - DNA, 20 bp, Artificial
  CRISPR gRNA sequence
ggctgtgacatcctgaccag

SEQ ID NO: 506271 - DNA, 20 bp, Artificial
  CRISPR gRNA sequence
gctgtgacatcctgaccagc

SEQ ID NO: 506272 - DNA, 20 bp, Artificial
  CRISPR gRNA sequence
gtgacatcctgaccagcagg

SEQ ID NO: 506273 - DNA, 20 bp, Artificial
  CRISPR gRNA sequence
tgaccagcaggtggtctctg

SEQ ID NO: 506274 - DNA, 20 bp, Artificial
  CRISPR gRNA sequence
aggtggtctctgtggatgtc

SEQ ID NO: 506275 - DNA, 20 bp, Artificial
  CRISPR gRNA sequence
tctctgtggatgtccggccc

SEQ ID NO: 506276 - DNA, 20 bp, Artificial
  CRISPR gRNA sequence
cctgcgctgacccactgtcc

SEQ ID NO: 506277 - DNA, 20 bp, Artificial
  CRISPR gRNA sequence
gcgctgacccactgtcccgg

SEQ ID NO: 506278 - DNA, 20 bp, Artificial
  CRISPR gRNA sequence
cactgtcccggcagcctgac

SEQ ID NO: 506279 - DNA, 20 bp, Artificial
  CRISPR gRNA sequence
cccggcagcctgaccagctc

SEQ ID NO: 506280 - DNA, 20 bp, Artificial
  CRISPR gRNA sequence
ccggcagcctgaccagctct

SEQ ID NO: 506281 - DNA, 20 bp, Artificial
  CRISPR gRNA sequence
accagctctgggtgcccact

SEQ ID NO: 506282 - DNA, 20 bp, Artificial
  CRISPR gRNA sequence
cagctctgggtgcccactcg

SEQ ID NO: 506283 - DNA, 20 bp, Artificial
  CRISPR gRNA sequence
agctctgggtgcccactcgg

SEQ ID NO: 506284 - DNA, 20 bp, Artificial
  CRISPR gRNA sequence
gctctgggtgcccactcgga

SEQ ID NO: 506285 - DNA, 20 bp, Artificial
  CRISPR gRNA sequence
tgcccactcggagggtcccc

SEQ ID NO: 506286 - DNA, 20 bp, Artificial
  CRISPR gRNA sequence
cccccatcccgtgtctcccg

SEQ ID NO: 506287 - DNA, 20 bp, Artificial
  CRISPR gRNA sequence
ccccatcccgtgtctcccgc

SEQ ID NO: 506288 - DNA, 20 bp, Artificial
  CRISPR gRNA sequence
cccatcccgtgtctcccgca

SEQ ID NO: 506289 - DNA, 20 bp, Artificial
  CRISPR gRNA sequence
gcagggtcctgctcccactc

SEQ ID NO: 506290 - DNA, 20 bp, Artificial
  CRISPR gRNA sequence
agggtcctgctcccactcca

SEQ ID NO: 506291 - DNA, 20 bp, Artificial
  CRISPR gRNA sequence
cctgctcccactccagagcc

SEQ ID NO: 506292 - DNA, 20 bp, Artificial
  CRISPR gRNA sequence
ctgctcccactccagagccc

SEQ ID NO: 506293 - DNA, 20 bp, Artificial
  CRISPR gRNA sequence
tgctcccactccagagcccg

SEQ ID NO: 506294 - DNA, 20 bp, Artificial
  CRISPR gRNA sequence
tccagagcccggggaaccta

SEQ ID NO: 506295 - DNA, 20 bp, Artificial
  CRISPR gRNA sequence
agagcccggggaacctatgg

SEQ ID NO: 506296 - DNA, 20 bp, Artificial
  CRISPR gRNA sequence
gagcccggggaacctatggc

SEQ ID NO: 506297 - DNA, 20 bp, Artificial
  CRISPR gRNA sequence
gaacctatggcaggaaccgc

SEQ ID NO: 506298 - DNA, 20 bp, Artificial
  CRISPR gRNA sequence
ggaaccgctggtctcgctgt

SEQ ID NO: 506299 - DNA, 20 bp, Artificial
  CRISPR gRNA sequence
tgtcggccccaacacaccac

SEQ ID NO: 506300 - DNA, 20 bp, Artificial
  CRISPR gRNA sequence
gtcggccccaacacaccacg

SEQ ID NO: 506301 - DNA, 20 bp, Artificial
  CRISPR gRNA sequence
ccccaacacaccacgaggtt

SEQ ID NO: 506302 - DNA, 20 bp, Artificial
  CRISPR gRNA sequence
acaccacgaggttgagcttg

SEQ ID NO: 506303 - DNA, 20 bp, Artificial
  CRISPR gRNA sequence
cacgaggttgagcttgtagc

SEQ ID NO: 506304 - DNA, 20 bp, Artificial
  CRISPR gRNA sequence
acgaggttgagcttgtagct

SEQ ID NO: 506305 - DNA, 20 bp, Artificial
  CRISPR gRNA sequence
ttgagcttgtagctgggata

SEQ ID NO: 506306 - DNA, 20 bp, Artificial
  CRISPR gRNA sequence
tgagcttgtagctgggatac

SEQ ID NO: 506307 - DNA, 20 bp, Artificial
  CRISPR gRNA sequence
ctgggatacgggcctgacaa

SEQ ID NO: 506308 - DNA, 20 bp, Artificial
  CRISPR gRNA sequence
ggcctgacaatggatccctg

SEQ ID NO: 506309 - DNA, 20 bp, Artificial
  CRISPR gRNA sequence
gacaatggatccctgtagtt

SEQ ID NO: 506310 - DNA, 20 bp, Artificial
  CRISPR gRNA sequence
agcaaatgttcactttacaa

SEQ ID NO: 506311 - DNA, 20 bp, Artificial
  CRISPR gRNA sequence
aaatgttcactttacaaaag

SEQ ID NO: 506312 - DNA, 20 bp, Artificial
  CRISPR gRNA sequence
tgttcactttacaaaagcag

SEQ ID NO: 506313 - DNA, 20 bp, Artificial
  CRISPR gRNA sequence
tacaaaagcagcggccctcc

SEQ ID NO: 506314 - DNA, 20 bp, Artificial
  CRISPR gRNA sequence
acaaaagcagcggccctccc

SEQ ID NO: 506315 - DNA, 20 bp, Artificial
  CRISPR gRNA sequence
actttccttccccaaacccc

SEQ ID NO: 506316 - DNA, 20 bp, Artificial
  CRISPR gRNA sequence
aaaccccgagtatgtctcct

SEQ ID NO: 506317 - DNA, 20 bp, Artificial
  CRISPR gRNA sequence
cgagtatgtctcctcagcct

SEQ ID NO: 506318 - DNA, 20 bp, Artificial
  CRISPR gRNA sequence
gtatgtctcctcagcctaag

SEQ ID NO: 506319 - DNA, 20 bp, Artificial
  CRISPR gRNA sequence
tgtctcctcagcctaagcag

SEQ ID NO: 506320 - DNA, 20 bp, Artificial
  CRISPR gRNA sequence
gtctcctcagcctaagcagc

SEQ ID NO: 506321 - DNA, 20 bp, Artificial
  CRISPR gRNA sequence
tctcctcagcctaagcagca

SEQ ID NO: 506322 - DNA, 20 bp, Artificial
  CRISPR gRNA sequence
cctcagcctaagcagcaggg

SEQ ID NO: 506323 - DNA, 20 bp, Artificial
  CRISPR gRNA sequence
ctcagcctaagcagcagggc

SEQ ID NO: 506324 - DNA, 20 bp, Artificial
  CRISPR gRNA sequence
tcagcctaagcagcagggca

SEQ ID NO: 506325 - DNA, 20 bp, Artificial
  CRISPR gRNA sequence
cagcctaagcagcagggcag

SEQ ID NO: 506326 - DNA, 20 bp, Artificial
  CRISPR gRNA sequence
agcagcagggcaggggctgt

SEQ ID NO: 506327 - DNA, 20 bp, Artificial
  CRISPR gRNA sequence
gcagcagggcaggggctgtg

SEQ ID NO: 506328 - DNA, 20 bp, Artificial
  CRISPR gRNA sequence
gcaggggctgtgaggctgcc

SEQ ID NO: 506329 - DNA, 20 bp, Artificial
  CRISPR gRNA sequence
gggctgtgaggctgcccagc

SEQ ID NO: 506330 - DNA, 20 bp, Artificial
  CRISPR gRNA sequence
ggctgtgaggctgcccagct

SEQ ID NO: 506331 - DNA, 20 bp, Artificial
  CRISPR gRNA sequence
tgtgaggctgcccagctggg

SEQ ID NO: 506332 - DNA, 20 bp, Artificial
  CRISPR gRNA sequence
tgaggctgcccagctgggca

SEQ ID NO: 506333 - DNA, 20 bp, Artificial
  CRISPR gRNA sequence
tgcccagctgggcagagccc

SEQ ID NO: 506334 - DNA, 20 bp, Artificial
  CRISPR gRNA sequence
gcccagctgggcagagcccc

SEQ ID NO: 506335 - DNA, 20 bp, Artificial
  CRISPR gRNA sequence
cagctgggcagagccccagg

SEQ ID NO: 506336 - DNA, 20 bp, Artificial
  CRISPR gRNA sequence
agctgggcagagccccaggc

SEQ ID NO: 506337 - DNA, 20 bp, Artificial
  CRISPR gRNA sequence
gctgggcagagccccaggca

SEQ ID NO: 506338 - DNA, 20 bp, Artificial
  CRISPR gRNA sequence
ctgggcagagccccaggcag

SEQ ID NO: 506339 - DNA, 20 bp, Artificial
  CRISPR gRNA sequence
tgggcagagccccaggcagg

SEQ ID NO: 506340 - DNA, 20 bp, Artificial
  CRISPR gRNA sequence
gcagagccccaggcaggggg

SEQ ID NO: 506341 - DNA, 20 bp, Artificial
  CRISPR gRNA sequence
agagccccaggcagggggaa

SEQ ID NO: 506342 - DNA, 20 bp, Artificial
  CRISPR gRNA sequence
gagccccaggcagggggaag

SEQ ID NO: 506343 - DNA, 20 bp, Artificial
  CRISPR gRNA sequence
agccccaggcagggggaaga

SEQ ID NO: 506344 - DNA, 20 bp, Artificial
  CRISPR gRNA sequence
gccccaggcagggggaagag

SEQ ID NO: 506345 - DNA, 20 bp, Artificial
  CRISPR gRNA sequence
ccccaggcagggggaagagg

SEQ ID NO: 506346 - DNA, 20 bp, Artificial
  CRISPR gRNA sequence
gcagggggaagagggggccc

SEQ ID NO: 506347 - DNA, 20 bp, Artificial
  CRISPR gRNA sequence
gtttcctgcgtgccattttg

SEQ ID NO: 506348 - DNA, 20 bp, Artificial
  CRISPR gRNA sequence
tcctgcgtgccattttgaag

SEQ ID NO: 506349 - DNA, 20 bp, Artificial
  CRISPR gRNA sequence
gcgtgccattttgaagaaga

SEQ ID NO: 506350 - DNA, 20 bp, Artificial
  CRISPR gRNA sequence
tgccattttgaagaagatgg

SEQ ID NO: 506351 - DNA, 20 bp, Artificial
  CRISPR gRNA sequence
tttgaagaagatggcggtga

SEQ ID NO: 506352 - DNA, 20 bp, Artificial
  CRISPR gRNA sequence
gaagatggcggtgatggccc

SEQ ID NO: 506353 - DNA, 20 bp, Artificial
  CRISPR gRNA sequence
tggcggtgatggccctggaa

SEQ ID NO: 506354 - DNA, 20 bp, Artificial
  CRISPR gRNA sequence
ggtgatggccctggaatggc

SEQ ID NO: 506355 - DNA, 20 bp, Artificial
  CRISPR gRNA sequence
gatggccctggaatggccag

SEQ ID NO: 506356 - DNA, 20 bp, Artificial
  CRISPR gRNA sequence
atggccctggaatggccagc

SEQ ID NO: 506357 - DNA, 20 bp, Artificial
  CRISPR gRNA sequence
ccctggaatggccagcaggt

SEQ ID NO: 506358 - DNA, 20 bp, Artificial
  CRISPR gRNA sequence
ccagcaggtcggtcactgtc

SEQ ID NO: 506359 - DNA, 20 bp, Artificial
  CRISPR gRNA sequence
aggtcggtcactgtccggat

SEQ ID NO: 506360 - DNA, 20 bp, Artificial
  CRISPR gRNA sequence
ggtcggtcactgtccggatg

SEQ ID NO: 506361 - DNA, 20 bp, Artificial
  CRISPR gRNA sequence
actgtccggatgaggataat

SEQ ID NO: 506362 - DNA, 20 bp, Artificial
  CRISPR gRNA sequence
ctgtccggatgaggataatc

SEQ ID NO: 506363 - DNA, 20 bp, Artificial
  CRISPR gRNA sequence
atgaggataatcgggccctt

SEQ ID NO: 506364 - DNA, 20 bp, Artificial
  CRISPR gRNA sequence
tgaggataatcgggcccttt

SEQ ID NO: 506365 - DNA, 20 bp, Artificial
  CRISPR gRNA sequence
gaggataatcgggcccttta

SEQ ID NO: 506366 - DNA, 20 bp, Artificial
  CRISPR gRNA sequence
gataatcgggccctttaggg

SEQ ID NO: 506367 - DNA, 20 bp, Artificial
  CRISPR gRNA sequence
ggctgctctgtgaattccct

SEQ ID NO: 506368 - DNA, 20 bp, Artificial
  CRISPR gRNA sequence
tgctctgtgaattccctgag

SEQ ID NO: 506369 - DNA, 20 bp, Artificial
  CRISPR gRNA sequence
gctctgtgaattccctgagt

SEQ ID NO: 506370 - DNA, 20 bp, Artificial
  CRISPR gRNA sequence
tgtgaattccctgagtgggt

SEQ ID NO: 506371 - DNA, 20 bp, Artificial
  CRISPR gRNA sequence
attccctgagtgggtgagct

SEQ ID NO: 506372 - DNA, 20 bp, Artificial
  CRISPR gRNA sequence
acccacgacgcactgcccgc

SEQ ID NO: 506373 - DNA, 20 bp, Artificial
  CRISPR gRNA sequence
cccacgacgcactgcccgcc

SEQ ID NO: 506374 - DNA, 20 bp, Artificial
  CRISPR gRNA sequence
gggcaccactacccctttca

SEQ ID NO: 506375 - DNA, 20 bp, Artificial
  CRISPR gRNA sequence
ccactacccctttcacagat

SEQ ID NO: 506376 - DNA, 20 bp, Artificial
  CRISPR gRNA sequence
cactacccctttcacagatg

SEQ ID NO: 506377 - DNA, 20 bp, Artificial
  CRISPR gRNA sequence
ctttcacagatgaggaaact

SEQ ID NO: 506378 - DNA, 20 bp, Artificial
  CRISPR gRNA sequence
tttcacagatgaggaaactg

SEQ ID NO: 506379 - DNA, 20 bp, Artificial
  CRISPR gRNA sequence
ttcacagatgaggaaactga

SEQ ID NO: 506380 - DNA, 20 bp, Artificial
  CRISPR gRNA sequence
agatgaggaaactgagggct

SEQ ID NO: 506381 - DNA, 20 bp, Artificial
  CRISPR gRNA sequence
gatgaggaaactgagggctc

SEQ ID NO: 506382 - DNA, 20 bp, Artificial
  CRISPR gRNA sequence
atgaggaaactgagggctcg

SEQ ID NO: 506383 - DNA, 20 bp, Artificial
  CRISPR gRNA sequence
ggaaactgagggctcggggt

SEQ ID NO: 506384 - DNA, 20 bp, Artificial
  CRISPR gRNA sequence
gaaactgagggctcggggta

SEQ ID NO: 506385 - DNA, 20 bp, Artificial
  CRISPR gRNA sequence
actgagggctcggggtaagg

SEQ ID NO: 506386 - DNA, 20 bp, Artificial
  CRISPR gRNA sequence
ctgagggctcggggtaagga

SEQ ID NO: 506387 - DNA, 20 bp, Artificial
  CRISPR gRNA sequence
tgagggctcggggtaaggaa

SEQ ID NO: 506388 - DNA, 20 bp, Artificial
  CRISPR gRNA sequence
gctcggggtaaggaagggcc

SEQ ID NO: 506389 - DNA, 20 bp, Artificial
  CRISPR gRNA sequence
ctcggggtaaggaagggcct

SEQ ID NO: 506390 - DNA, 20 bp, Artificial
  CRISPR gRNA sequence
tcggggtaaggaagggcctg

SEQ ID NO: 506391 - DNA, 20 bp, Artificial
  CRISPR gRNA sequence
gaagggcctggggcgtcctg

SEQ ID NO: 506392 - DNA, 20 bp, Artificial
  CRISPR gRNA sequence
ggcctggggcgtcctgtggt

SEQ ID NO: 506393 - DNA, 20 bp, Artificial
  CRISPR gRNA sequence
gggcgtcctgtggtaagtaa

SEQ ID NO: 506394 - DNA, 20 bp, Artificial
  CRISPR gRNA sequence
gcgtcctgtggtaagtaaca

SEQ ID NO: 506395 - DNA, 20 bp, Artificial
  CRISPR gRNA sequence
cctgtggtaagtaacagagc

SEQ ID NO: 506396 - DNA, 20 bp, Artificial
  CRISPR gRNA sequence
ctgtggtaagtaacagagct

SEQ ID NO: 506397 - DNA, 20 bp, Artificial
  CRISPR gRNA sequence
taagtaacagagctgggtgt

SEQ ID NO: 506398 - DNA, 20 bp, Artificial
  CRISPR gRNA sequence
aagtaacagagctgggtgtg

SEQ ID NO: 506399 - DNA, 20 bp, Artificial
  CRISPR gRNA sequence
aacagagctgggtgtgaggt

SEQ ID NO: 506400 - DNA, 20 bp, Artificial
  CRISPR gRNA sequence
tgggtgtgaggtgagccacc

SEQ ID NO: 506401 - DNA, 20 bp, Artificial
  CRISPR gRNA sequence
gggtgtgaggtgagccaccc

SEQ ID NO: 506402 - DNA, 20 bp, Artificial
  CRISPR gRNA sequence
ggtgtgaggtgagccaccca

SEQ ID NO: 506403 - DNA, 20 bp, Artificial
  CRISPR gRNA sequence
ccagggccctgtccaccctg

SEQ ID NO: 506404 - DNA, 20 bp, Artificial
  CRISPR gRNA sequence
gccctgtccaccctgaagaa

SEQ ID NO: 506405 - DNA, 20 bp, Artificial
  CRISPR gRNA sequence
ccctgtccaccctgaagaac

SEQ ID NO: 506406 - DNA, 20 bp, Artificial
  CRISPR gRNA sequence
cctgtccaccctgaagaacg

SEQ ID NO: 506407 - DNA, 20 bp, Artificial
  CRISPR gRNA sequence
accctgaagaacggggcacg

SEQ ID NO: 506408 - DNA, 20 bp, Artificial
  CRISPR gRNA sequence
acggggcacgtggctgtgta

SEQ ID NO: 506409 - DNA, 20 bp, Artificial
  CRISPR gRNA sequence
tgacaactatctcgttcctc

SEQ ID NO: 506410 - DNA, 20 bp, Artificial
  CRISPR gRNA sequence
gttcctccagctccaccctg

SEQ ID NO: 506411 - DNA, 20 bp, Artificial
  CRISPR gRNA sequence
tccagctccaccctgaagaa

SEQ ID NO: 506412 - DNA, 20 bp, Artificial
  CRISPR gRNA sequence
ccagctccaccctgaagaac

SEQ ID NO: 506413 - DNA, 20 bp, Artificial
  CRISPR gRNA sequence
cagctccaccctgaagaacg

SEQ ID NO: 506414 - DNA, 20 bp, Artificial
  CRISPR gRNA sequence
accctgaagaacggggcacg

SEQ ID NO: 506415 - DNA, 20 bp, Artificial
  CRISPR gRNA sequence
acggggcacgtggctgtgta

SEQ ID NO: 506416 - DNA, 20 bp, Artificial
  CRISPR gRNA sequence
tgacaaccacctccttcctc

SEQ ID NO: 506417 - DNA, 20 bp, Artificial
  CRISPR gRNA sequence
accacctccttcctccagct

SEQ ID NO: 506418 - DNA, 20 bp, Artificial
  CRISPR gRNA sequence
gctcagtccttctgtccctg

SEQ ID NO: 506419 - DNA, 20 bp, Artificial
  CRISPR gRNA sequence
tccttctgtccctgtggcct

SEQ ID NO: 506420 - DNA, 20 bp, Artificial
  CRISPR gRNA sequence
ccttctgtccctgtggcctc

SEQ ID NO: 506421 - DNA, 20 bp, Artificial
  CRISPR gRNA sequence
cttctgtccctgtggcctca

SEQ ID NO: 506422 - DNA, 20 bp, Artificial
  CRISPR gRNA sequence
cctcagggccacacactgtg

SEQ ID NO: 506423 - DNA, 20 bp, Artificial
  CRISPR gRNA sequence
ctcagggccacacactgtgc

SEQ ID NO: 506424 - DNA, 20 bp, Artificial
  CRISPR gRNA sequence
acacactgtgcaggctgcta

SEQ ID NO: 506425 - DNA, 20 bp, Artificial
  CRISPR gRNA sequence
cacactgtgcaggctgctat

SEQ ID NO: 506426 - DNA, 20 bp, Artificial
  CRISPR gRNA sequence
actgtgcaggctgctatggg

SEQ ID NO: 506427 - DNA, 20 bp, Artificial
  CRISPR gRNA sequence
tgtgcaggctgctatgggcg

SEQ ID NO: 506428 - DNA, 20 bp, Artificial
  CRISPR gRNA sequence
gtgcaggctgctatgggcgg

SEQ ID NO: 506429 - DNA, 20 bp, Artificial
  CRISPR gRNA sequence
ctatgggcggaggctccttt

SEQ ID NO: 506430 - DNA, 20 bp, Artificial
  CRISPR gRNA sequence
tatgggcggaggctcctttc

SEQ ID NO: 506431 - DNA, 20 bp, Artificial
  CRISPR gRNA sequence
tgggcggaggctcctttcag

SEQ ID NO: 506432 - DNA, 20 bp, Artificial
  CRISPR gRNA sequence
gggcggaggctcctttcagg

SEQ ID NO: 506433 - DNA, 20 bp, Artificial
  CRISPR gRNA sequence
ggcggaggctcctttcagga

SEQ ID NO: 506434 - DNA, 20 bp, Artificial
  CRISPR gRNA sequence
gctcctttcaggagggcgtg

SEQ ID NO: 506435 - DNA, 20 bp, Artificial
  CRISPR gRNA sequence
gtgcagtgtttccttccttc

SEQ ID NO: 506436 - DNA, 20 bp, Artificial
  CRISPR gRNA sequence
tctagcgaatccctgttaca

SEQ ID NO: 506437 - DNA, 20 bp, Artificial
  CRISPR gRNA sequence
gcgaatccctgttacacagt

SEQ ID NO: 506438 - DNA, 20 bp, Artificial
  CRISPR gRNA sequence
cgaatccctgttacacagtc

SEQ ID NO: 506439 - DNA, 20 bp, Artificial
  CRISPR gRNA sequence
gaatccctgttacacagtca

SEQ ID NO: 506440 - DNA, 20 bp, Artificial
  CRISPR gRNA sequence
tacacagtcagggctccacc

SEQ ID NO: 506441 - DNA, 20 bp, Artificial
  CRISPR gRNA sequence
acagtcagggctccacccag

SEQ ID NO: 506442 - DNA, 20 bp, Artificial
  CRISPR gRNA sequence
cagtcagggctccacccagc

SEQ ID NO: 506443 - DNA, 20 bp, Artificial
  CRISPR gRNA sequence
agggctccacccagcaggcc

SEQ ID NO: 506444 - DNA, 20 bp, Artificial
  CRISPR gRNA sequence
ctccacccagcaggcctggc

SEQ ID NO: 506445 - DNA, 20 bp, Artificial
  CRISPR gRNA sequence
gccacaccccacacatgcca

SEQ ID NO: 506446 - DNA, 20 bp, Artificial
  CRISPR gRNA sequence
cacaccccacacatgccaaa

SEQ ID NO: 506447 - DNA, 20 bp, Artificial
  CRISPR gRNA sequence
accccacacatgccaaagag

SEQ ID NO: 506448 - DNA, 20 bp, Artificial
  CRISPR gRNA sequence
ccacacatgccaaagagtgg

SEQ ID NO: 506449 - DNA, 20 bp, Artificial
  CRISPR gRNA sequence
tgccaaagagtggtagaccc

SEQ ID NO: 506450 - DNA, 20 bp, Artificial
  CRISPR gRNA sequence
aagagtggtagaccccggct

SEQ ID NO: 506451 - DNA, 20 bp, Artificial
  CRISPR gRNA sequence
tagaccccggctgagctcct

SEQ ID NO: 506452 - DNA, 20 bp, Artificial
  CRISPR gRNA sequence
gaccccggctgagctcctga

SEQ ID NO: 506453 - DNA, 20 bp, Artificial
  CRISPR gRNA sequence
accccggctgagctcctgag

SEQ ID NO: 506454 - DNA, 20 bp, Artificial
  CRISPR gRNA sequence
ccggctgagctcctgagagg

SEQ ID NO: 506455 - DNA, 20 bp, Artificial
  CRISPR gRNA sequence
gctcctgagaggtagcctct

SEQ ID NO: 506456 - DNA, 20 bp, Artificial
  CRISPR gRNA sequence
agaggtagcctctgagccct

SEQ ID NO: 506457 - DNA, 20 bp, Artificial
  CRISPR gRNA sequence
ccttggtacatcctacccga

SEQ ID NO: 506458 - DNA, 20 bp, Artificial
  CRISPR gRNA sequence
cttggtacatcctacccgat

SEQ ID NO: 506459 - DNA, 20 bp, Artificial
  CRISPR gRNA sequence
ttggtacatcctacccgatg

SEQ ID NO: 506460 - DNA, 20 bp, Artificial
  CRISPR gRNA sequence
tggtacatcctacccgatgg

SEQ ID NO: 506461 - DNA, 20 bp, Artificial
  CRISPR gRNA sequence
gatgggggtgtcattgttcc

SEQ ID NO: 506462 - DNA, 20 bp, Artificial
  CRISPR gRNA sequence
atgggggtgtcattgttcct

SEQ ID NO: 506463 - DNA, 20 bp, Artificial
  CRISPR gRNA sequence
tgggggtgtcattgttcctg

SEQ ID NO: 506464 - DNA, 20 bp, Artificial
  CRISPR gRNA sequence
tgtcattgttcctggggcct

SEQ ID NO: 506465 - DNA, 20 bp, Artificial
  CRISPR gRNA sequence
gtcattgttcctggggcctc

SEQ ID NO: 506466 - DNA, 20 bp, Artificial
  CRISPR gRNA sequence
cctggggcctcaggtcacac

SEQ ID NO: 506467 - DNA, 20 bp, Artificial
  CRISPR gRNA sequence
gggcctcaggtcacaccgga

SEQ ID NO: 506468 - DNA, 20 bp, Artificial
  CRISPR gRNA sequence
ggtcacaccggatagtccca

SEQ ID NO: 506469 - DNA, 20 bp, Artificial
  CRISPR gRNA sequence
gatagtcccacagtgtgatt

SEQ ID NO: 506470 - DNA, 20 bp, Artificial
  CRISPR gRNA sequence
atagtcccacagtgtgattt

SEQ ID NO: 506471 - DNA, 20 bp, Artificial
  CRISPR gRNA sequence
tagtcccacagtgtgatttg

SEQ ID NO: 506472 - DNA, 20 bp, Artificial
  CRISPR gRNA sequence
tcccacagtgtgatttgggg

SEQ ID NO: 506473 - DNA, 20 bp, Artificial
  CRISPR gRNA sequence
cccacagtgtgatttggggt

SEQ ID NO: 506474 - DNA, 20 bp, Artificial
  CRISPR gRNA sequence
ccacagtgtgatttggggtg

SEQ ID NO: 506475 - DNA, 20 bp, Artificial
  CRISPR gRNA sequence
tgtgatttggggtggggccc

SEQ ID NO: 506476 - DNA, 20 bp, Artificial
  CRISPR gRNA sequence
atttggggtggggccctgga

SEQ ID NO: 506477 - DNA, 20 bp, Artificial
  CRISPR gRNA sequence
gtggggccctggacagtttt

SEQ ID NO: 506478 - DNA, 20 bp, Artificial
  CRISPR gRNA sequence
acagttttcagcttgacctc

SEQ ID NO: 506479 - DNA, 20 bp, Artificial
  CRISPR gRNA sequence
agttttcagcttgacctctg

SEQ ID NO: 506480 - DNA, 20 bp, Artificial
  CRISPR gRNA sequence
gttttcagcttgacctctgg

SEQ ID NO: 506481 - DNA, 20 bp, Artificial
  CRISPR gRNA sequence
ttttcagcttgacctctgga

SEQ ID NO: 506482 - DNA, 20 bp, Artificial
  CRISPR gRNA sequence
cagcttgacctctggagggc

SEQ ID NO: 506483 - DNA, 20 bp, Artificial
  CRISPR gRNA sequence
gcttgacctctggagggcta

SEQ ID NO: 506484 - DNA, 20 bp, Artificial
  CRISPR gRNA sequence
cctctggagggctagagact

SEQ ID NO: 506485 - DNA, 20 bp, Artificial
  CRISPR gRNA sequence
ctctggagggctagagactg

SEQ ID NO: 506486 - DNA, 20 bp, Artificial
  CRISPR gRNA sequence
ggagggctagagactgaggt

SEQ ID NO: 506487 - DNA, 20 bp, Artificial
  CRISPR gRNA sequence
ctagagactgaggtcagcca

SEQ ID NO: 506488 - DNA, 20 bp, Artificial
  CRISPR gRNA sequence
tagagactgaggtcagccat

SEQ ID NO: 506489 - DNA, 20 bp, Artificial
  CRISPR gRNA sequence
agagactgaggtcagccatg

SEQ ID NO: 506490 - DNA, 20 bp, Artificial
  CRISPR gRNA sequence
tgaggtcagccatggggtgt

SEQ ID NO: 506491 - DNA, 20 bp, Artificial
  CRISPR gRNA sequence
gcgccgctgtgactgacccc

SEQ ID NO: 506492 - DNA, 20 bp, Artificial
  CRISPR gRNA sequence
ccgctgtgactgacccccag

SEQ ID NO: 506493 - DNA, 20 bp, Artificial
  CRISPR gRNA sequence
actgacccccagtagacacc

SEQ ID NO: 506494 - DNA, 20 bp, Artificial
  CRISPR gRNA sequence
ctgacccccagtagacaccg

SEQ ID NO: 506495 - DNA, 20 bp, Artificial
  CRISPR gRNA sequence
cccagtagacaccgaggctc

SEQ ID NO: 506496 - DNA, 20 bp, Artificial
  CRISPR gRNA sequence
cagtagacaccgaggctcaa

SEQ ID NO: 506497 - DNA, 20 bp, Artificial
  CRISPR gRNA sequence
ccgaggctcaagagcctcct

SEQ ID NO: 506498 - DNA, 20 bp, Artificial
  CRISPR gRNA sequence
cgaggctcaagagcctcctt

SEQ ID NO: 506499 - DNA, 20 bp, Artificial
  CRISPR gRNA sequence
gaggctcaagagcctccttg

SEQ ID NO: 506500 - DNA, 20 bp, Artificial
  CRISPR gRNA sequence
ggggaccatgttctgtgcat

SEQ ID NO: 506501 - DNA, 20 bp, Artificial
  CRISPR gRNA sequence
gggaccatgttctgtgcatg

SEQ ID NO: 506502 - DNA, 20 bp, Artificial
  CRISPR gRNA sequence
atgaggccacacatcatcgc

SEQ ID NO: 506503 - DNA, 20 bp, Artificial
  CRISPR gRNA sequence
tgaggccacacatcatcgct

SEQ ID NO: 506504 - DNA, 20 bp, Artificial
  CRISPR gRNA sequence
aggccacacatcatcgctgg

SEQ ID NO: 506505 - DNA, 20 bp, Artificial
  CRISPR gRNA sequence
ggccacacatcatcgctggg

SEQ ID NO: 506506 - DNA, 20 bp, Artificial
  CRISPR gRNA sequence
acacatcatcgctgggagga

SEQ ID NO: 506507 - DNA, 20 bp, Artificial
  CRISPR gRNA sequence
acatcatcgctgggaggatg

SEQ ID NO: 506508 - DNA, 20 bp, Artificial
  CRISPR gRNA sequence
gagcgccgcccacacccctg

SEQ ID NO: 506509 - DNA, 20 bp, Artificial
  CRISPR gRNA sequence
agcgccgcccacacccctgc

SEQ ID NO: 506510 - DNA, 20 bp, Artificial
  CRISPR gRNA sequence
gcgccgcccacacccctgca

SEQ ID NO: 506511 - DNA, 20 bp, Artificial
  CRISPR gRNA sequence
gccgcccacacccctgcagg

SEQ ID NO: 506512 - DNA, 20 bp, Artificial
  CRISPR gRNA sequence
ccgcccacacccctgcaggg

SEQ ID NO: 506513 - DNA, 20 bp, Artificial
  CRISPR gRNA sequence
cgcccacacccctgcaggga

SEQ ID NO: 506514 - DNA, 20 bp, Artificial
  CRISPR gRNA sequence
gcccacacccctgcagggag

SEQ ID NO: 506515 - DNA, 20 bp, Artificial
  CRISPR gRNA sequence
cccctgcagggaggggacac

SEQ ID NO: 506516 - DNA, 20 bp, Artificial
  CRISPR gRNA sequence
ccctgcagggaggggacact

SEQ ID NO: 506517 - DNA, 20 bp, Artificial
  CRISPR gRNA sequence
ctgcagggaggggacactgg

SEQ ID NO: 506518 - DNA, 20 bp, Artificial
  CRISPR gRNA sequence
agggaggggacactgggagc

SEQ ID NO: 506519 - DNA, 20 bp, Artificial
  CRISPR gRNA sequence
ggacactgggagctggtgcc

SEQ ID NO: 506520 - DNA, 20 bp, Artificial
  CRISPR gRNA sequence
ttgtctgtatcctcccacct

SEQ ID NO: 506521 - DNA, 20 bp, Artificial
  CRISPR gRNA sequence
tgtctgtatcctcccacctc

SEQ ID NO: 506522 - DNA, 20 bp, Artificial
  CRISPR gRNA sequence
ctgtatcctcccacctcggg

SEQ ID NO: 506523 - DNA, 20 bp, Artificial
  CRISPR gRNA sequence
tatcctcccacctcgggcag

SEQ ID NO: 506524 - DNA, 20 bp, Artificial
  CRISPR gRNA sequence
ctcccacctcgggcagcggc

SEQ ID NO: 506525 - DNA, 20 bp, Artificial
  CRISPR gRNA sequence
ctcgggcagcggctggcacc

SEQ ID NO: 506526 - DNA, 20 bp, Artificial
  CRISPR gRNA sequence
tcgggcagcggctggcaccc

SEQ ID NO: 506527 - DNA, 20 bp, Artificial
  CRISPR gRNA sequence
gggcagcggctggcacccag

SEQ ID NO: 506528 - DNA, 20 bp, Artificial
  CRISPR gRNA sequence
ggcagcggctggcacccagg

SEQ ID NO: 506529 - DNA, 20 bp, Artificial
  CRISPR gRNA sequence
gcagcggctggcacccagga

SEQ ID NO: 506530 - DNA, 20 bp, Artificial
  CRISPR gRNA sequence
cggctggcacccaggagggt

SEQ ID NO: 506531 - DNA, 20 bp, Artificial
  CRISPR gRNA sequence
ctgcaataaactgtaactgt

SEQ ID NO: 506532 - DNA, 20 bp, Artificial
  CRISPR gRNA sequence
aactgtaactgtgagtttac

SEQ ID NO: 506533 - DNA, 20 bp, Artificial
  CRISPR gRNA sequence
ctgtgagtttactggttcct

SEQ ID NO: 506534 - DNA, 20 bp, Artificial
  CRISPR gRNA sequence
tactggttcctgagctctgc

SEQ ID NO: 506535 - DNA, 20 bp, Artificial
  CRISPR gRNA sequence
ctgagctctgcaagtccttc

SEQ ID NO: 506536 - DNA, 20 bp, Artificial
  CRISPR gRNA sequence
tccggcaaatcactgatcct

SEQ ID NO: 506537 - DNA, 20 bp, Artificial
  CRISPR gRNA sequence
gcaaatcactgatcctgaga

SEQ ID NO: 506538 - DNA, 20 bp, Artificial
  CRISPR gRNA sequence
caaatcactgatcctgagaa

SEQ ID NO: 506539 - DNA, 20 bp, Artificial
  CRISPR gRNA sequence
actgatcctgagaaaggtct

SEQ ID NO: 506540 - DNA, 20 bp, Artificial
  CRISPR gRNA sequence
ctgatcctgagaaaggtctt

SEQ ID NO: 506541 - DNA, 20 bp, Artificial
  CRISPR gRNA sequence
aaaggtcttgggaaccccaa

SEQ ID NO: 506542 - DNA, 20 bp, Artificial
  CRISPR gRNA sequence
tgggaaccccaacagcacct

SEQ ID NO: 506543 - DNA, 20 bp, Artificial
  CRISPR gRNA sequence
tcttgacgcactgacctgct

SEQ ID NO: 506544 - DNA, 20 bp, Artificial
  CRISPR gRNA sequence
cttgacgcactgacctgctc

SEQ ID NO: 506545 - DNA, 20 bp, Artificial
  CRISPR gRNA sequence
acctgctcaggctgaacaca

SEQ ID NO: 506546 - DNA, 20 bp, Artificial
  CRISPR gRNA sequence
tcaggctgaacacatggcac

SEQ ID NO: 506547 - DNA, 20 bp, Artificial
  CRISPR gRNA sequence
ggctgaacacatggcactag

SEQ ID NO: 506548 - DNA, 20 bp, Artificial
  CRISPR gRNA sequence
tgaacacatggcactagcag

SEQ ID NO: 506549 - DNA, 20 bp, Artificial
  CRISPR gRNA sequence
tggcactagcagcggaaatg

SEQ ID NO: 506550 - DNA, 20 bp, Artificial
  CRISPR gRNA sequence
ggcactagcagcggaaatgc

SEQ ID NO: 506551 - DNA, 20 bp, Artificial
  CRISPR gRNA sequence
gcaggatgaacgtgtttcac

SEQ ID NO: 506552 - DNA, 20 bp, Artificial
  CRISPR gRNA sequence
caggatgaacgtgtttcact

SEQ ID NO: 506553 - DNA, 20 bp, Artificial
  CRISPR gRNA sequence
aggatgaacgtgtttcactg

SEQ ID NO: 506554 - DNA, 20 bp, Artificial
  CRISPR gRNA sequence
ggatgaacgtgtttcactgg

SEQ ID NO: 506555 - DNA, 20 bp, Artificial
  CRISPR gRNA sequence
tcactgggggcctctttttc

SEQ ID NO: 506556 - DNA, 20 bp, Artificial
  CRISPR gRNA sequence
cactgggggcctctttttct

SEQ ID NO: 506557 - DNA, 20 bp, Artificial
  CRISPR gRNA sequence
ctgggggcctctttttctag

SEQ ID NO: 506558 - DNA, 20 bp, Artificial
  CRISPR gRNA sequence
ggggcctctttttctaggag

SEQ ID NO: 506559 - DNA, 20 bp, Artificial
  CRISPR gRNA sequence
ggcctctttttctaggagca

SEQ ID NO: 506560 - DNA, 20 bp, Artificial
  CRISPR gRNA sequence
gcctctttttctaggagcag

SEQ ID NO: 506561 - DNA, 20 bp, Artificial
  CRISPR gRNA sequence
ctttttctaggagcagaggc

SEQ ID NO: 506562 - DNA, 20 bp, Artificial
  CRISPR gRNA sequence
taggagcagaggctggttat

SEQ ID NO: 506563 - DNA, 20 bp, Artificial
  CRISPR gRNA sequence
ttcatcccactccgcactcc

SEQ ID NO: 506564 - DNA, 20 bp, Artificial
  CRISPR gRNA sequence
tttgtgtaattttatcttca

SEQ ID NO: 506565 - DNA, 20 bp, Artificial
  CRISPR gRNA sequence
tgtgtaattttatcttcacg

SEQ ID NO: 506566 - DNA, 20 bp, Artificial
  CRISPR gRNA sequence
tgtaattttatcttcacgga

SEQ ID NO: 506567 - DNA, 20 bp, Artificial
  CRISPR gRNA sequence
gttgatgttcaaatgtatgt

SEQ ID NO: 506568 - DNA, 20 bp, Artificial
  CRISPR gRNA sequence
aatgtatgtgagcataaaat

SEQ ID NO: 506569 - DNA, 20 bp, Artificial
  CRISPR gRNA sequence
aagtgtgtttccataaaata

SEQ ID NO: 506570 - DNA, 20 bp, Artificial
  CRISPR gRNA sequence
taaagaattgtgttgtattc

SEQ ID NO: 506571 - DNA, 20 bp, Artificial
  CRISPR gRNA sequence
aaagaattgtgttgtattcc

SEQ ID NO: 506572 - DNA, 20 bp, Artificial
  CRISPR gRNA sequence
tgttgtattccaggaaaaaa

SEQ ID NO: 506573 - DNA, 20 bp, Artificial
  CRISPR gRNA sequence
acagaaatatcaccaatgcc

SEQ ID NO: 506574 - DNA, 20 bp, Artificial
  CRISPR gRNA sequence
gccaagacatgctgttaaca

SEQ ID NO: 506575 - DNA, 20 bp, Artificial
  CRISPR gRNA sequence
gacatgctgttaacacagct

SEQ ID NO: 506576 - DNA, 20 bp, Artificial
  CRISPR gRNA sequence
ctgttaacacagctgagttt

SEQ ID NO: 506577 - DNA, 20 bp, Artificial
  CRISPR gRNA sequence
tgttaacacagctgagtttc

SEQ ID NO: 506578 - DNA, 20 bp, Artificial
  CRISPR gRNA sequence
gttaacacagctgagtttca

SEQ ID NO: 506579 - DNA, 20 bp, Artificial
  CRISPR gRNA sequence
acacagctgagtttcaggga

SEQ ID NO: 506580 - DNA, 20 bp, Artificial
  CRISPR gRNA sequence
cacagctgagtttcagggac

SEQ ID NO: 506581 - DNA, 20 bp, Artificial
  CRISPR gRNA sequence
acagctgagtttcagggacg

SEQ ID NO: 506582 - DNA, 20 bp, Artificial
  CRISPR gRNA sequence
agctgagtttcagggacggg

SEQ ID NO: 506583 - DNA, 20 bp, Artificial
  CRISPR gRNA sequence
gctgagtttcagggacgggg

SEQ ID NO: 506584 - DNA, 20 bp, Artificial
  CRISPR gRNA sequence
ttcctcctcctatcgacacg

SEQ ID NO: 506585 - DNA, 20 bp, Artificial
  CRISPR gRNA sequence
tcctcctcctatcgacacgc

SEQ ID NO: 506586 - DNA, 20 bp, Artificial
  CRISPR gRNA sequence
cgcaggcgtcctgtccccga

SEQ ID NO: 506587 - DNA, 20 bp, Artificial
  CRISPR gRNA sequence
gcaggcgtcctgtccccgac

SEQ ID NO: 506588 - DNA, 20 bp, Artificial
  CRISPR gRNA sequence
ggcgtcctgtccccgacggg

SEQ ID NO: 506589 - DNA, 20 bp, Artificial
  CRISPR gRNA sequence
ctgtccccgacgggaagcct

SEQ ID NO: 506590 - DNA, 20 bp, Artificial
  CRISPR gRNA sequence
tgtccccgacgggaagcctc

SEQ ID NO: 506591 - DNA, 20 bp, Artificial
  CRISPR gRNA sequence
gaagcctcgggctcctcacc

SEQ ID NO: 506592 - DNA, 20 bp, Artificial
  CRISPR gRNA sequence
aagcctcgggctcctcacct

SEQ ID NO: 506593 - DNA, 20 bp, Artificial
  CRISPR gRNA sequence
agcctcgggctcctcaccta

SEQ ID NO: 506594 - DNA, 20 bp, Artificial
  CRISPR gRNA sequence
gcctcgggctcctcacctag

SEQ ID NO: 506595 - DNA, 20 bp, Artificial
  CRISPR gRNA sequence
cctcgggctcctcacctagg

SEQ ID NO: 506596 - DNA, 20 bp, Artificial
  CRISPR gRNA sequence
gctcctcacctagggggatc

SEQ ID NO: 506597 - DNA, 20 bp, Artificial
  CRISPR gRNA sequence
ctcctcacctagggggatcc

SEQ ID NO: 506598 - DNA, 20 bp, Artificial
  CRISPR gRNA sequence
acctagggggatccaggacc

SEQ ID NO: 506599 - DNA, 20 bp, Artificial
  CRISPR gRNA sequence
cctagggggatccaggacct

SEQ ID NO: 506600 - DNA, 20 bp, Artificial
  CRISPR gRNA sequence
gggggatccaggacctgggc

SEQ ID NO: 506601 - DNA, 20 bp, Artificial
  CRISPR gRNA sequence
gatccaggacctgggccggc

SEQ ID NO: 506602 - DNA, 20 bp, Artificial
  CRISPR gRNA sequence
cggctggttgctcacgtgcc

SEQ ID NO: 506603 - DNA, 20 bp, Artificial
  CRISPR gRNA sequence
ttgctcacgtgcccagcatg

SEQ ID NO: 506604 - DNA, 20 bp, Artificial
  CRISPR gRNA sequence
gctcacgtgcccagcatgca

SEQ ID NO: 506605 - DNA, 20 bp, Artificial
  CRISPR gRNA sequence
ctcacgtgcccagcatgcag

SEQ ID NO: 506606 - DNA, 20 bp, Artificial
  CRISPR gRNA sequence
acgtgcccagcatgcagagg

SEQ ID NO: 506607 - DNA, 20 bp, Artificial
  CRISPR gRNA sequence
cagcatgcagaggtggcgct

SEQ ID NO: 506608 - DNA, 20 bp, Artificial
  CRISPR gRNA sequence
agaggtggcgctcagacctg

SEQ ID NO: 506609 - DNA, 20 bp, Artificial
  CRISPR gRNA sequence
ggtggcgctcagacctgcag

SEQ ID NO: 506610 - DNA, 20 bp, Artificial
  CRISPR gRNA sequence
gctcagacctgcagtggcgc

SEQ ID NO: 506611 - DNA, 20 bp, Artificial
  CRISPR gRNA sequence
ctcagacctgcagtggcgct

SEQ ID NO: 506612 - DNA, 20 bp, Artificial
  CRISPR gRNA sequence
acctgcagtggcgctgggtc

SEQ ID NO: 506613 - DNA, 20 bp, Artificial
  CRISPR gRNA sequence
gtggcgctgggtctggcctg

SEQ ID NO: 506614 - DNA, 20 bp, Artificial
  CRISPR gRNA sequence
tgaaacatgcccccacccaa

SEQ ID NO: 506615 - DNA, 20 bp, Artificial
  CRISPR gRNA sequence
gcccccacccaatggatgct

SEQ ID NO: 506616 - DNA, 20 bp, Artificial
  CRISPR gRNA sequence
cccccacccaatggatgctc

SEQ ID NO: 506617 - DNA, 20 bp, Artificial
  CRISPR gRNA sequence
aatggatgctcgggacccaa

SEQ ID NO: 506618 - DNA, 20 bp, Artificial
  CRISPR gRNA sequence
acccaacagcactcacctcg

SEQ ID NO: 506619 - DNA, 20 bp, Artificial
  CRISPR gRNA sequence
cccaacagcactcacctcgt

SEQ ID NO: 506620 - DNA, 20 bp, Artificial
  CRISPR gRNA sequence
gtaggtcttcaccatcctac

SEQ ID NO: 506621 - DNA, 20 bp, Artificial
  CRISPR gRNA sequence
ccatcctactggtcaccgcg

SEQ ID NO: 506622 - DNA, 20 bp, Artificial
  CRISPR gRNA sequence
cctactggtcaccgcgaaga

SEQ ID NO: 506623 - DNA, 20 bp, Artificial
  CRISPR gRNA sequence
ctactggtcaccgcgaagat

SEQ ID NO: 506624 - DNA, 20 bp, Artificial
  CRISPR gRNA sequence
tggtcaccgcgaagatgggc

SEQ ID NO: 506625 - DNA, 20 bp, Artificial
  CRISPR gRNA sequence
gatgggctggatgttgtttt

SEQ ID NO: 506626 - DNA, 20 bp, Artificial
  CRISPR gRNA sequence
ggctggatgttgttttcagc

SEQ ID NO: 506627 - DNA, 20 bp, Artificial
  CRISPR gRNA sequence
ttttcagccagcttgtgcgc

SEQ ID NO: 506628 - DNA, 20 bp, Artificial
  CRISPR gRNA sequence
cagccagcttgtgcgccagc

SEQ ID NO: 506629 - DNA, 20 bp, Artificial
  CRISPR gRNA sequence
tgcgccagctggcccaccga

SEQ ID NO: 506630 - DNA, 20 bp, Artificial
  CRISPR gRNA sequence
gcgccagctggcccaccgat

SEQ ID NO: 506631 - DNA, 20 bp, Artificial
  CRISPR gRNA sequence
ccagctggcccaccgatggg

SEQ ID NO: 506632 - DNA, 20 bp, Artificial
  CRISPR gRNA sequence
ggcccaccgatgggtagtcc

SEQ ID NO: 506633 - DNA, 20 bp, Artificial
  CRISPR gRNA sequence
cccaccgatgggtagtcctg

SEQ ID NO: 506634 - DNA, 20 bp, Artificial
  CRISPR gRNA sequence
caccgatgggtagtcctgga

SEQ ID NO: 506635 - DNA, 20 bp, Artificial
  CRISPR gRNA sequence
ccgatgggtagtcctggaga

SEQ ID NO: 506636 - DNA, 20 bp, Artificial
  CRISPR gRNA sequence
cgatgggtagtcctggagag

SEQ ID NO: 506637 - DNA, 20 bp, Artificial
  CRISPR gRNA sequence
atgggtagtcctggagagag

SEQ ID NO: 506638 - DNA, 20 bp, Artificial
  CRISPR gRNA sequence
tgggtagtcctggagagagg

SEQ ID NO: 506639 - DNA, 20 bp, Artificial
  CRISPR gRNA sequence
tggagagaggaggtcctgct

SEQ ID NO: 506640 - DNA, 20 bp, Artificial
  CRISPR gRNA sequence
gagaggaggtcctgctcagt

SEQ ID NO: 506641 - DNA, 20 bp, Artificial
  CRISPR gRNA sequence
ggtcctgctcagttggcccc

SEQ ID NO: 506642 - DNA, 20 bp, Artificial
  CRISPR gRNA sequence
tgctcagttggccccgagtc

SEQ ID NO: 506643 - DNA, 20 bp, Artificial
  CRISPR gRNA sequence
gctcagttggccccgagtcc

SEQ ID NO: 506644 - DNA, 20 bp, Artificial
  CRISPR gRNA sequence
gttggccccgagtccaggac

SEQ ID NO: 506645 - DNA, 20 bp, Artificial
  CRISPR gRNA sequence
ttggccccgagtccaggaca

SEQ ID NO: 506646 - DNA, 20 bp, Artificial
  CRISPR gRNA sequence
cgagtccaggacaaggcttc

SEQ ID NO: 506647 - DNA, 20 bp, Artificial
  CRISPR gRNA sequence
gagtccaggacaaggcttcc

SEQ ID NO: 506648 - DNA, 20 bp, Artificial
  CRISPR gRNA sequence
ccgcccctgtctgccccgct

SEQ ID NO: 506649 - DNA, 20 bp, Artificial
  CRISPR gRNA sequence
ctgtctgccccgctcagcgt

SEQ ID NO: 506650 - DNA, 20 bp, Artificial
  CRISPR gRNA sequence
cccgtgcttcgaaccctctc

SEQ ID NO: 506651 - DNA, 20 bp, Artificial
  CRISPR gRNA sequence
ccgtgcttcgaaccctctct

SEQ ID NO: 506652 - DNA, 20 bp, Artificial
  CRISPR gRNA sequence
cgtgcttcgaaccctctctg

SEQ ID NO: 506653 - DNA, 20 bp, Artificial
  CRISPR gRNA sequence
gcttcgaaccctctctgggg

SEQ ID NO: 506654 - DNA, 20 bp, Artificial
  CRISPR gRNA sequence
cttcgaaccctctctgggga

SEQ ID NO: 506655 - DNA, 20 bp, Artificial
  CRISPR gRNA sequence
gaaccctctctggggaaggc

SEQ ID NO: 506656 - DNA, 20 bp, Artificial
  CRISPR gRNA sequence
accctctctggggaaggctg

SEQ ID NO: 506657 - DNA, 20 bp, Artificial
  CRISPR gRNA sequence
cctctctggggaaggctgga

SEQ ID NO: 506658 - DNA, 20 bp, Artificial
  CRISPR gRNA sequence
ctctctggggaaggctggag

SEQ ID NO: 506659 - DNA, 20 bp, Artificial
  CRISPR gRNA sequence
tctggggaaggctggagagg

SEQ ID NO: 506660 - DNA, 20 bp, Artificial
  CRISPR gRNA sequence
tggggaaggctggagaggca

SEQ ID NO: 506661 - DNA, 20 bp, Artificial
  CRISPR gRNA sequence
ggggaaggctggagaggcag

SEQ ID NO: 506662 - DNA, 20 bp, Artificial
  CRISPR gRNA sequence
gagaggcagaggctgccacg

SEQ ID NO: 506663 - DNA, 20 bp, Artificial
  CRISPR gRNA sequence
agaggcagaggctgccacgc

SEQ ID NO: 506664 - DNA, 20 bp, Artificial
  CRISPR gRNA sequence
aggcagaggctgccacgcag

SEQ ID NO: 506665 - DNA, 20 bp, Artificial
  CRISPR gRNA sequence
gaggctgccacgcaggagtg

SEQ ID NO: 506666 - DNA, 20 bp, Artificial
  CRISPR gRNA sequence
aggctgccacgcaggagtgc

SEQ ID NO: 506667 - DNA, 20 bp, Artificial
  CRISPR gRNA sequence
ggctgccacgcaggagtgca

SEQ ID NO: 506668 - DNA, 20 bp, Artificial
  CRISPR gRNA sequence
tgccacgcaggagtgcaggg

SEQ ID NO: 506669 - DNA, 20 bp, Artificial
  CRISPR gRNA sequence
ccacgcaggagtgcagggca

SEQ ID NO: 506670 - DNA, 20 bp, Artificial
  CRISPR gRNA sequence
acgcaggagtgcagggcaga

SEQ ID NO: 506671 - DNA, 20 bp, Artificial
  CRISPR gRNA sequence
cagagagctgccacgccctc

SEQ ID NO: 506672 - DNA, 20 bp, Artificial
  CRISPR gRNA sequence
agagagctgccacgccctct

SEQ ID NO: 506673 - DNA, 20 bp, Artificial
  CRISPR gRNA sequence
ccctctgggcaatgtgtgca

SEQ ID NO: 506674 - DNA, 20 bp, Artificial
  CRISPR gRNA sequence
gggcaatgtgtgcatagact

SEQ ID NO: 506675 - DNA, 20 bp, Artificial
  CRISPR gRNA sequence
ggcaatgtgtgcatagactc

SEQ ID NO: 506676 - DNA, 20 bp, Artificial
  CRISPR gRNA sequence
tgtgcatagactcgggcttt

SEQ ID NO: 506677 - DNA, 20 bp, Artificial
  CRISPR gRNA sequence
tgcatagactcgggctttca

SEQ ID NO: 506678 - DNA, 20 bp, Artificial
  CRISPR gRNA sequence
agactcgggctttcagagtc

SEQ ID NO: 506679 - DNA, 20 bp, Artificial
  CRISPR gRNA sequence
gactcgggctttcagagtcc

SEQ ID NO: 506680 - DNA, 20 bp, Artificial
  CRISPR gRNA sequence
ggctttcagagtccaggcat

SEQ ID NO: 506681 - DNA, 20 bp, Artificial
  CRISPR gRNA sequence
tttcagagtccaggcatgag

SEQ ID NO: 506682 - DNA, 20 bp, Artificial
  CRISPR gRNA sequence
tccaggcatgagcagcattt

SEQ ID NO: 506683 - DNA, 20 bp, Artificial
  CRISPR gRNA sequence
ccaggcatgagcagcatttg

SEQ ID NO: 506684 - DNA, 20 bp, Artificial
  CRISPR gRNA sequence
gcatttgaggcgtctcaccg

SEQ ID NO: 506685 - DNA, 20 bp, Artificial
  CRISPR gRNA sequence
catttgaggcgtctcaccgt

SEQ ID NO: 506686 - DNA, 20 bp, Artificial
  CRISPR gRNA sequence
gaggcgtctcaccgtgggac

SEQ ID NO: 506687 - DNA, 20 bp, Artificial
  CRISPR gRNA sequence
aggcgtctcaccgtgggact

SEQ ID NO: 506688 - DNA, 20 bp, Artificial
  CRISPR gRNA sequence
ggcgtctcaccgtgggactg

SEQ ID NO: 506689 - DNA, 20 bp, Artificial
  CRISPR gRNA sequence
cgtgggactggggatgtcca

SEQ ID NO: 506690 - DNA, 20 bp, Artificial
  CRISPR gRNA sequence
gtgggactggggatgtccac

SEQ ID NO: 506691 - DNA, 20 bp, Artificial
  CRISPR gRNA sequence
tgggactggggatgtccacg

SEQ ID NO: 506692 - DNA, 20 bp, Artificial
  CRISPR gRNA sequence
gggactggggatgtccacgg

SEQ ID NO: 506693 - DNA, 20 bp, Artificial
  CRISPR gRNA sequence
actggggatgtccacggggg

SEQ ID NO: 506694 - DNA, 20 bp, Artificial
  CRISPR gRNA sequence
tgtccacgggggcagaatcc

SEQ ID NO: 506695 - DNA, 20 bp, Artificial
  CRISPR gRNA sequence
gaatcccagccttccccaca

SEQ ID NO: 506696 - DNA, 20 bp, Artificial
  CRISPR gRNA sequence
tcccagccttccccacacgg

SEQ ID NO: 506697 - DNA, 20 bp, Artificial
  CRISPR gRNA sequence
ggtggacctgctttcgcact

SEQ ID NO: 506698 - DNA, 20 bp, Artificial
  CRISPR gRNA sequence
gtggacctgctttcgcactg

SEQ ID NO: 506699 - DNA, 20 bp, Artificial
  CRISPR gRNA sequence
tggacctgctttcgcactga

SEQ ID NO: 506700 - DNA, 20 bp, Artificial
  CRISPR gRNA sequence
ctttcgcactgagggacact

SEQ ID NO: 506701 - DNA, 20 bp, Artificial
  CRISPR gRNA sequence
cactgagggacactcagttt

SEQ ID NO: 506702 - DNA, 20 bp, Artificial
  CRISPR gRNA sequence
tgagggacactcagtttcgg

SEQ ID NO: 506703 - DNA, 20 bp, Artificial
  CRISPR gRNA sequence
agggacactcagtttcggta

SEQ ID NO: 506704 - DNA, 20 bp, Artificial
  CRISPR gRNA sequence
gggacactcagtttcggtag

SEQ ID NO: 506705 - DNA, 20 bp, Artificial
  CRISPR gRNA sequence
tcagtttcggtagaggccat

SEQ ID NO: 506706 - DNA, 20 bp, Artificial
  CRISPR gRNA sequence
tcggtagaggccatgagtgt

SEQ ID NO: 506707 - DNA, 20 bp, Artificial
  CRISPR gRNA sequence
cggtagaggccatgagtgtc

SEQ ID NO: 506708 - DNA, 20 bp, Artificial
  CRISPR gRNA sequence
gaggccatgagtgtcaggtg

SEQ ID NO: 506709 - DNA, 20 bp, Artificial
  CRISPR gRNA sequence
aggtgcggctctccctaccc

SEQ ID NO: 506710 - DNA, 20 bp, Artificial
  CRISPR gRNA sequence
ggctctccctacccgagttc

SEQ ID NO: 506711 - DNA, 20 bp, Artificial
  CRISPR gRNA sequence
gctctccctacccgagttcc

SEQ ID NO: 506712 - DNA, 20 bp, Artificial
  CRISPR gRNA sequence
ctacccgagttccgggaccc

SEQ ID NO: 506713 - DNA, 20 bp, Artificial
  CRISPR gRNA sequence
tacccgagttccgggacccg

SEQ ID NO: 506714 - DNA, 20 bp, Artificial
  CRISPR gRNA sequence
acccgagttccgggacccga

SEQ ID NO: 506715 - DNA, 20 bp, Artificial
  CRISPR gRNA sequence
agggccgtccctcccgtctg

SEQ ID NO: 506716 - DNA, 20 bp, Artificial
  CRISPR gRNA sequence
tccctcccgtctgtggctcc

SEQ ID NO: 506717 - DNA, 20 bp, Artificial
  CRISPR gRNA sequence
ctcccgtctgtggctcccgg

SEQ ID NO: 506718 - DNA, 20 bp, Artificial
  CRISPR gRNA sequence
cccgtctgtggctcccggcg

SEQ ID NO: 506719 - DNA, 20 bp, Artificial
  CRISPR gRNA sequence
ccgtctgtggctcccggcgg

SEQ ID NO: 506720 - DNA, 20 bp, Artificial
  CRISPR gRNA sequence
tggctcccggcggaggacct

SEQ ID NO: 506721 - DNA, 20 bp, Artificial
  CRISPR gRNA sequence
acctgagtcttgtatctcta

SEQ ID NO: 506722 - DNA, 20 bp, Artificial
  CRISPR gRNA sequence
tgtatctctaaagtcctttg

SEQ ID NO: 506723 - DNA, 20 bp, Artificial
  CRISPR gRNA sequence
ctaaagtcctttgcggcccc

SEQ ID NO: 506724 - DNA, 20 bp, Artificial
  CRISPR gRNA sequence
aaagtcctttgcggccccca

SEQ ID NO: 506725 - DNA, 20 bp, Artificial
  CRISPR gRNA sequence
gcccccagagcctacaacgt

SEQ ID NO: 506726 - DNA, 20 bp, Artificial
  CRISPR gRNA sequence
cccccagagcctacaacgtc

SEQ ID NO: 506727 - DNA, 20 bp, Artificial
  CRISPR gRNA sequence
agcctacaacgtcaggctgc

SEQ ID NO: 506728 - DNA, 20 bp, Artificial
  CRISPR gRNA sequence
cctacaacgtcaggctgcaa

SEQ ID NO: 506729 - DNA, 20 bp, Artificial
  CRISPR gRNA sequence
gctgcaagagcgtcgcacta

SEQ ID NO: 506730 - DNA, 20 bp, Artificial
  CRISPR gRNA sequence
caagagcgtcgcactacggc

SEQ ID NO: 506731 - DNA, 20 bp, Artificial
  CRISPR gRNA sequence
agcgtcgcactacggccagc

SEQ ID NO: 506732 - DNA, 20 bp, Artificial
  CRISPR gRNA sequence
gcgtcgcactacggccagcg

SEQ ID NO: 506733 - DNA, 20 bp, Artificial
  CRISPR gRNA sequence
gcactacggccagcgaggac

SEQ ID NO: 506734 - DNA, 20 bp, Artificial
  CRISPR gRNA sequence
gaggacaagccccttgtgac

SEQ ID NO: 506735 - DNA, 20 bp, Artificial
  CRISPR gRNA sequence
gacaagccccttgtgaccag

SEQ ID NO: 506736 - DNA, 20 bp, Artificial
  CRISPR gRNA sequence
tgtgaccagtggttgcctct

SEQ ID NO: 506737 - DNA, 20 bp, Artificial
  CRISPR gRNA sequence
agtggttgcctctcggccca

SEQ ID NO: 506738 - DNA, 20 bp, Artificial
  CRISPR gRNA sequence
tctcggcccacggctgatcc

SEQ ID NO: 506739 - DNA, 20 bp, Artificial
  CRISPR gRNA sequence
ggcccacggctgatcccagc

SEQ ID NO: 506740 - DNA, 20 bp, Artificial
  CRISPR gRNA sequence
ccacggctgatcccagccag

SEQ ID NO: 506741 - DNA, 20 bp, Artificial
  CRISPR gRNA sequence
ctgatcccagccagaagtcc

SEQ ID NO: 506742 - DNA, 20 bp, Artificial
  CRISPR gRNA sequence
ccagaagtcctggcccctct

SEQ ID NO: 506743 - DNA, 20 bp, Artificial
  CRISPR gRNA sequence
cctggcccctctgagccatt

SEQ ID NO: 506744 - DNA, 20 bp, Artificial
  CRISPR gRNA sequence
gagccattgagatgcctccg

SEQ ID NO: 506745 - DNA, 20 bp, Artificial
  CRISPR gRNA sequence
gccattgagatgcctccgca

SEQ ID NO: 506746 - DNA, 20 bp, Artificial
  CRISPR gRNA sequence
cattgagatgcctccgcaga

SEQ ID NO: 506747 - DNA, 20 bp, Artificial
  CRISPR gRNA sequence
attgagatgcctccgcagag

SEQ ID NO: 506748 - DNA, 20 bp, Artificial
  CRISPR gRNA sequence
tcatcctaacccgtgcatcc

SEQ ID NO: 506749 - DNA, 20 bp, Artificial
  CRISPR gRNA sequence
catcctaacccgtgcatcct

SEQ ID NO: 506750 - DNA, 20 bp, Artificial
  CRISPR gRNA sequence
ccctccctgcatgttcctca

SEQ ID NO: 506751 - DNA, 20 bp, Artificial
  CRISPR gRNA sequence
catgttcctcatggtccccg

SEQ ID NO: 506752 - DNA, 20 bp, Artificial
  CRISPR gRNA sequence
ggtccccgcagccgctcacc

SEQ ID NO: 506753 - DNA, 20 bp, Artificial
  CRISPR gRNA sequence
ccgcagccgctcacccagct

SEQ ID NO: 506754 - DNA, 20 bp, Artificial
  CRISPR gRNA sequence
cgcagccgctcacccagctc

SEQ ID NO: 506755 - DNA, 20 bp, Artificial
  CRISPR gRNA sequence
cgctcacccagctcaggcaa

SEQ ID NO: 506756 - DNA, 20 bp, Artificial
  CRISPR gRNA sequence
gctcacccagctcaggcaat

SEQ ID NO: 506757 - DNA, 20 bp, Artificial
  CRISPR gRNA sequence
ctcacccagctcaggcaatg

SEQ ID NO: 506758 - DNA, 20 bp, Artificial
  CRISPR gRNA sequence
tcacccagctcaggcaatgg

SEQ ID NO: 506759 - DNA, 20 bp, Artificial
  CRISPR gRNA sequence
cccagctcaggcaatggggg

SEQ ID NO: 506760 - DNA, 20 bp, Artificial
  CRISPR gRNA sequence
ccagctcaggcaatgggggc

SEQ ID NO: 506761 - DNA, 20 bp, Artificial
  CRISPR gRNA sequence
cagctcaggcaatgggggca

SEQ ID NO: 506762 - DNA, 20 bp, Artificial
  CRISPR gRNA sequence
gctcaggcaatgggggcagg

SEQ ID NO: 506763 - DNA, 20 bp, Artificial
  CRISPR gRNA sequence
ctcaggcaatgggggcaggg

SEQ ID NO: 506764 - DNA, 20 bp, Artificial
  CRISPR gRNA sequence
tcaggcaatgggggcaggga

SEQ ID NO: 506765 - DNA, 20 bp, Artificial
  CRISPR gRNA sequence
caggcaatgggggcagggag

SEQ ID NO: 506766 - DNA, 20 bp, Artificial
  CRISPR gRNA sequence
ggggcagggaggggccacac

SEQ ID NO: 506767 - DNA, 20 bp, Artificial
  CRISPR gRNA sequence
ggcagggaggggccacactg

SEQ ID NO: 506768 - DNA, 20 bp, Artificial
  CRISPR gRNA sequence
gcagggaggggccacactgg

SEQ ID NO: 506769 - DNA, 20 bp, Artificial
  CRISPR gRNA sequence
agggaggggccacactggag

SEQ ID NO: 506770 - DNA, 20 bp, Artificial
  CRISPR gRNA sequence
gggaggggccacactggagg

SEQ ID NO: 506771 - DNA, 20 bp, Artificial
  CRISPR gRNA sequence
aggggccacactggaggagg

SEQ ID NO: 506772 - DNA, 20 bp, Artificial
  CRISPR gRNA sequence
cacactggaggaggcggact

SEQ ID NO: 506773 - DNA, 20 bp, Artificial
  CRISPR gRNA sequence
acactggaggaggcggactc

SEQ ID NO: 506774 - DNA, 20 bp, Artificial
  CRISPR gRNA sequence
cactggaggaggcggactca

SEQ ID NO: 506775 - DNA, 20 bp, Artificial
  CRISPR gRNA sequence
actggaggaggcggactcag

SEQ ID NO: 506776 - DNA, 20 bp, Artificial
  CRISPR gRNA sequence
ggaggaggcggactcagggg

SEQ ID NO: 506777 - DNA, 20 bp, Artificial
  CRISPR gRNA sequence
ggaggcggactcaggggcag

SEQ ID NO: 506778 - DNA, 20 bp, Artificial
  CRISPR gRNA sequence
gaggcggactcaggggcagc

SEQ ID NO: 506779 - DNA, 20 bp, Artificial
  CRISPR gRNA sequence
aggcggactcaggggcagca

SEQ ID NO: 506780 - DNA, 20 bp, Artificial
  CRISPR gRNA sequence
caggggcagcagggaacgta

SEQ ID NO: 506781 - DNA, 20 bp, Artificial
  CRISPR gRNA sequence
gggcagcagggaacgtacag

SEQ ID NO: 506782 - DNA, 20 bp, Artificial
  CRISPR gRNA sequence
gcagcagggaacgtacagtg

SEQ ID NO: 506783 - DNA, 20 bp, Artificial
  CRISPR gRNA sequence
cagcagggaacgtacagtgg

SEQ ID NO: 506784 - DNA, 20 bp, Artificial
  CRISPR gRNA sequence
agggaacgtacagtggaggc

SEQ ID NO: 506785 - DNA, 20 bp, Artificial
  CRISPR gRNA sequence
gggaacgtacagtggaggcc

SEQ ID NO: 506786 - DNA, 20 bp, Artificial
  CRISPR gRNA sequence
gaacgtacagtggaggccgg

SEQ ID NO: 506787 - DNA, 20 bp, Artificial
  CRISPR gRNA sequence
aacgtacagtggaggccggg

SEQ ID NO: 506788 - DNA, 20 bp, Artificial
  CRISPR gRNA sequence
acgtacagtggaggccggga

SEQ ID NO: 506789 - DNA, 20 bp, Artificial
  CRISPR gRNA sequence
cgtacagtggaggccgggag

SEQ ID NO: 506790 - DNA, 20 bp, Artificial
  CRISPR gRNA sequence
gtacagtggaggccgggagg

SEQ ID NO: 506791 - DNA, 20 bp, Artificial
  CRISPR gRNA sequence
acagtggaggccgggagggg

SEQ ID NO: 506792 - DNA, 20 bp, Artificial
  CRISPR gRNA sequence
cagtggaggccgggaggggg

SEQ ID NO: 506793 - DNA, 20 bp, Artificial
  CRISPR gRNA sequence
gtggaggccgggagggggag

SEQ ID NO: 506794 - DNA, 20 bp, Artificial
  CRISPR gRNA sequence
tggaggccgggagggggagg

SEQ ID NO: 506795 - DNA, 20 bp, Artificial
  CRISPR gRNA sequence
aggccgggagggggaggagg

SEQ ID NO: 506796 - DNA, 20 bp, Artificial
  CRISPR gRNA sequence
agggggaggaggcggatgct

SEQ ID NO: 506797 - DNA, 20 bp, Artificial
  CRISPR gRNA sequence
gggggaggaggcggatgctt

SEQ ID NO: 506798 - DNA, 20 bp, Artificial
  CRISPR gRNA sequence
ggggaggaggcggatgcttg

SEQ ID NO: 506799 - DNA, 20 bp, Artificial
  CRISPR gRNA sequence
aggaggcggatgcttgggga

SEQ ID NO: 506800 - DNA, 20 bp, Artificial
  CRISPR gRNA sequence
ggaggcggatgcttggggat

SEQ ID NO: 506801 - DNA, 20 bp, Artificial
  CRISPR gRNA sequence
gatgcttggggatgggaccc

SEQ ID NO: 506802 - DNA, 20 bp, Artificial
  CRISPR gRNA sequence
cttggggatgggaccctggc

SEQ ID NO: 506803 - DNA, 20 bp, Artificial
  CRISPR gRNA sequence
tggggatgggaccctggcca

SEQ ID NO: 506804 - DNA, 20 bp, Artificial
  CRISPR gRNA sequence
ggggatgggaccctggccag

SEQ ID NO: 506805 - DNA, 20 bp, Artificial
  CRISPR gRNA sequence
gatgggaccctggccagagg

SEQ ID NO: 506806 - DNA, 20 bp, Artificial
  CRISPR gRNA sequence
atgggaccctggccagaggc

SEQ ID NO: 506807 - DNA, 20 bp, Artificial
  CRISPR gRNA sequence
tgggaccctggccagaggcg

SEQ ID NO: 506808 - DNA, 20 bp, Artificial
  CRISPR gRNA sequence
accctggccagaggcgggga

SEQ ID NO: 506809 - DNA, 20 bp, Artificial
  CRISPR gRNA sequence
ctggccagaggcggggacgg

SEQ ID NO: 506810 - DNA, 20 bp, Artificial
  CRISPR gRNA sequence
tggccagaggcggggacggc

SEQ ID NO: 506811 - DNA, 20 bp, Artificial
  CRISPR gRNA sequence
ggccagaggcggggacggca

SEQ ID NO: 506812 - DNA, 20 bp, Artificial
  CRISPR gRNA sequence
gaggcggggacggcagggtg

SEQ ID NO: 506813 - DNA, 20 bp, Artificial
  CRISPR gRNA sequence
gggacggcagggtgcagccg

SEQ ID NO: 506814 - DNA, 20 bp, Artificial
  CRISPR gRNA sequence
ggcagggtgcagccgtagcc

SEQ ID NO: 506815 - DNA, 20 bp, Artificial
  CRISPR gRNA sequence
gcagggtgcagccgtagcct

SEQ ID NO: 506816 - DNA, 20 bp, Artificial
  CRISPR gRNA sequence
cagggtgcagccgtagcctg

SEQ ID NO: 506817 - DNA, 20 bp, Artificial
  CRISPR gRNA sequence
agggtgcagccgtagcctgg

SEQ ID NO: 506818 - DNA, 20 bp, Artificial
  CRISPR gRNA sequence
gtgcagccgtagcctggggg

SEQ ID NO: 506819 - DNA, 20 bp, Artificial
  CRISPR gRNA sequence
gggcggttactatacctcca

SEQ ID NO: 506820 - DNA, 20 bp, Artificial
  CRISPR gRNA sequence
cggttactatacctccacag

SEQ ID NO: 506821 - DNA, 20 bp, Artificial
  CRISPR gRNA sequence
tatacctccacagcagctgt

SEQ ID NO: 506822 - DNA, 20 bp, Artificial
  CRISPR gRNA sequence
ctccacagcagctgtcagcc

SEQ ID NO: 506823 - DNA, 20 bp, Artificial
  CRISPR gRNA sequence
tccacagcagctgtcagccc

SEQ ID NO: 506824 - DNA, 20 bp, Artificial
  CRISPR gRNA sequence
acagcagctgtcagcccagg

SEQ ID NO: 506825 - DNA, 20 bp, Artificial
  CRISPR gRNA sequence
cagcagctgtcagcccaggt

SEQ ID NO: 506826 - DNA, 20 bp, Artificial
  CRISPR gRNA sequence
agcagctgtcagcccaggta

SEQ ID NO: 506827 - DNA, 20 bp, Artificial
  CRISPR gRNA sequence
gcagctgtcagcccaggtag

SEQ ID NO: 506828 - DNA, 20 bp, Artificial
  CRISPR gRNA sequence
cagctgtcagcccaggtagg

SEQ ID NO: 506829 - DNA, 20 bp, Artificial
  CRISPR gRNA sequence
agctgtcagcccaggtaggg

SEQ ID NO: 506830 - DNA, 20 bp, Artificial
  CRISPR gRNA sequence
tgtcagcccaggtagggggg

SEQ ID NO: 506831 - DNA, 20 bp, Artificial
  CRISPR gRNA sequence
cagcccaggtaggggggcag

SEQ ID NO: 506832 - DNA, 20 bp, Artificial
  CRISPR gRNA sequence
agcccaggtaggggggcagt

SEQ ID NO: 506833 - DNA, 20 bp, Artificial
  CRISPR gRNA sequence
gcccaggtaggggggcagtg

SEQ ID NO: 506834 - DNA, 20 bp, Artificial
  CRISPR gRNA sequence
aggtaggggggcagtggggc

SEQ ID NO: 506835 - DNA, 20 bp, Artificial
  CRISPR gRNA sequence
gtaggggggcagtggggctg

SEQ ID NO: 506836 - DNA, 20 bp, Artificial
  CRISPR gRNA sequence
gcagtggggctggagaccaa

SEQ ID NO: 506837 - DNA, 20 bp, Artificial
  CRISPR gRNA sequence
agtggggctggagaccaaca

SEQ ID NO: 506838 - DNA, 20 bp, Artificial
  CRISPR gRNA sequence
ggctggagaccaacagagcc

SEQ ID NO: 506839 - DNA, 20 bp, Artificial
  CRISPR gRNA sequence
gctggagaccaacagagcct

SEQ ID NO: 506840 - DNA, 20 bp, Artificial
  CRISPR gRNA sequence
acagagcctgggtgtcccac

SEQ ID NO: 506841 - DNA, 20 bp, Artificial
  CRISPR gRNA sequence
cagagcctgggtgtcccaca

SEQ ID NO: 506842 - DNA, 20 bp, Artificial
  CRISPR gRNA sequence
agagcctgggtgtcccacaa

SEQ ID NO: 506843 - DNA, 20 bp, Artificial
  CRISPR gRNA sequence
cctgggtgtcccacaagggc

SEQ ID NO: 506844 - DNA, 20 bp, Artificial
  CRISPR gRNA sequence
ctgggtgtcccacaagggcg

SEQ ID NO: 506845 - DNA, 20 bp, Artificial
  CRISPR gRNA sequence
gtgtcccacaagggcgaggc

SEQ ID NO: 506846 - DNA, 20 bp, Artificial
  CRISPR gRNA sequence
tgtcccacaagggcgaggcc

SEQ ID NO: 506847 - DNA, 20 bp, Artificial
  CRISPR gRNA sequence
acaagggcgaggccgggcct

SEQ ID NO: 506848 - DNA, 20 bp, Artificial
  CRISPR gRNA sequence
ggcgaggccgggcctcagcc

SEQ ID NO: 506849 - DNA, 20 bp, Artificial
  CRISPR gRNA sequence
ccaccaaccctaccctcccc

SEQ ID NO: 506850 - DNA, 20 bp, Artificial
  CRISPR gRNA sequence
accctaccctcccctggcct

SEQ ID NO: 506851 - DNA, 20 bp, Artificial
  CRISPR gRNA sequence
ccctaccctcccctggcctg

SEQ ID NO: 506852 - DNA, 20 bp, Artificial
  CRISPR gRNA sequence
accctcccctggcctgaggc

SEQ ID NO: 506853 - DNA, 20 bp, Artificial
  CRISPR gRNA sequence
cccctggcctgaggccagtc

SEQ ID NO: 506854 - DNA, 20 bp, Artificial
  CRISPR gRNA sequence
ccctggcctgaggccagtcc

SEQ ID NO: 506855 - DNA, 20 bp, Artificial
  CRISPR gRNA sequence
cctggcctgaggccagtccg

SEQ ID NO: 506856 - DNA, 20 bp, Artificial
  CRISPR gRNA sequence
tggcctgaggccagtccggg

SEQ ID NO: 506857 - DNA, 20 bp, Artificial
  CRISPR gRNA sequence
ggagaccccacgctgccact

SEQ ID NO: 506858 - DNA, 20 bp, Artificial
  CRISPR gRNA sequence
gagaccccacgctgccactt

SEQ ID NO: 506859 - DNA, 20 bp, Artificial
  CRISPR gRNA sequence
agaccccacgctgccacttg

SEQ ID NO: 506860 - DNA, 20 bp, Artificial
  CRISPR gRNA sequence
acgctgccacttggggcttc

SEQ ID NO: 506861 - DNA, 20 bp, Artificial
  CRISPR gRNA sequence
ctgccacttggggcttccag

SEQ ID NO: 506862 - DNA, 20 bp, Artificial
  CRISPR gRNA sequence
ggggcttccagaagtttcct

SEQ ID NO: 506863 - DNA, 20 bp, Artificial
  CRISPR gRNA sequence
gggcttccagaagtttcctc

SEQ ID NO: 506864 - DNA, 20 bp, Artificial
  CRISPR gRNA sequence
ttcctcaggaatctgctcct

SEQ ID NO: 506865 - DNA, 20 bp, Artificial
  CRISPR gRNA sequence
tcctcaggaatctgctcctt

SEQ ID NO: 506866 - DNA, 20 bp, Artificial
  CRISPR gRNA sequence
caggaatctgctccttgggt

SEQ ID NO: 506867 - DNA, 20 bp, Artificial
  CRISPR gRNA sequence
gaatctgctccttgggtcag

SEQ ID NO: 506868 - DNA, 20 bp, Artificial
  CRISPR gRNA sequence
aatctgctccttgggtcaga

SEQ ID NO: 506869 - DNA, 20 bp, Artificial
  CRISPR gRNA sequence
tctgctccttgggtcagaag

SEQ ID NO: 506870 - DNA, 20 bp, Artificial
  CRISPR gRNA sequence
ctgctccttgggtcagaagg

SEQ ID NO: 506871 - DNA, 20 bp, Artificial
  CRISPR gRNA sequence
gggtcagaaggaggctctgt

SEQ ID NO: 506872 - DNA, 20 bp, Artificial
  CRISPR gRNA sequence
ggtcagaaggaggctctgtc

SEQ ID NO: 506873 - DNA, 20 bp, Artificial
  CRISPR gRNA sequence
cagaaggaggctctgtcagg

SEQ ID NO: 506874 - DNA, 20 bp, Artificial
  CRISPR gRNA sequence
gaaggaggctctgtcaggtg

SEQ ID NO: 506875 - DNA, 20 bp, Artificial
  CRISPR gRNA sequence
cccacccttgtctcctccgt

SEQ ID NO: 506876 - DNA, 20 bp, Artificial
  CRISPR gRNA sequence
acccttgtctcctccgtcag

SEQ ID NO: 506877 - DNA, 20 bp, Artificial
  CRISPR gRNA sequence
ctccgtcagtggtgtcctgc

SEQ ID NO: 506878 - DNA, 20 bp, Artificial
  CRISPR gRNA sequence
tccgtcagtggtgtcctgcc

SEQ ID NO: 506879 - DNA, 20 bp, Artificial
  CRISPR gRNA sequence
gtcagtggtgtcctgccagg

SEQ ID NO: 506880 - DNA, 20 bp, Artificial
  CRISPR gRNA sequence
gtgtcctgccaggcggtgcc

SEQ ID NO: 506881 - DNA, 20 bp, Artificial
  CRISPR gRNA sequence
tgtcctgccaggcggtgcct

SEQ ID NO: 506882 - DNA, 20 bp, Artificial
  CRISPR gRNA sequence
ccaggcggtgcctgggtgcc

SEQ ID NO: 506883 - DNA, 20 bp, Artificial
  CRISPR gRNA sequence
caggcggtgcctgggtgcct

SEQ ID NO: 506884 - DNA, 20 bp, Artificial
  CRISPR gRNA sequence
aggcggtgcctgggtgcctg

SEQ ID NO: 506885 - DNA, 20 bp, Artificial
  CRISPR gRNA sequence
cggtgcctgggtgcctgggg

SEQ ID NO: 506886 - DNA, 20 bp, Artificial
  CRISPR gRNA sequence
ggtgcctgggtgcctggggt

SEQ ID NO: 506887 - DNA, 20 bp, Artificial
  CRISPR gRNA sequence
gtgcctgggtgcctggggtg

SEQ ID NO: 506888 - DNA, 20 bp, Artificial
  CRISPR gRNA sequence
attcgttgctcctcttgtac

SEQ ID NO: 506889 - DNA, 20 bp, Artificial
  CRISPR gRNA sequence
ctcttgtacaagttgtcctc

SEQ ID NO: 506890 - DNA, 20 bp, Artificial
  CRISPR gRNA sequence
tcttgtacaagttgtcctcc

SEQ ID NO: 506891 - DNA, 20 bp, Artificial
  CRISPR gRNA sequence
acaagttgtcctccaggtga

SEQ ID NO: 506892 - DNA, 20 bp, Artificial
  CRISPR gRNA sequence
agttgtcctccaggtgacag

SEQ ID NO: 506893 - DNA, 20 bp, Artificial
  CRISPR gRNA sequence
caggtgacagcggccgtcgt

SEQ ID NO: 506894 - DNA, 20 bp, Artificial
  CRISPR gRNA sequence
aggtgacagcggccgtcgtt

SEQ ID NO: 506895 - DNA, 20 bp, Artificial
  CRISPR gRNA sequence
ggtgacagcggccgtcgttg

SEQ ID NO: 506896 - DNA, 20 bp, Artificial
  CRISPR gRNA sequence
gtgacagcggccgtcgttgg

SEQ ID NO: 506897 - DNA, 20 bp, Artificial
  CRISPR gRNA sequence
cagcggccgtcgttgggggt

SEQ ID NO: 506898 - DNA, 20 bp, Artificial
  CRISPR gRNA sequence
agcggccgtcgttgggggtc

SEQ ID NO: 506899 - DNA, 20 bp, Artificial
  CRISPR gRNA sequence
gccgtcgttgggggtcagga

SEQ ID NO: 506900 - DNA, 20 bp, Artificial
  CRISPR gRNA sequence
ttgggggtcaggatggcgcc

SEQ ID NO: 506901 - DNA, 20 bp, Artificial
  CRISPR gRNA sequence
gcttcccgtcgcccgcgaaa

SEQ ID NO: 506902 - DNA, 20 bp, Artificial
  CRISPR gRNA sequence
tcccgtcgcccgcgaaatgg

SEQ ID NO: 506903 - DNA, 20 bp, Artificial
  CRISPR gRNA sequence
cgcgaaatggaagccgtcat

SEQ ID NO: 506904 - DNA, 20 bp, Artificial
  CRISPR gRNA sequence
gaaatggaagccgtcatcag

SEQ ID NO: 506905 - DNA, 20 bp, Artificial
  CRISPR gRNA sequence
ccgtcatcagtggcaaacac

SEQ ID NO: 506906 - DNA, 20 bp, Artificial
  CRISPR gRNA sequence
tcatcagtggcaaacaccag

SEQ ID NO: 506907 - DNA, 20 bp, Artificial
  CRISPR gRNA sequence
gcagccgcgtgacgttgcgc

SEQ ID NO: 506908 - DNA, 20 bp, Artificial
  CRISPR gRNA sequence
gcgccagccgatttcctcct

SEQ ID NO: 506909 - DNA, 20 bp, Artificial
  CRISPR gRNA sequence
ccagccgatttcctcctgag

SEQ ID NO: 506910 - DNA, 20 bp, Artificial
  CRISPR gRNA sequence
gccgatttcctcctgagaag

SEQ ID NO: 506911 - DNA, 20 bp, Artificial
  CRISPR gRNA sequence
ccgatttcctcctgagaaga

SEQ ID NO: 506912 - DNA, 20 bp, Artificial
  CRISPR gRNA sequence
ttcctcctgagaagaaggcg

SEQ ID NO: 506913 - DNA, 20 bp, Artificial
  CRISPR gRNA sequence
tcctcctgagaagaaggcgt

SEQ ID NO: 506914 - DNA, 20 bp, Artificial
  CRISPR gRNA sequence
cctcctgagaagaaggcgtg

SEQ ID NO: 506915 - DNA, 20 bp, Artificial
  CRISPR gRNA sequence
ctcctgagaagaaggcgtgg

SEQ ID NO: 506916 - DNA, 20 bp, Artificial
  CRISPR gRNA sequence
tcctgagaagaaggcgtggg

SEQ ID NO: 506917 - DNA, 20 bp, Artificial
  CRISPR gRNA sequence
tgagaagaaggcgtgggggg

SEQ ID NO: 506918 - DNA, 20 bp, Artificial
  CRISPR gRNA sequence
gagaagaaggcgtggggggc

SEQ ID NO: 506919 - DNA, 20 bp, Artificial
  CRISPR gRNA sequence
agaagaaggcgtggggggca

SEQ ID NO: 506920 - DNA, 20 bp, Artificial
  CRISPR gRNA sequence
gggggcagggttacctgcct

SEQ ID NO: 506921 - DNA, 20 bp, Artificial
  CRISPR gRNA sequence
ggttacctgcctcagtttcc

SEQ ID NO: 506922 - DNA, 20 bp, Artificial
  CRISPR gRNA sequence
ctgcctcagtttcccagacc

SEQ ID NO: 506923 - DNA, 20 bp, Artificial
  CRISPR gRNA sequence
gtttcccagacccggccctc

SEQ ID NO: 506924 - DNA, 20 bp, Artificial
  CRISPR gRNA sequence
ttcccagacccggccctctg

SEQ ID NO: 506925 - DNA, 20 bp, Artificial
  CRISPR gRNA sequence
ccagacccggccctctggag

SEQ ID NO: 506926 - DNA, 20 bp, Artificial
  CRISPR gRNA sequence
agacccggccctctggagca

SEQ ID NO: 506927 - DNA, 20 bp, Artificial
  CRISPR gRNA sequence
gacccggccctctggagcag

SEQ ID NO: 506928 - DNA, 20 bp, Artificial
  CRISPR gRNA sequence
cccggccctctggagcagag

SEQ ID NO: 506929 - DNA, 20 bp, Artificial
  CRISPR gRNA sequence
ctggagcagaggagacgatg

SEQ ID NO: 506930 - DNA, 20 bp, Artificial
  CRISPR gRNA sequence
ggagcagaggagacgatgca

SEQ ID NO: 506931 - DNA, 20 bp, Artificial
  CRISPR gRNA sequence
cagaggagacgatgcagagc

SEQ ID NO: 506932 - DNA, 20 bp, Artificial
  CRISPR gRNA sequence
aggagacgatgcagagctgg

SEQ ID NO: 506933 - DNA, 20 bp, Artificial
  CRISPR gRNA sequence
ggagacgatgcagagctggt

SEQ ID NO: 506934 - DNA, 20 bp, Artificial
  CRISPR gRNA sequence
gagacgatgcagagctggtg

SEQ ID NO: 506935 - DNA, 20 bp, Artificial
  CRISPR gRNA sequence
acgatgcagagctggtgggg

SEQ ID NO: 506936 - DNA, 20 bp, Artificial
  CRISPR gRNA sequence
gcagagctggtggggtggcc

SEQ ID NO: 506937 - DNA, 20 bp, Artificial
  CRISPR gRNA sequence
agagctggtggggtggcccg

SEQ ID NO: 506938 - DNA, 20 bp, Artificial
  CRISPR gRNA sequence
gagctggtggggtggcccgg

SEQ ID NO: 506939 - DNA, 20 bp, Artificial
  CRISPR gRNA sequence
tggtggggtggcccggaggc

SEQ ID NO: 506940 - DNA, 20 bp, Artificial
  CRISPR gRNA sequence
gggtggcccggaggctggtg

SEQ ID NO: 506941 - DNA, 20 bp, Artificial
  CRISPR gRNA sequence
ggtggcccggaggctggtgt

SEQ ID NO: 506942 - DNA, 20 bp, Artificial
  CRISPR gRNA sequence
gtgtgggtccccctttcccc

SEQ ID NO: 506943 - DNA, 20 bp, Artificial
  CRISPR gRNA sequence
tgtgggtccccctttcccct

SEQ ID NO: 506944 - DNA, 20 bp, Artificial
  CRISPR gRNA sequence
tccccctttcccctgggtct

SEQ ID NO: 506945 - DNA, 20 bp, Artificial
  CRISPR gRNA sequence
ccccctttcccctgggtctc

SEQ ID NO: 506946 - DNA, 20 bp, Artificial
  CRISPR gRNA sequence
cccctttcccctgggtctca

SEQ ID NO: 506947 - DNA, 20 bp, Artificial
  CRISPR gRNA sequence
tcccctgggtctcagggacc

SEQ ID NO: 506948 - DNA, 20 bp, Artificial
  CRISPR gRNA sequence
gggacccagctgtgttcccc

SEQ ID NO: 506949 - DNA, 20 bp, Artificial
  CRISPR gRNA sequence
gttcccccagacgccacgcc

SEQ ID NO: 506950 - DNA, 20 bp, Artificial
  CRISPR gRNA sequence
ttcccccagacgccacgccc

SEQ ID NO: 506951 - DNA, 20 bp, Artificial
  CRISPR gRNA sequence
cccccagacgccacgcccag

SEQ ID NO: 506952 - DNA, 20 bp, Artificial
  CRISPR gRNA sequence
ccccagacgccacgcccagg

SEQ ID NO: 506953 - DNA, 20 bp, Artificial
  CRISPR gRNA sequence
ccagacgccacgcccaggag

SEQ ID NO: 506954 - DNA, 20 bp, Artificial
  CRISPR gRNA sequence
ccacgcccaggaggagacaa

SEQ ID NO: 506955 - DNA, 20 bp, Artificial
  CRISPR gRNA sequence
caaacaccccgtgcacatgt

SEQ ID NO: 506956 - DNA, 20 bp, Artificial
  CRISPR gRNA sequence
aaacaccccgtgcacatgtg

SEQ ID NO: 506957 - DNA, 20 bp, Artificial
  CRISPR gRNA sequence
ccccgtgcacatgtgaggcg

SEQ ID NO: 506958 - DNA, 20 bp, Artificial
  CRISPR gRNA sequence
cccgtgcacatgtgaggcgc

SEQ ID NO: 506959 - DNA, 20 bp, Artificial
  CRISPR gRNA sequence
ccgtgcacatgtgaggcgca

SEQ ID NO: 506960 - DNA, 20 bp, Artificial
  CRISPR gRNA sequence
gtgcacatgtgaggcgcagg

SEQ ID NO: 506961 - DNA, 20 bp, Artificial
  CRISPR gRNA sequence
cacatgtgaggcgcagggag

SEQ ID NO: 506962 - DNA, 20 bp, Artificial
  CRISPR gRNA sequence
catgtgaggcgcagggagtg

SEQ ID NO: 506963 - DNA, 20 bp, Artificial
  CRISPR gRNA sequence
atgtgaggcgcagggagtgg

SEQ ID NO: 506964 - DNA, 20 bp, Artificial
  CRISPR gRNA sequence
gcagggagtggaggcacgtg

SEQ ID NO: 506965 - DNA, 20 bp, Artificial
  CRISPR gRNA sequence
ggagtggaggcacgtgtgga

SEQ ID NO: 506966 - DNA, 20 bp, Artificial
  CRISPR gRNA sequence
gagtggaggcacgtgtggaa

SEQ ID NO: 506967 - DNA, 20 bp, Artificial
  CRISPR gRNA sequence
ggaggcacgtgtggaaaggc

SEQ ID NO: 506968 - DNA, 20 bp, Artificial
  CRISPR gRNA sequence
gaggcacgtgtggaaaggca

SEQ ID NO: 506969 - DNA, 20 bp, Artificial
  CRISPR gRNA sequence
ggcacgtgtggaaaggcaag

SEQ ID NO: 506970 - DNA, 20 bp, Artificial
  CRISPR gRNA sequence
cacgtgtggaaaggcaagga

SEQ ID NO: 506971 - DNA, 20 bp, Artificial
  CRISPR gRNA sequence
cgtgtggaaaggcaaggaga

SEQ ID NO: 506972 - DNA, 20 bp, Artificial
  CRISPR gRNA sequence
gaaaggcaaggagagagaca

SEQ ID NO: 506973 - DNA, 20 bp, Artificial
  CRISPR gRNA sequence
caaggagagagacacggctg

SEQ ID NO: 506974 - DNA, 20 bp, Artificial
  CRISPR gRNA sequence
cggctgcggtccctgcactt

SEQ ID NO: 506975 - DNA, 20 bp, Artificial
  CRISPR gRNA sequence
gctgcggtccctgcacttca

SEQ ID NO: 506976 - DNA, 20 bp, Artificial
  CRISPR gRNA sequence
cggtccctgcacttcagagc

SEQ ID NO: 506977 - DNA, 20 bp, Artificial
  CRISPR gRNA sequence
ggtccctgcacttcagagct

SEQ ID NO: 506978 - DNA, 20 bp, Artificial
  CRISPR gRNA sequence
cagagctgggaacaaaccct

SEQ ID NO: 506979 - DNA, 20 bp, Artificial
  CRISPR gRNA sequence
agagctgggaacaaaccctc

SEQ ID NO: 506980 - DNA, 20 bp, Artificial
  CRISPR gRNA sequence
accctcaggaaaccatcccc

SEQ ID NO: 506981 - DNA, 20 bp, Artificial
  CRISPR gRNA sequence
ccctcaggaaaccatcccca

SEQ ID NO: 506982 - DNA, 20 bp, Artificial
  CRISPR gRNA sequence
cctcaggaaaccatccccaa

SEQ ID NO: 506983 - DNA, 20 bp, Artificial
  CRISPR gRNA sequence
ctcaggaaaccatccccaag

SEQ ID NO: 506984 - DNA, 20 bp, Artificial
  CRISPR gRNA sequence
cccaaggggaaaaaccctcg

SEQ ID NO: 506985 - DNA, 20 bp, Artificial
  CRISPR gRNA sequence
gaaaaaccctcgcagacgtg

SEQ ID NO: 506986 - DNA, 20 bp, Artificial
  CRISPR gRNA sequence
aaaaaccctcgcagacgtgt

SEQ ID NO: 506987 - DNA, 20 bp, Artificial
  CRISPR gRNA sequence
gcagacgtgtgggccacacg

SEQ ID NO: 506988 - DNA, 20 bp, Artificial
  CRISPR gRNA sequence
gtgtgggccacacgcagaac

SEQ ID NO: 506989 - DNA, 20 bp, Artificial
  CRISPR gRNA sequence
cacgcagaacgagtgcaaca

SEQ ID NO: 506990 - DNA, 20 bp, Artificial
  CRISPR gRNA sequence
cgcagaacgagtgcaacatg

SEQ ID NO: 506991 - DNA, 20 bp, Artificial
  CRISPR gRNA sequence
gcagaacgagtgcaacatgg

SEQ ID NO: 506992 - DNA, 20 bp, Artificial
  CRISPR gRNA sequence
agtgcaacatggaggaaaac

SEQ ID NO: 506993 - DNA, 20 bp, Artificial
  CRISPR gRNA sequence
acatggaggaaaacgagcct

SEQ ID NO: 506994 - DNA, 20 bp, Artificial
  CRISPR gRNA sequence
catggaggaaaacgagcctg

SEQ ID NO: 506995 - DNA, 20 bp, Artificial
  CRISPR gRNA sequence
atggaggaaaacgagcctga

SEQ ID NO: 506996 - DNA, 20 bp, Artificial
  CRISPR gRNA sequence
tggaggaaaacgagcctgag

SEQ ID NO: 506997 - DNA, 20 bp, Artificial
  CRISPR gRNA sequence
gaaaacgagcctgaggggcc

SEQ ID NO: 506998 - DNA, 20 bp, Artificial
  CRISPR gRNA sequence
aacgagcctgaggggcccag

SEQ ID NO: 506999 - DNA, 20 bp, Artificial
  CRISPR gRNA sequence
acgagcctgaggggcccagc

SEQ ID NO: 507000 - DNA, 20 bp, Artificial
  CRISPR gRNA sequence
tgaggggcccagcaggcctt

SEQ ID NO: 507001 - DNA, 20 bp, Artificial
  CRISPR gRNA sequence
ggccttgagtccaccattga

SEQ ID NO: 507002 - DNA, 20 bp, Artificial
  CRISPR gRNA sequence
agtccaccattgacagcccc

SEQ ID NO: 507003 - DNA, 20 bp, Artificial
  CRISPR gRNA sequence
ccaccattgacagcccctgg

SEQ ID NO: 507004 - DNA, 20 bp, Artificial
  CRISPR gRNA sequence
caccattgacagcccctggc

SEQ ID NO: 507005 - DNA, 20 bp, Artificial
  CRISPR gRNA sequence
cagcccctggcaggcgcatg

SEQ ID NO: 507006 - DNA, 20 bp, Artificial
  CRISPR gRNA sequence
agcccctggcaggcgcatgt

SEQ ID NO: 507007 - DNA, 20 bp, Artificial
  CRISPR gRNA sequence
gcccctggcaggcgcatgtg

SEQ ID NO: 507008 - DNA, 20 bp, Artificial
  CRISPR gRNA sequence
cccctggcaggcgcatgtgg

SEQ ID NO: 507009 - DNA, 20 bp, Artificial
  CRISPR gRNA sequence
tgtgggggccgtgcgtgtcc

SEQ ID NO: 507010 - DNA, 20 bp, Artificial
  CRISPR gRNA sequence
gtgggggccgtgcgtgtcct

SEQ ID NO: 507011 - DNA, 20 bp, Artificial
  CRISPR gRNA sequence
ggctgtgacctcacactcgt

SEQ ID NO: 507012 - DNA, 20 bp, Artificial
  CRISPR gRNA sequence
tgtgacctcacactcgtgag

SEQ ID NO: 507013 - DNA, 20 bp, Artificial
  CRISPR gRNA sequence
cgtgagcagtgtgtctgcgc

SEQ ID NO: 507014 - DNA, 20 bp, Artificial
  CRISPR gRNA sequence
gtgagcagtgtgtctgcgct

SEQ ID NO: 507015 - DNA, 20 bp, Artificial
  CRISPR gRNA sequence
gtgtgtctgcgctgggactg

SEQ ID NO: 507016 - DNA, 20 bp, Artificial
  CRISPR gRNA sequence
tgtgtctgcgctgggactgc

SEQ ID NO: 507017 - DNA, 20 bp, Artificial
  CRISPR gRNA sequence
gtgtctgcgctgggactgca

SEQ ID NO: 507018 - DNA, 20 bp, Artificial
  CRISPR gRNA sequence
tctgcgctgggactgcaggg

SEQ ID NO: 507019 - DNA, 20 bp, Artificial
  CRISPR gRNA sequence
gcgctgggactgcagggaag

SEQ ID NO: 507020 - DNA, 20 bp, Artificial
  CRISPR gRNA sequence
cgctgggactgcagggaagc

SEQ ID NO: 507021 - DNA, 20 bp, Artificial
  CRISPR gRNA sequence
ctgggactgcagggaagcag

SEQ ID NO: 507022 - DNA, 20 bp, Artificial
  CRISPR gRNA sequence
gggactgcagggaagcagga

SEQ ID NO: 507023 - DNA, 20 bp, Artificial
  CRISPR gRNA sequence
tgcagggaagcaggagagct

SEQ ID NO: 507024 - DNA, 20 bp, Artificial
  CRISPR gRNA sequence
gcagggaagcaggagagcta

SEQ ID NO: 507025 - DNA, 20 bp, Artificial
  CRISPR gRNA sequence
gggaagcaggagagctaagg

SEQ ID NO: 507026 - DNA, 20 bp, Artificial
  CRISPR gRNA sequence
ggaagcaggagagctaaggt

SEQ ID NO: 507027 - DNA, 20 bp, Artificial
  CRISPR gRNA sequence
ggagagctaaggtgggttgt

SEQ ID NO: 507028 - DNA, 20 bp, Artificial
  CRISPR gRNA sequence
gagagctaaggtgggttgtg

SEQ ID NO: 507029 - DNA, 20 bp, Artificial
  CRISPR gRNA sequence
agagctaaggtgggttgtga

SEQ ID NO: 507030 - DNA, 20 bp, Artificial
  CRISPR gRNA sequence
gagctaaggtgggttgtgag

SEQ ID NO: 507031 - DNA, 20 bp, Artificial
  CRISPR gRNA sequence
gctaaggtgggttgtgaggg

SEQ ID NO: 507032 - DNA, 20 bp, Artificial
  CRISPR gRNA sequence
ctaaggtgggttgtgagggg

SEQ ID NO: 507033 - DNA, 20 bp, Artificial
  CRISPR gRNA sequence
ggtgggttgtgaggggagga

SEQ ID NO: 507034 - DNA, 20 bp, Artificial
  CRISPR gRNA sequence
tgaggggaggacagtgcatg

SEQ ID NO: 507035 - DNA, 20 bp, Artificial
  CRISPR gRNA sequence
cagtgcatgtggcctcaaca

SEQ ID NO: 507036 - DNA, 20 bp, Artificial
  CRISPR gRNA sequence
catgtggcctcaacatggcc

SEQ ID NO: 507037 - DNA, 20 bp, Artificial
  CRISPR gRNA sequence
atgtggcctcaacatggccc

SEQ ID NO: 507038 - DNA, 20 bp, Artificial
  CRISPR gRNA sequence
tgtggcctcaacatggccca

SEQ ID NO: 507039 - DNA, 20 bp, Artificial
  CRISPR gRNA sequence
tcaacatggcccagggactg

SEQ ID NO: 507040 - DNA, 20 bp, Artificial
  CRISPR gRNA sequence
agggactgtggctgctctgt

SEQ ID NO: 507041 - DNA, 20 bp, Artificial
  CRISPR gRNA sequence
gggactgtggctgctctgtt

SEQ ID NO: 507042 - DNA, 20 bp, Artificial
  CRISPR gRNA sequence
tggctgctctgttaggctga

SEQ ID NO: 507043 - DNA, 20 bp, Artificial
  CRISPR gRNA sequence
ttaggctgacagtcacaaac

SEQ ID NO: 507044 - DNA, 20 bp, Artificial
  CRISPR gRNA sequence
taggctgacagtcacaaact

SEQ ID NO: 507045 - DNA, 20 bp, Artificial
  CRISPR gRNA sequence
gctgacagtcacaaactggg

SEQ ID NO: 507046 - DNA, 20 bp, Artificial
  CRISPR gRNA sequence
ctgacagtcacaaactgggt

SEQ ID NO: 507047 - DNA, 20 bp, Artificial
  CRISPR gRNA sequence
acagtcacaaactgggtggg

SEQ ID NO: 507048 - DNA, 20 bp, Artificial
  CRISPR gRNA sequence
cagtcacaaactgggtgggc

SEQ ID NO: 507049 - DNA, 20 bp, Artificial
  CRISPR gRNA sequence
caaactgggtgggcgggacg

SEQ ID NO: 507050 - DNA, 20 bp, Artificial
  CRISPR gRNA sequence
aactgggtgggcgggacgtg

SEQ ID NO: 507051 - DNA, 20 bp, Artificial
  CRISPR gRNA sequence
ctgggtgggcgggacgtgga

SEQ ID NO: 507052 - DNA, 20 bp, Artificial
  CRISPR gRNA sequence
acgtggagagcgacacacac

SEQ ID NO: 507053 - DNA, 20 bp, Artificial
  CRISPR gRNA sequence
cgtggagagcgacacacact

SEQ ID NO: 507054 - DNA, 20 bp, Artificial
  CRISPR gRNA sequence
ggagagcgacacacactggg

SEQ ID NO: 507055 - DNA, 20 bp, Artificial
  CRISPR gRNA sequence
agcgacacacactgggcagc

SEQ ID NO: 507056 - DNA, 20 bp, Artificial
  CRISPR gRNA sequence
ctgggcagccagcgcccacc

SEQ ID NO: 507057 - DNA, 20 bp, Artificial
  CRISPR gRNA sequence
cagccagcgcccacccggcc

SEQ ID NO: 507058 - DNA, 20 bp, Artificial
  CRISPR gRNA sequence
gccagcgcccacccggcctg

SEQ ID NO: 507059 - DNA, 20 bp, Artificial
  CRISPR gRNA sequence
ccagcgcccacccggcctgg

SEQ ID NO: 507060 - DNA, 20 bp, Artificial
  CRISPR gRNA sequence
cagcgcccacccggcctgga

SEQ ID NO: 507061 - DNA, 20 bp, Artificial
  CRISPR gRNA sequence
gcgcccacccggcctggagg

SEQ ID NO: 507062 - DNA, 20 bp, Artificial
  CRISPR gRNA sequence
cgcccacccggcctggaggg

SEQ ID NO: 507063 - DNA, 20 bp, Artificial
  CRISPR gRNA sequence
cccacccggcctggagggag

SEQ ID NO: 507064 - DNA, 20 bp, Artificial
  CRISPR gRNA sequence
ccacccggcctggagggagg

SEQ ID NO: 507065 - DNA, 20 bp, Artificial
  CRISPR gRNA sequence
cacccggcctggagggagga

SEQ ID NO: 507066 - DNA, 20 bp, Artificial
  CRISPR gRNA sequence
ccggcctggagggaggaggg

SEQ ID NO: 507067 - DNA, 20 bp, Artificial
  CRISPR gRNA sequence
ggaggagggtggttccaccc

SEQ ID NO: 507068 - DNA, 20 bp, Artificial
  CRISPR gRNA sequence
gaggagggtggttccacccc

SEQ ID NO: 507069 - DNA, 20 bp, Artificial
  CRISPR gRNA sequence
tggttccaccccaggaacca

SEQ ID NO: 507070 - DNA, 20 bp, Artificial
  CRISPR gRNA sequence
ggttccaccccaggaaccac

SEQ ID NO: 507071 - DNA, 20 bp, Artificial
  CRISPR gRNA sequence
gaaccacgggacctgctgcc

SEQ ID NO: 507072 - DNA, 20 bp, Artificial
  CRISPR gRNA sequence
ccacgggacctgctgcctag

SEQ ID NO: 507073 - DNA, 20 bp, Artificial
  CRISPR gRNA sequence
tagcggccctgttccaccct

SEQ ID NO: 507074 - DNA, 20 bp, Artificial
  CRISPR gRNA sequence
ttggccgctcgcaaaatgtt

SEQ ID NO: 507075 - DNA, 20 bp, Artificial
  CRISPR gRNA sequence
tggccgctcgcaaaatgttt

SEQ ID NO: 507076 - DNA, 20 bp, Artificial
  CRISPR gRNA sequence
gcaaaatgtttaggcttcat

SEQ ID NO: 507077 - DNA, 20 bp, Artificial
  CRISPR gRNA sequence
caaaatgtttaggcttcata

SEQ ID NO: 507078 - DNA, 20 bp, Artificial
  CRISPR gRNA sequence
taggcttcataaggtttgcc

SEQ ID NO: 507079 - DNA, 20 bp, Artificial
  CRISPR gRNA sequence
aggcttcataaggtttgccc

SEQ ID NO: 507080 - DNA, 20 bp, Artificial
  CRISPR gRNA sequence
ggcttcataaggtttgccca

SEQ ID NO: 507081 - DNA, 20 bp, Artificial
  CRISPR gRNA sequence
agggtcacaaatttaactca

SEQ ID NO: 507082 - DNA, 20 bp, Artificial
  CRISPR gRNA sequence
ctcacagcaaacaatgaaat

SEQ ID NO: 507083 - DNA, 20 bp, Artificial
  CRISPR gRNA sequence
gaaatcagcgcatgattttc

SEQ ID NO: 507084 - DNA, 20 bp, Artificial
  CRISPR gRNA sequence
gcatgattttcgagccctcg

SEQ ID NO: 507085 - DNA, 20 bp, Artificial
  CRISPR gRNA sequence
tcctcctgccctttcctgca

SEQ ID NO: 507086 - DNA, 20 bp, Artificial
  CRISPR gRNA sequence
cctcctgccctttcctgcat

SEQ ID NO: 507087 - DNA, 20 bp, Artificial
  CRISPR gRNA sequence
cctgccctttcctgcatggg

SEQ ID NO: 507088 - DNA, 20 bp, Artificial
  CRISPR gRNA sequence
gccctttcctgcatgggcag

SEQ ID NO: 507089 - DNA, 20 bp, Artificial
  CRISPR gRNA sequence
ctttcctgcatgggcagcag

SEQ ID NO: 507090 - DNA, 20 bp, Artificial
  CRISPR gRNA sequence
tttcctgcatgggcagcagc

SEQ ID NO: 507091 - DNA, 20 bp, Artificial
  CRISPR gRNA sequence
ttcctgcatgggcagcagca

SEQ ID NO: 507092 - DNA, 20 bp, Artificial
  CRISPR gRNA sequence
tgcatgggcagcagcagggt

SEQ ID NO: 507093 - DNA, 20 bp, Artificial
  CRISPR gRNA sequence
gcatgggcagcagcagggtg

SEQ ID NO: 507094 - DNA, 20 bp, Artificial
  CRISPR gRNA sequence
atgggcagcagcagggtgag

SEQ ID NO: 507095 - DNA, 20 bp, Artificial
  CRISPR gRNA sequence
gggtgaggagctgctctccc

SEQ ID NO: 507096 - DNA, 20 bp, Artificial
  CRISPR gRNA sequence
ggtgaggagctgctctcccc

SEQ ID NO: 507097 - DNA, 20 bp, Artificial
  CRISPR gRNA sequence
ggagctgctctccccaggcc

SEQ ID NO: 507098 - DNA, 20 bp, Artificial
  CRISPR gRNA sequence
gagctgctctccccaggccc

SEQ ID NO: 507099 - DNA, 20 bp, Artificial
  CRISPR gRNA sequence
tgctctccccaggcccaggc

SEQ ID NO: 507100 - DNA, 20 bp, Artificial
  CRISPR gRNA sequence
ctctccccaggcccaggctg

SEQ ID NO: 507101 - DNA, 20 bp, Artificial
  CRISPR gRNA sequence
aggcccaggctggagtccct

SEQ ID NO: 507102 - DNA, 20 bp, Artificial
  CRISPR gRNA sequence
gagtccctcagacgacctgc

SEQ ID NO: 507103 - DNA, 20 bp, Artificial
  CRISPR gRNA sequence
ccctcagacgacctgccggc

SEQ ID NO: 507104 - DNA, 20 bp, Artificial
  CRISPR gRNA sequence
cctcagacgacctgccggcc

SEQ ID NO: 507105 - DNA, 20 bp, Artificial
  CRISPR gRNA sequence
ctcagacgacctgccggcca

SEQ ID NO: 507106 - DNA, 20 bp, Artificial
  CRISPR gRNA sequence
ggtacccccctgcccccaca

SEQ ID NO: 507107 - DNA, 20 bp, Artificial
  CRISPR gRNA sequence
tgcccccacacagcgcctga

SEQ ID NO: 507108 - DNA, 20 bp, Artificial
  CRISPR gRNA sequence
cccccacacagcgcctgaca

SEQ ID NO: 507109 - DNA, 20 bp, Artificial
  CRISPR gRNA sequence
cctgacagagccccccacac

SEQ ID NO: 507110 - DNA, 20 bp, Artificial
  CRISPR gRNA sequence
ctgacagagccccccacact

SEQ ID NO: 507111 - DNA, 20 bp, Artificial
  CRISPR gRNA sequence
tgacagagccccccacactg

SEQ ID NO: 507112 - DNA, 20 bp, Artificial
  CRISPR gRNA sequence
gacagagccccccacactgg

SEQ ID NO: 507113 - DNA, 20 bp, Artificial
  CRISPR gRNA sequence
ccccccacactgggggaacg

SEQ ID NO: 507114 - DNA, 20 bp, Artificial
  CRISPR gRNA sequence
cccccacactgggggaacgt

SEQ ID NO: 507115 - DNA, 20 bp, Artificial
  CRISPR gRNA sequence
ccccacactgggggaacgtg

SEQ ID NO: 507116 - DNA, 20 bp, Artificial
  CRISPR gRNA sequence
ctgggggaacgtggggaccc

SEQ ID NO: 507117 - DNA, 20 bp, Artificial
  CRISPR gRNA sequence
ggggaacgtggggacccaag

SEQ ID NO: 507118 - DNA, 20 bp, Artificial
  CRISPR gRNA sequence
gggaacgtggggacccaagc

SEQ ID NO: 507119 - DNA, 20 bp, Artificial
  CRISPR gRNA sequence
ggaacgtggggacccaagca

SEQ ID NO: 507120 - DNA, 20 bp, Artificial
  CRISPR gRNA sequence
gaacgtggggacccaagcag

SEQ ID NO: 507121 - DNA, 20 bp, Artificial
  CRISPR gRNA sequence
cgtggggacccaagcagggg

SEQ ID NO: 507122 - DNA, 20 bp, Artificial
  CRISPR gRNA sequence
ggggacccaagcaggggcag

SEQ ID NO: 507123 - DNA, 20 bp, Artificial
  CRISPR gRNA sequence
agcaggggcagcggcctcac

SEQ ID NO: 507124 - DNA, 20 bp, Artificial
  CRISPR gRNA sequence
gcaggggcagcggcctcacc

SEQ ID NO: 507125 - DNA, 20 bp, Artificial
  CRISPR gRNA sequence
ggggcagcggcctcaccggg

SEQ ID NO: 507126 - DNA, 20 bp, Artificial
  CRISPR gRNA sequence
gggcagcggcctcaccgggc

SEQ ID NO: 507127 - DNA, 20 bp, Artificial
  CRISPR gRNA sequence
cagcggcctcaccgggcagg

SEQ ID NO: 507128 - DNA, 20 bp, Artificial
  CRISPR gRNA sequence
gcaggcggcgacctgcatca

SEQ ID NO: 507129 - DNA, 20 bp, Artificial
  CRISPR gRNA sequence
gcgacctgcatcatggcgtc

SEQ ID NO: 507130 - DNA, 20 bp, Artificial
  CRISPR gRNA sequence
catggcgtccagcccaccct

SEQ ID NO: 507131 - DNA, 20 bp, Artificial
  CRISPR gRNA sequence
atggcgtccagcccaccctc

SEQ ID NO: 507132 - DNA, 20 bp, Artificial
  CRISPR gRNA sequence
agcccaccctcgggtgcatc

SEQ ID NO: 507133 - DNA, 20 bp, Artificial
  CRISPR gRNA sequence
gcccaccctcgggtgcatcc

SEQ ID NO: 507134 - DNA, 20 bp, Artificial
  CRISPR gRNA sequence
ctcgggtgcatccaggtttc

SEQ ID NO: 507135 - DNA, 20 bp, Artificial
  CRISPR gRNA sequence
gcatccaggtttccggaaat

SEQ ID NO: 507136 - DNA, 20 bp, Artificial
  CRISPR gRNA sequence
aatcagctgcttcccgacct

SEQ ID NO: 507137 - DNA, 20 bp, Artificial
  CRISPR gRNA sequence
tcccgacctcggtctgaaac

SEQ ID NO: 507138 - DNA, 20 bp, Artificial
  CRISPR gRNA sequence
gacctcggtctgaaactggt

SEQ ID NO: 507139 - DNA, 20 bp, Artificial
  CRISPR gRNA sequence
cctcggtctgaaactggttg

SEQ ID NO: 507140 - DNA, 20 bp, Artificial
  CRISPR gRNA sequence
ctgaaactggttggagttgt

SEQ ID NO: 507141 - DNA, 20 bp, Artificial
  CRISPR gRNA sequence
aactggttggagttgttggt

SEQ ID NO: 507142 - DNA, 20 bp, Artificial
  CRISPR gRNA sequence
ttggagttgttggtcagctt

SEQ ID NO: 507143 - DNA, 20 bp, Artificial
  CRISPR gRNA sequence
tcagcttcagcacgtgcctg

SEQ ID NO: 507144 - DNA, 20 bp, Artificial
  CRISPR gRNA sequence
cagcttcagcacgtgcctga

SEQ ID NO: 507145 - DNA, 20 bp, Artificial
  CRISPR gRNA sequence
agcacgtgcctgaaggcaaa

SEQ ID NO: 507146 - DNA, 20 bp, Artificial
  CRISPR gRNA sequence
gcacgtgcctgaaggcaaac

SEQ ID NO: 507147 - DNA, 20 bp, Artificial
  CRISPR gRNA sequence
cacgtgcctgaaggcaaacg

SEQ ID NO: 507148 - DNA, 20 bp, Artificial
  CRISPR gRNA sequence
acgtgcctgaaggcaaacgg

SEQ ID NO: 507149 - DNA, 20 bp, Artificial
  CRISPR gRNA sequence
gcctgaaggcaaacgggggc

SEQ ID NO: 507150 - DNA, 20 bp, Artificial
  CRISPR gRNA sequence
ctggcactctttctccttgt

SEQ ID NO: 507151 - DNA, 20 bp, Artificial
  CRISPR gRNA sequence
tggcactctttctccttgtt

SEQ ID NO: 507152 - DNA, 20 bp, Artificial
  CRISPR gRNA sequence
ggcactctttctccttgttg

SEQ ID NO: 507153 - DNA, 20 bp, Artificial
  CRISPR gRNA sequence
tctttctccttgttggggca

SEQ ID NO: 507154 - DNA, 20 bp, Artificial
  CRISPR gRNA sequence
ctttctccttgttggggcat

SEQ ID NO: 507155 - DNA, 20 bp, Artificial
  CRISPR gRNA sequence
ttgttggggcatgggtttcg

SEQ ID NO: 507156 - DNA, 20 bp, Artificial
  CRISPR gRNA sequence
gcatgggtttcgcagcttat

SEQ ID NO: 507157 - DNA, 20 bp, Artificial
  CRISPR gRNA sequence
catgggtttcgcagcttatc

SEQ ID NO: 507158 - DNA, 20 bp, Artificial
  CRISPR gRNA sequence
atgggtttcgcagcttatca

SEQ ID NO: 507159 - DNA, 20 bp, Artificial
  CRISPR gRNA sequence
tcagggtgcgtgttcacgaa

SEQ ID NO: 507160 - DNA, 20 bp, Artificial
  CRISPR gRNA sequence
gggtgcgtgttcacgaacgg

SEQ ID NO: 507161 - DNA, 20 bp, Artificial
  CRISPR gRNA sequence
cgtgttcacgaacggcagca

SEQ ID NO: 507162 - DNA, 20 bp, Artificial
  CRISPR gRNA sequence
gcagcacggtcttgtccacg

SEQ ID NO: 507163 - DNA, 20 bp, Artificial
  CRISPR gRNA sequence
cagcacggtcttgtccacga

SEQ ID NO: 507164 - DNA, 20 bp, Artificial
  CRISPR gRNA sequence
tcttgtccacgaaggacccg

SEQ ID NO: 507165 - DNA, 20 bp, Artificial
  CRISPR gRNA sequence
cacgaaggacccgaagcctg

SEQ ID NO: 507166 - DNA, 20 bp, Artificial
  CRISPR gRNA sequence
acgaaggacccgaagcctgc

SEQ ID NO: 507167 - DNA, 20 bp, Artificial
  CRISPR gRNA sequence
cgaaggacccgaagcctgca

SEQ ID NO: 507168 - DNA, 20 bp, Artificial
  CRISPR gRNA sequence
cccgaagcctgcagggcaca

SEQ ID NO: 507169 - DNA, 20 bp, Artificial
  CRISPR gRNA sequence
cgaagcctgcagggcacatg

SEQ ID NO: 507170 - DNA, 20 bp, Artificial
  CRISPR gRNA sequence
gaagcctgcagggcacatgg

SEQ ID NO: 507171 - DNA, 20 bp, Artificial
  CRISPR gRNA sequence
aagcctgcagggcacatgga

SEQ ID NO: 507172 - DNA, 20 bp, Artificial
  CRISPR gRNA sequence
agcctgcagggcacatggag

SEQ ID NO: 507173 - DNA, 20 bp, Artificial
  CRISPR gRNA sequence
tgcagggcacatggaggggc

SEQ ID NO: 507174 - DNA, 20 bp, Artificial
  CRISPR gRNA sequence
gcagggcacatggaggggct

SEQ ID NO: 507175 - DNA, 20 bp, Artificial
  CRISPR gRNA sequence
cagggcacatggaggggctg

SEQ ID NO: 507176 - DNA, 20 bp, Artificial
  CRISPR gRNA sequence
gggcacatggaggggctggg

SEQ ID NO: 507177 - DNA, 20 bp, Artificial
  CRISPR gRNA sequence
ggcacatggaggggctgggg

SEQ ID NO: 507178 - DNA, 20 bp, Artificial
  CRISPR gRNA sequence
acatggaggggctggggagg

SEQ ID NO: 507179 - DNA, 20 bp, Artificial
  CRISPR gRNA sequence
tggaggggctggggaggtgg

SEQ ID NO: 507180 - DNA, 20 bp, Artificial
  CRISPR gRNA sequence
ggaggggctggggaggtggc

SEQ ID NO: 507181 - DNA, 20 bp, Artificial
  CRISPR gRNA sequence
gggctggggaggtggcaggc

SEQ ID NO: 507182 - DNA, 20 bp, Artificial
  CRISPR gRNA sequence
ggctggggaggtggcaggct

SEQ ID NO: 507183 - DNA, 20 bp, Artificial
  CRISPR gRNA sequence
gggaggtggcaggctgggcc

SEQ ID NO: 507184 - DNA, 20 bp, Artificial
  CRISPR gRNA sequence
ggaggtggcaggctgggccc

SEQ ID NO: 507185 - DNA, 20 bp, Artificial
  CRISPR gRNA sequence
ggtggcaggctgggcccagg

SEQ ID NO: 507186 - DNA, 20 bp, Artificial
  CRISPR gRNA sequence
gtggcaggctgggcccaggt

SEQ ID NO: 507187 - DNA, 20 bp, Artificial
  CRISPR gRNA sequence
ggcaggctgggcccaggtgg

SEQ ID NO: 507188 - DNA, 20 bp, Artificial
  CRISPR gRNA sequence
gcaggctgggcccaggtggg

SEQ ID NO: 507189 - DNA, 20 bp, Artificial
  CRISPR gRNA sequence
caggctgggcccaggtggga

SEQ ID NO: 507190 - DNA, 20 bp, Artificial
  CRISPR gRNA sequence
ctgggcccaggtgggagggc

SEQ ID NO: 507191 - DNA, 20 bp, Artificial
  CRISPR gRNA sequence
aggtgggagggccagcttca

SEQ ID NO: 507192 - DNA, 20 bp, Artificial
  CRISPR gRNA sequence
ggtgggagggccagcttcaa

SEQ ID NO: 507193 - DNA, 20 bp, Artificial
  CRISPR gRNA sequence
gtgggagggccagcttcaaa

SEQ ID NO: 507194 - DNA, 20 bp, Artificial
  CRISPR gRNA sequence
tgggagggccagcttcaaag

SEQ ID NO: 507195 - DNA, 20 bp, Artificial
  CRISPR gRNA sequence
ggccagcttcaaaggggcac

SEQ ID NO: 507196 - DNA, 20 bp, Artificial
  CRISPR gRNA sequence
gccagcttcaaaggggcacg

SEQ ID NO: 507197 - DNA, 20 bp, Artificial
  CRISPR gRNA sequence
ccagcttcaaaggggcacga

SEQ ID NO: 507198 - DNA, 20 bp, Artificial
  CRISPR gRNA sequence
cttcaaaggggcacgagggc

SEQ ID NO: 507199 - DNA, 20 bp, Artificial
  CRISPR gRNA sequence
caagcctgtttcctctctcc

SEQ ID NO: 507200 - DNA, 20 bp, Artificial
  CRISPR gRNA sequence
gcctgtttcctctctcctag

SEQ ID NO: 507201 - DNA, 20 bp, Artificial
  CRISPR gRNA sequence
cctgtttcctctctcctagc

SEQ ID NO: 507202 - DNA, 20 bp, Artificial
  CRISPR gRNA sequence
ctgtttcctctctcctagca

SEQ ID NO: 507203 - DNA, 20 bp, Artificial
  CRISPR gRNA sequence
gtttcctctctcctagcagg

SEQ ID NO: 507204 - DNA, 20 bp, Artificial
  CRISPR gRNA sequence
tttcctctctcctagcaggg

SEQ ID NO: 507205 - DNA, 20 bp, Artificial
  CRISPR gRNA sequence
cctctctcctagcagggagg

SEQ ID NO: 507206 - DNA, 20 bp, Artificial
  CRISPR gRNA sequence
tctctcctagcagggaggtg

SEQ ID NO: 507207 - DNA, 20 bp, Artificial
  CRISPR gRNA sequence
tcctagcagggaggtggaga

SEQ ID NO: 507208 - DNA, 20 bp, Artificial
  CRISPR gRNA sequence
agcagggaggtggagaaagc

SEQ ID NO: 507209 - DNA, 20 bp, Artificial
  CRISPR gRNA sequence
gggaggtggagaaagcaaga

SEQ ID NO: 507210 - DNA, 20 bp, Artificial
  CRISPR gRNA sequence
agaaagcaagatggcacatg

SEQ ID NO: 507211 - DNA, 20 bp, Artificial
  CRISPR gRNA sequence
aaagcaagatggcacatgtg

SEQ ID NO: 507212 - DNA, 20 bp, Artificial
  CRISPR gRNA sequence
cacatgtggagtgtgtgtgt

SEQ ID NO: 507213 - DNA, 20 bp, Artificial
  CRISPR gRNA sequence
tgtgagcatgtgcgttgtgc

SEQ ID NO: 507214 - DNA, 20 bp, Artificial
  CRISPR gRNA sequence
agcacacatgtgaacgtatg

SEQ ID NO: 507215 - DNA, 20 bp, Artificial
  CRISPR gRNA sequence
gcacacatgtgaacgtatgt

SEQ ID NO: 507216 - DNA, 20 bp, Artificial
  CRISPR gRNA sequence
tgtgggcgtgtgtgtgaacc

SEQ ID NO: 507217 - DNA, 20 bp, Artificial
  CRISPR gRNA sequence
gtgggcgtgtgtgtgaacct

SEQ ID NO: 507218 - DNA, 20 bp, Artificial
  CRISPR gRNA sequence
gggcgtgtgtgtgaacctgg

SEQ ID NO: 507219 - DNA, 20 bp, Artificial
  CRISPR gRNA sequence
ctgggagtgtgcaatgtaca

SEQ ID NO: 507220 - DNA, 20 bp, Artificial
  CRISPR gRNA sequence
agtgtgcaatgtacatggat

SEQ ID NO: 507221 - DNA, 20 bp, Artificial
  CRISPR gRNA sequence
caatgtacatggatgagcat

SEQ ID NO: 507222 - DNA, 20 bp, Artificial
  CRISPR gRNA sequence
cctgcatgtatgtgtgtgac

SEQ ID NO: 507223 - DNA, 20 bp, Artificial
  CRISPR gRNA sequence
ctgcatgtatgtgtgtgacc

SEQ ID NO: 507224 - DNA, 20 bp, Artificial
  CRISPR gRNA sequence
tgtgtgaccaggtatacatg

SEQ ID NO: 507225 - DNA, 20 bp, Artificial
  CRISPR gRNA sequence
gtgtgaccaggtatacatgt

SEQ ID NO: 507226 - DNA, 20 bp, Artificial
  CRISPR gRNA sequence
tatacatgtgggcatgtgaa

SEQ ID NO: 507227 - DNA, 20 bp, Artificial
  CRISPR gRNA sequence
atacatgtgggcatgtgaac

SEQ ID NO: 507228 - DNA, 20 bp, Artificial
  CRISPR gRNA sequence
cgtatgtgtatctgtgtgtg

SEQ ID NO: 507229 - DNA, 20 bp, Artificial
  CRISPR gRNA sequence
ccatctgcatgtgtaaacat

SEQ ID NO: 507230 - DNA, 20 bp, Artificial
  CRISPR gRNA sequence
aacatgagtgtgtacatgcg

SEQ ID NO: 507231 - DNA, 20 bp, Artificial
  CRISPR gRNA sequence
acgtattcctgtatgcatgt

SEQ ID NO: 507232 - DNA, 20 bp, Artificial
  CRISPR gRNA sequence
tgtatgcatgtgagcatgtt

SEQ ID NO: 507233 - DNA, 20 bp, Artificial
  CRISPR gRNA sequence
gtatgcatgtgagcatgttc

SEQ ID NO: 507234 - DNA, 20 bp, Artificial
  CRISPR gRNA sequence
catgtgagcatgttcaggta

SEQ ID NO: 507235 - DNA, 20 bp, Artificial
  CRISPR gRNA sequence
tgttcaggtatggacacacc

SEQ ID NO: 507236 - DNA, 20 bp, Artificial
  CRISPR gRNA sequence
atggacacacctagttcacg

SEQ ID NO: 507237 - DNA, 20 bp, Artificial
  CRISPR gRNA sequence
tggacacacctagttcacgt

SEQ ID NO: 507238 - DNA, 20 bp, Artificial
  CRISPR gRNA sequence
acctagttcacgtaggtgac

SEQ ID NO: 507239 - DNA, 20 bp, Artificial
  CRISPR gRNA sequence
cctagttcacgtaggtgacc

SEQ ID NO: 507240 - DNA, 20 bp, Artificial
  CRISPR gRNA sequence
taggtgaccaggtacatatg

SEQ ID NO: 507241 - DNA, 20 bp, Artificial
  CRISPR gRNA sequence
aggtgaccaggtacatatgt

SEQ ID NO: 507242 - DNA, 20 bp, Artificial
  CRISPR gRNA sequence
tatgtacgatttatacatgt

SEQ ID NO: 507243 - DNA, 20 bp, Artificial
  CRISPR gRNA sequence
acgatttatacatgtgagtg

SEQ ID NO: 507244 - DNA, 20 bp, Artificial
  CRISPR gRNA sequence
catgtgagtgaagacataca

SEQ ID NO: 507245 - DNA, 20 bp, Artificial
  CRISPR gRNA sequence
atgtgagtgaagacatacat

SEQ ID NO: 507246 - DNA, 20 bp, Artificial
  CRISPR gRNA sequence
agacatacatgggtgatcat

SEQ ID NO: 507247 - DNA, 20 bp, Artificial
  CRISPR gRNA sequence
gtgatcatgagtgtgcatgt

SEQ ID NO: 507248 - DNA, 20 bp, Artificial
  CRISPR gRNA sequence
agcatgtctgtgtgcacatg

SEQ ID NO: 507249 - DNA, 20 bp, Artificial
  CRISPR gRNA sequence
gtgcatgtgtgtgcacatgc

SEQ ID NO: 507250 - DNA, 20 bp, Artificial
  CRISPR gRNA sequence
gtgtgtgcacatgcaagtgt

SEQ ID NO: 507251 - DNA, 20 bp, Artificial
  CRISPR gRNA sequence
gagcatgcattcatgtgtgt

SEQ ID NO: 507252 - DNA, 20 bp, Artificial
  CRISPR gRNA sequence
gtgagcatgcatttgtgtgt

SEQ ID NO: 507253 - DNA, 20 bp, Artificial
  CRISPR gRNA sequence
gagcgtgcattcacgtgtgt

SEQ ID NO: 507254 - DNA, 20 bp, Artificial
  CRISPR gRNA sequence
gagcgtgcatttgtgcatgt

SEQ ID NO: 507255 - DNA, 20 bp, Artificial
  CRISPR gRNA sequence
gagcatacattcgcgtgtgt

SEQ ID NO: 507256 - DNA, 20 bp, Artificial
  CRISPR gRNA sequence
gtgagcatgcatttgcgtgt

SEQ ID NO: 507257 - DNA, 20 bp, Artificial
  CRISPR gRNA sequence
gtgagcatacattcatgtgt

SEQ ID NO: 507258 - DNA, 20 bp, Artificial
  CRISPR gRNA sequence
gtgagcatacattcacatgt

SEQ ID NO: 507259 - DNA, 20 bp, Artificial
  CRISPR gRNA sequence
gagcatacattcacatgtga

SEQ ID NO: 507260 - DNA, 20 bp, Artificial
  CRISPR gRNA sequence
gagcatgcatttgtgtgttt

SEQ ID NO: 507261 - DNA, 20 bp, Artificial
  CRISPR gRNA sequence
gtgtgtttgagcatgtgtgt

SEQ ID NO: 507262 - DNA, 20 bp, Artificial
  CRISPR gRNA sequence
gagcatacattcacgtgtgt

SEQ ID NO: 507263 - DNA, 20 bp, Artificial
  CRISPR gRNA sequence
attcacgtgtgtgtgcattt

SEQ ID NO: 507264 - DNA, 20 bp, Artificial
  CRISPR gRNA sequence
cgtgtgtgtgcatttgagtt

SEQ ID NO: 507265 - DNA, 20 bp, Artificial
  CRISPR gRNA sequence
gtgtgtgtgcatttgagttt

SEQ ID NO: 507266 - DNA, 20 bp, Artificial
  CRISPR gRNA sequence
ttgggtgtgcttttgtgtgt

SEQ ID NO: 507267 - DNA, 20 bp, Artificial
  CRISPR gRNA sequence
gagcatgcattcgcgtgtgt

SEQ ID NO: 507268 - DNA, 20 bp, Artificial
  CRISPR gRNA sequence
gagcatccatttgtgcatgt

SEQ ID NO: 507269 - DNA, 20 bp, Artificial
  CRISPR gRNA sequence
agcatccatttgtgcatgtg

SEQ ID NO: 507270 - DNA, 20 bp, Artificial
  CRISPR gRNA sequence
gtgaggatacattcatgtgt

SEQ ID NO: 507271 - DNA, 20 bp, Artificial
  CRISPR gRNA sequence
gagtgtgcattcgcatgtgt

SEQ ID NO: 507272 - DNA, 20 bp, Artificial
  CRISPR gRNA sequence
gtgagcgtgcatttgcgttt

SEQ ID NO: 507273 - DNA, 20 bp, Artificial
  CRISPR gRNA sequence
ttgagcatgcatttgtgtgt

SEQ ID NO: 507274 - DNA, 20 bp, Artificial
  CRISPR gRNA sequence
gtgaacatgcatttgtgtgt

SEQ ID NO: 507275 - DNA, 20 bp, Artificial
  CRISPR gRNA sequence
gagcgtgcattcacgtgcat

SEQ ID NO: 507276 - DNA, 20 bp, Artificial
  CRISPR gRNA sequence
atgagcgtgcatttgtgtgt

SEQ ID NO: 507277 - DNA, 20 bp, Artificial
  CRISPR gRNA sequence
gtgtgagcgtgcatttgtgt

SEQ ID NO: 507278 - DNA, 20 bp, Artificial
  CRISPR gRNA sequence
catgtgtgcatccccgcatg

SEQ ID NO: 507279 - DNA, 20 bp, Artificial
  CRISPR gRNA sequence
atgtgtgcatccccgcatgt

SEQ ID NO: 507280 - DNA, 20 bp, Artificial
  CRISPR gRNA sequence
tgtgtgcatccccgcatgta

SEQ ID NO: 507281 - DNA, 20 bp, Artificial
  CRISPR gRNA sequence
gtgcatccccgcatgtaggg

SEQ ID NO: 507282 - DNA, 20 bp, Artificial
  CRISPR gRNA sequence
tgcatccccgcatgtaggga

SEQ ID NO: 507283 - DNA, 20 bp, Artificial
  CRISPR gRNA sequence
atccccgcatgtagggaagg

SEQ ID NO: 507284 - DNA, 20 bp, Artificial
  CRISPR gRNA sequence
cccgcatgtagggaaggtgg

SEQ ID NO: 507285 - DNA, 20 bp, Artificial
  CRISPR gRNA sequence
cgcatgtagggaaggtggca

SEQ ID NO: 507286 - DNA, 20 bp, Artificial
  CRISPR gRNA sequence
aggtggcagagtgccgatgt

SEQ ID NO: 507287 - DNA, 20 bp, Artificial
  CRISPR gRNA sequence
tggcagagtgccgatgtgag

SEQ ID NO: 507288 - DNA, 20 bp, Artificial
  CRISPR gRNA sequence
agtgccgatgtgagaagcca

SEQ ID NO: 507289 - DNA, 20 bp, Artificial
  CRISPR gRNA sequence
ccgatgtgagaagccacggc

SEQ ID NO: 507290 - DNA, 20 bp, Artificial
  CRISPR gRNA sequence
atgtgagaagccacggccgg

SEQ ID NO: 507291 - DNA, 20 bp, Artificial
  CRISPR gRNA sequence
tgtgagaagccacggccggc

SEQ ID NO: 507292 - DNA, 20 bp, Artificial
  CRISPR gRNA sequence
gtgagaagccacggccggcg

SEQ ID NO: 507293 - DNA, 20 bp, Artificial
  CRISPR gRNA sequence
agaagccacggccggcgggg

SEQ ID NO: 507294 - DNA, 20 bp, Artificial
  CRISPR gRNA sequence
tgactgacacacacgtgtgc

SEQ ID NO: 507295 - DNA, 20 bp, Artificial
  CRISPR gRNA sequence
actgacacacacgtgtgctg

SEQ ID NO: 507296 - DNA, 20 bp, Artificial
  CRISPR gRNA sequence
tgtgctggagacctgctctg

SEQ ID NO: 507297 - DNA, 20 bp, Artificial
  CRISPR gRNA sequence
ctggagacctgctctgtggc

SEQ ID NO: 507298 - DNA, 20 bp, Artificial
  CRISPR gRNA sequence
tggagacctgctctgtggca

SEQ ID NO: 507299 - DNA, 20 bp, Artificial
  CRISPR gRNA sequence
agacctgctctgtggcaagg

SEQ ID NO: 507300 - DNA, 20 bp, Artificial
  CRISPR gRNA sequence
gctctgtggcaaggcagtgc

SEQ ID NO: 507301 - DNA, 20 bp, Artificial
  CRISPR gRNA sequence
gtggcaaggcagtgctggtg

SEQ ID NO: 507302 - DNA, 20 bp, Artificial
  CRISPR gRNA sequence
ggcaaggcagtgctggtgta

SEQ ID NO: 507303 - DNA, 20 bp, Artificial
  CRISPR gRNA sequence
aaggcagtgctggtgtagag

SEQ ID NO: 507304 - DNA, 20 bp, Artificial
  CRISPR gRNA sequence
ggcagtgctggtgtagagcg

SEQ ID NO: 507305 - DNA, 20 bp, Artificial
  CRISPR gRNA sequence
ctggtgtagagcggagccct

SEQ ID NO: 507306 - DNA, 20 bp, Artificial
  CRISPR gRNA sequence
gtagagcggagcccttggcc

SEQ ID NO: 507307 - DNA, 20 bp, Artificial
  CRISPR gRNA sequence
gagcggagcccttggcccag

SEQ ID NO: 507308 - DNA, 20 bp, Artificial
  CRISPR gRNA sequence
gcggagcccttggcccagca

SEQ ID NO: 507309 - DNA, 20 bp, Artificial
  CRISPR gRNA sequence
gcccagcagagcttgctgtg

SEQ ID NO: 507310 - DNA, 20 bp, Artificial
  CRISPR gRNA sequence
agcttgctgtgtggtttctt

SEQ ID NO: 507311 - DNA, 20 bp, Artificial
  CRISPR gRNA sequence
tgtgccgtctatatgtgttg

SEQ ID NO: 507312 - DNA, 20 bp, Artificial
  CRISPR gRNA sequence
ggtctttaatgtttaataat

SEQ ID NO: 507313 - DNA, 20 bp, Artificial
  CRISPR gRNA sequence
tgtttaataattggcactgt

SEQ ID NO: 507314 - DNA, 20 bp, Artificial
  CRISPR gRNA sequence
ttttgtcttttaaacatacc

SEQ ID NO: 507315 - DNA, 20 bp, Artificial
  CRISPR gRNA sequence
aacataccaagaaataaata

SEQ ID NO: 507316 - DNA, 20 bp, Artificial
  CRISPR gRNA sequence
acataccaagaaataaataa

SEQ ID NO: 507317 - DNA, 20 bp, Artificial
  CRISPR gRNA sequence
taccaagaaataaataaagg

SEQ ID NO: 507318 - DNA, 20 bp, Artificial
  CRISPR gRNA sequence
caagaaataaataaaggaag

SEQ ID NO: 507319 - DNA, 20 bp, Artificial
  CRISPR gRNA sequence
gaaataaataaaggaagtag

SEQ ID NO: 507320 - DNA, 20 bp, Artificial
  CRISPR gRNA sequence
taaataaaggaagtagaaga

SEQ ID NO: 507321 - DNA, 20 bp, Artificial
  CRISPR gRNA sequence
ataaaggaagtagaagatgg

SEQ ID NO: 507322 - DNA, 20 bp, Artificial
  CRISPR gRNA sequence
taaaggaagtagaagatgga

SEQ ID NO: 507323 - DNA, 20 bp, Artificial
  CRISPR gRNA sequence
aaaggaagtagaagatggaa

SEQ ID NO: 507324 - DNA, 20 bp, Artificial
  CRISPR gRNA sequence
aaggaagtagaagatggaag

SEQ ID NO: 507325 - DNA, 20 bp, Artificial
  CRISPR gRNA sequence
gaagtagaagatggaagggg

SEQ ID NO: 507326 - DNA, 20 bp, Artificial
  CRISPR gRNA sequence
gtagaagatggaaggggaag

SEQ ID NO: 507327 - DNA, 20 bp, Artificial
  CRISPR gRNA sequence
agaagatggaaggggaagtg

SEQ ID NO: 507328 - DNA, 20 bp, Artificial
  CRISPR gRNA sequence
gaagatggaaggggaagtgg

SEQ ID NO: 507329 - DNA, 20 bp, Artificial
  CRISPR gRNA sequence
aagatggaaggggaagtgga

SEQ ID NO: 507330 - DNA, 20 bp, Artificial
  CRISPR gRNA sequence
tggaaggggaagtggagggc

SEQ ID NO: 507331 - DNA, 20 bp, Artificial
  CRISPR gRNA sequence
gagggctggacaatgtctac

SEQ ID NO: 507332 - DNA, 20 bp, Artificial
  CRISPR gRNA sequence
tggacaatgtctacaagtgt

SEQ ID NO: 507333 - DNA, 20 bp, Artificial
  CRISPR gRNA sequence
ggacaatgtctacaagtgtt

SEQ ID NO: 507334 - DNA, 20 bp, Artificial
  CRISPR gRNA sequence
gacaatgtctacaagtgttg

SEQ ID NO: 507335 - DNA, 20 bp, Artificial
  CRISPR gRNA sequence
caatgtctacaagtgttggg

SEQ ID NO: 507336 - DNA, 20 bp, Artificial
  CRISPR gRNA sequence
gtctacaagtgttggggagc

SEQ ID NO: 507337 - DNA, 20 bp, Artificial
  CRISPR gRNA sequence
tctacaagtgttggggagcc

SEQ ID NO: 507338 - DNA, 20 bp, Artificial
  CRISPR gRNA sequence
ctacaagtgttggggagcca

SEQ ID NO: 507339 - DNA, 20 bp, Artificial
  CRISPR gRNA sequence
agtgttggggagccagggac

SEQ ID NO: 507340 - DNA, 20 bp, Artificial
  CRISPR gRNA sequence
gtgttggggagccagggact

SEQ ID NO: 507341 - DNA, 20 bp, Artificial
  CRISPR gRNA sequence
ggggagccagggactgggtg

SEQ ID NO: 507342 - DNA, 20 bp, Artificial
  CRISPR gRNA sequence
cagggactgggtgtggcccc

SEQ ID NO: 507343 - DNA, 20 bp, Artificial
  CRISPR gRNA sequence
ggactgggtgtggcccctgg

SEQ ID NO: 507344 - DNA, 20 bp, Artificial
  CRISPR gRNA sequence
gactgggtgtggcccctggc

SEQ ID NO: 507345 - DNA, 20 bp, Artificial
  CRISPR gRNA sequence
actgggtgtggcccctggca

SEQ ID NO: 507346 - DNA, 20 bp, Artificial
  CRISPR gRNA sequence
tgggtgtggcccctggcagg

SEQ ID NO: 507347 - DNA, 20 bp, Artificial
  CRISPR gRNA sequence
gggtgtggcccctggcaggg

SEQ ID NO: 507348 - DNA, 20 bp, Artificial
  CRISPR gRNA sequence
tgtggcccctggcagggagg

SEQ ID NO: 507349 - DNA, 20 bp, Artificial
  CRISPR gRNA sequence
gtggcccctggcagggaggc

SEQ ID NO: 507350 - DNA, 20 bp, Artificial
  CRISPR gRNA sequence
gcagggaggcaggccgactg

SEQ ID NO: 507351 - DNA, 20 bp, Artificial
  CRISPR gRNA sequence
gcaggccgactgcagccctg

SEQ ID NO: 507352 - DNA, 20 bp, Artificial
  CRISPR gRNA sequence
ctgcagccctgtggatgccc

SEQ ID NO: 507353 - DNA, 20 bp, Artificial
  CRISPR gRNA sequence
tgcagccctgtggatgccct

SEQ ID NO: 507354 - DNA, 20 bp, Artificial
  CRISPR gRNA sequence
gcagccctgtggatgccctg

SEQ ID NO: 507355 - DNA, 20 bp, Artificial
  CRISPR gRNA sequence
cagccctgtggatgccctgg

SEQ ID NO: 507356 - DNA, 20 bp, Artificial
  CRISPR gRNA sequence
agccctgtggatgccctggg

SEQ ID NO: 507357 - DNA, 20 bp, Artificial
  CRISPR gRNA sequence
gccctggggggacctgcatc

SEQ ID NO: 507358 - DNA, 20 bp, Artificial
  CRISPR gRNA sequence
ccctggggggacctgcatct

SEQ ID NO: 507359 - DNA, 20 bp, Artificial
  CRISPR gRNA sequence
cctggggggacctgcatctg

SEQ ID NO: 507360 - DNA, 20 bp, Artificial
  CRISPR gRNA sequence
ggacctgcatctggggcccc

SEQ ID NO: 507361 - DNA, 20 bp, Artificial
  CRISPR gRNA sequence
tggggcccccagatctaccc

SEQ ID NO: 507362 - DNA, 20 bp, Artificial
  CRISPR gRNA sequence
ggggcccccagatctaccct

SEQ ID NO: 507363 - DNA, 20 bp, Artificial
  CRISPR gRNA sequence
gggcccccagatctaccctg

SEQ ID NO: 507364 - DNA, 20 bp, Artificial
  CRISPR gRNA sequence
cagatctaccctggggacct

SEQ ID NO: 507365 - DNA, 20 bp, Artificial
  CRISPR gRNA sequence
taccctggggacctgagtgc

SEQ ID NO: 507366 - DNA, 20 bp, Artificial
  CRISPR gRNA sequence
accctggggacctgagtgcg

SEQ ID NO: 507367 - DNA, 20 bp, Artificial
  CRISPR gRNA sequence
cctggggacctgagtgcgag

SEQ ID NO: 507368 - DNA, 20 bp, Artificial
  CRISPR gRNA sequence
cctgagtgcgaggagttgtg

SEQ ID NO: 507369 - DNA, 20 bp, Artificial
  CRISPR gRNA sequence
ctgagtgcgaggagttgtgt

SEQ ID NO: 507370 - DNA, 20 bp, Artificial
  CRISPR gRNA sequence
gcgaggagttgtgtgggcca

SEQ ID NO: 507371 - DNA, 20 bp, Artificial
  CRISPR gRNA sequence
cgaggagttgtgtgggccac

SEQ ID NO: 507372 - DNA, 20 bp, Artificial
  CRISPR gRNA sequence
ggagttgtgtgggccacagg

SEQ ID NO: 507373 - DNA, 20 bp, Artificial
  CRISPR gRNA sequence
gagttgtgtgggccacaggc

SEQ ID NO: 507374 - DNA, 20 bp, Artificial
  CRISPR gRNA sequence
gttgtgtgggccacaggcag

SEQ ID NO: 507375 - DNA, 20 bp, Artificial
  CRISPR gRNA sequence
gtgtgggccacaggcaggag

SEQ ID NO: 507376 - DNA, 20 bp, Artificial
  CRISPR gRNA sequence
gggccacaggcaggagtggc

SEQ ID NO: 507377 - DNA, 20 bp, Artificial
  CRISPR gRNA sequence
ggccacaggcaggagtggcc

SEQ ID NO: 507378 - DNA, 20 bp, Artificial
  CRISPR gRNA sequence
gccacaggcaggagtggcca

SEQ ID NO: 507379 - DNA, 20 bp, Artificial
  CRISPR gRNA sequence
aggcaggagtggccagggtc

SEQ ID NO: 507380 - DNA, 20 bp, Artificial
  CRISPR gRNA sequence
ggcaggagtggccagggtct

SEQ ID NO: 507381 - DNA, 20 bp, Artificial
  CRISPR gRNA sequence
ggagtggccagggtctggga

SEQ ID NO: 507382 - DNA, 20 bp, Artificial
  CRISPR gRNA sequence
gagtggccagggtctgggaa

SEQ ID NO: 507383 - DNA, 20 bp, Artificial
  CRISPR gRNA sequence
gccagggtctgggaaaggac

SEQ ID NO: 507384 - DNA, 20 bp, Artificial
  CRISPR gRNA sequence
ccagggtctgggaaaggact

SEQ ID NO: 507385 - DNA, 20 bp, Artificial
  CRISPR gRNA sequence
aaggactgggttttgtcctg

SEQ ID NO: 507386 - DNA, 20 bp, Artificial
  CRISPR gRNA sequence
gggttttgtcctgcagtgcc

SEQ ID NO: 507387 - DNA, 20 bp, Artificial
  CRISPR gRNA sequence
ggttttgtcctgcagtgcct

SEQ ID NO: 507388 - DNA, 20 bp, Artificial
  CRISPR gRNA sequence
gtgcctgggcctcaccaatg

SEQ ID NO: 507389 - DNA, 20 bp, Artificial
  CRISPR gRNA sequence
ctgggcctcaccaatgcggc

SEQ ID NO: 507390 - DNA, 20 bp, Artificial
  CRISPR gRNA sequence
ctcaccaatgcggccggact

SEQ ID NO: 507391 - DNA, 20 bp, Artificial
  CRISPR gRNA sequence
ccggactcggtgatctcgtt

SEQ ID NO: 507392 - DNA, 20 bp, Artificial
  CRISPR gRNA sequence
cggactcggtgatctcgttg

SEQ ID NO: 507393 - DNA, 20 bp, Artificial
  CRISPR gRNA sequence
ggactcggtgatctcgttga

SEQ ID NO: 507394 - DNA, 20 bp, Artificial
  CRISPR gRNA sequence
cggtgatctcgttgagggcc

SEQ ID NO: 507395 - DNA, 20 bp, Artificial
  CRISPR gRNA sequence
gtgatctcgttgagggcccg

SEQ ID NO: 507396 - DNA, 20 bp, Artificial
  CRISPR gRNA sequence
atctcgttgagggcccggag

SEQ ID NO: 507397 - DNA, 20 bp, Artificial
  CRISPR gRNA sequence
tctcgttgagggcccggagc

SEQ ID NO: 507398 - DNA, 20 bp, Artificial
  CRISPR gRNA sequence
gcccggagcaggtcgccacc

SEQ ID NO: 507399 - DNA, 20 bp, Artificial
  CRISPR gRNA sequence
cctagcttcttgacattcct

SEQ ID NO: 507400 - DNA, 20 bp, Artificial
  CRISPR gRNA sequence
ctagcttcttgacattcctg

SEQ ID NO: 507401 - DNA, 20 bp, Artificial
  CRISPR gRNA sequence
ttgacattcctgaggtcatc

SEQ ID NO: 507402 - DNA, 20 bp, Artificial
  CRISPR gRNA sequence
attcctgaggtcatcaagca

SEQ ID NO: 507403 - DNA, 20 bp, Artificial
  CRISPR gRNA sequence
tcctgaggtcatcaagcatg

SEQ ID NO: 507404 - DNA, 20 bp, Artificial
  CRISPR gRNA sequence
tgaggtcatcaagcatggag

SEQ ID NO: 507405 - DNA, 20 bp, Artificial
  CRISPR gRNA sequence
gaggtcatcaagcatggagt

SEQ ID NO: 507406 - DNA, 20 bp, Artificial
  CRISPR gRNA sequence
ggtcatcaagcatggagtag

SEQ ID NO: 507407 - DNA, 20 bp, Artificial
  CRISPR gRNA sequence
tcatcaagcatggagtagga

SEQ ID NO: 507408 - DNA, 20 bp, Artificial
  CRISPR gRNA sequence
catcaagcatggagtaggag

SEQ ID NO: 507409 - DNA, 20 bp, Artificial
  CRISPR gRNA sequence
atggagtaggagaggtccat

SEQ ID NO: 507410 - DNA, 20 bp, Artificial
  CRISPR gRNA sequence
agtaggagaggtccatcaga

SEQ ID NO: 507411 - DNA, 20 bp, Artificial
  CRISPR gRNA sequence
gagaggtccatcagatagta

SEQ ID NO: 507412 - DNA, 20 bp, Artificial
  CRISPR gRNA sequence
agaggtccatcagatagtac

SEQ ID NO: 507413 - DNA, 20 bp, Artificial
  CRISPR gRNA sequence
catcagatagtacaggtcga

SEQ ID NO: 507414 - DNA, 20 bp, Artificial
  CRISPR gRNA sequence
atcagatagtacaggtcgat

SEQ ID NO: 507415 - DNA, 20 bp, Artificial
  CRISPR gRNA sequence
tcagatagtacaggtcgatg

SEQ ID NO: 507416 - DNA, 20 bp, Artificial
  CRISPR gRNA sequence
gatagtacaggtcgatgggg

SEQ ID NO: 507417 - DNA, 20 bp, Artificial
  CRISPR gRNA sequence
caggtcgatggggtagccct

SEQ ID NO: 507418 - DNA, 20 bp, Artificial
  CRISPR gRNA sequence
tggggtagcccttggcccgc

SEQ ID NO: 507419 - DNA, 20 bp, Artificial
  CRISPR gRNA sequence
ggtagcccttggcccgccgg

SEQ ID NO: 507420 - DNA, 20 bp, Artificial
  CRISPR gRNA sequence
gtagcccttggcccgccgga

SEQ ID NO: 507421 - DNA, 20 bp, Artificial
  CRISPR gRNA sequence
tcacgttgaacgctgctgcc

SEQ ID NO: 507422 - DNA, 20 bp, Artificial
  CRISPR gRNA sequence
aacgctgctgcctggcctgc

SEQ ID NO: 507423 - DNA, 20 bp, Artificial
  CRISPR gRNA sequence
gctgctgcctggcctgccgg

SEQ ID NO: 507424 - DNA, 20 bp, Artificial
  CRISPR gRNA sequence
ctgctgcctggcctgccggt

SEQ ID NO: 507425 - DNA, 20 bp, Artificial
  CRISPR gRNA sequence
tgctgcctggcctgccggtg

SEQ ID NO: 507426 - DNA, 20 bp, Artificial
  CRISPR gRNA sequence
gcctggcctgccggtgggga

SEQ ID NO: 507427 - DNA, 20 bp, Artificial
  CRISPR gRNA sequence
tgccggtggggacagaacaa

SEQ ID NO: 507428 - DNA, 20 bp, Artificial
  CRISPR gRNA sequence
gccggtggggacagaacaaa

SEQ ID NO: 507429 - DNA, 20 bp, Artificial
  CRISPR gRNA sequence
cggtggggacagaacaaaag

SEQ ID NO: 507430 - DNA, 20 bp, Artificial
  CRISPR gRNA sequence
gccacacctcacatctcaca

SEQ ID NO: 507431 - DNA, 20 bp, Artificial
  CRISPR gRNA sequence
ccacacctcacatctcacac

SEQ ID NO: 507432 - DNA, 20 bp, Artificial
  CRISPR gRNA sequence
cacacctcacatctcacaca

SEQ ID NO: 507433 - DNA, 20 bp, Artificial
  CRISPR gRNA sequence
cacatctcacacagggtgtc

SEQ ID NO: 507434 - DNA, 20 bp, Artificial
  CRISPR gRNA sequence
acatctcacacagggtgtct

SEQ ID NO: 507435 - DNA, 20 bp, Artificial
  CRISPR gRNA sequence
catctcacacagggtgtctg

SEQ ID NO: 507436 - DNA, 20 bp, Artificial
  CRISPR gRNA sequence
atctcacacagggtgtctgg

SEQ ID NO: 507437 - DNA, 20 bp, Artificial
  CRISPR gRNA sequence
acagggtgtctgggggcgtg

SEQ ID NO: 507438 - DNA, 20 bp, Artificial
  CRISPR gRNA sequence
gtctgggggcgtgtggcccc

SEQ ID NO: 507439 - DNA, 20 bp, Artificial
  CRISPR gRNA sequence
tgggggcgtgtggccccgag

SEQ ID NO: 507440 - DNA, 20 bp, Artificial
  CRISPR gRNA sequence
gggggcgtgtggccccgagc

SEQ ID NO: 507441 - DNA, 20 bp, Artificial
  CRISPR gRNA sequence
gccccgagcgggctgtgcac

SEQ ID NO: 507442 - DNA, 20 bp, Artificial
  CRISPR gRNA sequence
tgcactggcaccctctcctc

SEQ ID NO: 507443 - DNA, 20 bp, Artificial
  CRISPR gRNA sequence
tgacctcccctctccccgcc

SEQ ID NO: 507444 - DNA, 20 bp, Artificial
  CRISPR gRNA sequence
cctcccctctccccgcctgg

SEQ ID NO: 507445 - DNA, 20 bp, Artificial
  CRISPR gRNA sequence
ctcccctctccccgcctggc

SEQ ID NO: 507446 - DNA, 20 bp, Artificial
  CRISPR gRNA sequence
cccctctccccgcctggcag

SEQ ID NO: 507447 - DNA, 20 bp, Artificial
  CRISPR gRNA sequence
cctctccccgcctggcagga

SEQ ID NO: 507448 - DNA, 20 bp, Artificial
  CRISPR gRNA sequence
ccccgcctggcaggagagct

SEQ ID NO: 507449 - DNA, 20 bp, Artificial
  CRISPR gRNA sequence
cccgcctggcaggagagctg

SEQ ID NO: 507450 - DNA, 20 bp, Artificial
  CRISPR gRNA sequence
ctggcaggagagctgaggac

SEQ ID NO: 507451 - DNA, 20 bp, Artificial
  CRISPR gRNA sequence
ggagagctgaggaccagaca

SEQ ID NO: 507452 - DNA, 20 bp, Artificial
  CRISPR gRNA sequence
gagagctgaggaccagacac

SEQ ID NO: 507453 - DNA, 20 bp, Artificial
  CRISPR gRNA sequence
aggaccagacacaggacatc

SEQ ID NO: 507454 - DNA, 20 bp, Artificial
  CRISPR gRNA sequence
ggaccagacacaggacatcc

SEQ ID NO: 507455 - DNA, 20 bp, Artificial
  CRISPR gRNA sequence
ccagacacaggacatccagg

SEQ ID NO: 507456 - DNA, 20 bp, Artificial
  CRISPR gRNA sequence
cagacacaggacatccaggc

SEQ ID NO: 507457 - DNA, 20 bp, Artificial
  CRISPR gRNA sequence
cacaggacatccaggcaggc

SEQ ID NO: 507458 - DNA, 20 bp, Artificial
  CRISPR gRNA sequence
caggacatccaggcaggctg

SEQ ID NO: 507459 - DNA, 20 bp, Artificial
  CRISPR gRNA sequence
atccaggcaggctggagttt

SEQ ID NO: 507460 - DNA, 20 bp, Artificial
  CRISPR gRNA sequence
ccaggcaggctggagtttca

SEQ ID NO: 507461 - DNA, 20 bp, Artificial
  CRISPR gRNA sequence
caggcaggctggagtttcag

SEQ ID NO: 507462 - DNA, 20 bp, Artificial
  CRISPR gRNA sequence
gcaggctggagtttcagagg

SEQ ID NO: 507463 - DNA, 20 bp, Artificial
  CRISPR gRNA sequence
caggctggagtttcagagga

SEQ ID NO: 507464 - DNA, 20 bp, Artificial
  CRISPR gRNA sequence
cagaggaaggacatgactcc

SEQ ID NO: 507465 - DNA, 20 bp, Artificial
  CRISPR gRNA sequence
aaggacatgactcccggacg

SEQ ID NO: 507466 - DNA, 20 bp, Artificial
  CRISPR gRNA sequence
aggacatgactcccggacgc

SEQ ID NO: 507467 - DNA, 20 bp, Artificial
  CRISPR gRNA sequence
ggacgcaggcatgtgcctcg

SEQ ID NO: 507468 - DNA, 20 bp, Artificial
  CRISPR gRNA sequence
cagtgacactgaaacccgcc

SEQ ID NO: 507469 - DNA, 20 bp, Artificial
  CRISPR gRNA sequence
agtgacactgaaacccgcct

SEQ ID NO: 507470 - DNA, 20 bp, Artificial
  CRISPR gRNA sequence
gtgacactgaaacccgcctg

SEQ ID NO: 507471 - DNA, 20 bp, Artificial
  CRISPR gRNA sequence
tgaaacccgcctggggtgct

SEQ ID NO: 507472 - DNA, 20 bp, Artificial
  CRISPR gRNA sequence
aaacccgcctggggtgctta

SEQ ID NO: 507473 - DNA, 20 bp, Artificial
  CRISPR gRNA sequence
ggggtgcttagagttgacgc

SEQ ID NO: 507474 - DNA, 20 bp, Artificial
  CRISPR gRNA sequence
agagttgacgccagcgacat

SEQ ID NO: 507475 - DNA, 20 bp, Artificial
  CRISPR gRNA sequence
gagttgacgccagcgacatt

SEQ ID NO: 507476 - DNA, 20 bp, Artificial
  CRISPR gRNA sequence
agttgacgccagcgacattg

SEQ ID NO: 507477 - DNA, 20 bp, Artificial
  CRISPR gRNA sequence
cattggggacgcctttcatt

SEQ ID NO: 507478 - DNA, 20 bp, Artificial
  CRISPR gRNA sequence
ttggggacgcctttcattga

SEQ ID NO: 507479 - DNA, 20 bp, Artificial
  CRISPR gRNA sequence
gggacgcctttcattgagag

SEQ ID NO: 507480 - DNA, 20 bp, Artificial
  CRISPR gRNA sequence
acgcctttcattgagagtgg

SEQ ID NO: 507481 - DNA, 20 bp, Artificial
  CRISPR gRNA sequence
cctttcattgagagtggcag

SEQ ID NO: 507482 - DNA, 20 bp, Artificial
  CRISPR gRNA sequence
gagagtggcagcggctcacc

SEQ ID NO: 507483 - DNA, 20 bp, Artificial
  CRISPR gRNA sequence
agagtggcagcggctcacct

SEQ ID NO: 507484 - DNA, 20 bp, Artificial
  CRISPR gRNA sequence
acctgggctcacacctaacc

SEQ ID NO: 507485 - DNA, 20 bp, Artificial
  CRISPR gRNA sequence
ctaacccggccccatgcctg

SEQ ID NO: 507486 - DNA, 20 bp, Artificial
  CRISPR gRNA sequence
gccccatgcctgcagtccca

SEQ ID NO: 507487 - DNA, 20 bp, Artificial
  CRISPR gRNA sequence
ccccatgcctgcagtcccac

SEQ ID NO: 507488 - DNA, 20 bp, Artificial
  CRISPR gRNA sequence
agtcccacgggcgccctcat

SEQ ID NO: 507489 - DNA, 20 bp, Artificial
  CRISPR gRNA sequence
cccacgggcgccctcatcag

SEQ ID NO: 507490 - DNA, 20 bp, Artificial
  CRISPR gRNA sequence
cgccctcatcagcagccaca

SEQ ID NO: 507491 - DNA, 20 bp, Artificial
  CRISPR gRNA sequence
ctcatcagcagccacataga

SEQ ID NO: 507492 - DNA, 20 bp, Artificial
  CRISPR gRNA sequence
tcatcagcagccacatagac

SEQ ID NO: 507493 - DNA, 20 bp, Artificial
  CRISPR gRNA sequence
agacaggcatcacacgaacc

SEQ ID NO: 507494 - DNA, 20 bp, Artificial
  CRISPR gRNA sequence
cacacgaacctggcacttcc

SEQ ID NO: 507495 - DNA, 20 bp, Artificial
  CRISPR gRNA sequence
cgaacctggcacttcccagc

SEQ ID NO: 507496 - DNA, 20 bp, Artificial
  CRISPR gRNA sequence
gaacctggcacttcccagca

SEQ ID NO: 507497 - DNA, 20 bp, Artificial
  CRISPR gRNA sequence
acttcccagcaaggcccacg

SEQ ID NO: 507498 - DNA, 20 bp, Artificial
  CRISPR gRNA sequence
cttcccagcaaggcccacgc

SEQ ID NO: 507499 - DNA, 20 bp, Artificial
  CRISPR gRNA sequence
aggcccacgcgggccgtccc

SEQ ID NO: 507500 - DNA, 20 bp, Artificial
  CRISPR gRNA sequence
ggcccacgcgggccgtcccc

SEQ ID NO: 507501 - DNA, 20 bp, Artificial
  CRISPR gRNA sequence
cccacgcgggccgtccccag

SEQ ID NO: 507502 - DNA, 20 bp, Artificial
  CRISPR gRNA sequence
ccacgcgggccgtccccagg

SEQ ID NO: 507503 - DNA, 20 bp, Artificial
  CRISPR gRNA sequence
ggaggcccctttctccatcc

SEQ ID NO: 507504 - DNA, 20 bp, Artificial
  CRISPR gRNA sequence
ccctttctccatcccagccc

SEQ ID NO: 507505 - DNA, 20 bp, Artificial
  CRISPR gRNA sequence
acttccgctcgcccgcgtct

SEQ ID NO: 507506 - DNA, 20 bp, Artificial
  CRISPR gRNA sequence
ccgcgtctcagtcacacgtg

SEQ ID NO: 507507 - DNA, 20 bp, Artificial
  CRISPR gRNA sequence
cagtcacacgtgcggttgtg

SEQ ID NO: 507508 - DNA, 20 bp, Artificial
  CRISPR gRNA sequence
tgtttacctgtcaccgcaac

SEQ ID NO: 507509 - DNA, 20 bp, Artificial
  CRISPR gRNA sequence
ccgcaaccagcctgtgtccc

SEQ ID NO: 507510 - DNA, 20 bp, Artificial
  CRISPR gRNA sequence
cagcctgtgtccctggctcc

SEQ ID NO: 507511 - DNA, 20 bp, Artificial
  CRISPR gRNA sequence
ctggctcccagaaccgtgcc

SEQ ID NO: 507512 - DNA, 20 bp, Artificial
  CRISPR gRNA sequence
cccagaaccgtgcctggtac

SEQ ID NO: 507513 - DNA, 20 bp, Artificial
  CRISPR gRNA sequence
gaaccgtgcctggtacaagt

SEQ ID NO: 507514 - DNA, 20 bp, Artificial
  CRISPR gRNA sequence
cacacatcatgttaatgaat

SEQ ID NO: 507515 - DNA, 20 bp, Artificial
  CRISPR gRNA sequence
acatcatgttaatgaatgag

SEQ ID NO: 507516 - DNA, 20 bp, Artificial
  CRISPR gRNA sequence
catcatgttaatgaatgagc

SEQ ID NO: 507517 - DNA, 20 bp, Artificial
  CRISPR gRNA sequence
atcatgttaatgaatgagca

SEQ ID NO: 507518 - DNA, 20 bp, Artificial
  CRISPR gRNA sequence
catgttaatgaatgagcagg

SEQ ID NO: 507519 - DNA, 20 bp, Artificial
  CRISPR gRNA sequence
atgttaatgaatgagcaggg

SEQ ID NO: 507520 - DNA, 20 bp, Artificial
  CRISPR gRNA sequence
tgttaatgaatgagcaggga

SEQ ID NO: 507521 - DNA, 20 bp, Artificial
  CRISPR gRNA sequence
ttaatgaatgagcagggagg

SEQ ID NO: 507522 - DNA, 20 bp, Artificial
  CRISPR gRNA sequence
taatgaatgagcagggaggg

SEQ ID NO: 507523 - DNA, 20 bp, Artificial
  CRISPR gRNA sequence
aatgaatgagcagggaggga

SEQ ID NO: 507524 - DNA, 20 bp, Artificial
  CRISPR gRNA sequence
agcagggagggagggtgacg

SEQ ID NO: 507525 - DNA, 20 bp, Artificial
  CRISPR gRNA sequence
gtcccctctgccccaccctc

SEQ ID NO: 507526 - DNA, 20 bp, Artificial
  CRISPR gRNA sequence
ctgccccaccctccagcctt

SEQ ID NO: 507527 - DNA, 20 bp, Artificial
  CRISPR gRNA sequence
cctccagccttcagcccccc

SEQ ID NO: 507528 - DNA, 20 bp, Artificial
  CRISPR gRNA sequence
ctccagccttcagcccccct

SEQ ID NO: 507529 - DNA, 20 bp, Artificial
  CRISPR gRNA sequence
cagccttcagcccccctggg

SEQ ID NO: 507530 - DNA, 20 bp, Artificial
  CRISPR gRNA sequence
ccttcagcccccctgggcgg

SEQ ID NO: 507531 - DNA, 20 bp, Artificial
  CRISPR gRNA sequence
cttcagcccccctgggcggc

SEQ ID NO: 507532 - DNA, 20 bp, Artificial
  CRISPR gRNA sequence
gcccccctgggcggcaggac

SEQ ID NO: 507533 - DNA, 20 bp, Artificial
  CRISPR gRNA sequence
cctgggcggcaggacaagtg

SEQ ID NO: 507534 - DNA, 20 bp, Artificial
  CRISPR gRNA sequence
tgggcggcaggacaagtgca

SEQ ID NO: 507535 - DNA, 20 bp, Artificial
  CRISPR gRNA sequence
acctgcctgctgccacaccc

SEQ ID NO: 507536 - DNA, 20 bp, Artificial
  CRISPR gRNA sequence
cctgcctgctgccacaccct

SEQ ID NO: 507537 - DNA, 20 bp, Artificial
  CRISPR gRNA sequence
tgcctgctgccacaccctgg

SEQ ID NO: 507538 - DNA, 20 bp, Artificial
  CRISPR gRNA sequence
tgctgccacaccctgggaga

SEQ ID NO: 507539 - DNA, 20 bp, Artificial
  CRISPR gRNA sequence
gctgccacaccctgggagaa

SEQ ID NO: 507540 - DNA, 20 bp, Artificial
  CRISPR gRNA sequence
ctgccacaccctgggagaaa

SEQ ID NO: 507541 - DNA, 20 bp, Artificial
  CRISPR gRNA sequence
agggtatgtgcccctcctca

SEQ ID NO: 507542 - DNA, 20 bp, Artificial
  CRISPR gRNA sequence
aaatacaccacatgcacaca

SEQ ID NO: 507543 - DNA, 20 bp, Artificial
  CRISPR gRNA sequence
catgcacacacagtcacaca

SEQ ID NO: 507544 - DNA, 20 bp, Artificial
  CRISPR gRNA sequence
aaatataactcatgcacaca

SEQ ID NO: 507545 - DNA, 20 bp, Artificial
  CRISPR gRNA sequence
catgcacacacagtcacacg

SEQ ID NO: 507546 - DNA, 20 bp, Artificial
  CRISPR gRNA sequence
cacccacatatacacgcaca

SEQ ID NO: 507547 - DNA, 20 bp, Artificial
  CRISPR gRNA sequence
acgcacatggcacccacaca

SEQ ID NO: 507548 - DNA, 20 bp, Artificial
  CRISPR gRNA sequence
ctcacactcatacacaacac

SEQ ID NO: 507549 - DNA, 20 bp, Artificial
  CRISPR gRNA sequence
catacacaacaccagacaca

SEQ ID NO: 507550 - DNA, 20 bp, Artificial
  CRISPR gRNA sequence
cactcacccacattcacacc

SEQ ID NO: 507551 - DNA, 20 bp, Artificial
  CRISPR gRNA sequence
acattcacacccggcactcc

SEQ ID NO: 507552 - DNA, 20 bp, Artificial
  CRISPR gRNA sequence
acacccggcactcctggccc

SEQ ID NO: 507553 - DNA, 20 bp, Artificial
  CRISPR gRNA sequence
cctcgccctgctgtgccttg

SEQ ID NO: 507554 - DNA, 20 bp, Artificial
  CRISPR gRNA sequence
ctgctgtgccttgcagccct

SEQ ID NO: 507555 - DNA, 20 bp, Artificial
  CRISPR gRNA sequence
gctgtgccttgcagccctca

SEQ ID NO: 507556 - DNA, 20 bp, Artificial
  CRISPR gRNA sequence
ctgtgccttgcagccctcag

SEQ ID NO: 507557 - DNA, 20 bp, Artificial
  CRISPR gRNA sequence
cagccctcagaggcttcact

SEQ ID NO: 507558 - DNA, 20 bp, Artificial
  CRISPR gRNA sequence
cagaggcttcacttggcctc

SEQ ID NO: 507559 - DNA, 20 bp, Artificial
  CRISPR gRNA sequence
agaggcttcacttggcctct

SEQ ID NO: 507560 - DNA, 20 bp, Artificial
  CRISPR gRNA sequence
cttcacttggcctctgggcc

SEQ ID NO: 507561 - DNA, 20 bp, Artificial
  CRISPR gRNA sequence
ttcacttggcctctgggcca

SEQ ID NO: 507562 - DNA, 20 bp, Artificial
  CRISPR gRNA sequence
gaccccaatcactttctatg

SEQ ID NO: 507563 - DNA, 20 bp, Artificial
  CRISPR gRNA sequence
accccaatcactttctatga

SEQ ID NO: 507564 - DNA, 20 bp, Artificial
  CRISPR gRNA sequence
ccccaatcactttctatgaa

SEQ ID NO: 507565 - DNA, 20 bp, Artificial
  CRISPR gRNA sequence
aatcactttctatgaagggc

SEQ ID NO: 507566 - DNA, 20 bp, Artificial
  CRISPR gRNA sequence
actttctatgaagggccaga

SEQ ID NO: 507567 - DNA, 20 bp, Artificial
  CRISPR gRNA sequence
ggccagacagtaaatgtgtt

SEQ ID NO: 507568 - DNA, 20 bp, Artificial
  CRISPR gRNA sequence
acagtaaatgtgtttggctt

SEQ ID NO: 507569 - DNA, 20 bp, Artificial
  CRISPR gRNA sequence
cagtaaatgtgtttggcttt

SEQ ID NO: 507570 - DNA, 20 bp, Artificial
  CRISPR gRNA sequence
agtaaatgtgtttggctttg

SEQ ID NO: 507571 - DNA, 20 bp, Artificial
  CRISPR gRNA sequence
gtaaatgtgtttggctttgg

SEQ ID NO: 507572 - DNA, 20 bp, Artificial
  CRISPR gRNA sequence
gtttggctttgggggccgtg

SEQ ID NO: 507573 - DNA, 20 bp, Artificial
  CRISPR gRNA sequence
tgggggccgtgcggcgtctg

SEQ ID NO: 507574 - DNA, 20 bp, Artificial
  CRISPR gRNA sequence
gtgcggcgtctgcagcgaca

SEQ ID NO: 507575 - DNA, 20 bp, Artificial
  CRISPR gRNA sequence
gcggcgtctgcagcgacatg

SEQ ID NO: 507576 - DNA, 20 bp, Artificial
  CRISPR gRNA sequence
cggcgtctgcagcgacatgg

SEQ ID NO: 507577 - DNA, 20 bp, Artificial
  CRISPR gRNA sequence
gcgtctgcagcgacatggag

SEQ ID NO: 507578 - DNA, 20 bp, Artificial
  CRISPR gRNA sequence
cgtctgcagcgacatggagg

SEQ ID NO: 507579 - DNA, 20 bp, Artificial
  CRISPR gRNA sequence
ctgcagcgacatggaggagg

SEQ ID NO: 507580 - DNA, 20 bp, Artificial
  CRISPR gRNA sequence
gcgacatggaggaggcagcc

SEQ ID NO: 507581 - DNA, 20 bp, Artificial
  CRISPR gRNA sequence
agccaagaccatgtccccac

SEQ ID NO: 507582 - DNA, 20 bp, Artificial
  CRISPR gRNA sequence
ccatgtccccacgagcaatg

SEQ ID NO: 507583 - DNA, 20 bp, Artificial
  CRISPR gRNA sequence
cgagcaatgtggccatgctg

SEQ ID NO: 507584 - DNA, 20 bp, Artificial
  CRISPR gRNA sequence
atgtggccatgctgcagtca

SEQ ID NO: 507585 - DNA, 20 bp, Artificial
  CRISPR gRNA sequence
tgtggccatgctgcagtcaa

SEQ ID NO: 507586 - DNA, 20 bp, Artificial
  CRISPR gRNA sequence
gtggccatgctgcagtcaaa

SEQ ID NO: 507587 - DNA, 20 bp, Artificial
  CRISPR gRNA sequence
catgctgcagtcaaagggca

SEQ ID NO: 507588 - DNA, 20 bp, Artificial
  CRISPR gRNA sequence
gcagtcaaagggcacagaca

SEQ ID NO: 507589 - DNA, 20 bp, Artificial
  CRISPR gRNA sequence
cagtcaaagggcacagacat

SEQ ID NO: 507590 - DNA, 20 bp, Artificial
  CRISPR gRNA sequence
agggcacagacataggcctt

SEQ ID NO: 507591 - DNA, 20 bp, Artificial
  CRISPR gRNA sequence
gcacagacataggcctttgg

SEQ ID NO: 507592 - DNA, 20 bp, Artificial
  CRISPR gRNA sequence
taggcctttggtggctgacc

SEQ ID NO: 507593 - DNA, 20 bp, Artificial
  CRISPR gRNA sequence
aggcctttggtggctgacca

SEQ ID NO: 507594 - DNA, 20 bp, Artificial
  CRISPR gRNA sequence
ggcctttggtggctgaccaa

SEQ ID NO: 507595 - DNA, 20 bp, Artificial
  CRISPR gRNA sequence
gcctttggtggctgaccaag

SEQ ID NO: 507596 - DNA, 20 bp, Artificial
  CRISPR gRNA sequence
gggccccgtcccttcccttc

SEQ ID NO: 507597 - DNA, 20 bp, Artificial
  CRISPR gRNA sequence
gccccgtcccttcccttcca

SEQ ID NO: 507598 - DNA, 20 bp, Artificial
  CRISPR gRNA sequence
ccgtcccttcccttccagag

SEQ ID NO: 507599 - DNA, 20 bp, Artificial
  CRISPR gRNA sequence
gtcccttcccttccagagta

SEQ ID NO: 507600 - DNA, 20 bp, Artificial
  CRISPR gRNA sequence
tcccttcccttccagagtag

SEQ ID NO: 507601 - DNA, 20 bp, Artificial
  CRISPR gRNA sequence
tcccttccagagtagaggct

SEQ ID NO: 507602 - DNA, 20 bp, Artificial
  CRISPR gRNA sequence
tccagagtagaggctcagcg

SEQ ID NO: 507603 - DNA, 20 bp, Artificial
  CRISPR gRNA sequence
ccagagtagaggctcagcga

SEQ ID NO: 507604 - DNA, 20 bp, Artificial
  CRISPR gRNA sequence
cagagtagaggctcagcgaa

SEQ ID NO: 507605 - DNA, 20 bp, Artificial
  CRISPR gRNA sequence
gtagaggctcagcgaagggc

SEQ ID NO: 507606 - DNA, 20 bp, Artificial
  CRISPR gRNA sequence
gaggctcagcgaagggccag

SEQ ID NO: 507607 - DNA, 20 bp, Artificial
  CRISPR gRNA sequence
aggctcagcgaagggccagc

SEQ ID NO: 507608 - DNA, 20 bp, Artificial
  CRISPR gRNA sequence
agcgaagggccagcaggctg

SEQ ID NO: 507609 - DNA, 20 bp, Artificial
  CRISPR gRNA sequence
gcgaagggccagcaggctgc

SEQ ID NO: 507610 - DNA, 20 bp, Artificial
  CRISPR gRNA sequence
cgaagggccagcaggctgcg

SEQ ID NO: 507611 - DNA, 20 bp, Artificial
  CRISPR gRNA sequence
gaagggccagcaggctgcgg

SEQ ID NO: 507612 - DNA, 20 bp, Artificial
  CRISPR gRNA sequence
gggccagcaggctgcggggg

SEQ ID NO: 507613 - DNA, 20 bp, Artificial
  CRISPR gRNA sequence
ggccagcaggctgcgggggt

SEQ ID NO: 507614 - DNA, 20 bp, Artificial
  CRISPR gRNA sequence
gccagcaggctgcgggggta

SEQ ID NO: 507615 - DNA, 20 bp, Artificial
  CRISPR gRNA sequence
gcaggctgcgggggtagggc

SEQ ID NO: 507616 - DNA, 20 bp, Artificial
  CRISPR gRNA sequence
caggctgcgggggtagggcc

SEQ ID NO: 507617 - DNA, 20 bp, Artificial
  CRISPR gRNA sequence
gggtagggccaggaccccgc

SEQ ID NO: 507618 - DNA, 20 bp, Artificial
  CRISPR gRNA sequence
gtagggccaggaccccgcga

SEQ ID NO: 507619 - DNA, 20 bp, Artificial
  CRISPR gRNA sequence
tagggccaggaccccgcgag

SEQ ID NO: 507620 - DNA, 20 bp, Artificial
  CRISPR gRNA sequence
gccaggaccccgcgagagga

SEQ ID NO: 507621 - DNA, 20 bp, Artificial
  CRISPR gRNA sequence
gcgagaggacagtcccttcc

SEQ ID NO: 507622 - DNA, 20 bp, Artificial
  CRISPR gRNA sequence
cagatcctgccgccctgctc

SEQ ID NO: 507623 - DNA, 20 bp, Artificial
  CRISPR gRNA sequence
agatcctgccgccctgctct

SEQ ID NO: 507624 - DNA, 20 bp, Artificial
  CRISPR gRNA sequence
atcctgccgccctgctctgg

SEQ ID NO: 507625 - DNA, 20 bp, Artificial
  CRISPR gRNA sequence
cgccctgctctgggagcctg

SEQ ID NO: 507626 - DNA, 20 bp, Artificial
  CRISPR gRNA sequence
gctctgggagcctgtggccc

SEQ ID NO: 507627 - DNA, 20 bp, Artificial
  CRISPR gRNA sequence
ctctgggagcctgtggccct

SEQ ID NO: 507628 - DNA, 20 bp, Artificial
  CRISPR gRNA sequence
tctgggagcctgtggccctg

SEQ ID NO: 507629 - DNA, 20 bp, Artificial
  CRISPR gRNA sequence
tgtggccctggggtgctgtt

SEQ ID NO: 507630 - DNA, 20 bp, Artificial
  CRISPR gRNA sequence
gtgctgttaagatctctccc

SEQ ID NO: 507631 - DNA, 20 bp, Artificial
  CRISPR gRNA sequence
tctctccctggtgctcaccc

SEQ ID NO: 507632 - DNA, 20 bp, Artificial
  CRISPR gRNA sequence
accctcacctgcatccaccc

SEQ ID NO: 507633 - DNA, 20 bp, Artificial
  CRISPR gRNA sequence
cgagctcacctgtgccctcc

SEQ ID NO: 507634 - DNA, 20 bp, Artificial
  CRISPR gRNA sequence
agctcacctgtgccctccca

SEQ ID NO: 507635 - DNA, 20 bp, Artificial
  CRISPR gRNA sequence
gctcacctgtgccctcccag

SEQ ID NO: 507636 - DNA, 20 bp, Artificial
  CRISPR gRNA sequence
ctgtgccctcccagaggcca

SEQ ID NO: 507637 - DNA, 20 bp, Artificial
  CRISPR gRNA sequence
cacagcatttgccccctgca

SEQ ID NO: 507638 - DNA, 20 bp, Artificial
  CRISPR gRNA sequence
agcatttgccccctgcacag

SEQ ID NO: 507639 - DNA, 20 bp, Artificial
  CRISPR gRNA sequence
gcatttgccccctgcacagt

SEQ ID NO: 507640 - DNA, 20 bp, Artificial
  CRISPR gRNA sequence
catttgccccctgcacagtg

SEQ ID NO: 507641 - DNA, 20 bp, Artificial
  CRISPR gRNA sequence
tgcacagtggggatgcatgc

SEQ ID NO: 507642 - DNA, 20 bp, Artificial
  CRISPR gRNA sequence
gcacagtggggatgcatgcc

SEQ ID NO: 507643 - DNA, 20 bp, Artificial
  CRISPR gRNA sequence
tggggatgcatgccaggccg

SEQ ID NO: 507644 - DNA, 20 bp, Artificial
  CRISPR gRNA sequence
ggggatgcatgccaggccgt

SEQ ID NO: 507645 - DNA, 20 bp, Artificial
  CRISPR gRNA sequence
gatgcatgccaggccgtggg

SEQ ID NO: 507646 - DNA, 20 bp, Artificial
  CRISPR gRNA sequence
cactcccccacccttcccca

SEQ ID NO: 507647 - DNA, 20 bp, Artificial
  CRISPR gRNA sequence
cccacccttccccacggcac

SEQ ID NO: 507648 - DNA, 20 bp, Artificial
  CRISPR gRNA sequence
ccacccttccccacggcaca

SEQ ID NO: 507649 - DNA, 20 bp, Artificial
  CRISPR gRNA sequence
ggcacaaggatgcccccact

SEQ ID NO: 507650 - DNA, 20 bp, Artificial
  CRISPR gRNA sequence
gcacaaggatgcccccactc

SEQ ID NO: 507651 - DNA, 20 bp, Artificial
  CRISPR gRNA sequence
tcaggcgcacccccaccctc

SEQ ID NO: 507652 - DNA, 20 bp, Artificial
  CRISPR gRNA sequence
caggcgcacccccaccctcc

SEQ ID NO: 507653 - DNA, 20 bp, Artificial
  CRISPR gRNA sequence
acgatccttcctgacacctc

SEQ ID NO: 507654 - DNA, 20 bp, Artificial
  CRISPR gRNA sequence
tcctgacacctccagcacca

SEQ ID NO: 507655 - DNA, 20 bp, Artificial
  CRISPR gRNA sequence
ctgacacctccagcaccaca

SEQ ID NO: 507656 - DNA, 20 bp, Artificial
  CRISPR gRNA sequence
ccacagagctgcacaaactc

SEQ ID NO: 507657 - DNA, 20 bp, Artificial
  CRISPR gRNA sequence
agctgcacaaactctggcca

SEQ ID NO: 507658 - DNA, 20 bp, Artificial
  CRISPR gRNA sequence
gctgcacaaactctggccac

SEQ ID NO: 507659 - DNA, 20 bp, Artificial
  CRISPR gRNA sequence
gccacaggcaacacctctgt

SEQ ID NO: 507660 - DNA, 20 bp, Artificial
  CRISPR gRNA sequence
ggcaacacctctgtcagcct

SEQ ID NO: 507661 - DNA, 20 bp, Artificial
  CRISPR gRNA sequence
gcctcagtttcctcactgtg

SEQ ID NO: 507662 - DNA, 20 bp, Artificial
  CRISPR gRNA sequence
tcagtttcctcactgtgaag

SEQ ID NO: 507663 - DNA, 20 bp, Artificial
  CRISPR gRNA sequence
cagtttcctcactgtgaagt

SEQ ID NO: 507664 - DNA, 20 bp, Artificial
  CRISPR gRNA sequence
agtttcctcactgtgaagtg

SEQ ID NO: 507665 - DNA, 20 bp, Artificial
  CRISPR gRNA sequence
cctcactgtgaagtggggcg

SEQ ID NO: 507666 - DNA, 20 bp, Artificial
  CRISPR gRNA sequence
ctcactgtgaagtggggcgt

SEQ ID NO: 507667 - DNA, 20 bp, Artificial
  CRISPR gRNA sequence
tcactgtgaagtggggcgtg

SEQ ID NO: 507668 - DNA, 20 bp, Artificial
  CRISPR gRNA sequence
ggggcgtggggaaaatacat

SEQ ID NO: 507669 - DNA, 20 bp, Artificial
  CRISPR gRNA sequence
ggcgtggggaaaatacatca

SEQ ID NO: 507670 - DNA, 20 bp, Artificial
  CRISPR gRNA sequence
aaatacatcagagctgcctc

SEQ ID NO: 507671 - DNA, 20 bp, Artificial
  CRISPR gRNA sequence
aatacatcagagctgcctcc

SEQ ID NO: 507672 - DNA, 20 bp, Artificial
  CRISPR gRNA sequence
atacatcagagctgcctcca

SEQ ID NO: 507673 - DNA, 20 bp, Artificial
  CRISPR gRNA sequence
tacatcagagctgcctccag

SEQ ID NO: 507674 - DNA, 20 bp, Artificial
  CRISPR gRNA sequence
agagctgcctccaggggcca

SEQ ID NO: 507675 - DNA, 20 bp, Artificial
  CRISPR gRNA sequence
gagctgcctccaggggccac

SEQ ID NO: 507676 - DNA, 20 bp, Artificial
  CRISPR gRNA sequence
agctgcctccaggggccaca

SEQ ID NO: 507677 - DNA, 20 bp, Artificial
  CRISPR gRNA sequence
gcctccaggggccacagggc

SEQ ID NO: 507678 - DNA, 20 bp, Artificial
  CRISPR gRNA sequence
cctccaggggccacagggcc

SEQ ID NO: 507679 - DNA, 20 bp, Artificial
  CRISPR gRNA sequence
ggccacagggccaggccctc

SEQ ID NO: 507680 - DNA, 20 bp, Artificial
  CRISPR gRNA sequence
agggccaggccctcgagttt

SEQ ID NO: 507681 - DNA, 20 bp, Artificial
  CRISPR gRNA sequence
gggccaggccctcgagtttg

SEQ ID NO: 507682 - DNA, 20 bp, Artificial
  CRISPR gRNA sequence
caggccctcgagtttgaggt

SEQ ID NO: 507683 - DNA, 20 bp, Artificial
  CRISPR gRNA sequence
ggccctcgagtttgaggtca

SEQ ID NO: 507684 - DNA, 20 bp, Artificial
  CRISPR gRNA sequence
gccctcgagtttgaggtcag

SEQ ID NO: 507685 - DNA, 20 bp, Artificial
  CRISPR gRNA sequence
ctcgagtttgaggtcagagg

SEQ ID NO: 507686 - DNA, 20 bp, Artificial
  CRISPR gRNA sequence
cgagtttgaggtcagaggtg

SEQ ID NO: 507687 - DNA, 20 bp, Artificial
  CRISPR gRNA sequence
gagtttgaggtcagaggtgg

SEQ ID NO: 507688 - DNA, 20 bp, Artificial
  CRISPR gRNA sequence
gaggtcagaggtggaggttc

SEQ ID NO: 507689 - DNA, 20 bp, Artificial
  CRISPR gRNA sequence
gaggtggaggttccagcacg

SEQ ID NO: 507690 - DNA, 20 bp, Artificial
  CRISPR gRNA sequence
aggtggaggttccagcacga

SEQ ID NO: 507691 - DNA, 20 bp, Artificial
  CRISPR gRNA sequence
ggtggaggttccagcacgaa

SEQ ID NO: 507692 - DNA, 20 bp, Artificial
  CRISPR gRNA sequence
gtggaggttccagcacgaag

SEQ ID NO: 507693 - DNA, 20 bp, Artificial
  CRISPR gRNA sequence
aaggggcttgtgcctgctca

SEQ ID NO: 507694 - DNA, 20 bp, Artificial
  CRISPR gRNA sequence
aggggcttgtgcctgctcac

SEQ ID NO: 507695 - DNA, 20 bp, Artificial
  CRISPR gRNA sequence
ggggcttgtgcctgctcacg

SEQ ID NO: 507696 - DNA, 20 bp, Artificial
  CRISPR gRNA sequence
gcttgtgcctgctcacgggg

SEQ ID NO: 507697 - DNA, 20 bp, Artificial
  CRISPR gRNA sequence
gtgcctgctcacggggcagc

SEQ ID NO: 507698 - DNA, 20 bp, Artificial
  CRISPR gRNA sequence
tgcctgctcacggggcagcg

SEQ ID NO: 507699 - DNA, 20 bp, Artificial
  CRISPR gRNA sequence
gcctgctcacggggcagcga

SEQ ID NO: 507700 - DNA, 20 bp, Artificial
  CRISPR gRNA sequence
cctgctcacggggcagcgag

SEQ ID NO: 507701 - DNA, 20 bp, Artificial
  CRISPR gRNA sequence
gctcacggggcagcgagggg

SEQ ID NO: 507702 - DNA, 20 bp, Artificial
  CRISPR gRNA sequence
ctcacggggcagcgaggggc

SEQ ID NO: 507703 - DNA, 20 bp, Artificial
  CRISPR gRNA sequence
ggcaggcctgaccctaccac

SEQ ID NO: 507704 - DNA, 20 bp, Artificial
  CRISPR gRNA sequence
gcaggcctgaccctaccacc

SEQ ID NO: 507705 - DNA, 20 bp, Artificial
  CRISPR gRNA sequence
caggcctgaccctaccacca

SEQ ID NO: 507706 - DNA, 20 bp, Artificial
  CRISPR gRNA sequence
gcctgaccctaccaccaggg

SEQ ID NO: 507707 - DNA, 20 bp, Artificial
  CRISPR gRNA sequence
cctgaccctaccaccagggt

SEQ ID NO: 507708 - DNA, 20 bp, Artificial
  CRISPR gRNA sequence
ctgaccctaccaccagggtg

SEQ ID NO: 507709 - DNA, 20 bp, Artificial
  CRISPR gRNA sequence
gttttgtcccctgctgcccc

SEQ ID NO: 507710 - DNA, 20 bp, Artificial
  CRISPR gRNA sequence
ttttgtcccctgctgccccc

SEQ ID NO: 507711 - DNA, 20 bp, Artificial
  CRISPR gRNA sequence
tttgtcccctgctgccccca

SEQ ID NO: 507712 - DNA, 20 bp, Artificial
  CRISPR gRNA sequence
ctgctgcccccagggacacc

SEQ ID NO: 507713 - DNA, 20 bp, Artificial
  CRISPR gRNA sequence
tgctgcccccagggacacct

SEQ ID NO: 507714 - DNA, 20 bp, Artificial
  CRISPR gRNA sequence
acacctgggccctgctcctg

SEQ ID NO: 507715 - DNA, 20 bp, Artificial
  CRISPR gRNA sequence
cacctgggccctgctcctgc

SEQ ID NO: 507716 - DNA, 20 bp, Artificial
  CRISPR gRNA sequence
ctcctgcaggacctccccaa

SEQ ID NO: 507717 - DNA, 20 bp, Artificial
  CRISPR gRNA sequence
gcaggacctccccaatggct

SEQ ID NO: 507718 - DNA, 20 bp, Artificial
  CRISPR gRNA sequence
ccccatccctcactgtctcc

SEQ ID NO: 507719 - DNA, 20 bp, Artificial
  CRISPR gRNA sequence
tctcccagctgcctccctcc

SEQ ID NO: 507720 - DNA, 20 bp, Artificial
  CRISPR gRNA sequence
gcctccctcccggctgctgc

SEQ ID NO: 507721 - DNA, 20 bp, Artificial
  CRISPR gRNA sequence
ggctgctgctggctgtcacc

SEQ ID NO: 507722 - DNA, 20 bp, Artificial
  CRISPR gRNA sequence
tcacctggccgcctgcaccc

SEQ ID NO: 507723 - DNA, 20 bp, Artificial
  CRISPR gRNA sequence
cacctggccgcctgcaccct

SEQ ID NO: 507724 - DNA, 20 bp, Artificial
  CRISPR gRNA sequence
accctgggccactctgcccc

SEQ ID NO: 507725 - DNA, 20 bp, Artificial
  CRISPR gRNA sequence
ccctgggccactctgcccca

SEQ ID NO: 507726 - DNA, 20 bp, Artificial
  CRISPR gRNA sequence
actctgccccaaggctaact

SEQ ID NO: 507727 - DNA, 20 bp, Artificial
  CRISPR gRNA sequence
ctgccccaaggctaactcag

SEQ ID NO: 507728 - DNA, 20 bp, Artificial
  CRISPR gRNA sequence
taactcagtggccgctgacc

SEQ ID NO: 507729 - DNA, 20 bp, Artificial
  CRISPR gRNA sequence
aactcagtggccgctgacct

SEQ ID NO: 507730 - DNA, 20 bp, Artificial
  CRISPR gRNA sequence
cgctgacctgggcttcccct

SEQ ID NO: 507731 - DNA, 20 bp, Artificial
  CRISPR gRNA sequence
gctgacctgggcttcccctg

SEQ ID NO: 507732 - DNA, 20 bp, Artificial
  CRISPR gRNA sequence
ctgacctgggcttcccctga

SEQ ID NO: 507733 - DNA, 20 bp, Artificial
  CRISPR gRNA sequence
acctgggcttcccctgaggg

SEQ ID NO: 507734 - DNA, 20 bp, Artificial
  CRISPR gRNA sequence
ctgggcttcccctgagggca

SEQ ID NO: 507735 - DNA, 20 bp, Artificial
  CRISPR gRNA sequence
tcccctgagggcagagctct

SEQ ID NO: 507736 - DNA, 20 bp, Artificial
  CRISPR gRNA sequence
gagggcagagctctgagccc

SEQ ID NO: 507737 - DNA, 20 bp, Artificial
  CRISPR gRNA sequence
agccccagcctgtccgacac

SEQ ID NO: 507738 - DNA, 20 bp, Artificial
  CRISPR gRNA sequence
ccagcctgtccgacaccagc

SEQ ID NO: 507739 - DNA, 20 bp, Artificial
  CRISPR gRNA sequence
gacaccagctggttcctcta

SEQ ID NO: 507740 - DNA, 20 bp, Artificial
  CRISPR gRNA sequence
tggttcctctaaagtcaccc

SEQ ID NO: 507741 - DNA, 20 bp, Artificial
  CRISPR gRNA sequence
ccccgtctgcaccctctccc

SEQ ID NO: 507742 - DNA, 20 bp, Artificial
  CRISPR gRNA sequence
cccgtctgcaccctctccct

SEQ ID NO: 507743 - DNA, 20 bp, Artificial
  CRISPR gRNA sequence
cgtctgcaccctctccctgg

SEQ ID NO: 507744 - DNA, 20 bp, Artificial
  CRISPR gRNA sequence
tgcaccctctccctgggaga

SEQ ID NO: 507745 - DNA, 20 bp, Artificial
  CRISPR gRNA sequence
atggcttccccttccttccc

SEQ ID NO: 507746 - DNA, 20 bp, Artificial
  CRISPR gRNA sequence
ttccttccctggcctcactg

SEQ ID NO: 507747 - DNA, 20 bp, Artificial
  CRISPR gRNA sequence
tccctggcctcactgtggcc

SEQ ID NO: 507748 - DNA, 20 bp, Artificial
  CRISPR gRNA sequence
ccctggcctcactgtggcct

SEQ ID NO: 507749 - DNA, 20 bp, Artificial
  CRISPR gRNA sequence
ctggcctcactgtggcctgg

SEQ ID NO: 507750 - DNA, 20 bp, Artificial
  CRISPR gRNA sequence
tggcctcactgtggcctggg

SEQ ID NO: 507751 - DNA, 20 bp, Artificial
  CRISPR gRNA sequence
cactgtggcctgggaggtca

SEQ ID NO: 507752 - DNA, 20 bp, Artificial
  CRISPR gRNA sequence
actgtggcctgggaggtcac

SEQ ID NO: 507753 - DNA, 20 bp, Artificial
  CRISPR gRNA sequence
tggcctgggaggtcacaggt

SEQ ID NO: 507754 - DNA, 20 bp, Artificial
  CRISPR gRNA sequence
cctgggaggtcacaggtcgg

SEQ ID NO: 507755 - DNA, 20 bp, Artificial
  CRISPR gRNA sequence
tcacaggtcggtggccacac

SEQ ID NO: 507756 - DNA, 20 bp, Artificial
  CRISPR gRNA sequence
cacaggtcggtggccacacc

SEQ ID NO: 507757 - DNA, 20 bp, Artificial
  CRISPR gRNA sequence
caccaccacacctgccttcc

SEQ ID NO: 507758 - DNA, 20 bp, Artificial
  CRISPR gRNA sequence
ccaccacacctgccttcctg

SEQ ID NO: 507759 - DNA, 20 bp, Artificial
  CRISPR gRNA sequence
cacacctgccttcctggagc

SEQ ID NO: 507760 - DNA, 20 bp, Artificial
  CRISPR gRNA sequence
acacctgccttcctggagca

SEQ ID NO: 507761 - DNA, 20 bp, Artificial
  CRISPR gRNA sequence
acctgccttcctggagcaag

SEQ ID NO: 507762 - DNA, 20 bp, Artificial
  CRISPR gRNA sequence
cctgccttcctggagcaagg

SEQ ID NO: 507763 - DNA, 20 bp, Artificial
  CRISPR gRNA sequence
ctgccttcctggagcaagga

SEQ ID NO: 507764 - DNA, 20 bp, Artificial
  CRISPR gRNA sequence
gccttcctggagcaaggagg

SEQ ID NO: 507765 - DNA, 20 bp, Artificial
  CRISPR gRNA sequence
ccttcctttcttttcatttt

SEQ ID NO: 507766 - DNA, 20 bp, Artificial
  CRISPR gRNA sequence
cctttcttttcattttgaga

SEQ ID NO: 507767 - DNA, 20 bp, Artificial
  CRISPR gRNA sequence
cagaatctcgccctgtcgcc

SEQ ID NO: 507768 - DNA, 20 bp, Artificial
  CRISPR gRNA sequence
agaatctcgccctgtcgccc

SEQ ID NO: 507769 - DNA, 20 bp, Artificial
  CRISPR gRNA sequence
tcgccctgtcgcccaggcta

SEQ ID NO: 507770 - DNA, 20 bp, Artificial
  CRISPR gRNA sequence
ctgtcgcccaggctaaagtg

SEQ ID NO: 507771 - DNA, 20 bp, Artificial
  CRISPR gRNA sequence
tcgcccaggctaaagtgcag

SEQ ID NO: 507772 - DNA, 20 bp, Artificial
  CRISPR gRNA sequence
aaagtgcagtggcacaatct

SEQ ID NO: 507773 - DNA, 20 bp, Artificial
  CRISPR gRNA sequence
tcactgcaacctctgcctcc

SEQ ID NO: 507774 - DNA, 20 bp, Artificial
  CRISPR gRNA sequence
cactgcaacctctgcctccc

SEQ ID NO: 507775 - DNA, 20 bp, Artificial
  CRISPR gRNA sequence
aacctctgcctcccaggttc

SEQ ID NO: 507776 - DNA, 20 bp, Artificial
  CRISPR gRNA sequence
ttcaagtgattctcctgccg

SEQ ID NO: 507777 - DNA, 20 bp, Artificial
  CRISPR gRNA sequence
aagtgattctcctgccgcag

SEQ ID NO: 507778 - DNA, 20 bp, Artificial
  CRISPR gRNA sequence
agtgattctcctgccgcagc

SEQ ID NO: 507779 - DNA, 20 bp, Artificial
  CRISPR gRNA sequence
tgattctcctgccgcagcag

SEQ ID NO: 507780 - DNA, 20 bp, Artificial
  CRISPR gRNA sequence
ctgccgcagcaggagaatgt

SEQ ID NO: 507781 - DNA, 20 bp, Artificial
  CRISPR gRNA sequence
cgcagcaggagaatgttggc

SEQ ID NO: 507782 - DNA, 20 bp, Artificial
  CRISPR gRNA sequence
gcagcaggagaatgttggcc

SEQ ID NO: 507783 - DNA, 20 bp, Artificial
  CRISPR gRNA sequence
caggagaatgttggccaggc

SEQ ID NO: 507784 - DNA, 20 bp, Artificial
  CRISPR gRNA sequence
ggtctcgaacccccgacctc

SEQ ID NO: 507785 - DNA, 20 bp, Artificial
  CRISPR gRNA sequence
ctcaagtgatccacccgcct

SEQ ID NO: 507786 - DNA, 20 bp, Artificial
  CRISPR gRNA sequence
ccacccgcctcggcctccca

SEQ ID NO: 507787 - DNA, 20 bp, Artificial
  CRISPR gRNA sequence
gcctcggcctcccaaagtgc

SEQ ID NO: 507788 - DNA, 20 bp, Artificial
  CRISPR gRNA sequence
cctcggcctcccaaagtgct

SEQ ID NO: 507789 - DNA, 20 bp, Artificial
  CRISPR gRNA sequence
ctcccaaagtgctgggatta

SEQ ID NO: 507790 - DNA, 20 bp, Artificial
  CRISPR gRNA sequence
tcccaaagtgctgggattac

SEQ ID NO: 507791 - DNA, 20 bp, Artificial
  CRISPR gRNA sequence
agtgctgggattacaggcgt

SEQ ID NO: 507792 - DNA, 20 bp, Artificial
  CRISPR gRNA sequence
tacaggcgtgagccaccgat

SEQ ID NO: 507793 - DNA, 20 bp, Artificial
  CRISPR gRNA sequence
acaggcgtgagccaccgata

SEQ ID NO: 507794 - DNA, 20 bp, Artificial
  CRISPR gRNA sequence
aggcgtgagccaccgataag

SEQ ID NO: 507795 - DNA, 20 bp, Artificial
  CRISPR gRNA sequence
ggcgtgagccaccgataagg

SEQ ID NO: 507796 - DNA, 20 bp, Artificial
  CRISPR gRNA sequence
gcgtgagccaccgataagga

SEQ ID NO: 507797 - DNA, 20 bp, Artificial
  CRISPR gRNA sequence
gataaggagggcgtttctca

SEQ ID NO: 507798 - DNA, 20 bp, Artificial
  CRISPR gRNA sequence
ggcgtttctcaaagcactga

SEQ ID NO: 507799 - DNA, 20 bp, Artificial
  CRISPR gRNA sequence
gcgtttctcaaagcactgac

SEQ ID NO: 507800 - DNA, 20 bp, Artificial
  CRISPR gRNA sequence
cgtttctcaaagcactgaca

SEQ ID NO: 507801 - DNA, 20 bp, Artificial
  CRISPR gRNA sequence
gtttctcaaagcactgacag

SEQ ID NO: 507802 - DNA, 20 bp, Artificial
  CRISPR gRNA sequence
caggggactgtgttctgaaa

SEQ ID NO: 507803 - DNA, 20 bp, Artificial
  CRISPR gRNA sequence
aggggactgtgttctgaaac

SEQ ID NO: 507804 - DNA, 20 bp, Artificial
  CRISPR gRNA sequence
gtgttctgaaacaggtgctc

SEQ ID NO: 507805 - DNA, 20 bp, Artificial
  CRISPR gRNA sequence
ctgaaacaggtgctctggtc

SEQ ID NO: 507806 - DNA, 20 bp, Artificial
  CRISPR gRNA sequence
gtgctctggtcaagtcgaaa

SEQ ID NO: 507807 - DNA, 20 bp, Artificial
  CRISPR gRNA sequence
tgctctggtcaagtcgaaac

SEQ ID NO: 507808 - DNA, 20 bp, Artificial
  CRISPR gRNA sequence
tcaagtcgaaacaggtgctc

SEQ ID NO: 507809 - DNA, 20 bp, Artificial
  CRISPR gRNA sequence
tcgaaacaggtgctctggtc

SEQ ID NO: 507810 - DNA, 20 bp, Artificial
  CRISPR gRNA sequence
aacaggtgctctggtcaagt

SEQ ID NO: 507811 - DNA, 20 bp, Artificial
  CRISPR gRNA sequence
gtgctctggtcaagtcagtt

SEQ ID NO: 507812 - DNA, 20 bp, Artificial
  CRISPR gRNA sequence
tgctctggtcaagtcagttt

SEQ ID NO: 507813 - DNA, 20 bp, Artificial
  CRISPR gRNA sequence
caagtcagtttgggcaacac

SEQ ID NO: 507814 - DNA, 20 bp, Artificial
  CRISPR gRNA sequence
ttgggcaacactggtttaaa

SEQ ID NO: 507815 - DNA, 20 bp, Artificial
  CRISPR gRNA sequence
cactggtttaaacagttact

SEQ ID NO: 507816 - DNA, 20 bp, Artificial
  CRISPR gRNA sequence
actggtttaaacagttactt

SEQ ID NO: 507817 - DNA, 20 bp, Artificial
  CRISPR gRNA sequence
aaacagttacttaggtctct

SEQ ID NO: 507818 - DNA, 20 bp, Artificial
  CRISPR gRNA sequence
tacttaggtctcttggctgc

SEQ ID NO: 507819 - DNA, 20 bp, Artificial
  CRISPR gRNA sequence
ctcttggctgcaagactgat

SEQ ID NO: 507820 - DNA, 20 bp, Artificial
  CRISPR gRNA sequence
cttggctgcaagactgatca

SEQ ID NO: 507821 - DNA, 20 bp, Artificial
  CRISPR gRNA sequence
atcagagcctttactcttct

SEQ ID NO: 507822 - DNA, 20 bp, Artificial
  CRISPR gRNA sequence
cagagcctttactcttctaa

SEQ ID NO: 507823 - DNA, 20 bp, Artificial
  CRISPR gRNA sequence
ttactcttctaagagtaccc

SEQ ID NO: 507824 - DNA, 20 bp, Artificial
  CRISPR gRNA sequence
taagagtaccctggccttct

SEQ ID NO: 507825 - DNA, 20 bp, Artificial
  CRISPR gRNA sequence
ctggccttctgagtgtgtaa

SEQ ID NO: 507826 - DNA, 20 bp, Artificial
  CRISPR gRNA sequence
cttctgagtgtgtaatggaa

SEQ ID NO: 507827 - DNA, 20 bp, Artificial
  CRISPR gRNA sequence
atggaatagtgttttgcaaa

SEQ ID NO: 507828 - DNA, 20 bp, Artificial
  CRISPR gRNA sequence
atagtgttttgcaaatggtt

SEQ ID NO: 507829 - DNA, 20 bp, Artificial
  CRISPR gRNA sequence
tggtctccctttaaaaaaaa

SEQ ID NO: 507830 - DNA, 20 bp, Artificial
  CRISPR gRNA sequence
ggtctccctttaaaaaaaaa

SEQ ID NO: 507831 - DNA, 20 bp, Artificial
  CRISPR gRNA sequence
ccctttaaaaaaaaaaggtg

SEQ ID NO: 507832 - DNA, 20 bp, Artificial
  CRISPR gRNA sequence
aaaaaaaaggtgcagaacgt

SEQ ID NO: 507833 - DNA, 20 bp, Artificial
  CRISPR gRNA sequence
aaaaaaaggtgcagaacgtc

SEQ ID NO: 507834 - DNA, 20 bp, Artificial
  CRISPR gRNA sequence
ggtgcagaacgtcgggctgc

SEQ ID NO: 507835 - DNA, 20 bp, Artificial
  CRISPR gRNA sequence
tgcagaacgtcgggctgcga

SEQ ID NO: 507836 - DNA, 20 bp, Artificial
  CRISPR gRNA sequence
cagaacgtcgggctgcgaga

SEQ ID NO: 507837 - DNA, 20 bp, Artificial
  CRISPR gRNA sequence
cgtcgggctgcgagagagtg

SEQ ID NO: 507838 - DNA, 20 bp, Artificial
  CRISPR gRNA sequence
ctgcgagagagtgcagacac

SEQ ID NO: 507839 - DNA, 20 bp, Artificial
  CRISPR gRNA sequence
tgcgagagagtgcagacact

SEQ ID NO: 507840 - DNA, 20 bp, Artificial
  CRISPR gRNA sequence
gtgcagacactgggcaccga

SEQ ID NO: 507841 - DNA, 20 bp, Artificial
  CRISPR gRNA sequence
agacactgggcaccgatggt

SEQ ID NO: 507842 - DNA, 20 bp, Artificial
  CRISPR gRNA sequence
gacactgggcaccgatggta

SEQ ID NO: 507843 - DNA, 20 bp, Artificial
  CRISPR gRNA sequence
acactgggcaccgatggtaa

SEQ ID NO: 507844 - DNA, 20 bp, Artificial
  CRISPR gRNA sequence
tgggcaccgatggtaagggc

SEQ ID NO: 507845 - DNA, 20 bp, Artificial
  CRISPR gRNA sequence
gggcaccgatggtaagggct

SEQ ID NO: 507846 - DNA, 20 bp, Artificial
  CRISPR gRNA sequence
ggcaccgatggtaagggctg

SEQ ID NO: 507847 - DNA, 20 bp, Artificial
  CRISPR gRNA sequence
accgatggtaagggctgggg

SEQ ID NO: 507848 - DNA, 20 bp, Artificial
  CRISPR gRNA sequence
agggctggggcagctccacc

SEQ ID NO: 507849 - DNA, 20 bp, Artificial
  CRISPR gRNA sequence
gggctggggcagctccacct

SEQ ID NO: 507850 - DNA, 20 bp, Artificial
  CRISPR gRNA sequence
ggctggggcagctccacctg

SEQ ID NO: 507851 - DNA, 20 bp, Artificial
  CRISPR gRNA sequence
ggggcagctccacctgggga

SEQ ID NO: 507852 - DNA, 20 bp, Artificial
  CRISPR gRNA sequence
ggcagctccacctggggaca

SEQ ID NO: 507853 - DNA, 20 bp, Artificial
  CRISPR gRNA sequence
agctccacctggggacagag

SEQ ID NO: 507854 - DNA, 20 bp, Artificial
  CRISPR gRNA sequence
tccacctggggacagagcgg

SEQ ID NO: 507855 - DNA, 20 bp, Artificial
  CRISPR gRNA sequence
ccacctggggacagagcgga

SEQ ID NO: 507856 - DNA, 20 bp, Artificial
  CRISPR gRNA sequence
cacctggggacagagcggaa

SEQ ID NO: 507857 - DNA, 20 bp, Artificial
  CRISPR gRNA sequence
ggacagagcggaagggcact

SEQ ID NO: 507858 - DNA, 20 bp, Artificial
  CRISPR gRNA sequence
gacagagcggaagggcactg

SEQ ID NO: 507859 - DNA, 20 bp, Artificial
  CRISPR gRNA sequence
cagagcggaagggcactgag

SEQ ID NO: 507860 - DNA, 20 bp, Artificial
  CRISPR gRNA sequence
cggaagggcactgaggagct

SEQ ID NO: 507861 - DNA, 20 bp, Artificial
  CRISPR gRNA sequence
cactgaggagctcagctttc

SEQ ID NO: 507862 - DNA, 20 bp, Artificial
  CRISPR gRNA sequence
tgaggagctcagctttccag

SEQ ID NO: 507863 - DNA, 20 bp, Artificial
  CRISPR gRNA sequence
gctcagctttccagcagcct

SEQ ID NO: 507864 - DNA, 20 bp, Artificial
  CRISPR gRNA sequence
ctcagctttccagcagcctt

SEQ ID NO: 507865 - DNA, 20 bp, Artificial
  CRISPR gRNA sequence
tcagctttccagcagccttg

SEQ ID NO: 507866 - DNA, 20 bp, Artificial
  CRISPR gRNA sequence
cagcagccttggggcttcac

SEQ ID NO: 507867 - DNA, 20 bp, Artificial
  CRISPR gRNA sequence
gcccacacacccgtccgacc

SEQ ID NO: 507868 - DNA, 20 bp, Artificial
  CRISPR gRNA sequence
cgacccggacacatgccttc

SEQ ID NO: 507869 - DNA, 20 bp, Artificial
  CRISPR gRNA sequence
gacccggacacatgccttct

SEQ ID NO: 507870 - DNA, 20 bp, Artificial
  CRISPR gRNA sequence
ccggacacatgccttctggg

SEQ ID NO: 507871 - DNA, 20 bp, Artificial
  CRISPR gRNA sequence
tctgggcagccctgacaccc

SEQ ID NO: 507872 - DNA, 20 bp, Artificial
  CRISPR gRNA sequence
tgggcagccctgacacccca

SEQ ID NO: 507873 - DNA, 20 bp, Artificial
  CRISPR gRNA sequence
gcagccctgacaccccagag

SEQ ID NO: 507874 - DNA, 20 bp, Artificial
  CRISPR gRNA sequence
cagccctgacaccccagagc

SEQ ID NO: 507875 - DNA, 20 bp, Artificial
  CRISPR gRNA sequence
agccctgacaccccagagca

SEQ ID NO: 507876 - DNA, 20 bp, Artificial
  CRISPR gRNA sequence
ctgacaccccagagcagggc

SEQ ID NO: 507877 - DNA, 20 bp, Artificial
  CRISPR gRNA sequence
ccagagcagggccggactcc

SEQ ID NO: 507878 - DNA, 20 bp, Artificial
  CRISPR gRNA sequence
agcagggccggactcccagc

SEQ ID NO: 507879 - DNA, 20 bp, Artificial
  CRISPR gRNA sequence
cagggccggactcccagcca

SEQ ID NO: 507880 - DNA, 20 bp, Artificial
  CRISPR gRNA sequence
tcccagccagagccaataac

SEQ ID NO: 507881 - DNA, 20 bp, Artificial
  CRISPR gRNA sequence
gccagagccaataaccagca

SEQ ID NO: 507882 - DNA, 20 bp, Artificial
  CRISPR gRNA sequence
gagccaataaccagcacaga

SEQ ID NO: 507883 - DNA, 20 bp, Artificial
  CRISPR gRNA sequence
taaccagcacagacggtgcc

SEQ ID NO: 507884 - DNA, 20 bp, Artificial
  CRISPR gRNA sequence
cggtgcctggcaccaccacc

SEQ ID NO: 507885 - DNA, 20 bp, Artificial
  CRISPR gRNA sequence
ggtgcctggcaccaccaccg

SEQ ID NO: 507886 - DNA, 20 bp, Artificial
  CRISPR gRNA sequence
ctggcaccaccaccgaggcc

SEQ ID NO: 507887 - DNA, 20 bp, Artificial
  CRISPR gRNA sequence
ccaccgaggccaagcctacc

SEQ ID NO: 507888 - DNA, 20 bp, Artificial
  CRISPR gRNA sequence
aggccaagcctacctggtcg

SEQ ID NO: 507889 - DNA, 20 bp, Artificial
  CRISPR gRNA sequence
ggccaagcctacctggtcgc

SEQ ID NO: 507890 - DNA, 20 bp, Artificial
  CRISPR gRNA sequence
agcctacctggtcgcaggta

SEQ ID NO: 507891 - DNA, 20 bp, Artificial
  CRISPR gRNA sequence
aggtaaagcgtcactttttg

SEQ ID NO: 507892 - DNA, 20 bp, Artificial
  CRISPR gRNA sequence
ggtaaagcgtcactttttgt

SEQ ID NO: 507893 - DNA, 20 bp, Artificial
  CRISPR gRNA sequence
gtaaagcgtcactttttgtg

SEQ ID NO: 507894 - DNA, 20 bp, Artificial
  CRISPR gRNA sequence
agcgtcactttttgtgggga

SEQ ID NO: 507895 - DNA, 20 bp, Artificial
  CRISPR gRNA sequence
tttgtggggacagctgcttc

SEQ ID NO: 507896 - DNA, 20 bp, Artificial
  CRISPR gRNA sequence
gctgcttctggcccccattg

SEQ ID NO: 507897 - DNA, 20 bp, Artificial
  CRISPR gRNA sequence
ggcccccattgtggtcttcc

SEQ ID NO: 507898 - DNA, 20 bp, Artificial
  CRISPR gRNA sequence
gcccccattgtggtcttcct

SEQ ID NO: 507899 - DNA, 20 bp, Artificial
  CRISPR gRNA sequence
attgtggtcttcctgggttt

SEQ ID NO: 507900 - DNA, 20 bp, Artificial
  CRISPR gRNA sequence
tggtcttcctgggtttcagc

SEQ ID NO: 507901 - DNA, 20 bp, Artificial
  CRISPR gRNA sequence
ggtcttcctgggtttcagcg

SEQ ID NO: 507902 - DNA, 20 bp, Artificial
  CRISPR gRNA sequence
ctgggtttcagcgaggcttg

SEQ ID NO: 507903 - DNA, 20 bp, Artificial
  CRISPR gRNA sequence
tgggtttcagcgaggcttgt

SEQ ID NO: 507904 - DNA, 20 bp, Artificial
  CRISPR gRNA sequence
gggtttcagcgaggcttgtg

SEQ ID NO: 507905 - DNA, 20 bp, Artificial
  CRISPR gRNA sequence
tgtggggtccatgatgtcgt

SEQ ID NO: 507906 - DNA, 20 bp, Artificial
  CRISPR gRNA sequence
ccatgatgtcgtcagccgca

SEQ ID NO: 507907 - DNA, 20 bp, Artificial
  CRISPR gRNA sequence
tcagccgcacagcccctcat

SEQ ID NO: 507908 - DNA, 20 bp, Artificial
  CRISPR gRNA sequence
gccgcacagcccctcatgag

SEQ ID NO: 507909 - DNA, 20 bp, Artificial
  CRISPR gRNA sequence
cagcccctcatgagcagctg

SEQ ID NO: 507910 - DNA, 20 bp, Artificial
  CRISPR gRNA sequence
ccctcatgagcagctgtggc

SEQ ID NO: 507911 - DNA, 20 bp, Artificial
  CRISPR gRNA sequence
cctcatgagcagctgtggcc

SEQ ID NO: 507912 - DNA, 20 bp, Artificial
  CRISPR gRNA sequence
gcagctgtggccgggtgtcg

SEQ ID NO: 507913 - DNA, 20 bp, Artificial
  CRISPR gRNA sequence
tggccgggtgtcgcagcgaa

SEQ ID NO: 507914 - DNA, 20 bp, Artificial
  CRISPR gRNA sequence
gccgggtgtcgcagcgaatg

SEQ ID NO: 507915 - DNA, 20 bp, Artificial
  CRISPR gRNA sequence
ggtgtcgcagcgaatggagt

SEQ ID NO: 507916 - DNA, 20 bp, Artificial
  CRISPR gRNA sequence
gtgtcgcagcgaatggagtc

SEQ ID NO: 507917 - DNA, 20 bp, Artificial
  CRISPR gRNA sequence
cgaatggagtcaggatcccc

SEQ ID NO: 507918 - DNA, 20 bp, Artificial
  CRISPR gRNA sequence
caggatcccccggccctgtg

SEQ ID NO: 507919 - DNA, 20 bp, Artificial
  CRISPR gRNA sequence
cccccggccctgtgaagttc

SEQ ID NO: 507920 - DNA, 20 bp, Artificial
  CRISPR gRNA sequence
ccccggccctgtgaagttct

SEQ ID NO: 507921 - DNA, 20 bp, Artificial
  CRISPR gRNA sequence
cccggccctgtgaagttctg

SEQ ID NO: 507922 - DNA, 20 bp, Artificial
  CRISPR gRNA sequence
cggccctgtgaagttctggg

SEQ ID NO: 507923 - DNA, 20 bp, Artificial
  CRISPR gRNA sequence
ggccctgtgaagttctgggg

SEQ ID NO: 507924 - DNA, 20 bp, Artificial
  CRISPR gRNA sequence
gccctgtgaagttctgggga

SEQ ID NO: 507925 - DNA, 20 bp, Artificial
  CRISPR gRNA sequence
ccctgtgaagttctggggag

SEQ ID NO: 507926 - DNA, 20 bp, Artificial
  CRISPR gRNA sequence
cctgtgaagttctggggagg

SEQ ID NO: 507927 - DNA, 20 bp, Artificial
  CRISPR gRNA sequence
tgtgaagttctggggagggg

SEQ ID NO: 507928 - DNA, 20 bp, Artificial
  CRISPR gRNA sequence
aagttctggggagggggagt

SEQ ID NO: 507929 - DNA, 20 bp, Artificial
  CRISPR gRNA sequence
agttctggggagggggagtc

SEQ ID NO: 507930 - DNA, 20 bp, Artificial
  CRISPR gRNA sequence
gttctggggagggggagtca

SEQ ID NO: 507931 - DNA, 20 bp, Artificial
  CRISPR gRNA sequence
ttctggggagggggagtcag

SEQ ID NO: 507932 - DNA, 20 bp, Artificial
  CRISPR gRNA sequence
ggggagggggagtcaggggt

SEQ ID NO: 507933 - DNA, 20 bp, Artificial
  CRISPR gRNA sequence
gggagggggagtcaggggtc

SEQ ID NO: 507934 - DNA, 20 bp, Artificial
  CRISPR gRNA sequence
gagggggagtcaggggtcag

SEQ ID NO: 507935 - DNA, 20 bp, Artificial
  CRISPR gRNA sequence
agggggagtcaggggtcagg

SEQ ID NO: 507936 - DNA, 20 bp, Artificial
  CRISPR gRNA sequence
gggggagtcaggggtcagga

SEQ ID NO: 507937 - DNA, 20 bp, Artificial
  CRISPR gRNA sequence
ggggagtcaggggtcaggag

SEQ ID NO: 507938 - DNA, 20 bp, Artificial
  CRISPR gRNA sequence
gggagtcaggggtcaggagg

SEQ ID NO: 507939 - DNA, 20 bp, Artificial
  CRISPR gRNA sequence
gtcaggagggggccacactg

SEQ ID NO: 507940 - DNA, 20 bp, Artificial
  CRISPR gRNA sequence
tcaggagggggccacactgc

SEQ ID NO: 507941 - DNA, 20 bp, Artificial
  CRISPR gRNA sequence
gggccacactgcgggacctg

SEQ ID NO: 507942 - DNA, 20 bp, Artificial
  CRISPR gRNA sequence
ggccacactgcgggacctgc

SEQ ID NO: 507943 - DNA, 20 bp, Artificial
  CRISPR gRNA sequence
ccacactgcgggacctgcag

SEQ ID NO: 507944 - DNA, 20 bp, Artificial
  CRISPR gRNA sequence
cacactgcgggacctgcagg

SEQ ID NO: 507945 - DNA, 20 bp, Artificial
  CRISPR gRNA sequence
gggacctgcaggaggctgac

SEQ ID NO: 507946 - DNA, 20 bp, Artificial
  CRISPR gRNA sequence
tgcaggaggctgactggcca

SEQ ID NO: 507947 - DNA, 20 bp, Artificial
  CRISPR gRNA sequence
caggaggctgactggccatg

SEQ ID NO: 507948 - DNA, 20 bp, Artificial
  CRISPR gRNA sequence
aggaggctgactggccatgg

SEQ ID NO: 507949 - DNA, 20 bp, Artificial
  CRISPR gRNA sequence
ctgactggccatggaggact

SEQ ID NO: 507950 - DNA, 20 bp, Artificial
  CRISPR gRNA sequence
tgactggccatggaggactg

SEQ ID NO: 507951 - DNA, 20 bp, Artificial
  CRISPR gRNA sequence
gtcccctcctcctctgcgcc

SEQ ID NO: 507952 - DNA, 20 bp, Artificial
  CRISPR gRNA sequence
cctcctctgcgcctggaatt

SEQ ID NO: 507953 - DNA, 20 bp, Artificial
  CRISPR gRNA sequence
ctcctctgcgcctggaattt

SEQ ID NO: 507954 - DNA, 20 bp, Artificial
  CRISPR gRNA sequence
tctgcgcctggaatttggga

SEQ ID NO: 507955 - DNA, 20 bp, Artificial
  CRISPR gRNA sequence
gcgcctggaatttgggacag

SEQ ID NO: 507956 - DNA, 20 bp, Artificial
  CRISPR gRNA sequence
atttgggacagaagtccctg

SEQ ID NO: 507957 - DNA, 20 bp, Artificial
  CRISPR gRNA sequence
gggacagaagtccctgtgga

SEQ ID NO: 507958 - DNA, 20 bp, Artificial
  CRISPR gRNA sequence
gacagaagtccctgtggaca

SEQ ID NO: 507959 - DNA, 20 bp, Artificial
  CRISPR gRNA sequence
gaagtccctgtggacagaga

SEQ ID NO: 507960 - DNA, 20 bp, Artificial
  CRISPR gRNA sequence
aagtccctgtggacagagac

SEQ ID NO: 507961 - DNA, 20 bp, Artificial
  CRISPR gRNA sequence
agtccctgtggacagagaca

SEQ ID NO: 507962 - DNA, 20 bp, Artificial
  CRISPR gRNA sequence
tccctgtggacagagacagg

SEQ ID NO: 507963 - DNA, 20 bp, Artificial
  CRISPR gRNA sequence
acagagacagggagctcctt

SEQ ID NO: 507964 - DNA, 20 bp, Artificial
  CRISPR gRNA sequence
agggagctccttcagcctcc

SEQ ID NO: 507965 - DNA, 20 bp, Artificial
  CRISPR gRNA sequence
agctccttcagcctcccaga

SEQ ID NO: 507966 - DNA, 20 bp, Artificial
  CRISPR gRNA sequence
tcccagacagcccctccctg

SEQ ID NO: 507967 - DNA, 20 bp, Artificial
  CRISPR gRNA sequence
cccagacagcccctccctga

SEQ ID NO: 507968 - DNA, 20 bp, Artificial
  CRISPR gRNA sequence
agcccctccctgaaggctcc

SEQ ID NO: 507969 - DNA, 20 bp, Artificial
  CRISPR gRNA sequence
tccctgaaggctcccggcca

SEQ ID NO: 507970 - DNA, 20 bp, Artificial
  CRISPR gRNA sequence
ctgaaggctcccggccacag

SEQ ID NO: 507971 - DNA, 20 bp, Artificial
  CRISPR gRNA sequence
tcccggccacagcagacccc

SEQ ID NO: 507972 - DNA, 20 bp, Artificial
  CRISPR gRNA sequence
cccggccacagcagacccct

SEQ ID NO: 507973 - DNA, 20 bp, Artificial
  CRISPR gRNA sequence
ccggccacagcagacccctg

SEQ ID NO: 507974 - DNA, 20 bp, Artificial
  CRISPR gRNA sequence
cggccacagcagacccctgg

SEQ ID NO: 507975 - DNA, 20 bp, Artificial
  CRISPR gRNA sequence
ggccacagcagacccctggg

SEQ ID NO: 507976 - DNA, 20 bp, Artificial
  CRISPR gRNA sequence
cacagcagacccctgggggg

SEQ ID NO: 507977 - DNA, 20 bp, Artificial
  CRISPR gRNA sequence
acagcagacccctggggggc

SEQ ID NO: 507978 - DNA, 20 bp, Artificial
  CRISPR gRNA sequence
cagcagacccctggggggca

SEQ ID NO: 507979 - DNA, 20 bp, Artificial
  CRISPR gRNA sequence
atcgcctcctcctctgcctc

SEQ ID NO: 507980 - DNA, 20 bp, Artificial
  CRISPR gRNA sequence
gcctcctcctctgcctctag

SEQ ID NO: 507981 - DNA, 20 bp, Artificial
  CRISPR gRNA sequence
tcctcctctgcctctagcgg

SEQ ID NO: 507982 - DNA, 20 bp, Artificial
  CRISPR gRNA sequence
cctctgcctctagcggcaga

SEQ ID NO: 507983 - DNA, 20 bp, Artificial
  CRISPR gRNA sequence
ctctgcctctagcggcagaa

SEQ ID NO: 507984 - DNA, 20 bp, Artificial
  CRISPR gRNA sequence
ctctagcggcagaaaggact

SEQ ID NO: 507985 - DNA, 20 bp, Artificial
  CRISPR gRNA sequence
tctagcggcagaaaggactc

SEQ ID NO: 507986 - DNA, 20 bp, Artificial
  CRISPR gRNA sequence
aggactcaggacctactctc

SEQ ID NO: 507987 - DNA, 20 bp, Artificial
  CRISPR gRNA sequence
caggacctactctccagccc

SEQ ID NO: 507988 - DNA, 20 bp, Artificial
  CRISPR gRNA sequence
aggacctactctccagcccg

SEQ ID NO: 507989 - DNA, 20 bp, Artificial
  CRISPR gRNA sequence
ctccagcccgaggctgaccc

SEQ ID NO: 507990 - DNA, 20 bp, Artificial
  CRISPR gRNA sequence
ccagcccgaggctgacccaa

SEQ ID NO: 507991 - DNA, 20 bp, Artificial
  CRISPR gRNA sequence
cagcccgaggctgacccaag

SEQ ID NO: 507992 - DNA, 20 bp, Artificial
  CRISPR gRNA sequence
gcccgaggctgacccaagag

SEQ ID NO: 507993 - DNA, 20 bp, Artificial
  CRISPR gRNA sequence
ccgaggctgacccaagagga

SEQ ID NO: 507994 - DNA, 20 bp, Artificial
  CRISPR gRNA sequence
cgaggctgacccaagaggag

SEQ ID NO: 507995 - DNA, 20 bp, Artificial
  CRISPR gRNA sequence
tgacccaagaggagaggcct

SEQ ID NO: 507996 - DNA, 20 bp, Artificial
  CRISPR gRNA sequence
ggagaggcctcagcgtcctc

SEQ ID NO: 507997 - DNA, 20 bp, Artificial
  CRISPR gRNA sequence
gaggcctcagcgtcctctag

SEQ ID NO: 507998 - DNA, 20 bp, Artificial
  CRISPR gRNA sequence
cctcagcgtcctctagcagc

SEQ ID NO: 507999 - DNA, 20 bp, Artificial
  CRISPR gRNA sequence
gcgtcctctagcagctggcc

SEQ ID NO: 508000 - DNA, 20 bp, Artificial
  CRISPR gRNA sequence
cgtcctctagcagctggccc

SEQ ID NO: 508001 - DNA, 20 bp, Artificial
  CRISPR gRNA sequence
gtcctctagcagctggccca

SEQ ID NO: 508002 - DNA, 20 bp, Artificial
  CRISPR gRNA sequence
tcctctagcagctggcccag

SEQ ID NO: 508003 - DNA, 20 bp, Artificial
  CRISPR gRNA sequence
gcagctggcccaggggcttc

SEQ ID NO: 508004 - DNA, 20 bp, Artificial
  CRISPR gRNA sequence
aggggcttcaagcccttcat

SEQ ID NO: 508005 - DNA, 20 bp, Artificial
  CRISPR gRNA sequence
ggcttcaagcccttcatcag

SEQ ID NO: 508006 - DNA, 20 bp, Artificial
  CRISPR gRNA sequence
catcagcagaacctttgtcc

SEQ ID NO: 508007 - DNA, 20 bp, Artificial
  CRISPR gRNA sequence
atcagcagaacctttgtcca

SEQ ID NO: 508008 - DNA, 20 bp, Artificial
  CRISPR gRNA sequence
tcagcagaacctttgtccaa

SEQ ID NO: 508009 - DNA, 20 bp, Artificial
  CRISPR gRNA sequence
agcagaacctttgtccaagg

SEQ ID NO: 508010 - DNA, 20 bp, Artificial
  CRISPR gRNA sequence
aagggagttgctgtgtccca

SEQ ID NO: 508011 - DNA, 20 bp, Artificial
  CRISPR gRNA sequence
agggagttgctgtgtcccaa

SEQ ID NO: 508012 - DNA, 20 bp, Artificial
  CRISPR gRNA sequence
tgctgtgtcccaaaggaacg

SEQ ID NO: 508013 - DNA, 20 bp, Artificial
  CRISPR gRNA sequence
tgtgtcccaaaggaacgtgg

SEQ ID NO: 508014 - DNA, 20 bp, Artificial
  CRISPR gRNA sequence
caaaggaacgtggcagtccc

SEQ ID NO: 508015 - DNA, 20 bp, Artificial
  CRISPR gRNA sequence
aaaggaacgtggcagtccct

SEQ ID NO: 508016 - DNA, 20 bp, Artificial
  CRISPR gRNA sequence
gtggcagtccctaggccccc

SEQ ID NO: 508017 - DNA, 20 bp, Artificial
  CRISPR gRNA sequence
ccctaggcccccaagaaacc

SEQ ID NO: 508018 - DNA, 20 bp, Artificial
  CRISPR gRNA sequence
cccccaagaaacccagaaca

SEQ ID NO: 508019 - DNA, 20 bp, Artificial
  CRISPR gRNA sequence
ccccaagaaacccagaacat

SEQ ID NO: 508020 - DNA, 20 bp, Artificial
  CRISPR gRNA sequence
caagaaacccagaacatggg

SEQ ID NO: 508021 - DNA, 20 bp, Artificial
  CRISPR gRNA sequence
aagaaacccagaacatgggc

SEQ ID NO: 508022 - DNA, 20 bp, Artificial
  CRISPR gRNA sequence
agaaacccagaacatgggca

SEQ ID NO: 508023 - DNA, 20 bp, Artificial
  CRISPR gRNA sequence
ccagaacatgggcagggttc

SEQ ID NO: 508024 - DNA, 20 bp, Artificial
  CRISPR gRNA sequence
cagaacatgggcagggttct

SEQ ID NO: 508025 - DNA, 20 bp, Artificial
  CRISPR gRNA sequence
catgggcagggttctgggcc

SEQ ID NO: 508026 - DNA, 20 bp, Artificial
  CRISPR gRNA sequence
gttctgggccaagcccctca

SEQ ID NO: 508027 - DNA, 20 bp, Artificial
  CRISPR gRNA sequence
gggccaagcccctcaaagtt

SEQ ID NO: 508028 - DNA, 20 bp, Artificial
  CRISPR gRNA sequence
ccaagcccctcaaagtttag

SEQ ID NO: 508029 - DNA, 20 bp, Artificial
  CRISPR gRNA sequence
ctcaaagtttagaagaacaa

SEQ ID NO: 508030 - DNA, 20 bp, Artificial
  CRISPR gRNA sequence
aagtttagaagaacaaaagc

SEQ ID NO: 508031 - DNA, 20 bp, Artificial
  CRISPR gRNA sequence
gtttagaagaacaaaagctg

SEQ ID NO: 508032 - DNA, 20 bp, Artificial
  CRISPR gRNA sequence
tttagaagaacaaaagctgg

SEQ ID NO: 508033 - DNA, 20 bp, Artificial
  CRISPR gRNA sequence
ttagaagaacaaaagctgga

SEQ ID NO: 508034 - DNA, 20 bp, Artificial
  CRISPR gRNA sequence
tagaagaacaaaagctggag

SEQ ID NO: 508035 - DNA, 20 bp, Artificial
  CRISPR gRNA sequence
gaagaacaaaagctggaggg

SEQ ID NO: 508036 - DNA, 20 bp, Artificial
  CRISPR gRNA sequence
acaaaagctggaggggagcc

SEQ ID NO: 508037 - DNA, 20 bp, Artificial
  CRISPR gRNA sequence
caaaagctggaggggagcct

SEQ ID NO: 508038 - DNA, 20 bp, Artificial
  CRISPR gRNA sequence
aaagctggaggggagcctgg

SEQ ID NO: 508039 - DNA, 20 bp, Artificial
  CRISPR gRNA sequence
aagctggaggggagcctggg

SEQ ID NO: 508040 - DNA, 20 bp, Artificial
  CRISPR gRNA sequence
ggaggggagcctgggaggcc

SEQ ID NO: 508041 - DNA, 20 bp, Artificial
  CRISPR gRNA sequence
gaggggagcctgggaggcct

SEQ ID NO: 508042 - DNA, 20 bp, Artificial
  CRISPR gRNA sequence
gagcctgggaggcctgggcc

SEQ ID NO: 508043 - DNA, 20 bp, Artificial
  CRISPR gRNA sequence
agcctgggaggcctgggccc

SEQ ID NO: 508044 - DNA, 20 bp, Artificial
  CRISPR gRNA sequence
gcctgggaggcctgggccca

SEQ ID NO: 508045 - DNA, 20 bp, Artificial
  CRISPR gRNA sequence
ggcccagggcgctttcctct

SEQ ID NO: 508046 - DNA, 20 bp, Artificial
  CRISPR gRNA sequence
ctttgtccctgcaaatcccc

SEQ ID NO: 508047 - DNA, 20 bp, Artificial
  CRISPR gRNA sequence
caaatcccctggattctgat

SEQ ID NO: 508048 - DNA, 20 bp, Artificial
  CRISPR gRNA sequence
aaatcccctggattctgatg

SEQ ID NO: 508049 - DNA, 20 bp, Artificial
  CRISPR gRNA sequence
aatcccctggattctgatga

SEQ ID NO: 508050 - DNA, 20 bp, Artificial
  CRISPR gRNA sequence
attctgatgagggctgtgtt

SEQ ID NO: 508051 - DNA, 20 bp, Artificial
  CRISPR gRNA sequence
ctgatgagggctgtgtttgg

SEQ ID NO: 508052 - DNA, 20 bp, Artificial
  CRISPR gRNA sequence
tgatgagggctgtgtttggt

SEQ ID NO: 508053 - DNA, 20 bp, Artificial
  CRISPR gRNA sequence
tgtttggtgggtcccgtcac

SEQ ID NO: 508054 - DNA, 20 bp, Artificial
  CRISPR gRNA sequence
tgggtcccgtcactggcccc

SEQ ID NO: 508055 - DNA, 20 bp, Artificial
  CRISPR gRNA sequence
ccccgagcctgctgcctcta

SEQ ID NO: 508056 - DNA, 20 bp, Artificial
  CRISPR gRNA sequence
cccgagcctgctgcctctac

SEQ ID NO: 508057 - DNA, 20 bp, Artificial
  CRISPR gRNA sequence
ccgagcctgctgcctctaca

SEQ ID NO: 508058 - DNA, 20 bp, Artificial
  CRISPR gRNA sequence
agcctgctgcctctacaggg

SEQ ID NO: 508059 - DNA, 20 bp, Artificial
  CRISPR gRNA sequence
gcctgctgcctctacaggga

SEQ ID NO: 508060 - DNA, 20 bp, Artificial
  CRISPR gRNA sequence
cctgctgcctctacagggaa

SEQ ID NO: 508061 - DNA, 20 bp, Artificial
  CRISPR gRNA sequence
gcctctacagggaagggtgc

SEQ ID NO: 508062 - DNA, 20 bp, Artificial
  CRISPR gRNA sequence
agggaagggtgctggtgatg

SEQ ID NO: 508063 - DNA, 20 bp, Artificial
  CRISPR gRNA sequence
gggaagggtgctggtgatgc

SEQ ID NO: 508064 - DNA, 20 bp, Artificial
  CRISPR gRNA sequence
ggaagggtgctggtgatgcg

SEQ ID NO: 508065 - DNA, 20 bp, Artificial
  CRISPR gRNA sequence
gggtgctggtgatgcggggc

SEQ ID NO: 508066 - DNA, 20 bp, Artificial
  CRISPR gRNA sequence
tgctggtgatgcggggccag

SEQ ID NO: 508067 - DNA, 20 bp, Artificial
  CRISPR gRNA sequence
tgtttgtgcacttgctttcg

SEQ ID NO: 508068 - DNA, 20 bp, Artificial
  CRISPR gRNA sequence
tttgtgcacttgctttcgta

SEQ ID NO: 508069 - DNA, 20 bp, Artificial
  CRISPR gRNA sequence
ttgtgcacttgctttcgtag

SEQ ID NO: 508070 - DNA, 20 bp, Artificial
  CRISPR gRNA sequence
tgtgcacttgctttcgtaga

SEQ ID NO: 508071 - DNA, 20 bp, Artificial
  CRISPR gRNA sequence
gcacttgctttcgtagaggg

SEQ ID NO: 508072 - DNA, 20 bp, Artificial
  CRISPR gRNA sequence
tgctttcgtagagggaagct

SEQ ID NO: 508073 - DNA, 20 bp, Artificial
  CRISPR gRNA sequence
gctttcgtagagggaagctc

SEQ ID NO: 508074 - DNA, 20 bp, Artificial
  CRISPR gRNA sequence
tttcgtagagggaagctcag

SEQ ID NO: 508075 - DNA, 20 bp, Artificial
  CRISPR gRNA sequence
ttcgtagagggaagctcagg

SEQ ID NO: 508076 - DNA, 20 bp, Artificial
  CRISPR gRNA sequence
agagggaagctcaggaggat

SEQ ID NO: 508077 - DNA, 20 bp, Artificial
  CRISPR gRNA sequence
gaagctcaggaggataagcc

SEQ ID NO: 508078 - DNA, 20 bp, Artificial
  CRISPR gRNA sequence
aggaggataagcccggcccc

SEQ ID NO: 508079 - DNA, 20 bp, Artificial
  CRISPR gRNA sequence
gaggataagcccggccccca

SEQ ID NO: 508080 - DNA, 20 bp, Artificial
  CRISPR gRNA sequence
aggataagcccggcccccag

SEQ ID NO: 508081 - DNA, 20 bp, Artificial
  CRISPR gRNA sequence
taagcccggcccccagaggc

SEQ ID NO: 508082 - DNA, 20 bp, Artificial
  CRISPR gRNA sequence
cccggcccccagaggctggt

SEQ ID NO: 508083 - DNA, 20 bp, Artificial
  CRISPR gRNA sequence
ccagaggctggtgagtcccg

SEQ ID NO: 508084 - DNA, 20 bp, Artificial
  CRISPR gRNA sequence
cagaggctggtgagtcccgc

SEQ ID NO: 508085 - DNA, 20 bp, Artificial
  CRISPR gRNA sequence
aggctggtgagtcccgcagg

SEQ ID NO: 508086 - DNA, 20 bp, Artificial
  CRISPR gRNA sequence
ggctggtgagtcccgcaggc

SEQ ID NO: 508087 - DNA, 20 bp, Artificial
  CRISPR gRNA sequence
gctggtgagtcccgcaggca

SEQ ID NO: 508088 - DNA, 20 bp, Artificial
  CRISPR gRNA sequence
ctggtgagtcccgcaggcag

SEQ ID NO: 508089 - DNA, 20 bp, Artificial
  CRISPR gRNA sequence
tggtgagtcccgcaggcagg

SEQ ID NO: 508090 - DNA, 20 bp, Artificial
  CRISPR gRNA sequence
ggtgagtcccgcaggcaggg

SEQ ID NO: 508091 - DNA, 20 bp, Artificial
  CRISPR gRNA sequence
gagtcccgcaggcagggggg

SEQ ID NO: 508092 - DNA, 20 bp, Artificial
  CRISPR gRNA sequence
agtcccgcaggcaggggggc

SEQ ID NO: 508093 - DNA, 20 bp, Artificial
  CRISPR gRNA sequence
cccgcaggcaggggggcagg

SEQ ID NO: 508094 - DNA, 20 bp, Artificial
  CRISPR gRNA sequence
ccgcaggcaggggggcaggt

SEQ ID NO: 508095 - DNA, 20 bp, Artificial
  CRISPR gRNA sequence
gcaggcaggggggcaggtgg

SEQ ID NO: 508096 - DNA, 20 bp, Artificial
  CRISPR gRNA sequence
caggcaggggggcaggtggg

SEQ ID NO: 508097 - DNA, 20 bp, Artificial
  CRISPR gRNA sequence
aggcaggggggcaggtggga

SEQ ID NO: 508098 - DNA, 20 bp, Artificial
  CRISPR gRNA sequence
ggcaggggggcaggtgggag

SEQ ID NO: 508099 - DNA, 20 bp, Artificial
  CRISPR gRNA sequence
caggggggcaggtgggaggg

SEQ ID NO: 508100 - DNA, 20 bp, Artificial
  CRISPR gRNA sequence
aggggggcaggtgggagggg

SEQ ID NO: 508101 - DNA, 20 bp, Artificial
  CRISPR gRNA sequence
ggggggcaggtgggagggga

SEQ ID NO: 508102 - DNA, 20 bp, Artificial
  CRISPR gRNA sequence
caggtgggaggggagggcga

SEQ ID NO: 508103 - DNA, 20 bp, Artificial
  CRISPR gRNA sequence
gaggggagggcgacagtccc

SEQ ID NO: 508104 - DNA, 20 bp, Artificial
  CRISPR gRNA sequence
aggggagggcgacagtcccc

SEQ ID NO: 508105 - DNA, 20 bp, Artificial
  CRISPR gRNA sequence
ggggagggcgacagtcccca

SEQ ID NO: 508106 - DNA, 20 bp, Artificial
  CRISPR gRNA sequence
gtccccagggtgcctctttg

SEQ ID NO: 508107 - DNA, 20 bp, Artificial
  CRISPR gRNA sequence
tccccagggtgcctctttgt

SEQ ID NO: 508108 - DNA, 20 bp, Artificial
  CRISPR gRNA sequence
ccccagggtgcctctttgta

SEQ ID NO: 508109 - DNA, 20 bp, Artificial
  CRISPR gRNA sequence
ctttgtagggctctgacttt

SEQ ID NO: 508110 - DNA, 20 bp, Artificial
  CRISPR gRNA sequence
ggctctgacttttggaacca

SEQ ID NO: 508111 - DNA, 20 bp, Artificial
  CRISPR gRNA sequence
tggaaccacagaatttttta

SEQ ID NO: 508112 - DNA, 20 bp, Artificial
  CRISPR gRNA sequence
aaccacagaattttttaaag

SEQ ID NO: 508113 - DNA, 20 bp, Artificial
  CRISPR gRNA sequence
aattttttaaagaagtcctc

SEQ ID NO: 508114 - DNA, 20 bp, Artificial
  CRISPR gRNA sequence
aagaagtcctccagaaataa

SEQ ID NO: 508115 - DNA, 20 bp, Artificial
  CRISPR gRNA sequence
ctccagaaataaaagtacat

SEQ ID NO: 508116 - DNA, 20 bp, Artificial
  CRISPR gRNA sequence
agaaataaaagtacatcagc

SEQ ID NO: 508117 - DNA, 20 bp, Artificial
  CRISPR gRNA sequence
aagtacatcagcaagtatcc

SEQ ID NO: 508118 - DNA, 20 bp, Artificial
  CRISPR gRNA sequence
acatcagcaagtatcccagc

SEQ ID NO: 508119 - DNA, 20 bp, Artificial
  CRISPR gRNA sequence
atcagcaagtatcccagcaa

SEQ ID NO: 508120 - DNA, 20 bp, Artificial
  CRISPR gRNA sequence
cagcaagtatcccagcaaga

SEQ ID NO: 508121 - DNA, 20 bp, Artificial
  CRISPR gRNA sequence
agtatcccagcaagagagaa

SEQ ID NO: 508122 - DNA, 20 bp, Artificial
  CRISPR gRNA sequence
tcccagcaagagagaaaaga

SEQ ID NO: 508123 - DNA, 20 bp, Artificial
  CRISPR gRNA sequence
aagcctaaatgtaatccaca

SEQ ID NO: 508124 - DNA, 20 bp, Artificial
  CRISPR gRNA sequence
aaacaaacaaatctcactga

SEQ ID NO: 508125 - DNA, 20 bp, Artificial
  CRISPR gRNA sequence
aacaaacaaatctcactgaa

SEQ ID NO: 508126 - DNA, 20 bp, Artificial
  CRISPR gRNA sequence
tcactgaaaggtgtttattt

SEQ ID NO: 508127 - DNA, 20 bp, Artificial
  CRISPR gRNA sequence
actgaaaggtgtttatttca

SEQ ID NO: 508128 - DNA, 20 bp, Artificial
  CRISPR gRNA sequence
ctgaaaggtgtttatttcag

SEQ ID NO: 508129 - DNA, 20 bp, Artificial
  CRISPR gRNA sequence
gaaaggtgtttatttcagag

SEQ ID NO: 508130 - DNA, 20 bp, Artificial
  CRISPR gRNA sequence
tcagaggagctgaaaacctc

SEQ ID NO: 508131 - DNA, 20 bp, Artificial
  CRISPR gRNA sequence
aggagctgaaaacctccaga

SEQ ID NO: 508132 - DNA, 20 bp, Artificial
  CRISPR gRNA sequence
ggagctgaaaacctccagaa

SEQ ID NO: 508133 - DNA, 20 bp, Artificial
  CRISPR gRNA sequence
gagctgaaaacctccagaaa

SEQ ID NO: 508134 - DNA, 20 bp, Artificial
  CRISPR gRNA sequence
agctgaaaacctccagaaag

SEQ ID NO: 508135 - DNA, 20 bp, Artificial
  CRISPR gRNA sequence
ctgaaaacctccagaaaggg

SEQ ID NO: 508136 - DNA, 20 bp, Artificial
  CRISPR gRNA sequence
tgaaaacctccagaaagggg

SEQ ID NO: 508137 - DNA, 20 bp, Artificial
  CRISPR gRNA sequence
gaaaacctccagaaagggga

SEQ ID NO: 508138 - DNA, 20 bp, Artificial
  CRISPR gRNA sequence
gaaaggggagggaaaaaacc

SEQ ID NO: 508139 - DNA, 20 bp, Artificial
  CRISPR gRNA sequence
ggaaaaaacccagcctgacc

SEQ ID NO: 508140 - DNA, 20 bp, Artificial
  CRISPR gRNA sequence
gaaaaaacccagcctgacca

SEQ ID NO: 508141 - DNA, 20 bp, Artificial
  CRISPR gRNA sequence
aaaacccagcctgaccaagg

SEQ ID NO: 508142 - DNA, 20 bp, Artificial
  CRISPR gRNA sequence
tgaccaaggtagtttccacc

SEQ ID NO: 508143 - DNA, 20 bp, Artificial
  CRISPR gRNA sequence
gaccaaggtagtttccacct

SEQ ID NO: 508144 - DNA, 20 bp, Artificial
  CRISPR gRNA sequence
accaaggtagtttccacctg

SEQ ID NO: 508145 - DNA, 20 bp, Artificial
  CRISPR gRNA sequence
ggtagtttccacctggggcc

SEQ ID NO: 508146 - DNA, 20 bp, Artificial
  CRISPR gRNA sequence
tggggcctggccaccctgct

SEQ ID NO: 508147 - DNA, 20 bp, Artificial
  CRISPR gRNA sequence
ctggccaccctgctcagtcc

SEQ ID NO: 508148 - DNA, 20 bp, Artificial
  CRISPR gRNA sequence
tggccaccctgctcagtccg

SEQ ID NO: 508149 - DNA, 20 bp, Artificial
  CRISPR gRNA sequence
caccctgctcagtccgagga

SEQ ID NO: 508150 - DNA, 20 bp, Artificial
  CRISPR gRNA sequence
ctgctcagtccgaggacaga

SEQ ID NO: 508151 - DNA, 20 bp, Artificial
  CRISPR gRNA sequence
tgctcagtccgaggacagac

SEQ ID NO: 508152 - DNA, 20 bp, Artificial
  CRISPR gRNA sequence
ctcagtccgaggacagacgg

SEQ ID NO: 508153 - DNA, 20 bp, Artificial
  CRISPR gRNA sequence
gaggacagacgggagccacc

SEQ ID NO: 508154 - DNA, 20 bp, Artificial
  CRISPR gRNA sequence
gagccacccggcttctcctc

SEQ ID NO: 508155 - DNA, 20 bp, Artificial
  CRISPR gRNA sequence
agccacccggcttctcctcc

SEQ ID NO: 508156 - DNA, 20 bp, Artificial
  CRISPR gRNA sequence
gccacccggcttctcctccg

SEQ ID NO: 508157 - DNA, 20 bp, Artificial
  CRISPR gRNA sequence
cctccggggactgctcgccg

SEQ ID NO: 508158 - DNA, 20 bp, Artificial
  CRISPR gRNA sequence
ccggggactgctcgccgcgg

SEQ ID NO: 508159 - DNA, 20 bp, Artificial
  CRISPR gRNA sequence
gactgctcgccgcggtggcg

SEQ ID NO: 508160 - DNA, 20 bp, Artificial
  CRISPR gRNA sequence
actgctcgccgcggtggcgt

SEQ ID NO: 508161 - DNA, 20 bp, Artificial
  CRISPR gRNA sequence
ctcgccgcggtggcgtgggc

SEQ ID NO: 508162 - DNA, 20 bp, Artificial
  CRISPR gRNA sequence
cgccgcggtggcgtgggctg

SEQ ID NO: 508163 - DNA, 20 bp, Artificial
  CRISPR gRNA sequence
gccgcggtggcgtgggctgg

SEQ ID NO: 508164 - DNA, 20 bp, Artificial
  CRISPR gRNA sequence
ggcgtgggctggaggaccca

SEQ ID NO: 508165 - DNA, 20 bp, Artificial
  CRISPR gRNA sequence
ggacccaaagccgctccctg

SEQ ID NO: 508166 - DNA, 20 bp, Artificial
  CRISPR gRNA sequence
gacccaaagccgctccctgt

SEQ ID NO: 508167 - DNA, 20 bp, Artificial
  CRISPR gRNA sequence
tccctgtgggacgcaaaatt

SEQ ID NO: 508168 - DNA, 20 bp, Artificial
  CRISPR gRNA sequence
gggacgcaaaattgagaaat

SEQ ID NO: 508169 - DNA, 20 bp, Artificial
  CRISPR gRNA sequence
ggacgcaaaattgagaaatg

SEQ ID NO: 508170 - DNA, 20 bp, Artificial
  CRISPR gRNA sequence
cgcaaaattgagaaatgagg

SEQ ID NO: 508171 - DNA, 20 bp, Artificial
  CRISPR gRNA sequence
agaaatgaggaagctgctga

SEQ ID NO: 508172 - DNA, 20 bp, Artificial
  CRISPR gRNA sequence
atgaggaagctgctgacggt

SEQ ID NO: 508173 - DNA, 20 bp, Artificial
  CRISPR gRNA sequence
tgaggaagctgctgacggta

SEQ ID NO: 508174 - DNA, 20 bp, Artificial
  CRISPR gRNA sequence
agctgctgacggtaaggaat

SEQ ID NO: 508175 - DNA, 20 bp, Artificial
  CRISPR gRNA sequence
ctccaccccctccccttctc

SEQ ID NO: 508176 - DNA, 20 bp, Artificial
  CRISPR gRNA sequence
cctccccttctctagtttat

SEQ ID NO: 508177 - DNA, 20 bp, Artificial
  CRISPR gRNA sequence
cccttctctagtttataaga

SEQ ID NO: 508178 - DNA, 20 bp, Artificial
  CRISPR gRNA sequence
ccttctctagtttataagac

SEQ ID NO: 508179 - DNA, 20 bp, Artificial
  CRISPR gRNA sequence
ttctctagtttataagacag

SEQ ID NO: 508180 - DNA, 20 bp, Artificial
  CRISPR gRNA sequence
tagtttataagacaggagaa

SEQ ID NO: 508181 - DNA, 20 bp, Artificial
  CRISPR gRNA sequence
gtttataagacaggagaaaa

SEQ ID NO: 508182 - DNA, 20 bp, Artificial
  CRISPR gRNA sequence
ttataagacaggagaaaaga

SEQ ID NO: 508183 - DNA, 20 bp, Artificial
  CRISPR gRNA sequence
aagacaggagaaaagagaga

SEQ ID NO: 508184 - DNA, 20 bp, Artificial
  CRISPR gRNA sequence
gagaaaagagagaaagcaaa

SEQ ID NO: 508185 - DNA, 20 bp, Artificial
  CRISPR gRNA sequence
aaagagagaaagcaaaaagt

SEQ ID NO: 508186 - DNA, 20 bp, Artificial
  CRISPR gRNA sequence
agagaaagcaaaaagttgga

SEQ ID NO: 508187 - DNA, 20 bp, Artificial
  CRISPR gRNA sequence
agcaaaaagttggaaagaaa

SEQ ID NO: 508188 - DNA, 20 bp, Artificial
  CRISPR gRNA sequence
aaaaagttggaaagaaacag

SEQ ID NO: 508189 - DNA, 20 bp, Artificial
  CRISPR gRNA sequence
agttggaaagaaacagaagt

SEQ ID NO: 508190 - DNA, 20 bp, Artificial
  CRISPR gRNA sequence
agaaacagaagtaagataaa

SEQ ID NO: 508191 - DNA, 20 bp, Artificial
  CRISPR gRNA sequence
acagaagtaagataaatagc

SEQ ID NO: 508192 - DNA, 20 bp, Artificial
  CRISPR gRNA sequence
gataaatagccagatgacct

SEQ ID NO: 508193 - DNA, 20 bp, Artificial
  CRISPR gRNA sequence
atgaccttggcgccaccacc

SEQ ID NO: 508194 - DNA, 20 bp, Artificial
  CRISPR gRNA sequence
ttggcgccaccacccggccc

SEQ ID NO: 508195 - DNA, 20 bp, Artificial
  CRISPR gRNA sequence
gcgccaccacccggccctgg

SEQ ID NO: 508196 - DNA, 20 bp, Artificial
  CRISPR gRNA sequence
taacccctgaccaaaactac

SEQ ID NO: 508197 - DNA, 20 bp, Artificial
  CRISPR gRNA sequence
ctggtgttatctgtaaattc

SEQ ID NO: 508198 - DNA, 20 bp, Artificial
  CRISPR gRNA sequence
attccagacattgtatgaaa

SEQ ID NO: 508199 - DNA, 20 bp, Artificial
  CRISPR gRNA sequence
tgcaaaactttctgttctgt

SEQ ID NO: 508200 - DNA, 20 bp, Artificial
  CRISPR gRNA sequence
cagctgatgcatgtaacccc

SEQ ID NO: 508201 - DNA, 20 bp, Artificial
  CRISPR gRNA sequence
gatgcatgtaacccccagtc

SEQ ID NO: 508202 - DNA, 20 bp, Artificial
  CRISPR gRNA sequence
tctatcacaaccctttcatg

SEQ ID NO: 508203 - DNA, 20 bp, Artificial
  CRISPR gRNA sequence
accctttcatgtggacccct

SEQ ID NO: 508204 - DNA, 20 bp, Artificial
  CRISPR gRNA sequence
cctttcatgtggacccctta

SEQ ID NO: 508205 - DNA, 20 bp, Artificial
  CRISPR gRNA sequence
tgtggaccccttagagttgt

SEQ ID NO: 508206 - DNA, 20 bp, Artificial
  CRISPR gRNA sequence
ttagagttgtaagcccttaa

SEQ ID NO: 508207 - DNA, 20 bp, Artificial
  CRISPR gRNA sequence
tagagttgtaagcccttaaa

SEQ ID NO: 508208 - DNA, 20 bp, Artificial
  CRISPR gRNA sequence
agagttgtaagcccttaaaa

SEQ ID NO: 508209 - DNA, 20 bp, Artificial
  CRISPR gRNA sequence
ttgtaagcccttaaaagggc

SEQ ID NO: 508210 - DNA, 20 bp, Artificial
  CRISPR gRNA sequence
tgtaagcccttaaaagggct

SEQ ID NO: 508211 - DNA, 20 bp, Artificial
  CRISPR gRNA sequence
agggctaggaatttcttttt

SEQ ID NO: 508212 - DNA, 20 bp, Artificial
  CRISPR gRNA sequence
gggctaggaatttctttttc

SEQ ID NO: 508213 - DNA, 20 bp, Artificial
  CRISPR gRNA sequence
ggctaggaatttctttttcg

SEQ ID NO: 508214 - DNA, 20 bp, Artificial
  CRISPR gRNA sequence
ctaggaatttctttttcggg

SEQ ID NO: 508215 - DNA, 20 bp, Artificial
  CRISPR gRNA sequence
aatttctttttcggggagct

SEQ ID NO: 508216 - DNA, 20 bp, Artificial
  CRISPR gRNA sequence
tttcggggagctcggctctt

SEQ ID NO: 508217 - DNA, 20 bp, Artificial
  CRISPR gRNA sequence
gagctcggctcttaagacgc

SEQ ID NO: 508218 - DNA, 20 bp, Artificial
  CRISPR gRNA sequence
cgcaagtctgctgacactcc

SEQ ID NO: 508219 - DNA, 20 bp, Artificial
  CRISPR gRNA sequence
ctgacactcctggccaaata

SEQ ID NO: 508220 - DNA, 20 bp, Artificial
  CRISPR gRNA sequence
aagcccttccttctttaacc

SEQ ID NO: 508221 - DNA, 20 bp, Artificial
  CRISPR gRNA sequence
ccttctttaaccgagtgtct

SEQ ID NO: 508222 - DNA, 20 bp, Artificial
  CRISPR gRNA sequence
cttctttaaccgagtgtctg

SEQ ID NO: 508223 - DNA, 20 bp, Artificial
  CRISPR gRNA sequence
tgtctgaggaattctgtctg

SEQ ID NO: 508224 - DNA, 20 bp, Artificial
  CRISPR gRNA sequence
aattctgtctgcggcttgtc

SEQ ID NO: 508225 - DNA, 20 bp, Artificial
  CRISPR gRNA sequence
tgcggcttgtccggctacaa

SEQ ID NO: 508226 - DNA, 20 bp, Artificial
  CRISPR gRNA sequence
ttgtccggctacaacggtgc

SEQ ID NO: 508227 - DNA, 20 bp, Artificial
  CRISPR gRNA sequence
gtccggctacaacggtgctg

SEQ ID NO: 508228 - DNA, 20 bp, Artificial
  CRISPR gRNA sequence
gctacaacggtgctggagcc

SEQ ID NO: 508229 - DNA, 20 bp, Artificial
  CRISPR gRNA sequence
ggtgctggagcccagactct

SEQ ID NO: 508230 - DNA, 20 bp, Artificial
  CRISPR gRNA sequence
gtgctggagcccagactctc

SEQ ID NO: 508231 - DNA, 20 bp, Artificial
  CRISPR gRNA sequence
tgctggagcccagactctca

SEQ ID NO: 508232 - DNA, 20 bp, Artificial
  CRISPR gRNA sequence
ggagcccagactctcaggga

SEQ ID NO: 508233 - DNA, 20 bp, Artificial
  CRISPR gRNA sequence
gagcccagactctcagggaa

SEQ ID NO: 508234 - DNA, 20 bp, Artificial
  CRISPR gRNA sequence
actctcagggaaaggaaccc

SEQ ID NO: 508235 - DNA, 20 bp, Artificial
  CRISPR gRNA sequence
gggaaaggaacccgagccgt

SEQ ID NO: 508236 - DNA, 20 bp, Artificial
  CRISPR gRNA sequence
gtcagaaaaccatctgattc

SEQ ID NO: 508237 - DNA, 20 bp, Artificial
  CRISPR gRNA sequence
tcagaaaaccatctgattcc

SEQ ID NO: 508238 - DNA, 20 bp, Artificial
  CRISPR gRNA sequence
aaaaccatctgattccaggc

SEQ ID NO: 508239 - DNA, 20 bp, Artificial
  CRISPR gRNA sequence
aaaccatctgattccaggct

SEQ ID NO: 508240 - DNA, 20 bp, Artificial
  CRISPR gRNA sequence
aaccatctgattccaggctg

SEQ ID NO: 508241 - DNA, 20 bp, Artificial
  CRISPR gRNA sequence
atctgattccaggctggggc

SEQ ID NO: 508242 - DNA, 20 bp, Artificial
  CRISPR gRNA sequence
tctgattccaggctggggca

SEQ ID NO: 508243 - DNA, 20 bp, Artificial
  CRISPR gRNA sequence
ctgattccaggctggggcaa

SEQ ID NO: 508244 - DNA, 20 bp, Artificial
  CRISPR gRNA sequence
ccaggctggggcaagggaca

SEQ ID NO: 508245 - DNA, 20 bp, Artificial
  CRISPR gRNA sequence
aggctggggcaagggacatg

SEQ ID NO: 508246 - DNA, 20 bp, Artificial
  CRISPR gRNA sequence
tggggcaagggacatggaga

SEQ ID NO: 508247 - DNA, 20 bp, Artificial
  CRISPR gRNA sequence
ggggcaagggacatggagat

SEQ ID NO: 508248 - DNA, 20 bp, Artificial
  CRISPR gRNA sequence
gggacatggagatgggcctg

SEQ ID NO: 508249 - DNA, 20 bp, Artificial
  CRISPR gRNA sequence
cctgcagcatcatgttgctc

SEQ ID NO: 508250 - DNA, 20 bp, Artificial
  CRISPR gRNA sequence
cagcatcatgttgctccaga

SEQ ID NO: 508251 - DNA, 20 bp, Artificial
  CRISPR gRNA sequence
atcatgttgctccagaaagc

SEQ ID NO: 508252 - DNA, 20 bp, Artificial
  CRISPR gRNA sequence
tgttgctccagaaagcaaga

SEQ ID NO: 508253 - DNA, 20 bp, Artificial
  CRISPR gRNA sequence
ccagaaagcaagaaagtgct

SEQ ID NO: 508254 - DNA, 20 bp, Artificial
  CRISPR gRNA sequence
aagcaagaaagtgctcagaa

SEQ ID NO: 508255 - DNA, 20 bp, Artificial
  CRISPR gRNA sequence
caagaaagtgctcagaacgg

SEQ ID NO: 508256 - DNA, 20 bp, Artificial
  CRISPR gRNA sequence
aagtgctcagaacggtagaa

SEQ ID NO: 508257 - DNA, 20 bp, Artificial
  CRISPR gRNA sequence
agtgctcagaacggtagaac

SEQ ID NO: 508258 - DNA, 20 bp, Artificial
  CRISPR gRNA sequence
gtgctcagaacggtagaacg

SEQ ID NO: 508259 - DNA, 20 bp, Artificial
  CRISPR gRNA sequence
aacggtagaacggggatgca

SEQ ID NO: 508260 - DNA, 20 bp, Artificial
  CRISPR gRNA sequence
gtagaacggggatgcatgga

SEQ ID NO: 508261 - DNA, 20 bp, Artificial
  CRISPR gRNA sequence
tagaacggggatgcatggac

SEQ ID NO: 508262 - DNA, 20 bp, Artificial
  CRISPR gRNA sequence
ggatgcatggacaggacacg

SEQ ID NO: 508263 - DNA, 20 bp, Artificial
  CRISPR gRNA sequence
gcatggacaggacacgcagc

SEQ ID NO: 508264 - DNA, 20 bp, Artificial
  CRISPR gRNA sequence
acaggacacgcagccagacc

SEQ ID NO: 508265 - DNA, 20 bp, Artificial
  CRISPR gRNA sequence
ggacacgcagccagacccag

SEQ ID NO: 508266 - DNA, 20 bp, Artificial
  CRISPR gRNA sequence
cagccagacccagcggattt

SEQ ID NO: 508267 - DNA, 20 bp, Artificial
  CRISPR gRNA sequence
cccagcggatttgagcaact

SEQ ID NO: 508268 - DNA, 20 bp, Artificial
  CRISPR gRNA sequence
ccagcggatttgagcaactc

SEQ ID NO: 508269 - DNA, 20 bp, Artificial
  CRISPR gRNA sequence
cagcggatttgagcaactcg

SEQ ID NO: 508270 - DNA, 20 bp, Artificial
  CRISPR gRNA sequence
cggatttgagcaactcgggg

SEQ ID NO: 508271 - DNA, 20 bp, Artificial
  CRISPR gRNA sequence
tttgagcaactcggggaaga

SEQ ID NO: 508272 - DNA, 20 bp, Artificial
  CRISPR gRNA sequence
ttgagcaactcggggaagaa

SEQ ID NO: 508273 - DNA, 20 bp, Artificial
  CRISPR gRNA sequence
gcaactcggggaagaaagga

SEQ ID NO: 508274 - DNA, 20 bp, Artificial
  CRISPR gRNA sequence
cggggaagaaaggacagcca

SEQ ID NO: 508275 - DNA, 20 bp, Artificial
  CRISPR gRNA sequence
tactgaacaaaataaaactg

SEQ ID NO: 508276 - DNA, 20 bp, Artificial
  CRISPR gRNA sequence
actgaacaaaataaaactgt

SEQ ID NO: 508277 - DNA, 20 bp, Artificial
  CRISPR gRNA sequence
aaactgtgggtcacgctgat

SEQ ID NO: 508278 - DNA, 20 bp, Artificial
  CRISPR gRNA sequence
actgtgggtcacgctgatga

SEQ ID NO: 508279 - DNA, 20 bp, Artificial
  CRISPR gRNA sequence
tgtgggtcacgctgatgaga

SEQ ID NO: 508280 - DNA, 20 bp, Artificial
  CRISPR gRNA sequence
tgggtcacgctgatgagaga

SEQ ID NO: 508281 - DNA, 20 bp, Artificial
  CRISPR gRNA sequence
gggtcacgctgatgagagag

SEQ ID NO: 508282 - DNA, 20 bp, Artificial
  CRISPR gRNA sequence
cgctgatgagagagaggctg

SEQ ID NO: 508283 - DNA, 20 bp, Artificial
  CRISPR gRNA sequence
ctgatgagagagaggctgca

SEQ ID NO: 508284 - DNA, 20 bp, Artificial
  CRISPR gRNA sequence
atgagagagaggctgcagag

SEQ ID NO: 508285 - DNA, 20 bp, Artificial
  CRISPR gRNA sequence
tgagagagaggctgcagaga

SEQ ID NO: 508286 - DNA, 20 bp, Artificial
  CRISPR gRNA sequence
agagagaggctgcagagaag

SEQ ID NO: 508287 - DNA, 20 bp, Artificial
  CRISPR gRNA sequence
agagaggctgcagagaagga

SEQ ID NO: 508288 - DNA, 20 bp, Artificial
  CRISPR gRNA sequence
gagaaggagagacccttcct

SEQ ID NO: 508289 - DNA, 20 bp, Artificial
  CRISPR gRNA sequence
agaaggagagacccttcctt

SEQ ID NO: 508290 - DNA, 20 bp, Artificial
  CRISPR gRNA sequence
ggagagacccttccttaggt

SEQ ID NO: 508291 - DNA, 20 bp, Artificial
  CRISPR gRNA sequence
gagacccttccttaggttgg

SEQ ID NO: 508292 - DNA, 20 bp, Artificial
  CRISPR gRNA sequence
ttccttaggttggcagccgt

SEQ ID NO: 508293 - DNA, 20 bp, Artificial
  CRISPR gRNA sequence
cttaggttggcagccgtgag

SEQ ID NO: 508294 - DNA, 20 bp, Artificial
  CRISPR gRNA sequence
aggttggcagccgtgagtgg

SEQ ID NO: 508295 - DNA, 20 bp, Artificial
  CRISPR gRNA sequence
ggttggcagccgtgagtggc

SEQ ID NO: 508296 - DNA, 20 bp, Artificial
  CRISPR gRNA sequence
tggcagccgtgagtggcagg

SEQ ID NO: 508297 - DNA, 20 bp, Artificial
  CRISPR gRNA sequence
ggcagccgtgagtggcaggc

SEQ ID NO: 508298 - DNA, 20 bp, Artificial
  CRISPR gRNA sequence
gcagccgtgagtggcaggcg

SEQ ID NO: 508299 - DNA, 20 bp, Artificial
  CRISPR gRNA sequence
cgtgagtggcaggcggggac

SEQ ID NO: 508300 - DNA, 20 bp, Artificial
  CRISPR gRNA sequence
gtggcaggcggggaccagca

SEQ ID NO: 508301 - DNA, 20 bp, Artificial
  CRISPR gRNA sequence
accagcacggcaccaatctg

SEQ ID NO: 508302 - DNA, 20 bp, Artificial
  CRISPR gRNA sequence
gcaccaatctgcagccatcg

SEQ ID NO: 508303 - DNA, 20 bp, Artificial
  CRISPR gRNA sequence
atctgcagccatcgcagtga

SEQ ID NO: 508304 - DNA, 20 bp, Artificial
  CRISPR gRNA sequence
tgcagccatcgcagtgatgg

SEQ ID NO: 508305 - DNA, 20 bp, Artificial
  CRISPR gRNA sequence
catcgcagtgatggcggctt

SEQ ID NO: 508306 - DNA, 20 bp, Artificial
  CRISPR gRNA sequence
atcgcagtgatggcggcttc

SEQ ID NO: 508307 - DNA, 20 bp, Artificial
  CRISPR gRNA sequence
gcagtgatggcggcttcagg

SEQ ID NO: 508308 - DNA, 20 bp, Artificial
  CRISPR gRNA sequence
cagtgatggcggcttcaggc

SEQ ID NO: 508309 - DNA, 20 bp, Artificial
  CRISPR gRNA sequence
agtgatggcggcttcaggcg

SEQ ID NO: 508310 - DNA, 20 bp, Artificial
  CRISPR gRNA sequence
gcttcaggcggggacctccg

SEQ ID NO: 508311 - DNA, 20 bp, Artificial
  CRISPR gRNA sequence
cggggacctccgcggatgct

SEQ ID NO: 508312 - DNA, 20 bp, Artificial
  CRISPR gRNA sequence
ctccgcggatgctgagcctg

SEQ ID NO: 508313 - DNA, 20 bp, Artificial
  CRISPR gRNA sequence
tccgcggatgctgagcctgc

SEQ ID NO: 508314 - DNA, 20 bp, Artificial
  CRISPR gRNA sequence
gcctgcgggtgcgatttgat

SEQ ID NO: 508315 - DNA, 20 bp, Artificial
  CRISPR gRNA sequence
cctgcgggtgcgatttgatg

SEQ ID NO: 508316 - DNA, 20 bp, Artificial
  CRISPR gRNA sequence
ctgcgggtgcgatttgatga

SEQ ID NO: 508317 - DNA, 20 bp, Artificial
  CRISPR gRNA sequence
cgggtgcgatttgatgaggg

SEQ ID NO: 508318 - DNA, 20 bp, Artificial
  CRISPR gRNA sequence
tgatgagggcagaacctcac

SEQ ID NO: 508319 - DNA, 20 bp, Artificial
  CRISPR gRNA sequence
ggcagaacctcaccagccca

SEQ ID NO: 508320 - DNA, 20 bp, Artificial
  CRISPR gRNA sequence
agaacctcaccagcccacag

SEQ ID NO: 508321 - DNA, 20 bp, Artificial
  CRISPR gRNA sequence
caccagcccacagtggctgc

SEQ ID NO: 508322 - DNA, 20 bp, Artificial
  CRISPR gRNA sequence
accagcccacagtggctgcg

SEQ ID NO: 508323 - DNA, 20 bp, Artificial
  CRISPR gRNA sequence
ccagcccacagtggctgcga

SEQ ID NO: 508324 - DNA, 20 bp, Artificial
  CRISPR gRNA sequence
cagcccacagtggctgcgag

SEQ ID NO: 508325 - DNA, 20 bp, Artificial
  CRISPR gRNA sequence
gtggctgcgaggggatcatg

SEQ ID NO: 508326 - DNA, 20 bp, Artificial
  CRISPR gRNA sequence
gctgcgaggggatcatgcag

SEQ ID NO: 508327 - DNA, 20 bp, Artificial
  CRISPR gRNA sequence
ctgcgaggggatcatgcagc

SEQ ID NO: 508328 - DNA, 20 bp, Artificial
  CRISPR gRNA sequence
gaggggatcatgcagcggga

SEQ ID NO: 508329 - DNA, 20 bp, Artificial
  CRISPR gRNA sequence
aggggatcatgcagcgggat

SEQ ID NO: 508330 - DNA, 20 bp, Artificial
  CRISPR gRNA sequence
ggggatcatgcagcgggatg

SEQ ID NO: 508331 - DNA, 20 bp, Artificial
  CRISPR gRNA sequence
ggatcatgcagcgggatggg

SEQ ID NO: 508332 - DNA, 20 bp, Artificial
  CRISPR gRNA sequence
gatcatgcagcgggatgggg

SEQ ID NO: 508333 - DNA, 20 bp, Artificial
  CRISPR gRNA sequence
atgcagcgggatggggaggc

SEQ ID NO: 508334 - DNA, 20 bp, Artificial
  CRISPR gRNA sequence
tgcagcgggatggggaggcc

SEQ ID NO: 508335 - DNA, 20 bp, Artificial
  CRISPR gRNA sequence
gcagcgggatggggaggccg

SEQ ID NO: 508336 - DNA, 20 bp, Artificial
  CRISPR gRNA sequence
cagcgggatggggaggccgg

SEQ ID NO: 508337 - DNA, 20 bp, Artificial
  CRISPR gRNA sequence
agcgggatggggaggccggg

SEQ ID NO: 508338 - DNA, 20 bp, Artificial
  CRISPR gRNA sequence
aggccggggggatgccgtct

SEQ ID NO: 508339 - DNA, 20 bp, Artificial
  CRISPR gRNA sequence
ccggggggatgccgtctcag

SEQ ID NO: 508340 - DNA, 20 bp, Artificial
  CRISPR gRNA sequence
ggggggatgccgtctcagca

SEQ ID NO: 508341 - DNA, 20 bp, Artificial
  CRISPR gRNA sequence
ccgtccacgctgacctcatc

SEQ ID NO: 508342 - DNA, 20 bp, Artificial
  CRISPR gRNA sequence
cacgctgacctcatcaagac

SEQ ID NO: 508343 - DNA, 20 bp, Artificial
  CRISPR gRNA sequence
acgctgacctcatcaagact

SEQ ID NO: 508344 - DNA, 20 bp, Artificial
  CRISPR gRNA sequence
tgacctcatcaagactggga

SEQ ID NO: 508345 - DNA, 20 bp, Artificial
  CRISPR gRNA sequence
gacctcatcaagactgggac

SEQ ID NO: 508346 - DNA, 20 bp, Artificial
  CRISPR gRNA sequence
acctcatcaagactgggacg

SEQ ID NO: 508347 - DNA, 20 bp, Artificial
  CRISPR gRNA sequence
tcaagactgggacggggcca

SEQ ID NO: 508348 - DNA, 20 bp, Artificial
  CRISPR gRNA sequence
agactgggacggggccacag

SEQ ID NO: 508349 - DNA, 20 bp, Artificial
  CRISPR gRNA sequence
ggccacagcagtgcctctca

SEQ ID NO: 508350 - DNA, 20 bp, Artificial
  CRISPR gRNA sequence
gccacagcagtgcctctcat

SEQ ID NO: 508351 - DNA, 20 bp, Artificial
  CRISPR gRNA sequence
cagtgcctctcatgggcact

SEQ ID NO: 508352 - DNA, 20 bp, Artificial
  CRISPR gRNA sequence
agtgcctctcatgggcactt

SEQ ID NO: 508353 - DNA, 20 bp, Artificial
  CRISPR gRNA sequence
gcacttaggacaccgtcact

SEQ ID NO: 508354 - DNA, 20 bp, Artificial
  CRISPR gRNA sequence
cacttaggacaccgtcactg

SEQ ID NO: 508355 - DNA, 20 bp, Artificial
  CRISPR gRNA sequence
acttaggacaccgtcactga

SEQ ID NO: 508356 - DNA, 20 bp, Artificial
  CRISPR gRNA sequence
cttaggacaccgtcactgag

SEQ ID NO: 508357 - DNA, 20 bp, Artificial
  CRISPR gRNA sequence
tcactgaggggctcctgcca

SEQ ID NO: 508358 - DNA, 20 bp, Artificial
  CRISPR gRNA sequence
gctcctgccaaagcacacct

SEQ ID NO: 508359 - DNA, 20 bp, Artificial
  CRISPR gRNA sequence
tgccaaagcacacctgagtc

SEQ ID NO: 508360 - DNA, 20 bp, Artificial
  CRISPR gRNA sequence
gccaaagcacacctgagtcc

SEQ ID NO: 508361 - DNA, 20 bp, Artificial
  CRISPR gRNA sequence
aaagcacacctgagtccagg

SEQ ID NO: 508362 - DNA, 20 bp, Artificial
  CRISPR gRNA sequence
agcacacctgagtccaggca

SEQ ID NO: 508363 - DNA, 20 bp, Artificial
  CRISPR gRNA sequence
gcacacctgagtccaggcag

SEQ ID NO: 508364 - DNA, 20 bp, Artificial
  CRISPR gRNA sequence
agtccaggcagaggaaactc

SEQ ID NO: 508365 - DNA, 20 bp, Artificial
  CRISPR gRNA sequence
aggcagaggaaactccagac

SEQ ID NO: 508366 - DNA, 20 bp, Artificial
  CRISPR gRNA sequence
aaactccagacaagaccccc

SEQ ID NO: 508367 - DNA, 20 bp, Artificial
  CRISPR gRNA sequence
aactccagacaagacccccg

SEQ ID NO: 508368 - DNA, 20 bp, Artificial
  CRISPR gRNA sequence
actccagacaagacccccga

SEQ ID NO: 508369 - DNA, 20 bp, Artificial
  CRISPR gRNA sequence
cccccgagggtcatgctaca

SEQ ID NO: 508370 - DNA, 20 bp, Artificial
  CRISPR gRNA sequence
agctgctctcctgacttcct

SEQ ID NO: 508371 - DNA, 20 bp, Artificial
  CRISPR gRNA sequence
tgacttcctcagaaacgccc

SEQ ID NO: 508372 - DNA, 20 bp, Artificial
  CRISPR gRNA sequence
gacttcctcagaaacgccca

SEQ ID NO: 508373 - DNA, 20 bp, Artificial
  CRISPR gRNA sequence
tcctcagaaacgcccaagga

SEQ ID NO: 508374 - DNA, 20 bp, Artificial
  CRISPR gRNA sequence
cctcagaaacgcccaaggac

SEQ ID NO: 508375 - DNA, 20 bp, Artificial
  CRISPR gRNA sequence
agaaacgcccaaggacagga

SEQ ID NO: 508376 - DNA, 20 bp, Artificial
  CRISPR gRNA sequence
gcccaaggacaggaaagaca

SEQ ID NO: 508377 - DNA, 20 bp, Artificial
  CRISPR gRNA sequence
aaggacaggaaagacaaaga

SEQ ID NO: 508378 - DNA, 20 bp, Artificial
  CRISPR gRNA sequence
caggaaagacaaagaaagct

SEQ ID NO: 508379 - DNA, 20 bp, Artificial
  CRISPR gRNA sequence
aggaaagacaaagaaagctg

SEQ ID NO: 508380 - DNA, 20 bp, Artificial
  CRISPR gRNA sequence
aagaaagctgaggacttgtc

SEQ ID NO: 508381 - DNA, 20 bp, Artificial
  CRISPR gRNA sequence
ctgaggacttgtccagattc

SEQ ID NO: 508382 - DNA, 20 bp, Artificial
  CRISPR gRNA sequence
aggacttgtccagattcaag

SEQ ID NO: 508383 - DNA, 20 bp, Artificial
  CRISPR gRNA sequence
tgtccagattcaagaagccc

SEQ ID NO: 508384 - DNA, 20 bp, Artificial
  CRISPR gRNA sequence
gtccagattcaagaagccca

SEQ ID NO: 508385 - DNA, 20 bp, Artificial
  CRISPR gRNA sequence
ccagattcaagaagcccaag

SEQ ID NO: 508386 - DNA, 20 bp, Artificial
  CRISPR gRNA sequence
attcaagaagcccaaggaga

SEQ ID NO: 508387 - DNA, 20 bp, Artificial
  CRISPR gRNA sequence
agaagcccaaggagacggct

SEQ ID NO: 508388 - DNA, 20 bp, Artificial
  CRISPR gRNA sequence
cccaaggagacggctgagcg

SEQ ID NO: 508389 - DNA, 20 bp, Artificial
  CRISPR gRNA sequence
ccaaggagacggctgagcgt

SEQ ID NO: 508390 - DNA, 20 bp, Artificial
  CRISPR gRNA sequence
caaggagacggctgagcgta

SEQ ID NO: 508391 - DNA, 20 bp, Artificial
  CRISPR gRNA sequence
gagacggctgagcgtagggc

SEQ ID NO: 508392 - DNA, 20 bp, Artificial
  CRISPR gRNA sequence
ggctgagcgtagggcgagcc

SEQ ID NO: 508393 - DNA, 20 bp, Artificial
  CRISPR gRNA sequence
gctgagcgtagggcgagcct

SEQ ID NO: 508394 - DNA, 20 bp, Artificial
  CRISPR gRNA sequence
agcgtagggcgagcctgggt

SEQ ID NO: 508395 - DNA, 20 bp, Artificial
  CRISPR gRNA sequence
gcgtagggcgagcctgggtg

SEQ ID NO: 508396 - DNA, 20 bp, Artificial
  CRISPR gRNA sequence
gtagggcgagcctgggtgag

SEQ ID NO: 508397 - DNA, 20 bp, Artificial
  CRISPR gRNA sequence
cgagcctgggtgaggagatt

SEQ ID NO: 508398 - DNA, 20 bp, Artificial
  CRISPR gRNA sequence
agcctgggtgaggagattca

SEQ ID NO: 508399 - DNA, 20 bp, Artificial
  CRISPR gRNA sequence
ggtgaggagattcagagcgt

SEQ ID NO: 508400 - DNA, 20 bp, Artificial
  CRISPR gRNA sequence
aggagattcagagcgttaga

SEQ ID NO: 508401 - DNA, 20 bp, Artificial
  CRISPR gRNA sequence
attcagagcgttagacggct

SEQ ID NO: 508402 - DNA, 20 bp, Artificial
  CRISPR gRNA sequence
gagcgttagacggctgagcg

SEQ ID NO: 508403 - DNA, 20 bp, Artificial
  CRISPR gRNA sequence
ctgagcgcagtgtgtgaacc

SEQ ID NO: 508404 - DNA, 20 bp, Artificial
  CRISPR gRNA sequence
tgagcgcagtgtgtgaacct

SEQ ID NO: 508405 - DNA, 20 bp, Artificial
  CRISPR gRNA sequence
cgcagtgtgtgaacctgggt

SEQ ID NO: 508406 - DNA, 20 bp, Artificial
  CRISPR gRNA sequence
gcagtgtgtgaacctgggtt

SEQ ID NO: 508407 - DNA, 20 bp, Artificial
  CRISPR gRNA sequence
agtgtgtgaacctgggttag

SEQ ID NO: 508408 - DNA, 20 bp, Artificial
  CRISPR gRNA sequence
tgaacctgggttaggagatt

SEQ ID NO: 508409 - DNA, 20 bp, Artificial
  CRISPR gRNA sequence
gaacctgggttaggagattt

SEQ ID NO: 508410 - DNA, 20 bp, Artificial
  CRISPR gRNA sequence
aacctgggttaggagatttg

SEQ ID NO: 508411 - DNA, 20 bp, Artificial
  CRISPR gRNA sequence
ggttaggagatttggggcct

SEQ ID NO: 508412 - DNA, 20 bp, Artificial
  CRISPR gRNA sequence
aggagatttggggcctgaga

SEQ ID NO: 508413 - DNA, 20 bp, Artificial
  CRISPR gRNA sequence
atttggggcctgagatggct

SEQ ID NO: 508414 - DNA, 20 bp, Artificial
  CRISPR gRNA sequence
gggcctgagatggctgagtg

SEQ ID NO: 508415 - DNA, 20 bp, Artificial
  CRISPR gRNA sequence
ggcctgagatggctgagtgc

SEQ ID NO: 508416 - DNA, 20 bp, Artificial
  CRISPR gRNA sequence
gcctgagatggctgagtgca

SEQ ID NO: 508417 - DNA, 20 bp, Artificial
  CRISPR gRNA sequence
gagatggctgagtgcagggt

SEQ ID NO: 508418 - DNA, 20 bp, Artificial
  CRISPR gRNA sequence
gctgagtgcagggtgagcct

SEQ ID NO: 508419 - DNA, 20 bp, Artificial
  CRISPR gRNA sequence
agtgcagggtgagcctgagt

SEQ ID NO: 508420 - DNA, 20 bp, Artificial
  CRISPR gRNA sequence
gtgcagggtgagcctgagtg

SEQ ID NO: 508421 - DNA, 20 bp, Artificial
  CRISPR gRNA sequence
gcagggtgagcctgagtgag

SEQ ID NO: 508422 - DNA, 20 bp, Artificial
  CRISPR gRNA sequence
agcctgagtgaggagattct

SEQ ID NO: 508423 - DNA, 20 bp, Artificial
  CRISPR gRNA sequence
agtgaggagattctgagcct

SEQ ID NO: 508424 - DNA, 20 bp, Artificial
  CRISPR gRNA sequence
aggagattctgagcctgaga

SEQ ID NO: 508425 - DNA, 20 bp, Artificial
  CRISPR gRNA sequence
attctgagcctgagacagct

SEQ ID NO: 508426 - DNA, 20 bp, Artificial
  CRISPR gRNA sequence
gagcctgagacagctgagca

SEQ ID NO: 508427 - DNA, 20 bp, Artificial
  CRISPR gRNA sequence
agcctgagacagctgagcac

SEQ ID NO: 508428 - DNA, 20 bp, Artificial
  CRISPR gRNA sequence
gcctgagacagctgagcaca

SEQ ID NO: 508429 - DNA, 20 bp, Artificial
  CRISPR gRNA sequence
gagacagctgagcacagggt

SEQ ID NO: 508430 - DNA, 20 bp, Artificial
  CRISPR gRNA sequence
agctgagcacagggtgagcc

SEQ ID NO: 508431 - DNA, 20 bp, Artificial
  CRISPR gRNA sequence
gctgagcacagggtgagcct

SEQ ID NO: 508432 - DNA, 20 bp, Artificial
  CRISPR gRNA sequence
gcctgggtgacaaaatccac

SEQ ID NO: 508433 - DNA, 20 bp, Artificial
  CRISPR gRNA sequence
cctgggtgacaaaatccacc

SEQ ID NO: 508434 - DNA, 20 bp, Artificial
  CRISPR gRNA sequence
accaggaaaatatgctcacg

SEQ ID NO: 508435 - DNA, 20 bp, Artificial
  CRISPR gRNA sequence
tatgctcacgaagacatcat

SEQ ID NO: 508436 - DNA, 20 bp, Artificial
  CRISPR gRNA sequence
atgctcacgaagacatcatt

SEQ ID NO: 508437 - DNA, 20 bp, Artificial
  CRISPR gRNA sequence
gacaaccaataaaatatgcg

SEQ ID NO: 508438 - DNA, 20 bp, Artificial
  CRISPR gRNA sequence
aataaaatatgcgtagtgtg

SEQ ID NO: 508439 - DNA, 20 bp, Artificial
  CRISPR gRNA sequence
ataaaatatgcgtagtgtgt

SEQ ID NO: 508440 - DNA, 20 bp, Artificial
  CRISPR gRNA sequence
tgtgtaggtttgatgataat

SEQ ID NO: 508441 - DNA, 20 bp, Artificial
  CRISPR gRNA sequence
atacatgaatttatcaaata

SEQ ID NO: 508442 - DNA, 20 bp, Artificial
  CRISPR gRNA sequence
atcaaaatacatttacatca

SEQ ID NO: 508443 - DNA, 20 bp, Artificial
  CRISPR gRNA sequence
catcaaagtacatttcctct

SEQ ID NO: 508444 - DNA, 20 bp, Artificial
  CRISPR gRNA sequence
ttggccaccttgtccctgca

SEQ ID NO: 508445 - DNA, 20 bp, Artificial
  CRISPR gRNA sequence
ccttgtccctgcaaagcccc

SEQ ID NO: 508446 - DNA, 20 bp, Artificial
  CRISPR gRNA sequence
caaagcccctggattctgat

SEQ ID NO: 508447 - DNA, 20 bp, Artificial
  CRISPR gRNA sequence
aaagcccctggattctgata

SEQ ID NO: 508448 - DNA, 20 bp, Artificial
  CRISPR gRNA sequence
aagcccctggattctgataa

SEQ ID NO: 508449 - DNA, 20 bp, Artificial
  CRISPR gRNA sequence
attctgataagggctgtgtt

SEQ ID NO: 508450 - DNA, 20 bp, Artificial
  CRISPR gRNA sequence
ctgataagggctgtgtttgg

SEQ ID NO: 508451 - DNA, 20 bp, Artificial
  CRISPR gRNA sequence
tgataagggctgtgtttggt

SEQ ID NO: 508452 - DNA, 20 bp, Artificial
  CRISPR gRNA sequence
tgtttggtgggtcccgtcac

SEQ ID NO: 508453 - DNA, 20 bp, Artificial
  CRISPR gRNA sequence
ccccaaacctgctgactctg

SEQ ID NO: 508454 - DNA, 20 bp, Artificial
  CRISPR gRNA sequence
cccaaacctgctgactctgc

SEQ ID NO: 508455 - DNA, 20 bp, Artificial
  CRISPR gRNA sequence
aacctgctgactctgcagga

SEQ ID NO: 508456 - DNA, 20 bp, Artificial
  CRISPR gRNA sequence
gactctgcaggaaagcgtgc

SEQ ID NO: 508457 - DNA, 20 bp, Artificial
  CRISPR gRNA sequence
aggaaagcgtgctggcgatg

SEQ ID NO: 508458 - DNA, 20 bp, Artificial
  CRISPR gRNA sequence
ggaaagcgtgctggcgatgc

SEQ ID NO: 508459 - DNA, 20 bp, Artificial
  CRISPR gRNA sequence
gaaagcgtgctggcgatgcg

SEQ ID NO: 508460 - DNA, 20 bp, Artificial
  CRISPR gRNA sequence
gcgtgctggcgatgcggggc

SEQ ID NO: 508461 - DNA, 20 bp, Artificial
  CRISPR gRNA sequence
tgctggcgatgcggggccag

SEQ ID NO: 508462 - DNA, 20 bp, Artificial
  CRISPR gRNA sequence
tgtttctgcacttgcttacg

SEQ ID NO: 508463 - DNA, 20 bp, Artificial
  CRISPR gRNA sequence
acttgcttacgtagttttgt

SEQ ID NO: 508464 - DNA, 20 bp, Artificial
  CRISPR gRNA sequence
taagtgaaaaccttgttctt

SEQ ID NO: 508465 - DNA, 20 bp, Artificial
  CRISPR gRNA sequence
tgaaaaccttgttcttaaga

SEQ ID NO: 508466 - DNA, 20 bp, Artificial
  CRISPR gRNA sequence
cttaagaaagacctcccttg

SEQ ID NO: 508467 - DNA, 20 bp, Artificial
  CRISPR gRNA sequence
aagacctcccttgaagtact

SEQ ID NO: 508468 - DNA, 20 bp, Artificial
  CRISPR gRNA sequence
gacctcccttgaagtactaa

SEQ ID NO: 508469 - DNA, 20 bp, Artificial
  CRISPR gRNA sequence
ccttgaagtactaagagaca

SEQ ID NO: 508470 - DNA, 20 bp, Artificial
  CRISPR gRNA sequence
cttgaagtactaagagacaa

SEQ ID NO: 508471 - DNA, 20 bp, Artificial
  CRISPR gRNA sequence
ttgaagtactaagagacaaa

SEQ ID NO: 508472 - DNA, 20 bp, Artificial
  CRISPR gRNA sequence
ctccatgtctacaacctact

SEQ ID NO: 508473 - DNA, 20 bp, Artificial
  CRISPR gRNA sequence
gtctacaacctactcggaaa

SEQ ID NO: 508474 - DNA, 20 bp, Artificial
  CRISPR gRNA sequence
caacctactcggaaatggct

SEQ ID NO: 508475 - DNA, 20 bp, Artificial
  CRISPR gRNA sequence
aaatggctgagaaaaaatac

SEQ ID NO: 508476 - DNA, 20 bp, Artificial
  CRISPR gRNA sequence
gttctgtgtgtgtttccaaa

SEQ ID NO: 508477 - DNA, 20 bp, Artificial
  CRISPR gRNA sequence
tttccaaacagaccacacat

SEQ ID NO: 508478 - DNA, 20 bp, Artificial
  CRISPR gRNA sequence
cagaccacacatcagaacct

SEQ ID NO: 508479 - DNA, 20 bp, Artificial
  CRISPR gRNA sequence
agaccacacatcagaacctc

SEQ ID NO: 508480 - DNA, 20 bp, Artificial
  CRISPR gRNA sequence
gaccacacatcagaacctca

SEQ ID NO: 508481 - DNA, 20 bp, Artificial
  CRISPR gRNA sequence
accacacatcagaacctcag

SEQ ID NO: 508482 - DNA, 20 bp, Artificial
  CRISPR gRNA sequence
cagaacctcaggggcccctt

SEQ ID NO: 508483 - DNA, 20 bp, Artificial
  CRISPR gRNA sequence
agaacctcaggggccccttg

SEQ ID NO: 508484 - DNA, 20 bp, Artificial
  CRISPR gRNA sequence
gaacctcaggggccccttga

SEQ ID NO: 508485 - DNA, 20 bp, Artificial
  CRISPR gRNA sequence
aacctcaggggccccttgag

SEQ ID NO: 508486 - DNA, 20 bp, Artificial
  CRISPR gRNA sequence
cctcaggggccccttgaggg

SEQ ID NO: 508487 - DNA, 20 bp, Artificial
  CRISPR gRNA sequence
ctcaggggccccttgagggg

SEQ ID NO: 508488 - DNA, 20 bp, Artificial
  CRISPR gRNA sequence
tcaggggccccttgagggga

SEQ ID NO: 508489 - DNA, 20 bp, Artificial
  CRISPR gRNA sequence
gggccccttgaggggagggt

SEQ ID NO: 508490 - DNA, 20 bp, Artificial
  CRISPR gRNA sequence
ggccccttgaggggagggtg

SEQ ID NO: 508491 - DNA, 20 bp, Artificial
  CRISPR gRNA sequence
ccttgaggggagggtgaggc

SEQ ID NO: 508492 - DNA, 20 bp, Artificial
  CRISPR gRNA sequence
cttgaggggagggtgaggcc

SEQ ID NO: 508493 - DNA, 20 bp, Artificial
  CRISPR gRNA sequence
ttgaggggagggtgaggcca

SEQ ID NO: 508494 - DNA, 20 bp, Artificial
  CRISPR gRNA sequence
gggagggtgaggccagggtc

SEQ ID NO: 508495 - DNA, 20 bp, Artificial
  CRISPR gRNA sequence
ggagggtgaggccagggtct

SEQ ID NO: 508496 - DNA, 20 bp, Artificial
  CRISPR gRNA sequence
gagggtgaggccagggtctg

SEQ ID NO: 508497 - DNA, 20 bp, Artificial
  CRISPR gRNA sequence
ggtctggggaccccctcaaa

SEQ ID NO: 508498 - DNA, 20 bp, Artificial
  CRISPR gRNA sequence
ggaccccctcaaaaagaaaa

SEQ ID NO: 508499 - DNA, 20 bp, Artificial
  CRISPR gRNA sequence
accccctcaaaaagaaaatg

SEQ ID NO: 508500 - DNA, 20 bp, Artificial
  CRISPR gRNA sequence
caaaaagaaaatggagttgt

SEQ ID NO: 508501 - DNA, 20 bp, Artificial
  CRISPR gRNA sequence
aaatggagttgttggtcctc

SEQ ID NO: 508502 - DNA, 20 bp, Artificial
  CRISPR gRNA sequence
aatggagttgttggtcctct

SEQ ID NO: 508503 - DNA, 20 bp, Artificial
  CRISPR gRNA sequence
gttggtcctctgggtgccac

SEQ ID NO: 508504 - DNA, 20 bp, Artificial
  CRISPR gRNA sequence
cctctgggtgccactggctt

SEQ ID NO: 508505 - DNA, 20 bp, Artificial
  CRISPR gRNA sequence
ctctgggtgccactggcttc

SEQ ID NO: 508506 - DNA, 20 bp, Artificial
  CRISPR gRNA sequence
tctgggtgccactggcttca

SEQ ID NO: 508507 - DNA, 20 bp, Artificial
  CRISPR gRNA sequence
ctgggtgccactggcttcag

SEQ ID NO: 508508 - DNA, 20 bp, Artificial
  CRISPR gRNA sequence
ggtgccactggcttcagggg

SEQ ID NO: 508509 - DNA, 20 bp, Artificial
  CRISPR gRNA sequence
gtgccactggcttcaggggc

SEQ ID NO: 508510 - DNA, 20 bp, Artificial
  CRISPR gRNA sequence
cactggcttcaggggcagga

SEQ ID NO: 508511 - DNA, 20 bp, Artificial
  CRISPR gRNA sequence
actggcttcaggggcaggaa

SEQ ID NO: 508512 - DNA, 20 bp, Artificial
  CRISPR gRNA sequence
ctggcttcaggggcaggaaa

SEQ ID NO: 508513 - DNA, 20 bp, Artificial
  CRISPR gRNA sequence
ggcaggaaagggccctcacc

SEQ ID NO: 508514 - DNA, 20 bp, Artificial
  CRISPR gRNA sequence
gcaggaaagggccctcaccc

SEQ ID NO: 508515 - DNA, 20 bp, Artificial
  CRISPR gRNA sequence
aggaaagggccctcacccag

SEQ ID NO: 508516 - DNA, 20 bp, Artificial
  CRISPR gRNA sequence
aagggccctcacccaggagc

SEQ ID NO: 508517 - DNA, 20 bp, Artificial
  CRISPR gRNA sequence
agggccctcacccaggagct

SEQ ID NO: 508518 - DNA, 20 bp, Artificial
  CRISPR gRNA sequence
gccctcacccaggagctggg

SEQ ID NO: 508519 - DNA, 20 bp, Artificial
  CRISPR gRNA sequence
ccctcacccaggagctgggc

SEQ ID NO: 508520 - DNA, 20 bp, Artificial
  CRISPR gRNA sequence
tcacccaggagctgggcagg

SEQ ID NO: 508521 - DNA, 20 bp, Artificial
  CRISPR gRNA sequence
cacccaggagctgggcaggt

SEQ ID NO: 508522 - DNA, 20 bp, Artificial
  CRISPR gRNA sequence
acccaggagctgggcaggtg

SEQ ID NO: 508523 - DNA, 20 bp, Artificial
  CRISPR gRNA sequence
ccaggagctgggcaggtggg

SEQ ID NO: 508524 - DNA, 20 bp, Artificial
  CRISPR gRNA sequence
caggagctgggcaggtgggg

SEQ ID NO: 508525 - DNA, 20 bp, Artificial
  CRISPR gRNA sequence
aggagctgggcaggtgggga

SEQ ID NO: 508526 - DNA, 20 bp, Artificial
  CRISPR gRNA sequence
ggagctgggcaggtggggag

SEQ ID NO: 508527 - DNA, 20 bp, Artificial
  CRISPR gRNA sequence
tgggcaggtggggaggggtc

SEQ ID NO: 508528 - DNA, 20 bp, Artificial
  CRISPR gRNA sequence
gggcaggtggggaggggtcc

SEQ ID NO: 508529 - DNA, 20 bp, Artificial
  CRISPR gRNA sequence
gcaggtggggaggggtccag

SEQ ID NO: 508530 - DNA, 20 bp, Artificial
  CRISPR gRNA sequence
caggtggggaggggtccagg

SEQ ID NO: 508531 - DNA, 20 bp, Artificial
  CRISPR gRNA sequence
ggggtccaggaggcacttac

SEQ ID NO: 508532 - DNA, 20 bp, Artificial
  CRISPR gRNA sequence
aggaggcacttaccagcttc

SEQ ID NO: 508533 - DNA, 20 bp, Artificial
  CRISPR gRNA sequence
cacttaccagcttctggcac

SEQ ID NO: 508534 - DNA, 20 bp, Artificial
  CRISPR gRNA sequence
acttaccagcttctggcacc

SEQ ID NO: 508535 - DNA, 20 bp, Artificial
  CRISPR gRNA sequence
ccagcttctggcaccaggtg

SEQ ID NO: 508536 - DNA, 20 bp, Artificial
  CRISPR gRNA sequence
cttctggcaccaggtgcagc

SEQ ID NO: 508537 - DNA, 20 bp, Artificial
  CRISPR gRNA sequence
ttctggcaccaggtgcagcc

SEQ ID NO: 508538 - DNA, 20 bp, Artificial
  CRISPR gRNA sequence
gccccgactcgatgcattcc

SEQ ID NO: 508539 - DNA, 20 bp, Artificial
  CRISPR gRNA sequence
ccgactcgatgcattcccgg

SEQ ID NO: 508540 - DNA, 20 bp, Artificial
  CRISPR gRNA sequence
cttgaacttcgtgcactcct

SEQ ID NO: 508541 - DNA, 20 bp, Artificial
  CRISPR gRNA sequence
tgaacttcgtgcactcctga

SEQ ID NO: 508542 - DNA, 20 bp, Artificial
  CRISPR gRNA sequence
aacttcgtgcactcctgaga

SEQ ID NO: 508543 - DNA, 20 bp, Artificial
  CRISPR gRNA sequence
acttcgtgcactcctgagag

SEQ ID NO: 508544 - DNA, 20 bp, Artificial
  CRISPR gRNA sequence
tgcactcctgagagaggact

SEQ ID NO: 508545 - DNA, 20 bp, Artificial
  CRISPR gRNA sequence
gcactcctgagagaggactg

SEQ ID NO: 508546 - DNA, 20 bp, Artificial
  CRISPR gRNA sequence
cactcctgagagaggactga

SEQ ID NO: 508547 - DNA, 20 bp, Artificial
  CRISPR gRNA sequence
ctgagagaggactgagggac

SEQ ID NO: 508548 - DNA, 20 bp, Artificial
  CRISPR gRNA sequence
tgagagaggactgagggacg

SEQ ID NO: 508549 - DNA, 20 bp, Artificial
  CRISPR gRNA sequence
agaggactgagggacgaggc

SEQ ID NO: 508550 - DNA, 20 bp, Artificial
  CRISPR gRNA sequence
gactgagggacgaggccggc

SEQ ID NO: 508551 - DNA, 20 bp, Artificial
  CRISPR gRNA sequence
gagggacgaggccggctggt

SEQ ID NO: 508552 - DNA, 20 bp, Artificial
  CRISPR gRNA sequence
ggacgaggccggctggtgag

SEQ ID NO: 508553 - DNA, 20 bp, Artificial
  CRISPR gRNA sequence
gacgaggccggctggtgagt

SEQ ID NO: 508554 - DNA, 20 bp, Artificial
  CRISPR gRNA sequence
cggctggtgagtgggtgctc

SEQ ID NO: 508555 - DNA, 20 bp, Artificial
  CRISPR gRNA sequence
ggctggtgagtgggtgctct

SEQ ID NO: 508556 - DNA, 20 bp, Artificial
  CRISPR gRNA sequence
gggccgccctgcccacaccc

SEQ ID NO: 508557 - DNA, 20 bp, Artificial
  CRISPR gRNA sequence
ggccgccctgcccacaccca

SEQ ID NO: 508558 - DNA, 20 bp, Artificial
  CRISPR gRNA sequence
gccgccctgcccacacccaa

SEQ ID NO: 508559 - DNA, 20 bp, Artificial
  CRISPR gRNA sequence
ccgccctgcccacacccaag

SEQ ID NO: 508560 - DNA, 20 bp, Artificial
  CRISPR gRNA sequence
cgccctgcccacacccaagg

SEQ ID NO: 508561 - DNA, 20 bp, Artificial
  CRISPR gRNA sequence
ccctgcccacacccaagggg

SEQ ID NO: 508562 - DNA, 20 bp, Artificial
  CRISPR gRNA sequence
tgcccacacccaagggggag

SEQ ID NO: 508563 - DNA, 20 bp, Artificial
  CRISPR gRNA sequence
cccacacccaagggggagta

SEQ ID NO: 508564 - DNA, 20 bp, Artificial
  CRISPR gRNA sequence
acacccaagggggagtagag

SEQ ID NO: 508565 - DNA, 20 bp, Artificial
  CRISPR gRNA sequence
cacccaagggggagtagagc

SEQ ID NO: 508566 - DNA, 20 bp, Artificial
  CRISPR gRNA sequence
ccaagggggagtagagcagg

SEQ ID NO: 508567 - DNA, 20 bp, Artificial
  CRISPR gRNA sequence
caagggggagtagagcagga

SEQ ID NO: 508568 - DNA, 20 bp, Artificial
  CRISPR gRNA sequence
ggggagtagagcaggaaggt

SEQ ID NO: 508569 - DNA, 20 bp, Artificial
  CRISPR gRNA sequence
ggagtagagcaggaaggtca

SEQ ID NO: 508570 - DNA, 20 bp, Artificial
  CRISPR gRNA sequence
gagtagagcaggaaggtcag

SEQ ID NO: 508571 - DNA, 20 bp, Artificial
  CRISPR gRNA sequence
gtagagcaggaaggtcagag

SEQ ID NO: 508572 - DNA, 20 bp, Artificial
  CRISPR gRNA sequence
tagagcaggaaggtcagagg

SEQ ID NO: 508573 - DNA, 20 bp, Artificial
  CRISPR gRNA sequence
aaggtcagaggaggcccaaa

SEQ ID NO: 508574 - DNA, 20 bp, Artificial
  CRISPR gRNA sequence
tcagaggaggcccaaaaaga

SEQ ID NO: 508575 - DNA, 20 bp, Artificial
  CRISPR gRNA sequence
cagaggaggcccaaaaagac

SEQ ID NO: 508576 - DNA, 20 bp, Artificial
  CRISPR gRNA sequence
agaggaggcccaaaaagaca

SEQ ID NO: 508577 - DNA, 20 bp, Artificial
  CRISPR gRNA sequence
aggaggcccaaaaagacagg

SEQ ID NO: 508578 - DNA, 20 bp, Artificial
  CRISPR gRNA sequence
ggaggcccaaaaagacaggg

SEQ ID NO: 508579 - DNA, 20 bp, Artificial
  CRISPR gRNA sequence
ggcccaaaaagacagggagg

SEQ ID NO: 508580 - DNA, 20 bp, Artificial
  CRISPR gRNA sequence
aaagacagggaggcagcctc

SEQ ID NO: 508581 - DNA, 20 bp, Artificial
  CRISPR gRNA sequence
aagacagggaggcagcctcc

SEQ ID NO: 508582 - DNA, 20 bp, Artificial
  CRISPR gRNA sequence
gacagggaggcagcctccag

SEQ ID NO: 508583 - DNA, 20 bp, Artificial
  CRISPR gRNA sequence
acagggaggcagcctccagg

SEQ ID NO: 508584 - DNA, 20 bp, Artificial
  CRISPR gRNA sequence
agggaggcagcctccaggag

SEQ ID NO: 508585 - DNA, 20 bp, Artificial
  CRISPR gRNA sequence
cccgcattcgccaccacccc

SEQ ID NO: 508586 - DNA, 20 bp, Artificial
  CRISPR gRNA sequence
ccgcattcgccaccaccccc

SEQ ID NO: 508587 - DNA, 20 bp, Artificial
  CRISPR gRNA sequence
cgccaccacccccaggtgca

SEQ ID NO: 508588 - DNA, 20 bp, Artificial
  CRISPR gRNA sequence
ccaccacccccaggtgcaaa

SEQ ID NO: 508589 - DNA, 20 bp, Artificial
  CRISPR gRNA sequence
caccacccccaggtgcaaag

SEQ ID NO: 508590 - DNA, 20 bp, Artificial
  CRISPR gRNA sequence
accacccccaggtgcaaaga

SEQ ID NO: 508591 - DNA, 20 bp, Artificial
  CRISPR gRNA sequence
ccacccccaggtgcaaagag

SEQ ID NO: 508592 - DNA, 20 bp, Artificial
  CRISPR gRNA sequence
caggtgcaaagaggggccct

SEQ ID NO: 508593 - DNA, 20 bp, Artificial
  CRISPR gRNA sequence
aggtgcaaagaggggccctc

SEQ ID NO: 508594 - DNA, 20 bp, Artificial
  CRISPR gRNA sequence
aaagaggggccctcgggaaa

SEQ ID NO: 508595 - DNA, 20 bp, Artificial
  CRISPR gRNA sequence
ggggccctcgggaaacagca

SEQ ID NO: 508596 - DNA, 20 bp, Artificial
  CRISPR gRNA sequence
ctcgggaaacagcacagcta

SEQ ID NO: 508597 - DNA, 20 bp, Artificial
  CRISPR gRNA sequence
acagcacagctacagcctcc

SEQ ID NO: 508598 - DNA, 20 bp, Artificial
  CRISPR gRNA sequence
ctacagcctcctggcacgtg

SEQ ID NO: 508599 - DNA, 20 bp, Artificial
  CRISPR gRNA sequence
acagcctcctggcacgtgcg

SEQ ID NO: 508600 - DNA, 20 bp, Artificial
  CRISPR gRNA sequence
ctcctggcacgtgcggagac

SEQ ID NO: 508601 - DNA, 20 bp, Artificial
  CRISPR gRNA sequence
tcctggcacgtgcggagacg

SEQ ID NO: 508602 - DNA, 20 bp, Artificial
  CRISPR gRNA sequence
cacgtgcggagacgaggcct

SEQ ID NO: 508603 - DNA, 20 bp, Artificial
  CRISPR gRNA sequence
ctgagtccccgacctacccc

SEQ ID NO: 508604 - DNA, 20 bp, Artificial
  CRISPR gRNA sequence
agtccccgacctacccccag

SEQ ID NO: 508605 - DNA, 20 bp, Artificial
  CRISPR gRNA sequence
cccgacctacccccagtggc

SEQ ID NO: 508606 - DNA, 20 bp, Artificial
  CRISPR gRNA sequence
ccgacctacccccagtggca

SEQ ID NO: 508607 - DNA, 20 bp, Artificial
  CRISPR gRNA sequence
ccagtggcaaggtccttccc

SEQ ID NO: 508608 - DNA, 20 bp, Artificial
  CRISPR gRNA sequence
aaggtccttccccagcctcc

SEQ ID NO: 508609 - DNA, 20 bp, Artificial
  CRISPR gRNA sequence
aggtccttccccagcctccc

SEQ ID NO: 508610 - DNA, 20 bp, Artificial
  CRISPR gRNA sequence
ctcccgggaacttctgtcta

SEQ ID NO: 508611 - DNA, 20 bp, Artificial
  CRISPR gRNA sequence
tcccgggaacttctgtctat

SEQ ID NO: 508612 - DNA, 20 bp, Artificial
  CRISPR gRNA sequence
gggaacttctgtctatggga

SEQ ID NO: 508613 - DNA, 20 bp, Artificial
  CRISPR gRNA sequence
acttctgtctatgggaaagt

SEQ ID NO: 508614 - DNA, 20 bp, Artificial
  CRISPR gRNA sequence
cttctgtctatgggaaagtg

SEQ ID NO: 508615 - DNA, 20 bp, Artificial
  CRISPR gRNA sequence
ttctgtctatgggaaagtga

SEQ ID NO: 508616 - DNA, 20 bp, Artificial
  CRISPR gRNA sequence
tgtctatgggaaagtgaggg

SEQ ID NO: 508617 - DNA, 20 bp, Artificial
  CRISPR gRNA sequence
gtctatgggaaagtgagggc

SEQ ID NO: 508618 - DNA, 20 bp, Artificial
  CRISPR gRNA sequence
caggccctgttctccctgat

SEQ ID NO: 508619 - DNA, 20 bp, Artificial
  CRISPR gRNA sequence
cctgattggaatgtcacgcg

SEQ ID NO: 508620 - DNA, 20 bp, Artificial
  CRISPR gRNA sequence
tgattggaatgtcacgcgtg

SEQ ID NO: 508621 - DNA, 20 bp, Artificial
  CRISPR gRNA sequence
cacgcgtggagtcccctccg

SEQ ID NO: 508622 - DNA, 20 bp, Artificial
  CRISPR gRNA sequence
ggagtcccctccgtggaaca

SEQ ID NO: 508623 - DNA, 20 bp, Artificial
  CRISPR gRNA sequence
acacagaactcaccgcaccc

SEQ ID NO: 508624 - DNA, 20 bp, Artificial
  CRISPR gRNA sequence
cacagaactcaccgcacccg

SEQ ID NO: 508625 - DNA, 20 bp, Artificial
  CRISPR gRNA sequence
acagaactcaccgcacccga

SEQ ID NO: 508626 - DNA, 20 bp, Artificial
  CRISPR gRNA sequence
agaactcaccgcacccgagg

SEQ ID NO: 508627 - DNA, 20 bp, Artificial
  CRISPR gRNA sequence
aactcaccgcacccgaggga

SEQ ID NO: 508628 - DNA, 20 bp, Artificial
  CRISPR gRNA sequence
tcaccgcacccgagggagag

SEQ ID NO: 508629 - DNA, 20 bp, Artificial
  CRISPR gRNA sequence
ccgagggagagcagccccac

SEQ ID NO: 508630 - DNA, 20 bp, Artificial
  CRISPR gRNA sequence
cgagggagagcagccccacc

SEQ ID NO: 508631 - DNA, 20 bp, Artificial
  CRISPR gRNA sequence
gagggagagcagccccacca

SEQ ID NO: 508632 - DNA, 20 bp, Artificial
  CRISPR gRNA sequence
gagagcagccccaccagggc

SEQ ID NO: 508633 - DNA, 20 bp, Artificial
  CRISPR gRNA sequence
agcagccccaccagggcgag

SEQ ID NO: 508634 - DNA, 20 bp, Artificial
  CRISPR gRNA sequence
agccccaccagggcgagcag

SEQ ID NO: 508635 - DNA, 20 bp, Artificial
  CRISPR gRNA sequence
gccccaccagggcgagcagt

SEQ ID NO: 508636 - DNA, 20 bp, Artificial
  CRISPR gRNA sequence
ccccaccagggcgagcagtg

SEQ ID NO: 508637 - DNA, 20 bp, Artificial
  CRISPR gRNA sequence
cccaccagggcgagcagtgg

SEQ ID NO: 508638 - DNA, 20 bp, Artificial
  CRISPR gRNA sequence
ccaccagggcgagcagtggg

SEQ ID NO: 508639 - DNA, 20 bp, Artificial
  CRISPR gRNA sequence
agggcgagcagtggggggcg

SEQ ID NO: 508640 - DNA, 20 bp, Artificial
  CRISPR gRNA sequence
gggcgagcagtggggggcgc

SEQ ID NO: 508641 - DNA, 20 bp, Artificial
  CRISPR gRNA sequence
agcagtggggggcgcaggcc

SEQ ID NO: 508642 - DNA, 20 bp, Artificial
  CRISPR gRNA sequence
cgcaggcccagcatgtcctg

SEQ ID NO: 508643 - DNA, 20 bp, Artificial
  CRISPR gRNA sequence
caggcccagcatgtcctgtg

SEQ ID NO: 508644 - DNA, 20 bp, Artificial
  CRISPR gRNA sequence
aggcccagcatgtcctgtgg

SEQ ID NO: 508645 - DNA, 20 bp, Artificial
  CRISPR gRNA sequence
ggcccagcatgtcctgtgga

SEQ ID NO: 508646 - DNA, 20 bp, Artificial
  CRISPR gRNA sequence
ccagcatgtcctgtggaggg

SEQ ID NO: 508647 - DNA, 20 bp, Artificial
  CRISPR gRNA sequence
cagcatgtcctgtggaggga

SEQ ID NO: 508648 - DNA, 20 bp, Artificial
  CRISPR gRNA sequence
agcatgtcctgtggagggaa

SEQ ID NO: 508649 - DNA, 20 bp, Artificial
  CRISPR gRNA sequence
gcatgtcctgtggagggaag

SEQ ID NO: 508650 - DNA, 20 bp, Artificial
  CRISPR gRNA sequence
cctgtggagggaaggggtct

SEQ ID NO: 508651 - DNA, 20 bp, Artificial
  CRISPR gRNA sequence
gagggaaggggtcttggtga

SEQ ID NO: 508652 - DNA, 20 bp, Artificial
  CRISPR gRNA sequence
aggggtcttggtgacggtct

SEQ ID NO: 508653 - DNA, 20 bp, Artificial
  CRISPR gRNA sequence
ggggtcttggtgacggtctc

SEQ ID NO: 508654 - DNA, 20 bp, Artificial
  CRISPR gRNA sequence
acggtctcaggcccaacccc

SEQ ID NO: 508655 - DNA, 20 bp, Artificial
  CRISPR gRNA sequence
cggtctcaggcccaacccct

SEQ ID NO: 508656 - DNA, 20 bp, Artificial
  CRISPR gRNA sequence
ggtctcaggcccaacccctg

SEQ ID NO: 508657 - DNA, 20 bp, Artificial
  CRISPR gRNA sequence
cctggggctgaccacccatg

SEQ ID NO: 508658 - DNA, 20 bp, Artificial
  CRISPR gRNA sequence
ccacccatgaagctcccctc

SEQ ID NO: 508659 - DNA, 20 bp, Artificial
  CRISPR gRNA sequence
ccatgaagctcccctccagc

SEQ ID NO: 508660 - DNA, 20 bp, Artificial
  CRISPR gRNA sequence
aagctcccctccagctggcc

SEQ ID NO: 508661 - DNA, 20 bp, Artificial
  CRISPR gRNA sequence
agctcccctccagctggcct

SEQ ID NO: 508662 - DNA, 20 bp, Artificial
  CRISPR gRNA sequence
ccctccagctggcctgggac

SEQ ID NO: 508663 - DNA, 20 bp, Artificial
  CRISPR gRNA sequence
cctccagctggcctgggaca

SEQ ID NO: 508664 - DNA, 20 bp, Artificial
  CRISPR gRNA sequence
tccagctggcctgggacaag

SEQ ID NO: 508665 - DNA, 20 bp, Artificial
  CRISPR gRNA sequence
gctggcctgggacaaggagc

SEQ ID NO: 508666 - DNA, 20 bp, Artificial
  CRISPR gRNA sequence
ctggcctgggacaaggagct

SEQ ID NO: 508667 - DNA, 20 bp, Artificial
  CRISPR gRNA sequence
tggcctgggacaaggagctg

SEQ ID NO: 508668 - DNA, 20 bp, Artificial
  CRISPR gRNA sequence
ctggggccctgtccctgctg

SEQ ID NO: 508669 - DNA, 20 bp, Artificial
  CRISPR gRNA sequence
tggggccctgtccctgctgc

SEQ ID NO: 508670 - DNA, 20 bp, Artificial
  CRISPR gRNA sequence
ggggccctgtccctgctgca

SEQ ID NO: 508671 - DNA, 20 bp, Artificial
  CRISPR gRNA sequence
gggccctgtccctgctgcag

SEQ ID NO: 508672 - DNA, 20 bp, Artificial
  CRISPR gRNA sequence
ggccctgtccctgctgcagg

SEQ ID NO: 508673 - DNA, 20 bp, Artificial
  CRISPR gRNA sequence
cctgtccctgctgcaggggg

SEQ ID NO: 508674 - DNA, 20 bp, Artificial
  CRISPR gRNA sequence
ctgtccctgctgcagggggt

SEQ ID NO: 508675 - DNA, 20 bp, Artificial
  CRISPR gRNA sequence
ccctgctgcagggggtgggt

SEQ ID NO: 508676 - DNA, 20 bp, Artificial
  CRISPR gRNA sequence
cctgctgcagggggtgggtt

SEQ ID NO: 508677 - DNA, 20 bp, Artificial
  CRISPR gRNA sequence
ctgctgcagggggtgggtta

SEQ ID NO: 508678 - DNA, 20 bp, Artificial
  CRISPR gRNA sequence
tgcagggggtgggttagggt

SEQ ID NO: 508679 - DNA, 20 bp, Artificial
  CRISPR gRNA sequence
gcagggggtgggttagggtc

SEQ ID NO: 508680 - DNA, 20 bp, Artificial
  CRISPR gRNA sequence
ggggtgggttagggtcaggc

SEQ ID NO: 508681 - DNA, 20 bp, Artificial
  CRISPR gRNA sequence
gggttagggtcaggccagca

SEQ ID NO: 508682 - DNA, 20 bp, Artificial
  CRISPR gRNA sequence
tcaggccagcacagctgcac

SEQ ID NO: 508683 - DNA, 20 bp, Artificial
  CRISPR gRNA sequence
caggccagcacagctgcact

SEQ ID NO: 508684 - DNA, 20 bp, Artificial
  CRISPR gRNA sequence
cagcacagctgcactgggcc

SEQ ID NO: 508685 - DNA, 20 bp, Artificial
  CRISPR gRNA sequence
gcactgggcccagctgccaa

SEQ ID NO: 508686 - DNA, 20 bp, Artificial
  CRISPR gRNA sequence
tgggcccagctgccaacagc

SEQ ID NO: 508687 - DNA, 20 bp, Artificial
  CRISPR gRNA sequence
gggcccagctgccaacagcc

SEQ ID NO: 508688 - DNA, 20 bp, Artificial
  CRISPR gRNA sequence
ggcccagctgccaacagcca

SEQ ID NO: 508689 - DNA, 20 bp, Artificial
  CRISPR gRNA sequence
cccagctgccaacagccagg

SEQ ID NO: 508690 - DNA, 20 bp, Artificial
  CRISPR gRNA sequence
ccagctgccaacagccaggg

SEQ ID NO: 508691 - DNA, 20 bp, Artificial
  CRISPR gRNA sequence
cagctgccaacagccaggga

SEQ ID NO: 508692 - DNA, 20 bp, Artificial
  CRISPR gRNA sequence
gctgccaacagccagggagg

SEQ ID NO: 508693 - DNA, 20 bp, Artificial
  CRISPR gRNA sequence
ctgccaacagccagggaggg

SEQ ID NO: 508694 - DNA, 20 bp, Artificial
  CRISPR gRNA sequence
tgccaacagccagggaggga

SEQ ID NO: 508695 - DNA, 20 bp, Artificial
  CRISPR gRNA sequence
agccagggagggagggatcc

SEQ ID NO: 508696 - DNA, 20 bp, Artificial
  CRISPR gRNA sequence
gccagggagggagggatccc

SEQ ID NO: 508697 - DNA, 20 bp, Artificial
  CRISPR gRNA sequence
ggagggagggatcccgggct

SEQ ID NO: 508698 - DNA, 20 bp, Artificial
  CRISPR gRNA sequence
gggagggatcccgggctcag

SEQ ID NO: 508699 - DNA, 20 bp, Artificial
  CRISPR gRNA sequence
ggatcccgggctcagcagtg

SEQ ID NO: 508700 - DNA, 20 bp, Artificial
  CRISPR gRNA sequence
gatcccgggctcagcagtgc

SEQ ID NO: 508701 - DNA, 20 bp, Artificial
  CRISPR gRNA sequence
cccgggctcagcagtgcggg

SEQ ID NO: 508702 - DNA, 20 bp, Artificial
  CRISPR gRNA sequence
gtgcgggcagcacacctgct

SEQ ID NO: 508703 - DNA, 20 bp, Artificial
  CRISPR gRNA sequence
gggcagcacacctgctcagc

SEQ ID NO: 508704 - DNA, 20 bp, Artificial
  CRISPR gRNA sequence
ggcagcacacctgctcagcc

SEQ ID NO: 508705 - DNA, 20 bp, Artificial
  CRISPR gRNA sequence
cacctgctcagccaggcacc

SEQ ID NO: 508706 - DNA, 20 bp, Artificial
  CRISPR gRNA sequence
acctgctcagccaggcaccc

SEQ ID NO: 508707 - DNA, 20 bp, Artificial
  CRISPR gRNA sequence
gctcagccaggcacccagga

SEQ ID NO: 508708 - DNA, 20 bp, Artificial
  CRISPR gRNA sequence
ccaggcacccaggacagctg

SEQ ID NO: 508709 - DNA, 20 bp, Artificial
  CRISPR gRNA sequence
ggcacccaggacagctgcag

SEQ ID NO: 508710 - DNA, 20 bp, Artificial
  CRISPR gRNA sequence
gcacccaggacagctgcagc

SEQ ID NO: 508711 - DNA, 20 bp, Artificial
  CRISPR gRNA sequence
acagctgcagcgggcccctg

SEQ ID NO: 508712 - DNA, 20 bp, Artificial
  CRISPR gRNA sequence
agctgcagcgggcccctgca

SEQ ID NO: 508713 - DNA, 20 bp, Artificial
  CRISPR gRNA sequence
gctgcagcgggcccctgcag

SEQ ID NO: 508714 - DNA, 20 bp, Artificial
  CRISPR gRNA sequence
ccctgcagaggcacacaaca

SEQ ID NO: 508715 - DNA, 20 bp, Artificial
  CRISPR gRNA sequence
cctgcagaggcacacaacac

SEQ ID NO: 508716 - DNA, 20 bp, Artificial
  CRISPR gRNA sequence
cacaggcacacacacacatg

SEQ ID NO: 508717 - DNA, 20 bp, Artificial
  CRISPR gRNA sequence
catgcacgtgtacgtgcata

SEQ ID NO: 508718 - DNA, 20 bp, Artificial
  CRISPR gRNA sequence
acaccacacatatgtacaca

SEQ ID NO: 508719 - DNA, 20 bp, Artificial
  CRISPR gRNA sequence
accacacatatgtacacaca

SEQ ID NO: 508720 - DNA, 20 bp, Artificial
  CRISPR gRNA sequence
acccacaccatactccccgc

SEQ ID NO: 508721 - DNA, 20 bp, Artificial
  CRISPR gRNA sequence
acacacacatacacaccaca

SEQ ID NO: 508722 - DNA, 20 bp, Artificial
  CRISPR gRNA sequence
atgtacacgcacacaaacac

SEQ ID NO: 508723 - DNA, 20 bp, Artificial
  CRISPR gRNA sequence
acaccagaaccccacacacc

SEQ ID NO: 508724 - DNA, 20 bp, Artificial
  CRISPR gRNA sequence
ccggtgtgtgcactctgccc

SEQ ID NO: 508725 - DNA, 20 bp, Artificial
  CRISPR gRNA sequence
cactctgccccagtgtgccc

SEQ ID NO: 508726 - DNA, 20 bp, Artificial
  CRISPR gRNA sequence
actctgccccagtgtgcccc

SEQ ID NO: 508727 - DNA, 20 bp, Artificial
  CRISPR gRNA sequence
gtgtgccccaggtcctccgt

SEQ ID NO: 508728 - DNA, 20 bp, Artificial
  CRISPR gRNA sequence
tgccccaggtcctccgtgag

SEQ ID NO: 508729 - DNA, 20 bp, Artificial
  CRISPR gRNA sequence
ccccaggtcctccgtgagca

SEQ ID NO: 508730 - DNA, 20 bp, Artificial
  CRISPR gRNA sequence
ccgtgagcagagcctgtgct

SEQ ID NO: 508731 - DNA, 20 bp, Artificial
  CRISPR gRNA sequence
gtgagcagagcctgtgcttg

SEQ ID NO: 508732 - DNA, 20 bp, Artificial
  CRISPR gRNA sequence
tgagcagagcctgtgcttgg

SEQ ID NO: 508733 - DNA, 20 bp, Artificial
  CRISPR gRNA sequence
agcagagcctgtgcttggag

SEQ ID NO: 508734 - DNA, 20 bp, Artificial
  CRISPR gRNA sequence
cagagcctgtgcttggagga

SEQ ID NO: 508735 - DNA, 20 bp, Artificial
  CRISPR gRNA sequence
gcctgtgcttggaggagagc

SEQ ID NO: 508736 - DNA, 20 bp, Artificial
  CRISPR gRNA sequence
cctgtgcttggaggagagct

SEQ ID NO: 508737 - DNA, 20 bp, Artificial
  CRISPR gRNA sequence
gcttggaggagagctgggct

SEQ ID NO: 508738 - DNA, 20 bp, Artificial
  CRISPR gRNA sequence
ggcttggccctgtctctctg

SEQ ID NO: 508739 - DNA, 20 bp, Artificial
  CRISPR gRNA sequence
ttggccctgtctctctgtgg

SEQ ID NO: 508740 - DNA, 20 bp, Artificial
  CRISPR gRNA sequence
gtctctctgtggcagaaaca

SEQ ID NO: 508741 - DNA, 20 bp, Artificial
  CRISPR gRNA sequence
ctctgtggcagaaacatagc

SEQ ID NO: 508742 - DNA, 20 bp, Artificial
  CRISPR gRNA sequence
tctgtggcagaaacatagcc

SEQ ID NO: 508743 - DNA, 20 bp, Artificial
  CRISPR gRNA sequence
gtggcagaaacatagccagg

SEQ ID NO: 508744 - DNA, 20 bp, Artificial
  CRISPR gRNA sequence
ggcagaaacatagccaggaa

SEQ ID NO: 508745 - DNA, 20 bp, Artificial
  CRISPR gRNA sequence
gaaacatagccaggaagaga

SEQ ID NO: 508746 - DNA, 20 bp, Artificial
  CRISPR gRNA sequence
catagccaggaagagaaagc

SEQ ID NO: 508747 - DNA, 20 bp, Artificial
  CRISPR gRNA sequence
gccaggaagagaaagctggc

SEQ ID NO: 508748 - DNA, 20 bp, Artificial
  CRISPR gRNA sequence
gaaagctggctggatgcccg

SEQ ID NO: 508749 - DNA, 20 bp, Artificial
  CRISPR gRNA sequence
aaagctggctggatgcccgc

SEQ ID NO: 508750 - DNA, 20 bp, Artificial
  CRISPR gRNA sequence
ggctggatgcccgcgggtgc

SEQ ID NO: 508751 - DNA, 20 bp, Artificial
  CRISPR gRNA sequence
gctggatgcccgcgggtgcc

SEQ ID NO: 508752 - DNA, 20 bp, Artificial
  CRISPR gRNA sequence
gcgggtgccaggctgtgtgc

SEQ ID NO: 508753 - DNA, 20 bp, Artificial
  CRISPR gRNA sequence
cgggtgccaggctgtgtgcc

SEQ ID NO: 508754 - DNA, 20 bp, Artificial
  CRISPR gRNA sequence
gtgccaggctgtgtgccagg

SEQ ID NO: 508755 - DNA, 20 bp, Artificial
  CRISPR gRNA sequence
gccaggctgtgtgccaggaa

SEQ ID NO: 508756 - DNA, 20 bp, Artificial
  CRISPR gRNA sequence
ggctgtgtgccaggaagaga

SEQ ID NO: 508757 - DNA, 20 bp, Artificial
  CRISPR gRNA sequence
gtgtgccaggaagagaaagc

SEQ ID NO: 508758 - DNA, 20 bp, Artificial
  CRISPR gRNA sequence
gaaagctggcttgatgcccg

SEQ ID NO: 508759 - DNA, 20 bp, Artificial
  CRISPR gRNA sequence
aaagctggcttgatgcccgc

SEQ ID NO: 508760 - DNA, 20 bp, Artificial
  CRISPR gRNA sequence
gcttgatgcccgcgggtgcc

SEQ ID NO: 508761 - DNA, 20 bp, Artificial
  CRISPR gRNA sequence
gcgggtgccaagctgtgtgc

SEQ ID NO: 508762 - DNA, 20 bp, Artificial
  CRISPR gRNA sequence
cgggtgccaagctgtgtgct

SEQ ID NO: 508763 - DNA, 20 bp, Artificial
  CRISPR gRNA sequence
agctgtgtgctaggcctgcc

SEQ ID NO: 508764 - DNA, 20 bp, Artificial
  CRISPR gRNA sequence
gctgtgtgctaggcctgccc

SEQ ID NO: 508765 - DNA, 20 bp, Artificial
  CRISPR gRNA sequence
tgtgtgctaggcctgcccag

SEQ ID NO: 508766 - DNA, 20 bp, Artificial
  CRISPR gRNA sequence
aggcctgcccaggagccctg

SEQ ID NO: 508767 - DNA, 20 bp, Artificial
  CRISPR gRNA sequence
aggagccctgcagtccctgc

SEQ ID NO: 508768 - DNA, 20 bp, Artificial
  CRISPR gRNA sequence
ggagccctgcagtccctgcc

SEQ ID NO: 508769 - DNA, 20 bp, Artificial
  CRISPR gRNA sequence
gccctgcagtccctgccagg

SEQ ID NO: 508770 - DNA, 20 bp, Artificial
  CRISPR gRNA sequence
ccctgcagtccctgccaggt

SEQ ID NO: 508771 - DNA, 20 bp, Artificial
  CRISPR gRNA sequence
tccctgccaggtgggaaaaa

SEQ ID NO: 508772 - DNA, 20 bp, Artificial
  CRISPR gRNA sequence
aaaagtcacctgacttgccc

SEQ ID NO: 508773 - DNA, 20 bp, Artificial
  CRISPR gRNA sequence
acctgacttgcccaagccac

SEQ ID NO: 508774 - DNA, 20 bp, Artificial
  CRISPR gRNA sequence
ttgcccaagccaccagttgc

SEQ ID NO: 508775 - DNA, 20 bp, Artificial
  CRISPR gRNA sequence
tgcccaagccaccagttgcc

SEQ ID NO: 508776 - DNA, 20 bp, Artificial
  CRISPR gRNA sequence
gcccaagccaccagttgccg

SEQ ID NO: 508777 - DNA, 20 bp, Artificial
  CRISPR gRNA sequence
gggtcctgcccttttgtttc

SEQ ID NO: 508778 - DNA, 20 bp, Artificial
  CRISPR gRNA sequence
gtccttaacccacgcatcca

SEQ ID NO: 508779 - DNA, 20 bp, Artificial
  CRISPR gRNA sequence
ttaacccacgcatccacagc

SEQ ID NO: 508780 - DNA, 20 bp, Artificial
  CRISPR gRNA sequence
taacccacgcatccacagcc

SEQ ID NO: 508781 - DNA, 20 bp, Artificial
  CRISPR gRNA sequence
aacccacgcatccacagcca

SEQ ID NO: 508782 - DNA, 20 bp, Artificial
  CRISPR gRNA sequence
acccacgcatccacagccag

SEQ ID NO: 508783 - DNA, 20 bp, Artificial
  CRISPR gRNA sequence
cacgcatccacagccagggg

SEQ ID NO: 508784 - DNA, 20 bp, Artificial
  CRISPR gRNA sequence
atccacagccaggggcggct

SEQ ID NO: 508785 - DNA, 20 bp, Artificial
  CRISPR gRNA sequence
cacagccaggggcggctcag

SEQ ID NO: 508786 - DNA, 20 bp, Artificial
  CRISPR gRNA sequence
ggcggctcagtggtcactca

SEQ ID NO: 508787 - DNA, 20 bp, Artificial
  CRISPR gRNA sequence
gcggctcagtggtcactcac

SEQ ID NO: 508788 - DNA, 20 bp, Artificial
  CRISPR gRNA sequence
agtggtcactcacaggccct

SEQ ID NO: 508789 - DNA, 20 bp, Artificial
  CRISPR gRNA sequence
cactcacaggccctcggccc

SEQ ID NO: 508790 - DNA, 20 bp, Artificial
  CRISPR gRNA sequence
ctcacaggccctcggcccca

SEQ ID NO: 508791 - DNA, 20 bp, Artificial
  CRISPR gRNA sequence
tcacaggccctcggccccag

SEQ ID NO: 508792 - DNA, 20 bp, Artificial
  CRISPR gRNA sequence
cggccccagaggcaaaatga

SEQ ID NO: 508793 - DNA, 20 bp, Artificial
  CRISPR gRNA sequence
ccccagaggcaaaatgacgg

SEQ ID NO: 508794 - DNA, 20 bp, Artificial
  CRISPR gRNA sequence
cagaggcaaaatgacggaag

SEQ ID NO: 508795 - DNA, 20 bp, Artificial
  CRISPR gRNA sequence
agaggcaaaatgacggaagc

SEQ ID NO: 508796 - DNA, 20 bp, Artificial
  CRISPR gRNA sequence
aaaatgacggaagcaggcct

SEQ ID NO: 508797 - DNA, 20 bp, Artificial
  CRISPR gRNA sequence
gacggaagcaggcctcagcc

SEQ ID NO: 508798 - DNA, 20 bp, Artificial
  CRISPR gRNA sequence
agcaggcctcagcctggtgc

SEQ ID NO: 508799 - DNA, 20 bp, Artificial
  CRISPR gRNA sequence
caggcctcagcctggtgctg

SEQ ID NO: 508800 - DNA, 20 bp, Artificial
  CRISPR gRNA sequence
aggcctcagcctggtgctgg

SEQ ID NO: 508801 - DNA, 20 bp, Artificial
  CRISPR gRNA sequence
ctcagcctggtgctggaggc

SEQ ID NO: 508802 - DNA, 20 bp, Artificial
  CRISPR gRNA sequence
agcctggtgctggaggccgg

SEQ ID NO: 508803 - DNA, 20 bp, Artificial
  CRISPR gRNA sequence
tggaggccggcagcacctcc

SEQ ID NO: 508804 - DNA, 20 bp, Artificial
  CRISPR gRNA sequence
aggccggcagcacctcctag

SEQ ID NO: 508805 - DNA, 20 bp, Artificial
  CRISPR gRNA sequence
ggccggcagcacctcctagc

SEQ ID NO: 508806 - DNA, 20 bp, Artificial
  CRISPR gRNA sequence
cggcagcacctcctagcggg

SEQ ID NO: 508807 - DNA, 20 bp, Artificial
  CRISPR gRNA sequence
cagcacctcctagcgggcag

SEQ ID NO: 508808 - DNA, 20 bp, Artificial
  CRISPR gRNA sequence
agcacctcctagcgggcagc

SEQ ID NO: 508809 - DNA, 20 bp, Artificial
  CRISPR gRNA sequence
gcacctcctagcgggcagca

SEQ ID NO: 508810 - DNA, 20 bp, Artificial
  CRISPR gRNA sequence
cagcagggccgttccacccc

SEQ ID NO: 508811 - DNA, 20 bp, Artificial
  CRISPR gRNA sequence
agcagggccgttccacccct

SEQ ID NO: 508812 - DNA, 20 bp, Artificial
  CRISPR gRNA sequence
tgggttcccttccctccatc

SEQ ID NO: 508813 - DNA, 20 bp, Artificial
  CRISPR gRNA sequence
gggttcccttccctccatcc

SEQ ID NO: 508814 - DNA, 20 bp, Artificial
  CRISPR gRNA sequence
gttcccttccctccatccgg

SEQ ID NO: 508815 - DNA, 20 bp, Artificial
  CRISPR gRNA sequence
ttcccttccctccatccggg

SEQ ID NO: 508816 - DNA, 20 bp, Artificial
  CRISPR gRNA sequence
catccgggaggtgcccaaac

SEQ ID NO: 508817 - DNA, 20 bp, Artificial
  CRISPR gRNA sequence
atccgggaggtgcccaaacc

SEQ ID NO: 508818 - DNA, 20 bp, Artificial
  CRISPR gRNA sequence
ggaggtgcccaaaccaggcc

SEQ ID NO: 508819 - DNA, 20 bp, Artificial
  CRISPR gRNA sequence
gaggtgcccaaaccaggcct

SEQ ID NO: 508820 - DNA, 20 bp, Artificial
  CRISPR gRNA sequence
tgcccaaaccaggcctaggt

SEQ ID NO: 508821 - DNA, 20 bp, Artificial
  CRISPR gRNA sequence
ccaggcctaggtcggctcct

SEQ ID NO: 508822 - DNA, 20 bp, Artificial
  CRISPR gRNA sequence
caggcctaggtcggctcctt

SEQ ID NO: 508823 - DNA, 20 bp, Artificial
  CRISPR gRNA sequence
aggcctaggtcggctccttg

SEQ ID NO: 508824 - DNA, 20 bp, Artificial
  CRISPR gRNA sequence
ggcctaggtcggctccttgg

SEQ ID NO: 508825 - DNA, 20 bp, Artificial
  CRISPR gRNA sequence
gcctaggtcggctccttggg

SEQ ID NO: 508826 - DNA, 20 bp, Artificial
  CRISPR gRNA sequence
gtcggctccttggggggtct

SEQ ID NO: 508827 - DNA, 20 bp, Artificial
  CRISPR gRNA sequence
tcggctccttggggggtctt

SEQ ID NO: 508828 - DNA, 20 bp, Artificial
  CRISPR gRNA sequence
cggctccttggggggtctta

SEQ ID NO: 508829 - DNA, 20 bp, Artificial
  CRISPR gRNA sequence
tggggggtcttagggcttcc

SEQ ID NO: 508830 - DNA, 20 bp, Artificial
  CRISPR gRNA sequence
ggggggtcttagggcttcct

SEQ ID NO: 508831 - DNA, 20 bp, Artificial
  CRISPR gRNA sequence
gggtcttagggcttcctagg

SEQ ID NO: 508832 - DNA, 20 bp, Artificial
  CRISPR gRNA sequence
ggtcttagggcttcctaggt

SEQ ID NO: 508833 - DNA, 20 bp, Artificial
  CRISPR gRNA sequence
gtcttagggcttcctaggtg

SEQ ID NO: 508834 - DNA, 20 bp, Artificial
  CRISPR gRNA sequence
ttagggcttcctaggtgggg

SEQ ID NO: 508835 - DNA, 20 bp, Artificial
  CRISPR gRNA sequence
tagggcttcctaggtggggt

SEQ ID NO: 508836 - DNA, 20 bp, Artificial
  CRISPR gRNA sequence
tcctaggtggggtgggcccc

SEQ ID NO: 508837 - DNA, 20 bp, Artificial
  CRISPR gRNA sequence
cctaggtggggtgggcccct

SEQ ID NO: 508838 - DNA, 20 bp, Artificial
  CRISPR gRNA sequence
ggcccctgggtctgacctcc

SEQ ID NO: 508839 - DNA, 20 bp, Artificial
  CRISPR gRNA sequence
gcccctgggtctgacctccc

SEQ ID NO: 508840 - DNA, 20 bp, Artificial
  CRISPR gRNA sequence
ggtctgacctcccaggacct

SEQ ID NO: 508841 - DNA, 20 bp, Artificial
  CRISPR gRNA sequence
cccaggacctgagaacatta

SEQ ID NO: 508842 - DNA, 20 bp, Artificial
  CRISPR gRNA sequence
ggacctgagaacattatagc

SEQ ID NO: 508843 - DNA, 20 bp, Artificial
  CRISPR gRNA sequence
ctgagaacattatagctggc

SEQ ID NO: 508844 - DNA, 20 bp, Artificial
  CRISPR gRNA sequence
tgagaacattatagctggct

SEQ ID NO: 508845 - DNA, 20 bp, Artificial
  CRISPR gRNA sequence
ctggctgggacccttttatc

SEQ ID NO: 508846 - DNA, 20 bp, Artificial
  CRISPR gRNA sequence
ggacccttttatctggcacc

SEQ ID NO: 508847 - DNA, 20 bp, Artificial
  CRISPR gRNA sequence
cccttttatctggcaccaag

SEQ ID NO: 508848 - DNA, 20 bp, Artificial
  CRISPR gRNA sequence
ccttttatctggcaccaaga

SEQ ID NO: 508849 - DNA, 20 bp, Artificial
  CRISPR gRNA sequence
tttatctggcaccaagaagg

SEQ ID NO: 508850 - DNA, 20 bp, Artificial
  CRISPR gRNA sequence
tatctggcaccaagaaggtg

SEQ ID NO: 508851 - DNA, 20 bp, Artificial
  CRISPR gRNA sequence
tctggcaccaagaaggtgga

SEQ ID NO: 508852 - DNA, 20 bp, Artificial
  CRISPR gRNA sequence
ctggcaccaagaaggtggag

SEQ ID NO: 508853 - DNA, 20 bp, Artificial
  CRISPR gRNA sequence
caagaaggtggagaggtact

SEQ ID NO: 508854 - DNA, 20 bp, Artificial
  CRISPR gRNA sequence
gaaggtggagaggtactgag

SEQ ID NO: 508855 - DNA, 20 bp, Artificial
  CRISPR gRNA sequence
aaggtggagaggtactgaga

SEQ ID NO: 508856 - DNA, 20 bp, Artificial
  CRISPR gRNA sequence
aggtggagaggtactgagaa

SEQ ID NO: 508857 - DNA, 20 bp, Artificial
  CRISPR gRNA sequence
ggtggagaggtactgagaag

SEQ ID NO: 508858 - DNA, 20 bp, Artificial
  CRISPR gRNA sequence
aggtactgagaaggggtacc

SEQ ID NO: 508859 - DNA, 20 bp, Artificial
  CRISPR gRNA sequence
ggtactgagaaggggtaccc

SEQ ID NO: 508860 - DNA, 20 bp, Artificial
  CRISPR gRNA sequence
tactgagaaggggtacccag

SEQ ID NO: 508861 - DNA, 20 bp, Artificial
  CRISPR gRNA sequence
acccaggagccttcctgtca

SEQ ID NO: 508862 - DNA, 20 bp, Artificial
  CRISPR gRNA sequence
caggagccttcctgtcatgg

SEQ ID NO: 508863 - DNA, 20 bp, Artificial
  CRISPR gRNA sequence
aggagccttcctgtcatggt

SEQ ID NO: 508864 - DNA, 20 bp, Artificial
  CRISPR gRNA sequence
agccttcctgtcatggtggg

SEQ ID NO: 508865 - DNA, 20 bp, Artificial
  CRISPR gRNA sequence
gccttcctgtcatggtgggc

SEQ ID NO: 508866 - DNA, 20 bp, Artificial
  CRISPR gRNA sequence
ttcctgtcatggtgggcagg

SEQ ID NO: 508867 - DNA, 20 bp, Artificial
  CRISPR gRNA sequence
ggaagacatttccgttaccc

SEQ ID NO: 508868 - DNA, 20 bp, Artificial
  CRISPR gRNA sequence
gaagacatttccgttaccct

SEQ ID NO: 508869 - DNA, 20 bp, Artificial
  CRISPR gRNA sequence
aagacatttccgttaccctg

SEQ ID NO: 508870 - DNA, 20 bp, Artificial
  CRISPR gRNA sequence
cgttaccctggggctgttgt

SEQ ID NO: 508871 - DNA, 20 bp, Artificial
  CRISPR gRNA sequence
taccctggggctgttgtcag

SEQ ID NO: 508872 - DNA, 20 bp, Artificial
  CRISPR gRNA sequence
tggggctgttgtcagaagca

SEQ ID NO: 508873 - DNA, 20 bp, Artificial
  CRISPR gRNA sequence
aaagatcaacacacctcctc

SEQ ID NO: 508874 - DNA, 20 bp, Artificial
  CRISPR gRNA sequence
acacctcctccagcaaatgc

SEQ ID NO: 508875 - DNA, 20 bp, Artificial
  CRISPR gRNA sequence
gcaaatgccagttcctgtca

SEQ ID NO: 508876 - DNA, 20 bp, Artificial
  CRISPR gRNA sequence
cagttcctgtcacggcctcc

SEQ ID NO: 508877 - DNA, 20 bp, Artificial
  CRISPR gRNA sequence
agttcctgtcacggcctccc

SEQ ID NO: 508878 - DNA, 20 bp, Artificial
  CRISPR gRNA sequence
gtcacggcctcccaggctgc

SEQ ID NO: 508879 - DNA, 20 bp, Artificial
  CRISPR gRNA sequence
tcacggcctcccaggctgct

SEQ ID NO: 508880 - DNA, 20 bp, Artificial
  CRISPR gRNA sequence
cacggcctcccaggctgctg

SEQ ID NO: 508881 - DNA, 20 bp, Artificial
  CRISPR gRNA sequence
cctgccccacacccttccct

SEQ ID NO: 508882 - DNA, 20 bp, Artificial
  CRISPR gRNA sequence
ctgccccacacccttccctc

SEQ ID NO: 508883 - DNA, 20 bp, Artificial
  CRISPR gRNA sequence
ccccacacccttccctcggg

SEQ ID NO: 508884 - DNA, 20 bp, Artificial
  CRISPR gRNA sequence
acccttccctcgggtggtgc

SEQ ID NO: 508885 - DNA, 20 bp, Artificial
  CRISPR gRNA sequence
cttccctcgggtggtgctgg

SEQ ID NO: 508886 - DNA, 20 bp, Artificial
  CRISPR gRNA sequence
ttccctcgggtggtgctggc

SEQ ID NO: 508887 - DNA, 20 bp, Artificial
  CRISPR gRNA sequence
tccctcgggtggtgctggca

SEQ ID NO: 508888 - DNA, 20 bp, Artificial
  CRISPR gRNA sequence
tggtgctggcagggccaccc

SEQ ID NO: 508889 - DNA, 20 bp, Artificial
  CRISPR gRNA sequence
ggtgctggcagggccaccca

SEQ ID NO: 508890 - DNA, 20 bp, Artificial
  CRISPR gRNA sequence
tggcagggccacccaaggtt

SEQ ID NO: 508891 - DNA, 20 bp, Artificial
  CRISPR gRNA sequence
cagggccacccaaggttcag

SEQ ID NO: 508892 - DNA, 20 bp, Artificial
  CRISPR gRNA sequence
agggccacccaaggttcagt

SEQ ID NO: 508893 - DNA, 20 bp, Artificial
  CRISPR gRNA sequence
gccacccaaggttcagtggg

SEQ ID NO: 508894 - DNA, 20 bp, Artificial
  CRISPR gRNA sequence
aaggttcagtgggcagaccc

SEQ ID NO: 508895 - DNA, 20 bp, Artificial
  CRISPR gRNA sequence
ttcagtgggcagacccaagc

SEQ ID NO: 508896 - DNA, 20 bp, Artificial
  CRISPR gRNA sequence
agtgggcagacccaagccag

SEQ ID NO: 508897 - DNA, 20 bp, Artificial
  CRISPR gRNA sequence
tgggcagacccaagccagca

SEQ ID NO: 508898 - DNA, 20 bp, Artificial
  CRISPR gRNA sequence
aagccagcagagccccaaac

SEQ ID NO: 508899 - DNA, 20 bp, Artificial
  CRISPR gRNA sequence
agccagcagagccccaaact

SEQ ID NO: 508900 - DNA, 20 bp, Artificial
  CRISPR gRNA sequence
gccagcagagccccaaacta

SEQ ID NO: 508901 - DNA, 20 bp, Artificial
  CRISPR gRNA sequence
agccccaaactagggcctgc

SEQ ID NO: 508902 - DNA, 20 bp, Artificial
  CRISPR gRNA sequence
actagggcctgccggctttg

SEQ ID NO: 508903 - DNA, 20 bp, Artificial
  CRISPR gRNA sequence
gggcctgccggctttgaaga

SEQ ID NO: 508904 - DNA, 20 bp, Artificial
  CRISPR gRNA sequence
gccggctttgaagacagcgc

SEQ ID NO: 508905 - DNA, 20 bp, Artificial
  CRISPR gRNA sequence
ccggctttgaagacagcgct

SEQ ID NO: 508906 - DNA, 20 bp, Artificial
  CRISPR gRNA sequence
cagcgctgggtgctgtgctg

SEQ ID NO: 508907 - DNA, 20 bp, Artificial
  CRISPR gRNA sequence
ctgggtgctgtgctgtggcc

SEQ ID NO: 508908 - DNA, 20 bp, Artificial
  CRISPR gRNA sequence
tgggtgctgtgctgtggccc

SEQ ID NO: 508909 - DNA, 20 bp, Artificial
  CRISPR gRNA sequence
ggtgctgtgctgtggcccgg

SEQ ID NO: 508910 - DNA, 20 bp, Artificial
  CRISPR gRNA sequence
gtgctgtgctgtggcccggg

SEQ ID NO: 508911 - DNA, 20 bp, Artificial
  CRISPR gRNA sequence
gtgctgtggcccgggaggct

SEQ ID NO: 508912 - DNA, 20 bp, Artificial
  CRISPR gRNA sequence
tgctgtggcccgggaggctc

SEQ ID NO: 508913 - DNA, 20 bp, Artificial
  CRISPR gRNA sequence
ccgggaggctcgggtgccct

SEQ ID NO: 508914 - DNA, 20 bp, Artificial
  CRISPR gRNA sequence
ggctcgggtgccctcagcca

SEQ ID NO: 508915 - DNA, 20 bp, Artificial
  CRISPR gRNA sequence
gctcgggtgccctcagccac

SEQ ID NO: 508916 - DNA, 20 bp, Artificial
  CRISPR gRNA sequence
gtgccctcagccacaggccc

SEQ ID NO: 508917 - DNA, 20 bp, Artificial
  CRISPR gRNA sequence
ggctcccctccatcccccga

SEQ ID NO: 508918 - DNA, 20 bp, Artificial
  CRISPR gRNA sequence
cgaaagccctgcacctgtgc

SEQ ID NO: 508919 - DNA, 20 bp, Artificial
  CRISPR gRNA sequence
gaaagccctgcacctgtgct

SEQ ID NO: 508920 - DNA, 20 bp, Artificial
  CRISPR gRNA sequence
aaagccctgcacctgtgctg

SEQ ID NO: 508921 - DNA, 20 bp, Artificial
  CRISPR gRNA sequence
aagccctgcacctgtgctgg

SEQ ID NO: 508922 - DNA, 20 bp, Artificial
  CRISPR gRNA sequence
gcacctgtgctgggggctct

SEQ ID NO: 508923 - DNA, 20 bp, Artificial
  CRISPR gRNA sequence
cacctgtgctgggggctctg

SEQ ID NO: 508924 - DNA, 20 bp, Artificial
  CRISPR gRNA sequence
gctgggggctctgaggccaa

SEQ ID NO: 508925 - DNA, 20 bp, Artificial
  CRISPR gRNA sequence
gaggccaacggaacacccac

SEQ ID NO: 508926 - DNA, 20 bp, Artificial
  CRISPR gRNA sequence
aggccaacggaacacccacc

SEQ ID NO: 508927 - DNA, 20 bp, Artificial
  CRISPR gRNA sequence
ggccaacggaacacccacca

SEQ ID NO: 508928 - DNA, 20 bp, Artificial
  CRISPR gRNA sequence
gccaacggaacacccaccag

SEQ ID NO: 508929 - DNA, 20 bp, Artificial
  CRISPR gRNA sequence
cacccaccaggggcccatct

SEQ ID NO: 508930 - DNA, 20 bp, Artificial
  CRISPR gRNA sequence
acccaccaggggcccatctg

SEQ ID NO: 508931 - DNA, 20 bp, Artificial
  CRISPR gRNA sequence
gggcccatctgaggatccca

SEQ ID NO: 508932 - DNA, 20 bp, Artificial
  CRISPR gRNA sequence
catctgaggatcccacagct

SEQ ID NO: 508933 - DNA, 20 bp, Artificial
  CRISPR gRNA sequence
cacagcttagacgccccaac

SEQ ID NO: 508934 - DNA, 20 bp, Artificial
  CRISPR gRNA sequence
tagacgccccaacaagcccc

SEQ ID NO: 508935 - DNA, 20 bp, Artificial
  CRISPR gRNA sequence
agacgccccaacaagcccca

SEQ ID NO: 508936 - DNA, 20 bp, Artificial
  CRISPR gRNA sequence
gccccaaggtcctgttgttt

SEQ ID NO: 508937 - DNA, 20 bp, Artificial
  CRISPR gRNA sequence
ccaaggtcctgttgttttgg

SEQ ID NO: 508938 - DNA, 20 bp, Artificial
  CRISPR gRNA sequence
ttggcagtgacctcattccc

SEQ ID NO: 508939 - DNA, 20 bp, Artificial
  CRISPR gRNA sequence
tgacctcattccctggttcc

SEQ ID NO: 508940 - DNA, 20 bp, Artificial
  CRISPR gRNA sequence
gttcccagcaaaattataat

SEQ ID NO: 508941 - DNA, 20 bp, Artificial
  CRISPR gRNA sequence
tcagaatacaaaaatgtcaa

SEQ ID NO: 508942 - DNA, 20 bp, Artificial
  CRISPR gRNA sequence
cagaatacaaaaatgtcaaa

SEQ ID NO: 508943 - DNA, 20 bp, Artificial
  CRISPR gRNA sequence
agaatacaaaaatgtcaaaa

SEQ ID NO: 508944 - DNA, 20 bp, Artificial
  CRISPR gRNA sequence
acccttgatccttcccgtcc

SEQ ID NO: 508945 - DNA, 20 bp, Artificial
  CRISPR gRNA sequence
cccttgatccttcccgtcct

SEQ ID NO: 508946 - DNA, 20 bp, Artificial
  CRISPR gRNA sequence
ccttgatccttcccgtcctg

SEQ ID NO: 508947 - DNA, 20 bp, Artificial
  CRISPR gRNA sequence
tcccgtcctggggtcaaaaa

SEQ ID NO: 508948 - DNA, 20 bp, Artificial
  CRISPR gRNA sequence
tgcaccctgctgtaacttcc

SEQ ID NO: 508949 - DNA, 20 bp, Artificial
  CRISPR gRNA sequence
caccctgctgtaacttcctg

SEQ ID NO: 508950 - DNA, 20 bp, Artificial
  CRISPR gRNA sequence
accctgctgtaacttcctgg

SEQ ID NO: 508951 - DNA, 20 bp, Artificial
  CRISPR gRNA sequence
cctgctgtaacttcctggag

SEQ ID NO: 508952 - DNA, 20 bp, Artificial
  CRISPR gRNA sequence
ctgctgtaacttcctggagg

SEQ ID NO: 508953 - DNA, 20 bp, Artificial
  CRISPR gRNA sequence
ctgtaacttcctggaggagg

SEQ ID NO: 508954 - DNA, 20 bp, Artificial
  CRISPR gRNA sequence
cttcctggaggaggtggttt

SEQ ID NO: 508955 - DNA, 20 bp, Artificial
  CRISPR gRNA sequence
gaggtggttttggttcacat

SEQ ID NO: 508956 - DNA, 20 bp, Artificial
  CRISPR gRNA sequence
aggtggttttggttcacatt

SEQ ID NO: 508957 - DNA, 20 bp, Artificial
  CRISPR gRNA sequence
tgggcccaccctgtgtctga

SEQ ID NO: 508958 - DNA, 20 bp, Artificial
  CRISPR gRNA sequence
gcccccatatctctgatcgt

SEQ ID NO: 508959 - DNA, 20 bp, Artificial
  CRISPR gRNA sequence
cccccatatctctgatcgtt

SEQ ID NO: 508960 - DNA, 20 bp, Artificial
  CRISPR gRNA sequence
ccccatatctctgatcgttg

SEQ ID NO: 508961 - DNA, 20 bp, Artificial
  CRISPR gRNA sequence
cccatatctctgatcgttgg

SEQ ID NO: 508962 - DNA, 20 bp, Artificial
  CRISPR gRNA sequence
tctctgatcgttgggggttg

SEQ ID NO: 508963 - DNA, 20 bp, Artificial
  CRISPR gRNA sequence
gatcgttgggggttgtggtt

SEQ ID NO: 508964 - DNA, 20 bp, Artificial
  CRISPR gRNA sequence
atcgttgggggttgtggttc

SEQ ID NO: 508965 - DNA, 20 bp, Artificial
  CRISPR gRNA sequence
tgggggttgtggttcaggcc

SEQ ID NO: 508966 - DNA, 20 bp, Artificial
  CRISPR gRNA sequence
gggggttgtggttcaggccg

SEQ ID NO: 508967 - DNA, 20 bp, Artificial
  CRISPR gRNA sequence
gttgtggttcaggccgaggc

SEQ ID NO: 508968 - DNA, 20 bp, Artificial
  CRISPR gRNA sequence
gttcaggccgaggccagttc

SEQ ID NO: 508969 - DNA, 20 bp, Artificial
  CRISPR gRNA sequence
gccagttccagctctccatc

SEQ ID NO: 508970 - DNA, 20 bp, Artificial
  CRISPR gRNA sequence
ccagttccagctctccatct

SEQ ID NO: 508971 - DNA, 20 bp, Artificial
  CRISPR gRNA sequence
tctccatctgggccccctca

SEQ ID NO: 508972 - DNA, 20 bp, Artificial
  CRISPR gRNA sequence
ccccctcaaagtcctgcgcc

SEQ ID NO: 508973 - DNA, 20 bp, Artificial
  CRISPR gRNA sequence
tcctgcgcctggactgacct

SEQ ID NO: 508974 - DNA, 20 bp, Artificial
  CRISPR gRNA sequence
tggactgacctcggtgccac

SEQ ID NO: 508975 - DNA, 20 bp, Artificial
  CRISPR gRNA sequence
tcggtgccacgagtgcccac

SEQ ID NO: 508976 - DNA, 20 bp, Artificial
  CRISPR gRNA sequence
acgagtgcccaccagcccct

SEQ ID NO: 508977 - DNA, 20 bp, Artificial
  CRISPR gRNA sequence
ccaccagcccctcagctgat

SEQ ID NO: 508978 - DNA, 20 bp, Artificial
  CRISPR gRNA sequence
accagcccctcagctgatcg

SEQ ID NO: 508979 - DNA, 20 bp, Artificial
  CRISPR gRNA sequence
ccagcccctcagctgatcgg

SEQ ID NO: 508980 - DNA, 20 bp, Artificial
  CRISPR gRNA sequence
atcggaggccctgtgcgtgc

SEQ ID NO: 508981 - DNA, 20 bp, Artificial
  CRISPR gRNA sequence
cggaggccctgtgcgtgctg

SEQ ID NO: 508982 - DNA, 20 bp, Artificial
  CRISPR gRNA sequence
tgtgcgtgctggagctaccc

SEQ ID NO: 508983 - DNA, 20 bp, Artificial
  CRISPR gRNA sequence
gtgcgtgctggagctacccc

SEQ ID NO: 508984 - DNA, 20 bp, Artificial
  CRISPR gRNA sequence
tgcgtgctggagctacccca

SEQ ID NO: 508985 - DNA, 20 bp, Artificial
  CRISPR gRNA sequence
gctggagctaccccagggtg

SEQ ID NO: 508986 - DNA, 20 bp, Artificial
  CRISPR gRNA sequence
ctggagctaccccagggtgc

SEQ ID NO: 508987 - DNA, 20 bp, Artificial
  CRISPR gRNA sequence
tggagctaccccagggtgca

SEQ ID NO: 508988 - DNA, 20 bp, Artificial
  CRISPR gRNA sequence
ctaccccagggtgcagggtc

SEQ ID NO: 508989 - DNA, 20 bp, Artificial
  CRISPR gRNA sequence
cccagggtgcagggtccagc

SEQ ID NO: 508990 - DNA, 20 bp, Artificial
  CRISPR gRNA sequence
gtgcagggtccagccagctt

SEQ ID NO: 508991 - DNA, 20 bp, Artificial
  CRISPR gRNA sequence
tgcagggtccagccagcttc

SEQ ID NO: 508992 - DNA, 20 bp, Artificial
  CRISPR gRNA sequence
agccagcttcaggactcccc

SEQ ID NO: 508993 - DNA, 20 bp, Artificial
  CRISPR gRNA sequence
gccagcttcaggactccccc

SEQ ID NO: 508994 - DNA, 20 bp, Artificial
  CRISPR gRNA sequence
ccagcttcaggactccccca

SEQ ID NO: 508995 - DNA, 20 bp, Artificial
  CRISPR gRNA sequence
ttcaggactcccccagggtg

SEQ ID NO: 508996 - DNA, 20 bp, Artificial
  CRISPR gRNA sequence
tcaggactcccccagggtgc

SEQ ID NO: 508997 - DNA, 20 bp, Artificial
  CRISPR gRNA sequence
caggactcccccagggtgca

SEQ ID NO: 508998 - DNA, 20 bp, Artificial
  CRISPR gRNA sequence
ctcccccagggtgcagggtc

SEQ ID NO: 508999 - DNA, 20 bp, Artificial
  CRISPR gRNA sequence
cccagggtgcagggtccagc

SEQ ID NO: 509000 - DNA, 20 bp, Artificial
  CRISPR gRNA sequence
gtgcagggtccagccggctt

SEQ ID NO: 509001 - DNA, 20 bp, Artificial
  CRISPR gRNA sequence
tgcagggtccagccggcttc

SEQ ID NO: 509002 - DNA, 20 bp, Artificial
  CRISPR gRNA sequence
agccggcttcaggactcccc

SEQ ID NO: 509003 - DNA, 20 bp, Artificial
  CRISPR gRNA sequence
gccggcttcaggactccccc

SEQ ID NO: 509004 - DNA, 20 bp, Artificial
  CRISPR gRNA sequence
ccggcttcaggactccccca

SEQ ID NO: 509005 - DNA, 20 bp, Artificial
  CRISPR gRNA sequence
ttcaggactcccccagggtg

SEQ ID NO: 509006 - DNA, 20 bp, Artificial
  CRISPR gRNA sequence
tcaggactcccccagggtgc

SEQ ID NO: 509007 - DNA, 20 bp, Artificial
  CRISPR gRNA sequence
caggactcccccagggtgca

SEQ ID NO: 509008 - DNA, 20 bp, Artificial
  CRISPR gRNA sequence
ctcccccagggtgcagggtc

SEQ ID NO: 509009 - DNA, 20 bp, Artificial
  CRISPR gRNA sequence
cccagggtgcagggtccagc

SEQ ID NO: 509010 - DNA, 20 bp, Artificial
  CRISPR gRNA sequence
gtgcagggtccagccggctt

SEQ ID NO: 509011 - DNA, 20 bp, Artificial
  CRISPR gRNA sequence
tgcagggtccagccggcttc

SEQ ID NO: 509012 - DNA, 20 bp, Artificial
  CRISPR gRNA sequence
agccggcttcaggactcccc

SEQ ID NO: 509013 - DNA, 20 bp, Artificial
  CRISPR gRNA sequence
gccggcttcaggactccccc

SEQ ID NO: 509014 - DNA, 20 bp, Artificial
  CRISPR gRNA sequence
ccggcttcaggactccccca

SEQ ID NO: 509015 - DNA, 20 bp, Artificial
  CRISPR gRNA sequence
ttcaggactcccccagggtg

SEQ ID NO: 509016 - DNA, 20 bp, Artificial
  CRISPR gRNA sequence
tcaggactcccccagggtgc

SEQ ID NO: 509017 - DNA, 20 bp, Artificial
  CRISPR gRNA sequence
caggactcccccagggtgca

SEQ ID NO: 509018 - DNA, 20 bp, Artificial
  CRISPR gRNA sequence
ctcccccagggtgcagggtc

SEQ ID NO: 509019 - DNA, 20 bp, Artificial
  CRISPR gRNA sequence
cccagggtgcagggtccagc

SEQ ID NO: 509020 - DNA, 20 bp, Artificial
  CRISPR gRNA sequence
gtgcagggtccagccggctt

SEQ ID NO: 509021 - DNA, 20 bp, Artificial
  CRISPR gRNA sequence
tgcagggtccagccggcttc

SEQ ID NO: 509022 - DNA, 20 bp, Artificial
  CRISPR gRNA sequence
agccggcttcaggactcccc

SEQ ID NO: 509023 - DNA, 20 bp, Artificial
  CRISPR gRNA sequence
gccggcttcaggactccccc

SEQ ID NO: 509024 - DNA, 20 bp, Artificial
  CRISPR gRNA sequence
ccggcttcaggactccccca

SEQ ID NO: 509025 - DNA, 20 bp, Artificial
  CRISPR gRNA sequence
ttcaggactcccccagggtg

SEQ ID NO: 509026 - DNA, 20 bp, Artificial
  CRISPR gRNA sequence
tcaggactcccccagggtgc

SEQ ID NO: 509027 - DNA, 20 bp, Artificial
  CRISPR gRNA sequence
caggactcccccagggtgca

SEQ ID NO: 509028 - DNA, 20 bp, Artificial
  CRISPR gRNA sequence
ctcccccagggtgcagggtc

SEQ ID NO: 509029 - DNA, 20 bp, Artificial
  CRISPR gRNA sequence
cccagggtgcagggtccagc

SEQ ID NO: 509030 - DNA, 20 bp, Artificial
  CRISPR gRNA sequence
gtgcagggtccagccggctt

SEQ ID NO: 509031 - DNA, 20 bp, Artificial
  CRISPR gRNA sequence
tgcagggtccagccggcttc

SEQ ID NO: 509032 - DNA, 20 bp, Artificial
  CRISPR gRNA sequence
agccggcttcaggactcccc

SEQ ID NO: 509033 - DNA, 20 bp, Artificial
  CRISPR gRNA sequence
gccggcttcaggactccccc

SEQ ID NO: 509034 - DNA, 20 bp, Artificial
  CRISPR gRNA sequence
ccggcttcaggactccccca

SEQ ID NO: 509035 - DNA, 20 bp, Artificial
  CRISPR gRNA sequence
ttcaggactcccccagggtg

SEQ ID NO: 509036 - DNA, 20 bp, Artificial
  CRISPR gRNA sequence
tcaggactcccccagggtgc

SEQ ID NO: 509037 - DNA, 20 bp, Artificial
  CRISPR gRNA sequence
caggactcccccagggtgca

SEQ ID NO: 509038 - DNA, 20 bp, Artificial
  CRISPR gRNA sequence
ctcccccagggtgcagggtc

SEQ ID NO: 509039 - DNA, 20 bp, Artificial
  CRISPR gRNA sequence
cccagggtgcagggtccagc

SEQ ID NO: 509040 - DNA, 20 bp, Artificial
  CRISPR gRNA sequence
gtgcagggtccagccggctt

SEQ ID NO: 509041 - DNA, 20 bp, Artificial
  CRISPR gRNA sequence
tgcagggtccagccggcttc

SEQ ID NO: 509042 - DNA, 20 bp, Artificial
  CRISPR gRNA sequence
agccggcttcaggactcccc

SEQ ID NO: 509043 - DNA, 20 bp, Artificial
  CRISPR gRNA sequence
gccggcttcaggactccccc

SEQ ID NO: 509044 - DNA, 20 bp, Artificial
  CRISPR gRNA sequence
ccggcttcaggactccccca

SEQ ID NO: 509045 - DNA, 20 bp, Artificial
  CRISPR gRNA sequence
ttcaggactcccccagggtg

SEQ ID NO: 509046 - DNA, 20 bp, Artificial
  CRISPR gRNA sequence
tcaggactcccccagggtgc

SEQ ID NO: 509047 - DNA, 20 bp, Artificial
  CRISPR gRNA sequence
caggactcccccagggtgca

SEQ ID NO: 509048 - DNA, 20 bp, Artificial
  CRISPR gRNA sequence
ctcccccagggtgcagggtc

SEQ ID NO: 509049 - DNA, 20 bp, Artificial
  CRISPR gRNA sequence
cccagggtgcagggtccagc

SEQ ID NO: 509050 - DNA, 20 bp, Artificial
  CRISPR gRNA sequence
gtgcagggtccagccggctt

SEQ ID NO: 509051 - DNA, 20 bp, Artificial
  CRISPR gRNA sequence
tgcagggtccagccggcttc

SEQ ID NO: 509052 - DNA, 20 bp, Artificial
  CRISPR gRNA sequence
agccggcttcaggactcccc

SEQ ID NO: 509053 - DNA, 20 bp, Artificial
  CRISPR gRNA sequence
gccggcttcaggactccccc

SEQ ID NO: 509054 - DNA, 20 bp, Artificial
  CRISPR gRNA sequence
ccggcttcaggactccccca

SEQ ID NO: 509055 - DNA, 20 bp, Artificial
  CRISPR gRNA sequence
ttcaggactcccccagggtg

SEQ ID NO: 509056 - DNA, 20 bp, Artificial
  CRISPR gRNA sequence
tcaggactcccccagggtgc

SEQ ID NO: 509057 - DNA, 20 bp, Artificial
  CRISPR gRNA sequence
caggactcccccagggtgca

SEQ ID NO: 509058 - DNA, 20 bp, Artificial
  CRISPR gRNA sequence
ctcccccagggtgcagggtc

SEQ ID NO: 509059 - DNA, 20 bp, Artificial
  CRISPR gRNA sequence
cccagggtgcagggtccagc

SEQ ID NO: 509060 - DNA, 20 bp, Artificial
  CRISPR gRNA sequence
gtgcagggtccagccggctt

SEQ ID NO: 509061 - DNA, 20 bp, Artificial
  CRISPR gRNA sequence
tgcagggtccagccggcttc

SEQ ID NO: 509062 - DNA, 20 bp, Artificial
  CRISPR gRNA sequence
agccggcttcaggactcccc

SEQ ID NO: 509063 - DNA, 20 bp, Artificial
  CRISPR gRNA sequence
gccggcttcaggactccccc

SEQ ID NO: 509064 - DNA, 20 bp, Artificial
  CRISPR gRNA sequence
ccggcttcaggactccccca

SEQ ID NO: 509065 - DNA, 20 bp, Artificial
  CRISPR gRNA sequence
ttcaggactcccccagggtg

SEQ ID NO: 509066 - DNA, 20 bp, Artificial
  CRISPR gRNA sequence
tcaggactcccccagggtgc

SEQ ID NO: 509067 - DNA, 20 bp, Artificial
  CRISPR gRNA sequence
caggactcccccagggtgca

SEQ ID NO: 509068 - DNA, 20 bp, Artificial
  CRISPR gRNA sequence
ctcccccagggtgcagggtc

SEQ ID NO: 509069 - DNA, 20 bp, Artificial
  CRISPR gRNA sequence
cccagggtgcagggtccagc

SEQ ID NO: 509070 - DNA, 20 bp, Artificial
  CRISPR gRNA sequence
gtgcagggtccagccggctt

SEQ ID NO: 509071 - DNA, 20 bp, Artificial
  CRISPR gRNA sequence
tgcagggtccagccggcttc

SEQ ID NO: 509072 - DNA, 20 bp, Artificial
  CRISPR gRNA sequence
agccggcttcaggactcccc

SEQ ID NO: 509073 - DNA, 20 bp, Artificial
  CRISPR gRNA sequence
gccggcttcaggactccccc

SEQ ID NO: 509074 - DNA, 20 bp, Artificial
  CRISPR gRNA sequence
ccggcttcaggactccccca

SEQ ID NO: 509075 - DNA, 20 bp, Artificial
  CRISPR gRNA sequence
ttcaggactcccccagggtg

SEQ ID NO: 509076 - DNA, 20 bp, Artificial
  CRISPR gRNA sequence
tcaggactcccccagggtgc

SEQ ID NO: 509077 - DNA, 20 bp, Artificial
  CRISPR gRNA sequence
caggactcccccagggtgca

SEQ ID NO: 509078 - DNA, 20 bp, Artificial
  CRISPR gRNA sequence
ctcccccagggtgcagggtc

SEQ ID NO: 509079 - DNA, 20 bp, Artificial
  CRISPR gRNA sequence
cccagggtgcagggtccagc

SEQ ID NO: 509080 - DNA, 20 bp, Artificial
  CRISPR gRNA sequence
gtgcagggtccagccggctt

SEQ ID NO: 509081 - DNA, 20 bp, Artificial
  CRISPR gRNA sequence
tgcagggtccagccggcttc

SEQ ID NO: 509082 - DNA, 20 bp, Artificial
  CRISPR gRNA sequence
agccggcttcaggactcccc

SEQ ID NO: 509083 - DNA, 20 bp, Artificial
  CRISPR gRNA sequence
gccggcttcaggactccccc

SEQ ID NO: 509084 - DNA, 20 bp, Artificial
  CRISPR gRNA sequence
ccggcttcaggactccccca

SEQ ID NO: 509085 - DNA, 20 bp, Artificial
  CRISPR gRNA sequence
ttcaggactcccccagggtg

SEQ ID NO: 509086 - DNA, 20 bp, Artificial
  CRISPR gRNA sequence
tcaggactcccccagggtgc

SEQ ID NO: 509087 - DNA, 20 bp, Artificial
  CRISPR gRNA sequence
caggactcccccagggtgca

SEQ ID NO: 509088 - DNA, 20 bp, Artificial
  CRISPR gRNA sequence
ctcccccagggtgcagggtc

SEQ ID NO: 509089 - DNA, 20 bp, Artificial
  CRISPR gRNA sequence
cccagggtgcagggtccagc

SEQ ID NO: 509090 - DNA, 20 bp, Artificial
  CRISPR gRNA sequence
gtgcagggtccagccggctt

SEQ ID NO: 509091 - DNA, 20 bp, Artificial
  CRISPR gRNA sequence
tgcagggtccagccggcttc

SEQ ID NO: 509092 - DNA, 20 bp, Artificial
  CRISPR gRNA sequence
agccggcttcaggactcccc

SEQ ID NO: 509093 - DNA, 20 bp, Artificial
  CRISPR gRNA sequence
gccggcttcaggactccccc

SEQ ID NO: 509094 - DNA, 20 bp, Artificial
  CRISPR gRNA sequence
ttcaggactcccccaggtcg

SEQ ID NO: 509095 - DNA, 20 bp, Artificial
  CRISPR gRNA sequence
ccccaggtcgcagctgcgcc

SEQ ID NO: 509096 - DNA, 20 bp, Artificial
  CRISPR gRNA sequence
caggtcgcagctgcgccaag

SEQ ID NO: 509097 - DNA, 20 bp, Artificial
  CRISPR gRNA sequence
aggtcgcagctgcgccaagt

SEQ ID NO: 509098 - DNA, 20 bp, Artificial
  CRISPR gRNA sequence
ggtcgcagctgcgccaagtg

SEQ ID NO: 509099 - DNA, 20 bp, Artificial
  CRISPR gRNA sequence
tcgcagctgcgccaagtggg

SEQ ID NO: 509100 - DNA, 20 bp, Artificial
  CRISPR gRNA sequence
cgcagctgcgccaagtgggg

SEQ ID NO: 509101 - DNA, 20 bp, Artificial
  CRISPR gRNA sequence
gcagctgcgccaagtgggga

SEQ ID NO: 509102 - DNA, 20 bp, Artificial
  CRISPR gRNA sequence
cagctgcgccaagtggggag

SEQ ID NO: 509103 - DNA, 20 bp, Artificial
  CRISPR gRNA sequence
agctgcgccaagtggggagg

SEQ ID NO: 509104 - DNA, 20 bp, Artificial
  CRISPR gRNA sequence
cgccaagtggggagggggtg

SEQ ID NO: 509105 - DNA, 20 bp, Artificial
  CRISPR gRNA sequence
gagggggtgcagacctcccc

SEQ ID NO: 509106 - DNA, 20 bp, Artificial
  CRISPR gRNA sequence
ggggtgcagacctcccctgg

SEQ ID NO: 509107 - DNA, 20 bp, Artificial
  CRISPR gRNA sequence
cagacctcccctggcagccc

SEQ ID NO: 509108 - DNA, 20 bp, Artificial
  CRISPR gRNA sequence
cctcccctggcagccccagc

SEQ ID NO: 509109 - DNA, 20 bp, Artificial
  CRISPR gRNA sequence
ctcccctggcagccccagcc

SEQ ID NO: 509110 - DNA, 20 bp, Artificial
  CRISPR gRNA sequence
cctggcagccccagccaggc

SEQ ID NO: 509111 - DNA, 20 bp, Artificial
  CRISPR gRNA sequence
gcagccccagccaggctggt

SEQ ID NO: 509112 - DNA, 20 bp, Artificial
  CRISPR gRNA sequence
cagccccagccaggctggta

SEQ ID NO: 509113 - DNA, 20 bp, Artificial
  CRISPR gRNA sequence
gctggtaaggactcacaccc

SEQ ID NO: 509114 - DNA, 20 bp, Artificial
  CRISPR gRNA sequence
ccccagctccacgctctccc

SEQ ID NO: 509115 - DNA, 20 bp, Artificial
  CRISPR gRNA sequence
cccagctccacgctctccct

SEQ ID NO: 509116 - DNA, 20 bp, Artificial
  CRISPR gRNA sequence
ccagctccacgctctccctg

SEQ ID NO: 509117 - DNA, 20 bp, Artificial
  CRISPR gRNA sequence
ccacgctctccctggggccg

SEQ ID NO: 509118 - DNA, 20 bp, Artificial
  CRISPR gRNA sequence
ctccctggggccgcagacat

SEQ ID NO: 509119 - DNA, 20 bp, Artificial
  CRISPR gRNA sequence
tccctggggccgcagacatg

SEQ ID NO: 509120 - DNA, 20 bp, Artificial
  CRISPR gRNA sequence
tgaggtctccgcccctaaca

SEQ ID NO: 509121 - DNA, 20 bp, Artificial
  CRISPR gRNA sequence
gcccctaacacagtcgtgac

SEQ ID NO: 509122 - DNA, 20 bp, Artificial
  CRISPR gRNA sequence
cctaacacagtcgtgaccag

SEQ ID NO: 509123 - DNA, 20 bp, Artificial
  CRISPR gRNA sequence
aaacacttcataccctcaaa

SEQ ID NO: 509124 - DNA, 20 bp, Artificial
  CRISPR gRNA sequence
aacacttcataccctcaaat

SEQ ID NO: 509125 - DNA, 20 bp, Artificial
  CRISPR gRNA sequence
acacttcataccctcaaatg

SEQ ID NO: 509126 - DNA, 20 bp, Artificial
  CRISPR gRNA sequence
taccctcaaatggggaaact

SEQ ID NO: 509127 - DNA, 20 bp, Artificial
  CRISPR gRNA sequence
accctcaaatggggaaactg

SEQ ID NO: 509128 - DNA, 20 bp, Artificial
  CRISPR gRNA sequence
ccctcaaatggggaaactga

SEQ ID NO: 509129 - DNA, 20 bp, Artificial
  CRISPR gRNA sequence
aatggggaaactgagggccc

SEQ ID NO: 509130 - DNA, 20 bp, Artificial
  CRISPR gRNA sequence
ggggaaactgagggccccag

SEQ ID NO: 509131 - DNA, 20 bp, Artificial
  CRISPR gRNA sequence
gaaactgagggccccagcag

SEQ ID NO: 509132 - DNA, 20 bp, Artificial
  CRISPR gRNA sequence
ctgagggccccagcagcagc

SEQ ID NO: 509133 - DNA, 20 bp, Artificial
  CRISPR gRNA sequence
gccccagcagcagcaagata

SEQ ID NO: 509134 - DNA, 20 bp, Artificial
  CRISPR gRNA sequence
gcagcagcaagatatggacc

SEQ ID NO: 509135 - DNA, 20 bp, Artificial
  CRISPR gRNA sequence
caagatatggacctggtgcc

SEQ ID NO: 509136 - DNA, 20 bp, Artificial
  CRISPR gRNA sequence
gacctggtgcccagttaccc

SEQ ID NO: 509137 - DNA, 20 bp, Artificial
  CRISPR gRNA sequence
acctggtgcccagttacccc

SEQ ID NO: 509138 - DNA, 20 bp, Artificial
  CRISPR gRNA sequence
cgggcactcccacctgccca

SEQ ID NO: 509139 - DNA, 20 bp, Artificial
  CRISPR gRNA sequence
gggcactcccacctgcccac

SEQ ID NO: 509140 - DNA, 20 bp, Artificial
  CRISPR gRNA sequence
ggcactcccacctgcccaca

SEQ ID NO: 509141 - DNA, 20 bp, Artificial
  CRISPR gRNA sequence
cactcccacctgcccacagg

SEQ ID NO: 509142 - DNA, 20 bp, Artificial
  CRISPR gRNA sequence
ctcccacctgcccacaggga

SEQ ID NO: 509143 - DNA, 20 bp, Artificial
  CRISPR gRNA sequence
tcccacctgcccacagggag

SEQ ID NO: 509144 - DNA, 20 bp, Artificial
  CRISPR gRNA sequence
cccacctgcccacagggaga

SEQ ID NO: 509145 - DNA, 20 bp, Artificial
  CRISPR gRNA sequence
ccacctgcccacagggagag

SEQ ID NO: 509146 - DNA, 20 bp, Artificial
  CRISPR gRNA sequence
cacctgcccacagggagagg

SEQ ID NO: 509147 - DNA, 20 bp, Artificial
  CRISPR gRNA sequence
gagggggtgcaccttgattc

SEQ ID NO: 509148 - DNA, 20 bp, Artificial
  CRISPR gRNA sequence
ggggtgcaccttgattccag

SEQ ID NO: 509149 - DNA, 20 bp, Artificial
  CRISPR gRNA sequence
gggtgcaccttgattccagc

SEQ ID NO: 509150 - DNA, 20 bp, Artificial
  CRISPR gRNA sequence
caccttgattccagcaggat

SEQ ID NO: 509151 - DNA, 20 bp, Artificial
  CRISPR gRNA sequence
tgattccagcaggattggct

SEQ ID NO: 509152 - DNA, 20 bp, Artificial
  CRISPR gRNA sequence
attccagcaggattggctca

SEQ ID NO: 509153 - DNA, 20 bp, Artificial
  CRISPR gRNA sequence
caggattggctcagagacca

SEQ ID NO: 509154 - DNA, 20 bp, Artificial
  CRISPR gRNA sequence
cggcaccccaaccttgacca

SEQ ID NO: 509155 - DNA, 20 bp, Artificial
  CRISPR gRNA sequence
ggcaccccaaccttgaccac

SEQ ID NO: 509156 - DNA, 20 bp, Artificial
  CRISPR gRNA sequence
accccaaccttgaccacagg

SEQ ID NO: 509157 - DNA, 20 bp, Artificial
  CRISPR gRNA sequence
ccccaaccttgaccacagga

SEQ ID NO: 509158 - DNA, 20 bp, Artificial
  CRISPR gRNA sequence
cccaaccttgaccacaggaa

SEQ ID NO: 509159 - DNA, 20 bp, Artificial
  CRISPR gRNA sequence
ccaaccttgaccacaggaag

SEQ ID NO: 509160 - DNA, 20 bp, Artificial
  CRISPR gRNA sequence
caaccttgaccacaggaagg

SEQ ID NO: 509161 - DNA, 20 bp, Artificial
  CRISPR gRNA sequence
cttgaccacaggaagggggc

SEQ ID NO: 509162 - DNA, 20 bp, Artificial
  CRISPR gRNA sequence
gaccacaggaagggggctgg

SEQ ID NO: 509163 - DNA, 20 bp, Artificial
  CRISPR gRNA sequence
accacaggaagggggctggt

SEQ ID NO: 509164 - DNA, 20 bp, Artificial
  CRISPR gRNA sequence
ccacaggaagggggctggtg

SEQ ID NO: 509165 - DNA, 20 bp, Artificial
  CRISPR gRNA sequence
acaggaagggggctggtggg

SEQ ID NO: 509166 - DNA, 20 bp, Artificial
  CRISPR gRNA sequence
ccccactgttgctcctccat

SEQ ID NO: 509167 - DNA, 20 bp, Artificial
  CRISPR gRNA sequence
cactgttgctcctccatgag

SEQ ID NO: 509168 - DNA, 20 bp, Artificial
  CRISPR gRNA sequence
tgctcctccatgagcagccc

SEQ ID NO: 509169 - DNA, 20 bp, Artificial
  CRISPR gRNA sequence
gctcctccatgagcagccct

SEQ ID NO: 509170 - DNA, 20 bp, Artificial
  CRISPR gRNA sequence
ctcctccatgagcagccctg

SEQ ID NO: 509171 - DNA, 20 bp, Artificial
  CRISPR gRNA sequence
tcctccatgagcagccctgg

SEQ ID NO: 509172 - DNA, 20 bp, Artificial
  CRISPR gRNA sequence
cctccatgagcagccctggg

SEQ ID NO: 509173 - DNA, 20 bp, Artificial
  CRISPR gRNA sequence
atgagcagccctggggggct

SEQ ID NO: 509174 - DNA, 20 bp, Artificial
  CRISPR gRNA sequence
gagcagccctggggggcttg

SEQ ID NO: 509175 - DNA, 20 bp, Artificial
  CRISPR gRNA sequence
agccctggggggcttggagc

SEQ ID NO: 509176 - DNA, 20 bp, Artificial
  CRISPR gRNA sequence
gccctggggggcttggagct

SEQ ID NO: 509177 - DNA, 20 bp, Artificial
  CRISPR gRNA sequence
ccctggggggcttggagctg

SEQ ID NO: 509178 - DNA, 20 bp, Artificial
  CRISPR gRNA sequence
cctggggggcttggagctgg

SEQ ID NO: 509179 - DNA, 20 bp, Artificial
  CRISPR gRNA sequence
gggcttggagctgggggcac

SEQ ID NO: 509180 - DNA, 20 bp, Artificial
  CRISPR gRNA sequence
gcttggagctgggggcacaa

SEQ ID NO: 509181 - DNA, 20 bp, Artificial
  CRISPR gRNA sequence
tggagctgggggcacaagag

SEQ ID NO: 509182 - DNA, 20 bp, Artificial
  CRISPR gRNA sequence
gctgggggcacaagagaagc

SEQ ID NO: 509183 - DNA, 20 bp, Artificial
  CRISPR gRNA sequence
ctgggggcacaagagaagcc

SEQ ID NO: 509184 - DNA, 20 bp, Artificial
  CRISPR gRNA sequence
cctgccccaccccccaatgc

SEQ ID NO: 509185 - DNA, 20 bp, Artificial
  CRISPR gRNA sequence
gccccaccccccaatgccag

SEQ ID NO: 509186 - DNA, 20 bp, Artificial
  CRISPR gRNA sequence
accccccaatgccagtggct

SEQ ID NO: 509187 - DNA, 20 bp, Artificial
  CRISPR gRNA sequence
ccaatgccagtggctgagcc

SEQ ID NO: 509188 - DNA, 20 bp, Artificial
  CRISPR gRNA sequence
agtggctgagcccagacaaa

SEQ ID NO: 509189 - DNA, 20 bp, Artificial
  CRISPR gRNA sequence
gctgagcccagacaaacagc

SEQ ID NO: 509190 - DNA, 20 bp, Artificial
  CRISPR gRNA sequence
ctgagcccagacaaacagct

SEQ ID NO: 509191 - DNA, 20 bp, Artificial
  CRISPR gRNA sequence
tgagcccagacaaacagctg

SEQ ID NO: 509192 - DNA, 20 bp, Artificial
  CRISPR gRNA sequence
cagacaaacagctggggatg

SEQ ID NO: 509193 - DNA, 20 bp, Artificial
  CRISPR gRNA sequence
agacaaacagctggggatga

SEQ ID NO: 509194 - DNA, 20 bp, Artificial
  CRISPR gRNA sequence
ctggggatgaaggtccgctc

SEQ ID NO: 509195 - DNA, 20 bp, Artificial
  CRISPR gRNA sequence
tggggatgaaggtccgctcc

SEQ ID NO: 509196 - DNA, 20 bp, Artificial
  CRISPR gRNA sequence
gggatgaaggtccgctccag

SEQ ID NO: 509197 - DNA, 20 bp, Artificial
  CRISPR gRNA sequence
ggatgaaggtccgctccagg

SEQ ID NO: 509198 - DNA, 20 bp, Artificial
  CRISPR gRNA sequence
gaaggtccgctccaggaggt

SEQ ID NO: 509199 - DNA, 20 bp, Artificial
  CRISPR gRNA sequence
aaggtccgctccaggaggta

SEQ ID NO: 509200 - DNA, 20 bp, Artificial
  CRISPR gRNA sequence
gtccgctccaggaggtaagg

SEQ ID NO: 509201 - DNA, 20 bp, Artificial
  CRISPR gRNA sequence
aggaggtaaggcagtgcact

SEQ ID NO: 509202 - DNA, 20 bp, Artificial
  CRISPR gRNA sequence
gtaaggcagtgcactgagcc

SEQ ID NO: 509203 - DNA, 20 bp, Artificial
  CRISPR gRNA sequence
aggcagtgcactgagcctgg

SEQ ID NO: 509204 - DNA, 20 bp, Artificial
  CRISPR gRNA sequence
agtgcactgagcctggcagc

SEQ ID NO: 509205 - DNA, 20 bp, Artificial
  CRISPR gRNA sequence
ggcagccagcctcccttctg

SEQ ID NO: 509206 - DNA, 20 bp, Artificial
  CRISPR gRNA sequence
gcagccagcctcccttctgt

SEQ ID NO: 509207 - DNA, 20 bp, Artificial
  CRISPR gRNA sequence
agccagcctcccttctgtgg

SEQ ID NO: 509208 - DNA, 20 bp, Artificial
  CRISPR gRNA sequence
gcctcccttctgtgggagaa

SEQ ID NO: 509209 - DNA, 20 bp, Artificial
  CRISPR gRNA sequence
cctcccttctgtgggagaac

SEQ ID NO: 509210 - DNA, 20 bp, Artificial
  CRISPR gRNA sequence
ctcccttctgtgggagaaca

SEQ ID NO: 509211 - DNA, 20 bp, Artificial
  CRISPR gRNA sequence
ccttctgtgggagaacaggg

SEQ ID NO: 509212 - DNA, 20 bp, Artificial
  CRISPR gRNA sequence
cttctgtgggagaacagggc

SEQ ID NO: 509213 - DNA, 20 bp, Artificial
  CRISPR gRNA sequence
ttctgtgggagaacagggca

SEQ ID NO: 509214 - DNA, 20 bp, Artificial
  CRISPR gRNA sequence
tgtgggagaacagggcaggg

SEQ ID NO: 509215 - DNA, 20 bp, Artificial
  CRISPR gRNA sequence
ggcagggcagcccctctgcc

SEQ ID NO: 509216 - DNA, 20 bp, Artificial
  CRISPR gRNA sequence
agggcagcccctctgcccag

SEQ ID NO: 509217 - DNA, 20 bp, Artificial
  CRISPR gRNA sequence
cagcccctctgcccagcagc

SEQ ID NO: 509218 - DNA, 20 bp, Artificial
  CRISPR gRNA sequence
agcccctctgcccagcagcc

SEQ ID NO: 509219 - DNA, 20 bp, Artificial
  CRISPR gRNA sequence
cctctgcccagcagccagga

SEQ ID NO: 509220 - DNA, 20 bp, Artificial
  CRISPR gRNA sequence
ccagcagccaggatggccca

SEQ ID NO: 509221 - DNA, 20 bp, Artificial
  CRISPR gRNA sequence
agcagccaggatggcccacg

SEQ ID NO: 509222 - DNA, 20 bp, Artificial
  CRISPR gRNA sequence
gcagccaggatggcccacgg

SEQ ID NO: 509223 - DNA, 20 bp, Artificial
  CRISPR gRNA sequence
caggatggcccacggaggtc

SEQ ID NO: 509224 - DNA, 20 bp, Artificial
  CRISPR gRNA sequence
aggatggcccacggaggtcc

SEQ ID NO: 509225 - DNA, 20 bp, Artificial
  CRISPR gRNA sequence
ggatggcccacggaggtcca

SEQ ID NO: 509226 - DNA, 20 bp, Artificial
  CRISPR gRNA sequence
ggaggtccagggcctcacct

SEQ ID NO: 509227 - DNA, 20 bp, Artificial
  CRISPR gRNA sequence
gaggtccagggcctcacctg

SEQ ID NO: 509228 - DNA, 20 bp, Artificial
  CRISPR gRNA sequence
cagggcctcacctgaggcct

SEQ ID NO: 509229 - DNA, 20 bp, Artificial
  CRISPR gRNA sequence
gggcctcacctgaggcctga

SEQ ID NO: 509230 - DNA, 20 bp, Artificial
  CRISPR gRNA sequence
cacctgaggcctgagagacc

SEQ ID NO: 509231 - DNA, 20 bp, Artificial
  CRISPR gRNA sequence
ctgagagaccaagaccccat

SEQ ID NO: 509232 - DNA, 20 bp, Artificial
  CRISPR gRNA sequence
tgagagaccaagaccccatc

SEQ ID NO: 509233 - DNA, 20 bp, Artificial
  CRISPR gRNA sequence
cccatcaggcctatctgcct

SEQ ID NO: 509234 - DNA, 20 bp, Artificial
  CRISPR gRNA sequence
ctcagtttcctccatgtgcc

SEQ ID NO: 509235 - DNA, 20 bp, Artificial
  CRISPR gRNA sequence
cagtttcctccatgtgcctg

SEQ ID NO: 509236 - DNA, 20 bp, Artificial
  CRISPR gRNA sequence
agtttcctccatgtgcctgg

SEQ ID NO: 509237 - DNA, 20 bp, Artificial
  CRISPR gRNA sequence
ttcctccatgtgcctggagg

SEQ ID NO: 509238 - DNA, 20 bp, Artificial
  CRISPR gRNA sequence
catgtgcctggaggtggtcg

SEQ ID NO: 509239 - DNA, 20 bp, Artificial
  CRISPR gRNA sequence
atgtgcctggaggtggtcga

SEQ ID NO: 509240 - DNA, 20 bp, Artificial
  CRISPR gRNA sequence
tgtgcctggaggtggtcgaa

SEQ ID NO: 509241 - DNA, 20 bp, Artificial
  CRISPR gRNA sequence
ggtggtcgaagggcctgtgc

SEQ ID NO: 509242 - DNA, 20 bp, Artificial
  CRISPR gRNA sequence
aagggcctgtgccagctccc

SEQ ID NO: 509243 - DNA, 20 bp, Artificial
  CRISPR gRNA sequence
agggcctgtgccagctccct

SEQ ID NO: 509244 - DNA, 20 bp, Artificial
  CRISPR gRNA sequence
gggcctgtgccagctccctg

SEQ ID NO: 509245 - DNA, 20 bp, Artificial
  CRISPR gRNA sequence
ggcctgtgccagctccctgg

SEQ ID NO: 509246 - DNA, 20 bp, Artificial
  CRISPR gRNA sequence
tgtgccagctccctggggga

SEQ ID NO: 509247 - DNA, 20 bp, Artificial
  CRISPR gRNA sequence
gtgccagctccctgggggat

SEQ ID NO: 509248 - DNA, 20 bp, Artificial
  CRISPR gRNA sequence
agctccctgggggatgggaa

SEQ ID NO: 509249 - DNA, 20 bp, Artificial
  CRISPR gRNA sequence
gctccctgggggatgggaat

SEQ ID NO: 509250 - DNA, 20 bp, Artificial
  CRISPR gRNA sequence
cctgggggatgggaatgggt

SEQ ID NO: 509251 - DNA, 20 bp, Artificial
  CRISPR gRNA sequence
ctgggggatgggaatgggta

SEQ ID NO: 509252 - DNA, 20 bp, Artificial
  CRISPR gRNA sequence
ggatgggaatgggtaaggca

SEQ ID NO: 509253 - DNA, 20 bp, Artificial
  CRISPR gRNA sequence
gaatgggtaaggcacagatg

SEQ ID NO: 509254 - DNA, 20 bp, Artificial
  CRISPR gRNA sequence
aatgggtaaggcacagatgt

SEQ ID NO: 509255 - DNA, 20 bp, Artificial
  CRISPR gRNA sequence
atgggtaaggcacagatgta

SEQ ID NO: 509256 - DNA, 20 bp, Artificial
  CRISPR gRNA sequence
ggtaaggcacagatgtaggg

SEQ ID NO: 509257 - DNA, 20 bp, Artificial
  CRISPR gRNA sequence
cacagatgtagggcagcatt

SEQ ID NO: 509258 - DNA, 20 bp, Artificial
  CRISPR gRNA sequence
acagatgtagggcagcattc

SEQ ID NO: 509259 - DNA, 20 bp, Artificial
  CRISPR gRNA sequence
tagggcagcattcgggcaaa

SEQ ID NO: 509260 - DNA, 20 bp, Artificial
  CRISPR gRNA sequence
agggcagcattcgggcaaac

SEQ ID NO: 509261 - DNA, 20 bp, Artificial
  CRISPR gRNA sequence
cattcgggcaaacaggtgcc

SEQ ID NO: 509262 - DNA, 20 bp, Artificial
  CRISPR gRNA sequence
tgcctggccactgtcacctc

SEQ ID NO: 509263 - DNA, 20 bp, Artificial
  CRISPR gRNA sequence
actgtcacctctggtgccct

SEQ ID NO: 509264 - DNA, 20 bp, Artificial
  CRISPR gRNA sequence
ctgtcacctctggtgccctg

SEQ ID NO: 509265 - DNA, 20 bp, Artificial
  CRISPR gRNA sequence
acctctggtgccctgaggct

SEQ ID NO: 509266 - DNA, 20 bp, Artificial
  CRISPR gRNA sequence
ctggtgccctgaggctaagc

SEQ ID NO: 509267 - DNA, 20 bp, Artificial
  CRISPR gRNA sequence
gtgccctgaggctaagccgg

SEQ ID NO: 509268 - DNA, 20 bp, Artificial
  CRISPR gRNA sequence
gccctgaggctaagccggca

SEQ ID NO: 509269 - DNA, 20 bp, Artificial
  CRISPR gRNA sequence
aggctaagccggcagagctg

SEQ ID NO: 509270 - DNA, 20 bp, Artificial
  CRISPR gRNA sequence
ggctaagccggcagagctgc

SEQ ID NO: 509271 - DNA, 20 bp, Artificial
  CRISPR gRNA sequence
gctaagccggcagagctgca

SEQ ID NO: 509272 - DNA, 20 bp, Artificial
  CRISPR gRNA sequence
aagccggcagagctgcaggg

SEQ ID NO: 509273 - DNA, 20 bp, Artificial
  CRISPR gRNA sequence
agccggcagagctgcagggc

SEQ ID NO: 509274 - DNA, 20 bp, Artificial
  CRISPR gRNA sequence
ccggcagagctgcagggcag

SEQ ID NO: 509275 - DNA, 20 bp, Artificial
  CRISPR gRNA sequence
cggcagagctgcagggcagg

SEQ ID NO: 509276 - DNA, 20 bp, Artificial
  CRISPR gRNA sequence
ggcagagctgcagggcagga

SEQ ID NO: 509277 - DNA, 20 bp, Artificial
  CRISPR gRNA sequence
gcagagctgcagggcaggag

SEQ ID NO: 509278 - DNA, 20 bp, Artificial
  CRISPR gRNA sequence
agagctgcagggcaggaggg

SEQ ID NO: 509279 - DNA, 20 bp, Artificial
  CRISPR gRNA sequence
gagctgcagggcaggagggg

SEQ ID NO: 509280 - DNA, 20 bp, Artificial
  CRISPR gRNA sequence
ctgcagggcaggaggggagg

SEQ ID NO: 509281 - DNA, 20 bp, Artificial
  CRISPR gRNA sequence
gcagggcaggaggggaggaa

SEQ ID NO: 509282 - DNA, 20 bp, Artificial
  CRISPR gRNA sequence
gcaggaggggaggaagagca

SEQ ID NO: 509283 - DNA, 20 bp, Artificial
  CRISPR gRNA sequence
agcacagacaccccccaccc

SEQ ID NO: 509284 - DNA, 20 bp, Artificial
  CRISPR gRNA sequence
caccccccaccccagcccct

SEQ ID NO: 509285 - DNA, 20 bp, Artificial
  CRISPR gRNA sequence
ccccaccccagcccctgagc

SEQ ID NO: 509286 - DNA, 20 bp, Artificial
  CRISPR gRNA sequence
cccagcccctgagctggccc

SEQ ID NO: 509287 - DNA, 20 bp, Artificial
  CRISPR gRNA sequence
cagcccctgagctggcccca

SEQ ID NO: 509288 - DNA, 20 bp, Artificial
  CRISPR gRNA sequence
ctgagctggccccagagctc

SEQ ID NO: 509289 - DNA, 20 bp, Artificial
  CRISPR gRNA sequence
ctggccccagagctctggcc

SEQ ID NO: 509290 - DNA, 20 bp, Artificial
  CRISPR gRNA sequence
ggccccagagctctggcctg

SEQ ID NO: 509291 - DNA, 20 bp, Artificial
  CRISPR gRNA sequence
gcctggagcctgatcaccct

SEQ ID NO: 509292 - DNA, 20 bp, Artificial
  CRISPR gRNA sequence
cctggagcctgatcaccctg

SEQ ID NO: 509293 - DNA, 20 bp, Artificial
  CRISPR gRNA sequence
ccctccctgctgccccacac

SEQ ID NO: 509294 - DNA, 20 bp, Artificial
  CRISPR gRNA sequence
cctccctgctgccccacact

SEQ ID NO: 509295 - DNA, 20 bp, Artificial
  CRISPR gRNA sequence
ctccctgctgccccacactg

SEQ ID NO: 509296 - DNA, 20 bp, Artificial
  CRISPR gRNA sequence
tccctgctgccccacactgg

SEQ ID NO: 509297 - DNA, 20 bp, Artificial
  CRISPR gRNA sequence
ctgctgccccacactggggg

SEQ ID NO: 509298 - DNA, 20 bp, Artificial
  CRISPR gRNA sequence
tgctgccccacactgggggc

SEQ ID NO: 509299 - DNA, 20 bp, Artificial
  CRISPR gRNA sequence
aggtgccctcctcattctcc

SEQ ID NO: 509300 - DNA, 20 bp, Artificial
  CRISPR gRNA sequence
ggtgccctcctcattctcca

SEQ ID NO: 509301 - DNA, 20 bp, Artificial
  CRISPR gRNA sequence
ccctccctgctgccccacac

SEQ ID NO: 509302 - DNA, 20 bp, Artificial
  CRISPR gRNA sequence
cctccctgctgccccacacc

SEQ ID NO: 509303 - DNA, 20 bp, Artificial
  CRISPR gRNA sequence
ctccctgctgccccacacca

SEQ ID NO: 509304 - DNA, 20 bp, Artificial
  CRISPR gRNA sequence
tccctgctgccccacaccag

SEQ ID NO: 509305 - DNA, 20 bp, Artificial
  CRISPR gRNA sequence
ctgctgccccacaccagggg

SEQ ID NO: 509306 - DNA, 20 bp, Artificial
  CRISPR gRNA sequence
tgctgccccacaccaggggc

SEQ ID NO: 509307 - DNA, 20 bp, Artificial
  CRISPR gRNA sequence
cgggtgccctcctcatcctc

SEQ ID NO: 509308 - DNA, 20 bp, Artificial
  CRISPR gRNA sequence
ccctcctcatcctccagctc

SEQ ID NO: 509309 - DNA, 20 bp, Artificial
  CRISPR gRNA sequence
gctctggacatcccccatct

SEQ ID NO: 509310 - DNA, 20 bp, Artificial
  CRISPR gRNA sequence
ctctggacatcccccatcta

SEQ ID NO: 509311 - DNA, 20 bp, Artificial
  CRISPR gRNA sequence
tctggacatcccccatctaa

SEQ ID NO: 509312 - DNA, 20 bp, Artificial
  CRISPR gRNA sequence
ggacatcccccatctaaggg

SEQ ID NO: 509313 - DNA, 20 bp, Artificial
  CRISPR gRNA sequence
gacatcccccatctaagggc

SEQ ID NO: 509314 - DNA, 20 bp, Artificial
  CRISPR gRNA sequence
atcccccatctaagggcggg

SEQ ID NO: 509315 - DNA, 20 bp, Artificial
  CRISPR gRNA sequence
tcccccatctaagggcgggc

SEQ ID NO: 509316 - DNA, 20 bp, Artificial
  CRISPR gRNA sequence
ggcgggcgggtccccttacc

SEQ ID NO: 509317 - DNA, 20 bp, Artificial
  CRISPR gRNA sequence
gggtccccttaccaagacct

SEQ ID NO: 509318 - DNA, 20 bp, Artificial
  CRISPR gRNA sequence
ggtccccttaccaagaccta

SEQ ID NO: 509319 - DNA, 20 bp, Artificial
  CRISPR gRNA sequence
gacctaaggtgcaaaaccca

SEQ ID NO: 509320 - DNA, 20 bp, Artificial
  CRISPR gRNA sequence
aaggtgcaaaacccaaagct

SEQ ID NO: 509321 - DNA, 20 bp, Artificial
  CRISPR gRNA sequence
aggtgcaaaacccaaagctg

SEQ ID NO: 509322 - DNA, 20 bp, Artificial
  CRISPR gRNA sequence
aacccaaagctgaggctgct

SEQ ID NO: 509323 - DNA, 20 bp, Artificial
  CRISPR gRNA sequence
acccaaagctgaggctgctt

SEQ ID NO: 509324 - DNA, 20 bp, Artificial
  CRISPR gRNA sequence
tgaggctgcttaggaatcca

SEQ ID NO: 509325 - DNA, 20 bp, Artificial
  CRISPR gRNA sequence
cttaggaatccacagcccca

SEQ ID NO: 509326 - DNA, 20 bp, Artificial
  CRISPR gRNA sequence
ttaggaatccacagccccac

SEQ ID NO: 509327 - DNA, 20 bp, Artificial
  CRISPR gRNA sequence
ccacagccccacaggcctct

SEQ ID NO: 509328 - DNA, 20 bp, Artificial
  CRISPR gRNA sequence
ggcctctcagaaccttgcat

SEQ ID NO: 509329 - DNA, 20 bp, Artificial
  CRISPR gRNA sequence
cctctcagaaccttgcatca

SEQ ID NO: 509330 - DNA, 20 bp, Artificial
  CRISPR gRNA sequence
ccttgacctcaaccctgccc

SEQ ID NO: 509331 - DNA, 20 bp, Artificial
  CRISPR gRNA sequence
tgacctcaaccctgcccgag

SEQ ID NO: 509332 - DNA, 20 bp, Artificial
  CRISPR gRNA sequence
gacctcaaccctgcccgaga

SEQ ID NO: 509333 - DNA, 20 bp, Artificial
  CRISPR gRNA sequence
ctcaaccctgcccgagaagg

SEQ ID NO: 509334 - DNA, 20 bp, Artificial
  CRISPR gRNA sequence
cctgcccgagaaggaagtgc

SEQ ID NO: 509335 - DNA, 20 bp, Artificial
  CRISPR gRNA sequence
aggaagtgctggtgcaaccc

SEQ ID NO: 509336 - DNA, 20 bp, Artificial
  CRISPR gRNA sequence
gtgctggtgcaaccccagcc

SEQ ID NO: 509337 - DNA, 20 bp, Artificial
  CRISPR gRNA sequence
gtgcaaccccagcccagctg

SEQ ID NO: 509338 - DNA, 20 bp, Artificial
  CRISPR gRNA sequence
tgcaaccccagcccagctgc

SEQ ID NO: 509339 - DNA, 20 bp, Artificial
  CRISPR gRNA sequence
aaccccagcccagctgcagg

SEQ ID NO: 509340 - DNA, 20 bp, Artificial
  CRISPR gRNA sequence
cccagcccagctgcaggaag

SEQ ID NO: 509341 - DNA, 20 bp, Artificial
  CRISPR gRNA sequence
aggaagtggtacctgtcacc

SEQ ID NO: 509342 - DNA, 20 bp, Artificial
  CRISPR gRNA sequence
ctgtcaccaagtcccctgca

SEQ ID NO: 509343 - DNA, 20 bp, Artificial
  CRISPR gRNA sequence
tgtcaccaagtcccctgcac

SEQ ID NO: 509344 - DNA, 20 bp, Artificial
  CRISPR gRNA sequence
gtcaccaagtcccctgcaca

SEQ ID NO: 509345 - DNA, 20 bp, Artificial
  CRISPR gRNA sequence
tcaccaagtcccctgcacag

SEQ ID NO: 509346 - DNA, 20 bp, Artificial
  CRISPR gRNA sequence
ccaagtcccctgcacagggg

SEQ ID NO: 509347 - DNA, 20 bp, Artificial
  CRISPR gRNA sequence
agtcccctgcacaggggaag

SEQ ID NO: 509348 - DNA, 20 bp, Artificial
  CRISPR gRNA sequence
gtcccctgcacaggggaagc

SEQ ID NO: 509349 - DNA, 20 bp, Artificial
  CRISPR gRNA sequence
tcccctgcacaggggaagca

SEQ ID NO: 509350 - DNA, 20 bp, Artificial
  CRISPR gRNA sequence
cccctgcacaggggaagcag

SEQ ID NO: 509351 - DNA, 20 bp, Artificial
  CRISPR gRNA sequence
ccctgcacaggggaagcagg

SEQ ID NO: 509352 - DNA, 20 bp, Artificial
  CRISPR gRNA sequence
cacaggggaagcagggggct

SEQ ID NO: 509353 - DNA, 20 bp, Artificial
  CRISPR gRNA sequence
acaggggaagcagggggctg

SEQ ID NO: 509354 - DNA, 20 bp, Artificial
  CRISPR gRNA sequence
caggggaagcagggggctga

SEQ ID NO: 509355 - DNA, 20 bp, Artificial
  CRISPR gRNA sequence
aggggaagcagggggctgag

SEQ ID NO: 509356 - DNA, 20 bp, Artificial
  CRISPR gRNA sequence
ggggaagcagggggctgagg

SEQ ID NO: 509357 - DNA, 20 bp, Artificial
  CRISPR gRNA sequence
gaagcagggggctgaggggg

SEQ ID NO: 509358 - DNA, 20 bp, Artificial
  CRISPR gRNA sequence
aagcagggggctgagggggc

SEQ ID NO: 509359 - DNA, 20 bp, Artificial
  CRISPR gRNA sequence
gggggctgagggggcaggac

SEQ ID NO: 509360 - DNA, 20 bp, Artificial
  CRISPR gRNA sequence
ggggctgagggggcaggacc

SEQ ID NO: 509361 - DNA, 20 bp, Artificial
  CRISPR gRNA sequence
gggctgagggggcaggacca

SEQ ID NO: 509362 - DNA, 20 bp, Artificial
  CRISPR gRNA sequence
ggctgagggggcaggaccag

SEQ ID NO: 509363 - DNA, 20 bp, Artificial
  CRISPR gRNA sequence
gctgagggggcaggaccagg

SEQ ID NO: 509364 - DNA, 20 bp, Artificial
  CRISPR gRNA sequence
gggggcaggaccagggggac

SEQ ID NO: 509365 - DNA, 20 bp, Artificial
  CRISPR gRNA sequence
ggggcaggaccagggggacg

SEQ ID NO: 509366 - DNA, 20 bp, Artificial
  CRISPR gRNA sequence
gggacgaggtcatccttccc

SEQ ID NO: 509367 - DNA, 20 bp, Artificial
  CRISPR gRNA sequence
gacgaggtcatccttccccg

SEQ ID NO: 509368 - DNA, 20 bp, Artificial
  CRISPR gRNA sequence
tccttccccggagaacccct

SEQ ID NO: 509369 - DNA, 20 bp, Artificial
  CRISPR gRNA sequence
ccttccccggagaacccctc

SEQ ID NO: 509370 - DNA, 20 bp, Artificial
  CRISPR gRNA sequence
cttccccggagaacccctca

SEQ ID NO: 509371 - DNA, 20 bp, Artificial
  CRISPR gRNA sequence
ttccccggagaacccctcag

SEQ ID NO: 509372 - DNA, 20 bp, Artificial
  CRISPR gRNA sequence
ccggagaacccctcaggggc

SEQ ID NO: 509373 - DNA, 20 bp, Artificial
  CRISPR gRNA sequence
cggagaacccctcaggggcc

SEQ ID NO: 509374 - DNA, 20 bp, Artificial
  CRISPR gRNA sequence
ggccgggcgcccttccctcc

SEQ ID NO: 509375 - DNA, 20 bp, Artificial
  CRISPR gRNA sequence
gccgggcgcccttccctccc

SEQ ID NO: 509376 - DNA, 20 bp, Artificial
  CRISPR gRNA sequence
cttccctcccgggcaccaaa

SEQ ID NO: 509377 - DNA, 20 bp, Artificial
  CRISPR gRNA sequence
tcccgggcaccaaatggaca

SEQ ID NO: 509378 - DNA, 20 bp, Artificial
  CRISPR gRNA sequence
accaaatggacacagctaac

SEQ ID NO: 509379 - DNA, 20 bp, Artificial
  CRISPR gRNA sequence
ctaacaagaaccacacttca

SEQ ID NO: 509380 - DNA, 20 bp, Artificial
  CRISPR gRNA sequence
caagaaccacacttcacggt

SEQ ID NO: 509381 - DNA, 20 bp, Artificial
  CRISPR gRNA sequence
accacacttcacggtgagca

SEQ ID NO: 509382 - DNA, 20 bp, Artificial
  CRISPR gRNA sequence
tgagcaaagctctgaacatt

SEQ ID NO: 509383 - DNA, 20 bp, Artificial
  CRISPR gRNA sequence
gagcaaagctctgaacattc

SEQ ID NO: 509384 - DNA, 20 bp, Artificial
  CRISPR gRNA sequence
gctctgaacattcaggctct

SEQ ID NO: 509385 - DNA, 20 bp, Artificial
  CRISPR gRNA sequence
attcaggctctgagacacga

SEQ ID NO: 509386 - DNA, 20 bp, Artificial
  CRISPR gRNA sequence
caggctctgagacacgaaag

SEQ ID NO: 509387 - DNA, 20 bp, Artificial
  CRISPR gRNA sequence
ctgagacacgaaagcggcgt

SEQ ID NO: 509388 - DNA, 20 bp, Artificial
  CRISPR gRNA sequence
agacacgaaagcggcgtcag

SEQ ID NO: 509389 - DNA, 20 bp, Artificial
  CRISPR gRNA sequence
acacgaaagcggcgtcagaa

SEQ ID NO: 509390 - DNA, 20 bp, Artificial
  CRISPR gRNA sequence
gcggcgtcagaagagacctg

SEQ ID NO: 509391 - DNA, 20 bp, Artificial
  CRISPR gRNA sequence
gcgtcagaagagacctgcag

SEQ ID NO: 509392 - DNA, 20 bp, Artificial
  CRISPR gRNA sequence
gaagagacctgcagcagatc

SEQ ID NO: 509393 - DNA, 20 bp, Artificial
  CRISPR gRNA sequence
aagagacctgcagcagatcc

SEQ ID NO: 509394 - DNA, 20 bp, Artificial
  CRISPR gRNA sequence
aaatcacacacaccctttca

SEQ ID NO: 509395 - DNA, 20 bp, Artificial
  CRISPR gRNA sequence
tcacacacaccctttcacag

SEQ ID NO: 509396 - DNA, 20 bp, Artificial
  CRISPR gRNA sequence
cacaccctttcacagaagtc

SEQ ID NO: 509397 - DNA, 20 bp, Artificial
  CRISPR gRNA sequence
acaccctttcacagaagtcg

SEQ ID NO: 509398 - DNA, 20 bp, Artificial
  CRISPR gRNA sequence
cctttcacagaagtcgagga

SEQ ID NO: 509399 - DNA, 20 bp, Artificial
  CRISPR gRNA sequence
ctttcacagaagtcgaggac

SEQ ID NO: 509400 - DNA, 20 bp, Artificial
  CRISPR gRNA sequence
ttcacagaagtcgaggacag

SEQ ID NO: 509401 - DNA, 20 bp, Artificial
  CRISPR gRNA sequence
agaagtcgaggacaggagaa

SEQ ID NO: 509402 - DNA, 20 bp, Artificial
  CRISPR gRNA sequence
gaagtcgaggacaggagaac

SEQ ID NO: 509403 - DNA, 20 bp, Artificial
  CRISPR gRNA sequence
agtcgaggacaggagaacag

SEQ ID NO: 509404 - DNA, 20 bp, Artificial
  CRISPR gRNA sequence
caggagaacaggagcaaaca

SEQ ID NO: 509405 - DNA, 20 bp, Artificial
  CRISPR gRNA sequence
aggagaacaggagcaaacac

SEQ ID NO: 509406 - DNA, 20 bp, Artificial
  CRISPR gRNA sequence
gaacaggagcaaacacagga

SEQ ID NO: 509407 - DNA, 20 bp, Artificial
  CRISPR gRNA sequence
aacaggagcaaacacaggaa

SEQ ID NO: 509408 - DNA, 20 bp, Artificial
  CRISPR gRNA sequence
aggagcaaacacaggaaagg

SEQ ID NO: 509409 - DNA, 20 bp, Artificial
  CRISPR gRNA sequence
gagcaaacacaggaaaggaa

SEQ ID NO: 509410 - DNA, 20 bp, Artificial
  CRISPR gRNA sequence
agcaaacacaggaaaggaag

SEQ ID NO: 509411 - DNA, 20 bp, Artificial
  CRISPR gRNA sequence
aacacaggaaaggaagaggc

SEQ ID NO: 509412 - DNA, 20 bp, Artificial
  CRISPR gRNA sequence
aggaaaggaagaggccagcc

SEQ ID NO: 509413 - DNA, 20 bp, Artificial
  CRISPR gRNA sequence
aaaggaagaggccagcctgg

SEQ ID NO: 509414 - DNA, 20 bp, Artificial
  CRISPR gRNA sequence
gtggctgacgcctgcaatcc

SEQ ID NO: 509415 - DNA, 20 bp, Artificial
  CRISPR gRNA sequence
gcctgcaatcccagtgtttt

SEQ ID NO: 509416 - DNA, 20 bp, Artificial
  CRISPR gRNA sequence
ctgcaatcccagtgttttga

SEQ ID NO: 509417 - DNA, 20 bp, Artificial
  CRISPR gRNA sequence
tgcaatcccagtgttttgag

SEQ ID NO: 509418 - DNA, 20 bp, Artificial
  CRISPR gRNA sequence
tcccagtgttttgagaggcc

SEQ ID NO: 509419 - DNA, 20 bp, Artificial
  CRISPR gRNA sequence
cccagtgttttgagaggcca

SEQ ID NO: 509420 - DNA, 20 bp, Artificial
  CRISPR gRNA sequence
agtgttttgagaggccaagg

SEQ ID NO: 509421 - DNA, 20 bp, Artificial
  CRISPR gRNA sequence
gtgttttgagaggccaaggc

SEQ ID NO: 509422 - DNA, 20 bp, Artificial
  CRISPR gRNA sequence
gttttgagaggccaaggcag

SEQ ID NO: 509423 - DNA, 20 bp, Artificial
  CRISPR gRNA sequence
ccaaggcaggagaatcactt

SEQ ID NO: 509424 - DNA, 20 bp, Artificial
  CRISPR gRNA sequence
caaggcaggagaatcacttg

SEQ ID NO: 509425 - DNA, 20 bp, Artificial
  CRISPR gRNA sequence
gcaggagaatcacttgaggc

SEQ ID NO: 509426 - DNA, 20 bp, Artificial
  CRISPR gRNA sequence
caggagaatcacttgaggcc

SEQ ID NO: 509427 - DNA, 20 bp, Artificial
  CRISPR gRNA sequence
ggagaatcacttgaggccag

SEQ ID NO: 509428 - DNA, 20 bp, Artificial
  CRISPR gRNA sequence
tcacttgaggccaggagttt

SEQ ID NO: 509429 - DNA, 20 bp, Artificial
  CRISPR gRNA sequence
acttgaggccaggagtttga

SEQ ID NO: 509430 - DNA, 20 bp, Artificial
  CRISPR gRNA sequence
tgaggccaggagtttgagag

SEQ ID NO: 509431 - DNA, 20 bp, Artificial
  CRISPR gRNA sequence
ccaggagtttgagagcagcc

SEQ ID NO: 509432 - DNA, 20 bp, Artificial
  CRISPR gRNA sequence
caggagtttgagagcagcct

SEQ ID NO: 509433 - DNA, 20 bp, Artificial
  CRISPR gRNA sequence
tgagagcagcctgggcaaca

SEQ ID NO: 509434 - DNA, 20 bp, Artificial
  CRISPR gRNA sequence
agcagcctgggcaacacagt

SEQ ID NO: 509435 - DNA, 20 bp, Artificial
  CRISPR gRNA sequence
acctctacaaaaaataaaaa

SEQ ID NO: 509436 - DNA, 20 bp, Artificial
  CRISPR gRNA sequence
aataaaaatagaaaataaat

SEQ ID NO: 509437 - DNA, 20 bp, Artificial
  CRISPR gRNA sequence
aaaatagaaaataaattagc

SEQ ID NO: 509438 - DNA, 20 bp, Artificial
  CRISPR gRNA sequence
gaaaataaattagccagaca

SEQ ID NO: 509439 - DNA, 20 bp, Artificial
  CRISPR gRNA sequence
aataaattagccagacatgg

SEQ ID NO: 509440 - DNA, 20 bp, Artificial
  CRISPR gRNA sequence
gacatggtggcatgcatctc

SEQ ID NO: 509441 - DNA, 20 bp, Artificial
  CRISPR gRNA sequence
gtggcatgcatctctagtcc

SEQ ID NO: 509442 - DNA, 20 bp, Artificial
  CRISPR gRNA sequence
catctctagtcccagttact

SEQ ID NO: 509443 - DNA, 20 bp, Artificial
  CRISPR gRNA sequence
atctctagtcccagttactc

SEQ ID NO: 509444 - DNA, 20 bp, Artificial
  CRISPR gRNA sequence
ctctagtcccagttactcag

SEQ ID NO: 509445 - DNA, 20 bp, Artificial
  CRISPR gRNA sequence
tctagtcccagttactcagg

SEQ ID NO: 509446 - DNA, 20 bp, Artificial
  CRISPR gRNA sequence
tcccagttactcaggaggct

SEQ ID NO: 509447 - DNA, 20 bp, Artificial
  CRISPR gRNA sequence
cccagttactcaggaggctg

SEQ ID NO: 509448 - DNA, 20 bp, Artificial
  CRISPR gRNA sequence
agttactcaggaggctgagg

SEQ ID NO: 509449 - DNA, 20 bp, Artificial
  CRISPR gRNA sequence
gttactcaggaggctgaggc

SEQ ID NO: 509450 - DNA, 20 bp, Artificial
  CRISPR gRNA sequence
tactcaggaggctgaggcag

SEQ ID NO: 509451 - DNA, 20 bp, Artificial
  CRISPR gRNA sequence
actcaggaggctgaggcagg

SEQ ID NO: 509452 - DNA, 20 bp, Artificial
  CRISPR gRNA sequence
gcaggaggatcactcgcgcc

SEQ ID NO: 509453 - DNA, 20 bp, Artificial
  CRISPR gRNA sequence
caggaggatcactcgcgccc

SEQ ID NO: 509454 - DNA, 20 bp, Artificial
  CRISPR gRNA sequence
ggaggatcactcgcgcccag

SEQ ID NO: 509455 - DNA, 20 bp, Artificial
  CRISPR gRNA sequence
gaggatcactcgcgcccagg

SEQ ID NO: 509456 - DNA, 20 bp, Artificial
  CRISPR gRNA sequence
aggatcactcgcgcccagga

SEQ ID NO: 509457 - DNA, 20 bp, Artificial
  CRISPR gRNA sequence
gatcactcgcgcccaggagg

SEQ ID NO: 509458 - DNA, 20 bp, Artificial
  CRISPR gRNA sequence
tcactcgcgcccaggaggga

SEQ ID NO: 509459 - DNA, 20 bp, Artificial
  CRISPR gRNA sequence
cgcccaggagggagagactg

SEQ ID NO: 509460 - DNA, 20 bp, Artificial
  CRISPR gRNA sequence
gagactgcagtgaaccctaa

SEQ ID NO: 509461 - DNA, 20 bp, Artificial
  CRISPR gRNA sequence
ctaatggcactgctgaactc

SEQ ID NO: 509462 - DNA, 20 bp, Artificial
  CRISPR gRNA sequence
ggcactgctgaactccagcc

SEQ ID NO: 509463 - DNA, 20 bp, Artificial
  CRISPR gRNA sequence
ctgaactccagcctagttga

SEQ ID NO: 509464 - DNA, 20 bp, Artificial
  CRISPR gRNA sequence
tccagcctagttgacagaac

SEQ ID NO: 509465 - DNA, 20 bp, Artificial
  CRISPR gRNA sequence
ccagcctagttgacagaacg

SEQ ID NO: 509466 - DNA, 20 bp, Artificial
  CRISPR gRNA sequence
aggccctgtctcaaaaaaaa

SEQ ID NO: 509467 - DNA, 20 bp, Artificial
  CRISPR gRNA sequence
ctgtctcaaaaaaaaaagaa

SEQ ID NO: 509468 - DNA, 20 bp, Artificial
  CRISPR gRNA sequence
caaaaaaaaaagaaaagaaa

SEQ ID NO: 509469 - DNA, 20 bp, Artificial
  CRISPR gRNA sequence
aaaaaaagaaaagaaaaaga

SEQ ID NO: 509470 - DNA, 20 bp, Artificial
  CRISPR gRNA sequence
aaaaaagaaaagaaaaagaa

SEQ ID NO: 509471 - DNA, 20 bp, Artificial
  CRISPR gRNA sequence
agaaaaagaaaggaaacttt

SEQ ID NO: 509472 - DNA, 20 bp, Artificial
  CRISPR gRNA sequence
aaagaaaggaaactttaagc

SEQ ID NO: 509473 - DNA, 20 bp, Artificial
  CRISPR gRNA sequence
aaaggaaactttaagcaaga

SEQ ID NO: 509474 - DNA, 20 bp, Artificial
  CRISPR gRNA sequence
ggaaactttaagcaagacag

SEQ ID NO: 509475 - DNA, 20 bp, Artificial
  CRISPR gRNA sequence
aaactttaagcaagacagca

SEQ ID NO: 509476 - DNA, 20 bp, Artificial
  CRISPR gRNA sequence
actttaagcaagacagcaga

SEQ ID NO: 509477 - DNA, 20 bp, Artificial
  CRISPR gRNA sequence
tttaagcaagacagcagaga

SEQ ID NO: 509478 - DNA, 20 bp, Artificial
  CRISPR gRNA sequence
ttaagcaagacagcagagag

SEQ ID NO: 509479 - DNA, 20 bp, Artificial
  CRISPR gRNA sequence
taagcaagacagcagagaga

SEQ ID NO: 509480 - DNA, 20 bp, Artificial
  CRISPR gRNA sequence
gcaagacagcagagagaggg

SEQ ID NO: 509481 - DNA, 20 bp, Artificial
  CRISPR gRNA sequence
aagacagcagagagagggca

SEQ ID NO: 509482 - DNA, 20 bp, Artificial
  CRISPR gRNA sequence
agagagggcagagcctatgc

SEQ ID NO: 509483 - DNA, 20 bp, Artificial
  CRISPR gRNA sequence
gagagggcagagcctatgct

SEQ ID NO: 509484 - DNA, 20 bp, Artificial
  CRISPR gRNA sequence
gagggcagagcctatgctgg

SEQ ID NO: 509485 - DNA, 20 bp, Artificial
  CRISPR gRNA sequence
gggcagagcctatgctggga

SEQ ID NO: 509486 - DNA, 20 bp, Artificial
  CRISPR gRNA sequence
ggcagagcctatgctgggag

SEQ ID NO: 509487 - DNA, 20 bp, Artificial
  CRISPR gRNA sequence
cctatgctgggagaggaatc

SEQ ID NO: 509488 - DNA, 20 bp, Artificial
  CRISPR gRNA sequence
atgctgggagaggaatccag

SEQ ID NO: 509489 - DNA, 20 bp, Artificial
  CRISPR gRNA sequence
tgctgggagaggaatccagc

SEQ ID NO: 509490 - DNA, 20 bp, Artificial
  CRISPR gRNA sequence
gctgggagaggaatccagcg

SEQ ID NO: 509491 - DNA, 20 bp, Artificial
  CRISPR gRNA sequence
ggagaggaatccagcggggt

SEQ ID NO: 509492 - DNA, 20 bp, Artificial
  CRISPR gRNA sequence
gagaggaatccagcggggtc

SEQ ID NO: 509493 - DNA, 20 bp, Artificial
  CRISPR gRNA sequence
ggcttcctttttattttttt

SEQ ID NO: 509494 - DNA, 20 bp, Artificial
  CRISPR gRNA sequence
tcctttttatttttttgaga

SEQ ID NO: 509495 - DNA, 20 bp, Artificial
  CRISPR gRNA sequence
ctttttatttttttgagacg

SEQ ID NO: 509496 - DNA, 20 bp, Artificial
  CRISPR gRNA sequence
agacggagttgcgctgtcac

SEQ ID NO: 509497 - DNA, 20 bp, Artificial
  CRISPR gRNA sequence
gagttgcgctgtcaccggcc

SEQ ID NO: 509498 - DNA, 20 bp, Artificial
  CRISPR gRNA sequence
gttgcgctgtcaccggcctg

SEQ ID NO: 509499 - DNA, 20 bp, Artificial
  CRISPR gRNA sequence
gctgtcaccggcctggagtg

SEQ ID NO: 509500 - DNA, 20 bp, Artificial
  CRISPR gRNA sequence
gtcaccggcctggagtgcag

SEQ ID NO: 509501 - DNA, 20 bp, Artificial
  CRISPR gRNA sequence
ggagtgcagtggcgcgatct

SEQ ID NO: 509502 - DNA, 20 bp, Artificial
  CRISPR gRNA sequence
gcgcgatctcagctcactgc

SEQ ID NO: 509503 - DNA, 20 bp, Artificial
  CRISPR gRNA sequence
tcactgcaagctccgcctcc

SEQ ID NO: 509504 - DNA, 20 bp, Artificial
  CRISPR gRNA sequence
cactgcaagctccgcctccc

SEQ ID NO: 509505 - DNA, 20 bp, Artificial
  CRISPR gRNA sequence
ttcatgccattctcctgcct

SEQ ID NO: 509506 - DNA, 20 bp, Artificial
  CRISPR gRNA sequence
ttctcctgcctcagcttcct

SEQ ID NO: 509507 - DNA, 20 bp, Artificial
  CRISPR gRNA sequence
tcctgcctcagcttcctgag

SEQ ID NO: 509508 - DNA, 20 bp, Artificial
  CRISPR gRNA sequence
gcctcagcttcctgagtagc

SEQ ID NO: 509509 - DNA, 20 bp, Artificial
  CRISPR gRNA sequence
cctcagcttcctgagtagct

SEQ ID NO: 509510 - DNA, 20 bp, Artificial
  CRISPR gRNA sequence
ttcctgagtagctgggacta

SEQ ID NO: 509511 - DNA, 20 bp, Artificial
  CRISPR gRNA sequence
tcctgagtagctgggactac

SEQ ID NO: 509512 - DNA, 20 bp, Artificial
  CRISPR gRNA sequence
caggctcccacgaccacgcc

SEQ ID NO: 509513 - DNA, 20 bp, Artificial
  CRISPR gRNA sequence
agctaatttttttgtgtttt

SEQ ID NO: 509514 - DNA, 20 bp, Artificial
  CRISPR gRNA sequence
taatttttttgtgtttttag

SEQ ID NO: 509515 - DNA, 20 bp, Artificial
  CRISPR gRNA sequence
atttttttgtgtttttagta

SEQ ID NO: 509516 - DNA, 20 bp, Artificial
  CRISPR gRNA sequence
tttgtgtttttagtagagac

SEQ ID NO: 509517 - DNA, 20 bp, Artificial
  CRISPR gRNA sequence
ttgtgtttttagtagagacg

SEQ ID NO: 509518 - DNA, 20 bp, Artificial
  CRISPR gRNA sequence
cgaggtttcatcgtgttgat

SEQ ID NO: 509519 - DNA, 20 bp, Artificial
  CRISPR gRNA sequence
gaggtttcatcgtgttgatc

SEQ ID NO: 509520 - DNA, 20 bp, Artificial
  CRISPR gRNA sequence
tttcatcgtgttgatcagga

SEQ ID NO: 509521 - DNA, 20 bp, Artificial
  CRISPR gRNA sequence
acctcatgatccgcccacct

SEQ ID NO: 509522 - DNA, 20 bp, Artificial
  CRISPR gRNA sequence
ccgcccacctcggcctccca

SEQ ID NO: 509523 - DNA, 20 bp, Artificial
  CRISPR gRNA sequence
acctcggcctcccaaagtgc

SEQ ID NO: 509524 - DNA, 20 bp, Artificial
  CRISPR gRNA sequence
cctcggcctcccaaagtgct

SEQ ID NO: 509525 - DNA, 20 bp, Artificial
  CRISPR gRNA sequence
ctcccaaagtgctgggatta

SEQ ID NO: 509526 - DNA, 20 bp, Artificial
  CRISPR gRNA sequence
tcccaaagtgctgggattac

SEQ ID NO: 509527 - DNA, 20 bp, Artificial
  CRISPR gRNA sequence
agtgctgggattacaggcgt

SEQ ID NO: 509528 - DNA, 20 bp, Artificial
  CRISPR gRNA sequence
caggcgtgagccaccgtgcc

SEQ ID NO: 509529 - DNA, 20 bp, Artificial
  CRISPR gRNA sequence
tgagccaccgtgcccagtct

SEQ ID NO: 509530 - DNA, 20 bp, Artificial
  CRISPR gRNA sequence
gagccaccgtgcccagtctc

SEQ ID NO: 509531 - DNA, 20 bp, Artificial
  CRISPR gRNA sequence
ttgcaaccccgtaaaaccct

SEQ ID NO: 509532 - DNA, 20 bp, Artificial
  CRISPR gRNA sequence
accccgtaaaaccctaagac

SEQ ID NO: 509533 - DNA, 20 bp, Artificial
  CRISPR gRNA sequence
accctaagacgagactgctt

SEQ ID NO: 509534 - DNA, 20 bp, Artificial
  CRISPR gRNA sequence
ccctaagacgagactgcttg

SEQ ID NO: 509535 - DNA, 20 bp, Artificial
  CRISPR gRNA sequence
gacgagactgcttgaggaac

SEQ ID NO: 509536 - DNA, 20 bp, Artificial
  CRISPR gRNA sequence
cgagactgcttgaggaacca

SEQ ID NO: 509537 - DNA, 20 bp, Artificial
  CRISPR gRNA sequence
gagactgcttgaggaaccag

SEQ ID NO: 509538 - DNA, 20 bp, Artificial
  CRISPR gRNA sequence
ttgaggaaccagaggccccg

SEQ ID NO: 509539 - DNA, 20 bp, Artificial
  CRISPR gRNA sequence
cagaggccccgcagacccat

SEQ ID NO: 509540 - DNA, 20 bp, Artificial
  CRISPR gRNA sequence
gacccattggaactttgcat

SEQ ID NO: 509541 - DNA, 20 bp, Artificial
  CRISPR gRNA sequence
cccattggaactttgcatca

SEQ ID NO: 509542 - DNA, 20 bp, Artificial
  CRISPR gRNA sequence
aaacccaccttgcgctgtcc

SEQ ID NO: 509543 - DNA, 20 bp, Artificial
  CRISPR gRNA sequence
acccaccttgcgctgtccta

SEQ ID NO: 509544 - DNA, 20 bp, Artificial
  CRISPR gRNA sequence
cccaccttgcgctgtcctag

SEQ ID NO: 509545 - DNA, 20 bp, Artificial
  CRISPR gRNA sequence
caccttgcgctgtcctagag

SEQ ID NO: 509546 - DNA, 20 bp, Artificial
  CRISPR gRNA sequence
ccttgcgctgtcctagagga

SEQ ID NO: 509547 - DNA, 20 bp, Artificial
  CRISPR gRNA sequence
cttgcgctgtcctagaggag

SEQ ID NO: 509548 - DNA, 20 bp, Artificial
  CRISPR gRNA sequence
gaggagaggcactcgcatca

SEQ ID NO: 509549 - DNA, 20 bp, Artificial
  CRISPR gRNA sequence
gcactcgcatcaaagtgact

SEQ ID NO: 509550 - DNA, 20 bp, Artificial
  CRISPR gRNA sequence
actcgcatcaaagtgactcg

SEQ ID NO: 509551 - DNA, 20 bp, Artificial
  CRISPR gRNA sequence
ctcgcatcaaagtgactcgg

SEQ ID NO: 509552 - DNA, 20 bp, Artificial
  CRISPR gRNA sequence
caaagtgactcggaggtgcg

SEQ ID NO: 509553 - DNA, 20 bp, Artificial
  CRISPR gRNA sequence
aaagtgactcggaggtgcgc

SEQ ID NO: 509554 - DNA, 20 bp, Artificial
  CRISPR gRNA sequence
gtgactcggaggtgcgcggg

SEQ ID NO: 509555 - DNA, 20 bp, Artificial
  CRISPR gRNA sequence
cggaggtgcgcgggaagtga

SEQ ID NO: 509556 - DNA, 20 bp, Artificial
  CRISPR gRNA sequence
gaagtgatggacgatgccgc

SEQ ID NO: 509557 - DNA, 20 bp, Artificial
  CRISPR gRNA sequence
aagtgatggacgatgccgcc

SEQ ID NO: 509558 - DNA, 20 bp, Artificial
  CRISPR gRNA sequence
agtgatggacgatgccgcca

SEQ ID NO: 509559 - DNA, 20 bp, Artificial
  CRISPR gRNA sequence
gtgatggacgatgccgccag

SEQ ID NO: 509560 - DNA, 20 bp, Artificial
  CRISPR gRNA sequence
ggacgatgccgccaggggac

SEQ ID NO: 509561 - DNA, 20 bp, Artificial
  CRISPR gRNA sequence
gacgatgccgccaggggaca

SEQ ID NO: 509562 - DNA, 20 bp, Artificial
  CRISPR gRNA sequence
atgccgccaggggacaaggt

SEQ ID NO: 509563 - DNA, 20 bp, Artificial
  CRISPR gRNA sequence
ccgccaggggacaaggttgg

SEQ ID NO: 509564 - DNA, 20 bp, Artificial
  CRISPR gRNA sequence
cgccaggggacaaggttgga

SEQ ID NO: 509565 - DNA, 20 bp, Artificial
  CRISPR gRNA sequence
caggggacaaggttggaagg

SEQ ID NO: 509566 - DNA, 20 bp, Artificial
  CRISPR gRNA sequence
ggggacaaggttggaaggaa

SEQ ID NO: 509567 - DNA, 20 bp, Artificial
  CRISPR gRNA sequence
gggacaaggttggaaggaag

SEQ ID NO: 509568 - DNA, 20 bp, Artificial
  CRISPR gRNA sequence
aggttggaaggaagaggaca

SEQ ID NO: 509569 - DNA, 20 bp, Artificial
  CRISPR gRNA sequence
ggttggaaggaagaggacat

SEQ ID NO: 509570 - DNA, 20 bp, Artificial
  CRISPR gRNA sequence
ttggaaggaagaggacatgg

SEQ ID NO: 509571 - DNA, 20 bp, Artificial
  CRISPR gRNA sequence
atgggagccaacccctgcgc

SEQ ID NO: 509572 - DNA, 20 bp, Artificial
  CRISPR gRNA sequence
tgggagccaacccctgcgct

SEQ ID NO: 509573 - DNA, 20 bp, Artificial
  CRISPR gRNA sequence
aacccctgcgctgggaactg

SEQ ID NO: 509574 - DNA, 20 bp, Artificial
  CRISPR gRNA sequence
acccctgcgctgggaactga

SEQ ID NO: 509575 - DNA, 20 bp, Artificial
  CRISPR gRNA sequence
gcgctgggaactgaaggctc

SEQ ID NO: 509576 - DNA, 20 bp, Artificial
  CRISPR gRNA sequence
cgctgggaactgaaggctca

SEQ ID NO: 509577 - DNA, 20 bp, Artificial
  CRISPR gRNA sequence
gctgggaactgaaggctcaa

SEQ ID NO: 509578 - DNA, 20 bp, Artificial
  CRISPR gRNA sequence
ctcaagggatgattataaac

SEQ ID NO: 509579 - DNA, 20 bp, Artificial
  CRISPR gRNA sequence
tcaagggatgattataaact

SEQ ID NO: 509580 - DNA, 20 bp, Artificial
  CRISPR gRNA sequence
aaactaggcatccacctttt

SEQ ID NO: 509581 - DNA, 20 bp, Artificial
  CRISPR gRNA sequence
gcatccaccttttaagccaa

SEQ ID NO: 509582 - DNA, 20 bp, Artificial
  CRISPR gRNA sequence
ccaccttttaagccaaaagc

SEQ ID NO: 509583 - DNA, 20 bp, Artificial
  CRISPR gRNA sequence
accttttaagccaaaagcca

SEQ ID NO: 509584 - DNA, 20 bp, Artificial
  CRISPR gRNA sequence
aagccaaaagccagagcatc

SEQ ID NO: 509585 - DNA, 20 bp, Artificial
  CRISPR gRNA sequence
caaaagccagagcatcaaga

SEQ ID NO: 509586 - DNA, 20 bp, Artificial
  CRISPR gRNA sequence
atggactcatttctgctttg

SEQ ID NO: 509587 - DNA, 20 bp, Artificial
  CRISPR gRNA sequence
tggactcatttctgctttgt

SEQ ID NO: 509588 - DNA, 20 bp, Artificial
  CRISPR gRNA sequence
tgctttgtaggaatgtgata

SEQ ID NO: 509589 - DNA, 20 bp, Artificial
  CRISPR gRNA sequence
gtaggaatgtgataaagaac

SEQ ID NO: 509590 - DNA, 20 bp, Artificial
  CRISPR gRNA sequence
aggaatgtgataaagaactg

SEQ ID NO: 509591 - DNA, 20 bp, Artificial
  CRISPR gRNA sequence
gaatgtgataaagaactgga

SEQ ID NO: 509592 - DNA, 20 bp, Artificial
  CRISPR gRNA sequence
tgtgataaagaactggagag

SEQ ID NO: 509593 - DNA, 20 bp, Artificial
  CRISPR gRNA sequence
gaactggagagaagtgccgt

SEQ ID NO: 509594 - DNA, 20 bp, Artificial
  CRISPR gRNA sequence
aactggagagaagtgccgtc

SEQ ID NO: 509595 - DNA, 20 bp, Artificial
  CRISPR gRNA sequence
tggagagaagtgccgtcagg

SEQ ID NO: 509596 - DNA, 20 bp, Artificial
  CRISPR gRNA sequence
ggagagaagtgccgtcaggt

SEQ ID NO: 509597 - DNA, 20 bp, Artificial
  CRISPR gRNA sequence
gagagaagtgccgtcaggtg

SEQ ID NO: 509598 - DNA, 20 bp, Artificial
  CRISPR gRNA sequence
aagtgccgtcaggtggggac

SEQ ID NO: 509599 - DNA, 20 bp, Artificial
  CRISPR gRNA sequence
ggggactggaacactgtcct

SEQ ID NO: 509600 - DNA, 20 bp, Artificial
  CRISPR gRNA sequence
ggaacactgtccttggatca

SEQ ID NO: 509601 - DNA, 20 bp, Artificial
  CRISPR gRNA sequence
aacactgtccttggatcaca

SEQ ID NO: 509602 - DNA, 20 bp, Artificial
  CRISPR gRNA sequence
acactgtccttggatcacag

SEQ ID NO: 509603 - DNA, 20 bp, Artificial
  CRISPR gRNA sequence
tccttggatcacagaggctc

SEQ ID NO: 509604 - DNA, 20 bp, Artificial
  CRISPR gRNA sequence
ccttggatcacagaggctcc

SEQ ID NO: 509605 - DNA, 20 bp, Artificial
  CRISPR gRNA sequence
cacagaggctccaggaaatc

SEQ ID NO: 509606 - DNA, 20 bp, Artificial
  CRISPR gRNA sequence
acagaggctccaggaaatcc

SEQ ID NO: 509607 - DNA, 20 bp, Artificial
  CRISPR gRNA sequence
cagaggctccaggaaatcca

SEQ ID NO: 509608 - DNA, 20 bp, Artificial
  CRISPR gRNA sequence
aggaaatccagggacaaaaa

SEQ ID NO: 509609 - DNA, 20 bp, Artificial
  CRISPR gRNA sequence
ggaaatccagggacaaaaac

SEQ ID NO: 509610 - DNA, 20 bp, Artificial
  CRISPR gRNA sequence
atccagggacaaaaacaggt

SEQ ID NO: 509611 - DNA, 20 bp, Artificial
  CRISPR gRNA sequence
caaaaacaggtcagatcaaa

SEQ ID NO: 509612 - DNA, 20 bp, Artificial
  CRISPR gRNA sequence
aaaaacaggtcagatcaaat

SEQ ID NO: 509613 - DNA, 20 bp, Artificial
  CRISPR gRNA sequence
aggtcagatcaaataggaac

SEQ ID NO: 509614 - DNA, 20 bp, Artificial
  CRISPR gRNA sequence
cagatcaaataggaacaagt

SEQ ID NO: 509615 - DNA, 20 bp, Artificial
  CRISPR gRNA sequence
gatcaaataggaacaagtcg

SEQ ID NO: 509616 - DNA, 20 bp, Artificial
  CRISPR gRNA sequence
caaataggaacaagtcggag

SEQ ID NO: 509617 - DNA, 20 bp, Artificial
  CRISPR gRNA sequence
aataggaacaagtcggagca

SEQ ID NO: 509618 - DNA, 20 bp, Artificial
  CRISPR gRNA sequence
taggaacaagtcggagcaga

SEQ ID NO: 509619 - DNA, 20 bp, Artificial
  CRISPR gRNA sequence
aggaacaagtcggagcagag

SEQ ID NO: 509620 - DNA, 20 bp, Artificial
  CRISPR gRNA sequence
aagtcggagcagagaggatg

SEQ ID NO: 509621 - DNA, 20 bp, Artificial
  CRISPR gRNA sequence
agtcggagcagagaggatgc

SEQ ID NO: 509622 - DNA, 20 bp, Artificial
  CRISPR gRNA sequence
agagaggatgcaggaaaacc

SEQ ID NO: 509623 - DNA, 20 bp, Artificial
  CRISPR gRNA sequence
ctgaacctgcgaccctgcaa

SEQ ID NO: 509624 - DNA, 20 bp, Artificial
  CRISPR gRNA sequence
ctgcaaaagcgtattttccc

SEQ ID NO: 509625 - DNA, 20 bp, Artificial
  CRISPR gRNA sequence
tgcaaaagcgtattttccca

SEQ ID NO: 509626 - DNA, 20 bp, Artificial
  CRISPR gRNA sequence
gcaaaagcgtattttcccaa

SEQ ID NO: 509627 - DNA, 20 bp, Artificial
  CRISPR gRNA sequence
aagcgtattttcccaagggt

SEQ ID NO: 509628 - DNA, 20 bp, Artificial
  CRISPR gRNA sequence
agcgtattttcccaagggtc

SEQ ID NO: 509629 - DNA, 20 bp, Artificial
  CRISPR gRNA sequence
gcgtattttcccaagggtca

SEQ ID NO: 509630 - DNA, 20 bp, Artificial
  CRISPR gRNA sequence
gtattttcccaagggtcagg

SEQ ID NO: 509631 - DNA, 20 bp, Artificial
  CRISPR gRNA sequence
gggagacgtgttcctactgt

SEQ ID NO: 509632 - DNA, 20 bp, Artificial
  CRISPR gRNA sequence
tgttggtttgactatctgtg

SEQ ID NO: 509633 - DNA, 20 bp, Artificial
  CRISPR gRNA sequence
tgactatctgtgaagtttga

SEQ ID NO: 509634 - DNA, 20 bp, Artificial
  CRISPR gRNA sequence
atctgtgaagtttgatagca

SEQ ID NO: 509635 - DNA, 20 bp, Artificial
  CRISPR gRNA sequence
gtttgtttgtttgttttttt

SEQ ID NO: 509636 - DNA, 20 bp, Artificial
  CRISPR gRNA sequence
gtttgtttgtttttttgaga

SEQ ID NO: 509637 - DNA, 20 bp, Artificial
  CRISPR gRNA sequence
ttgtttgtttttttgagatg

SEQ ID NO: 509638 - DNA, 20 bp, Artificial
  CRISPR gRNA sequence
tggagtctcactctgtcatc

SEQ ID NO: 509639 - DNA, 20 bp, Artificial
  CRISPR gRNA sequence
ggagtctcactctgtcatcc

SEQ ID NO: 509640 - DNA, 20 bp, Artificial
  CRISPR gRNA sequence
tctcactctgtcatccaggc

SEQ ID NO: 509641 - DNA, 20 bp, Artificial
  CRISPR gRNA sequence
tcactctgtcatccaggctg

SEQ ID NO: 509642 - DNA, 20 bp, Artificial
  CRISPR gRNA sequence
tcatccaggctggagtgcaa

SEQ ID NO: 509643 - DNA, 20 bp, Artificial
  CRISPR gRNA sequence
ccaggctggagtgcaatggc

SEQ ID NO: 509644 - DNA, 20 bp, Artificial
  CRISPR gRNA sequence
ggagtgcaatggctagatct

SEQ ID NO: 509645 - DNA, 20 bp, Artificial
  CRISPR gRNA sequence
aacctccgcctcccatgttc

SEQ ID NO: 509646 - DNA, 20 bp, Artificial
  CRISPR gRNA sequence
ttcaagaaattcttctgcct

SEQ ID NO: 509647 - DNA, 20 bp, Artificial
  CRISPR gRNA sequence
ttcttctgcctcagcctcct

SEQ ID NO: 509648 - DNA, 20 bp, Artificial
  CRISPR gRNA sequence
ttctgcctcagcctcctgag

SEQ ID NO: 509649 - DNA, 20 bp, Artificial
  CRISPR gRNA sequence
gcctcagcctcctgagtagc

SEQ ID NO: 509650 - DNA, 20 bp, Artificial
  CRISPR gRNA sequence
cctcagcctcctgagtagct

SEQ ID NO: 509651 - DNA, 20 bp, Artificial
  CRISPR gRNA sequence
ctcctgagtagctgggacta

SEQ ID NO: 509652 - DNA, 20 bp, Artificial
  CRISPR gRNA sequence
tcctgagtagctgggactat

SEQ ID NO: 509653 - DNA, 20 bp, Artificial
  CRISPR gRNA sequence
ggactataggtgcacaccac

SEQ ID NO: 509654 - DNA, 20 bp, Artificial
  CRISPR gRNA sequence
gactataggtgcacaccact

SEQ ID NO: 509655 - DNA, 20 bp, Artificial
  CRISPR gRNA sequence
taggtgcacaccactaggcc

SEQ ID NO: 509656 - DNA, 20 bp, Artificial
  CRISPR gRNA sequence
ccagctaatttttgtatttt

SEQ ID NO: 509657 - DNA, 20 bp, Artificial
  CRISPR gRNA sequence
gctaatttttgtatttttag

SEQ ID NO: 509658 - DNA, 20 bp, Artificial
  CRISPR gRNA sequence
taatttttgtatttttagta

SEQ ID NO: 509659 - DNA, 20 bp, Artificial
  CRISPR gRNA sequence
ttttgtatttttagtagaga

SEQ ID NO: 509660 - DNA, 20 bp, Artificial
  CRISPR gRNA sequence
ttgtatttttagtagagatg

SEQ ID NO: 509661 - DNA, 20 bp, Artificial
  CRISPR gRNA sequence
gagatggagtttcaccatat

SEQ ID NO: 509662 - DNA, 20 bp, Artificial
  CRISPR gRNA sequence
tggagtttcaccatattggc

SEQ ID NO: 509663 - DNA, 20 bp, Artificial
  CRISPR gRNA sequence
ggagtttcaccatattggcc

SEQ ID NO: 509664 - DNA, 20 bp, Artificial
  CRISPR gRNA sequence
tttcaccatattggccaggc

SEQ ID NO: 509665 - DNA, 20 bp, Artificial
  CRISPR gRNA sequence
acctcgtgatccgcctgcct

SEQ ID NO: 509666 - DNA, 20 bp, Artificial
  CRISPR gRNA sequence
ccgcctgcctcggcctccca

SEQ ID NO: 509667 - DNA, 20 bp, Artificial
  CRISPR gRNA sequence
gcctcggcctcccaaagtgc

SEQ ID NO: 509668 - DNA, 20 bp, Artificial
  CRISPR gRNA sequence
cctcggcctcccaaagtgct

SEQ ID NO: 509669 - DNA, 20 bp, Artificial
  CRISPR gRNA sequence
ctcccaaagtgctgggatta

SEQ ID NO: 509670 - DNA, 20 bp, Artificial
  CRISPR gRNA sequence
tcccaaagtgctgggattac

SEQ ID NO: 509671 - DNA, 20 bp, Artificial
  CRISPR gRNA sequence
agtgctgggattacaggcgt

SEQ ID NO: 509672 - DNA, 20 bp, Artificial
  CRISPR gRNA sequence
caggcgtgagccactgcgcc

SEQ ID NO: 509673 - DNA, 20 bp, Artificial
  CRISPR gRNA sequence
agccactgcgcccggcctga

SEQ ID NO: 509674 - DNA, 20 bp, Artificial
  CRISPR gRNA sequence
gcctgatagcacaaatttta

SEQ ID NO: 509675 - DNA, 20 bp, Artificial
  CRISPR gRNA sequence
cctgatagcacaaattttaa

SEQ ID NO: 509676 - DNA, 20 bp, Artificial
  CRISPR gRNA sequence
attttaaaggccacaatttc

SEQ ID NO: 509677 - DNA, 20 bp, Artificial
  CRISPR gRNA sequence
ctggccaaatgaaataaaat

SEQ ID NO: 509678 - DNA, 20 bp, Artificial
  CRISPR gRNA sequence
cccgacacacacatattaat

SEQ ID NO: 509679 - DNA, 20 bp, Artificial
  CRISPR gRNA sequence
ccgacacacacatattaata

SEQ ID NO: 509680 - DNA, 20 bp, Artificial
  CRISPR gRNA sequence
catattaataaggaatgcta

SEQ ID NO: 509681 - DNA, 20 bp, Artificial
  CRISPR gRNA sequence
agtactctgctaaatacctg

SEQ ID NO: 509682 - DNA, 20 bp, Artificial
  CRISPR gRNA sequence
ctgctaaatacctgaagtca

SEQ ID NO: 509683 - DNA, 20 bp, Artificial
  CRISPR gRNA sequence
tgctaaatacctgaagtcaa

SEQ ID NO: 509684 - DNA, 20 bp, Artificial
  CRISPR gRNA sequence
gctaaatacctgaagtcaaa

SEQ ID NO: 509685 - DNA, 20 bp, Artificial
  CRISPR gRNA sequence
gggaaatcaaatgatattta

SEQ ID NO: 509686 - DNA, 20 bp, Artificial
  CRISPR gRNA sequence
aaatgatatttacagcattt

SEQ ID NO: 509687 - DNA, 20 bp, Artificial
  CRISPR gRNA sequence
atatttacagcattttagac

SEQ ID NO: 509688 - DNA, 20 bp, Artificial
  CRISPR gRNA sequence
tatttacagcattttagaca

SEQ ID NO: 509689 - DNA, 20 bp, Artificial
  CRISPR gRNA sequence
atttacagcattttagacaa

SEQ ID NO: 509690 - DNA, 20 bp, Artificial
  CRISPR gRNA sequence
tttacagcattttagacaag

SEQ ID NO: 509691 - DNA, 20 bp, Artificial
  CRISPR gRNA sequence
ccactcctccatctaacatg

SEQ ID NO: 509692 - DNA, 20 bp, Artificial
  CRISPR gRNA sequence
cactcctccatctaacatga

SEQ ID NO: 509693 - DNA, 20 bp, Artificial
  CRISPR gRNA sequence
ctcctccatctaacatgaag

SEQ ID NO: 509694 - DNA, 20 bp, Artificial
  CRISPR gRNA sequence
tgaaggagactgtctgttcc

SEQ ID NO: 509695 - DNA, 20 bp, Artificial
  CRISPR gRNA sequence
gaaggagactgtctgttcct

SEQ ID NO: 509696 - DNA, 20 bp, Artificial
  CRISPR gRNA sequence
ggagactgtctgttcctggg

SEQ ID NO: 509697 - DNA, 20 bp, Artificial
  CRISPR gRNA sequence
ctgttcctgggtggcgacgt

SEQ ID NO: 509698 - DNA, 20 bp, Artificial
  CRISPR gRNA sequence
tgttcctgggtggcgacgtg

SEQ ID NO: 509699 - DNA, 20 bp, Artificial
  CRISPR gRNA sequence
ctgggtggcgacgtgaggcc

SEQ ID NO: 509700 - DNA, 20 bp, Artificial
  CRISPR gRNA sequence
tgggtggcgacgtgaggccg

SEQ ID NO: 509701 - DNA, 20 bp, Artificial
  CRISPR gRNA sequence
gcgacgtgaggccgaggccc

SEQ ID NO: 509702 - DNA, 20 bp, Artificial
  CRISPR gRNA sequence
ggccccggacactcttgctg

SEQ ID NO: 509703 - DNA, 20 bp, Artificial
  CRISPR gRNA sequence
cactcttgctgtggacataa

SEQ ID NO: 509704 - DNA, 20 bp, Artificial
  CRISPR gRNA sequence
ttgctgtggacataaaagaa

SEQ ID NO: 509705 - DNA, 20 bp, Artificial
  CRISPR gRNA sequence
aaagaatggccacaaatgtg

SEQ ID NO: 509706 - DNA, 20 bp, Artificial
  CRISPR gRNA sequence
aagaatggccacaaatgtgt

SEQ ID NO: 509707 - DNA, 20 bp, Artificial
  CRISPR gRNA sequence
gccacaaatgtgtaggactt

SEQ ID NO: 509708 - DNA, 20 bp, Artificial
  CRISPR gRNA sequence
aatgtgtaggacttcagttt

SEQ ID NO: 509709 - DNA, 20 bp, Artificial
  CRISPR gRNA sequence
atgtgtaggacttcagtttt

SEQ ID NO: 509710 - DNA, 20 bp, Artificial
  CRISPR gRNA sequence
tgtgtaggacttcagtttta

SEQ ID NO: 509711 - DNA, 20 bp, Artificial
  CRISPR gRNA sequence
ttttagggaataaaacaata

SEQ ID NO: 509712 - DNA, 20 bp, Artificial
  CRISPR gRNA sequence
tttagggaataaaacaataa

SEQ ID NO: 509713 - DNA, 20 bp, Artificial
  CRISPR gRNA sequence
gaataaaacaataaaggaaa

SEQ ID NO: 509714 - DNA, 20 bp, Artificial
  CRISPR gRNA sequence
taaaacaataaaggaaatag

SEQ ID NO: 509715 - DNA, 20 bp, Artificial
  CRISPR gRNA sequence
caataaaggaaatagaagaa

SEQ ID NO: 509716 - DNA, 20 bp, Artificial
  CRISPR gRNA sequence
aataaaggaaatagaagaat

SEQ ID NO: 509717 - DNA, 20 bp, Artificial
  CRISPR gRNA sequence
aaatagaagaataggtatct

SEQ ID NO: 509718 - DNA, 20 bp, Artificial
  CRISPR gRNA sequence
atagaagaataggtatctaa

SEQ ID NO: 509719 - DNA, 20 bp, Artificial
  CRISPR gRNA sequence
aagaataggtatctaagagt

SEQ ID NO: 509720 - DNA, 20 bp, Artificial
  CRISPR gRNA sequence
agaataggtatctaagagta

SEQ ID NO: 509721 - DNA, 20 bp, Artificial
  CRISPR gRNA sequence
atctaagagtaaggaaacct

SEQ ID NO: 509722 - DNA, 20 bp, Artificial
  CRISPR gRNA sequence
gtaaggaaacctcagcataa

SEQ ID NO: 509723 - DNA, 20 bp, Artificial
  CRISPR gRNA sequence
gaaacctcagcataaaagct

SEQ ID NO: 509724 - DNA, 20 bp, Artificial
  CRISPR gRNA sequence
aaacctcagcataaaagcta

SEQ ID NO: 509725 - DNA, 20 bp, Artificial
  CRISPR gRNA sequence
aacctcagcataaaagctaa

SEQ ID NO: 509726 - DNA, 20 bp, Artificial
  CRISPR gRNA sequence
acctcagcataaaagctaag

SEQ ID NO: 509727 - DNA, 20 bp, Artificial
  CRISPR gRNA sequence
ctcagcataaaagctaaggg

SEQ ID NO: 509728 - DNA, 20 bp, Artificial
  CRISPR gRNA sequence
tcagcataaaagctaagggg

SEQ ID NO: 509729 - DNA, 20 bp, Artificial
  CRISPR gRNA sequence
cataaaagctaaggggaggc

SEQ ID NO: 509730 - DNA, 20 bp, Artificial
  CRISPR gRNA sequence
ataaaagctaaggggaggcc

SEQ ID NO: 509731 - DNA, 20 bp, Artificial
  CRISPR gRNA sequence
agctaaggggaggccgggca

SEQ ID NO: 509732 - DNA, 20 bp, Artificial
  CRISPR gRNA sequence
taaggggaggccgggcatgg

SEQ ID NO: 509733 - DNA, 20 bp, Artificial
  CRISPR gRNA sequence
gtggctcatgcctgtaatcc

SEQ ID NO: 509734 - DNA, 20 bp, Artificial
  CRISPR gRNA sequence
tgcctgtaatcccagcactt

SEQ ID NO: 509735 - DNA, 20 bp, Artificial
  CRISPR gRNA sequence
gcctgtaatcccagcacttt

SEQ ID NO: 509736 - DNA, 20 bp, Artificial
  CRISPR gRNA sequence
ctgtaatcccagcactttgg

SEQ ID NO: 509737 - DNA, 20 bp, Artificial
  CRISPR gRNA sequence
tgtaatcccagcactttggg

SEQ ID NO: 509738 - DNA, 20 bp, Artificial
  CRISPR gRNA sequence
tcccagcactttgggaggct

SEQ ID NO: 509739 - DNA, 20 bp, Artificial
  CRISPR gRNA sequence
cccagcactttgggaggctg

SEQ ID NO: 509740 - DNA, 20 bp, Artificial
  CRISPR gRNA sequence
agcactttgggaggctgagg

SEQ ID NO: 509741 - DNA, 20 bp, Artificial
  CRISPR gRNA sequence
gcactttgggaggctgaggc

SEQ ID NO: 509742 - DNA, 20 bp, Artificial
  CRISPR gRNA sequence
ctttgggaggctgaggcagg

SEQ ID NO: 509743 - DNA, 20 bp, Artificial
  CRISPR gRNA sequence
ctgaggcaggcggatcacct

SEQ ID NO: 509744 - DNA, 20 bp, Artificial
  CRISPR gRNA sequence
tgaggcaggcggatcacctg

SEQ ID NO: 509745 - DNA, 20 bp, Artificial
  CRISPR gRNA sequence
gcaggcggatcacctgaggt

SEQ ID NO: 509746 - DNA, 20 bp, Artificial
  CRISPR gRNA sequence
caggcggatcacctgaggtc

SEQ ID NO: 509747 - DNA, 20 bp, Artificial
  CRISPR gRNA sequence
ggcggatcacctgaggtcag

SEQ ID NO: 509748 - DNA, 20 bp, Artificial
  CRISPR gRNA sequence
tcacctgaggtcaggagttt

SEQ ID NO: 509749 - DNA, 20 bp, Artificial
  CRISPR gRNA sequence
tgaggtcaggagtttgagac

SEQ ID NO: 509750 - DNA, 20 bp, Artificial
  CRISPR gRNA sequence
caggagtttgagaccagcct

SEQ ID NO: 509751 - DNA, 20 bp, Artificial
  CRISPR gRNA sequence
tgagaccagcctgagcaaca

SEQ ID NO: 509752 - DNA, 20 bp, Artificial
  CRISPR gRNA sequence
tctactaaaaatacataaat

SEQ ID NO: 509753 - DNA, 20 bp, Artificial
  CRISPR gRNA sequence
ctaaaaatacataaattagc

SEQ ID NO: 509754 - DNA, 20 bp, Artificial
  CRISPR gRNA sequence
taaaaatacataaattagct

SEQ ID NO: 509755 - DNA, 20 bp, Artificial
  CRISPR gRNA sequence
atacataaattagctgggct

SEQ ID NO: 509756 - DNA, 20 bp, Artificial
  CRISPR gRNA sequence
cataaattagctgggcttgg

SEQ ID NO: 509757 - DNA, 20 bp, Artificial
  CRISPR gRNA sequence
aaattagctgggcttggtgg

SEQ ID NO: 509758 - DNA, 20 bp, Artificial
  CRISPR gRNA sequence
aattagctgggcttggtggc

SEQ ID NO: 509759 - DNA, 20 bp, Artificial
  CRISPR gRNA sequence
gtggcgggcgcctgtaatcc

SEQ ID NO: 509760 - DNA, 20 bp, Artificial
  CRISPR gRNA sequence
ctgtaatcccagctactcgc

SEQ ID NO: 509761 - DNA, 20 bp, Artificial
  CRISPR gRNA sequence
tgtaatcccagctactcgcg

SEQ ID NO: 509762 - DNA, 20 bp, Artificial
  CRISPR gRNA sequence
tcccagctactcgcgaggct

SEQ ID NO: 509763 - DNA, 20 bp, Artificial
  CRISPR gRNA sequence
cccagctactcgcgaggctg

SEQ ID NO: 509764 - DNA, 20 bp, Artificial
  CRISPR gRNA sequence
agctactcgcgaggctgagg

SEQ ID NO: 509765 - DNA, 20 bp, Artificial
  CRISPR gRNA sequence
gctactcgcgaggctgaggc

SEQ ID NO: 509766 - DNA, 20 bp, Artificial
  CRISPR gRNA sequence
tactcgcgaggctgaggcag

SEQ ID NO: 509767 - DNA, 20 bp, Artificial
  CRISPR gRNA sequence
ctgaggcaggagaatcactt

SEQ ID NO: 509768 - DNA, 20 bp, Artificial
  CRISPR gRNA sequence
gcaggagaatcacttgagcc

SEQ ID NO: 509769 - DNA, 20 bp, Artificial
  CRISPR gRNA sequence
caggagaatcacttgagccc

SEQ ID NO: 509770 - DNA, 20 bp, Artificial
  CRISPR gRNA sequence
ggagaatcacttgagcccgg

SEQ ID NO: 509771 - DNA, 20 bp, Artificial
  CRISPR gRNA sequence
gagaatcacttgagcccggg

SEQ ID NO: 509772 - DNA, 20 bp, Artificial
  CRISPR gRNA sequence
aatcacttgagcccgggagg

SEQ ID NO: 509773 - DNA, 20 bp, Artificial
  CRISPR gRNA sequence
tcacttgagcccgggaggca

SEQ ID NO: 509774 - DNA, 20 bp, Artificial
  CRISPR gRNA sequence
cacttgagcccgggaggcag

SEQ ID NO: 509775 - DNA, 20 bp, Artificial
  CRISPR gRNA sequence
acttgagcccgggaggcaga

SEQ ID NO: 509776 - DNA, 20 bp, Artificial
  CRISPR gRNA sequence
agcccgggaggcagagggtg

SEQ ID NO: 509777 - DNA, 20 bp, Artificial
  CRISPR gRNA sequence
cgggaggcagagggtgcagt

SEQ ID NO: 509778 - DNA, 20 bp, Artificial
  CRISPR gRNA sequence
ggcagagggtgcagtgagct

SEQ ID NO: 509779 - DNA, 20 bp, Artificial
  CRISPR gRNA sequence
gagatctcacctctgcactc

SEQ ID NO: 509780 - DNA, 20 bp, Artificial
  CRISPR gRNA sequence
ctcacctctgcactccagcc

SEQ ID NO: 509781 - DNA, 20 bp, Artificial
  CRISPR gRNA sequence
tcacctctgcactccagcct

SEQ ID NO: 509782 - DNA, 20 bp, Artificial
  CRISPR gRNA sequence
tgcactccagcctgggcaac

SEQ ID NO: 509783 - DNA, 20 bp, Artificial
  CRISPR gRNA sequence
cactccagcctgggcaacaa

SEQ ID NO: 509784 - DNA, 20 bp, Artificial
  CRISPR gRNA sequence
caagagtgaaactgtctcaa

SEQ ID NO: 509785 - DNA, 20 bp, Artificial
  CRISPR gRNA sequence
tcaaaagaaaaaaaaaaaaa

SEQ ID NO: 509786 - DNA, 20 bp, Artificial
  CRISPR gRNA sequence
agaaaaaaaaaaaaaaagct

SEQ ID NO: 509787 - DNA, 20 bp, Artificial
  CRISPR gRNA sequence
gaaaaaaaaaaaaaaagcta

SEQ ID NO: 509788 - DNA, 20 bp, Artificial
  CRISPR gRNA sequence
aaaaaaaaaaaaaaagctaa

SEQ ID NO: 509789 - DNA, 20 bp, Artificial
  CRISPR gRNA sequence
aaaaaaaaaaaaaagctaag

SEQ ID NO: 509790 - DNA, 20 bp, Artificial
  CRISPR gRNA sequence
aaaaaaaaaaaaagctaagg

SEQ ID NO: 509791 - DNA, 20 bp, Artificial
  CRISPR gRNA sequence
aaaaaagctaagggggaaaa

SEQ ID NO: 509792 - DNA, 20 bp, Artificial
  CRISPR gRNA sequence
aagctaagggggaaaatagc

SEQ ID NO: 509793 - DNA, 20 bp, Artificial
  CRISPR gRNA sequence
ctaagggggaaaatagcaag

SEQ ID NO: 509794 - DNA, 20 bp, Artificial
  CRISPR gRNA sequence
gggggaaaatagcaagaaga

SEQ ID NO: 509795 - DNA, 20 bp, Artificial
  CRISPR gRNA sequence
aagaagacagactctaaaaa

SEQ ID NO: 509796 - DNA, 20 bp, Artificial
  CRISPR gRNA sequence
tgttgtactaacaaattgca

SEQ ID NO: 509797 - DNA, 20 bp, Artificial
  CRISPR gRNA sequence
ttgtactaacaaattgcata

SEQ ID NO: 509798 - DNA, 20 bp, Artificial
  CRISPR gRNA sequence
tgtactaacaaattgcatag

SEQ ID NO: 509799 - DNA, 20 bp, Artificial
  CRISPR gRNA sequence
aacaaattgcatagaggaaa

SEQ ID NO: 509800 - DNA, 20 bp, Artificial
  CRISPR gRNA sequence
ggaaatagctattatctctc

SEQ ID NO: 509801 - DNA, 20 bp, Artificial
  CRISPR gRNA sequence
ctattatctctctagtgcaa

SEQ ID NO: 509802 - DNA, 20 bp, Artificial
  CRISPR gRNA sequence
tattatctctctagtgcaaa

SEQ ID NO: 509803 - DNA, 20 bp, Artificial
  CRISPR gRNA sequence
tctctagtgcaaaaggtaaa

SEQ ID NO: 509804 - DNA, 20 bp, Artificial
  CRISPR gRNA sequence
aatggtaatcttcatctcta

SEQ ID NO: 509805 - DNA, 20 bp, Artificial
  CRISPR gRNA sequence
tggtaatcttcatctctaaa

SEQ ID NO: 509806 - DNA, 20 bp, Artificial
  CRISPR gRNA sequence
cttcatctctaaagagatct

SEQ ID NO: 509807 - DNA, 20 bp, Artificial
  CRISPR gRNA sequence
tcttagaaattaataacaaa

SEQ ID NO: 509808 - DNA, 20 bp, Artificial
  CRISPR gRNA sequence
cttagaaattaataacaaaa

SEQ ID NO: 509809 - DNA, 20 bp, Artificial
  CRISPR gRNA sequence
aaaaggtaaatactccattc

SEQ ID NO: 509810 - DNA, 20 bp, Artificial
  CRISPR gRNA sequence
aaaggtaaatactccattca

SEQ ID NO: 509811 - DNA, 20 bp, Artificial
  CRISPR gRNA sequence
actccattcaaggatgtttc

SEQ ID NO: 509812 - DNA, 20 bp, Artificial
  CRISPR gRNA sequence
ctccattcaaggatgtttca

SEQ ID NO: 509813 - DNA, 20 bp, Artificial
  CRISPR gRNA sequence
tccattcaaggatgtttcaa

SEQ ID NO: 509814 - DNA, 20 bp, Artificial
  CRISPR gRNA sequence
tcaaggatgtttcaagggtg

SEQ ID NO: 509815 - DNA, 20 bp, Artificial
  CRISPR gRNA sequence
tttcaagggtgtggcaccct

SEQ ID NO: 509816 - DNA, 20 bp, Artificial
  CRISPR gRNA sequence
caagggtgtggcaccctgag

SEQ ID NO: 509817 - DNA, 20 bp, Artificial
  CRISPR gRNA sequence
aagggtgtggcaccctgagc

SEQ ID NO: 509818 - DNA, 20 bp, Artificial
  CRISPR gRNA sequence
cctgagcaggtaattcacaa

SEQ ID NO: 509819 - DNA, 20 bp, Artificial
  CRISPR gRNA sequence
gagcaggtaattcacaaaag

SEQ ID NO: 509820 - DNA, 20 bp, Artificial
  CRISPR gRNA sequence
agcaggtaattcacaaaaga

SEQ ID NO: 509821 - DNA, 20 bp, Artificial
  CRISPR gRNA sequence
aggtaattcacaaaagaagg

SEQ ID NO: 509822 - DNA, 20 bp, Artificial
  CRISPR gRNA sequence
cacaaaagaaggaagaaaac

SEQ ID NO: 509823 - DNA, 20 bp, Artificial
  CRISPR gRNA sequence
aagaaggaagaaaactggct

SEQ ID NO: 509824 - DNA, 20 bp, Artificial
  CRISPR gRNA sequence
aaactggctaagaaacatat

SEQ ID NO: 509825 - DNA, 20 bp, Artificial
  CRISPR gRNA sequence
aagaaacatatgagtcaccc

SEQ ID NO: 509826 - DNA, 20 bp, Artificial
  CRISPR gRNA sequence
agaaacatatgagtcacccc

SEQ ID NO: 509827 - DNA, 20 bp, Artificial
  CRISPR gRNA sequence
acatatgagtcaccccagga

SEQ ID NO: 509828 - DNA, 20 bp, Artificial
  CRISPR gRNA sequence
gagtcaccccaggaaagaac

SEQ ID NO: 509829 - DNA, 20 bp, Artificial
  CRISPR gRNA sequence
agtcaccccaggaaagaacc

SEQ ID NO: 509830 - DNA, 20 bp, Artificial
  CRISPR gRNA sequence
gtcaccccaggaaagaacca

SEQ ID NO: 509831 - DNA, 20 bp, Artificial
  CRISPR gRNA sequence
caggaaagaaccagggattt

SEQ ID NO: 509832 - DNA, 20 bp, Artificial
  CRISPR gRNA sequence
aaatatcttgattccctgtg

SEQ ID NO: 509833 - DNA, 20 bp, Artificial
  CRISPR gRNA sequence
ctgtgtagccgtcaacgtgt

SEQ ID NO: 509834 - DNA, 20 bp, Artificial
  CRISPR gRNA sequence
cgtcaacgtgtaagatgctt

SEQ ID NO: 509835 - DNA, 20 bp, Artificial
  CRISPR gRNA sequence
caacgtgtaagatgctttgg

SEQ ID NO: 509836 - DNA, 20 bp, Artificial
  CRISPR gRNA sequence
gtaagatgctttggcggttt

SEQ ID NO: 509837 - DNA, 20 bp, Artificial
  CRISPR gRNA sequence
cggtttcggtgcctgcgcta

SEQ ID NO: 509838 - DNA, 20 bp, Artificial
  CRISPR gRNA sequence
gtttcggtgcctgcgctatg

SEQ ID NO: 509839 - DNA, 20 bp, Artificial
  CRISPR gRNA sequence
ctgcgctatggagtcccaca

SEQ ID NO: 509840 - DNA, 20 bp, Artificial
  CRISPR gRNA sequence
cagcaacgaaaacatgcaaa

SEQ ID NO: 509841 - DNA, 20 bp, Artificial
  CRISPR gRNA sequence
aaaacatgcaaacagctgct

SEQ ID NO: 509842 - DNA, 20 bp, Artificial
  CRISPR gRNA sequence
aaacatgcaaacagctgctc

SEQ ID NO: 509843 - DNA, 20 bp, Artificial
  CRISPR gRNA sequence
aacatgcaaacagctgctca

SEQ ID NO: 509844 - DNA, 20 bp, Artificial
  CRISPR gRNA sequence
atgcaaacagctgctcaggg

SEQ ID NO: 509845 - DNA, 20 bp, Artificial
  CRISPR gRNA sequence
aacagctgctcagggcagct

SEQ ID NO: 509846 - DNA, 20 bp, Artificial
  CRISPR gRNA sequence
ctcagggcagcttggcttcg

SEQ ID NO: 509847 - DNA, 20 bp, Artificial
  CRISPR gRNA sequence
gcagcttggcttcgtggtaa

SEQ ID NO: 509848 - DNA, 20 bp, Artificial
  CRISPR gRNA sequence
tcgtggtaaaagtgaattta

SEQ ID NO: 509849 - DNA, 20 bp, Artificial
  CRISPR gRNA sequence
cgtggtaaaagtgaatttat

SEQ ID NO: 509850 - DNA, 20 bp, Artificial
  CRISPR gRNA sequence
gtggtaaaagtgaatttatg

SEQ ID NO: 509851 - DNA, 20 bp, Artificial
  CRISPR gRNA sequence
agtgaatttatggggaaaaa

SEQ ID NO: 509852 - DNA, 20 bp, Artificial
  CRISPR gRNA sequence
tgaatttatggggaaaaaaa

SEQ ID NO: 509853 - DNA, 20 bp, Artificial
  CRISPR gRNA sequence
aatttatggggaaaaaaaga

SEQ ID NO: 509854 - DNA, 20 bp, Artificial
  CRISPR gRNA sequence
tggggaaaaaaagagagaca

SEQ ID NO: 509855 - DNA, 20 bp, Artificial
  CRISPR gRNA sequence
caaaatattctgcatttctc

SEQ ID NO: 509856 - DNA, 20 bp, Artificial
  CRISPR gRNA sequence
aaaatattctgcatttctct

SEQ ID NO: 509857 - DNA, 20 bp, Artificial
  CRISPR gRNA sequence
atattctgcatttctctggg

SEQ ID NO: 509858 - DNA, 20 bp, Artificial
  CRISPR gRNA sequence
ttctgcatttctctgggtgg

SEQ ID NO: 509859 - DNA, 20 bp, Artificial
  CRISPR gRNA sequence
tctctgggtggtggcactat

SEQ ID NO: 509860 - DNA, 20 bp, Artificial
  CRISPR gRNA sequence
ctttttgtgataaatgaata

SEQ ID NO: 509861 - DNA, 20 bp, Artificial
  CRISPR gRNA sequence
tttttgtgataaatgaataa

SEQ ID NO: 509862 - DNA, 20 bp, Artificial
  CRISPR gRNA sequence
aataaaggacattttaaaaa

SEQ ID NO: 509863 - DNA, 20 bp, Artificial
  CRISPR gRNA sequence
attttaaaaatggaatttca

SEQ ID NO: 509864 - DNA, 20 bp, Artificial
  CRISPR gRNA sequence
ttaaaaatggaatttcatgg

SEQ ID NO: 509865 - DNA, 20 bp, Artificial
  CRISPR gRNA sequence
ttatgctgaaattgctcctt

SEQ ID NO: 509866 - DNA, 20 bp, Artificial
  CRISPR gRNA sequence
aattgctccttcggattcca

SEQ ID NO: 509867 - DNA, 20 bp, Artificial
  CRISPR gRNA sequence
ccttcggattccaaagctac

SEQ ID NO: 509868 - DNA, 20 bp, Artificial
  CRISPR gRNA sequence
gttcccactgtgacgttgat

SEQ ID NO: 509869 - DNA, 20 bp, Artificial
  CRISPR gRNA sequence
ttcccactgtgacgttgatg

SEQ ID NO: 509870 - DNA, 20 bp, Artificial
  CRISPR gRNA sequence
ttgatgaggacgctgcttca

SEQ ID NO: 509871 - DNA, 20 bp, Artificial
  CRISPR gRNA sequence
atgaggacgctgcttcatgg

SEQ ID NO: 509872 - DNA, 20 bp, Artificial
  CRISPR gRNA sequence
aggacgctgcttcatggcag

SEQ ID NO: 509873 - DNA, 20 bp, Artificial
  CRISPR gRNA sequence
ggacgctgcttcatggcagt

SEQ ID NO: 509874 - DNA, 20 bp, Artificial
  CRISPR gRNA sequence
tggcagtgggacctccctgc

SEQ ID NO: 509875 - DNA, 20 bp, Artificial
  CRISPR gRNA sequence
gtgggacctccctgctggca

SEQ ID NO: 509876 - DNA, 20 bp, Artificial
  CRISPR gRNA sequence
tgggacctccctgctggcat

SEQ ID NO: 509877 - DNA, 20 bp, Artificial
  CRISPR gRNA sequence
ctcacccattcacccatcca

SEQ ID NO: 509878 - DNA, 20 bp, Artificial
  CRISPR gRNA sequence
tcacccattcacccatccat

SEQ ID NO: 509879 - DNA, 20 bp, Artificial
  CRISPR gRNA sequence
ccattcacccatccatggga

SEQ ID NO: 509880 - DNA, 20 bp, Artificial
  CRISPR gRNA sequence
cattcacccatccatgggac

SEQ ID NO: 509881 - DNA, 20 bp, Artificial
  CRISPR gRNA sequence
attcacccatccatgggaca

SEQ ID NO: 509882 - DNA, 20 bp, Artificial
  CRISPR gRNA sequence
ttcacccatccatgggacag

SEQ ID NO: 509883 - DNA, 20 bp, Artificial
  CRISPR gRNA sequence
tccatgggacaggggcttgc

SEQ ID NO: 509884 - DNA, 20 bp, Artificial
  CRISPR gRNA sequence
gggcttgccagcctctcctc

SEQ ID NO: 509885 - DNA, 20 bp, Artificial
  CRISPR gRNA sequence
ggcttgccagcctctcctct

SEQ ID NO: 509886 - DNA, 20 bp, Artificial
  CRISPR gRNA sequence
gccagcctctcctctaggca

SEQ ID NO: 509887 - DNA, 20 bp, Artificial
  CRISPR gRNA sequence
cctctcctctaggcacggcg

SEQ ID NO: 509888 - DNA, 20 bp, Artificial
  CRISPR gRNA sequence
ctctcctctaggcacggcgc

SEQ ID NO: 509889 - DNA, 20 bp, Artificial
  CRISPR gRNA sequence
tctcctctaggcacggcgca

SEQ ID NO: 509890 - DNA, 20 bp, Artificial
  CRISPR gRNA sequence
ctcctctaggcacggcgcag

SEQ ID NO: 509891 - DNA, 20 bp, Artificial
  CRISPR gRNA sequence
ctaggcacggcgcaggggct

SEQ ID NO: 509892 - DNA, 20 bp, Artificial
  CRISPR gRNA sequence
aggcacggcgcaggggctga

SEQ ID NO: 509893 - DNA, 20 bp, Artificial
  CRISPR gRNA sequence
aggggctgagagctgcactc

SEQ ID NO: 509894 - DNA, 20 bp, Artificial
  CRISPR gRNA sequence
ggggctgagagctgcactcc

SEQ ID NO: 509895 - DNA, 20 bp, Artificial
  CRISPR gRNA sequence
gagctgcactccaggactcc

SEQ ID NO: 509896 - DNA, 20 bp, Artificial
  CRISPR gRNA sequence
cctggactctgccctctgct

SEQ ID NO: 509897 - DNA, 20 bp, Artificial
  CRISPR gRNA sequence
ctgccctctgctgagactct

SEQ ID NO: 509898 - DNA, 20 bp, Artificial
  CRISPR gRNA sequence
ttttccccaacacctacccc

SEQ ID NO: 509899 - DNA, 20 bp, Artificial
  CRISPR gRNA sequence
ccccaagtttccatcacaca

SEQ ID NO: 509900 - DNA, 20 bp, Artificial
  CRISPR gRNA sequence
ccaacaccaacatgtgtccc

SEQ ID NO: 509901 - DNA, 20 bp, Artificial
  CRISPR gRNA sequence
caccaacatgtgtccccagc

SEQ ID NO: 509902 - DNA, 20 bp, Artificial
  CRISPR gRNA sequence
accaacatgtgtccccagcg

SEQ ID NO: 509903 - DNA, 20 bp, Artificial
  CRISPR gRNA sequence
cagcgaggctgtttacaaat

SEQ ID NO: 509904 - DNA, 20 bp, Artificial
  CRISPR gRNA sequence
gaggctgtttacaaatcagc

SEQ ID NO: 509905 - DNA, 20 bp, Artificial
  CRISPR gRNA sequence
aggctgtttacaaatcagct

SEQ ID NO: 509906 - DNA, 20 bp, Artificial
  CRISPR gRNA sequence
ctgtttacaaatcagctggg

SEQ ID NO: 509907 - DNA, 20 bp, Artificial
  CRISPR gRNA sequence
tgtttacaaatcagctgggc

SEQ ID NO: 509908 - DNA, 20 bp, Artificial
  CRISPR gRNA sequence
ttacaaatcagctgggcagg

SEQ ID NO: 509909 - DNA, 20 bp, Artificial
  CRISPR gRNA sequence
tacaaatcagctgggcagga

SEQ ID NO: 509910 - DNA, 20 bp, Artificial
  CRISPR gRNA sequence
tgggcaggaaggtgttcccc

SEQ ID NO: 509911 - DNA, 20 bp, Artificial
  CRISPR gRNA sequence
gggcaggaaggtgttcccct

SEQ ID NO: 509912 - DNA, 20 bp, Artificial
  CRISPR gRNA sequence
ggcaggaaggtgttcccctg

SEQ ID NO: 509913 - DNA, 20 bp, Artificial
  CRISPR gRNA sequence
ggctaactcttctgcactct

SEQ ID NO: 509914 - DNA, 20 bp, Artificial
  CRISPR gRNA sequence
ctgcactctcagaccctgaa

SEQ ID NO: 509915 - DNA, 20 bp, Artificial
  CRISPR gRNA sequence
actctcagaccctgaatggc

SEQ ID NO: 509916 - DNA, 20 bp, Artificial
  CRISPR gRNA sequence
tctcagaccctgaatggccg

SEQ ID NO: 509917 - DNA, 20 bp, Artificial
  CRISPR gRNA sequence
tcagaccctgaatggccgga

SEQ ID NO: 509918 - DNA, 20 bp, Artificial
  CRISPR gRNA sequence
gaatggccggagagaacacg

SEQ ID NO: 509919 - DNA, 20 bp, Artificial
  CRISPR gRNA sequence
gccggagagaacacgcagcc

SEQ ID NO: 509920 - DNA, 20 bp, Artificial
  CRISPR gRNA sequence
ccggagagaacacgcagccc

SEQ ID NO: 509921 - DNA, 20 bp, Artificial
  CRISPR gRNA sequence
cggagagaacacgcagcccg

SEQ ID NO: 509922 - DNA, 20 bp, Artificial
  CRISPR gRNA sequence
agagaacacgcagcccgggg

SEQ ID NO: 509923 - DNA, 20 bp, Artificial
  CRISPR gRNA sequence
gagaacacgcagcccggggt

SEQ ID NO: 509924 - DNA, 20 bp, Artificial
  CRISPR gRNA sequence
aacacgcagcccggggtggg

SEQ ID NO: 509925 - DNA, 20 bp, Artificial
  CRISPR gRNA sequence
acacgcagcccggggtgggc

SEQ ID NO: 509926 - DNA, 20 bp, Artificial
  CRISPR gRNA sequence
cacgcagcccggggtgggca

SEQ ID NO: 509927 - DNA, 20 bp, Artificial
  CRISPR gRNA sequence
acgcagcccggggtgggcag

SEQ ID NO: 509928 - DNA, 20 bp, Artificial
  CRISPR gRNA sequence
cccggggtgggcaggggcct

SEQ ID NO: 509929 - DNA, 20 bp, Artificial
  CRISPR gRNA sequence
ggtgggcaggggcctcagct

SEQ ID NO: 509930 - DNA, 20 bp, Artificial
  CRISPR gRNA sequence
gtgggcaggggcctcagctc

SEQ ID NO: 509931 - DNA, 20 bp, Artificial
  CRISPR gRNA sequence
gcaggggcctcagctcagga

SEQ ID NO: 509932 - DNA, 20 bp, Artificial
  CRISPR gRNA sequence
gcctcagctcaggacagcac

SEQ ID NO: 509933 - DNA, 20 bp, Artificial
  CRISPR gRNA sequence
cctcagctcaggacagcacc

SEQ ID NO: 509934 - DNA, 20 bp, Artificial
  CRISPR gRNA sequence
ctcagctcaggacagcacca

SEQ ID NO: 509935 - DNA, 20 bp, Artificial
  CRISPR gRNA sequence
cagggccctctgtgcttgct

SEQ ID NO: 509936 - DNA, 20 bp, Artificial
  CRISPR gRNA sequence
agggccctctgtgcttgctc

SEQ ID NO: 509937 - DNA, 20 bp, Artificial
  CRISPR gRNA sequence
gggccctctgtgcttgctca

SEQ ID NO: 509938 - DNA, 20 bp, Artificial
  CRISPR gRNA sequence
ctctgtgcttgctcagggcc

SEQ ID NO: 509939 - DNA, 20 bp, Artificial
  CRISPR gRNA sequence
tctgtgcttgctcagggcct

SEQ ID NO: 509940 - DNA, 20 bp, Artificial
  CRISPR gRNA sequence
gggcctgggctccacacaca

SEQ ID NO: 509941 - DNA, 20 bp, Artificial
  CRISPR gRNA sequence
ggcctgggctccacacacat

SEQ ID NO: 509942 - DNA, 20 bp, Artificial
  CRISPR gRNA sequence
gggctccacacacatgggct

SEQ ID NO: 509943 - DNA, 20 bp, Artificial
  CRISPR gRNA sequence
acctaatcaatgccccgtgt

SEQ ID NO: 509944 - DNA, 20 bp, Artificial
  CRISPR gRNA sequence
tcaatgccccgtgtcagtgc

SEQ ID NO: 509945 - DNA, 20 bp, Artificial
  CRISPR gRNA sequence
tgtcagtgccagtttgtgcc

SEQ ID NO: 509946 - DNA, 20 bp, Artificial
  CRISPR gRNA sequence
cagtgccagtttgtgccaag

SEQ ID NO: 509947 - DNA, 20 bp, Artificial
  CRISPR gRNA sequence
ccagtttgtgccaagcagaa

SEQ ID NO: 509948 - DNA, 20 bp, Artificial
  CRISPR gRNA sequence
cagtttgtgccaagcagaat

SEQ ID NO: 509949 - DNA, 20 bp, Artificial
  CRISPR gRNA sequence
gtttgtgccaagcagaatgg

SEQ ID NO: 509950 - DNA, 20 bp, Artificial
  CRISPR gRNA sequence
tttgtgccaagcagaatggg

SEQ ID NO: 509951 - DNA, 20 bp, Artificial
  CRISPR gRNA sequence
ttgtgccaagcagaatggga

SEQ ID NO: 509952 - DNA, 20 bp, Artificial
  CRISPR gRNA sequence
agaatgggagggataattgc

SEQ ID NO: 509953 - DNA, 20 bp, Artificial
  CRISPR gRNA sequence
ggagggataattgctggcac

SEQ ID NO: 509954 - DNA, 20 bp, Artificial
  CRISPR gRNA sequence
gagggataattgctggcacc

SEQ ID NO: 509955 - DNA, 20 bp, Artificial
  CRISPR gRNA sequence
ataattgctggcaccaggtc

SEQ ID NO: 509956 - DNA, 20 bp, Artificial
  CRISPR gRNA sequence
tgctggcaccaggtccggct

SEQ ID NO: 509957 - DNA, 20 bp, Artificial
  CRISPR gRNA sequence
gctggcaccaggtccggctt

SEQ ID NO: 509958 - DNA, 20 bp, Artificial
  CRISPR gRNA sequence
ctggcaccaggtccggcttg

SEQ ID NO: 509959 - DNA, 20 bp, Artificial
  CRISPR gRNA sequence
gcaccaggtccggcttgggg

SEQ ID NO: 509960 - DNA, 20 bp, Artificial
  CRISPR gRNA sequence
caccaggtccggcttggggt

SEQ ID NO: 509961 - DNA, 20 bp, Artificial
  CRISPR gRNA sequence
cttggggtgggtatcaccca

SEQ ID NO: 509962 - DNA, 20 bp, Artificial
  CRISPR gRNA sequence
acccacagctccataattgc

SEQ ID NO: 509963 - DNA, 20 bp, Artificial
  CRISPR gRNA sequence
cccacagctccataattgct

SEQ ID NO: 509964 - DNA, 20 bp, Artificial
  CRISPR gRNA sequence
taattgctaggcgcccactg

SEQ ID NO: 509965 - DNA, 20 bp, Artificial
  CRISPR gRNA sequence
attgctaggcgcccactgca

SEQ ID NO: 509966 - DNA, 20 bp, Artificial
  CRISPR gRNA sequence
cgcccactgcagagcccctt

SEQ ID NO: 509967 - DNA, 20 bp, Artificial
  CRISPR gRNA sequence
cactgcagagccccttgagt

SEQ ID NO: 509968 - DNA, 20 bp, Artificial
  CRISPR gRNA sequence
actgcagagccccttgagtt

SEQ ID NO: 509969 - DNA, 20 bp, Artificial
  CRISPR gRNA sequence
ctgcagagccccttgagttg

SEQ ID NO: 509970 - DNA, 20 bp, Artificial
  CRISPR gRNA sequence
ccccttgagttggggcttcc

SEQ ID NO: 509971 - DNA, 20 bp, Artificial
  CRISPR gRNA sequence
gttggggcttcccagcgacc

SEQ ID NO: 509972 - DNA, 20 bp, Artificial
  CRISPR gRNA sequence
gcgacctggcctgtacctgc

SEQ ID NO: 509973 - DNA, 20 bp, Artificial
  CRISPR gRNA sequence
cgacctggcctgtacctgct

SEQ ID NO: 509974 - DNA, 20 bp, Artificial
  CRISPR gRNA sequence
gcctgtgtcactgacccctg

SEQ ID NO: 509975 - DNA, 20 bp, Artificial
  CRISPR gRNA sequence
tgtgtcactgacccctgtgg

SEQ ID NO: 509976 - DNA, 20 bp, Artificial
  CRISPR gRNA sequence
tcactgacccctgtggcagc

SEQ ID NO: 509977 - DNA, 20 bp, Artificial
  CRISPR gRNA sequence
tggcagctggcattctcctc

SEQ ID NO: 509978 - DNA, 20 bp, Artificial
  CRISPR gRNA sequence
ggcagctggcattctcctcc

SEQ ID NO: 509979 - DNA, 20 bp, Artificial
  CRISPR gRNA sequence
ctggcattctcctccgggaa

SEQ ID NO: 509980 - DNA, 20 bp, Artificial
  CRISPR gRNA sequence
tggcattctcctccgggaac

SEQ ID NO: 509981 - DNA, 20 bp, Artificial
  CRISPR gRNA sequence
gcattctcctccgggaacgg

SEQ ID NO: 509982 - DNA, 20 bp, Artificial
  CRISPR gRNA sequence
tctcctccgggaacgggagc

SEQ ID NO: 509983 - DNA, 20 bp, Artificial
  CRISPR gRNA sequence
cgggaacgggagccagcctc

SEQ ID NO: 509984 - DNA, 20 bp, Artificial
  CRISPR gRNA sequence
ggagccagcctccggtgaca

SEQ ID NO: 509985 - DNA, 20 bp, Artificial
  CRISPR gRNA sequence
agcctccggtgacatggcct

SEQ ID NO: 509986 - DNA, 20 bp, Artificial
  CRISPR gRNA sequence
gcctccggtgacatggcctc

SEQ ID NO: 509987 - DNA, 20 bp, Artificial
  CRISPR gRNA sequence
tccggtgacatggcctcagg

SEQ ID NO: 509988 - DNA, 20 bp, Artificial
  CRISPR gRNA sequence
ccggtgacatggcctcaggc

SEQ ID NO: 509989 - DNA, 20 bp, Artificial
  CRISPR gRNA sequence
catggcctcaggcaggacca

SEQ ID NO: 509990 - DNA, 20 bp, Artificial
  CRISPR gRNA sequence
aggaccacggttctctgaca

SEQ ID NO: 509991 - DNA, 20 bp, Artificial
  CRISPR gRNA sequence
ggaccacggttctctgacac

SEQ ID NO: 509992 - DNA, 20 bp, Artificial
  CRISPR gRNA sequence
ggttctctgacacaggacac

SEQ ID NO: 509993 - DNA, 20 bp, Artificial
  CRISPR gRNA sequence
tctgacacaggacacgagtg

SEQ ID NO: 509994 - DNA, 20 bp, Artificial
  CRISPR gRNA sequence
acacaggacacgagtgcagc

SEQ ID NO: 509995 - DNA, 20 bp, Artificial
  CRISPR gRNA sequence
cacaggacacgagtgcagca

SEQ ID NO: 509996 - DNA, 20 bp, Artificial
  CRISPR gRNA sequence
acaggacacgagtgcagcaa

SEQ ID NO: 509997 - DNA, 20 bp, Artificial
  CRISPR gRNA sequence
caggacacgagtgcagcaag

SEQ ID NO: 509998 - DNA, 20 bp, Artificial
  CRISPR gRNA sequence
aggacacgagtgcagcaagg

SEQ ID NO: 509999 - DNA, 20 bp, Artificial
  CRISPR gRNA sequence
ggacacgagtgcagcaaggg

SEQ ID NO: 510000 - DNA, 20 bp, Artificial
  CRISPR gRNA sequence
tgcagcaaggggggcccaca

SEQ ID NO: 510001 - DNA, 20 bp, Artificial
  CRISPR gRNA sequence
gcagcaaggggggcccacac

SEQ ID NO: 510002 - DNA, 20 bp, Artificial
  CRISPR gRNA sequence
cccacacaggacctgttcca

SEQ ID NO: 510003 - DNA, 20 bp, Artificial
  CRISPR gRNA sequence
cctgttccatggaatcgcca

SEQ ID NO: 510004 - DNA, 20 bp, Artificial
  CRISPR gRNA sequence
ctgttccatggaatcgccac

SEQ ID NO: 510005 - DNA, 20 bp, Artificial
  CRISPR gRNA sequence
gcgtcacgctgccccatcca

SEQ ID NO: 510006 - DNA, 20 bp, Artificial
  CRISPR gRNA sequence
gtcacgctgccccatccaca

SEQ ID NO: 510007 - DNA, 20 bp, Artificial
  CRISPR gRNA sequence
tcacgctgccccatccacag

SEQ ID NO: 510008 - DNA, 20 bp, Artificial
  CRISPR gRNA sequence
ccacagaggcaaatgtccca

SEQ ID NO: 510009 - DNA, 20 bp, Artificial
  CRISPR gRNA sequence
aggcaaatgtcccacagccc

SEQ ID NO: 510010 - DNA, 20 bp, Artificial
  CRISPR gRNA sequence
tgtcccacagccctggtacc

SEQ ID NO: 510011 - DNA, 20 bp, Artificial
  CRISPR gRNA sequence
cccacagccctggtacctgg

SEQ ID NO: 510012 - DNA, 20 bp, Artificial
  CRISPR gRNA sequence
ccacagccctggtacctggt

SEQ ID NO: 510013 - DNA, 20 bp, Artificial
  CRISPR gRNA sequence
cacagccctggtacctggtg

SEQ ID NO: 510014 - DNA, 20 bp, Artificial
  CRISPR gRNA sequence
ccctggtacctggtggggcc

SEQ ID NO: 510015 - DNA, 20 bp, Artificial
  CRISPR gRNA sequence
gtacctggtggggcccggcc

SEQ ID NO: 510016 - DNA, 20 bp, Artificial
  CRISPR gRNA sequence
tacctggtggggcccggcct

SEQ ID NO: 510017 - DNA, 20 bp, Artificial
  CRISPR gRNA sequence
tggtggggcccggcctgggc

SEQ ID NO: 510018 - DNA, 20 bp, Artificial
  CRISPR gRNA sequence
gtggggcccggcctgggcca

SEQ ID NO: 510019 - DNA, 20 bp, Artificial
  CRISPR gRNA sequence
gggcccggcctgggccagag

SEQ ID NO: 510020 - DNA, 20 bp, Artificial
  CRISPR gRNA sequence
ccggcctgggccagagtgga

SEQ ID NO: 510021 - DNA, 20 bp, Artificial
  CRISPR gRNA sequence
tgggccagagtggacagacc

SEQ ID NO: 510022 - DNA, 20 bp, Artificial
  CRISPR gRNA sequence
gggccagagtggacagacct

SEQ ID NO: 510023 - DNA, 20 bp, Artificial
  CRISPR gRNA sequence
agagtggacagacctgggcc

SEQ ID NO: 510024 - DNA, 20 bp, Artificial
  CRISPR gRNA sequence
gtggacagacctgggcctgg

SEQ ID NO: 510025 - DNA, 20 bp, Artificial
  CRISPR gRNA sequence
tggacagacctgggcctggc

SEQ ID NO: 510026 - DNA, 20 bp, Artificial
  CRISPR gRNA sequence
gacagacctgggcctggcag

SEQ ID NO: 510027 - DNA, 20 bp, Artificial
  CRISPR gRNA sequence
cctgggcctggcaggagccc

SEQ ID NO: 510028 - DNA, 20 bp, Artificial
  CRISPR gRNA sequence
ctgggcctggcaggagccct

SEQ ID NO: 510029 - DNA, 20 bp, Artificial
  CRISPR gRNA sequence
tgggcctggcaggagccctg

SEQ ID NO: 510030 - DNA, 20 bp, Artificial
  CRISPR gRNA sequence
gcctggcaggagccctgggg

SEQ ID NO: 510031 - DNA, 20 bp, Artificial
  CRISPR gRNA sequence
ggcaggagccctggggaagt

SEQ ID NO: 510032 - DNA, 20 bp, Artificial
  CRISPR gRNA sequence
agccctggggaagtgagttc

SEQ ID NO: 510033 - DNA, 20 bp, Artificial
  CRISPR gRNA sequence
ggaagtgagttcaagttaca

SEQ ID NO: 510034 - DNA, 20 bp, Artificial
  CRISPR gRNA sequence
tcaagttacacggttgacta

SEQ ID NO: 510035 - DNA, 20 bp, Artificial
  CRISPR gRNA sequence
aagttacacggttgactata

SEQ ID NO: 510036 - DNA, 20 bp, Artificial
  CRISPR gRNA sequence
tacacggttgactatagaga

SEQ ID NO: 510037 - DNA, 20 bp, Artificial
  CRISPR gRNA sequence
cggttgactatagagacagc

SEQ ID NO: 510038 - DNA, 20 bp, Artificial
  CRISPR gRNA sequence
gttgactatagagacagctg

SEQ ID NO: 510039 - DNA, 20 bp, Artificial
  CRISPR gRNA sequence
acagctggagtgcgcacaat

SEQ ID NO: 510040 - DNA, 20 bp, Artificial
  CRISPR gRNA sequence
ctggagtgcgcacaattggc

SEQ ID NO: 510041 - DNA, 20 bp, Artificial
  CRISPR gRNA sequence
agaccacccctcctgtttca

SEQ ID NO: 510042 - DNA, 20 bp, Artificial
  CRISPR gRNA sequence
cacccctcctgtttcacaga

SEQ ID NO: 510043 - DNA, 20 bp, Artificial
  CRISPR gRNA sequence
acccctcctgtttcacagat

SEQ ID NO: 510044 - DNA, 20 bp, Artificial
  CRISPR gRNA sequence
cccctcctgtttcacagatg

SEQ ID NO: 510045 - DNA, 20 bp, Artificial
  CRISPR gRNA sequence
gtttcacagatggggaaact

SEQ ID NO: 510046 - DNA, 20 bp, Artificial
  CRISPR gRNA sequence
cagatggggaaactgagtca

SEQ ID NO: 510047 - DNA, 20 bp, Artificial
  CRISPR gRNA sequence
agatggggaaactgagtcac

SEQ ID NO: 510048 - DNA, 20 bp, Artificial
  CRISPR gRNA sequence
gatggggaaactgagtcacg

SEQ ID NO: 510049 - DNA, 20 bp, Artificial
  CRISPR gRNA sequence
atggggaaactgagtcacgg

SEQ ID NO: 510050 - DNA, 20 bp, Artificial
  CRISPR gRNA sequence
ctgagtcacgggggaccaaa

SEQ ID NO: 510051 - DNA, 20 bp, Artificial
  CRISPR gRNA sequence
tgctcaccccatgccccttc

SEQ ID NO: 510052 - DNA, 20 bp, Artificial
  CRISPR gRNA sequence
caccccatgccccttccaga

SEQ ID NO: 510053 - DNA, 20 bp, Artificial
  CRISPR gRNA sequence
accccatgccccttccagac

SEQ ID NO: 510054 - DNA, 20 bp, Artificial
  CRISPR gRNA sequence
ccccatgccccttccagaca

SEQ ID NO: 510055 - DNA, 20 bp, Artificial
  CRISPR gRNA sequence
tgccccttccagacagggtg

SEQ ID NO: 510056 - DNA, 20 bp, Artificial
  CRISPR gRNA sequence
ccttccagacagggtgcaga

SEQ ID NO: 510057 - DNA, 20 bp, Artificial
  CRISPR gRNA sequence
cttccagacagggtgcagat

SEQ ID NO: 510058 - DNA, 20 bp, Artificial
  CRISPR gRNA sequence
ttccagacagggtgcagata

SEQ ID NO: 510059 - DNA, 20 bp, Artificial
  CRISPR gRNA sequence
atagggcccctcccatctcc

SEQ ID NO: 510060 - DNA, 20 bp, Artificial
  CRISPR gRNA sequence
ggcccctcccatctcctgga

SEQ ID NO: 510061 - DNA, 20 bp, Artificial
  CRISPR gRNA sequence
tcccatctcctggatggccg

SEQ ID NO: 510062 - DNA, 20 bp, Artificial
  CRISPR gRNA sequence
ggatggccgcggcccctgtg

SEQ ID NO: 510063 - DNA, 20 bp, Artificial
  CRISPR gRNA sequence
cctgtgcagaacttccttca

SEQ ID NO: 510064 - DNA, 20 bp, Artificial
  CRISPR gRNA sequence
ctgtgcagaacttccttcat

SEQ ID NO: 510065 - DNA, 20 bp, Artificial
  CRISPR gRNA sequence
ttcatgggcacctcgctgtc

SEQ ID NO: 510066 - DNA, 20 bp, Artificial
  CRISPR gRNA sequence
tcatgggcacctcgctgtct

SEQ ID NO: 510067 - DNA, 20 bp, Artificial
  CRISPR gRNA sequence
catgggcacctcgctgtctg

SEQ ID NO: 510068 - DNA, 20 bp, Artificial
  CRISPR gRNA sequence
atgggcacctcgctgtctgg

SEQ ID NO: 510069 - DNA, 20 bp, Artificial
  CRISPR gRNA sequence
ctgtctgggggcctcttccc

SEQ ID NO: 510070 - DNA, 20 bp, Artificial
  CRISPR gRNA sequence
tgtctgggggcctcttcccc

SEQ ID NO: 510071 - DNA, 20 bp, Artificial
  CRISPR gRNA sequence
gtctgggggcctcttcccca

SEQ ID NO: 510072 - DNA, 20 bp, Artificial
  CRISPR gRNA sequence
ctgggggcctcttccccagg

SEQ ID NO: 510073 - DNA, 20 bp, Artificial
  CRISPR gRNA sequence
ctcttccccagggagtctcc

SEQ ID NO: 510074 - DNA, 20 bp, Artificial
  CRISPR gRNA sequence
ttccccagggagtctcctgg

SEQ ID NO: 510075 - DNA, 20 bp, Artificial
  CRISPR gRNA sequence
cccagggagtctcctggtgg

SEQ ID NO: 510076 - DNA, 20 bp, Artificial
  CRISPR gRNA sequence
tggtggtggccgtgttgcct

SEQ ID NO: 510077 - DNA, 20 bp, Artificial
  CRISPR gRNA sequence
ggtggtggccgtgttgcctc

SEQ ID NO: 510078 - DNA, 20 bp, Artificial
  CRISPR gRNA sequence
gcctcaggctcactgtgcac

SEQ ID NO: 510079 - DNA, 20 bp, Artificial
  CRISPR gRNA sequence
cctcaggctcactgtgcact

SEQ ID NO: 510080 - DNA, 20 bp, Artificial
  CRISPR gRNA sequence
caggctcactgtgcactagg

SEQ ID NO: 510081 - DNA, 20 bp, Artificial
  CRISPR gRNA sequence
aggctcactgtgcactaggc

SEQ ID NO: 510082 - DNA, 20 bp, Artificial
  CRISPR gRNA sequence
aggtcacgtcgatgccgcct

SEQ ID NO: 510083 - DNA, 20 bp, Artificial
  CRISPR gRNA sequence
ggtcacgtcgatgccgcctg

SEQ ID NO: 510084 - DNA, 20 bp, Artificial
  CRISPR gRNA sequence
gtcacgtcgatgccgcctga

SEQ ID NO: 510085 - DNA, 20 bp, Artificial
  CRISPR gRNA sequence
tcacgtcgatgccgcctgag

SEQ ID NO: 510086 - DNA, 20 bp, Artificial
  CRISPR gRNA sequence
cgtcgatgccgcctgagggg

SEQ ID NO: 510087 - DNA, 20 bp, Artificial
  CRISPR gRNA sequence
gtcgatgccgcctgaggggc

SEQ ID NO: 510088 - DNA, 20 bp, Artificial
  CRISPR gRNA sequence
tcgatgccgcctgaggggca

SEQ ID NO: 510089 - DNA, 20 bp, Artificial
  CRISPR gRNA sequence
cgatgccgcctgaggggcag

SEQ ID NO: 510090 - DNA, 20 bp, Artificial
  CRISPR gRNA sequence
gggcaggggttaccaccctg

SEQ ID NO: 510091 - DNA, 20 bp, Artificial
  CRISPR gRNA sequence
ggggttaccaccctgtggtt

SEQ ID NO: 510092 - DNA, 20 bp, Artificial
  CRISPR gRNA sequence
gggttaccaccctgtggttc

SEQ ID NO: 510093 - DNA, 20 bp, Artificial
  CRISPR gRNA sequence
taccaccctgtggttcaggt

SEQ ID NO: 510094 - DNA, 20 bp, Artificial
  CRISPR gRNA sequence
caccctgtggttcaggtgag

SEQ ID NO: 510095 - DNA, 20 bp, Artificial
  CRISPR gRNA sequence
gtggttcaggtgagaagctc

SEQ ID NO: 510096 - DNA, 20 bp, Artificial
  CRISPR gRNA sequence
tggttcaggtgagaagctcc

SEQ ID NO: 510097 - DNA, 20 bp, Artificial
  CRISPR gRNA sequence
caggtgagaagctccaggct

SEQ ID NO: 510098 - DNA, 20 bp, Artificial
  CRISPR gRNA sequence
aggtgagaagctccaggctc

SEQ ID NO: 510099 - DNA, 20 bp, Artificial
  CRISPR gRNA sequence
gtgagaagctccaggctcag

SEQ ID NO: 510100 - DNA, 20 bp, Artificial
  CRISPR gRNA sequence
gctccaggctcaggagtgtc

SEQ ID NO: 510101 - DNA, 20 bp, Artificial
  CRISPR gRNA sequence
ctcaggagtgtccagctgcc

SEQ ID NO: 510102 - DNA, 20 bp, Artificial
  CRISPR gRNA sequence
tcaggagtgtccagctgcct

SEQ ID NO: 510103 - DNA, 20 bp, Artificial
  CRISPR gRNA sequence
ggagtgtccagctgcctggg

SEQ ID NO: 510104 - DNA, 20 bp, Artificial
  CRISPR gRNA sequence
ccagctgcctgggcagtgtt

SEQ ID NO: 510105 - DNA, 20 bp, Artificial
  CRISPR gRNA sequence
gcagtgtttggatctcatgc

SEQ ID NO: 510106 - DNA, 20 bp, Artificial
  CRISPR gRNA sequence
gatctcatgccagcccctgc

SEQ ID NO: 510107 - DNA, 20 bp, Artificial
  CRISPR gRNA sequence
atctcatgccagcccctgcc

SEQ ID NO: 510108 - DNA, 20 bp, Artificial
  CRISPR gRNA sequence
ctcatgccagcccctgccag

SEQ ID NO: 510109 - DNA, 20 bp, Artificial
  CRISPR gRNA sequence
tcatgccagcccctgccagg

SEQ ID NO: 510110 - DNA, 20 bp, Artificial
  CRISPR gRNA sequence
gccaggaggccctgcttctc

SEQ ID NO: 510111 - DNA, 20 bp, Artificial
  CRISPR gRNA sequence
gaggccctgcttctccagcc

SEQ ID NO: 510112 - DNA, 20 bp, Artificial
  CRISPR gRNA sequence
ccagcccagcccacgcccac

SEQ ID NO: 510113 - DNA, 20 bp, Artificial
  CRISPR gRNA sequence
cagcccagcccacgcccacc

SEQ ID NO: 510114 - DNA, 20 bp, Artificial
  CRISPR gRNA sequence
atgcccctatttactccctt

SEQ ID NO: 510115 - DNA, 20 bp, Artificial
  CRISPR gRNA sequence
tgcccctatttactcccttg

SEQ ID NO: 510116 - DNA, 20 bp, Artificial
  CRISPR gRNA sequence
ctatttactcccttgaggca

SEQ ID NO: 510117 - DNA, 20 bp, Artificial
  CRISPR gRNA sequence
tatttactcccttgaggcaa

SEQ ID NO: 510118 - DNA, 20 bp, Artificial
  CRISPR gRNA sequence
tcccttgaggcaaaggccct

SEQ ID NO: 510119 - DNA, 20 bp, Artificial
  CRISPR gRNA sequence
cccttgaggcaaaggccctt

SEQ ID NO: 510120 - DNA, 20 bp, Artificial
  CRISPR gRNA sequence
ttgaggcaaaggcccttggg

SEQ ID NO: 510121 - DNA, 20 bp, Artificial
  CRISPR gRNA sequence
gcaaaggcccttgggtggct

SEQ ID NO: 510122 - DNA, 20 bp, Artificial
  CRISPR gRNA sequence
tggctaagcgtcccctctcc

SEQ ID NO: 510123 - DNA, 20 bp, Artificial
  CRISPR gRNA sequence
gcgtcccctctcccagcact

SEQ ID NO: 510124 - DNA, 20 bp, Artificial
  CRISPR gRNA sequence
gtcccctctcccagcactcg

SEQ ID NO: 510125 - DNA, 20 bp, Artificial
  CRISPR gRNA sequence
ctctcccagcactcggagct

SEQ ID NO: 510126 - DNA, 20 bp, Artificial
  CRISPR gRNA sequence
gagctgagcgtcccctctcc

SEQ ID NO: 510127 - DNA, 20 bp, Artificial
  CRISPR gRNA sequence
gcgtcccctctcccagcact

SEQ ID NO: 510128 - DNA, 20 bp, Artificial
  CRISPR gRNA sequence
gtcccctctcccagcactcg

SEQ ID NO: 510129 - DNA, 20 bp, Artificial
  CRISPR gRNA sequence
ctctcccagcactcggagct

SEQ ID NO: 510130 - DNA, 20 bp, Artificial
  CRISPR gRNA sequence
agctgagcattcccctctcc

SEQ ID NO: 510131 - DNA, 20 bp, Artificial
  CRISPR gRNA sequence
cattcccctctcccagcact

SEQ ID NO: 510132 - DNA, 20 bp, Artificial
  CRISPR gRNA sequence
ttcccctctcccagcactcg

SEQ ID NO: 510133 - DNA, 20 bp, Artificial
  CRISPR gRNA sequence
tcccctctcccagcactcgg

SEQ ID NO: 510134 - DNA, 20 bp, Artificial
  CRISPR gRNA sequence
ccagcactcggaggcacctg

SEQ ID NO: 510135 - DNA, 20 bp, Artificial
  CRISPR gRNA sequence
cggaggcacctgcagttgct

SEQ ID NO: 510136 - DNA, 20 bp, Artificial
  CRISPR gRNA sequence
cagttgctcagctgttcatt

SEQ ID NO: 510137 - DNA, 20 bp, Artificial
  CRISPR gRNA sequence
ctcagctgttcattgagtgc

SEQ ID NO: 510138 - DNA, 20 bp, Artificial
  CRISPR gRNA sequence
tcagctgttcattgagtgct

SEQ ID NO: 510139 - DNA, 20 bp, Artificial
  CRISPR gRNA sequence
agctgttcattgagtgctgg

SEQ ID NO: 510140 - DNA, 20 bp, Artificial
  CRISPR gRNA sequence
tgttcattgagtgctgggag

SEQ ID NO: 510141 - DNA, 20 bp, Artificial
  CRISPR gRNA sequence
ggagtggaaactcatacgct

SEQ ID NO: 510142 - DNA, 20 bp, Artificial
  CRISPR gRNA sequence
gtggaaactcatacgctgag

SEQ ID NO: 510143 - DNA, 20 bp, Artificial
  CRISPR gRNA sequence
gaaactcatacgctgagcgg

SEQ ID NO: 510144 - DNA, 20 bp, Artificial
  CRISPR gRNA sequence
gctgagcggcagtgacgctg

SEQ ID NO: 510145 - DNA, 20 bp, Artificial
  CRISPR gRNA sequence
tgagcggcagtgacgctgcg

SEQ ID NO: 510146 - DNA, 20 bp, Artificial
  CRISPR gRNA sequence
tgcggagctgacaaacccca

SEQ ID NO: 510147 - DNA, 20 bp, Artificial
  CRISPR gRNA sequence
gacaaaccccacagcccgcc

SEQ ID NO: 510148 - DNA, 20 bp, Artificial
  CRISPR gRNA sequence
gcccggtcacctgcttcacc

SEQ ID NO: 510149 - DNA, 20 bp, Artificial
  CRISPR gRNA sequence
cccggtcacctgcttcaccg

SEQ ID NO: 510150 - DNA, 20 bp, Artificial
  CRISPR gRNA sequence
ccggtcacctgcttcaccga

SEQ ID NO: 510151 - DNA, 20 bp, Artificial
  CRISPR gRNA sequence
acctgcttcaccgagggcca

SEQ ID NO: 510152 - DNA, 20 bp, Artificial
  CRISPR gRNA sequence
accgagggccacagcccccc

SEQ ID NO: 510153 - DNA, 20 bp, Artificial
  CRISPR gRNA sequence
ccgagggccacagccccccc

SEQ ID NO: 510154 - DNA, 20 bp, Artificial
  CRISPR gRNA sequence
cgagggccacagcccccccg

SEQ ID NO: 510155 - DNA, 20 bp, Artificial
  CRISPR gRNA sequence
ggccacagcccccccggggt

SEQ ID NO: 510156 - DNA, 20 bp, Artificial
  CRISPR gRNA sequence
gccacagcccccccggggtc

SEQ ID NO: 510157 - DNA, 20 bp, Artificial
  CRISPR gRNA sequence
acagcccccccggggtcagg

SEQ ID NO: 510158 - DNA, 20 bp, Artificial
  CRISPR gRNA sequence
cccccggggtcaggtggcca

SEQ ID NO: 510159 - DNA, 20 bp, Artificial
  CRISPR gRNA sequence
ccccggggtcaggtggccac

SEQ ID NO: 510160 - DNA, 20 bp, Artificial
  CRISPR gRNA sequence
cccggggtcaggtggccaca

SEQ ID NO: 510161 - DNA, 20 bp, Artificial
  CRISPR gRNA sequence
ccggggtcaggtggccacag

SEQ ID NO: 510162 - DNA, 20 bp, Artificial
  CRISPR gRNA sequence
tcaggtggccacaggggtcc

SEQ ID NO: 510163 - DNA, 20 bp, Artificial
  CRISPR gRNA sequence
ccacaggggtcctggccatg

SEQ ID NO: 510164 - DNA, 20 bp, Artificial
  CRISPR gRNA sequence
cacaggggtcctggccatgt

SEQ ID NO: 510165 - DNA, 20 bp, Artificial
  CRISPR gRNA sequence
catgtgggacatctgttctg

SEQ ID NO: 510166 - DNA, 20 bp, Artificial
  CRISPR gRNA sequence
atctgttctgtggccctgct

SEQ ID NO: 510167 - DNA, 20 bp, Artificial
  CRISPR gRNA sequence
tctgttctgtggccctgctc

SEQ ID NO: 510168 - DNA, 20 bp, Artificial
  CRISPR gRNA sequence
ttctgtggccctgctcagga

SEQ ID NO: 510169 - DNA, 20 bp, Artificial
  CRISPR gRNA sequence
gccctgctcaggatggcacc

SEQ ID NO: 510170 - DNA, 20 bp, Artificial
  CRISPR gRNA sequence
ctgctcaggatggcacccgg

SEQ ID NO: 510171 - DNA, 20 bp, Artificial
  CRISPR gRNA sequence
tgctcaggatggcacccggc

SEQ ID NO: 510172 - DNA, 20 bp, Artificial
  CRISPR gRNA sequence
gctcaggatggcacccggcg

SEQ ID NO: 510173 - DNA, 20 bp, Artificial
  CRISPR gRNA sequence
ggatggcacccggcggggac

SEQ ID NO: 510174 - DNA, 20 bp, Artificial
  CRISPR gRNA sequence
cacccggcggggactggccc

SEQ ID NO: 510175 - DNA, 20 bp, Artificial
  CRISPR gRNA sequence
acccggcggggactggccct

SEQ ID NO: 510176 - DNA, 20 bp, Artificial
  CRISPR gRNA sequence
cccggcggggactggccctg

SEQ ID NO: 510177 - DNA, 20 bp, Artificial
  CRISPR gRNA sequence
cggggactggccctggggcc

SEQ ID NO: 510178 - DNA, 20 bp, Artificial
  CRISPR gRNA sequence
ggggactggccctggggccg

SEQ ID NO: 510179 - DNA, 20 bp, Artificial
  CRISPR gRNA sequence
ctggccctggggccgaggca

SEQ ID NO: 510180 - DNA, 20 bp, Artificial
  CRISPR gRNA sequence
tggccctggggccgaggcat

SEQ ID NO: 510181 - DNA, 20 bp, Artificial
  CRISPR gRNA sequence
ctggggccgaggcatgggct

SEQ ID NO: 510182 - DNA, 20 bp, Artificial
  CRISPR gRNA sequence
tgggctcagccgccgccctg

SEQ ID NO: 510183 - DNA, 20 bp, Artificial
  CRISPR gRNA sequence
gggctcagccgccgccctgc

SEQ ID NO: 510184 - DNA, 20 bp, Artificial
  CRISPR gRNA sequence
ggctcagccgccgccctgca

SEQ ID NO: 510185 - DNA, 20 bp, Artificial
  CRISPR gRNA sequence
gccgccgccctgcagggacg

SEQ ID NO: 510186 - DNA, 20 bp, Artificial
  CRISPR gRNA sequence
ccgccctgcagggacgtagc

SEQ ID NO: 510187 - DNA, 20 bp, Artificial
  CRISPR gRNA sequence
cgccctgcagggacgtagcc

SEQ ID NO: 510188 - DNA, 20 bp, Artificial
  CRISPR gRNA sequence
gccctgcagggacgtagcca

SEQ ID NO: 510189 - DNA, 20 bp, Artificial
  CRISPR gRNA sequence
cgtagccagggacctcttcc

SEQ ID NO: 510190 - DNA, 20 bp, Artificial
  CRISPR gRNA sequence
agccagggacctcttcccag

SEQ ID NO: 510191 - DNA, 20 bp, Artificial
  CRISPR gRNA sequence
ccagggacctcttcccagca

SEQ ID NO: 510192 - DNA, 20 bp, Artificial
  CRISPR gRNA sequence
cagggacctcttcccagcag

SEQ ID NO: 510193 - DNA, 20 bp, Artificial
  CRISPR gRNA sequence
agggacctcttcccagcaga

SEQ ID NO: 510194 - DNA, 20 bp, Artificial
  CRISPR gRNA sequence
gggactcccccactcatccc

SEQ ID NO: 510195 - DNA, 20 bp, Artificial
  CRISPR gRNA sequence
ccactcatccccagaatact

SEQ ID NO: 510196 - DNA, 20 bp, Artificial
  CRISPR gRNA sequence
cactcatccccagaatactg

SEQ ID NO: 510197 - DNA, 20 bp, Artificial
  CRISPR gRNA sequence
actcatccccagaatactga

SEQ ID NO: 510198 - DNA, 20 bp, Artificial
  CRISPR gRNA sequence
ctcatccccagaatactgag

SEQ ID NO: 510199 - DNA, 20 bp, Artificial
  CRISPR gRNA sequence
cagaatactgaggggcacgc

SEQ ID NO: 510200 - DNA, 20 bp, Artificial
  CRISPR gRNA sequence
agaatactgaggggcacgct

SEQ ID NO: 510201 - DNA, 20 bp, Artificial
  CRISPR gRNA sequence
ctgaggggcacgctgggtgc

SEQ ID NO: 510202 - DNA, 20 bp, Artificial
  CRISPR gRNA sequence
tgaggggcacgctgggtgcc

SEQ ID NO: 510203 - DNA, 20 bp, Artificial
  CRISPR gRNA sequence
gggcacgctgggtgccaggc

SEQ ID NO: 510204 - DNA, 20 bp, Artificial
  CRISPR gRNA sequence
cacgctgggtgccaggctgg

SEQ ID NO: 510205 - DNA, 20 bp, Artificial
  CRISPR gRNA sequence
acgctgggtgccaggctggc

SEQ ID NO: 510206 - DNA, 20 bp, Artificial
  CRISPR gRNA sequence
cgctgggtgccaggctggca

SEQ ID NO: 510207 - DNA, 20 bp, Artificial
  CRISPR gRNA sequence
tgccaggctggcagggaccc

SEQ ID NO: 510208 - DNA, 20 bp, Artificial
  CRISPR gRNA sequence
gccaggctggcagggaccct

SEQ ID NO: 510209 - DNA, 20 bp, Artificial
  CRISPR gRNA sequence
ccaggctggcagggaccctg

SEQ ID NO: 510210 - DNA, 20 bp, Artificial
  CRISPR gRNA sequence
gaccctggggattctgctgt

SEQ ID NO: 510211 - DNA, 20 bp, Artificial
  CRISPR gRNA sequence
ctggggattctgctgtgagc

SEQ ID NO: 510212 - DNA, 20 bp, Artificial
  CRISPR gRNA sequence
ggattctgctgtgagctgga

SEQ ID NO: 510213 - DNA, 20 bp, Artificial
  CRISPR gRNA sequence
gattctgctgtgagctggat

SEQ ID NO: 510214 - DNA, 20 bp, Artificial
  CRISPR gRNA sequence
attctgctgtgagctggatg

SEQ ID NO: 510215 - DNA, 20 bp, Artificial
  CRISPR gRNA sequence
ctgctgtgagctggatgggg

SEQ ID NO: 510216 - DNA, 20 bp, Artificial
  CRISPR gRNA sequence
tgctgtgagctggatgggga

SEQ ID NO: 510217 - DNA, 20 bp, Artificial
  CRISPR gRNA sequence
ctgtgagctggatggggaag

SEQ ID NO: 510218 - DNA, 20 bp, Artificial
  CRISPR gRNA sequence
aggagttccttcctaaaatg

SEQ ID NO: 510219 - DNA, 20 bp, Artificial
  CRISPR gRNA sequence
gagttccttcctaaaatgtg

SEQ ID NO: 510220 - DNA, 20 bp, Artificial
  CRISPR gRNA sequence
ccttcctaaaatgtggagtc

SEQ ID NO: 510221 - DNA, 20 bp, Artificial
  CRISPR gRNA sequence
ttcctaaaatgtggagtctg

SEQ ID NO: 510222 - DNA, 20 bp, Artificial
  CRISPR gRNA sequence
tcctaaaatgtggagtctgg

SEQ ID NO: 510223 - DNA, 20 bp, Artificial
  CRISPR gRNA sequence
tggagtctggaggccactct

SEQ ID NO: 510224 - DNA, 20 bp, Artificial
  CRISPR gRNA sequence
tctggaggccactcttggta

SEQ ID NO: 510225 - DNA, 20 bp, Artificial
  CRISPR gRNA sequence
ggccactcttggtaaagtgc

SEQ ID NO: 510226 - DNA, 20 bp, Artificial
  CRISPR gRNA sequence
cttggtaaagtgctggcccc

SEQ ID NO: 510227 - DNA, 20 bp, Artificial
  CRISPR gRNA sequence
ttggtaaagtgctggccccc

SEQ ID NO: 510228 - DNA, 20 bp, Artificial
  CRISPR gRNA sequence
tggtaaagtgctggcccccg

SEQ ID NO: 510229 - DNA, 20 bp, Artificial
  CRISPR gRNA sequence
gctggcccccggggattctg

SEQ ID NO: 510230 - DNA, 20 bp, Artificial
  CRISPR gRNA sequence
gcccccggggattctgcagt

SEQ ID NO: 510231 - DNA, 20 bp, Artificial
  CRISPR gRNA sequence
ccggggattctgcagtgagc

SEQ ID NO: 510232 - DNA, 20 bp, Artificial
  CRISPR gRNA sequence
cggggattctgcagtgagct

SEQ ID NO: 510233 - DNA, 20 bp, Artificial
  CRISPR gRNA sequence
attctgcagtgagctgggca

SEQ ID NO: 510234 - DNA, 20 bp, Artificial
  CRISPR gRNA sequence
tgagctgggcatggattctg

SEQ ID NO: 510235 - DNA, 20 bp, Artificial
  CRISPR gRNA sequence
ctgggcatggattctgcagt

SEQ ID NO: 510236 - DNA, 20 bp, Artificial
  CRISPR gRNA sequence
gcatggattctgcagtgagc

SEQ ID NO: 510237 - DNA, 20 bp, Artificial
  CRISPR gRNA sequence
catggattctgcagtgagct

SEQ ID NO: 510238 - DNA, 20 bp, Artificial
  CRISPR gRNA sequence
agtgagctgggcttcactca

SEQ ID NO: 510239 - DNA, 20 bp, Artificial
  CRISPR gRNA sequence
cttcactcatggtgaaacgc

SEQ ID NO: 510240 - DNA, 20 bp, Artificial
  CRISPR gRNA sequence
ttcactcatggtgaaacgct

SEQ ID NO: 510241 - DNA, 20 bp, Artificial
  CRISPR gRNA sequence
tcactcatggtgaaacgctg

SEQ ID NO: 510242 - DNA, 20 bp, Artificial
  CRISPR gRNA sequence
atggtgaaacgctggggtga

SEQ ID NO: 510243 - DNA, 20 bp, Artificial
  CRISPR gRNA sequence
gtgaaacgctggggtgacgg

SEQ ID NO: 510244 - DNA, 20 bp, Artificial
  CRISPR gRNA sequence
aacgctggggtgacggcaga

SEQ ID NO: 510245 - DNA, 20 bp, Artificial
  CRISPR gRNA sequence
tggggtgacggcagacagcc

SEQ ID NO: 510246 - DNA, 20 bp, Artificial
  CRISPR gRNA sequence
gggtgacggcagacagccca

SEQ ID NO: 510247 - DNA, 20 bp, Artificial
  CRISPR gRNA sequence
ggcagacagcccagagcttc

SEQ ID NO: 510248 - DNA, 20 bp, Artificial
  CRISPR gRNA sequence
agacagcccagagcttctag

SEQ ID NO: 510249 - DNA, 20 bp, Artificial
  CRISPR gRNA sequence
tctagcagctcatttctgtg

SEQ ID NO: 510250 - DNA, 20 bp, Artificial
  CRISPR gRNA sequence
gctcatttctgtgaagcctc

SEQ ID NO: 510251 - DNA, 20 bp, Artificial
  CRISPR gRNA sequence
tctgtgaagcctccagaatc

SEQ ID NO: 510252 - DNA, 20 bp, Artificial
  CRISPR gRNA sequence
aagcctccagaatccggcct

SEQ ID NO: 510253 - DNA, 20 bp, Artificial
  CRISPR gRNA sequence
ggcctcagcccccaaacccg

SEQ ID NO: 510254 - DNA, 20 bp, Artificial
  CRISPR gRNA sequence
gcctcagcccccaaacccgc

SEQ ID NO: 510255 - DNA, 20 bp, Artificial
  CRISPR gRNA sequence
caggcgttgcgccaccgtca

SEQ ID NO: 510256 - DNA, 20 bp, Artificial
  CRISPR gRNA sequence
aggcgttgcgccaccgtcac

SEQ ID NO: 510257 - DNA, 20 bp, Artificial
  CRISPR gRNA sequence
ggcgttgcgccaccgtcacg

SEQ ID NO: 510258 - DNA, 20 bp, Artificial
  CRISPR gRNA sequence
gttgcgccaccgtcacgggg

SEQ ID NO: 510259 - DNA, 20 bp, Artificial
  CRISPR gRNA sequence
ttgcgccaccgtcacgggga

SEQ ID NO: 510260 - DNA, 20 bp, Artificial
  CRISPR gRNA sequence
gccaccgtcacggggaaggc

SEQ ID NO: 510261 - DNA, 20 bp, Artificial
  CRISPR gRNA sequence
gtcacggggaaggcgagtga

SEQ ID NO: 510262 - DNA, 20 bp, Artificial
  CRISPR gRNA sequence
cggggaaggcgagtgacagc

SEQ ID NO: 510263 - DNA, 20 bp, Artificial
  CRISPR gRNA sequence
gagtgtcccctatgccccca

SEQ ID NO: 510264 - DNA, 20 bp, Artificial
  CRISPR gRNA sequence
atgcccccacagctcgctcc

SEQ ID NO: 510265 - DNA, 20 bp, Artificial
  CRISPR gRNA sequence
tgcccccacagctcgctccc

SEQ ID NO: 510266 - DNA, 20 bp, Artificial
  CRISPR gRNA sequence
ccacagctcgctcccaggct

SEQ ID NO: 510267 - DNA, 20 bp, Artificial
  CRISPR gRNA sequence
cgctcccaggctgagctctc

SEQ ID NO: 510268 - DNA, 20 bp, Artificial
  CRISPR gRNA sequence
atccccccccttccccattg

SEQ ID NO: 510269 - DNA, 20 bp, Artificial
  CRISPR gRNA sequence
cacccctccttctccccacc

SEQ ID NO: 510270 - DNA, 20 bp, Artificial
  CRISPR gRNA sequence
acccctccttctccccaccc

SEQ ID NO: 510271 - DNA, 20 bp, Artificial
  CRISPR gRNA sequence
tctccccacccaggaactga

SEQ ID NO: 510272 - DNA, 20 bp, Artificial
  CRISPR gRNA sequence
tccccacccaggaactgaca

SEQ ID NO: 510273 - DNA, 20 bp, Artificial
  CRISPR gRNA sequence
ccccacccaggaactgacag

SEQ ID NO: 510274 - DNA, 20 bp, Artificial
  CRISPR gRNA sequence
ccacccaggaactgacagag

SEQ ID NO: 510275 - DNA, 20 bp, Artificial
  CRISPR gRNA sequence
acccaggaactgacagagga

SEQ ID NO: 510276 - DNA, 20 bp, Artificial
  CRISPR gRNA sequence
cccaggaactgacagaggag

SEQ ID NO: 510277 - DNA, 20 bp, Artificial
  CRISPR gRNA sequence
ccaggaactgacagaggaga

SEQ ID NO: 510278 - DNA, 20 bp, Artificial
  CRISPR gRNA sequence
caggaactgacagaggagag

SEQ ID NO: 510279 - DNA, 20 bp, Artificial
  CRISPR gRNA sequence
ctgacagaggagaggggccc

SEQ ID NO: 510280 - DNA, 20 bp, Artificial
  CRISPR gRNA sequence
cagaggagaggggccccgga

SEQ ID NO: 510281 - DNA, 20 bp, Artificial
  CRISPR gRNA sequence
ggagaggggccccggatgga

SEQ ID NO: 510282 - DNA, 20 bp, Artificial
  CRISPR gRNA sequence
gagaggggccccggatggac

SEQ ID NO: 510283 - DNA, 20 bp, Artificial
  CRISPR gRNA sequence
agaggggccccggatggaca

SEQ ID NO: 510284 - DNA, 20 bp, Artificial
  CRISPR gRNA sequence
gggccccggatggacaggga

SEQ ID NO: 510285 - DNA, 20 bp, Artificial
  CRISPR gRNA sequence
ccccggatggacagggacag

SEQ ID NO: 510286 - DNA, 20 bp, Artificial
  CRISPR gRNA sequence
cccggatggacagggacagc

SEQ ID NO: 510287 - DNA, 20 bp, Artificial
  CRISPR gRNA sequence
ccggatggacagggacagca

SEQ ID NO: 510288 - DNA, 20 bp, Artificial
  CRISPR gRNA sequence
gatggacagggacagcaggg

SEQ ID NO: 510289 - DNA, 20 bp, Artificial
  CRISPR gRNA sequence
gggacagcagggcagaatcc

SEQ ID NO: 510290 - DNA, 20 bp, Artificial
  CRISPR gRNA sequence
cagggcagaatcccagctcc

SEQ ID NO: 510291 - DNA, 20 bp, Artificial
  CRISPR gRNA sequence
agaatcccagctcccagatc

SEQ ID NO: 510292 - DNA, 20 bp, Artificial
  CRISPR gRNA sequence
gaatcccagctcccagatcc

SEQ ID NO: 510293 - DNA, 20 bp, Artificial
  CRISPR gRNA sequence
aatcccagctcccagatcca

SEQ ID NO: 510294 - DNA, 20 bp, Artificial
  CRISPR gRNA sequence
atcccagctcccagatccag

SEQ ID NO: 510295 - DNA, 20 bp, Artificial
  CRISPR gRNA sequence
cccagctcccagatccaggg

SEQ ID NO: 510296 - DNA, 20 bp, Artificial
  CRISPR gRNA sequence
ccagctcccagatccagggg

SEQ ID NO: 510297 - DNA, 20 bp, Artificial
  CRISPR gRNA sequence
cagctcccagatccagggga

SEQ ID NO: 510298 - DNA, 20 bp, Artificial
  CRISPR gRNA sequence
agctcccagatccaggggag

SEQ ID NO: 510299 - DNA, 20 bp, Artificial
  CRISPR gRNA sequence
gctcccagatccaggggagg

SEQ ID NO: 510300 - DNA, 20 bp, Artificial
  CRISPR gRNA sequence
ctcccagatccaggggaggg

SEQ ID NO: 510301 - DNA, 20 bp, Artificial
  CRISPR gRNA sequence
agatccaggggaggggggat

SEQ ID NO: 510302 - DNA, 20 bp, Artificial
  CRISPR gRNA sequence
gatccaggggaggggggatt

SEQ ID NO: 510303 - DNA, 20 bp, Artificial
  CRISPR gRNA sequence
aggggaggggggattgggtg

SEQ ID NO: 510304 - DNA, 20 bp, Artificial
  CRISPR gRNA sequence
ggggaggggggattgggtgt

SEQ ID NO: 510305 - DNA, 20 bp, Artificial
  CRISPR gRNA sequence
gggaggggggattgggtgtg

SEQ ID NO: 510306 - DNA, 20 bp, Artificial
  CRISPR gRNA sequence
ggggggattgggtgtgggga

SEQ ID NO: 510307 - DNA, 20 bp, Artificial
  CRISPR gRNA sequence
gggattgggtgtggggacgg

SEQ ID NO: 510308 - DNA, 20 bp, Artificial
  CRISPR gRNA sequence
gggtgtggggacggtggtgc

SEQ ID NO: 510309 - DNA, 20 bp, Artificial
  CRISPR gRNA sequence
ggtgtggggacggtggtgca

SEQ ID NO: 510310 - DNA, 20 bp, Artificial
  CRISPR gRNA sequence
gtgtggggacggtggtgcaa

SEQ ID NO: 510311 - DNA, 20 bp, Artificial
  CRISPR gRNA sequence
tgtggggacggtggtgcaag

SEQ ID NO: 510312 - DNA, 20 bp, Artificial
  CRISPR gRNA sequence
ggggacggtggtgcaagggg

SEQ ID NO: 510313 - DNA, 20 bp, Artificial
  CRISPR gRNA sequence
ggtggtgcaaggggtggtgc

SEQ ID NO: 510314 - DNA, 20 bp, Artificial
  CRISPR gRNA sequence
gtggtgcaaggggtggtgcc

SEQ ID NO: 510315 - DNA, 20 bp, Artificial
  CRISPR gRNA sequence
tggtgcaaggggtggtgcca

SEQ ID NO: 510316 - DNA, 20 bp, Artificial
  CRISPR gRNA sequence
ggtgcaaggggtggtgccag

SEQ ID NO: 510317 - DNA, 20 bp, Artificial
  CRISPR gRNA sequence
gcaaggggtggtgccagggg

SEQ ID NO: 510318 - DNA, 20 bp, Artificial
  CRISPR gRNA sequence
aaggggtggtgccaggggtg

SEQ ID NO: 510319 - DNA, 20 bp, Artificial
  CRISPR gRNA sequence
aggggtggtgccaggggtgg

SEQ ID NO: 510320 - DNA, 20 bp, Artificial
  CRISPR gRNA sequence
tgccaggggtggaggatgca

SEQ ID NO: 510321 - DNA, 20 bp, Artificial
  CRISPR gRNA sequence
gccaggggtggaggatgcat

SEQ ID NO: 510322 - DNA, 20 bp, Artificial
  CRISPR gRNA sequence
ccaggggtggaggatgcatg

SEQ ID NO: 510323 - DNA, 20 bp, Artificial
  CRISPR gRNA sequence
aggggtggaggatgcatggg

SEQ ID NO: 510324 - DNA, 20 bp, Artificial
  CRISPR gRNA sequence
ggggtggaggatgcatgggg

SEQ ID NO: 510325 - DNA, 20 bp, Artificial
  CRISPR gRNA sequence
gggtggaggatgcatgggga

SEQ ID NO: 510326 - DNA, 20 bp, Artificial
  CRISPR gRNA sequence
ggaggatgcatggggagggc

SEQ ID NO: 510327 - DNA, 20 bp, Artificial
  CRISPR gRNA sequence
gcatggggagggctggcccc

SEQ ID NO: 510328 - DNA, 20 bp, Artificial
  CRISPR gRNA sequence
atggggagggctggccccaa

SEQ ID NO: 510329 - DNA, 20 bp, Artificial
  CRISPR gRNA sequence
gagggctggccccaagagtg

SEQ ID NO: 510330 - DNA, 20 bp, Artificial
  CRISPR gRNA sequence
tggccccaagagtgcagtgt

SEQ ID NO: 510331 - DNA, 20 bp, Artificial
  CRISPR gRNA sequence
ggccccaagagtgcagtgtt

SEQ ID NO: 510332 - DNA, 20 bp, Artificial
  CRISPR gRNA sequence
gccccaagagtgcagtgttg

SEQ ID NO: 510333 - DNA, 20 bp, Artificial
  CRISPR gRNA sequence
ccccaagagtgcagtgttgg

SEQ ID NO: 510334 - DNA, 20 bp, Artificial
  CRISPR gRNA sequence
caagagtgcagtgttggggg

SEQ ID NO: 510335 - DNA, 20 bp, Artificial
  CRISPR gRNA sequence
aagagtgcagtgttggggga

SEQ ID NO: 510336 - DNA, 20 bp, Artificial
  CRISPR gRNA sequence
agagtgcagtgttgggggaa

SEQ ID NO: 510337 - DNA, 20 bp, Artificial
  CRISPR gRNA sequence
gagtgcagtgttgggggaag

SEQ ID NO: 510338 - DNA, 20 bp, Artificial
  CRISPR gRNA sequence
agtgcagtgttgggggaagg

SEQ ID NO: 510339 - DNA, 20 bp, Artificial
  CRISPR gRNA sequence
cagtgttgggggaagggggc

SEQ ID NO: 510340 - DNA, 20 bp, Artificial
  CRISPR gRNA sequence
agtgttgggggaagggggcc

SEQ ID NO: 510341 - DNA, 20 bp, Artificial
  CRISPR gRNA sequence
gttgggggaagggggccagg

SEQ ID NO: 510342 - DNA, 20 bp, Artificial
  CRISPR gRNA sequence
ttgggggaagggggccaggt

SEQ ID NO: 510343 - DNA, 20 bp, Artificial
  CRISPR gRNA sequence
ggaagggggccaggtgggcc

SEQ ID NO: 510344 - DNA, 20 bp, Artificial
  CRISPR gRNA sequence
gaagggggccaggtgggcct

SEQ ID NO: 510345 - DNA, 20 bp, Artificial
  CRISPR gRNA sequence
ggccaggtgggcctgggacc

SEQ ID NO: 510346 - DNA, 20 bp, Artificial
  CRISPR gRNA sequence
gccaggtgggcctgggaccc

SEQ ID NO: 510347 - DNA, 20 bp, Artificial
  CRISPR gRNA sequence
ccaggtgggcctgggaccca

SEQ ID NO: 510348 - DNA, 20 bp, Artificial
  CRISPR gRNA sequence
caggtgggcctgggacccag

SEQ ID NO: 510349 - DNA, 20 bp, Artificial
  CRISPR gRNA sequence
gggcctgggacccaggggcg

SEQ ID NO: 510350 - DNA, 20 bp, Artificial
  CRISPR gRNA sequence
ggcttcaatccccctcccac

SEQ ID NO: 510351 - DNA, 20 bp, Artificial
  CRISPR gRNA sequence
gcttcaatccccctcccacc

SEQ ID NO: 510352 - DNA, 20 bp, Artificial
  CRISPR gRNA sequence
tccccctcccaccaggacct

SEQ ID NO: 510353 - DNA, 20 bp, Artificial
  CRISPR gRNA sequence
ccccctcccaccaggacctt

SEQ ID NO: 510354 - DNA, 20 bp, Artificial
  CRISPR gRNA sequence
tcccaccaggaccttgggaa

SEQ ID NO: 510355 - DNA, 20 bp, Artificial
  CRISPR gRNA sequence
aggaccttgggaatggcctc

SEQ ID NO: 510356 - DNA, 20 bp, Artificial
  CRISPR gRNA sequence
ggaccttgggaatggcctcc

SEQ ID NO: 510357 - DNA, 20 bp, Artificial
  CRISPR gRNA sequence
accttgggaatggcctccag

SEQ ID NO: 510358 - DNA, 20 bp, Artificial
  CRISPR gRNA sequence
tggcctccaggagcctgttg

SEQ ID NO: 510359 - DNA, 20 bp, Artificial
  CRISPR gRNA sequence
ggcctccaggagcctgttgt

SEQ ID NO: 510360 - DNA, 20 bp, Artificial
  CRISPR gRNA sequence
gcctccaggagcctgttgtg

SEQ ID NO: 510361 - DNA, 20 bp, Artificial
  CRISPR gRNA sequence
ctccaggagcctgttgtggg

SEQ ID NO: 510362 - DNA, 20 bp, Artificial
  CRISPR gRNA sequence
tccaggagcctgttgtgggg

SEQ ID NO: 510363 - DNA, 20 bp, Artificial
  CRISPR gRNA sequence
ggagcctgttgtggggaggc

SEQ ID NO: 510364 - DNA, 20 bp, Artificial
  CRISPR gRNA sequence
gagcctgttgtggggaggcc

SEQ ID NO: 510365 - DNA, 20 bp, Artificial
  CRISPR gRNA sequence
agcctgttgtggggaggcca

SEQ ID NO: 510366 - DNA, 20 bp, Artificial
  CRISPR gRNA sequence
tgtggggaggccagggtcac

SEQ ID NO: 510367 - DNA, 20 bp, Artificial
  CRISPR gRNA sequence
accagctgaaccaactcgac

SEQ ID NO: 510368 - DNA, 20 bp, Artificial
  CRISPR gRNA sequence
ccaactcgaccagaatcgca

SEQ ID NO: 510369 - DNA, 20 bp, Artificial
  CRISPR gRNA sequence
actcgaccagaatcgcacag

SEQ ID NO: 510370 - DNA, 20 bp, Artificial
  CRISPR gRNA sequence
cagcggtgcccgctccccta

SEQ ID NO: 510371 - DNA, 20 bp, Artificial
  CRISPR gRNA sequence
ggtgcccgctcccctacagc

SEQ ID NO: 510372 - DNA, 20 bp, Artificial
  CRISPR gRNA sequence
ccctacagcaagacgtcacc

SEQ ID NO: 510373 - DNA, 20 bp, Artificial
  CRISPR gRNA sequence
cctacagcaagacgtcaccc

SEQ ID NO: 510374 - DNA, 20 bp, Artificial
  CRISPR gRNA sequence
ctacagcaagacgtcaccca

SEQ ID NO: 510375 - DNA, 20 bp, Artificial
  CRISPR gRNA sequence
tacagcaagacgtcacccag

SEQ ID NO: 510376 - DNA, 20 bp, Artificial
  CRISPR gRNA sequence
acgtcacccaggggtcccca

SEQ ID NO: 510377 - DNA, 20 bp, Artificial
  CRISPR gRNA sequence
gtcacccaggggtccccacg

SEQ ID NO: 510378 - DNA, 20 bp, Artificial
  CRISPR gRNA sequence
tcacccaggggtccccacgg

SEQ ID NO: 510379 - DNA, 20 bp, Artificial
  CRISPR gRNA sequence
acccaggggtccccacggag

SEQ ID NO: 510380 - DNA, 20 bp, Artificial
  CRISPR gRNA sequence
cccaggggtccccacggagg

SEQ ID NO: 510381 - DNA, 20 bp, Artificial
  CRISPR gRNA sequence
aggggtccccacggaggagg

SEQ ID NO: 510382 - DNA, 20 bp, Artificial
  CRISPR gRNA sequence
ggggtccccacggaggaggc

SEQ ID NO: 510383 - DNA, 20 bp, Artificial
  CRISPR gRNA sequence
gggtccccacggaggaggca

SEQ ID NO: 510384 - DNA, 20 bp, Artificial
  CRISPR gRNA sequence
tccccacggaggaggcaggg

SEQ ID NO: 510385 - DNA, 20 bp, Artificial
  CRISPR gRNA sequence
cggaggaggcagggaagctc

SEQ ID NO: 510386 - DNA, 20 bp, Artificial
  CRISPR gRNA sequence
ggaggaggcagggaagctcg

SEQ ID NO: 510387 - DNA, 20 bp, Artificial
  CRISPR gRNA sequence
gaggaggcagggaagctcga

SEQ ID NO: 510388 - DNA, 20 bp, Artificial
  CRISPR gRNA sequence
gcagggaagctcgagggtcc

SEQ ID NO: 510389 - DNA, 20 bp, Artificial
  CRISPR gRNA sequence
agggaagctcgagggtccca

SEQ ID NO: 510390 - DNA, 20 bp, Artificial
  CRISPR gRNA sequence
gggaagctcgagggtcccag

SEQ ID NO: 510391 - DNA, 20 bp, Artificial
  CRISPR gRNA sequence
gaagctcgagggtcccagag

SEQ ID NO: 510392 - DNA, 20 bp, Artificial
  CRISPR gRNA sequence
tcgagggtcccagaggagca

SEQ ID NO: 510393 - DNA, 20 bp, Artificial
  CRISPR gRNA sequence
gagggtcccagaggagcatg

SEQ ID NO: 510394 - DNA, 20 bp, Artificial
  CRISPR gRNA sequence
caccatacatgtacatacaa

SEQ ID NO: 510395 - DNA, 20 bp, Artificial
  CRISPR gRNA sequence
tatcacacaccacacactgc

SEQ ID NO: 510396 - DNA, 20 bp, Artificial
  CRISPR gRNA sequence
ccacacactgcgagtcgatc

SEQ ID NO: 510397 - DNA, 20 bp, Artificial
  CRISPR gRNA sequence
acacactgcgagtcgatctg

SEQ ID NO: 510398 - DNA, 20 bp, Artificial
  CRISPR gRNA sequence
actgcgagtcgatctggaga

SEQ ID NO: 510399 - DNA, 20 bp, Artificial
  CRISPR gRNA sequence
atctggagatggaatcgctg

SEQ ID NO: 510400 - DNA, 20 bp, Artificial
  CRISPR gRNA sequence
ggagatggaatcgctgtagc

SEQ ID NO: 510401 - DNA, 20 bp, Artificial
  CRISPR gRNA sequence
gagatggaatcgctgtagcc

SEQ ID NO: 510402 - DNA, 20 bp, Artificial
  CRISPR gRNA sequence
atggaatcgctgtagccagg

SEQ ID NO: 510403 - DNA, 20 bp, Artificial
  CRISPR gRNA sequence
tggaatcgctgtagccaggc

SEQ ID NO: 510404 - DNA, 20 bp, Artificial
  CRISPR gRNA sequence
ggaatcgctgtagccaggcg

SEQ ID NO: 510405 - DNA, 20 bp, Artificial
  CRISPR gRNA sequence
atcgctgtagccaggcgggg

SEQ ID NO: 510406 - DNA, 20 bp, Artificial
  CRISPR gRNA sequence
tagccaggcggggcagcatg

SEQ ID NO: 510407 - DNA, 20 bp, Artificial
  CRISPR gRNA sequence
caggcggggcagcatgcaga

SEQ ID NO: 510408 - DNA, 20 bp, Artificial
  CRISPR gRNA sequence
aggcggggcagcatgcagac

SEQ ID NO: 510409 - DNA, 20 bp, Artificial
  CRISPR gRNA sequence
gcggggcagcatgcagacag

SEQ ID NO: 510410 - DNA, 20 bp, Artificial
  CRISPR gRNA sequence
cggggcagcatgcagacagg

SEQ ID NO: 510411 - DNA, 20 bp, Artificial
  CRISPR gRNA sequence
ggggcagcatgcagacagga

SEQ ID NO: 510412 - DNA, 20 bp, Artificial
  CRISPR gRNA sequence
gcagacaggagggcctaaca

SEQ ID NO: 510413 - DNA, 20 bp, Artificial
  CRISPR gRNA sequence
cagacaggagggcctaacac

SEQ ID NO: 510414 - DNA, 20 bp, Artificial
  CRISPR gRNA sequence
acaggagggcctaacacagg

SEQ ID NO: 510415 - DNA, 20 bp, Artificial
  CRISPR gRNA sequence
caggagggcctaacacaggc

SEQ ID NO: 510416 - DNA, 20 bp, Artificial
  CRISPR gRNA sequence
gggcctaacacaggcaggcg

SEQ ID NO: 510417 - DNA, 20 bp, Artificial
  CRISPR gRNA sequence
cctaacacaggcaggcgcag

SEQ ID NO: 510418 - DNA, 20 bp, Artificial
  CRISPR gRNA sequence
ctaacacaggcaggcgcagc

SEQ ID NO: 510419 - DNA, 20 bp, Artificial
  CRISPR gRNA sequence
aggcaggcgcagcaggttca

SEQ ID NO: 510420 - DNA, 20 bp, Artificial
  CRISPR gRNA sequence
gcaggcgcagcaggttcaca

SEQ ID NO: 510421 - DNA, 20 bp, Artificial
  CRISPR gRNA sequence
caggcgcagcaggttcacag

SEQ ID NO: 510422 - DNA, 20 bp, Artificial
  CRISPR gRNA sequence
ggcgcagcaggttcacagag

SEQ ID NO: 510423 - DNA, 20 bp, Artificial
  CRISPR gRNA sequence
gcgcagcaggttcacagagg

SEQ ID NO: 510424 - DNA, 20 bp, Artificial
  CRISPR gRNA sequence
caggttcacagaggaggccc

SEQ ID NO: 510425 - DNA, 20 bp, Artificial
  CRISPR gRNA sequence
aggttcacagaggaggcccc

SEQ ID NO: 510426 - DNA, 20 bp, Artificial
  CRISPR gRNA sequence
ccgggaacctgcctcctgcc

SEQ ID NO: 510427 - DNA, 20 bp, Artificial
  CRISPR gRNA sequence
aacctgcctcctgcccagcc

SEQ ID NO: 510428 - DNA, 20 bp, Artificial
  CRISPR gRNA sequence
cctgcctcctgcccagcccg

SEQ ID NO: 510429 - DNA, 20 bp, Artificial
  CRISPR gRNA sequence
tcctgcccagcccggagcac

SEQ ID NO: 510430 - DNA, 20 bp, Artificial
  CRISPR gRNA sequence
cctgcccagcccggagcacc

SEQ ID NO: 510431 - DNA, 20 bp, Artificial
  CRISPR gRNA sequence
cccggagcaccaggaccccc

SEQ ID NO: 510432 - DNA, 20 bp, Artificial
  CRISPR gRNA sequence
ggaccccccagccgtccccc

SEQ ID NO: 510433 - DNA, 20 bp, Artificial
  CRISPR gRNA sequence
gaccccccagccgtccccct

SEQ ID NO: 510434 - DNA, 20 bp, Artificial
  CRISPR gRNA sequence
accccccagccgtcccccta

SEQ ID NO: 510435 - DNA, 20 bp, Artificial
  CRISPR gRNA sequence
ccccccagccgtccccctag

SEQ ID NO: 510436 - DNA, 20 bp, Artificial
  CRISPR gRNA sequence
gccgtccccctaggggcttg

SEQ ID NO: 510437 - DNA, 20 bp, Artificial
  CRISPR gRNA sequence
ccgtccccctaggggcttgt

SEQ ID NO: 510438 - DNA, 20 bp, Artificial
  CRISPR gRNA sequence
cccctaggggcttgtgggcc

SEQ ID NO: 510439 - DNA, 20 bp, Artificial
  CRISPR gRNA sequence
ttgtgggcccagcctcttcc

SEQ ID NO: 510440 - DNA, 20 bp, Artificial
  CRISPR gRNA sequence
cagcctcttcctggccttgc

SEQ ID NO: 510441 - DNA, 20 bp, Artificial
  CRISPR gRNA sequence
tcctggccttgccggcctca

SEQ ID NO: 510442 - DNA, 20 bp, Artificial
  CRISPR gRNA sequence
agccccttgtcctcccatgc

SEQ ID NO: 510443 - DNA, 20 bp, Artificial
  CRISPR gRNA sequence
tcccatgccggccccatcct

SEQ ID NO: 510444 - DNA, 20 bp, Artificial
  CRISPR gRNA sequence
ccggccccatcctcagccgc

SEQ ID NO: 510445 - DNA, 20 bp, Artificial
  CRISPR gRNA sequence
tcctcagccgcaagcgctcc

SEQ ID NO: 510446 - DNA, 20 bp, Artificial
  CRISPR gRNA sequence
agcgctcccagcacaccatg

SEQ ID NO: 510447 - DNA, 20 bp, Artificial
  CRISPR gRNA sequence
acaccatgtggctctgctct

SEQ ID NO: 510448 - DNA, 20 bp, Artificial
  CRISPR gRNA sequence
ccatgtggctctgctcttgg

SEQ ID NO: 510449 - DNA, 20 bp, Artificial
  CRISPR gRNA sequence
tgtggctctgctcttggtgg

SEQ ID NO: 510450 - DNA, 20 bp, Artificial
  CRISPR gRNA sequence
gtggctctgctcttggtggc

SEQ ID NO: 510451 - DNA, 20 bp, Artificial
  CRISPR gRNA sequence
tggcaggcacttccccttgc

SEQ ID NO: 510452 - DNA, 20 bp, Artificial
  CRISPR gRNA sequence
ggcaggcacttccccttgcc

SEQ ID NO: 510453 - DNA, 20 bp, Artificial
  CRISPR gRNA sequence
cttccccttgccgggtctca

SEQ ID NO: 510454 - DNA, 20 bp, Artificial
  CRISPR gRNA sequence
ttccccttgccgggtctcaa

SEQ ID NO: 510455 - DNA, 20 bp, Artificial
  CRISPR gRNA sequence
tccccttgccgggtctcaaa

SEQ ID NO: 510456 - DNA, 20 bp, Artificial
  CRISPR gRNA sequence
ccccttgccgggtctcaaag

SEQ ID NO: 510457 - DNA, 20 bp, Artificial
  CRISPR gRNA sequence
ccgggtctcaaaggggaccc

SEQ ID NO: 510458 - DNA, 20 bp, Artificial
  CRISPR gRNA sequence
gggtctcaaaggggaccctg

SEQ ID NO: 510459 - DNA, 20 bp, Artificial
  CRISPR gRNA sequence
tctcaaaggggaccctggag

SEQ ID NO: 510460 - DNA, 20 bp, Artificial
  CRISPR gRNA sequence
aaaggggaccctggagcaga

SEQ ID NO: 510461 - DNA, 20 bp, Artificial
  CRISPR gRNA sequence
ggaccctggagcagacggtc

SEQ ID NO: 510462 - DNA, 20 bp, Artificial
  CRISPR gRNA sequence
accctggagcagacggtctg

SEQ ID NO: 510463 - DNA, 20 bp, Artificial
  CRISPR gRNA sequence
gtctggagaccccttcctgc

SEQ ID NO: 510464 - DNA, 20 bp, Artificial
  CRISPR gRNA sequence
cccttcctgccagacacccc

SEQ ID NO: 510465 - DNA, 20 bp, Artificial
  CRISPR gRNA sequence
ccttcctgccagacacccct

SEQ ID NO: 510466 - DNA, 20 bp, Artificial
  CRISPR gRNA sequence
cctgccagacacccctgggc

SEQ ID NO: 510467 - DNA, 20 bp, Artificial
  CRISPR gRNA sequence
ctgccagacacccctgggcc

SEQ ID NO: 510468 - DNA, 20 bp, Artificial
  CRISPR gRNA sequence
tgccagacacccctgggccg

SEQ ID NO: 510469 - DNA, 20 bp, Artificial
  CRISPR gRNA sequence
cacccctgggccggggctat

SEQ ID NO: 510470 - DNA, 20 bp, Artificial
  CRISPR gRNA sequence
ccctgggccggggctataag

SEQ ID NO: 510471 - DNA, 20 bp, Artificial
  CRISPR gRNA sequence
cctgggccggggctataagc

SEQ ID NO: 510472 - DNA, 20 bp, Artificial
  CRISPR gRNA sequence
ctgggccggggctataagca

SEQ ID NO: 510473 - DNA, 20 bp, Artificial
  CRISPR gRNA sequence
ggggctataagcagggccac

SEQ ID NO: 510474 - DNA, 20 bp, Artificial
  CRISPR gRNA sequence
gggctataagcagggccacc

SEQ ID NO: 510475 - DNA, 20 bp, Artificial
  CRISPR gRNA sequence
ggctataagcagggccacca

SEQ ID NO: 510476 - DNA, 20 bp, Artificial
  CRISPR gRNA sequence
cagggccaccagggtcactc

SEQ ID NO: 510477 - DNA, 20 bp, Artificial
  CRISPR gRNA sequence
agggccaccagggtcactcc

SEQ ID NO: 510478 - DNA, 20 bp, Artificial
  CRISPR gRNA sequence
ccaccagggtcactccaggc

SEQ ID NO: 510479 - DNA, 20 bp, Artificial
  CRISPR gRNA sequence
caccagggtcactccaggct

SEQ ID NO: 510480 - DNA, 20 bp, Artificial
  CRISPR gRNA sequence
accagggtcactccaggctg

SEQ ID NO: 510481 - DNA, 20 bp, Artificial
  CRISPR gRNA sequence
agggtcactccaggctgggg

SEQ ID NO: 510482 - DNA, 20 bp, Artificial
  CRISPR gRNA sequence
gggtcactccaggctggggc

SEQ ID NO: 510483 - DNA, 20 bp, Artificial
  CRISPR gRNA sequence
gtcactccaggctggggcag

SEQ ID NO: 510484 - DNA, 20 bp, Artificial
  CRISPR gRNA sequence
cactccaggctggggcagga

SEQ ID NO: 510485 - DNA, 20 bp, Artificial
  CRISPR gRNA sequence
cttccctccaaaaatcaccg

SEQ ID NO: 510486 - DNA, 20 bp, Artificial
  CRISPR gRNA sequence
tccaaaaatcaccgtggaca

SEQ ID NO: 510487 - DNA, 20 bp, Artificial
  CRISPR gRNA sequence
aaaaatcaccgtggacatag

SEQ ID NO: 510488 - DNA, 20 bp, Artificial
  CRISPR gRNA sequence
aaaatcaccgtggacatagc

SEQ ID NO: 510489 - DNA, 20 bp, Artificial
  CRISPR gRNA sequence
aaatcaccgtggacatagcg

SEQ ID NO: 510490 - DNA, 20 bp, Artificial
  CRISPR gRNA sequence
ggcctctgcacactcaccct

SEQ ID NO: 510491 - DNA, 20 bp, Artificial
  CRISPR gRNA sequence
cacactcaccctcggtgtgc

SEQ ID NO: 510492 - DNA, 20 bp, Artificial
  CRISPR gRNA sequence
cactcaccctcggtgtgctg

SEQ ID NO: 510493 - DNA, 20 bp, Artificial
  CRISPR gRNA sequence
cctcggtgtgctggagtcct

SEQ ID NO: 510494 - DNA, 20 bp, Artificial
  CRISPR gRNA sequence
cggtgtgctggagtcctcgg

SEQ ID NO: 510495 - DNA, 20 bp, Artificial
  CRISPR gRNA sequence
ggagtcctcggcggtgctcc

SEQ ID NO: 510496 - DNA, 20 bp, Artificial
  CRISPR gRNA sequence
tcctcggcggtgctcctggc

SEQ ID NO: 510497 - DNA, 20 bp, Artificial
  CRISPR gRNA sequence
cctcggcggtgctcctggct

SEQ ID NO: 510498 - DNA, 20 bp, Artificial
  CRISPR gRNA sequence
gcggtgctcctggctgggcg

SEQ ID NO: 510499 - DNA, 20 bp, Artificial
  CRISPR gRNA sequence
cggtgctcctggctgggcgt

SEQ ID NO: 510500 - DNA, 20 bp, Artificial
  CRISPR gRNA sequence
ggtgctcctggctgggcgtg

SEQ ID NO: 510501 - DNA, 20 bp, Artificial
  CRISPR gRNA sequence
gtgctcctggctgggcgtgg

SEQ ID NO: 510502 - DNA, 20 bp, Artificial
  CRISPR gRNA sequence
gggcgtgggggctttgctac

SEQ ID NO: 510503 - DNA, 20 bp, Artificial
  CRISPR gRNA sequence
gctttgctaccagtctgccc

SEQ ID NO: 510504 - DNA, 20 bp, Artificial
  CRISPR gRNA sequence
ctttgctaccagtctgccct

SEQ ID NO: 510505 - DNA, 20 bp, Artificial
  CRISPR gRNA sequence
agtctgccctgggtcacgtc

SEQ ID NO: 510506 - DNA, 20 bp, Artificial
  CRISPR gRNA sequence
tgggtcacgtctagaaacct

SEQ ID NO: 510507 - DNA, 20 bp, Artificial
  CRISPR gRNA sequence
tcacgtctagaaacctcagc

SEQ ID NO: 510508 - DNA, 20 bp, Artificial
  CRISPR gRNA sequence
acgtctagaaacctcagctg

SEQ ID NO: 510509 - DNA, 20 bp, Artificial
  CRISPR gRNA sequence
cgtctagaaacctcagctgg

SEQ ID NO: 510510 - DNA, 20 bp, Artificial
  CRISPR gRNA sequence
agaaacctcagctggaggcg

SEQ ID NO: 510511 - DNA, 20 bp, Artificial
  CRISPR gRNA sequence
gaaacctcagctggaggcgc

SEQ ID NO: 510512 - DNA, 20 bp, Artificial
  CRISPR gRNA sequence
agctggaggcgcgggtcgta

SEQ ID NO: 510513 - DNA, 20 bp, Artificial
  CRISPR gRNA sequence
ctgacacttcctgttcctct

SEQ ID NO: 510514 - DNA, 20 bp, Artificial
  CRISPR gRNA sequence
tgttcctctcagctcctcct

SEQ ID NO: 510515 - DNA, 20 bp, Artificial
  CRISPR gRNA sequence
ttcctctcagctcctccttg

SEQ ID NO: 510516 - DNA, 20 bp, Artificial
  CRISPR gRNA sequence
tcctctcagctcctccttgg

SEQ ID NO: 510517 - DNA, 20 bp, Artificial
  CRISPR gRNA sequence
tctcagctcctccttggagg

SEQ ID NO: 510518 - DNA, 20 bp, Artificial
  CRISPR gRNA sequence
cagctcctccttggaggaag

SEQ ID NO: 510519 - DNA, 20 bp, Artificial
  CRISPR gRNA sequence
ctcctccttggaggaagtgg

SEQ ID NO: 510520 - DNA, 20 bp, Artificial
  CRISPR gRNA sequence
tcctccttggaggaagtggt

SEQ ID NO: 510521 - DNA, 20 bp, Artificial
  CRISPR gRNA sequence
agtggtgggttgcaccaccg

SEQ ID NO: 510522 - DNA, 20 bp, Artificial
  CRISPR gRNA sequence
ccctgcccctctccgctcta

SEQ ID NO: 510523 - DNA, 20 bp, Artificial
  CRISPR gRNA sequence
tgcccctctccgctctacag

SEQ ID NO: 510524 - DNA, 20 bp, Artificial
  CRISPR gRNA sequence
ctctacagcagctctgatgt

SEQ ID NO: 510525 - DNA, 20 bp, Artificial
  CRISPR gRNA sequence
ctacagcagctctgatgtca

SEQ ID NO: 510526 - DNA, 20 bp, Artificial
  CRISPR gRNA sequence
ctctgacatcagagctgctg

SEQ ID NO: 510527 - DNA, 20 bp, Artificial
  CRISPR gRNA sequence
ctgacatcagagctgctgta

SEQ ID NO: 510528 - DNA, 20 bp, Artificial
  CRISPR gRNA sequence
acatcagagctgctgtagag

SEQ ID NO: 510529 - DNA, 20 bp, Artificial
  CRISPR gRNA sequence
atcagagctgctgtagagcg

SEQ ID NO: 510530 - DNA, 20 bp, Artificial
  CRISPR gRNA sequence
cagagctgctgtagagcgga

SEQ ID NO: 510531 - DNA, 20 bp, Artificial
  CRISPR gRNA sequence
agagctgctgtagagcggag

SEQ ID NO: 510532 - DNA, 20 bp, Artificial
  CRISPR gRNA sequence
gagctgctgtagagcggaga

SEQ ID NO: 510533 - DNA, 20 bp, Artificial
  CRISPR gRNA sequence
agctgctgtagagcggagag

SEQ ID NO: 510534 - DNA, 20 bp, Artificial
  CRISPR gRNA sequence
tgctgtagagcggagagggg

SEQ ID NO: 510535 - DNA, 20 bp, Artificial
  CRISPR gRNA sequence
gctgtagagcggagaggggc

SEQ ID NO: 510536 - DNA, 20 bp, Artificial
  CRISPR gRNA sequence
ctgtagagcggagaggggca

SEQ ID NO: 510537 - DNA, 20 bp, Artificial
  CRISPR gRNA sequence
tgtagagcggagaggggcag

SEQ ID NO: 510538 - DNA, 20 bp, Artificial
  CRISPR gRNA sequence
agcggagaggggcaggggtg

SEQ ID NO: 510539 - DNA, 20 bp, Artificial
  CRISPR gRNA sequence
gcggagaggggcaggggtga

SEQ ID NO: 510540 - DNA, 20 bp, Artificial
  CRISPR gRNA sequence
cggagaggggcaggggtgaa

SEQ ID NO: 510541 - DNA, 20 bp, Artificial
  CRISPR gRNA sequence
ggggcaggggtgaagggcca

SEQ ID NO: 510542 - DNA, 20 bp, Artificial
  CRISPR gRNA sequence
gcaggggtgaagggccacgg

SEQ ID NO: 510543 - DNA, 20 bp, Artificial
  CRISPR gRNA sequence
tgcaacccaccacttcctcc

SEQ ID NO: 510544 - DNA, 20 bp, Artificial
  CRISPR gRNA sequence
gcaacccaccacttcctcca

SEQ ID NO: 510545 - DNA, 20 bp, Artificial
  CRISPR gRNA sequence
aacccaccacttcctccaag

SEQ ID NO: 510546 - DNA, 20 bp, Artificial
  CRISPR gRNA sequence
acccaccacttcctccaagg

SEQ ID NO: 510547 - DNA, 20 bp, Artificial
  CRISPR gRNA sequence
ccaccacttcctccaaggag

SEQ ID NO: 510548 - DNA, 20 bp, Artificial
  CRISPR gRNA sequence
acttcctccaaggaggagct

SEQ ID NO: 510549 - DNA, 20 bp, Artificial
  CRISPR gRNA sequence
ttcctccaaggaggagctga

SEQ ID NO: 510550 - DNA, 20 bp, Artificial
  CRISPR gRNA sequence
tcctccaaggaggagctgag

SEQ ID NO: 510551 - DNA, 20 bp, Artificial
  CRISPR gRNA sequence
caaggaggagctgagaggaa

SEQ ID NO: 510552 - DNA, 20 bp, Artificial
  CRISPR gRNA sequence
aaggaggagctgagaggaac

SEQ ID NO: 510553 - DNA, 20 bp, Artificial
  CRISPR gRNA sequence
gaggagctgagaggaacagg

SEQ ID NO: 510554 - DNA, 20 bp, Artificial
  CRISPR gRNA sequence
ctgagaggaacaggaagtgt

SEQ ID NO: 510555 - DNA, 20 bp, Artificial
  CRISPR gRNA sequence
tgagaggaacaggaagtgtc

SEQ ID NO: 510556 - DNA, 20 bp, Artificial
  CRISPR gRNA sequence
gactttacgacccgcgcctc

SEQ ID NO: 510557 - DNA, 20 bp, Artificial
  CRISPR gRNA sequence
tacgacccgcgcctccagct

SEQ ID NO: 510558 - DNA, 20 bp, Artificial
  CRISPR gRNA sequence
acgacccgcgcctccagctg

SEQ ID NO: 510559 - DNA, 20 bp, Artificial
  CRISPR gRNA sequence
gcgcctccagctgaggtttc

SEQ ID NO: 510560 - DNA, 20 bp, Artificial
  CRISPR gRNA sequence
tgaggtttctagacgtgacc

SEQ ID NO: 510561 - DNA, 20 bp, Artificial
  CRISPR gRNA sequence
gaggtttctagacgtgaccc

SEQ ID NO: 510562 - DNA, 20 bp, Artificial
  CRISPR gRNA sequence
aggtttctagacgtgaccca

SEQ ID NO: 510563 - DNA, 20 bp, Artificial
  CRISPR gRNA sequence
tttctagacgtgacccaggg

SEQ ID NO: 510564 - DNA, 20 bp, Artificial
  CRISPR gRNA sequence
agacgtgacccagggcagac

SEQ ID NO: 510565 - DNA, 20 bp, Artificial
  CRISPR gRNA sequence
cgtgacccagggcagactgg

SEQ ID NO: 510566 - DNA, 20 bp, Artificial
  CRISPR gRNA sequence
cccagggcagactggtagca

SEQ ID NO: 510567 - DNA, 20 bp, Artificial
  CRISPR gRNA sequence
ggtagcaaagcccccacgcc

SEQ ID NO: 510568 - DNA, 20 bp, Artificial
  CRISPR gRNA sequence
gcaaagcccccacgcccagc

SEQ ID NO: 510569 - DNA, 20 bp, Artificial
  CRISPR gRNA sequence
caaagcccccacgcccagcc

SEQ ID NO: 510570 - DNA, 20 bp, Artificial
  CRISPR gRNA sequence
aagcccccacgcccagccag

SEQ ID NO: 510571 - DNA, 20 bp, Artificial
  CRISPR gRNA sequence
gcccagccaggagcaccgcc

SEQ ID NO: 510572 - DNA, 20 bp, Artificial
  CRISPR gRNA sequence
cccagccaggagcaccgccg

SEQ ID NO: 510573 - DNA, 20 bp, Artificial
  CRISPR gRNA sequence
aggagcaccgccgaggactc

SEQ ID NO: 510574 - DNA, 20 bp, Artificial
  CRISPR gRNA sequence
gccgaggactccagcacacc

SEQ ID NO: 510575 - DNA, 20 bp, Artificial
  CRISPR gRNA sequence
ccgaggactccagcacaccg

SEQ ID NO: 510576 - DNA, 20 bp, Artificial
  CRISPR gRNA sequence
cgaggactccagcacaccga

SEQ ID NO: 510577 - DNA, 20 bp, Artificial
  CRISPR gRNA sequence
gactccagcacaccgagggt

SEQ ID NO: 510578 - DNA, 20 bp, Artificial
  CRISPR gRNA sequence
gcacaccgagggtgagtgtg

SEQ ID NO: 510579 - DNA, 20 bp, Artificial
  CRISPR gRNA sequence
acaccgagggtgagtgtgca

SEQ ID NO: 510580 - DNA, 20 bp, Artificial
  CRISPR gRNA sequence
caccgagggtgagtgtgcag

SEQ ID NO: 510581 - DNA, 20 bp, Artificial
  CRISPR gRNA sequence
cagaggccccgctatgtcca

SEQ ID NO: 510582 - DNA, 20 bp, Artificial
  CRISPR gRNA sequence
gctatgtccacggtgatttt

SEQ ID NO: 510583 - DNA, 20 bp, Artificial
  CRISPR gRNA sequence
tatgtccacggtgatttttg

SEQ ID NO: 510584 - DNA, 20 bp, Artificial
  CRISPR gRNA sequence
atgtccacggtgatttttgg

SEQ ID NO: 510585 - DNA, 20 bp, Artificial
  CRISPR gRNA sequence
tgtccacggtgatttttgga

SEQ ID NO: 510586 - DNA, 20 bp, Artificial
  CRISPR gRNA sequence
ccacggtgatttttggaggg

SEQ ID NO: 510587 - DNA, 20 bp, Artificial
  CRISPR gRNA sequence
agggaagcactctcctgccc

SEQ ID NO: 510588 - DNA, 20 bp, Artificial
  CRISPR gRNA sequence
agcactctcctgccccagcc

SEQ ID NO: 510589 - DNA, 20 bp, Artificial
  CRISPR gRNA sequence
cactctcctgccccagcctg

SEQ ID NO: 510590 - DNA, 20 bp, Artificial
  CRISPR gRNA sequence
gccccagcctggagtgaccc

SEQ ID NO: 510591 - DNA, 20 bp, Artificial
  CRISPR gRNA sequence
ccagcctggagtgaccctgg

SEQ ID NO: 510592 - DNA, 20 bp, Artificial
  CRISPR gRNA sequence
gaccctggtggccctgctta

SEQ ID NO: 510593 - DNA, 20 bp, Artificial
  CRISPR gRNA sequence
ggtggccctgcttatagccc

SEQ ID NO: 510594 - DNA, 20 bp, Artificial
  CRISPR gRNA sequence
ccctgcttatagccccggcc

SEQ ID NO: 510595 - DNA, 20 bp, Artificial
  CRISPR gRNA sequence
cctgcttatagccccggccc

SEQ ID NO: 510596 - DNA, 20 bp, Artificial
  CRISPR gRNA sequence
ctgcttatagccccggccca

SEQ ID NO: 510597 - DNA, 20 bp, Artificial
  CRISPR gRNA sequence
tgcttatagccccggcccag

SEQ ID NO: 510598 - DNA, 20 bp, Artificial
  CRISPR gRNA sequence
agccccggcccaggggtgtc

SEQ ID NO: 510599 - DNA, 20 bp, Artificial
  CRISPR gRNA sequence
cccggcccaggggtgtctgg

SEQ ID NO: 510600 - DNA, 20 bp, Artificial
  CRISPR gRNA sequence
ccggcccaggggtgtctggc

SEQ ID NO: 510601 - DNA, 20 bp, Artificial
  CRISPR gRNA sequence
gcccaggggtgtctggcagg

SEQ ID NO: 510602 - DNA, 20 bp, Artificial
  CRISPR gRNA sequence
cccaggggtgtctggcagga

SEQ ID NO: 510603 - DNA, 20 bp, Artificial
  CRISPR gRNA sequence
ccaggggtgtctggcaggaa

SEQ ID NO: 510604 - DNA, 20 bp, Artificial
  CRISPR gRNA sequence
caggggtgtctggcaggaag

SEQ ID NO: 510605 - DNA, 20 bp, Artificial
  CRISPR gRNA sequence
gtctggcaggaaggggtctc

SEQ ID NO: 510606 - DNA, 20 bp, Artificial
  CRISPR gRNA sequence
ggtctccagaccgtctgctc

SEQ ID NO: 510607 - DNA, 20 bp, Artificial
  CRISPR gRNA sequence
gtctccagaccgtctgctcc

SEQ ID NO: 510608 - DNA, 20 bp, Artificial
  CRISPR gRNA sequence
tctccagaccgtctgctcca

SEQ ID NO: 510609 - DNA, 20 bp, Artificial
  CRISPR gRNA sequence
tctgctccagggtccccttt

SEQ ID NO: 510610 - DNA, 20 bp, Artificial
  CRISPR gRNA sequence
ccagggtcccctttgagacc

SEQ ID NO: 510611 - DNA, 20 bp, Artificial
  CRISPR gRNA sequence
ggtcccctttgagacccggc

SEQ ID NO: 510612 - DNA, 20 bp, Artificial
  CRISPR gRNA sequence
gtcccctttgagacccggca

SEQ ID NO: 510613 - DNA, 20 bp, Artificial
  CRISPR gRNA sequence
tcccctttgagacccggcaa

SEQ ID NO: 510614 - DNA, 20 bp, Artificial
  CRISPR gRNA sequence
cccctttgagacccggcaag

SEQ ID NO: 510615 - DNA, 20 bp, Artificial
  CRISPR gRNA sequence
ctttgagacccggcaagggg

SEQ ID NO: 510616 - DNA, 20 bp, Artificial
  CRISPR gRNA sequence
aaggggaagtgcctgccacc

SEQ ID NO: 510617 - DNA, 20 bp, Artificial
  CRISPR gRNA sequence
ggggaagtgcctgccaccaa

SEQ ID NO: 510618 - DNA, 20 bp, Artificial
  CRISPR gRNA sequence
gaagtgcctgccaccaagag

SEQ ID NO: 510619 - DNA, 20 bp, Artificial
  CRISPR gRNA sequence
agtgcctgccaccaagagca

SEQ ID NO: 510620 - DNA, 20 bp, Artificial
  CRISPR gRNA sequence
ccaccaagagcagagccaca

SEQ ID NO: 510621 - DNA, 20 bp, Artificial
  CRISPR gRNA sequence
agcagagccacatggtgtgc

SEQ ID NO: 510622 - DNA, 20 bp, Artificial
  CRISPR gRNA sequence
gcagagccacatggtgtgct

SEQ ID NO: 510623 - DNA, 20 bp, Artificial
  CRISPR gRNA sequence
agagccacatggtgtgctgg

SEQ ID NO: 510624 - DNA, 20 bp, Artificial
  CRISPR gRNA sequence
tggtgtgctgggagcgcttg

SEQ ID NO: 510625 - DNA, 20 bp, Artificial
  CRISPR gRNA sequence
tgctgggagcgcttgcggct

SEQ ID NO: 510626 - DNA, 20 bp, Artificial
  CRISPR gRNA sequence
gctgggagcgcttgcggctg

SEQ ID NO: 510627 - DNA, 20 bp, Artificial
  CRISPR gRNA sequence
ggagcgcttgcggctgagga

SEQ ID NO: 510628 - DNA, 20 bp, Artificial
  CRISPR gRNA sequence
gagcgcttgcggctgaggat

SEQ ID NO: 510629 - DNA, 20 bp, Artificial
  CRISPR gRNA sequence
agcgcttgcggctgaggatg

SEQ ID NO: 510630 - DNA, 20 bp, Artificial
  CRISPR gRNA sequence
cttgcggctgaggatggggc

SEQ ID NO: 510631 - DNA, 20 bp, Artificial
  CRISPR gRNA sequence
ggctgaggatggggccggca

SEQ ID NO: 510632 - DNA, 20 bp, Artificial
  CRISPR gRNA sequence
gctgaggatggggccggcat

SEQ ID NO: 510633 - DNA, 20 bp, Artificial
  CRISPR gRNA sequence
tgaggatggggccggcatgg

SEQ ID NO: 510634 - DNA, 20 bp, Artificial
  CRISPR gRNA sequence
gaggatggggccggcatggg

SEQ ID NO: 510635 - DNA, 20 bp, Artificial
  CRISPR gRNA sequence
tggggccggcatgggaggac

SEQ ID NO: 510636 - DNA, 20 bp, Artificial
  CRISPR gRNA sequence
ggggccggcatgggaggaca

SEQ ID NO: 510637 - DNA, 20 bp, Artificial
  CRISPR gRNA sequence
gggccggcatgggaggacaa

SEQ ID NO: 510638 - DNA, 20 bp, Artificial
  CRISPR gRNA sequence
ggccggcatgggaggacaag

SEQ ID NO: 510639 - DNA, 20 bp, Artificial
  CRISPR gRNA sequence
atgggaggacaaggggctgt

SEQ ID NO: 510640 - DNA, 20 bp, Artificial
  CRISPR gRNA sequence
tgggaggacaaggggctgtg

SEQ ID NO: 510641 - DNA, 20 bp, Artificial
  CRISPR gRNA sequence
aggacaaggggctgtgaggc

SEQ ID NO: 510642 - DNA, 20 bp, Artificial
  CRISPR gRNA sequence
caaggggctgtgaggccggc

SEQ ID NO: 510643 - DNA, 20 bp, Artificial
  CRISPR gRNA sequence
aaggggctgtgaggccggca

SEQ ID NO: 510644 - DNA, 20 bp, Artificial
  CRISPR gRNA sequence
ggctgtgaggccggcaaggc

SEQ ID NO: 510645 - DNA, 20 bp, Artificial
  CRISPR gRNA sequence
gctgtgaggccggcaaggcc

SEQ ID NO: 510646 - DNA, 20 bp, Artificial
  CRISPR gRNA sequence
gtgaggccggcaaggccagg

SEQ ID NO: 510647 - DNA, 20 bp, Artificial
  CRISPR gRNA sequence
gaggccggcaaggccaggaa

SEQ ID NO: 510648 - DNA, 20 bp, Artificial
  CRISPR gRNA sequence
aggccggcaaggccaggaag

SEQ ID NO: 510649 - DNA, 20 bp, Artificial
  CRISPR gRNA sequence
cggcaaggccaggaagaggc

SEQ ID NO: 510650 - DNA, 20 bp, Artificial
  CRISPR gRNA sequence
ggcaaggccaggaagaggct

SEQ ID NO: 510651 - DNA, 20 bp, Artificial
  CRISPR gRNA sequence
caggaagaggctgggcccac

SEQ ID NO: 510652 - DNA, 20 bp, Artificial
  CRISPR gRNA sequence
aggctgggcccacaagcccc

SEQ ID NO: 510653 - DNA, 20 bp, Artificial
  CRISPR gRNA sequence
ggctgggcccacaagcccct

SEQ ID NO: 510654 - DNA, 20 bp, Artificial
  CRISPR gRNA sequence
gctgggcccacaagccccta

SEQ ID NO: 510655 - DNA, 20 bp, Artificial
  CRISPR gRNA sequence
ctgggcccacaagcccctag

SEQ ID NO: 510656 - DNA, 20 bp, Artificial
  CRISPR gRNA sequence
tgggcccacaagcccctagg

SEQ ID NO: 510657 - DNA, 20 bp, Artificial
  CRISPR gRNA sequence
cccacaagcccctaggggga

SEQ ID NO: 510658 - DNA, 20 bp, Artificial
  CRISPR gRNA sequence
caagcccctagggggacggc

SEQ ID NO: 510659 - DNA, 20 bp, Artificial
  CRISPR gRNA sequence
aagcccctagggggacggct

SEQ ID NO: 510660 - DNA, 20 bp, Artificial
  CRISPR gRNA sequence
agcccctagggggacggctg

SEQ ID NO: 510661 - DNA, 20 bp, Artificial
  CRISPR gRNA sequence
gcccctagggggacggctgg

SEQ ID NO: 510662 - DNA, 20 bp, Artificial
  CRISPR gRNA sequence
cccctagggggacggctggg

SEQ ID NO: 510663 - DNA, 20 bp, Artificial
  CRISPR gRNA sequence
gggggacggctggggggtcc

SEQ ID NO: 510664 - DNA, 20 bp, Artificial
  CRISPR gRNA sequence
gctggggggtcctggtgctc

SEQ ID NO: 510665 - DNA, 20 bp, Artificial
  CRISPR gRNA sequence
ctggggggtcctggtgctcc

SEQ ID NO: 510666 - DNA, 20 bp, Artificial
  CRISPR gRNA sequence
ggggtcctggtgctccgggc

SEQ ID NO: 510667 - DNA, 20 bp, Artificial
  CRISPR gRNA sequence
gggtcctggtgctccgggct

SEQ ID NO: 510668 - DNA, 20 bp, Artificial
  CRISPR gRNA sequence
tcctggtgctccgggctggg

SEQ ID NO: 510669 - DNA, 20 bp, Artificial
  CRISPR gRNA sequence
cctggtgctccgggctgggc

SEQ ID NO: 510670 - DNA, 20 bp, Artificial
  CRISPR gRNA sequence
tggtgctccgggctgggcag

SEQ ID NO: 510671 - DNA, 20 bp, Artificial
  CRISPR gRNA sequence
ggtgctccgggctgggcagg

SEQ ID NO: 510672 - DNA, 20 bp, Artificial
  CRISPR gRNA sequence
gctccgggctgggcaggagg

SEQ ID NO: 510673 - DNA, 20 bp, Artificial
  CRISPR gRNA sequence
ctccgggctgggcaggaggc

SEQ ID NO: 510674 - DNA, 20 bp, Artificial
  CRISPR gRNA sequence
ctgggcaggaggcaggttcc

SEQ ID NO: 510675 - DNA, 20 bp, Artificial
  CRISPR gRNA sequence
tgggcaggaggcaggttccc

SEQ ID NO: 510676 - DNA, 20 bp, Artificial
  CRISPR gRNA sequence
gggcaggaggcaggttcccg

SEQ ID NO: 510677 - DNA, 20 bp, Artificial
  CRISPR gRNA sequence
cctgctgcgcctgcctgtgt

SEQ ID NO: 510678 - DNA, 20 bp, Artificial
  CRISPR gRNA sequence
ctgctgcgcctgcctgtgtt

SEQ ID NO: 510679 - DNA, 20 bp, Artificial
  CRISPR gRNA sequence
tgtctgcatgctgccccgcc

SEQ ID NO: 510680 - DNA, 20 bp, Artificial
  CRISPR gRNA sequence
catgctgccccgcctggcta

SEQ ID NO: 510681 - DNA, 20 bp, Artificial
  CRISPR gRNA sequence
ggctacagcgattccatctc

SEQ ID NO: 510682 - DNA, 20 bp, Artificial
  CRISPR gRNA sequence
tccatctccagatcgactcg

SEQ ID NO: 510683 - DNA, 20 bp, Artificial
  CRISPR gRNA sequence
ccagatcgactcgcagtgtg

SEQ ID NO: 510684 - DNA, 20 bp, Artificial
  CRISPR gRNA sequence
gcagtgtgtggtgtgtgata

SEQ ID NO: 510685 - DNA, 20 bp, Artificial
  CRISPR gRNA sequence
gtgtggtgtgtgatatggtg

SEQ ID NO: 510686 - DNA, 20 bp, Artificial
  CRISPR gRNA sequence
gtgtgtgatatggtgtggtg

SEQ ID NO: 510687 - DNA, 20 bp, Artificial
  CRISPR gRNA sequence
atatggtgtggtgtggttcg

SEQ ID NO: 510688 - DNA, 20 bp, Artificial
  CRISPR gRNA sequence
gtggtgtggttcgtggtgtg

SEQ ID NO: 510689 - DNA, 20 bp, Artificial
  CRISPR gRNA sequence
ggtgtgtagtgtcgtgtgtg

SEQ ID NO: 510690 - DNA, 20 bp, Artificial
  CRISPR gRNA sequence
gtagtgtcgtgtgtgtagtg

SEQ ID NO: 510691 - DNA, 20 bp, Artificial
  CRISPR gRNA sequence
gtcgtgtgtgtagtgtggca

SEQ ID NO: 510692 - DNA, 20 bp, Artificial
  CRISPR gRNA sequence
tgtggcatggtgtgcatgta

SEQ ID NO: 510693 - DNA, 20 bp, Artificial
  CRISPR gRNA sequence
gcatgtatggtgcacgtgtg

SEQ ID NO: 510694 - DNA, 20 bp, Artificial
  CRISPR gRNA sequence
tatggtgcacgtgtgtggca

SEQ ID NO: 510695 - DNA, 20 bp, Artificial
  CRISPR gRNA sequence
tgcacgtgtgtggcatagcg

SEQ ID NO: 510696 - DNA, 20 bp, Artificial
  CRISPR gRNA sequence
gtgtgtggcatagcgtagtg

SEQ ID NO: 510697 - DNA, 20 bp, Artificial
  CRISPR gRNA sequence
ggtgtgtgtgtgtgcatgta

SEQ ID NO: 510698 - DNA, 20 bp, Artificial
  CRISPR gRNA sequence
tgtgtgcatgtatggtgtgc

SEQ ID NO: 510699 - DNA, 20 bp, Artificial
  CRISPR gRNA sequence
gcgagtgtgcgcatgtgatg

SEQ ID NO: 510700 - DNA, 20 bp, Artificial
  CRISPR gRNA sequence
cgagtgtgcgcatgtgatgt

SEQ ID NO: 510701 - DNA, 20 bp, Artificial
  CRISPR gRNA sequence
gagtgtgcgcatgtgatgtg

SEQ ID NO: 510702 - DNA, 20 bp, Artificial
  CRISPR gRNA sequence
gtgtgcgcatgtgatgtggg

SEQ ID NO: 510703 - DNA, 20 bp, Artificial
  CRISPR gRNA sequence
gtctgttgtatgtacatgta

SEQ ID NO: 510704 - DNA, 20 bp, Artificial
  CRISPR gRNA sequence
tatggtgcacatgtgtaatg

SEQ ID NO: 510705 - DNA, 20 bp, Artificial
  CRISPR gRNA sequence
tgcacatgtgtaatgtagtg

SEQ ID NO: 510706 - DNA, 20 bp, Artificial
  CRISPR gRNA sequence
atgtgtaatgtagtgtggtg

SEQ ID NO: 510707 - DNA, 20 bp, Artificial
  CRISPR gRNA sequence
taatgtagtgtggtgtggtg

SEQ ID NO: 510708 - DNA, 20 bp, Artificial
  CRISPR gRNA sequence
gcacatgctccatgctcctc

SEQ ID NO: 510709 - DNA, 20 bp, Artificial
  CRISPR gRNA sequence
cacatgctccatgctcctct

SEQ ID NO: 510710 - DNA, 20 bp, Artificial
  CRISPR gRNA sequence
catgctcctctgggaccctc

SEQ ID NO: 510711 - DNA, 20 bp, Artificial
  CRISPR gRNA sequence
gagcttccctgcctcctccg

SEQ ID NO: 510712 - DNA, 20 bp, Artificial
  CRISPR gRNA sequence
agcttccctgcctcctccgt

SEQ ID NO: 510713 - DNA, 20 bp, Artificial
  CRISPR gRNA sequence
gcttccctgcctcctccgtg

SEQ ID NO: 510714 - DNA, 20 bp, Artificial
  CRISPR gRNA sequence
gcctcctccgtggggacccc

SEQ ID NO: 510715 - DNA, 20 bp, Artificial
  CRISPR gRNA sequence
cctcctccgtggggacccct

SEQ ID NO: 510716 - DNA, 20 bp, Artificial
  CRISPR gRNA sequence
ccctgggtgacgtcttgctg

SEQ ID NO: 510717 - DNA, 20 bp, Artificial
  CRISPR gRNA sequence
cctgggtgacgtcttgctgt

SEQ ID NO: 510718 - DNA, 20 bp, Artificial
  CRISPR gRNA sequence
ctgggtgacgtcttgctgta

SEQ ID NO: 510719 - DNA, 20 bp, Artificial
  CRISPR gRNA sequence
tgggtgacgtcttgctgtag

SEQ ID NO: 510720 - DNA, 20 bp, Artificial
  CRISPR gRNA sequence
ggtgacgtcttgctgtaggg

SEQ ID NO: 510721 - DNA, 20 bp, Artificial
  CRISPR gRNA sequence
gacgtcttgctgtaggggag

SEQ ID NO: 510722 - DNA, 20 bp, Artificial
  CRISPR gRNA sequence
acgtcttgctgtaggggagc

SEQ ID NO: 510723 - DNA, 20 bp, Artificial
  CRISPR gRNA sequence
cgggcaccgctgtgcgattc

SEQ ID NO: 510724 - DNA, 20 bp, Artificial
  CRISPR gRNA sequence
accgctgtgcgattctggtc

SEQ ID NO: 510725 - DNA, 20 bp, Artificial
  CRISPR gRNA sequence
ctgtgcgattctggtcgagt

SEQ ID NO: 510726 - DNA, 20 bp, Artificial
  CRISPR gRNA sequence
cgattctggtcgagttggtt

SEQ ID NO: 510727 - DNA, 20 bp, Artificial
  CRISPR gRNA sequence
tctggtcgagttggttcagc

SEQ ID NO: 510728 - DNA, 20 bp, Artificial
  CRISPR gRNA sequence
gttggttcagctggtgaccc

SEQ ID NO: 510729 - DNA, 20 bp, Artificial
  CRISPR gRNA sequence
tgaccctggcctccccacaa

SEQ ID NO: 510730 - DNA, 20 bp, Artificial
  CRISPR gRNA sequence
gaccctggcctccccacaac

SEQ ID NO: 510731 - DNA, 20 bp, Artificial
  CRISPR gRNA sequence
gcctccccacaacaggctcc

SEQ ID NO: 510732 - DNA, 20 bp, Artificial
  CRISPR gRNA sequence
ctccccacaacaggctcctg

SEQ ID NO: 510733 - DNA, 20 bp, Artificial
  CRISPR gRNA sequence
tccccacaacaggctcctgg

SEQ ID NO: 510734 - DNA, 20 bp, Artificial
  CRISPR gRNA sequence
ggctcctggaggccattccc

SEQ ID NO: 510735 - DNA, 20 bp, Artificial
  CRISPR gRNA sequence
gctcctggaggccattccca

SEQ ID NO: 510736 - DNA, 20 bp, Artificial
  CRISPR gRNA sequence
ggaggccattcccaaggtcc

SEQ ID NO: 510737 - DNA, 20 bp, Artificial
  CRISPR gRNA sequence
ggccattcccaaggtcctgg

SEQ ID NO: 510738 - DNA, 20 bp, Artificial
  CRISPR gRNA sequence
gccattcccaaggtcctggt

SEQ ID NO: 510739 - DNA, 20 bp, Artificial
  CRISPR gRNA sequence
cattcccaaggtcctggtgg

SEQ ID NO: 510740 - DNA, 20 bp, Artificial
  CRISPR gRNA sequence
attcccaaggtcctggtggg

SEQ ID NO: 510741 - DNA, 20 bp, Artificial
  CRISPR gRNA sequence
ttcccaaggtcctggtggga

SEQ ID NO: 510742 - DNA, 20 bp, Artificial
  CRISPR gRNA sequence
tcccaaggtcctggtgggag

SEQ ID NO: 510743 - DNA, 20 bp, Artificial
  CRISPR gRNA sequence
cccaaggtcctggtgggagg

SEQ ID NO: 510744 - DNA, 20 bp, Artificial
  CRISPR gRNA sequence
tcctggtgggagggggattg

SEQ ID NO: 510745 - DNA, 20 bp, Artificial
  CRISPR gRNA sequence
ggggattgaagccacgcccc

SEQ ID NO: 510746 - DNA, 20 bp, Artificial
  CRISPR gRNA sequence
gggattgaagccacgcccct

SEQ ID NO: 510747 - DNA, 20 bp, Artificial
  CRISPR gRNA sequence
gaagccacgcccctgggtcc

SEQ ID NO: 510748 - DNA, 20 bp, Artificial
  CRISPR gRNA sequence
aagccacgcccctgggtccc

SEQ ID NO: 510749 - DNA, 20 bp, Artificial
  CRISPR gRNA sequence
ccctgggtcccaggcccacc

SEQ ID NO: 510750 - DNA, 20 bp, Artificial
  CRISPR gRNA sequence
ttcccccaacactgcactct

SEQ ID NO: 510751 - DNA, 20 bp, Artificial
  CRISPR gRNA sequence
tcccccaacactgcactctt

SEQ ID NO: 510752 - DNA, 20 bp, Artificial
  CRISPR gRNA sequence
cccccaacactgcactcttg

SEQ ID NO: 510753 - DNA, 20 bp, Artificial
  CRISPR gRNA sequence
caacactgcactcttggggc

SEQ ID NO: 510754 - DNA, 20 bp, Artificial
  CRISPR gRNA sequence
ccccatgcatcctccacccc

SEQ ID NO: 510755 - DNA, 20 bp, Artificial
  CRISPR gRNA sequence
acacccaatcccccctcccc

SEQ ID NO: 510756 - DNA, 20 bp, Artificial
  CRISPR gRNA sequence
aatcccccctcccctggatc

SEQ ID NO: 510757 - DNA, 20 bp, Artificial
  CRISPR gRNA sequence
atcccccctcccctggatct

SEQ ID NO: 510758 - DNA, 20 bp, Artificial
  CRISPR gRNA sequence
cccccctcccctggatctgg

SEQ ID NO: 510759 - DNA, 20 bp, Artificial
  CRISPR gRNA sequence
cctcccctggatctgggagc

SEQ ID NO: 510760 - DNA, 20 bp, Artificial
  CRISPR gRNA sequence
ctcccctggatctgggagct

SEQ ID NO: 510761 - DNA, 20 bp, Artificial
  CRISPR gRNA sequence
ccctgctgtccctgtccatc

SEQ ID NO: 510762 - DNA, 20 bp, Artificial
  CRISPR gRNA sequence
cctgctgtccctgtccatcc

SEQ ID NO: 510763 - DNA, 20 bp, Artificial
  CRISPR gRNA sequence
ctgctgtccctgtccatccg

SEQ ID NO: 510764 - DNA, 20 bp, Artificial
  CRISPR gRNA sequence
ccggggcccctctcctctgt

SEQ ID NO: 510765 - DNA, 20 bp, Artificial
  CRISPR gRNA sequence
ccctctcctctgtcagttcc

SEQ ID NO: 510766 - DNA, 20 bp, Artificial
  CRISPR gRNA sequence
cctctcctctgtcagttcct

SEQ ID NO: 510767 - DNA, 20 bp, Artificial
  CRISPR gRNA sequence
ctcctctgtcagttcctggg

SEQ ID NO: 510768 - DNA, 20 bp, Artificial
  CRISPR gRNA sequence
tcctctgtcagttcctgggt

SEQ ID NO: 510769 - DNA, 20 bp, Artificial
  CRISPR gRNA sequence
cctctgtcagttcctgggtg

SEQ ID NO: 510770 - DNA, 20 bp, Artificial
  CRISPR gRNA sequence
tctgtcagttcctgggtggg

SEQ ID NO: 510771 - DNA, 20 bp, Artificial
  CRISPR gRNA sequence
gtcagttcctgggtggggag

SEQ ID NO: 510772 - DNA, 20 bp, Artificial
  CRISPR gRNA sequence
tcagttcctgggtggggaga

SEQ ID NO: 510773 - DNA, 20 bp, Artificial
  CRISPR gRNA sequence
agttcctgggtggggagaag

SEQ ID NO: 510774 - DNA, 20 bp, Artificial
  CRISPR gRNA sequence
gttcctgggtggggagaagg

SEQ ID NO: 510775 - DNA, 20 bp, Artificial
  CRISPR gRNA sequence
ttcctgggtggggagaagga

SEQ ID NO: 510776 - DNA, 20 bp, Artificial
  CRISPR gRNA sequence
tcctgggtggggagaaggag

SEQ ID NO: 510777 - DNA, 20 bp, Artificial
  CRISPR gRNA sequence
tgggtggggagaaggagggg

SEQ ID NO: 510778 - DNA, 20 bp, Artificial
  CRISPR gRNA sequence
ggggagaaggaggggtggca

SEQ ID NO: 510779 - DNA, 20 bp, Artificial
  CRISPR gRNA sequence
gaggggtggcatggctgcaa

SEQ ID NO: 510780 - DNA, 20 bp, Artificial
  CRISPR gRNA sequence
aggggtggcatggctgcaat

SEQ ID NO: 510781 - DNA, 20 bp, Artificial
  CRISPR gRNA sequence
ggggtggcatggctgcaatg

SEQ ID NO: 510782 - DNA, 20 bp, Artificial
  CRISPR gRNA sequence
gtggcatggctgcaatgggg

SEQ ID NO: 510783 - DNA, 20 bp, Artificial
  CRISPR gRNA sequence
tggcatggctgcaatgggga

SEQ ID NO: 510784 - DNA, 20 bp, Artificial
  CRISPR gRNA sequence
ggcatggctgcaatggggaa

SEQ ID NO: 510785 - DNA, 20 bp, Artificial
  CRISPR gRNA sequence
gcatggctgcaatggggaag

SEQ ID NO: 510786 - DNA, 20 bp, Artificial
  CRISPR gRNA sequence
catggctgcaatggggaagg

SEQ ID NO: 510787 - DNA, 20 bp, Artificial
  CRISPR gRNA sequence
atggctgcaatggggaaggg

SEQ ID NO: 510788 - DNA, 20 bp, Artificial
  CRISPR gRNA sequence
tggctgcaatggggaagggg

SEQ ID NO: 510789 - DNA, 20 bp, Artificial
  CRISPR gRNA sequence
ggctgcaatggggaaggggg

SEQ ID NO: 510790 - DNA, 20 bp, Artificial
  CRISPR gRNA sequence
gcaatggggaagggggggga

SEQ ID NO: 510791 - DNA, 20 bp, Artificial
  CRISPR gRNA sequence
tggggaaggggggggatggc

SEQ ID NO: 510792 - DNA, 20 bp, Artificial
  CRISPR gRNA sequence
gggaaggggggggatggccg

SEQ ID NO: 510793 - DNA, 20 bp, Artificial
  CRISPR gRNA sequence
gaaggggggggatggccgga

SEQ ID NO: 510794 - DNA, 20 bp, Artificial
  CRISPR gRNA sequence
ggggggatggccggagagct

SEQ ID NO: 510795 - DNA, 20 bp, Artificial
  CRISPR gRNA sequence
gatggccggagagctcagcc

SEQ ID NO: 510796 - DNA, 20 bp, Artificial
  CRISPR gRNA sequence
atggccggagagctcagcct

SEQ ID NO: 510797 - DNA, 20 bp, Artificial
  CRISPR gRNA sequence
ggccggagagctcagcctgg

SEQ ID NO: 510798 - DNA, 20 bp, Artificial
  CRISPR gRNA sequence
ggagagctcagcctgggagc

SEQ ID NO: 510799 - DNA, 20 bp, Artificial
  CRISPR gRNA sequence
ctcagcctgggagcgagctg

SEQ ID NO: 510800 - DNA, 20 bp, Artificial
  CRISPR gRNA sequence
tcagcctgggagcgagctgt

SEQ ID NO: 510801 - DNA, 20 bp, Artificial
  CRISPR gRNA sequence
cagcctgggagcgagctgtg

SEQ ID NO: 510802 - DNA, 20 bp, Artificial
  CRISPR gRNA sequence
agcctgggagcgagctgtgg

SEQ ID NO: 510803 - DNA, 20 bp, Artificial
  CRISPR gRNA sequence
gggagcgagctgtgggggca

SEQ ID NO: 510804 - DNA, 20 bp, Artificial
  CRISPR gRNA sequence
ggagcgagctgtgggggcat

SEQ ID NO: 510805 - DNA, 20 bp, Artificial
  CRISPR gRNA sequence
gagcgagctgtgggggcata

SEQ ID NO: 510806 - DNA, 20 bp, Artificial
  CRISPR gRNA sequence
agcgagctgtgggggcatag

SEQ ID NO: 510807 - DNA, 20 bp, Artificial
  CRISPR gRNA sequence
gtcactcgccttccccgtga

SEQ ID NO: 510808 - DNA, 20 bp, Artificial
  CRISPR gRNA sequence
actcgccttccccgtgacgg

SEQ ID NO: 510809 - DNA, 20 bp, Artificial
  CRISPR gRNA sequence
tgacggtggcgcaacgcctg

SEQ ID NO: 510810 - DNA, 20 bp, Artificial
  CRISPR gRNA sequence
gacggtggcgcaacgcctgc

SEQ ID NO: 510811 - DNA, 20 bp, Artificial
  CRISPR gRNA sequence
tggcgcaacgcctgcgggtt

SEQ ID NO: 510812 - DNA, 20 bp, Artificial
  CRISPR gRNA sequence
ggcgcaacgcctgcgggttt

SEQ ID NO: 510813 - DNA, 20 bp, Artificial
  CRISPR gRNA sequence
gcgcaacgcctgcgggtttg

SEQ ID NO: 510814 - DNA, 20 bp, Artificial
  CRISPR gRNA sequence
cgcaacgcctgcgggtttgg

SEQ ID NO: 510815 - DNA, 20 bp, Artificial
  CRISPR gRNA sequence
cgcctgcgggtttgggggct

SEQ ID NO: 510816 - DNA, 20 bp, Artificial
  CRISPR gRNA sequence
gcctgcgggtttgggggctg

SEQ ID NO: 510817 - DNA, 20 bp, Artificial
  CRISPR gRNA sequence
gcgggtttgggggctgaggc

SEQ ID NO: 510818 - DNA, 20 bp, Artificial
  CRISPR gRNA sequence
tgggggctgaggccggattc

SEQ ID NO: 510819 - DNA, 20 bp, Artificial
  CRISPR gRNA sequence
ggggctgaggccggattctg

SEQ ID NO: 510820 - DNA, 20 bp, Artificial
  CRISPR gRNA sequence
gggctgaggccggattctgg

SEQ ID NO: 510821 - DNA, 20 bp, Artificial
  CRISPR gRNA sequence
gccggattctggaggcttca

SEQ ID NO: 510822 - DNA, 20 bp, Artificial
  CRISPR gRNA sequence
tctggaggcttcacagaaat

SEQ ID NO: 510823 - DNA, 20 bp, Artificial
  CRISPR gRNA sequence
gcttcacagaaatgagctgc

SEQ ID NO: 510824 - DNA, 20 bp, Artificial
  CRISPR gRNA sequence
tcacagaaatgagctgctag

SEQ ID NO: 510825 - DNA, 20 bp, Artificial
  CRISPR gRNA sequence
aaatgagctgctagaagctc

SEQ ID NO: 510826 - DNA, 20 bp, Artificial
  CRISPR gRNA sequence
aatgagctgctagaagctct

SEQ ID NO: 510827 - DNA, 20 bp, Artificial
  CRISPR gRNA sequence
tgggctgtctgccgtcaccc

SEQ ID NO: 510828 - DNA, 20 bp, Artificial
  CRISPR gRNA sequence
tcaccccagcgtttcaccat

SEQ ID NO: 510829 - DNA, 20 bp, Artificial
  CRISPR gRNA sequence
ccagcgtttcaccatgagtg

SEQ ID NO: 510830 - DNA, 20 bp, Artificial
  CRISPR gRNA sequence
gtttcaccatgagtgaagcc

SEQ ID NO: 510831 - DNA, 20 bp, Artificial
  CRISPR gRNA sequence
gagtgaagcccagctcactg

SEQ ID NO: 510832 - DNA, 20 bp, Artificial
  CRISPR gRNA sequence
ctcactgcagaatccatgcc

SEQ ID NO: 510833 - DNA, 20 bp, Artificial
  CRISPR gRNA sequence
aatccatgcccagctcactg

SEQ ID NO: 510834 - DNA, 20 bp, Artificial
  CRISPR gRNA sequence
ccagctcactgcagaatccc

SEQ ID NO: 510835 - DNA, 20 bp, Artificial
  CRISPR gRNA sequence
cagctcactgcagaatcccc

SEQ ID NO: 510836 - DNA, 20 bp, Artificial
  CRISPR gRNA sequence
agctcactgcagaatccccg

SEQ ID NO: 510837 - DNA, 20 bp, Artificial
  CRISPR gRNA sequence
gctcactgcagaatccccgg

SEQ ID NO: 510838 - DNA, 20 bp, Artificial
  CRISPR gRNA sequence
actgcagaatccccgggggc

SEQ ID NO: 510839 - DNA, 20 bp, Artificial
  CRISPR gRNA sequence
ccgggggccagcactttacc

SEQ ID NO: 510840 - DNA, 20 bp, Artificial
  CRISPR gRNA sequence
gggggccagcactttaccaa

SEQ ID NO: 510841 - DNA, 20 bp, Artificial
  CRISPR gRNA sequence
ggccagcactttaccaagag

SEQ ID NO: 510842 - DNA, 20 bp, Artificial
  CRISPR gRNA sequence
actttaccaagagtggcctc

SEQ ID NO: 510843 - DNA, 20 bp, Artificial
  CRISPR gRNA sequence
ggcctccagactccacattt

SEQ ID NO: 510844 - DNA, 20 bp, Artificial
  CRISPR gRNA sequence
gcctccagactccacatttt

SEQ ID NO: 510845 - DNA, 20 bp, Artificial
  CRISPR gRNA sequence
tccagactccacattttagg

SEQ ID NO: 510846 - DNA, 20 bp, Artificial
  CRISPR gRNA sequence
ccagactccacattttagga

SEQ ID NO: 510847 - DNA, 20 bp, Artificial
  CRISPR gRNA sequence
gaaggaactccttccccatc

SEQ ID NO: 510848 - DNA, 20 bp, Artificial
  CRISPR gRNA sequence
ctccttccccatccagctca

SEQ ID NO: 510849 - DNA, 20 bp, Artificial
  CRISPR gRNA sequence
cttccccatccagctcacag

SEQ ID NO: 510850 - DNA, 20 bp, Artificial
  CRISPR gRNA sequence
ccagctcacagcagaatccc

SEQ ID NO: 510851 - DNA, 20 bp, Artificial
  CRISPR gRNA sequence
cagctcacagcagaatcccc

SEQ ID NO: 510852 - DNA, 20 bp, Artificial
  CRISPR gRNA sequence
agctcacagcagaatcccca

SEQ ID NO: 510853 - DNA, 20 bp, Artificial
  CRISPR gRNA sequence
agaatccccagggtccctgc

SEQ ID NO: 510854 - DNA, 20 bp, Artificial
  CRISPR gRNA sequence
ccccagggtccctgccagcc

SEQ ID NO: 510855 - DNA, 20 bp, Artificial
  CRISPR gRNA sequence
gtccctgccagcctggcacc

SEQ ID NO: 510856 - DNA, 20 bp, Artificial
  CRISPR gRNA sequence
ctggcacccagcgtgcccct

SEQ ID NO: 510857 - DNA, 20 bp, Artificial
  CRISPR gRNA sequence
cagcgtgcccctcagtattc

SEQ ID NO: 510858 - DNA, 20 bp, Artificial
  CRISPR gRNA sequence
agcgtgcccctcagtattct

SEQ ID NO: 510859 - DNA, 20 bp, Artificial
  CRISPR gRNA sequence
gcgtgcccctcagtattctg

SEQ ID NO: 510860 - DNA, 20 bp, Artificial
  CRISPR gRNA sequence
cccctcagtattctggggat

SEQ ID NO: 510861 - DNA, 20 bp, Artificial
  CRISPR gRNA sequence
ctcagtattctggggatgag

SEQ ID NO: 510862 - DNA, 20 bp, Artificial
  CRISPR gRNA sequence
tcagtattctggggatgagt

SEQ ID NO: 510863 - DNA, 20 bp, Artificial
  CRISPR gRNA sequence
cagtattctggggatgagtg

SEQ ID NO: 510864 - DNA, 20 bp, Artificial
  CRISPR gRNA sequence
agtattctggggatgagtgg

SEQ ID NO: 510865 - DNA, 20 bp, Artificial
  CRISPR gRNA sequence
tattctggggatgagtgggg

SEQ ID NO: 510866 - DNA, 20 bp, Artificial
  CRISPR gRNA sequence
gagtgggggagtccctctgc

SEQ ID NO: 510867 - DNA, 20 bp, Artificial
  CRISPR gRNA sequence
agtgggggagtccctctgct

SEQ ID NO: 510868 - DNA, 20 bp, Artificial
  CRISPR gRNA sequence
gggggagtccctctgctggg

SEQ ID NO: 510869 - DNA, 20 bp, Artificial
  CRISPR gRNA sequence
gggagtccctctgctgggaa

SEQ ID NO: 510870 - DNA, 20 bp, Artificial
  CRISPR gRNA sequence
ggagtccctctgctgggaag

SEQ ID NO: 510871 - DNA, 20 bp, Artificial
  CRISPR gRNA sequence
ctctgctgggaagaggtccc

SEQ ID NO: 510872 - DNA, 20 bp, Artificial
  CRISPR gRNA sequence
ggtccctggctacgtccctg

SEQ ID NO: 510873 - DNA, 20 bp, Artificial
  CRISPR gRNA sequence
gtccctggctacgtccctgc

SEQ ID NO: 510874 - DNA, 20 bp, Artificial
  CRISPR gRNA sequence
tccctggctacgtccctgca

SEQ ID NO: 510875 - DNA, 20 bp, Artificial
  CRISPR gRNA sequence
ctggctacgtccctgcaggg

SEQ ID NO: 510876 - DNA, 20 bp, Artificial
  CRISPR gRNA sequence
gctacgtccctgcagggcgg

SEQ ID NO: 510877 - DNA, 20 bp, Artificial
  CRISPR gRNA sequence
gtccctgcagggcggcggct

SEQ ID NO: 510878 - DNA, 20 bp, Artificial
  CRISPR gRNA sequence
cggcggctgagcccatgcct

SEQ ID NO: 510879 - DNA, 20 bp, Artificial
  CRISPR gRNA sequence
ctgagcccatgcctcggccc

SEQ ID NO: 510880 - DNA, 20 bp, Artificial
  CRISPR gRNA sequence
tgagcccatgcctcggcccc

SEQ ID NO: 510881 - DNA, 20 bp, Artificial
  CRISPR gRNA sequence
gagcccatgcctcggcccca

SEQ ID NO: 510882 - DNA, 20 bp, Artificial
  CRISPR gRNA sequence
ccatgcctcggccccagggc

SEQ ID NO: 510883 - DNA, 20 bp, Artificial
  CRISPR gRNA sequence
gccccagggccagtccccgc

SEQ ID NO: 510884 - DNA, 20 bp, Artificial
  CRISPR gRNA sequence
ccccagggccagtccccgcc

SEQ ID NO: 510885 - DNA, 20 bp, Artificial
  CRISPR gRNA sequence
tccccgccgggtgccatcct

SEQ ID NO: 510886 - DNA, 20 bp, Artificial
  CRISPR gRNA sequence
ccgccgggtgccatcctgag

SEQ ID NO: 510887 - DNA, 20 bp, Artificial
  CRISPR gRNA sequence
cgccgggtgccatcctgagc

SEQ ID NO: 510888 - DNA, 20 bp, Artificial
  CRISPR gRNA sequence
gccgggtgccatcctgagca

SEQ ID NO: 510889 - DNA, 20 bp, Artificial
  CRISPR gRNA sequence
tgccatcctgagcagggcca

SEQ ID NO: 510890 - DNA, 20 bp, Artificial
  CRISPR gRNA sequence
tcctgagcagggccacagaa

SEQ ID NO: 510891 - DNA, 20 bp, Artificial
  CRISPR gRNA sequence
cacagaacagatgtcccaca

SEQ ID NO: 510892 - DNA, 20 bp, Artificial
  CRISPR gRNA sequence
gaacagatgtcccacatggc

SEQ ID NO: 510893 - DNA, 20 bp, Artificial
  CRISPR gRNA sequence
aacagatgtcccacatggcc

SEQ ID NO: 510894 - DNA, 20 bp, Artificial
  CRISPR gRNA sequence
ccacatggccaggacccctg

SEQ ID NO: 510895 - DNA, 20 bp, Artificial
  CRISPR gRNA sequence
cccctgtggccacctgaccc

SEQ ID NO: 510896 - DNA, 20 bp, Artificial
  CRISPR gRNA sequence
ccctgtggccacctgacccc

SEQ ID NO: 510897 - DNA, 20 bp, Artificial
  CRISPR gRNA sequence
cctgtggccacctgaccccg

SEQ ID NO: 510898 - DNA, 20 bp, Artificial
  CRISPR gRNA sequence
ctgtggccacctgaccccgg

SEQ ID NO: 510899 - DNA, 20 bp, Artificial
  CRISPR gRNA sequence
tgtggccacctgaccccggg

SEQ ID NO: 510900 - DNA, 20 bp, Artificial
  CRISPR gRNA sequence
gtggccacctgaccccgggg

SEQ ID NO: 510901 - DNA, 20 bp, Artificial
  CRISPR gRNA sequence
acctgaccccgggggggctg

SEQ ID NO: 510902 - DNA, 20 bp, Artificial
  CRISPR gRNA sequence
cccgggggggctgtggccct

SEQ ID NO: 510903 - DNA, 20 bp, Artificial
  CRISPR gRNA sequence
gggggctgtggccctcggtg

SEQ ID NO: 510904 - DNA, 20 bp, Artificial
  CRISPR gRNA sequence
ggctgtggccctcggtgaag

SEQ ID NO: 510905 - DNA, 20 bp, Artificial
  CRISPR gRNA sequence
gctgtggccctcggtgaagc

SEQ ID NO: 510906 - DNA, 20 bp, Artificial
  CRISPR gRNA sequence
ccctcggtgaagcaggtgac

SEQ ID NO: 510907 - DNA, 20 bp, Artificial
  CRISPR gRNA sequence
cctcggtgaagcaggtgacc

SEQ ID NO: 510908 - DNA, 20 bp, Artificial
  CRISPR gRNA sequence
cggtgaagcaggtgaccggg

SEQ ID NO: 510909 - DNA, 20 bp, Artificial
  CRISPR gRNA sequence
ggtgaagcaggtgaccgggc

SEQ ID NO: 510910 - DNA, 20 bp, Artificial
  CRISPR gRNA sequence
gcaggtgaccgggcgggctg

SEQ ID NO: 510911 - DNA, 20 bp, Artificial
  CRISPR gRNA sequence
caggtgaccgggcgggctgt

SEQ ID NO: 510912 - DNA, 20 bp, Artificial
  CRISPR gRNA sequence
aggtgaccgggcgggctgtg

SEQ ID NO: 510913 - DNA, 20 bp, Artificial
  CRISPR gRNA sequence
gggcgggctgtggggtttgt

SEQ ID NO: 510914 - DNA, 20 bp, Artificial
  CRISPR gRNA sequence
tgtggggtttgtcagctccg

SEQ ID NO: 510915 - DNA, 20 bp, Artificial
  CRISPR gRNA sequence
tccgcagcgtcactgccgct

SEQ ID NO: 510916 - DNA, 20 bp, Artificial
  CRISPR gRNA sequence
gtcactgccgctcagcgtat

SEQ ID NO: 510917 - DNA, 20 bp, Artificial
  CRISPR gRNA sequence
agcgtatgagtttccactcc

SEQ ID NO: 510918 - DNA, 20 bp, Artificial
  CRISPR gRNA sequence
cactcccagcactcaatgaa

SEQ ID NO: 510919 - DNA, 20 bp, Artificial
  CRISPR gRNA sequence
ccagcactcaatgaacagct

SEQ ID NO: 510920 - DNA, 20 bp, Artificial
  CRISPR gRNA sequence
aatgaacagctgagcaactg

SEQ ID NO: 510921 - DNA, 20 bp, Artificial
  CRISPR gRNA sequence
atgaacagctgagcaactgc

SEQ ID NO: 510922 - DNA, 20 bp, Artificial
  CRISPR gRNA sequence
gagcaactgcaggtgcctcc

SEQ ID NO: 510923 - DNA, 20 bp, Artificial
  CRISPR gRNA sequence
ctgcaggtgcctccgagtgc

SEQ ID NO: 510924 - DNA, 20 bp, Artificial
  CRISPR gRNA sequence
tgcaggtgcctccgagtgct

SEQ ID NO: 510925 - DNA, 20 bp, Artificial
  CRISPR gRNA sequence
caggtgcctccgagtgctgg

SEQ ID NO: 510926 - DNA, 20 bp, Artificial
  CRISPR gRNA sequence
ggtgcctccgagtgctggga

SEQ ID NO: 510927 - DNA, 20 bp, Artificial
  CRISPR gRNA sequence
gtgcctccgagtgctgggag

SEQ ID NO: 510928 - DNA, 20 bp, Artificial
  CRISPR gRNA sequence
tgcctccgagtgctgggaga

SEQ ID NO: 510929 - DNA, 20 bp, Artificial
  CRISPR gRNA sequence
gcctccgagtgctgggagag

SEQ ID NO: 510930 - DNA, 20 bp, Artificial
  CRISPR gRNA sequence
tgctgggagaggggaatgct

SEQ ID NO: 510931 - DNA, 20 bp, Artificial
  CRISPR gRNA sequence
agaggggaatgctcagctcc

SEQ ID NO: 510932 - DNA, 20 bp, Artificial
  CRISPR gRNA sequence
gaatgctcagctccgagtgc

SEQ ID NO: 510933 - DNA, 20 bp, Artificial
  CRISPR gRNA sequence
aatgctcagctccgagtgct

SEQ ID NO: 510934 - DNA, 20 bp, Artificial
  CRISPR gRNA sequence
tgctcagctccgagtgctgg

SEQ ID NO: 510935 - DNA, 20 bp, Artificial
  CRISPR gRNA sequence
ctcagctccgagtgctggga

SEQ ID NO: 510936 - DNA, 20 bp, Artificial
  CRISPR gRNA sequence
tcagctccgagtgctgggag

SEQ ID NO: 510937 - DNA, 20 bp, Artificial
  CRISPR gRNA sequence
cagctccgagtgctgggaga

SEQ ID NO: 510938 - DNA, 20 bp, Artificial
  CRISPR gRNA sequence
agctccgagtgctgggagag

SEQ ID NO: 510939 - DNA, 20 bp, Artificial
  CRISPR gRNA sequence
gtgctgggagaggggacgct

SEQ ID NO: 510940 - DNA, 20 bp, Artificial
  CRISPR gRNA sequence
gagaggggacgctcagctcc

SEQ ID NO: 510941 - DNA, 20 bp, Artificial
  CRISPR gRNA sequence
ggacgctcagctccgagtgc

SEQ ID NO: 510942 - DNA, 20 bp, Artificial
  CRISPR gRNA sequence
gacgctcagctccgagtgct

SEQ ID NO: 510943 - DNA, 20 bp, Artificial
  CRISPR gRNA sequence
cgctcagctccgagtgctgg

SEQ ID NO: 510944 - DNA, 20 bp, Artificial
  CRISPR gRNA sequence
ctcagctccgagtgctggga

SEQ ID NO: 510945 - DNA, 20 bp, Artificial
  CRISPR gRNA sequence
tcagctccgagtgctgggag

SEQ ID NO: 510946 - DNA, 20 bp, Artificial
  CRISPR gRNA sequence
cagctccgagtgctgggaga

SEQ ID NO: 510947 - DNA, 20 bp, Artificial
  CRISPR gRNA sequence
agctccgagtgctgggagag

SEQ ID NO: 510948 - DNA, 20 bp, Artificial
  CRISPR gRNA sequence
gtgctgggagaggggacgct

SEQ ID NO: 510949 - DNA, 20 bp, Artificial
  CRISPR gRNA sequence
gaggggacgcttagccaccc

SEQ ID NO: 510950 - DNA, 20 bp, Artificial
  CRISPR gRNA sequence
aggggacgcttagccaccca

SEQ ID NO: 510951 - DNA, 20 bp, Artificial
  CRISPR gRNA sequence
ggggacgcttagccacccaa

SEQ ID NO: 510952 - DNA, 20 bp, Artificial
  CRISPR gRNA sequence
cacccaagggcctttgcctc

SEQ ID NO: 510953 - DNA, 20 bp, Artificial
  CRISPR gRNA sequence
acccaagggcctttgcctca

SEQ ID NO: 510954 - DNA, 20 bp, Artificial
  CRISPR gRNA sequence
cccaagggcctttgcctcaa

SEQ ID NO: 510955 - DNA, 20 bp, Artificial
  CRISPR gRNA sequence
caagggcctttgcctcaagg

SEQ ID NO: 510956 - DNA, 20 bp, Artificial
  CRISPR gRNA sequence
ctttgcctcaagggagtaaa

SEQ ID NO: 510957 - DNA, 20 bp, Artificial
  CRISPR gRNA sequence
tttgcctcaagggagtaaat

SEQ ID NO: 510958 - DNA, 20 bp, Artificial
  CRISPR gRNA sequence
ttgcctcaagggagtaaata

SEQ ID NO: 510959 - DNA, 20 bp, Artificial
  CRISPR gRNA sequence
tgcctcaagggagtaaatag

SEQ ID NO: 510960 - DNA, 20 bp, Artificial
  CRISPR gRNA sequence
gagtaaataggggcatttcc

SEQ ID NO: 510961 - DNA, 20 bp, Artificial
  CRISPR gRNA sequence
taaataggggcatttcctgg

SEQ ID NO: 510962 - DNA, 20 bp, Artificial
  CRISPR gRNA sequence
aaataggggcatttcctggt

SEQ ID NO: 510963 - DNA, 20 bp, Artificial
  CRISPR gRNA sequence
ggggcatttcctggtgggcg

SEQ ID NO: 510964 - DNA, 20 bp, Artificial
  CRISPR gRNA sequence
gggcatttcctggtgggcgt

SEQ ID NO: 510965 - DNA, 20 bp, Artificial
  CRISPR gRNA sequence
atttcctggtgggcgtgggc

SEQ ID NO: 510966 - DNA, 20 bp, Artificial
  CRISPR gRNA sequence
tttcctggtgggcgtgggct

SEQ ID NO: 510967 - DNA, 20 bp, Artificial
  CRISPR gRNA sequence
ctggtgggcgtgggctgggc

SEQ ID NO: 510968 - DNA, 20 bp, Artificial
  CRISPR gRNA sequence
ggtgggcgtgggctgggctg

SEQ ID NO: 510969 - DNA, 20 bp, Artificial
  CRISPR gRNA sequence
gggcgtgggctgggctggag

SEQ ID NO: 510970 - DNA, 20 bp, Artificial
  CRISPR gRNA sequence
cgtgggctgggctggagaag

SEQ ID NO: 510971 - DNA, 20 bp, Artificial
  CRISPR gRNA sequence
gtgggctgggctggagaagc

SEQ ID NO: 510972 - DNA, 20 bp, Artificial
  CRISPR gRNA sequence
tgggctgggctggagaagca

SEQ ID NO: 510973 - DNA, 20 bp, Artificial
  CRISPR gRNA sequence
gctggagaagcagggcctcc

SEQ ID NO: 510974 - DNA, 20 bp, Artificial
  CRISPR gRNA sequence
ggagaagcagggcctcctgg

SEQ ID NO: 510975 - DNA, 20 bp, Artificial
  CRISPR gRNA sequence
gagaagcagggcctcctggc

SEQ ID NO: 510976 - DNA, 20 bp, Artificial
  CRISPR gRNA sequence
agaagcagggcctcctggca

SEQ ID NO: 510977 - DNA, 20 bp, Artificial
  CRISPR gRNA sequence
gaagcagggcctcctggcag

SEQ ID NO: 510978 - DNA, 20 bp, Artificial
  CRISPR gRNA sequence
cagggcctcctggcaggggc

SEQ ID NO: 510979 - DNA, 20 bp, Artificial
  CRISPR gRNA sequence
ctcctggcaggggctggcat

SEQ ID NO: 510980 - DNA, 20 bp, Artificial
  CRISPR gRNA sequence
catgagatccaaacactgcc

SEQ ID NO: 510981 - DNA, 20 bp, Artificial
  CRISPR gRNA sequence
atgagatccaaacactgccc

SEQ ID NO: 510982 - DNA, 20 bp, Artificial
  CRISPR gRNA sequence
agatccaaacactgcccagg

SEQ ID NO: 510983 - DNA, 20 bp, Artificial
  CRISPR gRNA sequence
ccaaacactgcccaggcagc

SEQ ID NO: 510984 - DNA, 20 bp, Artificial
  CRISPR gRNA sequence
ccaggcagctggacactcct

SEQ ID NO: 510985 - DNA, 20 bp, Artificial
  CRISPR gRNA sequence
cagctggacactcctgagcc

SEQ ID NO: 510986 - DNA, 20 bp, Artificial
  CRISPR gRNA sequence
gctggacactcctgagcctg

SEQ ID NO: 510987 - DNA, 20 bp, Artificial
  CRISPR gRNA sequence
ggagcttctcacctgaacca

SEQ ID NO: 510988 - DNA, 20 bp, Artificial
  CRISPR gRNA sequence
gagcttctcacctgaaccac

SEQ ID NO: 510989 - DNA, 20 bp, Artificial
  CRISPR gRNA sequence
agcttctcacctgaaccaca

SEQ ID NO: 510990 - DNA, 20 bp, Artificial
  CRISPR gRNA sequence
ttctcacctgaaccacaggg

SEQ ID NO: 510991 - DNA, 20 bp, Artificial
  CRISPR gRNA sequence
gggtggtaacccctgcccct

SEQ ID NO: 510992 - DNA, 20 bp, Artificial
  CRISPR gRNA sequence
ggtggtaacccctgcccctc

SEQ ID NO: 510993 - DNA, 20 bp, Artificial
  CRISPR gRNA sequence
ggtaacccctgcccctcagg

SEQ ID NO: 510994 - DNA, 20 bp, Artificial
  CRISPR gRNA sequence
cggcatcgacgtgacctgcc

SEQ ID NO: 510995 - DNA, 20 bp, Artificial
  CRISPR gRNA sequence
gacgtgacctgcctagtgca

SEQ ID NO: 510996 - DNA, 20 bp, Artificial
  CRISPR gRNA sequence
tgacctgcctagtgcacagt

SEQ ID NO: 510997 - DNA, 20 bp, Artificial
  CRISPR gRNA sequence
gcctagtgcacagtgagcct

SEQ ID NO: 510998 - DNA, 20 bp, Artificial
  CRISPR gRNA sequence
cctagtgcacagtgagcctg

SEQ ID NO: 510999 - DNA, 20 bp, Artificial
  CRISPR gRNA sequence
acagtgagcctgaggcaaca

SEQ ID NO: 511000 - DNA, 20 bp, Artificial
  CRISPR gRNA sequence
tgaggcaacacggccaccac

SEQ ID NO: 511001 - DNA, 20 bp, Artificial
  CRISPR gRNA sequence
gaggcaacacggccaccacc

SEQ ID NO: 511002 - DNA, 20 bp, Artificial
  CRISPR gRNA sequence
ggcaacacggccaccaccag

SEQ ID NO: 511003 - DNA, 20 bp, Artificial
  CRISPR gRNA sequence
gccaccaccaggagactccc

SEQ ID NO: 511004 - DNA, 20 bp, Artificial
  CRISPR gRNA sequence
ccaccaccaggagactccct

SEQ ID NO: 511005 - DNA, 20 bp, Artificial
  CRISPR gRNA sequence
caccaccaggagactccctg

SEQ ID NO: 511006 - DNA, 20 bp, Artificial
  CRISPR gRNA sequence
caccaggagactccctgggg

SEQ ID NO: 511007 - DNA, 20 bp, Artificial
  CRISPR gRNA sequence
ccaggagactccctggggaa

SEQ ID NO: 511008 - DNA, 20 bp, Artificial
  CRISPR gRNA sequence
caggagactccctggggaag

SEQ ID NO: 511009 - DNA, 20 bp, Artificial
  CRISPR gRNA sequence
ctccctggggaagaggcccc

SEQ ID NO: 511010 - DNA, 20 bp, Artificial
  CRISPR gRNA sequence
ctggggaagaggcccccaga

SEQ ID NO: 511011 - DNA, 20 bp, Artificial
  CRISPR gRNA sequence
ggaagaggcccccagacagc

SEQ ID NO: 511012 - DNA, 20 bp, Artificial
  CRISPR gRNA sequence
gaagaggcccccagacagcg

SEQ ID NO: 511013 - DNA, 20 bp, Artificial
  CRISPR gRNA sequence
cagacagcgaggtgcccatg

SEQ ID NO: 511014 - DNA, 20 bp, Artificial
  CRISPR gRNA sequence
agacagcgaggtgcccatga

SEQ ID NO: 511015 - DNA, 20 bp, Artificial
  CRISPR gRNA sequence
cagcgaggtgcccatgaagg

SEQ ID NO: 511016 - DNA, 20 bp, Artificial
  CRISPR gRNA sequence
cccatgaaggaagttctgca

SEQ ID NO: 511017 - DNA, 20 bp, Artificial
  CRISPR gRNA sequence
ccatgaaggaagttctgcac

SEQ ID NO: 511018 - DNA, 20 bp, Artificial
  CRISPR gRNA sequence
catgaaggaagttctgcaca

SEQ ID NO: 511019 - DNA, 20 bp, Artificial
  CRISPR gRNA sequence
atgaaggaagttctgcacag

SEQ ID NO: 511020 - DNA, 20 bp, Artificial
  CRISPR gRNA sequence
gaagttctgcacaggggccg

SEQ ID NO: 511021 - DNA, 20 bp, Artificial
  CRISPR gRNA sequence
gcacaggggccgcggccatc

SEQ ID NO: 511022 - DNA, 20 bp, Artificial
  CRISPR gRNA sequence
cacaggggccgcggccatcc

SEQ ID NO: 511023 - DNA, 20 bp, Artificial
  CRISPR gRNA sequence
caggggccgcggccatccag

SEQ ID NO: 511024 - DNA, 20 bp, Artificial
  CRISPR gRNA sequence
ggccgcggccatccaggaga

SEQ ID NO: 511025 - DNA, 20 bp, Artificial
  CRISPR gRNA sequence
gccgcggccatccaggagat

SEQ ID NO: 511026 - DNA, 20 bp, Artificial
  CRISPR gRNA sequence
cgcggccatccaggagatgg

SEQ ID NO: 511027 - DNA, 20 bp, Artificial
  CRISPR gRNA sequence
gcggccatccaggagatggg

SEQ ID NO: 511028 - DNA, 20 bp, Artificial
  CRISPR gRNA sequence
cggccatccaggagatggga

SEQ ID NO: 511029 - DNA, 20 bp, Artificial
  CRISPR gRNA sequence
ggccatccaggagatgggag

SEQ ID NO: 511030 - DNA, 20 bp, Artificial
  CRISPR gRNA sequence
ggccctatctgcaccctgtc

SEQ ID NO: 511031 - DNA, 20 bp, Artificial
  CRISPR gRNA sequence
cctatctgcaccctgtctgg

SEQ ID NO: 511032 - DNA, 20 bp, Artificial
  CRISPR gRNA sequence
ctatctgcaccctgtctgga

SEQ ID NO: 511033 - DNA, 20 bp, Artificial
  CRISPR gRNA sequence
tatctgcaccctgtctggaa

SEQ ID NO: 511034 - DNA, 20 bp, Artificial
  CRISPR gRNA sequence
atctgcaccctgtctggaag

SEQ ID NO: 511035 - DNA, 20 bp, Artificial
  CRISPR gRNA sequence
caccctgtctggaaggggca

SEQ ID NO: 511036 - DNA, 20 bp, Artificial
  CRISPR gRNA sequence
accctgtctggaaggggcat

SEQ ID NO: 511037 - DNA, 20 bp, Artificial
  CRISPR gRNA sequence
ccctgtctggaaggggcatg

SEQ ID NO: 511038 - DNA, 20 bp, Artificial
  CRISPR gRNA sequence
gtctggaaggggcatggggt

SEQ ID NO: 511039 - DNA, 20 bp, Artificial
  CRISPR gRNA sequence
tggaaggggcatggggtgag

SEQ ID NO: 511040 - DNA, 20 bp, Artificial
  CRISPR gRNA sequence
ggaaggggcatggggtgagc

SEQ ID NO: 511041 - DNA, 20 bp, Artificial
  CRISPR gRNA sequence
catggggtgagcaggctatt

SEQ ID NO: 511042 - DNA, 20 bp, Artificial
  CRISPR gRNA sequence
ctatttggtcccccgtgact

SEQ ID NO: 511043 - DNA, 20 bp, Artificial
  CRISPR gRNA sequence
cagtttccccatctgtgaaa

SEQ ID NO: 511044 - DNA, 20 bp, Artificial
  CRISPR gRNA sequence
agtttccccatctgtgaaac

SEQ ID NO: 511045 - DNA, 20 bp, Artificial
  CRISPR gRNA sequence
tttccccatctgtgaaacag

SEQ ID NO: 511046 - DNA, 20 bp, Artificial
  CRISPR gRNA sequence
ttccccatctgtgaaacagg

SEQ ID NO: 511047 - DNA, 20 bp, Artificial
  CRISPR gRNA sequence
tccccatctgtgaaacagga

SEQ ID NO: 511048 - DNA, 20 bp, Artificial
  CRISPR gRNA sequence
ccccatctgtgaaacaggag

SEQ ID NO: 511049 - DNA, 20 bp, Artificial
  CRISPR gRNA sequence
catctgtgaaacaggagggg

SEQ ID NO: 511050 - DNA, 20 bp, Artificial
  CRISPR gRNA sequence
gtgaaacaggaggggtggtc

SEQ ID NO: 511051 - DNA, 20 bp, Artificial
  CRISPR gRNA sequence
ctggccaattgtgcgcactc

SEQ ID NO: 511052 - DNA, 20 bp, Artificial
  CRISPR gRNA sequence
gcgcactccagctgtctcta

SEQ ID NO: 511053 - DNA, 20 bp, Artificial
  CRISPR gRNA sequence
gtaacttgaactcacttccc

SEQ ID NO: 511054 - DNA, 20 bp, Artificial
  CRISPR gRNA sequence
taacttgaactcacttcccc

SEQ ID NO: 511055 - DNA, 20 bp, Artificial
  CRISPR gRNA sequence
aacttgaactcacttcccca

SEQ ID NO: 511056 - DNA, 20 bp, Artificial
  CRISPR gRNA sequence
cacttccccagggctcctgc

SEQ ID NO: 511057 - DNA, 20 bp, Artificial
  CRISPR gRNA sequence
acttccccagggctcctgcc

SEQ ID NO: 511058 - DNA, 20 bp, Artificial
  CRISPR gRNA sequence
cccagggctcctgccaggcc

SEQ ID NO: 511059 - DNA, 20 bp, Artificial
  CRISPR gRNA sequence
ccagggctcctgccaggccc

SEQ ID NO: 511060 - DNA, 20 bp, Artificial
  CRISPR gRNA sequence
aggcccaggtctgtccactc

SEQ ID NO: 511061 - DNA, 20 bp, Artificial
  CRISPR gRNA sequence
caggtctgtccactctggcc

SEQ ID NO: 511062 - DNA, 20 bp, Artificial
  CRISPR gRNA sequence
aggtctgtccactctggccc

SEQ ID NO: 511063 - DNA, 20 bp, Artificial
  CRISPR gRNA sequence
ctgtccactctggcccaggc

SEQ ID NO: 511064 - DNA, 20 bp, Artificial
  CRISPR gRNA sequence
tgtccactctggcccaggcc

SEQ ID NO: 511065 - DNA, 20 bp, Artificial
  CRISPR gRNA sequence
tggcccaggccgggccccac

SEQ ID NO: 511066 - DNA, 20 bp, Artificial
  CRISPR gRNA sequence
ggcccaggccgggccccacc

SEQ ID NO: 511067 - DNA, 20 bp, Artificial
  CRISPR gRNA sequence
ggccgggccccaccaggtac

SEQ ID NO: 511068 - DNA, 20 bp, Artificial
  CRISPR gRNA sequence
gccgggccccaccaggtacc

SEQ ID NO: 511069 - DNA, 20 bp, Artificial
  CRISPR gRNA sequence
ccgggccccaccaggtacca

SEQ ID NO: 511070 - DNA, 20 bp, Artificial
  CRISPR gRNA sequence
cccaccaggtaccagggctg

SEQ ID NO: 511071 - DNA, 20 bp, Artificial
  CRISPR gRNA sequence
ccaccaggtaccagggctgt

SEQ ID NO: 511072 - DNA, 20 bp, Artificial
  CRISPR gRNA sequence
ctgtgggacatttgcctctg

SEQ ID NO: 511073 - DNA, 20 bp, Artificial
  CRISPR gRNA sequence
gggacatttgcctctgtgga

SEQ ID NO: 511074 - DNA, 20 bp, Artificial
  CRISPR gRNA sequence
ggacatttgcctctgtggat

SEQ ID NO: 511075 - DNA, 20 bp, Artificial
  CRISPR gRNA sequence
gacatttgcctctgtggatg

SEQ ID NO: 511076 - DNA, 20 bp, Artificial
  CRISPR gRNA sequence
atttgcctctgtggatgggg

SEQ ID NO: 511077 - DNA, 20 bp, Artificial
  CRISPR gRNA sequence
atggggcagcgtgacgcctg

SEQ ID NO: 511078 - DNA, 20 bp, Artificial
  CRISPR gRNA sequence
tgacgcctgtggcgattcca

SEQ ID NO: 511079 - DNA, 20 bp, Artificial
  CRISPR gRNA sequence
cctgtggcgattccatggaa

SEQ ID NO: 511080 - DNA, 20 bp, Artificial
  CRISPR gRNA sequence
ctgtggcgattccatggaac

SEQ ID NO: 511081 - DNA, 20 bp, Artificial
  CRISPR gRNA sequence
tccatggaacaggtcctgtg

SEQ ID NO: 511082 - DNA, 20 bp, Artificial
  CRISPR gRNA sequence
ccatggaacaggtcctgtgt

SEQ ID NO: 511083 - DNA, 20 bp, Artificial
  CRISPR gRNA sequence
gctgcactcgtgtcctgtgt

SEQ ID NO: 511084 - DNA, 20 bp, Artificial
  CRISPR gRNA sequence
tgcactcgtgtcctgtgtca

SEQ ID NO: 511085 - DNA, 20 bp, Artificial
  CRISPR gRNA sequence
tgtcctgtgtcagagaaccg

SEQ ID NO: 511086 - DNA, 20 bp, Artificial
  CRISPR gRNA sequence
agagaaccgtggtcctgcct

SEQ ID NO: 511087 - DNA, 20 bp, Artificial
  CRISPR gRNA sequence
gagaaccgtggtcctgcctg

SEQ ID NO: 511088 - DNA, 20 bp, Artificial
  CRISPR gRNA sequence
cctgcctgaggccatgtcac

SEQ ID NO: 511089 - DNA, 20 bp, Artificial
  CRISPR gRNA sequence
tgcctgaggccatgtcaccg

SEQ ID NO: 511090 - DNA, 20 bp, Artificial
  CRISPR gRNA sequence
gcctgaggccatgtcaccgg

SEQ ID NO: 511091 - DNA, 20 bp, Artificial
  CRISPR gRNA sequence
gaggccatgtcaccggaggc

SEQ ID NO: 511092 - DNA, 20 bp, Artificial
  CRISPR gRNA sequence
cggaggctggctcccgttcc

SEQ ID NO: 511093 - DNA, 20 bp, Artificial
  CRISPR gRNA sequence
gaggctggctcccgttcccg

SEQ ID NO: 511094 - DNA, 20 bp, Artificial
  CRISPR gRNA sequence
aggctggctcccgttcccgg

SEQ ID NO: 511095 - DNA, 20 bp, Artificial
  CRISPR gRNA sequence
gctggctcccgttcccggag

SEQ ID NO: 511096 - DNA, 20 bp, Artificial
  CRISPR gRNA sequence
ccgttcccggaggagaatgc

SEQ ID NO: 511097 - DNA, 20 bp, Artificial
  CRISPR gRNA sequence
gaggagaatgccagctgcca

SEQ ID NO: 511098 - DNA, 20 bp, Artificial
  CRISPR gRNA sequence
aggagaatgccagctgccac

SEQ ID NO: 511099 - DNA, 20 bp, Artificial
  CRISPR gRNA sequence
ggagaatgccagctgccaca

SEQ ID NO: 511100 - DNA, 20 bp, Artificial
  CRISPR gRNA sequence
gagaatgccagctgccacag

SEQ ID NO: 511101 - DNA, 20 bp, Artificial
  CRISPR gRNA sequence
atgccagctgccacaggggt

SEQ ID NO: 511102 - DNA, 20 bp, Artificial
  CRISPR gRNA sequence
tgccacaggggtcagtgaca

SEQ ID NO: 511103 - DNA, 20 bp, Artificial
  CRISPR gRNA sequence
gccacaggggtcagtgacac

SEQ ID NO: 511104 - DNA, 20 bp, Artificial
  CRISPR gRNA sequence
cagtgacacaggcatttgcc

SEQ ID NO: 511105 - DNA, 20 bp, Artificial
  CRISPR gRNA sequence
tgacacaggcatttgcccag

SEQ ID NO: 511106 - DNA, 20 bp, Artificial
  CRISPR gRNA sequence
gacacaggcatttgcccagc

SEQ ID NO: 511107 - DNA, 20 bp, Artificial
  CRISPR gRNA sequence
aggcatttgcccagcaggta

SEQ ID NO: 511108 - DNA, 20 bp, Artificial
  CRISPR gRNA sequence
ggcatttgcccagcaggtac

SEQ ID NO: 511109 - DNA, 20 bp, Artificial
  CRISPR gRNA sequence
tttgcccagcaggtacaggc

SEQ ID NO: 511110 - DNA, 20 bp, Artificial
  CRISPR gRNA sequence
ttgcccagcaggtacaggcc

SEQ ID NO: 511111 - DNA, 20 bp, Artificial
  CRISPR gRNA sequence
gcaggtacaggccaggtcgc

SEQ ID NO: 511112 - DNA, 20 bp, Artificial
  CRISPR gRNA sequence
caggtacaggccaggtcgct

SEQ ID NO: 511113 - DNA, 20 bp, Artificial
  CRISPR gRNA sequence
gtacaggccaggtcgctggg

SEQ ID NO: 511114 - DNA, 20 bp, Artificial
  CRISPR gRNA sequence
tcgctgggaagccccaactc

SEQ ID NO: 511115 - DNA, 20 bp, Artificial
  CRISPR gRNA sequence
cgctgggaagccccaactca

SEQ ID NO: 511116 - DNA, 20 bp, Artificial
  CRISPR gRNA sequence
gctgggaagccccaactcaa

SEQ ID NO: 511117 - DNA, 20 bp, Artificial
  CRISPR gRNA sequence
ctgggaagccccaactcaag

SEQ ID NO: 511118 - DNA, 20 bp, Artificial
  CRISPR gRNA sequence
ccccaactcaaggggctctg

SEQ ID NO: 511119 - DNA, 20 bp, Artificial
  CRISPR gRNA sequence
caactcaaggggctctgcag

SEQ ID NO: 511120 - DNA, 20 bp, Artificial
  CRISPR gRNA sequence
aactcaaggggctctgcagt

SEQ ID NO: 511121 - DNA, 20 bp, Artificial
  CRISPR gRNA sequence
ggggctctgcagtgggcgcc

SEQ ID NO: 511122 - DNA, 20 bp, Artificial
  CRISPR gRNA sequence
cagtgggcgcctagcaatta

SEQ ID NO: 511123 - DNA, 20 bp, Artificial
  CRISPR gRNA sequence
gtgggcgcctagcaattatg

SEQ ID NO: 511124 - DNA, 20 bp, Artificial
  CRISPR gRNA sequence
gcctagcaattatggagctg

SEQ ID NO: 511125 - DNA, 20 bp, Artificial
  CRISPR gRNA sequence
cctagcaattatggagctgt

SEQ ID NO: 511126 - DNA, 20 bp, Artificial
  CRISPR gRNA sequence
ctgtgggtgatacccacccc

SEQ ID NO: 511127 - DNA, 20 bp, Artificial
  CRISPR gRNA sequence
gggtgatacccaccccaagc

SEQ ID NO: 511128 - DNA, 20 bp, Artificial
  CRISPR gRNA sequence
tacccaccccaagccggacc

SEQ ID NO: 511129 - DNA, 20 bp, Artificial
  CRISPR gRNA sequence
ccccaagccggacctggtgc

SEQ ID NO: 511130 - DNA, 20 bp, Artificial
  CRISPR gRNA sequence
attatccctcccattctgct

SEQ ID NO: 511131 - DNA, 20 bp, Artificial
  CRISPR gRNA sequence
ccattctgcttggcacaaac

SEQ ID NO: 511132 - DNA, 20 bp, Artificial
  CRISPR gRNA sequence
ggcacaaactggcactgaca

SEQ ID NO: 511133 - DNA, 20 bp, Artificial
  CRISPR gRNA sequence
gcacaaactggcactgacac

SEQ ID NO: 511134 - DNA, 20 bp, Artificial
  CRISPR gRNA sequence
cacaaactggcactgacacg

SEQ ID NO: 511135 - DNA, 20 bp, Artificial
  CRISPR gRNA sequence
cactgacacggggcattgat

SEQ ID NO: 511136 - DNA, 20 bp, Artificial
  CRISPR gRNA sequence
actgacacggggcattgatt

SEQ ID NO: 511137 - DNA, 20 bp, Artificial
  CRISPR gRNA sequence
gacacggggcattgattagg

SEQ ID NO: 511138 - DNA, 20 bp, Artificial
  CRISPR gRNA sequence
tggttgcatttgtcgattcc

SEQ ID NO: 511139 - DNA, 20 bp, Artificial
  CRISPR gRNA sequence
cgattccgagcccatgtgtg

SEQ ID NO: 511140 - DNA, 20 bp, Artificial
  CRISPR gRNA sequence
attccgagcccatgtgtgtg

SEQ ID NO: 511141 - DNA, 20 bp, Artificial
  CRISPR gRNA sequence
gagcccatgtgtgtggagcc

SEQ ID NO: 511142 - DNA, 20 bp, Artificial
  CRISPR gRNA sequence
agcccatgtgtgtggagccc

SEQ ID NO: 511143 - DNA, 20 bp, Artificial
  CRISPR gRNA sequence
gtgtgtggagcccaggccct

SEQ ID NO: 511144 - DNA, 20 bp, Artificial
  CRISPR gRNA sequence
gtggagcccaggccctgagc

SEQ ID NO: 511145 - DNA, 20 bp, Artificial
  CRISPR gRNA sequence
gcccaggccctgagcaagca

SEQ ID NO: 511146 - DNA, 20 bp, Artificial
  CRISPR gRNA sequence
ccaggccctgagcaagcaca

SEQ ID NO: 511147 - DNA, 20 bp, Artificial
  CRISPR gRNA sequence
caggccctgagcaagcacag

SEQ ID NO: 511148 - DNA, 20 bp, Artificial
  CRISPR gRNA sequence
aggccctgagcaagcacaga

SEQ ID NO: 511149 - DNA, 20 bp, Artificial
  CRISPR gRNA sequence
tgagcaagcacagagggccc

SEQ ID NO: 511150 - DNA, 20 bp, Artificial
  CRISPR gRNA sequence
gagggccctggtgctgtcct

SEQ ID NO: 511151 - DNA, 20 bp, Artificial
  CRISPR gRNA sequence
ccctggtgctgtcctgagct

SEQ ID NO: 511152 - DNA, 20 bp, Artificial
  CRISPR gRNA sequence
cctggtgctgtcctgagctg

SEQ ID NO: 511153 - DNA, 20 bp, Artificial
  CRISPR gRNA sequence
gctgaggcccctgcccaccc

SEQ ID NO: 511154 - DNA, 20 bp, Artificial
  CRISPR gRNA sequence
ctgaggcccctgcccacccc

SEQ ID NO: 511155 - DNA, 20 bp, Artificial
  CRISPR gRNA sequence
cccgggctgcgtgttctctc

SEQ ID NO: 511156 - DNA, 20 bp, Artificial
  CRISPR gRNA sequence
gcgtgttctctccggccatt

SEQ ID NO: 511157 - DNA, 20 bp, Artificial
  CRISPR gRNA sequence
cgtgttctctccggccattc

SEQ ID NO: 511158 - DNA, 20 bp, Artificial
  CRISPR gRNA sequence
gtgttctctccggccattca

SEQ ID NO: 511159 - DNA, 20 bp, Artificial
  CRISPR gRNA sequence
tctccggccattcagggtct

SEQ ID NO: 511160 - DNA, 20 bp, Artificial
  CRISPR gRNA sequence
tccggccattcagggtctga

SEQ ID NO: 511161 - DNA, 20 bp, Artificial
  CRISPR gRNA sequence
ccattcagggtctgagagtg

SEQ ID NO: 511162 - DNA, 20 bp, Artificial
  CRISPR gRNA sequence
ttcagggtctgagagtgcag

SEQ ID NO: 511163 - DNA, 20 bp, Artificial
  CRISPR gRNA sequence
cagggtctgagagtgcagaa

SEQ ID NO: 511164 - DNA, 20 bp, Artificial
  CRISPR gRNA sequence
gtctgagagtgcagaagagt

SEQ ID NO: 511165 - DNA, 20 bp, Artificial
  CRISPR gRNA sequence
gagtgcagaagagttagccc

SEQ ID NO: 511166 - DNA, 20 bp, Artificial
  CRISPR gRNA sequence
agtgcagaagagttagcccc

SEQ ID NO: 511167 - DNA, 20 bp, Artificial
  CRISPR gRNA sequence
gtgcagaagagttagcccca

SEQ ID NO: 511168 - DNA, 20 bp, Artificial
  CRISPR gRNA sequence
tgcagaagagttagccccag

SEQ ID NO: 511169 - DNA, 20 bp, Artificial
  CRISPR gRNA sequence
caggggaacaccttcctgcc

SEQ ID NO: 511170 - DNA, 20 bp, Artificial
  CRISPR gRNA sequence
ctgcccagctgatttgtaaa

SEQ ID NO: 511171 - DNA, 20 bp, Artificial
  CRISPR gRNA sequence
tgatttgtaaacagcctcgc

SEQ ID NO: 511172 - DNA, 20 bp, Artificial
  CRISPR gRNA sequence
gatttgtaaacagcctcgct

SEQ ID NO: 511173 - DNA, 20 bp, Artificial
  CRISPR gRNA sequence
atttgtaaacagcctcgctg

SEQ ID NO: 511174 - DNA, 20 bp, Artificial
  CRISPR gRNA sequence
gcctcgctggggacacatgt

SEQ ID NO: 511175 - DNA, 20 bp, Artificial
  CRISPR gRNA sequence
ctggggacacatgttggtgt

SEQ ID NO: 511176 - DNA, 20 bp, Artificial
  CRISPR gRNA sequence
tggggacacatgttggtgtt

SEQ ID NO: 511177 - DNA, 20 bp, Artificial
  CRISPR gRNA sequence
gggacacatgttggtgttgg

SEQ ID NO: 511178 - DNA, 20 bp, Artificial
  CRISPR gRNA sequence
acacatgttggtgttgggag

SEQ ID NO: 511179 - DNA, 20 bp, Artificial
  CRISPR gRNA sequence
catgttggtgttgggagtgg

SEQ ID NO: 511180 - DNA, 20 bp, Artificial
  CRISPR gRNA sequence
tgttggtgttgggagtggtg

SEQ ID NO: 511181 - DNA, 20 bp, Artificial
  CRISPR gRNA sequence
gttggtgttgggagtggtgg

SEQ ID NO: 511182 - DNA, 20 bp, Artificial
  CRISPR gRNA sequence
gtggaggtttctgtgtgtga

SEQ ID NO: 511183 - DNA, 20 bp, Artificial
  CRISPR gRNA sequence
ttctgtgtgtgatggaaact

SEQ ID NO: 511184 - DNA, 20 bp, Artificial
  CRISPR gRNA sequence
tctgtgtgtgatggaaactt

SEQ ID NO: 511185 - DNA, 20 bp, Artificial
  CRISPR gRNA sequence
ctgtgtgtgatggaaacttg

SEQ ID NO: 511186 - DNA, 20 bp, Artificial
  CRISPR gRNA sequence
tgtgtgatggaaacttgggg

SEQ ID NO: 511187 - DNA, 20 bp, Artificial
  CRISPR gRNA sequence
gtgtgatggaaacttggggt

SEQ ID NO: 511188 - DNA, 20 bp, Artificial
  CRISPR gRNA sequence
tggaaacttggggtaggtgt

SEQ ID NO: 511189 - DNA, 20 bp, Artificial
  CRISPR gRNA sequence
ggaaacttggggtaggtgtt

SEQ ID NO: 511190 - DNA, 20 bp, Artificial
  CRISPR gRNA sequence
gaaacttggggtaggtgttg

SEQ ID NO: 511191 - DNA, 20 bp, Artificial
  CRISPR gRNA sequence
ttggggtaggtgttggggaa

SEQ ID NO: 511192 - DNA, 20 bp, Artificial
  CRISPR gRNA sequence
ggggtaggtgttggggaaaa

SEQ ID NO: 511193 - DNA, 20 bp, Artificial
  CRISPR gRNA sequence
gggtaggtgttggggaaaag

SEQ ID NO: 511194 - DNA, 20 bp, Artificial
  CRISPR gRNA sequence
tgttggggaaaagaggtgct

SEQ ID NO: 511195 - DNA, 20 bp, Artificial
  CRISPR gRNA sequence
ttggggaaaagaggtgctga

SEQ ID NO: 511196 - DNA, 20 bp, Artificial
  CRISPR gRNA sequence
aaaagaggtgctgagagtct

SEQ ID NO: 511197 - DNA, 20 bp, Artificial
  CRISPR gRNA sequence
agaggtgctgagagtctcag

SEQ ID NO: 511198 - DNA, 20 bp, Artificial
  CRISPR gRNA sequence
aggtgctgagagtctcagca

SEQ ID NO: 511199 - DNA, 20 bp, Artificial
  CRISPR gRNA sequence
ggtgctgagagtctcagcag

SEQ ID NO: 511200 - DNA, 20 bp, Artificial
  CRISPR gRNA sequence
gtgctgagagtctcagcaga

SEQ ID NO: 511201 - DNA, 20 bp, Artificial
  CRISPR gRNA sequence
ctgagagtctcagcagaggg

SEQ ID NO: 511202 - DNA, 20 bp, Artificial
  CRISPR gRNA sequence
gagagtctcagcagagggca

SEQ ID NO: 511203 - DNA, 20 bp, Artificial
  CRISPR gRNA sequence
tctcagcagagggcagagtc

SEQ ID NO: 511204 - DNA, 20 bp, Artificial
  CRISPR gRNA sequence
ctcagcagagggcagagtcc

SEQ ID NO: 511205 - DNA, 20 bp, Artificial
  CRISPR gRNA sequence
cagcagagggcagagtccag

SEQ ID NO: 511206 - DNA, 20 bp, Artificial
  CRISPR gRNA sequence
agggcagagtccaggagtcc

SEQ ID NO: 511207 - DNA, 20 bp, Artificial
  CRISPR gRNA sequence
ggcagagtccaggagtcctg

SEQ ID NO: 511208 - DNA, 20 bp, Artificial
  CRISPR gRNA sequence
agtccaggagtcctggagtg

SEQ ID NO: 511209 - DNA, 20 bp, Artificial
  CRISPR gRNA sequence
gagtcctggagtgcagctct

SEQ ID NO: 511210 - DNA, 20 bp, Artificial
  CRISPR gRNA sequence
ctcagcccctgcgccgtgcc

SEQ ID NO: 511211 - DNA, 20 bp, Artificial
  CRISPR gRNA sequence
cagcccctgcgccgtgccta

SEQ ID NO: 511212 - DNA, 20 bp, Artificial
  CRISPR gRNA sequence
agcccctgcgccgtgcctag

SEQ ID NO: 511213 - DNA, 20 bp, Artificial
  CRISPR gRNA sequence
cccctgcgccgtgcctagag

SEQ ID NO: 511214 - DNA, 20 bp, Artificial
  CRISPR gRNA sequence
cctgcgccgtgcctagagga

SEQ ID NO: 511215 - DNA, 20 bp, Artificial
  CRISPR gRNA sequence
ctgcgccgtgcctagaggag

SEQ ID NO: 511216 - DNA, 20 bp, Artificial
  CRISPR gRNA sequence
gccgtgcctagaggagaggc

SEQ ID NO: 511217 - DNA, 20 bp, Artificial
  CRISPR gRNA sequence
tgcctagaggagaggctggc

SEQ ID NO: 511218 - DNA, 20 bp, Artificial
  CRISPR gRNA sequence
gctggcaagcccctgtccca

SEQ ID NO: 511219 - DNA, 20 bp, Artificial
  CRISPR gRNA sequence
gcaagcccctgtcccatgga

SEQ ID NO: 511220 - DNA, 20 bp, Artificial
  CRISPR gRNA sequence
caagcccctgtcccatggat

SEQ ID NO: 511221 - DNA, 20 bp, Artificial
  CRISPR gRNA sequence
ctgtcccatggatgggtgaa

SEQ ID NO: 511222 - DNA, 20 bp, Artificial
  CRISPR gRNA sequence
tgtcccatggatgggtgaat

SEQ ID NO: 511223 - DNA, 20 bp, Artificial
  CRISPR gRNA sequence
ccatggatgggtgaatgggt

SEQ ID NO: 511224 - DNA, 20 bp, Artificial
  CRISPR gRNA sequence
atgggtgaatgggtgagtga

SEQ ID NO: 511225 - DNA, 20 bp, Artificial
  CRISPR gRNA sequence
ggtgaatgggtgagtgacag

SEQ ID NO: 511226 - DNA, 20 bp, Artificial
  CRISPR gRNA sequence
gggtgagtgacagtggcaac

SEQ ID NO: 511227 - DNA, 20 bp, Artificial
  CRISPR gRNA sequence
cagtggcaacaagcccatgc

SEQ ID NO: 511228 - DNA, 20 bp, Artificial
  CRISPR gRNA sequence
tggcaacaagcccatgccag

SEQ ID NO: 511229 - DNA, 20 bp, Artificial
  CRISPR gRNA sequence
ggcaacaagcccatgccagc

SEQ ID NO: 511230 - DNA, 20 bp, Artificial
  CRISPR gRNA sequence
gcaacaagcccatgccagca

SEQ ID NO: 511231 - DNA, 20 bp, Artificial
  CRISPR gRNA sequence
aacaagcccatgccagcagg

SEQ ID NO: 511232 - DNA, 20 bp, Artificial
  CRISPR gRNA sequence
acaagcccatgccagcaggg

SEQ ID NO: 511233 - DNA, 20 bp, Artificial
  CRISPR gRNA sequence
agggaggtcccactgccatg

SEQ ID NO: 511234 - DNA, 20 bp, Artificial
  CRISPR gRNA sequence
gaggtcccactgccatgaag

SEQ ID NO: 511235 - DNA, 20 bp, Artificial
  CRISPR gRNA sequence
cagcgtcctcatcaacgtca

SEQ ID NO: 511236 - DNA, 20 bp, Artificial
  CRISPR gRNA sequence
cgtcctcatcaacgtcacag

SEQ ID NO: 511237 - DNA, 20 bp, Artificial
  CRISPR gRNA sequence
gtcctcatcaacgtcacagt

SEQ ID NO: 511238 - DNA, 20 bp, Artificial
  CRISPR gRNA sequence
atcaacgtcacagtgggaac

SEQ ID NO: 511239 - DNA, 20 bp, Artificial
  CRISPR gRNA sequence
acgtcacagtgggaacaaga

SEQ ID NO: 511240 - DNA, 20 bp, Artificial
  CRISPR gRNA sequence
cacagtgggaacaagaaagc

SEQ ID NO: 511241 - DNA, 20 bp, Artificial
  CRISPR gRNA sequence
agtgggaacaagaaagccag

SEQ ID NO: 511242 - DNA, 20 bp, Artificial
  CRISPR gRNA sequence
aacaagaaagccagtagctt

SEQ ID NO: 511243 - DNA, 20 bp, Artificial
  CRISPR gRNA sequence
gccagtagctttggaatccg

SEQ ID NO: 511244 - DNA, 20 bp, Artificial
  CRISPR gRNA sequence
ccagtagctttggaatccga

SEQ ID NO: 511245 - DNA, 20 bp, Artificial
  CRISPR gRNA sequence
agtagctttggaatccgaag

SEQ ID NO: 511246 - DNA, 20 bp, Artificial
  CRISPR gRNA sequence
ggaatccgaaggagcaattt

SEQ ID NO: 511247 - DNA, 20 bp, Artificial
  CRISPR gRNA sequence
gcaatttcagcataattcgt

SEQ ID NO: 511248 - DNA, 20 bp, Artificial
  CRISPR gRNA sequence
ctttattcatttatcacaaa

SEQ ID NO: 511249 - DNA, 20 bp, Artificial
  CRISPR gRNA sequence
tttattcatttatcacaaaa

SEQ ID NO: 511250 - DNA, 20 bp, Artificial
  CRISPR gRNA sequence
ttattcatttatcacaaaaa

SEQ ID NO: 511251 - DNA, 20 bp, Artificial
  CRISPR gRNA sequence
ttcatttatcacaaaaaggg

SEQ ID NO: 511252 - DNA, 20 bp, Artificial
  CRISPR gRNA sequence
aaaagggtggaaaatacaaa

SEQ ID NO: 511253 - DNA, 20 bp, Artificial
  CRISPR gRNA sequence
aaagggtggaaaatacaaac

SEQ ID NO: 511254 - DNA, 20 bp, Artificial
  CRISPR gRNA sequence
atgaaaattgaaaatactca

SEQ ID NO: 511255 - DNA, 20 bp, Artificial
  CRISPR gRNA sequence
atactcatagtgccaccacc

SEQ ID NO: 511256 - DNA, 20 bp, Artificial
  CRISPR gRNA sequence
actcatagtgccaccaccca

SEQ ID NO: 511257 - DNA, 20 bp, Artificial
  CRISPR gRNA sequence
tgccaccacccagagaaatg

SEQ ID NO: 511258 - DNA, 20 bp, Artificial
  CRISPR gRNA sequence
cagagaaatgcagaatattt

SEQ ID NO: 511259 - DNA, 20 bp, Artificial
  CRISPR gRNA sequence
ataaattcacttttaccacg

SEQ ID NO: 511260 - DNA, 20 bp, Artificial
  CRISPR gRNA sequence
ttcacttttaccacgaagcc

SEQ ID NO: 511261 - DNA, 20 bp, Artificial
  CRISPR gRNA sequence
ccacgaagccaagctgccct

SEQ ID NO: 511262 - DNA, 20 bp, Artificial
  CRISPR gRNA sequence
cgaagccaagctgccctgag

SEQ ID NO: 511263 - DNA, 20 bp, Artificial
  CRISPR gRNA sequence
tgcatgttttcgttgctgtg

SEQ ID NO: 511264 - DNA, 20 bp, Artificial
  CRISPR gRNA sequence
gcatgttttcgttgctgtgt

SEQ ID NO: 511265 - DNA, 20 bp, Artificial
  CRISPR gRNA sequence
cgttgctgtgtgggactcca

SEQ ID NO: 511266 - DNA, 20 bp, Artificial
  CRISPR gRNA sequence
ctgtgtgggactccatagcg

SEQ ID NO: 511267 - DNA, 20 bp, Artificial
  CRISPR gRNA sequence
tgtgtgggactccatagcgc

SEQ ID NO: 511268 - DNA, 20 bp, Artificial
  CRISPR gRNA sequence
cgcaggcaccgaaaccgcca

SEQ ID NO: 511269 - DNA, 20 bp, Artificial
  CRISPR gRNA sequence
caaagcatcttacacgttga

SEQ ID NO: 511270 - DNA, 20 bp, Artificial
  CRISPR gRNA sequence
cttacacgttgacggctaca

SEQ ID NO: 511271 - DNA, 20 bp, Artificial
  CRISPR gRNA sequence
ttacacgttgacggctacac

SEQ ID NO: 511272 - DNA, 20 bp, Artificial
  CRISPR gRNA sequence
tacacgttgacggctacaca

SEQ ID NO: 511273 - DNA, 20 bp, Artificial
  CRISPR gRNA sequence
tgacggctacacagggaatc

SEQ ID NO: 511274 - DNA, 20 bp, Artificial
  CRISPR gRNA sequence
cacagggaatcaagatattt

SEQ ID NO: 511275 - DNA, 20 bp, Artificial
  CRISPR gRNA sequence
gatattttggctgaaatccc

SEQ ID NO: 511276 - DNA, 20 bp, Artificial
  CRISPR gRNA sequence
tgaaatccctggttctttcc

SEQ ID NO: 511277 - DNA, 20 bp, Artificial
  CRISPR gRNA sequence
gaaatccctggttctttcct

SEQ ID NO: 511278 - DNA, 20 bp, Artificial
  CRISPR gRNA sequence
aaatccctggttctttcctg

SEQ ID NO: 511279 - DNA, 20 bp, Artificial
  CRISPR gRNA sequence
ggggtgactcatatgtttct

SEQ ID NO: 511280 - DNA, 20 bp, Artificial
  CRISPR gRNA sequence
tgactcatatgtttcttagc

SEQ ID NO: 511281 - DNA, 20 bp, Artificial
  CRISPR gRNA sequence
tcttttgtgaattacctgct

SEQ ID NO: 511282 - DNA, 20 bp, Artificial
  CRISPR gRNA sequence
cttttgtgaattacctgctc

SEQ ID NO: 511283 - DNA, 20 bp, Artificial
  CRISPR gRNA sequence
ttttgtgaattacctgctca

SEQ ID NO: 511284 - DNA, 20 bp, Artificial
  CRISPR gRNA sequence
acccttgaaacatccttgaa

SEQ ID NO: 511285 - DNA, 20 bp, Artificial
  CRISPR gRNA sequence
ccttgaaacatccttgaatg

SEQ ID NO: 511286 - DNA, 20 bp, Artificial
  CRISPR gRNA sequence
cctttttgttattaatttct

SEQ ID NO: 511287 - DNA, 20 bp, Artificial
  CRISPR gRNA sequence
attaatttctaagatctctt

SEQ ID NO: 511288 - DNA, 20 bp, Artificial
  CRISPR gRNA sequence
taatttctaagatctcttta

SEQ ID NO: 511289 - DNA, 20 bp, Artificial
  CRISPR gRNA sequence
ctaagatctctttagagatg

SEQ ID NO: 511290 - DNA, 20 bp, Artificial
  CRISPR gRNA sequence
ttaccatttaccttttgcac

SEQ ID NO: 511291 - DNA, 20 bp, Artificial
  CRISPR gRNA sequence
accatttaccttttgcacta

SEQ ID NO: 511292 - DNA, 20 bp, Artificial
  CRISPR gRNA sequence
catttaccttttgcactaga

SEQ ID NO: 511293 - DNA, 20 bp, Artificial
  CRISPR gRNA sequence
cttttgcactagagagataa

SEQ ID NO: 511294 - DNA, 20 bp, Artificial
  CRISPR gRNA sequence
atttcctctatgcaatttgt

SEQ ID NO: 511295 - DNA, 20 bp, Artificial
  CRISPR gRNA sequence
agtacaacatgtgccatttt

SEQ ID NO: 511296 - DNA, 20 bp, Artificial
  CRISPR gRNA sequence
tacaacatgtgccattttta

SEQ ID NO: 511297 - DNA, 20 bp, Artificial
  CRISPR gRNA sequence
cttcttgctattttccccct

SEQ ID NO: 511298 - DNA, 20 bp, Artificial
  CRISPR gRNA sequence
tttttttttttttttctttt

SEQ ID NO: 511299 - DNA, 20 bp, Artificial
  CRISPR gRNA sequence
tttttttttttcttttgaga

SEQ ID NO: 511300 - DNA, 20 bp, Artificial
  CRISPR gRNA sequence
acagtttcactcttgttgcc

SEQ ID NO: 511301 - DNA, 20 bp, Artificial
  CRISPR gRNA sequence
cagtttcactcttgttgccc

SEQ ID NO: 511302 - DNA, 20 bp, Artificial
  CRISPR gRNA sequence
ttcactcttgttgcccaggc

SEQ ID NO: 511303 - DNA, 20 bp, Artificial
  CRISPR gRNA sequence
cactcttgttgcccaggctg

SEQ ID NO: 511304 - DNA, 20 bp, Artificial
  CRISPR gRNA sequence
ttgttgcccaggctggagtg

SEQ ID NO: 511305 - DNA, 20 bp, Artificial
  CRISPR gRNA sequence
gttgcccaggctggagtgca

SEQ ID NO: 511306 - DNA, 20 bp, Artificial
  CRISPR gRNA sequence
ttgcccaggctggagtgcag

SEQ ID NO: 511307 - DNA, 20 bp, Artificial
  CRISPR gRNA sequence
ccaggctggagtgcagaggt

SEQ ID NO: 511308 - DNA, 20 bp, Artificial
  CRISPR gRNA sequence
ggagtgcagaggtgagatct

SEQ ID NO: 511309 - DNA, 20 bp, Artificial
  CRISPR gRNA sequence
tcactgcaccctctgcctcc

SEQ ID NO: 511310 - DNA, 20 bp, Artificial
  CRISPR gRNA sequence
cactgcaccctctgcctccc

SEQ ID NO: 511311 - DNA, 20 bp, Artificial
  CRISPR gRNA sequence
accctctgcctcccgggctc

SEQ ID NO: 511312 - DNA, 20 bp, Artificial
  CRISPR gRNA sequence
ctcaagtgattctcctgcct

SEQ ID NO: 511313 - DNA, 20 bp, Artificial
  CRISPR gRNA sequence
ttctcctgcctcagcctcgc

SEQ ID NO: 511314 - DNA, 20 bp, Artificial
  CRISPR gRNA sequence
tcctgcctcagcctcgcgag

SEQ ID NO: 511315 - DNA, 20 bp, Artificial
  CRISPR gRNA sequence
gcctcagcctcgcgagtagc

SEQ ID NO: 511316 - DNA, 20 bp, Artificial
  CRISPR gRNA sequence
cctcagcctcgcgagtagct

SEQ ID NO: 511317 - DNA, 20 bp, Artificial
  CRISPR gRNA sequence
ctcgcgagtagctgggatta

SEQ ID NO: 511318 - DNA, 20 bp, Artificial
  CRISPR gRNA sequence
tcgcgagtagctgggattac

SEQ ID NO: 511319 - DNA, 20 bp, Artificial
  CRISPR gRNA sequence
gattacaggcgcccgccacc

SEQ ID NO: 511320 - DNA, 20 bp, Artificial
  CRISPR gRNA sequence
caggcgcccgccaccaagcc

SEQ ID NO: 511321 - DNA, 20 bp, Artificial
  CRISPR gRNA sequence
ccagctaatttatgtatttt

SEQ ID NO: 511322 - DNA, 20 bp, Artificial
  CRISPR gRNA sequence
gctaatttatgtatttttag

SEQ ID NO: 511323 - DNA, 20 bp, Artificial
  CRISPR gRNA sequence
taatttatgtatttttagta

SEQ ID NO: 511324 - DNA, 20 bp, Artificial
  CRISPR gRNA sequence
ttatgtatttttagtagaga

SEQ ID NO: 511325 - DNA, 20 bp, Artificial
  CRISPR gRNA sequence
tatgtatttttagtagagat

SEQ ID NO: 511326 - DNA, 20 bp, Artificial
  CRISPR gRNA sequence
atgtatttttagtagagatg

SEQ ID NO: 511327 - DNA, 20 bp, Artificial
  CRISPR gRNA sequence
tggggtttcactatgttgct

SEQ ID NO: 511328 - DNA, 20 bp, Artificial
  CRISPR gRNA sequence
ggggtttcactatgttgctc

SEQ ID NO: 511329 - DNA, 20 bp, Artificial
  CRISPR gRNA sequence
tttcactatgttgctcaggc

SEQ ID NO: 511330 - DNA, 20 bp, Artificial
  CRISPR gRNA sequence
tggtctcaaactcctgacct

SEQ ID NO: 511331 - DNA, 20 bp, Artificial
  CRISPR gRNA sequence
ggtctcaaactcctgacctc

SEQ ID NO: 511332 - DNA, 20 bp, Artificial
  CRISPR gRNA sequence
ctcaggtgatccgcctgcct

SEQ ID NO: 511333 - DNA, 20 bp, Artificial
  CRISPR gRNA sequence
ccgcctgcctcagcctccca

SEQ ID NO: 511334 - DNA, 20 bp, Artificial
  CRISPR gRNA sequence
gcctcagcctcccaaagtgc

SEQ ID NO: 511335 - DNA, 20 bp, Artificial
  CRISPR gRNA sequence
cctcagcctcccaaagtgct

SEQ ID NO: 511336 - DNA, 20 bp, Artificial
  CRISPR gRNA sequence
ctcccaaagtgctgggatta

SEQ ID NO: 511337 - DNA, 20 bp, Artificial
  CRISPR gRNA sequence
tcccaaagtgctgggattac

SEQ ID NO: 511338 - DNA, 20 bp, Artificial
  CRISPR gRNA sequence
agtgctgggattacaggcat

SEQ ID NO: 511339 - DNA, 20 bp, Artificial
  CRISPR gRNA sequence
caggcatgagccaccatgcc

SEQ ID NO: 511340 - DNA, 20 bp, Artificial
  CRISPR gRNA sequence
caccatgcccggcctcccct

SEQ ID NO: 511341 - DNA, 20 bp, Artificial
  CRISPR gRNA sequence
ctccccttagcttttatgct

SEQ ID NO: 511342 - DNA, 20 bp, Artificial
  CRISPR gRNA sequence
tccccttagcttttatgctg

SEQ ID NO: 511343 - DNA, 20 bp, Artificial
  CRISPR gRNA sequence
tgctgaggtttccttactct

SEQ ID NO: 511344 - DNA, 20 bp, Artificial
  CRISPR gRNA sequence
tgttttattccctaaaactg

SEQ ID NO: 511345 - DNA, 20 bp, Artificial
  CRISPR gRNA sequence
actgaagtcctacacatttg

SEQ ID NO: 511346 - DNA, 20 bp, Artificial
  CRISPR gRNA sequence
tggccattcttttatgtcca

SEQ ID NO: 511347 - DNA, 20 bp, Artificial
  CRISPR gRNA sequence
cattcttttatgtccacagc

SEQ ID NO: 511348 - DNA, 20 bp, Artificial
  CRISPR gRNA sequence
ttcttttatgtccacagcaa

SEQ ID NO: 511349 - DNA, 20 bp, Artificial
  CRISPR gRNA sequence
atgtccacagcaagagtgtc

SEQ ID NO: 511350 - DNA, 20 bp, Artificial
  CRISPR gRNA sequence
tgtccacagcaagagtgtcc

SEQ ID NO: 511351 - DNA, 20 bp, Artificial
  CRISPR gRNA sequence
gtccacagcaagagtgtccg

SEQ ID NO: 511352 - DNA, 20 bp, Artificial
  CRISPR gRNA sequence
agcaagagtgtccggggcct

SEQ ID NO: 511353 - DNA, 20 bp, Artificial
  CRISPR gRNA sequence
ctcggcctcacgtcgccacc

SEQ ID NO: 511354 - DNA, 20 bp, Artificial
  CRISPR gRNA sequence
tcggcctcacgtcgccaccc

SEQ ID NO: 511355 - DNA, 20 bp, Artificial
  CRISPR gRNA sequence
ctcacgtcgccacccaggaa

SEQ ID NO: 511356 - DNA, 20 bp, Artificial
  CRISPR gRNA sequence
cgtcgccacccaggaacaga

SEQ ID NO: 511357 - DNA, 20 bp, Artificial
  CRISPR gRNA sequence
acagacagtctccttcatgt

SEQ ID NO: 511358 - DNA, 20 bp, Artificial
  CRISPR gRNA sequence
acagtctccttcatgttaga

SEQ ID NO: 511359 - DNA, 20 bp, Artificial
  CRISPR gRNA sequence
agtctccttcatgttagatg

SEQ ID NO: 511360 - DNA, 20 bp, Artificial
  CRISPR gRNA sequence
gtctccttcatgttagatgg

SEQ ID NO: 511361 - DNA, 20 bp, Artificial
  CRISPR gRNA sequence
ctccttcatgttagatggag

SEQ ID NO: 511362 - DNA, 20 bp, Artificial
  CRISPR gRNA sequence
cttcatgttagatggaggag

SEQ ID NO: 511363 - DNA, 20 bp, Artificial
  CRISPR gRNA sequence
atttgatttccctttgactt

SEQ ID NO: 511364 - DNA, 20 bp, Artificial
  CRISPR gRNA sequence
tttgatttccctttgacttc

SEQ ID NO: 511365 - DNA, 20 bp, Artificial
  CRISPR gRNA sequence
tccctttgacttcaggtatt

SEQ ID NO: 511366 - DNA, 20 bp, Artificial
  CRISPR gRNA sequence
ctttgacttcaggtatttag

SEQ ID NO: 511367 - DNA, 20 bp, Artificial
  CRISPR gRNA sequence
ttgacttcaggtatttagca

SEQ ID NO: 511368 - DNA, 20 bp, Artificial
  CRISPR gRNA sequence
aggtatttagcagagtactt

SEQ ID NO: 511369 - DNA, 20 bp, Artificial
  CRISPR gRNA sequence
ccttattaatatgtgtgtgt

SEQ ID NO: 511370 - DNA, 20 bp, Artificial
  CRISPR gRNA sequence
cttattaatatgtgtgtgtc

SEQ ID NO: 511371 - DNA, 20 bp, Artificial
  CRISPR gRNA sequence
ttattaatatgtgtgtgtcg

SEQ ID NO: 511372 - DNA, 20 bp, Artificial
  CRISPR gRNA sequence
tattaatatgtgtgtgtcgg

SEQ ID NO: 511373 - DNA, 20 bp, Artificial
  CRISPR gRNA sequence
attaatatgtgtgtgtcggg

SEQ ID NO: 511374 - DNA, 20 bp, Artificial
  CRISPR gRNA sequence
ttaatatgtgtgtgtcgggg

SEQ ID NO: 511375 - DNA, 20 bp, Artificial
  CRISPR gRNA sequence
atatgtgtgtgtcggggggg

SEQ ID NO: 511376 - DNA, 20 bp, Artificial
  CRISPR gRNA sequence
tatgtgtgtgtcgggggggt

SEQ ID NO: 511377 - DNA, 20 bp, Artificial
  CRISPR gRNA sequence
atgtgtgtgtcgggggggtg

SEQ ID NO: 511378 - DNA, 20 bp, Artificial
  CRISPR gRNA sequence
gtgtctcattttatttcatt

SEQ ID NO: 511379 - DNA, 20 bp, Artificial
  CRISPR gRNA sequence
ctcattttatttcatttggc

SEQ ID NO: 511380 - DNA, 20 bp, Artificial
  CRISPR gRNA sequence
tttcatttggccagaaattg

SEQ ID NO: 511381 - DNA, 20 bp, Artificial
  CRISPR gRNA sequence
gcctttaaaatttgtgctat

SEQ ID NO: 511382 - DNA, 20 bp, Artificial
  CRISPR gRNA sequence
cctttaaaatttgtgctatc

SEQ ID NO: 511383 - DNA, 20 bp, Artificial
  CRISPR gRNA sequence
taaaatttgtgctatcaggc

SEQ ID NO: 511384 - DNA, 20 bp, Artificial
  CRISPR gRNA sequence
aaaatttgtgctatcaggcc

SEQ ID NO: 511385 - DNA, 20 bp, Artificial
  CRISPR gRNA sequence
ttgtgctatcaggccgggcg

SEQ ID NO: 511386 - DNA, 20 bp, Artificial
  CRISPR gRNA sequence
tgctatcaggccgggcgcag

SEQ ID NO: 511387 - DNA, 20 bp, Artificial
  CRISPR gRNA sequence
gtggctcacgcctgtaatcc

SEQ ID NO: 511388 - DNA, 20 bp, Artificial
  CRISPR gRNA sequence
cgcctgtaatcccagcactt

SEQ ID NO: 511389 - DNA, 20 bp, Artificial
  CRISPR gRNA sequence
gcctgtaatcccagcacttt

SEQ ID NO: 511390 - DNA, 20 bp, Artificial
  CRISPR gRNA sequence
ctgtaatcccagcactttgg

SEQ ID NO: 511391 - DNA, 20 bp, Artificial
  CRISPR gRNA sequence
tgtaatcccagcactttggg

SEQ ID NO: 511392 - DNA, 20 bp, Artificial
  CRISPR gRNA sequence
tcccagcactttgggaggcc

SEQ ID NO: 511393 - DNA, 20 bp, Artificial
  CRISPR gRNA sequence
cccagcactttgggaggccg

SEQ ID NO: 511394 - DNA, 20 bp, Artificial
  CRISPR gRNA sequence
agcactttgggaggccgagg

SEQ ID NO: 511395 - DNA, 20 bp, Artificial
  CRISPR gRNA sequence
gcactttgggaggccgaggc

SEQ ID NO: 511396 - DNA, 20 bp, Artificial
  CRISPR gRNA sequence
ctttgggaggccgaggcagg

SEQ ID NO: 511397 - DNA, 20 bp, Artificial
  CRISPR gRNA sequence
ggccgaggcaggcggatcac

SEQ ID NO: 511398 - DNA, 20 bp, Artificial
  CRISPR gRNA sequence
gccgaggcaggcggatcacg

SEQ ID NO: 511399 - DNA, 20 bp, Artificial
  CRISPR gRNA sequence
aggcaggcggatcacgaggt

SEQ ID NO: 511400 - DNA, 20 bp, Artificial
  CRISPR gRNA sequence
ggcaggcggatcacgaggtc

SEQ ID NO: 511401 - DNA, 20 bp, Artificial
  CRISPR gRNA sequence
caggcggatcacgaggtcag

SEQ ID NO: 511402 - DNA, 20 bp, Artificial
  CRISPR gRNA sequence
gatcacgaggtcaggagttc

SEQ ID NO: 511403 - DNA, 20 bp, Artificial
  CRISPR gRNA sequence
cgaggtcaggagttcgagac

SEQ ID NO: 511404 - DNA, 20 bp, Artificial
  CRISPR gRNA sequence
tcaggagttcgagaccagcc

SEQ ID NO: 511405 - DNA, 20 bp, Artificial
  CRISPR gRNA sequence
cgagaccagcctggccaata

SEQ ID NO: 511406 - DNA, 20 bp, Artificial
  CRISPR gRNA sequence
tctactaaaaatacaaaaat

SEQ ID NO: 511407 - DNA, 20 bp, Artificial
  CRISPR gRNA sequence
ctaaaaatacaaaaattagc

SEQ ID NO: 511408 - DNA, 20 bp, Artificial
  CRISPR gRNA sequence
taaaaatacaaaaattagct

SEQ ID NO: 511409 - DNA, 20 bp, Artificial
  CRISPR gRNA sequence
atacaaaaattagctgggcc

SEQ ID NO: 511410 - DNA, 20 bp, Artificial
  CRISPR gRNA sequence
caaaaattagctgggcctag

SEQ ID NO: 511411 - DNA, 20 bp, Artificial
  CRISPR gRNA sequence
ggcctagtggtgtgcaccta

SEQ ID NO: 511412 - DNA, 20 bp, Artificial
  CRISPR gRNA sequence
gtggtgtgcacctatagtcc

SEQ ID NO: 511413 - DNA, 20 bp, Artificial
  CRISPR gRNA sequence
cacctatagtcccagctact

SEQ ID NO: 511414 - DNA, 20 bp, Artificial
  CRISPR gRNA sequence
acctatagtcccagctactc

SEQ ID NO: 511415 - DNA, 20 bp, Artificial
  CRISPR gRNA sequence
ctatagtcccagctactcag

SEQ ID NO: 511416 - DNA, 20 bp, Artificial
  CRISPR gRNA sequence
tatagtcccagctactcagg

SEQ ID NO: 511417 - DNA, 20 bp, Artificial
  CRISPR gRNA sequence
tcccagctactcaggaggct

SEQ ID NO: 511418 - DNA, 20 bp, Artificial
  CRISPR gRNA sequence
cccagctactcaggaggctg

SEQ ID NO: 511419 - DNA, 20 bp, Artificial
  CRISPR gRNA sequence
agctactcaggaggctgagg

SEQ ID NO: 511420 - DNA, 20 bp, Artificial
  CRISPR gRNA sequence
tactcaggaggctgaggcag

SEQ ID NO: 511421 - DNA, 20 bp, Artificial
  CRISPR gRNA sequence
gcagaagaatttcttgaaca

SEQ ID NO: 511422 - DNA, 20 bp, Artificial
  CRISPR gRNA sequence
cagaagaatttcttgaacat

SEQ ID NO: 511423 - DNA, 20 bp, Artificial
  CRISPR gRNA sequence
gaagaatttcttgaacatgg

SEQ ID NO: 511424 - DNA, 20 bp, Artificial
  CRISPR gRNA sequence
aagaatttcttgaacatggg

SEQ ID NO: 511425 - DNA, 20 bp, Artificial
  CRISPR gRNA sequence
aatttcttgaacatgggagg

SEQ ID NO: 511426 - DNA, 20 bp, Artificial
  CRISPR gRNA sequence
tttcttgaacatgggaggcg

SEQ ID NO: 511427 - DNA, 20 bp, Artificial
  CRISPR gRNA sequence
ttcttgaacatgggaggcgg

SEQ ID NO: 511428 - DNA, 20 bp, Artificial
  CRISPR gRNA sequence
aacatgggaggcggaggttg

SEQ ID NO: 511429 - DNA, 20 bp, Artificial
  CRISPR gRNA sequence
tgggaggcggaggttgcagt

SEQ ID NO: 511430 - DNA, 20 bp, Artificial
  CRISPR gRNA sequence
ggcggaggttgcagtgagcc

SEQ ID NO: 511431 - DNA, 20 bp, Artificial
  CRISPR gRNA sequence
ggttgcagtgagccgagatc

SEQ ID NO: 511432 - DNA, 20 bp, Artificial
  CRISPR gRNA sequence
gagatctagccattgcactc

SEQ ID NO: 511433 - DNA, 20 bp, Artificial
  CRISPR gRNA sequence
ctagccattgcactccagcc

SEQ ID NO: 511434 - DNA, 20 bp, Artificial
  CRISPR gRNA sequence
ttgcactccagcctggatga

SEQ ID NO: 511435 - DNA, 20 bp, Artificial
  CRISPR gRNA sequence
gcactccagcctggatgaca

SEQ ID NO: 511436 - DNA, 20 bp, Artificial
  CRISPR gRNA sequence
tccagcctggatgacagagt

SEQ ID NO: 511437 - DNA, 20 bp, Artificial
  CRISPR gRNA sequence
aactgtgctatcaaacttca

SEQ ID NO: 511438 - DNA, 20 bp, Artificial
  CRISPR gRNA sequence
gtgctatcaaacttcacaga

SEQ ID NO: 511439 - DNA, 20 bp, Artificial
  CRISPR gRNA sequence
ttcacagatagtcaaaccaa

SEQ ID NO: 511440 - DNA, 20 bp, Artificial
  CRISPR gRNA sequence
acagatagtcaaaccaacag

SEQ ID NO: 511441 - DNA, 20 bp, Artificial
  CRISPR gRNA sequence
cagatagtcaaaccaacagt

SEQ ID NO: 511442 - DNA, 20 bp, Artificial
  CRISPR gRNA sequence
gaacacgtctccctgaccct

SEQ ID NO: 511443 - DNA, 20 bp, Artificial
  CRISPR gRNA sequence
aacacgtctccctgaccctt

SEQ ID NO: 511444 - DNA, 20 bp, Artificial
  CRISPR gRNA sequence
cttgggaaaatacgcttttg

SEQ ID NO: 511445 - DNA, 20 bp, Artificial
  CRISPR gRNA sequence
ttgggaaaatacgcttttgc

SEQ ID NO: 511446 - DNA, 20 bp, Artificial
  CRISPR gRNA sequence
tgggaaaatacgcttttgca

SEQ ID NO: 511447 - DNA, 20 bp, Artificial
  CRISPR gRNA sequence
aatacgcttttgcagggtcg

SEQ ID NO: 511448 - DNA, 20 bp, Artificial
  CRISPR gRNA sequence
atacgcttttgcagggtcgc

SEQ ID NO: 511449 - DNA, 20 bp, Artificial
  CRISPR gRNA sequence
cttttgcagggtcgcaggtt

SEQ ID NO: 511450 - DNA, 20 bp, Artificial
  CRISPR gRNA sequence
tttgcagggtcgcaggttca

SEQ ID NO: 511451 - DNA, 20 bp, Artificial
  CRISPR gRNA sequence
ttgcagggtcgcaggttcag

SEQ ID NO: 511452 - DNA, 20 bp, Artificial
  CRISPR gRNA sequence
tcgcaggttcagaggcgaca

SEQ ID NO: 511453 - DNA, 20 bp, Artificial
  CRISPR gRNA sequence
cgcaggttcagaggcgacat

SEQ ID NO: 511454 - DNA, 20 bp, Artificial
  CRISPR gRNA sequence
ggttcagaggcgacatgggc

SEQ ID NO: 511455 - DNA, 20 bp, Artificial
  CRISPR gRNA sequence
gttcagaggcgacatgggct

SEQ ID NO: 511456 - DNA, 20 bp, Artificial
  CRISPR gRNA sequence
atctgacctgtttttgtccc

SEQ ID NO: 511457 - DNA, 20 bp, Artificial
  CRISPR gRNA sequence
gtttttgtccctggatttcc

SEQ ID NO: 511458 - DNA, 20 bp, Artificial
  CRISPR gRNA sequence
ttttgtccctggatttcctg

SEQ ID NO: 511459 - DNA, 20 bp, Artificial
  CRISPR gRNA sequence
tcctggagcctctgtgatcc

SEQ ID NO: 511460 - DNA, 20 bp, Artificial
  CRISPR gRNA sequence
cctggagcctctgtgatcca

SEQ ID NO: 511461 - DNA, 20 bp, Artificial
  CRISPR gRNA sequence
gagcctctgtgatccaagga

SEQ ID NO: 511462 - DNA, 20 bp, Artificial
  CRISPR gRNA sequence
gtgatccaaggacagtgttc

SEQ ID NO: 511463 - DNA, 20 bp, Artificial
  CRISPR gRNA sequence
gtgttccagtccccacctga

SEQ ID NO: 511464 - DNA, 20 bp, Artificial
  CRISPR gRNA sequence
cacctgacggcacttctctc

SEQ ID NO: 511465 - DNA, 20 bp, Artificial
  CRISPR gRNA sequence
ttctttatcacattcctaca

SEQ ID NO: 511466 - DNA, 20 bp, Artificial
  CRISPR gRNA sequence
tttatcacattcctacaaag

SEQ ID NO: 511467 - DNA, 20 bp, Artificial
  CRISPR gRNA sequence
cattcctacaaagcagaaat

SEQ ID NO: 511468 - DNA, 20 bp, Artificial
  CRISPR gRNA sequence
atgagtccatcttgatgctc

SEQ ID NO: 511469 - DNA, 20 bp, Artificial
  CRISPR gRNA sequence
catcttgatgctctggcttt

SEQ ID NO: 511470 - DNA, 20 bp, Artificial
  CRISPR gRNA sequence
tgctctggcttttggcttaa

SEQ ID NO: 511471 - DNA, 20 bp, Artificial
  CRISPR gRNA sequence
gctctggcttttggcttaaa

SEQ ID NO: 511472 - DNA, 20 bp, Artificial
  CRISPR gRNA sequence
ctggcttttggcttaaaagg

SEQ ID NO: 511473 - DNA, 20 bp, Artificial
  CRISPR gRNA sequence
tggcttaaaaggtggatgcc

SEQ ID NO: 511474 - DNA, 20 bp, Artificial
  CRISPR gRNA sequence
ctagtttataatcatccctt

SEQ ID NO: 511475 - DNA, 20 bp, Artificial
  CRISPR gRNA sequence
ataatcatcccttgagcctt

SEQ ID NO: 511476 - DNA, 20 bp, Artificial
  CRISPR gRNA sequence
tcccttgagccttcagttcc

SEQ ID NO: 511477 - DNA, 20 bp, Artificial
  CRISPR gRNA sequence
tgagccttcagttcccagcg

SEQ ID NO: 511478 - DNA, 20 bp, Artificial
  CRISPR gRNA sequence
gagccttcagttcccagcgc

SEQ ID NO: 511479 - DNA, 20 bp, Artificial
  CRISPR gRNA sequence
agccttcagttcccagcgca

SEQ ID NO: 511480 - DNA, 20 bp, Artificial
  CRISPR gRNA sequence
gccttcagttcccagcgcag

SEQ ID NO: 511481 - DNA, 20 bp, Artificial
  CRISPR gRNA sequence
tcagttcccagcgcaggggt

SEQ ID NO: 511482 - DNA, 20 bp, Artificial
  CRISPR gRNA sequence
ttccttccaaccttgtcccc

SEQ ID NO: 511483 - DNA, 20 bp, Artificial
  CRISPR gRNA sequence
cttccaaccttgtcccctgg

SEQ ID NO: 511484 - DNA, 20 bp, Artificial
  CRISPR gRNA sequence
atcacttcccgcgcacctcc

SEQ ID NO: 511485 - DNA, 20 bp, Artificial
  CRISPR gRNA sequence
cctccgagtcactttgatgc

SEQ ID NO: 511486 - DNA, 20 bp, Artificial
  CRISPR gRNA sequence
tgatgcgagtgcctctcctc

SEQ ID NO: 511487 - DNA, 20 bp, Artificial
  CRISPR gRNA sequence
gatgcgagtgcctctcctct

SEQ ID NO: 511488 - DNA, 20 bp, Artificial
  CRISPR gRNA sequence
cgagtgcctctcctctagga

SEQ ID NO: 511489 - DNA, 20 bp, Artificial
  CRISPR gRNA sequence
cctctcctctaggacagcgc

SEQ ID NO: 511490 - DNA, 20 bp, Artificial
  CRISPR gRNA sequence
ctctcctctaggacagcgca

SEQ ID NO: 511491 - DNA, 20 bp, Artificial
  CRISPR gRNA sequence
tcctctaggacagcgcaagg

SEQ ID NO: 511492 - DNA, 20 bp, Artificial
  CRISPR gRNA sequence
cctctaggacagcgcaaggt

SEQ ID NO: 511493 - DNA, 20 bp, Artificial
  CRISPR gRNA sequence
ggacagcgcaaggtgggttt

SEQ ID NO: 511494 - DNA, 20 bp, Artificial
  CRISPR gRNA sequence
gcgcaaggtgggtttcagca

SEQ ID NO: 511495 - DNA, 20 bp, Artificial
  CRISPR gRNA sequence
cgcaaggtgggtttcagcac

SEQ ID NO: 511496 - DNA, 20 bp, Artificial
  CRISPR gRNA sequence
aaggtgggtttcagcacagg

SEQ ID NO: 511497 - DNA, 20 bp, Artificial
  CRISPR gRNA sequence
aggtgggtttcagcacaggc

SEQ ID NO: 511498 - DNA, 20 bp, Artificial
  CRISPR gRNA sequence
gtgggtttcagcacaggcag

SEQ ID NO: 511499 - DNA, 20 bp, Artificial
  CRISPR gRNA sequence
tgggtttcagcacaggcagg

SEQ ID NO: 511500 - DNA, 20 bp, Artificial
  CRISPR gRNA sequence
gtttcagcacaggcaggagg

SEQ ID NO: 511501 - DNA, 20 bp, Artificial
  CRISPR gRNA sequence
caggaggaagctctgatgca

SEQ ID NO: 511502 - DNA, 20 bp, Artificial
  CRISPR gRNA sequence
gctctgatgcaaagttccaa

SEQ ID NO: 511503 - DNA, 20 bp, Artificial
  CRISPR gRNA sequence
ctctgatgcaaagttccaat

SEQ ID NO: 511504 - DNA, 20 bp, Artificial
  CRISPR gRNA sequence
gcaaagttccaatgggtctg

SEQ ID NO: 511505 - DNA, 20 bp, Artificial
  CRISPR gRNA sequence
caaagttccaatgggtctgc

SEQ ID NO: 511506 - DNA, 20 bp, Artificial
  CRISPR gRNA sequence
aaagttccaatgggtctgcg

SEQ ID NO: 511507 - DNA, 20 bp, Artificial
  CRISPR gRNA sequence
caatgggtctgcggggcctc

SEQ ID NO: 511508 - DNA, 20 bp, Artificial
  CRISPR gRNA sequence
tgcggggcctctggttcctc

SEQ ID NO: 511509 - DNA, 20 bp, Artificial
  CRISPR gRNA sequence
ggggcctctggttcctcaag

SEQ ID NO: 511510 - DNA, 20 bp, Artificial
  CRISPR gRNA sequence
ttcctcaagcagtctcgtct

SEQ ID NO: 511511 - DNA, 20 bp, Artificial
  CRISPR gRNA sequence
tcctcaagcagtctcgtctt

SEQ ID NO: 511512 - DNA, 20 bp, Artificial
  CRISPR gRNA sequence
cctcaagcagtctcgtctta

SEQ ID NO: 511513 - DNA, 20 bp, Artificial
  CRISPR gRNA sequence
agtctcgtcttagggtttta

SEQ ID NO: 511514 - DNA, 20 bp, Artificial
  CRISPR gRNA sequence
gtctcgtcttagggttttac

SEQ ID NO: 511515 - DNA, 20 bp, Artificial
  CRISPR gRNA sequence
tctcgtcttagggttttacg

SEQ ID NO: 511516 - DNA, 20 bp, Artificial
  CRISPR gRNA sequence
gggttttacggggttgcaaa

SEQ ID NO: 511517 - DNA, 20 bp, Artificial
  CRISPR gRNA sequence
ggttttacggggttgcaaaa

SEQ ID NO: 511518 - DNA, 20 bp, Artificial
  CRISPR gRNA sequence
tttacggggttgcaaaaagg

SEQ ID NO: 511519 - DNA, 20 bp, Artificial
  CRISPR gRNA sequence
gggttgcaaaaaggaagcct

SEQ ID NO: 511520 - DNA, 20 bp, Artificial
  CRISPR gRNA sequence
gcaaaaaggaagcctgagac

SEQ ID NO: 511521 - DNA, 20 bp, Artificial
  CRISPR gRNA sequence
caaaaaggaagcctgagact

SEQ ID NO: 511522 - DNA, 20 bp, Artificial
  CRISPR gRNA sequence
aggaagcctgagactgggca

SEQ ID NO: 511523 - DNA, 20 bp, Artificial
  CRISPR gRNA sequence
aagcctgagactgggcacgg

SEQ ID NO: 511524 - DNA, 20 bp, Artificial
  CRISPR gRNA sequence
gtggctcacgcctgtaatcc

SEQ ID NO: 511525 - DNA, 20 bp, Artificial
  CRISPR gRNA sequence
cgcctgtaatcccagcactt

SEQ ID NO: 511526 - DNA, 20 bp, Artificial
  CRISPR gRNA sequence
gcctgtaatcccagcacttt

SEQ ID NO: 511527 - DNA, 20 bp, Artificial
  CRISPR gRNA sequence
ctgtaatcccagcactttgg

SEQ ID NO: 511528 - DNA, 20 bp, Artificial
  CRISPR gRNA sequence
tgtaatcccagcactttggg

SEQ ID NO: 511529 - DNA, 20 bp, Artificial
  CRISPR gRNA sequence
tcccagcactttgggaggcc

SEQ ID NO: 511530 - DNA, 20 bp, Artificial
  CRISPR gRNA sequence
cccagcactttgggaggccg

SEQ ID NO: 511531 - DNA, 20 bp, Artificial
  CRISPR gRNA sequence
agcactttgggaggccgagg

SEQ ID NO: 511532 - DNA, 20 bp, Artificial
  CRISPR gRNA sequence
gcactttgggaggccgaggt

SEQ ID NO: 511533 - DNA, 20 bp, Artificial
  CRISPR gRNA sequence
ctttgggaggccgaggtggg

SEQ ID NO: 511534 - DNA, 20 bp, Artificial
  CRISPR gRNA sequence
ggccgaggtgggcggatcat

SEQ ID NO: 511535 - DNA, 20 bp, Artificial
  CRISPR gRNA sequence
gccgaggtgggcggatcatg

SEQ ID NO: 511536 - DNA, 20 bp, Artificial
  CRISPR gRNA sequence
aggtgggcggatcatgaggt

SEQ ID NO: 511537 - DNA, 20 bp, Artificial
  CRISPR gRNA sequence
ggtgggcggatcatgaggtc

SEQ ID NO: 511538 - DNA, 20 bp, Artificial
  CRISPR gRNA sequence
tgggcggatcatgaggtcag

SEQ ID NO: 511539 - DNA, 20 bp, Artificial
  CRISPR gRNA sequence
gatcatgaggtcaggagatc

SEQ ID NO: 511540 - DNA, 20 bp, Artificial
  CRISPR gRNA sequence
tactaaaaacacaaaaaaat

SEQ ID NO: 511541 - DNA, 20 bp, Artificial
  CRISPR gRNA sequence
aaaaacacaaaaaaattagc

SEQ ID NO: 511542 - DNA, 20 bp, Artificial
  CRISPR gRNA sequence
aaaacacaaaaaaattagct

SEQ ID NO: 511543 - DNA, 20 bp, Artificial
  CRISPR gRNA sequence
acaaaaaaattagctgggcg

SEQ ID NO: 511544 - DNA, 20 bp, Artificial
  CRISPR gRNA sequence
aaattagctgggcgtggtcg

SEQ ID NO: 511545 - DNA, 20 bp, Artificial
  CRISPR gRNA sequence
aattagctgggcgtggtcgt

SEQ ID NO: 511546 - DNA, 20 bp, Artificial
  CRISPR gRNA sequence
ttagctgggcgtggtcgtgg

SEQ ID NO: 511547 - DNA, 20 bp, Artificial
  CRISPR gRNA sequence
ggcgtggtcgtgggagcctg

SEQ ID NO: 511548 - DNA, 20 bp, Artificial
  CRISPR gRNA sequence
gtcgtgggagcctgtagtcc

SEQ ID NO: 511549 - DNA, 20 bp, Artificial
  CRISPR gRNA sequence
agcctgtagtcccagctact

SEQ ID NO: 511550 - DNA, 20 bp, Artificial
  CRISPR gRNA sequence
gcctgtagtcccagctactc

SEQ ID NO: 511551 - DNA, 20 bp, Artificial
  CRISPR gRNA sequence
tgtagtcccagctactcagg

SEQ ID NO: 511552 - DNA, 20 bp, Artificial
  CRISPR gRNA sequence
tcccagctactcaggaagct

SEQ ID NO: 511553 - DNA, 20 bp, Artificial
  CRISPR gRNA sequence
cccagctactcaggaagctg

SEQ ID NO: 511554 - DNA, 20 bp, Artificial
  CRISPR gRNA sequence
agctactcaggaagctgagg

SEQ ID NO: 511555 - DNA, 20 bp, Artificial
  CRISPR gRNA sequence
gctactcaggaagctgaggc

SEQ ID NO: 511556 - DNA, 20 bp, Artificial
  CRISPR gRNA sequence
tactcaggaagctgaggcag

SEQ ID NO: 511557 - DNA, 20 bp, Artificial
  CRISPR gRNA sequence
aggaagctgaggcaggagaa

SEQ ID NO: 511558 - DNA, 20 bp, Artificial
  CRISPR gRNA sequence
gcaggagaatggcatgaacc

SEQ ID NO: 511559 - DNA, 20 bp, Artificial
  CRISPR gRNA sequence
caggagaatggcatgaacct

SEQ ID NO: 511560 - DNA, 20 bp, Artificial
  CRISPR gRNA sequence
ggagaatggcatgaacctgg

SEQ ID NO: 511561 - DNA, 20 bp, Artificial
  CRISPR gRNA sequence
gagaatggcatgaacctggg

SEQ ID NO: 511562 - DNA, 20 bp, Artificial
  CRISPR gRNA sequence
aatggcatgaacctgggagg

SEQ ID NO: 511563 - DNA, 20 bp, Artificial
  CRISPR gRNA sequence
tggcatgaacctgggaggcg

SEQ ID NO: 511564 - DNA, 20 bp, Artificial
  CRISPR gRNA sequence
aacctgggaggcggagcttg

SEQ ID NO: 511565 - DNA, 20 bp, Artificial
  CRISPR gRNA sequence
tgggaggcggagcttgcagt

SEQ ID NO: 511566 - DNA, 20 bp, Artificial
  CRISPR gRNA sequence
ggcggagcttgcagtgagct

SEQ ID NO: 511567 - DNA, 20 bp, Artificial
  CRISPR gRNA sequence
gagatcgcgccactgcactc

SEQ ID NO: 511568 - DNA, 20 bp, Artificial
  CRISPR gRNA sequence
agatcgcgccactgcactcc

SEQ ID NO: 511569 - DNA, 20 bp, Artificial
  CRISPR gRNA sequence
cgcgccactgcactccaggc

SEQ ID NO: 511570 - DNA, 20 bp, Artificial
  CRISPR gRNA sequence
actgcactccaggccggtga

SEQ ID NO: 511571 - DNA, 20 bp, Artificial
  CRISPR gRNA sequence
ctccgtctcaaaaaaataaa

SEQ ID NO: 511572 - DNA, 20 bp, Artificial
  CRISPR gRNA sequence
tccgtctcaaaaaaataaaa

SEQ ID NO: 511573 - DNA, 20 bp, Artificial
  CRISPR gRNA sequence
gtctcaaaaaaataaaaagg

SEQ ID NO: 511574 - DNA, 20 bp, Artificial
  CRISPR gRNA sequence
aaaaggaagcctgaccccgc

SEQ ID NO: 511575 - DNA, 20 bp, Artificial
  CRISPR gRNA sequence
accccgctggattcctctcc

SEQ ID NO: 511576 - DNA, 20 bp, Artificial
  CRISPR gRNA sequence
gctggattcctctcccagca

SEQ ID NO: 511577 - DNA, 20 bp, Artificial
  CRISPR gRNA sequence
ctggattcctctcccagcat

SEQ ID NO: 511578 - DNA, 20 bp, Artificial
  CRISPR gRNA sequence
tctctctgctgtcttgctta

SEQ ID NO: 511579 - DNA, 20 bp, Artificial
  CRISPR gRNA sequence
ttttcttttctttttttttt

SEQ ID NO: 511580 - DNA, 20 bp, Artificial
  CRISPR gRNA sequence
cttttcttttttttttgaga

SEQ ID NO: 511581 - DNA, 20 bp, Artificial
  CRISPR gRNA sequence
ttttcttttttttttgagac

SEQ ID NO: 511582 - DNA, 20 bp, Artificial
  CRISPR gRNA sequence
tttcttttttttttgagaca

SEQ ID NO: 511583 - DNA, 20 bp, Artificial
  CRISPR gRNA sequence
cagggcctcgttctgtcaac

SEQ ID NO: 511584 - DNA, 20 bp, Artificial
  CRISPR gRNA sequence
agggcctcgttctgtcaact

SEQ ID NO: 511585 - DNA, 20 bp, Artificial
  CRISPR gRNA sequence
cctcgttctgtcaactaggc

SEQ ID NO: 511586 - DNA, 20 bp, Artificial
  CRISPR gRNA sequence
tcgttctgtcaactaggctg

SEQ ID NO: 511587 - DNA, 20 bp, Artificial
  CRISPR gRNA sequence
ctgtcaactaggctggagtt

SEQ ID NO: 511588 - DNA, 20 bp, Artificial
  CRISPR gRNA sequence
tcaactaggctggagttcag

SEQ ID NO: 511589 - DNA, 20 bp, Artificial
  CRISPR gRNA sequence
ctggagttcagcagtgccat

SEQ ID NO: 511590 - DNA, 20 bp, Artificial
  CRISPR gRNA sequence
tggagttcagcagtgccatt

SEQ ID NO: 511591 - DNA, 20 bp, Artificial
  CRISPR gRNA sequence
ggagttcagcagtgccatta

SEQ ID NO: 511592 - DNA, 20 bp, Artificial
  CRISPR gRNA sequence
agtgccattagggttcactg

SEQ ID NO: 511593 - DNA, 20 bp, Artificial
  CRISPR gRNA sequence
tcactgcagtctctccctcc

SEQ ID NO: 511594 - DNA, 20 bp, Artificial
  CRISPR gRNA sequence
cactgcagtctctccctcct

SEQ ID NO: 511595 - DNA, 20 bp, Artificial
  CRISPR gRNA sequence
agtctctccctcctgggcgc

SEQ ID NO: 511596 - DNA, 20 bp, Artificial
  CRISPR gRNA sequence
cgcgagtgatcctcctgcct

SEQ ID NO: 511597 - DNA, 20 bp, Artificial
  CRISPR gRNA sequence
tcctcctgcctcagcctcct

SEQ ID NO: 511598 - DNA, 20 bp, Artificial
  CRISPR gRNA sequence
gcctcagcctcctgagtaac

SEQ ID NO: 511599 - DNA, 20 bp, Artificial
  CRISPR gRNA sequence
cctcagcctcctgagtaact

SEQ ID NO: 511600 - DNA, 20 bp, Artificial
  CRISPR gRNA sequence
gcctcctgagtaactgggac

SEQ ID NO: 511601 - DNA, 20 bp, Artificial
  CRISPR gRNA sequence
ctcctgagtaactgggacta

SEQ ID NO: 511602 - DNA, 20 bp, Artificial
  CRISPR gRNA sequence
gagatgcatgccaccatgtc

SEQ ID NO: 511603 - DNA, 20 bp, Artificial
  CRISPR gRNA sequence
ttttctatttttattttttg

SEQ ID NO: 511604 - DNA, 20 bp, Artificial
  CRISPR gRNA sequence
ttctatttttattttttgta

SEQ ID NO: 511605 - DNA, 20 bp, Artificial
  CRISPR gRNA sequence
tctatttttattttttgtag

SEQ ID NO: 511606 - DNA, 20 bp, Artificial
  CRISPR gRNA sequence
atttttattttttgtagagg

SEQ ID NO: 511607 - DNA, 20 bp, Artificial
  CRISPR gRNA sequence
tttttattttttgtagaggt

SEQ ID NO: 511608 - DNA, 20 bp, Artificial
  CRISPR gRNA sequence
tttattttttgtagaggtag

SEQ ID NO: 511609 - DNA, 20 bp, Artificial
  CRISPR gRNA sequence
aggagtctcactgtgttgcc

SEQ ID NO: 511610 - DNA, 20 bp, Artificial
  CRISPR gRNA sequence
ggagtctcactgtgttgccc

SEQ ID NO: 511611 - DNA, 20 bp, Artificial
  CRISPR gRNA sequence
ccaggctgctctcaaactcc

SEQ ID NO: 511612 - DNA, 20 bp, Artificial
  CRISPR gRNA sequence
gctctcaaactcctggcctc

SEQ ID NO: 511613 - DNA, 20 bp, Artificial
  CRISPR gRNA sequence
ctcaagtgattctcctgcct

SEQ ID NO: 511614 - DNA, 20 bp, Artificial
  CRISPR gRNA sequence
gccttggcctctcaaaacac

SEQ ID NO: 511615 - DNA, 20 bp, Artificial
  CRISPR gRNA sequence
ccttggcctctcaaaacact

SEQ ID NO: 511616 - DNA, 20 bp, Artificial
  CRISPR gRNA sequence
ctctcaaaacactgggattg

SEQ ID NO: 511617 - DNA, 20 bp, Artificial
  CRISPR gRNA sequence
tctcaaaacactgggattgc

SEQ ID NO: 511618 - DNA, 20 bp, Artificial
  CRISPR gRNA sequence
aacactgggattgcaggcgt

SEQ ID NO: 511619 - DNA, 20 bp, Artificial
  CRISPR gRNA sequence
ggattgcaggcgtcagccac

SEQ ID NO: 511620 - DNA, 20 bp, Artificial
  CRISPR gRNA sequence
gattgcaggcgtcagccacc

SEQ ID NO: 511621 - DNA, 20 bp, Artificial
  CRISPR gRNA sequence
gcaggcgtcagccaccaggc

SEQ ID NO: 511622 - DNA, 20 bp, Artificial
  CRISPR gRNA sequence
cctgtcctcgacttctgtga

SEQ ID NO: 511623 - DNA, 20 bp, Artificial
  CRISPR gRNA sequence
ctgtcctcgacttctgtgaa

SEQ ID NO: 511624 - DNA, 20 bp, Artificial
  CRISPR gRNA sequence
tgtcctcgacttctgtgaaa

SEQ ID NO: 511625 - DNA, 20 bp, Artificial
  CRISPR gRNA sequence
gtgaaagggtgtgtgtgatt

SEQ ID NO: 511626 - DNA, 20 bp, Artificial
  CRISPR gRNA sequence
agggtgtgtgtgatttggcc

SEQ ID NO: 511627 - DNA, 20 bp, Artificial
  CRISPR gRNA sequence
gatttggcccggatctgctg

SEQ ID NO: 511628 - DNA, 20 bp, Artificial
  CRISPR gRNA sequence
atttggcccggatctgctgc

SEQ ID NO: 511629 - DNA, 20 bp, Artificial
  CRISPR gRNA sequence
ctgacgccgctttcgtgtct

SEQ ID NO: 511630 - DNA, 20 bp, Artificial
  CRISPR gRNA sequence
gacgccgctttcgtgtctca

SEQ ID NO: 511631 - DNA, 20 bp, Artificial
  CRISPR gRNA sequence
tgtctcagagcctgaatgtt

SEQ ID NO: 511632 - DNA, 20 bp, Artificial
  CRISPR gRNA sequence
tctcagagcctgaatgttca

SEQ ID NO: 511633 - DNA, 20 bp, Artificial
  CRISPR gRNA sequence
tcagagctttgctcaccgtg

SEQ ID NO: 511634 - DNA, 20 bp, Artificial
  CRISPR gRNA sequence
gctttgctcaccgtgaagtg

SEQ ID NO: 511635 - DNA, 20 bp, Artificial
  CRISPR gRNA sequence
ccgtgaagtgtggttcttgt

SEQ ID NO: 511636 - DNA, 20 bp, Artificial
  CRISPR gRNA sequence
tcttgttagctgtgtccatt

SEQ ID NO: 511637 - DNA, 20 bp, Artificial
  CRISPR gRNA sequence
agctgtgtccatttggtgcc

SEQ ID NO: 511638 - DNA, 20 bp, Artificial
  CRISPR gRNA sequence
gctgtgtccatttggtgccc

SEQ ID NO: 511639 - DNA, 20 bp, Artificial
  CRISPR gRNA sequence
tgtgtccatttggtgcccgg

SEQ ID NO: 511640 - DNA, 20 bp, Artificial
  CRISPR gRNA sequence
gtgtccatttggtgcccggg

SEQ ID NO: 511641 - DNA, 20 bp, Artificial
  CRISPR gRNA sequence
tgtccatttggtgcccggga

SEQ ID NO: 511642 - DNA, 20 bp, Artificial
  CRISPR gRNA sequence
ccatttggtgcccgggaggg

SEQ ID NO: 511643 - DNA, 20 bp, Artificial
  CRISPR gRNA sequence
catttggtgcccgggaggga

SEQ ID NO: 511644 - DNA, 20 bp, Artificial
  CRISPR gRNA sequence
atttggtgcccgggagggaa

SEQ ID NO: 511645 - DNA, 20 bp, Artificial
  CRISPR gRNA sequence
gcccgggagggaagggcgcc

SEQ ID NO: 511646 - DNA, 20 bp, Artificial
  CRISPR gRNA sequence
gggaagggcgcccggcccct

SEQ ID NO: 511647 - DNA, 20 bp, Artificial
  CRISPR gRNA sequence
ggaagggcgcccggcccctg

SEQ ID NO: 511648 - DNA, 20 bp, Artificial
  CRISPR gRNA sequence
gaagggcgcccggcccctga

SEQ ID NO: 511649 - DNA, 20 bp, Artificial
  CRISPR gRNA sequence
aagggcgcccggcccctgag

SEQ ID NO: 511650 - DNA, 20 bp, Artificial
  CRISPR gRNA sequence
ccggcccctgaggggttctc

SEQ ID NO: 511651 - DNA, 20 bp, Artificial
  CRISPR gRNA sequence
cggcccctgaggggttctcc

SEQ ID NO: 511652 - DNA, 20 bp, Artificial
  CRISPR gRNA sequence
ggcccctgaggggttctccg

SEQ ID NO: 511653 - DNA, 20 bp, Artificial
  CRISPR gRNA sequence
ccctgaggggttctccgggg

SEQ ID NO: 511654 - DNA, 20 bp, Artificial
  CRISPR gRNA sequence
cctgaggggttctccgggga

SEQ ID NO: 511655 - DNA, 20 bp, Artificial
  CRISPR gRNA sequence
gaaggatgacctcgtccccc

SEQ ID NO: 511656 - DNA, 20 bp, Artificial
  CRISPR gRNA sequence
tccccctggtcctgccccct

SEQ ID NO: 511657 - DNA, 20 bp, Artificial
  CRISPR gRNA sequence
agccccctgcttcccctgtg

SEQ ID NO: 511658 - DNA, 20 bp, Artificial
  CRISPR gRNA sequence
gccccctgcttcccctgtgc

SEQ ID NO: 511659 - DNA, 20 bp, Artificial
  CRISPR gRNA sequence
ccccctgcttcccctgtgca

SEQ ID NO: 511660 - DNA, 20 bp, Artificial
  CRISPR gRNA sequence
cccctgcttcccctgtgcag

SEQ ID NO: 511661 - DNA, 20 bp, Artificial
  CRISPR gRNA sequence
cttcccctgtgcaggggact

SEQ ID NO: 511662 - DNA, 20 bp, Artificial
  CRISPR gRNA sequence
ctgtgcaggggacttggtga

SEQ ID NO: 511663 - DNA, 20 bp, Artificial
  CRISPR gRNA sequence
tgtgcaggggacttggtgac

SEQ ID NO: 511664 - DNA, 20 bp, Artificial
  CRISPR gRNA sequence
gtgacaggtaccacttcctg

SEQ ID NO: 511665 - DNA, 20 bp, Artificial
  CRISPR gRNA sequence
caggtaccacttcctgcagc

SEQ ID NO: 511666 - DNA, 20 bp, Artificial
  CRISPR gRNA sequence
aggtaccacttcctgcagct

SEQ ID NO: 511667 - DNA, 20 bp, Artificial
  CRISPR gRNA sequence
accacttcctgcagctgggc

SEQ ID NO: 511668 - DNA, 20 bp, Artificial
  CRISPR gRNA sequence
ccacttcctgcagctgggct

SEQ ID NO: 511669 - DNA, 20 bp, Artificial
  CRISPR gRNA sequence
cacttcctgcagctgggctg

SEQ ID NO: 511670 - DNA, 20 bp, Artificial
  CRISPR gRNA sequence
cagctgggctggggttgcac

SEQ ID NO: 511671 - DNA, 20 bp, Artificial
  CRISPR gRNA sequence
ttgcaccagcacttccttct

SEQ ID NO: 511672 - DNA, 20 bp, Artificial
  CRISPR gRNA sequence
tgcaccagcacttccttctc

SEQ ID NO: 511673 - DNA, 20 bp, Artificial
  CRISPR gRNA sequence
accagcacttccttctcggg

SEQ ID NO: 511674 - DNA, 20 bp, Artificial
  CRISPR gRNA sequence
ccagcacttccttctcgggc

SEQ ID NO: 511675 - DNA, 20 bp, Artificial
  CRISPR gRNA sequence
cagcacttccttctcgggca

SEQ ID NO: 511676 - DNA, 20 bp, Artificial
  CRISPR gRNA sequence
cttccttctcgggcagggtt

SEQ ID NO: 511677 - DNA, 20 bp, Artificial
  CRISPR gRNA sequence
ttccttctcgggcagggttg

SEQ ID NO: 511678 - DNA, 20 bp, Artificial
  CRISPR gRNA sequence
tctcgggcagggttgaggtc

SEQ ID NO: 511679 - DNA, 20 bp, Artificial
  CRISPR gRNA sequence
ctcgggcagggttgaggtca

SEQ ID NO: 511680 - DNA, 20 bp, Artificial
  CRISPR gRNA sequence
tcgggcagggttgaggtcaa

SEQ ID NO: 511681 - DNA, 20 bp, Artificial
  CRISPR gRNA sequence
gtcaagggcgactctgatgc

SEQ ID NO: 511682 - DNA, 20 bp, Artificial
  CRISPR gRNA sequence
tcaagggcgactctgatgca

SEQ ID NO: 511683 - DNA, 20 bp, Artificial
  CRISPR gRNA sequence
cgactctgatgcaaggttct

SEQ ID NO: 511684 - DNA, 20 bp, Artificial
  CRISPR gRNA sequence
actctgatgcaaggttctga

SEQ ID NO: 511685 - DNA, 20 bp, Artificial
  CRISPR gRNA sequence
ctctgatgcaaggttctgag

SEQ ID NO: 511686 - DNA, 20 bp, Artificial
  CRISPR gRNA sequence
gcaaggttctgagaggcctg

SEQ ID NO: 511687 - DNA, 20 bp, Artificial
  CRISPR gRNA sequence
caaggttctgagaggcctgt

SEQ ID NO: 511688 - DNA, 20 bp, Artificial
  CRISPR gRNA sequence
aaggttctgagaggcctgtg

SEQ ID NO: 511689 - DNA, 20 bp, Artificial
  CRISPR gRNA sequence
ctgagaggcctgtggggctg

SEQ ID NO: 511690 - DNA, 20 bp, Artificial
  CRISPR gRNA sequence
ctgtggggctgtggattcct

SEQ ID NO: 511691 - DNA, 20 bp, Artificial
  CRISPR gRNA sequence
tggggctgtggattcctaag

SEQ ID NO: 511692 - DNA, 20 bp, Artificial
  CRISPR gRNA sequence
tgtggattcctaagcagcct

SEQ ID NO: 511693 - DNA, 20 bp, Artificial
  CRISPR gRNA sequence
ttcctaagcagcctcagctt

SEQ ID NO: 511694 - DNA, 20 bp, Artificial
  CRISPR gRNA sequence
tcctaagcagcctcagcttt

SEQ ID NO: 511695 - DNA, 20 bp, Artificial
  CRISPR gRNA sequence
cagctttgggttttgcacct

SEQ ID NO: 511696 - DNA, 20 bp, Artificial
  CRISPR gRNA sequence
agctttgggttttgcacctt

SEQ ID NO: 511697 - DNA, 20 bp, Artificial
  CRISPR gRNA sequence
gggttttgcaccttaggtct

SEQ ID NO: 511698 - DNA, 20 bp, Artificial
  CRISPR gRNA sequence
tttgcaccttaggtcttggt

SEQ ID NO: 511699 - DNA, 20 bp, Artificial
  CRISPR gRNA sequence
ttgcaccttaggtcttggta

SEQ ID NO: 511700 - DNA, 20 bp, Artificial
  CRISPR gRNA sequence
tgcaccttaggtcttggtaa

SEQ ID NO: 511701 - DNA, 20 bp, Artificial
  CRISPR gRNA sequence
gcaccttaggtcttggtaag

SEQ ID NO: 511702 - DNA, 20 bp, Artificial
  CRISPR gRNA sequence
taaggggacccgcccgccct

SEQ ID NO: 511703 - DNA, 20 bp, Artificial
  CRISPR gRNA sequence
gggacccgcccgcccttaga

SEQ ID NO: 511704 - DNA, 20 bp, Artificial
  CRISPR gRNA sequence
ggacccgcccgcccttagat

SEQ ID NO: 511705 - DNA, 20 bp, Artificial
  CRISPR gRNA sequence
gacccgcccgcccttagatg

SEQ ID NO: 511706 - DNA, 20 bp, Artificial
  CRISPR gRNA sequence
acccgcccgcccttagatgg

SEQ ID NO: 511707 - DNA, 20 bp, Artificial
  CRISPR gRNA sequence
gcccttagatgggggatgtc

SEQ ID NO: 511708 - DNA, 20 bp, Artificial
  CRISPR gRNA sequence
ccttagatgggggatgtcca

SEQ ID NO: 511709 - DNA, 20 bp, Artificial
  CRISPR gRNA sequence
agatgggggatgtccagagc

SEQ ID NO: 511710 - DNA, 20 bp, Artificial
  CRISPR gRNA sequence
atgggggatgtccagagctg

SEQ ID NO: 511711 - DNA, 20 bp, Artificial
  CRISPR gRNA sequence
tgggggatgtccagagctgg

SEQ ID NO: 511712 - DNA, 20 bp, Artificial
  CRISPR gRNA sequence
gatgtccagagctggaggat

SEQ ID NO: 511713 - DNA, 20 bp, Artificial
  CRISPR gRNA sequence
atgtccagagctggaggatg

SEQ ID NO: 511714 - DNA, 20 bp, Artificial
  CRISPR gRNA sequence
gtccagagctggaggatgag

SEQ ID NO: 511715 - DNA, 20 bp, Artificial
  CRISPR gRNA sequence
tccagagctggaggatgagg

SEQ ID NO: 511716 - DNA, 20 bp, Artificial
  CRISPR gRNA sequence
ccagagctggaggatgagga

SEQ ID NO: 511717 - DNA, 20 bp, Artificial
  CRISPR gRNA sequence
atgaggagggcacccgcccc

SEQ ID NO: 511718 - DNA, 20 bp, Artificial
  CRISPR gRNA sequence
gagggcacccgcccctggtg

SEQ ID NO: 511719 - DNA, 20 bp, Artificial
  CRISPR gRNA sequence
agggcacccgcccctggtgt

SEQ ID NO: 511720 - DNA, 20 bp, Artificial
  CRISPR gRNA sequence
gggcacccgcccctggtgtg

SEQ ID NO: 511721 - DNA, 20 bp, Artificial
  CRISPR gRNA sequence
cacccgcccctggtgtgggg

SEQ ID NO: 511722 - DNA, 20 bp, Artificial
  CRISPR gRNA sequence
ccgcccctggtgtggggcag

SEQ ID NO: 511723 - DNA, 20 bp, Artificial
  CRISPR gRNA sequence
cgcccctggtgtggggcagc

SEQ ID NO: 511724 - DNA, 20 bp, Artificial
  CRISPR gRNA sequence
gcccctggtgtggggcagca

SEQ ID NO: 511725 - DNA, 20 bp, Artificial
  CRISPR gRNA sequence
ccctggtgtggggcagcagg

SEQ ID NO: 511726 - DNA, 20 bp, Artificial
  CRISPR gRNA sequence
cctggtgtggggcagcaggg

SEQ ID NO: 511727 - DNA, 20 bp, Artificial
  CRISPR gRNA sequence
ctggtgtggggcagcaggga

SEQ ID NO: 511728 - DNA, 20 bp, Artificial
  CRISPR gRNA sequence
tggggcagcagggagggcct

SEQ ID NO: 511729 - DNA, 20 bp, Artificial
  CRISPR gRNA sequence
gggcagcagggagggccttg

SEQ ID NO: 511730 - DNA, 20 bp, Artificial
  CRISPR gRNA sequence
cagggagggccttggagaat

SEQ ID NO: 511731 - DNA, 20 bp, Artificial
  CRISPR gRNA sequence
agggagggccttggagaatg

SEQ ID NO: 511732 - DNA, 20 bp, Artificial
  CRISPR gRNA sequence
ggagggccttggagaatgag

SEQ ID NO: 511733 - DNA, 20 bp, Artificial
  CRISPR gRNA sequence
gagggccttggagaatgagg

SEQ ID NO: 511734 - DNA, 20 bp, Artificial
  CRISPR gRNA sequence
agggccttggagaatgagga

SEQ ID NO: 511735 - DNA, 20 bp, Artificial
  CRISPR gRNA sequence
atgaggagggcacctgcccc

SEQ ID NO: 511736 - DNA, 20 bp, Artificial
  CRISPR gRNA sequence
gagggcacctgcccccagtg

SEQ ID NO: 511737 - DNA, 20 bp, Artificial
  CRISPR gRNA sequence
agggcacctgcccccagtgt

SEQ ID NO: 511738 - DNA, 20 bp, Artificial
  CRISPR gRNA sequence
gggcacctgcccccagtgtg

SEQ ID NO: 511739 - DNA, 20 bp, Artificial
  CRISPR gRNA sequence
cacctgcccccagtgtgggg

SEQ ID NO: 511740 - DNA, 20 bp, Artificial
  CRISPR gRNA sequence
ctgcccccagtgtggggcag

SEQ ID NO: 511741 - DNA, 20 bp, Artificial
  CRISPR gRNA sequence
tgcccccagtgtggggcagc

SEQ ID NO: 511742 - DNA, 20 bp, Artificial
  CRISPR gRNA sequence
gcccccagtgtggggcagca

SEQ ID NO: 511743 - DNA, 20 bp, Artificial
  CRISPR gRNA sequence
ccccagtgtggggcagcagg

SEQ ID NO: 511744 - DNA, 20 bp, Artificial
  CRISPR gRNA sequence
cccagtgtggggcagcaggg

SEQ ID NO: 511745 - DNA, 20 bp, Artificial
  CRISPR gRNA sequence
ccagtgtggggcagcaggga

SEQ ID NO: 511746 - DNA, 20 bp, Artificial
  CRISPR gRNA sequence
tggggcagcagggagggcct

SEQ ID NO: 511747 - DNA, 20 bp, Artificial
  CRISPR gRNA sequence
ggggcagcagggagggcctc

SEQ ID NO: 511748 - DNA, 20 bp, Artificial
  CRISPR gRNA sequence
gggcagcagggagggcctca

SEQ ID NO: 511749 - DNA, 20 bp, Artificial
  CRISPR gRNA sequence
agggagggcctcagggtgat

SEQ ID NO: 511750 - DNA, 20 bp, Artificial
  CRISPR gRNA sequence
gggagggcctcagggtgatc

SEQ ID NO: 511751 - DNA, 20 bp, Artificial
  CRISPR gRNA sequence
gcctcagggtgatcaggctc

SEQ ID NO: 511752 - DNA, 20 bp, Artificial
  CRISPR gRNA sequence
cctcagggtgatcaggctcc

SEQ ID NO: 511753 - DNA, 20 bp, Artificial
  CRISPR gRNA sequence
agggtgatcaggctccaggc

SEQ ID NO: 511754 - DNA, 20 bp, Artificial
  CRISPR gRNA sequence
ggtgatcaggctccaggcca

SEQ ID NO: 511755 - DNA, 20 bp, Artificial
  CRISPR gRNA sequence
caggctccaggccagagctc

SEQ ID NO: 511756 - DNA, 20 bp, Artificial
  CRISPR gRNA sequence
aggctccaggccagagctct

SEQ ID NO: 511757 - DNA, 20 bp, Artificial
  CRISPR gRNA sequence
ggctccaggccagagctctg

SEQ ID NO: 511758 - DNA, 20 bp, Artificial
  CRISPR gRNA sequence
ccaggccagagctctggggc

SEQ ID NO: 511759 - DNA, 20 bp, Artificial
  CRISPR gRNA sequence
ccagagctctggggccagct

SEQ ID NO: 511760 - DNA, 20 bp, Artificial
  CRISPR gRNA sequence
cagagctctggggccagctc

SEQ ID NO: 511761 - DNA, 20 bp, Artificial
  CRISPR gRNA sequence
agagctctggggccagctca

SEQ ID NO: 511762 - DNA, 20 bp, Artificial
  CRISPR gRNA sequence
gagctctggggccagctcag

SEQ ID NO: 511763 - DNA, 20 bp, Artificial
  CRISPR gRNA sequence
tctggggccagctcaggggc

SEQ ID NO: 511764 - DNA, 20 bp, Artificial
  CRISPR gRNA sequence
ctggggccagctcaggggct

SEQ ID NO: 511765 - DNA, 20 bp, Artificial
  CRISPR gRNA sequence
tggggccagctcaggggctg

SEQ ID NO: 511766 - DNA, 20 bp, Artificial
  CRISPR gRNA sequence
ggccagctcaggggctgggg

SEQ ID NO: 511767 - DNA, 20 bp, Artificial
  CRISPR gRNA sequence
gccagctcaggggctggggt

SEQ ID NO: 511768 - DNA, 20 bp, Artificial
  CRISPR gRNA sequence
ccagctcaggggctggggtg

SEQ ID NO: 511769 - DNA, 20 bp, Artificial
  CRISPR gRNA sequence
cagctcaggggctggggtgg

SEQ ID NO: 511770 - DNA, 20 bp, Artificial
  CRISPR gRNA sequence
agctcaggggctggggtggg

SEQ ID NO: 511771 - DNA, 20 bp, Artificial
  CRISPR gRNA sequence
cttcctcccctcctgccctg

SEQ ID NO: 511772 - DNA, 20 bp, Artificial
  CRISPR gRNA sequence
ctcctgccctgcagctctgc

SEQ ID NO: 511773 - DNA, 20 bp, Artificial
  CRISPR gRNA sequence
gccctgcagctctgccggct

SEQ ID NO: 511774 - DNA, 20 bp, Artificial
  CRISPR gRNA sequence
cagctctgccggcttagcct

SEQ ID NO: 511775 - DNA, 20 bp, Artificial
  CRISPR gRNA sequence
agctctgccggcttagcctc

SEQ ID NO: 511776 - DNA, 20 bp, Artificial
  CRISPR gRNA sequence
gctctgccggcttagcctca

SEQ ID NO: 511777 - DNA, 20 bp, Artificial
  CRISPR gRNA sequence
ccggcttagcctcagggcac

SEQ ID NO: 511778 - DNA, 20 bp, Artificial
  CRISPR gRNA sequence
ggcttagcctcagggcacca

SEQ ID NO: 511779 - DNA, 20 bp, Artificial
  CRISPR gRNA sequence
gcttagcctcagggcaccag

SEQ ID NO: 511780 - DNA, 20 bp, Artificial
  CRISPR gRNA sequence
cctcagggcaccagaggtga

SEQ ID NO: 511781 - DNA, 20 bp, Artificial
  CRISPR gRNA sequence
cagggcaccagaggtgacag

SEQ ID NO: 511782 - DNA, 20 bp, Artificial
  CRISPR gRNA sequence
gcaccagaggtgacagtggc

SEQ ID NO: 511783 - DNA, 20 bp, Artificial
  CRISPR gRNA sequence
caccagaggtgacagtggcc

SEQ ID NO: 511784 - DNA, 20 bp, Artificial
  CRISPR gRNA sequence
ccttacccattcccatcccc

SEQ ID NO: 511785 - DNA, 20 bp, Artificial
  CRISPR gRNA sequence
cttacccattcccatccccc

SEQ ID NO: 511786 - DNA, 20 bp, Artificial
  CRISPR gRNA sequence
ttacccattcccatccccca

SEQ ID NO: 511787 - DNA, 20 bp, Artificial
  CRISPR gRNA sequence
acccattcccatcccccagg

SEQ ID NO: 511788 - DNA, 20 bp, Artificial
  CRISPR gRNA sequence
attcccatcccccagggagc

SEQ ID NO: 511789 - DNA, 20 bp, Artificial
  CRISPR gRNA sequence
catcccccagggagctggca

SEQ ID NO: 511790 - DNA, 20 bp, Artificial
  CRISPR gRNA sequence
atcccccagggagctggcac

SEQ ID NO: 511791 - DNA, 20 bp, Artificial
  CRISPR gRNA sequence
acaggcccttcgaccacctc

SEQ ID NO: 511792 - DNA, 20 bp, Artificial
  CRISPR gRNA sequence
caggcccttcgaccacctcc

SEQ ID NO: 511793 - DNA, 20 bp, Artificial
  CRISPR gRNA sequence
ttcgaccacctccaggcaca

SEQ ID NO: 511794 - DNA, 20 bp, Artificial
  CRISPR gRNA sequence
cgaccacctccaggcacatg

SEQ ID NO: 511795 - DNA, 20 bp, Artificial
  CRISPR gRNA sequence
gaccacctccaggcacatgg

SEQ ID NO: 511796 - DNA, 20 bp, Artificial
  CRISPR gRNA sequence
ccaggcacatggaggaaact

SEQ ID NO: 511797 - DNA, 20 bp, Artificial
  CRISPR gRNA sequence
caggcacatggaggaaactg

SEQ ID NO: 511798 - DNA, 20 bp, Artificial
  CRISPR gRNA sequence
gcacatggaggaaactgagg

SEQ ID NO: 511799 - DNA, 20 bp, Artificial
  CRISPR gRNA sequence
atggaggaaactgaggcaga

SEQ ID NO: 511800 - DNA, 20 bp, Artificial
  CRISPR gRNA sequence
tggaggaaactgaggcagat

SEQ ID NO: 511801 - DNA, 20 bp, Artificial
  CRISPR gRNA sequence
actgaggcagataggcctga

SEQ ID NO: 511802 - DNA, 20 bp, Artificial
  CRISPR gRNA sequence
ctgaggcagataggcctgat

SEQ ID NO: 511803 - DNA, 20 bp, Artificial
  CRISPR gRNA sequence
tgaggcagataggcctgatg

SEQ ID NO: 511804 - DNA, 20 bp, Artificial
  CRISPR gRNA sequence
agataggcctgatggggtct

SEQ ID NO: 511805 - DNA, 20 bp, Artificial
  CRISPR gRNA sequence
ctgatggggtcttggtctct

SEQ ID NO: 511806 - DNA, 20 bp, Artificial
  CRISPR gRNA sequence
tgatggggtcttggtctctc

SEQ ID NO: 511807 - DNA, 20 bp, Artificial
  CRISPR gRNA sequence
ggtcttggtctctcaggcct

SEQ ID NO: 511808 - DNA, 20 bp, Artificial
  CRISPR gRNA sequence
gtcttggtctctcaggcctc

SEQ ID NO: 511809 - DNA, 20 bp, Artificial
  CRISPR gRNA sequence
tggtctctcaggcctcaggt

SEQ ID NO: 511810 - DNA, 20 bp, Artificial
  CRISPR gRNA sequence
ggtctctcaggcctcaggtg

SEQ ID NO: 511811 - DNA, 20 bp, Artificial
  CRISPR gRNA sequence
tcaggcctcaggtgaggccc

SEQ ID NO: 511812 - DNA, 20 bp, Artificial
  CRISPR gRNA sequence
ggtgaggccctggacctccg

SEQ ID NO: 511813 - DNA, 20 bp, Artificial
  CRISPR gRNA sequence
gtgaggccctggacctccgt

SEQ ID NO: 511814 - DNA, 20 bp, Artificial
  CRISPR gRNA sequence
tggacctccgtgggccatcc

SEQ ID NO: 511815 - DNA, 20 bp, Artificial
  CRISPR gRNA sequence
ccgtgggccatcctggctgc

SEQ ID NO: 511816 - DNA, 20 bp, Artificial
  CRISPR gRNA sequence
cgtgggccatcctggctgct

SEQ ID NO: 511817 - DNA, 20 bp, Artificial
  CRISPR gRNA sequence
gggccatcctggctgctggg

SEQ ID NO: 511818 - DNA, 20 bp, Artificial
  CRISPR gRNA sequence
gccatcctggctgctgggca

SEQ ID NO: 511819 - DNA, 20 bp, Artificial
  CRISPR gRNA sequence
ccatcctggctgctgggcag

SEQ ID NO: 511820 - DNA, 20 bp, Artificial
  CRISPR gRNA sequence
catcctggctgctgggcaga

SEQ ID NO: 511821 - DNA, 20 bp, Artificial
  CRISPR gRNA sequence
atcctggctgctgggcagag

SEQ ID NO: 511822 - DNA, 20 bp, Artificial
  CRISPR gRNA sequence
tgccctgccctgttctccca

SEQ ID NO: 511823 - DNA, 20 bp, Artificial
  CRISPR gRNA sequence
cctgccctgttctcccacag

SEQ ID NO: 511824 - DNA, 20 bp, Artificial
  CRISPR gRNA sequence
ctgccctgttctcccacaga

SEQ ID NO: 511825 - DNA, 20 bp, Artificial
  CRISPR gRNA sequence
tgccctgttctcccacagaa

SEQ ID NO: 511826 - DNA, 20 bp, Artificial
  CRISPR gRNA sequence
ccctgttctcccacagaagg

SEQ ID NO: 511827 - DNA, 20 bp, Artificial
  CRISPR gRNA sequence
cctgttctcccacagaaggg

SEQ ID NO: 511828 - DNA, 20 bp, Artificial
  CRISPR gRNA sequence
ttctcccacagaagggaggc

SEQ ID NO: 511829 - DNA, 20 bp, Artificial
  CRISPR gRNA sequence
acagaagggaggctggctgc

SEQ ID NO: 511830 - DNA, 20 bp, Artificial
  CRISPR gRNA sequence
cagaagggaggctggctgcc

SEQ ID NO: 511831 - DNA, 20 bp, Artificial
  CRISPR gRNA sequence
gggaggctggctgccaggct

SEQ ID NO: 511832 - DNA, 20 bp, Artificial
  CRISPR gRNA sequence
cagtgcactgccttacctcc

SEQ ID NO: 511833 - DNA, 20 bp, Artificial
  CRISPR gRNA sequence
gtgcactgccttacctcctg

SEQ ID NO: 511834 - DNA, 20 bp, Artificial
  CRISPR gRNA sequence
cactgccttacctcctggag

SEQ ID NO: 511835 - DNA, 20 bp, Artificial
  CRISPR gRNA sequence
ctggagcggaccttcatccc

SEQ ID NO: 511836 - DNA, 20 bp, Artificial
  CRISPR gRNA sequence
ttcatccccagctgtttgtc

SEQ ID NO: 511837 - DNA, 20 bp, Artificial
  CRISPR gRNA sequence
tcatccccagctgtttgtct

SEQ ID NO: 511838 - DNA, 20 bp, Artificial
  CRISPR gRNA sequence
cccagctgtttgtctgggct

SEQ ID NO: 511839 - DNA, 20 bp, Artificial
  CRISPR gRNA sequence
gtttgtctgggctcagccac

SEQ ID NO: 511840 - DNA, 20 bp, Artificial
  CRISPR gRNA sequence
ctgggctcagccactggcat

SEQ ID NO: 511841 - DNA, 20 bp, Artificial
  CRISPR gRNA sequence
tgggctcagccactggcatt

SEQ ID NO: 511842 - DNA, 20 bp, Artificial
  CRISPR gRNA sequence
gggctcagccactggcattg

SEQ ID NO: 511843 - DNA, 20 bp, Artificial
  CRISPR gRNA sequence
ggctcagccactggcattgg

SEQ ID NO: 511844 - DNA, 20 bp, Artificial
  CRISPR gRNA sequence
gctcagccactggcattggg

SEQ ID NO: 511845 - DNA, 20 bp, Artificial
  CRISPR gRNA sequence
cagccactggcattgggggg

SEQ ID NO: 511846 - DNA, 20 bp, Artificial
  CRISPR gRNA sequence
agccactggcattggggggt

SEQ ID NO: 511847 - DNA, 20 bp, Artificial
  CRISPR gRNA sequence
gccactggcattggggggtg

SEQ ID NO: 511848 - DNA, 20 bp, Artificial
  CRISPR gRNA sequence
actggcattggggggtgggg

SEQ ID NO: 511849 - DNA, 20 bp, Artificial
  CRISPR gRNA sequence
ctggcattggggggtggggc

SEQ ID NO: 511850 - DNA, 20 bp, Artificial
  CRISPR gRNA sequence
tggcattggggggtggggca

SEQ ID NO: 511851 - DNA, 20 bp, Artificial
  CRISPR gRNA sequence
ttggggggtggggcagggcc

SEQ ID NO: 511852 - DNA, 20 bp, Artificial
  CRISPR gRNA sequence
cctggcttctcttgtgcccc

SEQ ID NO: 511853 - DNA, 20 bp, Artificial
  CRISPR gRNA sequence
tctcttgtgcccccagctcc

SEQ ID NO: 511854 - DNA, 20 bp, Artificial
  CRISPR gRNA sequence
gcccccagctccaagccccc

SEQ ID NO: 511855 - DNA, 20 bp, Artificial
  CRISPR gRNA sequence
cccccagctccaagcccccc

SEQ ID NO: 511856 - DNA, 20 bp, Artificial
  CRISPR gRNA sequence
ccccagctccaagcccccca

SEQ ID NO: 511857 - DNA, 20 bp, Artificial
  CRISPR gRNA sequence
aagccccccagggctgctca

SEQ ID NO: 511858 - DNA, 20 bp, Artificial
  CRISPR gRNA sequence
gccccccagggctgctcatg

SEQ ID NO: 511859 - DNA, 20 bp, Artificial
  CRISPR gRNA sequence
ccccccagggctgctcatgg

SEQ ID NO: 511860 - DNA, 20 bp, Artificial
  CRISPR gRNA sequence
ccccagggctgctcatggag

SEQ ID NO: 511861 - DNA, 20 bp, Artificial
  CRISPR gRNA sequence
ggctgctcatggaggagcaa

SEQ ID NO: 511862 - DNA, 20 bp, Artificial
  CRISPR gRNA sequence
tgctcatggaggagcaacag

SEQ ID NO: 511863 - DNA, 20 bp, Artificial
  CRISPR gRNA sequence
gctcatggaggagcaacagt

SEQ ID NO: 511864 - DNA, 20 bp, Artificial
  CRISPR gRNA sequence
ctcatggaggagcaacagtg

SEQ ID NO: 511865 - DNA, 20 bp, Artificial
  CRISPR gRNA sequence
catggaggagcaacagtggg

SEQ ID NO: 511866 - DNA, 20 bp, Artificial
  CRISPR gRNA sequence
ggaggagcaacagtggggag

SEQ ID NO: 511867 - DNA, 20 bp, Artificial
  CRISPR gRNA sequence
gaggagcaacagtggggaga

SEQ ID NO: 511868 - DNA, 20 bp, Artificial
  CRISPR gRNA sequence
gagcaacagtggggagaagg

SEQ ID NO: 511869 - DNA, 20 bp, Artificial
  CRISPR gRNA sequence
gggagaaggtggctccccac

SEQ ID NO: 511870 - DNA, 20 bp, Artificial
  CRISPR gRNA sequence
ccccaccagcccccttcctg

SEQ ID NO: 511871 - DNA, 20 bp, Artificial
  CRISPR gRNA sequence
ccagcccccttcctgtggtc

SEQ ID NO: 511872 - DNA, 20 bp, Artificial
  CRISPR gRNA sequence
cagcccccttcctgtggtca

SEQ ID NO: 511873 - DNA, 20 bp, Artificial
  CRISPR gRNA sequence
ccccttcctgtggtcaaggt

SEQ ID NO: 511874 - DNA, 20 bp, Artificial
  CRISPR gRNA sequence
cccttcctgtggtcaaggtt

SEQ ID NO: 511875 - DNA, 20 bp, Artificial
  CRISPR gRNA sequence
ccttcctgtggtcaaggttg

SEQ ID NO: 511876 - DNA, 20 bp, Artificial
  CRISPR gRNA sequence
tggtcaaggttggggtgccg

SEQ ID NO: 511877 - DNA, 20 bp, Artificial
  CRISPR gRNA sequence
gttggggtgccgtggtctct

SEQ ID NO: 511878 - DNA, 20 bp, Artificial
  CRISPR gRNA sequence
ggtctctgagccaatcctgc

SEQ ID NO: 511879 - DNA, 20 bp, Artificial
  CRISPR gRNA sequence
gagccaatcctgctggaatc

SEQ ID NO: 511880 - DNA, 20 bp, Artificial
  CRISPR gRNA sequence
agccaatcctgctggaatca

SEQ ID NO: 511881 - DNA, 20 bp, Artificial
  CRISPR gRNA sequence
aggtgcaccccctctccctg

SEQ ID NO: 511882 - DNA, 20 bp, Artificial
  CRISPR gRNA sequence
ggtgcaccccctctccctgt

SEQ ID NO: 511883 - DNA, 20 bp, Artificial
  CRISPR gRNA sequence
gcaccccctctccctgtggg

SEQ ID NO: 511884 - DNA, 20 bp, Artificial
  CRISPR gRNA sequence
caccccctctccctgtgggc

SEQ ID NO: 511885 - DNA, 20 bp, Artificial
  CRISPR gRNA sequence
cccctctccctgtgggcagg

SEQ ID NO: 511886 - DNA, 20 bp, Artificial
  CRISPR gRNA sequence
ccctctccctgtgggcaggt

SEQ ID NO: 511887 - DNA, 20 bp, Artificial
  CRISPR gRNA sequence
ctctccctgtgggcaggtgg

SEQ ID NO: 511888 - DNA, 20 bp, Artificial
  CRISPR gRNA sequence
tgtgggcaggtgggagtgcc

SEQ ID NO: 511889 - DNA, 20 bp, Artificial
  CRISPR gRNA sequence
gtgggcaggtgggagtgccc

SEQ ID NO: 511890 - DNA, 20 bp, Artificial
  CRISPR gRNA sequence
tgggcaggtgggagtgcccg

SEQ ID NO: 511891 - DNA, 20 bp, Artificial
  CRISPR gRNA sequence
gtgggagtgcccggggtaac

SEQ ID NO: 511892 - DNA, 20 bp, Artificial
  CRISPR gRNA sequence
tgggagtgcccggggtaact

SEQ ID NO: 511893 - DNA, 20 bp, Artificial
  CRISPR gRNA sequence
tgcccggggtaactgggcac

SEQ ID NO: 511894 - DNA, 20 bp, Artificial
  CRISPR gRNA sequence
gcccggggtaactgggcacc

SEQ ID NO: 511895 - DNA, 20 bp, Artificial
  CRISPR gRNA sequence
ggtccatatcttgctgctgc

SEQ ID NO: 511896 - DNA, 20 bp, Artificial
  CRISPR gRNA sequence
gtccatatcttgctgctgct

SEQ ID NO: 511897 - DNA, 20 bp, Artificial
  CRISPR gRNA sequence
tccatatcttgctgctgctg

SEQ ID NO: 511898 - DNA, 20 bp, Artificial
  CRISPR gRNA sequence
cttgctgctgctggggccct

SEQ ID NO: 511899 - DNA, 20 bp, Artificial
  CRISPR gRNA sequence
ggccctcagtttccccattt

SEQ ID NO: 511900 - DNA, 20 bp, Artificial
  CRISPR gRNA sequence
gccctcagtttccccatttg

SEQ ID NO: 511901 - DNA, 20 bp, Artificial
  CRISPR gRNA sequence
ccctcagtttccccatttga

SEQ ID NO: 511902 - DNA, 20 bp, Artificial
  CRISPR gRNA sequence
tttccccatttgagggtatg

SEQ ID NO: 511903 - DNA, 20 bp, Artificial
  CRISPR gRNA sequence
atgaagtgtttgcatgccac

SEQ ID NO: 511904 - DNA, 20 bp, Artificial
  CRISPR gRNA sequence
gccactggtcacgactgtgt

SEQ ID NO: 511905 - DNA, 20 bp, Artificial
  CRISPR gRNA sequence
ccactggtcacgactgtgtt

SEQ ID NO: 511906 - DNA, 20 bp, Artificial
  CRISPR gRNA sequence
cactggtcacgactgtgtta

SEQ ID NO: 511907 - DNA, 20 bp, Artificial
  CRISPR gRNA sequence
actggtcacgactgtgttag

SEQ ID NO: 511908 - DNA, 20 bp, Artificial
  CRISPR gRNA sequence
ggtcacgactgtgttagggg

SEQ ID NO: 511909 - DNA, 20 bp, Artificial
  CRISPR gRNA sequence
tcacgactgtgttaggggcg

SEQ ID NO: 511910 - DNA, 20 bp, Artificial
  CRISPR gRNA sequence
gggcggagacctcatgtctg

SEQ ID NO: 511911 - DNA, 20 bp, Artificial
  CRISPR gRNA sequence
agacctcatgtctgcggccc

SEQ ID NO: 511912 - DNA, 20 bp, Artificial
  CRISPR gRNA sequence
gacctcatgtctgcggcccc

SEQ ID NO: 511913 - DNA, 20 bp, Artificial
  CRISPR gRNA sequence
acctcatgtctgcggcccca

SEQ ID NO: 511914 - DNA, 20 bp, Artificial
  CRISPR gRNA sequence
ctcatgtctgcggccccagg

SEQ ID NO: 511915 - DNA, 20 bp, Artificial
  CRISPR gRNA sequence
catgtctgcggccccaggga

SEQ ID NO: 511916 - DNA, 20 bp, Artificial
  CRISPR gRNA sequence
ctgcggccccagggagagcg

SEQ ID NO: 511917 - DNA, 20 bp, Artificial
  CRISPR gRNA sequence
gcggccccagggagagcgtg

SEQ ID NO: 511918 - DNA, 20 bp, Artificial
  CRISPR gRNA sequence
ccccagggagagcgtggagc

SEQ ID NO: 511919 - DNA, 20 bp, Artificial
  CRISPR gRNA sequence
cccagggagagcgtggagct

SEQ ID NO: 511920 - DNA, 20 bp, Artificial
  CRISPR gRNA sequence
ccagggagagcgtggagctg

SEQ ID NO: 511921 - DNA, 20 bp, Artificial
  CRISPR gRNA sequence
agagcgtggagctggggtgt

SEQ ID NO: 511922 - DNA, 20 bp, Artificial
  CRISPR gRNA sequence
gctggggtgtgagtccttac

SEQ ID NO: 511923 - DNA, 20 bp, Artificial
  CRISPR gRNA sequence
ggtgtgagtccttaccagcc

SEQ ID NO: 511924 - DNA, 20 bp, Artificial
  CRISPR gRNA sequence
tgagtccttaccagcctggc

SEQ ID NO: 511925 - DNA, 20 bp, Artificial
  CRISPR gRNA sequence
gagtccttaccagcctggct

SEQ ID NO: 511926 - DNA, 20 bp, Artificial
  CRISPR gRNA sequence
agtccttaccagcctggctg

SEQ ID NO: 511927 - DNA, 20 bp, Artificial
  CRISPR gRNA sequence
accagcctggctggggctgc

SEQ ID NO: 511928 - DNA, 20 bp, Artificial
  CRISPR gRNA sequence
ccagcctggctggggctgcc

SEQ ID NO: 511929 - DNA, 20 bp, Artificial
  CRISPR gRNA sequence
cagcctggctggggctgcca

SEQ ID NO: 511930 - DNA, 20 bp, Artificial
  CRISPR gRNA sequence
agcctggctggggctgccag

SEQ ID NO: 511931 - DNA, 20 bp, Artificial
  CRISPR gRNA sequence
cctggctggggctgccaggg

SEQ ID NO: 511932 - DNA, 20 bp, Artificial
  CRISPR gRNA sequence
ctggctggggctgccagggg

SEQ ID NO: 511933 - DNA, 20 bp, Artificial
  CRISPR gRNA sequence
gtctgcaccccctccccact

SEQ ID NO: 511934 - DNA, 20 bp, Artificial
  CRISPR gRNA sequence
caccccctccccacttggcg

SEQ ID NO: 511935 - DNA, 20 bp, Artificial
  CRISPR gRNA sequence
cacttggcgcagctgcgacc

SEQ ID NO: 511936 - DNA, 20 bp, Artificial
  CRISPR gRNA sequence
acttggcgcagctgcgacct

SEQ ID NO: 511937 - DNA, 20 bp, Artificial
  CRISPR gRNA sequence
cttggcgcagctgcgacctg

SEQ ID NO: 511938 - DNA, 20 bp, Artificial
  CRISPR gRNA sequence
ttggcgcagctgcgacctgg

SEQ ID NO: 511939 - DNA, 20 bp, Artificial
  CRISPR gRNA sequence
ggcgcagctgcgacctgggg

SEQ ID NO: 511940 - DNA, 20 bp, Artificial
  CRISPR gRNA sequence
tgcgacctgggggagtcctg

SEQ ID NO: 511941 - DNA, 20 bp, Artificial
  CRISPR gRNA sequence
acctgggggagtcctgaagc

SEQ ID NO: 511942 - DNA, 20 bp, Artificial
  CRISPR gRNA sequence
gggggagtcctgaagccggc

SEQ ID NO: 511943 - DNA, 20 bp, Artificial
  CRISPR gRNA sequence
gccggctggaccctgcaccc

SEQ ID NO: 511944 - DNA, 20 bp, Artificial
  CRISPR gRNA sequence
ccggctggaccctgcaccct

SEQ ID NO: 511945 - DNA, 20 bp, Artificial
  CRISPR gRNA sequence
cggctggaccctgcaccctg

SEQ ID NO: 511946 - DNA, 20 bp, Artificial
  CRISPR gRNA sequence
ggctggaccctgcaccctgg

SEQ ID NO: 511947 - DNA, 20 bp, Artificial
  CRISPR gRNA sequence
ctggaccctgcaccctgggg

SEQ ID NO: 511948 - DNA, 20 bp, Artificial
  CRISPR gRNA sequence
tgcaccctgggggagtcctg

SEQ ID NO: 511949 - DNA, 20 bp, Artificial
  CRISPR gRNA sequence
ccctgggggagtcctgaagc

SEQ ID NO: 511950 - DNA, 20 bp, Artificial
  CRISPR gRNA sequence
gggggagtcctgaagccggc

SEQ ID NO: 511951 - DNA, 20 bp, Artificial
  CRISPR gRNA sequence
gccggctggaccctgcaccc

SEQ ID NO: 511952 - DNA, 20 bp, Artificial
  CRISPR gRNA sequence
ccggctggaccctgcaccct

SEQ ID NO: 511953 - DNA, 20 bp, Artificial
  CRISPR gRNA sequence
cggctggaccctgcaccctg

SEQ ID NO: 511954 - DNA, 20 bp, Artificial
  CRISPR gRNA sequence
ggctggaccctgcaccctgg

SEQ ID NO: 511955 - DNA, 20 bp, Artificial
  CRISPR gRNA sequence
ctggaccctgcaccctgggg

SEQ ID NO: 511956 - DNA, 20 bp, Artificial
  CRISPR gRNA sequence
tgcaccctgggggagtcctg

SEQ ID NO: 511957 - DNA, 20 bp, Artificial
  CRISPR gRNA sequence
ccctgggggagtcctgaagc

SEQ ID NO: 511958 - DNA, 20 bp, Artificial
  CRISPR gRNA sequence
gggggagtcctgaagccggc

SEQ ID NO: 511959 - DNA, 20 bp, Artificial
  CRISPR gRNA sequence
gccggctggaccctgcaccc

SEQ ID NO: 511960 - DNA, 20 bp, Artificial
  CRISPR gRNA sequence
ccggctggaccctgcaccct

SEQ ID NO: 511961 - DNA, 20 bp, Artificial
  CRISPR gRNA sequence
cggctggaccctgcaccctg

SEQ ID NO: 511962 - DNA, 20 bp, Artificial
  CRISPR gRNA sequence
ggctggaccctgcaccctgg

SEQ ID NO: 511963 - DNA, 20 bp, Artificial
  CRISPR gRNA sequence
ctggaccctgcaccctgggg

SEQ ID NO: 511964 - DNA, 20 bp, Artificial
  CRISPR gRNA sequence
tgcaccctgggggagtcctg

SEQ ID NO: 511965 - DNA, 20 bp, Artificial
  CRISPR gRNA sequence
ccctgggggagtcctgaagc

SEQ ID NO: 511966 - DNA, 20 bp, Artificial
  CRISPR gRNA sequence
gggggagtcctgaagccggc

SEQ ID NO: 511967 - DNA, 20 bp, Artificial
  CRISPR gRNA sequence
gccggctggaccctgcaccc

SEQ ID NO: 511968 - DNA, 20 bp, Artificial
  CRISPR gRNA sequence
ccggctggaccctgcaccct

SEQ ID NO: 511969 - DNA, 20 bp, Artificial
  CRISPR gRNA sequence
cggctggaccctgcaccctg

SEQ ID NO: 511970 - DNA, 20 bp, Artificial
  CRISPR gRNA sequence
ggctggaccctgcaccctgg

SEQ ID NO: 511971 - DNA, 20 bp, Artificial
  CRISPR gRNA sequence
ctggaccctgcaccctgggg

SEQ ID NO: 511972 - DNA, 20 bp, Artificial
  CRISPR gRNA sequence
tgcaccctgggggagtcctg

SEQ ID NO: 511973 - DNA, 20 bp, Artificial
  CRISPR gRNA sequence
ccctgggggagtcctgaagc

SEQ ID NO: 511974 - DNA, 20 bp, Artificial
  CRISPR gRNA sequence
gggggagtcctgaagccggc

SEQ ID NO: 511975 - DNA, 20 bp, Artificial
  CRISPR gRNA sequence
gccggctggaccctgcaccc

SEQ ID NO: 511976 - DNA, 20 bp, Artificial
  CRISPR gRNA sequence
ccggctggaccctgcaccct

SEQ ID NO: 511977 - DNA, 20 bp, Artificial
  CRISPR gRNA sequence
cggctggaccctgcaccctg

SEQ ID NO: 511978 - DNA, 20 bp, Artificial
  CRISPR gRNA sequence
ggctggaccctgcaccctgg

SEQ ID NO: 511979 - DNA, 20 bp, Artificial
  CRISPR gRNA sequence
ctggaccctgcaccctgggg

SEQ ID NO: 511980 - DNA, 20 bp, Artificial
  CRISPR gRNA sequence
tgcaccctgggggagtcctg

SEQ ID NO: 511981 - DNA, 20 bp, Artificial
  CRISPR gRNA sequence
ccctgggggagtcctgaagc

SEQ ID NO: 511982 - DNA, 20 bp, Artificial
  CRISPR gRNA sequence
gggggagtcctgaagccggc

SEQ ID NO: 511983 - DNA, 20 bp, Artificial
  CRISPR gRNA sequence
gccggctggaccctgcaccc

SEQ ID NO: 511984 - DNA, 20 bp, Artificial
  CRISPR gRNA sequence
ccggctggaccctgcaccct

SEQ ID NO: 511985 - DNA, 20 bp, Artificial
  CRISPR gRNA sequence
cggctggaccctgcaccctg

SEQ ID NO: 511986 - DNA, 20 bp, Artificial
  CRISPR gRNA sequence
ggctggaccctgcaccctgg

SEQ ID NO: 511987 - DNA, 20 bp, Artificial
  CRISPR gRNA sequence
ctggaccctgcaccctgggg

SEQ ID NO: 511988 - DNA, 20 bp, Artificial
  CRISPR gRNA sequence
tgcaccctgggggagtcctg

SEQ ID NO: 511989 - DNA, 20 bp, Artificial
  CRISPR gRNA sequence
ccctgggggagtcctgaagc

SEQ ID NO: 511990 - DNA, 20 bp, Artificial
  CRISPR gRNA sequence
gggggagtcctgaagccggc

SEQ ID NO: 511991 - DNA, 20 bp, Artificial
  CRISPR gRNA sequence
gccggctggaccctgcaccc

SEQ ID NO: 511992 - DNA, 20 bp, Artificial
  CRISPR gRNA sequence
ccggctggaccctgcaccct

SEQ ID NO: 511993 - DNA, 20 bp, Artificial
  CRISPR gRNA sequence
cggctggaccctgcaccctg

SEQ ID NO: 511994 - DNA, 20 bp, Artificial
  CRISPR gRNA sequence
ggctggaccctgcaccctgg

SEQ ID NO: 511995 - DNA, 20 bp, Artificial
  CRISPR gRNA sequence
ctggaccctgcaccctgggg

SEQ ID NO: 511996 - DNA, 20 bp, Artificial
  CRISPR gRNA sequence
tgcaccctgggggagtcctg

SEQ ID NO: 511997 - DNA, 20 bp, Artificial
  CRISPR gRNA sequence
ccctgggggagtcctgaagc

SEQ ID NO: 511998 - DNA, 20 bp, Artificial
  CRISPR gRNA sequence
gggggagtcctgaagccggc

SEQ ID NO: 511999 - DNA, 20 bp, Artificial
  CRISPR gRNA sequence
gccggctggaccctgcaccc

SEQ ID NO: 512000 - DNA, 20 bp, Artificial
  CRISPR gRNA sequence
ccggctggaccctgcaccct

SEQ ID NO: 512001 - DNA, 20 bp, Artificial
  CRISPR gRNA sequence
cggctggaccctgcaccctg

SEQ ID NO: 512002 - DNA, 20 bp, Artificial
  CRISPR gRNA sequence
ggctggaccctgcaccctgg

SEQ ID NO: 512003 - DNA, 20 bp, Artificial
  CRISPR gRNA sequence
ctggaccctgcaccctgggg

SEQ ID NO: 512004 - DNA, 20 bp, Artificial
  CRISPR gRNA sequence
tgcaccctgggggagtcctg

SEQ ID NO: 512005 - DNA, 20 bp, Artificial
  CRISPR gRNA sequence
ccctgggggagtcctgaagc

SEQ ID NO: 512006 - DNA, 20 bp, Artificial
  CRISPR gRNA sequence
gggggagtcctgaagccggc

SEQ ID NO: 512007 - DNA, 20 bp, Artificial
  CRISPR gRNA sequence
gccggctggaccctgcaccc

SEQ ID NO: 512008 - DNA, 20 bp, Artificial
  CRISPR gRNA sequence
ccggctggaccctgcaccct

SEQ ID NO: 512009 - DNA, 20 bp, Artificial
  CRISPR gRNA sequence
cggctggaccctgcaccctg

SEQ ID NO: 512010 - DNA, 20 bp, Artificial
  CRISPR gRNA sequence
ggctggaccctgcaccctgg

SEQ ID NO: 512011 - DNA, 20 bp, Artificial
  CRISPR gRNA sequence
ctggaccctgcaccctgggg

SEQ ID NO: 512012 - DNA, 20 bp, Artificial
  CRISPR gRNA sequence
tgcaccctgggggagtcctg

SEQ ID NO: 512013 - DNA, 20 bp, Artificial
  CRISPR gRNA sequence
ccctgggggagtcctgaagc

SEQ ID NO: 512014 - DNA, 20 bp, Artificial
  CRISPR gRNA sequence
gggggagtcctgaagccggc

SEQ ID NO: 512015 - DNA, 20 bp, Artificial
  CRISPR gRNA sequence
gccggctggaccctgcaccc

SEQ ID NO: 512016 - DNA, 20 bp, Artificial
  CRISPR gRNA sequence
ccggctggaccctgcaccct

SEQ ID NO: 512017 - DNA, 20 bp, Artificial
  CRISPR gRNA sequence
cggctggaccctgcaccctg

SEQ ID NO: 512018 - DNA, 20 bp, Artificial
  CRISPR gRNA sequence
ggctggaccctgcaccctgg

SEQ ID NO: 512019 - DNA, 20 bp, Artificial
  CRISPR gRNA sequence
ctggaccctgcaccctgggg

SEQ ID NO: 512020 - DNA, 20 bp, Artificial
  CRISPR gRNA sequence
tgcaccctgggggagtcctg

SEQ ID NO: 512021 - DNA, 20 bp, Artificial
  CRISPR gRNA sequence
ccctgggggagtcctgaagc

SEQ ID NO: 512022 - DNA, 20 bp, Artificial
  CRISPR gRNA sequence
gggggagtcctgaagctggc

SEQ ID NO: 512023 - DNA, 20 bp, Artificial
  CRISPR gRNA sequence
gctggctggaccctgcaccc

SEQ ID NO: 512024 - DNA, 20 bp, Artificial
  CRISPR gRNA sequence
ctggctggaccctgcaccct

SEQ ID NO: 512025 - DNA, 20 bp, Artificial
  CRISPR gRNA sequence
tggctggaccctgcaccctg

SEQ ID NO: 512026 - DNA, 20 bp, Artificial
  CRISPR gRNA sequence
ctggaccctgcaccctgggg

SEQ ID NO: 512027 - DNA, 20 bp, Artificial
  CRISPR gRNA sequence
cctgcaccctggggtagctc

SEQ ID NO: 512028 - DNA, 20 bp, Artificial
  CRISPR gRNA sequence
tggggtagctccagcacgca

SEQ ID NO: 512029 - DNA, 20 bp, Artificial
  CRISPR gRNA sequence
ggggtagctccagcacgcac

SEQ ID NO: 512030 - DNA, 20 bp, Artificial
  CRISPR gRNA sequence
gggtagctccagcacgcaca

SEQ ID NO: 512031 - DNA, 20 bp, Artificial
  CRISPR gRNA sequence
gcacgcacagggcctccgat

SEQ ID NO: 512032 - DNA, 20 bp, Artificial
  CRISPR gRNA sequence
cacagggcctccgatcagct

SEQ ID NO: 512033 - DNA, 20 bp, Artificial
  CRISPR gRNA sequence
acagggcctccgatcagctg

SEQ ID NO: 512034 - DNA, 20 bp, Artificial
  CRISPR gRNA sequence
cagggcctccgatcagctga

SEQ ID NO: 512035 - DNA, 20 bp, Artificial
  CRISPR gRNA sequence
agggcctccgatcagctgag

SEQ ID NO: 512036 - DNA, 20 bp, Artificial
  CRISPR gRNA sequence
cctccgatcagctgaggggc

SEQ ID NO: 512037 - DNA, 20 bp, Artificial
  CRISPR gRNA sequence
ccgatcagctgaggggctgg

SEQ ID NO: 512038 - DNA, 20 bp, Artificial
  CRISPR gRNA sequence
cgatcagctgaggggctggt

SEQ ID NO: 512039 - DNA, 20 bp, Artificial
  CRISPR gRNA sequence
gaggggctggtgggcactcg

SEQ ID NO: 512040 - DNA, 20 bp, Artificial
  CRISPR gRNA sequence
tggtgggcactcgtggcacc

SEQ ID NO: 512041 - DNA, 20 bp, Artificial
  CRISPR gRNA sequence
ggtgggcactcgtggcaccg

SEQ ID NO: 512042 - DNA, 20 bp, Artificial
  CRISPR gRNA sequence
ggcactcgtggcaccgaggt

SEQ ID NO: 512043 - DNA, 20 bp, Artificial
  CRISPR gRNA sequence
tcgtggcaccgaggtcagtc

SEQ ID NO: 512044 - DNA, 20 bp, Artificial
  CRISPR gRNA sequence
cgtggcaccgaggtcagtcc

SEQ ID NO: 512045 - DNA, 20 bp, Artificial
  CRISPR gRNA sequence
caccgaggtcagtccaggcg

SEQ ID NO: 512046 - DNA, 20 bp, Artificial
  CRISPR gRNA sequence
accgaggtcagtccaggcgc

SEQ ID NO: 512047 - DNA, 20 bp, Artificial
  CRISPR gRNA sequence
cagtccaggcgcaggacttt

SEQ ID NO: 512048 - DNA, 20 bp, Artificial
  CRISPR gRNA sequence
agtccaggcgcaggactttg

SEQ ID NO: 512049 - DNA, 20 bp, Artificial
  CRISPR gRNA sequence
gtccaggcgcaggactttga

SEQ ID NO: 512050 - DNA, 20 bp, Artificial
  CRISPR gRNA sequence
tccaggcgcaggactttgag

SEQ ID NO: 512051 - DNA, 20 bp, Artificial
  CRISPR gRNA sequence
ccaggcgcaggactttgagg

SEQ ID NO: 512052 - DNA, 20 bp, Artificial
  CRISPR gRNA sequence
cgcaggactttgagggggcc

SEQ ID NO: 512053 - DNA, 20 bp, Artificial
  CRISPR gRNA sequence
ggactttgagggggcccaga

SEQ ID NO: 512054 - DNA, 20 bp, Artificial
  CRISPR gRNA sequence
actttgagggggcccagatg

SEQ ID NO: 512055 - DNA, 20 bp, Artificial
  CRISPR gRNA sequence
tttgagggggcccagatgga

SEQ ID NO: 512056 - DNA, 20 bp, Artificial
  CRISPR gRNA sequence
agggggcccagatggagagc

SEQ ID NO: 512057 - DNA, 20 bp, Artificial
  CRISPR gRNA sequence
cccagatggagagctggaac

SEQ ID NO: 512058 - DNA, 20 bp, Artificial
  CRISPR gRNA sequence
tggagagctggaactggcct

SEQ ID NO: 512059 - DNA, 20 bp, Artificial
  CRISPR gRNA sequence
gaaccacaacccccaacgat

SEQ ID NO: 512060 - DNA, 20 bp, Artificial
  CRISPR gRNA sequence
accacaacccccaacgatca

SEQ ID NO: 512061 - DNA, 20 bp, Artificial
  CRISPR gRNA sequence
acccccaacgatcagagata

SEQ ID NO: 512062 - DNA, 20 bp, Artificial
  CRISPR gRNA sequence
cccccaacgatcagagatat

SEQ ID NO: 512063 - DNA, 20 bp, Artificial
  CRISPR gRNA sequence
ccccaacgatcagagatatg

SEQ ID NO: 512064 - DNA, 20 bp, Artificial
  CRISPR gRNA sequence
cccaacgatcagagatatgg

SEQ ID NO: 512065 - DNA, 20 bp, Artificial
  CRISPR gRNA sequence
atcagagatatgggggcttt

SEQ ID NO: 512066 - DNA, 20 bp, Artificial
  CRISPR gRNA sequence
gatatgggggctttcagaca

SEQ ID NO: 512067 - DNA, 20 bp, Artificial
  CRISPR gRNA sequence
atatgggggctttcagacac

SEQ ID NO: 512068 - DNA, 20 bp, Artificial
  CRISPR gRNA sequence
tatgggggctttcagacaca

SEQ ID NO: 512069 - DNA, 20 bp, Artificial
  CRISPR gRNA sequence
gggggctttcagacacaggg

SEQ ID NO: 512070 - DNA, 20 bp, Artificial
  CRISPR gRNA sequence
ggggctttcagacacagggt

SEQ ID NO: 512071 - DNA, 20 bp, Artificial
  CRISPR gRNA sequence
tgaaccaaaaccacctcctc

SEQ ID NO: 512072 - DNA, 20 bp, Artificial
  CRISPR gRNA sequence
gaaccaaaaccacctcctcc

SEQ ID NO: 512073 - DNA, 20 bp, Artificial
  CRISPR gRNA sequence
ccaaaaccacctcctccagg

SEQ ID NO: 512074 - DNA, 20 bp, Artificial
  CRISPR gRNA sequence
ccacctcctccaggaagtta

SEQ ID NO: 512075 - DNA, 20 bp, Artificial
  CRISPR gRNA sequence
cctcctccaggaagttacag

SEQ ID NO: 512076 - DNA, 20 bp, Artificial
  CRISPR gRNA sequence
ctcctccaggaagttacagc

SEQ ID NO: 512077 - DNA, 20 bp, Artificial
  CRISPR gRNA sequence
tcctccaggaagttacagca

SEQ ID NO: 512078 - DNA, 20 bp, Artificial
  CRISPR gRNA sequence
caggaagttacagcagggtg

SEQ ID NO: 512079 - DNA, 20 bp, Artificial
  CRISPR gRNA sequence
aggaagttacagcagggtgc

SEQ ID NO: 512080 - DNA, 20 bp, Artificial
  CRISPR gRNA sequence
gcaggttctgtttttgaccc

SEQ ID NO: 512081 - DNA, 20 bp, Artificial
  CRISPR gRNA sequence
caggttctgtttttgacccc

SEQ ID NO: 512082 - DNA, 20 bp, Artificial
  CRISPR gRNA sequence
ttctgtttttgaccccagga

SEQ ID NO: 512083 - DNA, 20 bp, Artificial
  CRISPR gRNA sequence
tctgtttttgaccccaggac

SEQ ID NO: 512084 - DNA, 20 bp, Artificial
  CRISPR gRNA sequence
gtttttgaccccaggacggg

SEQ ID NO: 512085 - DNA, 20 bp, Artificial
  CRISPR gRNA sequence
tttttgaccccaggacggga

SEQ ID NO: 512086 - DNA, 20 bp, Artificial
  CRISPR gRNA sequence
accccaggacgggaaggatc

SEQ ID NO: 512087 - DNA, 20 bp, Artificial
  CRISPR gRNA sequence
ccccaggacgggaaggatca

SEQ ID NO: 512088 - DNA, 20 bp, Artificial
  CRISPR gRNA sequence
cccaggacgggaaggatcaa

SEQ ID NO: 512089 - DNA, 20 bp, Artificial
  CRISPR gRNA sequence
tattctgattataattttgc

SEQ ID NO: 512090 - DNA, 20 bp, Artificial
  CRISPR gRNA sequence
attctgattataattttgct

SEQ ID NO: 512091 - DNA, 20 bp, Artificial
  CRISPR gRNA sequence
attataattttgctgggaac

SEQ ID NO: 512092 - DNA, 20 bp, Artificial
  CRISPR gRNA sequence
ttataattttgctgggaacc

SEQ ID NO: 512093 - DNA, 20 bp, Artificial
  CRISPR gRNA sequence
tataattttgctgggaacca

SEQ ID NO: 512094 - DNA, 20 bp, Artificial
  CRISPR gRNA sequence
tttgctgggaaccagggaat

SEQ ID NO: 512095 - DNA, 20 bp, Artificial
  CRISPR gRNA sequence
ttgctgggaaccagggaatg

SEQ ID NO: 512096 - DNA, 20 bp, Artificial
  CRISPR gRNA sequence
tgaggtcactgccaaaacaa

SEQ ID NO: 512097 - DNA, 20 bp, Artificial
  CRISPR gRNA sequence
gaggtcactgccaaaacaac

SEQ ID NO: 512098 - DNA, 20 bp, Artificial
  CRISPR gRNA sequence
ctgccaaaacaacaggacct

SEQ ID NO: 512099 - DNA, 20 bp, Artificial
  CRISPR gRNA sequence
tgccaaaacaacaggacctt

SEQ ID NO: 512100 - DNA, 20 bp, Artificial
  CRISPR gRNA sequence
gccaaaacaacaggaccttg

SEQ ID NO: 512101 - DNA, 20 bp, Artificial
  CRISPR gRNA sequence
aacaggaccttggggcttgt

SEQ ID NO: 512102 - DNA, 20 bp, Artificial
  CRISPR gRNA sequence
acaggaccttggggcttgtt

SEQ ID NO: 512103 - DNA, 20 bp, Artificial
  CRISPR gRNA sequence
caggaccttggggcttgttg

SEQ ID NO: 512104 - DNA, 20 bp, Artificial
  CRISPR gRNA sequence
tggggcttgttggggcgtct

SEQ ID NO: 512105 - DNA, 20 bp, Artificial
  CRISPR gRNA sequence
ttgttggggcgtctaagctg

SEQ ID NO: 512106 - DNA, 20 bp, Artificial
  CRISPR gRNA sequence
tgttggggcgtctaagctgt

SEQ ID NO: 512107 - DNA, 20 bp, Artificial
  CRISPR gRNA sequence
cgtctaagctgtgggatcct

SEQ ID NO: 512108 - DNA, 20 bp, Artificial
  CRISPR gRNA sequence
taagctgtgggatcctcaga

SEQ ID NO: 512109 - DNA, 20 bp, Artificial
  CRISPR gRNA sequence
aagctgtgggatcctcagat

SEQ ID NO: 512110 - DNA, 20 bp, Artificial
  CRISPR gRNA sequence
gggatcctcagatgggcccc

SEQ ID NO: 512111 - DNA, 20 bp, Artificial
  CRISPR gRNA sequence
atcctcagatgggcccctgg

SEQ ID NO: 512112 - DNA, 20 bp, Artificial
  CRISPR gRNA sequence
tcctcagatgggcccctggt

SEQ ID NO: 512113 - DNA, 20 bp, Artificial
  CRISPR gRNA sequence
gcccctggtgggtgttccgt

SEQ ID NO: 512114 - DNA, 20 bp, Artificial
  CRISPR gRNA sequence
ggtgggtgttccgttggcct

SEQ ID NO: 512115 - DNA, 20 bp, Artificial
  CRISPR gRNA sequence
tgggtgttccgttggcctca

SEQ ID NO: 512116 - DNA, 20 bp, Artificial
  CRISPR gRNA sequence
tccgttggcctcagagcccc

SEQ ID NO: 512117 - DNA, 20 bp, Artificial
  CRISPR gRNA sequence
tggcctcagagcccccagca

SEQ ID NO: 512118 - DNA, 20 bp, Artificial
  CRISPR gRNA sequence
ggcctcagagcccccagcac

SEQ ID NO: 512119 - DNA, 20 bp, Artificial
  CRISPR gRNA sequence
cagagcccccagcacaggtg

SEQ ID NO: 512120 - DNA, 20 bp, Artificial
  CRISPR gRNA sequence
agagcccccagcacaggtgc

SEQ ID NO: 512121 - DNA, 20 bp, Artificial
  CRISPR gRNA sequence
gagcccccagcacaggtgca

SEQ ID NO: 512122 - DNA, 20 bp, Artificial
  CRISPR gRNA sequence
cagcacaggtgcagggcttt

SEQ ID NO: 512123 - DNA, 20 bp, Artificial
  CRISPR gRNA sequence
agcacaggtgcagggctttc

SEQ ID NO: 512124 - DNA, 20 bp, Artificial
  CRISPR gRNA sequence
gcacaggtgcagggctttcg

SEQ ID NO: 512125 - DNA, 20 bp, Artificial
  CRISPR gRNA sequence
cacaggtgcagggctttcgg

SEQ ID NO: 512126 - DNA, 20 bp, Artificial
  CRISPR gRNA sequence
ggtgcagggctttcggggga

SEQ ID NO: 512127 - DNA, 20 bp, Artificial
  CRISPR gRNA sequence
tgcagggctttcgggggatg

SEQ ID NO: 512128 - DNA, 20 bp, Artificial
  CRISPR gRNA sequence
gcagggctttcgggggatgg

SEQ ID NO: 512129 - DNA, 20 bp, Artificial
  CRISPR gRNA sequence
cagggctttcgggggatgga

SEQ ID NO: 512130 - DNA, 20 bp, Artificial
  CRISPR gRNA sequence
agggctttcgggggatggag

SEQ ID NO: 512131 - DNA, 20 bp, Artificial
  CRISPR gRNA sequence
ggctttcgggggatggaggg

SEQ ID NO: 512132 - DNA, 20 bp, Artificial
  CRISPR gRNA sequence
ttcgggggatggaggggagc

SEQ ID NO: 512133 - DNA, 20 bp, Artificial
  CRISPR gRNA sequence
tcgggggatggaggggagcc

SEQ ID NO: 512134 - DNA, 20 bp, Artificial
  CRISPR gRNA sequence
cgggggatggaggggagcca

SEQ ID NO: 512135 - DNA, 20 bp, Artificial
  CRISPR gRNA sequence
tggaggggagccagggcctg

SEQ ID NO: 512136 - DNA, 20 bp, Artificial
  CRISPR gRNA sequence
gggagccagggcctgtggct

SEQ ID NO: 512137 - DNA, 20 bp, Artificial
  CRISPR gRNA sequence
ggagccagggcctgtggctg

SEQ ID NO: 512138 - DNA, 20 bp, Artificial
  CRISPR gRNA sequence
gagccagggcctgtggctga

SEQ ID NO: 512139 - DNA, 20 bp, Artificial
  CRISPR gRNA sequence
gcctgtggctgagggcaccc

SEQ ID NO: 512140 - DNA, 20 bp, Artificial
  CRISPR gRNA sequence
ctgagggcacccgagcctcc

SEQ ID NO: 512141 - DNA, 20 bp, Artificial
  CRISPR gRNA sequence
tgagggcacccgagcctccc

SEQ ID NO: 512142 - DNA, 20 bp, Artificial
  CRISPR gRNA sequence
cacccgagcctcccgggcca

SEQ ID NO: 512143 - DNA, 20 bp, Artificial
  CRISPR gRNA sequence
gagcctcccgggccacagca

SEQ ID NO: 512144 - DNA, 20 bp, Artificial
  CRISPR gRNA sequence
ccgggccacagcacagcacc

SEQ ID NO: 512145 - DNA, 20 bp, Artificial
  CRISPR gRNA sequence
agcacccagcgctgtcttca

SEQ ID NO: 512146 - DNA, 20 bp, Artificial
  CRISPR gRNA sequence
cccagcgctgtcttcaaagc

SEQ ID NO: 512147 - DNA, 20 bp, Artificial
  CRISPR gRNA sequence
agcgctgtcttcaaagccgg

SEQ ID NO: 512148 - DNA, 20 bp, Artificial
  CRISPR gRNA sequence
gcgctgtcttcaaagccggc

SEQ ID NO: 512149 - DNA, 20 bp, Artificial
  CRISPR gRNA sequence
tcttcaaagccggcaggccc

SEQ ID NO: 512150 - DNA, 20 bp, Artificial
  CRISPR gRNA sequence
aaagccggcaggccctagtt

SEQ ID NO: 512151 - DNA, 20 bp, Artificial
  CRISPR gRNA sequence
aagccggcaggccctagttt

SEQ ID NO: 512152 - DNA, 20 bp, Artificial
  CRISPR gRNA sequence
agccggcaggccctagtttg

SEQ ID NO: 512153 - DNA, 20 bp, Artificial
  CRISPR gRNA sequence
gccctagtttggggctctgc

SEQ ID NO: 512154 - DNA, 20 bp, Artificial
  CRISPR gRNA sequence
agtttggggctctgctggct

SEQ ID NO: 512155 - DNA, 20 bp, Artificial
  CRISPR gRNA sequence
gtttggggctctgctggctt

SEQ ID NO: 512156 - DNA, 20 bp, Artificial
  CRISPR gRNA sequence
tgggtctgcccactgaacct

SEQ ID NO: 512157 - DNA, 20 bp, Artificial
  CRISPR gRNA sequence
gggtctgcccactgaacctt

SEQ ID NO: 512158 - DNA, 20 bp, Artificial
  CRISPR gRNA sequence
tctgcccactgaaccttggg

SEQ ID NO: 512159 - DNA, 20 bp, Artificial
  CRISPR gRNA sequence
tgaaccttgggtggccctgc

SEQ ID NO: 512160 - DNA, 20 bp, Artificial
  CRISPR gRNA sequence
tggccctgccagcaccaccc

SEQ ID NO: 512161 - DNA, 20 bp, Artificial
  CRISPR gRNA sequence
ggccctgccagcaccacccg

SEQ ID NO: 512162 - DNA, 20 bp, Artificial
  CRISPR gRNA sequence
gccctgccagcaccacccga

SEQ ID NO: 512163 - DNA, 20 bp, Artificial
  CRISPR gRNA sequence
ctgccagcaccacccgaggg

SEQ ID NO: 512164 - DNA, 20 bp, Artificial
  CRISPR gRNA sequence
tgccagcaccacccgaggga

SEQ ID NO: 512165 - DNA, 20 bp, Artificial
  CRISPR gRNA sequence
gccagcaccacccgagggaa

SEQ ID NO: 512166 - DNA, 20 bp, Artificial
  CRISPR gRNA sequence
caccacccgagggaagggtg

SEQ ID NO: 512167 - DNA, 20 bp, Artificial
  CRISPR gRNA sequence
accacccgagggaagggtgt

SEQ ID NO: 512168 - DNA, 20 bp, Artificial
  CRISPR gRNA sequence
ccacccgagggaagggtgtg

SEQ ID NO: 512169 - DNA, 20 bp, Artificial
  CRISPR gRNA sequence
cccgagggaagggtgtgggg

SEQ ID NO: 512170 - DNA, 20 bp, Artificial
  CRISPR gRNA sequence
ccgagggaagggtgtggggc

SEQ ID NO: 512171 - DNA, 20 bp, Artificial
  CRISPR gRNA sequence
ggtgtggggcaggaacgccc

SEQ ID NO: 512172 - DNA, 20 bp, Artificial
  CRISPR gRNA sequence
gtggggcaggaacgccccag

SEQ ID NO: 512173 - DNA, 20 bp, Artificial
  CRISPR gRNA sequence
gcaggaacgccccagcagcc

SEQ ID NO: 512174 - DNA, 20 bp, Artificial
  CRISPR gRNA sequence
caggaacgccccagcagcct

SEQ ID NO: 512175 - DNA, 20 bp, Artificial
  CRISPR gRNA sequence
ggaacgccccagcagcctgg

SEQ ID NO: 512176 - DNA, 20 bp, Artificial
  CRISPR gRNA sequence
gaacgccccagcagcctggg

SEQ ID NO: 512177 - DNA, 20 bp, Artificial
  CRISPR gRNA sequence
agcagcctgggaggccgtga

SEQ ID NO: 512178 - DNA, 20 bp, Artificial
  CRISPR gRNA sequence
gcagcctgggaggccgtgac

SEQ ID NO: 512179 - DNA, 20 bp, Artificial
  CRISPR gRNA sequence
tgggaggccgtgacaggaac

SEQ ID NO: 512180 - DNA, 20 bp, Artificial
  CRISPR gRNA sequence
tgacaggaactggcatttgc

SEQ ID NO: 512181 - DNA, 20 bp, Artificial
  CRISPR gRNA sequence
acaggaactggcatttgctg

SEQ ID NO: 512182 - DNA, 20 bp, Artificial
  CRISPR gRNA sequence
caggaactggcatttgctgg

SEQ ID NO: 512183 - DNA, 20 bp, Artificial
  CRISPR gRNA sequence
ggaactggcatttgctggag

SEQ ID NO: 512184 - DNA, 20 bp, Artificial
  CRISPR gRNA sequence
gaactggcatttgctggagg

SEQ ID NO: 512185 - DNA, 20 bp, Artificial
  CRISPR gRNA sequence
ttgatctttgcttctgacaa

SEQ ID NO: 512186 - DNA, 20 bp, Artificial
  CRISPR gRNA sequence
tttgcttctgacaacagccc

SEQ ID NO: 512187 - DNA, 20 bp, Artificial
  CRISPR gRNA sequence
ttgcttctgacaacagcccc

SEQ ID NO: 512188 - DNA, 20 bp, Artificial
  CRISPR gRNA sequence
tgcttctgacaacagcccca

SEQ ID NO: 512189 - DNA, 20 bp, Artificial
  CRISPR gRNA sequence
tgacaacagccccagggtaa

SEQ ID NO: 512190 - DNA, 20 bp, Artificial
  CRISPR gRNA sequence
tgtcttcctgcccaccatga

SEQ ID NO: 512191 - DNA, 20 bp, Artificial
  CRISPR gRNA sequence
gtcttcctgcccaccatgac

SEQ ID NO: 512192 - DNA, 20 bp, Artificial
  CRISPR gRNA sequence
ttcctgcccaccatgacagg

SEQ ID NO: 512193 - DNA, 20 bp, Artificial
  CRISPR gRNA sequence
tcctgcccaccatgacagga

SEQ ID NO: 512194 - DNA, 20 bp, Artificial
  CRISPR gRNA sequence
caccatgacaggaaggctcc

SEQ ID NO: 512195 - DNA, 20 bp, Artificial
  CRISPR gRNA sequence
accatgacaggaaggctcct

SEQ ID NO: 512196 - DNA, 20 bp, Artificial
  CRISPR gRNA sequence
ggctcctgggtaccccttct

SEQ ID NO: 512197 - DNA, 20 bp, Artificial
  CRISPR gRNA sequence
tcagtacctctccaccttct

SEQ ID NO: 512198 - DNA, 20 bp, Artificial
  CRISPR gRNA sequence
cctctccaccttcttggtgc

SEQ ID NO: 512199 - DNA, 20 bp, Artificial
  CRISPR gRNA sequence
accttcttggtgccagataa

SEQ ID NO: 512200 - DNA, 20 bp, Artificial
  CRISPR gRNA sequence
ccttcttggtgccagataaa

SEQ ID NO: 512201 - DNA, 20 bp, Artificial
  CRISPR gRNA sequence
cttcttggtgccagataaaa

SEQ ID NO: 512202 - DNA, 20 bp, Artificial
  CRISPR gRNA sequence
ggtgccagataaaagggtcc

SEQ ID NO: 512203 - DNA, 20 bp, Artificial
  CRISPR gRNA sequence
ccagataaaagggtcccagc

SEQ ID NO: 512204 - DNA, 20 bp, Artificial
  CRISPR gRNA sequence
ccagccagctataatgttct

SEQ ID NO: 512205 - DNA, 20 bp, Artificial
  CRISPR gRNA sequence
cagccagctataatgttctc

SEQ ID NO: 512206 - DNA, 20 bp, Artificial
  CRISPR gRNA sequence
gctataatgttctcaggtcc

SEQ ID NO: 512207 - DNA, 20 bp, Artificial
  CRISPR gRNA sequence
ctataatgttctcaggtcct

SEQ ID NO: 512208 - DNA, 20 bp, Artificial
  CRISPR gRNA sequence
ataatgttctcaggtcctgg

SEQ ID NO: 512209 - DNA, 20 bp, Artificial
  CRISPR gRNA sequence
taatgttctcaggtcctggg

SEQ ID NO: 512210 - DNA, 20 bp, Artificial
  CRISPR gRNA sequence
gttctcaggtcctgggaggt

SEQ ID NO: 512211 - DNA, 20 bp, Artificial
  CRISPR gRNA sequence
aggtcctgggaggtcagacc

SEQ ID NO: 512212 - DNA, 20 bp, Artificial
  CRISPR gRNA sequence
ggtcctgggaggtcagaccc

SEQ ID NO: 512213 - DNA, 20 bp, Artificial
  CRISPR gRNA sequence
gtcctgggaggtcagaccca

SEQ ID NO: 512214 - DNA, 20 bp, Artificial
  CRISPR gRNA sequence
tcctgggaggtcagacccag

SEQ ID NO: 512215 - DNA, 20 bp, Artificial
  CRISPR gRNA sequence
acccaggggcccaccccacc

SEQ ID NO: 512216 - DNA, 20 bp, Artificial
  CRISPR gRNA sequence
cccaggggcccaccccacct

SEQ ID NO: 512217 - DNA, 20 bp, Artificial
  CRISPR gRNA sequence
aggggcccaccccacctagg

SEQ ID NO: 512218 - DNA, 20 bp, Artificial
  CRISPR gRNA sequence
caccccacctaggaagccct

SEQ ID NO: 512219 - DNA, 20 bp, Artificial
  CRISPR gRNA sequence
aggaagccctaagacccccc

SEQ ID NO: 512220 - DNA, 20 bp, Artificial
  CRISPR gRNA sequence
ggaagccctaagacccccca

SEQ ID NO: 512221 - DNA, 20 bp, Artificial
  CRISPR gRNA sequence
aagccctaagaccccccaag

SEQ ID NO: 512222 - DNA, 20 bp, Artificial
  CRISPR gRNA sequence
gaccccccaaggagccgacc

SEQ ID NO: 512223 - DNA, 20 bp, Artificial
  CRISPR gRNA sequence
accccccaaggagccgacct

SEQ ID NO: 512224 - DNA, 20 bp, Artificial
  CRISPR gRNA sequence
ccaaggagccgacctaggcc

SEQ ID NO: 512225 - DNA, 20 bp, Artificial
  CRISPR gRNA sequence
gagccgacctaggcctggtt

SEQ ID NO: 512226 - DNA, 20 bp, Artificial
  CRISPR gRNA sequence
agccgacctaggcctggttt

SEQ ID NO: 512227 - DNA, 20 bp, Artificial
  CRISPR gRNA sequence
ggcctggtttgggcacctcc

SEQ ID NO: 512228 - DNA, 20 bp, Artificial
  CRISPR gRNA sequence
tggtttgggcacctcccgga

SEQ ID NO: 512229 - DNA, 20 bp, Artificial
  CRISPR gRNA sequence
gtttgggcacctcccggatg

SEQ ID NO: 512230 - DNA, 20 bp, Artificial
  CRISPR gRNA sequence
tttgggcacctcccggatgg

SEQ ID NO: 512231 - DNA, 20 bp, Artificial
  CRISPR gRNA sequence
ttgggcacctcccggatgga

SEQ ID NO: 512232 - DNA, 20 bp, Artificial
  CRISPR gRNA sequence
ggcacctcccggatggaggg

SEQ ID NO: 512233 - DNA, 20 bp, Artificial
  CRISPR gRNA sequence
gcacctcccggatggaggga

SEQ ID NO: 512234 - DNA, 20 bp, Artificial
  CRISPR gRNA sequence
cacctcccggatggagggaa

SEQ ID NO: 512235 - DNA, 20 bp, Artificial
  CRISPR gRNA sequence
cggatggagggaagggaacc

SEQ ID NO: 512236 - DNA, 20 bp, Artificial
  CRISPR gRNA sequence
ggatggagggaagggaaccc

SEQ ID NO: 512237 - DNA, 20 bp, Artificial
  CRISPR gRNA sequence
gatggagggaagggaaccca

SEQ ID NO: 512238 - DNA, 20 bp, Artificial
  CRISPR gRNA sequence
atggagggaagggaacccag

SEQ ID NO: 512239 - DNA, 20 bp, Artificial
  CRISPR gRNA sequence
gagggaagggaacccagggg

SEQ ID NO: 512240 - DNA, 20 bp, Artificial
  CRISPR gRNA sequence
aagggaacccaggggtggaa

SEQ ID NO: 512241 - DNA, 20 bp, Artificial
  CRISPR gRNA sequence
ggaacggccctgctgcccgc

SEQ ID NO: 512242 - DNA, 20 bp, Artificial
  CRISPR gRNA sequence
gaacggccctgctgcccgct

SEQ ID NO: 512243 - DNA, 20 bp, Artificial
  CRISPR gRNA sequence
acggccctgctgcccgctag

SEQ ID NO: 512244 - DNA, 20 bp, Artificial
  CRISPR gRNA sequence
cggccctgctgcccgctagg

SEQ ID NO: 512245 - DNA, 20 bp, Artificial
  CRISPR gRNA sequence
tgcccgctaggaggtgctgc

SEQ ID NO: 512246 - DNA, 20 bp, Artificial
  CRISPR gRNA sequence
taggaggtgctgccggcctc

SEQ ID NO: 512247 - DNA, 20 bp, Artificial
  CRISPR gRNA sequence
gtgctgccggcctccagcac

SEQ ID NO: 512248 - DNA, 20 bp, Artificial
  CRISPR gRNA sequence
tgctgccggcctccagcacc

SEQ ID NO: 512249 - DNA, 20 bp, Artificial
  CRISPR gRNA sequence
ccggcctccagcaccaggct

SEQ ID NO: 512250 - DNA, 20 bp, Artificial
  CRISPR gRNA sequence
cggcctccagcaccaggctg

SEQ ID NO: 512251 - DNA, 20 bp, Artificial
  CRISPR gRNA sequence
tgcttccgtcattttgcctc

SEQ ID NO: 512252 - DNA, 20 bp, Artificial
  CRISPR gRNA sequence
gcttccgtcattttgcctct

SEQ ID NO: 512253 - DNA, 20 bp, Artificial
  CRISPR gRNA sequence
cttccgtcattttgcctctg

SEQ ID NO: 512254 - DNA, 20 bp, Artificial
  CRISPR gRNA sequence
gtcattttgcctctggggcc

SEQ ID NO: 512255 - DNA, 20 bp, Artificial
  CRISPR gRNA sequence
tcattttgcctctggggccg

SEQ ID NO: 512256 - DNA, 20 bp, Artificial
  CRISPR gRNA sequence
cattttgcctctggggccga

SEQ ID NO: 512257 - DNA, 20 bp, Artificial
  CRISPR gRNA sequence
ctctggggccgagggcctgt

SEQ ID NO: 512258 - DNA, 20 bp, Artificial
  CRISPR gRNA sequence
agggcctgtgagtgaccact

SEQ ID NO: 512259 - DNA, 20 bp, Artificial
  CRISPR gRNA sequence
agtgaccactgagccgcccc

SEQ ID NO: 512260 - DNA, 20 bp, Artificial
  CRISPR gRNA sequence
cactgagccgcccctggctg

SEQ ID NO: 512261 - DNA, 20 bp, Artificial
  CRISPR gRNA sequence
cgcccctggctgtggatgcg

SEQ ID NO: 512262 - DNA, 20 bp, Artificial
  CRISPR gRNA sequence
gcccctggctgtggatgcgt

SEQ ID NO: 512263 - DNA, 20 bp, Artificial
  CRISPR gRNA sequence
tggctgtggatgcgtgggtt

SEQ ID NO: 512264 - DNA, 20 bp, Artificial
  CRISPR gRNA sequence
ggctgtggatgcgtgggtta

SEQ ID NO: 512265 - DNA, 20 bp, Artificial
  CRISPR gRNA sequence
gtggatgcgtgggttaagga

SEQ ID NO: 512266 - DNA, 20 bp, Artificial
  CRISPR gRNA sequence
tggatgcgtgggttaaggac

SEQ ID NO: 512267 - DNA, 20 bp, Artificial
  CRISPR gRNA sequence
ggatgcgtgggttaaggacg

SEQ ID NO: 512268 - DNA, 20 bp, Artificial
  CRISPR gRNA sequence
tgcgtgggttaaggacgggg

SEQ ID NO: 512269 - DNA, 20 bp, Artificial
  CRISPR gRNA sequence
gcgtgggttaaggacggggt

SEQ ID NO: 512270 - DNA, 20 bp, Artificial
  CRISPR gRNA sequence
ggacggggtgggtgtgtatc

SEQ ID NO: 512271 - DNA, 20 bp, Artificial
  CRISPR gRNA sequence
gggtgtgtatctggaaacaa

SEQ ID NO: 512272 - DNA, 20 bp, Artificial
  CRISPR gRNA sequence
ggtgtgtatctggaaacaaa

SEQ ID NO: 512273 - DNA, 20 bp, Artificial
  CRISPR gRNA sequence
gtgtgtatctggaaacaaaa

SEQ ID NO: 512274 - DNA, 20 bp, Artificial
  CRISPR gRNA sequence
tgtatctggaaacaaaaggg

SEQ ID NO: 512275 - DNA, 20 bp, Artificial
  CRISPR gRNA sequence
gtatctggaaacaaaagggc

SEQ ID NO: 512276 - DNA, 20 bp, Artificial
  CRISPR gRNA sequence
gaaacaaaagggcaggaccc

SEQ ID NO: 512277 - DNA, 20 bp, Artificial
  CRISPR gRNA sequence
aagggcaggaccccggcaac

SEQ ID NO: 512278 - DNA, 20 bp, Artificial
  CRISPR gRNA sequence
ggcaggaccccggcaactgg

SEQ ID NO: 512279 - DNA, 20 bp, Artificial
  CRISPR gRNA sequence
gaccccggcaactggtggct

SEQ ID NO: 512280 - DNA, 20 bp, Artificial
  CRISPR gRNA sequence
accccggcaactggtggctt

SEQ ID NO: 512281 - DNA, 20 bp, Artificial
  CRISPR gRNA sequence
cggcaactggtggcttgggc

SEQ ID NO: 512282 - DNA, 20 bp, Artificial
  CRISPR gRNA sequence
aactggtggcttgggcaagt

SEQ ID NO: 512283 - DNA, 20 bp, Artificial
  CRISPR gRNA sequence
actggtggcttgggcaagtc

SEQ ID NO: 512284 - DNA, 20 bp, Artificial
  CRISPR gRNA sequence
aggtgactttttttcccacc

SEQ ID NO: 512285 - DNA, 20 bp, Artificial
  CRISPR gRNA sequence
tgactttttttcccacctgg

SEQ ID NO: 512286 - DNA, 20 bp, Artificial
  CRISPR gRNA sequence
gactttttttcccacctggc

SEQ ID NO: 512287 - DNA, 20 bp, Artificial
  CRISPR gRNA sequence
actttttttcccacctggca

SEQ ID NO: 512288 - DNA, 20 bp, Artificial
  CRISPR gRNA sequence
ttcccacctggcagggactg

SEQ ID NO: 512289 - DNA, 20 bp, Artificial
  CRISPR gRNA sequence
tcccacctggcagggactgc

SEQ ID NO: 512290 - DNA, 20 bp, Artificial
  CRISPR gRNA sequence
cccacctggcagggactgca

SEQ ID NO: 512291 - DNA, 20 bp, Artificial
  CRISPR gRNA sequence
ggcagggactgcagggctcc

SEQ ID NO: 512292 - DNA, 20 bp, Artificial
  CRISPR gRNA sequence
gcagggactgcagggctcct

SEQ ID NO: 512293 - DNA, 20 bp, Artificial
  CRISPR gRNA sequence
gggactgcagggctcctggg

SEQ ID NO: 512294 - DNA, 20 bp, Artificial
  CRISPR gRNA sequence
ggactgcagggctcctgggc

SEQ ID NO: 512295 - DNA, 20 bp, Artificial
  CRISPR gRNA sequence
gcagggctcctgggcaggcc

SEQ ID NO: 512296 - DNA, 20 bp, Artificial
  CRISPR gRNA sequence
tcctgggcaggcctagcaca

SEQ ID NO: 512297 - DNA, 20 bp, Artificial
  CRISPR gRNA sequence
ggcaggcctagcacacagct

SEQ ID NO: 512298 - DNA, 20 bp, Artificial
  CRISPR gRNA sequence
agcacacagcttggcacccg

SEQ ID NO: 512299 - DNA, 20 bp, Artificial
  CRISPR gRNA sequence
gcacacagcttggcacccgc

SEQ ID NO: 512300 - DNA, 20 bp, Artificial
  CRISPR gRNA sequence
gcttggcacccgcgggcatc

SEQ ID NO: 512301 - DNA, 20 bp, Artificial
  CRISPR gRNA sequence
ggcacccgcgggcatcaagc

SEQ ID NO: 512302 - DNA, 20 bp, Artificial
  CRISPR gRNA sequence
tcaagccagctttctcttcc

SEQ ID NO: 512303 - DNA, 20 bp, Artificial
  CRISPR gRNA sequence
agctttctcttcctggcaca

SEQ ID NO: 512304 - DNA, 20 bp, Artificial
  CRISPR gRNA sequence
tctcttcctggcacacagcc

SEQ ID NO: 512305 - DNA, 20 bp, Artificial
  CRISPR gRNA sequence
ggcacacagcctggcacccg

SEQ ID NO: 512306 - DNA, 20 bp, Artificial
  CRISPR gRNA sequence
gcacacagcctggcacccgc

SEQ ID NO: 512307 - DNA, 20 bp, Artificial
  CRISPR gRNA sequence
gcctggcacccgcgggcatc

SEQ ID NO: 512308 - DNA, 20 bp, Artificial
  CRISPR gRNA sequence
ggcacccgcgggcatccagc

SEQ ID NO: 512309 - DNA, 20 bp, Artificial
  CRISPR gRNA sequence
tccagccagctttctcttcc

SEQ ID NO: 512310 - DNA, 20 bp, Artificial
  CRISPR gRNA sequence
tcctggctatgtttctgcca

SEQ ID NO: 512311 - DNA, 20 bp, Artificial
  CRISPR gRNA sequence
ctggctatgtttctgccaca

SEQ ID NO: 512312 - DNA, 20 bp, Artificial
  CRISPR gRNA sequence
ggctatgtttctgccacaga

SEQ ID NO: 512313 - DNA, 20 bp, Artificial
  CRISPR gRNA sequence
atgtttctgccacagagaga

SEQ ID NO: 512314 - DNA, 20 bp, Artificial
  CRISPR gRNA sequence
tgtttctgccacagagagac

SEQ ID NO: 512315 - DNA, 20 bp, Artificial
  CRISPR gRNA sequence
gtttctgccacagagagaca

SEQ ID NO: 512316 - DNA, 20 bp, Artificial
  CRISPR gRNA sequence
tgccacagagagacagggcc

SEQ ID NO: 512317 - DNA, 20 bp, Artificial
  CRISPR gRNA sequence
cagagagacagggccaagcc

SEQ ID NO: 512318 - DNA, 20 bp, Artificial
  CRISPR gRNA sequence
gccaagcccagctctcctcc

SEQ ID NO: 512319 - DNA, 20 bp, Artificial
  CRISPR gRNA sequence
gcccagctctcctccaagca

SEQ ID NO: 512320 - DNA, 20 bp, Artificial
  CRISPR gRNA sequence
cccagctctcctccaagcac

SEQ ID NO: 512321 - DNA, 20 bp, Artificial
  CRISPR gRNA sequence
ccaagcacaggctctgctca

SEQ ID NO: 512322 - DNA, 20 bp, Artificial
  CRISPR gRNA sequence
aagcacaggctctgctcacg

SEQ ID NO: 512323 - DNA, 20 bp, Artificial
  CRISPR gRNA sequence
agcacaggctctgctcacgg

SEQ ID NO: 512324 - DNA, 20 bp, Artificial
  CRISPR gRNA sequence
ggctctgctcacggaggacc

SEQ ID NO: 512325 - DNA, 20 bp, Artificial
  CRISPR gRNA sequence
gctctgctcacggaggacct

SEQ ID NO: 512326 - DNA, 20 bp, Artificial
  CRISPR gRNA sequence
ctctgctcacggaggacctg

SEQ ID NO: 512327 - DNA, 20 bp, Artificial
  CRISPR gRNA sequence
acggaggacctggggcacac

SEQ ID NO: 512328 - DNA, 20 bp, Artificial
  CRISPR gRNA sequence
cggaggacctggggcacact

SEQ ID NO: 512329 - DNA, 20 bp, Artificial
  CRISPR gRNA sequence
ggaggacctggggcacactg

SEQ ID NO: 512330 - DNA, 20 bp, Artificial
  CRISPR gRNA sequence
ggacctggggcacactgggg

SEQ ID NO: 512331 - DNA, 20 bp, Artificial
  CRISPR gRNA sequence
acctggggcacactggggca

SEQ ID NO: 512332 - DNA, 20 bp, Artificial
  CRISPR gRNA sequence
ctggggcagagtgcacacac

SEQ ID NO: 512333 - DNA, 20 bp, Artificial
  CRISPR gRNA sequence
tggggcagagtgcacacacc

SEQ ID NO: 512334 - DNA, 20 bp, Artificial
  CRISPR gRNA sequence
gagtgcacacaccgggtgtg

SEQ ID NO: 512335 - DNA, 20 bp, Artificial
  CRISPR gRNA sequence
agtgcacacaccgggtgtgt

SEQ ID NO: 512336 - DNA, 20 bp, Artificial
  CRISPR gRNA sequence
gtgcacacaccgggtgtgtg

SEQ ID NO: 512337 - DNA, 20 bp, Artificial
  CRISPR gRNA sequence
acaccgggtgtgtggggttc

SEQ ID NO: 512338 - DNA, 20 bp, Artificial
  CRISPR gRNA sequence
tgtacatttgcacgtgtgta

SEQ ID NO: 512339 - DNA, 20 bp, Artificial
  CRISPR gRNA sequence
gtgtgtatggtgtgtgcgtg

SEQ ID NO: 512340 - DNA, 20 bp, Artificial
  CRISPR gRNA sequence
gtgtggtgtgtgtgtctgtg

SEQ ID NO: 512341 - DNA, 20 bp, Artificial
  CRISPR gRNA sequence
tgcatgtgtatatttgtgtg

SEQ ID NO: 512342 - DNA, 20 bp, Artificial
  CRISPR gRNA sequence
gtatatttgtgtgtggtgtg

SEQ ID NO: 512343 - DNA, 20 bp, Artificial
  CRISPR gRNA sequence
gtgtggtgtgtagtgtcttg

SEQ ID NO: 512344 - DNA, 20 bp, Artificial
  CRISPR gRNA sequence
tgtggtgtgtagtgtcttgc

SEQ ID NO: 512345 - DNA, 20 bp, Artificial
  CRISPR gRNA sequence
gtggtgtgtagtgtcttgcg

SEQ ID NO: 512346 - DNA, 20 bp, Artificial
  CRISPR gRNA sequence
ggtgtgtagtgtcttgcggg

SEQ ID NO: 512347 - DNA, 20 bp, Artificial
  CRISPR gRNA sequence
gtagtgtcttgcggggagta

SEQ ID NO: 512348 - DNA, 20 bp, Artificial
  CRISPR gRNA sequence
gtcttgcggggagtatggtg

SEQ ID NO: 512349 - DNA, 20 bp, Artificial
  CRISPR gRNA sequence
tcttgcggggagtatggtgt

SEQ ID NO: 512350 - DNA, 20 bp, Artificial
  CRISPR gRNA sequence
gcggggagtatggtgtgggt

SEQ ID NO: 512351 - DNA, 20 bp, Artificial
  CRISPR gRNA sequence
cggggagtatggtgtgggta

SEQ ID NO: 512352 - DNA, 20 bp, Artificial
  CRISPR gRNA sequence
ggggagtatggtgtgggtaa

SEQ ID NO: 512353 - DNA, 20 bp, Artificial
  CRISPR gRNA sequence
gggagtatggtgtgggtaag

SEQ ID NO: 512354 - DNA, 20 bp, Artificial
  CRISPR gRNA sequence
tctctgtgtgtacatatgtg

SEQ ID NO: 512355 - DNA, 20 bp, Artificial
  CRISPR gRNA sequence
gtgtgatgcatgtatatgtg

SEQ ID NO: 512356 - DNA, 20 bp, Artificial
  CRISPR gRNA sequence
gtgtggtgtgtgcatgcacg

SEQ ID NO: 512357 - DNA, 20 bp, Artificial
  CRISPR gRNA sequence
atgcacgtggtgtgtacatg

SEQ ID NO: 512358 - DNA, 20 bp, Artificial
  CRISPR gRNA sequence
acgtggtgtgtacatgcagt

SEQ ID NO: 512359 - DNA, 20 bp, Artificial
  CRISPR gRNA sequence
cgtggtgtgtacatgcagtc

SEQ ID NO: 512360 - DNA, 20 bp, Artificial
  CRISPR gRNA sequence
tgcacgtacacgtgcatgtg

SEQ ID NO: 512361 - DNA, 20 bp, Artificial
  CRISPR gRNA sequence
gcctgtgttgtgtgcctctg

SEQ ID NO: 512362 - DNA, 20 bp, Artificial
  CRISPR gRNA sequence
cctgtgttgtgtgcctctgc

SEQ ID NO: 512363 - DNA, 20 bp, Artificial
  CRISPR gRNA sequence
ctgtgttgtgtgcctctgca

SEQ ID NO: 512364 - DNA, 20 bp, Artificial
  CRISPR gRNA sequence
tgtgttgtgtgcctctgcag

SEQ ID NO: 512365 - DNA, 20 bp, Artificial
  CRISPR gRNA sequence
gcctctgcaggggcccgctg

SEQ ID NO: 512366 - DNA, 20 bp, Artificial
  CRISPR gRNA sequence
ggggcccgctgcagctgtcc

SEQ ID NO: 512367 - DNA, 20 bp, Artificial
  CRISPR gRNA sequence
gggcccgctgcagctgtcct

SEQ ID NO: 512368 - DNA, 20 bp, Artificial
  CRISPR gRNA sequence
ctgcagctgtcctgggtgcc

SEQ ID NO: 512369 - DNA, 20 bp, Artificial
  CRISPR gRNA sequence
gctgtcctgggtgcctggct

SEQ ID NO: 512370 - DNA, 20 bp, Artificial
  CRISPR gRNA sequence
gtcctgggtgcctggctgag

SEQ ID NO: 512371 - DNA, 20 bp, Artificial
  CRISPR gRNA sequence
tcctgggtgcctggctgagc

SEQ ID NO: 512372 - DNA, 20 bp, Artificial
  CRISPR gRNA sequence
ggtgtgctgcccgcactgct

SEQ ID NO: 512373 - DNA, 20 bp, Artificial
  CRISPR gRNA sequence
gctgcccgcactgctgagcc

SEQ ID NO: 512374 - DNA, 20 bp, Artificial
  CRISPR gRNA sequence
ctgcccgcactgctgagccc

SEQ ID NO: 512375 - DNA, 20 bp, Artificial
  CRISPR gRNA sequence
gcccgggatccctccctccc

SEQ ID NO: 512376 - DNA, 20 bp, Artificial
  CRISPR gRNA sequence
atccctccctccctggctgt

SEQ ID NO: 512377 - DNA, 20 bp, Artificial
  CRISPR gRNA sequence
cctccctccctggctgttgg

SEQ ID NO: 512378 - DNA, 20 bp, Artificial
  CRISPR gRNA sequence
cctccctggctgttggcagc

SEQ ID NO: 512379 - DNA, 20 bp, Artificial
  CRISPR gRNA sequence
ctccctggctgttggcagct

SEQ ID NO: 512380 - DNA, 20 bp, Artificial
  CRISPR gRNA sequence
tggctgttggcagctgggcc

SEQ ID NO: 512381 - DNA, 20 bp, Artificial
  CRISPR gRNA sequence
gttggcagctgggcccagtg

SEQ ID NO: 512382 - DNA, 20 bp, Artificial
  CRISPR gRNA sequence
tgggcccagtgcagctgtgc

SEQ ID NO: 512383 - DNA, 20 bp, Artificial
  CRISPR gRNA sequence
tgaccctaacccaccccctg

SEQ ID NO: 512384 - DNA, 20 bp, Artificial
  CRISPR gRNA sequence
ccctaacccaccccctgcag

SEQ ID NO: 512385 - DNA, 20 bp, Artificial
  CRISPR gRNA sequence
cctaacccaccccctgcagc

SEQ ID NO: 512386 - DNA, 20 bp, Artificial
  CRISPR gRNA sequence
ctaacccaccccctgcagca

SEQ ID NO: 512387 - DNA, 20 bp, Artificial
  CRISPR gRNA sequence
cccaccccctgcagcaggga

SEQ ID NO: 512388 - DNA, 20 bp, Artificial
  CRISPR gRNA sequence
ccaccccctgcagcagggac

SEQ ID NO: 512389 - DNA, 20 bp, Artificial
  CRISPR gRNA sequence
caccccctgcagcagggaca

SEQ ID NO: 512390 - DNA, 20 bp, Artificial
  CRISPR gRNA sequence
ctgcagcagggacagggccc

SEQ ID NO: 512391 - DNA, 20 bp, Artificial
  CRISPR gRNA sequence
agggccccagctccttgtcc

SEQ ID NO: 512392 - DNA, 20 bp, Artificial
  CRISPR gRNA sequence
gggccccagctccttgtccc

SEQ ID NO: 512393 - DNA, 20 bp, Artificial
  CRISPR gRNA sequence
cccagctccttgtcccaggc

SEQ ID NO: 512394 - DNA, 20 bp, Artificial
  CRISPR gRNA sequence
gctccttgtcccaggccagc

SEQ ID NO: 512395 - DNA, 20 bp, Artificial
  CRISPR gRNA sequence
tccttgtcccaggccagctg

SEQ ID NO: 512396 - DNA, 20 bp, Artificial
  CRISPR gRNA sequence
ccttgtcccaggccagctgg

SEQ ID NO: 512397 - DNA, 20 bp, Artificial
  CRISPR gRNA sequence
cttgtcccaggccagctgga

SEQ ID NO: 512398 - DNA, 20 bp, Artificial
  CRISPR gRNA sequence
ttgtcccaggccagctggag

SEQ ID NO: 512399 - DNA, 20 bp, Artificial
  CRISPR gRNA sequence
gtcccaggccagctggaggg

SEQ ID NO: 512400 - DNA, 20 bp, Artificial
  CRISPR gRNA sequence
ccagctggaggggagcttca

SEQ ID NO: 512401 - DNA, 20 bp, Artificial
  CRISPR gRNA sequence
cagctggaggggagcttcat

SEQ ID NO: 512402 - DNA, 20 bp, Artificial
  CRISPR gRNA sequence
ctggaggggagcttcatggg

SEQ ID NO: 512403 - DNA, 20 bp, Artificial
  CRISPR gRNA sequence
aggggagcttcatgggtggt

SEQ ID NO: 512404 - DNA, 20 bp, Artificial
  CRISPR gRNA sequence
gcttcatgggtggtcagccc

SEQ ID NO: 512405 - DNA, 20 bp, Artificial
  CRISPR gRNA sequence
cttcatgggtggtcagcccc

SEQ ID NO: 512406 - DNA, 20 bp, Artificial
  CRISPR gRNA sequence
ttcatgggtggtcagcccca

SEQ ID NO: 512407 - DNA, 20 bp, Artificial
  CRISPR gRNA sequence
tcatgggtggtcagccccag

SEQ ID NO: 512408 - DNA, 20 bp, Artificial
  CRISPR gRNA sequence
gggtggtcagccccaggggt

SEQ ID NO: 512409 - DNA, 20 bp, Artificial
  CRISPR gRNA sequence
ggtggtcagccccaggggtt

SEQ ID NO: 512410 - DNA, 20 bp, Artificial
  CRISPR gRNA sequence
cagccccaggggttgggcct

SEQ ID NO: 512411 - DNA, 20 bp, Artificial
  CRISPR gRNA sequence
ttgggcctgagaccgtcacc

SEQ ID NO: 512412 - DNA, 20 bp, Artificial
  CRISPR gRNA sequence
accaagaccccttccctcca

SEQ ID NO: 512413 - DNA, 20 bp, Artificial
  CRISPR gRNA sequence
ccaagaccccttccctccac

SEQ ID NO: 512414 - DNA, 20 bp, Artificial
  CRISPR gRNA sequence
cttccctccacaggacatgc

SEQ ID NO: 512415 - DNA, 20 bp, Artificial
  CRISPR gRNA sequence
ttccctccacaggacatgct

SEQ ID NO: 512416 - DNA, 20 bp, Artificial
  CRISPR gRNA sequence
gcgccccccactgctcgccc

SEQ ID NO: 512417 - DNA, 20 bp, Artificial
  CRISPR gRNA sequence
ccccccactgctcgccctgg

SEQ ID NO: 512418 - DNA, 20 bp, Artificial
  CRISPR gRNA sequence
cccccactgctcgccctggt

SEQ ID NO: 512419 - DNA, 20 bp, Artificial
  CRISPR gRNA sequence
ccccactgctcgccctggtg

SEQ ID NO: 512420 - DNA, 20 bp, Artificial
  CRISPR gRNA sequence
ctggtggggctgctctccct

SEQ ID NO: 512421 - DNA, 20 bp, Artificial
  CRISPR gRNA sequence
tggtggggctgctctccctc

SEQ ID NO: 512422 - DNA, 20 bp, Artificial
  CRISPR gRNA sequence
gggctgctctccctcgggtg

SEQ ID NO: 512423 - DNA, 20 bp, Artificial
  CRISPR gRNA sequence
tgctctccctcgggtgcggt

SEQ ID NO: 512424 - DNA, 20 bp, Artificial
  CRISPR gRNA sequence
gcggtgagttctgtgttcca

SEQ ID NO: 512425 - DNA, 20 bp, Artificial
  CRISPR gRNA sequence
ggtgagttctgtgttccacg

SEQ ID NO: 512426 - DNA, 20 bp, Artificial
  CRISPR gRNA sequence
gtgagttctgtgttccacgg

SEQ ID NO: 512427 - DNA, 20 bp, Artificial
  CRISPR gRNA sequence
tgagttctgtgttccacgga

SEQ ID NO: 512428 - DNA, 20 bp, Artificial
  CRISPR gRNA sequence
gagttctgtgttccacggag

SEQ ID NO: 512429 - DNA, 20 bp, Artificial
  CRISPR gRNA sequence
tccacgcgtgacattccaat

SEQ ID NO: 512430 - DNA, 20 bp, Artificial
  CRISPR gRNA sequence
ccacgcgtgacattccaatc

SEQ ID NO: 512431 - DNA, 20 bp, Artificial
  CRISPR gRNA sequence
cacgcgtgacattccaatca

SEQ ID NO: 512432 - DNA, 20 bp, Artificial
  CRISPR gRNA sequence
cgcgtgacattccaatcagg

SEQ ID NO: 512433 - DNA, 20 bp, Artificial
  CRISPR gRNA sequence
gacattccaatcagggagaa

SEQ ID NO: 512434 - DNA, 20 bp, Artificial
  CRISPR gRNA sequence
acattccaatcagggagaac

SEQ ID NO: 512435 - DNA, 20 bp, Artificial
  CRISPR gRNA sequence
cattccaatcagggagaaca

SEQ ID NO: 512436 - DNA, 20 bp, Artificial
  CRISPR gRNA sequence
ggcctgccctcactttccca

SEQ ID NO: 512437 - DNA, 20 bp, Artificial
  CRISPR gRNA sequence
tgccctcactttcccataga

SEQ ID NO: 512438 - DNA, 20 bp, Artificial
  CRISPR gRNA sequence
cctcactttcccatagacag

SEQ ID NO: 512439 - DNA, 20 bp, Artificial
  CRISPR gRNA sequence
ttcccatagacagaagttcc

SEQ ID NO: 512440 - DNA, 20 bp, Artificial
  CRISPR gRNA sequence
tcccatagacagaagttccc

SEQ ID NO: 512441 - DNA, 20 bp, Artificial
  CRISPR gRNA sequence
ccatagacagaagttcccgg

SEQ ID NO: 512442 - DNA, 20 bp, Artificial
  CRISPR gRNA sequence
catagacagaagttcccggg

SEQ ID NO: 512443 - DNA, 20 bp, Artificial
  CRISPR gRNA sequence
gacagaagttcccgggaggc

SEQ ID NO: 512444 - DNA, 20 bp, Artificial
  CRISPR gRNA sequence
acagaagttcccgggaggct

SEQ ID NO: 512445 - DNA, 20 bp, Artificial
  CRISPR gRNA sequence
cagaagttcccgggaggctg

SEQ ID NO: 512446 - DNA, 20 bp, Artificial
  CRISPR gRNA sequence
aagttcccgggaggctgggg

SEQ ID NO: 512447 - DNA, 20 bp, Artificial
  CRISPR gRNA sequence
agttcccgggaggctgggga

SEQ ID NO: 512448 - DNA, 20 bp, Artificial
  CRISPR gRNA sequence
ctggggaaggaccttgccac

SEQ ID NO: 512449 - DNA, 20 bp, Artificial
  CRISPR gRNA sequence
tggggaaggaccttgccact

SEQ ID NO: 512450 - DNA, 20 bp, Artificial
  CRISPR gRNA sequence
ggggaaggaccttgccactg

SEQ ID NO: 512451 - DNA, 20 bp, Artificial
  CRISPR gRNA sequence
gggaaggaccttgccactgg

SEQ ID NO: 512452 - DNA, 20 bp, Artificial
  CRISPR gRNA sequence
aaggaccttgccactggggg

SEQ ID NO: 512453 - DNA, 20 bp, Artificial
  CRISPR gRNA sequence
aggaccttgccactgggggt

SEQ ID NO: 512454 - DNA, 20 bp, Artificial
  CRISPR gRNA sequence
ccttgccactgggggtaggt

SEQ ID NO: 512455 - DNA, 20 bp, Artificial
  CRISPR gRNA sequence
cttgccactgggggtaggtc

SEQ ID NO: 512456 - DNA, 20 bp, Artificial
  CRISPR gRNA sequence
ttgccactgggggtaggtcg

SEQ ID NO: 512457 - DNA, 20 bp, Artificial
  CRISPR gRNA sequence
ctgggggtaggtcggggact

SEQ ID NO: 512458 - DNA, 20 bp, Artificial
  CRISPR gRNA sequence
tgggggtaggtcggggactc

SEQ ID NO: 512459 - DNA, 20 bp, Artificial
  CRISPR gRNA sequence
ggcctcgtctccgcacgtgc

SEQ ID NO: 512460 - DNA, 20 bp, Artificial
  CRISPR gRNA sequence
gcctcgtctccgcacgtgcc

SEQ ID NO: 512461 - DNA, 20 bp, Artificial
  CRISPR gRNA sequence
ctcgtctccgcacgtgccag

SEQ ID NO: 512462 - DNA, 20 bp, Artificial
  CRISPR gRNA sequence
tcgtctccgcacgtgccagg

SEQ ID NO: 512463 - DNA, 20 bp, Artificial
  CRISPR gRNA sequence
ccgcacgtgccaggaggctg

SEQ ID NO: 512464 - DNA, 20 bp, Artificial
  CRISPR gRNA sequence
ctgtagctgtgctgtttccc

SEQ ID NO: 512465 - DNA, 20 bp, Artificial
  CRISPR gRNA sequence
tgtagctgtgctgtttcccg

SEQ ID NO: 512466 - DNA, 20 bp, Artificial
  CRISPR gRNA sequence
gtagctgtgctgtttcccga

SEQ ID NO: 512467 - DNA, 20 bp, Artificial
  CRISPR gRNA sequence
cgagggcccctctttgcacc

SEQ ID NO: 512468 - DNA, 20 bp, Artificial
  CRISPR gRNA sequence
gagggcccctctttgcacct

SEQ ID NO: 512469 - DNA, 20 bp, Artificial
  CRISPR gRNA sequence
agggcccctctttgcacctg

SEQ ID NO: 512470 - DNA, 20 bp, Artificial
  CRISPR gRNA sequence
gggcccctctttgcacctgg

SEQ ID NO: 512471 - DNA, 20 bp, Artificial
  CRISPR gRNA sequence
cccctctttgcacctggggg

SEQ ID NO: 512472 - DNA, 20 bp, Artificial
  CRISPR gRNA sequence
ctctttgcacctgggggtgg

SEQ ID NO: 512473 - DNA, 20 bp, Artificial
  CRISPR gRNA sequence
cctgggggtggtggcgaatg

SEQ ID NO: 512474 - DNA, 20 bp, Artificial
  CRISPR gRNA sequence
ctgggggtggtggcgaatgc

SEQ ID NO: 512475 - DNA, 20 bp, Artificial
  CRISPR gRNA sequence
tgggggtggtggcgaatgcg

SEQ ID NO: 512476 - DNA, 20 bp, Artificial
  CRISPR gRNA sequence
gcgaatgcggggtctcctcc

SEQ ID NO: 512477 - DNA, 20 bp, Artificial
  CRISPR gRNA sequence
gaatgcggggtctcctcctg

SEQ ID NO: 512478 - DNA, 20 bp, Artificial
  CRISPR gRNA sequence
aatgcggggtctcctcctgg

SEQ ID NO: 512479 - DNA, 20 bp, Artificial
  CRISPR gRNA sequence
aggctgcctccctgtctttt

SEQ ID NO: 512480 - DNA, 20 bp, Artificial
  CRISPR gRNA sequence
ggctgcctccctgtcttttt

SEQ ID NO: 512481 - DNA, 20 bp, Artificial
  CRISPR gRNA sequence
cttcctgctctactccccct

SEQ ID NO: 512482 - DNA, 20 bp, Artificial
  CRISPR gRNA sequence
ttcctgctctactccccctt

SEQ ID NO: 512483 - DNA, 20 bp, Artificial
  CRISPR gRNA sequence
gctctactcccccttgggtg

SEQ ID NO: 512484 - DNA, 20 bp, Artificial
  CRISPR gRNA sequence
ctctactcccccttgggtgt

SEQ ID NO: 512485 - DNA, 20 bp, Artificial
  CRISPR gRNA sequence
tactcccccttgggtgtggg

SEQ ID NO: 512486 - DNA, 20 bp, Artificial
  CRISPR gRNA sequence
actcccccttgggtgtgggc

SEQ ID NO: 512487 - DNA, 20 bp, Artificial
  CRISPR gRNA sequence
ctcccccttgggtgtgggca

SEQ ID NO: 512488 - DNA, 20 bp, Artificial
  CRISPR gRNA sequence
ccccttgggtgtgggcaggg

SEQ ID NO: 512489 - DNA, 20 bp, Artificial
  CRISPR gRNA sequence
tgggtgtgggcagggcggcc

SEQ ID NO: 512490 - DNA, 20 bp, Artificial
  CRISPR gRNA sequence
ggtgtgggcagggcggccca

SEQ ID NO: 512491 - DNA, 20 bp, Artificial
  CRISPR gRNA sequence
ggcccagagcacccactcac

SEQ ID NO: 512492 - DNA, 20 bp, Artificial
  CRISPR gRNA sequence
cagagcacccactcaccagc

SEQ ID NO: 512493 - DNA, 20 bp, Artificial
  CRISPR gRNA sequence
caccagccggcctcgtccct

SEQ ID NO: 512494 - DNA, 20 bp, Artificial
  CRISPR gRNA sequence
ctcgtccctcagtcctctct

SEQ ID NO: 512495 - DNA, 20 bp, Artificial
  CRISPR gRNA sequence
tcgtccctcagtcctctctc

SEQ ID NO: 512496 - DNA, 20 bp, Artificial
  CRISPR gRNA sequence
gtccctcagtcctctctcag

SEQ ID NO: 512497 - DNA, 20 bp, Artificial
  CRISPR gRNA sequence
tcctctctcaggagtgcacg

SEQ ID NO: 512498 - DNA, 20 bp, Artificial
  CRISPR gRNA sequence
ctcaggagtgcacgaagttc

SEQ ID NO: 512499 - DNA, 20 bp, Artificial
  CRISPR gRNA sequence
tcaggagtgcacgaagttca

SEQ ID NO: 512500 - DNA, 20 bp, Artificial
  CRISPR gRNA sequence
gagtgcacgaagttcaaggt

SEQ ID NO: 512501 - DNA, 20 bp, Artificial
  CRISPR gRNA sequence
tgcacgaagttcaaggtcag

SEQ ID NO: 512502 - DNA, 20 bp, Artificial
  CRISPR gRNA sequence
agttcaaggtcagcagctgc

SEQ ID NO: 512503 - DNA, 20 bp, Artificial
  CRISPR gRNA sequence
gttcaaggtcagcagctgcc

SEQ ID NO: 512504 - DNA, 20 bp, Artificial
  CRISPR gRNA sequence
gcagctgccgggaatgcatc

SEQ ID NO: 512505 - DNA, 20 bp, Artificial
  CRISPR gRNA sequence
ctgccgggaatgcatcgagt

SEQ ID NO: 512506 - DNA, 20 bp, Artificial
  CRISPR gRNA sequence
tgccgggaatgcatcgagtc

SEQ ID NO: 512507 - DNA, 20 bp, Artificial
  CRISPR gRNA sequence
gccgggaatgcatcgagtcg

SEQ ID NO: 512508 - DNA, 20 bp, Artificial
  CRISPR gRNA sequence
gaatgcatcgagtcggggcc

SEQ ID NO: 512509 - DNA, 20 bp, Artificial
  CRISPR gRNA sequence
agtcggggcccggctgcacc

SEQ ID NO: 512510 - DNA, 20 bp, Artificial
  CRISPR gRNA sequence
ggcccggctgcacctggtgc

SEQ ID NO: 512511 - DNA, 20 bp, Artificial
  CRISPR gRNA sequence
ccggctgcacctggtgccag

SEQ ID NO: 512512 - DNA, 20 bp, Artificial
  CRISPR gRNA sequence
ctgcacctggtgccagaagc

SEQ ID NO: 512513 - DNA, 20 bp, Artificial
  CRISPR gRNA sequence
acctggtgccagaagctggt

SEQ ID NO: 512514 - DNA, 20 bp, Artificial
  CRISPR gRNA sequence
agaagctggtaagtgcctcc

SEQ ID NO: 512515 - DNA, 20 bp, Artificial
  CRISPR gRNA sequence
tggacccctccccacctgcc

SEQ ID NO: 512516 - DNA, 20 bp, Artificial
  CRISPR gRNA sequence
ctccccacctgcccagctcc

SEQ ID NO: 512517 - DNA, 20 bp, Artificial
  CRISPR gRNA sequence
tccccacctgcccagctcct

SEQ ID NO: 512518 - DNA, 20 bp, Artificial
  CRISPR gRNA sequence
cacctgcccagctcctgggt

SEQ ID NO: 512519 - DNA, 20 bp, Artificial
  CRISPR gRNA sequence
acctgcccagctcctgggtg

SEQ ID NO: 512520 - DNA, 20 bp, Artificial
  CRISPR gRNA sequence
cctgcccagctcctgggtga

SEQ ID NO: 512521 - DNA, 20 bp, Artificial
  CRISPR gRNA sequence
agggccctttcctgcccctg

SEQ ID NO: 512522 - DNA, 20 bp, Artificial
  CRISPR gRNA sequence
ccctttcctgcccctgaagc

SEQ ID NO: 512523 - DNA, 20 bp, Artificial
  CRISPR gRNA sequence
tttcctgcccctgaagccag

SEQ ID NO: 512524 - DNA, 20 bp, Artificial
  CRISPR gRNA sequence
cccctgaagccagtggcacc

SEQ ID NO: 512525 - DNA, 20 bp, Artificial
  CRISPR gRNA sequence
cctgaagccagtggcaccca

SEQ ID NO: 512526 - DNA, 20 bp, Artificial
  CRISPR gRNA sequence
ctgaagccagtggcacccag

SEQ ID NO: 512527 - DNA, 20 bp, Artificial
  CRISPR gRNA sequence
aacaactccattttcttttt

SEQ ID NO: 512528 - DNA, 20 bp, Artificial
  CRISPR gRNA sequence
acaactccattttctttttg

SEQ ID NO: 512529 - DNA, 20 bp, Artificial
  CRISPR gRNA sequence
caactccattttctttttga

SEQ ID NO: 512530 - DNA, 20 bp, Artificial
  CRISPR gRNA sequence
aactccattttctttttgag

SEQ ID NO: 512531 - DNA, 20 bp, Artificial
  CRISPR gRNA sequence
actccattttctttttgagg

SEQ ID NO: 512532 - DNA, 20 bp, Artificial
  CRISPR gRNA sequence
tttctttttgagggggtccc

SEQ ID NO: 512533 - DNA, 20 bp, Artificial
  CRISPR gRNA sequence
ttgagggggtccccagaccc

SEQ ID NO: 512534 - DNA, 20 bp, Artificial
  CRISPR gRNA sequence
cctggcctcaccctcccctc

SEQ ID NO: 512535 - DNA, 20 bp, Artificial
  CRISPR gRNA sequence
ctggcctcaccctcccctca

SEQ ID NO: 512536 - DNA, 20 bp, Artificial
  CRISPR gRNA sequence
tggcctcaccctcccctcaa

SEQ ID NO: 512537 - DNA, 20 bp, Artificial
  CRISPR gRNA sequence
ggcctcaccctcccctcaag

SEQ ID NO: 512538 - DNA, 20 bp, Artificial
  CRISPR gRNA sequence
cctcccctcaaggggcccct

SEQ ID NO: 512539 - DNA, 20 bp, Artificial
  CRISPR gRNA sequence
ctcccctcaaggggcccctg

SEQ ID NO: 512540 - DNA, 20 bp, Artificial
  CRISPR gRNA sequence
gcccctgaggttctgatgtg

SEQ ID NO: 512541 - DNA, 20 bp, Artificial
  CRISPR gRNA sequence
gttctgatgtgtggtctgtt

SEQ ID NO: 512542 - DNA, 20 bp, Artificial
  CRISPR gRNA sequence
ggtctgtttggaaacacaca

SEQ ID NO: 512543 - DNA, 20 bp, Artificial
  CRISPR gRNA sequence
cacacacttgtattttttct

SEQ ID NO: 512544 - DNA, 20 bp, Artificial
  CRISPR gRNA sequence
attttttctcagccatttcc

SEQ ID NO: 512545 - DNA, 20 bp, Artificial
  CRISPR gRNA sequence
ttttctcagccatttccgag

SEQ ID NO: 512546 - DNA, 20 bp, Artificial
  CRISPR gRNA sequence
tttctcagccatttccgagt

SEQ ID NO: 512547 - DNA, 20 bp, Artificial
  CRISPR gRNA sequence
agccatttccgagtaggttg

SEQ ID NO: 512548 - DNA, 20 bp, Artificial
  CRISPR gRNA sequence
ttccgagtaggttgtagaca

SEQ ID NO: 512549 - DNA, 20 bp, Artificial
  CRISPR gRNA sequence
ccgagtaggttgtagacatg

SEQ ID NO: 512550 - DNA, 20 bp, Artificial
  CRISPR gRNA sequence
acatggagccctttgtctct

SEQ ID NO: 512551 - DNA, 20 bp, Artificial
  CRISPR gRNA sequence
cctttgtctcttagtacttc

SEQ ID NO: 512552 - DNA, 20 bp, Artificial
  CRISPR gRNA sequence
ctttgtctcttagtacttca

SEQ ID NO: 512553 - DNA, 20 bp, Artificial
  CRISPR gRNA sequence
tttgtctcttagtacttcaa

SEQ ID NO: 512554 - DNA, 20 bp, Artificial
  CRISPR gRNA sequence
tgtctcttagtacttcaagg

SEQ ID NO: 512555 - DNA, 20 bp, Artificial
  CRISPR gRNA sequence
gtctcttagtacttcaaggg

SEQ ID NO: 512556 - DNA, 20 bp, Artificial
  CRISPR gRNA sequence
cttcaagggaggtctttctt

SEQ ID NO: 512557 - DNA, 20 bp, Artificial
  CRISPR gRNA sequence
gggaggtctttcttaagaac

SEQ ID NO: 512558 - DNA, 20 bp, Artificial
  CRISPR gRNA sequence
ggaggtctttcttaagaaca

SEQ ID NO: 512559 - DNA, 20 bp, Artificial
  CRISPR gRNA sequence
tttcacttacaaaactacgt

SEQ ID NO: 512560 - DNA, 20 bp, Artificial
  CRISPR gRNA sequence
acttacaaaactacgtaagc

SEQ ID NO: 512561 - DNA, 20 bp, Artificial
  CRISPR gRNA sequence
caaaactacgtaagcaagtg

SEQ ID NO: 512562 - DNA, 20 bp, Artificial
  CRISPR gRNA sequence
tgcagaaacacgcgcgcttc

SEQ ID NO: 512563 - DNA, 20 bp, Artificial
  CRISPR gRNA sequence
cgcttctggccccgcatcgc

SEQ ID NO: 512564 - DNA, 20 bp, Artificial
  CRISPR gRNA sequence
atcgccagcacgctttcctg

SEQ ID NO: 512565 - DNA, 20 bp, Artificial
  CRISPR gRNA sequence
cgccagcacgctttcctgca

SEQ ID NO: 512566 - DNA, 20 bp, Artificial
  CRISPR gRNA sequence
agcacgctttcctgcagagt

SEQ ID NO: 512567 - DNA, 20 bp, Artificial
  CRISPR gRNA sequence
acgctttcctgcagagtcag

SEQ ID NO: 512568 - DNA, 20 bp, Artificial
  CRISPR gRNA sequence
cgctttcctgcagagtcagc

SEQ ID NO: 512569 - DNA, 20 bp, Artificial
  CRISPR gRNA sequence
tcctgcagagtcagcaggtt

SEQ ID NO: 512570 - DNA, 20 bp, Artificial
  CRISPR gRNA sequence
cctgcagagtcagcaggttt

SEQ ID NO: 512571 - DNA, 20 bp, Artificial
  CRISPR gRNA sequence
ctgcagagtcagcaggtttg

SEQ ID NO: 512572 - DNA, 20 bp, Artificial
  CRISPR gRNA sequence
agagtcagcaggtttggggc

SEQ ID NO: 512573 - DNA, 20 bp, Artificial
  CRISPR gRNA sequence
agcaggtttggggccagtga

SEQ ID NO: 512574 - DNA, 20 bp, Artificial
  CRISPR gRNA sequence
gcaggtttggggccagtgac

SEQ ID NO: 512575 - DNA, 20 bp, Artificial
  CRISPR gRNA sequence
gtgacgggacccaccaaaca

SEQ ID NO: 512576 - DNA, 20 bp, Artificial
  CRISPR gRNA sequence
ccaccaaacacagcccttat

SEQ ID NO: 512577 - DNA, 20 bp, Artificial
  CRISPR gRNA sequence
acacagcccttatcagaatc

SEQ ID NO: 512578 - DNA, 20 bp, Artificial
  CRISPR gRNA sequence
cacagcccttatcagaatcc

SEQ ID NO: 512579 - DNA, 20 bp, Artificial
  CRISPR gRNA sequence
acagcccttatcagaatcca

SEQ ID NO: 512580 - DNA, 20 bp, Artificial
  CRISPR gRNA sequence
cagcccttatcagaatccag

SEQ ID NO: 512581 - DNA, 20 bp, Artificial
  CRISPR gRNA sequence
atcagaatccaggggctttg

SEQ ID NO: 512582 - DNA, 20 bp, Artificial
  CRISPR gRNA sequence
tcagaatccaggggctttgc

SEQ ID NO: 512583 - DNA, 20 bp, Artificial
  CRISPR gRNA sequence
cagaatccaggggctttgca

SEQ ID NO: 512584 - DNA, 20 bp, Artificial
  CRISPR gRNA sequence
tccaggggctttgcagggac

SEQ ID NO: 512585 - DNA, 20 bp, Artificial
  CRISPR gRNA sequence
ccaggggctttgcagggaca

SEQ ID NO: 512586 - DNA, 20 bp, Artificial
  CRISPR gRNA sequence
ggggctttgcagggacaagg

SEQ ID NO: 512587 - DNA, 20 bp, Artificial
  CRISPR gRNA sequence
tttgcagggacaaggtggcc

SEQ ID NO: 512588 - DNA, 20 bp, Artificial
  CRISPR gRNA sequence
tgcagggacaaggtggccaa

SEQ ID NO: 512589 - DNA, 20 bp, Artificial
  CRISPR gRNA sequence
gcagggacaaggtggccaag

SEQ ID NO: 512590 - DNA, 20 bp, Artificial
  CRISPR gRNA sequence
ataaattcatgtatcaaatt

SEQ ID NO: 512591 - DNA, 20 bp, Artificial
  CRISPR gRNA sequence
taaattcatgtatcaaattc

SEQ ID NO: 512592 - DNA, 20 bp, Artificial
  CRISPR gRNA sequence
tgtatcaaattcaggaaatt

SEQ ID NO: 512593 - DNA, 20 bp, Artificial
  CRISPR gRNA sequence
aaattcaggaaattcagcat

SEQ ID NO: 512594 - DNA, 20 bp, Artificial
  CRISPR gRNA sequence
acacactacgcatattttat

SEQ ID NO: 512595 - DNA, 20 bp, Artificial
  CRISPR gRNA sequence
tgtcccaatgatgtcttcgt

SEQ ID NO: 512596 - DNA, 20 bp, Artificial
  CRISPR gRNA sequence
tcttcgtgagcatattttcc

SEQ ID NO: 512597 - DNA, 20 bp, Artificial
  CRISPR gRNA sequence
tcgtgagcatattttcctgg

SEQ ID NO: 512598 - DNA, 20 bp, Artificial
  CRISPR gRNA sequence
tcctggtggattttgtcacc

SEQ ID NO: 512599 - DNA, 20 bp, Artificial
  CRISPR gRNA sequence
cctggtggattttgtcaccc

SEQ ID NO: 512600 - DNA, 20 bp, Artificial
  CRISPR gRNA sequence
acccaggctcaccctgtgct

SEQ ID NO: 512601 - DNA, 20 bp, Artificial
  CRISPR gRNA sequence
caccctgtgctcagctgtct

SEQ ID NO: 512602 - DNA, 20 bp, Artificial
  CRISPR gRNA sequence
accctgtgctcagctgtctc

SEQ ID NO: 512603 - DNA, 20 bp, Artificial
  CRISPR gRNA sequence
gtgctcagctgtctcaggct

SEQ ID NO: 512604 - DNA, 20 bp, Artificial
  CRISPR gRNA sequence
aggctcagaatctcctcact

SEQ ID NO: 512605 - DNA, 20 bp, Artificial
  CRISPR gRNA sequence
ggctcagaatctcctcactc

SEQ ID NO: 512606 - DNA, 20 bp, Artificial
  CRISPR gRNA sequence
actcaggctcaccctgcact

SEQ ID NO: 512607 - DNA, 20 bp, Artificial
  CRISPR gRNA sequence
caccctgcactcagccatct

SEQ ID NO: 512608 - DNA, 20 bp, Artificial
  CRISPR gRNA sequence
accctgcactcagccatctc

SEQ ID NO: 512609 - DNA, 20 bp, Artificial
  CRISPR gRNA sequence
aggccccaaatctcctaacc

SEQ ID NO: 512610 - DNA, 20 bp, Artificial
  CRISPR gRNA sequence
ggccccaaatctcctaaccc

SEQ ID NO: 512611 - DNA, 20 bp, Artificial
  CRISPR gRNA sequence
ccaggttcacacactgcgct

SEQ ID NO: 512612 - DNA, 20 bp, Artificial
  CRISPR gRNA sequence
acgctctgaatctcctcacc

SEQ ID NO: 512613 - DNA, 20 bp, Artificial
  CRISPR gRNA sequence
cgctctgaatctcctcaccc

SEQ ID NO: 512614 - DNA, 20 bp, Artificial
  CRISPR gRNA sequence
acccaggctcgccctacgct

SEQ ID NO: 512615 - DNA, 20 bp, Artificial
  CRISPR gRNA sequence
cctacgctcagccgtctcct

SEQ ID NO: 512616 - DNA, 20 bp, Artificial
  CRISPR gRNA sequence
ctacgctcagccgtctcctt

SEQ ID NO: 512617 - DNA, 20 bp, Artificial
  CRISPR gRNA sequence
ctccttgggcttcttgaatc

SEQ ID NO: 512618 - DNA, 20 bp, Artificial
  CRISPR gRNA sequence
tgggcttcttgaatctggac

SEQ ID NO: 512619 - DNA, 20 bp, Artificial
  CRISPR gRNA sequence
cttgaatctggacaagtcct

SEQ ID NO: 512620 - DNA, 20 bp, Artificial
  CRISPR gRNA sequence
ttctttgtctttcctgtcct

SEQ ID NO: 512621 - DNA, 20 bp, Artificial
  CRISPR gRNA sequence
tctttgtctttcctgtcctt

SEQ ID NO: 512622 - DNA, 20 bp, Artificial
  CRISPR gRNA sequence
tcctgtccttgggcgtttct

SEQ ID NO: 512623 - DNA, 20 bp, Artificial
  CRISPR gRNA sequence
cctgtccttgggcgtttctg

SEQ ID NO: 512624 - DNA, 20 bp, Artificial
  CRISPR gRNA sequence
gtccttgggcgtttctgagg

SEQ ID NO: 512625 - DNA, 20 bp, Artificial
  CRISPR gRNA sequence
ttgggcgtttctgaggaagt

SEQ ID NO: 512626 - DNA, 20 bp, Artificial
  CRISPR gRNA sequence
tgggcgtttctgaggaagtc

SEQ ID NO: 512627 - DNA, 20 bp, Artificial
  CRISPR gRNA sequence
ggcgtttctgaggaagtcag

SEQ ID NO: 512628 - DNA, 20 bp, Artificial
  CRISPR gRNA sequence
cgtttctgaggaagtcagga

SEQ ID NO: 512629 - DNA, 20 bp, Artificial
  CRISPR gRNA sequence
ttctgaggaagtcaggagag

SEQ ID NO: 512630 - DNA, 20 bp, Artificial
  CRISPR gRNA sequence
aagtcaggagagcagctttg

SEQ ID NO: 512631 - DNA, 20 bp, Artificial
  CRISPR gRNA sequence
cagctttgtagcatgaccct

SEQ ID NO: 512632 - DNA, 20 bp, Artificial
  CRISPR gRNA sequence
agctttgtagcatgaccctc

SEQ ID NO: 512633 - DNA, 20 bp, Artificial
  CRISPR gRNA sequence
gctttgtagcatgaccctcg

SEQ ID NO: 512634 - DNA, 20 bp, Artificial
  CRISPR gRNA sequence
ctttgtagcatgaccctcgg

SEQ ID NO: 512635 - DNA, 20 bp, Artificial
  CRISPR gRNA sequence
tgaccctcgggggtcttgtc

SEQ ID NO: 512636 - DNA, 20 bp, Artificial
  CRISPR gRNA sequence
accctcgggggtcttgtctg

SEQ ID NO: 512637 - DNA, 20 bp, Artificial
  CRISPR gRNA sequence
tgtctggagtttcctctgcc

SEQ ID NO: 512638 - DNA, 20 bp, Artificial
  CRISPR gRNA sequence
gagtttcctctgcctggact

SEQ ID NO: 512639 - DNA, 20 bp, Artificial
  CRISPR gRNA sequence
agtttcctctgcctggactc

SEQ ID NO: 512640 - DNA, 20 bp, Artificial
  CRISPR gRNA sequence
gcctggactcaggtgtgctt

SEQ ID NO: 512641 - DNA, 20 bp, Artificial
  CRISPR gRNA sequence
tggactcaggtgtgctttgg

SEQ ID NO: 512642 - DNA, 20 bp, Artificial
  CRISPR gRNA sequence
ggactcaggtgtgctttggc

SEQ ID NO: 512643 - DNA, 20 bp, Artificial
  CRISPR gRNA sequence
actcaggtgtgctttggcag

SEQ ID NO: 512644 - DNA, 20 bp, Artificial
  CRISPR gRNA sequence
gtgctttggcaggagcccct

SEQ ID NO: 512645 - DNA, 20 bp, Artificial
  CRISPR gRNA sequence
tggcaggagcccctcagtga

SEQ ID NO: 512646 - DNA, 20 bp, Artificial
  CRISPR gRNA sequence
cccctcagtgacggtgtcct

SEQ ID NO: 512647 - DNA, 20 bp, Artificial
  CRISPR gRNA sequence
acggtgtcctaagtgcccat

SEQ ID NO: 512648 - DNA, 20 bp, Artificial
  CRISPR gRNA sequence
ggtgtcctaagtgcccatga

SEQ ID NO: 512649 - DNA, 20 bp, Artificial
  CRISPR gRNA sequence
gtgtcctaagtgcccatgag

SEQ ID NO: 512650 - DNA, 20 bp, Artificial
  CRISPR gRNA sequence
gcccatgagaggcactgctg

SEQ ID NO: 512651 - DNA, 20 bp, Artificial
  CRISPR gRNA sequence
gcactgctgtggccccgtcc

SEQ ID NO: 512652 - DNA, 20 bp, Artificial
  CRISPR gRNA sequence
ggccccgtcccagtcttgat

SEQ ID NO: 512653 - DNA, 20 bp, Artificial
  CRISPR gRNA sequence
gccccgtcccagtcttgatg

SEQ ID NO: 512654 - DNA, 20 bp, Artificial
  CRISPR gRNA sequence
cgtcccagtcttgatgaggt

SEQ ID NO: 512655 - DNA, 20 bp, Artificial
  CRISPR gRNA sequence
cagtcttgatgaggtcagcg

SEQ ID NO: 512656 - DNA, 20 bp, Artificial
  CRISPR gRNA sequence
cttgatgaggtcagcgtgga

SEQ ID NO: 512657 - DNA, 20 bp, Artificial
  CRISPR gRNA sequence
tcagcgtggacggctctgct

SEQ ID NO: 512658 - DNA, 20 bp, Artificial
  CRISPR gRNA sequence
cgtggacggctctgctgaga

SEQ ID NO: 512659 - DNA, 20 bp, Artificial
  CRISPR gRNA sequence
ctgctgagacggcatccccc

SEQ ID NO: 512660 - DNA, 20 bp, Artificial
  CRISPR gRNA sequence
cccgctgcatgatcccctcg

SEQ ID NO: 512661 - DNA, 20 bp, Artificial
  CRISPR gRNA sequence
tgatcccctcgcagccactg

SEQ ID NO: 512662 - DNA, 20 bp, Artificial
  CRISPR gRNA sequence
gatcccctcgcagccactgt

SEQ ID NO: 512663 - DNA, 20 bp, Artificial
  CRISPR gRNA sequence
ccctcgcagccactgtgggc

SEQ ID NO: 512664 - DNA, 20 bp, Artificial
  CRISPR gRNA sequence
cgcagccactgtgggctggt

SEQ ID NO: 512665 - DNA, 20 bp, Artificial
  CRISPR gRNA sequence
gcagccactgtgggctggtg

SEQ ID NO: 512666 - DNA, 20 bp, Artificial
  CRISPR gRNA sequence
ccctcatcaaatcgcacccg

SEQ ID NO: 512667 - DNA, 20 bp, Artificial
  CRISPR gRNA sequence
cctcatcaaatcgcacccgc

SEQ ID NO: 512668 - DNA, 20 bp, Artificial
  CRISPR gRNA sequence
tcaaatcgcacccgcaggct

SEQ ID NO: 512669 - DNA, 20 bp, Artificial
  CRISPR gRNA sequence
acccgcaggctcagcatccg

SEQ ID NO: 512670 - DNA, 20 bp, Artificial
  CRISPR gRNA sequence
ccgcaggctcagcatccgcg

SEQ ID NO: 512671 - DNA, 20 bp, Artificial
  CRISPR gRNA sequence
cgcaggctcagcatccgcgg

SEQ ID NO: 512672 - DNA, 20 bp, Artificial
  CRISPR gRNA sequence
tccgcggaggtccccgcctg

SEQ ID NO: 512673 - DNA, 20 bp, Artificial
  CRISPR gRNA sequence
tgaagccgccatcactgcga

SEQ ID NO: 512674 - DNA, 20 bp, Artificial
  CRISPR gRNA sequence
cgccatcactgcgatggctg

SEQ ID NO: 512675 - DNA, 20 bp, Artificial
  CRISPR gRNA sequence
tcactgcgatggctgcagat

SEQ ID NO: 512676 - DNA, 20 bp, Artificial
  CRISPR gRNA sequence
gctgcagattggtgccgtgc

SEQ ID NO: 512677 - DNA, 20 bp, Artificial
  CRISPR gRNA sequence
tggtccccgcctgccactca

SEQ ID NO: 512678 - DNA, 20 bp, Artificial
  CRISPR gRNA sequence
ccactcacggctgccaacct

SEQ ID NO: 512679 - DNA, 20 bp, Artificial
  CRISPR gRNA sequence
cactcacggctgccaaccta

SEQ ID NO: 512680 - DNA, 20 bp, Artificial
  CRISPR gRNA sequence
tcacggctgccaacctaagg

SEQ ID NO: 512681 - DNA, 20 bp, Artificial
  CRISPR gRNA sequence
cacggctgccaacctaagga

SEQ ID NO: 512682 - DNA, 20 bp, Artificial
  CRISPR gRNA sequence
acggctgccaacctaaggaa

SEQ ID NO: 512683 - DNA, 20 bp, Artificial
  CRISPR gRNA sequence
gaagggtctctccttctctg

SEQ ID NO: 512684 - DNA, 20 bp, Artificial
  CRISPR gRNA sequence
ctctgcagcctctctctcat

SEQ ID NO: 512685 - DNA, 20 bp, Artificial
  CRISPR gRNA sequence
tctctcatcagcgtgaccca

SEQ ID NO: 512686 - DNA, 20 bp, Artificial
  CRISPR gRNA sequence
acccacagttttattttgtt

SEQ ID NO: 512687 - DNA, 20 bp, Artificial
  CRISPR gRNA sequence
cacagttttattttgttcag

SEQ ID NO: 512688 - DNA, 20 bp, Artificial
  CRISPR gRNA sequence
gttcagtagtgcatgatctg

SEQ ID NO: 512689 - DNA, 20 bp, Artificial
  CRISPR gRNA sequence
gtggctgtcctttcttcccc

SEQ ID NO: 512690 - DNA, 20 bp, Artificial
  CRISPR gRNA sequence
cccgagttgctcaaatccgc

SEQ ID NO: 512691 - DNA, 20 bp, Artificial
  CRISPR gRNA sequence
ccgagttgctcaaatccgct

SEQ ID NO: 512692 - DNA, 20 bp, Artificial
  CRISPR gRNA sequence
ttgctcaaatccgctgggtc

SEQ ID NO: 512693 - DNA, 20 bp, Artificial
  CRISPR gRNA sequence
catccccgttctaccgttct

SEQ ID NO: 512694 - DNA, 20 bp, Artificial
  CRISPR gRNA sequence
ctgagcactttcttgctttc

SEQ ID NO: 512695 - DNA, 20 bp, Artificial
  CRISPR gRNA sequence
gagcactttcttgctttctg

SEQ ID NO: 512696 - DNA, 20 bp, Artificial
  CRISPR gRNA sequence
tctggagcaacatgatgctg

SEQ ID NO: 512697 - DNA, 20 bp, Artificial
  CRISPR gRNA sequence
ctggagcaacatgatgctgc

SEQ ID NO: 512698 - DNA, 20 bp, Artificial
  CRISPR gRNA sequence
catctccatgtcccttgccc

SEQ ID NO: 512699 - DNA, 20 bp, Artificial
  CRISPR gRNA sequence
ccatgtcccttgccccagcc

SEQ ID NO: 512700 - DNA, 20 bp, Artificial
  CRISPR gRNA sequence
cccttgccccagcctggaat

SEQ ID NO: 512701 - DNA, 20 bp, Artificial
  CRISPR gRNA sequence
tgccccagcctggaatcaga

SEQ ID NO: 512702 - DNA, 20 bp, Artificial
  CRISPR gRNA sequence
ggaatcagatggttttctga

SEQ ID NO: 512703 - DNA, 20 bp, Artificial
  CRISPR gRNA sequence
cagatggttttctgacggct

SEQ ID NO: 512704 - DNA, 20 bp, Artificial
  CRISPR gRNA sequence
agatggttttctgacggctc

SEQ ID NO: 512705 - DNA, 20 bp, Artificial
  CRISPR gRNA sequence
cggctcgggttcctttccct

SEQ ID NO: 512706 - DNA, 20 bp, Artificial
  CRISPR gRNA sequence
gctcgggttcctttccctga

SEQ ID NO: 512707 - DNA, 20 bp, Artificial
  CRISPR gRNA sequence
ggttcctttccctgagagtc

SEQ ID NO: 512708 - DNA, 20 bp, Artificial
  CRISPR gRNA sequence
gttcctttccctgagagtct

SEQ ID NO: 512709 - DNA, 20 bp, Artificial
  CRISPR gRNA sequence
ttccctgagagtctgggctc

SEQ ID NO: 512710 - DNA, 20 bp, Artificial
  CRISPR gRNA sequence
tctgggctccagcaccgttg

SEQ ID NO: 512711 - DNA, 20 bp, Artificial
  CRISPR gRNA sequence
ggctccagcaccgttgtagc

SEQ ID NO: 512712 - DNA, 20 bp, Artificial
  CRISPR gRNA sequence
cagcaccgttgtagccggac

SEQ ID NO: 512713 - DNA, 20 bp, Artificial
  CRISPR gRNA sequence
cgttgtagccggacaagccg

SEQ ID NO: 512714 - DNA, 20 bp, Artificial
  CRISPR gRNA sequence
gtagccggacaagccgcaga

SEQ ID NO: 512715 - DNA, 20 bp, Artificial
  CRISPR gRNA sequence
aagccgcagacagaattcct

SEQ ID NO: 512716 - DNA, 20 bp, Artificial
  CRISPR gRNA sequence
gacagaattcctcagacact

SEQ ID NO: 512717 - DNA, 20 bp, Artificial
  CRISPR gRNA sequence
attcctcagacactcggtta

SEQ ID NO: 512718 - DNA, 20 bp, Artificial
  CRISPR gRNA sequence
cctcagacactcggttaaag

SEQ ID NO: 512719 - DNA, 20 bp, Artificial
  CRISPR gRNA sequence
ctcagacactcggttaaaga

SEQ ID NO: 512720 - DNA, 20 bp, Artificial
  CRISPR gRNA sequence
agacactcggttaaagaagg

SEQ ID NO: 512721 - DNA, 20 bp, Artificial
  CRISPR gRNA sequence
gacactcggttaaagaagga

SEQ ID NO: 512722 - DNA, 20 bp, Artificial
  CRISPR gRNA sequence
acactcggttaaagaaggaa

SEQ ID NO: 512723 - DNA, 20 bp, Artificial
  CRISPR gRNA sequence
aaagaaggaagggctttatt

SEQ ID NO: 512724 - DNA, 20 bp, Artificial
  CRISPR gRNA sequence
aaggaagggctttatttggc

SEQ ID NO: 512725 - DNA, 20 bp, Artificial
  CRISPR gRNA sequence
aggaagggctttatttggcc

SEQ ID NO: 512726 - DNA, 20 bp, Artificial
  CRISPR gRNA sequence
gaagggctttatttggccag

SEQ ID NO: 512727 - DNA, 20 bp, Artificial
  CRISPR gRNA sequence
ctttatttggccaggagtgt

SEQ ID NO: 512728 - DNA, 20 bp, Artificial
  CRISPR gRNA sequence
tatttggccaggagtgtcag

SEQ ID NO: 512729 - DNA, 20 bp, Artificial
  CRISPR gRNA sequence
tgtcagcagacttgcgtctt

SEQ ID NO: 512730 - DNA, 20 bp, Artificial
  CRISPR gRNA sequence
tcagcagacttgcgtcttaa

SEQ ID NO: 512731 - DNA, 20 bp, Artificial
  CRISPR gRNA sequence
agacttgcgtcttaagagcc

SEQ ID NO: 512732 - DNA, 20 bp, Artificial
  CRISPR gRNA sequence
aagagccgagctccccgaaa

SEQ ID NO: 512733 - DNA, 20 bp, Artificial
  CRISPR gRNA sequence
ctccccgaaaaagaaattcc

SEQ ID NO: 512734 - DNA, 20 bp, Artificial
  CRISPR gRNA sequence
aagaaattcctagccctttt

SEQ ID NO: 512735 - DNA, 20 bp, Artificial
  CRISPR gRNA sequence
agaaattcctagccctttta

SEQ ID NO: 512736 - DNA, 20 bp, Artificial
  CRISPR gRNA sequence
gaaattcctagcccttttaa

SEQ ID NO: 512737 - DNA, 20 bp, Artificial
  CRISPR gRNA sequence
ttttaagggcttacaactct

SEQ ID NO: 512738 - DNA, 20 bp, Artificial
  CRISPR gRNA sequence
tttaagggcttacaactcta

SEQ ID NO: 512739 - DNA, 20 bp, Artificial
  CRISPR gRNA sequence
ttaagggcttacaactctaa

SEQ ID NO: 512740 - DNA, 20 bp, Artificial
  CRISPR gRNA sequence
taagggcttacaactctaag

SEQ ID NO: 512741 - DNA, 20 bp, Artificial
  CRISPR gRNA sequence
actctaaggggtccacatga

SEQ ID NO: 512742 - DNA, 20 bp, Artificial
  CRISPR gRNA sequence
ctctaaggggtccacatgaa

SEQ ID NO: 512743 - DNA, 20 bp, Artificial
  CRISPR gRNA sequence
tctaaggggtccacatgaaa

SEQ ID NO: 512744 - DNA, 20 bp, Artificial
  CRISPR gRNA sequence
tccacatgaaagggttgtga

SEQ ID NO: 512745 - DNA, 20 bp, Artificial
  CRISPR gRNA sequence
catgaaagggttgtgataga

SEQ ID NO: 512746 - DNA, 20 bp, Artificial
  CRISPR gRNA sequence
tgaaagggttgtgatagata

SEQ ID NO: 512747 - DNA, 20 bp, Artificial
  CRISPR gRNA sequence
agggttgtgatagatagagc

SEQ ID NO: 512748 - DNA, 20 bp, Artificial
  CRISPR gRNA sequence
tgtgatagatagagcaagtg

SEQ ID NO: 512749 - DNA, 20 bp, Artificial
  CRISPR gRNA sequence
gtgatagatagagcaagtgt

SEQ ID NO: 512750 - DNA, 20 bp, Artificial
  CRISPR gRNA sequence
tgatagatagagcaagtgtg

SEQ ID NO: 512751 - DNA, 20 bp, Artificial
  CRISPR gRNA sequence
gcaagtgtggggaacttgac

SEQ ID NO: 512752 - DNA, 20 bp, Artificial
  CRISPR gRNA sequence
caagtgtggggaacttgact

SEQ ID NO: 512753 - DNA, 20 bp, Artificial
  CRISPR gRNA sequence
aagtgtggggaacttgactg

SEQ ID NO: 512754 - DNA, 20 bp, Artificial
  CRISPR gRNA sequence
agtgtggggaacttgactgg

SEQ ID NO: 512755 - DNA, 20 bp, Artificial
  CRISPR gRNA sequence
tgactgggggttacatgcat

SEQ ID NO: 512756 - DNA, 20 bp, Artificial
  CRISPR gRNA sequence
gggttacatgcatcagctga

SEQ ID NO: 512757 - DNA, 20 bp, Artificial
  CRISPR gRNA sequence
acatgcatcagctgacagaa

SEQ ID NO: 512758 - DNA, 20 bp, Artificial
  CRISPR gRNA sequence
gcatcagctgacagaacaga

SEQ ID NO: 512759 - DNA, 20 bp, Artificial
  CRISPR gRNA sequence
atgctttttcatacaatgtc

SEQ ID NO: 512760 - DNA, 20 bp, Artificial
  CRISPR gRNA sequence
catacaatgtctggaattta

SEQ ID NO: 512761 - DNA, 20 bp, Artificial
  CRISPR gRNA sequence
ctggaatttacagataacac

SEQ ID NO: 512762 - DNA, 20 bp, Artificial
  CRISPR gRNA sequence
gaatttacagataacaccag

SEQ ID NO: 512763 - DNA, 20 bp, Artificial
  CRISPR gRNA sequence
acagataacaccagtagttt

SEQ ID NO: 512764 - DNA, 20 bp, Artificial
  CRISPR gRNA sequence
ataacaccagtagttttggt

SEQ ID NO: 512765 - DNA, 20 bp, Artificial
  CRISPR gRNA sequence
taacaccagtagttttggtc

SEQ ID NO: 512766 - DNA, 20 bp, Artificial
  CRISPR gRNA sequence
aacaccagtagttttggtca

SEQ ID NO: 512767 - DNA, 20 bp, Artificial
  CRISPR gRNA sequence
acaccagtagttttggtcag

SEQ ID NO: 512768 - DNA, 20 bp, Artificial
  CRISPR gRNA sequence
aataataataataatattat

SEQ ID NO: 512769 - DNA, 20 bp, Artificial
  CRISPR gRNA sequence
aatattattagtttaaccac

SEQ ID NO: 512770 - DNA, 20 bp, Artificial
  CRISPR gRNA sequence
atattattagtttaaccacc

SEQ ID NO: 512771 - DNA, 20 bp, Artificial
  CRISPR gRNA sequence
tattattagtttaaccacca

SEQ ID NO: 512772 - DNA, 20 bp, Artificial
  CRISPR gRNA sequence
attagtttaaccaccagggc

SEQ ID NO: 512773 - DNA, 20 bp, Artificial
  CRISPR gRNA sequence
ttagtttaaccaccagggcc

SEQ ID NO: 512774 - DNA, 20 bp, Artificial
  CRISPR gRNA sequence
gtttaaccaccagggccggg

SEQ ID NO: 512775 - DNA, 20 bp, Artificial
  CRISPR gRNA sequence
taaccaccagggccgggtgg

SEQ ID NO: 512776 - DNA, 20 bp, Artificial
  CRISPR gRNA sequence
cagggccgggtggtggcgcc

SEQ ID NO: 512777 - DNA, 20 bp, Artificial
  CRISPR gRNA sequence
agggccgggtggtggcgcca

SEQ ID NO: 512778 - DNA, 20 bp, Artificial
  CRISPR gRNA sequence
gtggtggcgccaaggtcatc

SEQ ID NO: 512779 - DNA, 20 bp, Artificial
  CRISPR gRNA sequence
ttttctcctgtcttataaac

SEQ ID NO: 512780 - DNA, 20 bp, Artificial
  CRISPR gRNA sequence
ttctcctgtcttataaacta

SEQ ID NO: 512781 - DNA, 20 bp, Artificial
  CRISPR gRNA sequence
tcctgtcttataaactagag

SEQ ID NO: 512782 - DNA, 20 bp, Artificial
  CRISPR gRNA sequence
cctgtcttataaactagaga

SEQ ID NO: 512783 - DNA, 20 bp, Artificial
  CRISPR gRNA sequence
ctgtcttataaactagagaa

SEQ ID NO: 512784 - DNA, 20 bp, Artificial
  CRISPR gRNA sequence
tgtcttataaactagagaag

SEQ ID NO: 512785 - DNA, 20 bp, Artificial
  CRISPR gRNA sequence
tcttataaactagagaaggg

SEQ ID NO: 512786 - DNA, 20 bp, Artificial
  CRISPR gRNA sequence
cttataaactagagaagggg

SEQ ID NO: 512787 - DNA, 20 bp, Artificial
  CRISPR gRNA sequence
ttataaactagagaagggga

SEQ ID NO: 512788 - DNA, 20 bp, Artificial
  CRISPR gRNA sequence
tataaactagagaaggggag

SEQ ID NO: 512789 - DNA, 20 bp, Artificial
  CRISPR gRNA sequence
ataaactagagaaggggagg

SEQ ID NO: 512790 - DNA, 20 bp, Artificial
  CRISPR gRNA sequence
aactagagaaggggaggggg

SEQ ID NO: 512791 - DNA, 20 bp, Artificial
  CRISPR gRNA sequence
ctagagaaggggagggggtg

SEQ ID NO: 512792 - DNA, 20 bp, Artificial
  CRISPR gRNA sequence
gagaaggggagggggtggag

SEQ ID NO: 512793 - DNA, 20 bp, Artificial
  CRISPR gRNA sequence
aaggggagggggtggagaag

SEQ ID NO: 512794 - DNA, 20 bp, Artificial
  CRISPR gRNA sequence
aggggagggggtggagaaga

SEQ ID NO: 512795 - DNA, 20 bp, Artificial
  CRISPR gRNA sequence
ggggagggggtggagaagaa

SEQ ID NO: 512796 - DNA, 20 bp, Artificial
  CRISPR gRNA sequence
gggagggggtggagaagaag

SEQ ID NO: 512797 - DNA, 20 bp, Artificial
  CRISPR gRNA sequence
gagggggtggagaagaaggg

SEQ ID NO: 512798 - DNA, 20 bp, Artificial
  CRISPR gRNA sequence
agggggtggagaagaagggg

SEQ ID NO: 512799 - DNA, 20 bp, Artificial
  CRISPR gRNA sequence
gggggtggagaagaagggga

SEQ ID NO: 512800 - DNA, 20 bp, Artificial
  CRISPR gRNA sequence
ggtggagaagaaggggaggg

SEQ ID NO: 512801 - DNA, 20 bp, Artificial
  CRISPR gRNA sequence
ggagaagaaggggagggcag

SEQ ID NO: 512802 - DNA, 20 bp, Artificial
  CRISPR gRNA sequence
gagaagaaggggagggcagc

SEQ ID NO: 512803 - DNA, 20 bp, Artificial
  CRISPR gRNA sequence
gaagaaggggagggcagcag

SEQ ID NO: 512804 - DNA, 20 bp, Artificial
  CRISPR gRNA sequence
gaaggggagggcagcaggag

SEQ ID NO: 512805 - DNA, 20 bp, Artificial
  CRISPR gRNA sequence
ggggagggcagcaggagaag

SEQ ID NO: 512806 - DNA, 20 bp, Artificial
  CRISPR gRNA sequence
ggtgtctcattccttaccgt

SEQ ID NO: 512807 - DNA, 20 bp, Artificial
  CRISPR gRNA sequence
gtctcattccttaccgtcag

SEQ ID NO: 512808 - DNA, 20 bp, Artificial
  CRISPR gRNA sequence
tttctcaattttgcgtccca

SEQ ID NO: 512809 - DNA, 20 bp, Artificial
  CRISPR gRNA sequence
ttctcaattttgcgtcccac

SEQ ID NO: 512810 - DNA, 20 bp, Artificial
  CRISPR gRNA sequence
tctcaattttgcgtcccaca

SEQ ID NO: 512811 - DNA, 20 bp, Artificial
  CRISPR gRNA sequence
tcaattttgcgtcccacagg

SEQ ID NO: 512812 - DNA, 20 bp, Artificial
  CRISPR gRNA sequence
attttgcgtcccacagggag

SEQ ID NO: 512813 - DNA, 20 bp, Artificial
  CRISPR gRNA sequence
cgtcccacagggagcggctt

SEQ ID NO: 512814 - DNA, 20 bp, Artificial
  CRISPR gRNA sequence
gtcccacagggagcggcttt

SEQ ID NO: 512815 - DNA, 20 bp, Artificial
  CRISPR gRNA sequence
gggagcggctttgggtcctc

SEQ ID NO: 512816 - DNA, 20 bp, Artificial
  CRISPR gRNA sequence
tcctccagcccacgccaccg

SEQ ID NO: 512817 - DNA, 20 bp, Artificial
  CRISPR gRNA sequence
ccagcccacgccaccgcggc

SEQ ID NO: 512818 - DNA, 20 bp, Artificial
  CRISPR gRNA sequence
gcccacgccaccgcggcgag

SEQ ID NO: 512819 - DNA, 20 bp, Artificial
  CRISPR gRNA sequence
ccaccgcggcgagcagtccc

SEQ ID NO: 512820 - DNA, 20 bp, Artificial
  CRISPR gRNA sequence
accgcggcgagcagtccccg

SEQ ID NO: 512821 - DNA, 20 bp, Artificial
  CRISPR gRNA sequence
ccgcggcgagcagtccccgg

SEQ ID NO: 512822 - DNA, 20 bp, Artificial
  CRISPR gRNA sequence
gcggcgagcagtccccggag

SEQ ID NO: 512823 - DNA, 20 bp, Artificial
  CRISPR gRNA sequence
gcgagcagtccccggaggag

SEQ ID NO: 512824 - DNA, 20 bp, Artificial
  CRISPR gRNA sequence
gcagtccccggaggagaagc

SEQ ID NO: 512825 - DNA, 20 bp, Artificial
  CRISPR gRNA sequence
cagtccccggaggagaagcc

SEQ ID NO: 512826 - DNA, 20 bp, Artificial
  CRISPR gRNA sequence
tccccggaggagaagccggg

SEQ ID NO: 512827 - DNA, 20 bp, Artificial
  CRISPR gRNA sequence
gggtggctcccgtctgtcct

SEQ ID NO: 512828 - DNA, 20 bp, Artificial
  CRISPR gRNA sequence
ctcccgtctgtcctcggact

SEQ ID NO: 512829 - DNA, 20 bp, Artificial
  CRISPR gRNA sequence
ccgtctgtcctcggactgag

SEQ ID NO: 512830 - DNA, 20 bp, Artificial
  CRISPR gRNA sequence
cgtctgtcctcggactgagc

SEQ ID NO: 512831 - DNA, 20 bp, Artificial
  CRISPR gRNA sequence
gtctgtcctcggactgagca

SEQ ID NO: 512832 - DNA, 20 bp, Artificial
  CRISPR gRNA sequence
tgtcctcggactgagcaggg

SEQ ID NO: 512833 - DNA, 20 bp, Artificial
  CRISPR gRNA sequence
ctcggactgagcagggtggc

SEQ ID NO: 512834 - DNA, 20 bp, Artificial
  CRISPR gRNA sequence
tcggactgagcagggtggcc

SEQ ID NO: 512835 - DNA, 20 bp, Artificial
  CRISPR gRNA sequence
tgagcagggtggccaggccc

SEQ ID NO: 512836 - DNA, 20 bp, Artificial
  CRISPR gRNA sequence
gagcagggtggccaggcccc

SEQ ID NO: 512837 - DNA, 20 bp, Artificial
  CRISPR gRNA sequence
cagggtggccaggccccagg

SEQ ID NO: 512838 - DNA, 20 bp, Artificial
  CRISPR gRNA sequence
gccccaggtggaaactacct

SEQ ID NO: 512839 - DNA, 20 bp, Artificial
  CRISPR gRNA sequence
caggtggaaactaccttggt

SEQ ID NO: 512840 - DNA, 20 bp, Artificial
  CRISPR gRNA sequence
aggtggaaactaccttggtc

SEQ ID NO: 512841 - DNA, 20 bp, Artificial
  CRISPR gRNA sequence
ggaaactaccttggtcaggc

SEQ ID NO: 512842 - DNA, 20 bp, Artificial
  CRISPR gRNA sequence
gaaactaccttggtcaggct

SEQ ID NO: 512843 - DNA, 20 bp, Artificial
  CRISPR gRNA sequence
ggttttttccctcccctttc

SEQ ID NO: 512844 - DNA, 20 bp, Artificial
  CRISPR gRNA sequence
ttttttccctcccctttctg

SEQ ID NO: 512845 - DNA, 20 bp, Artificial
  CRISPR gRNA sequence
tttttccctcccctttctgg

SEQ ID NO: 512846 - DNA, 20 bp, Artificial
  CRISPR gRNA sequence
ctcccctttctggaggtttt

SEQ ID NO: 512847 - DNA, 20 bp, Artificial
  CRISPR gRNA sequence
cctctgaaataaacaccttt

SEQ ID NO: 512848 - DNA, 20 bp, Artificial
  CRISPR gRNA sequence
tgaaataaacacctttcagt

SEQ ID NO: 512849 - DNA, 20 bp, Artificial
  CRISPR gRNA sequence
gagatttgtttgtttctgtg

SEQ ID NO: 512850 - DNA, 20 bp, Artificial
  CRISPR gRNA sequence
gtttctgtgtggattacatt

SEQ ID NO: 512851 - DNA, 20 bp, Artificial
  CRISPR gRNA sequence
tttctgtgtggattacattt

SEQ ID NO: 512852 - DNA, 20 bp, Artificial
  CRISPR gRNA sequence
ggctttcttttctctcttgc

SEQ ID NO: 512853 - DNA, 20 bp, Artificial
  CRISPR gRNA sequence
gctttcttttctctcttgct

SEQ ID NO: 512854 - DNA, 20 bp, Artificial
  CRISPR gRNA sequence
tgctgatgtacttttatttc

SEQ ID NO: 512855 - DNA, 20 bp, Artificial
  CRISPR gRNA sequence
ctgatgtacttttatttctg

SEQ ID NO: 512856 - DNA, 20 bp, Artificial
  CRISPR gRNA sequence
tgatgtacttttatttctgg

SEQ ID NO: 512857 - DNA, 20 bp, Artificial
  CRISPR gRNA sequence
gacttctttaaaaaattctg

SEQ ID NO: 512858 - DNA, 20 bp, Artificial
  CRISPR gRNA sequence
aaaaaattctgtggttccaa

SEQ ID NO: 512859 - DNA, 20 bp, Artificial
  CRISPR gRNA sequence
aattctgtggttccaaaagt

SEQ ID NO: 512860 - DNA, 20 bp, Artificial
  CRISPR gRNA sequence
ttctgtggttccaaaagtca

SEQ ID NO: 512861 - DNA, 20 bp, Artificial
  CRISPR gRNA sequence
ccaaaagtcagagccctaca

SEQ ID NO: 512862 - DNA, 20 bp, Artificial
  CRISPR gRNA sequence
aaaagtcagagccctacaaa

SEQ ID NO: 512863 - DNA, 20 bp, Artificial
  CRISPR gRNA sequence
aaagtcagagccctacaaag

SEQ ID NO: 512864 - DNA, 20 bp, Artificial
  CRISPR gRNA sequence
agccctacaaagaggcaccc

SEQ ID NO: 512865 - DNA, 20 bp, Artificial
  CRISPR gRNA sequence
gccctacaaagaggcaccct

SEQ ID NO: 512866 - DNA, 20 bp, Artificial
  CRISPR gRNA sequence
ccctacaaagaggcaccctg

SEQ ID NO: 512867 - DNA, 20 bp, Artificial
  CRISPR gRNA sequence
cccacctgcccccctgcctg

SEQ ID NO: 512868 - DNA, 20 bp, Artificial
  CRISPR gRNA sequence
ccacctgcccccctgcctgc

SEQ ID NO: 512869 - DNA, 20 bp, Artificial
  CRISPR gRNA sequence
cccctgcctgcgggactcac

SEQ ID NO: 512870 - DNA, 20 bp, Artificial
  CRISPR gRNA sequence
ctgcgggactcaccagcctc

SEQ ID NO: 512871 - DNA, 20 bp, Artificial
  CRISPR gRNA sequence
tgcgggactcaccagcctct

SEQ ID NO: 512872 - DNA, 20 bp, Artificial
  CRISPR gRNA sequence
gcgggactcaccagcctctg

SEQ ID NO: 512873 - DNA, 20 bp, Artificial
  CRISPR gRNA sequence
cgggactcaccagcctctgg

SEQ ID NO: 512874 - DNA, 20 bp, Artificial
  CRISPR gRNA sequence
actcaccagcctctgggggc

SEQ ID NO: 512875 - DNA, 20 bp, Artificial
  CRISPR gRNA sequence
ctcaccagcctctgggggcc

SEQ ID NO: 512876 - DNA, 20 bp, Artificial
  CRISPR gRNA sequence
ggggccgggcttatcctcct

SEQ ID NO: 512877 - DNA, 20 bp, Artificial
  CRISPR gRNA sequence
tcctgagcttccctctacga

SEQ ID NO: 512878 - DNA, 20 bp, Artificial
  CRISPR gRNA sequence
gagcttccctctacgaaagc

SEQ ID NO: 512879 - DNA, 20 bp, Artificial
  CRISPR gRNA sequence
agtgcacaaacacgcgcttc

SEQ ID NO: 512880 - DNA, 20 bp, Artificial
  CRISPR gRNA sequence
cgcttctggccccgcatcac

SEQ ID NO: 512881 - DNA, 20 bp, Artificial
  CRISPR gRNA sequence
atcaccagcacccttccctg

SEQ ID NO: 512882 - DNA, 20 bp, Artificial
  CRISPR gRNA sequence
caccagcacccttccctgta

SEQ ID NO: 512883 - DNA, 20 bp, Artificial
  CRISPR gRNA sequence
accagcacccttccctgtag

SEQ ID NO: 512884 - DNA, 20 bp, Artificial
  CRISPR gRNA sequence
agcacccttccctgtagagg

SEQ ID NO: 512885 - DNA, 20 bp, Artificial
  CRISPR gRNA sequence
acccttccctgtagaggcag

SEQ ID NO: 512886 - DNA, 20 bp, Artificial
  CRISPR gRNA sequence
cccttccctgtagaggcagc

SEQ ID NO: 512887 - DNA, 20 bp, Artificial
  CRISPR gRNA sequence
ccctgtagaggcagcaggct

SEQ ID NO: 512888 - DNA, 20 bp, Artificial
  CRISPR gRNA sequence
cctgtagaggcagcaggctc

SEQ ID NO: 512889 - DNA, 20 bp, Artificial
  CRISPR gRNA sequence
ctgtagaggcagcaggctcg

SEQ ID NO: 512890 - DNA, 20 bp, Artificial
  CRISPR gRNA sequence
agaggcagcaggctcggggc

SEQ ID NO: 512891 - DNA, 20 bp, Artificial
  CRISPR gRNA sequence
agcaggctcggggccagtga

SEQ ID NO: 512892 - DNA, 20 bp, Artificial
  CRISPR gRNA sequence
gcaggctcggggccagtgac

SEQ ID NO: 512893 - DNA, 20 bp, Artificial
  CRISPR gRNA sequence
gtgacgggacccaccaaaca

SEQ ID NO: 512894 - DNA, 20 bp, Artificial
  CRISPR gRNA sequence
ccaccaaacacagccctcat

SEQ ID NO: 512895 - DNA, 20 bp, Artificial
  CRISPR gRNA sequence
acacagccctcatcagaatc

SEQ ID NO: 512896 - DNA, 20 bp, Artificial
  CRISPR gRNA sequence
cacagccctcatcagaatcc

SEQ ID NO: 512897 - DNA, 20 bp, Artificial
  CRISPR gRNA sequence
acagccctcatcagaatcca

SEQ ID NO: 512898 - DNA, 20 bp, Artificial
  CRISPR gRNA sequence
cagccctcatcagaatccag

SEQ ID NO: 512899 - DNA, 20 bp, Artificial
  CRISPR gRNA sequence
atcagaatccaggggatttg

SEQ ID NO: 512900 - DNA, 20 bp, Artificial
  CRISPR gRNA sequence
tcagaatccaggggatttgc

SEQ ID NO: 512901 - DNA, 20 bp, Artificial
  CRISPR gRNA sequence
cagaatccaggggatttgca

SEQ ID NO: 512902 - DNA, 20 bp, Artificial
  CRISPR gRNA sequence
ccaggggatttgcagggaca

SEQ ID NO: 512903 - DNA, 20 bp, Artificial
  CRISPR gRNA sequence
ggggatttgcagggacaaag

SEQ ID NO: 512904 - DNA, 20 bp, Artificial
  CRISPR gRNA sequence
tttgcagggacaaagtggct

SEQ ID NO: 512905 - DNA, 20 bp, Artificial
  CRISPR gRNA sequence
tgcagggacaaagtggctga

SEQ ID NO: 512906 - DNA, 20 bp, Artificial
  CRISPR gRNA sequence
gcagggacaaagtggctgag

SEQ ID NO: 512907 - DNA, 20 bp, Artificial
  CRISPR gRNA sequence
ggacaaagtggctgagagga

SEQ ID NO: 512908 - DNA, 20 bp, Artificial
  CRISPR gRNA sequence
tggctgagaggaaagcgccc

SEQ ID NO: 512909 - DNA, 20 bp, Artificial
  CRISPR gRNA sequence
ggctgagaggaaagcgccct

SEQ ID NO: 512910 - DNA, 20 bp, Artificial
  CRISPR gRNA sequence
agaggaaagcgccctgggcc

SEQ ID NO: 512911 - DNA, 20 bp, Artificial
  CRISPR gRNA sequence
gaggaaagcgccctgggccc

SEQ ID NO: 512912 - DNA, 20 bp, Artificial
  CRISPR gRNA sequence
cgccctgggcccaggcctcc

SEQ ID NO: 512913 - DNA, 20 bp, Artificial
  CRISPR gRNA sequence
gccctgggcccaggcctccc

SEQ ID NO: 512914 - DNA, 20 bp, Artificial
  CRISPR gRNA sequence
aggcctcccaggctcccctc

SEQ ID NO: 512915 - DNA, 20 bp, Artificial
  CRISPR gRNA sequence
cttttgttcttctaaacttt

SEQ ID NO: 512916 - DNA, 20 bp, Artificial
  CRISPR gRNA sequence
ttttgttcttctaaactttg

SEQ ID NO: 512917 - DNA, 20 bp, Artificial
  CRISPR gRNA sequence
tttgttcttctaaactttga

SEQ ID NO: 512918 - DNA, 20 bp, Artificial
  CRISPR gRNA sequence
ttgttcttctaaactttgag

SEQ ID NO: 512919 - DNA, 20 bp, Artificial
  CRISPR gRNA sequence
cttctaaactttgaggggct

SEQ ID NO: 512920 - DNA, 20 bp, Artificial
  CRISPR gRNA sequence
aaactttgaggggcttggcc

SEQ ID NO: 512921 - DNA, 20 bp, Artificial
  CRISPR gRNA sequence
ccagaaccctgcccatgttc

SEQ ID NO: 512922 - DNA, 20 bp, Artificial
  CRISPR gRNA sequence
cagaaccctgcccatgttct

SEQ ID NO: 512923 - DNA, 20 bp, Artificial
  CRISPR gRNA sequence
tgcccatgttctgggtttct

SEQ ID NO: 512924 - DNA, 20 bp, Artificial
  CRISPR gRNA sequence
gcccatgttctgggtttctt

SEQ ID NO: 512925 - DNA, 20 bp, Artificial
  CRISPR gRNA sequence
cccatgttctgggtttcttg

SEQ ID NO: 512926 - DNA, 20 bp, Artificial
  CRISPR gRNA sequence
ccatgttctgggtttcttgg

SEQ ID NO: 512927 - DNA, 20 bp, Artificial
  CRISPR gRNA sequence
ttctgggtttcttgggggcc

SEQ ID NO: 512928 - DNA, 20 bp, Artificial
  CRISPR gRNA sequence
tctgggtttcttgggggcct

SEQ ID NO: 512929 - DNA, 20 bp, Artificial
  CRISPR gRNA sequence
ctgggtttcttgggggccta

SEQ ID NO: 512930 - DNA, 20 bp, Artificial
  CRISPR gRNA sequence
tagggactgccacgttcctt

SEQ ID NO: 512931 - DNA, 20 bp, Artificial
  CRISPR gRNA sequence
agggactgccacgttccttt

SEQ ID NO: 512932 - DNA, 20 bp, Artificial
  CRISPR gRNA sequence
tgccacgttcctttgggaca

SEQ ID NO: 512933 - DNA, 20 bp, Artificial
  CRISPR gRNA sequence
ttgggacacagcaactccct

SEQ ID NO: 512934 - DNA, 20 bp, Artificial
  CRISPR gRNA sequence
cacagcaactcccttggaca

SEQ ID NO: 512935 - DNA, 20 bp, Artificial
  CRISPR gRNA sequence
acagcaactcccttggacaa

SEQ ID NO: 512936 - DNA, 20 bp, Artificial
  CRISPR gRNA sequence
ggacaaaggttctgctgatg

SEQ ID NO: 512937 - DNA, 20 bp, Artificial
  CRISPR gRNA sequence
gacaaaggttctgctgatga

SEQ ID NO: 512938 - DNA, 20 bp, Artificial
  CRISPR gRNA sequence
acaaaggttctgctgatgaa

SEQ ID NO: 512939 - DNA, 20 bp, Artificial
  CRISPR gRNA sequence
ttctgctgatgaagggcttg

SEQ ID NO: 512940 - DNA, 20 bp, Artificial
  CRISPR gRNA sequence
gatgaagggcttgaagcccc

SEQ ID NO: 512941 - DNA, 20 bp, Artificial
  CRISPR gRNA sequence
atgaagggcttgaagcccct

SEQ ID NO: 512942 - DNA, 20 bp, Artificial
  CRISPR gRNA sequence
agggcttgaagcccctgggc

SEQ ID NO: 512943 - DNA, 20 bp, Artificial
  CRISPR gRNA sequence
gaagcccctgggccagctgc

SEQ ID NO: 512944 - DNA, 20 bp, Artificial
  CRISPR gRNA sequence
agcccctgggccagctgcta

SEQ ID NO: 512945 - DNA, 20 bp, Artificial
  CRISPR gRNA sequence
gcccctgggccagctgctag

SEQ ID NO: 512946 - DNA, 20 bp, Artificial
  CRISPR gRNA sequence
gccagctgctagaggacgct

SEQ ID NO: 512947 - DNA, 20 bp, Artificial
  CRISPR gRNA sequence
ccagctgctagaggacgctg

SEQ ID NO: 512948 - DNA, 20 bp, Artificial
  CRISPR gRNA sequence
gacgctgaggcctctcctct

SEQ ID NO: 512949 - DNA, 20 bp, Artificial
  CRISPR gRNA sequence
acgctgaggcctctcctctt

SEQ ID NO: 512950 - DNA, 20 bp, Artificial
  CRISPR gRNA sequence
tgaggcctctcctcttgggt

SEQ ID NO: 512951 - DNA, 20 bp, Artificial
  CRISPR gRNA sequence
ctctcctcttgggtcagcct

SEQ ID NO: 512952 - DNA, 20 bp, Artificial
  CRISPR gRNA sequence
tctcctcttgggtcagcctc

SEQ ID NO: 512953 - DNA, 20 bp, Artificial
  CRISPR gRNA sequence
ctcttgggtcagcctcgggc

SEQ ID NO: 512954 - DNA, 20 bp, Artificial
  CRISPR gRNA sequence
cttgggtcagcctcgggctg

SEQ ID NO: 512955 - DNA, 20 bp, Artificial
  CRISPR gRNA sequence
tgggtcagcctcgggctgga

SEQ ID NO: 512956 - DNA, 20 bp, Artificial
  CRISPR gRNA sequence
gtcagcctcgggctggagag

SEQ ID NO: 512957 - DNA, 20 bp, Artificial
  CRISPR gRNA sequence
tcagcctcgggctggagagt

SEQ ID NO: 512958 - DNA, 20 bp, Artificial
  CRISPR gRNA sequence
cgggctggagagtaggtcct

SEQ ID NO: 512959 - DNA, 20 bp, Artificial
  CRISPR gRNA sequence
tcctgagtcctttctgccgc

SEQ ID NO: 512960 - DNA, 20 bp, Artificial
  CRISPR gRNA sequence
ctgagtcctttctgccgcta

SEQ ID NO: 512961 - DNA, 20 bp, Artificial
  CRISPR gRNA sequence
tgagtcctttctgccgctag

SEQ ID NO: 512962 - DNA, 20 bp, Artificial
  CRISPR gRNA sequence
gtcctttctgccgctagagg

SEQ ID NO: 512963 - DNA, 20 bp, Artificial
  CRISPR gRNA sequence
cctttctgccgctagaggca

SEQ ID NO: 512964 - DNA, 20 bp, Artificial
  CRISPR gRNA sequence
ctttctgccgctagaggcag

SEQ ID NO: 512965 - DNA, 20 bp, Artificial
  CRISPR gRNA sequence
ttctgccgctagaggcagag

SEQ ID NO: 512966 - DNA, 20 bp, Artificial
  CRISPR gRNA sequence
tctgccgctagaggcagagg

SEQ ID NO: 512967 - DNA, 20 bp, Artificial
  CRISPR gRNA sequence
tgccgctagaggcagaggag

SEQ ID NO: 512968 - DNA, 20 bp, Artificial
  CRISPR gRNA sequence
gccgctagaggcagaggagg

SEQ ID NO: 512969 - DNA, 20 bp, Artificial
  CRISPR gRNA sequence
ggaggcgataccctgccccc

SEQ ID NO: 512970 - DNA, 20 bp, Artificial
  CRISPR gRNA sequence
gaggcgataccctgcccccc

SEQ ID NO: 512971 - DNA, 20 bp, Artificial
  CRISPR gRNA sequence
aggcgataccctgcccccca

SEQ ID NO: 512972 - DNA, 20 bp, Artificial
  CRISPR gRNA sequence
ggcgataccctgccccccag

SEQ ID NO: 512973 - DNA, 20 bp, Artificial
  CRISPR gRNA sequence
tgccccccaggggtctgctg

SEQ ID NO: 512974 - DNA, 20 bp, Artificial
  CRISPR gRNA sequence
ccccaggggtctgctgtggc

SEQ ID NO: 512975 - DNA, 20 bp, Artificial
  CRISPR gRNA sequence
cccaggggtctgctgtggcc

SEQ ID NO: 512976 - DNA, 20 bp, Artificial
  CRISPR gRNA sequence
caggggtctgctgtggccgg

SEQ ID NO: 512977 - DNA, 20 bp, Artificial
  CRISPR gRNA sequence
ctgctgtggccgggagcctt

SEQ ID NO: 512978 - DNA, 20 bp, Artificial
  CRISPR gRNA sequence
tgctgtggccgggagccttc

SEQ ID NO: 512979 - DNA, 20 bp, Artificial
  CRISPR gRNA sequence
gctgtggccgggagccttca

SEQ ID NO: 512980 - DNA, 20 bp, Artificial
  CRISPR gRNA sequence
tgtggccgggagccttcagg

SEQ ID NO: 512981 - DNA, 20 bp, Artificial
  CRISPR gRNA sequence
gtggccgggagccttcaggg

SEQ ID NO: 512982 - DNA, 20 bp, Artificial
  CRISPR gRNA sequence
tggccgggagccttcaggga

SEQ ID NO: 512983 - DNA, 20 bp, Artificial
  CRISPR gRNA sequence
ggccgggagccttcagggag

SEQ ID NO: 512984 - DNA, 20 bp, Artificial
  CRISPR gRNA sequence
gccttcagggaggggctgtc

SEQ ID NO: 512985 - DNA, 20 bp, Artificial
  CRISPR gRNA sequence
ccttcagggaggggctgtct

SEQ ID NO: 512986 - DNA, 20 bp, Artificial
  CRISPR gRNA sequence
ttcagggaggggctgtctgg

SEQ ID NO: 512987 - DNA, 20 bp, Artificial
  CRISPR gRNA sequence
tcagggaggggctgtctggg

SEQ ID NO: 512988 - DNA, 20 bp, Artificial
  CRISPR gRNA sequence
aggggctgtctgggaggctg

SEQ ID NO: 512989 - DNA, 20 bp, Artificial
  CRISPR gRNA sequence
ggggctgtctgggaggctga

SEQ ID NO: 512990 - DNA, 20 bp, Artificial
  CRISPR gRNA sequence
ggctgtctgggaggctgaag

SEQ ID NO: 512991 - DNA, 20 bp, Artificial
  CRISPR gRNA sequence
gagctccctgtctctgtcca

SEQ ID NO: 512992 - DNA, 20 bp, Artificial
  CRISPR gRNA sequence
agctccctgtctctgtccac

SEQ ID NO: 512993 - DNA, 20 bp, Artificial
  CRISPR gRNA sequence
gctccctgtctctgtccaca

SEQ ID NO: 512994 - DNA, 20 bp, Artificial
  CRISPR gRNA sequence
gggacttctgtcccaaattc

SEQ ID NO: 512995 - DNA, 20 bp, Artificial
  CRISPR gRNA sequence
ggacttctgtcccaaattcc

SEQ ID NO: 512996 - DNA, 20 bp, Artificial
  CRISPR gRNA sequence
tctgtcccaaattccaggcg

SEQ ID NO: 512997 - DNA, 20 bp, Artificial
  CRISPR gRNA sequence
tgtcccaaattccaggcgca

SEQ ID NO: 512998 - DNA, 20 bp, Artificial
  CRISPR gRNA sequence
gtcccaaattccaggcgcag

SEQ ID NO: 512999 - DNA, 20 bp, Artificial
  CRISPR gRNA sequence
cccaaattccaggcgcagag

SEQ ID NO: 513000 - DNA, 20 bp, Artificial
  CRISPR gRNA sequence
ccaaattccaggcgcagagg

SEQ ID NO: 513001 - DNA, 20 bp, Artificial
  CRISPR gRNA sequence
aaattccaggcgcagaggag

SEQ ID NO: 513002 - DNA, 20 bp, Artificial
  CRISPR gRNA sequence
aattccaggcgcagaggagg

SEQ ID NO: 513003 - DNA, 20 bp, Artificial
  CRISPR gRNA sequence
attccaggcgcagaggagga

SEQ ID NO: 513004 - DNA, 20 bp, Artificial
  CRISPR gRNA sequence
ttccaggcgcagaggaggag

SEQ ID NO: 513005 - DNA, 20 bp, Artificial
  CRISPR gRNA sequence
aggcgcagaggaggagggga

SEQ ID NO: 513006 - DNA, 20 bp, Artificial
  CRISPR gRNA sequence
ggcgcagaggaggaggggac

SEQ ID NO: 513007 - DNA, 20 bp, Artificial
  CRISPR gRNA sequence
gcgcagaggaggaggggaca

SEQ ID NO: 513008 - DNA, 20 bp, Artificial
  CRISPR gRNA sequence
cagaggaggaggggacaggg

SEQ ID NO: 513009 - DNA, 20 bp, Artificial
  CRISPR gRNA sequence
agaggaggaggggacagggt

SEQ ID NO: 513010 - DNA, 20 bp, Artificial
  CRISPR gRNA sequence
gaggggacagggtgggtcct

SEQ ID NO: 513011 - DNA, 20 bp, Artificial
  CRISPR gRNA sequence
ggtgggtcctcagtcctcca

SEQ ID NO: 513012 - DNA, 20 bp, Artificial
  CRISPR gRNA sequence
ggtcctcagtcctccatggc

SEQ ID NO: 513013 - DNA, 20 bp, Artificial
  CRISPR gRNA sequence
ctcagtcctccatggccagt

SEQ ID NO: 513014 - DNA, 20 bp, Artificial
  CRISPR gRNA sequence
catggccagtcagcctcctg

SEQ ID NO: 513015 - DNA, 20 bp, Artificial
  CRISPR gRNA sequence
atggccagtcagcctcctgc

SEQ ID NO: 513016 - DNA, 20 bp, Artificial
  CRISPR gRNA sequence
tcagcctcctgcaggtcccg

SEQ ID NO: 513017 - DNA, 20 bp, Artificial
  CRISPR gRNA sequence
ctcctgcaggtcccgcagtg

SEQ ID NO: 513018 - DNA, 20 bp, Artificial
  CRISPR gRNA sequence
gacccctgactccccctccc

SEQ ID NO: 513019 - DNA, 20 bp, Artificial
  CRISPR gRNA sequence
tccccctccccagaacttca

SEQ ID NO: 513020 - DNA, 20 bp, Artificial
  CRISPR gRNA sequence
ccccctccccagaacttcac

SEQ ID NO: 513021 - DNA, 20 bp, Artificial
  CRISPR gRNA sequence
cccctccccagaacttcaca

SEQ ID NO: 513022 - DNA, 20 bp, Artificial
  CRISPR gRNA sequence
tccccagaacttcacagggc

SEQ ID NO: 513023 - DNA, 20 bp, Artificial
  CRISPR gRNA sequence
ccccagaacttcacagggcc

SEQ ID NO: 513024 - DNA, 20 bp, Artificial
  CRISPR gRNA sequence
cccagaacttcacagggccg

SEQ ID NO: 513025 - DNA, 20 bp, Artificial
  CRISPR gRNA sequence
ccagaacttcacagggccgg

SEQ ID NO: 513026 - DNA, 20 bp, Artificial
  CRISPR gRNA sequence
actccattcgctgcgacacc

SEQ ID NO: 513027 - DNA, 20 bp, Artificial
  CRISPR gRNA sequence
ttcgctgcgacacccggcca

SEQ ID NO: 513028 - DNA, 20 bp, Artificial
  CRISPR gRNA sequence
acccggccacagctgctcat

SEQ ID NO: 513029 - DNA, 20 bp, Artificial
  CRISPR gRNA sequence
cccggccacagctgctcatg

SEQ ID NO: 513030 - DNA, 20 bp, Artificial
  CRISPR gRNA sequence
ccggccacagctgctcatga

SEQ ID NO: 513031 - DNA, 20 bp, Artificial
  CRISPR gRNA sequence
cggccacagctgctcatgag

SEQ ID NO: 513032 - DNA, 20 bp, Artificial
  CRISPR gRNA sequence
gctgctcatgaggggctgtg

SEQ ID NO: 513033 - DNA, 20 bp, Artificial
  CRISPR gRNA sequence
ctgtgcggctgacgacatca

SEQ ID NO: 513034 - DNA, 20 bp, Artificial
  CRISPR gRNA sequence
gacgacatcatggaccccac

SEQ ID NO: 513035 - DNA, 20 bp, Artificial
  CRISPR gRNA sequence
ccacaagcctcgctgaaacc

SEQ ID NO: 513036 - DNA, 20 bp, Artificial
  CRISPR gRNA sequence
cacaagcctcgctgaaaccc

SEQ ID NO: 513037 - DNA, 20 bp, Artificial
  CRISPR gRNA sequence
aagcctcgctgaaacccagg

SEQ ID NO: 513038 - DNA, 20 bp, Artificial
  CRISPR gRNA sequence
gaaacccaggaagaccacaa

SEQ ID NO: 513039 - DNA, 20 bp, Artificial
  CRISPR gRNA sequence
aaacccaggaagaccacaat

SEQ ID NO: 513040 - DNA, 20 bp, Artificial
  CRISPR gRNA sequence
aacccaggaagaccacaatg

SEQ ID NO: 513041 - DNA, 20 bp, Artificial
  CRISPR gRNA sequence
acccaggaagaccacaatgg

SEQ ID NO: 513042 - DNA, 20 bp, Artificial
  CRISPR gRNA sequence
aggaagaccacaatgggggc

SEQ ID NO: 513043 - DNA, 20 bp, Artificial
  CRISPR gRNA sequence
aagaccacaatgggggccag

SEQ ID NO: 513044 - DNA, 20 bp, Artificial
  CRISPR gRNA sequence
accacaatgggggccagaag

SEQ ID NO: 513045 - DNA, 20 bp, Artificial
  CRISPR gRNA sequence
gaagcagctgtccccacaaa

SEQ ID NO: 513046 - DNA, 20 bp, Artificial
  CRISPR gRNA sequence
agtgacgctttacctgcgac

SEQ ID NO: 513047 - DNA, 20 bp, Artificial
  CRISPR gRNA sequence
gtgacgctttacctgcgacc

SEQ ID NO: 513048 - DNA, 20 bp, Artificial
  CRISPR gRNA sequence
acgctttacctgcgaccagg

SEQ ID NO: 513049 - DNA, 20 bp, Artificial
  CRISPR gRNA sequence
cgctttacctgcgaccaggt

SEQ ID NO: 513050 - DNA, 20 bp, Artificial
  CRISPR gRNA sequence
tacctgcgaccaggtaggct

SEQ ID NO: 513051 - DNA, 20 bp, Artificial
  CRISPR gRNA sequence
cgaccaggtaggcttggcct

SEQ ID NO: 513052 - DNA, 20 bp, Artificial
  CRISPR gRNA sequence
ccaggtaggcttggcctcgg

SEQ ID NO: 513053 - DNA, 20 bp, Artificial
  CRISPR gRNA sequence
ggtaggcttggcctcggtgg

SEQ ID NO: 513054 - DNA, 20 bp, Artificial
  CRISPR gRNA sequence
cttggcctcggtggtggtgc

SEQ ID NO: 513055 - DNA, 20 bp, Artificial
  CRISPR gRNA sequence
ttggcctcggtggtggtgcc

SEQ ID NO: 513056 - DNA, 20 bp, Artificial
  CRISPR gRNA sequence
gtgccaggcaccgtctgtgc

SEQ ID NO: 513057 - DNA, 20 bp, Artificial
  CRISPR gRNA sequence
gcaccgtctgtgctggttat

SEQ ID NO: 513058 - DNA, 20 bp, Artificial
  CRISPR gRNA sequence
tctgtgctggttattggctc

SEQ ID NO: 513059 - DNA, 20 bp, Artificial
  CRISPR gRNA sequence
tgctggttattggctctggc

SEQ ID NO: 513060 - DNA, 20 bp, Artificial
  CRISPR gRNA sequence
gctggttattggctctggct

SEQ ID NO: 513061 - DNA, 20 bp, Artificial
  CRISPR gRNA sequence
tggttattggctctggctgg

SEQ ID NO: 513062 - DNA, 20 bp, Artificial
  CRISPR gRNA sequence
attggctctggctgggagtc

SEQ ID NO: 513063 - DNA, 20 bp, Artificial
  CRISPR gRNA sequence
ctgggagtccggccctgctc

SEQ ID NO: 513064 - DNA, 20 bp, Artificial
  CRISPR gRNA sequence
tgggagtccggccctgctct

SEQ ID NO: 513065 - DNA, 20 bp, Artificial
  CRISPR gRNA sequence
gggagtccggccctgctctg

SEQ ID NO: 513066 - DNA, 20 bp, Artificial
  CRISPR gRNA sequence
ccggccctgctctggggtgt

SEQ ID NO: 513067 - DNA, 20 bp, Artificial
  CRISPR gRNA sequence
cggccctgctctggggtgtc

SEQ ID NO: 513068 - DNA, 20 bp, Artificial
  CRISPR gRNA sequence
ggccctgctctggggtgtca

SEQ ID NO: 513069 - DNA, 20 bp, Artificial
  CRISPR gRNA sequence
tctggggtgtcagggctgcc

SEQ ID NO: 513070 - DNA, 20 bp, Artificial
  CRISPR gRNA sequence
ggggtgtcagggctgcccag

SEQ ID NO: 513071 - DNA, 20 bp, Artificial
  CRISPR gRNA sequence
gggtgtcagggctgcccaga

SEQ ID NO: 513072 - DNA, 20 bp, Artificial
  CRISPR gRNA sequence
ctgcccagaaggcatgtgtc

SEQ ID NO: 513073 - DNA, 20 bp, Artificial
  CRISPR gRNA sequence
tgcccagaaggcatgtgtcc

SEQ ID NO: 513074 - DNA, 20 bp, Artificial
  CRISPR gRNA sequence
cagaaggcatgtgtccgggt

SEQ ID NO: 513075 - DNA, 20 bp, Artificial
  CRISPR gRNA sequence
aggcatgtgtccgggtcgga

SEQ ID NO: 513076 - DNA, 20 bp, Artificial
  CRISPR gRNA sequence
ggcatgtgtccgggtcggac

SEQ ID NO: 513077 - DNA, 20 bp, Artificial
  CRISPR gRNA sequence
gtccgggtcggacgggtgtg

SEQ ID NO: 513078 - DNA, 20 bp, Artificial
  CRISPR gRNA sequence
tccgggtcggacgggtgtgt

SEQ ID NO: 513079 - DNA, 20 bp, Artificial
  CRISPR gRNA sequence
ggtcggacgggtgtgtgggc

SEQ ID NO: 513080 - DNA, 20 bp, Artificial
  CRISPR gRNA sequence
gacgggtgtgtgggccagtg

SEQ ID NO: 513081 - DNA, 20 bp, Artificial
  CRISPR gRNA sequence
gtgtgggccagtgaagcccc

SEQ ID NO: 513082 - DNA, 20 bp, Artificial
  CRISPR gRNA sequence
tgtgggccagtgaagcccca

SEQ ID NO: 513083 - DNA, 20 bp, Artificial
  CRISPR gRNA sequence
cagtgaagccccaaggctgc

SEQ ID NO: 513084 - DNA, 20 bp, Artificial
  CRISPR gRNA sequence
gaagccccaaggctgctgga

SEQ ID NO: 513085 - DNA, 20 bp, Artificial
  CRISPR gRNA sequence
cccaaggctgctggaaagct

SEQ ID NO: 513086 - DNA, 20 bp, Artificial
  CRISPR gRNA sequence
tgctggaaagctgagctcct

SEQ ID NO: 513087 - DNA, 20 bp, Artificial
  CRISPR gRNA sequence
gtgcccttccgctctgtccc

SEQ ID NO: 513088 - DNA, 20 bp, Artificial
  CRISPR gRNA sequence
tgcccttccgctctgtcccc

SEQ ID NO: 513089 - DNA, 20 bp, Artificial
  CRISPR gRNA sequence
ccttccgctctgtccccagg

SEQ ID NO: 513090 - DNA, 20 bp, Artificial
  CRISPR gRNA sequence
ttccgctctgtccccaggtg

SEQ ID NO: 513091 - DNA, 20 bp, Artificial
  CRISPR gRNA sequence
gtccccaggtggagctgccc

SEQ ID NO: 513092 - DNA, 20 bp, Artificial
  CRISPR gRNA sequence
gctgccccagcccttaccat

SEQ ID NO: 513093 - DNA, 20 bp, Artificial
  CRISPR gRNA sequence
cagcccttaccatcggtgcc

SEQ ID NO: 513094 - DNA, 20 bp, Artificial
  CRISPR gRNA sequence
ccagtgtctgcactctctcg

SEQ ID NO: 513095 - DNA, 20 bp, Artificial
  CRISPR gRNA sequence
ttctgcacctttttttttta

SEQ ID NO: 513096 - DNA, 20 bp, Artificial
  CRISPR gRNA sequence
tctgcaccttttttttttaa

SEQ ID NO: 513097 - DNA, 20 bp, Artificial
  CRISPR gRNA sequence
ctgcaccttttttttttaaa

SEQ ID NO: 513098 - DNA, 20 bp, Artificial
  CRISPR gRNA sequence
gcaccttttttttttaaagg

SEQ ID NO: 513099 - DNA, 20 bp, Artificial
  CRISPR gRNA sequence
acactattccattacacact

SEQ ID NO: 513100 - DNA, 20 bp, Artificial
  CRISPR gRNA sequence
ctattccattacacactcag

SEQ ID NO: 513101 - DNA, 20 bp, Artificial
  CRISPR gRNA sequence
tattccattacacactcaga

SEQ ID NO: 513102 - DNA, 20 bp, Artificial
  CRISPR gRNA sequence
ccattacacactcagaaggc

SEQ ID NO: 513103 - DNA, 20 bp, Artificial
  CRISPR gRNA sequence
cattacacactcagaaggcc

SEQ ID NO: 513104 - DNA, 20 bp, Artificial
  CRISPR gRNA sequence
attacacactcagaaggcca

SEQ ID NO: 513105 - DNA, 20 bp, Artificial
  CRISPR gRNA sequence
tcagaaggccagggtactct

SEQ ID NO: 513106 - DNA, 20 bp, Artificial
  CRISPR gRNA sequence
gaaggccagggtactcttag

SEQ ID NO: 513107 - DNA, 20 bp, Artificial
  CRISPR gRNA sequence
aggccagggtactcttagaa

SEQ ID NO: 513108 - DNA, 20 bp, Artificial
  CRISPR gRNA sequence
agggtactcttagaagagta

SEQ ID NO: 513109 - DNA, 20 bp, Artificial
  CRISPR gRNA sequence
gggtactcttagaagagtaa

SEQ ID NO: 513110 - DNA, 20 bp, Artificial
  CRISPR gRNA sequence
agaagagtaaaggctctgat

SEQ ID NO: 513111 - DNA, 20 bp, Artificial
  CRISPR gRNA sequence
aaaggctctgatcagtcttg

SEQ ID NO: 513112 - DNA, 20 bp, Artificial
  CRISPR gRNA sequence
ctctgatcagtcttgcagcc

SEQ ID NO: 513113 - DNA, 20 bp, Artificial
  CRISPR gRNA sequence
ctgatcagtcttgcagccaa

SEQ ID NO: 513114 - DNA, 20 bp, Artificial
  CRISPR gRNA sequence
gtcttgcagccaagagacct

SEQ ID NO: 513115 - DNA, 20 bp, Artificial
  CRISPR gRNA sequence
acctaagtaactgtttaaac

SEQ ID NO: 513116 - DNA, 20 bp, Artificial
  CRISPR gRNA sequence
gttgcccaaactgacttgac

SEQ ID NO: 513117 - DNA, 20 bp, Artificial
  CRISPR gRNA sequence
tgcccaaactgacttgacca

SEQ ID NO: 513118 - DNA, 20 bp, Artificial
  CRISPR gRNA sequence
agcacctgtttcgacttgac

SEQ ID NO: 513119 - DNA, 20 bp, Artificial
  CRISPR gRNA sequence
cacctgtttcgacttgacca

SEQ ID NO: 513120 - DNA, 20 bp, Artificial
  CRISPR gRNA sequence
cttgaccagagcacctgttt

SEQ ID NO: 513121 - DNA, 20 bp, Artificial
  CRISPR gRNA sequence
agagcacctgtttcagaaca

SEQ ID NO: 513122 - DNA, 20 bp, Artificial
  CRISPR gRNA sequence
ttcagaacacagtcccctgt

SEQ ID NO: 513123 - DNA, 20 bp, Artificial
  CRISPR gRNA sequence
cagtcccctgtcagtgcttt

SEQ ID NO: 513124 - DNA, 20 bp, Artificial
  CRISPR gRNA sequence
ttgagaaacgccctccttat

SEQ ID NO: 513125 - DNA, 20 bp, Artificial
  CRISPR gRNA sequence
agaaacgccctccttatcgg

SEQ ID NO: 513126 - DNA, 20 bp, Artificial
  CRISPR gRNA sequence
gtggctcacgcctgtaatcc

SEQ ID NO: 513127 - DNA, 20 bp, Artificial
  CRISPR gRNA sequence
cgcctgtaatcccagcactt

SEQ ID NO: 513128 - DNA, 20 bp, Artificial
  CRISPR gRNA sequence
gcctgtaatcccagcacttt

SEQ ID NO: 513129 - DNA, 20 bp, Artificial
  CRISPR gRNA sequence
ctgtaatcccagcactttgg

SEQ ID NO: 513130 - DNA, 20 bp, Artificial
  CRISPR gRNA sequence
tgtaatcccagcactttggg

SEQ ID NO: 513131 - DNA, 20 bp, Artificial
  CRISPR gRNA sequence
tcccagcactttgggaggcc

SEQ ID NO: 513132 - DNA, 20 bp, Artificial
  CRISPR gRNA sequence
cccagcactttgggaggccg

SEQ ID NO: 513133 - DNA, 20 bp, Artificial
  CRISPR gRNA sequence
agcactttgggaggccgagg

SEQ ID NO: 513134 - DNA, 20 bp, Artificial
  CRISPR gRNA sequence
gcactttgggaggccgaggc

SEQ ID NO: 513135 - DNA, 20 bp, Artificial
  CRISPR gRNA sequence
ctttgggaggccgaggcggg

SEQ ID NO: 513136 - DNA, 20 bp, Artificial
  CRISPR gRNA sequence
ccgaggcgggtggatcactt

SEQ ID NO: 513137 - DNA, 20 bp, Artificial
  CRISPR gRNA sequence
cgaggcgggtggatcacttg

SEQ ID NO: 513138 - DNA, 20 bp, Artificial
  CRISPR gRNA sequence
gcgggtggatcacttgaggt

SEQ ID NO: 513139 - DNA, 20 bp, Artificial
  CRISPR gRNA sequence
cgggtggatcacttgaggtc

SEQ ID NO: 513140 - DNA, 20 bp, Artificial
  CRISPR gRNA sequence
gggtggatcacttgaggtcg

SEQ ID NO: 513141 - DNA, 20 bp, Artificial
  CRISPR gRNA sequence
ggtggatcacttgaggtcgg

SEQ ID NO: 513142 - DNA, 20 bp, Artificial
  CRISPR gRNA sequence
tcacttgaggtcgggggttc

SEQ ID NO: 513143 - DNA, 20 bp, Artificial
  CRISPR gRNA sequence
tgaggtcgggggttcgagac

SEQ ID NO: 513144 - DNA, 20 bp, Artificial
  CRISPR gRNA sequence
tcgggggttcgagaccagcc

SEQ ID NO: 513145 - DNA, 20 bp, Artificial
  CRISPR gRNA sequence
tggccaacattctcctgctg

SEQ ID NO: 513146 - DNA, 20 bp, Artificial
  CRISPR gRNA sequence
ccaacattctcctgctgcgg

SEQ ID NO: 513147 - DNA, 20 bp, Artificial
  CRISPR gRNA sequence
caacattctcctgctgcggc

SEQ ID NO: 513148 - DNA, 20 bp, Artificial
  CRISPR gRNA sequence
acattctcctgctgcggcag

SEQ ID NO: 513149 - DNA, 20 bp, Artificial
  CRISPR gRNA sequence
gcaggagaatcacttgaacc

SEQ ID NO: 513150 - DNA, 20 bp, Artificial
  CRISPR gRNA sequence
caggagaatcacttgaacct

SEQ ID NO: 513151 - DNA, 20 bp, Artificial
  CRISPR gRNA sequence
ggagaatcacttgaacctgg

SEQ ID NO: 513152 - DNA, 20 bp, Artificial
  CRISPR gRNA sequence
gagaatcacttgaacctggg

SEQ ID NO: 513153 - DNA, 20 bp, Artificial
  CRISPR gRNA sequence
aatcacttgaacctgggagg

SEQ ID NO: 513154 - DNA, 20 bp, Artificial
  CRISPR gRNA sequence
tcacttgaacctgggaggca

SEQ ID NO: 513155 - DNA, 20 bp, Artificial
  CRISPR gRNA sequence
cacttgaacctgggaggcag

SEQ ID NO: 513156 - DNA, 20 bp, Artificial
  CRISPR gRNA sequence
aacctgggaggcagaggttg

SEQ ID NO: 513157 - DNA, 20 bp, Artificial
  CRISPR gRNA sequence
tgggaggcagaggttgcagt

SEQ ID NO: 513158 - DNA, 20 bp, Artificial
  CRISPR gRNA sequence
ggcagaggttgcagtgagcc

SEQ ID NO: 513159 - DNA, 20 bp, Artificial
  CRISPR gRNA sequence
aagattgtgccactgcactt

SEQ ID NO: 513160 - DNA, 20 bp, Artificial
  CRISPR gRNA sequence
tgtgccactgcactttagcc

SEQ ID NO: 513161 - DNA, 20 bp, Artificial
  CRISPR gRNA sequence
gtgccactgcactttagcct

SEQ ID NO: 513162 - DNA, 20 bp, Artificial
  CRISPR gRNA sequence
ctgcactttagcctgggcga

SEQ ID NO: 513163 - DNA, 20 bp, Artificial
  CRISPR gRNA sequence
tgcactttagcctgggcgac

SEQ ID NO: 513164 - DNA, 20 bp, Artificial
  CRISPR gRNA sequence
gcactttagcctgggcgaca

SEQ ID NO: 513165 - DNA, 20 bp, Artificial
  CRISPR gRNA sequence
tttagcctgggcgacagggc

SEQ ID NO: 513166 - DNA, 20 bp, Artificial
  CRISPR gRNA sequence
agattctgtctcaaaatgaa

SEQ ID NO: 513167 - DNA, 20 bp, Artificial
  CRISPR gRNA sequence
tctgtctcaaaatgaaaaga

SEQ ID NO: 513168 - DNA, 20 bp, Artificial
  CRISPR gRNA sequence
ctgtctcaaaatgaaaagaa

SEQ ID NO: 513169 - DNA, 20 bp, Artificial
  CRISPR gRNA sequence
tctcaaaatgaaaagaaagg

SEQ ID NO: 513170 - DNA, 20 bp, Artificial
  CRISPR gRNA sequence
ctcaaaatgaaaagaaagga

SEQ ID NO: 513171 - DNA, 20 bp, Artificial
  CRISPR gRNA sequence
tcaaaatgaaaagaaaggaa

SEQ ID NO: 513172 - DNA, 20 bp, Artificial
  CRISPR gRNA sequence
aaatgaaaagaaaggaaggg

SEQ ID NO: 513173 - DNA, 20 bp, Artificial
  CRISPR gRNA sequence
atgaaaagaaaggaagggaa

SEQ ID NO: 513174 - DNA, 20 bp, Artificial
  CRISPR gRNA sequence
aaaagaaaggaagggaagag

SEQ ID NO: 513175 - DNA, 20 bp, Artificial
  CRISPR gRNA sequence
aaagaaaggaagggaagaga

SEQ ID NO: 513176 - DNA, 20 bp, Artificial
  CRISPR gRNA sequence
aagaaaggaagggaagagaa

SEQ ID NO: 513177 - DNA, 20 bp, Artificial
  CRISPR gRNA sequence
agaaaggaagggaagagaag

SEQ ID NO: 513178 - DNA, 20 bp, Artificial
  CRISPR gRNA sequence
aaaggaagggaagagaaggg

SEQ ID NO: 513179 - DNA, 20 bp, Artificial
  CRISPR gRNA sequence
aaggaagggaagagaagggg

SEQ ID NO: 513180 - DNA, 20 bp, Artificial
  CRISPR gRNA sequence
aggaagggaagagaagggga

SEQ ID NO: 513181 - DNA, 20 bp, Artificial
  CRISPR gRNA sequence
aagggaagagaaggggaggg

SEQ ID NO: 513182 - DNA, 20 bp, Artificial
  CRISPR gRNA sequence
agggaagagaaggggaggga

SEQ ID NO: 513183 - DNA, 20 bp, Artificial
  CRISPR gRNA sequence
gggaagagaaggggagggaa

SEQ ID NO: 513184 - DNA, 20 bp, Artificial
  CRISPR gRNA sequence
gaagagaaggggagggaagg

SEQ ID NO: 513185 - DNA, 20 bp, Artificial
  CRISPR gRNA sequence
aagagaaggggagggaaggg

SEQ ID NO: 513186 - DNA, 20 bp, Artificial
  CRISPR gRNA sequence
agagaaggggagggaaggga

SEQ ID NO: 513187 - DNA, 20 bp, Artificial
  CRISPR gRNA sequence
agaaggggagggaagggagg

SEQ ID NO: 513188 - DNA, 20 bp, Artificial
  CRISPR gRNA sequence
gaaggggagggaagggaggg

SEQ ID NO: 513189 - DNA, 20 bp, Artificial
  CRISPR gRNA sequence
aaggggagggaagggaggga

SEQ ID NO: 513190 - DNA, 20 bp, Artificial
  CRISPR gRNA sequence
gggagggaagggagggaggg

SEQ ID NO: 513191 - DNA, 20 bp, Artificial
  CRISPR gRNA sequence
ggagggaagggagggaggga

SEQ ID NO: 513192 - DNA, 20 bp, Artificial
  CRISPR gRNA sequence
gagggaagggagggagggaa

SEQ ID NO: 513193 - DNA, 20 bp, Artificial
  CRISPR gRNA sequence
gggaagggagggagggaagg

SEQ ID NO: 513194 - DNA, 20 bp, Artificial
  CRISPR gRNA sequence
ggaagggagggagggaaggg

SEQ ID NO: 513195 - DNA, 20 bp, Artificial
  CRISPR gRNA sequence
gaagggagggagggaaggga

SEQ ID NO: 513196 - DNA, 20 bp, Artificial
  CRISPR gRNA sequence
gggagggagggaagggaggg

SEQ ID NO: 513197 - DNA, 20 bp, Artificial
  CRISPR gRNA sequence
ggagggagggaagggaggga

SEQ ID NO: 513198 - DNA, 20 bp, Artificial
  CRISPR gRNA sequence
gagggagggaagggagggaa

SEQ ID NO: 513199 - DNA, 20 bp, Artificial
  CRISPR gRNA sequence
gggagggaagggagggaagg

SEQ ID NO: 513200 - DNA, 20 bp, Artificial
  CRISPR gRNA sequence
ggagggaagggagggaaggg

SEQ ID NO: 513201 - DNA, 20 bp, Artificial
  CRISPR gRNA sequence
gagggaagggagggaaggga

SEQ ID NO: 513202 - DNA, 20 bp, Artificial
  CRISPR gRNA sequence
ggaagggagggaagggaggg

SEQ ID NO: 513203 - DNA, 20 bp, Artificial
  CRISPR gRNA sequence
gaagggagggaagggaggga

SEQ ID NO: 513204 - DNA, 20 bp, Artificial
  CRISPR gRNA sequence
aagggagggaagggagggaa

SEQ ID NO: 513205 - DNA, 20 bp, Artificial
  CRISPR gRNA sequence
agggagggaagggagggaag

SEQ ID NO: 513206 - DNA, 20 bp, Artificial
  CRISPR gRNA sequence
gagggaagggagggaagggg

SEQ ID NO: 513207 - DNA, 20 bp, Artificial
  CRISPR gRNA sequence
agggaagggagggaagggga

SEQ ID NO: 513208 - DNA, 20 bp, Artificial
  CRISPR gRNA sequence
gggaagggagggaaggggaa

SEQ ID NO: 513209 - DNA, 20 bp, Artificial
  CRISPR gRNA sequence
gaagggagggaaggggaagg

SEQ ID NO: 513210 - DNA, 20 bp, Artificial
  CRISPR gRNA sequence
aagggagggaaggggaaggg

SEQ ID NO: 513211 - DNA, 20 bp, Artificial
  CRISPR gRNA sequence
agggagggaaggggaaggga

SEQ ID NO: 513212 - DNA, 20 bp, Artificial
  CRISPR gRNA sequence
gagggaaggggaagggaggg

SEQ ID NO: 513213 - DNA, 20 bp, Artificial
  CRISPR gRNA sequence
gggaagggagggaagaaacg

SEQ ID NO: 513214 - DNA, 20 bp, Artificial
  CRISPR gRNA sequence
acgaagctccctccttgctc

SEQ ID NO: 513215 - DNA, 20 bp, Artificial
  CRISPR gRNA sequence
cgaagctccctccttgctcc

SEQ ID NO: 513216 - DNA, 20 bp, Artificial
  CRISPR gRNA sequence
agctccctccttgctccagg

SEQ ID NO: 513217 - DNA, 20 bp, Artificial
  CRISPR gRNA sequence
gctccctccttgctccagga

SEQ ID NO: 513218 - DNA, 20 bp, Artificial
  CRISPR gRNA sequence
ccctccttgctccaggaagg

SEQ ID NO: 513219 - DNA, 20 bp, Artificial
  CRISPR gRNA sequence
cctccttgctccaggaaggc

SEQ ID NO: 513220 - DNA, 20 bp, Artificial
  CRISPR gRNA sequence
ttgctccaggaaggcaggtg

SEQ ID NO: 513221 - DNA, 20 bp, Artificial
  CRISPR gRNA sequence
ctccaggaaggcaggtgtgg

SEQ ID NO: 513222 - DNA, 20 bp, Artificial
  CRISPR gRNA sequence
ggaaggcaggtgtggtggtg

SEQ ID NO: 513223 - DNA, 20 bp, Artificial
  CRISPR gRNA sequence
aggcaggtgtggtggtgcag

SEQ ID NO: 513224 - DNA, 20 bp, Artificial
  CRISPR gRNA sequence
aggtgtggtggtgcagcaga

SEQ ID NO: 513225 - DNA, 20 bp, Artificial
  CRISPR gRNA sequence
ggtgtggtggtgcagcagat

SEQ ID NO: 513226 - DNA, 20 bp, Artificial
  CRISPR gRNA sequence
tgtggtggtgcagcagatgg

SEQ ID NO: 513227 - DNA, 20 bp, Artificial
  CRISPR gRNA sequence
ggtggtgcagcagatgggag

SEQ ID NO: 513228 - DNA, 20 bp, Artificial
  CRISPR gRNA sequence
gtggtgcagcagatgggaga

SEQ ID NO: 513229 - DNA, 20 bp, Artificial
  CRISPR gRNA sequence
ggtgcagcagatgggagaag

SEQ ID NO: 513230 - DNA, 20 bp, Artificial
  CRISPR gRNA sequence
gtgcagcagatgggagaagg

SEQ ID NO: 513231 - DNA, 20 bp, Artificial
  CRISPR gRNA sequence
gcagatgggagaaggaggcc

SEQ ID NO: 513232 - DNA, 20 bp, Artificial
  CRISPR gRNA sequence
tgggagaaggaggcctggtg

SEQ ID NO: 513233 - DNA, 20 bp, Artificial
  CRISPR gRNA sequence
gccaccgacctgtgacctcc

SEQ ID NO: 513234 - DNA, 20 bp, Artificial
  CRISPR gRNA sequence
ccaccgacctgtgacctccc

SEQ ID NO: 513235 - DNA, 20 bp, Artificial
  CRISPR gRNA sequence
acctgtgacctcccaggcca

SEQ ID NO: 513236 - DNA, 20 bp, Artificial
  CRISPR gRNA sequence
gtgacctcccaggccacagt

SEQ ID NO: 513237 - DNA, 20 bp, Artificial
  CRISPR gRNA sequence
tgacctcccaggccacagtg

SEQ ID NO: 513238 - DNA, 20 bp, Artificial
  CRISPR gRNA sequence
ctcccaggccacagtgaggc

SEQ ID NO: 513239 - DNA, 20 bp, Artificial
  CRISPR gRNA sequence
tcccaggccacagtgaggcc

SEQ ID NO: 513240 - DNA, 20 bp, Artificial
  CRISPR gRNA sequence
cccaggccacagtgaggcca

SEQ ID NO: 513241 - DNA, 20 bp, Artificial
  CRISPR gRNA sequence
aggccacagtgaggccaggg

SEQ ID NO: 513242 - DNA, 20 bp, Artificial
  CRISPR gRNA sequence
ggccacagtgaggccaggga

SEQ ID NO: 513243 - DNA, 20 bp, Artificial
  CRISPR gRNA sequence
cacagtgaggccagggaagg

SEQ ID NO: 513244 - DNA, 20 bp, Artificial
  CRISPR gRNA sequence
acagtgaggccagggaagga

SEQ ID NO: 513245 - DNA, 20 bp, Artificial
  CRISPR gRNA sequence
cagtgaggccagggaaggaa

SEQ ID NO: 513246 - DNA, 20 bp, Artificial
  CRISPR gRNA sequence
agtgaggccagggaaggaag

SEQ ID NO: 513247 - DNA, 20 bp, Artificial
  CRISPR gRNA sequence
gaggccagggaaggaagggg

SEQ ID NO: 513248 - DNA, 20 bp, Artificial
  CRISPR gRNA sequence
aggaaggggaagccatctcc

SEQ ID NO: 513249 - DNA, 20 bp, Artificial
  CRISPR gRNA sequence
ggaaggggaagccatctccc

SEQ ID NO: 513250 - DNA, 20 bp, Artificial
  CRISPR gRNA sequence
gaaggggaagccatctccca

SEQ ID NO: 513251 - DNA, 20 bp, Artificial
  CRISPR gRNA sequence
aggggaagccatctcccagg

SEQ ID NO: 513252 - DNA, 20 bp, Artificial
  CRISPR gRNA sequence
gggaagccatctcccaggga

SEQ ID NO: 513253 - DNA, 20 bp, Artificial
  CRISPR gRNA sequence
ggaagccatctcccagggag

SEQ ID NO: 513254 - DNA, 20 bp, Artificial
  CRISPR gRNA sequence
gaagccatctcccagggaga

SEQ ID NO: 513255 - DNA, 20 bp, Artificial
  CRISPR gRNA sequence
catctcccagggagagggtg

SEQ ID NO: 513256 - DNA, 20 bp, Artificial
  CRISPR gRNA sequence
tcccagggagagggtgcaga

SEQ ID NO: 513257 - DNA, 20 bp, Artificial
  CRISPR gRNA sequence
cccagggagagggtgcagac

SEQ ID NO: 513258 - DNA, 20 bp, Artificial
  CRISPR gRNA sequence
ccagggagagggtgcagacg

SEQ ID NO: 513259 - DNA, 20 bp, Artificial
  CRISPR gRNA sequence
ggagagggtgcagacggggc

SEQ ID NO: 513260 - DNA, 20 bp, Artificial
  CRISPR gRNA sequence
gagagggtgcagacggggcc

SEQ ID NO: 513261 - DNA, 20 bp, Artificial
  CRISPR gRNA sequence
agagggtgcagacggggcca

SEQ ID NO: 513262 - DNA, 20 bp, Artificial
  CRISPR gRNA sequence
agacggggccagggtgactt

SEQ ID NO: 513263 - DNA, 20 bp, Artificial
  CRISPR gRNA sequence
acggggccagggtgacttta

SEQ ID NO: 513264 - DNA, 20 bp, Artificial
  CRISPR gRNA sequence
cggggccagggtgactttag

SEQ ID NO: 513265 - DNA, 20 bp, Artificial
  CRISPR gRNA sequence
cagggtgactttagaggaac

SEQ ID NO: 513266 - DNA, 20 bp, Artificial
  CRISPR gRNA sequence
gtgactttagaggaaccagc

SEQ ID NO: 513267 - DNA, 20 bp, Artificial
  CRISPR gRNA sequence
ttagaggaaccagctggtgt

SEQ ID NO: 513268 - DNA, 20 bp, Artificial
  CRISPR gRNA sequence
aggaaccagctggtgtcgga

SEQ ID NO: 513269 - DNA, 20 bp, Artificial
  CRISPR gRNA sequence
ggaaccagctggtgtcggac

SEQ ID NO: 513270 - DNA, 20 bp, Artificial
  CRISPR gRNA sequence
ccagctggtgtcggacaggc

SEQ ID NO: 513271 - DNA, 20 bp, Artificial
  CRISPR gRNA sequence
cagctggtgtcggacaggct

SEQ ID NO: 513272 - DNA, 20 bp, Artificial
  CRISPR gRNA sequence
agctggtgtcggacaggctg

SEQ ID NO: 513273 - DNA, 20 bp, Artificial
  CRISPR gRNA sequence
gtgtcggacaggctggggct

SEQ ID NO: 513274 - DNA, 20 bp, Artificial
  CRISPR gRNA sequence
gtcggacaggctggggctca

SEQ ID NO: 513275 - DNA, 20 bp, Artificial
  CRISPR gRNA sequence
ggggctcagagctctgccct

SEQ ID NO: 513276 - DNA, 20 bp, Artificial
  CRISPR gRNA sequence
gggctcagagctctgccctc

SEQ ID NO: 513277 - DNA, 20 bp, Artificial
  CRISPR gRNA sequence
ggctcagagctctgccctca

SEQ ID NO: 513278 - DNA, 20 bp, Artificial
  CRISPR gRNA sequence
gctcagagctctgccctcag

SEQ ID NO: 513279 - DNA, 20 bp, Artificial
  CRISPR gRNA sequence
cagagctctgccctcagggg

SEQ ID NO: 513280 - DNA, 20 bp, Artificial
  CRISPR gRNA sequence
ctctgccctcaggggaagcc

SEQ ID NO: 513281 - DNA, 20 bp, Artificial
  CRISPR gRNA sequence
tctgccctcaggggaagccc

SEQ ID NO: 513282 - DNA, 20 bp, Artificial
  CRISPR gRNA sequence
ccctcaggggaagcccaggt

SEQ ID NO: 513283 - DNA, 20 bp, Artificial
  CRISPR gRNA sequence
tcaggggaagcccaggtcag

SEQ ID NO: 513284 - DNA, 20 bp, Artificial
  CRISPR gRNA sequence
agcccaggtcagcggccact

SEQ ID NO: 513285 - DNA, 20 bp, Artificial
  CRISPR gRNA sequence
caggtcagcggccactgagt

SEQ ID NO: 513286 - DNA, 20 bp, Artificial
  CRISPR gRNA sequence
agcggccactgagttagcct

SEQ ID NO: 513287 - DNA, 20 bp, Artificial
  CRISPR gRNA sequence
gcggccactgagttagcctt

SEQ ID NO: 513288 - DNA, 20 bp, Artificial
  CRISPR gRNA sequence
cggccactgagttagccttg

SEQ ID NO: 513289 - DNA, 20 bp, Artificial
  CRISPR gRNA sequence
ccactgagttagccttgggg

SEQ ID NO: 513290 - DNA, 20 bp, Artificial
  CRISPR gRNA sequence
actgagttagccttggggca

SEQ ID NO: 513291 - DNA, 20 bp, Artificial
  CRISPR gRNA sequence
gagttagccttggggcagag

SEQ ID NO: 513292 - DNA, 20 bp, Artificial
  CRISPR gRNA sequence
agccttggggcagagtggcc

SEQ ID NO: 513293 - DNA, 20 bp, Artificial
  CRISPR gRNA sequence
gccttggggcagagtggccc

SEQ ID NO: 513294 - DNA, 20 bp, Artificial
  CRISPR gRNA sequence
ccttggggcagagtggccca

SEQ ID NO: 513295 - DNA, 20 bp, Artificial
  CRISPR gRNA sequence
gggcagagtggcccagggtg

SEQ ID NO: 513296 - DNA, 20 bp, Artificial
  CRISPR gRNA sequence
ggcagagtggcccagggtgc

SEQ ID NO: 513297 - DNA, 20 bp, Artificial
  CRISPR gRNA sequence
agagtggcccagggtgcagg

SEQ ID NO: 513298 - DNA, 20 bp, Artificial
  CRISPR gRNA sequence
tggcccagggtgcaggcggc

SEQ ID NO: 513299 - DNA, 20 bp, Artificial
  CRISPR gRNA sequence
ggcccagggtgcaggcggcc

SEQ ID NO: 513300 - DNA, 20 bp, Artificial
  CRISPR gRNA sequence
gggtgcaggcggccaggtga

SEQ ID NO: 513301 - DNA, 20 bp, Artificial
  CRISPR gRNA sequence
gcaggcggccaggtgacagc

SEQ ID NO: 513302 - DNA, 20 bp, Artificial
  CRISPR gRNA sequence
ggcggccaggtgacagccag

SEQ ID NO: 513303 - DNA, 20 bp, Artificial
  CRISPR gRNA sequence
ggccaggtgacagccagcag

SEQ ID NO: 513304 - DNA, 20 bp, Artificial
  CRISPR gRNA sequence
aggtgacagccagcagcagc

SEQ ID NO: 513305 - DNA, 20 bp, Artificial
  CRISPR gRNA sequence
ggtgacagccagcagcagcc

SEQ ID NO: 513306 - DNA, 20 bp, Artificial
  CRISPR gRNA sequence
tgacagccagcagcagccgg

SEQ ID NO: 513307 - DNA, 20 bp, Artificial
  CRISPR gRNA sequence
gacagccagcagcagccggg

SEQ ID NO: 513308 - DNA, 20 bp, Artificial
  CRISPR gRNA sequence
acagccagcagcagccggga

SEQ ID NO: 513309 - DNA, 20 bp, Artificial
  CRISPR gRNA sequence
agccagcagcagccgggagg

SEQ ID NO: 513310 - DNA, 20 bp, Artificial
  CRISPR gRNA sequence
gccagcagcagccgggaggg

SEQ ID NO: 513311 - DNA, 20 bp, Artificial
  CRISPR gRNA sequence
agcagcagccgggagggagg

SEQ ID NO: 513312 - DNA, 20 bp, Artificial
  CRISPR gRNA sequence
gcagccgggagggaggcagc

SEQ ID NO: 513313 - DNA, 20 bp, Artificial
  CRISPR gRNA sequence
cagccgggagggaggcagct

SEQ ID NO: 513314 - DNA, 20 bp, Artificial
  CRISPR gRNA sequence
gccgggagggaggcagctgg

SEQ ID NO: 513315 - DNA, 20 bp, Artificial
  CRISPR gRNA sequence
ggagggaggcagctgggaga

SEQ ID NO: 513316 - DNA, 20 bp, Artificial
  CRISPR gRNA sequence
ggaggcagctgggagacagt

SEQ ID NO: 513317 - DNA, 20 bp, Artificial
  CRISPR gRNA sequence
gaggcagctgggagacagtg

SEQ ID NO: 513318 - DNA, 20 bp, Artificial
  CRISPR gRNA sequence
aggcagctgggagacagtga

SEQ ID NO: 513319 - DNA, 20 bp, Artificial
  CRISPR gRNA sequence
agctgggagacagtgaggga

SEQ ID NO: 513320 - DNA, 20 bp, Artificial
  CRISPR gRNA sequence
gctgggagacagtgagggat

SEQ ID NO: 513321 - DNA, 20 bp, Artificial
  CRISPR gRNA sequence
ctgggagacagtgagggatg

SEQ ID NO: 513322 - DNA, 20 bp, Artificial
  CRISPR gRNA sequence
agacagtgagggatggggcc

SEQ ID NO: 513323 - DNA, 20 bp, Artificial
  CRISPR gRNA sequence
gagggatggggccgagccat

SEQ ID NO: 513324 - DNA, 20 bp, Artificial
  CRISPR gRNA sequence
agggatggggccgagccatt

SEQ ID NO: 513325 - DNA, 20 bp, Artificial
  CRISPR gRNA sequence
gggatggggccgagccattg

SEQ ID NO: 513326 - DNA, 20 bp, Artificial
  CRISPR gRNA sequence
gatggggccgagccattggg

SEQ ID NO: 513327 - DNA, 20 bp, Artificial
  CRISPR gRNA sequence
atggggccgagccattgggg

SEQ ID NO: 513328 - DNA, 20 bp, Artificial
  CRISPR gRNA sequence
gagccattggggaggtcctg

SEQ ID NO: 513329 - DNA, 20 bp, Artificial
  CRISPR gRNA sequence
agccattggggaggtcctgc

SEQ ID NO: 513330 - DNA, 20 bp, Artificial
  CRISPR gRNA sequence
ccattggggaggtcctgcag

SEQ ID NO: 513331 - DNA, 20 bp, Artificial
  CRISPR gRNA sequence
ttggggaggtcctgcaggag

SEQ ID NO: 513332 - DNA, 20 bp, Artificial
  CRISPR gRNA sequence
tggggaggtcctgcaggagc

SEQ ID NO: 513333 - DNA, 20 bp, Artificial
  CRISPR gRNA sequence
ggggaggtcctgcaggagca

SEQ ID NO: 513334 - DNA, 20 bp, Artificial
  CRISPR gRNA sequence
ggtcctgcaggagcagggcc

SEQ ID NO: 513335 - DNA, 20 bp, Artificial
  CRISPR gRNA sequence
gtcctgcaggagcagggccc

SEQ ID NO: 513336 - DNA, 20 bp, Artificial
  CRISPR gRNA sequence
gagcagggcccaggtgtccc

SEQ ID NO: 513337 - DNA, 20 bp, Artificial
  CRISPR gRNA sequence
agcagggcccaggtgtccct

SEQ ID NO: 513338 - DNA, 20 bp, Artificial
  CRISPR gRNA sequence
gcagggcccaggtgtccctg

SEQ ID NO: 513339 - DNA, 20 bp, Artificial
  CRISPR gRNA sequence
cagggcccaggtgtccctgg

SEQ ID NO: 513340 - DNA, 20 bp, Artificial
  CRISPR gRNA sequence
ggcccaggtgtccctggggg

SEQ ID NO: 513341 - DNA, 20 bp, Artificial
  CRISPR gRNA sequence
ccaggtgtccctgggggcag

SEQ ID NO: 513342 - DNA, 20 bp, Artificial
  CRISPR gRNA sequence
caggtgtccctgggggcagc

SEQ ID NO: 513343 - DNA, 20 bp, Artificial
  CRISPR gRNA sequence
aggtgtccctgggggcagca

SEQ ID NO: 513344 - DNA, 20 bp, Artificial
  CRISPR gRNA sequence
ggtgtccctgggggcagcag

SEQ ID NO: 513345 - DNA, 20 bp, Artificial
  CRISPR gRNA sequence
caggggacaaaaccccaccc

SEQ ID NO: 513346 - DNA, 20 bp, Artificial
  CRISPR gRNA sequence
gggacaaaaccccaccctgg

SEQ ID NO: 513347 - DNA, 20 bp, Artificial
  CRISPR gRNA sequence
acaaaaccccaccctggtgg

SEQ ID NO: 513348 - DNA, 20 bp, Artificial
  CRISPR gRNA sequence
caaaaccccaccctggtggt

SEQ ID NO: 513349 - DNA, 20 bp, Artificial
  CRISPR gRNA sequence
aaaaccccaccctggtggta

SEQ ID NO: 513350 - DNA, 20 bp, Artificial
  CRISPR gRNA sequence
ccccaccctggtggtagggt

SEQ ID NO: 513351 - DNA, 20 bp, Artificial
  CRISPR gRNA sequence
cccaccctggtggtagggtc

SEQ ID NO: 513352 - DNA, 20 bp, Artificial
  CRISPR gRNA sequence
cctgcccctcgctgccccgt

SEQ ID NO: 513353 - DNA, 20 bp, Artificial
  CRISPR gRNA sequence
gcccctcgctgccccgtgag

SEQ ID NO: 513354 - DNA, 20 bp, Artificial
  CRISPR gRNA sequence
cccctcgctgccccgtgagc

SEQ ID NO: 513355 - DNA, 20 bp, Artificial
  CRISPR gRNA sequence
gctgccccgtgagcaggcac

SEQ ID NO: 513356 - DNA, 20 bp, Artificial
  CRISPR gRNA sequence
aggcacaagccccttcgtgc

SEQ ID NO: 513357 - DNA, 20 bp, Artificial
  CRISPR gRNA sequence
ccacctctgacctcaaactc

SEQ ID NO: 513358 - DNA, 20 bp, Artificial
  CRISPR gRNA sequence
cacctctgacctcaaactcg

SEQ ID NO: 513359 - DNA, 20 bp, Artificial
  CRISPR gRNA sequence
acctctgacctcaaactcga

SEQ ID NO: 513360 - DNA, 20 bp, Artificial
  CRISPR gRNA sequence
tgacctcaaactcgagggcc

SEQ ID NO: 513361 - DNA, 20 bp, Artificial
  CRISPR gRNA sequence
aactcgagggcctggccctg

SEQ ID NO: 513362 - DNA, 20 bp, Artificial
  CRISPR gRNA sequence
gggcctggccctgtggcccc

SEQ ID NO: 513363 - DNA, 20 bp, Artificial
  CRISPR gRNA sequence
gcctggccctgtggcccctg

SEQ ID NO: 513364 - DNA, 20 bp, Artificial
  CRISPR gRNA sequence
cctggccctgtggcccctgg

SEQ ID NO: 513365 - DNA, 20 bp, Artificial
  CRISPR gRNA sequence
ggccctgtggcccctggagg

SEQ ID NO: 513366 - DNA, 20 bp, Artificial
  CRISPR gRNA sequence
tttccccacgccccacttca

SEQ ID NO: 513367 - DNA, 20 bp, Artificial
  CRISPR gRNA sequence
cccacgccccacttcacagt

SEQ ID NO: 513368 - DNA, 20 bp, Artificial
  CRISPR gRNA sequence
ccacgccccacttcacagtg

SEQ ID NO: 513369 - DNA, 20 bp, Artificial
  CRISPR gRNA sequence
cacttcacagtgaggaaact

SEQ ID NO: 513370 - DNA, 20 bp, Artificial
  CRISPR gRNA sequence
acttcacagtgaggaaactg

SEQ ID NO: 513371 - DNA, 20 bp, Artificial
  CRISPR gRNA sequence
agtgaggaaactgaggctga

SEQ ID NO: 513372 - DNA, 20 bp, Artificial
  CRISPR gRNA sequence
tgaggaaactgaggctgaca

SEQ ID NO: 513373 - DNA, 20 bp, Artificial
  CRISPR gRNA sequence
gaggaaactgaggctgacag

SEQ ID NO: 513374 - DNA, 20 bp, Artificial
  CRISPR gRNA sequence
gctgacagaggtgttgcctg

SEQ ID NO: 513375 - DNA, 20 bp, Artificial
  CRISPR gRNA sequence
acagaggtgttgcctgtggc

SEQ ID NO: 513376 - DNA, 20 bp, Artificial
  CRISPR gRNA sequence
agaggtgttgcctgtggcca

SEQ ID NO: 513377 - DNA, 20 bp, Artificial
  CRISPR gRNA sequence
gcctgtggccagagtttgtg

SEQ ID NO: 513378 - DNA, 20 bp, Artificial
  CRISPR gRNA sequence
ccagagtttgtgcagctctg

SEQ ID NO: 513379 - DNA, 20 bp, Artificial
  CRISPR gRNA sequence
tttgtgcagctctgtggtgc

SEQ ID NO: 513380 - DNA, 20 bp, Artificial
  CRISPR gRNA sequence
tgtgcagctctgtggtgctg

SEQ ID NO: 513381 - DNA, 20 bp, Artificial
  CRISPR gRNA sequence
gtgcagctctgtggtgctgg

SEQ ID NO: 513382 - DNA, 20 bp, Artificial
  CRISPR gRNA sequence
ctctgtggtgctggaggtgt

SEQ ID NO: 513383 - DNA, 20 bp, Artificial
  CRISPR gRNA sequence
tctgtggtgctggaggtgtc

SEQ ID NO: 513384 - DNA, 20 bp, Artificial
  CRISPR gRNA sequence
gtggtgctggaggtgtcagg

SEQ ID NO: 513385 - DNA, 20 bp, Artificial
  CRISPR gRNA sequence
tggtgctggaggtgtcagga

SEQ ID NO: 513386 - DNA, 20 bp, Artificial
  CRISPR gRNA sequence
ggtgtcaggaaggatcgtcc

SEQ ID NO: 513387 - DNA, 20 bp, Artificial
  CRISPR gRNA sequence
tgtcaggaaggatcgtcctg

SEQ ID NO: 513388 - DNA, 20 bp, Artificial
  CRISPR gRNA sequence
gtcaggaaggatcgtcctgg

SEQ ID NO: 513389 - DNA, 20 bp, Artificial
  CRISPR gRNA sequence
tcaggaaggatcgtcctgga

SEQ ID NO: 513390 - DNA, 20 bp, Artificial
  CRISPR gRNA sequence
ggaaggatcgtcctggaggg

SEQ ID NO: 513391 - DNA, 20 bp, Artificial
  CRISPR gRNA sequence
gaaggatcgtcctggagggt

SEQ ID NO: 513392 - DNA, 20 bp, Artificial
  CRISPR gRNA sequence
aaggatcgtcctggagggtg

SEQ ID NO: 513393 - DNA, 20 bp, Artificial
  CRISPR gRNA sequence
aggatcgtcctggagggtgg

SEQ ID NO: 513394 - DNA, 20 bp, Artificial
  CRISPR gRNA sequence
tggagggtgggggtgcgcct

SEQ ID NO: 513395 - DNA, 20 bp, Artificial
  CRISPR gRNA sequence
agggtgggggtgcgcctgag

SEQ ID NO: 513396 - DNA, 20 bp, Artificial
  CRISPR gRNA sequence
gggtgggggtgcgcctgagt

SEQ ID NO: 513397 - DNA, 20 bp, Artificial
  CRISPR gRNA sequence
ggtgggggtgcgcctgagtg

SEQ ID NO: 513398 - DNA, 20 bp, Artificial
  CRISPR gRNA sequence
gtgggggtgcgcctgagtgg

SEQ ID NO: 513399 - DNA, 20 bp, Artificial
  CRISPR gRNA sequence
gtgggggcatccttgtgccg

SEQ ID NO: 513400 - DNA, 20 bp, Artificial
  CRISPR gRNA sequence
tgggggcatccttgtgccgt

SEQ ID NO: 513401 - DNA, 20 bp, Artificial
  CRISPR gRNA sequence
gggggcatccttgtgccgtg

SEQ ID NO: 513402 - DNA, 20 bp, Artificial
  CRISPR gRNA sequence
ggcatccttgtgccgtgggg

SEQ ID NO: 513403 - DNA, 20 bp, Artificial
  CRISPR gRNA sequence
gcatccttgtgccgtgggga

SEQ ID NO: 513404 - DNA, 20 bp, Artificial
  CRISPR gRNA sequence
catccttgtgccgtggggaa

SEQ ID NO: 513405 - DNA, 20 bp, Artificial
  CRISPR gRNA sequence
ccttgtgccgtggggaaggg

SEQ ID NO: 513406 - DNA, 20 bp, Artificial
  CRISPR gRNA sequence
cttgtgccgtggggaagggt

SEQ ID NO: 513407 - DNA, 20 bp, Artificial
  CRISPR gRNA sequence
ttgtgccgtggggaagggtg

SEQ ID NO: 513408 - DNA, 20 bp, Artificial
  CRISPR gRNA sequence
tgtgccgtggggaagggtgg

SEQ ID NO: 513409 - DNA, 20 bp, Artificial
  CRISPR gRNA sequence
tgccgtggggaagggtgggg

SEQ ID NO: 513410 - DNA, 20 bp, Artificial
  CRISPR gRNA sequence
cgtggggaagggtgggggag

SEQ ID NO: 513411 - DNA, 20 bp, Artificial
  CRISPR gRNA sequence
ggtgggggagtggctgccca

SEQ ID NO: 513412 - DNA, 20 bp, Artificial
  CRISPR gRNA sequence
gggagtggctgcccacggcc

SEQ ID NO: 513413 - DNA, 20 bp, Artificial
  CRISPR gRNA sequence
tggcatgcatccccactgtg

SEQ ID NO: 513414 - DNA, 20 bp, Artificial
  CRISPR gRNA sequence
ggcatgcatccccactgtgc

SEQ ID NO: 513415 - DNA, 20 bp, Artificial
  CRISPR gRNA sequence
gcatgcatccccactgtgca

SEQ ID NO: 513416 - DNA, 20 bp, Artificial
  CRISPR gRNA sequence
catgcatccccactgtgcag

SEQ ID NO: 513417 - DNA, 20 bp, Artificial
  CRISPR gRNA sequence
atgcatccccactgtgcagg

SEQ ID NO: 513418 - DNA, 20 bp, Artificial
  CRISPR gRNA sequence
tgtgcagggggcaaatgctg

SEQ ID NO: 513419 - DNA, 20 bp, Artificial
  CRISPR gRNA sequence
ggggcaaatgctgtggcctc

SEQ ID NO: 513420 - DNA, 20 bp, Artificial
  CRISPR gRNA sequence
gggcaaatgctgtggcctct

SEQ ID NO: 513421 - DNA, 20 bp, Artificial
  CRISPR gRNA sequence
gcaaatgctgtggcctctgg

SEQ ID NO: 513422 - DNA, 20 bp, Artificial
  CRISPR gRNA sequence
caaatgctgtggcctctggg

SEQ ID NO: 513423 - DNA, 20 bp, Artificial
  CRISPR gRNA sequence
aaatgctgtggcctctggga

SEQ ID NO: 513424 - DNA, 20 bp, Artificial
  CRISPR gRNA sequence
ctgtggcctctgggagggca

SEQ ID NO: 513425 - DNA, 20 bp, Artificial
  CRISPR gRNA sequence
tgtggcctctgggagggcac

SEQ ID NO: 513426 - DNA, 20 bp, Artificial
  CRISPR gRNA sequence
gcctctgggagggcacaggt

SEQ ID NO: 513427 - DNA, 20 bp, Artificial
  CRISPR gRNA sequence
tgggagggcacaggtgagct

SEQ ID NO: 513428 - DNA, 20 bp, Artificial
  CRISPR gRNA sequence
gggagggcacaggtgagctc

SEQ ID NO: 513429 - DNA, 20 bp, Artificial
  CRISPR gRNA sequence
agggcacaggtgagctcggg

SEQ ID NO: 513430 - DNA, 20 bp, Artificial
  CRISPR gRNA sequence
caggtgagctcgggtggatg

SEQ ID NO: 513431 - DNA, 20 bp, Artificial
  CRISPR gRNA sequence
aggtgagctcgggtggatgc

SEQ ID NO: 513432 - DNA, 20 bp, Artificial
  CRISPR gRNA sequence
gagctcgggtggatgcaggt

SEQ ID NO: 513433 - DNA, 20 bp, Artificial
  CRISPR gRNA sequence
agctcgggtggatgcaggtg

SEQ ID NO: 513434 - DNA, 20 bp, Artificial
  CRISPR gRNA sequence
gctcgggtggatgcaggtga

SEQ ID NO: 513435 - DNA, 20 bp, Artificial
  CRISPR gRNA sequence
cgggtggatgcaggtgaggg

SEQ ID NO: 513436 - DNA, 20 bp, Artificial
  CRISPR gRNA sequence
gggtggatgcaggtgagggt

SEQ ID NO: 513437 - DNA, 20 bp, Artificial
  CRISPR gRNA sequence
caggtgagggtaggcaaact

SEQ ID NO: 513438 - DNA, 20 bp, Artificial
  CRISPR gRNA sequence
aggtgagggtaggcaaactc

SEQ ID NO: 513439 - DNA, 20 bp, Artificial
  CRISPR gRNA sequence
gagggtaggcaaactcgggt

SEQ ID NO: 513440 - DNA, 20 bp, Artificial
  CRISPR gRNA sequence
aggcaaactcgggtgagcac

SEQ ID NO: 513441 - DNA, 20 bp, Artificial
  CRISPR gRNA sequence
ggcaaactcgggtgagcacc

SEQ ID NO: 513442 - DNA, 20 bp, Artificial
  CRISPR gRNA sequence
gcaaactcgggtgagcacca

SEQ ID NO: 513443 - DNA, 20 bp, Artificial
  CRISPR gRNA sequence
aaactcgggtgagcaccagg

SEQ ID NO: 513444 - DNA, 20 bp, Artificial
  CRISPR gRNA sequence
actcgggtgagcaccaggga

SEQ ID NO: 513445 - DNA, 20 bp, Artificial
  CRISPR gRNA sequence
gcaccagggagagatcttaa

SEQ ID NO: 513446 - DNA, 20 bp, Artificial
  CRISPR gRNA sequence
gagagatcttaacagcaccc

SEQ ID NO: 513447 - DNA, 20 bp, Artificial
  CRISPR gRNA sequence
agagatcttaacagcacccc

SEQ ID NO: 513448 - DNA, 20 bp, Artificial
  CRISPR gRNA sequence
gagatcttaacagcacccca

SEQ ID NO: 513449 - DNA, 20 bp, Artificial
  CRISPR gRNA sequence
ttaacagcaccccagggcca

SEQ ID NO: 513450 - DNA, 20 bp, Artificial
  CRISPR gRNA sequence
taacagcaccccagggccac

SEQ ID NO: 513451 - DNA, 20 bp, Artificial
  CRISPR gRNA sequence
accccagggccacaggctcc

SEQ ID NO: 513452 - DNA, 20 bp, Artificial
  CRISPR gRNA sequence
cccagggccacaggctccca

SEQ ID NO: 513453 - DNA, 20 bp, Artificial
  CRISPR gRNA sequence
agggccacaggctcccagag

SEQ ID NO: 513454 - DNA, 20 bp, Artificial
  CRISPR gRNA sequence
gggccacaggctcccagagc

SEQ ID NO: 513455 - DNA, 20 bp, Artificial
  CRISPR gRNA sequence
ggccacaggctcccagagca

SEQ ID NO: 513456 - DNA, 20 bp, Artificial
  CRISPR gRNA sequence
cacaggctcccagagcaggg

SEQ ID NO: 513457 - DNA, 20 bp, Artificial
  CRISPR gRNA sequence
aggctcccagagcagggcgg

SEQ ID NO: 513458 - DNA, 20 bp, Artificial
  CRISPR gRNA sequence
ggctcccagagcagggcggc

SEQ ID NO: 513459 - DNA, 20 bp, Artificial
  CRISPR gRNA sequence
cagagcagggcggcaggatc

SEQ ID NO: 513460 - DNA, 20 bp, Artificial
  CRISPR gRNA sequence
agagcagggcggcaggatct

SEQ ID NO: 513461 - DNA, 20 bp, Artificial
  CRISPR gRNA sequence
gcagggcggcaggatctggg

SEQ ID NO: 513462 - DNA, 20 bp, Artificial
  CRISPR gRNA sequence
cagggcggcaggatctggga

SEQ ID NO: 513463 - DNA, 20 bp, Artificial
  CRISPR gRNA sequence
agggcggcaggatctgggaa

SEQ ID NO: 513464 - DNA, 20 bp, Artificial
  CRISPR gRNA sequence
gggaagggactgtcctctcg

SEQ ID NO: 513465 - DNA, 20 bp, Artificial
  CRISPR gRNA sequence
ggaagggactgtcctctcgc

SEQ ID NO: 513466 - DNA, 20 bp, Artificial
  CRISPR gRNA sequence
gaagggactgtcctctcgcg

SEQ ID NO: 513467 - DNA, 20 bp, Artificial
  CRISPR gRNA sequence
actgtcctctcgcggggtcc

SEQ ID NO: 513468 - DNA, 20 bp, Artificial
  CRISPR gRNA sequence
gggtcctggccctacccccg

SEQ ID NO: 513469 - DNA, 20 bp, Artificial
  CRISPR gRNA sequence
gccctacccccgcagcctgc

SEQ ID NO: 513470 - DNA, 20 bp, Artificial
  CRISPR gRNA sequence
cagcctgctggcccttcgct

SEQ ID NO: 513471 - DNA, 20 bp, Artificial
  CRISPR gRNA sequence
ccttcgctgagcctctactc

SEQ ID NO: 513472 - DNA, 20 bp, Artificial
  CRISPR gRNA sequence
tcgctgagcctctactctgg

SEQ ID NO: 513473 - DNA, 20 bp, Artificial
  CRISPR gRNA sequence
cgctgagcctctactctgga

SEQ ID NO: 513474 - DNA, 20 bp, Artificial
  CRISPR gRNA sequence
gctgagcctctactctggaa

SEQ ID NO: 513475 - DNA, 20 bp, Artificial
  CRISPR gRNA sequence
gagcctctactctggaaggg

SEQ ID NO: 513476 - DNA, 20 bp, Artificial
  CRISPR gRNA sequence
agcctctactctggaaggga

SEQ ID NO: 513477 - DNA, 20 bp, Artificial
  CRISPR gRNA sequence
gcctctactctggaagggaa

SEQ ID NO: 513478 - DNA, 20 bp, Artificial
  CRISPR gRNA sequence
ctactctggaagggaaggga

SEQ ID NO: 513479 - DNA, 20 bp, Artificial
  CRISPR gRNA sequence
tactctggaagggaagggac

SEQ ID NO: 513480 - DNA, 20 bp, Artificial
  CRISPR gRNA sequence
actctggaagggaagggacg

SEQ ID NO: 513481 - DNA, 20 bp, Artificial
  CRISPR gRNA sequence
agggaagggacggggcccct

SEQ ID NO: 513482 - DNA, 20 bp, Artificial
  CRISPR gRNA sequence
aagggacggggccccttggt

SEQ ID NO: 513483 - DNA, 20 bp, Artificial
  CRISPR gRNA sequence
ggccccttggtcagccacca

SEQ ID NO: 513484 - DNA, 20 bp, Artificial
  CRISPR gRNA sequence
gccccttggtcagccaccaa

SEQ ID NO: 513485 - DNA, 20 bp, Artificial
  CRISPR gRNA sequence
atgtctgtgccctttgactg

SEQ ID NO: 513486 - DNA, 20 bp, Artificial
  CRISPR gRNA sequence
tgtgccctttgactgcagca

SEQ ID NO: 513487 - DNA, 20 bp, Artificial
  CRISPR gRNA sequence
cagcatggccacattgctcg

SEQ ID NO: 513488 - DNA, 20 bp, Artificial
  CRISPR gRNA sequence
agcatggccacattgctcgt

SEQ ID NO: 513489 - DNA, 20 bp, Artificial
  CRISPR gRNA sequence
gcatggccacattgctcgtg

SEQ ID NO: 513490 - DNA, 20 bp, Artificial
  CRISPR gRNA sequence
ccacattgctcgtggggaca

SEQ ID NO: 513491 - DNA, 20 bp, Artificial
  CRISPR gRNA sequence
tgctcgtggggacatggtct

SEQ ID NO: 513492 - DNA, 20 bp, Artificial
  CRISPR gRNA sequence
ctgcctcctccatgtcgctg

SEQ ID NO: 513493 - DNA, 20 bp, Artificial
  CRISPR gRNA sequence
atgtcgctgcagacgccgca

SEQ ID NO: 513494 - DNA, 20 bp, Artificial
  CRISPR gRNA sequence
cagacgccgcacggccccca

SEQ ID NO: 513495 - DNA, 20 bp, Artificial
  CRISPR gRNA sequence
agccaaacacatttactgtc

SEQ ID NO: 513496 - DNA, 20 bp, Artificial
  CRISPR gRNA sequence
atttactgtctggcccttca

SEQ ID NO: 513497 - DNA, 20 bp, Artificial
  CRISPR gRNA sequence
actgtctggcccttcataga

SEQ ID NO: 513498 - DNA, 20 bp, Artificial
  CRISPR gRNA sequence
ggcccttcatagaaagtgat

SEQ ID NO: 513499 - DNA, 20 bp, Artificial
  CRISPR gRNA sequence
gcccttcatagaaagtgatt

SEQ ID NO: 513500 - DNA, 20 bp, Artificial
  CRISPR gRNA sequence
cccttcatagaaagtgattg

SEQ ID NO: 513501 - DNA, 20 bp, Artificial
  CRISPR gRNA sequence
tagaaagtgattggggtcct

SEQ ID NO: 513502 - DNA, 20 bp, Artificial
  CRISPR gRNA sequence
agtgattggggtccttggcc

SEQ ID NO: 513503 - DNA, 20 bp, Artificial
  CRISPR gRNA sequence
tgattggggtccttggccca

SEQ ID NO: 513504 - DNA, 20 bp, Artificial
  CRISPR gRNA sequence
gattggggtccttggcccag

SEQ ID NO: 513505 - DNA, 20 bp, Artificial
  CRISPR gRNA sequence
gggtccttggcccagaggcc

SEQ ID NO: 513506 - DNA, 20 bp, Artificial
  CRISPR gRNA sequence
cttggcccagaggccaagtg

SEQ ID NO: 513507 - DNA, 20 bp, Artificial
  CRISPR gRNA sequence
agaggccaagtgaagcctct

SEQ ID NO: 513508 - DNA, 20 bp, Artificial
  CRISPR gRNA sequence
gaggccaagtgaagcctctg

SEQ ID NO: 513509 - DNA, 20 bp, Artificial
  CRISPR gRNA sequence
aggccaagtgaagcctctga

SEQ ID NO: 513510 - DNA, 20 bp, Artificial
  CRISPR gRNA sequence
gtgaagcctctgagggctgc

SEQ ID NO: 513511 - DNA, 20 bp, Artificial
  CRISPR gRNA sequence
tgaagcctctgagggctgca

SEQ ID NO: 513512 - DNA, 20 bp, Artificial
  CRISPR gRNA sequence
cctctgagggctgcaaggca

SEQ ID NO: 513513 - DNA, 20 bp, Artificial
  CRISPR gRNA sequence
ctgagggctgcaaggcacag

SEQ ID NO: 513514 - DNA, 20 bp, Artificial
  CRISPR gRNA sequence
tgagggctgcaaggcacagc

SEQ ID NO: 513515 - DNA, 20 bp, Artificial
  CRISPR gRNA sequence
gagggctgcaaggcacagca

SEQ ID NO: 513516 - DNA, 20 bp, Artificial
  CRISPR gRNA sequence
gctgcaaggcacagcagggc

SEQ ID NO: 513517 - DNA, 20 bp, Artificial
  CRISPR gRNA sequence
ctgcaaggcacagcagggcg

SEQ ID NO: 513518 - DNA, 20 bp, Artificial
  CRISPR gRNA sequence
tgcaaggcacagcagggcga

SEQ ID NO: 513519 - DNA, 20 bp, Artificial
  CRISPR gRNA sequence
aggcacagcagggcgagggc

SEQ ID NO: 513520 - DNA, 20 bp, Artificial
  CRISPR gRNA sequence
ggcacagcagggcgagggcc

SEQ ID NO: 513521 - DNA, 20 bp, Artificial
  CRISPR gRNA sequence
gcacagcagggcgagggcca

SEQ ID NO: 513522 - DNA, 20 bp, Artificial
  CRISPR gRNA sequence
agcagggcgagggccagggc

SEQ ID NO: 513523 - DNA, 20 bp, Artificial
  CRISPR gRNA sequence
gcagggcgagggccagggcc

SEQ ID NO: 513524 - DNA, 20 bp, Artificial
  CRISPR gRNA sequence
agggcgagggccagggccag

SEQ ID NO: 513525 - DNA, 20 bp, Artificial
  CRISPR gRNA sequence
agggccagggccaggagtgc

SEQ ID NO: 513526 - DNA, 20 bp, Artificial
  CRISPR gRNA sequence
gggccagggccaggagtgcc

SEQ ID NO: 513527 - DNA, 20 bp, Artificial
  CRISPR gRNA sequence
aggagtgccgggtgtgaatg

SEQ ID NO: 513528 - DNA, 20 bp, Artificial
  CRISPR gRNA sequence
ggagtgccgggtgtgaatgt

SEQ ID NO: 513529 - DNA, 20 bp, Artificial
  CRISPR gRNA sequence
tgccgggtgtgaatgtgggt

SEQ ID NO: 513530 - DNA, 20 bp, Artificial
  CRISPR gRNA sequence
gggtgagtgtgtgtgtgtgt

SEQ ID NO: 513531 - DNA, 20 bp, Artificial
  CRISPR gRNA sequence
tgtgtgagcgcatgtgtgtg

SEQ ID NO: 513532 - DNA, 20 bp, Artificial
  CRISPR gRNA sequence
gtgtggtgtgtgtgtatgca

SEQ ID NO: 513533 - DNA, 20 bp, Artificial
  CRISPR gRNA sequence
gtgtgtatgcatggtgtgtg

SEQ ID NO: 513534 - DNA, 20 bp, Artificial
  CRISPR gRNA sequence
gtgtgtggtatgtatgtgtt

SEQ ID NO: 513535 - DNA, 20 bp, Artificial
  CRISPR gRNA sequence
tgtatgtgtttagcattgtg

SEQ ID NO: 513536 - DNA, 20 bp, Artificial
  CRISPR gRNA sequence
gtatgtgtttagcattgtgt

SEQ ID NO: 513537 - DNA, 20 bp, Artificial
  CRISPR gRNA sequence
tatgtgtttagcattgtgtg

SEQ ID NO: 513538 - DNA, 20 bp, Artificial
  CRISPR gRNA sequence
gtggggtgtgtgtatatgtg

SEQ ID NO: 513539 - DNA, 20 bp, Artificial
  CRISPR gRNA sequence
atgtgtggcacgtgtgtgta

SEQ ID NO: 513540 - DNA, 20 bp, Artificial
  CRISPR gRNA sequence
tgtgtggcacgtgtgtgtat

SEQ ID NO: 513541 - DNA, 20 bp, Artificial
  CRISPR gRNA sequence
tgggtgtgaatgcatgtgtg

SEQ ID NO: 513542 - DNA, 20 bp, Artificial
  CRISPR gRNA sequence
gtggcatgtgtatatgtgtg

SEQ ID NO: 513543 - DNA, 20 bp, Artificial
  CRISPR gRNA sequence
tgtggcatgcatgtgtatgt

SEQ ID NO: 513544 - DNA, 20 bp, Artificial
  CRISPR gRNA sequence
tgtatgtgagtgcatgtgtg

SEQ ID NO: 513545 - DNA, 20 bp, Artificial
  CRISPR gRNA sequence
tgtgtgtggtgtatgtgcgt

SEQ ID NO: 513546 - DNA, 20 bp, Artificial
  CRISPR gRNA sequence
tgagtgcatgtgtgtgtgtt

SEQ ID NO: 513547 - DNA, 20 bp, Artificial
  CRISPR gRNA sequence
tggtgtgtgtatgtgtgtgc

SEQ ID NO: 513548 - DNA, 20 bp, Artificial
  CRISPR gRNA sequence
cgagtgtgtgtgcgtgcatg

SEQ ID NO: 513549 - DNA, 20 bp, Artificial
  CRISPR gRNA sequence
gtgtgtttgtgtatatgaac

SEQ ID NO: 513550 - DNA, 20 bp, Artificial
  CRISPR gRNA sequence
tgtatatgaacaagtacata

SEQ ID NO: 513551 - DNA, 20 bp, Artificial
  CRISPR gRNA sequence
tagtatgtgtgctttgtgtc

SEQ ID NO: 513552 - DNA, 20 bp, Artificial
  CRISPR gRNA sequence
ttgtgtctggtgttgtgtat

SEQ ID NO: 513553 - DNA, 20 bp, Artificial
  CRISPR gRNA sequence
ctggtgttgtgtatgagtgt

SEQ ID NO: 513554 - DNA, 20 bp, Artificial
  CRISPR gRNA sequence
tggtgttgtgtatgagtgtg

SEQ ID NO: 513555 - DNA, 20 bp, Artificial
  CRISPR gRNA sequence
tgtgtgtatgcgtgcatgtg

SEQ ID NO: 513556 - DNA, 20 bp, Artificial
  CRISPR gRNA sequence
gtgtatgcgtgcatgtgtgg

SEQ ID NO: 513557 - DNA, 20 bp, Artificial
  CRISPR gRNA sequence
atgcgtgcatgtgtggtggt

SEQ ID NO: 513558 - DNA, 20 bp, Artificial
  CRISPR gRNA sequence
tgtgtggtggttggtgtttg

SEQ ID NO: 513559 - DNA, 20 bp, Artificial
  CRISPR gRNA sequence
gtggtgtgtgtgcatatttg

SEQ ID NO: 513560 - DNA, 20 bp, Artificial
  CRISPR gRNA sequence
tgtggtgtgtttgctgtgtg

SEQ ID NO: 513561 - DNA, 20 bp, Artificial
  CRISPR gRNA sequence
gtggtgtgtttgctgtgtgt

SEQ ID NO: 513562 - DNA, 20 bp, Artificial
  CRISPR gRNA sequence
gtgccatgtgcgtgtatatg

SEQ ID NO: 513563 - DNA, 20 bp, Artificial
  CRISPR gRNA sequence
tgccatgtgcgtgtatatgt

SEQ ID NO: 513564 - DNA, 20 bp, Artificial
  CRISPR gRNA sequence
acgtgtgactgtgtgtgcat

SEQ ID NO: 513565 - DNA, 20 bp, Artificial
  CRISPR gRNA sequence
catgagttatatttgtgtgt

SEQ ID NO: 513566 - DNA, 20 bp, Artificial
  CRISPR gRNA sequence
attgtgtgtgtgcatatatg

SEQ ID NO: 513567 - DNA, 20 bp, Artificial
  CRISPR gRNA sequence
ttgtgtgtgtgcatatatgt

SEQ ID NO: 513568 - DNA, 20 bp, Artificial
  CRISPR gRNA sequence
tgtgtgactgtgtgtgcatg

SEQ ID NO: 513569 - DNA, 20 bp, Artificial
  CRISPR gRNA sequence
gcatgtggtgtatttatgtg

SEQ ID NO: 513570 - DNA, 20 bp, Artificial
  CRISPR gRNA sequence
catgtggtgtatttatgtgt

SEQ ID NO: 513571 - DNA, 20 bp, Artificial
  CRISPR gRNA sequence
tgtggtgtatttatgtgtag

SEQ ID NO: 513572 - DNA, 20 bp, Artificial
  CRISPR gRNA sequence
gtgcgtgtgtgtgtgtctgt

SEQ ID NO: 513573 - DNA, 20 bp, Artificial
  CRISPR gRNA sequence
tgcgtgtgtgtgtgtctgtg

SEQ ID NO: 513574 - DNA, 20 bp, Artificial
  CRISPR gRNA sequence
cgtgtgtgtgtgtctgtgag

SEQ ID NO: 513575 - DNA, 20 bp, Artificial
  CRISPR gRNA sequence
gtgtgtgtgtgtctgtgagg

SEQ ID NO: 513576 - DNA, 20 bp, Artificial
  CRISPR gRNA sequence
tgtgtgtgtgtctgtgagga

SEQ ID NO: 513577 - DNA, 20 bp, Artificial
  CRISPR gRNA sequence
gtgtgtgtgtctgtgaggag

SEQ ID NO: 513578 - DNA, 20 bp, Artificial
  CRISPR gRNA sequence
ggggcacataccctttctcc

SEQ ID NO: 513579 - DNA, 20 bp, Artificial
  CRISPR gRNA sequence
gggcacataccctttctccc

SEQ ID NO: 513580 - DNA, 20 bp, Artificial
  CRISPR gRNA sequence
ggcacataccctttctccca

SEQ ID NO: 513581 - DNA, 20 bp, Artificial
  CRISPR gRNA sequence
ataccctttctcccagggtg

SEQ ID NO: 513582 - DNA, 20 bp, Artificial
  CRISPR gRNA sequence
ccctttctcccagggtgtgg

SEQ ID NO: 513583 - DNA, 20 bp, Artificial
  CRISPR gRNA sequence
tttctcccagggtgtggcag

SEQ ID NO: 513584 - DNA, 20 bp, Artificial
  CRISPR gRNA sequence
ttctcccagggtgtggcagc

SEQ ID NO: 513585 - DNA, 20 bp, Artificial
  CRISPR gRNA sequence
tcccagggtgtggcagcagg

SEQ ID NO: 513586 - DNA, 20 bp, Artificial
  CRISPR gRNA sequence
cccagggtgtggcagcaggc

SEQ ID NO: 513587 - DNA, 20 bp, Artificial
  CRISPR gRNA sequence
gggtgtggcagcaggcaggt

SEQ ID NO: 513588 - DNA, 20 bp, Artificial
  CRISPR gRNA sequence
ggtgtggcagcaggcaggtt

SEQ ID NO: 513589 - DNA, 20 bp, Artificial
  CRISPR gRNA sequence
gtgtggcagcaggcaggttg

SEQ ID NO: 513590 - DNA, 20 bp, Artificial
  CRISPR gRNA sequence
tgtggcagcaggcaggttgg

SEQ ID NO: 513591 - DNA, 20 bp, Artificial
  CRISPR gRNA sequence
ggcagcaggcaggttggggg

SEQ ID NO: 513592 - DNA, 20 bp, Artificial
  CRISPR gRNA sequence
cagcaggcaggttgggggtg

SEQ ID NO: 513593 - DNA, 20 bp, Artificial
  CRISPR gRNA sequence
caggcaggttgggggtggag

SEQ ID NO: 513594 - DNA, 20 bp, Artificial
  CRISPR gRNA sequence
aggcaggttgggggtggagt

SEQ ID NO: 513595 - DNA, 20 bp, Artificial
  CRISPR gRNA sequence
tctgcacttgtcctgccgcc

SEQ ID NO: 513596 - DNA, 20 bp, Artificial
  CRISPR gRNA sequence
ctgcacttgtcctgccgccc

SEQ ID NO: 513597 - DNA, 20 bp, Artificial
  CRISPR gRNA sequence
tgcacttgtcctgccgccca

SEQ ID NO: 513598 - DNA, 20 bp, Artificial
  CRISPR gRNA sequence
gcacttgtcctgccgcccag

SEQ ID NO: 513599 - DNA, 20 bp, Artificial
  CRISPR gRNA sequence
cacttgtcctgccgcccagg

SEQ ID NO: 513600 - DNA, 20 bp, Artificial
  CRISPR gRNA sequence
acttgtcctgccgcccaggg

SEQ ID NO: 513601 - DNA, 20 bp, Artificial
  CRISPR gRNA sequence
cctgccgcccaggggggctg

SEQ ID NO: 513602 - DNA, 20 bp, Artificial
  CRISPR gRNA sequence
ctgccgcccaggggggctga

SEQ ID NO: 513603 - DNA, 20 bp, Artificial
  CRISPR gRNA sequence
cgcccaggggggctgaaggc

SEQ ID NO: 513604 - DNA, 20 bp, Artificial
  CRISPR gRNA sequence
cccaggggggctgaaggctg

SEQ ID NO: 513605 - DNA, 20 bp, Artificial
  CRISPR gRNA sequence
ccaggggggctgaaggctgg

SEQ ID NO: 513606 - DNA, 20 bp, Artificial
  CRISPR gRNA sequence
caggggggctgaaggctgga

SEQ ID NO: 513607 - DNA, 20 bp, Artificial
  CRISPR gRNA sequence
gggggctgaaggctggaggg

SEQ ID NO: 513608 - DNA, 20 bp, Artificial
  CRISPR gRNA sequence
ggggctgaaggctggagggt

SEQ ID NO: 513609 - DNA, 20 bp, Artificial
  CRISPR gRNA sequence
gggctgaaggctggagggtg

SEQ ID NO: 513610 - DNA, 20 bp, Artificial
  CRISPR gRNA sequence
ctgaaggctggagggtgggg

SEQ ID NO: 513611 - DNA, 20 bp, Artificial
  CRISPR gRNA sequence
gaaggctggagggtggggca

SEQ ID NO: 513612 - DNA, 20 bp, Artificial
  CRISPR gRNA sequence
aaggctggagggtggggcag

SEQ ID NO: 513613 - DNA, 20 bp, Artificial
  CRISPR gRNA sequence
aggctggagggtggggcaga

SEQ ID NO: 513614 - DNA, 20 bp, Artificial
  CRISPR gRNA sequence
ggctggagggtggggcagag

SEQ ID NO: 513615 - DNA, 20 bp, Artificial
  CRISPR gRNA sequence
ggagggtggggcagagggga

SEQ ID NO: 513616 - DNA, 20 bp, Artificial
  CRISPR gRNA sequence
gagggtggggcagaggggac

SEQ ID NO: 513617 - DNA, 20 bp, Artificial
  CRISPR gRNA sequence
attaacatgatgtgtgttta

SEQ ID NO: 513618 - DNA, 20 bp, Artificial
  CRISPR gRNA sequence
taacatgatgtgtgtttatg

SEQ ID NO: 513619 - DNA, 20 bp, Artificial
  CRISPR gRNA sequence
acatgatgtgtgtttatgga

SEQ ID NO: 513620 - DNA, 20 bp, Artificial
  CRISPR gRNA sequence
tatggagagctgacttgtac

SEQ ID NO: 513621 - DNA, 20 bp, Artificial
  CRISPR gRNA sequence
atggagagctgacttgtacc

SEQ ID NO: 513622 - DNA, 20 bp, Artificial
  CRISPR gRNA sequence
gagctgacttgtaccaggca

SEQ ID NO: 513623 - DNA, 20 bp, Artificial
  CRISPR gRNA sequence
acttgtaccaggcacggttc

SEQ ID NO: 513624 - DNA, 20 bp, Artificial
  CRISPR gRNA sequence
cttgtaccaggcacggttct

SEQ ID NO: 513625 - DNA, 20 bp, Artificial
  CRISPR gRNA sequence
tgtaccaggcacggttctgg

SEQ ID NO: 513626 - DNA, 20 bp, Artificial
  CRISPR gRNA sequence
ccaggcacggttctgggagc

SEQ ID NO: 513627 - DNA, 20 bp, Artificial
  CRISPR gRNA sequence
caggcacggttctgggagcc

SEQ ID NO: 513628 - DNA, 20 bp, Artificial
  CRISPR gRNA sequence
aggcacggttctgggagcca

SEQ ID NO: 513629 - DNA, 20 bp, Artificial
  CRISPR gRNA sequence
ggttctgggagccagggaca

SEQ ID NO: 513630 - DNA, 20 bp, Artificial
  CRISPR gRNA sequence
gttctgggagccagggacac

SEQ ID NO: 513631 - DNA, 20 bp, Artificial
  CRISPR gRNA sequence
tgggagccagggacacaggc

SEQ ID NO: 513632 - DNA, 20 bp, Artificial
  CRISPR gRNA sequence
ccagggacacaggctggttg

SEQ ID NO: 513633 - DNA, 20 bp, Artificial
  CRISPR gRNA sequence
acacaggctggttgcggtga

SEQ ID NO: 513634 - DNA, 20 bp, Artificial
  CRISPR gRNA sequence
cacaggctggttgcggtgac

SEQ ID NO: 513635 - DNA, 20 bp, Artificial
  CRISPR gRNA sequence
tggttgcggtgacaggtaaa

SEQ ID NO: 513636 - DNA, 20 bp, Artificial
  CRISPR gRNA sequence
tgcggtgacaggtaaacaga

SEQ ID NO: 513637 - DNA, 20 bp, Artificial
  CRISPR gRNA sequence
acacaaccgcacgtgtgact

SEQ ID NO: 513638 - DNA, 20 bp, Artificial
  CRISPR gRNA sequence
ccgcacgtgtgactgagacg

SEQ ID NO: 513639 - DNA, 20 bp, Artificial
  CRISPR gRNA sequence
cgcacgtgtgactgagacgc

SEQ ID NO: 513640 - DNA, 20 bp, Artificial
  CRISPR gRNA sequence
cgtgtgactgagacgcgggc

SEQ ID NO: 513641 - DNA, 20 bp, Artificial
  CRISPR gRNA sequence
gtgactgagacgcgggcgag

SEQ ID NO: 513642 - DNA, 20 bp, Artificial
  CRISPR gRNA sequence
actgagacgcgggcgagcgg

SEQ ID NO: 513643 - DNA, 20 bp, Artificial
  CRISPR gRNA sequence
gacgcgggcgagcggaagtc

SEQ ID NO: 513644 - DNA, 20 bp, Artificial
  CRISPR gRNA sequence
acgcgggcgagcggaagtcc

SEQ ID NO: 513645 - DNA, 20 bp, Artificial
  CRISPR gRNA sequence
cgcgggcgagcggaagtcca

SEQ ID NO: 513646 - DNA, 20 bp, Artificial
  CRISPR gRNA sequence
ggcgagcggaagtccagggc

SEQ ID NO: 513647 - DNA, 20 bp, Artificial
  CRISPR gRNA sequence
gcgagcggaagtccagggct

SEQ ID NO: 513648 - DNA, 20 bp, Artificial
  CRISPR gRNA sequence
gcggaagtccagggctggga

SEQ ID NO: 513649 - DNA, 20 bp, Artificial
  CRISPR gRNA sequence
ggaagtccagggctgggatg

SEQ ID NO: 513650 - DNA, 20 bp, Artificial
  CRISPR gRNA sequence
gtccagggctgggatggaga

SEQ ID NO: 513651 - DNA, 20 bp, Artificial
  CRISPR gRNA sequence
tccagggctgggatggagaa

SEQ ID NO: 513652 - DNA, 20 bp, Artificial
  CRISPR gRNA sequence
ccagggctgggatggagaaa

SEQ ID NO: 513653 - DNA, 20 bp, Artificial
  CRISPR gRNA sequence
cagggctgggatggagaaag

SEQ ID NO: 513654 - DNA, 20 bp, Artificial
  CRISPR gRNA sequence
ggatggagaaaggggcctcc

SEQ ID NO: 513655 - DNA, 20 bp, Artificial
  CRISPR gRNA sequence
gatggagaaaggggcctcct

SEQ ID NO: 513656 - DNA, 20 bp, Artificial
  CRISPR gRNA sequence
atggagaaaggggcctcctg

SEQ ID NO: 513657 - DNA, 20 bp, Artificial
  CRISPR gRNA sequence
agaaaggggcctcctgggga

SEQ ID NO: 513658 - DNA, 20 bp, Artificial
  CRISPR gRNA sequence
cctcctggggacggcccgcg

SEQ ID NO: 513659 - DNA, 20 bp, Artificial
  CRISPR gRNA sequence
ctcctggggacggcccgcgt

SEQ ID NO: 513660 - DNA, 20 bp, Artificial
  CRISPR gRNA sequence
acggcccgcgtgggccttgc

SEQ ID NO: 513661 - DNA, 20 bp, Artificial
  CRISPR gRNA sequence
cggcccgcgtgggccttgct

SEQ ID NO: 513662 - DNA, 20 bp, Artificial
  CRISPR gRNA sequence
cccgcgtgggccttgctggg

SEQ ID NO: 513663 - DNA, 20 bp, Artificial
  CRISPR gRNA sequence
tgggccttgctgggaagtgc

SEQ ID NO: 513664 - DNA, 20 bp, Artificial
  CRISPR gRNA sequence
gggccttgctgggaagtgcc

SEQ ID NO: 513665 - DNA, 20 bp, Artificial
  CRISPR gRNA sequence
tcgtgtgatgcctgtctatg

SEQ ID NO: 513666 - DNA, 20 bp, Artificial
  CRISPR gRNA sequence
ctgtctatgtggctgctgat

SEQ ID NO: 513667 - DNA, 20 bp, Artificial
  CRISPR gRNA sequence
tgtctatgtggctgctgatg

SEQ ID NO: 513668 - DNA, 20 bp, Artificial
  CRISPR gRNA sequence
gtctatgtggctgctgatga

SEQ ID NO: 513669 - DNA, 20 bp, Artificial
  CRISPR gRNA sequence
gctgctgatgagggcgcccg

SEQ ID NO: 513670 - DNA, 20 bp, Artificial
  CRISPR gRNA sequence
ctgctgatgagggcgcccgt

SEQ ID NO: 513671 - DNA, 20 bp, Artificial
  CRISPR gRNA sequence
tgagggcgcccgtgggactg

SEQ ID NO: 513672 - DNA, 20 bp, Artificial
  CRISPR gRNA sequence
gagggcgcccgtgggactgc

SEQ ID NO: 513673 - DNA, 20 bp, Artificial
  CRISPR gRNA sequence
cgcccgtgggactgcaggca

SEQ ID NO: 513674 - DNA, 20 bp, Artificial
  CRISPR gRNA sequence
gcccgtgggactgcaggcat

SEQ ID NO: 513675 - DNA, 20 bp, Artificial
  CRISPR gRNA sequence
cccgtgggactgcaggcatg

SEQ ID NO: 513676 - DNA, 20 bp, Artificial
  CRISPR gRNA sequence
tgggactgcaggcatggggc

SEQ ID NO: 513677 - DNA, 20 bp, Artificial
  CRISPR gRNA sequence
gggactgcaggcatggggcc

SEQ ID NO: 513678 - DNA, 20 bp, Artificial
  CRISPR gRNA sequence
ctgcaggcatggggccgggt

SEQ ID NO: 513679 - DNA, 20 bp, Artificial
  CRISPR gRNA sequence
tgcaggcatggggccgggtt

SEQ ID NO: 513680 - DNA, 20 bp, Artificial
  CRISPR gRNA sequence
catggggccgggttaggtgt

SEQ ID NO: 513681 - DNA, 20 bp, Artificial
  CRISPR gRNA sequence
ggccgggttaggtgtgagcc

SEQ ID NO: 513682 - DNA, 20 bp, Artificial
  CRISPR gRNA sequence
gccgggttaggtgtgagccc

SEQ ID NO: 513683 - DNA, 20 bp, Artificial
  CRISPR gRNA sequence
ggttaggtgtgagcccaggt

SEQ ID NO: 513684 - DNA, 20 bp, Artificial
  CRISPR gRNA sequence
gccgctgccactctcaatga

SEQ ID NO: 513685 - DNA, 20 bp, Artificial
  CRISPR gRNA sequence
ccgctgccactctcaatgaa

SEQ ID NO: 513686 - DNA, 20 bp, Artificial
  CRISPR gRNA sequence
aaaggcgtccccaatgtcgc

SEQ ID NO: 513687 - DNA, 20 bp, Artificial
  CRISPR gRNA sequence
atgtcgctggcgtcaactct

SEQ ID NO: 513688 - DNA, 20 bp, Artificial
  CRISPR gRNA sequence
ggcgtcaactctaagcaccc

SEQ ID NO: 513689 - DNA, 20 bp, Artificial
  CRISPR gRNA sequence
gcgtcaactctaagcacccc

SEQ ID NO: 513690 - DNA, 20 bp, Artificial
  CRISPR gRNA sequence
tcaactctaagcaccccagg

SEQ ID NO: 513691 - DNA, 20 bp, Artificial
  CRISPR gRNA sequence
caactctaagcaccccaggc

SEQ ID NO: 513692 - DNA, 20 bp, Artificial
  CRISPR gRNA sequence
taagcaccccaggcgggttt

SEQ ID NO: 513693 - DNA, 20 bp, Artificial
  CRISPR gRNA sequence
gcgggtttcagtgtcactgc

SEQ ID NO: 513694 - DNA, 20 bp, Artificial
  CRISPR gRNA sequence
cgggtttcagtgtcactgcg

SEQ ID NO: 513695 - DNA, 20 bp, Artificial
  CRISPR gRNA sequence
gcgaggcacatgcctgcgtc

SEQ ID NO: 513696 - DNA, 20 bp, Artificial
  CRISPR gRNA sequence
cgaggcacatgcctgcgtcc

SEQ ID NO: 513697 - DNA, 20 bp, Artificial
  CRISPR gRNA sequence
aggcacatgcctgcgtccgg

SEQ ID NO: 513698 - DNA, 20 bp, Artificial
  CRISPR gRNA sequence
atgtccttcctctgaaactc

SEQ ID NO: 513699 - DNA, 20 bp, Artificial
  CRISPR gRNA sequence
ctctgaaactccagcctgcc

SEQ ID NO: 513700 - DNA, 20 bp, Artificial
  CRISPR gRNA sequence
ctgcctggatgtcctgtgtc

SEQ ID NO: 513701 - DNA, 20 bp, Artificial
  CRISPR gRNA sequence
gatgtcctgtgtctggtcct

SEQ ID NO: 513702 - DNA, 20 bp, Artificial
  CRISPR gRNA sequence
ctggtcctcagctctcctgc

SEQ ID NO: 513703 - DNA, 20 bp, Artificial
  CRISPR gRNA sequence
tggtcctcagctctcctgcc

SEQ ID NO: 513704 - DNA, 20 bp, Artificial
  CRISPR gRNA sequence
tcctcagctctcctgccagg

SEQ ID NO: 513705 - DNA, 20 bp, Artificial
  CRISPR gRNA sequence
cctcagctctcctgccaggc

SEQ ID NO: 513706 - DNA, 20 bp, Artificial
  CRISPR gRNA sequence
ctcagctctcctgccaggcg

SEQ ID NO: 513707 - DNA, 20 bp, Artificial
  CRISPR gRNA sequence
cagctctcctgccaggcggg

SEQ ID NO: 513708 - DNA, 20 bp, Artificial
  CRISPR gRNA sequence
gctctcctgccaggcgggga

SEQ ID NO: 513709 - DNA, 20 bp, Artificial
  CRISPR gRNA sequence
ctctcctgccaggcggggag

SEQ ID NO: 513710 - DNA, 20 bp, Artificial
  CRISPR gRNA sequence
tctcctgccaggcggggaga

SEQ ID NO: 513711 - DNA, 20 bp, Artificial
  CRISPR gRNA sequence
ctcctgccaggcggggagag

SEQ ID NO: 513712 - DNA, 20 bp, Artificial
  CRISPR gRNA sequence
cctgccaggcggggagaggg

SEQ ID NO: 513713 - DNA, 20 bp, Artificial
  CRISPR gRNA sequence
ctgccaggcggggagagggg

SEQ ID NO: 513714 - DNA, 20 bp, Artificial
  CRISPR gRNA sequence
caggcggggagaggggaggt

SEQ ID NO: 513715 - DNA, 20 bp, Artificial
  CRISPR gRNA sequence
aggcggggagaggggaggtc

SEQ ID NO: 513716 - DNA, 20 bp, Artificial
  CRISPR gRNA sequence
gcggggagaggggaggtcag

SEQ ID NO: 513717 - DNA, 20 bp, Artificial
  CRISPR gRNA sequence
cggggagaggggaggtcagg

SEQ ID NO: 513718 - DNA, 20 bp, Artificial
  CRISPR gRNA sequence
gaggggaggtcaggaggatt

SEQ ID NO: 513719 - DNA, 20 bp, Artificial
  CRISPR gRNA sequence
aggggaggtcaggaggattt

SEQ ID NO: 513720 - DNA, 20 bp, Artificial
  CRISPR gRNA sequence
ggggaggtcaggaggatttg

SEQ ID NO: 513721 - DNA, 20 bp, Artificial
  CRISPR gRNA sequence
gggaggtcaggaggatttgg

SEQ ID NO: 513722 - DNA, 20 bp, Artificial
  CRISPR gRNA sequence
ggtcaggaggatttgggggc

SEQ ID NO: 513723 - DNA, 20 bp, Artificial
  CRISPR gRNA sequence
tcaggaggatttgggggctg

SEQ ID NO: 513724 - DNA, 20 bp, Artificial
  CRISPR gRNA sequence
caggaggatttgggggctgg

SEQ ID NO: 513725 - DNA, 20 bp, Artificial
  CRISPR gRNA sequence
ggaggatttgggggctggag

SEQ ID NO: 513726 - DNA, 20 bp, Artificial
  CRISPR gRNA sequence
aggatttgggggctggagga

SEQ ID NO: 513727 - DNA, 20 bp, Artificial
  CRISPR gRNA sequence
ggatttgggggctggaggag

SEQ ID NO: 513728 - DNA, 20 bp, Artificial
  CRISPR gRNA sequence
gatttgggggctggaggaga

SEQ ID NO: 513729 - DNA, 20 bp, Artificial
  CRISPR gRNA sequence
ggggctggaggagagggtgc

SEQ ID NO: 513730 - DNA, 20 bp, Artificial
  CRISPR gRNA sequence
gaggagagggtgccagtgca

SEQ ID NO: 513731 - DNA, 20 bp, Artificial
  CRISPR gRNA sequence
gtgccagtgcacagcccgct

SEQ ID NO: 513732 - DNA, 20 bp, Artificial
  CRISPR gRNA sequence
tgccagtgcacagcccgctc

SEQ ID NO: 513733 - DNA, 20 bp, Artificial
  CRISPR gRNA sequence
gccagtgcacagcccgctcg

SEQ ID NO: 513734 - DNA, 20 bp, Artificial
  CRISPR gRNA sequence
cgctcggggccacacgcccc

SEQ ID NO: 513735 - DNA, 20 bp, Artificial
  CRISPR gRNA sequence
cgcccccagacaccctgtgt

SEQ ID NO: 513736 - DNA, 20 bp, Artificial
  CRISPR gRNA sequence
agacaccctgtgtgagatgt

SEQ ID NO: 513737 - DNA, 20 bp, Artificial
  CRISPR gRNA sequence
gacaccctgtgtgagatgtg

SEQ ID NO: 513738 - DNA, 20 bp, Artificial
  CRISPR gRNA sequence
cctgtgtgagatgtgaggtg

SEQ ID NO: 513739 - DNA, 20 bp, Artificial
  CRISPR gRNA sequence
tccttttgttctgtccccac

SEQ ID NO: 513740 - DNA, 20 bp, Artificial
  CRISPR gRNA sequence
ttttgttctgtccccaccgg

SEQ ID NO: 513741 - DNA, 20 bp, Artificial
  CRISPR gRNA sequence
tttgttctgtccccaccggc

SEQ ID NO: 513742 - DNA, 20 bp, Artificial
  CRISPR gRNA sequence
ttctgtccccaccggcaggc

SEQ ID NO: 513743 - DNA, 20 bp, Artificial
  CRISPR gRNA sequence
tctgtccccaccggcaggcc

SEQ ID NO: 513744 - DNA, 20 bp, Artificial
  CRISPR gRNA sequence
gtccccaccggcaggccagg

SEQ ID NO: 513745 - DNA, 20 bp, Artificial
  CRISPR gRNA sequence
cccaccggcaggccaggcag

SEQ ID NO: 513746 - DNA, 20 bp, Artificial
  CRISPR gRNA sequence
cagcgttcaacgtgaccttc

SEQ ID NO: 513747 - DNA, 20 bp, Artificial
  CRISPR gRNA sequence
cgttcaacgtgaccttccgg

SEQ ID NO: 513748 - DNA, 20 bp, Artificial
  CRISPR gRNA sequence
gttcaacgtgaccttccggc

SEQ ID NO: 513749 - DNA, 20 bp, Artificial
  CRISPR gRNA sequence
acgtgaccttccggcgggcc

SEQ ID NO: 513750 - DNA, 20 bp, Artificial
  CRISPR gRNA sequence
cgtgaccttccggcgggcca

SEQ ID NO: 513751 - DNA, 20 bp, Artificial
  CRISPR gRNA sequence
gtgaccttccggcgggccaa

SEQ ID NO: 513752 - DNA, 20 bp, Artificial
  CRISPR gRNA sequence
catcgacctgtactatctga

SEQ ID NO: 513753 - DNA, 20 bp, Artificial
  CRISPR gRNA sequence
tactccatgcttgatgacct

SEQ ID NO: 513754 - DNA, 20 bp, Artificial
  CRISPR gRNA sequence
actccatgcttgatgacctc

SEQ ID NO: 513755 - DNA, 20 bp, Artificial
  CRISPR gRNA sequence
ttgatgacctcaggaatgtc

SEQ ID NO: 513756 - DNA, 20 bp, Artificial
  CRISPR gRNA sequence
atgacctcaggaatgtcaag

SEQ ID NO: 513757 - DNA, 20 bp, Artificial
  CRISPR gRNA sequence
cctcaggaatgtcaagaagc

SEQ ID NO: 513758 - DNA, 20 bp, Artificial
  CRISPR gRNA sequence
ctcaggaatgtcaagaagct

SEQ ID NO: 513759 - DNA, 20 bp, Artificial
  CRISPR gRNA sequence
aggaatgtcaagaagctagg

SEQ ID NO: 513760 - DNA, 20 bp, Artificial
  CRISPR gRNA sequence
agctaggtggcgacctgctc

SEQ ID NO: 513761 - DNA, 20 bp, Artificial
  CRISPR gRNA sequence
gctaggtggcgacctgctcc

SEQ ID NO: 513762 - DNA, 20 bp, Artificial
  CRISPR gRNA sequence
acctgctccgggccctcaac

SEQ ID NO: 513763 - DNA, 20 bp, Artificial
  CRISPR gRNA sequence
gggccctcaacgagatcacc

SEQ ID NO: 513764 - DNA, 20 bp, Artificial
  CRISPR gRNA sequence
ctcaacgagatcaccgagtc

SEQ ID NO: 513765 - DNA, 20 bp, Artificial
  CRISPR gRNA sequence
atcaccgagtccggccgcat

SEQ ID NO: 513766 - DNA, 20 bp, Artificial
  CRISPR gRNA sequence
ccgagtccggccgcattggt

SEQ ID NO: 513767 - DNA, 20 bp, Artificial
  CRISPR gRNA sequence
cgagtccggccgcattggtg

SEQ ID NO: 513768 - DNA, 20 bp, Artificial
  CRISPR gRNA sequence
ccggccgcattggtgaggcc

SEQ ID NO: 513769 - DNA, 20 bp, Artificial
  CRISPR gRNA sequence
cggccgcattggtgaggccc

SEQ ID NO: 513770 - DNA, 20 bp, Artificial
  CRISPR gRNA sequence
ttggtgaggcccaggcactg

SEQ ID NO: 513771 - DNA, 20 bp, Artificial
  CRISPR gRNA sequence
tggtgaggcccaggcactgc

SEQ ID NO: 513772 - DNA, 20 bp, Artificial
  CRISPR gRNA sequence
aggcactgcaggacaaaacc

SEQ ID NO: 513773 - DNA, 20 bp, Artificial
  CRISPR gRNA sequence
gacaaaacccagtcctttcc

SEQ ID NO: 513774 - DNA, 20 bp, Artificial
  CRISPR gRNA sequence
cccagtcctttcccagaccc

SEQ ID NO: 513775 - DNA, 20 bp, Artificial
  CRISPR gRNA sequence
accctggccactcctgcctg

SEQ ID NO: 513776 - DNA, 20 bp, Artificial
  CRISPR gRNA sequence
cccacacaactcctcgcact

SEQ ID NO: 513777 - DNA, 20 bp, Artificial
  CRISPR gRNA sequence
ccacacaactcctcgcactc

SEQ ID NO: 513778 - DNA, 20 bp, Artificial
  CRISPR gRNA sequence
actcctcgcactcaggtccc

SEQ ID NO: 513779 - DNA, 20 bp, Artificial
  CRISPR gRNA sequence
ctcctcgcactcaggtcccc

SEQ ID NO: 513780 - DNA, 20 bp, Artificial
  CRISPR gRNA sequence
tcctcgcactcaggtcccca

SEQ ID NO: 513781 - DNA, 20 bp, Artificial
  CRISPR gRNA sequence
tcgcactcaggtccccaggg

SEQ ID NO: 513782 - DNA, 20 bp, Artificial
  CRISPR gRNA sequence
tcaggtccccagggtagatc

SEQ ID NO: 513783 - DNA, 20 bp, Artificial
  CRISPR gRNA sequence
caggtccccagggtagatct

SEQ ID NO: 513784 - DNA, 20 bp, Artificial
  CRISPR gRNA sequence
aggtccccagggtagatctg

SEQ ID NO: 513785 - DNA, 20 bp, Artificial
  CRISPR gRNA sequence
ggtccccagggtagatctgg

SEQ ID NO: 513786 - DNA, 20 bp, Artificial
  CRISPR gRNA sequence
cagggtagatctgggggccc

SEQ ID NO: 513787 - DNA, 20 bp, Artificial
  CRISPR gRNA sequence
agatctgggggccccagatg

SEQ ID NO: 513788 - DNA, 20 bp, Artificial
  CRISPR gRNA sequence
gatctgggggccccagatgc

SEQ ID NO: 513789 - DNA, 20 bp, Artificial
  CRISPR gRNA sequence
gccccagatgcaggtccccc

SEQ ID NO: 513790 - DNA, 20 bp, Artificial
  CRISPR gRNA sequence
ccccagatgcaggtcccccc

SEQ ID NO: 513791 - DNA, 20 bp, Artificial
  CRISPR gRNA sequence
cccagatgcaggtcccccca

SEQ ID NO: 513792 - DNA, 20 bp, Artificial
  CRISPR gRNA sequence
aggtccccccagggcatcca

SEQ ID NO: 513793 - DNA, 20 bp, Artificial
  CRISPR gRNA sequence
ggtccccccagggcatccac

SEQ ID NO: 513794 - DNA, 20 bp, Artificial
  CRISPR gRNA sequence
gtccccccagggcatccaca

SEQ ID NO: 513795 - DNA, 20 bp, Artificial
  CRISPR gRNA sequence
ccagggcatccacagggctg

SEQ ID NO: 513796 - DNA, 20 bp, Artificial
  CRISPR gRNA sequence
ggcatccacagggctgcagt

SEQ ID NO: 513797 - DNA, 20 bp, Artificial
  CRISPR gRNA sequence
cagtcggcctgcctccctgc

SEQ ID NO: 513798 - DNA, 20 bp, Artificial
  CRISPR gRNA sequence
agtcggcctgcctccctgcc

SEQ ID NO: 513799 - DNA, 20 bp, Artificial
  CRISPR gRNA sequence
gtcggcctgcctccctgcca

SEQ ID NO: 513800 - DNA, 20 bp, Artificial
  CRISPR gRNA sequence
tcggcctgcctccctgccag

SEQ ID NO: 513801 - DNA, 20 bp, Artificial
  CRISPR gRNA sequence
tccctgccaggggccacacc

SEQ ID NO: 513802 - DNA, 20 bp, Artificial
  CRISPR gRNA sequence
caggggccacacccagtccc

SEQ ID NO: 513803 - DNA, 20 bp, Artificial
  CRISPR gRNA sequence
ccctggctccccaacacttg

SEQ ID NO: 513804 - DNA, 20 bp, Artificial
  CRISPR gRNA sequence
caacacttgtagacattgtc

SEQ ID NO: 513805 - DNA, 20 bp, Artificial
  CRISPR gRNA sequence
tacttcctttatttatttct

SEQ ID NO: 513806 - DNA, 20 bp, Artificial
  CRISPR gRNA sequence
ttatttcttggtatgtttaa

SEQ ID NO: 513807 - DNA, 20 bp, Artificial
  CRISPR gRNA sequence
tttaaaagacaaaattctga

SEQ ID NO: 513808 - DNA, 20 bp, Artificial
  CRISPR gRNA sequence
gtgccaattattaaacatta

SEQ ID NO: 513809 - DNA, 20 bp, Artificial
  CRISPR gRNA sequence
attaaagaccacaacacata

SEQ ID NO: 513810 - DNA, 20 bp, Artificial
  CRISPR gRNA sequence
aagaccacaacacatataga

SEQ ID NO: 513811 - DNA, 20 bp, Artificial
  CRISPR gRNA sequence
cacaacacatatagacggca

SEQ ID NO: 513812 - DNA, 20 bp, Artificial
  CRISPR gRNA sequence
acatatagacggcacagcga

SEQ ID NO: 513813 - DNA, 20 bp, Artificial
  CRISPR gRNA sequence
tatagacggcacagcgacgg

SEQ ID NO: 513814 - DNA, 20 bp, Artificial
  CRISPR gRNA sequence
gcacagcgacggcagcactg

SEQ ID NO: 513815 - DNA, 20 bp, Artificial
  CRISPR gRNA sequence
gcagcactgaagaaaccaca

SEQ ID NO: 513816 - DNA, 20 bp, Artificial
  CRISPR gRNA sequence
cactgaagaaaccacacagc

SEQ ID NO: 513817 - DNA, 20 bp, Artificial
  CRISPR gRNA sequence
aaccacacagcaagctctgc

SEQ ID NO: 513818 - DNA, 20 bp, Artificial
  CRISPR gRNA sequence
accacacagcaagctctgct

SEQ ID NO: 513819 - DNA, 20 bp, Artificial
  CRISPR gRNA sequence
acagcaagctctgctgggcc

SEQ ID NO: 513820 - DNA, 20 bp, Artificial
  CRISPR gRNA sequence
cagcaagctctgctgggcca

SEQ ID NO: 513821 - DNA, 20 bp, Artificial
  CRISPR gRNA sequence
agcaagctctgctgggccaa

SEQ ID NO: 513822 - DNA, 20 bp, Artificial
  CRISPR gRNA sequence
ccaagggctccgctctacac

SEQ ID NO: 513823 - DNA, 20 bp, Artificial
  CRISPR gRNA sequence
acaccagcactgccttgcca

SEQ ID NO: 513824 - DNA, 20 bp, Artificial
  CRISPR gRNA sequence
accagcactgccttgccaca

SEQ ID NO: 513825 - DNA, 20 bp, Artificial
  CRISPR gRNA sequence
agcactgccttgccacagag

SEQ ID NO: 513826 - DNA, 20 bp, Artificial
  CRISPR gRNA sequence
gcactgccttgccacagagc

SEQ ID NO: 513827 - DNA, 20 bp, Artificial
  CRISPR gRNA sequence
cttgccacagagcaggtctc

SEQ ID NO: 513828 - DNA, 20 bp, Artificial
  CRISPR gRNA sequence
tctccagcacacgtgtgtgt

SEQ ID NO: 513829 - DNA, 20 bp, Artificial
  CRISPR gRNA sequence
gcacacgtgtgtgtcagtca

SEQ ID NO: 513830 - DNA, 20 bp, Artificial
  CRISPR gRNA sequence
acagcgcatgtcttccccgc

SEQ ID NO: 513831 - DNA, 20 bp, Artificial
  CRISPR gRNA sequence
catgtcttccccgccggccg

SEQ ID NO: 513832 - DNA, 20 bp, Artificial
  CRISPR gRNA sequence
ccggccgtggcttctcacat

SEQ ID NO: 513833 - DNA, 20 bp, Artificial
  CRISPR gRNA sequence
tctgccaccttccctacatg

SEQ ID NO: 513834 - DNA, 20 bp, Artificial
  CRISPR gRNA sequence
ctgccaccttccctacatgc

SEQ ID NO: 513835 - DNA, 20 bp, Artificial
  CRISPR gRNA sequence
tgccaccttccctacatgcg

SEQ ID NO: 513836 - DNA, 20 bp, Artificial
  CRISPR gRNA sequence
acgataacacacacacacac

SEQ ID NO: 513837 - DNA, 20 bp, Artificial
  CRISPR gRNA sequence
tgtatcctcacatgcacaaa

SEQ ID NO: 513838 - DNA, 20 bp, Artificial
  CRISPR gRNA sequence
gaatgcatgctcacacacaa

SEQ ID NO: 513839 - DNA, 20 bp, Artificial
  CRISPR gRNA sequence
tgtgcacacacatgcacaca

SEQ ID NO: 513840 - DNA, 20 bp, Artificial
  CRISPR gRNA sequence
acacagtcatacacacgtgc

SEQ ID NO: 513841 - DNA, 20 bp, Artificial
  CRISPR gRNA sequence
tgcaagaccacatgtgcaca

SEQ ID NO: 513842 - DNA, 20 bp, Artificial
  CRISPR gRNA sequence
cacatgcccacatatgtacc

SEQ ID NO: 513843 - DNA, 20 bp, Artificial
  CRISPR gRNA sequence
acctggtcacctacgtgaac

SEQ ID NO: 513844 - DNA, 20 bp, Artificial
  CRISPR gRNA sequence
cctggtcacctacgtgaact

SEQ ID NO: 513845 - DNA, 20 bp, Artificial
  CRISPR gRNA sequence
tgaacatgctcacatgcata

SEQ ID NO: 513846 - DNA, 20 bp, Artificial
  CRISPR gRNA sequence
gaacatgctcacatgcatac

SEQ ID NO: 513847 - DNA, 20 bp, Artificial
  CRISPR gRNA sequence
tacaggaatacgtgcacaca

SEQ ID NO: 513848 - DNA, 20 bp, Artificial
  CRISPR gRNA sequence
cacactcatgtttacacatg

SEQ ID NO: 513849 - DNA, 20 bp, Artificial
  CRISPR gRNA sequence
ctcatgtttacacatgcaga

SEQ ID NO: 513850 - DNA, 20 bp, Artificial
  CRISPR gRNA sequence
catgcagatggctgcacaca

SEQ ID NO: 513851 - DNA, 20 bp, Artificial
  CRISPR gRNA sequence
cacatgcccacatgtatacc

SEQ ID NO: 513852 - DNA, 20 bp, Artificial
  CRISPR gRNA sequence
cctggtcacacacatacatg

SEQ ID NO: 513853 - DNA, 20 bp, Artificial
  CRISPR gRNA sequence
ctggtcacacacatacatgc

SEQ ID NO: 513854 - DNA, 20 bp, Artificial
  CRISPR gRNA sequence
ccatgtacattgcacactcc

SEQ ID NO: 513855 - DNA, 20 bp, Artificial
  CRISPR gRNA sequence
catgtacattgcacactccc

SEQ ID NO: 513856 - DNA, 20 bp, Artificial
  CRISPR gRNA sequence
tgctttctccacctccctgc

SEQ ID NO: 513857 - DNA, 20 bp, Artificial
  CRISPR gRNA sequence
gctttctccacctccctgct

SEQ ID NO: 513858 - DNA, 20 bp, Artificial
  CRISPR gRNA sequence
tttctccacctccctgctag

SEQ ID NO: 513859 - DNA, 20 bp, Artificial
  CRISPR gRNA sequence
tctccacctccctgctagga

SEQ ID NO: 513860 - DNA, 20 bp, Artificial
  CRISPR gRNA sequence
tccacctccctgctaggaga

SEQ ID NO: 513861 - DNA, 20 bp, Artificial
  CRISPR gRNA sequence
ccacctccctgctaggagag

SEQ ID NO: 513862 - DNA, 20 bp, Artificial
  CRISPR gRNA sequence
ccctgctaggagagaggaaa

SEQ ID NO: 513863 - DNA, 20 bp, Artificial
  CRISPR gRNA sequence
cctgctaggagagaggaaac

SEQ ID NO: 513864 - DNA, 20 bp, Artificial
  CRISPR gRNA sequence
cttgccctcgtgcccctttg

SEQ ID NO: 513865 - DNA, 20 bp, Artificial
  CRISPR gRNA sequence
ccctcgtgcccctttgaagc

SEQ ID NO: 513866 - DNA, 20 bp, Artificial
  CRISPR gRNA sequence
ttgaagctggccctcccacc

SEQ ID NO: 513867 - DNA, 20 bp, Artificial
  CRISPR gRNA sequence
tgaagctggccctcccacct

SEQ ID NO: 513868 - DNA, 20 bp, Artificial
  CRISPR gRNA sequence
ctggccctcccacctgggcc

SEQ ID NO: 513869 - DNA, 20 bp, Artificial
  CRISPR gRNA sequence
ggcccagcctgccacctccc

SEQ ID NO: 513870 - DNA, 20 bp, Artificial
  CRISPR gRNA sequence
cagcccctccatgtgccctg

SEQ ID NO: 513871 - DNA, 20 bp, Artificial
  CRISPR gRNA sequence
agcccctccatgtgccctgc

SEQ ID NO: 513872 - DNA, 20 bp, Artificial
  CRISPR gRNA sequence
tccatgtgccctgcaggctt

SEQ ID NO: 513873 - DNA, 20 bp, Artificial
  CRISPR gRNA sequence
ccatgtgccctgcaggcttc

SEQ ID NO: 513874 - DNA, 20 bp, Artificial
  CRISPR gRNA sequence
tgcaggcttcgggtccttcg

SEQ ID NO: 513875 - DNA, 20 bp, Artificial
  CRISPR gRNA sequence
gcttcgggtccttcgtggac

SEQ ID NO: 513876 - DNA, 20 bp, Artificial
  CRISPR gRNA sequence
tcgtgaacacgcaccctgat

SEQ ID NO: 513877 - DNA, 20 bp, Artificial
  CRISPR gRNA sequence
tgcgaaacccatgccccaac

SEQ ID NO: 513878 - DNA, 20 bp, Artificial
  CRISPR gRNA sequence
gcgaaacccatgccccaaca

SEQ ID NO: 513879 - DNA, 20 bp, Artificial
  CRISPR gRNA sequence
gaaacccatgccccaacaag

SEQ ID NO: 513880 - DNA, 20 bp, Artificial
  CRISPR gRNA sequence
cccatgccccaacaaggaga

SEQ ID NO: 513881 - DNA, 20 bp, Artificial
  CRISPR gRNA sequence
catgccccaacaaggagaaa

SEQ ID NO: 513882 - DNA, 20 bp, Artificial
  CRISPR gRNA sequence
ccaacaaggagaaagagtgc

SEQ ID NO: 513883 - DNA, 20 bp, Artificial
  CRISPR gRNA sequence
tgccagcccccgtttgcctt

SEQ ID NO: 513884 - DNA, 20 bp, Artificial
  CRISPR gRNA sequence
gccagcccccgtttgccttc

SEQ ID NO: 513885 - DNA, 20 bp, Artificial
  CRISPR gRNA sequence
ttgccttcaggcacgtgctg

SEQ ID NO: 513886 - DNA, 20 bp, Artificial
  CRISPR gRNA sequence
agctgaccaacaactccaac

SEQ ID NO: 513887 - DNA, 20 bp, Artificial
  CRISPR gRNA sequence
ccaacaactccaaccagttt

SEQ ID NO: 513888 - DNA, 20 bp, Artificial
  CRISPR gRNA sequence
actccaaccagtttcagacc

SEQ ID NO: 513889 - DNA, 20 bp, Artificial
  CRISPR gRNA sequence
ctccaaccagtttcagaccg

SEQ ID NO: 513890 - DNA, 20 bp, Artificial
  CRISPR gRNA sequence
aaccagtttcagaccgaggt

SEQ ID NO: 513891 - DNA, 20 bp, Artificial
  CRISPR gRNA sequence
accagtttcagaccgaggtc

SEQ ID NO: 513892 - DNA, 20 bp, Artificial
  CRISPR gRNA sequence
agtttcagaccgaggtcggg

SEQ ID NO: 513893 - DNA, 20 bp, Artificial
  CRISPR gRNA sequence
ttcagaccgaggtcgggaag

SEQ ID NO: 513894 - DNA, 20 bp, Artificial
  CRISPR gRNA sequence
gtcgggaagcagctgatttc

SEQ ID NO: 513895 - DNA, 20 bp, Artificial
  CRISPR gRNA sequence
gcagctgatttccggaaacc

SEQ ID NO: 513896 - DNA, 20 bp, Artificial
  CRISPR gRNA sequence
ccggaaacctggatgcaccc

SEQ ID NO: 513897 - DNA, 20 bp, Artificial
  CRISPR gRNA sequence
cggaaacctggatgcacccg

SEQ ID NO: 513898 - DNA, 20 bp, Artificial
  CRISPR gRNA sequence
ggaaacctggatgcacccga

SEQ ID NO: 513899 - DNA, 20 bp, Artificial
  CRISPR gRNA sequence
aacctggatgcacccgaggg

SEQ ID NO: 513900 - DNA, 20 bp, Artificial
  CRISPR gRNA sequence
acctggatgcacccgagggt

SEQ ID NO: 513901 - DNA, 20 bp, Artificial
  CRISPR gRNA sequence
ggatgcacccgagggtgggc

SEQ ID NO: 513902 - DNA, 20 bp, Artificial
  CRISPR gRNA sequence
gtgggctggacgccatgatg

SEQ ID NO: 513903 - DNA, 20 bp, Artificial
  CRISPR gRNA sequence
tgggctggacgccatgatgc

SEQ ID NO: 513904 - DNA, 20 bp, Artificial
  CRISPR gRNA sequence
gatgcaggtcgccgcctgcc

SEQ ID NO: 513905 - DNA, 20 bp, Artificial
  CRISPR gRNA sequence
caggtcgccgcctgcccggt

SEQ ID NO: 513906 - DNA, 20 bp, Artificial
  CRISPR gRNA sequence
aggtcgccgcctgcccggtg

SEQ ID NO: 513907 - DNA, 20 bp, Artificial
  CRISPR gRNA sequence
gtgaggccgctgcccctgct

SEQ ID NO: 513908 - DNA, 20 bp, Artificial
  CRISPR gRNA sequence
tgaggccgctgcccctgctt

SEQ ID NO: 513909 - DNA, 20 bp, Artificial
  CRISPR gRNA sequence
cttgggtccccacgttcccc

SEQ ID NO: 513910 - DNA, 20 bp, Artificial
  CRISPR gRNA sequence
gtccccacgttcccccagtg

SEQ ID NO: 513911 - DNA, 20 bp, Artificial
  CRISPR gRNA sequence
tccccacgttcccccagtgt

SEQ ID NO: 513912 - DNA, 20 bp, Artificial
  CRISPR gRNA sequence
ccccacgttcccccagtgtg

SEQ ID NO: 513913 - DNA, 20 bp, Artificial
  CRISPR gRNA sequence
cccacgttcccccagtgtgg

SEQ ID NO: 513914 - DNA, 20 bp, Artificial
  CRISPR gRNA sequence
ccacgttcccccagtgtggg

SEQ ID NO: 513915 - DNA, 20 bp, Artificial
  CRISPR gRNA sequence
cccagtgtggggggctctgt

SEQ ID NO: 513916 - DNA, 20 bp, Artificial
  CRISPR gRNA sequence
ccagtgtggggggctctgtc

SEQ ID NO: 513917 - DNA, 20 bp, Artificial
  CRISPR gRNA sequence
gggctctgtcaggcgctgtg

SEQ ID NO: 513918 - DNA, 20 bp, Artificial
  CRISPR gRNA sequence
ggctctgtcaggcgctgtgt

SEQ ID NO: 513919 - DNA, 20 bp, Artificial
  CRISPR gRNA sequence
gctctgtcaggcgctgtgtg

SEQ ID NO: 513920 - DNA, 20 bp, Artificial
  CRISPR gRNA sequence
ctctgtcaggcgctgtgtgg

SEQ ID NO: 513921 - DNA, 20 bp, Artificial
  CRISPR gRNA sequence
tgtcaggcgctgtgtggggg

SEQ ID NO: 513922 - DNA, 20 bp, Artificial
  CRISPR gRNA sequence
gtcaggcgctgtgtgggggc

SEQ ID NO: 513923 - DNA, 20 bp, Artificial
  CRISPR gRNA sequence
tcaggcgctgtgtgggggca

SEQ ID NO: 513924 - DNA, 20 bp, Artificial
  CRISPR gRNA sequence
caggcgctgtgtgggggcag

SEQ ID NO: 513925 - DNA, 20 bp, Artificial
  CRISPR gRNA sequence
aggcgctgtgtgggggcagg

SEQ ID NO: 513926 - DNA, 20 bp, Artificial
  CRISPR gRNA sequence
ggcgctgtgtgggggcaggg

SEQ ID NO: 513927 - DNA, 20 bp, Artificial
  CRISPR gRNA sequence
gtgggggcaggggggtaccc

SEQ ID NO: 513928 - DNA, 20 bp, Artificial
  CRISPR gRNA sequence
gggcaggggggtaccctggc

SEQ ID NO: 513929 - DNA, 20 bp, Artificial
  CRISPR gRNA sequence
caggggggtaccctggccgg

SEQ ID NO: 513930 - DNA, 20 bp, Artificial
  CRISPR gRNA sequence
aggggggtaccctggccggc

SEQ ID NO: 513931 - DNA, 20 bp, Artificial
  CRISPR gRNA sequence
ccctggccggcaggtcgtct

SEQ ID NO: 513932 - DNA, 20 bp, Artificial
  CRISPR gRNA sequence
cctggccggcaggtcgtctg

SEQ ID NO: 513933 - DNA, 20 bp, Artificial
  CRISPR gRNA sequence
ctggccggcaggtcgtctga

SEQ ID NO: 513934 - DNA, 20 bp, Artificial
  CRISPR gRNA sequence
gcaggtcgtctgagggactc

SEQ ID NO: 513935 - DNA, 20 bp, Artificial
  CRISPR gRNA sequence
tcgtctgagggactccagcc

SEQ ID NO: 513936 - DNA, 20 bp, Artificial
  CRISPR gRNA sequence
cgtctgagggactccagcct

SEQ ID NO: 513937 - DNA, 20 bp, Artificial
  CRISPR gRNA sequence
gagggactccagcctgggcc

SEQ ID NO: 513938 - DNA, 20 bp, Artificial
  CRISPR gRNA sequence
agggactccagcctgggcct

SEQ ID NO: 513939 - DNA, 20 bp, Artificial
  CRISPR gRNA sequence
gggactccagcctgggcctg

SEQ ID NO: 513940 - DNA, 20 bp, Artificial
  CRISPR gRNA sequence
gactccagcctgggcctggg

SEQ ID NO: 513941 - DNA, 20 bp, Artificial
  CRISPR gRNA sequence
ctccagcctgggcctgggga

SEQ ID NO: 513942 - DNA, 20 bp, Artificial
  CRISPR gRNA sequence
cagcctgggcctggggagag

SEQ ID NO: 513943 - DNA, 20 bp, Artificial
  CRISPR gRNA sequence
tcaccctgctgctgcccatg

SEQ ID NO: 513944 - DNA, 20 bp, Artificial
  CRISPR gRNA sequence
caccctgctgctgcccatgc

SEQ ID NO: 513945 - DNA, 20 bp, Artificial
  CRISPR gRNA sequence
ctgctgctgcccatgcagga

SEQ ID NO: 513946 - DNA, 20 bp, Artificial
  CRISPR gRNA sequence
tgctgctgcccatgcaggaa

SEQ ID NO: 513947 - DNA, 20 bp, Artificial
  CRISPR gRNA sequence
gctgctgcccatgcaggaaa

SEQ ID NO: 513948 - DNA, 20 bp, Artificial
  CRISPR gRNA sequence
gctgcccatgcaggaaaggg

SEQ ID NO: 513949 - DNA, 20 bp, Artificial
  CRISPR gRNA sequence
ctgcccatgcaggaaagggc

SEQ ID NO: 513950 - DNA, 20 bp, Artificial
  CRISPR gRNA sequence
gcccatgcaggaaagggcag

SEQ ID NO: 513951 - DNA, 20 bp, Artificial
  CRISPR gRNA sequence
cccatgcaggaaagggcagg

SEQ ID NO: 513952 - DNA, 20 bp, Artificial
  CRISPR gRNA sequence
atgcaggaaagggcaggagg

SEQ ID NO: 513953 - DNA, 20 bp, Artificial
  CRISPR gRNA sequence
tgcaggaaagggcaggagga

SEQ ID NO: 513954 - DNA, 20 bp, Artificial
  CRISPR gRNA sequence
gcaggaaagggcaggaggaa

SEQ ID NO: 513955 - DNA, 20 bp, Artificial
  CRISPR gRNA sequence
aggaaagggcaggaggaagg

SEQ ID NO: 513956 - DNA, 20 bp, Artificial
  CRISPR gRNA sequence
ggaaagggcaggaggaaggg

SEQ ID NO: 513957 - DNA, 20 bp, Artificial
  CRISPR gRNA sequence
gaaagggcaggaggaaggga

SEQ ID NO: 513958 - DNA, 20 bp, Artificial
  CRISPR gRNA sequence
gaggaagggagggtgaccac

SEQ ID NO: 513959 - DNA, 20 bp, Artificial
  CRISPR gRNA sequence
aggaagggagggtgaccacg

SEQ ID NO: 513960 - DNA, 20 bp, Artificial
  CRISPR gRNA sequence
ggaagggagggtgaccacga

SEQ ID NO: 513961 - DNA, 20 bp, Artificial
  CRISPR gRNA sequence
ctgatttcattgtttgctgt

SEQ ID NO: 513962 - DNA, 20 bp, Artificial
  CRISPR gRNA sequence
gtgagttaaatttgtgaccc

SEQ ID NO: 513963 - DNA, 20 bp, Artificial
  CRISPR gRNA sequence
tgagttaaatttgtgaccct

SEQ ID NO: 513964 - DNA, 20 bp, Artificial
  CRISPR gRNA sequence
gaccctgggcaaaccttatg

SEQ ID NO: 513965 - DNA, 20 bp, Artificial
  CRISPR gRNA sequence
atgaagcctaaacattttgc

SEQ ID NO: 513966 - DNA, 20 bp, Artificial
  CRISPR gRNA sequence
aagcctaaacattttgcgag

SEQ ID NO: 513967 - DNA, 20 bp, Artificial
  CRISPR gRNA sequence
taaacattttgcgagcggcc

SEQ ID NO: 513968 - DNA, 20 bp, Artificial
  CRISPR gRNA sequence
aaacattttgcgagcggcca

SEQ ID NO: 513969 - DNA, 20 bp, Artificial
  CRISPR gRNA sequence
aacattttgcgagcggccaa

SEQ ID NO: 513970 - DNA, 20 bp, Artificial
  CRISPR gRNA sequence
attttgcgagcggccaaggg

SEQ ID NO: 513971 - DNA, 20 bp, Artificial
  CRISPR gRNA sequence
gcgagcggccaagggtggaa

SEQ ID NO: 513972 - DNA, 20 bp, Artificial
  CRISPR gRNA sequence
cgagcggccaagggtggaac

SEQ ID NO: 513973 - DNA, 20 bp, Artificial
  CRISPR gRNA sequence
gagcggccaagggtggaaca

SEQ ID NO: 513974 - DNA, 20 bp, Artificial
  CRISPR gRNA sequence
caagggtggaacagggccgc

SEQ ID NO: 513975 - DNA, 20 bp, Artificial
  CRISPR gRNA sequence
aagggtggaacagggccgct

SEQ ID NO: 513976 - DNA, 20 bp, Artificial
  CRISPR gRNA sequence
ggtggaacagggccgctagg

SEQ ID NO: 513977 - DNA, 20 bp, Artificial
  CRISPR gRNA sequence
ggaacagggccgctaggcag

SEQ ID NO: 513978 - DNA, 20 bp, Artificial
  CRISPR gRNA sequence
gaacagggccgctaggcagc

SEQ ID NO: 513979 - DNA, 20 bp, Artificial
  CRISPR gRNA sequence
ccgctaggcagcaggtcccg

SEQ ID NO: 513980 - DNA, 20 bp, Artificial
  CRISPR gRNA sequence
gcagcaggtcccgtggttcc

SEQ ID NO: 513981 - DNA, 20 bp, Artificial
  CRISPR gRNA sequence
cagcaggtcccgtggttcct

SEQ ID NO: 513982 - DNA, 20 bp, Artificial
  CRISPR gRNA sequence
agcaggtcccgtggttcctg

SEQ ID NO: 513983 - DNA, 20 bp, Artificial
  CRISPR gRNA sequence
aggtcccgtggttcctgggg

SEQ ID NO: 513984 - DNA, 20 bp, Artificial
  CRISPR gRNA sequence
tggaaccaccctcctccctc

SEQ ID NO: 513985 - DNA, 20 bp, Artificial
  CRISPR gRNA sequence
ggaaccaccctcctccctcc

SEQ ID NO: 513986 - DNA, 20 bp, Artificial
  CRISPR gRNA sequence
ccaccctcctccctccaggc

SEQ ID NO: 513987 - DNA, 20 bp, Artificial
  CRISPR gRNA sequence
caccctcctccctccaggcc

SEQ ID NO: 513988 - DNA, 20 bp, Artificial
  CRISPR gRNA sequence
cctcctccctccaggccggg

SEQ ID NO: 513989 - DNA, 20 bp, Artificial
  CRISPR gRNA sequence
ctcctccctccaggccgggt

SEQ ID NO: 513990 - DNA, 20 bp, Artificial
  CRISPR gRNA sequence
cctccaggccgggtgggcgc

SEQ ID NO: 513991 - DNA, 20 bp, Artificial
  CRISPR gRNA sequence
ccgggtgggcgctggctgcc

SEQ ID NO: 513992 - DNA, 20 bp, Artificial
  CRISPR gRNA sequence
ctctccacgtcccgcccacc

SEQ ID NO: 513993 - DNA, 20 bp, Artificial
  CRISPR gRNA sequence
cccacccagtttgtgactgt

SEQ ID NO: 513994 - DNA, 20 bp, Artificial
  CRISPR gRNA sequence
gtttgtgactgtcagcctaa

SEQ ID NO: 513995 - DNA, 20 bp, Artificial
  CRISPR gRNA sequence
ttgtgactgtcagcctaaca

SEQ ID NO: 513996 - DNA, 20 bp, Artificial
  CRISPR gRNA sequence
tgactgtcagcctaacagag

SEQ ID NO: 513997 - DNA, 20 bp, Artificial
  CRISPR gRNA sequence
tcagcctaacagagcagcca

SEQ ID NO: 513998 - DNA, 20 bp, Artificial
  CRISPR gRNA sequence
aacagagcagccacagtccc

SEQ ID NO: 513999 - DNA, 20 bp, Artificial
  CRISPR gRNA sequence
acagagcagccacagtccct

SEQ ID NO: 514000 - DNA, 20 bp, Artificial
  CRISPR gRNA sequence
cacagtccctgggccatgtt

SEQ ID NO: 514001 - DNA, 20 bp, Artificial
  CRISPR gRNA sequence
acagtccctgggccatgttg

SEQ ID NO: 514002 - DNA, 20 bp, Artificial
  CRISPR gRNA sequence
cctcccctcacaacccacct

SEQ ID NO: 514003 - DNA, 20 bp, Artificial
  CRISPR gRNA sequence
ttagctctcctgcttccctg

SEQ ID NO: 514004 - DNA, 20 bp, Artificial
  CRISPR gRNA sequence
ctcctgcttccctgcagtcc

SEQ ID NO: 514005 - DNA, 20 bp, Artificial
  CRISPR gRNA sequence
gcttccctgcagtcccagcg

SEQ ID NO: 514006 - DNA, 20 bp, Artificial
  CRISPR gRNA sequence
agcgcagacacactgctcac

SEQ ID NO: 514007 - DNA, 20 bp, Artificial
  CRISPR gRNA sequence
gacacactgctcacgagtgt

SEQ ID NO: 514008 - DNA, 20 bp, Artificial
  CRISPR gRNA sequence
acacactgctcacgagtgtg

SEQ ID NO: 514009 - DNA, 20 bp, Artificial
  CRISPR gRNA sequence
tgctcacgagtgtgaggtca

SEQ ID NO: 514010 - DNA, 20 bp, Artificial
  CRISPR gRNA sequence
acgagtgtgaggtcacagcc

SEQ ID NO: 514011 - DNA, 20 bp, Artificial
  CRISPR gRNA sequence
cgagtgtgaggtcacagcct

SEQ ID NO: 514012 - DNA, 20 bp, Artificial
  CRISPR gRNA sequence
gtcacagcctaggacacgca

SEQ ID NO: 514013 - DNA, 20 bp, Artificial
  CRISPR gRNA sequence
cggcccccacatgcgcctgc

SEQ ID NO: 514014 - DNA, 20 bp, Artificial
  CRISPR gRNA sequence
ggcccccacatgcgcctgcc

SEQ ID NO: 514015 - DNA, 20 bp, Artificial
  CRISPR gRNA sequence
gcccccacatgcgcctgcca

SEQ ID NO: 514016 - DNA, 20 bp, Artificial
  CRISPR gRNA sequence
cccccacatgcgcctgccag

SEQ ID NO: 514017 - DNA, 20 bp, Artificial
  CRISPR gRNA sequence
cgcctgccaggggctgtcaa

SEQ ID NO: 514018 - DNA, 20 bp, Artificial
  CRISPR gRNA sequence
ctgccaggggctgtcaatgg

SEQ ID NO: 514019 - DNA, 20 bp, Artificial
  CRISPR gRNA sequence
gggctgtcaatggtggactc

SEQ ID NO: 514020 - DNA, 20 bp, Artificial
  CRISPR gRNA sequence
ggctgtcaatggtggactca

SEQ ID NO: 514021 - DNA, 20 bp, Artificial
  CRISPR gRNA sequence
atggtggactcaaggcctgc

SEQ ID NO: 514022 - DNA, 20 bp, Artificial
  CRISPR gRNA sequence
tggtggactcaaggcctgct

SEQ ID NO: 514023 - DNA, 20 bp, Artificial
  CRISPR gRNA sequence
tcaaggcctgctgggcccct

SEQ ID NO: 514024 - DNA, 20 bp, Artificial
  CRISPR gRNA sequence
caaggcctgctgggcccctc

SEQ ID NO: 514025 - DNA, 20 bp, Artificial
  CRISPR gRNA sequence
tgttgcactcgttctgcgtg

SEQ ID NO: 514026 - DNA, 20 bp, Artificial
  CRISPR gRNA sequence
cgtgtggcccacacgtctgc

SEQ ID NO: 514027 - DNA, 20 bp, Artificial
  CRISPR gRNA sequence
gtgtggcccacacgtctgcg

SEQ ID NO: 514028 - DNA, 20 bp, Artificial
  CRISPR gRNA sequence
tgtggcccacacgtctgcga

SEQ ID NO: 514029 - DNA, 20 bp, Artificial
  CRISPR gRNA sequence
tctgcgagggtttttcccct

SEQ ID NO: 514030 - DNA, 20 bp, Artificial
  CRISPR gRNA sequence
ctgcgagggtttttcccctt

SEQ ID NO: 514031 - DNA, 20 bp, Artificial
  CRISPR gRNA sequence
tgcgagggtttttccccttg

SEQ ID NO: 514032 - DNA, 20 bp, Artificial
  CRISPR gRNA sequence
agggtttttccccttgggga

SEQ ID NO: 514033 - DNA, 20 bp, Artificial
  CRISPR gRNA sequence
ccccttggggatggtttcct

SEQ ID NO: 514034 - DNA, 20 bp, Artificial
  CRISPR gRNA sequence
cccttggggatggtttcctg

SEQ ID NO: 514035 - DNA, 20 bp, Artificial
  CRISPR gRNA sequence
ccttggggatggtttcctga

SEQ ID NO: 514036 - DNA, 20 bp, Artificial
  CRISPR gRNA sequence
gtttcctgagggtttgttcc

SEQ ID NO: 514037 - DNA, 20 bp, Artificial
  CRISPR gRNA sequence
agggtttgttcccagctctg

SEQ ID NO: 514038 - DNA, 20 bp, Artificial
  CRISPR gRNA sequence
ttgttcccagctctgaagtg

SEQ ID NO: 514039 - DNA, 20 bp, Artificial
  CRISPR gRNA sequence
tgttcccagctctgaagtgc

SEQ ID NO: 514040 - DNA, 20 bp, Artificial
  CRISPR gRNA sequence
gttcccagctctgaagtgca

SEQ ID NO: 514041 - DNA, 20 bp, Artificial
  CRISPR gRNA sequence
gctctgaagtgcagggaccg

SEQ ID NO: 514042 - DNA, 20 bp, Artificial
  CRISPR gRNA sequence
ccctgcgcctcacatgtgca

SEQ ID NO: 514043 - DNA, 20 bp, Artificial
  CRISPR gRNA sequence
cctgcgcctcacatgtgcac

SEQ ID NO: 514044 - DNA, 20 bp, Artificial
  CRISPR gRNA sequence
ctgcgcctcacatgtgcacg

SEQ ID NO: 514045 - DNA, 20 bp, Artificial
  CRISPR gRNA sequence
cacatgtgcacggggtgttt

SEQ ID NO: 514046 - DNA, 20 bp, Artificial
  CRISPR gRNA sequence
acatgtgcacggggtgtttg

SEQ ID NO: 514047 - DNA, 20 bp, Artificial
  CRISPR gRNA sequence
catgtgcacggggtgtttga

SEQ ID NO: 514048 - DNA, 20 bp, Artificial
  CRISPR gRNA sequence
tgagggccgttgtctcctcc

SEQ ID NO: 514049 - DNA, 20 bp, Artificial
  CRISPR gRNA sequence
gagggccgttgtctcctcct

SEQ ID NO: 514050 - DNA, 20 bp, Artificial
  CRISPR gRNA sequence
ccgttgtctcctcctgggcg

SEQ ID NO: 514051 - DNA, 20 bp, Artificial
  CRISPR gRNA sequence
ctcctcctgggcgtggcgtc

SEQ ID NO: 514052 - DNA, 20 bp, Artificial
  CRISPR gRNA sequence
tcctcctgggcgtggcgtct

SEQ ID NO: 514053 - DNA, 20 bp, Artificial
  CRISPR gRNA sequence
cctcctgggcgtggcgtctg

SEQ ID NO: 514054 - DNA, 20 bp, Artificial
  CRISPR gRNA sequence
ctcctgggcgtggcgtctgg

SEQ ID NO: 514055 - DNA, 20 bp, Artificial
  CRISPR gRNA sequence
gcgtggcgtctgggggaaca

SEQ ID NO: 514056 - DNA, 20 bp, Artificial
  CRISPR gRNA sequence
ggcgtctgggggaacacagc

SEQ ID NO: 514057 - DNA, 20 bp, Artificial
  CRISPR gRNA sequence
gcgtctgggggaacacagct

SEQ ID NO: 514058 - DNA, 20 bp, Artificial
  CRISPR gRNA sequence
gggaacacagctgggtccct

SEQ ID NO: 514059 - DNA, 20 bp, Artificial
  CRISPR gRNA sequence
acagctgggtccctgagacc

SEQ ID NO: 514060 - DNA, 20 bp, Artificial
  CRISPR gRNA sequence
cagctgggtccctgagaccc

SEQ ID NO: 514061 - DNA, 20 bp, Artificial
  CRISPR gRNA sequence
agctgggtccctgagaccca

SEQ ID NO: 514062 - DNA, 20 bp, Artificial
  CRISPR gRNA sequence
gctgggtccctgagacccag

SEQ ID NO: 514063 - DNA, 20 bp, Artificial
  CRISPR gRNA sequence
ggtccctgagacccagggga

SEQ ID NO: 514064 - DNA, 20 bp, Artificial
  CRISPR gRNA sequence
gtccctgagacccaggggaa

SEQ ID NO: 514065 - DNA, 20 bp, Artificial
  CRISPR gRNA sequence
tccctgagacccaggggaaa

SEQ ID NO: 514066 - DNA, 20 bp, Artificial
  CRISPR gRNA sequence
ccctgagacccaggggaaag

SEQ ID NO: 514067 - DNA, 20 bp, Artificial
  CRISPR gRNA sequence
cctgagacccaggggaaagg

SEQ ID NO: 514068 - DNA, 20 bp, Artificial
  CRISPR gRNA sequence
ggggaaagggggacccacac

SEQ ID NO: 514069 - DNA, 20 bp, Artificial
  CRISPR gRNA sequence
gggggacccacaccagcctc

SEQ ID NO: 514070 - DNA, 20 bp, Artificial
  CRISPR gRNA sequence
ggggacccacaccagcctcc

SEQ ID NO: 514071 - DNA, 20 bp, Artificial
  CRISPR gRNA sequence
cagcctccgggccaccccac

SEQ ID NO: 514072 - DNA, 20 bp, Artificial
  CRISPR gRNA sequence
ctgcatcgtctcctctgctc

SEQ ID NO: 514073 - DNA, 20 bp, Artificial
  CRISPR gRNA sequence
gcatcgtctcctctgctcca

SEQ ID NO: 514074 - DNA, 20 bp, Artificial
  CRISPR gRNA sequence
catcgtctcctctgctccag

SEQ ID NO: 514075 - DNA, 20 bp, Artificial
  CRISPR gRNA sequence
atcgtctcctctgctccaga

SEQ ID NO: 514076 - DNA, 20 bp, Artificial
  CRISPR gRNA sequence
tctcctctgctccagagggc

SEQ ID NO: 514077 - DNA, 20 bp, Artificial
  CRISPR gRNA sequence
ctcctctgctccagagggcc

SEQ ID NO: 514078 - DNA, 20 bp, Artificial
  CRISPR gRNA sequence
ctgctccagagggccgggtc

SEQ ID NO: 514079 - DNA, 20 bp, Artificial
  CRISPR gRNA sequence
tgctccagagggccgggtct

SEQ ID NO: 514080 - DNA, 20 bp, Artificial
  CRISPR gRNA sequence
agggccgggtctgggaaact

SEQ ID NO: 514081 - DNA, 20 bp, Artificial
  CRISPR gRNA sequence
gggccgggtctgggaaactg

SEQ ID NO: 514082 - DNA, 20 bp, Artificial
  CRISPR gRNA sequence
ccgggtctgggaaactgagg

SEQ ID NO: 514083 - DNA, 20 bp, Artificial
  CRISPR gRNA sequence
cgggtctgggaaactgaggc

SEQ ID NO: 514084 - DNA, 20 bp, Artificial
  CRISPR gRNA sequence
tgccccccacgccttcttct

SEQ ID NO: 514085 - DNA, 20 bp, Artificial
  CRISPR gRNA sequence
gccccccacgccttcttctc

SEQ ID NO: 514086 - DNA, 20 bp, Artificial
  CRISPR gRNA sequence
cccccacgccttcttctcag

SEQ ID NO: 514087 - DNA, 20 bp, Artificial
  CRISPR gRNA sequence
ccccacgccttcttctcagg

SEQ ID NO: 514088 - DNA, 20 bp, Artificial
  CRISPR gRNA sequence
ccttcttctcaggaggaaat

SEQ ID NO: 514089 - DNA, 20 bp, Artificial
  CRISPR gRNA sequence
cttctcaggaggaaatcggc

SEQ ID NO: 514090 - DNA, 20 bp, Artificial
  CRISPR gRNA sequence
tcggctggcgcaacgtcacg

SEQ ID NO: 514091 - DNA, 20 bp, Artificial
  CRISPR gRNA sequence
gcgcaacgtcacgcggctgc

SEQ ID NO: 514092 - DNA, 20 bp, Artificial
  CRISPR gRNA sequence
ctggtgtttgccactgatga

SEQ ID NO: 514093 - DNA, 20 bp, Artificial
  CRISPR gRNA sequence
tgatgacggcttccatttcg

SEQ ID NO: 514094 - DNA, 20 bp, Artificial
  CRISPR gRNA sequence
gatgacggcttccatttcgc

SEQ ID NO: 514095 - DNA, 20 bp, Artificial
  CRISPR gRNA sequence
ggcttccatttcgcgggcga

SEQ ID NO: 514096 - DNA, 20 bp, Artificial
  CRISPR gRNA sequence
gcttccatttcgcgggcgac

SEQ ID NO: 514097 - DNA, 20 bp, Artificial
  CRISPR gRNA sequence
tccatttcgcgggcgacggg

SEQ ID NO: 514098 - DNA, 20 bp, Artificial
  CRISPR gRNA sequence
tttcgcgggcgacgggaagc

SEQ ID NO: 514099 - DNA, 20 bp, Artificial
  CRISPR gRNA sequence
ttcgcgggcgacgggaagct

SEQ ID NO: 514100 - DNA, 20 bp, Artificial
  CRISPR gRNA sequence
gccatcctgacccccaacga

SEQ ID NO: 514101 - DNA, 20 bp, Artificial
  CRISPR gRNA sequence
caacgacggccgctgtcacc

SEQ ID NO: 514102 - DNA, 20 bp, Artificial
  CRISPR gRNA sequence
acgacggccgctgtcacctg

SEQ ID NO: 514103 - DNA, 20 bp, Artificial
  CRISPR gRNA sequence
cgacggccgctgtcacctgg

SEQ ID NO: 514104 - DNA, 20 bp, Artificial
  CRISPR gRNA sequence
acctggaggacaacttgtac

SEQ ID NO: 514105 - DNA, 20 bp, Artificial
  CRISPR gRNA sequence
ctggaggacaacttgtacaa

SEQ ID NO: 514106 - DNA, 20 bp, Artificial
  CRISPR gRNA sequence
tggaggacaacttgtacaag

SEQ ID NO: 514107 - DNA, 20 bp, Artificial
  CRISPR gRNA sequence
gaggacaacttgtacaagag

SEQ ID NO: 514108 - DNA, 20 bp, Artificial
  CRISPR gRNA sequence
aagaggagcaacgaattcgt

SEQ ID NO: 514109 - DNA, 20 bp, Artificial
  CRISPR gRNA sequence
gaattcgtaagtccccaccc

SEQ ID NO: 514110 - DNA, 20 bp, Artificial
  CRISPR gRNA sequence
aattcgtaagtccccacccc

SEQ ID NO: 514111 - DNA, 20 bp, Artificial
  CRISPR gRNA sequence
aagtccccaccccaggcacc

SEQ ID NO: 514112 - DNA, 20 bp, Artificial
  CRISPR gRNA sequence
agtccccaccccaggcaccc

SEQ ID NO: 514113 - DNA, 20 bp, Artificial
  CRISPR gRNA sequence
ccaggcacccaggcaccgcc

SEQ ID NO: 514114 - DNA, 20 bp, Artificial
  CRISPR gRNA sequence
ggcacccaggcaccgcctgg

SEQ ID NO: 514115 - DNA, 20 bp, Artificial
  CRISPR gRNA sequence
gcacccaggcaccgcctggc

SEQ ID NO: 514116 - DNA, 20 bp, Artificial
  CRISPR gRNA sequence
gcctggcaggacaccactga

SEQ ID NO: 514117 - DNA, 20 bp, Artificial
  CRISPR gRNA sequence
ctggcaggacaccactgacg

SEQ ID NO: 514118 - DNA, 20 bp, Artificial
  CRISPR gRNA sequence
tggcaggacaccactgacgg

SEQ ID NO: 514119 - DNA, 20 bp, Artificial
  CRISPR gRNA sequence
gcaggacaccactgacggag

SEQ ID NO: 514120 - DNA, 20 bp, Artificial
  CRISPR gRNA sequence
acaccactgacggaggagac

SEQ ID NO: 514121 - DNA, 20 bp, Artificial
  CRISPR gRNA sequence
caccactgacggaggagaca

SEQ ID NO: 514122 - DNA, 20 bp, Artificial
  CRISPR gRNA sequence
accactgacggaggagacaa

SEQ ID NO: 514123 - DNA, 20 bp, Artificial
  CRISPR gRNA sequence
actgacggaggagacaaggg

SEQ ID NO: 514124 - DNA, 20 bp, Artificial
  CRISPR gRNA sequence
ctgacggaggagacaagggt

SEQ ID NO: 514125 - DNA, 20 bp, Artificial
  CRISPR gRNA sequence
tgacggaggagacaagggtg

SEQ ID NO: 514126 - DNA, 20 bp, Artificial
  CRISPR gRNA sequence
agggtggggtctccacctga

SEQ ID NO: 514127 - DNA, 20 bp, Artificial
  CRISPR gRNA sequence
ggtggggtctccacctgaca

SEQ ID NO: 514128 - DNA, 20 bp, Artificial
  CRISPR gRNA sequence
acagagcctccttctgaccc

SEQ ID NO: 514129 - DNA, 20 bp, Artificial
  CRISPR gRNA sequence
cagagcctccttctgaccca

SEQ ID NO: 514130 - DNA, 20 bp, Artificial
  CRISPR gRNA sequence
gagcctccttctgacccaag

SEQ ID NO: 514131 - DNA, 20 bp, Artificial
  CRISPR gRNA sequence
cctccttctgacccaaggag

SEQ ID NO: 514132 - DNA, 20 bp, Artificial
  CRISPR gRNA sequence
gacccaaggagcagattcct

SEQ ID NO: 514133 - DNA, 20 bp, Artificial
  CRISPR gRNA sequence
acccaaggagcagattcctg

SEQ ID NO: 514134 - DNA, 20 bp, Artificial
  CRISPR gRNA sequence
cagattcctgaggaaacttc

SEQ ID NO: 514135 - DNA, 20 bp, Artificial
  CRISPR gRNA sequence
attcctgaggaaacttctgg

SEQ ID NO: 514136 - DNA, 20 bp, Artificial
  CRISPR gRNA sequence
aggaaacttctggaagcccc

SEQ ID NO: 514137 - DNA, 20 bp, Artificial
  CRISPR gRNA sequence
aaacttctggaagccccaag

SEQ ID NO: 514138 - DNA, 20 bp, Artificial
  CRISPR gRNA sequence
cttctggaagccccaagtgg

SEQ ID NO: 514139 - DNA, 20 bp, Artificial
  CRISPR gRNA sequence
ggaagccccaagtggcagcg

SEQ ID NO: 514140 - DNA, 20 bp, Artificial
  CRISPR gRNA sequence
gaagccccaagtggcagcgt

SEQ ID NO: 514141 - DNA, 20 bp, Artificial
  CRISPR gRNA sequence
aagccccaagtggcagcgtg

SEQ ID NO: 514142 - DNA, 20 bp, Artificial
  CRISPR gRNA sequence
gtggcagcgtggggtctccc

SEQ ID NO: 514143 - DNA, 20 bp, Artificial
  CRISPR gRNA sequence
agcgtggggtctccccggac

SEQ ID NO: 514144 - DNA, 20 bp, Artificial
  CRISPR gRNA sequence
gggtctccccggactggcct

SEQ ID NO: 514145 - DNA, 20 bp, Artificial
  CRISPR gRNA sequence
ggtctccccggactggcctc

SEQ ID NO: 514146 - DNA, 20 bp, Artificial
  CRISPR gRNA sequence
tccccggactggcctcaggc

SEQ ID NO: 514147 - DNA, 20 bp, Artificial
  CRISPR gRNA sequence
ccccggactggcctcaggcc

SEQ ID NO: 514148 - DNA, 20 bp, Artificial
  CRISPR gRNA sequence
cccggactggcctcaggcca

SEQ ID NO: 514149 - DNA, 20 bp, Artificial
  CRISPR gRNA sequence
ccggactggcctcaggccag

SEQ ID NO: 514150 - DNA, 20 bp, Artificial
  CRISPR gRNA sequence
ggactggcctcaggccaggg

SEQ ID NO: 514151 - DNA, 20 bp, Artificial
  CRISPR gRNA sequence
gactggcctcaggccagggg

SEQ ID NO: 514152 - DNA, 20 bp, Artificial
  CRISPR gRNA sequence
actggcctcaggccagggga

SEQ ID NO: 514153 - DNA, 20 bp, Artificial
  CRISPR gRNA sequence
ggcctcaggccaggggaggg

SEQ ID NO: 514154 - DNA, 20 bp, Artificial
  CRISPR gRNA sequence
gcctcaggccaggggagggt

SEQ ID NO: 514155 - DNA, 20 bp, Artificial
  CRISPR gRNA sequence
cctcaggccaggggagggta

SEQ ID NO: 514156 - DNA, 20 bp, Artificial
  CRISPR gRNA sequence
aggccaggggagggtagggt

SEQ ID NO: 514157 - DNA, 20 bp, Artificial
  CRISPR gRNA sequence
ccaggggagggtagggttgg

SEQ ID NO: 514158 - DNA, 20 bp, Artificial
  CRISPR gRNA sequence
caggggagggtagggttggt

SEQ ID NO: 514159 - DNA, 20 bp, Artificial
  CRISPR gRNA sequence
aggggagggtagggttggtg

SEQ ID NO: 514160 - DNA, 20 bp, Artificial
  CRISPR gRNA sequence
ggggagggtagggttggtgg

SEQ ID NO: 514161 - DNA, 20 bp, Artificial
  CRISPR gRNA sequence
gagggtagggttggtggggg

SEQ ID NO: 514162 - DNA, 20 bp, Artificial
  CRISPR gRNA sequence
gtagggttggtgggggcagc

SEQ ID NO: 514163 - DNA, 20 bp, Artificial
  CRISPR gRNA sequence
tagggttggtgggggcagcc

SEQ ID NO: 514164 - DNA, 20 bp, Artificial
  CRISPR gRNA sequence
ttggtgggggcagccaggct

SEQ ID NO: 514165 - DNA, 20 bp, Artificial
  CRISPR gRNA sequence
tggtgggggcagccaggctg

SEQ ID NO: 514166 - DNA, 20 bp, Artificial
  CRISPR gRNA sequence
ggggcagccaggctgaggcc

SEQ ID NO: 514167 - DNA, 20 bp, Artificial
  CRISPR gRNA sequence
gaggcccggcctcgcccttg

SEQ ID NO: 514168 - DNA, 20 bp, Artificial
  CRISPR gRNA sequence
aggcccggcctcgcccttgt

SEQ ID NO: 514169 - DNA, 20 bp, Artificial
  CRISPR gRNA sequence
cctcgcccttgtgggacacc

SEQ ID NO: 514170 - DNA, 20 bp, Artificial
  CRISPR gRNA sequence
ctcgcccttgtgggacaccc

SEQ ID NO: 514171 - DNA, 20 bp, Artificial
  CRISPR gRNA sequence
gtgggacacccaggctctgt

SEQ ID NO: 514172 - DNA, 20 bp, Artificial
  CRISPR gRNA sequence
acccaggctctgttggtctc

SEQ ID NO: 514173 - DNA, 20 bp, Artificial
  CRISPR gRNA sequence
agccccactgcccccctacc

SEQ ID NO: 514174 - DNA, 20 bp, Artificial
  CRISPR gRNA sequence
gccccactgcccccctacct

SEQ ID NO: 514175 - DNA, 20 bp, Artificial
  CRISPR gRNA sequence
tgcccccctacctgggctga

SEQ ID NO: 514176 - DNA, 20 bp, Artificial
  CRISPR gRNA sequence
acctgggctgacagctgctg

SEQ ID NO: 514177 - DNA, 20 bp, Artificial
  CRISPR gRNA sequence
ctgggctgacagctgctgtg

SEQ ID NO: 514178 - DNA, 20 bp, Artificial
  CRISPR gRNA sequence
tgggctgacagctgctgtgg

SEQ ID NO: 514179 - DNA, 20 bp, Artificial
  CRISPR gRNA sequence
tgacagctgctgtggaggta

SEQ ID NO: 514180 - DNA, 20 bp, Artificial
  CRISPR gRNA sequence
ggaggtatagtaaccgcccc

SEQ ID NO: 514181 - DNA, 20 bp, Artificial
  CRISPR gRNA sequence
gaggtatagtaaccgccccc

SEQ ID NO: 514182 - DNA, 20 bp, Artificial
  CRISPR gRNA sequence
tagtaaccgcccccaggcta

SEQ ID NO: 514183 - DNA, 20 bp, Artificial
  CRISPR gRNA sequence
caccctgccgtccccgcctc

SEQ ID NO: 514184 - DNA, 20 bp, Artificial
  CRISPR gRNA sequence
ctgccgtccccgcctctggc

SEQ ID NO: 514185 - DNA, 20 bp, Artificial
  CRISPR gRNA sequence
tgccgtccccgcctctggcc

SEQ ID NO: 514186 - DNA, 20 bp, Artificial
  CRISPR gRNA sequence
gccgtccccgcctctggcca

SEQ ID NO: 514187 - DNA, 20 bp, Artificial
  CRISPR gRNA sequence
ctggccagggtcccatcccc

SEQ ID NO: 514188 - DNA, 20 bp, Artificial
  CRISPR gRNA sequence
catccgcctcctccccctcc

SEQ ID NO: 514189 - DNA, 20 bp, Artificial
  CRISPR gRNA sequence
gtacgttccctgctgcccct

SEQ ID NO: 514190 - DNA, 20 bp, Artificial
  CRISPR gRNA sequence
gcccctgagtccgcctcctc

SEQ ID NO: 514191 - DNA, 20 bp, Artificial
  CRISPR gRNA sequence
tgagtccgcctcctccagtg

SEQ ID NO: 514192 - DNA, 20 bp, Artificial
  CRISPR gRNA sequence
cctccctgcccccattgcct

SEQ ID NO: 514193 - DNA, 20 bp, Artificial
  CRISPR gRNA sequence
cctgcccccattgcctgagc

SEQ ID NO: 514194 - DNA, 20 bp, Artificial
  CRISPR gRNA sequence
ctgcccccattgcctgagct

SEQ ID NO: 514195 - DNA, 20 bp, Artificial
  CRISPR gRNA sequence
ccccattgcctgagctgggt

SEQ ID NO: 514196 - DNA, 20 bp, Artificial
  CRISPR gRNA sequence
cattgcctgagctgggtgag

SEQ ID NO: 514197 - DNA, 20 bp, Artificial
  CRISPR gRNA sequence
ctgagctgggtgagcggctg

SEQ ID NO: 514198 - DNA, 20 bp, Artificial
  CRISPR gRNA sequence
tgagctgggtgagcggctgc

SEQ ID NO: 514199 - DNA, 20 bp, Artificial
  CRISPR gRNA sequence
gagctgggtgagcggctgcg

SEQ ID NO: 514200 - DNA, 20 bp, Artificial
  CRISPR gRNA sequence
tgagcggctgcggggaccat

SEQ ID NO: 514201 - DNA, 20 bp, Artificial
  CRISPR gRNA sequence
gagcggctgcggggaccatg

SEQ ID NO: 514202 - DNA, 20 bp, Artificial
  CRISPR gRNA sequence
cggggaccatgaggaacatg

SEQ ID NO: 514203 - DNA, 20 bp, Artificial
  CRISPR gRNA sequence
ggggaccatgaggaacatgc

SEQ ID NO: 514204 - DNA, 20 bp, Artificial
  CRISPR gRNA sequence
gggaccatgaggaacatgca

SEQ ID NO: 514205 - DNA, 20 bp, Artificial
  CRISPR gRNA sequence
gaccatgaggaacatgcagg

SEQ ID NO: 514206 - DNA, 20 bp, Artificial
  CRISPR gRNA sequence
accatgaggaacatgcaggg

SEQ ID NO: 514207 - DNA, 20 bp, Artificial
  CRISPR gRNA sequence
ccatgaggaacatgcaggga

SEQ ID NO: 514208 - DNA, 20 bp, Artificial
  CRISPR gRNA sequence
gaggaacatgcagggaggga

SEQ ID NO: 514209 - DNA, 20 bp, Artificial
  CRISPR gRNA sequence
ggaacatgcagggagggaca

SEQ ID NO: 514210 - DNA, 20 bp, Artificial
  CRISPR gRNA sequence
gaacatgcagggagggacag

SEQ ID NO: 514211 - DNA, 20 bp, Artificial
  CRISPR gRNA sequence
atgcagggagggacagaggc

SEQ ID NO: 514212 - DNA, 20 bp, Artificial
  CRISPR gRNA sequence
cagggagggacagaggcgag

SEQ ID NO: 514213 - DNA, 20 bp, Artificial
  CRISPR gRNA sequence
agggagggacagaggcgaga

SEQ ID NO: 514214 - DNA, 20 bp, Artificial
  CRISPR gRNA sequence
ggagggacagaggcgagaag

SEQ ID NO: 514215 - DNA, 20 bp, Artificial
  CRISPR gRNA sequence
gacagaggcgagaaggagcc

SEQ ID NO: 514216 - DNA, 20 bp, Artificial
  CRISPR gRNA sequence
acagaggcgagaaggagccc

SEQ ID NO: 514217 - DNA, 20 bp, Artificial
  CRISPR gRNA sequence
gagaaggagcccaggatgca

SEQ ID NO: 514218 - DNA, 20 bp, Artificial
  CRISPR gRNA sequence
agaaggagcccaggatgcac

SEQ ID NO: 514219 - DNA, 20 bp, Artificial
  CRISPR gRNA sequence
ggagcccaggatgcacgggt

SEQ ID NO: 514220 - DNA, 20 bp, Artificial
  CRISPR gRNA sequence
gagcccaggatgcacgggtt

SEQ ID NO: 514221 - DNA, 20 bp, Artificial
  CRISPR gRNA sequence
caggatgcacgggttaggat

SEQ ID NO: 514222 - DNA, 20 bp, Artificial
  CRISPR gRNA sequence
ggttaggatgagcctctctg

SEQ ID NO: 514223 - DNA, 20 bp, Artificial
  CRISPR gRNA sequence
ttaggatgagcctctctgcg

SEQ ID NO: 514224 - DNA, 20 bp, Artificial
  CRISPR gRNA sequence
taggatgagcctctctgcgg

SEQ ID NO: 514225 - DNA, 20 bp, Artificial
  CRISPR gRNA sequence
tctctgcggaggcatctcaa

SEQ ID NO: 514226 - DNA, 20 bp, Artificial
  CRISPR gRNA sequence
gcggaggcatctcaatggct

SEQ ID NO: 514227 - DNA, 20 bp, Artificial
  CRISPR gRNA sequence
ggaggcatctcaatggctca

SEQ ID NO: 514228 - DNA, 20 bp, Artificial
  CRISPR gRNA sequence
gaggcatctcaatggctcag

SEQ ID NO: 514229 - DNA, 20 bp, Artificial
  CRISPR gRNA sequence
aggcatctcaatggctcaga

SEQ ID NO: 514230 - DNA, 20 bp, Artificial
  CRISPR gRNA sequence
ggcatctcaatggctcagag

SEQ ID NO: 514231 - DNA, 20 bp, Artificial
  CRISPR gRNA sequence
tctcaatggctcagaggggc

SEQ ID NO: 514232 - DNA, 20 bp, Artificial
  CRISPR gRNA sequence
ctcaatggctcagaggggcc

SEQ ID NO: 514233 - DNA, 20 bp, Artificial
  CRISPR gRNA sequence
ctcagaggggccaggacttc

SEQ ID NO: 514234 - DNA, 20 bp, Artificial
  CRISPR gRNA sequence
gaggggccaggacttctggc

SEQ ID NO: 514235 - DNA, 20 bp, Artificial
  CRISPR gRNA sequence
aggggccaggacttctggct

SEQ ID NO: 514236 - DNA, 20 bp, Artificial
  CRISPR gRNA sequence
ccaggacttctggctgggat

SEQ ID NO: 514237 - DNA, 20 bp, Artificial
  CRISPR gRNA sequence
cttctggctgggatcagccg

SEQ ID NO: 514238 - DNA, 20 bp, Artificial
  CRISPR gRNA sequence
ttctggctgggatcagccgt

SEQ ID NO: 514239 - DNA, 20 bp, Artificial
  CRISPR gRNA sequence
gctgggatcagccgtgggcc

SEQ ID NO: 514240 - DNA, 20 bp, Artificial
  CRISPR gRNA sequence
tgggatcagccgtgggccga

SEQ ID NO: 514241 - DNA, 20 bp, Artificial
  CRISPR gRNA sequence
gggatcagccgtgggccgag

SEQ ID NO: 514242 - DNA, 20 bp, Artificial
  CRISPR gRNA sequence
gtgggccgagaggcaaccac

SEQ ID NO: 514243 - DNA, 20 bp, Artificial
  CRISPR gRNA sequence
gagaggcaaccactggtcac

SEQ ID NO: 514244 - DNA, 20 bp, Artificial
  CRISPR gRNA sequence
agaggcaaccactggtcaca

SEQ ID NO: 514245 - DNA, 20 bp, Artificial
  CRISPR gRNA sequence
gaggcaaccactggtcacaa

SEQ ID NO: 514246 - DNA, 20 bp, Artificial
  CRISPR gRNA sequence
aggcaaccactggtcacaag

SEQ ID NO: 514247 - DNA, 20 bp, Artificial
  CRISPR gRNA sequence
cacaaggggcttgtcctcgc

SEQ ID NO: 514248 - DNA, 20 bp, Artificial
  CRISPR gRNA sequence
gggcttgtcctcgctggccg

SEQ ID NO: 514249 - DNA, 20 bp, Artificial
  CRISPR gRNA sequence
gccgtagtgcgacgctcttg

SEQ ID NO: 514250 - DNA, 20 bp, Artificial
  CRISPR gRNA sequence
gctcttgcagcctgacgttg

SEQ ID NO: 514251 - DNA, 20 bp, Artificial
  CRISPR gRNA sequence
ctcttgcagcctgacgttgt

SEQ ID NO: 514252 - DNA, 20 bp, Artificial
  CRISPR gRNA sequence
cagcctgacgttgtaggctc

SEQ ID NO: 514253 - DNA, 20 bp, Artificial
  CRISPR gRNA sequence
agcctgacgttgtaggctct

SEQ ID NO: 514254 - DNA, 20 bp, Artificial
  CRISPR gRNA sequence
gcctgacgttgtaggctctg

SEQ ID NO: 514255 - DNA, 20 bp, Artificial
  CRISPR gRNA sequence
cctgacgttgtaggctctgg

SEQ ID NO: 514256 - DNA, 20 bp, Artificial
  CRISPR gRNA sequence
tgtaggctctgggggccgca

SEQ ID NO: 514257 - DNA, 20 bp, Artificial
  CRISPR gRNA sequence
gtaggctctgggggccgcaa

SEQ ID NO: 514258 - DNA, 20 bp, Artificial
  CRISPR gRNA sequence
ctgggggccgcaaaggactt

SEQ ID NO: 514259 - DNA, 20 bp, Artificial
  CRISPR gRNA sequence
gggggccgcaaaggacttta

SEQ ID NO: 514260 - DNA, 20 bp, Artificial
  CRISPR gRNA sequence
gcaaaggactttagagatac

SEQ ID NO: 514261 - DNA, 20 bp, Artificial
  CRISPR gRNA sequence
gactttagagatacaagact

SEQ ID NO: 514262 - DNA, 20 bp, Artificial
  CRISPR gRNA sequence
actttagagatacaagactc

SEQ ID NO: 514263 - DNA, 20 bp, Artificial
  CRISPR gRNA sequence
acaagactcaggtcctccgc

SEQ ID NO: 514264 - DNA, 20 bp, Artificial
  CRISPR gRNA sequence
caagactcaggtcctccgcc

SEQ ID NO: 514265 - DNA, 20 bp, Artificial
  CRISPR gRNA sequence
agactcaggtcctccgccgg

SEQ ID NO: 514266 - DNA, 20 bp, Artificial
  CRISPR gRNA sequence
aggtcctccgccgggagcca

SEQ ID NO: 514267 - DNA, 20 bp, Artificial
  CRISPR gRNA sequence
cctccgccgggagccacaga

SEQ ID NO: 514268 - DNA, 20 bp, Artificial
  CRISPR gRNA sequence
ctccgccgggagccacagac

SEQ ID NO: 514269 - DNA, 20 bp, Artificial
  CRISPR gRNA sequence
ccgccgggagccacagacgg

SEQ ID NO: 514270 - DNA, 20 bp, Artificial
  CRISPR gRNA sequence
cgccgggagccacagacggg

SEQ ID NO: 514271 - DNA, 20 bp, Artificial
  CRISPR gRNA sequence
gccgggagccacagacggga

SEQ ID NO: 514272 - DNA, 20 bp, Artificial
  CRISPR gRNA sequence
ggagccacagacgggaggga

SEQ ID NO: 514273 - DNA, 20 bp, Artificial
  CRISPR gRNA sequence
cagacgggagggacggccct

SEQ ID NO: 514274 - DNA, 20 bp, Artificial
  CRISPR gRNA sequence
agacgggagggacggccctc

SEQ ID NO: 514275 - DNA, 20 bp, Artificial
  CRISPR gRNA sequence
gagggacggccctcgggtcc

SEQ ID NO: 514276 - DNA, 20 bp, Artificial
  CRISPR gRNA sequence
ggccctcgggtcccggaact

SEQ ID NO: 514277 - DNA, 20 bp, Artificial
  CRISPR gRNA sequence
gccctcgggtcccggaactc

SEQ ID NO: 514278 - DNA, 20 bp, Artificial
  CRISPR gRNA sequence
ctcgggtcccggaactcggg

SEQ ID NO: 514279 - DNA, 20 bp, Artificial
  CRISPR gRNA sequence
tcgggtcccggaactcgggt

SEQ ID NO: 514280 - DNA, 20 bp, Artificial
  CRISPR gRNA sequence
cgggtcccggaactcgggta

SEQ ID NO: 514281 - DNA, 20 bp, Artificial
  CRISPR gRNA sequence
ggtcccggaactcgggtagg

SEQ ID NO: 514282 - DNA, 20 bp, Artificial
  CRISPR gRNA sequence
tcccggaactcgggtaggga

SEQ ID NO: 514283 - DNA, 20 bp, Artificial
  CRISPR gRNA sequence
agagccgcacctgacactca

SEQ ID NO: 514284 - DNA, 20 bp, Artificial
  CRISPR gRNA sequence
tcatggcctctaccgaaact

SEQ ID NO: 514285 - DNA, 20 bp, Artificial
  CRISPR gRNA sequence
taccgaaactgagtgtccct

SEQ ID NO: 514286 - DNA, 20 bp, Artificial
  CRISPR gRNA sequence
ctgagtgtccctcagtgcga

SEQ ID NO: 514287 - DNA, 20 bp, Artificial
  CRISPR gRNA sequence
agtgtccctcagtgcgaaag

SEQ ID NO: 514288 - DNA, 20 bp, Artificial
  CRISPR gRNA sequence
gtgtccctcagtgcgaaagc

SEQ ID NO: 514289 - DNA, 20 bp, Artificial
  CRISPR gRNA sequence
gcgaaagcaggtccaccgtg

SEQ ID NO: 514290 - DNA, 20 bp, Artificial
  CRISPR gRNA sequence
cgaaagcaggtccaccgtgt

SEQ ID NO: 514291 - DNA, 20 bp, Artificial
  CRISPR gRNA sequence
gaaagcaggtccaccgtgtg

SEQ ID NO: 514292 - DNA, 20 bp, Artificial
  CRISPR gRNA sequence
agcaggtccaccgtgtgggg

SEQ ID NO: 514293 - DNA, 20 bp, Artificial
  CRISPR gRNA sequence
gcaggtccaccgtgtgggga

SEQ ID NO: 514294 - DNA, 20 bp, Artificial
  CRISPR gRNA sequence
gtccaccgtgtggggaaggc

SEQ ID NO: 514295 - DNA, 20 bp, Artificial
  CRISPR gRNA sequence
tccaccgtgtggggaaggct

SEQ ID NO: 514296 - DNA, 20 bp, Artificial
  CRISPR gRNA sequence
aggctgggattctgcccccg

SEQ ID NO: 514297 - DNA, 20 bp, Artificial
  CRISPR gRNA sequence
tctgcccccgtggacatccc

SEQ ID NO: 514298 - DNA, 20 bp, Artificial
  CRISPR gRNA sequence
cgtggacatccccagtccca

SEQ ID NO: 514299 - DNA, 20 bp, Artificial
  CRISPR gRNA sequence
gacatccccagtcccacggt

SEQ ID NO: 514300 - DNA, 20 bp, Artificial
  CRISPR gRNA sequence
cctcaaatgctgctcatgcc

SEQ ID NO: 514301 - DNA, 20 bp, Artificial
  CRISPR gRNA sequence
tgctcatgcctggactctga

SEQ ID NO: 514302 - DNA, 20 bp, Artificial
  CRISPR gRNA sequence
tgcctggactctgaaagccc

SEQ ID NO: 514303 - DNA, 20 bp, Artificial
  CRISPR gRNA sequence
gagtctatgcacacattgcc

SEQ ID NO: 514304 - DNA, 20 bp, Artificial
  CRISPR gRNA sequence
gtctatgcacacattgccca

SEQ ID NO: 514305 - DNA, 20 bp, Artificial
  CRISPR gRNA sequence
tctatgcacacattgcccag

SEQ ID NO: 514306 - DNA, 20 bp, Artificial
  CRISPR gRNA sequence
ctatgcacacattgcccaga

SEQ ID NO: 514307 - DNA, 20 bp, Artificial
  CRISPR gRNA sequence
cacacattgcccagagggcg

SEQ ID NO: 514308 - DNA, 20 bp, Artificial
  CRISPR gRNA sequence
acattgcccagagggcgtgg

SEQ ID NO: 514309 - DNA, 20 bp, Artificial
  CRISPR gRNA sequence
ctctgccctgcactcctgcg

SEQ ID NO: 514310 - DNA, 20 bp, Artificial
  CRISPR gRNA sequence
tgccctgcactcctgcgtgg

SEQ ID NO: 514311 - DNA, 20 bp, Artificial
  CRISPR gRNA sequence
cgtggcagcctctgcctctc

SEQ ID NO: 514312 - DNA, 20 bp, Artificial
  CRISPR gRNA sequence
tctgcctctccagccttccc

SEQ ID NO: 514313 - DNA, 20 bp, Artificial
  CRISPR gRNA sequence
tgcctctccagccttcccca

SEQ ID NO: 514314 - DNA, 20 bp, Artificial
  CRISPR gRNA sequence
cctctccagccttccccaga

SEQ ID NO: 514315 - DNA, 20 bp, Artificial
  CRISPR gRNA sequence
ctctccagccttccccagag

SEQ ID NO: 514316 - DNA, 20 bp, Artificial
  CRISPR gRNA sequence
tctccagccttccccagaga

SEQ ID NO: 514317 - DNA, 20 bp, Artificial
  CRISPR gRNA sequence
ccttccccagagagggttcg

SEQ ID NO: 514318 - DNA, 20 bp, Artificial
  CRISPR gRNA sequence
cccagagagggttcgaagca

SEQ ID NO: 514319 - DNA, 20 bp, Artificial
  CRISPR gRNA sequence
ccagagagggttcgaagcac

SEQ ID NO: 514320 - DNA, 20 bp, Artificial
  CRISPR gRNA sequence
gagagggttcgaagcacggg

SEQ ID NO: 514321 - DNA, 20 bp, Artificial
  CRISPR gRNA sequence
agagggttcgaagcacgggc

SEQ ID NO: 514322 - DNA, 20 bp, Artificial
  CRISPR gRNA sequence
gagggttcgaagcacgggca

SEQ ID NO: 514323 - DNA, 20 bp, Artificial
  CRISPR gRNA sequence
gcacgggcagggctgacgct

SEQ ID NO: 514324 - DNA, 20 bp, Artificial
  CRISPR gRNA sequence
cgggcagggctgacgctgag

SEQ ID NO: 514325 - DNA, 20 bp, Artificial
  CRISPR gRNA sequence
gggcagggctgacgctgagc

SEQ ID NO: 514326 - DNA, 20 bp, Artificial
  CRISPR gRNA sequence
ggcagggctgacgctgagcg

SEQ ID NO: 514327 - DNA, 20 bp, Artificial
  CRISPR gRNA sequence
agggctgacgctgagcgggg

SEQ ID NO: 514328 - DNA, 20 bp, Artificial
  CRISPR gRNA sequence
ctgacgctgagcggggcaga

SEQ ID NO: 514329 - DNA, 20 bp, Artificial
  CRISPR gRNA sequence
tgacgctgagcggggcagac

SEQ ID NO: 514330 - DNA, 20 bp, Artificial
  CRISPR gRNA sequence
gacgctgagcggggcagaca

SEQ ID NO: 514331 - DNA, 20 bp, Artificial
  CRISPR gRNA sequence
acgctgagcggggcagacag

SEQ ID NO: 514332 - DNA, 20 bp, Artificial
  CRISPR gRNA sequence
ctgagcggggcagacagggg

SEQ ID NO: 514333 - DNA, 20 bp, Artificial
  CRISPR gRNA sequence
tgagcggggcagacaggggc

SEQ ID NO: 514334 - DNA, 20 bp, Artificial
  CRISPR gRNA sequence
ggcagacaggggcgggtacc

SEQ ID NO: 514335 - DNA, 20 bp, Artificial
  CRISPR gRNA sequence
agacaggggcgggtacctgg

SEQ ID NO: 514336 - DNA, 20 bp, Artificial
  CRISPR gRNA sequence
ggtacctggaagccttgtcc

SEQ ID NO: 514337 - DNA, 20 bp, Artificial
  CRISPR gRNA sequence
tggaagccttgtcctggact

SEQ ID NO: 514338 - DNA, 20 bp, Artificial
  CRISPR gRNA sequence
ggaagccttgtcctggactc

SEQ ID NO: 514339 - DNA, 20 bp, Artificial
  CRISPR gRNA sequence
gaagccttgtcctggactcg

SEQ ID NO: 514340 - DNA, 20 bp, Artificial
  CRISPR gRNA sequence
tcctggactcggggccaact

SEQ ID NO: 514341 - DNA, 20 bp, Artificial
  CRISPR gRNA sequence
tggactcggggccaactgag

SEQ ID NO: 514342 - DNA, 20 bp, Artificial
  CRISPR gRNA sequence
ggactcggggccaactgagc

SEQ ID NO: 514343 - DNA, 20 bp, Artificial
  CRISPR gRNA sequence
tgagcaggacctcctctctc

SEQ ID NO: 514344 - DNA, 20 bp, Artificial
  CRISPR gRNA sequence
gagcaggacctcctctctcc

SEQ ID NO: 514345 - DNA, 20 bp, Artificial
  CRISPR gRNA sequence
ctctctccaggactacccat

SEQ ID NO: 514346 - DNA, 20 bp, Artificial
  CRISPR gRNA sequence
tctccaggactacccatcgg

SEQ ID NO: 514347 - DNA, 20 bp, Artificial
  CRISPR gRNA sequence
ctccaggactacccatcggt

SEQ ID NO: 514348 - DNA, 20 bp, Artificial
  CRISPR gRNA sequence
aggactacccatcggtgggc

SEQ ID NO: 514349 - DNA, 20 bp, Artificial
  CRISPR gRNA sequence
ctacccatcggtgggccagc

SEQ ID NO: 514350 - DNA, 20 bp, Artificial
  CRISPR gRNA sequence
cggtgggccagctggcgcac

SEQ ID NO: 514351 - DNA, 20 bp, Artificial
  CRISPR gRNA sequence
gggccagctggcgcacaagc

SEQ ID NO: 514352 - DNA, 20 bp, Artificial
  CRISPR gRNA sequence
agctggctgaaaacaacatc

SEQ ID NO: 514353 - DNA, 20 bp, Artificial
  CRISPR gRNA sequence
caacatccagcccatcttcg

SEQ ID NO: 514354 - DNA, 20 bp, Artificial
  CRISPR gRNA sequence
cagcccatcttcgcggtgac

SEQ ID NO: 514355 - DNA, 20 bp, Artificial
  CRISPR gRNA sequence
cccatcttcgcggtgaccag

SEQ ID NO: 514356 - DNA, 20 bp, Artificial
  CRISPR gRNA sequence
ccatcttcgcggtgaccagt

SEQ ID NO: 514357 - DNA, 20 bp, Artificial
  CRISPR gRNA sequence
cttcgcggtgaccagtagga

SEQ ID NO: 514358 - DNA, 20 bp, Artificial
  CRISPR gRNA sequence
cggtgaccagtaggatggtg

SEQ ID NO: 514359 - DNA, 20 bp, Artificial
  CRISPR gRNA sequence
gtaggatggtgaagacctac

SEQ ID NO: 514360 - DNA, 20 bp, Artificial
  CRISPR gRNA sequence
taggatggtgaagacctacg

SEQ ID NO: 514361 - DNA, 20 bp, Artificial
  CRISPR gRNA sequence
atggtgaagacctacgaggt

SEQ ID NO: 514362 - DNA, 20 bp, Artificial
  CRISPR gRNA sequence
acctacgaggtgagtgctgt

SEQ ID NO: 514363 - DNA, 20 bp, Artificial
  CRISPR gRNA sequence
cctacgaggtgagtgctgtt

SEQ ID NO: 514364 - DNA, 20 bp, Artificial
  CRISPR gRNA sequence
ggtgagtgctgttgggtccc

SEQ ID NO: 514365 - DNA, 20 bp, Artificial
  CRISPR gRNA sequence
gttgggtcccgagcatccat

SEQ ID NO: 514366 - DNA, 20 bp, Artificial
  CRISPR gRNA sequence
ttgggtcccgagcatccatt

SEQ ID NO: 514367 - DNA, 20 bp, Artificial
  CRISPR gRNA sequence
ggtcccgagcatccattggg

SEQ ID NO: 514368 - DNA, 20 bp, Artificial
  CRISPR gRNA sequence
gtcccgagcatccattgggt

SEQ ID NO: 514369 - DNA, 20 bp, Artificial
  CRISPR gRNA sequence
tcccgagcatccattgggtg

SEQ ID NO: 514370 - DNA, 20 bp, Artificial
  CRISPR gRNA sequence
cccgagcatccattgggtgg

SEQ ID NO: 514371 - DNA, 20 bp, Artificial
  CRISPR gRNA sequence
cattgggtgggggcatgttt

SEQ ID NO: 514372 - DNA, 20 bp, Artificial
  CRISPR gRNA sequence
gtgggggcatgtttcagcca

SEQ ID NO: 514373 - DNA, 20 bp, Artificial
  CRISPR gRNA sequence
tgggggcatgtttcagccac

SEQ ID NO: 514374 - DNA, 20 bp, Artificial
  CRISPR gRNA sequence
ggcatgtttcagccacaggc

SEQ ID NO: 514375 - DNA, 20 bp, Artificial
  CRISPR gRNA sequence
tttcagccacaggccagacc

SEQ ID NO: 514376 - DNA, 20 bp, Artificial
  CRISPR gRNA sequence
ggccagacccagcgccactg

SEQ ID NO: 514377 - DNA, 20 bp, Artificial
  CRISPR gRNA sequence
gccagacccagcgccactgc

SEQ ID NO: 514378 - DNA, 20 bp, Artificial
  CRISPR gRNA sequence
cccagcgccactgcaggtct

SEQ ID NO: 514379 - DNA, 20 bp, Artificial
  CRISPR gRNA sequence
tgagcgccacctctgcatgc

SEQ ID NO: 514380 - DNA, 20 bp, Artificial
  CRISPR gRNA sequence
gagcgccacctctgcatgct

SEQ ID NO: 514381 - DNA, 20 bp, Artificial
  CRISPR gRNA sequence
cctctgcatgctgggcacgt

SEQ ID NO: 514382 - DNA, 20 bp, Artificial
  CRISPR gRNA sequence
atgctgggcacgtgagcaac

SEQ ID NO: 514383 - DNA, 20 bp, Artificial
  CRISPR gRNA sequence
tgggcacgtgagcaaccagc

SEQ ID NO: 514384 - DNA, 20 bp, Artificial
  CRISPR gRNA sequence
acgtgagcaaccagccggcc

SEQ ID NO: 514385 - DNA, 20 bp, Artificial
  CRISPR gRNA sequence
cgtgagcaaccagccggccc

SEQ ID NO: 514386 - DNA, 20 bp, Artificial
  CRISPR gRNA sequence
caaccagccggcccaggtcc

SEQ ID NO: 514387 - DNA, 20 bp, Artificial
  CRISPR gRNA sequence
gcccaggtcctggatccccc

SEQ ID NO: 514388 - DNA, 20 bp, Artificial
  CRISPR gRNA sequence
cccaggtcctggatccccct

SEQ ID NO: 514389 - DNA, 20 bp, Artificial
  CRISPR gRNA sequence
ggtcctggatccccctaggt

SEQ ID NO: 514390 - DNA, 20 bp, Artificial
  CRISPR gRNA sequence
gtcctggatccccctaggtg

SEQ ID NO: 514391 - DNA, 20 bp, Artificial
  CRISPR gRNA sequence
cctggatccccctaggtgag

SEQ ID NO: 514392 - DNA, 20 bp, Artificial
  CRISPR gRNA sequence
tccccctaggtgaggagccc

SEQ ID NO: 514393 - DNA, 20 bp, Artificial
  CRISPR gRNA sequence
ccccctaggtgaggagcccg

SEQ ID NO: 514394 - DNA, 20 bp, Artificial
  CRISPR gRNA sequence
aggagcccgaggcttcccgt

SEQ ID NO: 514395 - DNA, 20 bp, Artificial
  CRISPR gRNA sequence
ggagcccgaggcttcccgtc

SEQ ID NO: 514396 - DNA, 20 bp, Artificial
  CRISPR gRNA sequence
gagcccgaggcttcccgtcg

SEQ ID NO: 514397 - DNA, 20 bp, Artificial
  CRISPR gRNA sequence
ccgaggcttcccgtcgggga

SEQ ID NO: 514398 - DNA, 20 bp, Artificial
  CRISPR gRNA sequence
cgaggcttcccgtcggggac

SEQ ID NO: 514399 - DNA, 20 bp, Artificial
  CRISPR gRNA sequence
acaggacgcctgcgtgtcga

SEQ ID NO: 514400 - DNA, 20 bp, Artificial
  CRISPR gRNA sequence
caggacgcctgcgtgtcgat

SEQ ID NO: 514401 - DNA, 20 bp, Artificial
  CRISPR gRNA sequence
ggacgcctgcgtgtcgatag

SEQ ID NO: 514402 - DNA, 20 bp, Artificial
  CRISPR gRNA sequence
gacgcctgcgtgtcgatagg

SEQ ID NO: 514403 - DNA, 20 bp, Artificial
  CRISPR gRNA sequence
cgcctgcgtgtcgataggag

SEQ ID NO: 514404 - DNA, 20 bp, Artificial
  CRISPR gRNA sequence
gcctgcgtgtcgataggagg

SEQ ID NO: 514405 - DNA, 20 bp, Artificial
  CRISPR gRNA sequence
tcctccccgtccctgaaact

SEQ ID NO: 514406 - DNA, 20 bp, Artificial
  CRISPR gRNA sequence
ctgaaactcagctgtgttaa

SEQ ID NO: 514407 - DNA, 20 bp, Artificial
  CRISPR gRNA sequence
gctgtgttaacagcatgtct

SEQ ID NO: 514408 - DNA, 20 bp, Artificial
  CRISPR gRNA sequence
ttaacagcatgtcttggcat

SEQ ID NO: 514409 - DNA, 20 bp, Artificial
  CRISPR gRNA sequence
gtgatatttctgttttttcc

SEQ ID NO: 514410 - DNA, 20 bp, Artificial
  CRISPR gRNA sequence
caacacaattctttatttta

SEQ ID NO: 514411 - DNA, 20 bp, Artificial
  CRISPR gRNA sequence
gaacatcaacactctccgtg

SEQ ID NO: 514412 - DNA, 20 bp, Artificial
  CRISPR gRNA sequence
aattacacaaaaacgttcac

SEQ ID NO: 514413 - DNA, 20 bp, Artificial
  CRISPR gRNA sequence
cacaaaaacgttcacaagct

SEQ ID NO: 514414 - DNA, 20 bp, Artificial
  CRISPR gRNA sequence
caaaaacgttcacaagcttg

SEQ ID NO: 514415 - DNA, 20 bp, Artificial
  CRISPR gRNA sequence
acgttcacaagcttggagtg

SEQ ID NO: 514416 - DNA, 20 bp, Artificial
  CRISPR gRNA sequence
gttcacaagcttggagtgcg

SEQ ID NO: 514417 - DNA, 20 bp, Artificial
  CRISPR gRNA sequence
cacaagcttggagtgcggag

SEQ ID NO: 514418 - DNA, 20 bp, Artificial
  CRISPR gRNA sequence
acaagcttggagtgcggagt

SEQ ID NO: 514419 - DNA, 20 bp, Artificial
  CRISPR gRNA sequence
ggagtgggatgaatttcacg

SEQ ID NO: 514420 - DNA, 20 bp, Artificial
  CRISPR gRNA sequence
gagtgggatgaatttcacga

SEQ ID NO: 514421 - DNA, 20 bp, Artificial
  CRISPR gRNA sequence
tgggatgaatttcacgaagg

SEQ ID NO: 514422 - DNA, 20 bp, Artificial
  CRISPR gRNA sequence
tgaatttcacgaaggaagca

SEQ ID NO: 514423 - DNA, 20 bp, Artificial
  CRISPR gRNA sequence
aaggaagcacagctgataac

SEQ ID NO: 514424 - DNA, 20 bp, Artificial
  CRISPR gRNA sequence
tgataaccagcctctgctcc

SEQ ID NO: 514425 - DNA, 20 bp, Artificial
  CRISPR gRNA sequence
ccagcctctgctcctagaaa

SEQ ID NO: 514426 - DNA, 20 bp, Artificial
  CRISPR gRNA sequence
agcctctgctcctagaaaaa

SEQ ID NO: 514427 - DNA, 20 bp, Artificial
  CRISPR gRNA sequence
gcctctgctcctagaaaaag

SEQ ID NO: 514428 - DNA, 20 bp, Artificial
  CRISPR gRNA sequence
ctcctagaaaaagaggcccc

SEQ ID NO: 514429 - DNA, 20 bp, Artificial
  CRISPR gRNA sequence
tcatcctgcatttccgctgc

SEQ ID NO: 514430 - DNA, 20 bp, Artificial
  CRISPR gRNA sequence
cgctgctagtgccatgtgtt

SEQ ID NO: 514431 - DNA, 20 bp, Artificial
  CRISPR gRNA sequence
tagtgccatgtgttcagcct

SEQ ID NO: 514432 - DNA, 20 bp, Artificial
  CRISPR gRNA sequence
tgccatgtgttcagcctgag

SEQ ID NO: 514433 - DNA, 20 bp, Artificial
  CRISPR gRNA sequence
gccatgtgttcagcctgagc

SEQ ID NO: 514434 - DNA, 20 bp, Artificial
  CRISPR gRNA sequence
tgtgttcagcctgagcaggt

SEQ ID NO: 514435 - DNA, 20 bp, Artificial
  CRISPR gRNA sequence
cctgagcaggtcagtgcgtc

SEQ ID NO: 514436 - DNA, 20 bp, Artificial
  CRISPR gRNA sequence
ggtcagtgcgtcaagacgct

SEQ ID NO: 514437 - DNA, 20 bp, Artificial
  CRISPR gRNA sequence
gtcagtgcgtcaagacgctc

SEQ ID NO: 514438 - DNA, 20 bp, Artificial
  CRISPR gRNA sequence
tcaagacgctcaggtgctgt

SEQ ID NO: 514439 - DNA, 20 bp, Artificial
  CRISPR gRNA sequence
caagacgctcaggtgctgtt

SEQ ID NO: 514440 - DNA, 20 bp, Artificial
  CRISPR gRNA sequence
aagacgctcaggtgctgttg

SEQ ID NO: 514441 - DNA, 20 bp, Artificial
  CRISPR gRNA sequence
caggtgctgttggggttccc

SEQ ID NO: 514442 - DNA, 20 bp, Artificial
  CRISPR gRNA sequence
ggggttcccaagacctttct

SEQ ID NO: 514443 - DNA, 20 bp, Artificial
  CRISPR gRNA sequence
gggttcccaagacctttctc

SEQ ID NO: 514444 - DNA, 20 bp, Artificial
  CRISPR gRNA sequence
cccaagacctttctcaggat

SEQ ID NO: 514445 - DNA, 20 bp, Artificial
  CRISPR gRNA sequence
tctcaggatcagtgatttgc

SEQ ID NO: 514446 - DNA, 20 bp, Artificial
  CRISPR gRNA sequence
caggatcagtgatttgccgg

SEQ ID NO: 514447 - DNA, 20 bp, Artificial
  CRISPR gRNA sequence
aggatcagtgatttgccgga

SEQ ID NO: 514448 - DNA, 20 bp, Artificial
  CRISPR gRNA sequence
tgatttgccggaaggacttg

SEQ ID NO: 514449 - DNA, 20 bp, Artificial
  CRISPR gRNA sequence
atttgccggaaggacttgca

SEQ ID NO: 514450 - DNA, 20 bp, Artificial
  CRISPR gRNA sequence
ccggaaggacttgcagagct

SEQ ID NO: 514451 - DNA, 20 bp, Artificial
  CRISPR gRNA sequence
cggaaggacttgcagagctc

SEQ ID NO: 514452 - DNA, 20 bp, Artificial
  CRISPR gRNA sequence
gacttgcagagctcaggaac

SEQ ID NO: 514453 - DNA, 20 bp, Artificial
  CRISPR gRNA sequence
ctcaggaaccagtaaactca

SEQ ID NO: 514454 - DNA, 20 bp, Artificial
  CRISPR gRNA sequence
aaccagtaaactcacagtta

SEQ ID NO: 514455 - DNA, 20 bp, Artificial
  CRISPR gRNA sequence
ctcacagttacagtttattg

SEQ ID NO: 514456 - DNA, 20 bp, Artificial
  CRISPR gRNA sequence
cacagttacagtttattgca

SEQ ID NO: 514457 - DNA, 20 bp, Artificial
  CRISPR gRNA sequence
tattgcagagccgaccctcc

SEQ ID NO: 514458 - DNA, 20 bp, Artificial
  CRISPR gRNA sequence
attgcagagccgaccctcct

SEQ ID NO: 514459 - DNA, 20 bp, Artificial
  CRISPR gRNA sequence
gagccgaccctcctgggtgc

SEQ ID NO: 514460 - DNA, 20 bp, Artificial
  CRISPR gRNA sequence
ctgggtgccagccgctgccc

SEQ ID NO: 514461 - DNA, 20 bp, Artificial
  CRISPR gRNA sequence
tgggtgccagccgctgcccg

SEQ ID NO: 514462 - DNA, 20 bp, Artificial
  CRISPR gRNA sequence
gtgccagccgctgcccgagg

SEQ ID NO: 514463 - DNA, 20 bp, Artificial
  CRISPR gRNA sequence
tgccagccgctgcccgaggt

SEQ ID NO: 514464 - DNA, 20 bp, Artificial
  CRISPR gRNA sequence
ccagccgctgcccgaggtgg

SEQ ID NO: 514465 - DNA, 20 bp, Artificial
  CRISPR gRNA sequence
cagccgctgcccgaggtggg

SEQ ID NO: 514466 - DNA, 20 bp, Artificial
  CRISPR gRNA sequence
ctgcccgaggtgggaggata

SEQ ID NO: 514467 - DNA, 20 bp, Artificial
  CRISPR gRNA sequence
aggtgggaggatacagacaa

SEQ ID NO: 514468 - DNA, 20 bp, Artificial
  CRISPR gRNA sequence
gggaggatacagacaaaagt

SEQ ID NO: 514469 - DNA, 20 bp, Artificial
  CRISPR gRNA sequence
gatacagacaaaagtcagca

SEQ ID NO: 514470 - DNA, 20 bp, Artificial
  CRISPR gRNA sequence
atacagacaaaagtcagcaa

SEQ ID NO: 514471 - DNA, 20 bp, Artificial
  CRISPR gRNA sequence
acaaaagtcagcaaaggtca

SEQ ID NO: 514472 - DNA, 20 bp, Artificial
  CRISPR gRNA sequence
caaaagtcagcaaaggtcaa

SEQ ID NO: 514473 - DNA, 20 bp, Artificial
  CRISPR gRNA sequence
cagcaaaggtcaaaggtgca

SEQ ID NO: 514474 - DNA, 20 bp, Artificial
  CRISPR gRNA sequence
agcaaaggtcaaaggtgcac

SEQ ID NO: 514475 - DNA, 20 bp, Artificial
  CRISPR gRNA sequence
caaaggtcaaaggtgcacag

SEQ ID NO: 514476 - DNA, 20 bp, Artificial
  CRISPR gRNA sequence
aaggtcaaaggtgcacagga

SEQ ID NO: 514477 - DNA, 20 bp, Artificial
  CRISPR gRNA sequence
aaggtgcacaggagagaaac

SEQ ID NO: 514478 - DNA, 20 bp, Artificial
  CRISPR gRNA sequence
aggtgcacaggagagaaacc

SEQ ID NO: 514479 - DNA, 20 bp, Artificial
  CRISPR gRNA sequence
acaggagagaaaccaggcac

SEQ ID NO: 514480 - DNA, 20 bp, Artificial
  CRISPR gRNA sequence
agaaaccaggcaccagctcc

SEQ ID NO: 514481 - DNA, 20 bp, Artificial
  CRISPR gRNA sequence
ctcccagtgtcccctccctg

SEQ ID NO: 514482 - DNA, 20 bp, Artificial
  CRISPR gRNA sequence
tcccagtgtcccctccctgc

SEQ ID NO: 514483 - DNA, 20 bp, Artificial
  CRISPR gRNA sequence
cccagtgtcccctccctgca

SEQ ID NO: 514484 - DNA, 20 bp, Artificial
  CRISPR gRNA sequence
ccagtgtcccctccctgcag

SEQ ID NO: 514485 - DNA, 20 bp, Artificial
  CRISPR gRNA sequence
gtcccctccctgcaggggtg

SEQ ID NO: 514486 - DNA, 20 bp, Artificial
  CRISPR gRNA sequence
tcccctccctgcaggggtgt

SEQ ID NO: 514487 - DNA, 20 bp, Artificial
  CRISPR gRNA sequence
cctccctgcaggggtgtggg

SEQ ID NO: 514488 - DNA, 20 bp, Artificial
  CRISPR gRNA sequence
tgggcggcgctccatcctcc

SEQ ID NO: 514489 - DNA, 20 bp, Artificial
  CRISPR gRNA sequence
atcctcccagcgatgatgtg

SEQ ID NO: 514490 - DNA, 20 bp, Artificial
  CRISPR gRNA sequence
atgatgtgtggcctcatgca

SEQ ID NO: 514491 - DNA, 20 bp, Artificial
  CRISPR gRNA sequence
gtggcctcatgcacagaaca

SEQ ID NO: 514492 - DNA, 20 bp, Artificial
  CRISPR gRNA sequence
atgcacagaacatggtcccc

SEQ ID NO: 514493 - DNA, 20 bp, Artificial
  CRISPR gRNA sequence
tgcacagaacatggtcccca

SEQ ID NO: 514494 - DNA, 20 bp, Artificial
  CRISPR gRNA sequence
cacagaacatggtccccaag

SEQ ID NO: 514495 - DNA, 20 bp, Artificial
  CRISPR gRNA sequence
acagaacatggtccccaagg

SEQ ID NO: 514496 - DNA, 20 bp, Artificial
  CRISPR gRNA sequence
tggtccccaaggaggctctt

SEQ ID NO: 514497 - DNA, 20 bp, Artificial
  CRISPR gRNA sequence
ccaaggaggctcttgagcct

SEQ ID NO: 514498 - DNA, 20 bp, Artificial
  CRISPR gRNA sequence
tcttgagcctcggtgtctac

SEQ ID NO: 514499 - DNA, 20 bp, Artificial
  CRISPR gRNA sequence
cttgagcctcggtgtctact

SEQ ID NO: 514500 - DNA, 20 bp, Artificial
  CRISPR gRNA sequence
ttgagcctcggtgtctactg

SEQ ID NO: 514501 - DNA, 20 bp, Artificial
  CRISPR gRNA sequence
tgagcctcggtgtctactgg

SEQ ID NO: 514502 - DNA, 20 bp, Artificial
  CRISPR gRNA sequence
cctcggtgtctactgggggt

SEQ ID NO: 514503 - DNA, 20 bp, Artificial
  CRISPR gRNA sequence
tgtctactgggggtcagtca

SEQ ID NO: 514504 - DNA, 20 bp, Artificial
  CRISPR gRNA sequence
ctactgggggtcagtcacag

SEQ ID NO: 514505 - DNA, 20 bp, Artificial
  CRISPR gRNA sequence
gggggtcagtcacagcggcg

SEQ ID NO: 514506 - DNA, 20 bp, Artificial
  CRISPR gRNA sequence
gcggcgcggctgacacccca

SEQ ID NO: 514507 - DNA, 20 bp, Artificial
  CRISPR gRNA sequence
tgacaccccatggctgacct

SEQ ID NO: 514508 - DNA, 20 bp, Artificial
  CRISPR gRNA sequence
ccatggctgacctcagtctc

SEQ ID NO: 514509 - DNA, 20 bp, Artificial
  CRISPR gRNA sequence
gacctcagtctctagccctc

SEQ ID NO: 514510 - DNA, 20 bp, Artificial
  CRISPR gRNA sequence
cctcagtctctagccctcca

SEQ ID NO: 514511 - DNA, 20 bp, Artificial
  CRISPR gRNA sequence
ctcagtctctagccctccag

SEQ ID NO: 514512 - DNA, 20 bp, Artificial
  CRISPR gRNA sequence
tctctagccctccagaggtc

SEQ ID NO: 514513 - DNA, 20 bp, Artificial
  CRISPR gRNA sequence
aggtcaagctgaaaactgtc

SEQ ID NO: 514514 - DNA, 20 bp, Artificial
  CRISPR gRNA sequence
ggtcaagctgaaaactgtcc

SEQ ID NO: 514515 - DNA, 20 bp, Artificial
  CRISPR gRNA sequence
gtcaagctgaaaactgtcca

SEQ ID NO: 514516 - DNA, 20 bp, Artificial
  CRISPR gRNA sequence
ccccaccccaaatcacactg

SEQ ID NO: 514517 - DNA, 20 bp, Artificial
  CRISPR gRNA sequence
cccaccccaaatcacactgt

SEQ ID NO: 514518 - DNA, 20 bp, Artificial
  CRISPR gRNA sequence
aatcacactgtgggactatc

SEQ ID NO: 514519 - DNA, 20 bp, Artificial
  CRISPR gRNA sequence
gggactatccggtgtgacct

SEQ ID NO: 514520 - DNA, 20 bp, Artificial
  CRISPR gRNA sequence
ggactatccggtgtgacctg

SEQ ID NO: 514521 - DNA, 20 bp, Artificial
  CRISPR gRNA sequence
tccggtgtgacctgaggccc

SEQ ID NO: 514522 - DNA, 20 bp, Artificial
  CRISPR gRNA sequence
ccggtgtgacctgaggcccc

SEQ ID NO: 514523 - DNA, 20 bp, Artificial
  CRISPR gRNA sequence
aggaacaatgacacccccat

SEQ ID NO: 514524 - DNA, 20 bp, Artificial
  CRISPR gRNA sequence
ggaacaatgacacccccatc

SEQ ID NO: 514525 - DNA, 20 bp, Artificial
  CRISPR gRNA sequence
acaatgacacccccatcggg

SEQ ID NO: 514526 - DNA, 20 bp, Artificial
  CRISPR gRNA sequence
caatgacacccccatcgggt

SEQ ID NO: 514527 - DNA, 20 bp, Artificial
  CRISPR gRNA sequence
cccatcgggtaggatgtacc

SEQ ID NO: 514528 - DNA, 20 bp, Artificial
  CRISPR gRNA sequence
ccatcgggtaggatgtacca

SEQ ID NO: 514529 - DNA, 20 bp, Artificial
  CRISPR gRNA sequence
catcgggtaggatgtaccaa

SEQ ID NO: 514530 - DNA, 20 bp, Artificial
  CRISPR gRNA sequence
ggtaggatgtaccaagggct

SEQ ID NO: 514531 - DNA, 20 bp, Artificial
  CRISPR gRNA sequence
taggatgtaccaagggctca

SEQ ID NO: 514532 - DNA, 20 bp, Artificial
  CRISPR gRNA sequence
aggatgtaccaagggctcag

SEQ ID NO: 514533 - DNA, 20 bp, Artificial
  CRISPR gRNA sequence
agggctcagaggctacctct

SEQ ID NO: 514534 - DNA, 20 bp, Artificial
  CRISPR gRNA sequence
gggctcagaggctacctctc

SEQ ID NO: 514535 - DNA, 20 bp, Artificial
  CRISPR gRNA sequence
gctcagaggctacctctcag

SEQ ID NO: 514536 - DNA, 20 bp, Artificial
  CRISPR gRNA sequence
gaggctacctctcaggagct

SEQ ID NO: 514537 - DNA, 20 bp, Artificial
  CRISPR gRNA sequence
ctacctctcaggagctcagc

SEQ ID NO: 514538 - DNA, 20 bp, Artificial
  CRISPR gRNA sequence
tacctctcaggagctcagcc

SEQ ID NO: 514539 - DNA, 20 bp, Artificial
  CRISPR gRNA sequence
acctctcaggagctcagccg

SEQ ID NO: 514540 - DNA, 20 bp, Artificial
  CRISPR gRNA sequence
agccggggtctaccactctt

SEQ ID NO: 514541 - DNA, 20 bp, Artificial
  CRISPR gRNA sequence
ctaccactctttggcatgtg

SEQ ID NO: 514542 - DNA, 20 bp, Artificial
  CRISPR gRNA sequence
taccactctttggcatgtgt

SEQ ID NO: 514543 - DNA, 20 bp, Artificial
  CRISPR gRNA sequence
accactctttggcatgtgtg

SEQ ID NO: 514544 - DNA, 20 bp, Artificial
  CRISPR gRNA sequence
tctttggcatgtgtggggtg

SEQ ID NO: 514545 - DNA, 20 bp, Artificial
  CRISPR gRNA sequence
tggcatgtgtggggtgtggc

SEQ ID NO: 514546 - DNA, 20 bp, Artificial
  CRISPR gRNA sequence
atgtgtggggtgtggccagc

SEQ ID NO: 514547 - DNA, 20 bp, Artificial
  CRISPR gRNA sequence
tgtgtggggtgtggccagcc

SEQ ID NO: 514548 - DNA, 20 bp, Artificial
  CRISPR gRNA sequence
gtgtggccagccaggcctgc

SEQ ID NO: 514549 - DNA, 20 bp, Artificial
  CRISPR gRNA sequence
tgtggccagccaggcctgct

SEQ ID NO: 514550 - DNA, 20 bp, Artificial
  CRISPR gRNA sequence
ggccagccaggcctgctggg

SEQ ID NO: 514551 - DNA, 20 bp, Artificial
  CRISPR gRNA sequence
ccagccaggcctgctgggtg

SEQ ID NO: 514552 - DNA, 20 bp, Artificial
  CRISPR gRNA sequence
gtggagccctgactgtgtaa

SEQ ID NO: 514553 - DNA, 20 bp, Artificial
  CRISPR gRNA sequence
tggagccctgactgtgtaac

SEQ ID NO: 514554 - DNA, 20 bp, Artificial
  CRISPR gRNA sequence
ggagccctgactgtgtaaca

SEQ ID NO: 514555 - DNA, 20 bp, Artificial
  CRISPR gRNA sequence
actgtgtaacagggattcgc

SEQ ID NO: 514556 - DNA, 20 bp, Artificial
  CRISPR gRNA sequence
gtgtaacagggattcgctag

SEQ ID NO: 514557 - DNA, 20 bp, Artificial
  CRISPR gRNA sequence
tgtaacagggattcgctaga

SEQ ID NO: 514558 - DNA, 20 bp, Artificial
  CRISPR gRNA sequence
aacagggattcgctagaagg

SEQ ID NO: 514559 - DNA, 20 bp, Artificial
  CRISPR gRNA sequence
acagggattcgctagaagga

SEQ ID NO: 514560 - DNA, 20 bp, Artificial
  CRISPR gRNA sequence
aacactgcacgccctcctga

SEQ ID NO: 514561 - DNA, 20 bp, Artificial
  CRISPR gRNA sequence
acactgcacgccctcctgaa

SEQ ID NO: 514562 - DNA, 20 bp, Artificial
  CRISPR gRNA sequence
actgcacgccctcctgaaag

SEQ ID NO: 514563 - DNA, 20 bp, Artificial
  CRISPR gRNA sequence
ctgaaaggagcctccgccca

SEQ ID NO: 514564 - DNA, 20 bp, Artificial
  CRISPR gRNA sequence
aaaggagcctccgcccatag

SEQ ID NO: 514565 - DNA, 20 bp, Artificial
  CRISPR gRNA sequence
tccgcccatagcagcctgca

SEQ ID NO: 514566 - DNA, 20 bp, Artificial
  CRISPR gRNA sequence
atagcagcctgcacagtgtg

SEQ ID NO: 514567 - DNA, 20 bp, Artificial
  CRISPR gRNA sequence
cctgcacagtgtgtggccct

SEQ ID NO: 514568 - DNA, 20 bp, Artificial
  CRISPR gRNA sequence
ctgcacagtgtgtggccctg

SEQ ID NO: 514569 - DNA, 20 bp, Artificial
  CRISPR gRNA sequence
agtgtgtggccctgaggcca

SEQ ID NO: 514570 - DNA, 20 bp, Artificial
  CRISPR gRNA sequence
gtgtgtggccctgaggccac

SEQ ID NO: 514571 - DNA, 20 bp, Artificial
  CRISPR gRNA sequence
tgtgtggccctgaggccaca

SEQ ID NO: 514572 - DNA, 20 bp, Artificial
  CRISPR gRNA sequence
tggccctgaggccacaggga

SEQ ID NO: 514573 - DNA, 20 bp, Artificial
  CRISPR gRNA sequence
ccctgaggccacagggacag

SEQ ID NO: 514574 - DNA, 20 bp, Artificial
  CRISPR gRNA sequence
cctgaggccacagggacaga

SEQ ID NO: 514575 - DNA, 20 bp, Artificial
  CRISPR gRNA sequence
gccacagggacagaaggact

SEQ ID NO: 514576 - DNA, 20 bp, Artificial
  CRISPR gRNA sequence
cagggacagaaggactgagc

SEQ ID NO: 514577 - DNA, 20 bp, Artificial
  CRISPR gRNA sequence
gggacagaaggactgagctg

SEQ ID NO: 514578 - DNA, 20 bp, Artificial
  CRISPR gRNA sequence
ggacagaaggactgagctgg

SEQ ID NO: 514579 - DNA, 20 bp, Artificial
  CRISPR gRNA sequence
cagaaggactgagctggagg

SEQ ID NO: 514580 - DNA, 20 bp, Artificial
  CRISPR gRNA sequence
agaaggactgagctggagga

SEQ ID NO: 514581 - DNA, 20 bp, Artificial
  CRISPR gRNA sequence
aaggactgagctggaggaag

SEQ ID NO: 514582 - DNA, 20 bp, Artificial
  CRISPR gRNA sequence
aggactgagctggaggaagg

SEQ ID NO: 514583 - DNA, 20 bp, Artificial
  CRISPR gRNA sequence
actgagctggaggaaggagg

SEQ ID NO: 514584 - DNA, 20 bp, Artificial
  CRISPR gRNA sequence
ggttgtcattgtactttaca

SEQ ID NO: 514585 - DNA, 20 bp, Artificial
  CRISPR gRNA sequence
cagccacgtgccccgttctt

SEQ ID NO: 514586 - DNA, 20 bp, Artificial
  CRISPR gRNA sequence
agccacgtgccccgttcttc

SEQ ID NO: 514587 - DNA, 20 bp, Artificial
  CRISPR gRNA sequence
gccacgtgccccgttcttca

SEQ ID NO: 514588 - DNA, 20 bp, Artificial
  CRISPR gRNA sequence
acgtgccccgttcttcaggg

SEQ ID NO: 514589 - DNA, 20 bp, Artificial
  CRISPR gRNA sequence
gtgccccgttcttcagggtg

SEQ ID NO: 514590 - DNA, 20 bp, Artificial
  CRISPR gRNA sequence
cccgttcttcagggtggagc

SEQ ID NO: 514591 - DNA, 20 bp, Artificial
  CRISPR gRNA sequence
cgttcttcagggtggagctg

SEQ ID NO: 514592 - DNA, 20 bp, Artificial
  CRISPR gRNA sequence
gttcttcagggtggagctgg

SEQ ID NO: 514593 - DNA, 20 bp, Artificial
  CRISPR gRNA sequence
cagggtggagctggaggaac

SEQ ID NO: 514594 - DNA, 20 bp, Artificial
  CRISPR gRNA sequence
gtggagctggaggaacgaga

SEQ ID NO: 514595 - DNA, 20 bp, Artificial
  CRISPR gRNA sequence
agttgtcattgtactttaca

SEQ ID NO: 514596 - DNA, 20 bp, Artificial
  CRISPR gRNA sequence
cagccacgtgccccgttctt

SEQ ID NO: 514597 - DNA, 20 bp, Artificial
  CRISPR gRNA sequence
agccacgtgccccgttcttc

SEQ ID NO: 514598 - DNA, 20 bp, Artificial
  CRISPR gRNA sequence
gccacgtgccccgttcttca

SEQ ID NO: 514599 - DNA, 20 bp, Artificial
  CRISPR gRNA sequence
acgtgccccgttcttcaggg

SEQ ID NO: 514600 - DNA, 20 bp, Artificial
  CRISPR gRNA sequence
gccccgttcttcagggtgga

SEQ ID NO: 514601 - DNA, 20 bp, Artificial
  CRISPR gRNA sequence
ccccgttcttcagggtggac

SEQ ID NO: 514602 - DNA, 20 bp, Artificial
  CRISPR gRNA sequence
cccgttcttcagggtggaca

SEQ ID NO: 514603 - DNA, 20 bp, Artificial
  CRISPR gRNA sequence
cttcagggtggacagggccc

SEQ ID NO: 514604 - DNA, 20 bp, Artificial
  CRISPR gRNA sequence
ttcagggtggacagggccct

SEQ ID NO: 514605 - DNA, 20 bp, Artificial
  CRISPR gRNA sequence
agggtggacagggccctggg

SEQ ID NO: 514606 - DNA, 20 bp, Artificial
  CRISPR gRNA sequence
tgggtggctcacctcacacc

SEQ ID NO: 514607 - DNA, 20 bp, Artificial
  CRISPR gRNA sequence
cccagctctgttacttacca

SEQ ID NO: 514608 - DNA, 20 bp, Artificial
  CRISPR gRNA sequence
ccagctctgttacttaccac

SEQ ID NO: 514609 - DNA, 20 bp, Artificial
  CRISPR gRNA sequence
ttacttaccacaggacgccc

SEQ ID NO: 514610 - DNA, 20 bp, Artificial
  CRISPR gRNA sequence
tacttaccacaggacgcccc

SEQ ID NO: 514611 - DNA, 20 bp, Artificial
  CRISPR gRNA sequence
cccaggcccttccttacccc

SEQ ID NO: 514612 - DNA, 20 bp, Artificial
  CRISPR gRNA sequence
ccttccttaccccgagccct

SEQ ID NO: 514613 - DNA, 20 bp, Artificial
  CRISPR gRNA sequence
ctcagtttcctcatctgtga

SEQ ID NO: 514614 - DNA, 20 bp, Artificial
  CRISPR gRNA sequence
tcagtttcctcatctgtgaa

SEQ ID NO: 514615 - DNA, 20 bp, Artificial
  CRISPR gRNA sequence
cagtttcctcatctgtgaaa

SEQ ID NO: 514616 - DNA, 20 bp, Artificial
  CRISPR gRNA sequence
agtttcctcatctgtgaaag

SEQ ID NO: 514617 - DNA, 20 bp, Artificial
  CRISPR gRNA sequence
ttcctcatctgtgaaagggg

SEQ ID NO: 514618 - DNA, 20 bp, Artificial
  CRISPR gRNA sequence
ctcatctgtgaaaggggtag

SEQ ID NO: 514619 - DNA, 20 bp, Artificial
  CRISPR gRNA sequence
gtgaaaggggtagtggtgcc

SEQ ID NO: 514620 - DNA, 20 bp, Artificial
  CRISPR gRNA sequence
aaaggggtagtggtgcccgg

SEQ ID NO: 514621 - DNA, 20 bp, Artificial
  CRISPR gRNA sequence
aaggggtagtggtgcccggc

SEQ ID NO: 514622 - DNA, 20 bp, Artificial
  CRISPR gRNA sequence
gggtagtggtgcccggcggg

SEQ ID NO: 514623 - DNA, 20 bp, Artificial
  CRISPR gRNA sequence
gcccggcgggcagtgcgtcg

SEQ ID NO: 514624 - DNA, 20 bp, Artificial
  CRISPR gRNA sequence
cccggcgggcagtgcgtcgt

SEQ ID NO: 514625 - DNA, 20 bp, Artificial
  CRISPR gRNA sequence
ggcagtgcgtcgtgggtact

SEQ ID NO: 514626 - DNA, 20 bp, Artificial
  CRISPR gRNA sequence
gggtactgagctcacccact

SEQ ID NO: 514627 - DNA, 20 bp, Artificial
  CRISPR gRNA sequence
ggtactgagctcacccactc

SEQ ID NO: 514628 - DNA, 20 bp, Artificial
  CRISPR gRNA sequence
gtactgagctcacccactca

SEQ ID NO: 514629 - DNA, 20 bp, Artificial
  CRISPR gRNA sequence
tcacccactcagggaattca

SEQ ID NO: 514630 - DNA, 20 bp, Artificial
  CRISPR gRNA sequence
acccactcagggaattcaca

SEQ ID NO: 514631 - DNA, 20 bp, Artificial
  CRISPR gRNA sequence
cactcagggaattcacagag

SEQ ID NO: 514632 - DNA, 20 bp, Artificial
  CRISPR gRNA sequence
ttcacagagcagccgcccta

SEQ ID NO: 514633 - DNA, 20 bp, Artificial
  CRISPR gRNA sequence
tcacagagcagccgccctaa

SEQ ID NO: 514634 - DNA, 20 bp, Artificial
  CRISPR gRNA sequence
cacagagcagccgccctaaa

SEQ ID NO: 514635 - DNA, 20 bp, Artificial
  CRISPR gRNA sequence
agggcccgattatcctcatc

SEQ ID NO: 514636 - DNA, 20 bp, Artificial
  CRISPR gRNA sequence
cccgattatcctcatccgga

SEQ ID NO: 514637 - DNA, 20 bp, Artificial
  CRISPR gRNA sequence
ccggacagtgaccgacctgc

SEQ ID NO: 514638 - DNA, 20 bp, Artificial
  CRISPR gRNA sequence
gaccgacctgctggccattc

SEQ ID NO: 514639 - DNA, 20 bp, Artificial
  CRISPR gRNA sequence
accgacctgctggccattcc

SEQ ID NO: 514640 - DNA, 20 bp, Artificial
  CRISPR gRNA sequence
ccgacctgctggccattcca

SEQ ID NO: 514641 - DNA, 20 bp, Artificial
  CRISPR gRNA sequence
caccgccatcttcttcaaaa

SEQ ID NO: 514642 - DNA, 20 bp, Artificial
  CRISPR gRNA sequence
atcttcttcaaaatggcacg

SEQ ID NO: 514643 - DNA, 20 bp, Artificial
  CRISPR gRNA sequence
tcttcttcaaaatggcacgc

SEQ ID NO: 514644 - DNA, 20 bp, Artificial
  CRISPR gRNA sequence
caaaatggcacgcaggaaac

SEQ ID NO: 514645 - DNA, 20 bp, Artificial
  CRISPR gRNA sequence
aaaatggcacgcaggaaacc

SEQ ID NO: 514646 - DNA, 20 bp, Artificial
  CRISPR gRNA sequence
aaatggcacgcaggaaacca

SEQ ID NO: 514647 - DNA, 20 bp, Artificial
  CRISPR gRNA sequence
ggccccctcttccccctgcc

SEQ ID NO: 514648 - DNA, 20 bp, Artificial
  CRISPR gRNA sequence
gccccctcttccccctgcct

SEQ ID NO: 514649 - DNA, 20 bp, Artificial
  CRISPR gRNA sequence
ccccctcttccccctgcctg

SEQ ID NO: 514650 - DNA, 20 bp, Artificial
  CRISPR gRNA sequence
cccctgcctggggctctgcc

SEQ ID NO: 514651 - DNA, 20 bp, Artificial
  CRISPR gRNA sequence
tgcctggggctctgcccagc

SEQ ID NO: 514652 - DNA, 20 bp, Artificial
  CRISPR gRNA sequence
gcctggggctctgcccagct

SEQ ID NO: 514653 - DNA, 20 bp, Artificial
  CRISPR gRNA sequence
tggggctctgcccagctggg

SEQ ID NO: 514654 - DNA, 20 bp, Artificial
  CRISPR gRNA sequence
tgcccagctgggcagcctca

SEQ ID NO: 514655 - DNA, 20 bp, Artificial
  CRISPR gRNA sequence
acagcccctgccctgctgct

SEQ ID NO: 514656 - DNA, 20 bp, Artificial
  CRISPR gRNA sequence
cagcccctgccctgctgctt

SEQ ID NO: 514657 - DNA, 20 bp, Artificial
  CRISPR gRNA sequence
cctgccctgctgcttaggct

SEQ ID NO: 514658 - DNA, 20 bp, Artificial
  CRISPR gRNA sequence
ctgccctgctgcttaggctg

SEQ ID NO: 514659 - DNA, 20 bp, Artificial
  CRISPR gRNA sequence
gccctgctgcttaggctgag

SEQ ID NO: 514660 - DNA, 20 bp, Artificial
  CRISPR gRNA sequence
ttaggctgaggagacatact

SEQ ID NO: 514661 - DNA, 20 bp, Artificial
  CRISPR gRNA sequence
taggctgaggagacatactc

SEQ ID NO: 514662 - DNA, 20 bp, Artificial
  CRISPR gRNA sequence
aggctgaggagacatactcg

SEQ ID NO: 514663 - DNA, 20 bp, Artificial
  CRISPR gRNA sequence
gaggagacatactcggggtt

SEQ ID NO: 514664 - DNA, 20 bp, Artificial
  CRISPR gRNA sequence
aggagacatactcggggttt

SEQ ID NO: 514665 - DNA, 20 bp, Artificial
  CRISPR gRNA sequence
ggagacatactcggggtttg

SEQ ID NO: 514666 - DNA, 20 bp, Artificial
  CRISPR gRNA sequence
gacatactcggggtttgggg

SEQ ID NO: 514667 - DNA, 20 bp, Artificial
  CRISPR gRNA sequence
acatactcggggtttgggga

SEQ ID NO: 514668 - DNA, 20 bp, Artificial
  CRISPR gRNA sequence
actcggggtttggggaagga

SEQ ID NO: 514669 - DNA, 20 bp, Artificial
  CRISPR gRNA sequence
gtttggggaaggaaagtgcc

SEQ ID NO: 514670 - DNA, 20 bp, Artificial
  CRISPR gRNA sequence
tttggggaaggaaagtgccc

SEQ ID NO: 514671 - DNA, 20 bp, Artificial
  CRISPR gRNA sequence
tggggaaggaaagtgcccgg

SEQ ID NO: 514672 - DNA, 20 bp, Artificial
  CRISPR gRNA sequence
ggggaaggaaagtgcccggg

SEQ ID NO: 514673 - DNA, 20 bp, Artificial
  CRISPR gRNA sequence
gggaaggaaagtgcccggga

SEQ ID NO: 514674 - DNA, 20 bp, Artificial
  CRISPR gRNA sequence
ggagggccgctgcttttgta

SEQ ID NO: 514675 - DNA, 20 bp, Artificial
  CRISPR gRNA sequence
agtgaacatttgctgaacta

SEQ ID NO: 514676 - DNA, 20 bp, Artificial
  CRISPR gRNA sequence
gtgaacatttgctgaactac

SEQ ID NO: 514677 - DNA, 20 bp, Artificial
  CRISPR gRNA sequence
tgaacatttgctgaactaca

SEQ ID NO: 514678 - DNA, 20 bp, Artificial
  CRISPR gRNA sequence
gaactacagggatccattgt

SEQ ID NO: 514679 - DNA, 20 bp, Artificial
  CRISPR gRNA sequence
aactacagggatccattgtc

SEQ ID NO: 514680 - DNA, 20 bp, Artificial
  CRISPR gRNA sequence
ccattgtcaggcccgtatcc

SEQ ID NO: 514681 - DNA, 20 bp, Artificial
  CRISPR gRNA sequence
caggcccgtatcccagctac

SEQ ID NO: 514682 - DNA, 20 bp, Artificial
  CRISPR gRNA sequence
cagctacaagctcaacctcg

SEQ ID NO: 514683 - DNA, 20 bp, Artificial
  CRISPR gRNA sequence
agctcaacctcgtggtgtgt

SEQ ID NO: 514684 - DNA, 20 bp, Artificial
  CRISPR gRNA sequence
gctcaacctcgtggtgtgtt

SEQ ID NO: 514685 - DNA, 20 bp, Artificial
  CRISPR gRNA sequence
ctcaacctcgtggtgtgttg

SEQ ID NO: 514686 - DNA, 20 bp, Artificial
  CRISPR gRNA sequence
tcgtggtgtgttggggccga

SEQ ID NO: 514687 - DNA, 20 bp, Artificial
  CRISPR gRNA sequence
ggtgtgttggggccgacagc

SEQ ID NO: 514688 - DNA, 20 bp, Artificial
  CRISPR gRNA sequence
gttggggccgacagcgagac

SEQ ID NO: 514689 - DNA, 20 bp, Artificial
  CRISPR gRNA sequence
ggggccgacagcgagaccag

SEQ ID NO: 514690 - DNA, 20 bp, Artificial
  CRISPR gRNA sequence
gagaccagcggttcctgcca

SEQ ID NO: 514691 - DNA, 20 bp, Artificial
  CRISPR gRNA sequence
agaccagcggttcctgccat

SEQ ID NO: 514692 - DNA, 20 bp, Artificial
  CRISPR gRNA sequence
ggttcctgccataggttccc

SEQ ID NO: 514693 - DNA, 20 bp, Artificial
  CRISPR gRNA sequence
gttcctgccataggttcccc

SEQ ID NO: 514694 - DNA, 20 bp, Artificial
  CRISPR gRNA sequence
gccataggttccccgggctc

SEQ ID NO: 514695 - DNA, 20 bp, Artificial
  CRISPR gRNA sequence
cataggttccccgggctctg

SEQ ID NO: 514696 - DNA, 20 bp, Artificial
  CRISPR gRNA sequence
aggttccccgggctctggag

SEQ ID NO: 514697 - DNA, 20 bp, Artificial
  CRISPR gRNA sequence
ggttccccgggctctggagt

SEQ ID NO: 514698 - DNA, 20 bp, Artificial
  CRISPR gRNA sequence
ttccccgggctctggagtgg

SEQ ID NO: 514699 - DNA, 20 bp, Artificial
  CRISPR gRNA sequence
cccgggctctggagtgggag

SEQ ID NO: 514700 - DNA, 20 bp, Artificial
  CRISPR gRNA sequence
ccgggctctggagtgggagc

SEQ ID NO: 514701 - DNA, 20 bp, Artificial
  CRISPR gRNA sequence
ggagtgggagcaggaccctg

SEQ ID NO: 514702 - DNA, 20 bp, Artificial
  CRISPR gRNA sequence
gagtgggagcaggaccctgc

SEQ ID NO: 514703 - DNA, 20 bp, Artificial
  CRISPR gRNA sequence
gtgggagcaggaccctgcgg

SEQ ID NO: 514704 - DNA, 20 bp, Artificial
  CRISPR gRNA sequence
gcaggaccctgcgggagaca

SEQ ID NO: 514705 - DNA, 20 bp, Artificial
  CRISPR gRNA sequence
caggaccctgcgggagacac

SEQ ID NO: 514706 - DNA, 20 bp, Artificial
  CRISPR gRNA sequence
accctgcgggagacacggga

SEQ ID NO: 514707 - DNA, 20 bp, Artificial
  CRISPR gRNA sequence
ccctgcgggagacacgggat

SEQ ID NO: 514708 - DNA, 20 bp, Artificial
  CRISPR gRNA sequence
cctgcgggagacacgggatg

SEQ ID NO: 514709 - DNA, 20 bp, Artificial
  CRISPR gRNA sequence
ctgcgggagacacgggatgg

SEQ ID NO: 514710 - DNA, 20 bp, Artificial
  CRISPR gRNA sequence
cgggagacacgggatggggg

SEQ ID NO: 514711 - DNA, 20 bp, Artificial
  CRISPR gRNA sequence
gggagacacgggatgggggc

SEQ ID NO: 514712 - DNA, 20 bp, Artificial
  CRISPR gRNA sequence
acgggatgggggcaggtgtc

SEQ ID NO: 514713 - DNA, 20 bp, Artificial
  CRISPR gRNA sequence
cgggatgggggcaggtgtct

SEQ ID NO: 514714 - DNA, 20 bp, Artificial
  CRISPR gRNA sequence
gggatgggggcaggtgtctg

SEQ ID NO: 514715 - DNA, 20 bp, Artificial
  CRISPR gRNA sequence
ggatgggggcaggtgtctgg

SEQ ID NO: 514716 - DNA, 20 bp, Artificial
  CRISPR gRNA sequence
aggtgtctgggggaccctcc

SEQ ID NO: 514717 - DNA, 20 bp, Artificial
  CRISPR gRNA sequence
tgtctgggggaccctccgag

SEQ ID NO: 514718 - DNA, 20 bp, Artificial
  CRISPR gRNA sequence
gtctgggggaccctccgagt

SEQ ID NO: 514719 - DNA, 20 bp, Artificial
  CRISPR gRNA sequence
ggaccctccgagtgggcacc

SEQ ID NO: 514720 - DNA, 20 bp, Artificial
  CRISPR gRNA sequence
accctccgagtgggcaccca

SEQ ID NO: 514721 - DNA, 20 bp, Artificial
  CRISPR gRNA sequence
tccgagtgggcacccagagc

SEQ ID NO: 514722 - DNA, 20 bp, Artificial
  CRISPR gRNA sequence
agtgggcacccagagctggt

SEQ ID NO: 514723 - DNA, 20 bp, Artificial
  CRISPR gRNA sequence
gtgggcacccagagctggtc

SEQ ID NO: 514724 - DNA, 20 bp, Artificial
  CRISPR gRNA sequence
cccagagctggtcaggctgc

SEQ ID NO: 514725 - DNA, 20 bp, Artificial
  CRISPR gRNA sequence
ccagagctggtcaggctgcc

SEQ ID NO: 514726 - DNA, 20 bp, Artificial
  CRISPR gRNA sequence
agctggtcaggctgccggga

SEQ ID NO: 514727 - DNA, 20 bp, Artificial
  CRISPR gRNA sequence
tggtcaggctgccgggacag

SEQ ID NO: 514728 - DNA, 20 bp, Artificial
  CRISPR gRNA sequence
ggtcaggctgccgggacagt

SEQ ID NO: 514729 - DNA, 20 bp, Artificial
  CRISPR gRNA sequence
aggctgccgggacagtgggt

SEQ ID NO: 514730 - DNA, 20 bp, Artificial
  CRISPR gRNA sequence
gccgggacagtgggtcagcg

SEQ ID NO: 514731 - DNA, 20 bp, Artificial
  CRISPR gRNA sequence
ccgggacagtgggtcagcgc

SEQ ID NO: 514732 - DNA, 20 bp, Artificial
  CRISPR gRNA sequence
cgggacagtgggtcagcgca

SEQ ID NO: 514733 - DNA, 20 bp, Artificial
  CRISPR gRNA sequence
gacagtgggtcagcgcaggg

SEQ ID NO: 514734 - DNA, 20 bp, Artificial
  CRISPR gRNA sequence
acagtgggtcagcgcagggc

SEQ ID NO: 514735 - DNA, 20 bp, Artificial
  CRISPR gRNA sequence
cagtgggtcagcgcagggca

SEQ ID NO: 514736 - DNA, 20 bp, Artificial
  CRISPR gRNA sequence
gggtcagcgcagggcagggc

SEQ ID NO: 514737 - DNA, 20 bp, Artificial
  CRISPR gRNA sequence
ggtcagcgcagggcagggct

SEQ ID NO: 514738 - DNA, 20 bp, Artificial
  CRISPR gRNA sequence
gtcagcgcagggcagggctg

SEQ ID NO: 514739 - DNA, 20 bp, Artificial
  CRISPR gRNA sequence
gcgcagggcagggctggggc

SEQ ID NO: 514740 - DNA, 20 bp, Artificial
  CRISPR gRNA sequence
gggctggggccggacatcca

SEQ ID NO: 514741 - DNA, 20 bp, Artificial
  CRISPR gRNA sequence
gctggggccggacatccaca

SEQ ID NO: 514742 - DNA, 20 bp, Artificial
  CRISPR gRNA sequence
catccacagagaccacctgc

SEQ ID NO: 514743 - DNA, 20 bp, Artificial
  CRISPR gRNA sequence
cacagagaccacctgctggt

SEQ ID NO: 514744 - DNA, 20 bp, Artificial
  CRISPR gRNA sequence
acagagaccacctgctggtc

SEQ ID NO: 514745 - DNA, 20 bp, Artificial
  CRISPR gRNA sequence
acctgctggtcaggatgtca

SEQ ID NO: 514746 - DNA, 20 bp, Artificial
  CRISPR gRNA sequence
acagccctgtgtcccatctg

SEQ ID NO: 514747 - DNA, 20 bp, Artificial
  CRISPR gRNA sequence
cagccctgtgtcccatctgt

SEQ ID NO: 514748 - DNA, 20 bp, Artificial
  CRISPR gRNA sequence
ccctgtgtcccatctgtagg

SEQ ID NO: 514749 - DNA, 20 bp, Artificial
  CRISPR gRNA sequence
ccatctgtaggtggccatga

SEQ ID NO: 514750 - DNA, 20 bp, Artificial
  CRISPR gRNA sequence
catgacggtcccctcctcac

SEQ ID NO: 514751 - DNA, 20 bp, Artificial
  CRISPR gRNA sequence
gacggtcccctcctcaccag

SEQ ID NO: 514752 - DNA, 20 bp, Artificial
  CRISPR gRNA sequence
ggtcccctcctcaccagcag

SEQ ID NO: 514753 - DNA, 20 bp, Artificial
  CRISPR gRNA sequence
cccctcctcaccagcagtag

SEQ ID NO: 514754 - DNA, 20 bp, Artificial
  CRISPR gRNA sequence
ccctcctcaccagcagtagc

SEQ ID NO: 514755 - DNA, 20 bp, Artificial
  CRISPR gRNA sequence
caatcctttgccatttgtca

SEQ ID NO: 514756 - DNA, 20 bp, Artificial
  CRISPR gRNA sequence
tcctttgccatttgtcatgg

SEQ ID NO: 514757 - DNA, 20 bp, Artificial
  CRISPR gRNA sequence
ttgccatttgtcatggcagc

SEQ ID NO: 514758 - DNA, 20 bp, Artificial
  CRISPR gRNA sequence
ttgtcatggcagccagactc

SEQ ID NO: 514759 - DNA, 20 bp, Artificial
  CRISPR gRNA sequence
tgtcatggcagccagactcc

SEQ ID NO: 514760 - DNA, 20 bp, Artificial
  CRISPR gRNA sequence
ggcagccagactccaggcga

SEQ ID NO: 514761 - DNA, 20 bp, Artificial
  CRISPR gRNA sequence
ccagactccaggcgatggtg

SEQ ID NO: 514762 - DNA, 20 bp, Artificial
  CRISPR gRNA sequence
tccaggcgatggtgtggcac

SEQ ID NO: 514763 - DNA, 20 bp, Artificial
  CRISPR gRNA sequence
ccaggcgatggtgtggcacc

SEQ ID NO: 514764 - DNA, 20 bp, Artificial
  CRISPR gRNA sequence
caggcgatggtgtggcacca

SEQ ID NO: 514765 - DNA, 20 bp, Artificial
  CRISPR gRNA sequence
cgatggtgtggcaccagggc

SEQ ID NO: 514766 - DNA, 20 bp, Artificial
  CRISPR gRNA sequence
gatggtgtggcaccagggcc

SEQ ID NO: 514767 - DNA, 20 bp, Artificial
  CRISPR gRNA sequence
gtggcaccagggccaggcac

SEQ ID NO: 514768 - DNA, 20 bp, Artificial
  CRISPR gRNA sequence
ggcaccagggccaggcactg

SEQ ID NO: 514769 - DNA, 20 bp, Artificial
  CRISPR gRNA sequence
gcaccagggccaggcactgg

SEQ ID NO: 514770 - DNA, 20 bp, Artificial
  CRISPR gRNA sequence
ccagggccaggcactggagg

SEQ ID NO: 514771 - DNA, 20 bp, Artificial
  CRISPR gRNA sequence
cagggccaggcactggaggc

SEQ ID NO: 514772 - DNA, 20 bp, Artificial
  CRISPR gRNA sequence
ggccaggcactggaggcagg

SEQ ID NO: 514773 - DNA, 20 bp, Artificial
  CRISPR gRNA sequence
ccaggcactggaggcaggta

SEQ ID NO: 514774 - DNA, 20 bp, Artificial
  CRISPR gRNA sequence
tgcaccccatgcctactgct

SEQ ID NO: 514775 - DNA, 20 bp, Artificial
  CRISPR gRNA sequence
ccatgcctactgctgagcct

SEQ ID NO: 514776 - DNA, 20 bp, Artificial
  CRISPR gRNA sequence
catgcctactgctgagcctt

SEQ ID NO: 514777 - DNA, 20 bp, Artificial
  CRISPR gRNA sequence
atgcctactgctgagccttg

SEQ ID NO: 514778 - DNA, 20 bp, Artificial
  CRISPR gRNA sequence
tgctgagccttggggcacac

SEQ ID NO: 514779 - DNA, 20 bp, Artificial
  CRISPR gRNA sequence
tggggcacacaagccttcct

SEQ ID NO: 514780 - DNA, 20 bp, Artificial
  CRISPR gRNA sequence
aagccttcctcagcctttcc

SEQ ID NO: 514781 - DNA, 20 bp, Artificial
  CRISPR gRNA sequence
cagcctttcctggtcacctt

SEQ ID NO: 514782 - DNA, 20 bp, Artificial
  CRISPR gRNA sequence
agcctttcctggtcaccttc

SEQ ID NO: 514783 - DNA, 20 bp, Artificial
  CRISPR gRNA sequence
gcctttcctggtcaccttcg

SEQ ID NO: 514784 - DNA, 20 bp, Artificial
  CRISPR gRNA sequence
cctttcctggtcaccttcgg

SEQ ID NO: 514785 - DNA, 20 bp, Artificial
  CRISPR gRNA sequence
ttcctggtcaccttcggggg

SEQ ID NO: 514786 - DNA, 20 bp, Artificial
  CRISPR gRNA sequence
ggtcaccttcgggggtggtc

SEQ ID NO: 514787 - DNA, 20 bp, Artificial
  CRISPR gRNA sequence
gtcaccttcgggggtggtca

SEQ ID NO: 514788 - DNA, 20 bp, Artificial
  CRISPR gRNA sequence
ttcgggggtggtcaaggcaa

SEQ ID NO: 514789 - DNA, 20 bp, Artificial
  CRISPR gRNA sequence
tcgggggtggtcaaggcaac

SEQ ID NO: 514790 - DNA, 20 bp, Artificial
  CRISPR gRNA sequence
ggggtggtcaaggcaacagg

SEQ ID NO: 514791 - DNA, 20 bp, Artificial
  CRISPR gRNA sequence
tggtcaaggcaacaggcagc

SEQ ID NO: 514792 - DNA, 20 bp, Artificial
  CRISPR gRNA sequence
aaggcaacaggcagcgagtg

SEQ ID NO: 514793 - DNA, 20 bp, Artificial
  CRISPR gRNA sequence
acacgtgccacgccccctcc

SEQ ID NO: 514794 - DNA, 20 bp, Artificial
  CRISPR gRNA sequence
tccgagtgtgtttctgcacc

SEQ ID NO: 514795 - DNA, 20 bp, Artificial
  CRISPR gRNA sequence
gtgtttctgcaccaagcgca

SEQ ID NO: 514796 - DNA, 20 bp, Artificial
  CRISPR gRNA sequence
tttctgcaccaagcgcacag

SEQ ID NO: 514797 - DNA, 20 bp, Artificial
  CRISPR gRNA sequence
ttctgcaccaagcgcacagc

SEQ ID NO: 514798 - DNA, 20 bp, Artificial
  CRISPR gRNA sequence
caccaagcgcacagcaggct

SEQ ID NO: 514799 - DNA, 20 bp, Artificial
  CRISPR gRNA sequence
caagcgcacagcaggctcag

SEQ ID NO: 514800 - DNA, 20 bp, Artificial
  CRISPR gRNA sequence
aagcgcacagcaggctcagc

SEQ ID NO: 514801 - DNA, 20 bp, Artificial
  CRISPR gRNA sequence
gcacagcaggctcagcagga

SEQ ID NO: 514802 - DNA, 20 bp, Artificial
  CRISPR gRNA sequence
cacagcaggctcagcaggac

SEQ ID NO: 514803 - DNA, 20 bp, Artificial
  CRISPR gRNA sequence
aggctcagcaggacaggatg

SEQ ID NO: 514804 - DNA, 20 bp, Artificial
  CRISPR gRNA sequence
ggctcagcaggacaggatgt

SEQ ID NO: 514805 - DNA, 20 bp, Artificial
  CRISPR gRNA sequence
ctcagcaggacaggatgtgg

SEQ ID NO: 514806 - DNA, 20 bp, Artificial
  CRISPR gRNA sequence
tcagcaggacaggatgtggg

SEQ ID NO: 514807 - DNA, 20 bp, Artificial
  CRISPR gRNA sequence
cagcaggacaggatgtggga

SEQ ID NO: 514808 - DNA, 20 bp, Artificial
  CRISPR gRNA sequence
ggacaggatgtgggagggcc

SEQ ID NO: 514809 - DNA, 20 bp, Artificial
  CRISPR gRNA sequence
tgggagggcccagctctccc

SEQ ID NO: 514810 - DNA, 20 bp, Artificial
  CRISPR gRNA sequence
agggcccagctctcccaaga

SEQ ID NO: 514811 - DNA, 20 bp, Artificial
  CRISPR gRNA sequence
gggcccagctctcccaagac

SEQ ID NO: 514812 - DNA, 20 bp, Artificial
  CRISPR gRNA sequence
ggcccagctctcccaagaca

SEQ ID NO: 514813 - DNA, 20 bp, Artificial
  CRISPR gRNA sequence
cagctctcccaagacaggga

SEQ ID NO: 514814 - DNA, 20 bp, Artificial
  CRISPR gRNA sequence
tcccaagacagggatggccc

SEQ ID NO: 514815 - DNA, 20 bp, Artificial
  CRISPR gRNA sequence
agacagggatggccccagac

SEQ ID NO: 514816 - DNA, 20 bp, Artificial
  CRISPR gRNA sequence
gacagggatggccccagact

SEQ ID NO: 514817 - DNA, 20 bp, Artificial
  CRISPR gRNA sequence
gggatggccccagactggga

SEQ ID NO: 514818 - DNA, 20 bp, Artificial
  CRISPR gRNA sequence
tggccccagactgggacgga

SEQ ID NO: 514819 - DNA, 20 bp, Artificial
  CRISPR gRNA sequence
ccccagactgggacggatgg

SEQ ID NO: 514820 - DNA, 20 bp, Artificial
  CRISPR gRNA sequence
cagactgggacggatggaag

SEQ ID NO: 514821 - DNA, 20 bp, Artificial
  CRISPR gRNA sequence
agactgggacggatggaagt

SEQ ID NO: 514822 - DNA, 20 bp, Artificial
  CRISPR gRNA sequence
ctgggacggatggaagtggg

SEQ ID NO: 514823 - DNA, 20 bp, Artificial
  CRISPR gRNA sequence
ggacggatggaagtgggcgg

SEQ ID NO: 514824 - DNA, 20 bp, Artificial
  CRISPR gRNA sequence
gacggatggaagtgggcggt

SEQ ID NO: 514825 - DNA, 20 bp, Artificial
  CRISPR gRNA sequence
ggatggaagtgggcggtggg

SEQ ID NO: 514826 - DNA, 20 bp, Artificial
  CRISPR gRNA sequence
atggaagtgggcggtgggcg

SEQ ID NO: 514827 - DNA, 20 bp, Artificial
  CRISPR gRNA sequence
tggaagtgggcggtgggcgg

SEQ ID NO: 514828 - DNA, 20 bp, Artificial
  CRISPR gRNA sequence
ggaagtgggcggtgggcgga

SEQ ID NO: 514829 - DNA, 20 bp, Artificial
  CRISPR gRNA sequence
tgggcggtgggcggagggcg

SEQ ID NO: 514830 - DNA, 20 bp, Artificial
  CRISPR gRNA sequence
ggcggtgggcggagggcgca

SEQ ID NO: 514831 - DNA, 20 bp, Artificial
  CRISPR gRNA sequence
gcggtgggcggagggcgcag

SEQ ID NO: 514832 - DNA, 20 bp, Artificial
  CRISPR gRNA sequence
ggtgggcggagggcgcagag

SEQ ID NO: 514833 - DNA, 20 bp, Artificial
  CRISPR gRNA sequence
gtgggcggagggcgcagagg

SEQ ID NO: 514834 - DNA, 20 bp, Artificial
  CRISPR gRNA sequence
tgggcggagggcgcagagga

SEQ ID NO: 514835 - DNA, 20 bp, Artificial
  CRISPR gRNA sequence
gcggagggcgcagaggaggg

SEQ ID NO: 514836 - DNA, 20 bp, Artificial
  CRISPR gRNA sequence
gagggcgcagaggagggtgg

SEQ ID NO: 514837 - DNA, 20 bp, Artificial
  CRISPR gRNA sequence
gcgcagaggagggtggtggc

SEQ ID NO: 514838 - DNA, 20 bp, Artificial
  CRISPR gRNA sequence
cgcagaggagggtggtggcc

SEQ ID NO: 514839 - DNA, 20 bp, Artificial
  CRISPR gRNA sequence
ggtggtggccaggctgtgac

SEQ ID NO: 514840 - DNA, 20 bp, Artificial
  CRISPR gRNA sequence
ggccaggctgtgaccggccc

SEQ ID NO: 514841 - DNA, 20 bp, Artificial
  CRISPR gRNA sequence
gccaggctgtgaccggcccc

SEQ ID NO: 514842 - DNA, 20 bp, Artificial
  CRISPR gRNA sequence
caggctgtgaccggccccag

SEQ ID NO: 514843 - DNA, 20 bp, Artificial
  CRISPR gRNA sequence
gaccggccccaggagctcca

SEQ ID NO: 514844 - DNA, 20 bp, Artificial
  CRISPR gRNA sequence
cggccccaggagctccatgg

SEQ ID NO: 514845 - DNA, 20 bp, Artificial
  CRISPR gRNA sequence
ggccccaggagctccatgga

SEQ ID NO: 514846 - DNA, 20 bp, Artificial
  CRISPR gRNA sequence
gccccaggagctccatggaa

SEQ ID NO: 514847 - DNA, 20 bp, Artificial
  CRISPR gRNA sequence
aggagctccatggaagggac

SEQ ID NO: 514848 - DNA, 20 bp, Artificial
  CRISPR gRNA sequence
ggagctccatggaagggact

SEQ ID NO: 514849 - DNA, 20 bp, Artificial
  CRISPR gRNA sequence
tggaagggactgggcccatg

SEQ ID NO: 514850 - DNA, 20 bp, Artificial
  CRISPR gRNA sequence
ggaagggactgggcccatgc

SEQ ID NO: 514851 - DNA, 20 bp, Artificial
  CRISPR gRNA sequence
gaagggactgggcccatgca

SEQ ID NO: 514852 - DNA, 20 bp, Artificial
  CRISPR gRNA sequence
gggactgggcccatgcaggg

SEQ ID NO: 514853 - DNA, 20 bp, Artificial
  CRISPR gRNA sequence
gggcccatgcagggcagtca

SEQ ID NO: 514854 - DNA, 20 bp, Artificial
  CRISPR gRNA sequence
ggcccatgcagggcagtcat

SEQ ID NO: 514855 - DNA, 20 bp, Artificial
  CRISPR gRNA sequence
cccatgcagggcagtcatgg

SEQ ID NO: 514856 - DNA, 20 bp, Artificial
  CRISPR gRNA sequence
ccatgcagggcagtcatggg

SEQ ID NO: 514857 - DNA, 20 bp, Artificial
  CRISPR gRNA sequence
catgcagggcagtcatggga

SEQ ID NO: 514858 - DNA, 20 bp, Artificial
  CRISPR gRNA sequence
agggcagtcatgggagggtt

SEQ ID NO: 514859 - DNA, 20 bp, Artificial
  CRISPR gRNA sequence
gggcagtcatgggagggttt

SEQ ID NO: 514860 - DNA, 20 bp, Artificial
  CRISPR gRNA sequence
cagtcatgggagggtttggg

SEQ ID NO: 514861 - DNA, 20 bp, Artificial
  CRISPR gRNA sequence
agtcatgggagggtttgggc

SEQ ID NO: 514862 - DNA, 20 bp, Artificial
  CRISPR gRNA sequence
gtcatgggagggtttgggcg

SEQ ID NO: 514863 - DNA, 20 bp, Artificial
  CRISPR gRNA sequence
catgggagggtttgggcggg

SEQ ID NO: 514864 - DNA, 20 bp, Artificial
  CRISPR gRNA sequence
atgggagggtttgggcgggg

SEQ ID NO: 514865 - DNA, 20 bp, Artificial
  CRISPR gRNA sequence
gaccatctgctccgtgttcc

SEQ ID NO: 514866 - DNA, 20 bp, Artificial
  CRISPR gRNA sequence
catctgctccgtgttcctgg

SEQ ID NO: 514867 - DNA, 20 bp, Artificial
  CRISPR gRNA sequence
atctgctccgtgttcctgga

SEQ ID NO: 514868 - DNA, 20 bp, Artificial
  CRISPR gRNA sequence
gatgccgcaatcttccatga

SEQ ID NO: 514869 - DNA, 20 bp, Artificial
  CRISPR gRNA sequence
gccgcaatcttccatgaaag

SEQ ID NO: 514870 - DNA, 20 bp, Artificial
  CRISPR gRNA sequence
aatcttccatgaaagaagct

SEQ ID NO: 514871 - DNA, 20 bp, Artificial
  CRISPR gRNA sequence
gaaagaagctgagcatgtgt

SEQ ID NO: 514872 - DNA, 20 bp, Artificial
  CRISPR gRNA sequence
aagctgagcatgtgtgagca

SEQ ID NO: 514873 - DNA, 20 bp, Artificial
  CRISPR gRNA sequence
agctgagcatgtgtgagcat

SEQ ID NO: 514874 - DNA, 20 bp, Artificial
  CRISPR gRNA sequence
gctgagcatgtgtgagcatg

SEQ ID NO: 514875 - DNA, 20 bp, Artificial
  CRISPR gRNA sequence
ctgagcatgtgtgagcatgg

SEQ ID NO: 514876 - DNA, 20 bp, Artificial
  CRISPR gRNA sequence
gagcatgtgtgagcatgggg

SEQ ID NO: 514877 - DNA, 20 bp, Artificial
  CRISPR gRNA sequence
agcatgtgtgagcatggggg

SEQ ID NO: 514878 - DNA, 20 bp, Artificial
  CRISPR gRNA sequence
tgtgtgagcatgggggaggc

SEQ ID NO: 514879 - DNA, 20 bp, Artificial
  CRISPR gRNA sequence
tggctgcgcccctgtgcatc

SEQ ID NO: 514880 - DNA, 20 bp, Artificial
  CRISPR gRNA sequence
tgcgcccctgtgcatctggc

SEQ ID NO: 514881 - DNA, 20 bp, Artificial
  CRISPR gRNA sequence
cccctgtgcatctggccggc

SEQ ID NO: 514882 - DNA, 20 bp, Artificial
  CRISPR gRNA sequence
ccggccagaaccgatgtcac

SEQ ID NO: 514883 - DNA, 20 bp, Artificial
  CRISPR gRNA sequence
cggccagaaccgatgtcacc

SEQ ID NO: 514884 - DNA, 20 bp, Artificial
  CRISPR gRNA sequence
accgggctgtttaacaccca

SEQ ID NO: 514885 - DNA, 20 bp, Artificial
  CRISPR gRNA sequence
gtttaacacccatggaaact

SEQ ID NO: 514886 - DNA, 20 bp, Artificial
  CRISPR gRNA sequence
taacacccatggaaactcag

SEQ ID NO: 514887 - DNA, 20 bp, Artificial
  CRISPR gRNA sequence
acacccatggaaactcagta

SEQ ID NO: 514888 - DNA, 20 bp, Artificial
  CRISPR gRNA sequence
tggaaactcagtagagtgcc

SEQ ID NO: 514889 - DNA, 20 bp, Artificial
  CRISPR gRNA sequence
gaaactcagtagagtgccaa

SEQ ID NO: 514890 - DNA, 20 bp, Artificial
  CRISPR gRNA sequence
agtagagtgccaagagccga

SEQ ID NO: 514891 - DNA, 20 bp, Artificial
  CRISPR gRNA sequence
gccaagagccgatggcttcc

SEQ ID NO: 514892 - DNA, 20 bp, Artificial
  CRISPR gRNA sequence
tttactgtgatccaccctcg

SEQ ID NO: 514893 - DNA, 20 bp, Artificial
  CRISPR gRNA sequence
ttactgtgatccaccctcgt

SEQ ID NO: 514894 - DNA, 20 bp, Artificial
  CRISPR gRNA sequence
tactgtgatccaccctcgtg

SEQ ID NO: 514895 - DNA, 20 bp, Artificial
  CRISPR gRNA sequence
acttccgcctaccatctgtg

SEQ ID NO: 514896 - DNA, 20 bp, Artificial
  CRISPR gRNA sequence
tccgcctaccatctgtgtgg

SEQ ID NO: 514897 - DNA, 20 bp, Artificial
  CRISPR gRNA sequence
gcctaccatctgtgtggtgg

SEQ ID NO: 514898 - DNA, 20 bp, Artificial
  CRISPR gRNA sequence
cctaccatctgtgtggtggt

SEQ ID NO: 514899 - DNA, 20 bp, Artificial
  CRISPR gRNA sequence
gtaggaattccctacctgtg

SEQ ID NO: 514900 - DNA, 20 bp, Artificial
  CRISPR gRNA sequence
ggaattccctacctgtgtgg

SEQ ID NO: 514901 - DNA, 20 bp, Artificial
  CRISPR gRNA sequence
tacctgtgtggtggaaattc

SEQ ID NO: 514902 - DNA, 20 bp, Artificial
  CRISPR gRNA sequence
gtggaaattctggccaacac

SEQ ID NO: 514903 - DNA, 20 bp, Artificial
  CRISPR gRNA sequence
ccatgcacgtcctcccaacc

SEQ ID NO: 514904 - DNA, 20 bp, Artificial
  CRISPR gRNA sequence
tcccaacccagtgatattgc

SEQ ID NO: 514905 - DNA, 20 bp, Artificial
  CRISPR gRNA sequence
attgcgagcttgaaatccac

SEQ ID NO: 514906 - DNA, 20 bp, Artificial
  CRISPR gRNA sequence
ttgcgagcttgaaatccacc

SEQ ID NO: 514907 - DNA, 20 bp, Artificial
  CRISPR gRNA sequence
cgagcttgaaatccaccagg

SEQ ID NO: 514908 - DNA, 20 bp, Artificial
  CRISPR gRNA sequence
gagcttgaaatccaccaggc

SEQ ID NO: 514909 - DNA, 20 bp, Artificial
  CRISPR gRNA sequence
aggcaggatcactcacacca

SEQ ID NO: 514910 - DNA, 20 bp, Artificial
  CRISPR gRNA sequence
ggcaggatcactcacaccac

SEQ ID NO: 514911 - DNA, 20 bp, Artificial
  CRISPR gRNA sequence
aggatcactcacaccacagg

SEQ ID NO: 514912 - DNA, 20 bp, Artificial
  CRISPR gRNA sequence
ggatcactcacaccacaggc

SEQ ID NO: 514913 - DNA, 20 bp, Artificial
  CRISPR gRNA sequence
atcactcacaccacaggcag

SEQ ID NO: 514914 - DNA, 20 bp, Artificial
  CRISPR gRNA sequence
aggcaggagtactcacacca

SEQ ID NO: 514915 - DNA, 20 bp, Artificial
  CRISPR gRNA sequence
ggcaggagtactcacaccac

SEQ ID NO: 514916 - DNA, 20 bp, Artificial
  CRISPR gRNA sequence
aggagtactcacaccacagg

SEQ ID NO: 514917 - DNA, 20 bp, Artificial
  CRISPR gRNA sequence
ggagtactcacaccacaggc

SEQ ID NO: 514918 - DNA, 20 bp, Artificial
  CRISPR gRNA sequence
agtactcacaccacaggcgg

SEQ ID NO: 514919 - DNA, 20 bp, Artificial
  CRISPR gRNA sequence
actcacaccacaggcgggag

SEQ ID NO: 514920 - DNA, 20 bp, Artificial
  CRISPR gRNA sequence
aggcgggagcagtcacaccg

SEQ ID NO: 514921 - DNA, 20 bp, Artificial
  CRISPR gRNA sequence
ggcgggagcagtcacaccgc

SEQ ID NO: 514922 - DNA, 20 bp, Artificial
  CRISPR gRNA sequence
gggagcagtcacaccgcagg

SEQ ID NO: 514923 - DNA, 20 bp, Artificial
  CRISPR gRNA sequence
ggagcagtcacaccgcaggc

SEQ ID NO: 514924 - DNA, 20 bp, Artificial
  CRISPR gRNA sequence
aggcaggatcactcacactg

SEQ ID NO: 514925 - DNA, 20 bp, Artificial
  CRISPR gRNA sequence
ggcaggatcactcacactgc

SEQ ID NO: 514926 - DNA, 20 bp, Artificial
  CRISPR gRNA sequence
aggatcactcacactgcagg

SEQ ID NO: 514927 - DNA, 20 bp, Artificial
  CRISPR gRNA sequence
ggatcactcacactgcaggc

SEQ ID NO: 514928 - DNA, 20 bp, Artificial
  CRISPR gRNA sequence
aggcgggatcactcacaccg

SEQ ID NO: 514929 - DNA, 20 bp, Artificial
  CRISPR gRNA sequence
ggcgggatcactcacaccgc

SEQ ID NO: 514930 - DNA, 20 bp, Artificial
  CRISPR gRNA sequence
gggatcactcacaccgcagg

SEQ ID NO: 514931 - DNA, 20 bp, Artificial
  CRISPR gRNA sequence
ggatcactcacaccgcaggc

SEQ ID NO: 514932 - DNA, 20 bp, Artificial
  CRISPR gRNA sequence
atcactcacaccgcaggcgg

SEQ ID NO: 514933 - DNA, 20 bp, Artificial
  CRISPR gRNA sequence
aggcgggagcactcacaccg

SEQ ID NO: 514934 - DNA, 20 bp, Artificial
  CRISPR gRNA sequence
ggcgggagcactcacaccgc

SEQ ID NO: 514935 - DNA, 20 bp, Artificial
  CRISPR gRNA sequence
gggagcactcacaccgcagg

SEQ ID NO: 514936 - DNA, 20 bp, Artificial
  CRISPR gRNA sequence
ggagcactcacaccgcaggc

SEQ ID NO: 514937 - DNA, 20 bp, Artificial
  CRISPR gRNA sequence
aggcgggatcactcacaccg

SEQ ID NO: 514938 - DNA, 20 bp, Artificial
  CRISPR gRNA sequence
ggcgggatcactcacaccgc

SEQ ID NO: 514939 - DNA, 20 bp, Artificial
  CRISPR gRNA sequence
gggatcactcacaccgcagg

SEQ ID NO: 514940 - DNA, 20 bp, Artificial
  CRISPR gRNA sequence
ggatcactcacaccgcaggc

SEQ ID NO: 514941 - DNA, 20 bp, Artificial
  CRISPR gRNA sequence
atcactcacaccgcaggcag

SEQ ID NO: 514942 - DNA, 20 bp, Artificial
  CRISPR gRNA sequence
tcactcacaccgcaggcagg

SEQ ID NO: 514943 - DNA, 20 bp, Artificial
  CRISPR gRNA sequence
cgcaggcaggaggactcaca

SEQ ID NO: 514944 - DNA, 20 bp, Artificial
  CRISPR gRNA sequence
gcaggcaggaggactcacac

SEQ ID NO: 514945 - DNA, 20 bp, Artificial
  CRISPR gRNA sequence
ggcaggaggactcacacggg

SEQ ID NO: 514946 - DNA, 20 bp, Artificial
  CRISPR gRNA sequence
gcaggaggactcacacgggc

SEQ ID NO: 514947 - DNA, 20 bp, Artificial
  CRISPR gRNA sequence
aggactcacacgggcaggcc

SEQ ID NO: 514948 - DNA, 20 bp, Artificial
  CRISPR gRNA sequence
ggcaggcctggacaatgctg

SEQ ID NO: 514949 - DNA, 20 bp, Artificial
  CRISPR gRNA sequence
gcctggacaatgctgcagct

SEQ ID NO: 514950 - DNA, 20 bp, Artificial
  CRISPR gRNA sequence
cctggacaatgctgcagctc

SEQ ID NO: 514951 - DNA, 20 bp, Artificial
  CRISPR gRNA sequence
ctggacaatgctgcagctca

SEQ ID NO: 514952 - DNA, 20 bp, Artificial
  CRISPR gRNA sequence
ttcttatcctcatgatgcaa

SEQ ID NO: 514953 - DNA, 20 bp, Artificial
  CRISPR gRNA sequence
tcatttcattttattttatt

SEQ ID NO: 514954 - DNA, 20 bp, Artificial
  CRISPR gRNA sequence
ttcattttattttattgaga

SEQ ID NO: 514955 - DNA, 20 bp, Artificial
  CRISPR gRNA sequence
cattttattttattgagaca

SEQ ID NO: 514956 - DNA, 20 bp, Artificial
  CRISPR gRNA sequence
agagttttgctcttgttgcc

SEQ ID NO: 514957 - DNA, 20 bp, Artificial
  CRISPR gRNA sequence
gagttttgctcttgttgccc

SEQ ID NO: 514958 - DNA, 20 bp, Artificial
  CRISPR gRNA sequence
tttgctcttgttgcccaggc

SEQ ID NO: 514959 - DNA, 20 bp, Artificial
  CRISPR gRNA sequence
tgctcttgttgcccaggctg

SEQ ID NO: 514960 - DNA, 20 bp, Artificial
  CRISPR gRNA sequence
ttgcccaggctggagtgcca

SEQ ID NO: 514961 - DNA, 20 bp, Artificial
  CRISPR gRNA sequence
ggagtgccatggtgtgatct

SEQ ID NO: 514962 - DNA, 20 bp, Artificial
  CRISPR gRNA sequence
tcattgcgacctccgcctcc

SEQ ID NO: 514963 - DNA, 20 bp, Artificial
  CRISPR gRNA sequence
cattgcgacctccgcctcct

SEQ ID NO: 514964 - DNA, 20 bp, Artificial
  CRISPR gRNA sequence
cctcctgggttctcctgcct

SEQ ID NO: 514965 - DNA, 20 bp, Artificial
  CRISPR gRNA sequence
ttctcctgcctcagtctcct

SEQ ID NO: 514966 - DNA, 20 bp, Artificial
  CRISPR gRNA sequence
tcctgcctcagtctcctgag

SEQ ID NO: 514967 - DNA, 20 bp, Artificial
  CRISPR gRNA sequence
gcctcagtctcctgagtagc

SEQ ID NO: 514968 - DNA, 20 bp, Artificial
  CRISPR gRNA sequence
cctcagtctcctgagtagct

SEQ ID NO: 514969 - DNA, 20 bp, Artificial
  CRISPR gRNA sequence
ctcctgagtagctgggctta

SEQ ID NO: 514970 - DNA, 20 bp, Artificial
  CRISPR gRNA sequence
tcctgagtagctgggcttac

SEQ ID NO: 514971 - DNA, 20 bp, Artificial
  CRISPR gRNA sequence
caggtgcccaccaccacgcc

SEQ ID NO: 514972 - DNA, 20 bp, Artificial
  CRISPR gRNA sequence
ccagctaatttttgtatttt

SEQ ID NO: 514973 - DNA, 20 bp, Artificial
  CRISPR gRNA sequence
gctaatttttgtatttttag

SEQ ID NO: 514974 - DNA, 20 bp, Artificial
  CRISPR gRNA sequence
taatttttgtatttttagta

SEQ ID NO: 514975 - DNA, 20 bp, Artificial
  CRISPR gRNA sequence
ttttgtatttttagtagaga

SEQ ID NO: 514976 - DNA, 20 bp, Artificial
  CRISPR gRNA sequence
tttgtatttttagtagagac

SEQ ID NO: 514977 - DNA, 20 bp, Artificial
  CRISPR gRNA sequence
ttgtatttttagtagagacg

SEQ ID NO: 514978 - DNA, 20 bp, Artificial
  CRISPR gRNA sequence
gagacggggtttcaccatgt

SEQ ID NO: 514979 - DNA, 20 bp, Artificial
  CRISPR gRNA sequence
cggggtttcaccatgttggc

SEQ ID NO: 514980 - DNA, 20 bp, Artificial
  CRISPR gRNA sequence
ggggtttcaccatgttggcc

SEQ ID NO: 514981 - DNA, 20 bp, Artificial
  CRISPR gRNA sequence
tttcaccatgttggccaggc

SEQ ID NO: 514982 - DNA, 20 bp, Artificial
  CRISPR gRNA sequence
tggtctcaaactcctgacct

SEQ ID NO: 514983 - DNA, 20 bp, Artificial
  CRISPR gRNA sequence
cctcagtgatccacccactt

SEQ ID NO: 514984 - DNA, 20 bp, Artificial
  CRISPR gRNA sequence
ccacccactttggcctccca

SEQ ID NO: 514985 - DNA, 20 bp, Artificial
  CRISPR gRNA sequence
actttggcctcccaaagtgc

SEQ ID NO: 514986 - DNA, 20 bp, Artificial
  CRISPR gRNA sequence
ctttggcctcccaaagtgct

SEQ ID NO: 514987 - DNA, 20 bp, Artificial
  CRISPR gRNA sequence
ctcccaaagtgctgggatca

SEQ ID NO: 514988 - DNA, 20 bp, Artificial
  CRISPR gRNA sequence
tcccaaagtgctgggatcac

SEQ ID NO: 514989 - DNA, 20 bp, Artificial
  CRISPR gRNA sequence
agtgctgggatcacaggcgt

SEQ ID NO: 514990 - DNA, 20 bp, Artificial
  CRISPR gRNA sequence
caggcgtgagccatcatgcc

SEQ ID NO: 514991 - DNA, 20 bp, Artificial
  CRISPR gRNA sequence
gtgagccatcatgcctggcc

SEQ ID NO: 514992 - DNA, 20 bp, Artificial
  CRISPR gRNA sequence
tgagccatcatgcctggcct

SEQ ID NO: 514993 - DNA, 20 bp, Artificial
  CRISPR gRNA sequence
ttgttttgttttgttttttt

SEQ ID NO: 514994 - DNA, 20 bp, Artificial
  CRISPR gRNA sequence
ttgttttgtttttttgagac

SEQ ID NO: 514995 - DNA, 20 bp, Artificial
  CRISPR gRNA sequence
tgttttgtttttttgagaca

SEQ ID NO: 514996 - DNA, 20 bp, Artificial
  CRISPR gRNA sequence
caaggtcttgctctgtcgcc

SEQ ID NO: 514997 - DNA, 20 bp, Artificial
  CRISPR gRNA sequence
aaggtcttgctctgtcgccc

SEQ ID NO: 514998 - DNA, 20 bp, Artificial
  CRISPR gRNA sequence
tcttgctctgtcgcccaggc

SEQ ID NO: 514999 - DNA, 20 bp, Artificial
  CRISPR gRNA sequence
ttgctctgtcgcccaggctg

SEQ ID NO: 515000 - DNA, 20 bp, Artificial
  CRISPR gRNA sequence
ctgtcgcccaggctggagtg

SEQ ID NO: 515001 - DNA, 20 bp, Artificial
  CRISPR gRNA sequence
tcgcccaggctggagtgcag

SEQ ID NO: 515002 - DNA, 20 bp, Artificial
  CRISPR gRNA sequence
ggagtgcagtggtgcgatct

SEQ ID NO: 515003 - DNA, 20 bp, Artificial
  CRISPR gRNA sequence
tcactgcaacctccacctcc

SEQ ID NO: 515004 - DNA, 20 bp, Artificial
  CRISPR gRNA sequence
cactgcaacctccacctcct

SEQ ID NO: 515005 - DNA, 20 bp, Artificial
  CRISPR gRNA sequence
aacctccacctcctgggttt

SEQ ID NO: 515006 - DNA, 20 bp, Artificial
  CRISPR gRNA sequence
tttaagtgatcctcctgcct

SEQ ID NO: 515007 - DNA, 20 bp, Artificial
  CRISPR gRNA sequence
tcctcctgcctcagcctccc

SEQ ID NO: 515008 - DNA, 20 bp, Artificial
  CRISPR gRNA sequence
gcctcagcctcccgagtatc

SEQ ID NO: 515009 - DNA, 20 bp, Artificial
  CRISPR gRNA sequence
ctcccgagtatctggtacta

SEQ ID NO: 515010 - DNA, 20 bp, Artificial
  CRISPR gRNA sequence
tcccgagtatctggtactac

SEQ ID NO: 515011 - DNA, 20 bp, Artificial
  CRISPR gRNA sequence
tctaatatttgtactttttg

SEQ ID NO: 515012 - DNA, 20 bp, Artificial
  CRISPR gRNA sequence
taatatttgtactttttgta

SEQ ID NO: 515013 - DNA, 20 bp, Artificial
  CRISPR gRNA sequence
atttgtactttttgtagaga

SEQ ID NO: 515014 - DNA, 20 bp, Artificial
  CRISPR gRNA sequence
tttgtactttttgtagagat

SEQ ID NO: 515015 - DNA, 20 bp, Artificial
  CRISPR gRNA sequence
ttgtactttttgtagagatg

SEQ ID NO: 515016 - DNA, 20 bp, Artificial
  CRISPR gRNA sequence
tggggtcttcttatgttgcc

SEQ ID NO: 515017 - DNA, 20 bp, Artificial
  CRISPR gRNA sequence
ggggtcttcttatgttgccc

SEQ ID NO: 515018 - DNA, 20 bp, Artificial
  CRISPR gRNA sequence
tcttcttatgttgcccaggc

SEQ ID NO: 515019 - DNA, 20 bp, Artificial
  CRISPR gRNA sequence
ccaggctggtcctgaactcc

SEQ ID NO: 515020 - DNA, 20 bp, Artificial
  CRISPR gRNA sequence
caggctggtcctgaactcct

SEQ ID NO: 515021 - DNA, 20 bp, Artificial
  CRISPR gRNA sequence
tggtcctgaactcctgggct

SEQ ID NO: 515022 - DNA, 20 bp, Artificial
  CRISPR gRNA sequence
ggtcctgaactcctgggctc

SEQ ID NO: 515023 - DNA, 20 bp, Artificial
  CRISPR gRNA sequence
ctcaggcaatcttcccacat

SEQ ID NO: 515024 - DNA, 20 bp, Artificial
  CRISPR gRNA sequence
tcttcccacatcggcctccc

SEQ ID NO: 515025 - DNA, 20 bp, Artificial
  CRISPR gRNA sequence
cacatcggcctcccgagtac

SEQ ID NO: 515026 - DNA, 20 bp, Artificial
  CRISPR gRNA sequence
cctcccgagtactggtattc

SEQ ID NO: 515027 - DNA, 20 bp, Artificial
  CRISPR gRNA sequence
ctcccgagtactggtattcc

SEQ ID NO: 515028 - DNA, 20 bp, Artificial
  CRISPR gRNA sequence
gagtactggtattccaggcg

SEQ ID NO: 515029 - DNA, 20 bp, Artificial
  CRISPR gRNA sequence
ggtattccaggcgtggcccc

SEQ ID NO: 515030 - DNA, 20 bp, Artificial
  CRISPR gRNA sequence
gtattccaggcgtggcccct

SEQ ID NO: 515031 - DNA, 20 bp, Artificial
  CRISPR gRNA sequence
ttccaggcgtggcccctggg

SEQ ID NO: 515032 - DNA, 20 bp, Artificial
  CRISPR gRNA sequence
ggcgtggcccctgggcagct

SEQ ID NO: 515033 - DNA, 20 bp, Artificial
  CRISPR gRNA sequence
gcgtggcccctgggcagctc

SEQ ID NO: 515034 - DNA, 20 bp, Artificial
  CRISPR gRNA sequence
cgtggcccctgggcagctca

SEQ ID NO: 515035 - DNA, 20 bp, Artificial
  CRISPR gRNA sequence
gctcagggctttttaccccc

SEQ ID NO: 515036 - DNA, 20 bp, Artificial
  CRISPR gRNA sequence
acatcactgaccacacactc

SEQ ID NO: 515037 - DNA, 20 bp, Artificial
  CRISPR gRNA sequence
catcactgaccacacactct

SEQ ID NO: 515038 - DNA, 20 bp, Artificial
  CRISPR gRNA sequence
atcactgaccacacactctg

SEQ ID NO: 515039 - DNA, 20 bp, Artificial
  CRISPR gRNA sequence
gaccacacactctggggacc

SEQ ID NO: 515040 - DNA, 20 bp, Artificial
  CRISPR gRNA sequence
accaagtgcaaaactgcgtt

SEQ ID NO: 515041 - DNA, 20 bp, Artificial
  CRISPR gRNA sequence
ccaagtgcaaaactgcgttg

SEQ ID NO: 515042 - DNA, 20 bp, Artificial
  CRISPR gRNA sequence
aactgcgttgaggaccgtcc

SEQ ID NO: 515043 - DNA, 20 bp, Artificial
  CRISPR gRNA sequence
ggaccgtcccagccattttg

SEQ ID NO: 515044 - DNA, 20 bp, Artificial
  CRISPR gRNA sequence
gaccgtcccagccattttgc

SEQ ID NO: 515045 - DNA, 20 bp, Artificial
  CRISPR gRNA sequence
tcccagccattttgcaggtg

SEQ ID NO: 515046 - DNA, 20 bp, Artificial
  CRISPR gRNA sequence
cagccattttgcaggtgcag

SEQ ID NO: 515047 - DNA, 20 bp, Artificial
  CRISPR gRNA sequence
tttgcaggtgcagaagcccc

SEQ ID NO: 515048 - DNA, 20 bp, Artificial
  CRISPR gRNA sequence
ttgcaggtgcagaagcccct

SEQ ID NO: 515049 - DNA, 20 bp, Artificial
  CRISPR gRNA sequence
tgcaggtgcagaagcccctg

SEQ ID NO: 515050 - DNA, 20 bp, Artificial
  CRISPR gRNA sequence
ggtgcagaagcccctggggt

SEQ ID NO: 515051 - DNA, 20 bp, Artificial
  CRISPR gRNA sequence
agaagcccctggggtgagcc

SEQ ID NO: 515052 - DNA, 20 bp, Artificial
  CRISPR gRNA sequence
cctggggtgagcccagtgcg

SEQ ID NO: 515053 - DNA, 20 bp, Artificial
  CRISPR gRNA sequence
tggggtgagcccagtgcgtg

SEQ ID NO: 515054 - DNA, 20 bp, Artificial
  CRISPR gRNA sequence
cccagtgcgtggagatgccg

SEQ ID NO: 515055 - DNA, 20 bp, Artificial
  CRISPR gRNA sequence
tgcgtggagatgccgtggca

SEQ ID NO: 515056 - DNA, 20 bp, Artificial
  CRISPR gRNA sequence
gcgtggagatgccgtggcac

SEQ ID NO: 515057 - DNA, 20 bp, Artificial
  CRISPR gRNA sequence
agatgccgtggcacaggtcc

SEQ ID NO: 515058 - DNA, 20 bp, Artificial
  CRISPR gRNA sequence
ggtcctagccgtgccatgtc

SEQ ID NO: 515059 - DNA, 20 bp, Artificial
  CRISPR gRNA sequence
tgtctggtcttcttgcccaa

SEQ ID NO: 515060 - DNA, 20 bp, Artificial
  CRISPR gRNA sequence
ttgcccaacagaaactcacc

SEQ ID NO: 515061 - DNA, 20 bp, Artificial
  CRISPR gRNA sequence
aactcaccgagatcatcccc

SEQ ID NO: 515062 - DNA, 20 bp, Artificial
  CRISPR gRNA sequence
caccgagatcatccccaagt

SEQ ID NO: 515063 - DNA, 20 bp, Artificial
  CRISPR gRNA sequence
gatcatccccaagtcagccg

SEQ ID NO: 515064 - DNA, 20 bp, Artificial
  CRISPR gRNA sequence
atcatccccaagtcagccgt

SEQ ID NO: 515065 - DNA, 20 bp, Artificial
  CRISPR gRNA sequence
tcatccccaagtcagccgtg

SEQ ID NO: 515066 - DNA, 20 bp, Artificial
  CRISPR gRNA sequence
catccccaagtcagccgtgg

SEQ ID NO: 515067 - DNA, 20 bp, Artificial
  CRISPR gRNA sequence
tccccaagtcagccgtgggg

SEQ ID NO: 515068 - DNA, 20 bp, Artificial
  CRISPR gRNA sequence
cagccgtgggggagctgtct

SEQ ID NO: 515069 - DNA, 20 bp, Artificial
  CRISPR gRNA sequence
agccgtgggggagctgtctg

SEQ ID NO: 515070 - DNA, 20 bp, Artificial
  CRISPR gRNA sequence
ggggagctgtctgaggactc

SEQ ID NO: 515071 - DNA, 20 bp, Artificial
  CRISPR gRNA sequence
gtctgaggactccagcaatg

SEQ ID NO: 515072 - DNA, 20 bp, Artificial
  CRISPR gRNA sequence
gcaatgtggtccatctcatt

SEQ ID NO: 515073 - DNA, 20 bp, Artificial
  CRISPR gRNA sequence
attaagaatgcttacaatgt

SEQ ID NO: 515074 - DNA, 20 bp, Artificial
  CRISPR gRNA sequence
tgtgagtctcccgcaccact

SEQ ID NO: 515075 - DNA, 20 bp, Artificial
  CRISPR gRNA sequence
agtctcccgcaccactcagc

SEQ ID NO: 515076 - DNA, 20 bp, Artificial
  CRISPR gRNA sequence
gtctcccgcaccactcagct

SEQ ID NO: 515077 - DNA, 20 bp, Artificial
  CRISPR gRNA sequence
caccactcagctgggaccca

SEQ ID NO: 515078 - DNA, 20 bp, Artificial
  CRISPR gRNA sequence
accactcagctgggacccat

SEQ ID NO: 515079 - DNA, 20 bp, Artificial
  CRISPR gRNA sequence
ccactcagctgggacccatg

SEQ ID NO: 515080 - DNA, 20 bp, Artificial
  CRISPR gRNA sequence
ctcagctgggacccatgggg

SEQ ID NO: 515081 - DNA, 20 bp, Artificial
  CRISPR gRNA sequence
gctgggacccatggggtggc

SEQ ID NO: 515082 - DNA, 20 bp, Artificial
  CRISPR gRNA sequence
ggccagcaatctccccactg

SEQ ID NO: 515083 - DNA, 20 bp, Artificial
  CRISPR gRNA sequence
gccagcaatctccccactgc

SEQ ID NO: 515084 - DNA, 20 bp, Artificial
  CRISPR gRNA sequence
gcaatctccccactgcaggt

SEQ ID NO: 515085 - DNA, 20 bp, Artificial
  CRISPR gRNA sequence
ctgcaggtcagctcctgctg

SEQ ID NO: 515086 - DNA, 20 bp, Artificial
  CRISPR gRNA sequence
tgcaggtcagctcctgctgc

SEQ ID NO: 515087 - DNA, 20 bp, Artificial
  CRISPR gRNA sequence
ggtcagctcctgctgcaggt

SEQ ID NO: 515088 - DNA, 20 bp, Artificial
  CRISPR gRNA sequence
cagctcctgctgcaggtcag

SEQ ID NO: 515089 - DNA, 20 bp, Artificial
  CRISPR gRNA sequence
agctcctgctgcaggtcagc

SEQ ID NO: 515090 - DNA, 20 bp, Artificial
  CRISPR gRNA sequence
ctcctgctgcaggtcagcag

SEQ ID NO: 515091 - DNA, 20 bp, Artificial
  CRISPR gRNA sequence
tcctgctgcaggtcagcagg

SEQ ID NO: 515092 - DNA, 20 bp, Artificial
  CRISPR gRNA sequence
cctgctgcaggtcagcagga

SEQ ID NO: 515093 - DNA, 20 bp, Artificial
  CRISPR gRNA sequence
gctgcaggtcagcaggaggg

SEQ ID NO: 515094 - DNA, 20 bp, Artificial
  CRISPR gRNA sequence
aggtcagcaggagggtggtc

SEQ ID NO: 515095 - DNA, 20 bp, Artificial
  CRISPR gRNA sequence
ggtcagcaggagggtggtct

SEQ ID NO: 515096 - DNA, 20 bp, Artificial
  CRISPR gRNA sequence
tcagcaggagggtggtctgg

SEQ ID NO: 515097 - DNA, 20 bp, Artificial
  CRISPR gRNA sequence
cagcaggagggtggtctggg

SEQ ID NO: 515098 - DNA, 20 bp, Artificial
  CRISPR gRNA sequence
aggagggtggtctgggagga

SEQ ID NO: 515099 - DNA, 20 bp, Artificial
  CRISPR gRNA sequence
ggaggaaagcccctgccccg

SEQ ID NO: 515100 - DNA, 20 bp, Artificial
  CRISPR gRNA sequence
gaggaaagcccctgccccgt

SEQ ID NO: 515101 - DNA, 20 bp, Artificial
  CRISPR gRNA sequence
aaagcccctgccccgtgggc

SEQ ID NO: 515102 - DNA, 20 bp, Artificial
  CRISPR gRNA sequence
cctgccccgtgggccagctg

SEQ ID NO: 515103 - DNA, 20 bp, Artificial
  CRISPR gRNA sequence
gcagcctcccgacctgccct

SEQ ID NO: 515104 - DNA, 20 bp, Artificial
  CRISPR gRNA sequence
cagcctcccgacctgccctc

SEQ ID NO: 515105 - DNA, 20 bp, Artificial
  CRISPR gRNA sequence
ccgacctgccctcaggcctc

SEQ ID NO: 515106 - DNA, 20 bp, Artificial
  CRISPR gRNA sequence
cgacctgccctcaggcctcc

SEQ ID NO: 515107 - DNA, 20 bp, Artificial
  CRISPR gRNA sequence
ctcaggcctccaggacaccc

SEQ ID NO: 515108 - DNA, 20 bp, Artificial
  CRISPR gRNA sequence
gcctccaggacaccctggcc

SEQ ID NO: 515109 - DNA, 20 bp, Artificial
  CRISPR gRNA sequence
accctggcccggcacttcca

SEQ ID NO: 515110 - DNA, 20 bp, Artificial
  CRISPR gRNA sequence
ccctggcccggcacttccac

SEQ ID NO: 515111 - DNA, 20 bp, Artificial
  CRISPR gRNA sequence
cctggcccggcacttccacg

SEQ ID NO: 515112 - DNA, 20 bp, Artificial
  CRISPR gRNA sequence
tggcccggcacttccacggg

SEQ ID NO: 515113 - DNA, 20 bp, Artificial
  CRISPR gRNA sequence
ggcacttccacggggagctc

SEQ ID NO: 515114 - DNA, 20 bp, Artificial
  CRISPR gRNA sequence
gcacttccacggggagctct

SEQ ID NO: 515115 - DNA, 20 bp, Artificial
  CRISPR gRNA sequence
gtcctctctcgttgatgttg

SEQ ID NO: 515116 - DNA, 20 bp, Artificial
  CRISPR gRNA sequence
tcctctctcgttgatgttgt

SEQ ID NO: 515117 - DNA, 20 bp, Artificial
  CRISPR gRNA sequence
ggcgatgctccctgaaacct

SEQ ID NO: 515118 - DNA, 20 bp, Artificial
  CRISPR gRNA sequence
gctccctgaaacctgagctc

SEQ ID NO: 515119 - DNA, 20 bp, Artificial
  CRISPR gRNA sequence
gagctccggactcttcattc

SEQ ID NO: 515120 - DNA, 20 bp, Artificial
  CRISPR gRNA sequence
tcattccagactcttctctg

SEQ ID NO: 515121 - DNA, 20 bp, Artificial
  CRISPR gRNA sequence
cattccagactcttctctgc

SEQ ID NO: 515122 - DNA, 20 bp, Artificial
  CRISPR gRNA sequence
ctcttctctgcgggtctcta

SEQ ID NO: 515123 - DNA, 20 bp, Artificial
  CRISPR gRNA sequence
cttctctgcgggtctctatg

SEQ ID NO: 515124 - DNA, 20 bp, Artificial
  CRISPR gRNA sequence
ctctgcgggtctctatggag

SEQ ID NO: 515125 - DNA, 20 bp, Artificial
  CRISPR gRNA sequence
tctgcgggtctctatggaga

SEQ ID NO: 515126 - DNA, 20 bp, Artificial
  CRISPR gRNA sequence
ctgcgggtctctatggagaa

SEQ ID NO: 515127 - DNA, 20 bp, Artificial
  CRISPR gRNA sequence
gcgggtctctatggagaagg

SEQ ID NO: 515128 - DNA, 20 bp, Artificial
  CRISPR gRNA sequence
cgggtctctatggagaaggg

SEQ ID NO: 515129 - DNA, 20 bp, Artificial
  CRISPR gRNA sequence
gtctctatggagaagggagg

SEQ ID NO: 515130 - DNA, 20 bp, Artificial
  CRISPR gRNA sequence
ctatggagaagggaggtgga

SEQ ID NO: 515131 - DNA, 20 bp, Artificial
  CRISPR gRNA sequence
agaagggaggtggacagctc

SEQ ID NO: 515132 - DNA, 20 bp, Artificial
  CRISPR gRNA sequence
agggaggtggacagctctgg

SEQ ID NO: 515133 - DNA, 20 bp, Artificial
  CRISPR gRNA sequence
tggacagctctggtggcaaa

SEQ ID NO: 515134 - DNA, 20 bp, Artificial
  CRISPR gRNA sequence
agctctggtggcaaacagtg

SEQ ID NO: 515135 - DNA, 20 bp, Artificial
  CRISPR gRNA sequence
ctggtggcaaacagtgcagc

SEQ ID NO: 515136 - DNA, 20 bp, Artificial
  CRISPR gRNA sequence
tggtggcaaacagtgcagct

SEQ ID NO: 515137 - DNA, 20 bp, Artificial
  CRISPR gRNA sequence
ggtggcaaacagtgcagctg

SEQ ID NO: 515138 - DNA, 20 bp, Artificial
  CRISPR gRNA sequence
ggcaaacagtgcagctgggg

SEQ ID NO: 515139 - DNA, 20 bp, Artificial
  CRISPR gRNA sequence
gcaaacagtgcagctggggc

SEQ ID NO: 515140 - DNA, 20 bp, Artificial
  CRISPR gRNA sequence
aaacagtgcagctggggcag

SEQ ID NO: 515141 - DNA, 20 bp, Artificial
  CRISPR gRNA sequence
aacagtgcagctggggcagg

SEQ ID NO: 515142 - DNA, 20 bp, Artificial
  CRISPR gRNA sequence
cagtgcagctggggcaggag

SEQ ID NO: 515143 - DNA, 20 bp, Artificial
  CRISPR gRNA sequence
agtgcagctggggcaggagg

SEQ ID NO: 515144 - DNA, 20 bp, Artificial
  CRISPR gRNA sequence
gctggggcaggaggaggcca

SEQ ID NO: 515145 - DNA, 20 bp, Artificial
  CRISPR gRNA sequence
ctggggcaggaggaggccac

SEQ ID NO: 515146 - DNA, 20 bp, Artificial
  CRISPR gRNA sequence
gaggccacaggaaaccccca

SEQ ID NO: 515147 - DNA, 20 bp, Artificial
  CRISPR gRNA sequence
gccacaggaaacccccacag

SEQ ID NO: 515148 - DNA, 20 bp, Artificial
  CRISPR gRNA sequence
ggaaacccccacagtggact

SEQ ID NO: 515149 - DNA, 20 bp, Artificial
  CRISPR gRNA sequence
gaaacccccacagtggactt

SEQ ID NO: 515150 - DNA, 20 bp, Artificial
  CRISPR gRNA sequence
cccacagtggacttgggccc

SEQ ID NO: 515151 - DNA, 20 bp, Artificial
  CRISPR gRNA sequence
ccacagtggacttgggccct

SEQ ID NO: 515152 - DNA, 20 bp, Artificial
  CRISPR gRNA sequence
cagtggacttgggccctggg

SEQ ID NO: 515153 - DNA, 20 bp, Artificial
  CRISPR gRNA sequence
tgggccctgggaagacaccc

SEQ ID NO: 515154 - DNA, 20 bp, Artificial
  CRISPR gRNA sequence
gggccctgggaagacaccct

SEQ ID NO: 515155 - DNA, 20 bp, Artificial
  CRISPR gRNA sequence
ggccctgggaagacaccctg

SEQ ID NO: 515156 - DNA, 20 bp, Artificial
  CRISPR gRNA sequence
gccctgggaagacaccctgg

SEQ ID NO: 515157 - DNA, 20 bp, Artificial
  CRISPR gRNA sequence
ccctgggaagacaccctggg

SEQ ID NO: 515158 - DNA, 20 bp, Artificial
  CRISPR gRNA sequence
tgggaagacaccctgggggg

SEQ ID NO: 515159 - DNA, 20 bp, Artificial
  CRISPR gRNA sequence
cttgctctgttcacctgtcc

SEQ ID NO: 515160 - DNA, 20 bp, Artificial
  CRISPR gRNA sequence
ttgctctgttcacctgtcct

SEQ ID NO: 515161 - DNA, 20 bp, Artificial
  CRISPR gRNA sequence
tctgttcacctgtcctgggc

SEQ ID NO: 515162 - DNA, 20 bp, Artificial
  CRISPR gRNA sequence
cacctgtcctgggcaagctc

SEQ ID NO: 515163 - DNA, 20 bp, Artificial
  CRISPR gRNA sequence
cctgtcctgggcaagctcca

SEQ ID NO: 515164 - DNA, 20 bp, Artificial
  CRISPR gRNA sequence
gtcctgggcaagctccagag

SEQ ID NO: 515165 - DNA, 20 bp, Artificial
  CRISPR gRNA sequence
ttaacccctgaatttctccc

SEQ ID NO: 515166 - DNA, 20 bp, Artificial
  CRISPR gRNA sequence
ctgaatttctccctggtgca

SEQ ID NO: 515167 - DNA, 20 bp, Artificial
  CRISPR gRNA sequence
tccctggtgcacggcccatc

SEQ ID NO: 515168 - DNA, 20 bp, Artificial
  CRISPR gRNA sequence
cggcccatcgagctgcaccc

SEQ ID NO: 515169 - DNA, 20 bp, Artificial
  CRISPR gRNA sequence
ggcccatcgagctgcaccct

SEQ ID NO: 515170 - DNA, 20 bp, Artificial
  CRISPR gRNA sequence
tgcaccctgggctgctcccc

SEQ ID NO: 515171 - DNA, 20 bp, Artificial
  CRISPR gRNA sequence
gcaccctgggctgctcccct

SEQ ID NO: 515172 - DNA, 20 bp, Artificial
  CRISPR gRNA sequence
caccctgggctgctcccctg

SEQ ID NO: 515173 - DNA, 20 bp, Artificial
  CRISPR gRNA sequence
ccctgggctgctcccctggg

SEQ ID NO: 515174 - DNA, 20 bp, Artificial
  CRISPR gRNA sequence
ctgctcccctggggagccca

SEQ ID NO: 515175 - DNA, 20 bp, Artificial
  CRISPR gRNA sequence
ccctggggagcccatggccc

SEQ ID NO: 515176 - DNA, 20 bp, Artificial
  CRISPR gRNA sequence
tggggagcccatggccctgg

SEQ ID NO: 515177 - DNA, 20 bp, Artificial
  CRISPR gRNA sequence
ggggagcccatggccctggt

SEQ ID NO: 515178 - DNA, 20 bp, Artificial
  CRISPR gRNA sequence
gcccatggccctggtgggca

SEQ ID NO: 515179 - DNA, 20 bp, Artificial
  CRISPR gRNA sequence
cccatggccctggtgggcat

SEQ ID NO: 515180 - DNA, 20 bp, Artificial
  CRISPR gRNA sequence
atggccctggtgggcatagg

SEQ ID NO: 515181 - DNA, 20 bp, Artificial
  CRISPR gRNA sequence
tggccctggtgggcataggt

SEQ ID NO: 515182 - DNA, 20 bp, Artificial
  CRISPR gRNA sequence
ctggtgggcataggtaggca

SEQ ID NO: 515183 - DNA, 20 bp, Artificial
  CRISPR gRNA sequence
tggtgggcataggtaggcat

SEQ ID NO: 515184 - DNA, 20 bp, Artificial
  CRISPR gRNA sequence
aggtaggcataggtgcgcac

SEQ ID NO: 515185 - DNA, 20 bp, Artificial
  CRISPR gRNA sequence
ggtaggcataggtgcgcact

SEQ ID NO: 515186 - DNA, 20 bp, Artificial
  CRISPR gRNA sequence
ggtgcgcactaggtgccatt

SEQ ID NO: 515187 - DNA, 20 bp, Artificial
  CRISPR gRNA sequence
gtgcgcactaggtgccattc

SEQ ID NO: 515188 - DNA, 20 bp, Artificial
  CRISPR gRNA sequence
tgcgcactaggtgccattca

SEQ ID NO: 515189 - DNA, 20 bp, Artificial
  CRISPR gRNA sequence
ctaggtgccattcagggccc

SEQ ID NO: 515190 - DNA, 20 bp, Artificial
  CRISPR gRNA sequence
taggtgccattcagggcccc

SEQ ID NO: 515191 - DNA, 20 bp, Artificial
  CRISPR gRNA sequence
ccattcagggccccaggcac

SEQ ID NO: 515192 - DNA, 20 bp, Artificial
  CRISPR gRNA sequence
attcagggccccaggcacca

SEQ ID NO: 515193 - DNA, 20 bp, Artificial
  CRISPR gRNA sequence
ttcagggccccaggcaccag

SEQ ID NO: 515194 - DNA, 20 bp, Artificial
  CRISPR gRNA sequence
accagaggtcccgactgctc

SEQ ID NO: 515195 - DNA, 20 bp, Artificial
  CRISPR gRNA sequence
ctgctctggaaatctacccc

SEQ ID NO: 515196 - DNA, 20 bp, Artificial
  CRISPR gRNA sequence
tgctctggaaatctaccccc

SEQ ID NO: 515197 - DNA, 20 bp, Artificial
  CRISPR gRNA sequence
ctggaaatctacccccaggt

SEQ ID NO: 515198 - DNA, 20 bp, Artificial
  CRISPR gRNA sequence
ggaaatctacccccaggtga

SEQ ID NO: 515199 - DNA, 20 bp, Artificial
  CRISPR gRNA sequence
ccccaggtgagagatgttct

SEQ ID NO: 515200 - DNA, 20 bp, Artificial
  CRISPR gRNA sequence
gagagatgttctcagaattc

SEQ ID NO: 515201 - DNA, 20 bp, Artificial
  CRISPR gRNA sequence
atgttctcagaattctggcc

SEQ ID NO: 515202 - DNA, 20 bp, Artificial
  CRISPR gRNA sequence
aattctggcctggatccttc

SEQ ID NO: 515203 - DNA, 20 bp, Artificial
  CRISPR gRNA sequence
attctggcctggatccttct

SEQ ID NO: 515204 - DNA, 20 bp, Artificial
  CRISPR gRNA sequence
gcctggatccttctaggcca

SEQ ID NO: 515205 - DNA, 20 bp, Artificial
  CRISPR gRNA sequence
cctggatccttctaggccaa

SEQ ID NO: 515206 - DNA, 20 bp, Artificial
  CRISPR gRNA sequence
ttctaggccaaaggtcctgc

SEQ ID NO: 515207 - DNA, 20 bp, Artificial
  CRISPR gRNA sequence
gccaaaggtcctgctggctt

SEQ ID NO: 515208 - DNA, 20 bp, Artificial
  CRISPR gRNA sequence
ccaaaggtcctgctggcttg

SEQ ID NO: 515209 - DNA, 20 bp, Artificial
  CRISPR gRNA sequence
caaaggtcctgctggcttga

SEQ ID NO: 515210 - DNA, 20 bp, Artificial
  CRISPR gRNA sequence
aaggtcctgctggcttgagg

SEQ ID NO: 515211 - DNA, 20 bp, Artificial
  CRISPR gRNA sequence
cctgctggcttgagggagct

SEQ ID NO: 515212 - DNA, 20 bp, Artificial
  CRISPR gRNA sequence
cttgagggagctcagcacgt

SEQ ID NO: 515213 - DNA, 20 bp, Artificial
  CRISPR gRNA sequence
ttagcgcctccgacaaacgt

SEQ ID NO: 515214 - DNA, 20 bp, Artificial
  CRISPR gRNA sequence
tagcgcctccgacaaacgtt

SEQ ID NO: 515215 - DNA, 20 bp, Artificial
  CRISPR gRNA sequence
tgggtcattgaattaaactg

SEQ ID NO: 515216 - DNA, 20 bp, Artificial
  CRISPR gRNA sequence
gggtcattgaattaaactga

SEQ ID NO: 515217 - DNA, 20 bp, Artificial
  CRISPR gRNA sequence
tgaattaaactgaaggcccg

SEQ ID NO: 515218 - DNA, 20 bp, Artificial
  CRISPR gRNA sequence
aattaaactgaaggcccgtg

SEQ ID NO: 515219 - DNA, 20 bp, Artificial
  CRISPR gRNA sequence
attaaactgaaggcccgtgg

SEQ ID NO: 515220 - DNA, 20 bp, Artificial
  CRISPR gRNA sequence
taaactgaaggcccgtggag

SEQ ID NO: 515221 - DNA, 20 bp, Artificial
  CRISPR gRNA sequence
aaactgaaggcccgtggagg

SEQ ID NO: 515222 - DNA, 20 bp, Artificial
  CRISPR gRNA sequence
gaggtgccatttgcttctcg

SEQ ID NO: 515223 - DNA, 20 bp, Artificial
  CRISPR gRNA sequence
tgcttctcgtagcctcccgt

SEQ ID NO: 515224 - DNA, 20 bp, Artificial
  CRISPR gRNA sequence
tcccgtgagccccaaacccc

SEQ ID NO: 515225 - DNA, 20 bp, Artificial
  CRISPR gRNA sequence
ccgtgagccccaaaccccca

SEQ ID NO: 515226 - DNA, 20 bp, Artificial
  CRISPR gRNA sequence
tgagccccaaacccccagag

SEQ ID NO: 515227 - DNA, 20 bp, Artificial
  CRISPR gRNA sequence
acccccagagcagaccctcc

SEQ ID NO: 515228 - DNA, 20 bp, Artificial
  CRISPR gRNA sequence
cccccagagcagaccctcct

SEQ ID NO: 515229 - DNA, 20 bp, Artificial
  CRISPR gRNA sequence
gagcagaccctcctgggtgc

SEQ ID NO: 515230 - DNA, 20 bp, Artificial
  CRISPR gRNA sequence
ctgggtgccagccactgccc

SEQ ID NO: 515231 - DNA, 20 bp, Artificial
  CRISPR gRNA sequence
tgggtgccagccactgcccg

SEQ ID NO: 515232 - DNA, 20 bp, Artificial
  CRISPR gRNA sequence
gaggtgtttctgtccttaca

SEQ ID NO: 515233 - DNA, 20 bp, Artificial
  CRISPR gRNA sequence
ggtgtttctgtccttacaca

SEQ ID NO: 515234 - DNA, 20 bp, Artificial
  CRISPR gRNA sequence
gtgtttctgtccttacacag

SEQ ID NO: 515235 - DNA, 20 bp, Artificial
  CRISPR gRNA sequence
ctgtccttacacagaggatg

SEQ ID NO: 515236 - DNA, 20 bp, Artificial
  CRISPR gRNA sequence
tgtccttacacagaggatgc

SEQ ID NO: 515237 - DNA, 20 bp, Artificial
  CRISPR gRNA sequence
tgcaggtgacgccactgccc

SEQ ID NO: 515238 - DNA, 20 bp, Artificial
  CRISPR gRNA sequence
ctcaatttccgtctgtctct

SEQ ID NO: 515239 - DNA, 20 bp, Artificial
  CRISPR gRNA sequence
tctctccatctctctgtctc

SEQ ID NO: 515240 - DNA, 20 bp, Artificial
  CRISPR gRNA sequence
catctctctgtctctggctc

SEQ ID NO: 515241 - DNA, 20 bp, Artificial
  CRISPR gRNA sequence
tatcgcttgaacaatttatg

SEQ ID NO: 515242 - DNA, 20 bp, Artificial
  CRISPR gRNA sequence
atgcagctcctgccctgtgc

SEQ ID NO: 515243 - DNA, 20 bp, Artificial
  CRISPR gRNA sequence
tgcagctcctgccctgtgct

SEQ ID NO: 515244 - DNA, 20 bp, Artificial
  CRISPR gRNA sequence
tcctgccctgtgctaggtcc

SEQ ID NO: 515245 - DNA, 20 bp, Artificial
  CRISPR gRNA sequence
cctgccctgtgctaggtcct

SEQ ID NO: 515246 - DNA, 20 bp, Artificial
  CRISPR gRNA sequence
ctgccctgtgctaggtcctg

SEQ ID NO: 515247 - DNA, 20 bp, Artificial
  CRISPR gRNA sequence
gtgctaggtcctggggactc

SEQ ID NO: 515248 - DNA, 20 bp, Artificial
  CRISPR gRNA sequence
tgctaggtcctggggactca

SEQ ID NO: 515249 - DNA, 20 bp, Artificial
  CRISPR gRNA sequence
ggtcctggggactcaaggct

SEQ ID NO: 515250 - DNA, 20 bp, Artificial
  CRISPR gRNA sequence
gtcctggggactcaaggctg

SEQ ID NO: 515251 - DNA, 20 bp, Artificial
  CRISPR gRNA sequence
cctggggactcaaggctgag

SEQ ID NO: 515252 - DNA, 20 bp, Artificial
  CRISPR gRNA sequence
ggggactcaaggctgaggag

SEQ ID NO: 515253 - DNA, 20 bp, Artificial
  CRISPR gRNA sequence
gactcaaggctgaggagcag

SEQ ID NO: 515254 - DNA, 20 bp, Artificial
  CRISPR gRNA sequence
tcaaggctgaggagcagcag

SEQ ID NO: 515255 - DNA, 20 bp, Artificial
  CRISPR gRNA sequence
cagcagaagctcccacccct

SEQ ID NO: 515256 - DNA, 20 bp, Artificial
  CRISPR gRNA sequence
agcagaagctcccacccctg

SEQ ID NO: 515257 - DNA, 20 bp, Artificial
  CRISPR gRNA sequence
cacccctgaggctcacaccc

SEQ ID NO: 515258 - DNA, 20 bp, Artificial
  CRISPR gRNA sequence
ctcacaccctggctccatgc

SEQ ID NO: 515259 - DNA, 20 bp, Artificial
  CRISPR gRNA sequence
tggctccatgctagtccctg

SEQ ID NO: 515260 - DNA, 20 bp, Artificial
  CRISPR gRNA sequence
tccatgctagtccctgtggt

SEQ ID NO: 515261 - DNA, 20 bp, Artificial
  CRISPR gRNA sequence
ccatgctagtccctgtggtc

SEQ ID NO: 515262 - DNA, 20 bp, Artificial
  CRISPR gRNA sequence
ccctgtggtcaggctgtctc

SEQ ID NO: 515263 - DNA, 20 bp, Artificial
  CRISPR gRNA sequence
cctgtggtcaggctgtctcg

SEQ ID NO: 515264 - DNA, 20 bp, Artificial
  CRISPR gRNA sequence
ctgtggtcaggctgtctcga

SEQ ID NO: 515265 - DNA, 20 bp, Artificial
  CRISPR gRNA sequence
tggtcaggctgtctcgaggg

SEQ ID NO: 515266 - DNA, 20 bp, Artificial
  CRISPR gRNA sequence
ggtcaggctgtctcgagggc

SEQ ID NO: 515267 - DNA, 20 bp, Artificial
  CRISPR gRNA sequence
ctgtctcgagggcaggactg

SEQ ID NO: 515268 - DNA, 20 bp, Artificial
  CRISPR gRNA sequence
cgagggcaggactgtggccc

SEQ ID NO: 515269 - DNA, 20 bp, Artificial
  CRISPR gRNA sequence
gggcaggactgtggccctgg

SEQ ID NO: 515270 - DNA, 20 bp, Artificial
  CRISPR gRNA sequence
cctggcagccctgccatcct

SEQ ID NO: 515271 - DNA, 20 bp, Artificial
  CRISPR gRNA sequence
tgtgctctcctctgtgtcat

SEQ ID NO: 515272 - DNA, 20 bp, Artificial
  CRISPR gRNA sequence
tctgtgtcattagctgacac

SEQ ID NO: 515273 - DNA, 20 bp, Artificial
  CRISPR gRNA sequence
ctgtgtcattagctgacact

SEQ ID NO: 515274 - DNA, 20 bp, Artificial
  CRISPR gRNA sequence
tgtgtcattagctgacactg

SEQ ID NO: 515275 - DNA, 20 bp, Artificial
  CRISPR gRNA sequence
tgacactggggacttgcact

SEQ ID NO: 515276 - DNA, 20 bp, Artificial
  CRISPR gRNA sequence
acactggggacttgcactga

SEQ ID NO: 515277 - DNA, 20 bp, Artificial
  CRISPR gRNA sequence
cactggggacttgcactgag

SEQ ID NO: 515278 - DNA, 20 bp, Artificial
  CRISPR gRNA sequence
ctggggacttgcactgagag

SEQ ID NO: 515279 - DNA, 20 bp, Artificial
  CRISPR gRNA sequence
gggacttgcactgagaggag

SEQ ID NO: 515280 - DNA, 20 bp, Artificial
  CRISPR gRNA sequence
acttgcactgagaggagaag

SEQ ID NO: 515281 - DNA, 20 bp, Artificial
  CRISPR gRNA sequence
ttgcactgagaggagaagtg

SEQ ID NO: 515282 - DNA, 20 bp, Artificial
  CRISPR gRNA sequence
actgagaggagaagtggaga

SEQ ID NO: 515283 - DNA, 20 bp, Artificial
  CRISPR gRNA sequence
ctgagaggagaagtggagac

SEQ ID NO: 515284 - DNA, 20 bp, Artificial
  CRISPR gRNA sequence
tggagacgggtctaaaccgc

SEQ ID NO: 515285 - DNA, 20 bp, Artificial
  CRISPR gRNA sequence
ggagacgggtctaaaccgct

SEQ ID NO: 515286 - DNA, 20 bp, Artificial
  CRISPR gRNA sequence
acgggtctaaaccgctgggc

SEQ ID NO: 515287 - DNA, 20 bp, Artificial
  CRISPR gRNA sequence
cgggtctaaaccgctgggcc

SEQ ID NO: 515288 - DNA, 20 bp, Artificial
  CRISPR gRNA sequence
gtctaaaccgctgggccagg

SEQ ID NO: 515289 - DNA, 20 bp, Artificial
  CRISPR gRNA sequence
tctaaaccgctgggccaggc

SEQ ID NO: 515290 - DNA, 20 bp, Artificial
  CRISPR gRNA sequence
ctaaaccgctgggccaggca

SEQ ID NO: 515291 - DNA, 20 bp, Artificial
  CRISPR gRNA sequence
accgctgggccaggcagggc

SEQ ID NO: 515292 - DNA, 20 bp, Artificial
  CRISPR gRNA sequence
ccgctgggccaggcagggcc

SEQ ID NO: 515293 - DNA, 20 bp, Artificial
  CRISPR gRNA sequence
gccaggcagggccaggacaa

SEQ ID NO: 515294 - DNA, 20 bp, Artificial
  CRISPR gRNA sequence
caacagaaacactcgccccc

SEQ ID NO: 515295 - DNA, 20 bp, Artificial
  CRISPR gRNA sequence
acagaaacactcgcccccaa

SEQ ID NO: 515296 - DNA, 20 bp, Artificial
  CRISPR gRNA sequence
gagtaaccgctctctgcccg

SEQ ID NO: 515297 - DNA, 20 bp, Artificial
  CRISPR gRNA sequence
tgcccgcagaaactctcctc

SEQ ID NO: 515298 - DNA, 20 bp, Artificial
  CRISPR gRNA sequence
gcccgcagaaactctcctcc

SEQ ID NO: 515299 - DNA, 20 bp, Artificial
  CRISPR gRNA sequence
cccgcagaaactctcctcca

SEQ ID NO: 515300 - DNA, 20 bp, Artificial
  CRISPR gRNA sequence
actctcctccagggtcttcc

SEQ ID NO: 515301 - DNA, 20 bp, Artificial
  CRISPR gRNA sequence
cgccctccccgacaccctga

SEQ ID NO: 515302 - DNA, 20 bp, Artificial
  CRISPR gRNA sequence
gtcacctacgactccttctg

SEQ ID NO: 515303 - DNA, 20 bp, Artificial
  CRISPR gRNA sequence
tacgactccttctgcagcaa

SEQ ID NO: 515304 - DNA, 20 bp, Artificial
  CRISPR gRNA sequence
cgactccttctgcagcaatg

SEQ ID NO: 515305 - DNA, 20 bp, Artificial
  CRISPR gRNA sequence
tgcagcaatggagtgacgca

SEQ ID NO: 515306 - DNA, 20 bp, Artificial
  CRISPR gRNA sequence
gcagcaatggagtgacgcac

SEQ ID NO: 515307 - DNA, 20 bp, Artificial
  CRISPR gRNA sequence
atggagtgacgcacaggaac

SEQ ID NO: 515308 - DNA, 20 bp, Artificial
  CRISPR gRNA sequence
gtgacgcacaggaaccagcc

SEQ ID NO: 515309 - DNA, 20 bp, Artificial
  CRISPR gRNA sequence
gacgcacaggaaccagccca

SEQ ID NO: 515310 - DNA, 20 bp, Artificial
  CRISPR gRNA sequence
acgcacaggaaccagcccag

SEQ ID NO: 515311 - DNA, 20 bp, Artificial
  CRISPR gRNA sequence
cagcccagaggtgactgtga

SEQ ID NO: 515312 - DNA, 20 bp, Artificial
  CRISPR gRNA sequence
gaggtgactgtgatggcgtg

SEQ ID NO: 515313 - DNA, 20 bp, Artificial
  CRISPR gRNA sequence
tggcgtgcagatcaatgtcc

SEQ ID NO: 515314 - DNA, 20 bp, Artificial
  CRISPR gRNA sequence
gtgcagatcaatgtcccggt

SEQ ID NO: 515315 - DNA, 20 bp, Artificial
  CRISPR gRNA sequence
gatcaatgtcccggtgagcc

SEQ ID NO: 515316 - DNA, 20 bp, Artificial
  CRISPR gRNA sequence
gtcccggtgagcctggccac

SEQ ID NO: 515317 - DNA, 20 bp, Artificial
  CRISPR gRNA sequence
tcccggtgagcctggccaca

SEQ ID NO: 515318 - DNA, 20 bp, Artificial
  CRISPR gRNA sequence
cccggtgagcctggccacaa

SEQ ID NO: 515319 - DNA, 20 bp, Artificial
  CRISPR gRNA sequence
ggccacaagggtccccatcc

SEQ ID NO: 515320 - DNA, 20 bp, Artificial
  CRISPR gRNA sequence
ggtccccatcccagcttgct

SEQ ID NO: 515321 - DNA, 20 bp, Artificial
  CRISPR gRNA sequence
gtccccatcccagcttgctg

SEQ ID NO: 515322 - DNA, 20 bp, Artificial
  CRISPR gRNA sequence
tccccatcccagcttgctga

SEQ ID NO: 515323 - DNA, 20 bp, Artificial
  CRISPR gRNA sequence
ccccatcccagcttgctgag

SEQ ID NO: 515324 - DNA, 20 bp, Artificial
  CRISPR gRNA sequence
cccagcttgctgaggggctc

SEQ ID NO: 515325 - DNA, 20 bp, Artificial
  CRISPR gRNA sequence
ccagcttgctgaggggctct

SEQ ID NO: 515326 - DNA, 20 bp, Artificial
  CRISPR gRNA sequence
cagcttgctgaggggctctg

SEQ ID NO: 515327 - DNA, 20 bp, Artificial
  CRISPR gRNA sequence
ttgctgaggggctctgggga

SEQ ID NO: 515328 - DNA, 20 bp, Artificial
  CRISPR gRNA sequence
tgaggggctctggggacagc

SEQ ID NO: 515329 - DNA, 20 bp, Artificial
  CRISPR gRNA sequence
ggggctctggggacagccag

SEQ ID NO: 515330 - DNA, 20 bp, Artificial
  CRISPR gRNA sequence
gggctctggggacagccaga

SEQ ID NO: 515331 - DNA, 20 bp, Artificial
  CRISPR gRNA sequence
gctctggggacagccagaag

SEQ ID NO: 515332 - DNA, 20 bp, Artificial
  CRISPR gRNA sequence
tggggacagccagaaggagc

SEQ ID NO: 515333 - DNA, 20 bp, Artificial
  CRISPR gRNA sequence
ggggacagccagaaggagcc

SEQ ID NO: 515334 - DNA, 20 bp, Artificial
  CRISPR gRNA sequence
gggacagccagaaggagcca

SEQ ID NO: 515335 - DNA, 20 bp, Artificial
  CRISPR gRNA sequence
aggagccagggtccccatcc

SEQ ID NO: 515336 - DNA, 20 bp, Artificial
  CRISPR gRNA sequence
ggtccccatcccagcacact

SEQ ID NO: 515337 - DNA, 20 bp, Artificial
  CRISPR gRNA sequence
gtccccatcccagcacactg

SEQ ID NO: 515338 - DNA, 20 bp, Artificial
  CRISPR gRNA sequence
tccccatcccagcacactga

SEQ ID NO: 515339 - DNA, 20 bp, Artificial
  CRISPR gRNA sequence
ccccatcccagcacactgag

SEQ ID NO: 515340 - DNA, 20 bp, Artificial
  CRISPR gRNA sequence
cccagcacactgaggggtcc

SEQ ID NO: 515341 - DNA, 20 bp, Artificial
  CRISPR gRNA sequence
ccagcacactgaggggtcct

SEQ ID NO: 515342 - DNA, 20 bp, Artificial
  CRISPR gRNA sequence
cagcacactgaggggtcctg

SEQ ID NO: 515343 - DNA, 20 bp, Artificial
  CRISPR gRNA sequence
acactgaggggtcctgggga

SEQ ID NO: 515344 - DNA, 20 bp, Artificial
  CRISPR gRNA sequence
tgaggggtcctggggacagc

SEQ ID NO: 515345 - DNA, 20 bp, Artificial
  CRISPR gRNA sequence
ggggtcctggggacagccag

SEQ ID NO: 515346 - DNA, 20 bp, Artificial
  CRISPR gRNA sequence
gggtcctggggacagccaga

SEQ ID NO: 515347 - DNA, 20 bp, Artificial
  CRISPR gRNA sequence
gtcctggggacagccagaag

SEQ ID NO: 515348 - DNA, 20 bp, Artificial
  CRISPR gRNA sequence
tggggacagccagaaggagc

SEQ ID NO: 515349 - DNA, 20 bp, Artificial
  CRISPR gRNA sequence
ggggacagccagaaggagcc

SEQ ID NO: 515350 - DNA, 20 bp, Artificial
  CRISPR gRNA sequence
gggacagccagaaggagcca

SEQ ID NO: 515351 - DNA, 20 bp, Artificial
  CRISPR gRNA sequence
aggagccagggtccccatcc

SEQ ID NO: 515352 - DNA, 20 bp, Artificial
  CRISPR gRNA sequence
tccccatcccagcactctga

SEQ ID NO: 515353 - DNA, 20 bp, Artificial
  CRISPR gRNA sequence
ccccatcccagcactctgac

SEQ ID NO: 515354 - DNA, 20 bp, Artificial
  CRISPR gRNA sequence
cccatcccagcactctgacg

SEQ ID NO: 515355 - DNA, 20 bp, Artificial
  CRISPR gRNA sequence
ccatcccagcactctgacgg

SEQ ID NO: 515356 - DNA, 20 bp, Artificial
  CRISPR gRNA sequence
tcccagcactctgacggggg

SEQ ID NO: 515357 - DNA, 20 bp, Artificial
  CRISPR gRNA sequence
cccagcactctgacgggggc

SEQ ID NO: 515358 - DNA, 20 bp, Artificial
  CRISPR gRNA sequence
ccagcactctgacgggggca

SEQ ID NO: 515359 - DNA, 20 bp, Artificial
  CRISPR gRNA sequence
agcactctgacgggggcagg

SEQ ID NO: 515360 - DNA, 20 bp, Artificial
  CRISPR gRNA sequence
gcactctgacgggggcaggg

SEQ ID NO: 515361 - DNA, 20 bp, Artificial
  CRISPR gRNA sequence
cactctgacgggggcaggga

SEQ ID NO: 515362 - DNA, 20 bp, Artificial
  CRISPR gRNA sequence
actctgacgggggcagggag

SEQ ID NO: 515363 - DNA, 20 bp, Artificial
  CRISPR gRNA sequence
cgggggcagggaggggcaca

SEQ ID NO: 515364 - DNA, 20 bp, Artificial
  CRISPR gRNA sequence
gggggcagggaggggcacac

SEQ ID NO: 515365 - DNA, 20 bp, Artificial
  CRISPR gRNA sequence
agggaggggcacacaggcat

SEQ ID NO: 515366 - DNA, 20 bp, Artificial
  CRISPR gRNA sequence
ggaggggcacacaggcatca

SEQ ID NO: 515367 - DNA, 20 bp, Artificial
  CRISPR gRNA sequence
gaggggcacacaggcatcag

SEQ ID NO: 515368 - DNA, 20 bp, Artificial
  CRISPR gRNA sequence
cacaggcatcagaggctgtc

SEQ ID NO: 515369 - DNA, 20 bp, Artificial
  CRISPR gRNA sequence
acaggcatcagaggctgtct

SEQ ID NO: 515370 - DNA, 20 bp, Artificial
  CRISPR gRNA sequence
aggcatcagaggctgtctgg

SEQ ID NO: 515371 - DNA, 20 bp, Artificial
  CRISPR gRNA sequence
catcagaggctgtctgggag

SEQ ID NO: 515372 - DNA, 20 bp, Artificial
  CRISPR gRNA sequence
atcagaggctgtctgggagc

SEQ ID NO: 515373 - DNA, 20 bp, Artificial
  CRISPR gRNA sequence
agaggctgtctgggagcagg

SEQ ID NO: 515374 - DNA, 20 bp, Artificial
  CRISPR gRNA sequence
tgggagcaggcagcatccac

SEQ ID NO: 515375 - DNA, 20 bp, Artificial
  CRISPR gRNA sequence
gagcaggcagcatccactgg

SEQ ID NO: 515376 - DNA, 20 bp, Artificial
  CRISPR gRNA sequence
agcaggcagcatccactgga

SEQ ID NO: 515377 - DNA, 20 bp, Artificial
  CRISPR gRNA sequence
tccttcacatcctctctgcc

SEQ ID NO: 515378 - DNA, 20 bp, Artificial
  CRISPR gRNA sequence
ccttcacatcctctctgccg

SEQ ID NO: 515379 - DNA, 20 bp, Artificial
  CRISPR gRNA sequence
cacatcctctctgccgaggc

SEQ ID NO: 515380 - DNA, 20 bp, Artificial
  CRISPR gRNA sequence
ggccagacgctttccttgtg

SEQ ID NO: 515381 - DNA, 20 bp, Artificial
  CRISPR gRNA sequence
tttccttgtgaagctgatgt

SEQ ID NO: 515382 - DNA, 20 bp, Artificial
  CRISPR gRNA sequence
ttccttgtgaagctgatgtc

SEQ ID NO: 515383 - DNA, 20 bp, Artificial
  CRISPR gRNA sequence
gaagctgatgtcaggaacgt

SEQ ID NO: 515384 - DNA, 20 bp, Artificial
  CRISPR gRNA sequence
ctgatgtcaggaacgtcagt

SEQ ID NO: 515385 - DNA, 20 bp, Artificial
  CRISPR gRNA sequence
gatgtcaggaacgtcagtga

SEQ ID NO: 515386 - DNA, 20 bp, Artificial
  CRISPR gRNA sequence
atgtcaggaacgtcagtgag

SEQ ID NO: 515387 - DNA, 20 bp, Artificial
  CRISPR gRNA sequence
tgtcaggaacgtcagtgaga

SEQ ID NO: 515388 - DNA, 20 bp, Artificial
  CRISPR gRNA sequence
aacgtcagtgagagggtgcc

SEQ ID NO: 515389 - DNA, 20 bp, Artificial
  CRISPR gRNA sequence
cgtcagtgagagggtgccga

SEQ ID NO: 515390 - DNA, 20 bp, Artificial
  CRISPR gRNA sequence
gtcagtgagagggtgccgag

SEQ ID NO: 515391 - DNA, 20 bp, Artificial
  CRISPR gRNA sequence
tcagtgagagggtgccgaga

SEQ ID NO: 515392 - DNA, 20 bp, Artificial
  CRISPR gRNA sequence
ggtgccgagagggtgcttct

SEQ ID NO: 515393 - DNA, 20 bp, Artificial
  CRISPR gRNA sequence
ccgagagggtgcttctcagt

SEQ ID NO: 515394 - DNA, 20 bp, Artificial
  CRISPR gRNA sequence
gagagggtgcttctcagtga

SEQ ID NO: 515395 - DNA, 20 bp, Artificial
  CRISPR gRNA sequence
agagggtgcttctcagtgag

SEQ ID NO: 515396 - DNA, 20 bp, Artificial
  CRISPR gRNA sequence
gagggtgcttctcagtgaga

SEQ ID NO: 515397 - DNA, 20 bp, Artificial
  CRISPR gRNA sequence
gcttctcagtgagagggtgc

SEQ ID NO: 515398 - DNA, 20 bp, Artificial
  CRISPR gRNA sequence
cttctcagtgagagggtgct

SEQ ID NO: 515399 - DNA, 20 bp, Artificial
  CRISPR gRNA sequence
tctcagtgagagggtgctgg

SEQ ID NO: 515400 - DNA, 20 bp, Artificial
  CRISPR gRNA sequence
ctcagtgagagggtgctggg

SEQ ID NO: 515401 - DNA, 20 bp, Artificial
  CRISPR gRNA sequence
tcagtgagagggtgctggga

SEQ ID NO: 515402 - DNA, 20 bp, Artificial
  CRISPR gRNA sequence
agggttcttcacacacgcct

SEQ ID NO: 515403 - DNA, 20 bp, Artificial
  CRISPR gRNA sequence
tcacacacgccttggccccc

SEQ ID NO: 515404 - DNA, 20 bp, Artificial
  CRISPR gRNA sequence
acacacgccttggcccccaa

SEQ ID NO: 515405 - DNA, 20 bp, Artificial
  CRISPR gRNA sequence
aagagtcctactcatcaacc

SEQ ID NO: 515406 - DNA, 20 bp, Artificial
  CRISPR gRNA sequence
gagtcctactcatcaacctg

SEQ ID NO: 515407 - DNA, 20 bp, Artificial
  CRISPR gRNA sequence
caacctggagcccaaatccc

SEQ ID NO: 515408 - DNA, 20 bp, Artificial
  CRISPR gRNA sequence
aacctggagcccaaatccct

SEQ ID NO: 515409 - DNA, 20 bp, Artificial
  CRISPR gRNA sequence
tggagcccaaatccctgggt

SEQ ID NO: 515410 - DNA, 20 bp, Artificial
  CRISPR gRNA sequence
ggagcccaaatccctgggtc

SEQ ID NO: 515411 - DNA, 20 bp, Artificial
  CRISPR gRNA sequence
atccctgggtcaggccactg

SEQ ID NO: 515412 - DNA, 20 bp, Artificial
  CRISPR gRNA sequence
gggtcaggccactgcagact

SEQ ID NO: 515413 - DNA, 20 bp, Artificial
  CRISPR gRNA sequence
ggtcaggccactgcagactg

SEQ ID NO: 515414 - DNA, 20 bp, Artificial
  CRISPR gRNA sequence
gtcaggccactgcagactga

SEQ ID NO: 515415 - DNA, 20 bp, Artificial
  CRISPR gRNA sequence
ggccactgcagactgaggga

SEQ ID NO: 515416 - DNA, 20 bp, Artificial
  CRISPR gRNA sequence
ccactgcagactgagggatg

SEQ ID NO: 515417 - DNA, 20 bp, Artificial
  CRISPR gRNA sequence
cagactgagggatggagtga

SEQ ID NO: 515418 - DNA, 20 bp, Artificial
  CRISPR gRNA sequence
ggagtgatggctgcgccccc

SEQ ID NO: 515419 - DNA, 20 bp, Artificial
  CRISPR gRNA sequence
gagtgatggctgcgccccct

SEQ ID NO: 515420 - DNA, 20 bp, Artificial
  CRISPR gRNA sequence
agtgatggctgcgccccctg

SEQ ID NO: 515421 - DNA, 20 bp, Artificial
  CRISPR gRNA sequence
gtgatggctgcgccccctgg

SEQ ID NO: 515422 - DNA, 20 bp, Artificial
  CRISPR gRNA sequence
atggctgcgccccctggggg

SEQ ID NO: 515423 - DNA, 20 bp, Artificial
  CRISPR gRNA sequence
cgccccctgggggcagacgc

SEQ ID NO: 515424 - DNA, 20 bp, Artificial
  CRISPR gRNA sequence
gggggcagacgccggacaca

SEQ ID NO: 515425 - DNA, 20 bp, Artificial
  CRISPR gRNA sequence
cagacgccggacacacagaa

SEQ ID NO: 515426 - DNA, 20 bp, Artificial
  CRISPR gRNA sequence
agacgccggacacacagaac

SEQ ID NO: 515427 - DNA, 20 bp, Artificial
  CRISPR gRNA sequence
acacacagaacaggcgcaaa

SEQ ID NO: 515428 - DNA, 20 bp, Artificial
  CRISPR gRNA sequence
acaggcgcaaacggcaaacc

SEQ ID NO: 515429 - DNA, 20 bp, Artificial
  CRISPR gRNA sequence
caggcgcaaacggcaaacct

SEQ ID NO: 515430 - DNA, 20 bp, Artificial
  CRISPR gRNA sequence
gcgcaaacggcaaacctggg

SEQ ID NO: 515431 - DNA, 20 bp, Artificial
  CRISPR gRNA sequence
cgcaaacggcaaacctgggt

SEQ ID NO: 515432 - DNA, 20 bp, Artificial
  CRISPR gRNA sequence
gcaaacggcaaacctgggta

SEQ ID NO: 515433 - DNA, 20 bp, Artificial
  CRISPR gRNA sequence
acggcaaacctgggtagggt

SEQ ID NO: 515434 - DNA, 20 bp, Artificial
  CRISPR gRNA sequence
gtttcattctgtttttttga

SEQ ID NO: 515435 - DNA, 20 bp, Artificial
  CRISPR gRNA sequence
gtttttttgacagaaacatt

SEQ ID NO: 515436 - DNA, 20 bp, Artificial
  CRISPR gRNA sequence
tttttttgacagaaacatta

SEQ ID NO: 515437 - DNA, 20 bp, Artificial
  CRISPR gRNA sequence
ttgacagaaacattaaggca

SEQ ID NO: 515438 - DNA, 20 bp, Artificial
  CRISPR gRNA sequence
tgacagaaacattaaggcat

SEQ ID NO: 515439 - DNA, 20 bp, Artificial
  CRISPR gRNA sequence
acattaaggcatgggccaca

SEQ ID NO: 515440 - DNA, 20 bp, Artificial
  CRISPR gRNA sequence
cattaaggcatgggccacac

SEQ ID NO: 515441 - DNA, 20 bp, Artificial
  CRISPR gRNA sequence
taaggcatgggccacacagg

SEQ ID NO: 515442 - DNA, 20 bp, Artificial
  CRISPR gRNA sequence
gcatgggccacacaggtggt

SEQ ID NO: 515443 - DNA, 20 bp, Artificial
  CRISPR gRNA sequence
catgggccacacaggtggtt

SEQ ID NO: 515444 - DNA, 20 bp, Artificial
  CRISPR gRNA sequence
gccacacaggtggttaggaa

SEQ ID NO: 515445 - DNA, 20 bp, Artificial
  CRISPR gRNA sequence
ggtggttaggaatggacact

SEQ ID NO: 515446 - DNA, 20 bp, Artificial
  CRISPR gRNA sequence
gagttccttctctaatcttt

SEQ ID NO: 515447 - DNA, 20 bp, Artificial
  CRISPR gRNA sequence
agttccttctctaatctttc

SEQ ID NO: 515448 - DNA, 20 bp, Artificial
  CRISPR gRNA sequence
ttctctaatctttcaggttt

SEQ ID NO: 515449 - DNA, 20 bp, Artificial
  CRISPR gRNA sequence
ttttttgtttttttttttgc

SEQ ID NO: 515450 - DNA, 20 bp, Artificial
  CRISPR gRNA sequence
gctagctgtgaaataatatt

SEQ ID NO: 515451 - DNA, 20 bp, Artificial
  CRISPR gRNA sequence
gctgtgaaataatattcagc

SEQ ID NO: 515452 - DNA, 20 bp, Artificial
  CRISPR gRNA sequence
gcattttcttaatatgactt

SEQ ID NO: 515453 - DNA, 20 bp, Artificial
  CRISPR gRNA sequence
attccttcaaacatgtttct

SEQ ID NO: 515454 - DNA, 20 bp, Artificial
  CRISPR gRNA sequence
ttcttggtaaatgttgcctg

SEQ ID NO: 515455 - DNA, 20 bp, Artificial
  CRISPR gRNA sequence
tttttttttttttttttttt

SEQ ID NO: 515456 - DNA, 20 bp, Artificial
  CRISPR gRNA sequence
ttttttttttttttttgaga

SEQ ID NO: 515457 - DNA, 20 bp, Artificial
  CRISPR gRNA sequence
ttttttttttttttgagatg

SEQ ID NO: 515458 - DNA, 20 bp, Artificial
  CRISPR gRNA sequence
tggagtttcgctctgtcgcc

SEQ ID NO: 515459 - DNA, 20 bp, Artificial
  CRISPR gRNA sequence
ggagtttcgctctgtcgccc

SEQ ID NO: 515460 - DNA, 20 bp, Artificial
  CRISPR gRNA sequence
tttcgctctgtcgcccaggc

SEQ ID NO: 515461 - DNA, 20 bp, Artificial
  CRISPR gRNA sequence
tcgctctgtcgcccaggctg

SEQ ID NO: 515462 - DNA, 20 bp, Artificial
  CRISPR gRNA sequence
tcgcccaggctggagtgcac

SEQ ID NO: 515463 - DNA, 20 bp, Artificial
  CRISPR gRNA sequence
ggagtgcactggtgcgatct

SEQ ID NO: 515464 - DNA, 20 bp, Artificial
  CRISPR gRNA sequence
atcttggctcactacaatcc

SEQ ID NO: 515465 - DNA, 20 bp, Artificial
  CRISPR gRNA sequence
tccaagtgattctcctgact

SEQ ID NO: 515466 - DNA, 20 bp, Artificial
  CRISPR gRNA sequence
ttctcctgactcagcctcct

SEQ ID NO: 515467 - DNA, 20 bp, Artificial
  CRISPR gRNA sequence
tcctgactcagcctcctgag

SEQ ID NO: 515468 - DNA, 20 bp, Artificial
  CRISPR gRNA sequence
gactcagcctcctgagtagc

SEQ ID NO: 515469 - DNA, 20 bp, Artificial
  CRISPR gRNA sequence
actcagcctcctgagtagct

SEQ ID NO: 515470 - DNA, 20 bp, Artificial
  CRISPR gRNA sequence
ctcctgagtagctgggacta

SEQ ID NO: 515471 - DNA, 20 bp, Artificial
  CRISPR gRNA sequence
tcctgagtagctgggactac

SEQ ID NO: 515472 - DNA, 20 bp, Artificial
  CRISPR gRNA sequence
caggcgtgtgccaccacgct

SEQ ID NO: 515473 - DNA, 20 bp, Artificial
  CRISPR gRNA sequence
tcggctaatttttgtatttt

SEQ ID NO: 515474 - DNA, 20 bp, Artificial
  CRISPR gRNA sequence
gctaatttttgtatttttag

SEQ ID NO: 515475 - DNA, 20 bp, Artificial
  CRISPR gRNA sequence
taatttttgtatttttagta

SEQ ID NO: 515476 - DNA, 20 bp, Artificial
  CRISPR gRNA sequence
ttttgtatttttagtagaga

SEQ ID NO: 515477 - DNA, 20 bp, Artificial
  CRISPR gRNA sequence
ttgtatttttagtagagaca

SEQ ID NO: 515478 - DNA, 20 bp, Artificial
  CRISPR gRNA sequence
gagacagagtttcgccatgt

SEQ ID NO: 515479 - DNA, 20 bp, Artificial
  CRISPR gRNA sequence
cagagtttcgccatgttggc

SEQ ID NO: 515480 - DNA, 20 bp, Artificial
  CRISPR gRNA sequence
agagtttcgccatgttggcc

SEQ ID NO: 515481 - DNA, 20 bp, Artificial
  CRISPR gRNA sequence
tttcgccatgttggccaggc

SEQ ID NO: 515482 - DNA, 20 bp, Artificial
  CRISPR gRNA sequence
tggtctcaaactcttgccct

SEQ ID NO: 515483 - DNA, 20 bp, Artificial
  CRISPR gRNA sequence
ctcagatgatctacccgcct

SEQ ID NO: 515484 - DNA, 20 bp, Artificial
  CRISPR gRNA sequence
ctacccgcctcggcctccca

SEQ ID NO: 515485 - DNA, 20 bp, Artificial
  CRISPR gRNA sequence
gcctcggcctcccacagtgc

SEQ ID NO: 515486 - DNA, 20 bp, Artificial
  CRISPR gRNA sequence
cctcggcctcccacagtgct

SEQ ID NO: 515487 - DNA, 20 bp, Artificial
  CRISPR gRNA sequence
ctcccacagtgctgggatta

SEQ ID NO: 515488 - DNA, 20 bp, Artificial
  CRISPR gRNA sequence
tcccacagtgctgggattac

SEQ ID NO: 515489 - DNA, 20 bp, Artificial
  CRISPR gRNA sequence
agtgctgggattacaggcgt

SEQ ID NO: 515490 - DNA, 20 bp, Artificial
  CRISPR gRNA sequence
gggattacaggcgtgagccg

SEQ ID NO: 515491 - DNA, 20 bp, Artificial
  CRISPR gRNA sequence
caggcgtgagccgcggcgcc

SEQ ID NO: 515492 - DNA, 20 bp, Artificial
  CRISPR gRNA sequence
cgcggcgcccagctgtccca

SEQ ID NO: 515493 - DNA, 20 bp, Artificial
  CRISPR gRNA sequence
gctgtcccatggattctcac

SEQ ID NO: 515494 - DNA, 20 bp, Artificial
  CRISPR gRNA sequence
ccagaacgtttccctcatgt

SEQ ID NO: 515495 - DNA, 20 bp, Artificial
  CRISPR gRNA sequence
cagaacgtttccctcatgtt

SEQ ID NO: 515496 - DNA, 20 bp, Artificial
  CRISPR gRNA sequence
aacgtttccctcatgttggg

SEQ ID NO: 515497 - DNA, 20 bp, Artificial
  CRISPR gRNA sequence
tccctcatgttgggtggtct

SEQ ID NO: 515498 - DNA, 20 bp, Artificial
  CRISPR gRNA sequence
ctcatgttgggtggtctgag

SEQ ID NO: 515499 - DNA, 20 bp, Artificial
  CRISPR gRNA sequence
tcatgttgggtggtctgagt

SEQ ID NO: 515500 - DNA, 20 bp, Artificial
  CRISPR gRNA sequence
atgttgggtggtctgagtgg

SEQ ID NO: 515501 - DNA, 20 bp, Artificial
  CRISPR gRNA sequence
ggtctgagtgggagtgtgct

SEQ ID NO: 515502 - DNA, 20 bp, Artificial
  CRISPR gRNA sequence
cacatgtctctgctgatgtg

SEQ ID NO: 515503 - DNA, 20 bp, Artificial
  CRISPR gRNA sequence
tgtctctgctgatgtgtggc

SEQ ID NO: 515504 - DNA, 20 bp, Artificial
  CRISPR gRNA sequence
gtctctgctgatgtgtggcc

SEQ ID NO: 515505 - DNA, 20 bp, Artificial
  CRISPR gRNA sequence
tctctgctgatgtgtggccg

SEQ ID NO: 515506 - DNA, 20 bp, Artificial
  CRISPR gRNA sequence
tctgctgatgtgtggccggg

SEQ ID NO: 515507 - DNA, 20 bp, Artificial
  CRISPR gRNA sequence
atgtgtggccggggagatcc

SEQ ID NO: 515508 - DNA, 20 bp, Artificial
  CRISPR gRNA sequence
ggccggggagatcctggtgc

SEQ ID NO: 515509 - DNA, 20 bp, Artificial
  CRISPR gRNA sequence
ggggagatcctggtgccggc

SEQ ID NO: 515510 - DNA, 20 bp, Artificial
  CRISPR gRNA sequence
gatcctggtgccggccagtg

SEQ ID NO: 515511 - DNA, 20 bp, Artificial
  CRISPR gRNA sequence
atcctggtgccggccagtgc

SEQ ID NO: 515512 - DNA, 20 bp, Artificial
  CRISPR gRNA sequence
cctggtgccggccagtgcgg

SEQ ID NO: 515513 - DNA, 20 bp, Artificial
  CRISPR gRNA sequence
tgccggccagtgcgggagtg

SEQ ID NO: 515514 - DNA, 20 bp, Artificial
  CRISPR gRNA sequence
gccggccagtgcgggagtgc

SEQ ID NO: 515515 - DNA, 20 bp, Artificial
  CRISPR gRNA sequence
ggccagtgcgggagtgcggg

SEQ ID NO: 515516 - DNA, 20 bp, Artificial
  CRISPR gRNA sequence
ccagtgcgggagtgcgggca

SEQ ID NO: 515517 - DNA, 20 bp, Artificial
  CRISPR gRNA sequence
cgggcagagcacctccttgc

SEQ ID NO: 515518 - DNA, 20 bp, Artificial
  CRISPR gRNA sequence
acctccttgccggctgactt

SEQ ID NO: 515519 - DNA, 20 bp, Artificial
  CRISPR gRNA sequence
tgccggctgactttggctct

SEQ ID NO: 515520 - DNA, 20 bp, Artificial
  CRISPR gRNA sequence
tgactttggctctcggatct

SEQ ID NO: 515521 - DNA, 20 bp, Artificial
  CRISPR gRNA sequence
tggctctcggatctgagcat

SEQ ID NO: 515522 - DNA, 20 bp, Artificial
  CRISPR gRNA sequence
gcatcagctcttcctgctcc

SEQ ID NO: 515523 - DNA, 20 bp, Artificial
  CRISPR gRNA sequence
cctccccacgctgaaccccc

SEQ ID NO: 515524 - DNA, 20 bp, Artificial
  CRISPR gRNA sequence
ctccccacgctgaacccccc

SEQ ID NO: 515525 - DNA, 20 bp, Artificial
  CRISPR gRNA sequence
tgaaccccccaggacccctg

SEQ ID NO: 515526 - DNA, 20 bp, Artificial
  CRISPR gRNA sequence
aaccccccaggacccctgca

SEQ ID NO: 515527 - DNA, 20 bp, Artificial
  CRISPR gRNA sequence
accccccaggacccctgcag

SEQ ID NO: 515528 - DNA, 20 bp, Artificial
  CRISPR gRNA sequence
cccaggacccctgcagaggc

SEQ ID NO: 515529 - DNA, 20 bp, Artificial
  CRISPR gRNA sequence
ccaggacccctgcagaggcc

SEQ ID NO: 515530 - DNA, 20 bp, Artificial
  CRISPR gRNA sequence
aggacccctgcagaggccag

SEQ ID NO: 515531 - DNA, 20 bp, Artificial
  CRISPR gRNA sequence
ggacccctgcagaggccagg

SEQ ID NO: 515532 - DNA, 20 bp, Artificial
  CRISPR gRNA sequence
ccctgcagaggccaggaggt

SEQ ID NO: 515533 - DNA, 20 bp, Artificial
  CRISPR gRNA sequence
cctgcagaggccaggaggtg

SEQ ID NO: 515534 - DNA, 20 bp, Artificial
  CRISPR gRNA sequence
ctgcagaggccaggaggtga

SEQ ID NO: 515535 - DNA, 20 bp, Artificial
  CRISPR gRNA sequence
agaggccaggaggtgagggt

SEQ ID NO: 515536 - DNA, 20 bp, Artificial
  CRISPR gRNA sequence
gaggccaggaggtgagggtt

SEQ ID NO: 515537 - DNA, 20 bp, Artificial
  CRISPR gRNA sequence
ggccaggaggtgagggttgg

SEQ ID NO: 515538 - DNA, 20 bp, Artificial
  CRISPR gRNA sequence
aggaggtgagggttgggagc

SEQ ID NO: 515539 - DNA, 20 bp, Artificial
  CRISPR gRNA sequence
ggaggtgagggttgggagct

SEQ ID NO: 515540 - DNA, 20 bp, Artificial
  CRISPR gRNA sequence
tgggagctgggctgccaccc

SEQ ID NO: 515541 - DNA, 20 bp, Artificial
  CRISPR gRNA sequence
gggctgccaccctggccacc

SEQ ID NO: 515542 - DNA, 20 bp, Artificial
  CRISPR gRNA sequence
ggctgccaccctggccaccg

SEQ ID NO: 515543 - DNA, 20 bp, Artificial
  CRISPR gRNA sequence
gctgccaccctggccaccga

SEQ ID NO: 515544 - DNA, 20 bp, Artificial
  CRISPR gRNA sequence
gccaccgagggtccccacct

SEQ ID NO: 515545 - DNA, 20 bp, Artificial
  CRISPR gRNA sequence
cgagggtccccacctgagcc

SEQ ID NO: 515546 - DNA, 20 bp, Artificial
  CRISPR gRNA sequence
ctgagcccagcactgccctg

SEQ ID NO: 515547 - DNA, 20 bp, Artificial
  CRISPR gRNA sequence
ctgccctgcagatcaccttc

SEQ ID NO: 515548 - DNA, 20 bp, Artificial
  CRISPR gRNA sequence
tgccctgcagatcaccttcc

SEQ ID NO: 515549 - DNA, 20 bp, Artificial
  CRISPR gRNA sequence
tgcagatcaccttccaggtg

SEQ ID NO: 515550 - DNA, 20 bp, Artificial
  CRISPR gRNA sequence
gcagatcaccttccaggtga

SEQ ID NO: 515551 - DNA, 20 bp, Artificial
  CRISPR gRNA sequence
caccttccaggtgaaggtca

SEQ ID NO: 515552 - DNA, 20 bp, Artificial
  CRISPR gRNA sequence
ccaggtgaaggtcacggcca

SEQ ID NO: 515553 - DNA, 20 bp, Artificial
  CRISPR gRNA sequence
aggtgaaggtcacggccaca

SEQ ID NO: 515554 - DNA, 20 bp, Artificial
  CRISPR gRNA sequence
tcacggccacagagtgcatc

SEQ ID NO: 515555 - DNA, 20 bp, Artificial
  CRISPR gRNA sequence
cacggccacagagtgcatcc

SEQ ID NO: 515556 - DNA, 20 bp, Artificial
  CRISPR gRNA sequence
cggccacagagtgcatccag

SEQ ID NO: 515557 - DNA, 20 bp, Artificial
  CRISPR gRNA sequence
ccacagagtgcatccaggag

SEQ ID NO: 515558 - DNA, 20 bp, Artificial
  CRISPR gRNA sequence
aggagcagtcgtttgtcatc

SEQ ID NO: 515559 - DNA, 20 bp, Artificial
  CRISPR gRNA sequence
ggagcagtcgtttgtcatcc

SEQ ID NO: 515560 - DNA, 20 bp, Artificial
  CRISPR gRNA sequence
gtcgtttgtcatccgggcgc

SEQ ID NO: 515561 - DNA, 20 bp, Artificial
  CRISPR gRNA sequence
tcgtttgtcatccgggcgct

SEQ ID NO: 515562 - DNA, 20 bp, Artificial
  CRISPR gRNA sequence
catccgggcgctgggcttca

SEQ ID NO: 515563 - DNA, 20 bp, Artificial
  CRISPR gRNA sequence
ggcgctgggcttcacggaca

SEQ ID NO: 515564 - DNA, 20 bp, Artificial
  CRISPR gRNA sequence
tcacggacatagtgaccgtg

SEQ ID NO: 515565 - DNA, 20 bp, Artificial
  CRISPR gRNA sequence
cacggacatagtgaccgtgc

SEQ ID NO: 515566 - DNA, 20 bp, Artificial
  CRISPR gRNA sequence
tgaccgtgcaggttcttccc

SEQ ID NO: 515567 - DNA, 20 bp, Artificial
  CRISPR gRNA sequence
tgcaggttcttccccagtgt

SEQ ID NO: 515568 - DNA, 20 bp, Artificial
  CRISPR gRNA sequence
ttcttccccagtgtgagtgc

SEQ ID NO: 515569 - DNA, 20 bp, Artificial
  CRISPR gRNA sequence
cccagtgtgagtgccggtgc

SEQ ID NO: 515570 - DNA, 20 bp, Artificial
  CRISPR gRNA sequence
ccagtgtgagtgccggtgcc

SEQ ID NO: 515571 - DNA, 20 bp, Artificial
  CRISPR gRNA sequence
gtgagtgccggtgccgggac

SEQ ID NO: 515572 - DNA, 20 bp, Artificial
  CRISPR gRNA sequence
gagtgccggtgccgggacca

SEQ ID NO: 515573 - DNA, 20 bp, Artificial
  CRISPR gRNA sequence
tgccggtgccgggaccagag

SEQ ID NO: 515574 - DNA, 20 bp, Artificial
  CRISPR gRNA sequence
ccggtgccgggaccagagca

SEQ ID NO: 515575 - DNA, 20 bp, Artificial
  CRISPR gRNA sequence
cgggaccagagcagagaccg

SEQ ID NO: 515576 - DNA, 20 bp, Artificial
  CRISPR gRNA sequence
agagaccgcagcctctgcca

SEQ ID NO: 515577 - DNA, 20 bp, Artificial
  CRISPR gRNA sequence
accgcagcctctgccatggc

SEQ ID NO: 515578 - DNA, 20 bp, Artificial
  CRISPR gRNA sequence
ccgcagcctctgccatggca

SEQ ID NO: 515579 - DNA, 20 bp, Artificial
  CRISPR gRNA sequence
cgcagcctctgccatggcaa

SEQ ID NO: 515580 - DNA, 20 bp, Artificial
  CRISPR gRNA sequence
ctgccatggcaagggcttct

SEQ ID NO: 515581 - DNA, 20 bp, Artificial
  CRISPR gRNA sequence
gccatggcaagggcttcttg

SEQ ID NO: 515582 - DNA, 20 bp, Artificial
  CRISPR gRNA sequence
ggcaagggcttcttggagtg

SEQ ID NO: 515583 - DNA, 20 bp, Artificial
  CRISPR gRNA sequence
ttcttggagtgcggcatctg

SEQ ID NO: 515584 - DNA, 20 bp, Artificial
  CRISPR gRNA sequence
tcttggagtgcggcatctgc

SEQ ID NO: 515585 - DNA, 20 bp, Artificial
  CRISPR gRNA sequence
ggagtgcggcatctgcaggt

SEQ ID NO: 515586 - DNA, 20 bp, Artificial
  CRISPR gRNA sequence
gagtgcggcatctgcaggtg

SEQ ID NO: 515587 - DNA, 20 bp, Artificial
  CRISPR gRNA sequence
tgcggcatctgcaggtgagg

SEQ ID NO: 515588 - DNA, 20 bp, Artificial
  CRISPR gRNA sequence
gcggcatctgcaggtgaggc

SEQ ID NO: 515589 - DNA, 20 bp, Artificial
  CRISPR gRNA sequence
atctgcaggtgaggcgggcg

SEQ ID NO: 515590 - DNA, 20 bp, Artificial
  CRISPR gRNA sequence
tctgcaggtgaggcgggcgc

SEQ ID NO: 515591 - DNA, 20 bp, Artificial
  CRISPR gRNA sequence
gtccctgttgaaccatcccc

SEQ ID NO: 515592 - DNA, 20 bp, Artificial
  CRISPR gRNA sequence
catccccgagccccacccca

SEQ ID NO: 515593 - DNA, 20 bp, Artificial
  CRISPR gRNA sequence
atccccgagccccaccccac

SEQ ID NO: 515594 - DNA, 20 bp, Artificial
  CRISPR gRNA sequence
tccccgagccccaccccaca

SEQ ID NO: 515595 - DNA, 20 bp, Artificial
  CRISPR gRNA sequence
ccgagccccaccccacaggg

SEQ ID NO: 515596 - DNA, 20 bp, Artificial
  CRISPR gRNA sequence
cgagccccaccccacagggc

SEQ ID NO: 515597 - DNA, 20 bp, Artificial
  CRISPR gRNA sequence
ccaccccacagggcaggtgt

SEQ ID NO: 515598 - DNA, 20 bp, Artificial
  CRISPR gRNA sequence
ccccacagggcaggtgtcgg

SEQ ID NO: 515599 - DNA, 20 bp, Artificial
  CRISPR gRNA sequence
cccacagggcaggtgtcggc

SEQ ID NO: 515600 - DNA, 20 bp, Artificial
  CRISPR gRNA sequence
cagggcaggtgtcggcaggt

SEQ ID NO: 515601 - DNA, 20 bp, Artificial
  CRISPR gRNA sequence
agggcaggtgtcggcaggtg

SEQ ID NO: 515602 - DNA, 20 bp, Artificial
  CRISPR gRNA sequence
gcaggtgtcggcaggtgagg

SEQ ID NO: 515603 - DNA, 20 bp, Artificial
  CRISPR gRNA sequence
caggtgtcggcaggtgaggt

SEQ ID NO: 515604 - DNA, 20 bp, Artificial
  CRISPR gRNA sequence
gtcggcaggtgaggtgggtg

SEQ ID NO: 515605 - DNA, 20 bp, Artificial
  CRISPR gRNA sequence
tcggcaggtgaggtgggtgc

SEQ ID NO: 515606 - DNA, 20 bp, Artificial
  CRISPR gRNA sequence
gcaggtgaggtgggtgcagg

SEQ ID NO: 515607 - DNA, 20 bp, Artificial
  CRISPR gRNA sequence
ccatcccttcccccacccca

SEQ ID NO: 515608 - DNA, 20 bp, Artificial
  CRISPR gRNA sequence
atcccttcccccaccccacg

SEQ ID NO: 515609 - DNA, 20 bp, Artificial
  CRISPR gRNA sequence
ccttcccccaccccacggag

SEQ ID NO: 515610 - DNA, 20 bp, Artificial
  CRISPR gRNA sequence
cttcccccaccccacggagc

SEQ ID NO: 515611 - DNA, 20 bp, Artificial
  CRISPR gRNA sequence
accccacggagcaggcatcc

SEQ ID NO: 515612 - DNA, 20 bp, Artificial
  CRISPR gRNA sequence
ccccacggagcaggcatcct

SEQ ID NO: 515613 - DNA, 20 bp, Artificial
  CRISPR gRNA sequence
cccacggagcaggcatcctg

SEQ ID NO: 515614 - DNA, 20 bp, Artificial
  CRISPR gRNA sequence
ccacggagcaggcatcctgg

SEQ ID NO: 515615 - DNA, 20 bp, Artificial
  CRISPR gRNA sequence
atcctgggggcccccttctg

SEQ ID NO: 515616 - DNA, 20 bp, Artificial
  CRISPR gRNA sequence
tcctgggggcccccttctgc

SEQ ID NO: 515617 - DNA, 20 bp, Artificial
  CRISPR gRNA sequence
ctgggggcccccttctgcag

SEQ ID NO: 515618 - DNA, 20 bp, Artificial
  CRISPR gRNA sequence
tgggggcccccttctgcagg

SEQ ID NO: 515619 - DNA, 20 bp, Artificial
  CRISPR gRNA sequence
gggcccccttctgcaggagg

SEQ ID NO: 515620 - DNA, 20 bp, Artificial
  CRISPR gRNA sequence
ggcccccttctgcaggaggt

SEQ ID NO: 515621 - DNA, 20 bp, Artificial
  CRISPR gRNA sequence
gcccccttctgcaggaggtg

SEQ ID NO: 515622 - DNA, 20 bp, Artificial
  CRISPR gRNA sequence
ccccttctgcaggaggtggg

SEQ ID NO: 515623 - DNA, 20 bp, Artificial
  CRISPR gRNA sequence
ctgcaggaggtggggagatt

SEQ ID NO: 515624 - DNA, 20 bp, Artificial
  CRISPR gRNA sequence
tgcaggaggtggggagattt

SEQ ID NO: 515625 - DNA, 20 bp, Artificial
  CRISPR gRNA sequence
gaggtggggagatttgggat

SEQ ID NO: 515626 - DNA, 20 bp, Artificial
  CRISPR gRNA sequence
ggagatttgggattggaacc

SEQ ID NO: 515627 - DNA, 20 bp, Artificial
  CRISPR gRNA sequence
gattggaacccagaacccct

SEQ ID NO: 515628 - DNA, 20 bp, Artificial
  CRISPR gRNA sequence
ggaacccagaacccctcggc

SEQ ID NO: 515629 - DNA, 20 bp, Artificial
  CRISPR gRNA sequence
aagccctcacccgtgctcct

SEQ ID NO: 515630 - DNA, 20 bp, Artificial
  CRISPR gRNA sequence
cctcacccgtgctcctgagc

SEQ ID NO: 515631 - DNA, 20 bp, Artificial
  CRISPR gRNA sequence
ctcacccgtgctcctgagcc

SEQ ID NO: 515632 - DNA, 20 bp, Artificial
  CRISPR gRNA sequence
tcacccgtgctcctgagcca

SEQ ID NO: 515633 - DNA, 20 bp, Artificial
  CRISPR gRNA sequence
gtgctcctgagccagggcac

SEQ ID NO: 515634 - DNA, 20 bp, Artificial
  CRISPR gRNA sequence
agccagggcaccagcaatgc

SEQ ID NO: 515635 - DNA, 20 bp, Artificial
  CRISPR gRNA sequence
agcctgtactctacactctc

SEQ ID NO: 515636 - DNA, 20 bp, Artificial
  CRISPR gRNA sequence
tactctacactctctggcca

SEQ ID NO: 515637 - DNA, 20 bp, Artificial
  CRISPR gRNA sequence
ctctacactctctggccatg

SEQ ID NO: 515638 - DNA, 20 bp, Artificial
  CRISPR gRNA sequence
tctacactctctggccatgg

SEQ ID NO: 515639 - DNA, 20 bp, Artificial
  CRISPR gRNA sequence
tctctggccatggaggaccc

SEQ ID NO: 515640 - DNA, 20 bp, Artificial
  CRISPR gRNA sequence
ctctggccatggaggaccca

SEQ ID NO: 515641 - DNA, 20 bp, Artificial
  CRISPR gRNA sequence
tggccatggaggacccaagg

SEQ ID NO: 515642 - DNA, 20 bp, Artificial
  CRISPR gRNA sequence
ggccatggaggacccaaggc

SEQ ID NO: 515643 - DNA, 20 bp, Artificial
  CRISPR gRNA sequence
gccatggaggacccaaggca

SEQ ID NO: 515644 - DNA, 20 bp, Artificial
  CRISPR gRNA sequence
ccatggaggacccaaggcag

SEQ ID NO: 515645 - DNA, 20 bp, Artificial
  CRISPR gRNA sequence
gacccaaggcaggggacttg

SEQ ID NO: 515646 - DNA, 20 bp, Artificial
  CRISPR gRNA sequence
acccaaggcaggggacttgt

SEQ ID NO: 515647 - DNA, 20 bp, Artificial
  CRISPR gRNA sequence
caaggcaggggacttgtggg

SEQ ID NO: 515648 - DNA, 20 bp, Artificial
  CRISPR gRNA sequence
aaggcaggggacttgtgggc

SEQ ID NO: 515649 - DNA, 20 bp, Artificial
  CRISPR gRNA sequence
ggcaggggacttgtgggcag

SEQ ID NO: 515650 - DNA, 20 bp, Artificial
  CRISPR gRNA sequence
gcaggggacttgtgggcagg

SEQ ID NO: 515651 - DNA, 20 bp, Artificial
  CRISPR gRNA sequence
gggcaggaggaccccctcac

SEQ ID NO: 515652 - DNA, 20 bp, Artificial
  CRISPR gRNA sequence
gcaggaggaccccctcacca

SEQ ID NO: 515653 - DNA, 20 bp, Artificial
  CRISPR gRNA sequence
caggaggaccccctcaccag

SEQ ID NO: 515654 - DNA, 20 bp, Artificial
  CRISPR gRNA sequence
aggaccccctcaccagagga

SEQ ID NO: 515655 - DNA, 20 bp, Artificial
  CRISPR gRNA sequence
gaccccctcaccagaggatg

SEQ ID NO: 515656 - DNA, 20 bp, Artificial
  CRISPR gRNA sequence
accccctcaccagaggatgg

SEQ ID NO: 515657 - DNA, 20 bp, Artificial
  CRISPR gRNA sequence
cagaggatggaggcccatct

SEQ ID NO: 515658 - DNA, 20 bp, Artificial
  CRISPR gRNA sequence
agaggatggaggcccatctc

SEQ ID NO: 515659 - DNA, 20 bp, Artificial
  CRISPR gRNA sequence
gaggatggaggcccatctca

SEQ ID NO: 515660 - DNA, 20 bp, Artificial
  CRISPR gRNA sequence
aggatggaggcccatctcag

SEQ ID NO: 515661 - DNA, 20 bp, Artificial
  CRISPR gRNA sequence
gaggcccatctcaggggcac

SEQ ID NO: 515662 - DNA, 20 bp, Artificial
  CRISPR gRNA sequence
aggcccatctcaggggcaca

SEQ ID NO: 515663 - DNA, 20 bp, Artificial
  CRISPR gRNA sequence
gcccatctcaggggcacaag

SEQ ID NO: 515664 - DNA, 20 bp, Artificial
  CRISPR gRNA sequence
ggggcacaaggagtccccgc

SEQ ID NO: 515665 - DNA, 20 bp, Artificial
  CRISPR gRNA sequence
gggcacaaggagtccccgct

SEQ ID NO: 515666 - DNA, 20 bp, Artificial
  CRISPR gRNA sequence
gtccccgctgggcgtgccca

SEQ ID NO: 515667 - DNA, 20 bp, Artificial
  CRISPR gRNA sequence
ctgggcgtgcccatggcctt

SEQ ID NO: 515668 - DNA, 20 bp, Artificial
  CRISPR gRNA sequence
ggcgtgcccatggccttgag

SEQ ID NO: 515669 - DNA, 20 bp, Artificial
  CRISPR gRNA sequence
gcgtgcccatggccttgagt

SEQ ID NO: 515670 - DNA, 20 bp, Artificial
  CRISPR gRNA sequence
tgcccgaccttccttgaccc

SEQ ID NO: 515671 - DNA, 20 bp, Artificial
  CRISPR gRNA sequence
gcccgaccttccttgaccct

SEQ ID NO: 515672 - DNA, 20 bp, Artificial
  CRISPR gRNA sequence
ccgaccttccttgaccctag

SEQ ID NO: 515673 - DNA, 20 bp, Artificial
  CRISPR gRNA sequence
ccttccttgaccctaggagc

SEQ ID NO: 515674 - DNA, 20 bp, Artificial
  CRISPR gRNA sequence
agctggcttctctctgacct

SEQ ID NO: 515675 - DNA, 20 bp, Artificial
  CRISPR gRNA sequence
gctggcttctctctgacctt

SEQ ID NO: 515676 - DNA, 20 bp, Artificial
  CRISPR gRNA sequence
ctggcttctctctgaccttg

SEQ ID NO: 515677 - DNA, 20 bp, Artificial
  CRISPR gRNA sequence
ctctctgaccttggggaccc

SEQ ID NO: 515678 - DNA, 20 bp, Artificial
  CRISPR gRNA sequence
tctctgaccttggggaccca

SEQ ID NO: 515679 - DNA, 20 bp, Artificial
  CRISPR gRNA sequence
ccttggggacccaaggccat

SEQ ID NO: 515680 - DNA, 20 bp, Artificial
  CRISPR gRNA sequence
cttggggacccaaggccatc

SEQ ID NO: 515681 - DNA, 20 bp, Artificial
  CRISPR gRNA sequence
gggacccaaggccatcaggc

SEQ ID NO: 515682 - DNA, 20 bp, Artificial
  CRISPR gRNA sequence
acccaaggccatcaggctgg

SEQ ID NO: 515683 - DNA, 20 bp, Artificial
  CRISPR gRNA sequence
ggccatcaggctggcagccc

SEQ ID NO: 515684 - DNA, 20 bp, Artificial
  CRISPR gRNA sequence
gccatcaggctggcagccct

SEQ ID NO: 515685 - DNA, 20 bp, Artificial
  CRISPR gRNA sequence
ccatcaggctggcagccctg

SEQ ID NO: 515686 - DNA, 20 bp, Artificial
  CRISPR gRNA sequence
aggctggcagccctggggca

SEQ ID NO: 515687 - DNA, 20 bp, Artificial
  CRISPR gRNA sequence
ggctggcagccctggggcat

SEQ ID NO: 515688 - DNA, 20 bp, Artificial
  CRISPR gRNA sequence
tggcagccctggggcatggg

SEQ ID NO: 515689 - DNA, 20 bp, Artificial
  CRISPR gRNA sequence
agccctggggcatgggtggc

SEQ ID NO: 515690 - DNA, 20 bp, Artificial
  CRISPR gRNA sequence
ccctggggcatgggtggcta

SEQ ID NO: 515691 - DNA, 20 bp, Artificial
  CRISPR gRNA sequence
ctggggcatgggtggctaga

SEQ ID NO: 515692 - DNA, 20 bp, Artificial
  CRISPR gRNA sequence
tgggtggctagagagcctcc

SEQ ID NO: 515693 - DNA, 20 bp, Artificial
  CRISPR gRNA sequence
gggtggctagagagcctcct

SEQ ID NO: 515694 - DNA, 20 bp, Artificial
  CRISPR gRNA sequence
ggctagagagcctcctggga

SEQ ID NO: 515695 - DNA, 20 bp, Artificial
  CRISPR gRNA sequence
gctagagagcctcctgggac

SEQ ID NO: 515696 - DNA, 20 bp, Artificial
  CRISPR gRNA sequence
gagcctcctgggacaggtga

SEQ ID NO: 515697 - DNA, 20 bp, Artificial
  CRISPR gRNA sequence
ctgggacaggtgatggcttc

SEQ ID NO: 515698 - DNA, 20 bp, Artificial
  CRISPR gRNA sequence
tgggacaggtgatggcttct

SEQ ID NO: 515699 - DNA, 20 bp, Artificial
  CRISPR gRNA sequence
ggacaggtgatggcttctgg

SEQ ID NO: 515700 - DNA, 20 bp, Artificial
  CRISPR gRNA sequence
ggtgatggcttctgggagcc

SEQ ID NO: 515701 - DNA, 20 bp, Artificial
  CRISPR gRNA sequence
gtgatggcttctgggagcct

SEQ ID NO: 515702 - DNA, 20 bp, Artificial
  CRISPR gRNA sequence
ttctgggagcctgggcccca

SEQ ID NO: 515703 - DNA, 20 bp, Artificial
  CRISPR gRNA sequence
tctgggagcctgggccccat

SEQ ID NO: 515704 - DNA, 20 bp, Artificial
  CRISPR gRNA sequence
gggccccataggccacctct

SEQ ID NO: 515705 - DNA, 20 bp, Artificial
  CRISPR gRNA sequence
ggccccataggccacctctt

SEQ ID NO: 515706 - DNA, 20 bp, Artificial
  CRISPR gRNA sequence
tgggcgtgcacaccccctgc

SEQ ID NO: 515707 - DNA, 20 bp, Artificial
  CRISPR gRNA sequence
gggcgtgcacaccccctgcc

SEQ ID NO: 515708 - DNA, 20 bp, Artificial
  CRISPR gRNA sequence
tgcacaccccctgccaggcg

SEQ ID NO: 515709 - DNA, 20 bp, Artificial
  CRISPR gRNA sequence
gcacaccccctgccaggcgt

SEQ ID NO: 515710 - DNA, 20 bp, Artificial
  CRISPR gRNA sequence
caggcgtgggcaccccacct

SEQ ID NO: 515711 - DNA, 20 bp, Artificial
  CRISPR gRNA sequence
aggcgtgggcaccccacctc

SEQ ID NO: 515712 - DNA, 20 bp, Artificial
  CRISPR gRNA sequence
ggcgtgggcaccccacctca

SEQ ID NO: 515713 - DNA, 20 bp, Artificial
  CRISPR gRNA sequence
cgtgggcaccccacctcagg

SEQ ID NO: 515714 - DNA, 20 bp, Artificial
  CRISPR gRNA sequence
gggcaccccacctcagggag

SEQ ID NO: 515715 - DNA, 20 bp, Artificial
  CRISPR gRNA sequence
caccccacctcagggagaag

SEQ ID NO: 515716 - DNA, 20 bp, Artificial
  CRISPR gRNA sequence
accccacctcagggagaagt

SEQ ID NO: 515717 - DNA, 20 bp, Artificial
  CRISPR gRNA sequence
ccccacctcagggagaagtg

SEQ ID NO: 515718 - DNA, 20 bp, Artificial
  CRISPR gRNA sequence
cccacctcagggagaagtgg

SEQ ID NO: 515719 - DNA, 20 bp, Artificial
  CRISPR gRNA sequence
cctcagggagaagtggggga

SEQ ID NO: 515720 - DNA, 20 bp, Artificial
  CRISPR gRNA sequence
ctcagggagaagtgggggac

SEQ ID NO: 515721 - DNA, 20 bp, Artificial
  CRISPR gRNA sequence
agggagaagtgggggacagg

SEQ ID NO: 515722 - DNA, 20 bp, Artificial
  CRISPR gRNA sequence
aagtgggggacaggtggacc

SEQ ID NO: 515723 - DNA, 20 bp, Artificial
  CRISPR gRNA sequence
tgggggacaggtggacccag

SEQ ID NO: 515724 - DNA, 20 bp, Artificial
  CRISPR gRNA sequence
gggggacaggtggacccagt

SEQ ID NO: 515725 - DNA, 20 bp, Artificial
  CRISPR gRNA sequence
ggggacaggtggacccagtg

SEQ ID NO: 515726 - DNA, 20 bp, Artificial
  CRISPR gRNA sequence
ggacaggtggacccagtggg

SEQ ID NO: 515727 - DNA, 20 bp, Artificial
  CRISPR gRNA sequence
gacaggtggacccagtgggg

SEQ ID NO: 515728 - DNA, 20 bp, Artificial
  CRISPR gRNA sequence
acccagtggggaggttcaca

SEQ ID NO: 515729 - DNA, 20 bp, Artificial
  CRISPR gRNA sequence
ggggaggttcacatggcact

SEQ ID NO: 515730 - DNA, 20 bp, Artificial
  CRISPR gRNA sequence
aggttcacatggcactcagc

SEQ ID NO: 515731 - DNA, 20 bp, Artificial
  CRISPR gRNA sequence
ggttcacatggcactcagcc

SEQ ID NO: 515732 - DNA, 20 bp, Artificial
  CRISPR gRNA sequence
tcacatggcactcagccagg

SEQ ID NO: 515733 - DNA, 20 bp, Artificial
  CRISPR gRNA sequence
actcagccaggcggcctgcc

SEQ ID NO: 515734 - DNA, 20 bp, Artificial
  CRISPR gRNA sequence
ctcagccaggcggcctgccc

SEQ ID NO: 515735 - DNA, 20 bp, Artificial
  CRISPR gRNA sequence
tcagccaggcggcctgcccg

SEQ ID NO: 515736 - DNA, 20 bp, Artificial
  CRISPR gRNA sequence
cagccaggcggcctgcccgg

SEQ ID NO: 515737 - DNA, 20 bp, Artificial
  CRISPR gRNA sequence
caggcggcctgcccgggggc

SEQ ID NO: 515738 - DNA, 20 bp, Artificial
  CRISPR gRNA sequence
cggcctgcccgggggctgga

SEQ ID NO: 515739 - DNA, 20 bp, Artificial
  CRISPR gRNA sequence
tccccctttccttgcttgcc

SEQ ID NO: 515740 - DNA, 20 bp, Artificial
  CRISPR gRNA sequence
cctttccttgcttgcctggc

SEQ ID NO: 515741 - DNA, 20 bp, Artificial
  CRISPR gRNA sequence
tttccttgcttgcctggcca

SEQ ID NO: 515742 - DNA, 20 bp, Artificial
  CRISPR gRNA sequence
gcttgcctggccagagctgc

SEQ ID NO: 515743 - DNA, 20 bp, Artificial
  CRISPR gRNA sequence
cttgcctggccagagctgct

SEQ ID NO: 515744 - DNA, 20 bp, Artificial
  CRISPR gRNA sequence
gagctgctaggctgacctcc

SEQ ID NO: 515745 - DNA, 20 bp, Artificial
  CRISPR gRNA sequence
agctgctaggctgacctccc

SEQ ID NO: 515746 - DNA, 20 bp, Artificial
  CRISPR gRNA sequence
ggactctgccccctttgctc

SEQ ID NO: 515747 - DNA, 20 bp, Artificial
  CRISPR gRNA sequence
ctcctcccctgtcctgaccg

SEQ ID NO: 515748 - DNA, 20 bp, Artificial
  CRISPR gRNA sequence
cgcagtgccaatccacgtcc

SEQ ID NO: 515749 - DNA, 20 bp, Artificial
  CRISPR gRNA sequence
agtgccaatccacgtcctgg

SEQ ID NO: 515750 - DNA, 20 bp, Artificial
  CRISPR gRNA sequence
gccaatccacgtcctggtgg

SEQ ID NO: 515751 - DNA, 20 bp, Artificial
  CRISPR gRNA sequence
gcagtgcccttcctcacctt

SEQ ID NO: 515752 - DNA, 20 bp, Artificial
  CRISPR gRNA sequence
cagtgcccttcctcaccttc

SEQ ID NO: 515753 - DNA, 20 bp, Artificial
  CRISPR gRNA sequence
cttcaggtccctgctgcccc

SEQ ID NO: 515754 - DNA, 20 bp, Artificial
  CRISPR gRNA sequence
cccagcctcctcccatatct

SEQ ID NO: 515755 - DNA, 20 bp, Artificial
  CRISPR gRNA sequence
ccagcctcctcccatatctc

SEQ ID NO: 515756 - DNA, 20 bp, Artificial
  CRISPR gRNA sequence
cccatatctcaggacaatga

SEQ ID NO: 515757 - DNA, 20 bp, Artificial
  CRISPR gRNA sequence
caggacaatgatggtctctg

SEQ ID NO: 515758 - DNA, 20 bp, Artificial
  CRISPR gRNA sequence
aatgatggtctctgtggtct

SEQ ID NO: 515759 - DNA, 20 bp, Artificial
  CRISPR gRNA sequence
gatggtctctgtggtcttgg

SEQ ID NO: 515760 - DNA, 20 bp, Artificial
  CRISPR gRNA sequence
ctgttgctgtcctcgtgcct

SEQ ID NO: 515761 - DNA, 20 bp, Artificial
  CRISPR gRNA sequence
ttgctgtcctcgtgcctcag

SEQ ID NO: 515762 - DNA, 20 bp, Artificial
  CRISPR gRNA sequence
ggccaccccgcccactgtcc

SEQ ID NO: 515763 - DNA, 20 bp, Artificial
  CRISPR gRNA sequence
gccaccccgcccactgtcct

SEQ ID NO: 515764 - DNA, 20 bp, Artificial
  CRISPR gRNA sequence
cgcccactgtcctgggtgtg

SEQ ID NO: 515765 - DNA, 20 bp, Artificial
  CRISPR gRNA sequence
ctgtcctgggtgtgcagccc

SEQ ID NO: 515766 - DNA, 20 bp, Artificial
  CRISPR gRNA sequence
tgtcctgggtgtgcagccct

SEQ ID NO: 515767 - DNA, 20 bp, Artificial
  CRISPR gRNA sequence
gtcctgggtgtgcagccctg

SEQ ID NO: 515768 - DNA, 20 bp, Artificial
  CRISPR gRNA sequence
ctgggtgtgcagccctgggg

SEQ ID NO: 515769 - DNA, 20 bp, Artificial
  CRISPR gRNA sequence
gccctggggcggcctcttca

SEQ ID NO: 515770 - DNA, 20 bp, Artificial
  CRISPR gRNA sequence
ccctggggcggcctcttcac

SEQ ID NO: 515771 - DNA, 20 bp, Artificial
  CRISPR gRNA sequence
gcggcctcttcacgggactg

SEQ ID NO: 515772 - DNA, 20 bp, Artificial
  CRISPR gRNA sequence
cggcctcttcacgggactgt

SEQ ID NO: 515773 - DNA, 20 bp, Artificial
  CRISPR gRNA sequence
ggcctcttcacgggactgta

SEQ ID NO: 515774 - DNA, 20 bp, Artificial
  CRISPR gRNA sequence
gcctcttcacgggactgtag

SEQ ID NO: 515775 - DNA, 20 bp, Artificial
  CRISPR gRNA sequence
acgggactgtaggggtgact

SEQ ID NO: 515776 - DNA, 20 bp, Artificial
  CRISPR gRNA sequence
gactgtaggggtgactcagt

SEQ ID NO: 515777 - DNA, 20 bp, Artificial
  CRISPR gRNA sequence
ggtgactcagtcggaacact

SEQ ID NO: 515778 - DNA, 20 bp, Artificial
  CRISPR gRNA sequence
gactcagtcggaacacttgg

SEQ ID NO: 515779 - DNA, 20 bp, Artificial
  CRISPR gRNA sequence
actcagtcggaacacttggc

SEQ ID NO: 515780 - DNA, 20 bp, Artificial
  CRISPR gRNA sequence
tcggaacacttggcaggtgt

SEQ ID NO: 515781 - DNA, 20 bp, Artificial
  CRISPR gRNA sequence
cggaacacttggcaggtgtc

SEQ ID NO: 515782 - DNA, 20 bp, Artificial
  CRISPR gRNA sequence
ggaacacttggcaggtgtcg

SEQ ID NO: 515783 - DNA, 20 bp, Artificial
  CRISPR gRNA sequence
gaacacttggcaggtgtcgg

SEQ ID NO: 515784 - DNA, 20 bp, Artificial
  CRISPR gRNA sequence
aacacttggcaggtgtcggg

SEQ ID NO: 515785 - DNA, 20 bp, Artificial
  CRISPR gRNA sequence
tgtcggggggtgccctgcca

SEQ ID NO: 515786 - DNA, 20 bp, Artificial
  CRISPR gRNA sequence
gtcggggggtgccctgccac

SEQ ID NO: 515787 - DNA, 20 bp, Artificial
  CRISPR gRNA sequence
ggtgccctgccacaggtact

SEQ ID NO: 515788 - DNA, 20 bp, Artificial
  CRISPR gRNA sequence
gccacaggtactcagacact

SEQ ID NO: 515789 - DNA, 20 bp, Artificial
  CRISPR gRNA sequence
tactcagacactcggtcctg

SEQ ID NO: 515790 - DNA, 20 bp, Artificial
  CRISPR gRNA sequence
ggtcctgcagcttcctcctc

SEQ ID NO: 515791 - DNA, 20 bp, Artificial
  CRISPR gRNA sequence
gtcctgcagcttcctcctct

SEQ ID NO: 515792 - DNA, 20 bp, Artificial
  CRISPR gRNA sequence
tcctgcagcttcctcctctg

SEQ ID NO: 515793 - DNA, 20 bp, Artificial
  CRISPR gRNA sequence
ctgcagcttcctcctctggg

SEQ ID NO: 515794 - DNA, 20 bp, Artificial
  CRISPR gRNA sequence
cagcttcctcctctggggag

SEQ ID NO: 515795 - DNA, 20 bp, Artificial
  CRISPR gRNA sequence
agcttcctcctctggggagc

SEQ ID NO: 515796 - DNA, 20 bp, Artificial
  CRISPR gRNA sequence
cttcctcctctggggagcag

SEQ ID NO: 515797 - DNA, 20 bp, Artificial
  CRISPR gRNA sequence
tcctcctctggggagcagga

SEQ ID NO: 515798 - DNA, 20 bp, Artificial
  CRISPR gRNA sequence
ctggggagcaggagagcccg

SEQ ID NO: 515799 - DNA, 20 bp, Artificial
  CRISPR gRNA sequence
gggagcaggagagcccgtgg

SEQ ID NO: 515800 - DNA, 20 bp, Artificial
  CRISPR gRNA sequence
cccgtggcagtgccgtctct

SEQ ID NO: 515801 - DNA, 20 bp, Artificial
  CRISPR gRNA sequence
ccgtggcagtgccgtctctg

SEQ ID NO: 515802 - DNA, 20 bp, Artificial
  CRISPR gRNA sequence
tgccgtctctgaggatgcct

SEQ ID NO: 515803 - DNA, 20 bp, Artificial
  CRISPR gRNA sequence
gccgtctctgaggatgcctc

SEQ ID NO: 515804 - DNA, 20 bp, Artificial
  CRISPR gRNA sequence
ccgtctctgaggatgcctca

SEQ ID NO: 515805 - DNA, 20 bp, Artificial
  CRISPR gRNA sequence
aggatgcctcagggtgtgtg

SEQ ID NO: 515806 - DNA, 20 bp, Artificial
  CRISPR gRNA sequence
tgtgtgtggctcctgcctgc

SEQ ID NO: 515807 - DNA, 20 bp, Artificial
  CRISPR gRNA sequence
gtgtggctcctgcctgccag

SEQ ID NO: 515808 - DNA, 20 bp, Artificial
  CRISPR gRNA sequence
gcctgccagcggcttgatgc

SEQ ID NO: 515809 - DNA, 20 bp, Artificial
  CRISPR gRNA sequence
ccctgcattctcccacaacc

SEQ ID NO: 515810 - DNA, 20 bp, Artificial
  CRISPR gRNA sequence
tctcccacaacctggcctgt

SEQ ID NO: 515811 - DNA, 20 bp, Artificial
  CRISPR gRNA sequence
ggcctgtcagtgcacgaacg

SEQ ID NO: 515812 - DNA, 20 bp, Artificial
  CRISPR gRNA sequence
gcctgtcagtgcacgaacgc

SEQ ID NO: 515813 - DNA, 20 bp, Artificial
  CRISPR gRNA sequence
ctgtcagtgcacgaacgcag

SEQ ID NO: 515814 - DNA, 20 bp, Artificial
  CRISPR gRNA sequence
tgtcagtgcacgaacgcagg

SEQ ID NO: 515815 - DNA, 20 bp, Artificial
  CRISPR gRNA sequence
gtcagtgcacgaacgcagga

SEQ ID NO: 515816 - DNA, 20 bp, Artificial
  CRISPR gRNA sequence
cagtgcacgaacgcaggagg

SEQ ID NO: 515817 - DNA, 20 bp, Artificial
  CRISPR gRNA sequence
agtgcacgaacgcaggaggg

SEQ ID NO: 515818 - DNA, 20 bp, Artificial
  CRISPR gRNA sequence
gtgcacgaacgcaggaggga

SEQ ID NO: 515819 - DNA, 20 bp, Artificial
  CRISPR gRNA sequence
cacgaacgcaggagggaggg

SEQ ID NO: 515820 - DNA, 20 bp, Artificial
  CRISPR gRNA sequence
acgaacgcaggagggagggc

SEQ ID NO: 515821 - DNA, 20 bp, Artificial
  CRISPR gRNA sequence
cgaacgcaggagggagggcg

SEQ ID NO: 515822 - DNA, 20 bp, Artificial
  CRISPR gRNA sequence
caggagggagggcggggctg

SEQ ID NO: 515823 - DNA, 20 bp, Artificial
  CRISPR gRNA sequence
gagggagggcggggctgtgg

SEQ ID NO: 515824 - DNA, 20 bp, Artificial
  CRISPR gRNA sequence
agggagggcggggctgtggc

SEQ ID NO: 515825 - DNA, 20 bp, Artificial
  CRISPR gRNA sequence
ggagggcggggctgtggcag

SEQ ID NO: 515826 - DNA, 20 bp, Artificial
  CRISPR gRNA sequence
gagggcggggctgtggcagg

SEQ ID NO: 515827 - DNA, 20 bp, Artificial
  CRISPR gRNA sequence
ggcggggctgtggcaggagg

SEQ ID NO: 515828 - DNA, 20 bp, Artificial
  CRISPR gRNA sequence
ctgtggcaggaggcagtgcc

SEQ ID NO: 515829 - DNA, 20 bp, Artificial
  CRISPR gRNA sequence
aggcagtgccgagtccccac

SEQ ID NO: 515830 - DNA, 20 bp, Artificial
  CRISPR gRNA sequence
agtccccactggccaccatg

SEQ ID NO: 515831 - DNA, 20 bp, Artificial
  CRISPR gRNA sequence
gtccccactggccaccatgt

SEQ ID NO: 515832 - DNA, 20 bp, Artificial
  CRISPR gRNA sequence
tccccactggccaccatgtg

SEQ ID NO: 515833 - DNA, 20 bp, Artificial
  CRISPR gRNA sequence
tggccaccatgtggggcacg

SEQ ID NO: 515834 - DNA, 20 bp, Artificial
  CRISPR gRNA sequence
ggccaccatgtggggcacgc

SEQ ID NO: 515835 - DNA, 20 bp, Artificial
  CRISPR gRNA sequence
ccaccatgtggggcacgcag

SEQ ID NO: 515836 - DNA, 20 bp, Artificial
  CRISPR gRNA sequence
ccatgtggggcacgcaggag

SEQ ID NO: 515837 - DNA, 20 bp, Artificial
  CRISPR gRNA sequence
gggcacgcaggagcagacac

SEQ ID NO: 515838 - DNA, 20 bp, Artificial
  CRISPR gRNA sequence
gagcagacaccagccactca

SEQ ID NO: 515839 - DNA, 20 bp, Artificial
  CRISPR gRNA sequence
gcagacaccagccactcaca

SEQ ID NO: 515840 - DNA, 20 bp, Artificial
  CRISPR gRNA sequence
accagccactcacagagcac

SEQ ID NO: 515841 - DNA, 20 bp, Artificial
  CRISPR gRNA sequence
ctcacagagcaccggtatcg

SEQ ID NO: 515842 - DNA, 20 bp, Artificial
  CRISPR gRNA sequence
agagcaccggtatcgcagca

SEQ ID NO: 515843 - DNA, 20 bp, Artificial
  CRISPR gRNA sequence
gagcaccggtatcgcagcac

SEQ ID NO: 515844 - DNA, 20 bp, Artificial
  CRISPR gRNA sequence
cgcagcacaggccatgtgca

SEQ ID NO: 515845 - DNA, 20 bp, Artificial
  CRISPR gRNA sequence
ccatgtgcatggctgcaaca

SEQ ID NO: 515846 - DNA, 20 bp, Artificial
  CRISPR gRNA sequence
atggctgcaacacagctcca

SEQ ID NO: 515847 - DNA, 20 bp, Artificial
  CRISPR gRNA sequence
ctgcaacacagctccacagt

SEQ ID NO: 515848 - DNA, 20 bp, Artificial
  CRISPR gRNA sequence
agctccacagtgagcctgcc

SEQ ID NO: 515849 - DNA, 20 bp, Artificial
  CRISPR gRNA sequence
ctgccgagccactgcatgcg

SEQ ID NO: 515850 - DNA, 20 bp, Artificial
  CRISPR gRNA sequence
tgccgagccactgcatgcgc

SEQ ID NO: 515851 - DNA, 20 bp, Artificial
  CRISPR gRNA sequence
agccactgcatgcgcaggcc

SEQ ID NO: 515852 - DNA, 20 bp, Artificial
  CRISPR gRNA sequence
gccactgcatgcgcaggcca

SEQ ID NO: 515853 - DNA, 20 bp, Artificial
  CRISPR gRNA sequence
ctgcatgcgcaggccaaggc

SEQ ID NO: 515854 - DNA, 20 bp, Artificial
  CRISPR gRNA sequence
tgcatgcgcaggccaaggcc

SEQ ID NO: 515855 - DNA, 20 bp, Artificial
  CRISPR gRNA sequence
ccaggtgtctgctttcccct

SEQ ID NO: 515856 - DNA, 20 bp, Artificial
  CRISPR gRNA sequence
caggtgtctgctttcccctc

SEQ ID NO: 515857 - DNA, 20 bp, Artificial
  CRISPR gRNA sequence
gctttcccctcgggacatcc

SEQ ID NO: 515858 - DNA, 20 bp, Artificial
  CRISPR gRNA sequence
ctttcccctcgggacatcct

SEQ ID NO: 515859 - DNA, 20 bp, Artificial
  CRISPR gRNA sequence
tttcccctcgggacatcctg

SEQ ID NO: 515860 - DNA, 20 bp, Artificial
  CRISPR gRNA sequence
tcccctcgggacatcctggg

SEQ ID NO: 515861 - DNA, 20 bp, Artificial
  CRISPR gRNA sequence
cccctcgggacatcctgggg

SEQ ID NO: 515862 - DNA, 20 bp, Artificial
  CRISPR gRNA sequence
ccctcgggacatcctgggga

SEQ ID NO: 515863 - DNA, 20 bp, Artificial
  CRISPR gRNA sequence
gacatcctggggagggaacg

SEQ ID NO: 515864 - DNA, 20 bp, Artificial
  CRISPR gRNA sequence
acatcctggggagggaacgc

SEQ ID NO: 515865 - DNA, 20 bp, Artificial
  CRISPR gRNA sequence
catcctggggagggaacgcg

SEQ ID NO: 515866 - DNA, 20 bp, Artificial
  CRISPR gRNA sequence
gcggggcccctgcacgtttt

SEQ ID NO: 515867 - DNA, 20 bp, Artificial
  CRISPR gRNA sequence
ctgcacgttttgagcacatt

SEQ ID NO: 515868 - DNA, 20 bp, Artificial
  CRISPR gRNA sequence
ttttgagcacatttagtccg

SEQ ID NO: 515869 - DNA, 20 bp, Artificial
  CRISPR gRNA sequence
gagcacatttagtccgtggc

SEQ ID NO: 515870 - DNA, 20 bp, Artificial
  CRISPR gRNA sequence
tttagtccgtggcaagtgct

SEQ ID NO: 515871 - DNA, 20 bp, Artificial
  CRISPR gRNA sequence
agtccgtggcaagtgctcag

SEQ ID NO: 515872 - DNA, 20 bp, Artificial
  CRISPR gRNA sequence
gtccgtggcaagtgctcagt

SEQ ID NO: 515873 - DNA, 20 bp, Artificial
  CRISPR gRNA sequence
gcaagtgctcagtaggcctc

SEQ ID NO: 515874 - DNA, 20 bp, Artificial
  CRISPR gRNA sequence
caagtgctcagtaggcctcg

SEQ ID NO: 515875 - DNA, 20 bp, Artificial
  CRISPR gRNA sequence
tgctcagtaggcctcgagga

SEQ ID NO: 515876 - DNA, 20 bp, Artificial
  CRISPR gRNA sequence
gaggaaagcaaaatgtgcca

SEQ ID NO: 515877 - DNA, 20 bp, Artificial
  CRISPR gRNA sequence
aggaaagcaaaatgtgccat

SEQ ID NO: 515878 - DNA, 20 bp, Artificial
  CRISPR gRNA sequence
ggaaagcaaaatgtgccata

SEQ ID NO: 515879 - DNA, 20 bp, Artificial
  CRISPR gRNA sequence
gaaagcaaaatgtgccatag

SEQ ID NO: 515880 - DNA, 20 bp, Artificial
  CRISPR gRNA sequence
ccataggggtgttctccacc

SEQ ID NO: 515881 - DNA, 20 bp, Artificial
  CRISPR gRNA sequence
cataggggtgttctccacca

SEQ ID NO: 515882 - DNA, 20 bp, Artificial
  CRISPR gRNA sequence
ataggggtgttctccaccaa

SEQ ID NO: 515883 - DNA, 20 bp, Artificial
  CRISPR gRNA sequence
gggtgttctccaccaagggc

SEQ ID NO: 515884 - DNA, 20 bp, Artificial
  CRISPR gRNA sequence
ggtgttctccaccaagggca

SEQ ID NO: 515885 - DNA, 20 bp, Artificial
  CRISPR gRNA sequence
gtgttctccaccaagggcaa

SEQ ID NO: 515886 - DNA, 20 bp, Artificial
  CRISPR gRNA sequence
tgttctccaccaagggcaag

SEQ ID NO: 515887 - DNA, 20 bp, Artificial
  CRISPR gRNA sequence
tccaccaagggcaaggggcc

SEQ ID NO: 515888 - DNA, 20 bp, Artificial
  CRISPR gRNA sequence
caccaagggcaaggggcctg

SEQ ID NO: 515889 - DNA, 20 bp, Artificial
  CRISPR gRNA sequence
accaagggcaaggggcctgg

SEQ ID NO: 515890 - DNA, 20 bp, Artificial
  CRISPR gRNA sequence
agggcaaggggcctggagga

SEQ ID NO: 515891 - DNA, 20 bp, Artificial
  CRISPR gRNA sequence
gggcaaggggcctggaggac

SEQ ID NO: 515892 - DNA, 20 bp, Artificial
  CRISPR gRNA sequence
ggcaaggggcctggaggaca

SEQ ID NO: 515893 - DNA, 20 bp, Artificial
  CRISPR gRNA sequence
aaggggcctggaggacaggg

SEQ ID NO: 515894 - DNA, 20 bp, Artificial
  CRISPR gRNA sequence
tgtcccttgtcccacatcac

SEQ ID NO: 515895 - DNA, 20 bp, Artificial
  CRISPR gRNA sequence
gtcccttgtcccacatcact

SEQ ID NO: 515896 - DNA, 20 bp, Artificial
  CRISPR gRNA sequence
tcccttgtcccacatcactg

SEQ ID NO: 515897 - DNA, 20 bp, Artificial
  CRISPR gRNA sequence
cccttgtcccacatcactgg

SEQ ID NO: 515898 - DNA, 20 bp, Artificial
  CRISPR gRNA sequence
ccttgtcccacatcactggg

SEQ ID NO: 515899 - DNA, 20 bp, Artificial
  CRISPR gRNA sequence
ttgtcccacatcactggggg

SEQ ID NO: 515900 - DNA, 20 bp, Artificial
  CRISPR gRNA sequence
cactggggggagcctgacct

SEQ ID NO: 515901 - DNA, 20 bp, Artificial
  CRISPR gRNA sequence
actggggggagcctgacctt

SEQ ID NO: 515902 - DNA, 20 bp, Artificial
  CRISPR gRNA sequence
ctggggggagcctgaccttg

SEQ ID NO: 515903 - DNA, 20 bp, Artificial
  CRISPR gRNA sequence
cttggggcccctcctgtccc

SEQ ID NO: 515904 - DNA, 20 bp, Artificial
  CRISPR gRNA sequence
ttggggcccctcctgtcccc

SEQ ID NO: 515905 - DNA, 20 bp, Artificial
  CRISPR gRNA sequence
cctgtccccaggtgtgacac

SEQ ID NO: 515906 - DNA, 20 bp, Artificial
  CRISPR gRNA sequence
aggtgtgacactggctacat

SEQ ID NO: 515907 - DNA, 20 bp, Artificial
  CRISPR gRNA sequence
ggtgtgacactggctacatt

SEQ ID NO: 515908 - DNA, 20 bp, Artificial
  CRISPR gRNA sequence
gctacattgggaaaaactgt

SEQ ID NO: 515909 - DNA, 20 bp, Artificial
  CRISPR gRNA sequence
ttgggaaaaactgtgagtgc

SEQ ID NO: 515910 - DNA, 20 bp, Artificial
  CRISPR gRNA sequence
aaaactgtgagtgccagaca

SEQ ID NO: 515911 - DNA, 20 bp, Artificial
  CRISPR gRNA sequence
aaactgtgagtgccagacac

SEQ ID NO: 515912 - DNA, 20 bp, Artificial
  CRISPR gRNA sequence
aactgtgagtgccagacaca

SEQ ID NO: 515913 - DNA, 20 bp, Artificial
  CRISPR gRNA sequence
gtgagtgccagacacagggc

SEQ ID NO: 515914 - DNA, 20 bp, Artificial
  CRISPR gRNA sequence
gagtgccagacacagggccg

SEQ ID NO: 515915 - DNA, 20 bp, Artificial
  CRISPR gRNA sequence
tgccagacacagggccggag

SEQ ID NO: 515916 - DNA, 20 bp, Artificial
  CRISPR gRNA sequence
agacacagggccggagcagc

SEQ ID NO: 515917 - DNA, 20 bp, Artificial
  CRISPR gRNA sequence
gacacagggccggagcagcc

SEQ ID NO: 515918 - DNA, 20 bp, Artificial
  CRISPR gRNA sequence
cacagggccggagcagccag

SEQ ID NO: 515919 - DNA, 20 bp, Artificial
  CRISPR gRNA sequence
gggccggagcagccaggagc

SEQ ID NO: 515920 - DNA, 20 bp, Artificial
  CRISPR gRNA sequence
ccggagcagccaggagctgg

SEQ ID NO: 515921 - DNA, 20 bp, Artificial
  CRISPR gRNA sequence
cggagcagccaggagctgga

SEQ ID NO: 515922 - DNA, 20 bp, Artificial
  CRISPR gRNA sequence
agcagccaggagctggaagg

SEQ ID NO: 515923 - DNA, 20 bp, Artificial
  CRISPR gRNA sequence
aggagctggaaggaagctgc

SEQ ID NO: 515924 - DNA, 20 bp, Artificial
  CRISPR gRNA sequence
agctggaaggaagctgccgg

SEQ ID NO: 515925 - DNA, 20 bp, Artificial
  CRISPR gRNA sequence
gctggaaggaagctgccgga

SEQ ID NO: 515926 - DNA, 20 bp, Artificial
  CRISPR gRNA sequence
caacaactccatcatctgct

SEQ ID NO: 515927 - DNA, 20 bp, Artificial
  CRISPR gRNA sequence
aacaactccatcatctgctc

SEQ ID NO: 515928 - DNA, 20 bp, Artificial
  CRISPR gRNA sequence
acaactccatcatctgctca

SEQ ID NO: 515929 - DNA, 20 bp, Artificial
  CRISPR gRNA sequence
ctccatcatctgctcagggc

SEQ ID NO: 515930 - DNA, 20 bp, Artificial
  CRISPR gRNA sequence
tccatcatctgctcagggct

SEQ ID NO: 515931 - DNA, 20 bp, Artificial
  CRISPR gRNA sequence
ccatcatctgctcagggctg

SEQ ID NO: 515932 - DNA, 20 bp, Artificial
  CRISPR gRNA sequence
catcatctgctcagggctgg

SEQ ID NO: 515933 - DNA, 20 bp, Artificial
  CRISPR gRNA sequence
gggctgggggactgtgtctg

SEQ ID NO: 515934 - DNA, 20 bp, Artificial
  CRISPR gRNA sequence
ggctgggggactgtgtctgc

SEQ ID NO: 515935 - DNA, 20 bp, Artificial
  CRISPR gRNA sequence
tgggggactgtgtctgcggg

SEQ ID NO: 515936 - DNA, 20 bp, Artificial
  CRISPR gRNA sequence
gggcagtgcctgtgccacac

SEQ ID NO: 515937 - DNA, 20 bp, Artificial
  CRISPR gRNA sequence
tgccacaccagcgacgtccc

SEQ ID NO: 515938 - DNA, 20 bp, Artificial
  CRISPR gRNA sequence
acaccagcgacgtccccggc

SEQ ID NO: 515939 - DNA, 20 bp, Artificial
  CRISPR gRNA sequence
gtccccggcaagctgatata

SEQ ID NO: 515940 - DNA, 20 bp, Artificial
  CRISPR gRNA sequence
tccccggcaagctgatatac

SEQ ID NO: 515941 - DNA, 20 bp, Artificial
  CRISPR gRNA sequence
ccggcaagctgatatacggg

SEQ ID NO: 515942 - DNA, 20 bp, Artificial
  CRISPR gRNA sequence
tgatatacgggcagtactgc

SEQ ID NO: 515943 - DNA, 20 bp, Artificial
  CRISPR gRNA sequence
agtgtgacaccatcaactgt

SEQ ID NO: 515944 - DNA, 20 bp, Artificial
  CRISPR gRNA sequence
atcaactgtgagcgctacaa

SEQ ID NO: 515945 - DNA, 20 bp, Artificial
  CRISPR gRNA sequence
actgtgagcgctacaacggc

SEQ ID NO: 515946 - DNA, 20 bp, Artificial
  CRISPR gRNA sequence
ctgtgagcgctacaacggcc

SEQ ID NO: 515947 - DNA, 20 bp, Artificial
  CRISPR gRNA sequence
cgctacaacggccaggtctg

SEQ ID NO: 515948 - DNA, 20 bp, Artificial
  CRISPR gRNA sequence
tacaacggccaggtctgcgg

SEQ ID NO: 515949 - DNA, 20 bp, Artificial
  CRISPR gRNA sequence
cggccaggtctgcggcggcc

SEQ ID NO: 515950 - DNA, 20 bp, Artificial
  CRISPR gRNA sequence
ggccaggtctgcggcggccc

SEQ ID NO: 515951 - DNA, 20 bp, Artificial
  CRISPR gRNA sequence
aggtctgcggcggcccgggt

SEQ ID NO: 515952 - DNA, 20 bp, Artificial
  CRISPR gRNA sequence
cggcggcccgggtgagcccg

SEQ ID NO: 515953 - DNA, 20 bp, Artificial
  CRISPR gRNA sequence
ggcggcccgggtgagcccgt

SEQ ID NO: 515954 - DNA, 20 bp, Artificial
  CRISPR gRNA sequence
gtgagcccgtgggtccctgc

SEQ ID NO: 515955 - DNA, 20 bp, Artificial
  CRISPR gRNA sequence
cgtgggtccctgctggacaa

SEQ ID NO: 515956 - DNA, 20 bp, Artificial
  CRISPR gRNA sequence
gctggacaacggccgtcctg

SEQ ID NO: 515957 - DNA, 20 bp, Artificial
  CRISPR gRNA sequence
acaacggccgtcctgcggca

SEQ ID NO: 515958 - DNA, 20 bp, Artificial
  CRISPR gRNA sequence
gccgtcctgcggcacagact

SEQ ID NO: 515959 - DNA, 20 bp, Artificial
  CRISPR gRNA sequence
ctgcggcacagacttggtgt

SEQ ID NO: 515960 - DNA, 20 bp, Artificial
  CRISPR gRNA sequence
tgcggcacagacttggtgtt

SEQ ID NO: 515961 - DNA, 20 bp, Artificial
  CRISPR gRNA sequence
gcggcacagacttggtgttg

SEQ ID NO: 515962 - DNA, 20 bp, Artificial
  CRISPR gRNA sequence
cggcacagacttggtgttgg

SEQ ID NO: 515963 - DNA, 20 bp, Artificial
  CRISPR gRNA sequence
ggcacagacttggtgttggg

SEQ ID NO: 515964 - DNA, 20 bp, Artificial
  CRISPR gRNA sequence
tggtgttggggggtgcgttc

SEQ ID NO: 515965 - DNA, 20 bp, Artificial
  CRISPR gRNA sequence
tgcgttctggaccattcaac

SEQ ID NO: 515966 - DNA, 20 bp, Artificial
  CRISPR gRNA sequence
gttctggaccattcaacgag

SEQ ID NO: 515967 - DNA, 20 bp, Artificial
  CRISPR gRNA sequence
ggaccattcaacgagtggaa

SEQ ID NO: 515968 - DNA, 20 bp, Artificial
  CRISPR gRNA sequence
cattcaacgagtggaacaga

SEQ ID NO: 515969 - DNA, 20 bp, Artificial
  CRISPR gRNA sequence
attcaacgagtggaacagaa

SEQ ID NO: 515970 - DNA, 20 bp, Artificial
  CRISPR gRNA sequence
ttcaacgagtggaacagaaa

SEQ ID NO: 515971 - DNA, 20 bp, Artificial
  CRISPR gRNA sequence
tcaacgagtggaacagaaag

SEQ ID NO: 515972 - DNA, 20 bp, Artificial
  CRISPR gRNA sequence
caacgagtggaacagaaagg

SEQ ID NO: 515973 - DNA, 20 bp, Artificial
  CRISPR gRNA sequence
aacgagtggaacagaaaggg

SEQ ID NO: 515974 - DNA, 20 bp, Artificial
  CRISPR gRNA sequence
gaacagaaaggggggatcct

SEQ ID NO: 515975 - DNA, 20 bp, Artificial
  CRISPR gRNA sequence
aacagaaaggggggatcctg

SEQ ID NO: 515976 - DNA, 20 bp, Artificial
  CRISPR gRNA sequence
gaaaggggggatcctgagga

SEQ ID NO: 515977 - DNA, 20 bp, Artificial
  CRISPR gRNA sequence
ggggggatcctgaggacaga

SEQ ID NO: 515978 - DNA, 20 bp, Artificial
  CRISPR gRNA sequence
atcctgaggacagacagtgc

SEQ ID NO: 515979 - DNA, 20 bp, Artificial
  CRISPR gRNA sequence
cagacagtgcaagtctcgcc

SEQ ID NO: 515980 - DNA, 20 bp, Artificial
  CRISPR gRNA sequence
tgcaagtctcgcccagccac

SEQ ID NO: 515981 - DNA, 20 bp, Artificial
  CRISPR gRNA sequence
gcaagtctcgcccagccacc

SEQ ID NO: 515982 - DNA, 20 bp, Artificial
  CRISPR gRNA sequence
ctcgcccagccaccgggcgt

SEQ ID NO: 515983 - DNA, 20 bp, Artificial
  CRISPR gRNA sequence
gcccagccaccgggcgtcag

SEQ ID NO: 515984 - DNA, 20 bp, Artificial
  CRISPR gRNA sequence
cccagccaccgggcgtcagc

SEQ ID NO: 515985 - DNA, 20 bp, Artificial
  CRISPR gRNA sequence
accgggcgtcagcaggaact

SEQ ID NO: 515986 - DNA, 20 bp, Artificial
  CRISPR gRNA sequence
ggcgtcagcaggaacttgga

SEQ ID NO: 515987 - DNA, 20 bp, Artificial
  CRISPR gRNA sequence
ccctgcaccccgccctgcct

SEQ ID NO: 515988 - DNA, 20 bp, Artificial
  CRISPR gRNA sequence
gcctcagtttctgtgtccat

SEQ ID NO: 515989 - DNA, 20 bp, Artificial
  CRISPR gRNA sequence
cctcagtttctgtgtccatg

SEQ ID NO: 515990 - DNA, 20 bp, Artificial
  CRISPR gRNA sequence
gtttctgtgtccatgaggac

SEQ ID NO: 515991 - DNA, 20 bp, Artificial
  CRISPR gRNA sequence
tttctgtgtccatgaggaca

SEQ ID NO: 515992 - DNA, 20 bp, Artificial
  CRISPR gRNA sequence
atgaggacaaggcgtccttg

SEQ ID NO: 515993 - DNA, 20 bp, Artificial
  CRISPR gRNA sequence
tgaggacaaggcgtccttgt

SEQ ID NO: 515994 - DNA, 20 bp, Artificial
  CRISPR gRNA sequence
gaggacaaggcgtccttgtg

SEQ ID NO: 515995 - DNA, 20 bp, Artificial
  CRISPR gRNA sequence
ggacaaggcgtccttgtggg

SEQ ID NO: 515996 - DNA, 20 bp, Artificial
  CRISPR gRNA sequence
gacaaggcgtccttgtgggg

SEQ ID NO: 515997 - DNA, 20 bp, Artificial
  CRISPR gRNA sequence
acaaggcgtccttgtgggga

SEQ ID NO: 515998 - DNA, 20 bp, Artificial
  CRISPR gRNA sequence
gtccttgtggggagggccca

SEQ ID NO: 515999 - DNA, 20 bp, Artificial
  CRISPR gRNA sequence
tccttgtggggagggcccac

SEQ ID NO: 516000 - DNA, 20 bp, Artificial
  CRISPR gRNA sequence
cttgtggggagggcccacag

SEQ ID NO: 516001 - DNA, 20 bp, Artificial
  CRISPR gRNA sequence
ttgtggggagggcccacagg

SEQ ID NO: 516002 - DNA, 20 bp, Artificial
  CRISPR gRNA sequence
gggagggcccacaggaggaa

SEQ ID NO: 516003 - DNA, 20 bp, Artificial
  CRISPR gRNA sequence
gcccacaggaggaacggtca

SEQ ID NO: 516004 - DNA, 20 bp, Artificial
  CRISPR gRNA sequence
ggaacggtcatagccctatt

SEQ ID NO: 516005 - DNA, 20 bp, Artificial
  CRISPR gRNA sequence
gaacggtcatagccctattg

SEQ ID NO: 516006 - DNA, 20 bp, Artificial
  CRISPR gRNA sequence
ccctattgaggtcccattca

SEQ ID NO: 516007 - DNA, 20 bp, Artificial
  CRISPR gRNA sequence
tattgaggtcccattcacag

SEQ ID NO: 516008 - DNA, 20 bp, Artificial
  CRISPR gRNA sequence
attgaggtcccattcacagc

SEQ ID NO: 516009 - DNA, 20 bp, Artificial
  CRISPR gRNA sequence
ttgaggtcccattcacagca

SEQ ID NO: 516010 - DNA, 20 bp, Artificial
  CRISPR gRNA sequence
aggtcccattcacagcaggg

SEQ ID NO: 516011 - DNA, 20 bp, Artificial
  CRISPR gRNA sequence
ggtcccattcacagcagggc

SEQ ID NO: 516012 - DNA, 20 bp, Artificial
  CRISPR gRNA sequence
gtcccattcacagcagggca

SEQ ID NO: 516013 - DNA, 20 bp, Artificial
  CRISPR gRNA sequence
tcccattcacagcagggcag

SEQ ID NO: 516014 - DNA, 20 bp, Artificial
  CRISPR gRNA sequence
ccattcacagcagggcaggg

SEQ ID NO: 516015 - DNA, 20 bp, Artificial
  CRISPR gRNA sequence
cattcacagcagggcagggg

SEQ ID NO: 516016 - DNA, 20 bp, Artificial
  CRISPR gRNA sequence
acagcagggcaggggaggtc

SEQ ID NO: 516017 - DNA, 20 bp, Artificial
  CRISPR gRNA sequence
agggcaggggaggtccagac

SEQ ID NO: 516018 - DNA, 20 bp, Artificial
  CRISPR gRNA sequence
caggggaggtccagactggc

SEQ ID NO: 516019 - DNA, 20 bp, Artificial
  CRISPR gRNA sequence
aggggaggtccagactggcc

SEQ ID NO: 516020 - DNA, 20 bp, Artificial
  CRISPR gRNA sequence
gggaggtccagactggccag

SEQ ID NO: 516021 - DNA, 20 bp, Artificial
  CRISPR gRNA sequence
ggaggtccagactggccagg

SEQ ID NO: 516022 - DNA, 20 bp, Artificial
  CRISPR gRNA sequence
ggtccagactggccaggagg

SEQ ID NO: 516023 - DNA, 20 bp, Artificial
  CRISPR gRNA sequence
ctggccaggaggcggccacg

SEQ ID NO: 516024 - DNA, 20 bp, Artificial
  CRISPR gRNA sequence
ccaggaggcggccacgtggc

SEQ ID NO: 516025 - DNA, 20 bp, Artificial
  CRISPR gRNA sequence
ggaggcggccacgtggctgg

SEQ ID NO: 516026 - DNA, 20 bp, Artificial
  CRISPR gRNA sequence
gaggcggccacgtggctggc

SEQ ID NO: 516027 - DNA, 20 bp, Artificial
  CRISPR gRNA sequence
aggcggccacgtggctggcg

SEQ ID NO: 516028 - DNA, 20 bp, Artificial
  CRISPR gRNA sequence
ggcggccacgtggctggcgg

SEQ ID NO: 516029 - DNA, 20 bp, Artificial
  CRISPR gRNA sequence
ggccacgtggctggcggggg

SEQ ID NO: 516030 - DNA, 20 bp, Artificial
  CRISPR gRNA sequence
cacgtggctggcgggggcag

SEQ ID NO: 516031 - DNA, 20 bp, Artificial
  CRISPR gRNA sequence
acgtggctggcgggggcaga

SEQ ID NO: 516032 - DNA, 20 bp, Artificial
  CRISPR gRNA sequence
cgtggctggcgggggcagaa

SEQ ID NO: 516033 - DNA, 20 bp, Artificial
  CRISPR gRNA sequence
ctggcgggggcagaagggcc

SEQ ID NO: 516034 - DNA, 20 bp, Artificial
  CRISPR gRNA sequence
cgggggcagaagggcctggc

SEQ ID NO: 516035 - DNA, 20 bp, Artificial
  CRISPR gRNA sequence
gggcagaagggcctggctag

SEQ ID NO: 516036 - DNA, 20 bp, Artificial
  CRISPR gRNA sequence
gtggccccatgccttttgct

SEQ ID NO: 516037 - DNA, 20 bp, Artificial
  CRISPR gRNA sequence
tggccccatgccttttgctc

SEQ ID NO: 516038 - DNA, 20 bp, Artificial
  CRISPR gRNA sequence
ttttgctcaggaacatcccc

SEQ ID NO: 516039 - DNA, 20 bp, Artificial
  CRISPR gRNA sequence
tttgctcaggaacatccccc

SEQ ID NO: 516040 - DNA, 20 bp, Artificial
  CRISPR gRNA sequence
ctcaggaacatcccccaggc

SEQ ID NO: 516041 - DNA, 20 bp, Artificial
  CRISPR gRNA sequence
caggaacatcccccaggctg

SEQ ID NO: 516042 - DNA, 20 bp, Artificial
  CRISPR gRNA sequence
aggaacatcccccaggctgg

SEQ ID NO: 516043 - DNA, 20 bp, Artificial
  CRISPR gRNA sequence
gaacatcccccaggctggag

SEQ ID NO: 516044 - DNA, 20 bp, Artificial
  CRISPR gRNA sequence
aacatcccccaggctggagg

SEQ ID NO: 516045 - DNA, 20 bp, Artificial
  CRISPR gRNA sequence
atcccccaggctggaggagg

SEQ ID NO: 516046 - DNA, 20 bp, Artificial
  CRISPR gRNA sequence
tcccccaggctggaggaggc

SEQ ID NO: 516047 - DNA, 20 bp, Artificial
  CRISPR gRNA sequence
cccaggctggaggaggcagg

SEQ ID NO: 516048 - DNA, 20 bp, Artificial
  CRISPR gRNA sequence
ccaggctggaggaggcaggc

SEQ ID NO: 516049 - DNA, 20 bp, Artificial
  CRISPR gRNA sequence
gctggaggaggcaggcgggc

SEQ ID NO: 516050 - DNA, 20 bp, Artificial
  CRISPR gRNA sequence
tggaggaggcaggcgggccg

SEQ ID NO: 516051 - DNA, 20 bp, Artificial
  CRISPR gRNA sequence
ggaggaggcaggcgggccgg

SEQ ID NO: 516052 - DNA, 20 bp, Artificial
  CRISPR gRNA sequence
gaggaggcaggcgggccgga

SEQ ID NO: 516053 - DNA, 20 bp, Artificial
  CRISPR gRNA sequence
ggaggcaggcgggccggagg

SEQ ID NO: 516054 - DNA, 20 bp, Artificial
  CRISPR gRNA sequence
cgggccggagggagcaaccg

SEQ ID NO: 516055 - DNA, 20 bp, Artificial
  CRISPR gRNA sequence
gccggagggagcaaccgcag

SEQ ID NO: 516056 - DNA, 20 bp, Artificial
  CRISPR gRNA sequence
ccggagggagcaaccgcagt

SEQ ID NO: 516057 - DNA, 20 bp, Artificial
  CRISPR gRNA sequence
cggagggagcaaccgcagtg

SEQ ID NO: 516058 - DNA, 20 bp, Artificial
  CRISPR gRNA sequence
gagcaaccgcagtggggttt

SEQ ID NO: 516059 - DNA, 20 bp, Artificial
  CRISPR gRNA sequence
agcaaccgcagtggggtttc

SEQ ID NO: 516060 - DNA, 20 bp, Artificial
  CRISPR gRNA sequence
aaccgcagtggggtttcggg

SEQ ID NO: 516061 - DNA, 20 bp, Artificial
  CRISPR gRNA sequence
accgcagtggggtttcgggc

SEQ ID NO: 516062 - DNA, 20 bp, Artificial
  CRISPR gRNA sequence
gtggggtttcgggcgggtct

SEQ ID NO: 516063 - DNA, 20 bp, Artificial
  CRISPR gRNA sequence
ttcgggcgggtctcggttcc

SEQ ID NO: 516064 - DNA, 20 bp, Artificial
  CRISPR gRNA sequence
tcgggcgggtctcggttccc

SEQ ID NO: 516065 - DNA, 20 bp, Artificial
  CRISPR gRNA sequence
cgggtctcggttcccaggcc

SEQ ID NO: 516066 - DNA, 20 bp, Artificial
  CRISPR gRNA sequence
gtctcggttcccaggccaag

SEQ ID NO: 516067 - DNA, 20 bp, Artificial
  CRISPR gRNA sequence
tctcggttcccaggccaagc

SEQ ID NO: 516068 - DNA, 20 bp, Artificial
  CRISPR gRNA sequence
tcggttcccaggccaagcag

SEQ ID NO: 516069 - DNA, 20 bp, Artificial
  CRISPR gRNA sequence
tcccaggccaagcaggagct

SEQ ID NO: 516070 - DNA, 20 bp, Artificial
  CRISPR gRNA sequence
agccgtgctgccccgtcttc

SEQ ID NO: 516071 - DNA, 20 bp, Artificial
  CRISPR gRNA sequence
gccgtgctgccccgtcttcc

SEQ ID NO: 516072 - DNA, 20 bp, Artificial
  CRISPR gRNA sequence
ccgtgctgccccgtcttcca

SEQ ID NO: 516073 - DNA, 20 bp, Artificial
  CRISPR gRNA sequence
gtgctgccccgtcttccagg

SEQ ID NO: 516074 - DNA, 20 bp, Artificial
  CRISPR gRNA sequence
tgctgccccgtcttccaggg

SEQ ID NO: 516075 - DNA, 20 bp, Artificial
  CRISPR gRNA sequence
gctgccccgtcttccaggga

SEQ ID NO: 516076 - DNA, 20 bp, Artificial
  CRISPR gRNA sequence
ctgccccgtcttccagggag

SEQ ID NO: 516077 - DNA, 20 bp, Artificial
  CRISPR gRNA sequence
tgccccgtcttccagggagg

SEQ ID NO: 516078 - DNA, 20 bp, Artificial
  CRISPR gRNA sequence
gggagggggctctgcttctg

SEQ ID NO: 516079 - DNA, 20 bp, Artificial
  CRISPR gRNA sequence
ggagggggctctgcttctgc

SEQ ID NO: 516080 - DNA, 20 bp, Artificial
  CRISPR gRNA sequence
gggggctctgcttctgcggg

SEQ ID NO: 516081 - DNA, 20 bp, Artificial
  CRISPR gRNA sequence
cgggaagtgccgctgccacc

SEQ ID NO: 516082 - DNA, 20 bp, Artificial
  CRISPR gRNA sequence
gggaagtgccgctgccaccc

SEQ ID NO: 516083 - DNA, 20 bp, Artificial
  CRISPR gRNA sequence
gccgctgccacccgggcttt

SEQ ID NO: 516084 - DNA, 20 bp, Artificial
  CRISPR gRNA sequence
ccgctgccacccgggctttg

SEQ ID NO: 516085 - DNA, 20 bp, Artificial
  CRISPR gRNA sequence
cgctgccacccgggctttga

SEQ ID NO: 516086 - DNA, 20 bp, Artificial
  CRISPR gRNA sequence
ccacccgggctttgagggct

SEQ ID NO: 516087 - DNA, 20 bp, Artificial
  CRISPR gRNA sequence
gctttgagggctcagcgtgc

SEQ ID NO: 516088 - DNA, 20 bp, Artificial
  CRISPR gRNA sequence
agggctcagcgtgccagtgc

SEQ ID NO: 516089 - DNA, 20 bp, Artificial
  CRISPR gRNA sequence
ggctcagcgtgccagtgcga

SEQ ID NO: 516090 - DNA, 20 bp, Artificial
  CRISPR gRNA sequence
gctcagcgtgccagtgcgag

SEQ ID NO: 516091 - DNA, 20 bp, Artificial
  CRISPR gRNA sequence
gccagtgcgagaggaccact

SEQ ID NO: 516092 - DNA, 20 bp, Artificial
  CRISPR gRNA sequence
ccagtgcgagaggaccactg

SEQ ID NO: 516093 - DNA, 20 bp, Artificial
  CRISPR gRNA sequence
cagtgcgagaggaccactga

SEQ ID NO: 516094 - DNA, 20 bp, Artificial
  CRISPR gRNA sequence
ctgagggctgcctgaacccg

SEQ ID NO: 516095 - DNA, 20 bp, Artificial
  CRISPR gRNA sequence
gcctgaacccgcggcgtgtt

SEQ ID NO: 516096 - DNA, 20 bp, Artificial
  CRISPR gRNA sequence
aacccgcggcgtgttgagtg

SEQ ID NO: 516097 - DNA, 20 bp, Artificial
  CRISPR gRNA sequence
ccgcggcgtgttgagtgtag

SEQ ID NO: 516098 - DNA, 20 bp, Artificial
  CRISPR gRNA sequence
cgtgttgagtgtagtggtcg

SEQ ID NO: 516099 - DNA, 20 bp, Artificial
  CRISPR gRNA sequence
ttgagtgtagtggtcgtggc

SEQ ID NO: 516100 - DNA, 20 bp, Artificial
  CRISPR gRNA sequence
ggtgccgctgcaacgtatgc

SEQ ID NO: 516101 - DNA, 20 bp, Artificial
  CRISPR gRNA sequence
caacgtatgcgagtgccatt

SEQ ID NO: 516102 - DNA, 20 bp, Artificial
  CRISPR gRNA sequence
aacgtatgcgagtgccattc

SEQ ID NO: 516103 - DNA, 20 bp, Artificial
  CRISPR gRNA sequence
gcgagtgccattcaggctac

SEQ ID NO: 516104 - DNA, 20 bp, Artificial
  CRISPR gRNA sequence
gctaccagctgcctctgtgc

SEQ ID NO: 516105 - DNA, 20 bp, Artificial
  CRISPR gRNA sequence
ctaccagctgcctctgtgcc

SEQ ID NO: 516106 - DNA, 20 bp, Artificial
  CRISPR gRNA sequence
accagctgcctctgtgccag

SEQ ID NO: 516107 - DNA, 20 bp, Artificial
  CRISPR gRNA sequence
cctctgtgccaggagtgccc

SEQ ID NO: 516108 - DNA, 20 bp, Artificial
  CRISPR gRNA sequence
cccggctgcccctcaccctg

SEQ ID NO: 516109 - DNA, 20 bp, Artificial
  CRISPR gRNA sequence
gctgcccctcaccctgtggc

SEQ ID NO: 516110 - DNA, 20 bp, Artificial
  CRISPR gRNA sequence
accctgtggcaagtacatgt

SEQ ID NO: 516111 - DNA, 20 bp, Artificial
  CRISPR gRNA sequence
gtggcaagtacatgtgagtg

SEQ ID NO: 516112 - DNA, 20 bp, Artificial
  CRISPR gRNA sequence
tggcaagtacatgtgagtgc

SEQ ID NO: 516113 - DNA, 20 bp, Artificial
  CRISPR gRNA sequence
caagtacatgtgagtgcagg

SEQ ID NO: 516114 - DNA, 20 bp, Artificial
  CRISPR gRNA sequence
agtacatgtgagtgcaggcg

SEQ ID NO: 516115 - DNA, 20 bp, Artificial
  CRISPR gRNA sequence
acatgtgagtgcaggcggag

SEQ ID NO: 516116 - DNA, 20 bp, Artificial
  CRISPR gRNA sequence
catgtgagtgcaggcggagc

SEQ ID NO: 516117 - DNA, 20 bp, Artificial
  CRISPR gRNA sequence
gtgagtgcaggcggagcagg

SEQ ID NO: 516118 - DNA, 20 bp, Artificial
  CRISPR gRNA sequence
tgagtgcaggcggagcaggc

SEQ ID NO: 516119 - DNA, 20 bp, Artificial
  CRISPR gRNA sequence
gagtgcaggcggagcaggca

SEQ ID NO: 516120 - DNA, 20 bp, Artificial
  CRISPR gRNA sequence
tgcaggcggagcaggcaggg

SEQ ID NO: 516121 - DNA, 20 bp, Artificial
  CRISPR gRNA sequence
gcaggcggagcaggcagggc

SEQ ID NO: 516122 - DNA, 20 bp, Artificial
  CRISPR gRNA sequence
ggcggagcaggcagggcggg

SEQ ID NO: 516123 - DNA, 20 bp, Artificial
  CRISPR gRNA sequence
gcggagcaggcagggcgggc

SEQ ID NO: 516124 - DNA, 20 bp, Artificial
  CRISPR gRNA sequence
cggagcaggcagggcgggca

SEQ ID NO: 516125 - DNA, 20 bp, Artificial
  CRISPR gRNA sequence
gggcagggatccccactccc

SEQ ID NO: 516126 - DNA, 20 bp, Artificial
  CRISPR gRNA sequence
ccactccccggccacctacc

SEQ ID NO: 516127 - DNA, 20 bp, Artificial
  CRISPR gRNA sequence
ctccccggccacctacccag

SEQ ID NO: 516128 - DNA, 20 bp, Artificial
  CRISPR gRNA sequence
ccggccacctacccagcagc

SEQ ID NO: 516129 - DNA, 20 bp, Artificial
  CRISPR gRNA sequence
cggccacctacccagcagcc

SEQ ID NO: 516130 - DNA, 20 bp, Artificial
  CRISPR gRNA sequence
acccagcagccgggctcact

SEQ ID NO: 516131 - DNA, 20 bp, Artificial
  CRISPR gRNA sequence
cccagcagccgggctcactc

SEQ ID NO: 516132 - DNA, 20 bp, Artificial
  CRISPR gRNA sequence
ccagcagccgggctcactcg

SEQ ID NO: 516133 - DNA, 20 bp, Artificial
  CRISPR gRNA sequence
ccgggctcactcggggaccc

SEQ ID NO: 516134 - DNA, 20 bp, Artificial
  CRISPR gRNA sequence
gctcactcggggaccccagt

SEQ ID NO: 516135 - DNA, 20 bp, Artificial
  CRISPR gRNA sequence
cagtgagcacctctgcaccg

SEQ ID NO: 516136 - DNA, 20 bp, Artificial
  CRISPR gRNA sequence
agtgagcacctctgcaccgc

SEQ ID NO: 516137 - DNA, 20 bp, Artificial
  CRISPR gRNA sequence
gtgagcacctctgcaccgcg

SEQ ID NO: 516138 - DNA, 20 bp, Artificial
  CRISPR gRNA sequence
ctgcaccgcggggttctctg

SEQ ID NO: 516139 - DNA, 20 bp, Artificial
  CRISPR gRNA sequence
tgcaccgcggggttctctgc

SEQ ID NO: 516140 - DNA, 20 bp, Artificial
  CRISPR gRNA sequence
gggttctctgcgggtgcgtc

SEQ ID NO: 516141 - DNA, 20 bp, Artificial
  CRISPR gRNA sequence
tctgcgggtgcgtctggact

SEQ ID NO: 516142 - DNA, 20 bp, Artificial
  CRISPR gRNA sequence
ctgcgggtgcgtctggactg

SEQ ID NO: 516143 - DNA, 20 bp, Artificial
  CRISPR gRNA sequence
tgcgggtgcgtctggactga

SEQ ID NO: 516144 - DNA, 20 bp, Artificial
  CRISPR gRNA sequence
gcgggtgcgtctggactgag

SEQ ID NO: 516145 - DNA, 20 bp, Artificial
  CRISPR gRNA sequence
ctggactgaggggccctccg

SEQ ID NO: 516146 - DNA, 20 bp, Artificial
  CRISPR gRNA sequence
cctcctgtgcgcacctgccg

SEQ ID NO: 516147 - DNA, 20 bp, Artificial
  CRISPR gRNA sequence
ctcctgtgcgcacctgccgc

SEQ ID NO: 516148 - DNA, 20 bp, Artificial
  CRISPR gRNA sequence
tgcgcacctgccgcgggccc

SEQ ID NO: 516149 - DNA, 20 bp, Artificial
  CRISPR gRNA sequence
gcgcacctgccgcgggccct

SEQ ID NO: 516150 - DNA, 20 bp, Artificial
  CRISPR gRNA sequence
cctgccgcgggccctgggat

SEQ ID NO: 516151 - DNA, 20 bp, Artificial
  CRISPR gRNA sequence
ctgccgcgggccctgggatc

SEQ ID NO: 516152 - DNA, 20 bp, Artificial
  CRISPR gRNA sequence
gggccctgggatcaggcttc

SEQ ID NO: 516153 - DNA, 20 bp, Artificial
  CRISPR gRNA sequence
gcacccgcatctgccccact

SEQ ID NO: 516154 - DNA, 20 bp, Artificial
  CRISPR gRNA sequence
cacccgcatctgccccactt

SEQ ID NO: 516155 - DNA, 20 bp, Artificial
  CRISPR gRNA sequence
ccccacttgggccccctcct

SEQ ID NO: 516156 - DNA, 20 bp, Artificial
  CRISPR gRNA sequence
ttgggccccctccttggcct

SEQ ID NO: 516157 - DNA, 20 bp, Artificial
  CRISPR gRNA sequence
tgggccccctccttggcctg

SEQ ID NO: 516158 - DNA, 20 bp, Artificial
  CRISPR gRNA sequence
gggccccctccttggcctga

SEQ ID NO: 516159 - DNA, 20 bp, Artificial
  CRISPR gRNA sequence
ccaaccccacctgccccccc

SEQ ID NO: 516160 - DNA, 20 bp, Artificial
  CRISPR gRNA sequence
accccacctgccccccctgg

SEQ ID NO: 516161 - DNA, 20 bp, Artificial
  CRISPR gRNA sequence
cccctggtggacacacaccc

SEQ ID NO: 516162 - DNA, 20 bp, Artificial
  CRISPR gRNA sequence
gtggacacacacccaagccc

SEQ ID NO: 516163 - DNA, 20 bp, Artificial
  CRISPR gRNA sequence
caagcccgagcccccgttgc

SEQ ID NO: 516164 - DNA, 20 bp, Artificial
  CRISPR gRNA sequence
agcccgagcccccgttgccg

SEQ ID NO: 516165 - DNA, 20 bp, Artificial
  CRISPR gRNA sequence
gccggagcccccgcacaccc

SEQ ID NO: 516166 - DNA, 20 bp, Artificial
  CRISPR gRNA sequence
ctggcaccgatgctcacacc

SEQ ID NO: 516167 - DNA, 20 bp, Artificial
  CRISPR gRNA sequence
tgctcacacctggctccccg

SEQ ID NO: 516168 - DNA, 20 bp, Artificial
  CRISPR gRNA sequence
ctccccgcagctcctgcgcc

SEQ ID NO: 516169 - DNA, 20 bp, Artificial
  CRISPR gRNA sequence
gctcctgcgccgagtgcctg

SEQ ID NO: 516170 - DNA, 20 bp, Artificial
  CRISPR gRNA sequence
ccgagtgcctgaagttcgaa

SEQ ID NO: 516171 - DNA, 20 bp, Artificial
  CRISPR gRNA sequence
cgagtgcctgaagttcgaaa

SEQ ID NO: 516172 - DNA, 20 bp, Artificial
  CRISPR gRNA sequence
gagtgcctgaagttcgaaaa

SEQ ID NO: 516173 - DNA, 20 bp, Artificial
  CRISPR gRNA sequence
aagttcgaaaagggcccctt

SEQ ID NO: 516174 - DNA, 20 bp, Artificial
  CRISPR gRNA sequence
agttcgaaaagggccccttt

SEQ ID NO: 516175 - DNA, 20 bp, Artificial
  CRISPR gRNA sequence
tcgaaaagggcccctttggg

SEQ ID NO: 516176 - DNA, 20 bp, Artificial
  CRISPR gRNA sequence
ggcccctttgggaagaactg

SEQ ID NO: 516177 - DNA, 20 bp, Artificial
  CRISPR gRNA sequence
ctttgggaagaactgcagcg

SEQ ID NO: 516178 - DNA, 20 bp, Artificial
  CRISPR gRNA sequence
gaactgcagcgcggcgtgtc

SEQ ID NO: 516179 - DNA, 20 bp, Artificial
  CRISPR gRNA sequence
aactgcagcgcggcgtgtcc

SEQ ID NO: 516180 - DNA, 20 bp, Artificial
  CRISPR gRNA sequence
gcgcggcgtgtccgggcctg

SEQ ID NO: 516181 - DNA, 20 bp, Artificial
  CRISPR gRNA sequence
agctgtcgaacaaccccgtg

SEQ ID NO: 516182 - DNA, 20 bp, Artificial
  CRISPR gRNA sequence
gctgtcgaacaaccccgtga

SEQ ID NO: 516183 - DNA, 20 bp, Artificial
  CRISPR gRNA sequence
ctgtcgaacaaccccgtgaa

SEQ ID NO: 516184 - DNA, 20 bp, Artificial
  CRISPR gRNA sequence
tcgaacaaccccgtgaaggg

SEQ ID NO: 516185 - DNA, 20 bp, Artificial
  CRISPR gRNA sequence
cgaacaaccccgtgaagggc

SEQ ID NO: 516186 - DNA, 20 bp, Artificial
  CRISPR gRNA sequence
ccgtgaagggcaggacctgc

SEQ ID NO: 516187 - DNA, 20 bp, Artificial
  CRISPR gRNA sequence
cgtgaagggcaggacctgca

SEQ ID NO: 516188 - DNA, 20 bp, Artificial
  CRISPR gRNA sequence
tgaagggcaggacctgcaag

SEQ ID NO: 516189 - DNA, 20 bp, Artificial
  CRISPR gRNA sequence
aagggcaggacctgcaagga

SEQ ID NO: 516190 - DNA, 20 bp, Artificial
  CRISPR gRNA sequence
agggcaggacctgcaaggag

SEQ ID NO: 516191 - DNA, 20 bp, Artificial
  CRISPR gRNA sequence
gggcaggacctgcaaggaga

SEQ ID NO: 516192 - DNA, 20 bp, Artificial
  CRISPR gRNA sequence
gacctgcaaggagagggact

SEQ ID NO: 516193 - DNA, 20 bp, Artificial
  CRISPR gRNA sequence
cctgcaaggagagggactca

SEQ ID NO: 516194 - DNA, 20 bp, Artificial
  CRISPR gRNA sequence
ctgcaaggagagggactcag

SEQ ID NO: 516195 - DNA, 20 bp, Artificial
  CRISPR gRNA sequence
tgcaaggagagggactcaga

SEQ ID NO: 516196 - DNA, 20 bp, Artificial
  CRISPR gRNA sequence
agagggactcagagggctgc

SEQ ID NO: 516197 - DNA, 20 bp, Artificial
  CRISPR gRNA sequence
gagggactcagagggctgct

SEQ ID NO: 516198 - DNA, 20 bp, Artificial
  CRISPR gRNA sequence
ggactcagagggctgctggg

SEQ ID NO: 516199 - DNA, 20 bp, Artificial
  CRISPR gRNA sequence
ctgctgggtggcctacacgc

SEQ ID NO: 516200 - DNA, 20 bp, Artificial
  CRISPR gRNA sequence
gctgggtggcctacacgctg

SEQ ID NO: 516201 - DNA, 20 bp, Artificial
  CRISPR gRNA sequence
gggtggcctacacgctggag

SEQ ID NO: 516202 - DNA, 20 bp, Artificial
  CRISPR gRNA sequence
tggcctacacgctggagcag

SEQ ID NO: 516203 - DNA, 20 bp, Artificial
  CRISPR gRNA sequence
ggcctacacgctggagcagc

SEQ ID NO: 516204 - DNA, 20 bp, Artificial
  CRISPR gRNA sequence
tacacgctggagcagcagga

SEQ ID NO: 516205 - DNA, 20 bp, Artificial
  CRISPR gRNA sequence
acacgctggagcagcaggac

SEQ ID NO: 516206 - DNA, 20 bp, Artificial
  CRISPR gRNA sequence
gctggagcagcaggacggga

SEQ ID NO: 516207 - DNA, 20 bp, Artificial
  CRISPR gRNA sequence
ggaccgctacctcatctatg

SEQ ID NO: 516208 - DNA, 20 bp, Artificial
  CRISPR gRNA sequence
gctacctcatctatgtggat

SEQ ID NO: 516209 - DNA, 20 bp, Artificial
  CRISPR gRNA sequence
tacctcatctatgtggatga

SEQ ID NO: 516210 - DNA, 20 bp, Artificial
  CRISPR gRNA sequence
catctatgtggatgagagcc

SEQ ID NO: 516211 - DNA, 20 bp, Artificial
  CRISPR gRNA sequence
atctatgtggatgagagccg

SEQ ID NO: 516212 - DNA, 20 bp, Artificial
  CRISPR gRNA sequence
atgtggatgagagccgaggt

SEQ ID NO: 516213 - DNA, 20 bp, Artificial
  CRISPR gRNA sequence
tgtggatgagagccgaggtg

SEQ ID NO: 516214 - DNA, 20 bp, Artificial
  CRISPR gRNA sequence
gagagccgaggtgaggccgc

SEQ ID NO: 516215 - DNA, 20 bp, Artificial
  CRISPR gRNA sequence
agagccgaggtgaggccgct

SEQ ID NO: 516216 - DNA, 20 bp, Artificial
  CRISPR gRNA sequence
gagccgaggtgaggccgctg

SEQ ID NO: 516217 - DNA, 20 bp, Artificial
  CRISPR gRNA sequence
gaggtgaggccgctggggtg

SEQ ID NO: 516218 - DNA, 20 bp, Artificial
  CRISPR gRNA sequence
gtgaggccgctggggtgcag

SEQ ID NO: 516219 - DNA, 20 bp, Artificial
  CRISPR gRNA sequence
tgaggccgctggggtgcagc

SEQ ID NO: 516220 - DNA, 20 bp, Artificial
  CRISPR gRNA sequence
gaggccgctggggtgcagcg

SEQ ID NO: 516221 - DNA, 20 bp, Artificial
  CRISPR gRNA sequence
cgctggggtgcagcggggac

SEQ ID NO: 516222 - DNA, 20 bp, Artificial
  CRISPR gRNA sequence
ggtgcagcggggaccggctc

SEQ ID NO: 516223 - DNA, 20 bp, Artificial
  CRISPR gRNA sequence
tgcagcggggaccggctcca

SEQ ID NO: 516224 - DNA, 20 bp, Artificial
  CRISPR gRNA sequence
ggggaccggctccagagctc

SEQ ID NO: 516225 - DNA, 20 bp, Artificial
  CRISPR gRNA sequence
cggctccagagctccggctg

SEQ ID NO: 516226 - DNA, 20 bp, Artificial
  CRISPR gRNA sequence
ggctccagagctccggctgc

SEQ ID NO: 516227 - DNA, 20 bp, Artificial
  CRISPR gRNA sequence
gctccagagctccggctgcg

SEQ ID NO: 516228 - DNA, 20 bp, Artificial
  CRISPR gRNA sequence
ctccggctgcggggtctccg

SEQ ID NO: 516229 - DNA, 20 bp, Artificial
  CRISPR gRNA sequence
ccggctgcggggtctccgca

SEQ ID NO: 516230 - DNA, 20 bp, Artificial
  CRISPR gRNA sequence
cggctgcggggtctccgcag

SEQ ID NO: 516231 - DNA, 20 bp, Artificial
  CRISPR gRNA sequence
tgcggggtctccgcagaggc

SEQ ID NO: 516232 - DNA, 20 bp, Artificial
  CRISPR gRNA sequence
gcggggtctccgcagaggcg

SEQ ID NO: 516233 - DNA, 20 bp, Artificial
  CRISPR gRNA sequence
cggggtctccgcagaggcga

SEQ ID NO: 516234 - DNA, 20 bp, Artificial
  CRISPR gRNA sequence
ggtctccgcagaggcgaggg

SEQ ID NO: 516235 - DNA, 20 bp, Artificial
  CRISPR gRNA sequence
ccgcagaggcgagggtggtg

SEQ ID NO: 516236 - DNA, 20 bp, Artificial
  CRISPR gRNA sequence
cagaggcgagggtggtgcgg

SEQ ID NO: 516237 - DNA, 20 bp, Artificial
  CRISPR gRNA sequence
agaggcgagggtggtgcgga

SEQ ID NO: 516238 - DNA, 20 bp, Artificial
  CRISPR gRNA sequence
aggcgagggtggtgcggaag

SEQ ID NO: 516239 - DNA, 20 bp, Artificial
  CRISPR gRNA sequence
ggcgagggtggtgcggaagg

SEQ ID NO: 516240 - DNA, 20 bp, Artificial
  CRISPR gRNA sequence
cggaaggaggatctcacctc

SEQ ID NO: 516241 - DNA, 20 bp, Artificial
  CRISPR gRNA sequence
ggatctcacctccagtgttg

SEQ ID NO: 516242 - DNA, 20 bp, Artificial
  CRISPR gRNA sequence
gatctcacctccagtgttgt

SEQ ID NO: 516243 - DNA, 20 bp, Artificial
  CRISPR gRNA sequence
cacctccagtgttgtgggcc

SEQ ID NO: 516244 - DNA, 20 bp, Artificial
  CRISPR gRNA sequence
ctccagtgttgtgggcccag

SEQ ID NO: 516245 - DNA, 20 bp, Artificial
  CRISPR gRNA sequence
tccagtgttgtgggcccagc

SEQ ID NO: 516246 - DNA, 20 bp, Artificial
  CRISPR gRNA sequence
ccagtgttgtgggcccagca

SEQ ID NO: 516247 - DNA, 20 bp, Artificial
  CRISPR gRNA sequence
gtgttgtgggcccagcaggg

SEQ ID NO: 516248 - DNA, 20 bp, Artificial
  CRISPR gRNA sequence
gtgggcccagcagggtggat

SEQ ID NO: 516249 - DNA, 20 bp, Artificial
  CRISPR gRNA sequence
agcagggtggatgagccatg

SEQ ID NO: 516250 - DNA, 20 bp, Artificial
  CRISPR gRNA sequence
gcagggtggatgagccatgc

SEQ ID NO: 516251 - DNA, 20 bp, Artificial
  CRISPR gRNA sequence
tgagccatgcgggatgccct

SEQ ID NO: 516252 - DNA, 20 bp, Artificial
  CRISPR gRNA sequence
cgggatgcccttggcattgc

SEQ ID NO: 516253 - DNA, 20 bp, Artificial
  CRISPR gRNA sequence
gggatgcccttggcattgca

SEQ ID NO: 516254 - DNA, 20 bp, Artificial
  CRISPR gRNA sequence
gatgcccttggcattgcaag

SEQ ID NO: 516255 - DNA, 20 bp, Artificial
  CRISPR gRNA sequence
atgcccttggcattgcaagg

SEQ ID NO: 516256 - DNA, 20 bp, Artificial
  CRISPR gRNA sequence
ccttggcattgcaaggaggc

SEQ ID NO: 516257 - DNA, 20 bp, Artificial
  CRISPR gRNA sequence
ttggcattgcaaggaggcca

SEQ ID NO: 516258 - DNA, 20 bp, Artificial
  CRISPR gRNA sequence
tggcattgcaaggaggccag

SEQ ID NO: 516259 - DNA, 20 bp, Artificial
  CRISPR gRNA sequence
attgcaaggaggccagaggc

SEQ ID NO: 516260 - DNA, 20 bp, Artificial
  CRISPR gRNA sequence
gaggccggtcccctcacccc

SEQ ID NO: 516261 - DNA, 20 bp, Artificial
  CRISPR gRNA sequence
gccggtcccctcacccccag

SEQ ID NO: 516262 - DNA, 20 bp, Artificial
  CRISPR gRNA sequence
tcctcacctgaccccacatc

SEQ ID NO: 516263 - DNA, 20 bp, Artificial
  CRISPR gRNA sequence
cacctgaccccacatcaagc

SEQ ID NO: 516264 - DNA, 20 bp, Artificial
  CRISPR gRNA sequence
acctgaccccacatcaagct

SEQ ID NO: 516265 - DNA, 20 bp, Artificial
  CRISPR gRNA sequence
tgaccccacatcaagctggg

SEQ ID NO: 516266 - DNA, 20 bp, Artificial
  CRISPR gRNA sequence
ccccacatcaagctgggcag

SEQ ID NO: 516267 - DNA, 20 bp, Artificial
  CRISPR gRNA sequence
acatcaagctgggcagcaga

SEQ ID NO: 516268 - DNA, 20 bp, Artificial
  CRISPR gRNA sequence
gcagcagacggcctgctccc

SEQ ID NO: 516269 - DNA, 20 bp, Artificial
  CRISPR gRNA sequence
cagcagacggcctgctccct

SEQ ID NO: 516270 - DNA, 20 bp, Artificial
  CRISPR gRNA sequence
agcagacggcctgctccctg

SEQ ID NO: 516271 - DNA, 20 bp, Artificial
  CRISPR gRNA sequence
gcagacggcctgctccctgg

SEQ ID NO: 516272 - DNA, 20 bp, Artificial
  CRISPR gRNA sequence
ggggcaccactgctccacac

SEQ ID NO: 516273 - DNA, 20 bp, Artificial
  CRISPR gRNA sequence
gggcaccactgctccacacc

SEQ ID NO: 516274 - DNA, 20 bp, Artificial
  CRISPR gRNA sequence
caccactgctccacaccggg

SEQ ID NO: 516275 - DNA, 20 bp, Artificial
  CRISPR gRNA sequence
accactgctccacaccgggc

SEQ ID NO: 516276 - DNA, 20 bp, Artificial
  CRISPR gRNA sequence
tccacaccgggcaggcccac

SEQ ID NO: 516277 - DNA, 20 bp, Artificial
  CRISPR gRNA sequence
aggcccaccagcatgccaca

SEQ ID NO: 516278 - DNA, 20 bp, Artificial
  CRISPR gRNA sequence
caccagcatgccacacggcc

SEQ ID NO: 516279 - DNA, 20 bp, Artificial
  CRISPR gRNA sequence
accagcatgccacacggccc

SEQ ID NO: 516280 - DNA, 20 bp, Artificial
  CRISPR gRNA sequence
cggcccgggccatctcccgc

SEQ ID NO: 516281 - DNA, 20 bp, Artificial
  CRISPR gRNA sequence
atctcccgctggatgcctca

SEQ ID NO: 516282 - DNA, 20 bp, Artificial
  CRISPR gRNA sequence
tctcccgctggatgcctcat

SEQ ID NO: 516283 - DNA, 20 bp, Artificial
  CRISPR gRNA sequence
ctcccgctggatgcctcatg

SEQ ID NO: 516284 - DNA, 20 bp, Artificial
  CRISPR gRNA sequence
cgctggatgcctcatggggc

SEQ ID NO: 516285 - DNA, 20 bp, Artificial
  CRISPR gRNA sequence
gctggatgcctcatggggca

SEQ ID NO: 516286 - DNA, 20 bp, Artificial
  CRISPR gRNA sequence
gcctcatggggcaaggcttg

SEQ ID NO: 516287 - DNA, 20 bp, Artificial
  CRISPR gRNA sequence
tggggcaaggcttgcagttg

SEQ ID NO: 516288 - DNA, 20 bp, Artificial
  CRISPR gRNA sequence
ggggcaaggcttgcagttgc

SEQ ID NO: 516289 - DNA, 20 bp, Artificial
  CRISPR gRNA sequence
ggcttgcagttgcaggtccc

SEQ ID NO: 516290 - DNA, 20 bp, Artificial
  CRISPR gRNA sequence
gcttgcagttgcaggtcccc

SEQ ID NO: 516291 - DNA, 20 bp, Artificial
  CRISPR gRNA sequence
cttgcagttgcaggtcccca

SEQ ID NO: 516292 - DNA, 20 bp, Artificial
  CRISPR gRNA sequence
ttgcagttgcaggtccccag

SEQ ID NO: 516293 - DNA, 20 bp, Artificial
  CRISPR gRNA sequence
cagttgcaggtccccagggg

SEQ ID NO: 516294 - DNA, 20 bp, Artificial
  CRISPR gRNA sequence
aggtccccaggggtggcccg

SEQ ID NO: 516295 - DNA, 20 bp, Artificial
  CRISPR gRNA sequence
ccccaggggtggcccgcggt

SEQ ID NO: 516296 - DNA, 20 bp, Artificial
  CRISPR gRNA sequence
cccaggggtggcccgcggtc

SEQ ID NO: 516297 - DNA, 20 bp, Artificial
  CRISPR gRNA sequence
ccgcggtcaggttgctgcgt

SEQ ID NO: 516298 - DNA, 20 bp, Artificial
  CRISPR gRNA sequence
cgcggtcaggttgctgcgtg

SEQ ID NO: 516299 - DNA, 20 bp, Artificial
  CRISPR gRNA sequence
ttgctgcgtgaggctccttt

SEQ ID NO: 516300 - DNA, 20 bp, Artificial
  CRISPR gRNA sequence
tgctgcgtgaggctcctttg

SEQ ID NO: 516301 - DNA, 20 bp, Artificial
  CRISPR gRNA sequence
gctgcgtgaggctcctttga

SEQ ID NO: 516302 - DNA, 20 bp, Artificial
  CRISPR gRNA sequence
ctgcgtgaggctcctttgag

SEQ ID NO: 516303 - DNA, 20 bp, Artificial
  CRISPR gRNA sequence
tgaggctcctttgaggggat

SEQ ID NO: 516304 - DNA, 20 bp, Artificial
  CRISPR gRNA sequence
gaggctcctttgaggggatt

SEQ ID NO: 516305 - DNA, 20 bp, Artificial
  CRISPR gRNA sequence
ggctcctttgaggggattgg

SEQ ID NO: 516306 - DNA, 20 bp, Artificial
  CRISPR gRNA sequence
ttgaggggattgggagatcc

SEQ ID NO: 516307 - DNA, 20 bp, Artificial
  CRISPR gRNA sequence
gattgggagatcctggtgct

SEQ ID NO: 516308 - DNA, 20 bp, Artificial
  CRISPR gRNA sequence
agatcctggtgctcggctct

SEQ ID NO: 516309 - DNA, 20 bp, Artificial
  CRISPR gRNA sequence
tggtgctcggctctcagccc

SEQ ID NO: 516310 - DNA, 20 bp, Artificial
  CRISPR gRNA sequence
gtgctcggctctcagccctg

SEQ ID NO: 516311 - DNA, 20 bp, Artificial
  CRISPR gRNA sequence
tgctcggctctcagccctgg

SEQ ID NO: 516312 - DNA, 20 bp, Artificial
  CRISPR gRNA sequence
gctcggctctcagccctgga

SEQ ID NO: 516313 - DNA, 20 bp, Artificial
  CRISPR gRNA sequence
ctcggctctcagccctggag

SEQ ID NO: 516314 - DNA, 20 bp, Artificial
  CRISPR gRNA sequence
ctctcagccctggaggggcc

SEQ ID NO: 516315 - DNA, 20 bp, Artificial
  CRISPR gRNA sequence
tctcagccctggaggggccc

SEQ ID NO: 516316 - DNA, 20 bp, Artificial
  CRISPR gRNA sequence
ctcagccctggaggggccca

SEQ ID NO: 516317 - DNA, 20 bp, Artificial
  CRISPR gRNA sequence
ctggaggggcccagggccac

SEQ ID NO: 516318 - DNA, 20 bp, Artificial
  CRISPR gRNA sequence
tggaggggcccagggccacc

SEQ ID NO: 516319 - DNA, 20 bp, Artificial
  CRISPR gRNA sequence
caccgtccccatcactcgtt

SEQ ID NO: 516320 - DNA, 20 bp, Artificial
  CRISPR gRNA sequence
ccccatcactcgttcggctc

SEQ ID NO: 516321 - DNA, 20 bp, Artificial
  CRISPR gRNA sequence
tcactcgttcggctccagtc

SEQ ID NO: 516322 - DNA, 20 bp, Artificial
  CRISPR gRNA sequence
tcgttcggctccagtccagt

SEQ ID NO: 516323 - DNA, 20 bp, Artificial
  CRISPR gRNA sequence
ggctccagtccagtcggaac

SEQ ID NO: 516324 - DNA, 20 bp, Artificial
  CRISPR gRNA sequence
agtccagtcggaaccagtcc

SEQ ID NO: 516325 - DNA, 20 bp, Artificial
  CRISPR gRNA sequence
cggaaccagtcccagcccca

SEQ ID NO: 516326 - DNA, 20 bp, Artificial
  CRISPR gRNA sequence
tcccagccccacagtgacct

SEQ ID NO: 516327 - DNA, 20 bp, Artificial
  CRISPR gRNA sequence
cagccccacagtgaccttgg

SEQ ID NO: 516328 - DNA, 20 bp, Artificial
  CRISPR gRNA sequence
ggcactgaccctgtctcatt

SEQ ID NO: 516329 - DNA, 20 bp, Artificial
  CRISPR gRNA sequence
gaccctgtctcattcggctc

SEQ ID NO: 516330 - DNA, 20 bp, Artificial
  CRISPR gRNA sequence
ctgtctcattcggctccagt

SEQ ID NO: 516331 - DNA, 20 bp, Artificial
  CRISPR gRNA sequence
cattcggctccagtcggaac

SEQ ID NO: 516332 - DNA, 20 bp, Artificial
  CRISPR gRNA sequence
gctccagtcggaaccagtcc

SEQ ID NO: 516333 - DNA, 20 bp, Artificial
  CRISPR gRNA sequence
cggaaccagtcccagcccca

SEQ ID NO: 516334 - DNA, 20 bp, Artificial
  CRISPR gRNA sequence
tcccagccccacagtgacct

SEQ ID NO: 516335 - DNA, 20 bp, Artificial
  CRISPR gRNA sequence
cagccccacagtgaccttgg

SEQ ID NO: 516336 - DNA, 20 bp, Artificial
  CRISPR gRNA sequence
ggcactgaccctgtctcatt

SEQ ID NO: 516337 - DNA, 20 bp, Artificial
  CRISPR gRNA sequence
gaccctgtctcattcagctc

SEQ ID NO: 516338 - DNA, 20 bp, Artificial
  CRISPR gRNA sequence
ctgtctcattcagctccagt

SEQ ID NO: 516339 - DNA, 20 bp, Artificial
  CRISPR gRNA sequence
cattcagctccagttggaac

SEQ ID NO: 516340 - DNA, 20 bp, Artificial
  CRISPR gRNA sequence
attcagctccagttggaacc

SEQ ID NO: 516341 - DNA, 20 bp, Artificial
  CRISPR gRNA sequence
gctccagttggaaccaggcc

SEQ ID NO: 516342 - DNA, 20 bp, Artificial
  CRISPR gRNA sequence
tggaaccaggcccagcccca

SEQ ID NO: 516343 - DNA, 20 bp, Artificial
  CRISPR gRNA sequence
gcccagccccacggtgacct

SEQ ID NO: 516344 - DNA, 20 bp, Artificial
  CRISPR gRNA sequence
cacggtgaccttggtgacac

SEQ ID NO: 516345 - DNA, 20 bp, Artificial
  CRISPR gRNA sequence
tgacactggccctgcttctt

SEQ ID NO: 516346 - DNA, 20 bp, Artificial
  CRISPR gRNA sequence
gacactggccctgcttcttc

SEQ ID NO: 516347 - DNA, 20 bp, Artificial
  CRISPR gRNA sequence
tcttcaggtctcatgttcca

SEQ ID NO: 516348 - DNA, 20 bp, Artificial
  CRISPR gRNA sequence
cttcaggtctcatgttccac

SEQ ID NO: 516349 - DNA, 20 bp, Artificial
  CRISPR gRNA sequence
ctcatgttccacaggctcct

SEQ ID NO: 516350 - DNA, 20 bp, Artificial
  CRISPR gRNA sequence
catgttccacaggctcctga

SEQ ID NO: 516351 - DNA, 20 bp, Artificial
  CRISPR gRNA sequence
atgttccacaggctcctgag

SEQ ID NO: 516352 - DNA, 20 bp, Artificial
  CRISPR gRNA sequence
ttccacaggctcctgagagg

SEQ ID NO: 516353 - DNA, 20 bp, Artificial
  CRISPR gRNA sequence
ccacaggctcctgagaggca

SEQ ID NO: 516354 - DNA, 20 bp, Artificial
  CRISPR gRNA sequence
cacaggctcctgagaggcag

SEQ ID NO: 516355 - DNA, 20 bp, Artificial
  CRISPR gRNA sequence
acaggctcctgagaggcaga

SEQ ID NO: 516356 - DNA, 20 bp, Artificial
  CRISPR gRNA sequence
caggctcctgagaggcagag

SEQ ID NO: 516357 - DNA, 20 bp, Artificial
  CRISPR gRNA sequence
ctcctgagaggcagaggggc

SEQ ID NO: 516358 - DNA, 20 bp, Artificial
  CRISPR gRNA sequence
tcctgagaggcagaggggct

SEQ ID NO: 516359 - DNA, 20 bp, Artificial
  CRISPR gRNA sequence
cctgagaggcagaggggctg

SEQ ID NO: 516360 - DNA, 20 bp, Artificial
  CRISPR gRNA sequence
agaggcagaggggctggggc

SEQ ID NO: 516361 - DNA, 20 bp, Artificial
  CRISPR gRNA sequence
gaggcagaggggctggggct

SEQ ID NO: 516362 - DNA, 20 bp, Artificial
  CRISPR gRNA sequence
aggcagaggggctggggctg

SEQ ID NO: 516363 - DNA, 20 bp, Artificial
  CRISPR gRNA sequence
ggcagaggggctggggctgg

SEQ ID NO: 516364 - DNA, 20 bp, Artificial
  CRISPR gRNA sequence
gcagaggggctggggctggg

SEQ ID NO: 516365 - DNA, 20 bp, Artificial
  CRISPR gRNA sequence
ggctggggctggggggccgc

SEQ ID NO: 516366 - DNA, 20 bp, Artificial
  CRISPR gRNA sequence
tggggctggggggccgctgg

SEQ ID NO: 516367 - DNA, 20 bp, Artificial
  CRISPR gRNA sequence
gggccgctggcggactccat

SEQ ID NO: 516368 - DNA, 20 bp, Artificial
  CRISPR gRNA sequence
ggccgctggcggactccatc

SEQ ID NO: 516369 - DNA, 20 bp, Artificial
  CRISPR gRNA sequence
ctggcggactccatcaggca

SEQ ID NO: 516370 - DNA, 20 bp, Artificial
  CRISPR gRNA sequence
cggactccatcaggcatggc

SEQ ID NO: 516371 - DNA, 20 bp, Artificial
  CRISPR gRNA sequence
actccatcaggcatggccag

SEQ ID NO: 516372 - DNA, 20 bp, Artificial
  CRISPR gRNA sequence
catcaggcatggccagcagc

SEQ ID NO: 516373 - DNA, 20 bp, Artificial
  CRISPR gRNA sequence
aggcatggccagcagccggc

SEQ ID NO: 516374 - DNA, 20 bp, Artificial
  CRISPR gRNA sequence
ggcatggccagcagccggcc

SEQ ID NO: 516375 - DNA, 20 bp, Artificial
  CRISPR gRNA sequence
gcagccggccaggactcttg

SEQ ID NO: 516376 - DNA, 20 bp, Artificial
  CRISPR gRNA sequence
gccaggactcttgcagaact

SEQ ID NO: 516377 - DNA, 20 bp, Artificial
  CRISPR gRNA sequence
actcttgcagaactgagacc

SEQ ID NO: 516378 - DNA, 20 bp, Artificial
  CRISPR gRNA sequence
ctcttgcagaactgagacct

SEQ ID NO: 516379 - DNA, 20 bp, Artificial
  CRISPR gRNA sequence
cttgcagaactgagacctgg

SEQ ID NO: 516380 - DNA, 20 bp, Artificial
  CRISPR gRNA sequence
cctgggagctcctccctcac

SEQ ID NO: 516381 - DNA, 20 bp, Artificial
  CRISPR gRNA sequence
ctgggagctcctccctcacc

SEQ ID NO: 516382 - DNA, 20 bp, Artificial
  CRISPR gRNA sequence
ggagctcctccctcaccagg

SEQ ID NO: 516383 - DNA, 20 bp, Artificial
  CRISPR gRNA sequence
gagctcctccctcaccagga

SEQ ID NO: 516384 - DNA, 20 bp, Artificial
  CRISPR gRNA sequence
agctcctccctcaccaggaa

SEQ ID NO: 516385 - DNA, 20 bp, Artificial
  CRISPR gRNA sequence
ccctcaccaggaagggaccc

SEQ ID NO: 516386 - DNA, 20 bp, Artificial
  CRISPR gRNA sequence
cctcaccaggaagggacccg

SEQ ID NO: 516387 - DNA, 20 bp, Artificial
  CRISPR gRNA sequence
caccaggaagggacccgagg

SEQ ID NO: 516388 - DNA, 20 bp, Artificial
  CRISPR gRNA sequence
accaggaagggacccgaggc

SEQ ID NO: 516389 - DNA, 20 bp, Artificial
  CRISPR gRNA sequence
aggaagggacccgaggcagg

SEQ ID NO: 516390 - DNA, 20 bp, Artificial
  CRISPR gRNA sequence
aagggacccgaggcaggcgg

SEQ ID NO: 516391 - DNA, 20 bp, Artificial
  CRISPR gRNA sequence
agggacccgaggcaggcggc

SEQ ID NO: 516392 - DNA, 20 bp, Artificial
  CRISPR gRNA sequence
gggacccgaggcaggcggcg

SEQ ID NO: 516393 - DNA, 20 bp, Artificial
  CRISPR gRNA sequence
ggacccgaggcaggcggcgg

SEQ ID NO: 516394 - DNA, 20 bp, Artificial
  CRISPR gRNA sequence
ggcaggcggcgggggtctct

SEQ ID NO: 516395 - DNA, 20 bp, Artificial
  CRISPR gRNA sequence
ggcgggggtctctgagcctg

SEQ ID NO: 516396 - DNA, 20 bp, Artificial
  CRISPR gRNA sequence
gcgggggtctctgagcctgt

SEQ ID NO: 516397 - DNA, 20 bp, Artificial
  CRISPR gRNA sequence
gagcctgtaggtgacatgcc

SEQ ID NO: 516398 - DNA, 20 bp, Artificial
  CRISPR gRNA sequence
gcctgtaggtgacatgcctg

SEQ ID NO: 516399 - DNA, 20 bp, Artificial
  CRISPR gRNA sequence
tggagctcacaacccacatg

SEQ ID NO: 516400 - DNA, 20 bp, Artificial
  CRISPR gRNA sequence
ggagctcacaacccacatgt

SEQ ID NO: 516401 - DNA, 20 bp, Artificial
  CRISPR gRNA sequence
tcacaacccacatgtgggcc

SEQ ID NO: 516402 - DNA, 20 bp, Artificial
  CRISPR gRNA sequence
cacaacccacatgtgggcct

SEQ ID NO: 516403 - DNA, 20 bp, Artificial
  CRISPR gRNA sequence
acaacccacatgtgggcctg

SEQ ID NO: 516404 - DNA, 20 bp, Artificial
  CRISPR gRNA sequence
cacatgtgggcctggggctg

SEQ ID NO: 516405 - DNA, 20 bp, Artificial
  CRISPR gRNA sequence
ggctgcagacccccacctgc

SEQ ID NO: 516406 - DNA, 20 bp, Artificial
  CRISPR gRNA sequence
gctgcagacccccacctgcc

SEQ ID NO: 516407 - DNA, 20 bp, Artificial
  CRISPR gRNA sequence
ctgcagacccccacctgcca

SEQ ID NO: 516408 - DNA, 20 bp, Artificial
  CRISPR gRNA sequence
cagacccccacctgccaggg

SEQ ID NO: 516409 - DNA, 20 bp, Artificial
  CRISPR gRNA sequence
agacccccacctgccagggc

SEQ ID NO: 516410 - DNA, 20 bp, Artificial
  CRISPR gRNA sequence
tgccagggcaggaacccctg

SEQ ID NO: 516411 - DNA, 20 bp, Artificial
  CRISPR gRNA sequence
gccagggcaggaacccctgc

SEQ ID NO: 516412 - DNA, 20 bp, Artificial
  CRISPR gRNA sequence
gaacccctgcgggccacttt

SEQ ID NO: 516413 - DNA, 20 bp, Artificial
  CRISPR gRNA sequence
aacccctgcgggccactttg

SEQ ID NO: 516414 - DNA, 20 bp, Artificial
  CRISPR gRNA sequence
acccctgcgggccactttga

SEQ ID NO: 516415 - DNA, 20 bp, Artificial
  CRISPR gRNA sequence
ctgcgggccactttgaggga

SEQ ID NO: 516416 - DNA, 20 bp, Artificial
  CRISPR gRNA sequence
gccactttgagggacagact

SEQ ID NO: 516417 - DNA, 20 bp, Artificial
  CRISPR gRNA sequence
ccactttgagggacagactt

SEQ ID NO: 516418 - DNA, 20 bp, Artificial
  CRISPR gRNA sequence
ggacagacttgggtcacgtc

SEQ ID NO: 516419 - DNA, 20 bp, Artificial
  CRISPR gRNA sequence
acgtctggtttgtgcaatcc

SEQ ID NO: 516420 - DNA, 20 bp, Artificial
  CRISPR gRNA sequence
tggtttgtgcaatcctggcc

SEQ ID NO: 516421 - DNA, 20 bp, Artificial
  CRISPR gRNA sequence
ggccaagtcacttcaccttt

SEQ ID NO: 516422 - DNA, 20 bp, Artificial
  CRISPR gRNA sequence
gccaagtcacttcacctttg

SEQ ID NO: 516423 - DNA, 20 bp, Artificial
  CRISPR gRNA sequence
agtcacttcacctttgagga

SEQ ID NO: 516424 - DNA, 20 bp, Artificial
  CRISPR gRNA sequence
gtcacttcacctttgaggac

SEQ ID NO: 516425 - DNA, 20 bp, Artificial
  CRISPR gRNA sequence
ttcacctttgaggacaggtg

SEQ ID NO: 516426 - DNA, 20 bp, Artificial
  CRISPR gRNA sequence
tcacctttgaggacaggtga

SEQ ID NO: 516427 - DNA, 20 bp, Artificial
  CRISPR gRNA sequence
cctttgaggacaggtgaagg

SEQ ID NO: 516428 - DNA, 20 bp, Artificial
  CRISPR gRNA sequence
ctttgaggacaggtgaagga

SEQ ID NO: 516429 - DNA, 20 bp, Artificial
  CRISPR gRNA sequence
tgaggacaggtgaaggaagg

SEQ ID NO: 516430 - DNA, 20 bp, Artificial
  CRISPR gRNA sequence
gaggacaggtgaaggaaggc

SEQ ID NO: 516431 - DNA, 20 bp, Artificial
  CRISPR gRNA sequence
gtgaaggaaggcaggtcccc

SEQ ID NO: 516432 - DNA, 20 bp, Artificial
  CRISPR gRNA sequence
tgaaggaaggcaggtccccc

SEQ ID NO: 516433 - DNA, 20 bp, Artificial
  CRISPR gRNA sequence
ggaaggcaggtcccccagga

SEQ ID NO: 516434 - DNA, 20 bp, Artificial
  CRISPR gRNA sequence
gaaggcaggtcccccaggaa

SEQ ID NO: 516435 - DNA, 20 bp, Artificial
  CRISPR gRNA sequence
ggcaggtcccccaggaaagg

SEQ ID NO: 516436 - DNA, 20 bp, Artificial
  CRISPR gRNA sequence
gcaggtcccccaggaaaggc

SEQ ID NO: 516437 - DNA, 20 bp, Artificial
  CRISPR gRNA sequence
gtcccccaggaaaggcagga

SEQ ID NO: 516438 - DNA, 20 bp, Artificial
  CRISPR gRNA sequence
ccccaggaaaggcaggatgg

SEQ ID NO: 516439 - DNA, 20 bp, Artificial
  CRISPR gRNA sequence
cccaggaaaggcaggatggc

SEQ ID NO: 516440 - DNA, 20 bp, Artificial
  CRISPR gRNA sequence
caggaaaggcaggatggcag

SEQ ID NO: 516441 - DNA, 20 bp, Artificial
  CRISPR gRNA sequence
aggaaaggcaggatggcagg

SEQ ID NO: 516442 - DNA, 20 bp, Artificial
  CRISPR gRNA sequence
ggaaaggcaggatggcagga

SEQ ID NO: 516443 - DNA, 20 bp, Artificial
  CRISPR gRNA sequence
gaaaggcaggatggcaggag

SEQ ID NO: 516444 - DNA, 20 bp, Artificial
  CRISPR gRNA sequence
aaaggcaggatggcaggagg

SEQ ID NO: 516445 - DNA, 20 bp, Artificial
  CRISPR gRNA sequence
caggatggcaggagggggca

SEQ ID NO: 516446 - DNA, 20 bp, Artificial
  CRISPR gRNA sequence
aggatggcaggagggggcac

SEQ ID NO: 516447 - DNA, 20 bp, Artificial
  CRISPR gRNA sequence
ggatggcaggagggggcacg

SEQ ID NO: 516448 - DNA, 20 bp, Artificial
  CRISPR gRNA sequence
atggcaggagggggcacggg

SEQ ID NO: 516449 - DNA, 20 bp, Artificial
  CRISPR gRNA sequence
caggagggggcacggggagt

SEQ ID NO: 516450 - DNA, 20 bp, Artificial
  CRISPR gRNA sequence
ggagggggcacggggagtga

SEQ ID NO: 516451 - DNA, 20 bp, Artificial
  CRISPR gRNA sequence
gggcacggggagtgagagtg

SEQ ID NO: 516452 - DNA, 20 bp, Artificial
  CRISPR gRNA sequence
ggcacggggagtgagagtgc

SEQ ID NO: 516453 - DNA, 20 bp, Artificial
  CRISPR gRNA sequence
cggggagtgagagtgcaggt

SEQ ID NO: 516454 - DNA, 20 bp, Artificial
  CRISPR gRNA sequence
ggggagtgagagtgcaggtc

SEQ ID NO: 516455 - DNA, 20 bp, Artificial
  CRISPR gRNA sequence
agtgagagtgcaggtcagga

SEQ ID NO: 516456 - DNA, 20 bp, Artificial
  CRISPR gRNA sequence
gagagtgcaggtcaggatgg

SEQ ID NO: 516457 - DNA, 20 bp, Artificial
  CRISPR gRNA sequence
agagtgcaggtcaggatggc

SEQ ID NO: 516458 - DNA, 20 bp, Artificial
  CRISPR gRNA sequence
agtgcaggtcaggatggcag

SEQ ID NO: 516459 - DNA, 20 bp, Artificial
  CRISPR gRNA sequence
gtgcaggtcaggatggcagg

SEQ ID NO: 516460 - DNA, 20 bp, Artificial
  CRISPR gRNA sequence
tgcaggtcaggatggcagga

SEQ ID NO: 516461 - DNA, 20 bp, Artificial
  CRISPR gRNA sequence
gcaggtcaggatggcaggag

SEQ ID NO: 516462 - DNA, 20 bp, Artificial
  CRISPR gRNA sequence
caggtcaggatggcaggagg

SEQ ID NO: 516463 - DNA, 20 bp, Artificial
  CRISPR gRNA sequence
caggatggcaggagggggca

SEQ ID NO: 516464 - DNA, 20 bp, Artificial
  CRISPR gRNA sequence
aggatggcaggagggggcac

SEQ ID NO: 516465 - DNA, 20 bp, Artificial
  CRISPR gRNA sequence
ggatggcaggagggggcaca

SEQ ID NO: 516466 - DNA, 20 bp, Artificial
  CRISPR gRNA sequence
atggcaggagggggcacagg

SEQ ID NO: 516467 - DNA, 20 bp, Artificial
  CRISPR gRNA sequence
caggagggggcacagggagt

SEQ ID NO: 516468 - DNA, 20 bp, Artificial
  CRISPR gRNA sequence
aggagggggcacagggagtg

SEQ ID NO: 516469 - DNA, 20 bp, Artificial
  CRISPR gRNA sequence
ggagggggcacagggagtga

SEQ ID NO: 516470 - DNA, 20 bp, Artificial
  CRISPR gRNA sequence
gggcacagggagtgagggtg

SEQ ID NO: 516471 - DNA, 20 bp, Artificial
  CRISPR gRNA sequence
cagggagtgagggtgcagat

SEQ ID NO: 516472 - DNA, 20 bp, Artificial
  CRISPR gRNA sequence
agggagtgagggtgcagatc

SEQ ID NO: 516473 - DNA, 20 bp, Artificial
  CRISPR gRNA sequence
agtgagggtgcagatcagga

SEQ ID NO: 516474 - DNA, 20 bp, Artificial
  CRISPR gRNA sequence
gagggtgcagatcaggatgg

SEQ ID NO: 516475 - DNA, 20 bp, Artificial
  CRISPR gRNA sequence
agggtgcagatcaggatggc

SEQ ID NO: 516476 - DNA, 20 bp, Artificial
  CRISPR gRNA sequence
ggtgcagatcaggatggcag

SEQ ID NO: 516477 - DNA, 20 bp, Artificial
  CRISPR gRNA sequence
caggatggcaggagcaacca

SEQ ID NO: 516478 - DNA, 20 bp, Artificial
  CRISPR gRNA sequence
aggatggcaggagcaaccac

SEQ ID NO: 516479 - DNA, 20 bp, Artificial
  CRISPR gRNA sequence
ggatggcaggagcaaccaca

SEQ ID NO: 516480 - DNA, 20 bp, Artificial
  CRISPR gRNA sequence
atggcaggagcaaccacagg

SEQ ID NO: 516481 - DNA, 20 bp, Artificial
  CRISPR gRNA sequence
caggagcaaccacagggagt

SEQ ID NO: 516482 - DNA, 20 bp, Artificial
  CRISPR gRNA sequence
aggagcaaccacagggagtg

SEQ ID NO: 516483 - DNA, 20 bp, Artificial
  CRISPR gRNA sequence
ggagcaaccacagggagtga

SEQ ID NO: 516484 - DNA, 20 bp, Artificial
  CRISPR gRNA sequence
aaccacagggagtgagggtg

SEQ ID NO: 516485 - DNA, 20 bp, Artificial
  CRISPR gRNA sequence
accacagggagtgagggtgc

SEQ ID NO: 516486 - DNA, 20 bp, Artificial
  CRISPR gRNA sequence
cagggagtgagggtgcaggt

SEQ ID NO: 516487 - DNA, 20 bp, Artificial
  CRISPR gRNA sequence
agggagtgagggtgcaggtc

SEQ ID NO: 516488 - DNA, 20 bp, Artificial
  CRISPR gRNA sequence
agtgagggtgcaggtcagga

SEQ ID NO: 516489 - DNA, 20 bp, Artificial
  CRISPR gRNA sequence
gagggtgcaggtcaggatgg

SEQ ID NO: 516490 - DNA, 20 bp, Artificial
  CRISPR gRNA sequence
agggtgcaggtcaggatggc

SEQ ID NO: 516491 - DNA, 20 bp, Artificial
  CRISPR gRNA sequence
ggtgcaggtcaggatggcag

SEQ ID NO: 516492 - DNA, 20 bp, Artificial
  CRISPR gRNA sequence
gtgcaggtcaggatggcagg

SEQ ID NO: 516493 - DNA, 20 bp, Artificial
  CRISPR gRNA sequence
tgcaggtcaggatggcagga

SEQ ID NO: 516494 - DNA, 20 bp, Artificial
  CRISPR gRNA sequence
gcaggtcaggatggcaggag

SEQ ID NO: 516495 - DNA, 20 bp, Artificial
  CRISPR gRNA sequence
tcaggatggcaggaggggta

SEQ ID NO: 516496 - DNA, 20 bp, Artificial
  CRISPR gRNA sequence
caggatggcaggaggggtac

SEQ ID NO: 516497 - DNA, 20 bp, Artificial
  CRISPR gRNA sequence
aggatggcaggaggggtaca

SEQ ID NO: 516498 - DNA, 20 bp, Artificial
  CRISPR gRNA sequence
gatggcaggaggggtacagg

SEQ ID NO: 516499 - DNA, 20 bp, Artificial
  CRISPR gRNA sequence
gcaggaggggtacagggagt

SEQ ID NO: 516500 - DNA, 20 bp, Artificial
  CRISPR gRNA sequence
caggaggggtacagggagtg

SEQ ID NO: 516501 - DNA, 20 bp, Artificial
  CRISPR gRNA sequence
ggtacagggagtgaggatgc

SEQ ID NO: 516502 - DNA, 20 bp, Artificial
  CRISPR gRNA sequence
agggagtgaggatgccagac

SEQ ID NO: 516503 - DNA, 20 bp, Artificial
  CRISPR gRNA sequence
gggagtgaggatgccagacc

SEQ ID NO: 516504 - DNA, 20 bp, Artificial
  CRISPR gRNA sequence
gtgaggatgccagaccaggc

SEQ ID NO: 516505 - DNA, 20 bp, Artificial
  CRISPR gRNA sequence
tgaggatgccagaccaggcc

SEQ ID NO: 516506 - DNA, 20 bp, Artificial
  CRISPR gRNA sequence
gaggatgccagaccaggcca

SEQ ID NO: 516507 - DNA, 20 bp, Artificial
  CRISPR gRNA sequence
ccagggactgcactgaacgc

SEQ ID NO: 516508 - DNA, 20 bp, Artificial
  CRISPR gRNA sequence
ctgaacgctagtgtctgtcc

SEQ ID NO: 516509 - DNA, 20 bp, Artificial
  CRISPR gRNA sequence
tgaacgctagtgtctgtccc

SEQ ID NO: 516510 - DNA, 20 bp, Artificial
  CRISPR gRNA sequence
gaacgctagtgtctgtccca

SEQ ID NO: 516511 - DNA, 20 bp, Artificial
  CRISPR gRNA sequence
gctagtgtctgtcccagggt

SEQ ID NO: 516512 - DNA, 20 bp, Artificial
  CRISPR gRNA sequence
agtgtctgtcccagggtcag

SEQ ID NO: 516513 - DNA, 20 bp, Artificial
  CRISPR gRNA sequence
tgtcccagggtcagcagctg

SEQ ID NO: 516514 - DNA, 20 bp, Artificial
  CRISPR gRNA sequence
gtcccagggtcagcagctgt

SEQ ID NO: 516515 - DNA, 20 bp, Artificial
  CRISPR gRNA sequence
agggtcagcagctgtgggcc

SEQ ID NO: 516516 - DNA, 20 bp, Artificial
  CRISPR gRNA sequence
gctgtgggcctggcccacta

SEQ ID NO: 516517 - DNA, 20 bp, Artificial
  CRISPR gRNA sequence
gcctggcccactatggccca

SEQ ID NO: 516518 - DNA, 20 bp, Artificial
  CRISPR gRNA sequence
tggcccacagtccccatgct

SEQ ID NO: 516519 - DNA, 20 bp, Artificial
  CRISPR gRNA sequence
ggcccacagtccccatgctc

SEQ ID NO: 516520 - DNA, 20 bp, Artificial
  CRISPR gRNA sequence
cccacagtccccatgctcag

SEQ ID NO: 516521 - DNA, 20 bp, Artificial
  CRISPR gRNA sequence
ccacagtccccatgctcagg

SEQ ID NO: 516522 - DNA, 20 bp, Artificial
  CRISPR gRNA sequence
cagtccccatgctcaggagg

SEQ ID NO: 516523 - DNA, 20 bp, Artificial
  CRISPR gRNA sequence
agtccccatgctcaggaggt

SEQ ID NO: 516524 - DNA, 20 bp, Artificial
  CRISPR gRNA sequence
ccatgctcaggaggtgggca

SEQ ID NO: 516525 - DNA, 20 bp, Artificial
  CRISPR gRNA sequence
ggaggtgggcacagctgccg

SEQ ID NO: 516526 - DNA, 20 bp, Artificial
  CRISPR gRNA sequence
gaggtgggcacagctgccgt

SEQ ID NO: 516527 - DNA, 20 bp, Artificial
  CRISPR gRNA sequence
ggcacagctgccgtgggaac

SEQ ID NO: 516528 - DNA, 20 bp, Artificial
  CRISPR gRNA sequence
gcacagctgccgtgggaacc

SEQ ID NO: 516529 - DNA, 20 bp, Artificial
  CRISPR gRNA sequence
ggaccttgcgttgctcatcc

SEQ ID NO: 516530 - DNA, 20 bp, Artificial
  CRISPR gRNA sequence
tgcgttgctcatcctggcac

SEQ ID NO: 516531 - DNA, 20 bp, Artificial
  CRISPR gRNA sequence
tggcaccggcctcacctgct

SEQ ID NO: 516532 - DNA, 20 bp, Artificial
  CRISPR gRNA sequence
cggcctcacctgctgagctc

SEQ ID NO: 516533 - DNA, 20 bp, Artificial
  CRISPR gRNA sequence
acctgctgagctctggtctc

SEQ ID NO: 516534 - DNA, 20 bp, Artificial
  CRISPR gRNA sequence
acgaccacaaatcactttca

SEQ ID NO: 516535 - DNA, 20 bp, Artificial
  CRISPR gRNA sequence
cacaaatcactttcacagta

SEQ ID NO: 516536 - DNA, 20 bp, Artificial
  CRISPR gRNA sequence
acaaatcactttcacagtat

SEQ ID NO: 516537 - DNA, 20 bp, Artificial
  CRISPR gRNA sequence
caaatcactttcacagtatg

SEQ ID NO: 516538 - DNA, 20 bp, Artificial
  CRISPR gRNA sequence
aatcactttcacagtatggg

SEQ ID NO: 516539 - DNA, 20 bp, Artificial
  CRISPR gRNA sequence
acagtatggggagtgaactc

SEQ ID NO: 516540 - DNA, 20 bp, Artificial
  CRISPR gRNA sequence
gtatggggagtgaactccag

SEQ ID NO: 516541 - DNA, 20 bp, Artificial
  CRISPR gRNA sequence
tatggggagtgaactccagc

SEQ ID NO: 516542 - DNA, 20 bp, Artificial
  CRISPR gRNA sequence
atggggagtgaactccagca

SEQ ID NO: 516543 - DNA, 20 bp, Artificial
  CRISPR gRNA sequence
tgaactccagcagggaccct

SEQ ID NO: 516544 - DNA, 20 bp, Artificial
  CRISPR gRNA sequence
tccagcagggaccctgagcc

SEQ ID NO: 516545 - DNA, 20 bp, Artificial
  CRISPR gRNA sequence
cctggttctgaactctgctg

SEQ ID NO: 516546 - DNA, 20 bp, Artificial
  CRISPR gRNA sequence
ctggttctgaactctgctgt

SEQ ID NO: 516547 - DNA, 20 bp, Artificial
  CRISPR gRNA sequence
ggttctgaactctgctgtag

SEQ ID NO: 516548 - DNA, 20 bp, Artificial
  CRISPR gRNA sequence
ttctgaactctgctgtagga

SEQ ID NO: 516549 - DNA, 20 bp, Artificial
  CRISPR gRNA sequence
tgaactctgctgtaggagag

SEQ ID NO: 516550 - DNA, 20 bp, Artificial
  CRISPR gRNA sequence
gaactctgctgtaggagagc

SEQ ID NO: 516551 - DNA, 20 bp, Artificial
  CRISPR gRNA sequence
aactctgctgtaggagagcg

SEQ ID NO: 516552 - DNA, 20 bp, Artificial
  CRISPR gRNA sequence
tcgcactgtgtcctaccccc

SEQ ID NO: 516553 - DNA, 20 bp, Artificial
  CRISPR gRNA sequence
tgtgtcctaccccccagtat

SEQ ID NO: 516554 - DNA, 20 bp, Artificial
  CRISPR gRNA sequence
ccagtattagcactctgtcc

SEQ ID NO: 516555 - DNA, 20 bp, Artificial
  CRISPR gRNA sequence
agcactctgtcctggctgcc

SEQ ID NO: 516556 - DNA, 20 bp, Artificial
  CRISPR gRNA sequence
gtcctggctgcccggtaccc

SEQ ID NO: 516557 - DNA, 20 bp, Artificial
  CRISPR gRNA sequence
ggccctgccttcttctctgt

SEQ ID NO: 516558 - DNA, 20 bp, Artificial
  CRISPR gRNA sequence
cctgccttcttctctgtcag

SEQ ID NO: 516559 - DNA, 20 bp, Artificial
  CRISPR gRNA sequence
ctgccttcttctctgtcagc

SEQ ID NO: 516560 - DNA, 20 bp, Artificial
  CRISPR gRNA sequence
tgccttcttctctgtcagca

SEQ ID NO: 516561 - DNA, 20 bp, Artificial
  CRISPR gRNA sequence
gccttcttctctgtcagcag

SEQ ID NO: 516562 - DNA, 20 bp, Artificial
  CRISPR gRNA sequence
ttcttctctgtcagcagggg

SEQ ID NO: 516563 - DNA, 20 bp, Artificial
  CRISPR gRNA sequence
ttctctgtcagcaggggtgg

SEQ ID NO: 516564 - DNA, 20 bp, Artificial
  CRISPR gRNA sequence
gtcagcaggggtggtggcaa

SEQ ID NO: 516565 - DNA, 20 bp, Artificial
  CRISPR gRNA sequence
ggggtggtggcaatggccct

SEQ ID NO: 516566 - DNA, 20 bp, Artificial
  CRISPR gRNA sequence
gggtggtggcaatggccctt

SEQ ID NO: 516567 - DNA, 20 bp, Artificial
  CRISPR gRNA sequence
aatggcccttaggtttcatt

SEQ ID NO: 516568 - DNA, 20 bp, Artificial
  CRISPR gRNA sequence
ttaggtttcatttggaacca

SEQ ID NO: 516569 - DNA, 20 bp, Artificial
  CRISPR gRNA sequence
taggtttcatttggaaccac

SEQ ID NO: 516570 - DNA, 20 bp, Artificial
  CRISPR gRNA sequence
aggtttcatttggaaccaca

SEQ ID NO: 516571 - DNA, 20 bp, Artificial
  CRISPR gRNA sequence
tcatttggaaccacagggcc

SEQ ID NO: 516572 - DNA, 20 bp, Artificial
  CRISPR gRNA sequence
tggaaccacagggcctggcc

SEQ ID NO: 516573 - DNA, 20 bp, Artificial
  CRISPR gRNA sequence
acagggcctggcctggaatc

SEQ ID NO: 516574 - DNA, 20 bp, Artificial
  CRISPR gRNA sequence
gggcctggcctggaatccag

SEQ ID NO: 516575 - DNA, 20 bp, Artificial
  CRISPR gRNA sequence
ggcctggcctggaatccagc

SEQ ID NO: 516576 - DNA, 20 bp, Artificial
  CRISPR gRNA sequence
gcctggcctggaatccagca

SEQ ID NO: 516577 - DNA, 20 bp, Artificial
  CRISPR gRNA sequence
cctggcctggaatccagcag

SEQ ID NO: 516578 - DNA, 20 bp, Artificial
  CRISPR gRNA sequence
gcctggaatccagcaggggc

SEQ ID NO: 516579 - DNA, 20 bp, Artificial
  CRISPR gRNA sequence
cctggaatccagcaggggct

SEQ ID NO: 516580 - DNA, 20 bp, Artificial
  CRISPR gRNA sequence
gaatccagcaggggctgggc

SEQ ID NO: 516581 - DNA, 20 bp, Artificial
  CRISPR gRNA sequence
aatccagcaggggctgggcc

SEQ ID NO: 516582 - DNA, 20 bp, Artificial
  CRISPR gRNA sequence
gccaggttctcactgacccc

SEQ ID NO: 516583 - DNA, 20 bp, Artificial
  CRISPR gRNA sequence
ttctcactgacccctggcca

SEQ ID NO: 516584 - DNA, 20 bp, Artificial
  CRISPR gRNA sequence
ctgacccctggccatggtga

SEQ ID NO: 516585 - DNA, 20 bp, Artificial
  CRISPR gRNA sequence
cccctggccatggtgatgga

SEQ ID NO: 516586 - DNA, 20 bp, Artificial
  CRISPR gRNA sequence
tggccatggtgatggatggt

SEQ ID NO: 516587 - DNA, 20 bp, Artificial
  CRISPR gRNA sequence
catggtgatggatggtgagc

SEQ ID NO: 516588 - DNA, 20 bp, Artificial
  CRISPR gRNA sequence
atggtgatggatggtgagcc

SEQ ID NO: 516589 - DNA, 20 bp, Artificial
  CRISPR gRNA sequence
tggtgatggatggtgagccg

SEQ ID NO: 516590 - DNA, 20 bp, Artificial
  CRISPR gRNA sequence
tggatggtgagccggggccc

SEQ ID NO: 516591 - DNA, 20 bp, Artificial
  CRISPR gRNA sequence
ggatggtgagccggggccct

SEQ ID NO: 516592 - DNA, 20 bp, Artificial
  CRISPR gRNA sequence
ctgggaacctccgtctctct

SEQ ID NO: 516593 - DNA, 20 bp, Artificial
  CRISPR gRNA sequence
tctctctaagtgctgtgttg

SEQ ID NO: 516594 - DNA, 20 bp, Artificial
  CRISPR gRNA sequence
ctctctaagtgctgtgttgt

SEQ ID NO: 516595 - DNA, 20 bp, Artificial
  CRISPR gRNA sequence
tctctaagtgctgtgttgtg

SEQ ID NO: 516596 - DNA, 20 bp, Artificial
  CRISPR gRNA sequence
gctgtgttgtggggtgacct

SEQ ID NO: 516597 - DNA, 20 bp, Artificial
  CRISPR gRNA sequence
gtggggtgacctcggacctg

SEQ ID NO: 516598 - DNA, 20 bp, Artificial
  CRISPR gRNA sequence
tggggtgacctcggacctgt

SEQ ID NO: 516599 - DNA, 20 bp, Artificial
  CRISPR gRNA sequence
acctcggacctgtgggcaca

SEQ ID NO: 516600 - DNA, 20 bp, Artificial
  CRISPR gRNA sequence
ggacctgtgggcacacggct

SEQ ID NO: 516601 - DNA, 20 bp, Artificial
  CRISPR gRNA sequence
ctgtgggcacacggctcagt

SEQ ID NO: 516602 - DNA, 20 bp, Artificial
  CRISPR gRNA sequence
gggcacacggctcagtgaga

SEQ ID NO: 516603 - DNA, 20 bp, Artificial
  CRISPR gRNA sequence
ggcacacggctcagtgagat

SEQ ID NO: 516604 - DNA, 20 bp, Artificial
  CRISPR gRNA sequence
gcacacggctcagtgagatg

SEQ ID NO: 516605 - DNA, 20 bp, Artificial
  CRISPR gRNA sequence
acggctcagtgagatggggc

SEQ ID NO: 516606 - DNA, 20 bp, Artificial
  CRISPR gRNA sequence
gatggggctggactgacgct

SEQ ID NO: 516607 - DNA, 20 bp, Artificial
  CRISPR gRNA sequence
atggggctggactgacgctc

SEQ ID NO: 516608 - DNA, 20 bp, Artificial
  CRISPR gRNA sequence
caggtgtgctgcttcttccc

SEQ ID NO: 516609 - DNA, 20 bp, Artificial
  CRISPR gRNA sequence
ggtgtgctgcttcttcccta

SEQ ID NO: 516610 - DNA, 20 bp, Artificial
  CRISPR gRNA sequence
tgcttcttccctagagtgtg

SEQ ID NO: 516611 - DNA, 20 bp, Artificial
  CRISPR gRNA sequence
ttcttccctagagtgtgtgg

SEQ ID NO: 516612 - DNA, 20 bp, Artificial
  CRISPR gRNA sequence
tcttccctagagtgtgtggc

SEQ ID NO: 516613 - DNA, 20 bp, Artificial
  CRISPR gRNA sequence
cccaacatcgccgccatcgt

SEQ ID NO: 516614 - DNA, 20 bp, Artificial
  CRISPR gRNA sequence
ccaacatcgccgccatcgtc

SEQ ID NO: 516615 - DNA, 20 bp, Artificial
  CRISPR gRNA sequence
caacatcgccgccatcgtcg

SEQ ID NO: 516616 - DNA, 20 bp, Artificial
  CRISPR gRNA sequence
aacatcgccgccatcgtcgg

SEQ ID NO: 516617 - DNA, 20 bp, Artificial
  CRISPR gRNA sequence
cgccatcgtcgggggcaccg

SEQ ID NO: 516618 - DNA, 20 bp, Artificial
  CRISPR gRNA sequence
catcgtcgggggcaccgtgg

SEQ ID NO: 516619 - DNA, 20 bp, Artificial
  CRISPR gRNA sequence
atcgtcgggggcaccgtggc

SEQ ID NO: 516620 - DNA, 20 bp, Artificial
  CRISPR gRNA sequence
gtggcaggcatcgtgctgat

SEQ ID NO: 516621 - DNA, 20 bp, Artificial
  CRISPR gRNA sequence
gctgatcggcattctcctgc

SEQ ID NO: 516622 - DNA, 20 bp, Artificial
  CRISPR gRNA sequence
gcattctcctgctggtcatc

SEQ ID NO: 516623 - DNA, 20 bp, Artificial
  CRISPR gRNA sequence
ttctcctgctggtcatctgg

SEQ ID NO: 516624 - DNA, 20 bp, Artificial
  CRISPR gRNA sequence
tctcctgctggtcatctgga

SEQ ID NO: 516625 - DNA, 20 bp, Artificial
  CRISPR gRNA sequence
tggaaggctctgatccacct

SEQ ID NO: 516626 - DNA, 20 bp, Artificial
  CRISPR gRNA sequence
tgatccacctgagcgacctc

SEQ ID NO: 516627 - DNA, 20 bp, Artificial
  CRISPR gRNA sequence
gatccacctgagcgacctcc

SEQ ID NO: 516628 - DNA, 20 bp, Artificial
  CRISPR gRNA sequence
tccacctgagcgacctccgg

SEQ ID NO: 516629 - DNA, 20 bp, Artificial
  CRISPR gRNA sequence
ctgagcgacctccgggagta

SEQ ID NO: 516630 - DNA, 20 bp, Artificial
  CRISPR gRNA sequence
tgagcgacctccgggagtac

SEQ ID NO: 516631 - DNA, 20 bp, Artificial
  CRISPR gRNA sequence
tccgggagtacaggcgcttt

SEQ ID NO: 516632 - DNA, 20 bp, Artificial
  CRISPR gRNA sequence
gggagtacaggcgctttgag

SEQ ID NO: 516633 - DNA, 20 bp, Artificial
  CRISPR gRNA sequence
ggagtacaggcgctttgaga

SEQ ID NO: 516634 - DNA, 20 bp, Artificial
  CRISPR gRNA sequence
agtacaggcgctttgagaag

SEQ ID NO: 516635 - DNA, 20 bp, Artificial
  CRISPR gRNA sequence
acaggcgctttgagaaggag

SEQ ID NO: 516636 - DNA, 20 bp, Artificial
  CRISPR gRNA sequence
gctttgagaaggagaagctc

SEQ ID NO: 516637 - DNA, 20 bp, Artificial
  CRISPR gRNA sequence
agaaggagaagctcaagtcc

SEQ ID NO: 516638 - DNA, 20 bp, Artificial
  CRISPR gRNA sequence
aggagaagctcaagtcccag

SEQ ID NO: 516639 - DNA, 20 bp, Artificial
  CRISPR gRNA sequence
aagtcccagtggaacaatgt

SEQ ID NO: 516640 - DNA, 20 bp, Artificial
  CRISPR gRNA sequence
tcccagtggaacaatgtaag

SEQ ID NO: 516641 - DNA, 20 bp, Artificial
  CRISPR gRNA sequence
acaatgtaagtggccgtcct

SEQ ID NO: 516642 - DNA, 20 bp, Artificial
  CRISPR gRNA sequence
caatgtaagtggccgtcctt

SEQ ID NO: 516643 - DNA, 20 bp, Artificial
  CRISPR gRNA sequence
aatgtaagtggccgtccttg

SEQ ID NO: 516644 - DNA, 20 bp, Artificial
  CRISPR gRNA sequence
atgtaagtggccgtccttgg

SEQ ID NO: 516645 - DNA, 20 bp, Artificial
  CRISPR gRNA sequence
ccgtccttgggggtcccacg

SEQ ID NO: 516646 - DNA, 20 bp, Artificial
  CRISPR gRNA sequence
gtccttgggggtcccacgca

SEQ ID NO: 516647 - DNA, 20 bp, Artificial
  CRISPR gRNA sequence
tccttgggggtcccacgcag

SEQ ID NO: 516648 - DNA, 20 bp, Artificial
  CRISPR gRNA sequence
ccttgggggtcccacgcaga

SEQ ID NO: 516649 - DNA, 20 bp, Artificial
  CRISPR gRNA sequence
cttgggggtcccacgcagag

SEQ ID NO: 516650 - DNA, 20 bp, Artificial
  CRISPR gRNA sequence
cactatgcgacctcctgctg

SEQ ID NO: 516651 - DNA, 20 bp, Artificial
  CRISPR gRNA sequence
actatgcgacctcctgctgc

SEQ ID NO: 516652 - DNA, 20 bp, Artificial
  CRISPR gRNA sequence
tatgcgacctcctgctgcgg

SEQ ID NO: 516653 - DNA, 20 bp, Artificial
  CRISPR gRNA sequence
atgcgacctcctgctgcggg

SEQ ID NO: 516654 - DNA, 20 bp, Artificial
  CRISPR gRNA sequence
cctcctgctgcgggaggccg

SEQ ID NO: 516655 - DNA, 20 bp, Artificial
  CRISPR gRNA sequence
aggccgtggacacccgtgtg

SEQ ID NO: 516656 - DNA, 20 bp, Artificial
  CRISPR gRNA sequence
acccgtgtgtggctgcaccc

SEQ ID NO: 516657 - DNA, 20 bp, Artificial
  CRISPR gRNA sequence
tggctgcaccccggcctccc

SEQ ID NO: 516658 - DNA, 20 bp, Artificial
  CRISPR gRNA sequence
ggctgcaccccggcctcccc

SEQ ID NO: 516659 - DNA, 20 bp, Artificial
  CRISPR gRNA sequence
tgcaccccggcctccccagg

SEQ ID NO: 516660 - DNA, 20 bp, Artificial
  CRISPR gRNA sequence
tccccaggcagcttgtcctc

SEQ ID NO: 516661 - DNA, 20 bp, Artificial
  CRISPR gRNA sequence
ccccaggcagcttgtcctct

SEQ ID NO: 516662 - DNA, 20 bp, Artificial
  CRISPR gRNA sequence
cctctgggcgtccgccgctg

SEQ ID NO: 516663 - DNA, 20 bp, Artificial
  CRISPR gRNA sequence
ctctgggcgtccgccgctgt

SEQ ID NO: 516664 - DNA, 20 bp, Artificial
  CRISPR gRNA sequence
gggcgtccgccgctgtgggt

SEQ ID NO: 516665 - DNA, 20 bp, Artificial
  CRISPR gRNA sequence
tccgccgctgtgggtgagct

SEQ ID NO: 516666 - DNA, 20 bp, Artificial
  CRISPR gRNA sequence
ctgtgggtgagcttggctgc

SEQ ID NO: 516667 - DNA, 20 bp, Artificial
  CRISPR gRNA sequence
gtgagcttggctgccggtgc

SEQ ID NO: 516668 - DNA, 20 bp, Artificial
  CRISPR gRNA sequence
tgagcttggctgccggtgct

SEQ ID NO: 516669 - DNA, 20 bp, Artificial
  CRISPR gRNA sequence
ggctgccggtgctgggaccc

SEQ ID NO: 516670 - DNA, 20 bp, Artificial
  CRISPR gRNA sequence
gctgccggtgctgggaccct

SEQ ID NO: 516671 - DNA, 20 bp, Artificial
  CRISPR gRNA sequence
ctgccggtgctgggaccctg

SEQ ID NO: 516672 - DNA, 20 bp, Artificial
  CRISPR gRNA sequence
tgccggtgctgggaccctgg

SEQ ID NO: 516673 - DNA, 20 bp, Artificial
  CRISPR gRNA sequence
gccggtgctgggaccctggg

SEQ ID NO: 516674 - DNA, 20 bp, Artificial
  CRISPR gRNA sequence
ccggtgctgggaccctgggg

SEQ ID NO: 516675 - DNA, 20 bp, Artificial
  CRISPR gRNA sequence
tgggggggctgccccacgtc

SEQ ID NO: 516676 - DNA, 20 bp, Artificial
  CRISPR gRNA sequence
ccacgtctagctcttcctca

SEQ ID NO: 516677 - DNA, 20 bp, Artificial
  CRISPR gRNA sequence
ctagctcttcctcaaagtga

SEQ ID NO: 516678 - DNA, 20 bp, Artificial
  CRISPR gRNA sequence
tcaaagtgacggcttccatg

SEQ ID NO: 516679 - DNA, 20 bp, Artificial
  CRISPR gRNA sequence
caaagtgacggcttccatgc

SEQ ID NO: 516680 - DNA, 20 bp, Artificial
  CRISPR gRNA sequence
aaagtgacggcttccatgcg

SEQ ID NO: 516681 - DNA, 20 bp, Artificial
  CRISPR gRNA sequence
agtgacggcttccatgcggg

SEQ ID NO: 516682 - DNA, 20 bp, Artificial
  CRISPR gRNA sequence
ttccatgcggggagtgtcct

SEQ ID NO: 516683 - DNA, 20 bp, Artificial
  CRISPR gRNA sequence
tccatgcggggagtgtcctc

SEQ ID NO: 516684 - DNA, 20 bp, Artificial
  CRISPR gRNA sequence
ccatgcggggagtgtcctca

SEQ ID NO: 516685 - DNA, 20 bp, Artificial
  CRISPR gRNA sequence
atgcggggagtgtcctcagg

SEQ ID NO: 516686 - DNA, 20 bp, Artificial
  CRISPR gRNA sequence
ggggagtgtcctcagggaga

SEQ ID NO: 516687 - DNA, 20 bp, Artificial
  CRISPR gRNA sequence
tgaaaacctcccacactcac

SEQ ID NO: 516688 - DNA, 20 bp, Artificial
  CRISPR gRNA sequence
cccctgtttgcatttcccac

SEQ ID NO: 516689 - DNA, 20 bp, Artificial
  CRISPR gRNA sequence
ccctgtttgcatttcccacc

SEQ ID NO: 516690 - DNA, 20 bp, Artificial
  CRISPR gRNA sequence
accaggataatccccttttc

SEQ ID NO: 516691 - DNA, 20 bp, Artificial
  CRISPR gRNA sequence
caggataatccccttttcaa

SEQ ID NO: 516692 - DNA, 20 bp, Artificial
  CRISPR gRNA sequence
tttcaagagcgccaccacga

SEQ ID NO: 516693 - DNA, 20 bp, Artificial
  CRISPR gRNA sequence
ccacgacggtcatgaacccc

SEQ ID NO: 516694 - DNA, 20 bp, Artificial
  CRISPR gRNA sequence
tcatgaaccccaagtttgct

SEQ ID NO: 516695 - DNA, 20 bp, Artificial
  CRISPR gRNA sequence
atgaaccccaagtttgctga

SEQ ID NO: 516696 - DNA, 20 bp, Artificial
  CRISPR gRNA sequence
accccaagtttgctgagagt

SEQ ID NO: 516697 - DNA, 20 bp, Artificial
  CRISPR gRNA sequence
ccccaagtttgctgagagtt

SEQ ID NO: 516698 - DNA, 20 bp, Artificial
  CRISPR gRNA sequence
ccaagtttgctgagagttag

SEQ ID NO: 516699 - DNA, 20 bp, Artificial
  CRISPR gRNA sequence
tgctgagagttaggagcact

SEQ ID NO: 516700 - DNA, 20 bp, Artificial
  CRISPR gRNA sequence
agagttaggagcacttggtg

SEQ ID NO: 516701 - DNA, 20 bp, Artificial
  CRISPR gRNA sequence
taggagcacttggtgaagac

SEQ ID NO: 516702 - DNA, 20 bp, Artificial
  CRISPR gRNA sequence
aggagcacttggtgaagaca

SEQ ID NO: 516703 - DNA, 20 bp, Artificial
  CRISPR gRNA sequence
cttggtgaagacaaggccgt

SEQ ID NO: 516704 - DNA, 20 bp, Artificial
  CRISPR gRNA sequence
ttggtgaagacaaggccgtc

SEQ ID NO: 516705 - DNA, 20 bp, Artificial
  CRISPR gRNA sequence
accatgtctgccccatcacg

SEQ ID NO: 516706 - DNA, 20 bp, Artificial
  CRISPR gRNA sequence
gtctgccccatcacgcggcc

SEQ ID NO: 516707 - DNA, 20 bp, Artificial
  CRISPR gRNA sequence
cccatcacgcggccgagaca

SEQ ID NO: 516708 - DNA, 20 bp, Artificial
  CRISPR gRNA sequence
ggccgagacatggcttgcca

SEQ ID NO: 516709 - DNA, 20 bp, Artificial
  CRISPR gRNA sequence
catggcttgccacagctctt

SEQ ID NO: 516710 - DNA, 20 bp, Artificial
  CRISPR gRNA sequence
atggcttgccacagctcttg

SEQ ID NO: 516711 - DNA, 20 bp, Artificial
  CRISPR gRNA sequence
tgaggatgtcaccaattaac

SEQ ID NO: 516712 - DNA, 20 bp, Artificial
  CRISPR gRNA sequence
tcaccaattaaccagaaatc

SEQ ID NO: 516713 - DNA, 20 bp, Artificial
  CRISPR gRNA sequence
attttccgccctcaaaatga

SEQ ID NO: 516714 - DNA, 20 bp, Artificial
  CRISPR gRNA sequence
cgccctcaaaatgacagcca

SEQ ID NO: 516715 - DNA, 20 bp, Artificial
  CRISPR gRNA sequence
ctcaaaatgacagccatggc

SEQ ID NO: 516716 - DNA, 20 bp, Artificial
  CRISPR gRNA sequence
aaatgacagccatggccggc

SEQ ID NO: 516717 - DNA, 20 bp, Artificial
  CRISPR gRNA sequence
aatgacagccatggccggcc

SEQ ID NO: 516718 - DNA, 20 bp, Artificial
  CRISPR gRNA sequence
catggccggccgggtgcttc

SEQ ID NO: 516719 - DNA, 20 bp, Artificial
  CRISPR gRNA sequence
atggccggccgggtgcttct

SEQ ID NO: 516720 - DNA, 20 bp, Artificial
  CRISPR gRNA sequence
tggccggccgggtgcttctg

SEQ ID NO: 516721 - DNA, 20 bp, Artificial
  CRISPR gRNA sequence
ggccggccgggtgcttctgg

SEQ ID NO: 516722 - DNA, 20 bp, Artificial
  CRISPR gRNA sequence
gggtgcttctgggggctcgt

SEQ ID NO: 516723 - DNA, 20 bp, Artificial
  CRISPR gRNA sequence
ggtgcttctgggggctcgtc

SEQ ID NO: 516724 - DNA, 20 bp, Artificial
  CRISPR gRNA sequence
gtgcttctgggggctcgtcg

SEQ ID NO: 516725 - DNA, 20 bp, Artificial
  CRISPR gRNA sequence
tgcttctgggggctcgtcgg

SEQ ID NO: 516726 - DNA, 20 bp, Artificial
  CRISPR gRNA sequence
gcttctgggggctcgtcggg

SEQ ID NO: 516727 - DNA, 20 bp, Artificial
  CRISPR gRNA sequence
ctgggggctcgtcgggggga

SEQ ID NO: 516728 - DNA, 20 bp, Artificial
  CRISPR gRNA sequence
ggggacagctccactctgac

SEQ ID NO: 516729 - DNA, 20 bp, Artificial
  CRISPR gRNA sequence
cagctccactctgactggca

SEQ ID NO: 516730 - DNA, 20 bp, Artificial
  CRISPR gRNA sequence
tgactggcacagtctttgca

SEQ ID NO: 516731 - DNA, 20 bp, Artificial
  CRISPR gRNA sequence
actggcacagtctttgcatg

SEQ ID NO: 516732 - DNA, 20 bp, Artificial
  CRISPR gRNA sequence
cagtctttgcatggagactt

SEQ ID NO: 516733 - DNA, 20 bp, Artificial
  CRISPR gRNA sequence
agtctttgcatggagacttg

SEQ ID NO: 516734 - DNA, 20 bp, Artificial
  CRISPR gRNA sequence
tctttgcatggagacttgag

SEQ ID NO: 516735 - DNA, 20 bp, Artificial
  CRISPR gRNA sequence
ctttgcatggagacttgagg

SEQ ID NO: 516736 - DNA, 20 bp, Artificial
  CRISPR gRNA sequence
tttgcatggagacttgagga

SEQ ID NO: 516737 - DNA, 20 bp, Artificial
  CRISPR gRNA sequence
tgcatggagacttgaggagg

SEQ ID NO: 516738 - DNA, 20 bp, Artificial
  CRISPR gRNA sequence
gcatggagacttgaggaggg

SEQ ID NO: 516739 - DNA, 20 bp, Artificial
  CRISPR gRNA sequence
catggagacttgaggaggga

SEQ ID NO: 516740 - DNA, 20 bp, Artificial
  CRISPR gRNA sequence
gacttgaggagggagggctt

SEQ ID NO: 516741 - DNA, 20 bp, Artificial
  CRISPR gRNA sequence
acttgaggagggagggcttg

SEQ ID NO: 516742 - DNA, 20 bp, Artificial
  CRISPR gRNA sequence
gaggagggagggcttgaggt

SEQ ID NO: 516743 - DNA, 20 bp, Artificial
  CRISPR gRNA sequence
agggagggcttgaggttggt

SEQ ID NO: 516744 - DNA, 20 bp, Artificial
  CRISPR gRNA sequence
gggagggcttgaggttggtg

SEQ ID NO: 516745 - DNA, 20 bp, Artificial
  CRISPR gRNA sequence
gggcttgaggttggtgaggt

SEQ ID NO: 516746 - DNA, 20 bp, Artificial
  CRISPR gRNA sequence
ggcttgaggttggtgaggtt

SEQ ID NO: 516747 - DNA, 20 bp, Artificial
  CRISPR gRNA sequence
taggtgcgtgtttcctgtgc

SEQ ID NO: 516748 - DNA, 20 bp, Artificial
  CRISPR gRNA sequence
tgcgtgtttcctgtgcaagt

SEQ ID NO: 516749 - DNA, 20 bp, Artificial
  CRISPR gRNA sequence
gcgtgtttcctgtgcaagtc

SEQ ID NO: 516750 - DNA, 20 bp, Artificial
  CRISPR gRNA sequence
tcctgtgcaagtcaggacat

SEQ ID NO: 516751 - DNA, 20 bp, Artificial
  CRISPR gRNA sequence
tcaggacatcagtctgatta

SEQ ID NO: 516752 - DNA, 20 bp, Artificial
  CRISPR gRNA sequence
caggacatcagtctgattaa

SEQ ID NO: 516753 - DNA, 20 bp, Artificial
  CRISPR gRNA sequence
gacatcagtctgattaaagg

SEQ ID NO: 516754 - DNA, 20 bp, Artificial
  CRISPR gRNA sequence
ttatttacatttaaacttgt

SEQ ID NO: 516755 - DNA, 20 bp, Artificial
  CRISPR gRNA sequence
tatttacatttaaacttgtc

SEQ ID NO: 516756 - DNA, 20 bp, Artificial
  CRISPR gRNA sequence
atttacatttaaacttgtca

SEQ ID NO: 516757 - DNA, 20 bp, Artificial
  CRISPR gRNA sequence
ttgttaatcaatcacgtgta

SEQ ID NO: 516758 - DNA, 20 bp, Artificial
  CRISPR gRNA sequence
aaaaaaataaaacttcaata

SEQ ID NO: 516759 - DNA, 20 bp, Artificial
  CRISPR gRNA sequence
aaaaaataaaacttcaatac

SEQ ID NO: 516760 - DNA, 20 bp, Artificial
  CRISPR gRNA sequence
acttcaatacaggctgtcca

SEQ ID NO: 516761 - DNA, 20 bp, Artificial
  CRISPR gRNA sequence
tacaggctgtccatggaaac

SEQ ID NO: 516762 - DNA, 20 bp, Artificial
  CRISPR gRNA sequence
acaggctgtccatggaaact

SEQ ID NO: 516763 - DNA, 20 bp, Artificial
  CRISPR gRNA sequence
gtccgctgtattcccccgac

SEQ ID NO: 516764 - DNA, 20 bp, Artificial
  CRISPR gRNA sequence
gctgtattcccccgactggc

SEQ ID NO: 516765 - DNA, 20 bp, Artificial
  CRISPR gRNA sequence
ctgtattcccccgactggca

SEQ ID NO: 516766 - DNA, 20 bp, Artificial
  CRISPR gRNA sequence
tattcccccgactggcaagg

SEQ ID NO: 516767 - DNA, 20 bp, Artificial
  CRISPR gRNA sequence
cccccgactggcaaggtggc

SEQ ID NO: 516768 - DNA, 20 bp, Artificial
  CRISPR gRNA sequence
ccccgactggcaaggtggcc

SEQ ID NO: 516769 - DNA, 20 bp, Artificial
  CRISPR gRNA sequence
gcaaggtggccaggcacacg

SEQ ID NO: 516770 - DNA, 20 bp, Artificial
  CRISPR gRNA sequence
caaggtggccaggcacacgt

SEQ ID NO: 516771 - DNA, 20 bp, Artificial
  CRISPR gRNA sequence
gcccgctgacctttgccaca

SEQ ID NO: 516772 - DNA, 20 bp, Artificial
  CRISPR gRNA sequence
cccgctgacctttgccacac

SEQ ID NO: 516773 - DNA, 20 bp, Artificial
  CRISPR gRNA sequence
acctttgccacacaggcaca

SEQ ID NO: 516774 - DNA, 20 bp, Artificial
  CRISPR gRNA sequence
ttgccacacaggcacacagc

SEQ ID NO: 516775 - DNA, 20 bp, Artificial
  CRISPR gRNA sequence
ctggccaccttgccagtcgg

SEQ ID NO: 516776 - DNA, 20 bp, Artificial
  CRISPR gRNA sequence
ttgattaacaatataattaa

SEQ ID NO: 516777 - DNA, 20 bp, Artificial
  CRISPR gRNA sequence
catgcaaagactgtgccagt

SEQ ID NO: 516778 - DNA, 20 bp, Artificial
  CRISPR gRNA sequence
attttgagggcggaaaataa

SEQ ID NO: 516779 - DNA, 20 bp, Artificial
  CRISPR gRNA sequence
cgcgtgatggggcagacatg

SEQ ID NO: 516780 - DNA, 20 bp, Artificial
  CRISPR gRNA sequence
ctcctaactctcagcaaact

SEQ ID NO: 516781 - DNA, 20 bp, Artificial
  CRISPR gRNA sequence
cgtggtggcgctcttgaaaa

SEQ ID NO: 516782 - DNA, 20 bp, Artificial
  CRISPR gRNA sequence
ggaaatgcaaacaggggctt

SEQ ID NO: 516783 - DNA, 20 bp, Artificial
  CRISPR gRNA sequence
agtgtgggaggttttcagag

SEQ ID NO: 516784 - DNA, 20 bp, Artificial
  CRISPR gRNA sequence
tagacgtggggcagcccccc

SEQ ID NO: 516785 - DNA, 20 bp, Artificial
  CRISPR gRNA sequence
gacaagctgcctggggaggc

SEQ ID NO: 516786 - DNA, 20 bp, Artificial
  CRISPR gRNA sequence
aggccggggtgcagccacac

SEQ ID NO: 516787 - DNA, 20 bp, Artificial
  CRISPR gRNA sequence
tactcccggaggtcgctcag

SEQ ID NO: 516788 - DNA, 20 bp, Artificial
  CRISPR gRNA sequence
gccttccagatgaccagcag

SEQ ID NO: 516789 - DNA, 20 bp, Artificial
  CRISPR gRNA sequence
caccatccatcaccatggcc

SEQ ID NO: 516790 - DNA, 20 bp, Artificial
  CRISPR gRNA sequence
agaacctggcccagcccctg

SEQ ID NO: 516791 - DNA, 20 bp, Artificial
  CRISPR gRNA sequence
gacagagaagaaggcagggc

SEQ ID NO: 516792 - DNA, 20 bp, Artificial
  CRISPR gRNA sequence
agggtaccgggcagccagga

SEQ ID NO: 516793 - DNA, 20 bp, Artificial
  CRISPR gRNA sequence
aggacagagtgctaatactg

SEQ ID NO: 516794 - DNA, 20 bp, Artificial
  CRISPR gRNA sequence
gggaccccgctctcctacag

SEQ ID NO: 516795 - DNA, 20 bp, Artificial
  CRISPR gRNA sequence
gcagagttcagaaccaggct

SEQ ID NO: 516796 - DNA, 20 bp, Artificial
  CRISPR gRNA sequence
accaggctcagggtccctgc

SEQ ID NO: 516797 - DNA, 20 bp, Artificial
  CRISPR gRNA sequence
tcagcaggtgaggccggtgc

SEQ ID NO: 516798 - DNA, 20 bp, Artificial
  CRISPR gRNA sequence
caaaggtgaagtgacttggc

SEQ ID NO: 516799 - DNA, 20 bp, Artificial
  CRISPR gRNA sequence
tgtccctcaaagtggcccgc

SEQ ID NO: 516800 - DNA, 20 bp, Artificial
  CRISPR gRNA sequence
gggttcctgccctggcaggt

SEQ ID NO: 516801 - DNA, 20 bp, Artificial
  CRISPR gRNA sequence
ctgcagccccaggcccacat

SEQ ID NO: 516802 - DNA, 20 bp, Artificial
  CRISPR gRNA sequence
agagacccccgccgcctgcc

SEQ ID NO: 516803 - DNA, 20 bp, Artificial
  CRISPR gRNA sequence
ctcccaggtctcagttctgc

SEQ ID NO: 516804 - DNA, 20 bp, Artificial
  CRISPR gRNA sequence
cggctgctggccatgcctga

SEQ ID NO: 516805 - DNA, 20 bp, Artificial
  CRISPR gRNA sequence
gggcctggttccaactggag

SEQ ID NO: 516806 - DNA, 20 bp, Artificial
  CRISPR gRNA sequence
ccaactggagctgaatgaga

SEQ ID NO: 516807 - DNA, 20 bp, Artificial
  CRISPR gRNA sequence
gggactggttccgactggag

SEQ ID NO: 516808 - DNA, 20 bp, Artificial
  CRISPR gRNA sequence
ccgactggagccgaatgaga

SEQ ID NO: 516809 - DNA, 20 bp, Artificial
  CRISPR gRNA sequence
tccgactggactggagccga

SEQ ID NO: 516810 - DNA, 20 bp, Artificial
  CRISPR gRNA sequence
cagggctgagagccgagcac

SEQ ID NO: 516811 - DNA, 20 bp, Artificial
  CRISPR gRNA sequence
gtctgctgcccagcttgatg

SEQ ID NO: 516812 - DNA, 20 bp, Artificial
  CRISPR gRNA sequence
gagggaaaggggaggctgct

SEQ ID NO: 516813 - DNA, 20 bp, Artificial
  CRISPR gRNA sequence
gtaggccacccagcagccct

SEQ ID NO: 516814 - DNA, 20 bp, Artificial
  CRISPR gRNA sequence
cttgcaggtcctgcccttca

SEQ ID NO: 516815 - DNA, 20 bp, Artificial
  CRISPR gRNA sequence
ccaggtgtgagcatcggtgc

SEQ ID NO: 516816 - DNA, 20 bp, Artificial
  CRISPR gRNA sequence
ccggcaacgggggctcgggc

SEQ ID NO: 516817 - DNA, 20 bp, Artificial
  CRISPR gRNA sequence
tgtccaccagggggggcagg

SEQ ID NO: 516818 - DNA, 20 bp, Artificial
  CRISPR gRNA sequence
ggggcccaagtggggcagat

SEQ ID NO: 516819 - DNA, 20 bp, Artificial
  CRISPR gRNA sequence
gtggggcagatgcgggtgca

SEQ ID NO: 516820 - DNA, 20 bp, Artificial
  CRISPR gRNA sequence
cgcggtgcagaggtgctcac

SEQ ID NO: 516821 - DNA, 20 bp, Artificial
  CRISPR gRNA sequence
agaggtgctcactggggtcc

SEQ ID NO: 516822 - DNA, 20 bp, Artificial
  CRISPR gRNA sequence
tccccgagtgagcccggctg

SEQ ID NO: 516823 - DNA, 20 bp, Artificial
  CRISPR gRNA sequence
ggctgctgggtaggtggccg

SEQ ID NO: 516824 - DNA, 20 bp, Artificial
  CRISPR gRNA sequence
tgggtaggtggccggggagt

SEQ ID NO: 516825 - DNA, 20 bp, Artificial
  CRISPR gRNA sequence
gcactcacatgtacttgcca

SEQ ID NO: 516826 - DNA, 20 bp, Artificial
  CRISPR gRNA sequence
gcacagaggcagctggtagc

SEQ ID NO: 516827 - DNA, 20 bp, Artificial
  CRISPR gRNA sequence
accactacactcaacacgcc

SEQ ID NO: 516828 - DNA, 20 bp, Artificial
  CRISPR gRNA sequence
gcacgctgagccctcaaagc

SEQ ID NO: 516829 - DNA, 20 bp, Artificial
  CRISPR gRNA sequence
cgcctgcctcctccagcctg

SEQ ID NO: 516830 - DNA, 20 bp, Artificial
  CRISPR gRNA sequence
tggacctcccctgccctgct

SEQ ID NO: 516831 - DNA, 20 bp, Artificial
  CRISPR gRNA sequence
acacagaaactgaggcaggg

SEQ ID NO: 516832 - DNA, 20 bp, Artificial
  CRISPR gRNA sequence
agacttgcactgtctgtcct

SEQ ID NO: 516833 - DNA, 20 bp, Artificial
  CRISPR gRNA sequence
ccccctttctgttccactcg

SEQ ID NO: 516834 - DNA, 20 bp, Artificial
  CRISPR gRNA sequence
ccccagccctgagcagatga

SEQ ID NO: 516835 - DNA, 20 bp, Artificial
  CRISPR gRNA sequence
ggggccccgcgttccctccc

SEQ ID NO: 516836 - DNA, 20 bp, Artificial
  CRISPR gRNA sequence
tgctgcgataccggtgctct

SEQ ID NO: 516837 - DNA, 20 bp, Artificial
  CRISPR gRNA sequence
actgacaggccaggttgtgg

SEQ ID NO: 516838 - DNA, 20 bp, Artificial
  CRISPR gRNA sequence
tgtgggagaatgcagggaca

SEQ ID NO: 516839 - DNA, 20 bp, Artificial
  CRISPR gRNA sequence
cagaggaggaagctgcagga

SEQ ID NO: 516840 - DNA, 20 bp, Artificial
  CRISPR gRNA sequence
gaagctgcaggaccgagtgt

SEQ ID NO: 516841 - DNA, 20 bp, Artificial
  CRISPR gRNA sequence
acacctgccaagtgttccga

SEQ ID NO: 516842 - DNA, 20 bp, Artificial
  CRISPR gRNA sequence
tgcacacccaggacagtggg

SEQ ID NO: 516843 - DNA, 20 bp, Artificial
  CRISPR gRNA sequence
aagggcactgccaccaggac

SEQ ID NO: 516844 - DNA, 20 bp, Artificial
  CRISPR gRNA sequence
ggtgaccagagcaaaggggg

SEQ ID NO: 516845 - DNA, 20 bp, Artificial
  CRISPR gRNA sequence
cccccgggcaggccgcctgg

SEQ ID NO: 516846 - DNA, 20 bp, Artificial
  CRISPR gRNA sequence
gtgccatgtgaacctcccca

SEQ ID NO: 516847 - DNA, 20 bp, Artificial
  CRISPR gRNA sequence
tcccccacttctccctgagg

SEQ ID NO: 516848 - DNA, 20 bp, Artificial
  CRISPR gRNA sequence
tggggtgcccacgcctggca

SEQ ID NO: 516849 - DNA, 20 bp, Artificial
  CRISPR gRNA sequence
gggctgccagcctgatggcc

SEQ ID NO: 516850 - DNA, 20 bp, Artificial
  CRISPR gRNA sequence
gtcagagagaagccagctcc

SEQ ID NO: 516851 - DNA, 20 bp, Artificial
  CRISPR gRNA sequence
gggcctccatcctctggtga

SEQ ID NO: 516852 - DNA, 20 bp, Artificial
  CRISPR gRNA sequence
ctgcccacaagtcccctgcc

SEQ ID NO: 516853 - DNA, 20 bp, Artificial
  CRISPR gRNA sequence
ccttgggtcctccatggcca

SEQ ID NO: 516854 - DNA, 20 bp, Artificial
  CRISPR gRNA sequence
tcctccatggccagagagtg

SEQ ID NO: 516855 - DNA, 20 bp, Artificial
  CRISPR gRNA sequence
tggtgccctggctcaggagc

SEQ ID NO: 516856 - DNA, 20 bp, Artificial
  CRISPR gRNA sequence
gcacgggtgagggcttgccg

SEQ ID NO: 516857 - DNA, 20 bp, Artificial
  CRISPR gRNA sequence
tgagggcttgccgaggggtt

SEQ ID NO: 516858 - DNA, 20 bp, Artificial
  CRISPR gRNA sequence
ctcctgcagaagggggcccc

SEQ ID NO: 516859 - DNA, 20 bp, Artificial
  CRISPR gRNA sequence
cccccaggatgcctgctccg

SEQ ID NO: 516860 - DNA, 20 bp, Artificial
  CRISPR gRNA sequence
ctgctccgtggggtggggga

SEQ ID NO: 516861 - DNA, 20 bp, Artificial
  CRISPR gRNA sequence
acctgccgacacctgccctg

SEQ ID NO: 516862 - DNA, 20 bp, Artificial
  CRISPR gRNA sequence
tgccctgtggggtggggctc

SEQ ID NO: 516863 - DNA, 20 bp, Artificial
  CRISPR gRNA sequence
atgtccgtgaagcccagcgc

SEQ ID NO: 516864 - DNA, 20 bp, Artificial
  CRISPR gRNA sequence
cggatgacaaacgactgctc

SEQ ID NO: 516865 - DNA, 20 bp, Artificial
  CRISPR gRNA sequence
aggtggggaccctcggtggc

SEQ ID NO: 516866 - DNA, 20 bp, Artificial
  CRISPR gRNA sequence
cctcacctcctggcctctgc

SEQ ID NO: 516867 - DNA, 20 bp, Artificial
  CRISPR gRNA sequence
tggcctctgcaggggtcctg

SEQ ID NO: 516868 - DNA, 20 bp, Artificial
  CRISPR gRNA sequence
ggggttcagcgtggggagga

SEQ ID NO: 516869 - DNA, 20 bp, Artificial
  CRISPR gRNA sequence
actcccgcactggccggcac

SEQ ID NO: 516870 - DNA, 20 bp, Artificial
  CRISPR gRNA sequence
catgagggaaacgttctggt

SEQ ID NO: 516871 - DNA, 20 bp, Artificial
  CRISPR gRNA sequence
cagcactgtgggaggccgag

SEQ ID NO: 516872 - DNA, 20 bp, Artificial
  CRISPR gRNA sequence
cgggtagatcatctgagggc

SEQ ID NO: 516873 - DNA, 20 bp, Artificial
  CRISPR gRNA sequence
agtcccagctactcaggagg

SEQ ID NO: 516874 - DNA, 20 bp, Artificial
  CRISPR gRNA sequence
tactcaggaggctgagtcag

SEQ ID NO: 516875 - DNA, 20 bp, Artificial
  CRISPR gRNA sequence
ggctgagtcaggagaatcac

SEQ ID NO: 516876 - DNA, 20 bp, Artificial
  CRISPR gRNA sequence
ttaccaagaaacatgtttga

SEQ ID NO: 516877 - DNA, 20 bp, Artificial
  CRISPR gRNA sequence
caatgaaagcaagtgtcttg

SEQ ID NO: 516878 - DNA, 20 bp, Artificial
  CRISPR gRNA sequence
caaaaagaaacaacaaatga

SEQ ID NO: 516879 - DNA, 20 bp, Artificial
  CRISPR gRNA sequence
taatgtttctgtcaaaaaaa

SEQ ID NO: 516880 - DNA, 20 bp, Artificial
  CRISPR gRNA sequence
agtctgcagtggcctgaccc

SEQ ID NO: 516881 - DNA, 20 bp, Artificial
  CRISPR gRNA sequence
gggatttgggctccaggttg

SEQ ID NO: 516882 - DNA, 20 bp, Artificial
  CRISPR gRNA sequence
aagcgtctggcctcggcaga

SEQ ID NO: 516883 - DNA, 20 bp, Artificial
  CRISPR gRNA sequence
gaggatgtgaaggaaagaaa

SEQ ID NO: 516884 - DNA, 20 bp, Artificial
  CRISPR gRNA sequence
aaagaaacagggtccttcca

SEQ ID NO: 516885 - DNA, 20 bp, Artificial
  CRISPR gRNA sequence
gtgcccctccctgcccccgt

SEQ ID NO: 516886 - DNA, 20 bp, Artificial
  CRISPR gRNA sequence
ccctgcccccgtcagagtgc

SEQ ID NO: 516887 - DNA, 20 bp, Artificial
  CRISPR gRNA sequence
cccaggacccctcagtgtgc

SEQ ID NO: 516888 - DNA, 20 bp, Artificial
  CRISPR gRNA sequence
cccagagcccctcagcaagc

SEQ ID NO: 516889 - DNA, 20 bp, Artificial
  CRISPR gRNA sequence
cgtcactccattgctgcaga

SEQ ID NO: 516890 - DNA, 20 bp, Artificial
  CRISPR gRNA sequence
aaggagtcgtaggtgacttt

SEQ ID NO: 516891 - DNA, 20 bp, Artificial
  CRISPR gRNA sequence
gatccaggaagaccctggag

SEQ ID NO: 516892 - DNA, 20 bp, Artificial
  CRISPR gRNA sequence
gagagcggttactcttgggg

SEQ ID NO: 516893 - DNA, 20 bp, Artificial
  CRISPR gRNA sequence
tgacacagaggagagcacag

SEQ ID NO: 516894 - DNA, 20 bp, Artificial
  CRISPR gRNA sequence
agagcacagcaggatgtgct

SEQ ID NO: 516895 - DNA, 20 bp, Artificial
  CRISPR gRNA sequence
cacagggactagcatggagc

SEQ ID NO: 516896 - DNA, 20 bp, Artificial
  CRISPR gRNA sequence
ggagccagggtgtgagcctc

SEQ ID NO: 516897 - DNA, 20 bp, Artificial
  CRISPR gRNA sequence
gcttctgctgctcctcagcc

SEQ ID NO: 516898 - DNA, 20 bp, Artificial
  CRISPR gRNA sequence
gggacaggttcataggggca

SEQ ID NO: 516899 - DNA, 20 bp, Artificial
  CRISPR gRNA sequence
caggttcataggggcatcgg

SEQ ID NO: 516900 - DNA, 20 bp, Artificial
  CRISPR gRNA sequence
gggcagtggctggcacccag

SEQ ID NO: 516901 - DNA, 20 bp, Artificial
  CRISPR gRNA sequence
cacccaggagggtctgctct

SEQ ID NO: 516902 - DNA, 20 bp, Artificial
  CRISPR gRNA sequence
cagcaggacctttggcctag

SEQ ID NO: 516903 - DNA, 20 bp, Artificial
  CRISPR gRNA sequence
tggcctagaaggatccaggc

SEQ ID NO: 516904 - DNA, 20 bp, Artificial
  CRISPR gRNA sequence
tctgagaacatctctcacct

SEQ ID NO: 516905 - DNA, 20 bp, Artificial
  CRISPR gRNA sequence
gacctctggtgcctggggcc

SEQ ID NO: 516906 - DNA, 20 bp, Artificial
  CRISPR gRNA sequence
ggctccccaggggagcagcc

SEQ ID NO: 516907 - DNA, 20 bp, Artificial
  CRISPR gRNA sequence
cgtgcaccagggagaaattc

SEQ ID NO: 516908 - DNA, 20 bp, Artificial
  CRISPR gRNA sequence
ggacaggtgaacagagcaag

SEQ ID NO: 516909 - DNA, 20 bp, Artificial
  CRISPR gRNA sequence
gcaagaggaattccaccccc

SEQ ID NO: 516910 - DNA, 20 bp, Artificial
  CRISPR gRNA sequence
ccagggcccaagtccactgt

SEQ ID NO: 516911 - DNA, 20 bp, Artificial
  CRISPR gRNA sequence
ctccatagagacccgcagag

SEQ ID NO: 516912 - DNA, 20 bp, Artificial
  CRISPR gRNA sequence
gagacccgcagagaagagtc

SEQ ID NO: 516913 - DNA, 20 bp, Artificial
  CRISPR gRNA sequence
gcagagaagagtctggaatg

SEQ ID NO: 516914 - DNA, 20 bp, Artificial
  CRISPR gRNA sequence
tccccgtggaagtgccgggc

SEQ ID NO: 516915 - DNA, 20 bp, Artificial
  CRISPR gRNA sequence
gggagattgctggccacccc

SEQ ID NO: 516916 - DNA, 20 bp, Artificial
  CRISPR gRNA sequence
ggccaccccatgggtcccag

SEQ ID NO: 516917 - DNA, 20 bp, Artificial
  CRISPR gRNA sequence
aatgagatggaccacattgc

SEQ ID NO: 516918 - DNA, 20 bp, Artificial
  CRISPR gRNA sequence
agctcccccacggctgactt

SEQ ID NO: 516919 - DNA, 20 bp, Artificial
  CRISPR gRNA sequence
ctgacttggggatgatctcg

SEQ ID NO: 516920 - DNA, 20 bp, Artificial
  CRISPR gRNA sequence
gcagttttgcacttggtccc

SEQ ID NO: 516921 - DNA, 20 bp, Artificial
  CRISPR gRNA sequence
atgtgtggtaagaggttctt

SEQ ID NO: 516922 - DNA, 20 bp, Artificial
  CRISPR gRNA sequence
agctgcccaggggccacgcc

SEQ ID NO: 516923 - DNA, 20 bp, Artificial
  CRISPR gRNA sequence
tgggaagattgcctgagccc

SEQ ID NO: 516924 - DNA, 20 bp, Artificial
  CRISPR gRNA sequence
tctacaaaaagtacaaatat

SEQ ID NO: 516925 - DNA, 20 bp, Artificial
  CRISPR gRNA sequence
tactcgggaggctgaggcag

SEQ ID NO: 516926 - DNA, 20 bp, Artificial
  CRISPR gRNA sequence
cagcactttgggaggccaaa

SEQ ID NO: 516927 - DNA, 20 bp, Artificial
  CRISPR gRNA sequence
actttgggaggccaaagtgg

SEQ ID NO: 516928 - DNA, 20 bp, Artificial
  CRISPR gRNA sequence
gtgggtggatcactgaggtc

SEQ ID NO: 516929 - DNA, 20 bp, Artificial
  CRISPR gRNA sequence
aaaaattactgttgcatcat

SEQ ID NO: 516930 - DNA, 20 bp, Artificial
  CRISPR gRNA sequence
cattgtccaggcctgcccgt

SEQ ID NO: 516931 - DNA, 20 bp, Artificial
  CRISPR gRNA sequence
tgagtcctcctgcctgcggt

SEQ ID NO: 516932 - DNA, 20 bp, Artificial
  CRISPR gRNA sequence
tgagtgatcccgcctgcggt

SEQ ID NO: 516933 - DNA, 20 bp, Artificial
  CRISPR gRNA sequence
tgagtgctcccgcctgcggt

SEQ ID NO: 516934 - DNA, 20 bp, Artificial
  CRISPR gRNA sequence
tgagtgatcccgcctgcagt

SEQ ID NO: 516935 - DNA, 20 bp, Artificial
  CRISPR gRNA sequence
tgactgctcccgcctgtggt

SEQ ID NO: 516936 - DNA, 20 bp, Artificial
  CRISPR gRNA sequence
tgagtactcctgcctgtggt

SEQ ID NO: 516937 - DNA, 20 bp, Artificial
  CRISPR gRNA sequence
ggtgtgagtgatcctgcctg

SEQ ID NO: 516938 - DNA, 20 bp, Artificial
  CRISPR gRNA sequence
atttcaagctcgcaatatca

SEQ ID NO: 516939 - DNA, 20 bp, Artificial
  CRISPR gRNA sequence
gcatggtggccagtgttggc

SEQ ID NO: 516940 - DNA, 20 bp, Artificial
  CRISPR gRNA sequence
gaatttccaccacacaggta

SEQ ID NO: 516941 - DNA, 20 bp, Artificial
  CRISPR gRNA sequence
gtaggcggaagtagccccac

SEQ ID NO: 516942 - DNA, 20 bp, Artificial
  CRISPR gRNA sequence
gcggaagtagccccacgagg

SEQ ID NO: 516943 - DNA, 20 bp, Artificial
  CRISPR gRNA sequence
catcggctcttggcactcta

SEQ ID NO: 516944 - DNA, 20 bp, Artificial
  CRISPR gRNA sequence
tggcactctactgagtttcc

SEQ ID NO: 516945 - DNA, 20 bp, Artificial
  CRISPR gRNA sequence
caggaacacggagcagatgg

SEQ ID NO: 516946 - DNA, 20 bp, Artificial
  CRISPR gRNA sequence
ccaaggctcagcagtaggca

SEQ ID NO: 516947 - DNA, 20 bp, Artificial
  CRISPR gRNA sequence
cctggtgccacaccatcgcc

SEQ ID NO: 516948 - DNA, 20 bp, Artificial
  CRISPR gRNA sequence
ggctgccatgacaaatggca

SEQ ID NO: 516949 - DNA, 20 bp, Artificial
  CRISPR gRNA sequence
ctgaccagcaggtggtctct

SEQ ID NO: 516950 - DNA, 20 bp, Artificial
  CRISPR gRNA sequence
tcccggcagcctgaccagct

SEQ ID NO: 516951 - DNA, 20 bp, Artificial
  CRISPR gRNA sequence
cagctctgggtgcccactcg

SEQ ID NO: 516952 - DNA, 20 bp, Artificial
  CRISPR gRNA sequence
cccccatcccgtgtctcccg

SEQ ID NO: 516953 - DNA, 20 bp, Artificial
  CRISPR gRNA sequence
cacgaggttgagcttgtagc

SEQ ID NO: 516954 - DNA, 20 bp, Artificial
  CRISPR gRNA sequence
gctgggatacgggcctgaca

SEQ ID NO: 516955 - DNA, 20 bp, Artificial
  CRISPR gRNA sequence
gcactttccttccccaaacc

SEQ ID NO: 516956 - DNA, 20 bp, Artificial
  CRISPR gRNA sequence
gaagatggcggtgatggccc

SEQ ID NO: 516957 - DNA, 20 bp, Artificial
  CRISPR gRNA sequence
gccagcaggtcggtcactgt

SEQ ID NO: 516958 - DNA, 20 bp, Artificial
  CRISPR gRNA sequence
aggtcggtcactgtccggat

SEQ ID NO: 516959 - DNA, 20 bp, Artificial
  CRISPR gRNA sequence
ccctttagggcggctgctct

SEQ ID NO: 516960 - DNA, 20 bp, Artificial
  CRISPR gRNA sequence
gcggctgctctgtgaattcc

SEQ ID NO: 516961 - DNA, 20 bp, Artificial
  CRISPR gRNA sequence
ctgctctgtgaattccctga

SEQ ID NO: 516962 - DNA, 20 bp, Artificial
  CRISPR gRNA sequence
agatgaggaaactgagggct

SEQ ID NO: 516963 - DNA, 20 bp, Artificial
  CRISPR gRNA sequence
tcctgtggtaagtaacagag

SEQ ID NO: 516964 - DNA, 20 bp, Artificial
  CRISPR gRNA sequence
gcagtgtttccttccttcta

SEQ ID NO: 516965 - DNA, 20 bp, Artificial
  CRISPR gRNA sequence
gccacaccccacacatgcca

SEQ ID NO: 516966 - DNA, 20 bp, Artificial
  CRISPR gRNA sequence
cttggtacatcctacccgat

SEQ ID NO: 516967 - DNA, 20 bp, Artificial
  CRISPR gRNA sequence
tcctggggcctcaggtcaca

SEQ ID NO: 516968 - DNA, 20 bp, Artificial
  CRISPR gRNA sequence
gatagtcccacagtgtgatt

SEQ ID NO: 516969 - DNA, 20 bp, Artificial
  CRISPR gRNA sequence
ctagagactgaggtcagcca

SEQ ID NO: 516970 - DNA, 20 bp, Artificial
  CRISPR gRNA sequence
aggccacacatcatcgctgg

SEQ ID NO: 516971 - DNA, 20 bp, Artificial
  CRISPR gRNA sequence
gggcagcggctggcacccag

SEQ ID NO: 516972 - DNA, 20 bp, Artificial
  CRISPR gRNA sequence
ctctgcaataaactgtaact

SEQ ID NO: 516973 - DNA, 20 bp, Artificial
  CRISPR gRNA sequence
tggcactagcagcggaaatg

SEQ ID NO: 516974 - DNA, 20 bp, Artificial
  CRISPR gRNA sequence
tgtgtaattttatcttcacg

SEQ ID NO: 516975 - DNA, 20 bp, Artificial
  CRISPR gRNA sequence
aagtgtgtttccataaaata

SEQ ID NO: 516976 - DNA, 20 bp, Artificial
  CRISPR gRNA sequence
aagacatgctgttaacacag

SEQ ID NO: 516977 - DNA, 20 bp, Artificial
  CRISPR gRNA sequence
gctgagtttcagggacgggg

SEQ ID NO: 516978 - DNA, 20 bp, Artificial
  CRISPR gRNA sequence
gcctcgggctcctcacctag

SEQ ID NO: 516979 - DNA, 20 bp, Artificial
  CRISPR gRNA sequence
cgctcagacctgcagtggcg

SEQ ID NO: 516980 - DNA, 20 bp, Artificial
  CRISPR gRNA sequence
ctgaaacatgcccccaccca

SEQ ID NO: 516981 - DNA, 20 bp, Artificial
  CRISPR gRNA sequence
ctggtcaccgcgaagatggg

SEQ ID NO: 516982 - DNA, 20 bp, Artificial
  CRISPR gRNA sequence
gtgcgccagctggcccaccg

SEQ ID NO: 516983 - DNA, 20 bp, Artificial
  CRISPR gRNA sequence
gaggtcctgctcagttggcc

SEQ ID NO: 516984 - DNA, 20 bp, Artificial
  CRISPR gRNA sequence
agaggcagaggctgccacgc

SEQ ID NO: 516985 - DNA, 20 bp, Artificial
  CRISPR gRNA sequence
tgtgcatagactcgggcttt

SEQ ID NO: 516986 - DNA, 20 bp, Artificial
  CRISPR gRNA sequence
aggcgtctcaccgtgggact

SEQ ID NO: 516987 - DNA, 20 bp, Artificial
  CRISPR gRNA sequence
actggggatgtccacggggg

SEQ ID NO: 516988 - DNA, 20 bp, Artificial
  CRISPR gRNA sequence
actcagtttcggtagaggcc

SEQ ID NO: 516989 - DNA, 20 bp, Artificial
  CRISPR gRNA sequence
tcaggtgcggctctccctac

SEQ ID NO: 516990 - DNA, 20 bp, Artificial
  CRISPR gRNA sequence
tgtggctcccggcggaggac

SEQ ID NO: 516991 - DNA, 20 bp, Artificial
  CRISPR gRNA sequence
gaggccgggagggggaggag

SEQ ID NO: 516992 - DNA, 20 bp, Artificial
  CRISPR gRNA sequence
gggggaggaggcggatgctt

SEQ ID NO: 516993 - DNA, 20 bp, Artificial
  CRISPR gRNA sequence
ctggccagaggcggggacgg

SEQ ID NO: 516994 - DNA, 20 bp, Artificial
  CRISPR gRNA sequence
gggctggagaccaacagagc

SEQ ID NO: 516995 - DNA, 20 bp, Artificial
  CRISPR gRNA sequence
gggcttccagaagtttcctc

SEQ ID NO: 516996 - DNA, 20 bp, Artificial
  CRISPR gRNA sequence
tttcctcaggaatctgctcc

SEQ ID NO: 516997 - DNA, 20 bp, Artificial
  CRISPR gRNA sequence
ggtgtcctgccaggcggtgc

SEQ ID NO: 516998 - DNA, 20 bp, Artificial
  CRISPR gRNA sequence
ccaggcggtgcctgggtgcc

SEQ ID NO: 516999 - DNA, 20 bp, Artificial
  CRISPR gRNA sequence
ggtgcctggggtggggactt

SEQ ID NO: 517000 - DNA, 20 bp, Artificial
  CRISPR gRNA sequence
aggtgacagcggccgtcgtt

SEQ ID NO: 517001 - DNA, 20 bp, Artificial
  CRISPR gRNA sequence
cagcggccgtcgttgggggt

SEQ ID NO: 517002 - DNA, 20 bp, Artificial
  CRISPR gRNA sequence
tgagaagaaggcgtgggggg

SEQ ID NO: 517003 - DNA, 20 bp, Artificial
  CRISPR gRNA sequence
aggagacgatgcagagctgg

SEQ ID NO: 517004 - DNA, 20 bp, Artificial
  CRISPR gRNA sequence
ggggtggcccggaggctggt

SEQ ID NO: 517005 - DNA, 20 bp, Artificial
  CRISPR gRNA sequence
ggtgtgggtccccctttccc

SEQ ID NO: 517006 - DNA, 20 bp, Artificial
  CRISPR gRNA sequence
ccgtgcacatgtgaggcgca

SEQ ID NO: 517007 - DNA, 20 bp, Artificial
  CRISPR gRNA sequence
acgtgtgggccacacgcaga

SEQ ID NO: 517008 - DNA, 20 bp, Artificial
  CRISPR gRNA sequence
cctgaggggcccagcaggcc

SEQ ID NO: 517009 - DNA, 20 bp, Artificial
  CRISPR gRNA sequence
agggaagcaggagagctaag

SEQ ID NO: 517010 - DNA, 20 bp, Artificial
  CRISPR gRNA sequence
gttaggctgacagtcacaaa

SEQ ID NO: 517011 - DNA, 20 bp, Artificial
  CRISPR gRNA sequence
cccacccggcctggagggag

SEQ ID NO: 517012 - DNA, 20 bp, Artificial
  CRISPR gRNA sequence
taggcttcataaggtttgcc

SEQ ID NO: 517013 - DNA, 20 bp, Artificial
  CRISPR gRNA sequence
ctttcctgcatgggcagcag

SEQ ID NO: 517014 - DNA, 20 bp, Artificial
  CRISPR gRNA sequence
tgctctccccaggcccaggc

SEQ ID NO: 517015 - DNA, 20 bp, Artificial
  CRISPR gRNA sequence
ccctcagacgacctgccggc

SEQ ID NO: 517016 - DNA, 20 bp, Artificial
  CRISPR gRNA sequence
tcatggcgtccagcccaccc

SEQ ID NO: 517017 - DNA, 20 bp, Artificial
  CRISPR gRNA sequence
gacctcggtctgaaactggt

SEQ ID NO: 517018 - DNA, 20 bp, Artificial
  CRISPR gRNA sequence
ctctttctccttgttggggc

SEQ ID NO: 517019 - DNA, 20 bp, Artificial
  CRISPR gRNA sequence
gcatgggtttcgcagcttat

SEQ ID NO: 517020 - DNA, 20 bp, Artificial
  CRISPR gRNA sequence
agaaagcaagatggcacatg

SEQ ID NO: 517021 - DNA, 20 bp, Artificial
  CRISPR gRNA sequence
gtgggcgtgtgtgtgaacct

SEQ ID NO: 517022 - DNA, 20 bp, Artificial
  CRISPR gRNA sequence
cctgggagtgtgcaatgtac

SEQ ID NO: 517023 - DNA, 20 bp, Artificial
  CRISPR gRNA sequence
agccatctgcatgtgtaaac

SEQ ID NO: 517024 - DNA, 20 bp, Artificial
  CRISPR gRNA sequence
tttatgtacgatttatacat

SEQ ID NO: 517025 - DNA, 20 bp, Artificial
  CRISPR gRNA sequence
acatgtgagtgaagacatac

SEQ ID NO: 517026 - DNA, 20 bp, Artificial
  CRISPR gRNA sequence
gaagacatacatgggtgatc

SEQ ID NO: 517027 - DNA, 20 bp, Artificial
  CRISPR gRNA sequence
gcattcacgtgtgtgtgcat

SEQ ID NO: 517028 - DNA, 20 bp, Artificial
  CRISPR gRNA sequence
acgtgtgtgtgcatttgagt

SEQ ID NO: 517029 - DNA, 20 bp, Artificial
  CRISPR gRNA sequence
gagcatccatttgtgcatgt

SEQ ID NO: 517030 - DNA, 20 bp, Artificial
  CRISPR gRNA sequence
atgtgaggatacattcatgt

SEQ ID NO: 517031 - DNA, 20 bp, Artificial
  CRISPR gRNA sequence
gtttgagcatgcatttgtgt

SEQ ID NO: 517032 - DNA, 20 bp, Artificial
  CRISPR gRNA sequence
cccgcatgtagggaaggtgg

SEQ ID NO: 517033 - DNA, 20 bp, Artificial
  CRISPR gRNA sequence
tgtttaataattggcactgt

SEQ ID NO: 517034 - DNA, 20 bp, Artificial
  CRISPR gRNA sequence
aagtgttggggagccaggga

SEQ ID NO: 517035 - DNA, 20 bp, Artificial
  CRISPR gRNA sequence
ggcaggccgactgcagccct

SEQ ID NO: 517036 - DNA, 20 bp, Artificial
  CRISPR gRNA sequence
cccagatctaccctggggac

SEQ ID NO: 517037 - DNA, 20 bp, Artificial
  CRISPR gRNA sequence
accctggggacctgagtgcg

SEQ ID NO: 517038 - DNA, 20 bp, Artificial
  CRISPR gRNA sequence
gagttgtgtgggccacaggc

SEQ ID NO: 517039 - DNA, 20 bp, Artificial
  CRISPR gRNA sequence
gggccacaggcaggagtggc

SEQ ID NO: 517040 - DNA, 20 bp, Artificial
  CRISPR gRNA sequence
ggccagggtctgggaaagga

SEQ ID NO: 517041 - DNA, 20 bp, Artificial
  CRISPR gRNA sequence
attcctgaggtcatcaagca

SEQ ID NO: 517042 - DNA, 20 bp, Artificial
  CRISPR gRNA sequence
catcagatagtacaggtcga

SEQ ID NO: 517043 - DNA, 20 bp, Artificial
  CRISPR gRNA sequence
gccacacctcacatctcaca

SEQ ID NO: 517044 - DNA, 20 bp, Artificial
  CRISPR gRNA sequence
cacaggacatccaggcaggc

SEQ ID NO: 517045 - DNA, 20 bp, Artificial
  CRISPR gRNA sequence
cagtgacactgaaacccgcc

SEQ ID NO: 517046 - DNA, 20 bp, Artificial
  CRISPR gRNA sequence
tgaaacccgcctggggtgct

SEQ ID NO: 517047 - DNA, 20 bp, Artificial
  CRISPR gRNA sequence
cattggggacgcctttcatt

SEQ ID NO: 517048 - DNA, 20 bp, Artificial
  CRISPR gRNA sequence
cataaacacacatcatgtta

SEQ ID NO: 517049 - DNA, 20 bp, Artificial
  CRISPR gRNA sequence
ttaatgaatgagcagggagg

SEQ ID NO: 517050 - DNA, 20 bp, Artificial
  CRISPR gRNA sequence
tgctgccacaccctgggaga

SEQ ID NO: 517051 - DNA, 20 bp, Artificial
  CRISPR gRNA sequence
gggccccgtcccttcccttc

SEQ ID NO: 517052 - DNA, 20 bp, Artificial
  CRISPR gRNA sequence
gcgaagggccagcaggctgc

SEQ ID NO: 517053 - DNA, 20 bp, Artificial
  CRISPR gRNA sequence
gctctgggagcctgtggccc

SEQ ID NO: 517054 - DNA, 20 bp, Artificial
  CRISPR gRNA sequence
gatctctccctggtgctcac

SEQ ID NO: 517055 - DNA, 20 bp, Artificial
  CRISPR gRNA sequence
gcatttgccccctgcacagt

SEQ ID NO: 517056 - DNA, 20 bp, Artificial
  CRISPR gRNA sequence
cccacccttccccacggcac

SEQ ID NO: 517057 - DNA, 20 bp, Artificial
  CRISPR gRNA sequence
ggggccacagggccaggccc

SEQ ID NO: 517058 - DNA, 20 bp, Artificial
  CRISPR gRNA sequence
ggcaggcctgaccctaccac

SEQ ID NO: 517059 - DNA, 20 bp, Artificial
  CRISPR gRNA sequence
gcctgaccctaccaccaggg

SEQ ID NO: 517060 - DNA, 20 bp, Artificial
  CRISPR gRNA sequence
cctttcttttcattttgaga

SEQ ID NO: 517061 - DNA, 20 bp, Artificial
  CRISPR gRNA sequence
tgattctcctgccgcagcag

SEQ ID NO: 517062 - DNA, 20 bp, Artificial
  CRISPR gRNA sequence
gcctcggcctcccaaagtgc

SEQ ID NO: 517063 - DNA, 20 bp, Artificial
  CRISPR gRNA sequence
atcagagcctttactcttct

SEQ ID NO: 517064 - DNA, 20 bp, Artificial
  CRISPR gRNA sequence
tctaagagtaccctggcctt

SEQ ID NO: 517065 - DNA, 20 bp, Artificial
  CRISPR gRNA sequence
ctggccttctgagtgtgtaa

SEQ ID NO: 517066 - DNA, 20 bp, Artificial
  CRISPR gRNA sequence
tgcagaacgtcgggctgcga

SEQ ID NO: 517067 - DNA, 20 bp, Artificial
  CRISPR gRNA sequence
tggcccccattgtggtcttc

SEQ ID NO: 517068 - DNA, 20 bp, Artificial
  CRISPR gRNA sequence
ctgggtttcagcgaggcttg

SEQ ID NO: 517069 - DNA, 20 bp, Artificial
  CRISPR gRNA sequence
cccctcatgagcagctgtgg

SEQ ID NO: 517070 - DNA, 20 bp, Artificial
  CRISPR gRNA sequence
agctgtggccgggtgtcgca

SEQ ID NO: 517071 - DNA, 20 bp, Artificial
  CRISPR gRNA sequence
tggccgggtgtcgcagcgaa

SEQ ID NO: 517072 - DNA, 20 bp, Artificial
  CRISPR gRNA sequence
ggtgtcgcagcgaatggagt

SEQ ID NO: 517073 - DNA, 20 bp, Artificial
  CRISPR gRNA sequence
cctgtgaagttctggggagg

SEQ ID NO: 517074 - DNA, 20 bp, Artificial
  CRISPR gRNA sequence
agttctggggagggggagtc

SEQ ID NO: 517075 - DNA, 20 bp, Artificial
  CRISPR gRNA sequence
gtcccctcctcctctgcgcc

SEQ ID NO: 517076 - DNA, 20 bp, Artificial
  CRISPR gRNA sequence
cacagcagacccctgggggg

SEQ ID NO: 517077 - DNA, 20 bp, Artificial
  CRISPR gRNA sequence
tcagcagaacctttgtccaa

SEQ ID NO: 517078 - DNA, 20 bp, Artificial
  CRISPR gRNA sequence
caagaaacccagaacatggg

SEQ ID NO: 517079 - DNA, 20 bp, Artificial
  CRISPR gRNA sequence
actttgtccctgcaaatccc

SEQ ID NO: 517080 - DNA, 20 bp, Artificial
  CRISPR gRNA sequence
tctgatgagggctgtgtttg

SEQ ID NO: 517081 - DNA, 20 bp, Artificial
  CRISPR gRNA sequence
agcctgctgcctctacaggg

SEQ ID NO: 517082 - DNA, 20 bp, Artificial
  CRISPR gRNA sequence
tttcgtagagggaagctcag

SEQ ID NO: 517083 - DNA, 20 bp, Artificial
  CRISPR gRNA sequence
agcccggcccccagaggctg

SEQ ID NO: 517084 - DNA, 20 bp, Artificial
  CRISPR gRNA sequence
gaggggagggcgacagtccc

SEQ ID NO: 517085 - DNA, 20 bp, Artificial
  CRISPR gRNA sequence
ggctctgacttttggaacca

SEQ ID NO: 517086 - DNA, 20 bp, Artificial
  CRISPR gRNA sequence
tgaggaagctgctgacggta

SEQ ID NO: 517087 - DNA, 20 bp, Artificial
  CRISPR gRNA sequence
accctttcatgtggacccct

SEQ ID NO: 517088 - DNA, 20 bp, Artificial
  CRISPR gRNA sequence
tgtaagcccttaaaagggct

SEQ ID NO: 517089 - DNA, 20 bp, Artificial
  CRISPR gRNA sequence
taaagcccttccttctttaa

SEQ ID NO: 517090 - DNA, 20 bp, Artificial
  CRISPR gRNA sequence
cttctttaaccgagtgtctg

SEQ ID NO: 517091 - DNA, 20 bp, Artificial
  CRISPR gRNA sequence
agtgctcagaacggtagaac

SEQ ID NO: 517092 - DNA, 20 bp, Artificial
  CRISPR gRNA sequence
aggacacgcagccagaccca

SEQ ID NO: 517093 - DNA, 20 bp, Artificial
  CRISPR gRNA sequence
ctactgaacaaaataaaact

SEQ ID NO: 517094 - DNA, 20 bp, Artificial
  CRISPR gRNA sequence
ccttccttaggttggcagcc

SEQ ID NO: 517095 - DNA, 20 bp, Artificial
  CRISPR gRNA sequence
ggcttcaggcggggacctcc

SEQ ID NO: 517096 - DNA, 20 bp, Artificial
  CRISPR gRNA sequence
cctccgcggatgctgagcct

SEQ ID NO: 517097 - DNA, 20 bp, Artificial
  CRISPR gRNA sequence
ccagcccacagtggctgcga

SEQ ID NO: 517098 - DNA, 20 bp, Artificial
  CRISPR gRNA sequence
gctgcgaggggatcatgcag

SEQ ID NO: 517099 - DNA, 20 bp, Artificial
  CRISPR gRNA sequence
cagcgggatggggaggccgg

SEQ ID NO: 517100 - DNA, 20 bp, Artificial
  CRISPR gRNA sequence
gggctcctgccaaagcacac

SEQ ID NO: 517101 - DNA, 20 bp, Artificial
  CRISPR gRNA sequence
aaactccagacaagaccccc

SEQ ID NO: 517102 - DNA, 20 bp, Artificial
  CRISPR gRNA sequence
cggctgagcgtagggcgagc

SEQ ID NO: 517103 - DNA, 20 bp, Artificial
  CRISPR gRNA sequence
gctgagcgcagtgtgtgaac

SEQ ID NO: 517104 - DNA, 20 bp, Artificial
  CRISPR gRNA sequence
agatttggggcctgagatgg

SEQ ID NO: 517105 - DNA, 20 bp, Artificial
  CRISPR gRNA sequence
gggcctgagatggctgagtg

SEQ ID NO: 517106 - DNA, 20 bp, Artificial
  CRISPR gRNA sequence
tggctgagtgcagggtgagc

SEQ ID NO: 517107 - DNA, 20 bp, Artificial
  CRISPR gRNA sequence
gagcctgagacagctgagca

SEQ ID NO: 517108 - DNA, 20 bp, Artificial
  CRISPR gRNA sequence
cagctgagcacagggtgagc

SEQ ID NO: 517109 - DNA, 20 bp, Artificial
  CRISPR gRNA sequence
atgataatgagataccaatg

SEQ ID NO: 517110 - DNA, 20 bp, Artificial
  CRISPR gRNA sequence
agataccaatgctgaatttc

SEQ ID NO: 517111 - DNA, 20 bp, Artificial
  CRISPR gRNA sequence
gaatttcctgaatttgatac

SEQ ID NO: 517112 - DNA, 20 bp, Artificial
  CRISPR gRNA sequence
accttgtccctgcaaagccc

SEQ ID NO: 517113 - DNA, 20 bp, Artificial
  CRISPR gRNA sequence
tctgataagggctgtgtttg

SEQ ID NO: 517114 - DNA, 20 bp, Artificial
  CRISPR gRNA sequence
cctcaggggccccttgaggg

SEQ ID NO: 517115 - DNA, 20 bp, Artificial
  CRISPR gRNA sequence
ccttgaggggagggtgaggc

SEQ ID NO: 517116 - DNA, 20 bp, Artificial
  CRISPR gRNA sequence
ggaccccctcaaaaagaaaa

SEQ ID NO: 517117 - DNA, 20 bp, Artificial
  CRISPR gRNA sequence
aaaatggagttgttggtcct

SEQ ID NO: 517118 - DNA, 20 bp, Artificial
  CRISPR gRNA sequence
caggagctgggcaggtgggg

SEQ ID NO: 517119 - DNA, 20 bp, Artificial
  CRISPR gRNA sequence
ctgagggacgaggccggctg

SEQ ID NO: 517120 - DNA, 20 bp, Artificial
  CRISPR gRNA sequence
gggacgaggccggctggtga

SEQ ID NO: 517121 - DNA, 20 bp, Artificial
  CRISPR gRNA sequence
cgccctgcccacacccaagg

SEQ ID NO: 517122 - DNA, 20 bp, Artificial
  CRISPR gRNA sequence
ggcacgtgcggagacgaggc

SEQ ID NO: 517123 - DNA, 20 bp, Artificial
  CRISPR gRNA sequence
caggccctgttctccctgat

SEQ ID NO: 517124 - DNA, 20 bp, Artificial
  CRISPR gRNA sequence
cctgattggaatgtcacgcg

SEQ ID NO: 517125 - DNA, 20 bp, Artificial
  CRISPR gRNA sequence
cagcatgtcctgtggaggga

SEQ ID NO: 517126 - DNA, 20 bp, Artificial
  CRISPR gRNA sequence
ggggccctgtccctgctgca

SEQ ID NO: 517127 - DNA, 20 bp, Artificial
  CRISPR gRNA sequence
ccctgtccctgctgcagggg

SEQ ID NO: 517128 - DNA, 20 bp, Artificial
  CRISPR gRNA sequence
ccctgctgcagggggtgggt

SEQ ID NO: 517129 - DNA, 20 bp, Artificial
  CRISPR gRNA sequence
ctgccaacagccagggaggg

SEQ ID NO: 517130 - DNA, 20 bp, Artificial
  CRISPR gRNA sequence
agccaggaagagaaagctgg

SEQ ID NO: 517131 - DNA, 20 bp, Artificial
  CRISPR gRNA sequence
agaaagctggctggatgccc

SEQ ID NO: 517132 - DNA, 20 bp, Artificial
  CRISPR gRNA sequence
agaaagctggcttgatgccc

SEQ ID NO: 517133 - DNA, 20 bp, Artificial
  CRISPR gRNA sequence
ttgcccaagccaccagttgc

SEQ ID NO: 517134 - DNA, 20 bp, Artificial
  CRISPR gRNA sequence
gcagcagggccgttccaccc

SEQ ID NO: 517135 - DNA, 20 bp, Artificial
  CRISPR gRNA sequence
aggcctaggtcggctccttg

SEQ ID NO: 517136 - DNA, 20 bp, Artificial
  CRISPR gRNA sequence
gggtcttagggcttcctagg

SEQ ID NO: 517137 - DNA, 20 bp, Artificial
  CRISPR gRNA sequence
ttcctaggtggggtgggccc

SEQ ID NO: 517138 - DNA, 20 bp, Artificial
  CRISPR gRNA sequence
aaggtggagaggtactgaga

SEQ ID NO: 517139 - DNA, 20 bp, Artificial
  CRISPR gRNA sequence
tcctgccccacacccttccc

SEQ ID NO: 517140 - DNA, 20 bp, Artificial
  CRISPR gRNA sequence
tgccggctttgaagacagcg

SEQ ID NO: 517141 - DNA, 20 bp, Artificial
  CRISPR gRNA sequence
tgtgctgtggcccgggaggc

SEQ ID NO: 517142 - DNA, 20 bp, Artificial
  CRISPR gRNA sequence
cacccaccaggggcccatct

SEQ ID NO: 517143 - DNA, 20 bp, Artificial
  CRISPR gRNA sequence
gttcccagcaaaattataat

SEQ ID NO: 517144 - DNA, 20 bp, Artificial
  CRISPR gRNA sequence
acccttgatccttcccgtcc

SEQ ID NO: 517145 - DNA, 20 bp, Artificial
  CRISPR gRNA sequence
cccccatatctctgatcgtt

SEQ ID NO: 517146 - DNA, 20 bp, Artificial
  CRISPR gRNA sequence
cctggactgacctcggtgcc

SEQ ID NO: 517147 - DNA, 20 bp, Artificial
  CRISPR gRNA sequence
tgtgcgtgctggagctaccc

SEQ ID NO: 517148 - DNA, 20 bp, Artificial
  CRISPR gRNA sequence
gctggagctaccccagggtg

SEQ ID NO: 517149 - DNA, 20 bp, Artificial
  CRISPR gRNA sequence
agccagcttcaggactcccc

SEQ ID NO: 517150 - DNA, 20 bp, Artificial
  CRISPR gRNA sequence
ttcaggactcccccagggtg

SEQ ID NO: 517151 - DNA, 20 bp, Artificial
  CRISPR gRNA sequence
agccggcttcaggactcccc

SEQ ID NO: 517152 - DNA, 20 bp, Artificial
  CRISPR gRNA sequence
ttcaggactcccccagggtg

SEQ ID NO: 517153 - DNA, 20 bp, Artificial
  CRISPR gRNA sequence
agccggcttcaggactcccc

SEQ ID NO: 517154 - DNA, 20 bp, Artificial
  CRISPR gRNA sequence
ttcaggactcccccagggtg

SEQ ID NO: 517155 - DNA, 20 bp, Artificial
  CRISPR gRNA sequence
agccggcttcaggactcccc

SEQ ID NO: 517156 - DNA, 20 bp, Artificial
  CRISPR gRNA sequence
ttcaggactcccccagggtg

SEQ ID NO: 517157 - DNA, 20 bp, Artificial
  CRISPR gRNA sequence
agccggcttcaggactcccc

SEQ ID NO: 517158 - DNA, 20 bp, Artificial
  CRISPR gRNA sequence
ttcaggactcccccagggtg

SEQ ID NO: 517159 - DNA, 20 bp, Artificial
  CRISPR gRNA sequence
agccggcttcaggactcccc

SEQ ID NO: 517160 - DNA, 20 bp, Artificial
  CRISPR gRNA sequence
ttcaggactcccccagggtg

SEQ ID NO: 517161 - DNA, 20 bp, Artificial
  CRISPR gRNA sequence
agccggcttcaggactcccc

SEQ ID NO: 517162 - DNA, 20 bp, Artificial
  CRISPR gRNA sequence
ttcaggactcccccagggtg

SEQ ID NO: 517163 - DNA, 20 bp, Artificial
  CRISPR gRNA sequence
agccggcttcaggactcccc

SEQ ID NO: 517164 - DNA, 20 bp, Artificial
  CRISPR gRNA sequence
ttcaggactcccccagggtg

SEQ ID NO: 517165 - DNA, 20 bp, Artificial
  CRISPR gRNA sequence
agccggcttcaggactcccc

SEQ ID NO: 517166 - DNA, 20 bp, Artificial
  CRISPR gRNA sequence
ttcaggactcccccagggtg

SEQ ID NO: 517167 - DNA, 20 bp, Artificial
  CRISPR gRNA sequence
agccggcttcaggactcccc

SEQ ID NO: 517168 - DNA, 20 bp, Artificial
  CRISPR gRNA sequence
ttcaggactcccccagggtg

SEQ ID NO: 517169 - DNA, 20 bp, Artificial
  CRISPR gRNA sequence
gcagctgcgccaagtgggga

SEQ ID NO: 517170 - DNA, 20 bp, Artificial
  CRISPR gRNA sequence
cccacctgcccacagggaga

SEQ ID NO: 517171 - DNA, 20 bp, Artificial
  CRISPR gRNA sequence
ggggtgcaccttgattccag

SEQ ID NO: 517172 - DNA, 20 bp, Artificial
  CRISPR gRNA sequence
ctgagcccagacaaacagct

SEQ ID NO: 517173 - DNA, 20 bp, Artificial
  CRISPR gRNA sequence
cagcccctctgcccagcagc

SEQ ID NO: 517174 - DNA, 20 bp, Artificial
  CRISPR gRNA sequence
gggcctgtgccagctccctg

SEQ ID NO: 517175 - DNA, 20 bp, Artificial
  CRISPR gRNA sequence
gtgccagctccctgggggat

SEQ ID NO: 517176 - DNA, 20 bp, Artificial
  CRISPR gRNA sequence
cagctccctgggggatggga

SEQ ID NO: 517177 - DNA, 20 bp, Artificial
  CRISPR gRNA sequence
cctgctgccccacaccaggg

SEQ ID NO: 517178 - DNA, 20 bp, Artificial
  CRISPR gRNA sequence
catcccccatctaagggcgg

SEQ ID NO: 517179 - DNA, 20 bp, Artificial
  CRISPR gRNA sequence
acccaaagctgaggctgctt

SEQ ID NO: 517180 - DNA, 20 bp, Artificial
  CRISPR gRNA sequence
ggcctctcagaaccttgcat

SEQ ID NO: 517181 - DNA, 20 bp, Artificial
  CRISPR gRNA sequence
gttttgagaggccaaggcag

SEQ ID NO: 517182 - DNA, 20 bp, Artificial
  CRISPR gRNA sequence
caggagaatcacttgaggcc

SEQ ID NO: 517183 - DNA, 20 bp, Artificial
  CRISPR gRNA sequence
tactcaggaggctgaggcag

SEQ ID NO: 517184 - DNA, 20 bp, Artificial
  CRISPR gRNA sequence
ggcagagcctatgctgggag

SEQ ID NO: 517185 - DNA, 20 bp, Artificial
  CRISPR gRNA sequence
atgctgggagaggaatccag

SEQ ID NO: 517186 - DNA, 20 bp, Artificial
  CRISPR gRNA sequence
tcctttttatttttttgaga

SEQ ID NO: 517187 - DNA, 20 bp, Artificial
  CRISPR gRNA sequence
gagttgcgctgtcaccggcc

SEQ ID NO: 517188 - DNA, 20 bp, Artificial
  CRISPR gRNA sequence
cattctcctgcctcagcttc

SEQ ID NO: 517189 - DNA, 20 bp, Artificial
  CRISPR gRNA sequence
cgaggtttcatcgtgttgat

SEQ ID NO: 517190 - DNA, 20 bp, Artificial
  CRISPR gRNA sequence
acctcggcctcccaaagtgc

SEQ ID NO: 517191 - DNA, 20 bp, Artificial
  CRISPR gRNA sequence
cgctgggaactgaaggctca

SEQ ID NO: 517192 - DNA, 20 bp, Artificial
  CRISPR gRNA sequence
tggactcatttctgctttgt

SEQ ID NO: 517193 - DNA, 20 bp, Artificial
  CRISPR gRNA sequence
tggggactggaacactgtcc

SEQ ID NO: 517194 - DNA, 20 bp, Artificial
  CRISPR gRNA sequence
taggaacaagtcggagcaga

SEQ ID NO: 517195 - DNA, 20 bp, Artificial
  CRISPR gRNA sequence
ctgcaaaagcgtattttccc

SEQ ID NO: 517196 - DNA, 20 bp, Artificial
  CRISPR gRNA sequence
gtttgtttgtttttttgaga

SEQ ID NO: 517197 - DNA, 20 bp, Artificial
  CRISPR gRNA sequence
tctcactctgtcatccaggc

SEQ ID NO: 517198 - DNA, 20 bp, Artificial
  CRISPR gRNA sequence
aattcttctgcctcagcctc

SEQ ID NO: 517199 - DNA, 20 bp, Artificial
  CRISPR gRNA sequence
ttttgtatttttagtagaga

SEQ ID NO: 517200 - DNA, 20 bp, Artificial
  CRISPR gRNA sequence
gcctcggcctcccaaagtgc

SEQ ID NO: 517201 - DNA, 20 bp, Artificial
  CRISPR gRNA sequence
ccgacacacacatattaata

SEQ ID NO: 517202 - DNA, 20 bp, Artificial
  CRISPR gRNA sequence
atgaaggagactgtctgttc

SEQ ID NO: 517203 - DNA, 20 bp, Artificial
  CRISPR gRNA sequence
cactcttgctgtggacataa

SEQ ID NO: 517204 - DNA, 20 bp, Artificial
  CRISPR gRNA sequence
tgtgtaggacttcagtttta

SEQ ID NO: 517205 - DNA, 20 bp, Artificial
  CRISPR gRNA sequence
taaaacaataaaggaaatag

SEQ ID NO: 517206 - DNA, 20 bp, Artificial
  CRISPR gRNA sequence
aaatagaagaataggtatct

SEQ ID NO: 517207 - DNA, 20 bp, Artificial
  CRISPR gRNA sequence
actttgggaggctgaggcag

SEQ ID NO: 517208 - DNA, 20 bp, Artificial
  CRISPR gRNA sequence
caggcggatcacctgaggtc

SEQ ID NO: 517209 - DNA, 20 bp, Artificial
  CRISPR gRNA sequence
tactcgcgaggctgaggcag

SEQ ID NO: 517210 - DNA, 20 bp, Artificial
  CRISPR gRNA sequence
tcacttgagcccgggaggca

SEQ ID NO: 517211 - DNA, 20 bp, Artificial
  CRISPR gRNA sequence
tgcactccagcctgggcaac

SEQ ID NO: 517212 - DNA, 20 bp, Artificial
  CRISPR gRNA sequence
aaaaggtaaatactccattc

SEQ ID NO: 517213 - DNA, 20 bp, Artificial
  CRISPR gRNA sequence
actccattcaaggatgtttc

SEQ ID NO: 517214 - DNA, 20 bp, Artificial
  CRISPR gRNA sequence
gaaaactggctaagaaacat

SEQ ID NO: 517215 - DNA, 20 bp, Artificial
  CRISPR gRNA sequence
agtcaccccaggaaagaacc

SEQ ID NO: 517216 - DNA, 20 bp, Artificial
  CRISPR gRNA sequence
cggtttcggtgcctgcgcta

SEQ ID NO: 517217 - DNA, 20 bp, Artificial
  CRISPR gRNA sequence
agcttggcttcgtggtaaaa

SEQ ID NO: 517218 - DNA, 20 bp, Artificial
  CRISPR gRNA sequence
ccaaaatattctgcatttct

SEQ ID NO: 517219 - DNA, 20 bp, Artificial
  CRISPR gRNA sequence
tttctctgggtggtggcact

SEQ ID NO: 517220 - DNA, 20 bp, Artificial
  CRISPR gRNA sequence
ttccaccctttttgtgataa

SEQ ID NO: 517221 - DNA, 20 bp, Artificial
  CRISPR gRNA sequence
aataaaggacattttaaaaa

SEQ ID NO: 517222 - DNA, 20 bp, Artificial
  CRISPR gRNA sequence
atggaatttcatggtggccg

SEQ ID NO: 517223 - DNA, 20 bp, Artificial
  CRISPR gRNA sequence
attatgctgaaattgctcct

SEQ ID NO: 517224 - DNA, 20 bp, Artificial
  CRISPR gRNA sequence
ctcttctgcactctcagacc

SEQ ID NO: 517225 - DNA, 20 bp, Artificial
  CRISPR gRNA sequence
gccggagagaacacgcagcc

SEQ ID NO: 517226 - DNA, 20 bp, Artificial
  CRISPR gRNA sequence
gggctccacacacatgggct

SEQ ID NO: 517227 - DNA, 20 bp, Artificial
  CRISPR gRNA sequence
cagtgccagtttgtgccaag

SEQ ID NO: 517228 - DNA, 20 bp, Artificial
  CRISPR gRNA sequence
tttgtgccaagcagaatggg

SEQ ID NO: 517229 - DNA, 20 bp, Artificial
  CRISPR gRNA sequence
tgctggcaccaggtccggct

SEQ ID NO: 517230 - DNA, 20 bp, Artificial
  CRISPR gRNA sequence
ggcaccaggtccggcttggg

SEQ ID NO: 517231 - DNA, 20 bp, Artificial
  CRISPR gRNA sequence
ggcgcccactgcagagcccc

SEQ ID NO: 517232 - DNA, 20 bp, Artificial
  CRISPR gRNA sequence
acggttctctgacacaggac

SEQ ID NO: 517233 - DNA, 20 bp, Artificial
  CRISPR gRNA sequence
cccacacaggacctgttcca

SEQ ID NO: 517234 - DNA, 20 bp, Artificial
  CRISPR gRNA sequence
tggtggggcccggcctgggc

SEQ ID NO: 517235 - DNA, 20 bp, Artificial
  CRISPR gRNA sequence
ctggcaggagccctggggaa

SEQ ID NO: 517236 - DNA, 20 bp, Artificial
  CRISPR gRNA sequence
cggttgactatagagacagc

SEQ ID NO: 517237 - DNA, 20 bp, Artificial
  CRISPR gRNA sequence
ctgtttcacagatggggaaa

SEQ ID NO: 517238 - DNA, 20 bp, Artificial
  CRISPR gRNA sequence
caccccatgccccttccaga

SEQ ID NO: 517239 - DNA, 20 bp, Artificial
  CRISPR gRNA sequence
gatagggcccctcccatctc

SEQ ID NO: 517240 - DNA, 20 bp, Artificial
  CRISPR gRNA sequence
gtctgggggcctcttcccca

SEQ ID NO: 517241 - DNA, 20 bp, Artificial
  CRISPR gRNA sequence
gtcgatgccgcctgaggggc

SEQ ID NO: 517242 - DNA, 20 bp, Artificial
  CRISPR gRNA sequence
aggtgagaagctccaggctc

SEQ ID NO: 517243 - DNA, 20 bp, Artificial
  CRISPR gRNA sequence
tccagctgcctgggcagtgt

SEQ ID NO: 517244 - DNA, 20 bp, Artificial
  CRISPR gRNA sequence
ctcccttgaggcaaaggccc

SEQ ID NO: 517245 - DNA, 20 bp, Artificial
  CRISPR gRNA sequence
tgcagttgctcagctgttca

SEQ ID NO: 517246 - DNA, 20 bp, Artificial
  CRISPR gRNA sequence
tcagctgttcattgagtgct

SEQ ID NO: 517247 - DNA, 20 bp, Artificial
  CRISPR gRNA sequence
accgagggccacagcccccc

SEQ ID NO: 517248 - DNA, 20 bp, Artificial
  CRISPR gRNA sequence
ccccggggtcaggtggccac

SEQ ID NO: 517249 - DNA, 20 bp, Artificial
  CRISPR gRNA sequence
atctgttctgtggccctgct

SEQ ID NO: 517250 - DNA, 20 bp, Artificial
  CRISPR gRNA sequence
gggactcccccactcatccc

SEQ ID NO: 517251 - DNA, 20 bp, Artificial
  CRISPR gRNA sequence
ccagaatactgaggggcacg

SEQ ID NO: 517252 - DNA, 20 bp, Artificial
  CRISPR gRNA sequence
gccaggctggcagggaccct

SEQ ID NO: 517253 - DNA, 20 bp, Artificial
  CRISPR gRNA sequence
cctggggattctgctgtgag

SEQ ID NO: 517254 - DNA, 20 bp, Artificial
  CRISPR gRNA sequence
tgctgtgagctggatgggga

SEQ ID NO: 517255 - DNA, 20 bp, Artificial
  CRISPR gRNA sequence
aggagttccttcctaaaatg

SEQ ID NO: 517256 - DNA, 20 bp, Artificial
  CRISPR gRNA sequence
ttggtaaagtgctggccccc

SEQ ID NO: 517257 - DNA, 20 bp, Artificial
  CRISPR gRNA sequence
gattctgcagtgagctgggc

SEQ ID NO: 517258 - DNA, 20 bp, Artificial
  CRISPR gRNA sequence
cttcactcatggtgaaacgc

SEQ ID NO: 517259 - DNA, 20 bp, Artificial
  CRISPR gRNA sequence
gctcatttctgtgaagcctc

SEQ ID NO: 517260 - DNA, 20 bp, Artificial
  CRISPR gRNA sequence
gcgccaccgtcacggggaag

SEQ ID NO: 517261 - DNA, 20 bp, Artificial
  CRISPR gRNA sequence
cacggggaaggcgagtgaca

SEQ ID NO: 517262 - DNA, 20 bp, Artificial
  CRISPR gRNA sequence
actgacagaggagaggggcc

SEQ ID NO: 517263 - DNA, 20 bp, Artificial
  CRISPR gRNA sequence
gatggacagggacagcaggg

SEQ ID NO: 517264 - DNA, 20 bp, Artificial
  CRISPR gRNA sequence
gctcccagatccaggggagg

SEQ ID NO: 517265 - DNA, 20 bp, Artificial
  CRISPR gRNA sequence
cagatccaggggagggggga

SEQ ID NO: 517266 - DNA, 20 bp, Artificial
  CRISPR gRNA sequence
ggtgtggggacggtggtgca

SEQ ID NO: 517267 - DNA, 20 bp, Artificial
  CRISPR gRNA sequence
gtggtgcaaggggtggtgcc

SEQ ID NO: 517268 - DNA, 20 bp, Artificial
  CRISPR gRNA sequence
aaggggtggtgccaggggtg

SEQ ID NO: 517269 - DNA, 20 bp, Artificial
  CRISPR gRNA sequence
gcatggggagggctggcccc

SEQ ID NO: 517270 - DNA, 20 bp, Artificial
  CRISPR gRNA sequence
ccccctcccaccaggacctt

SEQ ID NO: 517271 - DNA, 20 bp, Artificial
  CRISPR gRNA sequence
ggagcctgttgtggggaggc

SEQ ID NO: 517272 - DNA, 20 bp, Artificial
  CRISPR gRNA sequence
accagctgaaccaactcgac

SEQ ID NO: 517273 - DNA, 20 bp, Artificial
  CRISPR gRNA sequence
cctacagcaagacgtcaccc

SEQ ID NO: 517274 - DNA, 20 bp, Artificial
  CRISPR gRNA sequence
cggaggaggcagggaagctc

SEQ ID NO: 517275 - DNA, 20 bp, Artificial
  CRISPR gRNA sequence
catatcacacaccacacact

SEQ ID NO: 517276 - DNA, 20 bp, Artificial
  CRISPR gRNA sequence
actgcgagtcgatctggaga

SEQ ID NO: 517277 - DNA, 20 bp, Artificial
  CRISPR gRNA sequence
gtggcaggcacttccccttg

SEQ ID NO: 517278 - DNA, 20 bp, Artificial
  CRISPR gRNA sequence
ggggctataagcagggccac

SEQ ID NO: 517279 - DNA, 20 bp, Artificial
  CRISPR gRNA sequence
gtcactccaggctggggcag

SEQ ID NO: 517280 - DNA, 20 bp, Artificial
  CRISPR gRNA sequence
cacactcaccctcggtgtgc

SEQ ID NO: 517281 - DNA, 20 bp, Artificial
  CRISPR gRNA sequence
ggctttgctaccagtctgcc

SEQ ID NO: 517282 - DNA, 20 bp, Artificial
  CRISPR gRNA sequence
tagaaacctcagctggaggc

SEQ ID NO: 517283 - DNA, 20 bp, Artificial
  CRISPR gRNA sequence
gctcctccttggaggaagtg

SEQ ID NO: 517284 - DNA, 20 bp, Artificial
  CRISPR gRNA sequence
gctgtagagcggagaggggc

SEQ ID NO: 517285 - DNA, 20 bp, Artificial
  CRISPR gRNA sequence
gccgaggactccagcacacc

SEQ ID NO: 517286 - DNA, 20 bp, Artificial
  CRISPR gRNA sequence
aggactccagcacaccgagg

SEQ ID NO: 517287 - DNA, 20 bp, Artificial
  CRISPR gRNA sequence
agcactctcctgccccagcc

SEQ ID NO: 517288 - DNA, 20 bp, Artificial
  CRISPR gRNA sequence
cctgcttatagccccggccc

SEQ ID NO: 517289 - DNA, 20 bp, Artificial
  CRISPR gRNA sequence
cccaggggtgtctggcagga

SEQ ID NO: 517290 - DNA, 20 bp, Artificial
  CRISPR gRNA sequence
ggtctccagaccgtctgctc

SEQ ID NO: 517291 - DNA, 20 bp, Artificial
  CRISPR gRNA sequence
tgctgggagcgcttgcggct

SEQ ID NO: 517292 - DNA, 20 bp, Artificial
  CRISPR gRNA sequence
agcccctagggggacggctg

SEQ ID NO: 517293 - DNA, 20 bp, Artificial
  CRISPR gRNA sequence
tgtgtgtgcatgtatggtgt

SEQ ID NO: 517294 - DNA, 20 bp, Artificial
  CRISPR gRNA sequence
gagtgtgcgcatgtgatgtg

SEQ ID NO: 517295 - DNA, 20 bp, Artificial
  CRISPR gRNA sequence
tgcctcctccgtggggaccc

SEQ ID NO: 517296 - DNA, 20 bp, Artificial
  CRISPR gRNA sequence
gcaccgctgtgcgattctgg

SEQ ID NO: 517297 - DNA, 20 bp, Artificial
  CRISPR gRNA sequence
tcccaaggtcctggtgggag

SEQ ID NO: 517298 - DNA, 20 bp, Artificial
  CRISPR gRNA sequence
gggggattgaagccacgccc

SEQ ID NO: 517299 - DNA, 20 bp, Artificial
  CRISPR gRNA sequence
cacacccaatcccccctccc

SEQ ID NO: 517300 - DNA, 20 bp, Artificial
  CRISPR gRNA sequence
cctcccctggatctgggagc

SEQ ID NO: 517301 - DNA, 20 bp, Artificial
  CRISPR gRNA sequence
cccctctcctctgtcagttc

SEQ ID NO: 517302 - DNA, 20 bp, Artificial
  CRISPR gRNA sequence
gttcctgggtggggagaagg

SEQ ID NO: 517303 - DNA, 20 bp, Artificial
  CRISPR gRNA sequence
tggctgcaatggggaagggg

SEQ ID NO: 517304 - DNA, 20 bp, Artificial
  CRISPR gRNA sequence
gtgacggtggcgcaacgcct

SEQ ID NO: 517305 - DNA, 20 bp, Artificial
  CRISPR gRNA sequence
tgcgggtttgggggctgagg

SEQ ID NO: 517306 - DNA, 20 bp, Artificial
  CRISPR gRNA sequence
cgtcaccccagcgtttcacc

SEQ ID NO: 517307 - DNA, 20 bp, Artificial
  CRISPR gRNA sequence
gagtgaagcccagctcactg

SEQ ID NO: 517308 - DNA, 20 bp, Artificial
  CRISPR gRNA sequence
aatccatgcccagctcactg

SEQ ID NO: 517309 - DNA, 20 bp, Artificial
  CRISPR gRNA sequence
ccgggggccagcactttacc

SEQ ID NO: 517310 - DNA, 20 bp, Artificial
  CRISPR gRNA sequence
cttccccatccagctcacag

SEQ ID NO: 517311 - DNA, 20 bp, Artificial
  CRISPR gRNA sequence
ccagctcacagcagaatccc

SEQ ID NO: 517312 - DNA, 20 bp, Artificial
  CRISPR gRNA sequence
agcgtgcccctcagtattct

SEQ ID NO: 517313 - DNA, 20 bp, Artificial
  CRISPR gRNA sequence
tgcccctcagtattctgggg

SEQ ID NO: 517314 - DNA, 20 bp, Artificial
  CRISPR gRNA sequence
agtattctggggatgagtgg

SEQ ID NO: 517315 - DNA, 20 bp, Artificial
  CRISPR gRNA sequence
ggccccagggccagtccccg

SEQ ID NO: 517316 - DNA, 20 bp, Artificial
  CRISPR gRNA sequence
gcaggtgaccgggcgggctg

SEQ ID NO: 517317 - DNA, 20 bp, Artificial
  CRISPR gRNA sequence
gcgtcactgccgctcagcgt

SEQ ID NO: 517318 - DNA, 20 bp, Artificial
  CRISPR gRNA sequence
ctgagcaactgcaggtgcct

SEQ ID NO: 517319 - DNA, 20 bp, Artificial
  CRISPR gRNA sequence
gcctccgagtgctgggagag

SEQ ID NO: 517320 - DNA, 20 bp, Artificial
  CRISPR gRNA sequence
ggagaggggaatgctcagct

SEQ ID NO: 517321 - DNA, 20 bp, Artificial
  CRISPR gRNA sequence
gggagaggggacgctcagct

SEQ ID NO: 517322 - DNA, 20 bp, Artificial
  CRISPR gRNA sequence
cccaagggcctttgcctcaa

SEQ ID NO: 517323 - DNA, 20 bp, Artificial
  CRISPR gRNA sequence
ggagcttctcacctgaacca

SEQ ID NO: 517324 - DNA, 20 bp, Artificial
  CRISPR gRNA sequence
caccctgtctggaaggggca

SEQ ID NO: 517325 - DNA, 20 bp, Artificial
  CRISPR gRNA sequence
ttccccatctgtgaaacagg

SEQ ID NO: 517326 - DNA, 20 bp, Artificial
  CRISPR gRNA sequence
gctgtgggacatttgcctct

SEQ ID NO: 517327 - DNA, 20 bp, Artificial
  CRISPR gRNA sequence
gctggctcccgttcccggag

SEQ ID NO: 517328 - DNA, 20 bp, Artificial
  CRISPR gRNA sequence
aggagaatgccagctgccac

SEQ ID NO: 517329 - DNA, 20 bp, Artificial
  CRISPR gRNA sequence
cgcctagcaattatggagct

SEQ ID NO: 517330 - DNA, 20 bp, Artificial
  CRISPR gRNA sequence
gcgtgttctctccggccatt

SEQ ID NO: 517331 - DNA, 20 bp, Artificial
  CRISPR gRNA sequence
tctccggccattcagggtct

SEQ ID NO: 517332 - DNA, 20 bp, Artificial
  CRISPR gRNA sequence
ttcagggtctgagagtgcag

SEQ ID NO: 517333 - DNA, 20 bp, Artificial
  CRISPR gRNA sequence
tggggacacatgttggtgtt

SEQ ID NO: 517334 - DNA, 20 bp, Artificial
  CRISPR gRNA sequence
ttctgtgtgtgatggaaact

SEQ ID NO: 517335 - DNA, 20 bp, Artificial
  CRISPR gRNA sequence
tgttggggaaaagaggtgct

SEQ ID NO: 517336 - DNA, 20 bp, Artificial
  CRISPR gRNA sequence
ctgagagtctcagcagaggg

SEQ ID NO: 517337 - DNA, 20 bp, Artificial
  CRISPR gRNA sequence
ctcagcagagggcagagtcc

SEQ ID NO: 517338 - DNA, 20 bp, Artificial
  CRISPR gRNA sequence
agggcagagtccaggagtcc

SEQ ID NO: 517339 - DNA, 20 bp, Artificial
  CRISPR gRNA sequence
ggctggcaagcccctgtccc

SEQ ID NO: 517340 - DNA, 20 bp, Artificial
  CRISPR gRNA sequence
ggcaagcccctgtcccatgg

SEQ ID NO: 517341 - DNA, 20 bp, Artificial
  CRISPR gRNA sequence
agcccctgtcccatggatgg

SEQ ID NO: 517342 - DNA, 20 bp, Artificial
  CRISPR gRNA sequence
cctgtcccatggatgggtga

SEQ ID NO: 517343 - DNA, 20 bp, Artificial
  CRISPR gRNA sequence
tcccatggatgggtgaatgg

SEQ ID NO: 517344 - DNA, 20 bp, Artificial
  CRISPR gRNA sequence
aacaagaaagccagtagctt

SEQ ID NO: 517345 - DNA, 20 bp, Artificial
  CRISPR gRNA sequence
ctttattcatttatcacaaa

SEQ ID NO: 517346 - DNA, 20 bp, Artificial
  CRISPR gRNA sequence
aaagggtggaaaatacaaac

SEQ ID NO: 517347 - DNA, 20 bp, Artificial
  CRISPR gRNA sequence
tgccaccacccagagaaatg

SEQ ID NO: 517348 - DNA, 20 bp, Artificial
  CRISPR gRNA sequence
tacacgttgacggctacaca

SEQ ID NO: 517349 - DNA, 20 bp, Artificial
  CRISPR gRNA sequence
tgaaatccctggttctttcc

SEQ ID NO: 517350 - DNA, 20 bp, Artificial
  CRISPR gRNA sequence
ccagttttcttccttctttt

SEQ ID NO: 517351 - DNA, 20 bp, Artificial
  CRISPR gRNA sequence
tcttttgtgaattacctgct

SEQ ID NO: 517352 - DNA, 20 bp, Artificial
  CRISPR gRNA sequence
gccacacccttgaaacatcc

SEQ ID NO: 517353 - DNA, 20 bp, Artificial
  CRISPR gRNA sequence
acccttgaaacatccttgaa

SEQ ID NO: 517354 - DNA, 20 bp, Artificial
  CRISPR gRNA sequence
agtacaacatgtgccatttt

SEQ ID NO: 517355 - DNA, 20 bp, Artificial
  CRISPR gRNA sequence
ttcactcttgttgcccaggc

SEQ ID NO: 517356 - DNA, 20 bp, Artificial
  CRISPR gRNA sequence
gattctcctgcctcagcctc

SEQ ID NO: 517357 - DNA, 20 bp, Artificial
  CRISPR gRNA sequence
gcctcagcctcgcgagtagc

SEQ ID NO: 517358 - DNA, 20 bp, Artificial
  CRISPR gRNA sequence
ttatgtatttttagtagaga

SEQ ID NO: 517359 - DNA, 20 bp, Artificial
  CRISPR gRNA sequence
gcctcagcctcccaaagtgc

SEQ ID NO: 517360 - DNA, 20 bp, Artificial
  CRISPR gRNA sequence
cattcttttatgtccacagc

SEQ ID NO: 517361 - DNA, 20 bp, Artificial
  CRISPR gRNA sequence
gtctccttcatgttagatgg

SEQ ID NO: 517362 - DNA, 20 bp, Artificial
  CRISPR gRNA sequence
ctttgacttcaggtatttag

SEQ ID NO: 517363 - DNA, 20 bp, Artificial
  CRISPR gRNA sequence
tattaatatgtgtgtgtcgg

SEQ ID NO: 517364 - DNA, 20 bp, Artificial
  CRISPR gRNA sequence
atatgtgtgtgtcggggggg

SEQ ID NO: 517365 - DNA, 20 bp, Artificial
  CRISPR gRNA sequence
actttgggaggccgaggcag

SEQ ID NO: 517366 - DNA, 20 bp, Artificial
  CRISPR gRNA sequence
ggcaggcggatcacgaggtc

SEQ ID NO: 517367 - DNA, 20 bp, Artificial
  CRISPR gRNA sequence
tactcaggaggctgaggcag

SEQ ID NO: 517368 - DNA, 20 bp, Artificial
  CRISPR gRNA sequence
tctagccattgcactccagc

SEQ ID NO: 517369 - DNA, 20 bp, Artificial
  CRISPR gRNA sequence
ttgcactccagcctggatga

SEQ ID NO: 517370 - DNA, 20 bp, Artificial
  CRISPR gRNA sequence
cttgggaaaatacgcttttg

SEQ ID NO: 517371 - DNA, 20 bp, Artificial
  CRISPR gRNA sequence
aggttcagaggcgacatggg

SEQ ID NO: 517372 - DNA, 20 bp, Artificial
  CRISPR gRNA sequence
gatctgacctgtttttgtcc

SEQ ID NO: 517373 - DNA, 20 bp, Artificial
  CRISPR gRNA sequence
cacattcctacaaagcagaa

SEQ ID NO: 517374 - DNA, 20 bp, Artificial
  CRISPR gRNA sequence
tctggcttttggcttaaaag

SEQ ID NO: 517375 - DNA, 20 bp, Artificial
  CRISPR gRNA sequence
gagccttcagttcccagcgc

SEQ ID NO: 517376 - DNA, 20 bp, Artificial
  CRISPR gRNA sequence
ccatcacttcccgcgcacct

SEQ ID NO: 517377 - DNA, 20 bp, Artificial
  CRISPR gRNA sequence
cacctccgagtcactttgat

SEQ ID NO: 517378 - DNA, 20 bp, Artificial
  CRISPR gRNA sequence
ctcctctaggacagcgcaag

SEQ ID NO: 517379 - DNA, 20 bp, Artificial
  CRISPR gRNA sequence
agctctgatgcaaagttcca

SEQ ID NO: 517380 - DNA, 20 bp, Artificial
  CRISPR gRNA sequence
ttcctcaagcagtctcgtct

SEQ ID NO: 517381 - DNA, 20 bp, Artificial
  CRISPR gRNA sequence
agtctcgtcttagggtttta

SEQ ID NO: 517382 - DNA, 20 bp, Artificial
  CRISPR gRNA sequence
actttgggaggccgaggtgg

SEQ ID NO: 517383 - DNA, 20 bp, Artificial
  CRISPR gRNA sequence
tactcaggaagctgaggcag

SEQ ID NO: 517384 - DNA, 20 bp, Artificial
  CRISPR gRNA sequence
aaaaaggaagcctgaccccg

SEQ ID NO: 517385 - DNA, 20 bp, Artificial
  CRISPR gRNA sequence
cctcgttctgtcaactaggc

SEQ ID NO: 517386 - DNA, 20 bp, Artificial
  CRISPR gRNA sequence
ctggagttcagcagtgccat

SEQ ID NO: 517387 - DNA, 20 bp, Artificial
  CRISPR gRNA sequence
gcagtctctccctcctgggc

SEQ ID NO: 517388 - DNA, 20 bp, Artificial
  CRISPR gRNA sequence
gatcctcctgcctcagcctc

SEQ ID NO: 517389 - DNA, 20 bp, Artificial
  CRISPR gRNA sequence
tttttattttttgtagaggt

SEQ ID NO: 517390 - DNA, 20 bp, Artificial
  CRISPR gRNA sequence
gccttggcctctcaaaacac

SEQ ID NO: 517391 - DNA, 20 bp, Artificial
  CRISPR gRNA sequence
cctgtcctcgacttctgtga

SEQ ID NO: 517392 - DNA, 20 bp, Artificial
  CRISPR gRNA sequence
aagggtgtgtgtgatttggc

SEQ ID NO: 517393 - DNA, 20 bp, Artificial
  CRISPR gRNA sequence
ccgctttcgtgtctcagagc

SEQ ID NO: 517394 - DNA, 20 bp, Artificial
  CRISPR gRNA sequence
ggaagggcgcccggcccctg

SEQ ID NO: 517395 - DNA, 20 bp, Artificial
  CRISPR gRNA sequence
ccctgaggggttctccgggg

SEQ ID NO: 517396 - DNA, 20 bp, Artificial
  CRISPR gRNA sequence
accacttcctgcagctgggc

SEQ ID NO: 517397 - DNA, 20 bp, Artificial
  CRISPR gRNA sequence
accagcacttccttctcggg

SEQ ID NO: 517398 - DNA, 20 bp, Artificial
  CRISPR gRNA sequence
tctgagaggcctgtggggct

SEQ ID NO: 517399 - DNA, 20 bp, Artificial
  CRISPR gRNA sequence
attcctaagcagcctcagct

SEQ ID NO: 517400 - DNA, 20 bp, Artificial
  CRISPR gRNA sequence
gacccgcccgcccttagatg

SEQ ID NO: 517401 - DNA, 20 bp, Artificial
  CRISPR gRNA sequence
atgggggatgtccagagctg

SEQ ID NO: 517402 - DNA, 20 bp, Artificial
  CRISPR gRNA sequence
gggcagcagggagggccttg

SEQ ID NO: 517403 - DNA, 20 bp, Artificial
  CRISPR gRNA sequence
tggggcagcagggagggcct

SEQ ID NO: 517404 - DNA, 20 bp, Artificial
  CRISPR gRNA sequence
tctggggccagctcaggggc

SEQ ID NO: 517405 - DNA, 20 bp, Artificial
  CRISPR gRNA sequence
ccagctcaggggctggggtg

SEQ ID NO: 517406 - DNA, 20 bp, Artificial
  CRISPR gRNA sequence
gtggccaggcacctgtttgc

SEQ ID NO: 517407 - DNA, 20 bp, Artificial
  CRISPR gRNA sequence
actgaggcagataggcctga

SEQ ID NO: 517408 - DNA, 20 bp, Artificial
  CRISPR gRNA sequence
gggctcagccactggcattg

SEQ ID NO: 517409 - DNA, 20 bp, Artificial
  CRISPR gRNA sequence
ccccttcctgtggtcaaggt

SEQ ID NO: 517410 - DNA, 20 bp, Artificial
  CRISPR gRNA sequence
ggtctctgagccaatcctgc

SEQ ID NO: 517411 - DNA, 20 bp, Artificial
  CRISPR gRNA sequence
ccctctccctgtgggcaggt

SEQ ID NO: 517412 - DNA, 20 bp, Artificial
  CRISPR gRNA sequence
tgtgggcaggtgggagtgcc

SEQ ID NO: 517413 - DNA, 20 bp, Artificial
  CRISPR gRNA sequence
ggccctcagtttccccattt

SEQ ID NO: 517414 - DNA, 20 bp, Artificial
  CRISPR gRNA sequence
ccccagggagagcgtggagc

SEQ ID NO: 517415 - DNA, 20 bp, Artificial
  CRISPR gRNA sequence
ggagagcgtggagctggggt

SEQ ID NO: 517416 - DNA, 20 bp, Artificial
  CRISPR gRNA sequence
ttggcgcagctgcgacctgg

SEQ ID NO: 517417 - DNA, 20 bp, Artificial
  CRISPR gRNA sequence
ggctggaccctgcaccctgg

SEQ ID NO: 517418 - DNA, 20 bp, Artificial
  CRISPR gRNA sequence
ggctggaccctgcaccctgg

SEQ ID NO: 517419 - DNA, 20 bp, Artificial
  CRISPR gRNA sequence
ggctggaccctgcaccctgg

SEQ ID NO: 517420 - DNA, 20 bp, Artificial
  CRISPR gRNA sequence
ggctggaccctgcaccctgg

SEQ ID NO: 517421 - DNA, 20 bp, Artificial
  CRISPR gRNA sequence
ggctggaccctgcaccctgg

SEQ ID NO: 517422 - DNA, 20 bp, Artificial
  CRISPR gRNA sequence
ggctggaccctgcaccctgg

SEQ ID NO: 517423 - DNA, 20 bp, Artificial
  CRISPR gRNA sequence
ggctggaccctgcaccctgg

SEQ ID NO: 517424 - DNA, 20 bp, Artificial
  CRISPR gRNA sequence
ggctggaccctgcaccctgg

SEQ ID NO: 517425 - DNA, 20 bp, Artificial
  CRISPR gRNA sequence
ggctggaccctgcaccctgg

SEQ ID NO: 517426 - DNA, 20 bp, Artificial
  CRISPR gRNA sequence
ggctggaccctgcaccctgg

SEQ ID NO: 517427 - DNA, 20 bp, Artificial
  CRISPR gRNA sequence
gctggctggaccctgcaccc

SEQ ID NO: 517428 - DNA, 20 bp, Artificial
  CRISPR gRNA sequence
gatatgggggctttcagaca

SEQ ID NO: 517429 - DNA, 20 bp, Artificial
  CRISPR gRNA sequence
cctcctccaggaagttacag

SEQ ID NO: 517430 - DNA, 20 bp, Artificial
  CRISPR gRNA sequence
gtttttgaccccaggacggg

SEQ ID NO: 517431 - DNA, 20 bp, Artificial
  CRISPR gRNA sequence
accccaggacgggaaggatc

SEQ ID NO: 517432 - DNA, 20 bp, Artificial
  CRISPR gRNA sequence
tataattttgctgggaacca

SEQ ID NO: 517433 - DNA, 20 bp, Artificial
  CRISPR gRNA sequence
ttgttggggcgtctaagctg

SEQ ID NO: 517434 - DNA, 20 bp, Artificial
  CRISPR gRNA sequence
gatcctcagatgggcccctg

SEQ ID NO: 517435 - DNA, 20 bp, Artificial
  CRISPR gRNA sequence
gcacaggtgcagggctttcg

SEQ ID NO: 517436 - DNA, 20 bp, Artificial
  CRISPR gRNA sequence
tagtttggggctctgctggc

SEQ ID NO: 517437 - DNA, 20 bp, Artificial
  CRISPR gRNA sequence
ttgggtctgcccactgaacc

SEQ ID NO: 517438 - DNA, 20 bp, Artificial
  CRISPR gRNA sequence
ctgccagcaccacccgaggg

SEQ ID NO: 517439 - DNA, 20 bp, Artificial
  CRISPR gRNA sequence
tttgcttctgacaacagccc

SEQ ID NO: 517440 - DNA, 20 bp, Artificial
  CRISPR gRNA sequence
ccaccatgacaggaaggctc

SEQ ID NO: 517441 - DNA, 20 bp, Artificial
  CRISPR gRNA sequence
accttcttggtgccagataa

SEQ ID NO: 517442 - DNA, 20 bp, Artificial
  CRISPR gRNA sequence
aggcctggtttgggcacctc

SEQ ID NO: 517443 - DNA, 20 bp, Artificial
  CRISPR gRNA sequence
ggatggagggaagggaaccc

SEQ ID NO: 517444 - DNA, 20 bp, Artificial
  CRISPR gRNA sequence
gcctctggggccgagggcct

SEQ ID NO: 517445 - DNA, 20 bp, Artificial
  CRISPR gRNA sequence
ccactgagccgcccctggct

SEQ ID NO: 517446 - DNA, 20 bp, Artificial
  CRISPR gRNA sequence
ccgcccctggctgtggatgc

SEQ ID NO: 517447 - DNA, 20 bp, Artificial
  CRISPR gRNA sequence
gtggatgcgtgggttaagga

SEQ ID NO: 517448 - DNA, 20 bp, Artificial
  CRISPR gRNA sequence
atgcgtgggttaaggacggg

SEQ ID NO: 517449 - DNA, 20 bp, Artificial
  CRISPR gRNA sequence
ggacctggggcacactgggg

SEQ ID NO: 517450 - DNA, 20 bp, Artificial
  CRISPR gRNA sequence
actggggcagagtgcacaca

SEQ ID NO: 517451 - DNA, 20 bp, Artificial
  CRISPR gRNA sequence
gagtgcacacaccgggtgtg

SEQ ID NO: 517452 - DNA, 20 bp, Artificial
  CRISPR gRNA sequence
gtggtgtgtagtgtcttgcg

SEQ ID NO: 517453 - DNA, 20 bp, Artificial
  CRISPR gRNA sequence
tgtcttgcggggagtatggt

SEQ ID NO: 517454 - DNA, 20 bp, Artificial
  CRISPR gRNA sequence
cggggagtatggtgtgggta

SEQ ID NO: 517455 - DNA, 20 bp, Artificial
  CRISPR gRNA sequence
aggggcccgctgcagctgtc

SEQ ID NO: 517456 - DNA, 20 bp, Artificial
  CRISPR gRNA sequence
gctgcccgcactgctgagcc

SEQ ID NO: 517457 - DNA, 20 bp, Artificial
  CRISPR gRNA sequence
gccagctggaggggagcttc

SEQ ID NO: 517458 - DNA, 20 bp, Artificial
  CRISPR gRNA sequence
cttcatgggtggtcagcccc

SEQ ID NO: 517459 - DNA, 20 bp, Artificial
  CRISPR gRNA sequence
cctggtggggctgctctccc

SEQ ID NO: 517460 - DNA, 20 bp, Artificial
  CRISPR gRNA sequence
gctgctctccctcgggtgcg

SEQ ID NO: 517461 - DNA, 20 bp, Artificial
  CRISPR gRNA sequence
tggggaaggaccttgccact

SEQ ID NO: 517462 - DNA, 20 bp, Artificial
  CRISPR gRNA sequence
gagggcccctctttgcacct

SEQ ID NO: 517463 - DNA, 20 bp, Artificial
  CRISPR gRNA sequence
ctttgcacctgggggtggtg

SEQ ID NO: 517464 - DNA, 20 bp, Artificial
  CRISPR gRNA sequence
cctgggggtggtggcgaatg

SEQ ID NO: 517465 - DNA, 20 bp, Artificial
  CRISPR gRNA sequence
ccttcctgctctactccccc

SEQ ID NO: 517466 - DNA, 20 bp, Artificial
  CRISPR gRNA sequence
tcgtccctcagtcctctctc

SEQ ID NO: 517467 - DNA, 20 bp, Artificial
  CRISPR gRNA sequence
gttcaaggtcagcagctgcc

SEQ ID NO: 517468 - DNA, 20 bp, Artificial
  CRISPR gRNA sequence
cagcagctgccgggaatgca

SEQ ID NO: 517469 - DNA, 20 bp, Artificial
  CRISPR gRNA sequence
cctccccacctgcccagctc

SEQ ID NO: 517470 - DNA, 20 bp, Artificial
  CRISPR gRNA sequence
caactccattttctttttga

SEQ ID NO: 517471 - DNA, 20 bp, Artificial
  CRISPR gRNA sequence
gtattttttctcagccattt

SEQ ID NO: 517472 - DNA, 20 bp, Artificial
  CRISPR gRNA sequence
atcgccagcacgctttcctg

SEQ ID NO: 517473 - DNA, 20 bp, Artificial
  CRISPR gRNA sequence
ccaccaaacacagcccttat

SEQ ID NO: 517474 - DNA, 20 bp, Artificial
  CRISPR gRNA sequence
ttcgtgagcatattttcctg

SEQ ID NO: 517475 - DNA, 20 bp, Artificial
  CRISPR gRNA sequence
gtgctcagctgtctcaggct

SEQ ID NO: 517476 - DNA, 20 bp, Artificial
  CRISPR gRNA sequence
gcgctcagccgtctaacgct

SEQ ID NO: 517477 - DNA, 20 bp, Artificial
  CRISPR gRNA sequence
cagccgtctccttgggcttc

SEQ ID NO: 517478 - DNA, 20 bp, Artificial
  CRISPR gRNA sequence
agctttgtagcatgaccctc

SEQ ID NO: 517479 - DNA, 20 bp, Artificial
  CRISPR gRNA sequence
tgaccctcgggggtcttgtc

SEQ ID NO: 517480 - DNA, 20 bp, Artificial
  CRISPR gRNA sequence
tcacggctgccaacctaagg

SEQ ID NO: 517481 - DNA, 20 bp, Artificial
  CRISPR gRNA sequence
ctgtggctgtcctttcttcc

SEQ ID NO: 517482 - DNA, 20 bp, Artificial
  CRISPR gRNA sequence
ccccgagttgctcaaatccg

SEQ ID NO: 517483 - DNA, 20 bp, Artificial
  CRISPR gRNA sequence
ccatgtcccttgccccagcc

SEQ ID NO: 517484 - DNA, 20 bp, Artificial
  CRISPR gRNA sequence
tcagatggttttctgacggc

SEQ ID NO: 517485 - DNA, 20 bp, Artificial
  CRISPR gRNA sequence
cggctcgggttcctttccct

SEQ ID NO: 517486 - DNA, 20 bp, Artificial
  CRISPR gRNA sequence
gtagccggacaagccgcaga

SEQ ID NO: 517487 - DNA, 20 bp, Artificial
  CRISPR gRNA sequence
aggaagggctttatttggcc

SEQ ID NO: 517488 - DNA, 20 bp, Artificial
  CRISPR gRNA sequence
tttaagggcttacaactcta

SEQ ID NO: 517489 - DNA, 20 bp, Artificial
  CRISPR gRNA sequence
actctaaggggtccacatga

SEQ ID NO: 517490 - DNA, 20 bp, Artificial
  CRISPR gRNA sequence
caagtgtggggaacttgact

SEQ ID NO: 517491 - DNA, 20 bp, Artificial
  CRISPR gRNA sequence
atgctttttcatacaatgtc

SEQ ID NO: 517492 - DNA, 20 bp, Artificial
  CRISPR gRNA sequence
taacaccagtagttttggtc

SEQ ID NO: 517493 - DNA, 20 bp, Artificial
  CRISPR gRNA sequence
tattagtttaaccaccaggg

SEQ ID NO: 517494 - DNA, 20 bp, Artificial
  CRISPR gRNA sequence
ttataaactagagaagggga

SEQ ID NO: 517495 - DNA, 20 bp, Artificial
  CRISPR gRNA sequence
gcgtcccacagggagcggct

SEQ ID NO: 517496 - DNA, 20 bp, Artificial
  CRISPR gRNA sequence
agcagtccccggaggagaag

SEQ ID NO: 517497 - DNA, 20 bp, Artificial
  CRISPR gRNA sequence
ccgtctgtcctcggactgag

SEQ ID NO: 517498 - DNA, 20 bp, Artificial
  CRISPR gRNA sequence
tggaaactaccttggtcagg

SEQ ID NO: 517499 - DNA, 20 bp, Artificial
  CRISPR gRNA sequence
tgagatttgtttgtttctgt

SEQ ID NO: 517500 - DNA, 20 bp, Artificial
  CRISPR gRNA sequence
ggctttcttttctctcttgc

SEQ ID NO: 517501 - DNA, 20 bp, Artificial
  CRISPR gRNA sequence
ccaccaaacacagccctcat

SEQ ID NO: 517502 - DNA, 20 bp, Artificial
  CRISPR gRNA sequence
acagccctcatcagaatcca

SEQ ID NO: 517503 - DNA, 20 bp, Artificial
  CRISPR gRNA sequence
cccagaaccctgcccatgtt

SEQ ID NO: 517504 - DNA, 20 bp, Artificial
  CRISPR gRNA sequence
ggacgctgaggcctctcctc

SEQ ID NO: 517505 - DNA, 20 bp, Artificial
  CRISPR gRNA sequence
cttgggtcagcctcgggctg

SEQ ID NO: 517506 - DNA, 20 bp, Artificial
  CRISPR gRNA sequence
ctcgggctggagagtaggtc

SEQ ID NO: 517507 - DNA, 20 bp, Artificial
  CRISPR gRNA sequence
gaggcgataccctgcccccc

SEQ ID NO: 517508 - DNA, 20 bp, Artificial
  CRISPR gRNA sequence
aggcgcagaggaggagggga

SEQ ID NO: 517509 - DNA, 20 bp, Artificial
  CRISPR gRNA sequence
gcagaggaggaggggacagg

SEQ ID NO: 517510 - DNA, 20 bp, Artificial
  CRISPR gRNA sequence
cccagaacttcacagggccg

SEQ ID NO: 517511 - DNA, 20 bp, Artificial
  CRISPR gRNA sequence
gctggttattggctctggct

SEQ ID NO: 517512 - DNA, 20 bp, Artificial
  CRISPR gRNA sequence
ctgggagtccggccctgctc

SEQ ID NO: 517513 - DNA, 20 bp, Artificial
  CRISPR gRNA sequence
gctgcccagaaggcatgtgt

SEQ ID NO: 517514 - DNA, 20 bp, Artificial
  CRISPR gRNA sequence
aaggcatgtgtccgggtcgg

SEQ ID NO: 517515 - DNA, 20 bp, Artificial
  CRISPR gRNA sequence
ccattacacactcagaaggc

SEQ ID NO: 517516 - DNA, 20 bp, Artificial
  CRISPR gRNA sequence
gaaggccagggtactcttag

SEQ ID NO: 517517 - DNA, 20 bp, Artificial
  CRISPR gRNA sequence
cagcactttgggaggccgag

SEQ ID NO: 517518 - DNA, 20 bp, Artificial
  CRISPR gRNA sequence
actttgggaggccgaggcgg

SEQ ID NO: 517519 - DNA, 20 bp, Artificial
  CRISPR gRNA sequence
cgggtggatcacttgaggtc

SEQ ID NO: 517520 - DNA, 20 bp, Artificial
  CRISPR gRNA sequence
acattctcctgctgcggcag

SEQ ID NO: 517521 - DNA, 20 bp, Artificial
  CRISPR gRNA sequence
gggaagccatctcccaggga

SEQ ID NO: 517522 - DNA, 20 bp, Artificial
  CRISPR gRNA sequence
ggagagggtgcagacggggc

SEQ ID NO: 517523 - DNA, 20 bp, Artificial
  CRISPR gRNA sequence
gaagcccaggtcagcggcca

SEQ ID NO: 517524 - DNA, 20 bp, Artificial
  CRISPR gRNA sequence
ccactgagttagccttgggg

SEQ ID NO: 517525 - DNA, 20 bp, Artificial
  CRISPR gRNA sequence
agccttggggcagagtggcc

SEQ ID NO: 517526 - DNA, 20 bp, Artificial
  CRISPR gRNA sequence
gaggcagctgggagacagtg

SEQ ID NO: 517527 - DNA, 20 bp, Artificial
  CRISPR gRNA sequence
acaaaaccccaccctggtgg

SEQ ID NO: 517528 - DNA, 20 bp, Artificial
  CRISPR gRNA sequence
acagaggtgttgcctgtggc

SEQ ID NO: 517529 - DNA, 20 bp, Artificial
  CRISPR gRNA sequence
gtggtgctggaggtgtcagg

SEQ ID NO: 517530 - DNA, 20 bp, Artificial
  CRISPR gRNA sequence
tgtcaggaaggatcgtcctg

SEQ ID NO: 517531 - DNA, 20 bp, Artificial
  CRISPR gRNA sequence
gaaggatcgtcctggagggt

SEQ ID NO: 517532 - DNA, 20 bp, Artificial
  CRISPR gRNA sequence
cctggagggtgggggtgcgc

SEQ ID NO: 517533 - DNA, 20 bp, Artificial
  CRISPR gRNA sequence
ggcatccttgtgccgtgggg

SEQ ID NO: 517534 - DNA, 20 bp, Artificial
  CRISPR gRNA sequence
tgtgccgtggggaagggtgg

SEQ ID NO: 517535 - DNA, 20 bp, Artificial
  CRISPR gRNA sequence
ctgggagggcacaggtgagc

SEQ ID NO: 517536 - DNA, 20 bp, Artificial
  CRISPR gRNA sequence
gagggcacaggtgagctcgg

SEQ ID NO: 517537 - DNA, 20 bp, Artificial
  CRISPR gRNA sequence
gagctcgggtggatgcaggt

SEQ ID NO: 517538 - DNA, 20 bp, Artificial
  CRISPR gRNA sequence
gcaggtgagggtaggcaaac

SEQ ID NO: 517539 - DNA, 20 bp, Artificial
  CRISPR gRNA sequence
aggctcccagagcagggcgg

SEQ ID NO: 517540 - DNA, 20 bp, Artificial
  CRISPR gRNA sequence
gggaagggactgtcctctcg

SEQ ID NO: 517541 - DNA, 20 bp, Artificial
  CRISPR gRNA sequence
ggcccttcatagaaagtgat

SEQ ID NO: 517542 - DNA, 20 bp, Artificial
  CRISPR gRNA sequence
gcagggcgagggccagggcc

SEQ ID NO: 517543 - DNA, 20 bp, Artificial
  CRISPR gRNA sequence
gagggccagggccaggagtg

SEQ ID NO: 517544 - DNA, 20 bp, Artificial
  CRISPR gRNA sequence
cagggccaggagtgccgggt

SEQ ID NO: 517545 - DNA, 20 bp, Artificial
  CRISPR gRNA sequence
caggagtgccgggtgtgaat

SEQ ID NO: 517546 - DNA, 20 bp, Artificial
  CRISPR gRNA sequence
agtgccgggtgtgaatgtgg

SEQ ID NO: 517547 - DNA, 20 bp, Artificial
  CRISPR gRNA sequence
tgtatgtgtttagcattgtg

SEQ ID NO: 517548 - DNA, 20 bp, Artificial
  CRISPR gRNA sequence
tatgtgtggcacgtgtgtgt

SEQ ID NO: 517549 - DNA, 20 bp, Artificial
  CRISPR gRNA sequence
tggcacgtgtgtgtatgggt

SEQ ID NO: 517550 - DNA, 20 bp, Artificial
  CRISPR gRNA sequence
tgtgtggcatgcatgtgtat

SEQ ID NO: 517551 - DNA, 20 bp, Artificial
  CRISPR gRNA sequence
catgtgtgtggtgtatgtgc

SEQ ID NO: 517552 - DNA, 20 bp, Artificial
  CRISPR gRNA sequence
tttggtgtgtgtatgtgtgt

SEQ ID NO: 517553 - DNA, 20 bp, Artificial
  CRISPR gRNA sequence
ctttgtgtctggtgttgtgt

SEQ ID NO: 517554 - DNA, 20 bp, Artificial
  CRISPR gRNA sequence
ttgtggtgtgtttgctgtgt

SEQ ID NO: 517555 - DNA, 20 bp, Artificial
  CRISPR gRNA sequence
ggtgccatgtgcgtgtatat

SEQ ID NO: 517556 - DNA, 20 bp, Artificial
  CRISPR gRNA sequence
ctacgtgtgactgtgtgtgc

SEQ ID NO: 517557 - DNA, 20 bp, Artificial
  CRISPR gRNA sequence
tgcatgagttatatttgtgt

SEQ ID NO: 517558 - DNA, 20 bp, Artificial
  CRISPR gRNA sequence
tattgtgtgtgtgcatatat

SEQ ID NO: 517559 - DNA, 20 bp, Artificial
  CRISPR gRNA sequence
catgtggtgtatttatgtgt

SEQ ID NO: 517560 - DNA, 20 bp, Artificial
  CRISPR gRNA sequence
ggggcacataccctttctcc

SEQ ID NO: 517561 - DNA, 20 bp, Artificial
  CRISPR gRNA sequence
ggtgtggcagcaggcaggtt

SEQ ID NO: 517562 - DNA, 20 bp, Artificial
  CRISPR gRNA sequence
ggcagcaggcaggttggggg

SEQ ID NO: 517563 - DNA, 20 bp, Artificial
  CRISPR gRNA sequence
cccaggggggctgaaggctg

SEQ ID NO: 517564 - DNA, 20 bp, Artificial
  CRISPR gRNA sequence
ggcgagcggaagtccagggc

SEQ ID NO: 517565 - DNA, 20 bp, Artificial
  CRISPR gRNA sequence
gtgggactgcaggcatgggg

SEQ ID NO: 517566 - DNA, 20 bp, Artificial
  CRISPR gRNA sequence
gtcaactctaagcaccccag

SEQ ID NO: 517567 - DNA, 20 bp, Artificial
  CRISPR gRNA sequence
cgaggcacatgcctgcgtcc

SEQ ID NO: 517568 - DNA, 20 bp, Artificial
  CRISPR gRNA sequence
cctctgaaactccagcctgc

SEQ ID NO: 517569 - DNA, 20 bp, Artificial
  CRISPR gRNA sequence
gcggggagaggggaggtcag

SEQ ID NO: 517570 - DNA, 20 bp, Artificial
  CRISPR gRNA sequence
aggatttgggggctggagga

SEQ ID NO: 517571 - DNA, 20 bp, Artificial
  CRISPR gRNA sequence
actccatgcttgatgacctc

SEQ ID NO: 517572 - DNA, 20 bp, Artificial
  CRISPR gRNA sequence
ccgggccctcaacgagatca

SEQ ID NO: 517573 - DNA, 20 bp, Artificial
  CRISPR gRNA sequence
actcctcgcactcaggtccc

SEQ ID NO: 517574 - DNA, 20 bp, Artificial
  CRISPR gRNA sequence
ctgccaccttccctacatgc

SEQ ID NO: 517575 - DNA, 20 bp, Artificial
  CRISPR gRNA sequence
acaaatgcacgctcatgcac

SEQ ID NO: 517576 - DNA, 20 bp, Artificial
  CRISPR gRNA sequence
gcaaatgcacgctcacacat

SEQ ID NO: 517577 - DNA, 20 bp, Artificial
  CRISPR gRNA sequence
atgcgaatgcacactcacac

SEQ ID NO: 517578 - DNA, 20 bp, Artificial
  CRISPR gRNA sequence
atgtatcctcacatgcacaa

SEQ ID NO: 517579 - DNA, 20 bp, Artificial
  CRISPR gRNA sequence
acaaatggatgctcacacac

SEQ ID NO: 517580 - DNA, 20 bp, Artificial
  CRISPR gRNA sequence
aaactcaaatgcacacacac

SEQ ID NO: 517581 - DNA, 20 bp, Artificial
  CRISPR gRNA sequence
gtgaatgcatgctcacacac

SEQ ID NO: 517582 - DNA, 20 bp, Artificial
  CRISPR gRNA sequence
acaaatgcatgctctcacat

SEQ ID NO: 517583 - DNA, 20 bp, Artificial
  CRISPR gRNA sequence
atgtgaatgtatgctcacac

SEQ ID NO: 517584 - DNA, 20 bp, Artificial
  CRISPR gRNA sequence
gcaaatgcatgctcacacac

SEQ ID NO: 517585 - DNA, 20 bp, Artificial
  CRISPR gRNA sequence
acaaatgcacgctcacacac

SEQ ID NO: 517586 - DNA, 20 bp, Artificial
  CRISPR gRNA sequence
acaaatgcatgctcacacac

SEQ ID NO: 517587 - DNA, 20 bp, Artificial
  CRISPR gRNA sequence
gaacatgctcacatgcatac

SEQ ID NO: 517588 - DNA, 20 bp, Artificial
  CRISPR gRNA sequence
ctccatgtgccctgcaggct

SEQ ID NO: 517589 - DNA, 20 bp, Artificial
  CRISPR gRNA sequence
cccatgccccaacaaggaga

SEQ ID NO: 517590 - DNA, 20 bp, Artificial
  CRISPR gRNA sequence
agcagctgatttccggaaac

SEQ ID NO: 517591 - DNA, 20 bp, Artificial
  CRISPR gRNA sequence
ccggaaacctggatgcaccc

SEQ ID NO: 517592 - DNA, 20 bp, Artificial
  CRISPR gRNA sequence
ggtgaggccgctgcccctgc

SEQ ID NO: 517593 - DNA, 20 bp, Artificial
  CRISPR gRNA sequence
caggcgctgtgtgggggcag

SEQ ID NO: 517594 - DNA, 20 bp, Artificial
  CRISPR gRNA sequence
aggaaagggcaggaggaagg

SEQ ID NO: 517595 - DNA, 20 bp, Artificial
  CRISPR gRNA sequence
cgctgatttcattgtttgct

SEQ ID NO: 517596 - DNA, 20 bp, Artificial
  CRISPR gRNA sequence
taaacattttgcgagcggcc

SEQ ID NO: 517597 - DNA, 20 bp, Artificial
  CRISPR gRNA sequence
gcagcaggtcccgtggttcc

SEQ ID NO: 517598 - DNA, 20 bp, Artificial
  CRISPR gRNA sequence
accaccctcctccctccagg

SEQ ID NO: 517599 - DNA, 20 bp, Artificial
  CRISPR gRNA sequence
ccagcgcagacacactgctc

SEQ ID NO: 517600 - DNA, 20 bp, Artificial
  CRISPR gRNA sequence
cgtgtggcccacacgtctgc

SEQ ID NO: 517601 - DNA, 20 bp, Artificial
  CRISPR gRNA sequence
ctgcgagggtttttcccctt

SEQ ID NO: 517602 - DNA, 20 bp, Artificial
  CRISPR gRNA sequence
ccccttggggatggtttcct

SEQ ID NO: 517603 - DNA, 20 bp, Artificial
  CRISPR gRNA sequence
ccctgcgcctcacatgtgca

SEQ ID NO: 517604 - DNA, 20 bp, Artificial
  CRISPR gRNA sequence
tggcgtctgggggaacacag

SEQ ID NO: 517605 - DNA, 20 bp, Artificial
  CRISPR gRNA sequence
gtctcctctgctccagaggg

SEQ ID NO: 517606 - DNA, 20 bp, Artificial
  CRISPR gRNA sequence
caacttgtacaagaggagca

SEQ ID NO: 517607 - DNA, 20 bp, Artificial
  CRISPR gRNA sequence
acaccactgacggaggagac

SEQ ID NO: 517608 - DNA, 20 bp, Artificial
  CRISPR gRNA sequence
actgacggaggagacaaggg

SEQ ID NO: 517609 - DNA, 20 bp, Artificial
  CRISPR gRNA sequence
ggaagccccaagtggcagcg

SEQ ID NO: 517610 - DNA, 20 bp, Artificial
  CRISPR gRNA sequence
ggactggcctcaggccaggg

SEQ ID NO: 517611 - DNA, 20 bp, Artificial
  CRISPR gRNA sequence
ggcctcaggccaggggaggg

SEQ ID NO: 517612 - DNA, 20 bp, Artificial
  CRISPR gRNA sequence
ctgccgtccccgcctctggc

SEQ ID NO: 517613 - DNA, 20 bp, Artificial
  CRISPR gRNA sequence
ctgtacgttccctgctgccc

SEQ ID NO: 517614 - DNA, 20 bp, Artificial
  CRISPR gRNA sequence
ccctgcccccattgcctgag

SEQ ID NO: 517615 - DNA, 20 bp, Artificial
  CRISPR gRNA sequence
gacagaggcgagaaggagcc

SEQ ID NO: 517616 - DNA, 20 bp, Artificial
  CRISPR gRNA sequence
cgagaaggagcccaggatgc

SEQ ID NO: 517617 - DNA, 20 bp, Artificial
  CRISPR gRNA sequence
ggagcccaggatgcacgggt

SEQ ID NO: 517618 - DNA, 20 bp, Artificial
  CRISPR gRNA sequence
gaggggccaggacttctggc

SEQ ID NO: 517619 - DNA, 20 bp, Artificial
  CRISPR gRNA sequence
acagacgggagggacggccc

SEQ ID NO: 517620 - DNA, 20 bp, Artificial
  CRISPR gRNA sequence
cggccctcgggtcccggaac

SEQ ID NO: 517621 - DNA, 20 bp, Artificial
  CRISPR gRNA sequence
actcatggcctctaccgaaa

SEQ ID NO: 517622 - DNA, 20 bp, Artificial
  CRISPR gRNA sequence
gtccaccgtgtggggaaggc

SEQ ID NO: 517623 - DNA, 20 bp, Artificial
  CRISPR gRNA sequence
catgcctggactctgaaagc

SEQ ID NO: 517624 - DNA, 20 bp, Artificial
  CRISPR gRNA sequence
cctctccagccttccccaga

SEQ ID NO: 517625 - DNA, 20 bp, Artificial
  CRISPR gRNA sequence
gctgagcggggcagacaggg

SEQ ID NO: 517626 - DNA, 20 bp, Artificial
  CRISPR gRNA sequence
cccatcttcgcggtgaccag

SEQ ID NO: 517627 - DNA, 20 bp, Artificial
  CRISPR gRNA sequence
ggatggtgaagacctacgag

SEQ ID NO: 517628 - DNA, 20 bp, Artificial
  CRISPR gRNA sequence
gacctacgaggtgagtgctg

SEQ ID NO: 517629 - DNA, 20 bp, Artificial
  CRISPR gRNA sequence
tgttgggtcccgagcatcca

SEQ ID NO: 517630 - DNA, 20 bp, Artificial
  CRISPR gRNA sequence
gcaaccagccggcccaggtc

SEQ ID NO: 517631 - DNA, 20 bp, Artificial
  CRISPR gRNA sequence
gcctgcgtgtcgataggagg

SEQ ID NO: 517632 - DNA, 20 bp, Artificial
  CRISPR gRNA sequence
gtgatatttctgttttttcc

SEQ ID NO: 517633 - DNA, 20 bp, Artificial
  CRISPR gRNA sequence
cacaaaaacgttcacaagct

SEQ ID NO: 517634 - DNA, 20 bp, Artificial
  CRISPR gRNA sequence
acgttcacaagcttggagtg

SEQ ID NO: 517635 - DNA, 20 bp, Artificial
  CRISPR gRNA sequence
cacaagcttggagtgcggag

SEQ ID NO: 517636 - DNA, 20 bp, Artificial
  CRISPR gRNA sequence
agcttggagtgcggagtggg

SEQ ID NO: 517637 - DNA, 20 bp, Artificial
  CRISPR gRNA sequence
tcaagacgctcaggtgctgt

SEQ ID NO: 517638 - DNA, 20 bp, Artificial
  CRISPR gRNA sequence
ggggttcccaagacctttct

SEQ ID NO: 517639 - DNA, 20 bp, Artificial
  CRISPR gRNA sequence
ttattgcagagccgaccctc

SEQ ID NO: 517640 - DNA, 20 bp, Artificial
  CRISPR gRNA sequence
ccagccgctgcccgaggtgg

SEQ ID NO: 517641 - DNA, 20 bp, Artificial
  CRISPR gRNA sequence
tcccagtgtcccctccctgc

SEQ ID NO: 517642 - DNA, 20 bp, Artificial
  CRISPR gRNA sequence
cttgagcctcggtgtctact

SEQ ID NO: 517643 - DNA, 20 bp, Artificial
  CRISPR gRNA sequence
caggaacaatgacaccccca

SEQ ID NO: 517644 - DNA, 20 bp, Artificial
  CRISPR gRNA sequence
acaatgacacccccatcggg

SEQ ID NO: 517645 - DNA, 20 bp, Artificial
  CRISPR gRNA sequence
ctacctctcaggagctcagc

SEQ ID NO: 517646 - DNA, 20 bp, Artificial
  CRISPR gRNA sequence
ctaccactctttggcatgtg

SEQ ID NO: 517647 - DNA, 20 bp, Artificial
  CRISPR gRNA sequence
ggtgtggccagccaggcctg

SEQ ID NO: 517648 - DNA, 20 bp, Artificial
  CRISPR gRNA sequence
tggagccctgactgtgtaac

SEQ ID NO: 517649 - DNA, 20 bp, Artificial
  CRISPR gRNA sequence
cagccacgtgccccgttctt

SEQ ID NO: 517650 - DNA, 20 bp, Artificial
  CRISPR gRNA sequence
cagccacgtgccccgttctt

SEQ ID NO: 517651 - DNA, 20 bp, Artificial
  CRISPR gRNA sequence
tcttcagggtggacagggcc

SEQ ID NO: 517652 - DNA, 20 bp, Artificial
  CRISPR gRNA sequence
tcagtttcctcatctgtgaa

SEQ ID NO: 517653 - DNA, 20 bp, Artificial
  CRISPR gRNA sequence
tgcccggcgggcagtgcgtc

SEQ ID NO: 517654 - DNA, 20 bp, Artificial
  CRISPR gRNA sequence
gtactgagctcacccactca

SEQ ID NO: 517655 - DNA, 20 bp, Artificial
  CRISPR gRNA sequence
ttaggctgaggagacatact

SEQ ID NO: 517656 - DNA, 20 bp, Artificial
  CRISPR gRNA sequence
gtgaacatttgctgaactac

SEQ ID NO: 517657 - DNA, 20 bp, Artificial
  CRISPR gRNA sequence
gccataggttccccgggctc

SEQ ID NO: 517658 - DNA, 20 bp, Artificial
  CRISPR gRNA sequence
gcaggaccctgcgggagaca

SEQ ID NO: 517659 - DNA, 20 bp, Artificial
  CRISPR gRNA sequence
gcaggtgtctgggggaccct

SEQ ID NO: 517660 - DNA, 20 bp, Artificial
  CRISPR gRNA sequence
ctggtcaggctgccgggaca

SEQ ID NO: 517661 - DNA, 20 bp, Artificial
  CRISPR gRNA sequence
cacagagaccacctgctggt

SEQ ID NO: 517662 - DNA, 20 bp, Artificial
  CRISPR gRNA sequence
ggccaggcactggaggcagg

SEQ ID NO: 517663 - DNA, 20 bp, Artificial
  CRISPR gRNA sequence
agcctttcctggtcaccttc

SEQ ID NO: 517664 - DNA, 20 bp, Artificial
  CRISPR gRNA sequence
ggtggtcaaggcaacaggca

SEQ ID NO: 517665 - DNA, 20 bp, Artificial
  CRISPR gRNA sequence
acacacgtgccacgccccct

SEQ ID NO: 517666 - DNA, 20 bp, Artificial
  CRISPR gRNA sequence
gcacagcaggctcagcagga

SEQ ID NO: 517667 - DNA, 20 bp, Artificial
  CRISPR gRNA sequence
gggcccagctctcccaagac

SEQ ID NO: 517668 - DNA, 20 bp, Artificial
  CRISPR gRNA sequence
agggatggccccagactggg

SEQ ID NO: 517669 - DNA, 20 bp, Artificial
  CRISPR gRNA sequence
ggtgggcggagggcgcagag

SEQ ID NO: 517670 - DNA, 20 bp, Artificial
  CRISPR gRNA sequence
cccatgcagggcagtcatgg

SEQ ID NO: 517671 - DNA, 20 bp, Artificial
  CRISPR gRNA sequence
taacacccatggaaactcag

SEQ ID NO: 517672 - DNA, 20 bp, Artificial
  CRISPR gRNA sequence
cctaccatctgtgtggtggt

SEQ ID NO: 517673 - DNA, 20 bp, Artificial
  CRISPR gRNA sequence
cgagcttgaaatccaccagg

SEQ ID NO: 517674 - DNA, 20 bp, Artificial
  CRISPR gRNA sequence
ggatcactcacaccacaggc

SEQ ID NO: 517675 - DNA, 20 bp, Artificial
  CRISPR gRNA sequence
gggagcagtcacaccgcagg

SEQ ID NO: 517676 - DNA, 20 bp, Artificial
  CRISPR gRNA sequence
aggatcactcacactgcagg

SEQ ID NO: 517677 - DNA, 20 bp, Artificial
  CRISPR gRNA sequence
gggagcactcacaccgcagg

SEQ ID NO: 517678 - DNA, 20 bp, Artificial
  CRISPR gRNA sequence
ttcattttattttattgaga

SEQ ID NO: 517679 - DNA, 20 bp, Artificial
  CRISPR gRNA sequence
tttgctcttgttgcccaggc

SEQ ID NO: 517680 - DNA, 20 bp, Artificial
  CRISPR gRNA sequence
ctcattgcgacctccgcctc

SEQ ID NO: 517681 - DNA, 20 bp, Artificial
  CRISPR gRNA sequence
ggttctcctgcctcagtctc

SEQ ID NO: 517682 - DNA, 20 bp, Artificial
  CRISPR gRNA sequence
ttttgtatttttagtagaga

SEQ ID NO: 517683 - DNA, 20 bp, Artificial
  CRISPR gRNA sequence
actttggcctcccaaagtgc

SEQ ID NO: 517684 - DNA, 20 bp, Artificial
  CRISPR gRNA sequence
cgtgagccatcatgcctggc

SEQ ID NO: 517685 - DNA, 20 bp, Artificial
  CRISPR gRNA sequence
tcttgctctgtcgcccaggc

SEQ ID NO: 517686 - DNA, 20 bp, Artificial
  CRISPR gRNA sequence
ctcactgcaacctccacctc

SEQ ID NO: 517687 - DNA, 20 bp, Artificial
  CRISPR gRNA sequence
gatcctcctgcctcagcctc

SEQ ID NO: 517688 - DNA, 20 bp, Artificial
  CRISPR gRNA sequence
atttgtactttttgtagaga

SEQ ID NO: 517689 - DNA, 20 bp, Artificial
  CRISPR gRNA sequence
aatcttcccacatcggcctc

SEQ ID NO: 517690 - DNA, 20 bp, Artificial
  CRISPR gRNA sequence
tttgcaggtgcagaagcccc

SEQ ID NO: 517691 - DNA, 20 bp, Artificial
  CRISPR gRNA sequence
gcaatgtggtccatctcatt

SEQ ID NO: 517692 - DNA, 20 bp, Artificial
  CRISPR gRNA sequence
tcattaagaatgcttacaat

SEQ ID NO: 517693 - DNA, 20 bp, Artificial
  CRISPR gRNA sequence
caccactcagctgggaccca

SEQ ID NO: 517694 - DNA, 20 bp, Artificial
  CRISPR gRNA sequence
ctcctgctgcaggtcagcag

SEQ ID NO: 517695 - DNA, 20 bp, Artificial
  CRISPR gRNA sequence
cggcacttccacggggagct

SEQ ID NO: 517696 - DNA, 20 bp, Artificial
  CRISPR gRNA sequence
ttcattccagactcttctct

SEQ ID NO: 517697 - DNA, 20 bp, Artificial
  CRISPR gRNA sequence
ggccctgggaagacaccctg

SEQ ID NO: 517698 - DNA, 20 bp, Artificial
  CRISPR gRNA sequence
tgggaagacaccctgggggg

SEQ ID NO: 517699 - DNA, 20 bp, Artificial
  CRISPR gRNA sequence
tccagagaagcccttaaccc

SEQ ID NO: 517700 - DNA, 20 bp, Artificial
  CRISPR gRNA sequence
ccccaggtgagagatgttct

SEQ ID NO: 517701 - DNA, 20 bp, Artificial
  CRISPR gRNA sequence
gatgttctcagaattctggc

SEQ ID NO: 517702 - DNA, 20 bp, Artificial
  CRISPR gRNA sequence
gttagcgcctccgacaaacg

SEQ ID NO: 517703 - DNA, 20 bp, Artificial
  CRISPR gRNA sequence
ctccgacaaacgttgggtca

SEQ ID NO: 517704 - DNA, 20 bp, Artificial
  CRISPR gRNA sequence
aacccccagagcagaccctc

SEQ ID NO: 517705 - DNA, 20 bp, Artificial
  CRISPR gRNA sequence
ggtgtttctgtccttacaca

SEQ ID NO: 517706 - DNA, 20 bp, Artificial
  CRISPR gRNA sequence
cactgagaggagaagtggag

SEQ ID NO: 517707 - DNA, 20 bp, Artificial
  CRISPR gRNA sequence
caacagaaacactcgccccc

SEQ ID NO: 517708 - DNA, 20 bp, Artificial
  CRISPR gRNA sequence
tgcccgcagaaactctcctc

SEQ ID NO: 517709 - DNA, 20 bp, Artificial
  CRISPR gRNA sequence
aactctcctccagggtcttc

SEQ ID NO: 517710 - DNA, 20 bp, Artificial
  CRISPR gRNA sequence
tacgactccttctgcagcaa

SEQ ID NO: 517711 - DNA, 20 bp, Artificial
  CRISPR gRNA sequence
gtcccggtgagcctggccac

SEQ ID NO: 517712 - DNA, 20 bp, Artificial
  CRISPR gRNA sequence
tggggacagccagaaggagc

SEQ ID NO: 517713 - DNA, 20 bp, Artificial
  CRISPR gRNA sequence
gtccccatcccagcacactg

SEQ ID NO: 517714 - DNA, 20 bp, Artificial
  CRISPR gRNA sequence
tggggacagccagaaggagc

SEQ ID NO: 517715 - DNA, 20 bp, Artificial
  CRISPR gRNA sequence
gatgtcaggaacgtcagtga

SEQ ID NO: 517716 - DNA, 20 bp, Artificial
  CRISPR gRNA sequence
cgtcagtgagagggtgccga

SEQ ID NO: 517717 - DNA, 20 bp, Artificial
  CRISPR gRNA sequence
gagagggtgcttctcagtga

SEQ ID NO: 517718 - DNA, 20 bp, Artificial
  CRISPR gRNA sequence
tctcagtgagagggtgctgg

SEQ ID NO: 517719 - DNA, 20 bp, Artificial
  CRISPR gRNA sequence
tcacacacgccttggccccc

SEQ ID NO: 517720 - DNA, 20 bp, Artificial
  CRISPR gRNA sequence
tcaacctggagcccaaatcc

SEQ ID NO: 517721 - DNA, 20 bp, Artificial
  CRISPR gRNA sequence
ggtcaggccactgcagactg

SEQ ID NO: 517722 - DNA, 20 bp, Artificial
  CRISPR gRNA sequence
ggccactgcagactgaggga

SEQ ID NO: 517723 - DNA, 20 bp, Artificial
  CRISPR gRNA sequence
aacaggcgcaaacggcaaac

SEQ ID NO: 517724 - DNA, 20 bp, Artificial
  CRISPR gRNA sequence
gcgcaaacggcaaacctggg

SEQ ID NO: 517725 - DNA, 20 bp, Artificial
  CRISPR gRNA sequence
catgggccacacaggtggtt

SEQ ID NO: 517726 - DNA, 20 bp, Artificial
  CRISPR gRNA sequence
caggtggttaggaatggaca

SEQ ID NO: 517727 - DNA, 20 bp, Artificial
  CRISPR gRNA sequence
gcattttcttaatatgactt

SEQ ID NO: 517728 - DNA, 20 bp, Artificial
  CRISPR gRNA sequence
tttcttggtaaatgttgcct

SEQ ID NO: 517729 - DNA, 20 bp, Artificial
  CRISPR gRNA sequence
ttttttttttttttttgaga

SEQ ID NO: 517730 - DNA, 20 bp, Artificial
  CRISPR gRNA sequence
tttcgctctgtcgcccaggc

SEQ ID NO: 517731 - DNA, 20 bp, Artificial
  CRISPR gRNA sequence
gattctcctgactcagcctc

SEQ ID NO: 517732 - DNA, 20 bp, Artificial
  CRISPR gRNA sequence
ttttgtatttttagtagaga

SEQ ID NO: 517733 - DNA, 20 bp, Artificial
  CRISPR gRNA sequence
gcctcggcctcccacagtgc

SEQ ID NO: 517734 - DNA, 20 bp, Artificial
  CRISPR gRNA sequence
ccgcggcgcccagctgtccc

SEQ ID NO: 517735 - DNA, 20 bp, Artificial
  CRISPR gRNA sequence
accagaacgtttccctcatg

SEQ ID NO: 517736 - DNA, 20 bp, Artificial
  CRISPR gRNA sequence
tttccctcatgttgggtggt

SEQ ID NO: 517737 - DNA, 20 bp, Artificial
  CRISPR gRNA sequence
tcatgttgggtggtctgagt

SEQ ID NO: 517738 - DNA, 20 bp, Artificial
  CRISPR gRNA sequence
atcctggtgccggccagtgc

SEQ ID NO: 517739 - DNA, 20 bp, Artificial
  CRISPR gRNA sequence
ttgccggctgactttggctc

SEQ ID NO: 517740 - DNA, 20 bp, Artificial
  CRISPR gRNA sequence
ccctgcagaggccaggaggt

SEQ ID NO: 517741 - DNA, 20 bp, Artificial
  CRISPR gRNA sequence
gggctgccaccctggccacc

SEQ ID NO: 517742 - DNA, 20 bp, Artificial
  CRISPR gRNA sequence
ccaggtgaaggtcacggcca

SEQ ID NO: 517743 - DNA, 20 bp, Artificial
  CRISPR gRNA sequence
cgtgcaggttcttccccagt

SEQ ID NO: 517744 - DNA, 20 bp, Artificial
  CRISPR gRNA sequence
ctgccatggcaagggcttct

SEQ ID NO: 517745 - DNA, 20 bp, Artificial
  CRISPR gRNA sequence
ggcaggtgtcggcaggtgag

SEQ ID NO: 517746 - DNA, 20 bp, Artificial
  CRISPR gRNA sequence
ctgcaggaggtggggagatt

SEQ ID NO: 517747 - DNA, 20 bp, Artificial
  CRISPR gRNA sequence
gcaggaggaccccctcacca

SEQ ID NO: 517748 - DNA, 20 bp, Artificial
  CRISPR gRNA sequence
aggcccatctcaggggcaca

SEQ ID NO: 517749 - DNA, 20 bp, Artificial
  CRISPR gRNA sequence
cgctgggcgtgcccatggcc

SEQ ID NO: 517750 - DNA, 20 bp, Artificial
  CRISPR gRNA sequence
gggcgtgcccatggccttga

SEQ ID NO: 517751 - DNA, 20 bp, Artificial
  CRISPR gRNA sequence
caggctggcagccctggggc

SEQ ID NO: 517752 - DNA, 20 bp, Artificial
  CRISPR gRNA sequence
ccaggcggcctgcccggggg

SEQ ID NO: 517753 - DNA, 20 bp, Artificial
  CRISPR gRNA sequence
tggccaccccgcccactgtc

SEQ ID NO: 517754 - DNA, 20 bp, Artificial
  CRISPR gRNA sequence
cggcctcttcacgggactgt

SEQ ID NO: 517755 - DNA, 20 bp, Artificial
  CRISPR gRNA sequence
ggaacacttggcaggtgtcg

SEQ ID NO: 517756 - DNA, 20 bp, Artificial
  CRISPR gRNA sequence
cccgtggcagtgccgtctct

SEQ ID NO: 517757 - DNA, 20 bp, Artificial
  CRISPR gRNA sequence
tgccgtctctgaggatgcct

SEQ ID NO: 517758 - DNA, 20 bp, Artificial
  CRISPR gRNA sequence
ggctgtggcaggaggcagtg

SEQ ID NO: 517759 - DNA, 20 bp, Artificial
  CRISPR gRNA sequence
aggaaagcaaaatgtgccat

SEQ ID NO: 517760 - DNA, 20 bp, Artificial
  CRISPR gRNA sequence
tggctacattgggaaaaact

SEQ ID NO: 517761 - DNA, 20 bp, Artificial
  CRISPR gRNA sequence
gctgatatacgggcagtact

SEQ ID NO: 517762 - DNA, 20 bp, Artificial
  CRISPR gRNA sequence
acggccaggtctgcggcggc

SEQ ID NO: 517763 - DNA, 20 bp, Artificial
  CRISPR gRNA sequence
gcggcggcccgggtgagccc

SEQ ID NO: 517764 - DNA, 20 bp, Artificial
  CRISPR gRNA sequence
gcggcacagacttggtgttg

SEQ ID NO: 517765 - DNA, 20 bp, Artificial
  CRISPR gRNA sequence
ggtgcgttctggaccattca

SEQ ID NO: 517766 - DNA, 20 bp, Artificial
  CRISPR gRNA sequence
caacgagtggaacagaaagg

SEQ ID NO: 517767 - DNA, 20 bp, Artificial
  CRISPR gRNA sequence
caccgggcgtcagcaggaac

SEQ ID NO: 517768 - DNA, 20 bp, Artificial
  CRISPR gRNA sequence
gccggagggagcaaccgcag

SEQ ID NO: 517769 - DNA, 20 bp, Artificial
  CRISPR gRNA sequence
caaccgcagtggggtttcgg

SEQ ID NO: 517770 - DNA, 20 bp, Artificial
  CRISPR gRNA sequence
ctgcctgaacccgcggcgtg

SEQ ID NO: 517771 - DNA, 20 bp, Artificial
  CRISPR gRNA sequence
ccggtgccgctgcaacgtat

SEQ ID NO: 517772 - DNA, 20 bp, Artificial
  CRISPR gRNA sequence
ctaccagctgcctctgtgcc

SEQ ID NO: 517773 - DNA, 20 bp, Artificial
  CRISPR gRNA sequence
tcaccctgtggcaagtacat

SEQ ID NO: 517774 - DNA, 20 bp, Artificial
  CRISPR gRNA sequence
gcggagcaggcagggcgggc

SEQ ID NO: 517775 - DNA, 20 bp, Artificial
  CRISPR gRNA sequence
cagtgagcacctctgcaccg

SEQ ID NO: 517776 - DNA, 20 bp, Artificial
  CRISPR gRNA sequence
tctgcaccgcggggttctct

SEQ ID NO: 517777 - DNA, 20 bp, Artificial
  CRISPR gRNA sequence
tgcgcacctgccgcgggccc

SEQ ID NO: 517778 - DNA, 20 bp, Artificial
  CRISPR gRNA sequence
ggctccccgcagctcctgcg

SEQ ID NO: 517779 - DNA, 20 bp, Artificial
  CRISPR gRNA sequence
gagagggactcagagggctg

SEQ ID NO: 517780 - DNA, 20 bp, Artificial
  CRISPR gRNA sequence
tacacgctggagcagcagga

SEQ ID NO: 517781 - DNA, 20 bp, Artificial
  CRISPR gRNA sequence
tggaccgctacctcatctat

SEQ ID NO: 517782 - DNA, 20 bp, Artificial
  CRISPR gRNA sequence
gagagccgaggtgaggccgc

SEQ ID NO: 517783 - DNA, 20 bp, Artificial
  CRISPR gRNA sequence
cggctccagagctccggctg

SEQ ID NO: 517784 - DNA, 20 bp, Artificial
  CRISPR gRNA sequence
tgcggggtctccgcagaggc

SEQ ID NO: 517785 - DNA, 20 bp, Artificial
  CRISPR gRNA sequence
aggcgagggtggtgcggaag

SEQ ID NO: 517786 - DNA, 20 bp, Artificial
  CRISPR gRNA sequence
ctccagtgttgtgggcccag

SEQ ID NO: 517787 - DNA, 20 bp, Artificial
  CRISPR gRNA sequence
agtgttgtgggcccagcagg

SEQ ID NO: 517788 - DNA, 20 bp, Artificial
  CRISPR gRNA sequence
agcagggtggatgagccatg

SEQ ID NO: 517789 - DNA, 20 bp, Artificial
  CRISPR gRNA sequence
acggcccgggccatctcccg

SEQ ID NO: 517790 - DNA, 20 bp, Artificial
  CRISPR gRNA sequence
gcttgcagttgcaggtcccc

SEQ ID NO: 517791 - DNA, 20 bp, Artificial
  CRISPR gRNA sequence
gctgcgtgaggctcctttga

SEQ ID NO: 517792 - DNA, 20 bp, Artificial
  CRISPR gRNA sequence
agggacccgaggcaggcggc

SEQ ID NO: 517793 - DNA, 20 bp, Artificial
  CRISPR gRNA sequence
ggccactttgagggacagac

SEQ ID NO: 517794 - DNA, 20 bp, Artificial
  CRISPR gRNA sequence
ggcaggtcccccaggaaagg

SEQ ID NO: 517795 - DNA, 20 bp, Artificial
  CRISPR gRNA sequence
ggatggcaggagggggcacg

SEQ ID NO: 517796 - DNA, 20 bp, Artificial
  CRISPR gRNA sequence
caggagggggcacggggagt

SEQ ID NO: 517797 - DNA, 20 bp, Artificial
  CRISPR gRNA sequence
cggggagtgagagtgcaggt

SEQ ID NO: 517798 - DNA, 20 bp, Artificial
  CRISPR gRNA sequence
ggatggcaggagggggcaca

SEQ ID NO: 517799 - DNA, 20 bp, Artificial
  CRISPR gRNA sequence
caggagggggcacagggagt

SEQ ID NO: 517800 - DNA, 20 bp, Artificial
  CRISPR gRNA sequence
cagggagtgagggtgcagat

SEQ ID NO: 517801 - DNA, 20 bp, Artificial
  CRISPR gRNA sequence
ggatggcaggagcaaccaca

SEQ ID NO: 517802 - DNA, 20 bp, Artificial
  CRISPR gRNA sequence
caggagcaaccacagggagt

SEQ ID NO: 517803 - DNA, 20 bp, Artificial
  CRISPR gRNA sequence
cagggagtgagggtgcaggt

SEQ ID NO: 517804 - DNA, 20 bp, Artificial
  CRISPR gRNA sequence
gtgcaggtcaggatggcagg

SEQ ID NO: 517805 - DNA, 20 bp, Artificial
  CRISPR gRNA sequence
aggatggcaggaggggtaca

SEQ ID NO: 517806 - DNA, 20 bp, Artificial
  CRISPR gRNA sequence
gcaggaggggtacagggagt

SEQ ID NO: 517807 - DNA, 20 bp, Artificial
  CRISPR gRNA sequence
ctgaacgctagtgtctgtcc

SEQ ID NO: 517808 - DNA, 20 bp, Artificial
  CRISPR gRNA sequence
caaatcactttcacagtatg

SEQ ID NO: 517809 - DNA, 20 bp, Artificial
  CRISPR gRNA sequence
tgaactctgctgtaggagag

SEQ ID NO: 517810 - DNA, 20 bp, Artificial
  CRISPR gRNA sequence
ctgccttcttctctgtcagc

SEQ ID NO: 517811 - DNA, 20 bp, Artificial
  CRISPR gRNA sequence
tggaaccacagggcctggcc

SEQ ID NO: 517812 - DNA, 20 bp, Artificial
  CRISPR gRNA sequence
actgacccctggccatggtg

SEQ ID NO: 517813 - DNA, 20 bp, Artificial
  CRISPR gRNA sequence
tctctctaagtgctgtgttg

SEQ ID NO: 517814 - DNA, 20 bp, Artificial
  CRISPR gRNA sequence
caggtgtgctgcttcttccc

SEQ ID NO: 517815 - DNA, 20 bp, Artificial
  CRISPR gRNA sequence
gatccacctgagcgacctcc

SEQ ID NO: 517816 - DNA, 20 bp, Artificial
  CRISPR gRNA sequence
caatgtaagtggccgtcctt

SEQ ID NO: 517817 - DNA, 20 bp, Artificial
  CRISPR gRNA sequence
tcctctgggcgtccgccgct

SEQ ID NO: 517818 - DNA, 20 bp, Artificial
  CRISPR gRNA sequence
aaagtgacggcttccatgcg

SEQ ID NO: 517819 - DNA, 20 bp, Artificial
  CRISPR gRNA sequence
cccctgtttgcatttcccac

SEQ ID NO: 517820 - DNA, 20 bp, Artificial
  CRISPR gRNA sequence
tcatgaaccccaagtttgct

SEQ ID NO: 517821 - DNA, 20 bp, Artificial
  CRISPR gRNA sequence
catggcttgccacagctctt

SEQ ID NO: 517822 - DNA, 20 bp, Artificial
  CRISPR gRNA sequence
aaaatgacagccatggccgg

SEQ ID NO: 517823 - DNA, 20 bp, Artificial
  CRISPR gRNA sequence
ttatttacatttaaacttgt

SEQ ID NO: 517824 - DNA, 20 bp, Artificial
  CRISPR gRNA sequence
ggaatacagcggacacagtg

SEQ ID NO: 517825 - DNA, 20 bp, Artificial
  CRISPR gRNA sequence
tttccatggacagcctgtat

SEQ ID NO: 517826 - DNA, 20 bp, Artificial
  CRISPR gRNA sequence
gttttattttttttctatac

SEQ ID NO: 517827 - DNA, 20 bp, Artificial
  CRISPR gRNA sequence
tattttttttctatacacgt

SEQ ID NO: 517828 - DNA, 20 bp, Artificial
  CRISPR gRNA sequence
ggatgtcattttataccctg

SEQ ID NO: 517829 - DNA, 20 bp, Artificial
  CRISPR gRNA sequence
cattttgagggcggaaaata

SEQ ID NO: 517830 - DNA, 20 bp, Artificial
  CRISPR gRNA sequence
tcgtggtggcgctcttgaaa

SEQ ID NO: 517831 - DNA, 20 bp, Artificial
  CRISPR gRNA sequence
tcctggtgggaaatgcaaac

SEQ ID NO: 517832 - DNA, 20 bp, Artificial
  CRISPR gRNA sequence
aacaggggcttgtgagtgtg

SEQ ID NO: 517833 - DNA, 20 bp, Artificial
  CRISPR gRNA sequence
ttacattgttccactgggac

SEQ ID NO: 517834 - DNA, 20 bp, Artificial
  CRISPR gRNA sequence
gagaacctggcccagcccct

SEQ ID NO: 517835 - DNA, 20 bp, Artificial
  CRISPR gRNA sequence
gttcactccccatactgtga

SEQ ID NO: 517836 - DNA, 20 bp, Artificial
  CRISPR gRNA sequence
tcaaaggtgaagtgacttgg

SEQ ID NO: 517837 - DNA, 20 bp, Artificial
  CRISPR gRNA sequence
agggagcaggccgtctgctg

SEQ ID NO: 517838 - DNA, 20 bp, Artificial
  CRISPR gRNA sequence
ggggctccggcaacgggggc

SEQ ID NO: 517839 - DNA, 20 bp, Artificial
  CRISPR gRNA sequence
acggggcagcacggctaagc

SEQ ID NO: 517840 - DNA, 20 bp, Artificial
  CRISPR gRNA sequence
actcgcagtactgcccgtat

SEQ ID NO: 517841 - DNA, 20 bp, Artificial
  CRISPR gRNA sequence
gatggagttgttgtccttcc

SEQ ID NO: 517842 - DNA, 20 bp, Artificial
  CRISPR gRNA sequence
ccggccctgtgtctggcact

SEQ ID NO: 517843 - DNA, 20 bp, Artificial
  CRISPR gRNA sequence
gagaacacccctatggcaca

SEQ ID NO: 517844 - DNA, 20 bp, Artificial
  CRISPR gRNA sequence
tgtgggagaatgcagggaca

SEQ ID NO: 517845 - DNA, 20 bp, Artificial
  CRISPR gRNA sequence
gaagggcactgccaccagga

SEQ ID NO: 517846 - DNA, 20 bp, Artificial
  CRISPR gRNA sequence
cctggctcaggagcacgggt

SEQ ID NO: 517847 - DNA, 20 bp, Artificial
  CRISPR gRNA sequence
cgggtagatcatctgagggc

SEQ ID NO: 517848 - DNA, 20 bp, Artificial
  CRISPR gRNA sequence
aggctgagtcaggagaatca

SEQ ID NO: 517849 - DNA, 20 bp, Artificial
  CRISPR gRNA sequence
caggcaacatttaccaagaa

SEQ ID NO: 517850 - DNA, 20 bp, Artificial
  CRISPR gRNA sequence
aaaaaacaaaaagaaacaac

SEQ ID NO: 517851 - DNA, 20 bp, Artificial
  CRISPR gRNA sequence
tggataataaacttaaacct

SEQ ID NO: 517852 - DNA, 20 bp, Artificial
  CRISPR gRNA sequence
cacctgtgtggcccatgcct

SEQ ID NO: 517853 - DNA, 20 bp, Artificial
  CRISPR gRNA sequence
atcatgacaactaaccctac

SEQ ID NO: 517854 - DNA, 20 bp, Artificial
  CRISPR gRNA sequence
caactaaccctacccaggtt

SEQ ID NO: 517855 - DNA, 20 bp, Artificial
  CRISPR gRNA sequence
cagtctgcagtggcctgacc

SEQ ID NO: 517856 - DNA, 20 bp, Artificial
  CRISPR gRNA sequence
ctctcactgacgttcctgac

SEQ ID NO: 517857 - DNA, 20 bp, Artificial
  CRISPR gRNA sequence
gatccaggaagaccctggag

SEQ ID NO: 517858 - DNA, 20 bp, Artificial
  CRISPR gRNA sequence
gagcggttactcttgggggc

SEQ ID NO: 517859 - DNA, 20 bp, Artificial
  CRISPR gRNA sequence
gtcctggccctgcctggccc

SEQ ID NO: 517860 - DNA, 20 bp, Artificial
  CRISPR gRNA sequence
agggtgtgagcctcaggggt

SEQ ID NO: 517861 - DNA, 20 bp, Artificial
  CRISPR gRNA sequence
cacccaggagggtctgctct

SEQ ID NO: 517862 - DNA, 20 bp, Artificial
  CRISPR gRNA sequence
tggcacctcctccacgggcc

SEQ ID NO: 517863 - DNA, 20 bp, Artificial
  CRISPR gRNA sequence
ttcagtttaattcaatgacc

SEQ ID NO: 517864 - DNA, 20 bp, Artificial
  CRISPR gRNA sequence
gagaacatctctcacctggg

SEQ ID NO: 517865 - DNA, 20 bp, Artificial
  CRISPR gRNA sequence
cagggagaaattcaggggtt

SEQ ID NO: 517866 - DNA, 20 bp, Artificial
  CRISPR gRNA sequence
tcaggggttaagggcttctc

SEQ ID NO: 517867 - DNA, 20 bp, Artificial
  CRISPR gRNA sequence
ccagggcccaagtccactgt

SEQ ID NO: 517868 - DNA, 20 bp, Artificial
  CRISPR gRNA sequence
gcctcctcctgccccagctg

SEQ ID NO: 517869 - DNA, 20 bp, Artificial
  CRISPR gRNA sequence
tggaatgaagagtccggagc

SEQ ID NO: 517870 - DNA, 20 bp, Artificial
  CRISPR gRNA sequence
ctgcagctggcccacggggc

SEQ ID NO: 517871 - DNA, 20 bp, Artificial
  CRISPR gRNA sequence
gcaggagctgacctgcagtg

SEQ ID NO: 517872 - DNA, 20 bp, Artificial
  CRISPR gRNA sequence
ctgacttggggatgatctcg

SEQ ID NO: 517873 - DNA, 20 bp, Artificial
  CRISPR gRNA sequence
ccacgcactgggctcacccc

SEQ ID NO: 517874 - DNA, 20 bp, Artificial
  CRISPR gRNA sequence
atggctgggacggtcctcaa

SEQ ID NO: 517875 - DNA, 20 bp, Artificial
  CRISPR gRNA sequence
gtactcgggaggccgatgtg

SEQ ID NO: 517876 - DNA, 20 bp, Artificial
  CRISPR gRNA sequence
gtgggtggatcactgaggtc

SEQ ID NO: 517877 - DNA, 20 bp, Artificial
  CRISPR gRNA sequence
tggtgtgagtgatcctgcct

SEQ ID NO: 517878 - DNA, 20 bp, Artificial
  CRISPR gRNA sequence
catcggctcttggcactcta

SEQ ID NO: 517879 - DNA, 20 bp, Artificial
  CRISPR gRNA sequence
ctcccccatgctcacacatg

SEQ ID NO: 517880 - DNA, 20 bp, Artificial
  CRISPR gRNA sequence
acatgctcagcttctttcat

SEQ ID NO: 517881 - DNA, 20 bp, Artificial
  CRISPR gRNA sequence
cctgtcctgctgagcctgct

SEQ ID NO: 517882 - DNA, 20 bp, Artificial
  CRISPR gRNA sequence
ggtgaccaggaaaggctgag

SEQ ID NO: 517883 - DNA, 20 bp, Artificial
  CRISPR gRNA sequence
tggctgccatgacaaatggc

SEQ ID NO: 517884 - DNA, 20 bp, Artificial
  CRISPR gRNA sequence
ggccccaacacaccacgagg

SEQ ID NO: 517885 - DNA, 20 bp, Artificial
  CRISPR gRNA sequence
aggcagggggaagagggggc

SEQ ID NO: 517886 - DNA, 20 bp, Artificial
  CRISPR gRNA sequence
gctcctttcaggagggcgtg

SEQ ID NO: 517887 - DNA, 20 bp, Artificial
  CRISPR gRNA sequence
tcacaccggatagtcccaca

SEQ ID NO: 517888 - DNA, 20 bp, Artificial
  CRISPR gRNA sequence
tgatttggggtggggccctg

SEQ ID NO: 517889 - DNA, 20 bp, Artificial
  CRISPR gRNA sequence
gggtggggccctggacagtt

SEQ ID NO: 517890 - DNA, 20 bp, Artificial
  CRISPR gRNA sequence
ggggacactgggagctggtg

SEQ ID NO: 517891 - DNA, 20 bp, Artificial
  CRISPR gRNA sequence
ctctgcaataaactgtaact

SEQ ID NO: 517892 - DNA, 20 bp, Artificial
  CRISPR gRNA sequence
gcagcggaaatgcaggatga

SEQ ID NO: 517893 - DNA, 20 bp, Artificial
  CRISPR gRNA sequence
gagcagaggctggttatcag

SEQ ID NO: 517894 - DNA, 20 bp, Artificial
  CRISPR gRNA sequence
aattcatcccactccgcact

SEQ ID NO: 517895 - DNA, 20 bp, Artificial
  CRISPR gRNA sequence
actccgcactccaagcttgt

SEQ ID NO: 517896 - DNA, 20 bp, Artificial
  CRISPR gRNA sequence
tgtatgtgagcataaaataa

SEQ ID NO: 517897 - DNA, 20 bp, Artificial
  CRISPR gRNA sequence
aagacatgctgttaacacag

SEQ ID NO: 517898 - DNA, 20 bp, Artificial
  CRISPR gRNA sequence
caccgcgaagatgggctgga

SEQ ID NO: 517899 - DNA, 20 bp, Artificial
  CRISPR gRNA sequence
tgggctggatgttgttttca

SEQ ID NO: 517900 - DNA, 20 bp, Artificial
  CRISPR gRNA sequence
agttggccccgagtccagga

SEQ ID NO: 517901 - DNA, 20 bp, Artificial
  CRISPR gRNA sequence
ccgctcagcgtcagccctgc

SEQ ID NO: 517902 - DNA, 20 bp, Artificial
  CRISPR gRNA sequence
tgggcaatgtgtgcatagac

SEQ ID NO: 517903 - DNA, 20 bp, Artificial
  CRISPR gRNA sequence
cagccttccccacacggtgg

SEQ ID NO: 517904 - DNA, 20 bp, Artificial
  CRISPR gRNA sequence
tgctttcgcactgagggaca

SEQ ID NO: 517905 - DNA, 20 bp, Artificial
  CRISPR gRNA sequence
ggccgggagggggaggaggc

SEQ ID NO: 517906 - DNA, 20 bp, Artificial
  CRISPR gRNA sequence
ggagaccccacgctgccact

SEQ ID NO: 517907 - DNA, 20 bp, Artificial
  CRISPR gRNA sequence
cgctgccacttggggcttcc

SEQ ID NO: 517908 - DNA, 20 bp, Artificial
  CRISPR gRNA sequence
cgttgggggtcaggatggcg

SEQ ID NO: 517909 - DNA, 20 bp, Artificial
  CRISPR gRNA sequence
cagccgcgtgacgttgcgcc

SEQ ID NO: 517910 - DNA, 20 bp, Artificial
  CRISPR gRNA sequence
tggggggcagggttacctgc

SEQ ID NO: 517911 - DNA, 20 bp, Artificial
  CRISPR gRNA sequence
tccacccttggccgctcgca

SEQ ID NO: 517912 - DNA, 20 bp, Artificial
  CRISPR gRNA sequence
cttggccgctcgcaaaatgt

SEQ ID NO: 517913 - DNA, 20 bp, Artificial
  CRISPR gRNA sequence
cgcaaaatgtttaggcttca

SEQ ID NO: 517914 - DNA, 20 bp, Artificial
  CRISPR gRNA sequence
cagcaaacaatgaaatcagc

SEQ ID NO: 517915 - DNA, 20 bp, Artificial
  CRISPR gRNA sequence
cagcccaccctcgggtgcat

SEQ ID NO: 517916 - DNA, 20 bp, Artificial
  CRISPR gRNA sequence
catccaggtttccggaaatc

SEQ ID NO: 517917 - DNA, 20 bp, Artificial
  CRISPR gRNA sequence
gaaactggttggagttgttg

SEQ ID NO: 517918 - DNA, 20 bp, Artificial
  CRISPR gRNA sequence
ctctttctccttgttggggc

SEQ ID NO: 517919 - DNA, 20 bp, Artificial
  CRISPR gRNA sequence
ccttgttggggcatgggttt

SEQ ID NO: 517920 - DNA, 20 bp, Artificial
  CRISPR gRNA sequence
ggctgggcccaggtgggagg

SEQ ID NO: 517921 - DNA, 20 bp, Artificial
  CRISPR gRNA sequence
tcaaaggggcacgagggcaa

SEQ ID NO: 517922 - DNA, 20 bp, Artificial
  CRISPR gRNA sequence
ccaggtacatatgtgggcat

SEQ ID NO: 517923 - DNA, 20 bp, Artificial
  CRISPR gRNA sequence
atgtgggcatgtgtgtttat

SEQ ID NO: 517924 - DNA, 20 bp, Artificial
  CRISPR gRNA sequence
acatgtgagagcatgcattt

SEQ ID NO: 517925 - DNA, 20 bp, Artificial
  CRISPR gRNA sequence
gcattcacgtgtgtgtgcat

SEQ ID NO: 517926 - DNA, 20 bp, Artificial
  CRISPR gRNA sequence
gtgtgtgcatttgagtttgg

SEQ ID NO: 517927 - DNA, 20 bp, Artificial
  CRISPR gRNA sequence
tcgcatgtgtgagcgtgcat

SEQ ID NO: 517928 - DNA, 20 bp, Artificial
  CRISPR gRNA sequence
gtgcatttgtgtgagcatgc

SEQ ID NO: 517929 - DNA, 20 bp, Artificial
  CRISPR gRNA sequence
gagcggagcccttggcccag

SEQ ID NO: 517930 - DNA, 20 bp, Artificial
  CRISPR gRNA sequence
tggcccagcagagcttgctg

SEQ ID NO: 517931 - DNA, 20 bp, Artificial
  CRISPR gRNA sequence
tctatatgtgttgtggtctt

SEQ ID NO: 517932 - DNA, 20 bp, Artificial
  CRISPR gRNA sequence
ggccagggtctgggaaagga

SEQ ID NO: 517933 - DNA, 20 bp, Artificial
  CRISPR gRNA sequence
gggcccggagcaggtcgcca

SEQ ID NO: 517934 - DNA, 20 bp, Artificial
  CRISPR gRNA sequence
cacaggacatccaggcaggc

SEQ ID NO: 517935 - DNA, 20 bp, Artificial
  CRISPR gRNA sequence
gtgacactgaaacccgcctg

SEQ ID NO: 517936 - DNA, 20 bp, Artificial
  CRISPR gRNA sequence
acacgtgcggttgtgtagct

SEQ ID NO: 517937 - DNA, 20 bp, Artificial
  CRISPR gRNA sequence
tgctgtgccttgcagccctc

SEQ ID NO: 517938 - DNA, 20 bp, Artificial
  CRISPR gRNA sequence
tatgaagggccagacagtaa

SEQ ID NO: 517939 - DNA, 20 bp, Artificial
  CRISPR gRNA sequence
agggccagacagtaaatgtg

SEQ ID NO: 517940 - DNA, 20 bp, Artificial
  CRISPR gRNA sequence
gatctctccctggtgctcac

SEQ ID NO: 517941 - DNA, 20 bp, Artificial
  CRISPR gRNA sequence
caggcaacacctctgtcagc

SEQ ID NO: 517942 - DNA, 20 bp, Artificial
  CRISPR gRNA sequence
ggggccacagggccaggccc

SEQ ID NO: 517943 - DNA, 20 bp, Artificial
  CRISPR gRNA sequence
aggtggaggttccagcacga

SEQ ID NO: 517944 - DNA, 20 bp, Artificial
  CRISPR gRNA sequence
gcctgaccctaccaccaggg

SEQ ID NO: 517945 - DNA, 20 bp, Artificial
  CRISPR gRNA sequence
ctaactcagtggccgctgac

SEQ ID NO: 517946 - DNA, 20 bp, Artificial
  CRISPR gRNA sequence
tctgcaccctctccctggga

SEQ ID NO: 517947 - DNA, 20 bp, Artificial
  CRISPR gRNA sequence
ctgccttcctggagcaagga

SEQ ID NO: 517948 - DNA, 20 bp, Artificial
  CRISPR gRNA sequence
ttcctggagcaaggagggag

SEQ ID NO: 517949 - DNA, 20 bp, Artificial
  CRISPR gRNA sequence
aacctctgcctcccaggttc

SEQ ID NO: 517950 - DNA, 20 bp, Artificial
  CRISPR gRNA sequence
cgcctcggcctcccaaagtg

SEQ ID NO: 517951 - DNA, 20 bp, Artificial
  CRISPR gRNA sequence
gcgtgagccaccgataagga

SEQ ID NO: 517952 - DNA, 20 bp, Artificial
  CRISPR gRNA sequence
gaaacaggtgctctggtcaa

SEQ ID NO: 517953 - DNA, 20 bp, Artificial
  CRISPR gRNA sequence
gtcaagtcagtttgggcaac

SEQ ID NO: 517954 - DNA, 20 bp, Artificial
  CRISPR gRNA sequence
cttctgagtgtgtaatggaa

SEQ ID NO: 517955 - DNA, 20 bp, Artificial
  CRISPR gRNA sequence
taatggaatagtgttttgca

SEQ ID NO: 517956 - DNA, 20 bp, Artificial
  CRISPR gRNA sequence
agcggaagggcactgaggag

SEQ ID NO: 517957 - DNA, 20 bp, Artificial
  CRISPR gRNA sequence
gctcagctttccagcagcct

SEQ ID NO: 517958 - DNA, 20 bp, Artificial
  CRISPR gRNA sequence
gcgtcactttttgtggggac

SEQ ID NO: 517959 - DNA, 20 bp, Artificial
  CRISPR gRNA sequence
tggcccccattgtggtcttc

SEQ ID NO: 517960 - DNA, 20 bp, Artificial
  CRISPR gRNA sequence
gtggtcttcctgggtttcag

SEQ ID NO: 517961 - DNA, 20 bp, Artificial
  CRISPR gRNA sequence
cgtcctctagcagctggccc

SEQ ID NO: 517962 - DNA, 20 bp, Artificial
  CRISPR gRNA sequence
gggttctgggccaagcccct

SEQ ID NO: 517963 - DNA, 20 bp, Artificial
  CRISPR gRNA sequence
gcctgggaggcctgggccca

SEQ ID NO: 517964 - DNA, 20 bp, Artificial
  CRISPR gRNA sequence
cactttgtccctgcaaatcc

SEQ ID NO: 517965 - DNA, 20 bp, Artificial
  CRISPR gRNA sequence
cccctggattctgatgaggg

SEQ ID NO: 517966 - DNA, 20 bp, Artificial
  CRISPR gRNA sequence
ggtgatgcggggccagaagc

SEQ ID NO: 517967 - DNA, 20 bp, Artificial
  CRISPR gRNA sequence
ccagaagcgcgtgtttgtgc

SEQ ID NO: 517968 - DNA, 20 bp, Artificial
  CRISPR gRNA sequence
aacaaacaaatctcactgaa

SEQ ID NO: 517969 - DNA, 20 bp, Artificial
  CRISPR gRNA sequence
aaaaaacccagcctgaccaa

SEQ ID NO: 517970 - DNA, 20 bp, Artificial
  CRISPR gRNA sequence
ccgaggacagacgggagcca

SEQ ID NO: 517971 - DNA, 20 bp, Artificial
  CRISPR gRNA sequence
ttctccaccccctccccttc

SEQ ID NO: 517972 - DNA, 20 bp, Artificial
  CRISPR gRNA sequence
agtgtctgaggaattctgtc

SEQ ID NO: 517973 - DNA, 20 bp, Artificial
  CRISPR gRNA sequence
acccgagccgtcagaaaacc

SEQ ID NO: 517974 - DNA, 20 bp, Artificial
  CRISPR gRNA sequence
caggacacgcagccagaccc

SEQ ID NO: 517975 - DNA, 20 bp, Artificial
  CRISPR gRNA sequence
tctgcagccatcgcagtgat

SEQ ID NO: 517976 - DNA, 20 bp, Artificial
  CRISPR gRNA sequence
cgcggatgctgagcctgcgg

SEQ ID NO: 517977 - DNA, 20 bp, Artificial
  CRISPR gRNA sequence
caaagaaagctgaggacttg

SEQ ID NO: 517978 - DNA, 20 bp, Artificial
  CRISPR gRNA sequence
gcgtagggcgagcctgggtg

SEQ ID NO: 517979 - DNA, 20 bp, Artificial
  CRISPR gRNA sequence
gcagtgtgtgaacctgggtt

SEQ ID NO: 517980 - DNA, 20 bp, Artificial
  CRISPR gRNA sequence
gtgcagggtgagcctgagtg

SEQ ID NO: 517981 - DNA, 20 bp, Artificial
  CRISPR gRNA sequence
caataaaatatgcgtagtgt

SEQ ID NO: 517982 - DNA, 20 bp, Artificial
  CRISPR gRNA sequence
caccttgtccctgcaaagcc

SEQ ID NO: 517983 - DNA, 20 bp, Artificial
  CRISPR gRNA sequence
cccctggattctgataaggg

SEQ ID NO: 517984 - DNA, 20 bp, Artificial
  CRISPR gRNA sequence
cgatgcggggccagaagcgc

SEQ ID NO: 517985 - DNA, 20 bp, Artificial
  CRISPR gRNA sequence
agaagcgcgcgtgtttctgc

SEQ ID NO: 517986 - DNA, 20 bp, Artificial
  CRISPR gRNA sequence
cgtgtttctgcacttgctta

SEQ ID NO: 517987 - DNA, 20 bp, Artificial
  CRISPR gRNA sequence
aatacaagtgtgtgttctgt

SEQ ID NO: 517988 - DNA, 20 bp, Artificial
  CRISPR gRNA sequence
ttgttggtcctctgggtgcc

SEQ ID NO: 517989 - DNA, 20 bp, Artificial
  CRISPR gRNA sequence
gaggggtccaggaggcactt

SEQ ID NO: 517990 - DNA, 20 bp, Artificial
  CRISPR gRNA sequence
gtgagggcaggccctgttct

SEQ ID NO: 517991 - DNA, 20 bp, Artificial
  CRISPR gRNA sequence
aggtcctccgtgagcagagc

SEQ ID NO: 517992 - DNA, 20 bp, Artificial
  CRISPR gRNA sequence
agcctgtgcttggaggagag

SEQ ID NO: 517993 - DNA, 20 bp, Artificial
  CRISPR gRNA sequence
ctgtgtgccaggaagagaaa

SEQ ID NO: 517994 - DNA, 20 bp, Artificial
  CRISPR gRNA sequence
cagttgccggggtcctgccc

SEQ ID NO: 517995 - DNA, 20 bp, Artificial
  CRISPR gRNA sequence
gtcggctccttggggggtct

SEQ ID NO: 517996 - DNA, 20 bp, Artificial
  CRISPR gRNA sequence
agagccccaaactagggcct

SEQ ID NO: 517997 - DNA, 20 bp, Artificial
  CRISPR gRNA sequence
aggggcccatctgaggatcc

SEQ ID NO: 517998 - DNA, 20 bp, Artificial
  CRISPR gRNA sequence
cccaacaagccccaaggtcc

SEQ ID NO: 517999 - DNA, 20 bp, Artificial
  CRISPR gRNA sequence
tgctgtaacttcctggagga

SEQ ID NO: 518000 - DNA, 20 bp, Artificial
  CRISPR gRNA sequence
accccagggtgcagggtcca

SEQ ID NO: 518001 - DNA, 20 bp, Artificial
  CRISPR gRNA sequence
cccccagggtgcagggtcca

SEQ ID NO: 518002 - DNA, 20 bp, Artificial
  CRISPR gRNA sequence
cccccagggtgcagggtcca

SEQ ID NO: 518003 - DNA, 20 bp, Artificial
  CRISPR gRNA sequence
cccccagggtgcagggtcca

SEQ ID NO: 518004 - DNA, 20 bp, Artificial
  CRISPR gRNA sequence
cccccagggtgcagggtcca

SEQ ID NO: 518005 - DNA, 20 bp, Artificial
  CRISPR gRNA sequence
cccccagggtgcagggtcca

SEQ ID NO: 518006 - DNA, 20 bp, Artificial
  CRISPR gRNA sequence
cccccagggtgcagggtcca

SEQ ID NO: 518007 - DNA, 20 bp, Artificial
  CRISPR gRNA sequence
cccccagggtgcagggtcca

SEQ ID NO: 518008 - DNA, 20 bp, Artificial
  CRISPR gRNA sequence
cccccagggtgcagggtcca

SEQ ID NO: 518009 - DNA, 20 bp, Artificial
  CRISPR gRNA sequence
cccccagggtgcagggtcca

SEQ ID NO: 518010 - DNA, 20 bp, Artificial
  CRISPR gRNA sequence
cccccagggtgcagggtcca

SEQ ID NO: 518011 - DNA, 20 bp, Artificial
  CRISPR gRNA sequence
ccacagggagagggggtgca

SEQ ID NO: 518012 - DNA, 20 bp, Artificial
  CRISPR gRNA sequence
gggggtgcaccttgattcca

SEQ ID NO: 518013 - DNA, 20 bp, Artificial
  CRISPR gRNA sequence
ctcctccatgagcagccctg

SEQ ID NO: 518014 - DNA, 20 bp, Artificial
  CRISPR gRNA sequence
accccatcaggcctatctgc

SEQ ID NO: 518015 - DNA, 20 bp, Artificial
  CRISPR gRNA sequence
ggtgcaaaacccaaagctga

SEQ ID NO: 518016 - DNA, 20 bp, Artificial
  CRISPR gRNA sequence
gtggctgacgcctgcaatcc

SEQ ID NO: 518017 - DNA, 20 bp, Artificial
  CRISPR gRNA sequence
caggagaatcacttgaggcc

SEQ ID NO: 518018 - DNA, 20 bp, Artificial
  CRISPR gRNA sequence
gggagaggaatccagcgggg

SEQ ID NO: 518019 - DNA, 20 bp, Artificial
  CRISPR gRNA sequence
ggttcatgccattctcctgc

SEQ ID NO: 518020 - DNA, 20 bp, Artificial
  CRISPR gRNA sequence
accacgcccagctaattttt

SEQ ID NO: 518021 - DNA, 20 bp, Artificial
  CRISPR gRNA sequence
ttttgtgtttttagtagaga

SEQ ID NO: 518022 - DNA, 20 bp, Artificial
  CRISPR gRNA sequence
cacctcggcctcccaaagtg

SEQ ID NO: 518023 - DNA, 20 bp, Artificial
  CRISPR gRNA sequence
gtgagccaccgtgcccagtc

SEQ ID NO: 518024 - DNA, 20 bp, Artificial
  CRISPR gRNA sequence
cccgtaaaaccctaagacga

SEQ ID NO: 518025 - DNA, 20 bp, Artificial
  CRISPR gRNA sequence
gacccattggaactttgcat

SEQ ID NO: 518026 - DNA, 20 bp, Artificial
  CRISPR gRNA sequence
ctgggaactgaaggctcaag

SEQ ID NO: 518027 - DNA, 20 bp, Artificial
  CRISPR gRNA sequence
gagcatcaagatggactcat

SEQ ID NO: 518028 - DNA, 20 bp, Artificial
  CRISPR gRNA sequence
cagggagacgtgttcctact

SEQ ID NO: 518029 - DNA, 20 bp, Artificial
  CRISPR gRNA sequence
actgttggtttgactatctg

SEQ ID NO: 518030 - DNA, 20 bp, Artificial
  CRISPR gRNA sequence
ctatctgtgaagtttgatag

SEQ ID NO: 518031 - DNA, 20 bp, Artificial
  CRISPR gRNA sequence
tgtgaagtttgatagcacag

SEQ ID NO: 518032 - DNA, 20 bp, Artificial
  CRISPR gRNA sequence
aagtttgatagcacagtttt

SEQ ID NO: 518033 - DNA, 20 bp, Artificial
  CRISPR gRNA sequence
ttgatagcacagttttgttt

SEQ ID NO: 518034 - DNA, 20 bp, Artificial
  CRISPR gRNA sequence
tagcacagttttgtttgttt

SEQ ID NO: 518035 - DNA, 20 bp, Artificial
  CRISPR gRNA sequence
ttttgtatttttagtagaga

SEQ ID NO: 518036 - DNA, 20 bp, Artificial
  CRISPR gRNA sequence
tgcctcggcctcccaaagtg

SEQ ID NO: 518037 - DNA, 20 bp, Artificial
  CRISPR gRNA sequence
tggccacaaatgtgtaggac

SEQ ID NO: 518038 - DNA, 20 bp, Artificial
  CRISPR gRNA sequence
caggcggatcacctgaggtc

SEQ ID NO: 518039 - DNA, 20 bp, Artificial
  CRISPR gRNA sequence
actaaaaatacataaattag

SEQ ID NO: 518040 - DNA, 20 bp, Artificial
  CRISPR gRNA sequence
aaggtaaatactccattcaa

SEQ ID NO: 518041 - DNA, 20 bp, Artificial
  CRISPR gRNA sequence
gagtcaccccaggaaagaac

SEQ ID NO: 518042 - DNA, 20 bp, Artificial
  CRISPR gRNA sequence
cagggatttcagccaaaata

SEQ ID NO: 518043 - DNA, 20 bp, Artificial
  CRISPR gRNA sequence
tgtgtagccgtcaacgtgta

SEQ ID NO: 518044 - DNA, 20 bp, Artificial
  CRISPR gRNA sequence
gtcaacgtgtaagatgcttt

SEQ ID NO: 518045 - DNA, 20 bp, Artificial
  CRISPR gRNA sequence
acatgcaaacagctgctcag

SEQ ID NO: 518046 - DNA, 20 bp, Artificial
  CRISPR gRNA sequence
caaacagctgctcagggcag

SEQ ID NO: 518047 - DNA, 20 bp, Artificial
  CRISPR gRNA sequence
gtattttcaattttcattat

SEQ ID NO: 518048 - DNA, 20 bp, Artificial
  CRISPR gRNA sequence
aattatgctgaaattgctcc

SEQ ID NO: 518049 - DNA, 20 bp, Artificial
  CRISPR gRNA sequence
ctccttcggattccaaagct

SEQ ID NO: 518050 - DNA, 20 bp, Artificial
  CRISPR gRNA sequence
cactgtgacgttgatgagga

SEQ ID NO: 518051 - DNA, 20 bp, Artificial
  CRISPR gRNA sequence
agtgggacctccctgctggc

SEQ ID NO: 518052 - DNA, 20 bp, Artificial
  CRISPR gRNA sequence
cattcacccatccatgggac

SEQ ID NO: 518053 - DNA, 20 bp, Artificial
  CRISPR gRNA sequence
tcttttccccaacacctacc

SEQ ID NO: 518054 - DNA, 20 bp, Artificial
  CRISPR gRNA sequence
ccaacatgtgtccccagcga

SEQ ID NO: 518055 - DNA, 20 bp, Artificial
  CRISPR gRNA sequence
caggacagcaccagggccct

SEQ ID NO: 518056 - DNA, 20 bp, Artificial
  CRISPR gRNA sequence
aatcaatgccccgtgtcagt

SEQ ID NO: 518057 - DNA, 20 bp, Artificial
  CRISPR gRNA sequence
ggataattgctggcaccagg

SEQ ID NO: 518058 - DNA, 20 bp, Artificial
  CRISPR gRNA sequence
cactgcagagccccttgagt

SEQ ID NO: 518059 - DNA, 20 bp, Artificial
  CRISPR gRNA sequence
acaattggccagaccacccc

SEQ ID NO: 518060 - DNA, 20 bp, Artificial
  CRISPR gRNA sequence
ggagtgtccagctgcctggg

SEQ ID NO: 518061 - DNA, 20 bp, Artificial
  CRISPR gRNA sequence
tgccagcccctgccaggagg

SEQ ID NO: 518062 - DNA, 20 bp, Artificial
  CRISPR gRNA sequence
accccacagcccgcccggtc

SEQ ID NO: 518063 - DNA, 20 bp, Artificial
  CRISPR gRNA sequence
tgccaggctggcagggaccc

SEQ ID NO: 518064 - DNA, 20 bp, Artificial
  CRISPR gRNA sequence
cttggtaaagtgctggcccc

SEQ ID NO: 518065 - DNA, 20 bp, Artificial
  CRISPR gRNA sequence
ggattctgcagtgagctggg

SEQ ID NO: 518066 - DNA, 20 bp, Artificial
  CRISPR gRNA sequence
ggcatggattctgcagtgag

SEQ ID NO: 518067 - DNA, 20 bp, Artificial
  CRISPR gRNA sequence
tggggtgacggcagacagcc

SEQ ID NO: 518068 - DNA, 20 bp, Artificial
  CRISPR gRNA sequence
agctcccagatccaggggag

SEQ ID NO: 518069 - DNA, 20 bp, Artificial
  CRISPR gRNA sequence
gtgggcctgggacccagggg

SEQ ID NO: 518070 - DNA, 20 bp, Artificial
  CRISPR gRNA sequence
gaccccccagccgtccccct

SEQ ID NO: 518071 - DNA, 20 bp, Artificial
  CRISPR gRNA sequence
cactccaggctggggcagga

SEQ ID NO: 518072 - DNA, 20 bp, Artificial
  CRISPR gRNA sequence
cggtgctcctggctgggcgt

SEQ ID NO: 518073 - DNA, 20 bp, Artificial
  CRISPR gRNA sequence
ttacgacccgcgcctccagc

SEQ ID NO: 518074 - DNA, 20 bp, Artificial
  CRISPR gRNA sequence
cagaggccccgctatgtcca

SEQ ID NO: 518075 - DNA, 20 bp, Artificial
  CRISPR gRNA sequence
gcctggagtgaccctggtgg

SEQ ID NO: 518076 - DNA, 20 bp, Artificial
  CRISPR gRNA sequence
agagccacatggtgtgctgg

SEQ ID NO: 518077 - DNA, 20 bp, Artificial
  CRISPR gRNA sequence
catgctgccccgcctggcta

SEQ ID NO: 518078 - DNA, 20 bp, Artificial
  CRISPR gRNA sequence
tccatgctcctctgggaccc

SEQ ID NO: 518079 - DNA, 20 bp, Artificial
  CRISPR gRNA sequence
gtaggggagcgggcaccgct

SEQ ID NO: 518080 - DNA, 20 bp, Artificial
  CRISPR gRNA sequence
ttcccaaggtcctggtggga

SEQ ID NO: 518081 - DNA, 20 bp, Artificial
  CRISPR gRNA sequence
ccctcccctggatctgggag

SEQ ID NO: 518082 - DNA, 20 bp, Artificial
  CRISPR gRNA sequence
gtgacggtggcgcaacgcct

SEQ ID NO: 518083 - DNA, 20 bp, Artificial
  CRISPR gRNA sequence
ctgcgggtttgggggctgag

SEQ ID NO: 518084 - DNA, 20 bp, Artificial
  CRISPR gRNA sequence
gggggctgaggccggattct

SEQ ID NO: 518085 - DNA, 20 bp, Artificial
  CRISPR gRNA sequence
tgggctgtctgccgtcaccc

SEQ ID NO: 518086 - DNA, 20 bp, Artificial
  CRISPR gRNA sequence
gcaggtgaccgggcgggctg

SEQ ID NO: 518087 - DNA, 20 bp, Artificial
  CRISPR gRNA sequence
gcgtcactgccgctcagcgt

SEQ ID NO: 518088 - DNA, 20 bp, Artificial
  CRISPR gRNA sequence
gctccgagtgctgggagagg

SEQ ID NO: 518089 - DNA, 20 bp, Artificial
  CRISPR gRNA sequence
cagctggacactcctgagcc

SEQ ID NO: 518090 - DNA, 20 bp, Artificial
  CRISPR gRNA sequence
ggctatttggtcccccgtga

SEQ ID NO: 518091 - DNA, 20 bp, Artificial
  CRISPR gRNA sequence
atggggcagcgtgacgcctg

SEQ ID NO: 518092 - DNA, 20 bp, Artificial
  CRISPR gRNA sequence
gccagcaattatccctccca

SEQ ID NO: 518093 - DNA, 20 bp, Artificial
  CRISPR gRNA sequence
aaactggcactgacacgggg

SEQ ID NO: 518094 - DNA, 20 bp, Artificial
  CRISPR gRNA sequence
attgattaggtggttgcatt

SEQ ID NO: 518095 - DNA, 20 bp, Artificial
  CRISPR gRNA sequence
aggggaacaccttcctgccc

SEQ ID NO: 518096 - DNA, 20 bp, Artificial
  CRISPR gRNA sequence
atgttggtgttgggagtggt

SEQ ID NO: 518097 - DNA, 20 bp, Artificial
  CRISPR gRNA sequence
acagtgggaacaagaaagcc

SEQ ID NO: 518098 - DNA, 20 bp, Artificial
  CRISPR gRNA sequence
gaagccaagctgccctgagc

SEQ ID NO: 518099 - DNA, 20 bp, Artificial
  CRISPR gRNA sequence
gctgccctgagcagctgttt

SEQ ID NO: 518100 - DNA, 20 bp, Artificial
  CRISPR gRNA sequence
gttctttcctggggtgactc

SEQ ID NO: 518101 - DNA, 20 bp, Artificial
  CRISPR gRNA sequence
ggtgactcatatgtttctta

SEQ ID NO: 518102 - DNA, 20 bp, Artificial
  CRISPR gRNA sequence
ttctaagatctctttagaga

SEQ ID NO: 518103 - DNA, 20 bp, Artificial
  CRISPR gRNA sequence
gtcttcttgctattttcccc

SEQ ID NO: 518104 - DNA, 20 bp, Artificial
  CRISPR gRNA sequence
tttttttttttttcttttga

SEQ ID NO: 518105 - DNA, 20 bp, Artificial
  CRISPR gRNA sequence
accctctgcctcccgggctc

SEQ ID NO: 518106 - DNA, 20 bp, Artificial
  CRISPR gRNA sequence
tgcctcagcctcgcgagtag

SEQ ID NO: 518107 - DNA, 20 bp, Artificial
  CRISPR gRNA sequence
ttatgtatttttagtagaga

SEQ ID NO: 518108 - DNA, 20 bp, Artificial
  CRISPR gRNA sequence
tgcctcagcctcccaaagtg

SEQ ID NO: 518109 - DNA, 20 bp, Artificial
  CRISPR gRNA sequence
gccaccatgcccggcctccc

SEQ ID NO: 518110 - DNA, 20 bp, Artificial
  CRISPR gRNA sequence
cctccccttagcttttatgc

SEQ ID NO: 518111 - DNA, 20 bp, Artificial
  CRISPR gRNA sequence
acctattcttctatttcctt

SEQ ID NO: 518112 - DNA, 20 bp, Artificial
  CRISPR gRNA sequence
tctaaaatgctgtaaatatc

SEQ ID NO: 518113 - DNA, 20 bp, Artificial
  CRISPR gRNA sequence
tctccctgacccttgggaaa

SEQ ID NO: 518114 - DNA, 20 bp, Artificial
  CRISPR gRNA sequence
aggttcagaggcgacatggg

SEQ ID NO: 518115 - DNA, 20 bp, Artificial
  CRISPR gRNA sequence
acttgttcctatttgatctg

SEQ ID NO: 518116 - DNA, 20 bp, Artificial
  CRISPR gRNA sequence
tgatctgacctgtttttgtc

SEQ ID NO: 518117 - DNA, 20 bp, Artificial
  CRISPR gRNA sequence
aaatgagtccatcttgatgc

SEQ ID NO: 518118 - DNA, 20 bp, Artificial
  CRISPR gRNA sequence
tccatcttgatgctctggct

SEQ ID NO: 518119 - DNA, 20 bp, Artificial
  CRISPR gRNA sequence
tttggcttaaaaggtggatg

SEQ ID NO: 518120 - DNA, 20 bp, Artificial
  CRISPR gRNA sequence
ctcctctaggacagcgcaag

SEQ ID NO: 518121 - DNA, 20 bp, Artificial
  CRISPR gRNA sequence
ttcctcaagcagtctcgtct

SEQ ID NO: 518122 - DNA, 20 bp, Artificial
  CRISPR gRNA sequence
aatggcatgaacctgggagg

SEQ ID NO: 518123 - DNA, 20 bp, Artificial
  CRISPR gRNA sequence
taaaaaggaagcctgacccc

SEQ ID NO: 518124 - DNA, 20 bp, Artificial
  CRISPR gRNA sequence
gctctgccctctctctgctg

SEQ ID NO: 518125 - DNA, 20 bp, Artificial
  CRISPR gRNA sequence
cctctctctgctgtcttgct

SEQ ID NO: 518126 - DNA, 20 bp, Artificial
  CRISPR gRNA sequence
gctctcaaactcctggcctc

SEQ ID NO: 518127 - DNA, 20 bp, Artificial
  CRISPR gRNA sequence
tgccttggcctctcaaaaca

SEQ ID NO: 518128 - DNA, 20 bp, Artificial
  CRISPR gRNA sequence
caggctggcctcttcctttc

SEQ ID NO: 518129 - DNA, 20 bp, Artificial
  CRISPR gRNA sequence
cgacttctgtgaaagggtgt

SEQ ID NO: 518130 - DNA, 20 bp, Artificial
  CRISPR gRNA sequence
ctgctgcaggtctcttctga

SEQ ID NO: 518131 - DNA, 20 bp, Artificial
  CRISPR gRNA sequence
tgtctcagagcctgaatgtt

SEQ ID NO: 518132 - DNA, 20 bp, Artificial
  CRISPR gRNA sequence
ctggtcctgccccctcagcc

SEQ ID NO: 518133 - DNA, 20 bp, Artificial
  CRISPR gRNA sequence
ttctgagaggcctgtggggc

SEQ ID NO: 518134 - DNA, 20 bp, Artificial
  CRISPR gRNA sequence
gctgtggattcctaagcagc

SEQ ID NO: 518135 - DNA, 20 bp, Artificial
  CRISPR gRNA sequence
attcctaagcagcctcagct

SEQ ID NO: 518136 - DNA, 20 bp, Artificial
  CRISPR gRNA sequence
ccctcctgccctgcagctct

SEQ ID NO: 518137 - DNA, 20 bp, Artificial
  CRISPR gRNA sequence
agaggtgacagtggccaggc

SEQ ID NO: 518138 - DNA, 20 bp, Artificial
  CRISPR gRNA sequence
tggagcggaccttcatcccc

SEQ ID NO: 518139 - DNA, 20 bp, Artificial
  CRISPR gRNA sequence
cattggggggtggggcaggg

SEQ ID NO: 518140 - DNA, 20 bp, Artificial
  CRISPR gRNA sequence
atcttgctgctgctggggcc

SEQ ID NO: 518141 - DNA, 20 bp, Artificial
  CRISPR gRNA sequence
tttccccatttgagggtatg

SEQ ID NO: 518142 - DNA, 20 bp, Artificial
  CRISPR gRNA sequence
cccccaacgatcagagatat

SEQ ID NO: 518143 - DNA, 20 bp, Artificial
  CRISPR gRNA sequence
aagttacagcagggtgcagg

SEQ ID NO: 518144 - DNA, 20 bp, Artificial
  CRISPR gRNA sequence
tcccttttgacatttttgta

SEQ ID NO: 518145 - DNA, 20 bp, Artificial
  CRISPR gRNA sequence
ctgccaaaacaacaggacct

SEQ ID NO: 518146 - DNA, 20 bp, Artificial
  CRISPR gRNA sequence
cagagcccccagcacaggtg

SEQ ID NO: 518147 - DNA, 20 bp, Artificial
  CRISPR gRNA sequence
tgtcttcaaagccggcaggc

SEQ ID NO: 518148 - DNA, 20 bp, Artificial
  CRISPR gRNA sequence
aggccctagtttggggctct

SEQ ID NO: 518149 - DNA, 20 bp, Artificial
  CRISPR gRNA sequence
gctggaggaggtgtgttgat

SEQ ID NO: 518150 - DNA, 20 bp, Artificial
  CRISPR gRNA sequence
ccccaaggagccgacctagg

SEQ ID NO: 518151 - DNA, 20 bp, Artificial
  CRISPR gRNA sequence
gcctccagcaccaggctgag

SEQ ID NO: 518152 - DNA, 20 bp, Artificial
  CRISPR gRNA sequence
agggcaggaccccggcaact

SEQ ID NO: 518153 - DNA, 20 bp, Artificial
  CRISPR gRNA sequence
gctcctgggcaggcctagca

SEQ ID NO: 518154 - DNA, 20 bp, Artificial
  CRISPR gRNA sequence
ttggcacccgcgggcatcaa

SEQ ID NO: 518155 - DNA, 20 bp, Artificial
  CRISPR gRNA sequence
ctggcacccgcgggcatcca

SEQ ID NO: 518156 - DNA, 20 bp, Artificial
  CRISPR gRNA sequence
agccagctttctcttcctgg

SEQ ID NO: 518157 - DNA, 20 bp, Artificial
  CRISPR gRNA sequence
acaccgggtgtgtggggttc

SEQ ID NO: 518158 - DNA, 20 bp, Artificial
  CRISPR gRNA sequence
ttgtcccaggccagctggag

SEQ ID NO: 518159 - DNA, 20 bp, Artificial
  CRISPR gRNA sequence
gtgccaggaggctgtagctg

SEQ ID NO: 518160 - DNA, 20 bp, Artificial
  CRISPR gRNA sequence
ccctgaggttctgatgtgtg

SEQ ID NO: 518161 - DNA, 20 bp, Artificial
  CRISPR gRNA sequence
agggaggtctttcttaagaa

SEQ ID NO: 518162 - DNA, 20 bp, Artificial
  CRISPR gRNA sequence
gtaagcaagtgcagaaacac

SEQ ID NO: 518163 - DNA, 20 bp, Artificial
  CRISPR gRNA sequence
cttctggccccgcatcgcca

SEQ ID NO: 518164 - DNA, 20 bp, Artificial
  CRISPR gRNA sequence
cacgctttcctgcagagtca

SEQ ID NO: 518165 - DNA, 20 bp, Artificial
  CRISPR gRNA sequence
cacagcccttatcagaatcc

SEQ ID NO: 518166 - DNA, 20 bp, Artificial
  CRISPR gRNA sequence
cttcgtgagcatattttcct

SEQ ID NO: 518167 - DNA, 20 bp, Artificial
  CRISPR gRNA sequence
ccctacgctcagccgtctcc

SEQ ID NO: 518168 - DNA, 20 bp, Artificial
  CRISPR gRNA sequence
ttcttgaatctggacaagtc

SEQ ID NO: 518169 - DNA, 20 bp, Artificial
  CRISPR gRNA sequence
tctttgtctttcctgtcctt

SEQ ID NO: 518170 - DNA, 20 bp, Artificial
  CRISPR gRNA sequence
gtttctgaggaagtcaggag

SEQ ID NO: 518171 - DNA, 20 bp, Artificial
  CRISPR gRNA sequence
tgaccctcgggggtcttgtc

SEQ ID NO: 518172 - DNA, 20 bp, Artificial
  CRISPR gRNA sequence
tttcctctgcctggactcag

SEQ ID NO: 518173 - DNA, 20 bp, Artificial
  CRISPR gRNA sequence
gccgccatcactgcgatggc

SEQ ID NO: 518174 - DNA, 20 bp, Artificial
  CRISPR gRNA sequence
tctctctcatcagcgtgacc

SEQ ID NO: 518175 - DNA, 20 bp, Artificial
  CRISPR gRNA sequence
ttctaccgttctgagcactt

SEQ ID NO: 518176 - DNA, 20 bp, Artificial
  CRISPR gRNA sequence
cttgccccagcctggaatca

SEQ ID NO: 518177 - DNA, 20 bp, Artificial
  CRISPR gRNA sequence
agacactcggttaaagaagg

SEQ ID NO: 518178 - DNA, 20 bp, Artificial
  CRISPR gRNA sequence
aagaaattcctagccctttt

SEQ ID NO: 518179 - DNA, 20 bp, Artificial
  CRISPR gRNA sequence
atgcatcagctgacagaaca

SEQ ID NO: 518180 - DNA, 20 bp, Artificial
  CRISPR gRNA sequence
tgacagaacagaaagttttg

SEQ ID NO: 518181 - DNA, 20 bp, Artificial
  CRISPR gRNA sequence
tggaatttacagataacacc

SEQ ID NO: 518182 - DNA, 20 bp, Artificial
  CRISPR gRNA sequence
ataataataataataatatt

SEQ ID NO: 518183 - DNA, 20 bp, Artificial
  CRISPR gRNA sequence
catctggctatttatcttac

SEQ ID NO: 518184 - DNA, 20 bp, Artificial
  CRISPR gRNA sequence
acttctgtttctttccaact

SEQ ID NO: 518185 - DNA, 20 bp, Artificial
  CRISPR gRNA sequence
gtgtctcattccttaccgtc

SEQ ID NO: 518186 - DNA, 20 bp, Artificial
  CRISPR gRNA sequence
caattttgcgtcccacaggg

SEQ ID NO: 518187 - DNA, 20 bp, Artificial
  CRISPR gRNA sequence
tggaaactaccttggtcagg

SEQ ID NO: 518188 - DNA, 20 bp, Artificial
  CRISPR gRNA sequence
gttttttccctcccctttct

SEQ ID NO: 518189 - DNA, 20 bp, Artificial
  CRISPR gRNA sequence
tctgaaataaacacctttca

SEQ ID NO: 518190 - DNA, 20 bp, Artificial
  CRISPR gRNA sequence
aataaacacctttcagtgag

SEQ ID NO: 518191 - DNA, 20 bp, Artificial
  CRISPR gRNA sequence
aacacctttcagtgagattt

SEQ ID NO: 518192 - DNA, 20 bp, Artificial
  CRISPR gRNA sequence
gtgagatttgtttgtttctg

SEQ ID NO: 518193 - DNA, 20 bp, Artificial
  CRISPR gRNA sequence
tgtttctgtgtggattacat

SEQ ID NO: 518194 - DNA, 20 bp, Artificial
  CRISPR gRNA sequence
gactcaccagcctctggggg

SEQ ID NO: 518195 - DNA, 20 bp, Artificial
  CRISPR gRNA sequence
tgggggccgggcttatcctc

SEQ ID NO: 518196 - DNA, 20 bp, Artificial
  CRISPR gRNA sequence
acgaaagcaagtgcacaaac

SEQ ID NO: 518197 - DNA, 20 bp, Artificial
  CRISPR gRNA sequence
cacagccctcatcagaatcc

SEQ ID NO: 518198 - DNA, 20 bp, Artificial
  CRISPR gRNA sequence
ccaggcctcccaggctcccc

SEQ ID NO: 518199 - DNA, 20 bp, Artificial
  CRISPR gRNA sequence
ttttgttcttctaaactttg

SEQ ID NO: 518200 - DNA, 20 bp, Artificial
  CRISPR gRNA sequence
cccagaaccctgcccatgtt

SEQ ID NO: 518201 - DNA, 20 bp, Artificial
  CRISPR gRNA sequence
ggacaaaggttctgctgatg

SEQ ID NO: 518202 - DNA, 20 bp, Artificial
  CRISPR gRNA sequence
gcagctgtccccacaaaaag

SEQ ID NO: 518203 - DNA, 20 bp, Artificial
  CRISPR gRNA sequence
gacgctttacctgcgaccag

SEQ ID NO: 518204 - DNA, 20 bp, Artificial
  CRISPR gRNA sequence
tgcagccaagagacctaagt

SEQ ID NO: 518205 - DNA, 20 bp, Artificial
  CRISPR gRNA sequence
caaactgacttgaccagagc

SEQ ID NO: 518206 - DNA, 20 bp, Artificial
  CRISPR gRNA sequence
tgtttcgacttgaccagagc

SEQ ID NO: 518207 - DNA, 20 bp, Artificial
  CRISPR gRNA sequence
ttcagaacacagtcccctgt

SEQ ID NO: 518208 - DNA, 20 bp, Artificial
  CRISPR gRNA sequence
gaggcagaggttgcagtgag

SEQ ID NO: 518209 - DNA, 20 bp, Artificial
  CRISPR gRNA sequence
actttagcctgggcgacagg

SEQ ID NO: 518210 - DNA, 20 bp, Artificial
  CRISPR gRNA sequence
acagaggtgttgcctgtggc

SEQ ID NO: 518211 - DNA, 20 bp, Artificial
  CRISPR gRNA sequence
actgtctggcccttcataga

SEQ ID NO: 518212 - DNA, 20 bp, Artificial
  CRISPR gRNA sequence
gcatggtgtgtgtggtatgt

SEQ ID NO: 518213 - DNA, 20 bp, Artificial
  CRISPR gRNA sequence
atgtgcgtgagtgcatgtgt

SEQ ID NO: 518214 - DNA, 20 bp, Artificial
  CRISPR gRNA sequence
agtgtgtgtgcgtgcatgtg

SEQ ID NO: 518215 - DNA, 20 bp, Artificial
  CRISPR gRNA sequence
tgaacaagtacatatagtat

SEQ ID NO: 518216 - DNA, 20 bp, Artificial
  CRISPR gRNA sequence
atgcgtgcatgtgtggtggt

SEQ ID NO: 518217 - DNA, 20 bp, Artificial
  CRISPR gRNA sequence
ggtgtgtgtgcatatttgtg

SEQ ID NO: 518218 - DNA, 20 bp, Artificial
  CRISPR gRNA sequence
tggagggtggggcagagggg

SEQ ID NO: 518219 - DNA, 20 bp, Artificial
  CRISPR gRNA sequence
tgctcattcattaacatgat

SEQ ID NO: 518220 - DNA, 20 bp, Artificial
  CRISPR gRNA sequence
gtcaactctaagcaccccag

SEQ ID NO: 518221 - DNA, 20 bp, Artificial
  CRISPR gRNA sequence
ggcggggagaggggaggtca

SEQ ID NO: 518222 - DNA, 20 bp, Artificial
  CRISPR gRNA sequence
tctgatggacctctcctact

SEQ ID NO: 518223 - DNA, 20 bp, Artificial
  CRISPR gRNA sequence
cttcctttatttatttcttg

SEQ ID NO: 518224 - DNA, 20 bp, Artificial
  CRISPR gRNA sequence
cgcatgtcttccccgccggc

SEQ ID NO: 518225 - DNA, 20 bp, Artificial
  CRISPR gRNA sequence
tgtgctacgcatgtacacac

SEQ ID NO: 518226 - DNA, 20 bp, Artificial
  CRISPR gRNA sequence
acgcccacatacgttcacat

SEQ ID NO: 518227 - DNA, 20 bp, Artificial
  CRISPR gRNA sequence
cacacactccacatgtgcca

SEQ ID NO: 518228 - DNA, 20 bp, Artificial
  CRISPR gRNA sequence
tccctgctaggagagaggaa

SEQ ID NO: 518229 - DNA, 20 bp, Artificial
  CRISPR gRNA sequence
ccagcccctccatgtgccct

SEQ ID NO: 518230 - DNA, 20 bp, Artificial
  CRISPR gRNA sequence
caaggagaaagagtgccagc

SEQ ID NO: 518231 - DNA, 20 bp, Artificial
  CRISPR gRNA sequence
gaagctgaccaacaactcca

SEQ ID NO: 518232 - DNA, 20 bp, Artificial
  CRISPR gRNA sequence
tcagaccgaggtcgggaagc

SEQ ID NO: 518233 - DNA, 20 bp, Artificial
  CRISPR gRNA sequence
ctgcccggtgaggccgctgc

SEQ ID NO: 518234 - DNA, 20 bp, Artificial
  CRISPR gRNA sequence
acgagggctcgaaaatcatg

SEQ ID NO: 518235 - DNA, 20 bp, Artificial
  CRISPR gRNA sequence
cgaaaatcatgcgctgattt

SEQ ID NO: 518236 - DNA, 20 bp, Artificial
  CRISPR gRNA sequence
cgctctccacgtcccgccca

SEQ ID NO: 518237 - DNA, 20 bp, Artificial
  CRISPR gRNA sequence
ctcacaacccaccttagctc

SEQ ID NO: 518238 - DNA, 20 bp, Artificial
  CRISPR gRNA sequence
aggcctgctgggcccctcag

SEQ ID NO: 518239 - DNA, 20 bp, Artificial
  CRISPR gRNA sequence
cgtgtggcccacacgtctgc

SEQ ID NO: 518240 - DNA, 20 bp, Artificial
  CRISPR gRNA sequence
cgagggtttttccccttggg

SEQ ID NO: 518241 - DNA, 20 bp, Artificial
  CRISPR gRNA sequence
ccccttggggatggtttcct

SEQ ID NO: 518242 - DNA, 20 bp, Artificial
  CRISPR gRNA sequence
ctgcgcctcacatgtgcacg

SEQ ID NO: 518243 - DNA, 20 bp, Artificial
  CRISPR gRNA sequence
gcgcaacgtcacgcggctgc

SEQ ID NO: 518244 - DNA, 20 bp, Artificial
  CRISPR gRNA sequence
tgctggtgtttgccactgat

SEQ ID NO: 518245 - DNA, 20 bp, Artificial
  CRISPR gRNA sequence
agcctccttctgacccaagg

SEQ ID NO: 518246 - DNA, 20 bp, Artificial
  CRISPR gRNA sequence
agaggcaaccactggtcaca

SEQ ID NO: 518247 - DNA, 20 bp, Artificial
  CRISPR gRNA sequence
ggtccaccgtgtggggaagg

SEQ ID NO: 518248 - DNA, 20 bp, Artificial
  CRISPR gRNA sequence
cgagcatccattgggtgggg

SEQ ID NO: 518249 - DNA, 20 bp, Artificial
  CRISPR gRNA sequence
atccccctaggtgaggagcc

SEQ ID NO: 518250 - DNA, 20 bp, Artificial
  CRISPR gRNA sequence
tgtcttggcattggtgatat

SEQ ID NO: 518251 - DNA, 20 bp, Artificial
  CRISPR gRNA sequence
aaaattacacaaaaacgttc

SEQ ID NO: 518252 - DNA, 20 bp, Artificial
  CRISPR gRNA sequence
cccaagacctttctcaggat

SEQ ID NO: 518253 - DNA, 20 bp, Artificial
  CRISPR gRNA sequence
ggaaccagtaaactcacagt

SEQ ID NO: 518254 - DNA, 20 bp, Artificial
  CRISPR gRNA sequence
gtggagccctgactgtgtaa

SEQ ID NO: 518255 - DNA, 20 bp, Artificial
  CRISPR gRNA sequence
gcccttccttaccccgagcc

SEQ ID NO: 518256 - DNA, 20 bp, Artificial
  CRISPR gRNA sequence
cagagcagccgccctaaagg

SEQ ID NO: 518257 - DNA, 20 bp, Artificial
  CRISPR gRNA sequence
cagcctcacagcccctgccc

SEQ ID NO: 518258 - DNA, 20 bp, Artificial
  CRISPR gRNA sequence
ttaggctgaggagacatact

SEQ ID NO: 518259 - DNA, 20 bp, Artificial
  CRISPR gRNA sequence
aggaaagtgcccgggagggc

SEQ ID NO: 518260 - DNA, 20 bp, Artificial
  CRISPR gRNA sequence
acgtgccacgccccctccga

SEQ ID NO: 518261 - DNA, 20 bp, Artificial
  CRISPR gRNA sequence
cccatgcagggcagtcatgg

SEQ ID NO: 518262 - DNA, 20 bp, Artificial
  CRISPR gRNA sequence
ggccagaaccgatgtcaccg

SEQ ID NO: 518263 - DNA, 20 bp, Artificial
  CRISPR gRNA sequence
tcagtagagtgccaagagcc

SEQ ID NO: 518264 - DNA, 20 bp, Artificial
  CRISPR gRNA sequence
gccaagagccgatggcttcc

SEQ ID NO: 518265 - DNA, 20 bp, Artificial
  CRISPR gRNA sequence
cctcccaacccagtgatatt

SEQ ID NO: 518266 - DNA, 20 bp, Artificial
  CRISPR gRNA sequence
gcctggacaatgctgcagct

SEQ ID NO: 518267 - DNA, 20 bp, Artificial
  CRISPR gRNA sequence
gacaatgctgcagctcaggg

SEQ ID NO: 518268 - DNA, 20 bp, Artificial
  CRISPR gRNA sequence
ttcattttattttattgaga

SEQ ID NO: 518269 - DNA, 20 bp, Artificial
  CRISPR gRNA sequence
tgcctcagtctcctgagtag

SEQ ID NO: 518270 - DNA, 20 bp, Artificial
  CRISPR gRNA sequence
ttttgtatttttagtagaga

SEQ ID NO: 518271 - DNA, 20 bp, Artificial
  CRISPR gRNA sequence
cgtgagccatcatgcctggc

SEQ ID NO: 518272 - DNA, 20 bp, Artificial
  CRISPR gRNA sequence
tcatgcctggcctgggtttt

SEQ ID NO: 518273 - DNA, 20 bp, Artificial
  CRISPR gRNA sequence
cctggcctgggttttttttg

SEQ ID NO: 518274 - DNA, 20 bp, Artificial
  CRISPR gRNA sequence
cctgggttttttttgttttg

SEQ ID NO: 518275 - DNA, 20 bp, Artificial
  CRISPR gRNA sequence
ctcactgcaacctccacctc

SEQ ID NO: 518276 - DNA, 20 bp, Artificial
  CRISPR gRNA sequence
ggcgtggcccctgggcagct

SEQ ID NO: 518277 - DNA, 20 bp, Artificial
  CRISPR gRNA sequence
aatgtggtccatctcattaa

SEQ ID NO: 518278 - DNA, 20 bp, Artificial
  CRISPR gRNA sequence
ccttctaggccaaaggtcct

SEQ ID NO: 518279 - DNA, 20 bp, Artificial
  CRISPR gRNA sequence
aggcccgtggaggaggtgcc

SEQ ID NO: 518280 - DNA, 20 bp, Artificial
  CRISPR gRNA sequence
tgggtgccagccactgcccg

SEQ ID NO: 518281 - DNA, 20 bp, Artificial
  CRISPR gRNA sequence
ctgtctctgtctctgcctct

SEQ ID NO: 518282 - DNA, 20 bp, Artificial
  CRISPR gRNA sequence
ctctgtctgtctctgcctct

SEQ ID NO: 518283 - DNA, 20 bp, Artificial
  CRISPR gRNA sequence
ctgtttctccccatctctct

SEQ ID NO: 518284 - DNA, 20 bp, Artificial
  CRISPR gRNA sequence
ctggccacaagggtccccat

SEQ ID NO: 518285 - DNA, 20 bp, Artificial
  CRISPR gRNA sequence
ggcagcatccactggaagga

SEQ ID NO: 518286 - DNA, 20 bp, Artificial
  CRISPR gRNA sequence
acatcctctctgccgaggcc

SEQ ID NO: 518287 - DNA, 20 bp, Artificial
  CRISPR gRNA sequence
tcagtgagagggtgccgaga

SEQ ID NO: 518288 - DNA, 20 bp, Artificial
  CRISPR gRNA sequence
aacctgggtagggttagttg

SEQ ID NO: 518289 - DNA, 20 bp, Artificial
  CRISPR gRNA sequence
gttagttgtcatgattttct

SEQ ID NO: 518290 - DNA, 20 bp, Artificial
  CRISPR gRNA sequence
atgattttctgcgtgtttca

SEQ ID NO: 518291 - DNA, 20 bp, Artificial
  CRISPR gRNA sequence
tgagttccttctctaatctt

SEQ ID NO: 518292 - DNA, 20 bp, Artificial
  CRISPR gRNA sequence
ccttctctaatctttcaggt

SEQ ID NO: 518293 - DNA, 20 bp, Artificial
  CRISPR gRNA sequence
aagtttattatccaatcatt

SEQ ID NO: 518294 - DNA, 20 bp, Artificial
  CRISPR gRNA sequence
tccaatcatttgttgtttct

SEQ ID NO: 518295 - DNA, 20 bp, Artificial
  CRISPR gRNA sequence
atttgttgtttctttttgtt

SEQ ID NO: 518296 - DNA, 20 bp, Artificial
  CRISPR gRNA sequence
gtttctttttgttttttgtt

SEQ ID NO: 518297 - DNA, 20 bp, Artificial
  CRISPR gRNA sequence
gaaataatattcagcaagac

SEQ ID NO: 518298 - DNA, 20 bp, Artificial
  CRISPR gRNA sequence
tgactttggaattccttcaa

SEQ ID NO: 518299 - DNA, 20 bp, Artificial
  CRISPR gRNA sequence
gtttcttggtaaatgttgcc

SEQ ID NO: 518300 - DNA, 20 bp, Artificial
  CRISPR gRNA sequence
ttttttttttttttttgaga

SEQ ID NO: 518301 - DNA, 20 bp, Artificial
  CRISPR gRNA sequence
atcttggctcactacaatcc

SEQ ID NO: 518302 - DNA, 20 bp, Artificial
  CRISPR gRNA sequence
ttttgtatttttagtagaga

SEQ ID NO: 518303 - DNA, 20 bp, Artificial
  CRISPR gRNA sequence
cgcctcggcctcccacagtg

SEQ ID NO: 518304 - DNA, 20 bp, Artificial
  CRISPR gRNA sequence
gccgcggcgcccagctgtcc

SEQ ID NO: 518305 - DNA, 20 bp, Artificial
  CRISPR gRNA sequence
tgtcccatggattctcacca

SEQ ID NO: 518306 - DNA, 20 bp, Artificial
  CRISPR gRNA sequence
gtggtctgagtgggagtgtg

SEQ ID NO: 518307 - DNA, 20 bp, Artificial
  CRISPR gRNA sequence
gtgggagtgtgctcagcttc

SEQ ID NO: 518308 - DNA, 20 bp, Artificial
  CRISPR gRNA sequence
cacagagtgcatccaggagc

SEQ ID NO: 518309 - DNA, 20 bp, Artificial
  CRISPR gRNA sequence
agtcgtttgtcatccgggcg

SEQ ID NO: 518310 - DNA, 20 bp, Artificial
  CRISPR gRNA sequence
accgcagcctctgccatggc

SEQ ID NO: 518311 - DNA, 20 bp, Artificial
  CRISPR gRNA sequence
gcccccttctgcaggaggtg

SEQ ID NO: 518312 - DNA, 20 bp, Artificial
  CRISPR gRNA sequence
tctgcaggaggtggggagat

SEQ ID NO: 518313 - DNA, 20 bp, Artificial
  CRISPR gRNA sequence
gaccttccttgaccctagga

SEQ ID NO: 518314 - DNA, 20 bp, Artificial
  CRISPR gRNA sequence
gagagcctcctgggacaggt

SEQ ID NO: 518315 - DNA, 20 bp, Artificial
  CRISPR gRNA sequence
ctggatggctgtcccccttt

SEQ ID NO: 518316 - DNA, 20 bp, Artificial
  CRISPR gRNA sequence
ggtactcagacactcggtcc

SEQ ID NO: 518317 - DNA, 20 bp, Artificial
  CRISPR gRNA sequence
gtgtgtggctcctgcctgcc

SEQ ID NO: 518318 - DNA, 20 bp, Artificial
  CRISPR gRNA sequence
ctgcctgccagcggcttgat

SEQ ID NO: 518319 - DNA, 20 bp, Artificial
  CRISPR gRNA sequence
tgcgcaggccaaggccaggt

SEQ ID NO: 518320 - DNA, 20 bp, Artificial
  CRISPR gRNA sequence
ggagggaacgcggggcccct

SEQ ID NO: 518321 - DNA, 20 bp, Artificial
  CRISPR gRNA sequence
ggccctgcaccccgccctgc

SEQ ID NO: 518322 - DNA, 20 bp, Artificial
  CRISPR gRNA sequence
gccggagggagcaaccgcag

SEQ ID NO: 518323 - DNA, 20 bp, Artificial
  CRISPR gRNA sequence
tctcggttcccaggccaagc

SEQ ID NO: 518324 - DNA, 20 bp, Artificial
  CRISPR gRNA sequence
cccgtcttccagggaggggg

SEQ ID NO: 518325 - DNA, 20 bp, Artificial
  CRISPR gRNA sequence
gcgggaagtgccgctgccac

SEQ ID NO: 518326 - DNA, 20 bp, Artificial
  CRISPR gRNA sequence
acctgccgcgggccctggga

SEQ ID NO: 518327 - DNA, 20 bp, Artificial
  CRISPR gRNA sequence
ccgctggatgcctcatgggg

SEQ ID NO: 518328 - DNA, 20 bp, Artificial
  CRISPR gRNA sequence
tgctgcgtgaggctcctttg

SEQ ID NO: 518329 - DNA, 20 bp, Artificial
  CRISPR gRNA sequence
ggtgaccttggtgacactgg

SEQ ID NO: 518330 - DNA, 20 bp, Artificial
  CRISPR gRNA sequence
agggacagacttgggtcacg

SEQ ID NO: 518331 - DNA, 20 bp, Artificial
  CRISPR gRNA sequence
aggggtggtggcaatggccc

SEQ ID NO: 518332 - DNA, 20 bp, Artificial
  CRISPR gRNA sequence
gctggactgacgctcaggtg

SEQ ID NO: 518333 - DNA, 20 bp, Artificial
  CRISPR gRNA sequence
tgagcgacctccgggagtac

SEQ ID NO: 518334 - DNA, 20 bp, Artificial
  CRISPR gRNA sequence
gctgcaccccggcctcccca

SEQ ID NO: 518335 - DNA, 20 bp, Artificial
  CRISPR gRNA sequence
ctgggcgtccgccgctgtgg

SEQ ID NO: 518336 - DNA, 20 bp, Artificial
  CRISPR gRNA sequence
gtctagctcttcctcaaagt

SEQ ID NO: 518337 - DNA, 20 bp, Artificial
  CRISPR gRNA sequence
gcggggagtgtcctcaggga

SEQ ID NO: 518338 - DNA, 20 bp, Artificial
  CRISPR gRNA sequence
aacctcccacactcacaagc

SEQ ID NO: 518339 - DNA, 20 bp, Artificial
  CRISPR gRNA sequence
caccacgacggtcatgaacc

SEQ ID NO: 518340 - DNA, 20 bp, Artificial
  CRISPR gRNA sequence
gccccatcacgcggccgaga

SEQ ID NO: 518341 - DNA, 20 bp, Artificial
  CRISPR gRNA sequence
aatgacagccatggccggcc

SEQ ID NO: 518342 - DNA, 20 bp, Artificial
  CRISPR gRNA sequence
tgcatggagacttgaggagg

SEQ ID NO: 518343 - DNA, 20 bp, Artificial
  CRISPR gRNA sequence
tgaggttggtgaggttaggt

SEQ ID NO: 518344 - DNA, 20 bp, Artificial
  CRISPR gRNA sequence
ctgtgcaagtcaggacatca

SEQ ID NO: 518345 - DNA, 20 bp, Artificial
  CRISPR gRNA sequence
ctttgccacacaggcacaca

SEQ ID NO: 518346 - DNA, 20 bp, Artificial
  CRISPR gRNA sequence
gagtgtgggaggttttcaga

SEQ ID NO: 518347 - DNA, 20 bp, Artificial
  CRISPR gRNA sequence
agccttccagatgaccagca

SEQ ID NO: 518348 - DNA, 20 bp, Artificial
  CRISPR gRNA sequence
gacgccttgtcctcatggac

SEQ ID NO: 518349 - DNA, 20 bp, Artificial
  CRISPR gRNA sequence
cactgacaggccaggttgtg

SEQ ID NO: 518350 - DNA, 20 bp, Artificial
  CRISPR gRNA sequence
agggtcaaggaaggtcgggc

SEQ ID NO: 518351 - DNA, 20 bp, Artificial
  CRISPR gRNA sequence
acatgagggaaacgttctgg

SEQ ID NO: 518352 - DNA, 20 bp, Artificial
  CRISPR gRNA sequence
ctactcaggaggctgagtca

SEQ ID NO: 518353 - DNA, 20 bp, Artificial
  CRISPR gRNA sequence
aatccacaggcaacatttac

SEQ ID NO: 518354 - DNA, 20 bp, Artificial
  CRISPR gRNA sequence
aaggaattccaaagtcatat

SEQ ID NO: 518355 - DNA, 20 bp, Artificial
  CRISPR gRNA sequence
aaacaaaaaacaaaaaacaa

SEQ ID NO: 518356 - DNA, 20 bp, Artificial
  CRISPR gRNA sequence
ttaatgtttctgtcaaaaaa

SEQ ID NO: 518357 - DNA, 20 bp, Artificial
  CRISPR gRNA sequence
aaaaaaacagaatgaaacac

SEQ ID NO: 518358 - DNA, 20 bp, Artificial
  CRISPR gRNA sequence
cggcagagaggatgtgaagg

SEQ ID NO: 518359 - DNA, 20 bp, Artificial
  CRISPR gRNA sequence
tcaagcgataagagagatgg

SEQ ID NO: 518360 - DNA, 20 bp, Artificial
  CRISPR gRNA sequence
agccagagacagagagatgg

SEQ ID NO: 518361 - DNA, 20 bp, Artificial
  CRISPR gRNA sequence
agagacagacagagagagac

SEQ ID NO: 518362 - DNA, 20 bp, Artificial
  CRISPR gRNA sequence
cctgcatcctctgtgtaagg

SEQ ID NO: 518363 - DNA, 20 bp, Artificial
  CRISPR gRNA sequence
ttggcctagaaggatccagg

SEQ ID NO: 518364 - DNA, 20 bp, Artificial
  CRISPR gRNA sequence
ctcgatgggccgtgcaccag

SEQ ID NO: 518365 - DNA, 20 bp, Artificial
  CRISPR gRNA sequence
ttactgttgcatcatgagga

SEQ ID NO: 518366 - DNA, 20 bp, Artificial
  CRISPR gRNA sequence
gttgcatcatgaggataaga

SEQ ID NO: 518367 - DNA, 20 bp, Artificial
  CRISPR gRNA sequence
tgcatggtggccagtgttgg

SEQ ID NO: 518368 - DNA, 20 bp, Artificial
  CRISPR gRNA sequence
gagcctgctgtgcgcttggt

SEQ ID NO: 518369 - DNA, 20 bp, Artificial
  CRISPR gRNA sequence
ttccggcaaatcactgatcc

SEQ ID NO: 518370 - DNA, 20 bp, Artificial
  CRISPR gRNA sequence
taagtgtgtttccataaaat

SEQ ID NO: 518371 - DNA, 20 bp, Artificial
  CRISPR gRNA sequence
gtgttgtattccaggaaaaa

SEQ ID NO: 518372 - DNA, 20 bp, Artificial
  CRISPR gRNA sequence
gactggggatgtccacgggg

SEQ ID NO: 518373 - DNA, 20 bp, Artificial
  CRISPR gRNA sequence
ctctctcctagcagggaggt

SEQ ID NO: 518374 - DNA, 20 bp, Artificial
  CRISPR gRNA sequence
atgtttaataattggcactg

SEQ ID NO: 518375 - DNA, 20 bp, Artificial
  CRISPR gRNA sequence
attttgtcttttaaacatac

SEQ ID NO: 518376 - DNA, 20 bp, Artificial
  CRISPR gRNA sequence
ctgcctgctgccacaccctg

SEQ ID NO: 518377 - DNA, 20 bp, Artificial
  CRISPR gRNA sequence
tcctttcttttcattttgag

SEQ ID NO: 518378 - DNA, 20 bp, Artificial
  CRISPR gRNA sequence
gtgattctcctgccgcagca

SEQ ID NO: 518379 - DNA, 20 bp, Artificial
  CRISPR gRNA sequence
ctcctcctctgcctctagcg

SEQ ID NO: 518380 - DNA, 20 bp, Artificial
  CRISPR gRNA sequence
cgtggcagtccctaggcccc

SEQ ID NO: 518381 - DNA, 20 bp, Artificial
  CRISPR gRNA sequence
gggctctgacttttggaacc

SEQ ID NO: 518382 - DNA, 20 bp, Artificial
  CRISPR gRNA sequence
gaattttttaaagaagtcct

SEQ ID NO: 518383 - DNA, 20 bp, Artificial
  CRISPR gRNA sequence
tcagcaagtatcccagcaag

SEQ ID NO: 518384 - DNA, 20 bp, Artificial
  CRISPR gRNA sequence
aagtatcccagcaagagaga

SEQ ID NO: 518385 - DNA, 20 bp, Artificial
  CRISPR gRNA sequence
aaagcctaaatgtaatccac

SEQ ID NO: 518386 - DNA, 20 bp, Artificial
  CRISPR gRNA sequence
ttcagaggagctgaaaacct

SEQ ID NO: 518387 - DNA, 20 bp, Artificial
  CRISPR gRNA sequence
ctccctgtgggacgcaaaat

SEQ ID NO: 518388 - DNA, 20 bp, Artificial
  CRISPR gRNA sequence
cttctctagtttataagaca

SEQ ID NO: 518389 - DNA, 20 bp, Artificial
  CRISPR gRNA sequence
tttataagacaggagaaaag

SEQ ID NO: 518390 - DNA, 20 bp, Artificial
  CRISPR gRNA sequence
gagagaaagcaaaaagttgg

SEQ ID NO: 518391 - DNA, 20 bp, Artificial
  CRISPR gRNA sequence
agggaaaggaacccgagccg

SEQ ID NO: 518392 - DNA, 20 bp, Artificial
  CRISPR gRNA sequence
gcctgcagcatcatgttgct

SEQ ID NO: 518393 - DNA, 20 bp, Artificial
  CRISPR gRNA sequence
catcatgttgctccagaaag

SEQ ID NO: 518394 - DNA, 20 bp, Artificial
  CRISPR gRNA sequence
gcggatttgagcaactcggg

SEQ ID NO: 518395 - DNA, 20 bp, Artificial
  CRISPR gRNA sequence
aagctgctctcctgacttcc

SEQ ID NO: 518396 - DNA, 20 bp, Artificial
  CRISPR gRNA sequence
cgcccaaggacaggaaagac

SEQ ID NO: 518397 - DNA, 20 bp, Artificial
  CRISPR gRNA sequence
gtaagtgaaaaccttgttct

SEQ ID NO: 518398 - DNA, 20 bp, Artificial
  CRISPR gRNA sequence
acaacctactcggaaatggc

SEQ ID NO: 518399 - DNA, 20 bp, Artificial
  CRISPR gRNA sequence
gggtctggggaccccctcaa

SEQ ID NO: 518400 - DNA, 20 bp, Artificial
  CRISPR gRNA sequence
cttggccctgtctctctgtg

SEQ ID NO: 518401 - DNA, 20 bp, Artificial
  CRISPR gRNA sequence
tggcagaaacatagccagga

SEQ ID NO: 518402 - DNA, 20 bp, Artificial
  CRISPR gRNA sequence
tgccaggctgtgtgccagga

SEQ ID NO: 518403 - DNA, 20 bp, Artificial
  CRISPR gRNA sequence
ggttcccagcaaaattataa

SEQ ID NO: 518404 - DNA, 20 bp, Artificial
  CRISPR gRNA sequence
tgttttgagaggccaaggca

SEQ ID NO: 518405 - DNA, 20 bp, Artificial
  CRISPR gRNA sequence
tacctctacaaaaaataaaa

SEQ ID NO: 518406 - DNA, 20 bp, Artificial
  CRISPR gRNA sequence
gaggccctgtctcaaaaaaa

SEQ ID NO: 518407 - DNA, 20 bp, Artificial
  CRISPR gRNA sequence
cctgtctcaaaaaaaaaaga

SEQ ID NO: 518408 - DNA, 20 bp, Artificial
  CRISPR gRNA sequence
tcaaaaaaaaaagaaaagaa

SEQ ID NO: 518409 - DNA, 20 bp, Artificial
  CRISPR gRNA sequence
caacctccgcctcccatgtt

SEQ ID NO: 518410 - DNA, 20 bp, Artificial
  CRISPR gRNA sequence
acactcttgctgtggacata

SEQ ID NO: 518411 - DNA, 20 bp, Artificial
  CRISPR gRNA sequence
ataaaacaataaaggaaata

SEQ ID NO: 518412 - DNA, 20 bp, Artificial
  CRISPR gRNA sequence
ctactcgcgaggctgaggca

SEQ ID NO: 518413 - DNA, 20 bp, Artificial
  CRISPR gRNA sequence
acaagagtgaaactgtctca

SEQ ID NO: 518414 - DNA, 20 bp, Artificial
  CRISPR gRNA sequence
tcttcatctctaaagagatc

SEQ ID NO: 518415 - DNA, 20 bp, Artificial
  CRISPR gRNA sequence
caggtaattcacaaaagaag

SEQ ID NO: 518416 - DNA, 20 bp, Artificial
  CRISPR gRNA sequence
aaagaaggaagaaaactggc

SEQ ID NO: 518417 - DNA, 20 bp, Artificial
  CRISPR gRNA sequence
accccaagtttccatcacac

SEQ ID NO: 518418 - DNA, 20 bp, Artificial
  CRISPR gRNA sequence
tcagtgccagtttgtgccaa

SEQ ID NO: 518419 - DNA, 20 bp, Artificial
  CRISPR gRNA sequence
agggactcccccactcatcc

SEQ ID NO: 518420 - DNA, 20 bp, Artificial
  CRISPR gRNA sequence
agctcatttctgtgaagcct

SEQ ID NO: 518421 - DNA, 20 bp, Artificial
  CRISPR gRNA sequence
ggatggacagggacagcagg

SEQ ID NO: 518422 - DNA, 20 bp, Artificial
  CRISPR gRNA sequence
caccagctgaaccaactcga

SEQ ID NO: 518423 - DNA, 20 bp, Artificial
  CRISPR gRNA sequence
cagtctgccctgggtcacgt

SEQ ID NO: 518424 - DNA, 20 bp, Artificial
  CRISPR gRNA sequence
ggccggattctggaggcttc

SEQ ID NO: 518425 - DNA, 20 bp, Artificial
  CRISPR gRNA sequence
tgagtgaagcccagctcact

SEQ ID NO: 518426 - DNA, 20 bp, Artificial
  CRISPR gRNA sequence
gaatccatgcccagctcact

SEQ ID NO: 518427 - DNA, 20 bp, Artificial
  CRISPR gRNA sequence
ccttccccatccagctcaca

SEQ ID NO: 518428 - DNA, 20 bp, Artificial
  CRISPR gRNA sequence
ggctggctcccgttcccgga

SEQ ID NO: 518429 - DNA, 20 bp, Artificial
  CRISPR gRNA sequence
catcaacgtcacagtgggaa

SEQ ID NO: 518430 - DNA, 20 bp, Artificial
  CRISPR gRNA sequence
tactcatagtgccaccaccc

SEQ ID NO: 518431 - DNA, 20 bp, Artificial
  CRISPR gRNA sequence
gtgccaccacccagagaaat

SEQ ID NO: 518432 - DNA, 20 bp, Artificial
  CRISPR gRNA sequence
tctcattttatttcatttgg

SEQ ID NO: 518433 - DNA, 20 bp, Artificial
  CRISPR gRNA sequence
ctactcaggaggctgaggca

SEQ ID NO: 518434 - DNA, 20 bp, Artificial
  CRISPR gRNA sequence
ctttatcacattcctacaaa

SEQ ID NO: 518435 - DNA, 20 bp, Artificial
  CRISPR gRNA sequence
ctactcaggaagctgaggca

SEQ ID NO: 518436 - DNA, 20 bp, Artificial
  CRISPR gRNA sequence
ggggcagcagggagggcctt

SEQ ID NO: 518437 - DNA, 20 bp, Artificial
  CRISPR gRNA sequence
acaaaactacgtaagcaagt

SEQ ID NO: 518438 - DNA, 20 bp, Artificial
  CRISPR gRNA sequence
cccaccaaacacagccctta

SEQ ID NO: 518439 - DNA, 20 bp, Artificial
  CRISPR gRNA sequence
tgtgctcagctgtctcaggc

SEQ ID NO: 518440 - DNA, 20 bp, Artificial
  CRISPR gRNA sequence
tgtagccggacaagccgcag

SEQ ID NO: 518441 - DNA, 20 bp, Artificial
  CRISPR gRNA sequence
taagagccgagctccccgaa

SEQ ID NO: 518442 - DNA, 20 bp, Artificial
  CRISPR gRNA sequence
tacatgcatcagctgacaga

SEQ ID NO: 518443 - DNA, 20 bp, Artificial
  CRISPR gRNA sequence
cccaccaaacacagccctca

SEQ ID NO: 518444 - DNA, 20 bp, Artificial
  CRISPR gRNA sequence
acagtcccctgtcagtgctt

SEQ ID NO: 518445 - DNA, 20 bp, Artificial
  CRISPR gRNA sequence
aacattctcctgctgcggca

SEQ ID NO: 518446 - DNA, 20 bp, Artificial
  CRISPR gRNA sequence
gagattctgtctcaaaatga

SEQ ID NO: 518447 - DNA, 20 bp, Artificial
  CRISPR gRNA sequence
ggagggaaggggaagggagg

SEQ ID NO: 518448 - DNA, 20 bp, Artificial
  CRISPR gRNA sequence
catttactgtctggcccttc

SEQ ID NO: 518449 - DNA, 20 bp, Artificial
  CRISPR gRNA sequence
cggaagtccagggctgggat

SEQ ID NO: 518450 - DNA, 20 bp, Artificial
  CRISPR gRNA sequence
ggcacagcgacggcagcact

SEQ ID NO: 518451 - DNA, 20 bp, Artificial
  CRISPR gRNA sequence
cgaaacccatgccccaacaa

SEQ ID NO: 518452 - DNA, 20 bp, Artificial
  CRISPR gRNA sequence
ctgataaccagcctctgctc

SEQ ID NO: 518453 - DNA, 20 bp, Artificial
  CRISPR gRNA sequence
aaaggtcaaaggtgcacagg

SEQ ID NO: 518454 - DNA, 20 bp, Artificial
  CRISPR gRNA sequence
atgtctggtcttcttgccca

SEQ ID NO: 518455 - DNA, 20 bp, Artificial
  CRISPR gRNA sequence
agcaatgtggtccatctcat

SEQ ID NO: 518456 - DNA, 20 bp, Artificial
  CRISPR gRNA sequence
cccccaggtgagagatgttc

SEQ ID NO: 518457 - DNA, 20 bp, Artificial
  CRISPR gRNA sequence
ggccaggcagggccaggaca

SEQ ID NO: 518458 - DNA, 20 bp, Artificial
  CRISPR gRNA sequence
agagtaaccgctctctgccc

SEQ ID NO: 518459 - DNA, 20 bp, Artificial
  CRISPR gRNA sequence
tgtttcattctgtttttttg

SEQ ID NO: 518460 - DNA, 20 bp, Artificial
  CRISPR gRNA sequence
tggaccattcaacgagtgga

SEQ ID NO: 518461 - DNA, 20 bp, Artificial
  CRISPR gRNA sequence
catgcggggagtgtcctcag

SEQ ID NO: 518462 - DNA, 20 bp, Artificial
  CRISPR gRNA sequence
ttgaggatgtcaccaattaa

SEQ ID NO: 518463 - DNA, 20 bp, Artificial
  CRISPR gRNA sequence
attgttaatcaatcacgtgt

SEQ ID NO: 518464 - DNA, 20 bp, Artificial
  CRISPR gRNA sequence
tgccacggactaaatgtgct

SEQ ID NO: 518465 - DNA, 20 bp, Artificial
  CRISPR gRNA sequence
atttcacagctagcaaaaaa

SEQ ID NO: 518466 - DNA, 20 bp, Artificial
  CRISPR gRNA sequence
agctagcaaaaaaaaaaaca

SEQ ID NO: 518467 - DNA, 20 bp, Artificial
  CRISPR gRNA sequence
aaaaaaaaaaacaaaaaaca

SEQ ID NO: 518468 - DNA, 20 bp, Artificial
  CRISPR gRNA sequence
tgccttaatgtttctgtcaa

SEQ ID NO: 518469 - DNA, 20 bp, Artificial
  CRISPR gRNA sequence
agagcaagaccttgtctcaa

SEQ ID NO: 518470 - DNA, 20 bp, Artificial
  CRISPR gRNA sequence
aagaccttgtctcaaaaaaa

SEQ ID NO: 518471 - DNA, 20 bp, Artificial
  CRISPR gRNA sequence
cttgtctcaaaaaaacaaaa

SEQ ID NO: 518472 - DNA, 20 bp, Artificial
  CRISPR gRNA sequence
aaaaaacaaaacaaaacaaa

SEQ ID NO: 518473 - DNA, 20 bp, Artificial
  CRISPR gRNA sequence
tccagcctgggcaacaagag

SEQ ID NO: 518474 - DNA, 20 bp, Artificial
  CRISPR gRNA sequence
aattgtgttgtattccagga

SEQ ID NO: 518475 - DNA, 20 bp, Artificial
  CRISPR gRNA sequence
aggaaaccatccccaagggg

SEQ ID NO: 518476 - DNA, 20 bp, Artificial
  CRISPR gRNA sequence
agaacgagtgcaacatggag

SEQ ID NO: 518477 - DNA, 20 bp, Artificial
  CRISPR gRNA sequence
gtgtttatttcagaggagct

SEQ ID NO: 518478 - DNA, 20 bp, Artificial
  CRISPR gRNA sequence
acctccagaaaggggaggga

SEQ ID NO: 518479 - DNA, 20 bp, Artificial
  CRISPR gRNA sequence
tattattattaacccctgac

SEQ ID NO: 518480 - DNA, 20 bp, Artificial
  CRISPR gRNA sequence
cattgtatgaaaaagcattg

SEQ ID NO: 518481 - DNA, 20 bp, Artificial
  CRISPR gRNA sequence
gaaaggaacccgagccgtca

SEQ ID NO: 518482 - DNA, 20 bp, Artificial
  CRISPR gRNA sequence
tcatgcactactgaacaaaa

SEQ ID NO: 518483 - DNA, 20 bp, Artificial
  CRISPR gRNA sequence
gcttacgtagttttgtaagt

SEQ ID NO: 518484 - DNA, 20 bp, Artificial
  CRISPR gRNA sequence
atccttcccgtcctggggtc

SEQ ID NO: 518485 - DNA, 20 bp, Artificial
  CRISPR gRNA sequence
ccttaccaagacctaaggtg

SEQ ID NO: 518486 - DNA, 20 bp, Artificial
  CRISPR gRNA sequence
gcttcctttttgcaaccccg

SEQ ID NO: 518487 - DNA, 20 bp, Artificial
  CRISPR gRNA sequence
gctccaggaaatccagggac

SEQ ID NO: 518488 - DNA, 20 bp, Artificial
  CRISPR gRNA sequence
tcggagcagagaggatgcag

SEQ ID NO: 518489 - DNA, 20 bp, Artificial
  CRISPR gRNA sequence
aggacttcagttttagggaa

SEQ ID NO: 518490 - DNA, 20 bp, Artificial
  CRISPR gRNA sequence
gtaattcacaaaagaaggaa

SEQ ID NO: 518491 - DNA, 20 bp, Artificial
  CRISPR gRNA sequence
atggagtcccacacagcaac

SEQ ID NO: 518492 - DNA, 20 bp, Artificial
  CRISPR gRNA sequence
tcctttattgttttattccc

SEQ ID NO: 518493 - DNA, 20 bp, Artificial
  CRISPR gRNA sequence
agagtgagactccatctcaa

SEQ ID NO: 518494 - DNA, 20 bp, Artificial
  CRISPR gRNA sequence
caaaaaaacaaacaaacaaa

SEQ ID NO: 518495 - DNA, 20 bp, Artificial
  CRISPR gRNA sequence
gatgaaacctcgtctctact

SEQ ID NO: 518496 - DNA, 20 bp, Artificial
  CRISPR gRNA sequence
attctcctgccttggcctct

SEQ ID NO: 518497 - DNA, 20 bp, Artificial
  CRISPR gRNA sequence
agggtgggcccaatgtgaac

SEQ ID NO: 518498 - DNA, 20 bp, Artificial
  CRISPR gRNA sequence
ccagggaatgaggtcactgc

SEQ ID NO: 518499 - DNA, 20 bp, Artificial
  CRISPR gRNA sequence
aagaacaaggttttcactta

SEQ ID NO: 518500 - DNA, 20 bp, Artificial
  CRISPR gRNA sequence
aagggagaccaaaccatttg

SEQ ID NO: 518501 - DNA, 20 bp, Artificial
  CRISPR gRNA sequence
tccctgggggcagcagggga

SEQ ID NO: 518502 - DNA, 20 bp, Artificial
  CRISPR gRNA sequence
gaggcccaggcactgcagga

SEQ ID NO: 518503 - DNA, 20 bp, Artificial
  CRISPR gRNA sequence
agctggcgcacaagctggct

SEQ ID NO: 518504 - DNA, 20 bp, Artificial
  CRISPR gRNA sequence
ccgtgaagataaaattacac

SEQ ID NO: 518505 - DNA, 20 bp, Artificial
  CRISPR gRNA sequence
agccctccagaggtcaagct

SEQ ID NO: 518506 - DNA, 20 bp, Artificial
  CRISPR gRNA sequence
cacactctggggaccaagtg

SEQ ID NO: 518507 - DNA, 20 bp, Artificial
  CRISPR gRNA sequence
atgccagcttccacatctgt

SEQ ID NO: 518508 - DNA, 20 bp, Artificial
  CRISPR gRNA sequence
gtgacactggctacattggg

SEQ ID NO: 518509 - DNA, 20 bp, Artificial
  CRISPR gRNA sequence
agggagaaagattctgctct

SEQ ID NO: 518510 - DNA, 20 bp, Artificial
  CRISPR gRNA sequence
tcacgtgtatagaaaaaaaa

SEQ ID NO: 518511 - DNA, 20 bp, Artificial
  CRISPR gRNA sequence
tgtgcctgtgtggcaaaggt

SEQ ID NO: 518512 - DNA, 20 bp, Artificial
  CRISPR gRNA sequence
tgtggcaaaggtcagcgggc

SEQ ID NO: 518513 - DNA, 20 bp, Artificial
  CRISPR gRNA sequence
gccaccttgccagtcggggg

SEQ ID NO: 518514 - DNA, 20 bp, Artificial
  CRISPR gRNA sequence
gccagtcgggggaatacagc

SEQ ID NO: 518515 - DNA, 20 bp, Artificial
  CRISPR gRNA sequence
ccagtcgggggaatacagcg

SEQ ID NO: 518516 - DNA, 20 bp, Artificial
  CRISPR gRNA sequence
ccatggacagcctgtattga

SEQ ID NO: 518517 - DNA, 20 bp, Artificial
  CRISPR gRNA sequence
catggacagcctgtattgaa

SEQ ID NO: 518518 - DNA, 20 bp, Artificial
  CRISPR gRNA sequence
tattgaagttttattttttt

SEQ ID NO: 518519 - DNA, 20 bp, Artificial
  CRISPR gRNA sequence
aagttttattttttttctat

SEQ ID NO: 518520 - DNA, 20 bp, Artificial
  CRISPR gRNA sequence
tattttttttctatacacgt

SEQ ID NO: 518521 - DNA, 20 bp, Artificial
  CRISPR gRNA sequence
attttttttctatacacgtg

SEQ ID NO: 518522 - DNA, 20 bp, Artificial
  CRISPR gRNA sequence
ttttttttctatacacgtga

SEQ ID NO: 518523 - DNA, 20 bp, Artificial
  CRISPR gRNA sequence
tttttctatacacgtgattg

SEQ ID NO: 518524 - DNA, 20 bp, Artificial
  CRISPR gRNA sequence
ttttctatacacgtgattga

SEQ ID NO: 518525 - DNA, 20 bp, Artificial
  CRISPR gRNA sequence
tttctatacacgtgattgat

SEQ ID NO: 518526 - DNA, 20 bp, Artificial
  CRISPR gRNA sequence
ttctatacacgtgattgatt

SEQ ID NO: 518527 - DNA, 20 bp, Artificial
  CRISPR gRNA sequence
tctatacacgtgattgatta

SEQ ID NO: 518528 - DNA, 20 bp, Artificial
  CRISPR gRNA sequence
ctatacacgtgattgattaa

SEQ ID NO: 518529 - DNA, 20 bp, Artificial
  CRISPR gRNA sequence
tatacacgtgattgattaac

SEQ ID NO: 518530 - DNA, 20 bp, Artificial
  CRISPR gRNA sequence
tacacgtgattgattaacaa

SEQ ID NO: 518531 - DNA, 20 bp, Artificial
  CRISPR gRNA sequence
attaacaatataattaatgg

SEQ ID NO: 518532 - DNA, 20 bp, Artificial
  CRISPR gRNA sequence
acaatataattaatgggatg

SEQ ID NO: 518533 - DNA, 20 bp, Artificial
  CRISPR gRNA sequence
atgggatgtcattttatacc

SEQ ID NO: 518534 - DNA, 20 bp, Artificial
  CRISPR gRNA sequence
tataccctgacaagtttaaa

SEQ ID NO: 518535 - DNA, 20 bp, Artificial
  CRISPR gRNA sequence
ataccctgacaagtttaaat

SEQ ID NO: 518536 - DNA, 20 bp, Artificial
  CRISPR gRNA sequence
taccctgacaagtttaaatg

SEQ ID NO: 518537 - DNA, 20 bp, Artificial
  CRISPR gRNA sequence
acaagtttaaatgtaaataa

SEQ ID NO: 518538 - DNA, 20 bp, Artificial
  CRISPR gRNA sequence
aaatgtaaataaattggcac

SEQ ID NO: 518539 - DNA, 20 bp, Artificial
  CRISPR gRNA sequence
aatgtaaataaattggcacc

SEQ ID NO: 518540 - DNA, 20 bp, Artificial
  CRISPR gRNA sequence
gcaccacctttaatcagact

SEQ ID NO: 518541 - DNA, 20 bp, Artificial
  CRISPR gRNA sequence
taatcagactgatgtcctga

SEQ ID NO: 518542 - DNA, 20 bp, Artificial
  CRISPR gRNA sequence
aatcagactgatgtcctgac

SEQ ID NO: 518543 - DNA, 20 bp, Artificial
  CRISPR gRNA sequence
atcagactgatgtcctgact

SEQ ID NO: 518544 - DNA, 20 bp, Artificial
  CRISPR gRNA sequence
atgtcctgacttgcacagga

SEQ ID NO: 518545 - DNA, 20 bp, Artificial
  CRISPR gRNA sequence
acttgcacaggaaacacgca

SEQ ID NO: 518546 - DNA, 20 bp, Artificial
  CRISPR gRNA sequence
gcacaggaaacacgcaccta

SEQ ID NO: 518547 - DNA, 20 bp, Artificial
  CRISPR gRNA sequence
cacaggaaacacgcacctaa

SEQ ID NO: 518548 - DNA, 20 bp, Artificial
  CRISPR gRNA sequence
acctcaccaacctcaagccc

SEQ ID NO: 518549 - DNA, 20 bp, Artificial
  CRISPR gRNA sequence
accaacctcaagccctccct

SEQ ID NO: 518550 - DNA, 20 bp, Artificial
  CRISPR gRNA sequence
aagccctccctcctcaagtc

SEQ ID NO: 518551 - DNA, 20 bp, Artificial
  CRISPR gRNA sequence
cctcctcaagtctccatgca

SEQ ID NO: 518552 - DNA, 20 bp, Artificial
  CRISPR gRNA sequence
ctcaagtctccatgcaaaga

SEQ ID NO: 518553 - DNA, 20 bp, Artificial
  CRISPR gRNA sequence
aagtctccatgcaaagactg

SEQ ID NO: 518554 - DNA, 20 bp, Artificial
  CRISPR gRNA sequence
catgcaaagactgtgccagt

SEQ ID NO: 518555 - DNA, 20 bp, Artificial
  CRISPR gRNA sequence
tgccagtcagagtggagctg

SEQ ID NO: 518556 - DNA, 20 bp, Artificial
  CRISPR gRNA sequence
tccccccgacgagcccccag

SEQ ID NO: 518557 - DNA, 20 bp, Artificial
  CRISPR gRNA sequence
tcattttgagggcggaaaat

SEQ ID NO: 518558 - DNA, 20 bp, Artificial
  CRISPR gRNA sequence
tgagggcggaaaataactgg

SEQ ID NO: 518559 - DNA, 20 bp, Artificial
  CRISPR gRNA sequence
gagggcggaaaataactgga

SEQ ID NO: 518560 - DNA, 20 bp, Artificial
  CRISPR gRNA sequence
agggcggaaaataactggat

SEQ ID NO: 518561 - DNA, 20 bp, Artificial
  CRISPR gRNA sequence
gatttctggttaattggtga

SEQ ID NO: 518562 - DNA, 20 bp, Artificial
  CRISPR gRNA sequence
ctggttaattggtgacatcc

SEQ ID NO: 518563 - DNA, 20 bp, Artificial
  CRISPR gRNA sequence
tggttaattggtgacatcct

SEQ ID NO: 518564 - DNA, 20 bp, Artificial
  CRISPR gRNA sequence
gttaattggtgacatcctca

SEQ ID NO: 518565 - DNA, 20 bp, Artificial
  CRISPR gRNA sequence
attggtgacatcctcaagag

SEQ ID NO: 518566 - DNA, 20 bp, Artificial
  CRISPR gRNA sequence
gtgacatcctcaagagctgt

SEQ ID NO: 518567 - DNA, 20 bp, Artificial
  CRISPR gRNA sequence
aagagctgtggcaagccatg

SEQ ID NO: 518568 - DNA, 20 bp, Artificial
  CRISPR gRNA sequence
tggcaagccatgtctcggcc

SEQ ID NO: 518569 - DNA, 20 bp, Artificial
  CRISPR gRNA sequence
ggccgcgtgatggggcagac

SEQ ID NO: 518570 - DNA, 20 bp, Artificial
  CRISPR gRNA sequence
acggccttgtcttcaccaag

SEQ ID NO: 518571 - DNA, 20 bp, Artificial
  CRISPR gRNA sequence
gtcttcaccaagtgctccta

SEQ ID NO: 518572 - DNA, 20 bp, Artificial
  CRISPR gRNA sequence
tcttcaccaagtgctcctaa

SEQ ID NO: 518573 - DNA, 20 bp, Artificial
  CRISPR gRNA sequence
caccaagtgctcctaactct

SEQ ID NO: 518574 - DNA, 20 bp, Artificial
  CRISPR gRNA sequence
accaagtgctcctaactctc

SEQ ID NO: 518575 - DNA, 20 bp, Artificial
  CRISPR gRNA sequence
ctaactctcagcaaacttgg

SEQ ID NO: 518576 - DNA, 20 bp, Artificial
  CRISPR gRNA sequence
actctcagcaaacttggggt

SEQ ID NO: 518577 - DNA, 20 bp, Artificial
  CRISPR gRNA sequence
tcagcaaacttggggttcat

SEQ ID NO: 518578 - DNA, 20 bp, Artificial
  CRISPR gRNA sequence
agcaaacttggggttcatga

SEQ ID NO: 518579 - DNA, 20 bp, Artificial
  CRISPR gRNA sequence
ggggttcatgaccgtcgtgg

SEQ ID NO: 518580 - DNA, 20 bp, Artificial
  CRISPR gRNA sequence
gggttcatgaccgtcgtggt

SEQ ID NO: 518581 - DNA, 20 bp, Artificial
  CRISPR gRNA sequence
atgaccgtcgtggtggcgct

SEQ ID NO: 518582 - DNA, 20 bp, Artificial
  CRISPR gRNA sequence
ttgaaaaggggattatcctg

SEQ ID NO: 518583 - DNA, 20 bp, Artificial
  CRISPR gRNA sequence
gaaaaggggattatcctggt

SEQ ID NO: 518584 - DNA, 20 bp, Artificial
  CRISPR gRNA sequence
aaaaggggattatcctggtg

SEQ ID NO: 518585 - DNA, 20 bp, Artificial
  CRISPR gRNA sequence
tcctggtgggaaatgcaaac

SEQ ID NO: 518586 - DNA, 20 bp, Artificial
  CRISPR gRNA sequence
gtgggaaatgcaaacagggg

SEQ ID NO: 518587 - DNA, 20 bp, Artificial
  CRISPR gRNA sequence
gtgagtgtgggaggttttca

SEQ ID NO: 518588 - DNA, 20 bp, Artificial
  CRISPR gRNA sequence
tgagtgtgggaggttttcag

SEQ ID NO: 518589 - DNA, 20 bp, Artificial
  CRISPR gRNA sequence
tcagagcagaatctttctcc

SEQ ID NO: 518590 - DNA, 20 bp, Artificial
  CRISPR gRNA sequence
cagagcagaatctttctccc

SEQ ID NO: 518591 - DNA, 20 bp, Artificial
  CRISPR gRNA sequence
agagcagaatctttctccct

SEQ ID NO: 518592 - DNA, 20 bp, Artificial
  CRISPR gRNA sequence
tctccctgaggacactcccc

SEQ ID NO: 518593 - DNA, 20 bp, Artificial
  CRISPR gRNA sequence
ctccctgaggacactccccg

SEQ ID NO: 518594 - DNA, 20 bp, Artificial
  CRISPR gRNA sequence
tccctgaggacactccccgc

SEQ ID NO: 518595 - DNA, 20 bp, Artificial
  CRISPR gRNA sequence
cctgaggacactccccgcat

SEQ ID NO: 518596 - DNA, 20 bp, Artificial
  CRISPR gRNA sequence
aggacactccccgcatggaa

SEQ ID NO: 518597 - DNA, 20 bp, Artificial
  CRISPR gRNA sequence
cccgcatggaagccgtcact

SEQ ID NO: 518598 - DNA, 20 bp, Artificial
  CRISPR gRNA sequence
tgaggaagagctagacgtgg

SEQ ID NO: 518599 - DNA, 20 bp, Artificial
  CRISPR gRNA sequence
gaggaagagctagacgtggg

SEQ ID NO: 518600 - DNA, 20 bp, Artificial
  CRISPR gRNA sequence
aggaagagctagacgtgggg

SEQ ID NO: 518601 - DNA, 20 bp, Artificial
  CRISPR gRNA sequence
gacgtggggcagccccccca

SEQ ID NO: 518602 - DNA, 20 bp, Artificial
  CRISPR gRNA sequence
acccacagcggcggacgccc

SEQ ID NO: 518603 - DNA, 20 bp, Artificial
  CRISPR gRNA sequence
cctggggaggccggggtgca

SEQ ID NO: 518604 - DNA, 20 bp, Artificial
  CRISPR gRNA sequence
gggaggccggggtgcagcca

SEQ ID NO: 518605 - DNA, 20 bp, Artificial
  CRISPR gRNA sequence
ccgcagcaggaggtcgcata

SEQ ID NO: 518606 - DNA, 20 bp, Artificial
  CRISPR gRNA sequence
tgcgtgggacccccaaggac

SEQ ID NO: 518607 - DNA, 20 bp, Artificial
  CRISPR gRNA sequence
cgtgggacccccaaggacgg

SEQ ID NO: 518608 - DNA, 20 bp, Artificial
  CRISPR gRNA sequence
acattgttccactgggactt

SEQ ID NO: 518609 - DNA, 20 bp, Artificial
  CRISPR gRNA sequence
cattgttccactgggacttg

SEQ ID NO: 518610 - DNA, 20 bp, Artificial
  CRISPR gRNA sequence
ttccactgggacttgagctt

SEQ ID NO: 518611 - DNA, 20 bp, Artificial
  CRISPR gRNA sequence
cactgggacttgagcttctc

SEQ ID NO: 518612 - DNA, 20 bp, Artificial
  CRISPR gRNA sequence
ggacttgagcttctccttct

SEQ ID NO: 518613 - DNA, 20 bp, Artificial
  CRISPR gRNA sequence
gagcttctccttctcaaagc

SEQ ID NO: 518614 - DNA, 20 bp, Artificial
  CRISPR gRNA sequence
agcttctccttctcaaagcg

SEQ ID NO: 518615 - DNA, 20 bp, Artificial
  CRISPR gRNA sequence
ctccttctcaaagcgcctgt

SEQ ID NO: 518616 - DNA, 20 bp, Artificial
  CRISPR gRNA sequence
tccttctcaaagcgcctgta

SEQ ID NO: 518617 - DNA, 20 bp, Artificial
  CRISPR gRNA sequence
cttctcaaagcgcctgtact

SEQ ID NO: 518618 - DNA, 20 bp, Artificial
  CRISPR gRNA sequence
ctcaaagcgcctgtactccc

SEQ ID NO: 518619 - DNA, 20 bp, Artificial
  CRISPR gRNA sequence
tcaaagcgcctgtactcccg

SEQ ID NO: 518620 - DNA, 20 bp, Artificial
  CRISPR gRNA sequence
aaagcgcctgtactcccgga

SEQ ID NO: 518621 - DNA, 20 bp, Artificial
  CRISPR gRNA sequence
tactcccggaggtcgctcag

SEQ ID NO: 518622 - DNA, 20 bp, Artificial
  CRISPR gRNA sequence
ccggaggtcgctcaggtgga

SEQ ID NO: 518623 - DNA, 20 bp, Artificial
  CRISPR gRNA sequence
aggtggatcagagccttcca

SEQ ID NO: 518624 - DNA, 20 bp, Artificial
  CRISPR gRNA sequence
ccagatgaccagcaggagaa

SEQ ID NO: 518625 - DNA, 20 bp, Artificial
  CRISPR gRNA sequence
cagatgaccagcaggagaat

SEQ ID NO: 518626 - DNA, 20 bp, Artificial
  CRISPR gRNA sequence
ccacggtgcccccgacgatg

SEQ ID NO: 518627 - DNA, 20 bp, Artificial
  CRISPR gRNA sequence
gggcctgccacacactctag

SEQ ID NO: 518628 - DNA, 20 bp, Artificial
  CRISPR gRNA sequence
ccacacactctagggaagaa

SEQ ID NO: 518629 - DNA, 20 bp, Artificial
  CRISPR gRNA sequence
tagggaagaagcagcacacc

SEQ ID NO: 518630 - DNA, 20 bp, Artificial
  CRISPR gRNA sequence
gggaagaagcagcacacctg

SEQ ID NO: 518631 - DNA, 20 bp, Artificial
  CRISPR gRNA sequence
agcgtcagtccagccccatc

SEQ ID NO: 518632 - DNA, 20 bp, Artificial
  CRISPR gRNA sequence
actgagccgtgtgcccacag

SEQ ID NO: 518633 - DNA, 20 bp, Artificial
  CRISPR gRNA sequence
agccgtgtgcccacaggtcc

SEQ ID NO: 518634 - DNA, 20 bp, Artificial
  CRISPR gRNA sequence
agagagacggaggttcccag

SEQ ID NO: 518635 - DNA, 20 bp, Artificial
  CRISPR gRNA sequence
gagagacggaggttcccagg

SEQ ID NO: 518636 - DNA, 20 bp, Artificial
  CRISPR gRNA sequence
ccagggccccggctcaccat

SEQ ID NO: 518637 - DNA, 20 bp, Artificial
  CRISPR gRNA sequence
accatccatcaccatggcca

SEQ ID NO: 518638 - DNA, 20 bp, Artificial
  CRISPR gRNA sequence
gcccagcccctgctggattc

SEQ ID NO: 518639 - DNA, 20 bp, Artificial
  CRISPR gRNA sequence
ctggattccaggccaggccc

SEQ ID NO: 518640 - DNA, 20 bp, Artificial
  CRISPR gRNA sequence
gattccaggccaggccctgt

SEQ ID NO: 518641 - DNA, 20 bp, Artificial
  CRISPR gRNA sequence
caggccaggccctgtggttc

SEQ ID NO: 518642 - DNA, 20 bp, Artificial
  CRISPR gRNA sequence
tggttccaaatgaaacctaa

SEQ ID NO: 518643 - DNA, 20 bp, Artificial
  CRISPR gRNA sequence
caaatgaaacctaagggcca

SEQ ID NO: 518644 - DNA, 20 bp, Artificial
  CRISPR gRNA sequence
agggccattgccaccacccc

SEQ ID NO: 518645 - DNA, 20 bp, Artificial
  CRISPR gRNA sequence
ccaccacccctgctgacaga

SEQ ID NO: 518646 - DNA, 20 bp, Artificial
  CRISPR gRNA sequence
ctgacagagaagaaggcagg

SEQ ID NO: 518647 - DNA, 20 bp, Artificial
  CRISPR gRNA sequence
acagagaagaaggcagggcc

SEQ ID NO: 518648 - DNA, 20 bp, Artificial
  CRISPR gRNA sequence
atactggggggtaggacaca

SEQ ID NO: 518649 - DNA, 20 bp, Artificial
  CRISPR gRNA sequence
gggggtaggacacagtgcga

SEQ ID NO: 518650 - DNA, 20 bp, Artificial
  CRISPR gRNA sequence
tcctacagcagagttcagaa

SEQ ID NO: 518651 - DNA, 20 bp, Artificial
  CRISPR gRNA sequence
ctacagcagagttcagaacc

SEQ ID NO: 518652 - DNA, 20 bp, Artificial
  CRISPR gRNA sequence
cagcagagttcagaaccagg

SEQ ID NO: 518653 - DNA, 20 bp, Artificial
  CRISPR gRNA sequence
agaaccaggctcagggtccc

SEQ ID NO: 518654 - DNA, 20 bp, Artificial
  CRISPR gRNA sequence
agggtccctgctggagttca

SEQ ID NO: 518655 - DNA, 20 bp, Artificial
  CRISPR gRNA sequence
ctggagttcactccccatac

SEQ ID NO: 518656 - DNA, 20 bp, Artificial
  CRISPR gRNA sequence
gagttcactccccatactgt

SEQ ID NO: 518657 - DNA, 20 bp, Artificial
  CRISPR gRNA sequence
actccccatactgtgaaagt

SEQ ID NO: 518658 - DNA, 20 bp, Artificial
  CRISPR gRNA sequence
cccatactgtgaaagtgatt

SEQ ID NO: 518659 - DNA, 20 bp, Artificial
  CRISPR gRNA sequence
tgaaagtgatttgtggtcgt

SEQ ID NO: 518660 - DNA, 20 bp, Artificial
  CRISPR gRNA sequence
gtggtcgtcaaggacaagac

SEQ ID NO: 518661 - DNA, 20 bp, Artificial
  CRISPR gRNA sequence
tggtcgtcaaggacaagacc

SEQ ID NO: 518662 - DNA, 20 bp, Artificial
  CRISPR gRNA sequence
agcaggtgaggccggtgcca

SEQ ID NO: 518663 - DNA, 20 bp, Artificial
  CRISPR gRNA sequence
gttcccacggcagctgtgcc

SEQ ID NO: 518664 - DNA, 20 bp, Artificial
  CRISPR gRNA sequence
ccacggcagctgtgcccacc

SEQ ID NO: 518665 - DNA, 20 bp, Artificial
  CRISPR gRNA sequence
tgcccacctcctgagcatgg

SEQ ID NO: 518666 - DNA, 20 bp, Artificial
  CRISPR gRNA sequence
ctgagcatggggactgtggg

SEQ ID NO: 518667 - DNA, 20 bp, Artificial
  CRISPR gRNA sequence
agcatggggactgtgggcca

SEQ ID NO: 518668 - DNA, 20 bp, Artificial
  CRISPR gRNA sequence
tgggccatagtgggccaggc

SEQ ID NO: 518669 - DNA, 20 bp, Artificial
  CRISPR gRNA sequence
ctgaccctgggacagacact

SEQ ID NO: 518670 - DNA, 20 bp, Artificial
  CRISPR gRNA sequence
accctgggacagacactagc

SEQ ID NO: 518671 - DNA, 20 bp, Artificial
  CRISPR gRNA sequence
ggacagacactagcgttcag

SEQ ID NO: 518672 - DNA, 20 bp, Artificial
  CRISPR gRNA sequence
gcgttcagtgcagtccctgg

SEQ ID NO: 518673 - DNA, 20 bp, Artificial
  CRISPR gRNA sequence
agtgcagtccctggcctggt

SEQ ID NO: 518674 - DNA, 20 bp, Artificial
  CRISPR gRNA sequence
gcctggtctggcatcctcac

SEQ ID NO: 518675 - DNA, 20 bp, Artificial
  CRISPR gRNA sequence
gtctggcatcctcactccct

SEQ ID NO: 518676 - DNA, 20 bp, Artificial
  CRISPR gRNA sequence
gcatcctcactccctgtacc

SEQ ID NO: 518677 - DNA, 20 bp, Artificial
  CRISPR gRNA sequence
actccctgtacccctcctgc

SEQ ID NO: 518678 - DNA, 20 bp, Artificial
  CRISPR gRNA sequence
cctgtacccctcctgccatc

SEQ ID NO: 518679 - DNA, 20 bp, Artificial
  CRISPR gRNA sequence
tacccctcctgccatcctga

SEQ ID NO: 518680 - DNA, 20 bp, Artificial
  CRISPR gRNA sequence
ctgccatcctgacctgcacc

SEQ ID NO: 518681 - DNA, 20 bp, Artificial
  CRISPR gRNA sequence
ccatcctgacctgcaccctc

SEQ ID NO: 518682 - DNA, 20 bp, Artificial
  CRISPR gRNA sequence
acctgcaccctcactccctg

SEQ ID NO: 518683 - DNA, 20 bp, Artificial
  CRISPR gRNA sequence
caccctcactccctgtggtt

SEQ ID NO: 518684 - DNA, 20 bp, Artificial
  CRISPR gRNA sequence
actccctgtggttgctcctg

SEQ ID NO: 518685 - DNA, 20 bp, Artificial
  CRISPR gRNA sequence
cctgtggttgctcctgccat

SEQ ID NO: 518686 - DNA, 20 bp, Artificial
  CRISPR gRNA sequence
tggttgctcctgccatcctg

SEQ ID NO: 518687 - DNA, 20 bp, Artificial
  CRISPR gRNA sequence
ctcctgccatcctgatctgc

SEQ ID NO: 518688 - DNA, 20 bp, Artificial
  CRISPR gRNA sequence
ctgccatcctgatctgcacc

SEQ ID NO: 518689 - DNA, 20 bp, Artificial
  CRISPR gRNA sequence
ccatcctgatctgcaccctc

SEQ ID NO: 518690 - DNA, 20 bp, Artificial
  CRISPR gRNA sequence
atctgcaccctcactccctg

SEQ ID NO: 518691 - DNA, 20 bp, Artificial
  CRISPR gRNA sequence
caccctcactccctgtgccc

SEQ ID NO: 518692 - DNA, 20 bp, Artificial
  CRISPR gRNA sequence
actccctgtgccccctcctg

SEQ ID NO: 518693 - DNA, 20 bp, Artificial
  CRISPR gRNA sequence
cctgtgccccctcctgccat

SEQ ID NO: 518694 - DNA, 20 bp, Artificial
  CRISPR gRNA sequence
tgccccctcctgccatcctg

SEQ ID NO: 518695 - DNA, 20 bp, Artificial
  CRISPR gRNA sequence
ctgccatcctgacctgcact

SEQ ID NO: 518696 - DNA, 20 bp, Artificial
  CRISPR gRNA sequence
ccatcctgacctgcactctc

SEQ ID NO: 518697 - DNA, 20 bp, Artificial
  CRISPR gRNA sequence
acctgcactctcactccccg

SEQ ID NO: 518698 - DNA, 20 bp, Artificial
  CRISPR gRNA sequence
cactctcactccccgtgccc

SEQ ID NO: 518699 - DNA, 20 bp, Artificial
  CRISPR gRNA sequence
tcactccccgtgccccctcc

SEQ ID NO: 518700 - DNA, 20 bp, Artificial
  CRISPR gRNA sequence
actccccgtgccccctcctg

SEQ ID NO: 518701 - DNA, 20 bp, Artificial
  CRISPR gRNA sequence
cccgtgccccctcctgccat

SEQ ID NO: 518702 - DNA, 20 bp, Artificial
  CRISPR gRNA sequence
ctgccatcctgcctttcctg

SEQ ID NO: 518703 - DNA, 20 bp, Artificial
  CRISPR gRNA sequence
ccatcctgcctttcctgggg

SEQ ID NO: 518704 - DNA, 20 bp, Artificial
  CRISPR gRNA sequence
cctttcctgggggacctgcc

SEQ ID NO: 518705 - DNA, 20 bp, Artificial
  CRISPR gRNA sequence
tcctgggggacctgccttcc

SEQ ID NO: 518706 - DNA, 20 bp, Artificial
  CRISPR gRNA sequence
cctgggggacctgccttcct

SEQ ID NO: 518707 - DNA, 20 bp, Artificial
  CRISPR gRNA sequence
ctgggggacctgccttcctt

SEQ ID NO: 518708 - DNA, 20 bp, Artificial
  CRISPR gRNA sequence
ggggacctgccttccttcac

SEQ ID NO: 518709 - DNA, 20 bp, Artificial
  CRISPR gRNA sequence
ccttccttcacctgtcctca

SEQ ID NO: 518710 - DNA, 20 bp, Artificial
  CRISPR gRNA sequence
ccttcacctgtcctcaaagg

SEQ ID NO: 518711 - DNA, 20 bp, Artificial
  CRISPR gRNA sequence
cttcacctgtcctcaaaggt

SEQ ID NO: 518712 - DNA, 20 bp, Artificial
  CRISPR gRNA sequence
cacctgtcctcaaaggtgaa

SEQ ID NO: 518713 - DNA, 20 bp, Artificial
  CRISPR gRNA sequence
acctgtcctcaaaggtgaag

SEQ ID NO: 518714 - DNA, 20 bp, Artificial
  CRISPR gRNA sequence
tcctcaaaggtgaagtgact

SEQ ID NO: 518715 - DNA, 20 bp, Artificial
  CRISPR gRNA sequence
aaaggtgaagtgacttggcc

SEQ ID NO: 518716 - DNA, 20 bp, Artificial
  CRISPR gRNA sequence
ggccaggattgcacaaacca

SEQ ID NO: 518717 - DNA, 20 bp, Artificial
  CRISPR gRNA sequence
gccaggattgcacaaaccag

SEQ ID NO: 518718 - DNA, 20 bp, Artificial
  CRISPR gRNA sequence
cacaaaccagacgtgaccca

SEQ ID NO: 518719 - DNA, 20 bp, Artificial
  CRISPR gRNA sequence
tccctcaaagtggcccgcag

SEQ ID NO: 518720 - DNA, 20 bp, Artificial
  CRISPR gRNA sequence
aaagtggcccgcaggggttc

SEQ ID NO: 518721 - DNA, 20 bp, Artificial
  CRISPR gRNA sequence
ctgccctggcaggtgggggt

SEQ ID NO: 518722 - DNA, 20 bp, Artificial
  CRISPR gRNA sequence
ccctggcaggtgggggtctg

SEQ ID NO: 518723 - DNA, 20 bp, Artificial
  CRISPR gRNA sequence
gcaggtgggggtctgcagcc

SEQ ID NO: 518724 - DNA, 20 bp, Artificial
  CRISPR gRNA sequence
cagccccaggcccacatgtg

SEQ ID NO: 518725 - DNA, 20 bp, Artificial
  CRISPR gRNA sequence
tgagctccaggcatgtcacc

SEQ ID NO: 518726 - DNA, 20 bp, Artificial
  CRISPR gRNA sequence
caggcatgtcacctacaggc

SEQ ID NO: 518727 - DNA, 20 bp, Artificial
  CRISPR gRNA sequence
caggctcagagacccccgcc

SEQ ID NO: 518728 - DNA, 20 bp, Artificial
  CRISPR gRNA sequence
agagacccccgccgcctgcc

SEQ ID NO: 518729 - DNA, 20 bp, Artificial
  CRISPR gRNA sequence
cctcgggtcccttcctggtg

SEQ ID NO: 518730 - DNA, 20 bp, Artificial
  CRISPR gRNA sequence
gggtcccttcctggtgaggg

SEQ ID NO: 518731 - DNA, 20 bp, Artificial
  CRISPR gRNA sequence
cctggtgagggaggagctcc

SEQ ID NO: 518732 - DNA, 20 bp, Artificial
  CRISPR gRNA sequence
ctggtgagggaggagctccc

SEQ ID NO: 518733 - DNA, 20 bp, Artificial
  CRISPR gRNA sequence
gtgagggaggagctcccagg

SEQ ID NO: 518734 - DNA, 20 bp, Artificial
  CRISPR gRNA sequence
ccaggtctcagttctgcaag

SEQ ID NO: 518735 - DNA, 20 bp, Artificial
  CRISPR gRNA sequence
agttctgcaagagtcctggc

SEQ ID NO: 518736 - DNA, 20 bp, Artificial
  CRISPR gRNA sequence
tgcaagagtcctggccggct

SEQ ID NO: 518737 - DNA, 20 bp, Artificial
  CRISPR gRNA sequence
caagagtcctggccggctgc

SEQ ID NO: 518738 - DNA, 20 bp, Artificial
  CRISPR gRNA sequence
gccggctgctggccatgcct

SEQ ID NO: 518739 - DNA, 20 bp, Artificial
  CRISPR gRNA sequence
ctggccatgcctgatggagt

SEQ ID NO: 518740 - DNA, 20 bp, Artificial
  CRISPR gRNA sequence
gccatgcctgatggagtccg

SEQ ID NO: 518741 - DNA, 20 bp, Artificial
  CRISPR gRNA sequence
atggagtccgccagcggccc

SEQ ID NO: 518742 - DNA, 20 bp, Artificial
  CRISPR gRNA sequence
tgcctctcaggagcctgtgg

SEQ ID NO: 518743 - DNA, 20 bp, Artificial
  CRISPR gRNA sequence
cctctcaggagcctgtggaa

SEQ ID NO: 518744 - DNA, 20 bp, Artificial
  CRISPR gRNA sequence
tcaggagcctgtggaacatg

SEQ ID NO: 518745 - DNA, 20 bp, Artificial
  CRISPR gRNA sequence
aggagcctgtggaacatgag

SEQ ID NO: 518746 - DNA, 20 bp, Artificial
  CRISPR gRNA sequence
tggaacatgagacctgaaga

SEQ ID NO: 518747 - DNA, 20 bp, Artificial
  CRISPR gRNA sequence
aagaagcagggccagtgtca

SEQ ID NO: 518748 - DNA, 20 bp, Artificial
  CRISPR gRNA sequence
ggcctggttccaactggagc

SEQ ID NO: 518749 - DNA, 20 bp, Artificial
  CRISPR gRNA sequence
gttccaactggagctgaatg

SEQ ID NO: 518750 - DNA, 20 bp, Artificial
  CRISPR gRNA sequence
caactggagctgaatgagac

SEQ ID NO: 518751 - DNA, 20 bp, Artificial
  CRISPR gRNA sequence
gagctgaatgagacagggtc

SEQ ID NO: 518752 - DNA, 20 bp, Artificial
  CRISPR gRNA sequence
aatgagacagggtcagtgcc

SEQ ID NO: 518753 - DNA, 20 bp, Artificial
  CRISPR gRNA sequence
tggggctgggactggttccg

SEQ ID NO: 518754 - DNA, 20 bp, Artificial
  CRISPR gRNA sequence
ggactggttccgactggagc

SEQ ID NO: 518755 - DNA, 20 bp, Artificial
  CRISPR gRNA sequence
gttccgactggagccgaatg

SEQ ID NO: 518756 - DNA, 20 bp, Artificial
  CRISPR gRNA sequence
cgactggagccgaatgagac

SEQ ID NO: 518757 - DNA, 20 bp, Artificial
  CRISPR gRNA sequence
gagccgaatgagacagggtc

SEQ ID NO: 518758 - DNA, 20 bp, Artificial
  CRISPR gRNA sequence
tggggctgggactggttccg

SEQ ID NO: 518759 - DNA, 20 bp, Artificial
  CRISPR gRNA sequence
ggactggttccgactggact

SEQ ID NO: 518760 - DNA, 20 bp, Artificial
  CRISPR gRNA sequence
gttccgactggactggagcc

SEQ ID NO: 518761 - DNA, 20 bp, Artificial
  CRISPR gRNA sequence
cgactggactggagccgaac

SEQ ID NO: 518762 - DNA, 20 bp, Artificial
  CRISPR gRNA sequence
gactggagccgaacgagtga

SEQ ID NO: 518763 - DNA, 20 bp, Artificial
  CRISPR gRNA sequence
gagccgaacgagtgatgggg

SEQ ID NO: 518764 - DNA, 20 bp, Artificial
  CRISPR gRNA sequence
gtggccctgggcccctccag

SEQ ID NO: 518765 - DNA, 20 bp, Artificial
  CRISPR gRNA sequence
ggcccctccagggctgagag

SEQ ID NO: 518766 - DNA, 20 bp, Artificial
  CRISPR gRNA sequence
cagggctgagagccgagcac

SEQ ID NO: 518767 - DNA, 20 bp, Artificial
  CRISPR gRNA sequence
agagccgagcaccaggatct

SEQ ID NO: 518768 - DNA, 20 bp, Artificial
  CRISPR gRNA sequence
ccaatcccctcaaaggagcc

SEQ ID NO: 518769 - DNA, 20 bp, Artificial
  CRISPR gRNA sequence
aaaggagcctcacgcagcaa

SEQ ID NO: 518770 - DNA, 20 bp, Artificial
  CRISPR gRNA sequence
acgcagcaacctgaccgcgg

SEQ ID NO: 518771 - DNA, 20 bp, Artificial
  CRISPR gRNA sequence
accgcgggccacccctgggg

SEQ ID NO: 518772 - DNA, 20 bp, Artificial
  CRISPR gRNA sequence
gggacctgcaactgcaagcc

SEQ ID NO: 518773 - DNA, 20 bp, Artificial
  CRISPR gRNA sequence
caactgcaagccttgcccca

SEQ ID NO: 518774 - DNA, 20 bp, Artificial
  CRISPR gRNA sequence
caagccttgccccatgaggc

SEQ ID NO: 518775 - DNA, 20 bp, Artificial
  CRISPR gRNA sequence
gccccatgaggcatccagcg

SEQ ID NO: 518776 - DNA, 20 bp, Artificial
  CRISPR gRNA sequence
ccccatgaggcatccagcgg

SEQ ID NO: 518777 - DNA, 20 bp, Artificial
  CRISPR gRNA sequence
gtgggcctgcccggtgtgga

SEQ ID NO: 518778 - DNA, 20 bp, Artificial
  CRISPR gRNA sequence
cccggtgtggagcagtggtg

SEQ ID NO: 518779 - DNA, 20 bp, Artificial
  CRISPR gRNA sequence
ctgcccagcttgatgtgggg

SEQ ID NO: 518780 - DNA, 20 bp, Artificial
  CRISPR gRNA sequence
cccagcttgatgtggggtca

SEQ ID NO: 518781 - DNA, 20 bp, Artificial
  CRISPR gRNA sequence
gatgtggggtcaggtgagga

SEQ ID NO: 518782 - DNA, 20 bp, Artificial
  CRISPR gRNA sequence
atgtggggtcaggtgaggag

SEQ ID NO: 518783 - DNA, 20 bp, Artificial
  CRISPR gRNA sequence
ctgggggtgaggggaccggc

SEQ ID NO: 518784 - DNA, 20 bp, Artificial
  CRISPR gRNA sequence
ggggtgaggggaccggcctc

SEQ ID NO: 518785 - DNA, 20 bp, Artificial
  CRISPR gRNA sequence
tggcctccttgcaatgccaa

SEQ ID NO: 518786 - DNA, 20 bp, Artificial
  CRISPR gRNA sequence
gcctccttgcaatgccaagg

SEQ ID NO: 518787 - DNA, 20 bp, Artificial
  CRISPR gRNA sequence
cttgcaatgccaagggcatc

SEQ ID NO: 518788 - DNA, 20 bp, Artificial
  CRISPR gRNA sequence
gcaatgccaagggcatcccg

SEQ ID NO: 518789 - DNA, 20 bp, Artificial
  CRISPR gRNA sequence
caatgccaagggcatcccgc

SEQ ID NO: 518790 - DNA, 20 bp, Artificial
  CRISPR gRNA sequence
atccaccctgctgggcccac

SEQ ID NO: 518791 - DNA, 20 bp, Artificial
  CRISPR gRNA sequence
ctgggcccacaacactggag

SEQ ID NO: 518792 - DNA, 20 bp, Artificial
  CRISPR gRNA sequence
ggcccacaacactggaggtg

SEQ ID NO: 518793 - DNA, 20 bp, Artificial
  CRISPR gRNA sequence
gaggtgagatcctccttccg

SEQ ID NO: 518794 - DNA, 20 bp, Artificial
  CRISPR gRNA sequence
cttccgcaccaccctcgcct

SEQ ID NO: 518795 - DNA, 20 bp, Artificial
  CRISPR gRNA sequence
ccgcaccaccctcgcctctg

SEQ ID NO: 518796 - DNA, 20 bp, Artificial
  CRISPR gRNA sequence
cgcaccaccctcgcctctgc

SEQ ID NO: 518797 - DNA, 20 bp, Artificial
  CRISPR gRNA sequence
gcctctgcggagaccccgca

SEQ ID NO: 518798 - DNA, 20 bp, Artificial
  CRISPR gRNA sequence
tgcggagaccccgcagccgg

SEQ ID NO: 518799 - DNA, 20 bp, Artificial
  CRISPR gRNA sequence
cggagaccccgcagccggag

SEQ ID NO: 518800 - DNA, 20 bp, Artificial
  CRISPR gRNA sequence
tggagccggtccccgctgca

SEQ ID NO: 518801 - DNA, 20 bp, Artificial
  CRISPR gRNA sequence
gagccggtccccgctgcacc

SEQ ID NO: 518802 - DNA, 20 bp, Artificial
  CRISPR gRNA sequence
caccccagcggcctcacctc

SEQ ID NO: 518803 - DNA, 20 bp, Artificial
  CRISPR gRNA sequence
acctcggctctcatccacat

SEQ ID NO: 518804 - DNA, 20 bp, Artificial
  CRISPR gRNA sequence
ggctctcatccacatagatg

SEQ ID NO: 518805 - DNA, 20 bp, Artificial
  CRISPR gRNA sequence
tcatccacatagatgaggta

SEQ ID NO: 518806 - DNA, 20 bp, Artificial
  CRISPR gRNA sequence
atccacatagatgaggtagc

SEQ ID NO: 518807 - DNA, 20 bp, Artificial
  CRISPR gRNA sequence
ctgctccagcgtgtaggcca

SEQ ID NO: 518808 - DNA, 20 bp, Artificial
  CRISPR gRNA sequence
ctccagcgtgtaggccaccc

SEQ ID NO: 518809 - DNA, 20 bp, Artificial
  CRISPR gRNA sequence
cagcgtgtaggccacccagc

SEQ ID NO: 518810 - DNA, 20 bp, Artificial
  CRISPR gRNA sequence
tgagtccctctccttgcagg

SEQ ID NO: 518811 - DNA, 20 bp, Artificial
  CRISPR gRNA sequence
agtccctctccttgcaggtc

SEQ ID NO: 518812 - DNA, 20 bp, Artificial
  CRISPR gRNA sequence
tccttgcaggtcctgccctt

SEQ ID NO: 518813 - DNA, 20 bp, Artificial
  CRISPR gRNA sequence
cttgcaggtcctgcccttca

SEQ ID NO: 518814 - DNA, 20 bp, Artificial
  CRISPR gRNA sequence
gcaggtcctgcccttcacgg

SEQ ID NO: 518815 - DNA, 20 bp, Artificial
  CRISPR gRNA sequence
caggtcctgcccttcacggg

SEQ ID NO: 518816 - DNA, 20 bp, Artificial
  CRISPR gRNA sequence
cccttcacggggttgttcga

SEQ ID NO: 518817 - DNA, 20 bp, Artificial
  CRISPR gRNA sequence
cacggggttgttcgacagct

SEQ ID NO: 518818 - DNA, 20 bp, Artificial
  CRISPR gRNA sequence
acggggttgttcgacagctg

SEQ ID NO: 518819 - DNA, 20 bp, Artificial
  CRISPR gRNA sequence
ttcgacagctgcaggcccgg

SEQ ID NO: 518820 - DNA, 20 bp, Artificial
  CRISPR gRNA sequence
gacagctgcaggcccggaca

SEQ ID NO: 518821 - DNA, 20 bp, Artificial
  CRISPR gRNA sequence
caggcccggacacgccgcgc

SEQ ID NO: 518822 - DNA, 20 bp, Artificial
  CRISPR gRNA sequence
cagttcttcccaaaggggcc

SEQ ID NO: 518823 - DNA, 20 bp, Artificial
  CRISPR gRNA sequence
ttcccaaaggggcccttttc

SEQ ID NO: 518824 - DNA, 20 bp, Artificial
  CRISPR gRNA sequence
cccaaaggggcccttttcga

SEQ ID NO: 518825 - DNA, 20 bp, Artificial
  CRISPR gRNA sequence
ccaaaggggcccttttcgaa

SEQ ID NO: 518826 - DNA, 20 bp, Artificial
  CRISPR gRNA sequence
ttcgaacttcaggcactcgg

SEQ ID NO: 518827 - DNA, 20 bp, Artificial
  CRISPR gRNA sequence
tcgaacttcaggcactcggc

SEQ ID NO: 518828 - DNA, 20 bp, Artificial
  CRISPR gRNA sequence
cgaacttcaggcactcggcg

SEQ ID NO: 518829 - DNA, 20 bp, Artificial
  CRISPR gRNA sequence
gaacttcaggcactcggcgc

SEQ ID NO: 518830 - DNA, 20 bp, Artificial
  CRISPR gRNA sequence
caggcactcggcgcaggagc

SEQ ID NO: 518831 - DNA, 20 bp, Artificial
  CRISPR gRNA sequence
aggcactcggcgcaggagct

SEQ ID NO: 518832 - DNA, 20 bp, Artificial
  CRISPR gRNA sequence
ggcgcaggagctgcggggag

SEQ ID NO: 518833 - DNA, 20 bp, Artificial
  CRISPR gRNA sequence
cggggagccaggtgtgagca

SEQ ID NO: 518834 - DNA, 20 bp, Artificial
  CRISPR gRNA sequence
cggcaacgggggctcgggct

SEQ ID NO: 518835 - DNA, 20 bp, Artificial
  CRISPR gRNA sequence
gggcttgggtgtgtgtccac

SEQ ID NO: 518836 - DNA, 20 bp, Artificial
  CRISPR gRNA sequence
gggtgtgtgtccaccagggg

SEQ ID NO: 518837 - DNA, 20 bp, Artificial
  CRISPR gRNA sequence
ggtgtgtgtccaccaggggg

SEQ ID NO: 518838 - DNA, 20 bp, Artificial
  CRISPR gRNA sequence
gggcgccctcaggccaagga

SEQ ID NO: 518839 - DNA, 20 bp, Artificial
  CRISPR gRNA sequence
aggccaaggagggggcccaa

SEQ ID NO: 518840 - DNA, 20 bp, Artificial
  CRISPR gRNA sequence
gaagcctgatcccagggccc

SEQ ID NO: 518841 - DNA, 20 bp, Artificial
  CRISPR gRNA sequence
atcccagggcccgcggcagg

SEQ ID NO: 518842 - DNA, 20 bp, Artificial
  CRISPR gRNA sequence
agtccagacgcacccgcaga

SEQ ID NO: 518843 - DNA, 20 bp, Artificial
  CRISPR gRNA sequence
actggggtccccgagtgagc

SEQ ID NO: 518844 - DNA, 20 bp, Artificial
  CRISPR gRNA sequence
gggtccccgagtgagcccgg

SEQ ID NO: 518845 - DNA, 20 bp, Artificial
  CRISPR gRNA sequence
ctgggtaggtggccggggag

SEQ ID NO: 518846 - DNA, 20 bp, Artificial
  CRISPR gRNA sequence
ggtaggtggccggggagtgg

SEQ ID NO: 518847 - DNA, 20 bp, Artificial
  CRISPR gRNA sequence
cccgccctgcctgctccgcc

SEQ ID NO: 518848 - DNA, 20 bp, Artificial
  CRISPR gRNA sequence
cctgctccgcctgcactcac

SEQ ID NO: 518849 - DNA, 20 bp, Artificial
  CRISPR gRNA sequence
ctccgcctgcactcacatgt

SEQ ID NO: 518850 - DNA, 20 bp, Artificial
  CRISPR gRNA sequence
cgcctgcactcacatgtact

SEQ ID NO: 518851 - DNA, 20 bp, Artificial
  CRISPR gRNA sequence
cactcacatgtacttgccac

SEQ ID NO: 518852 - DNA, 20 bp, Artificial
  CRISPR gRNA sequence
acatgtacttgccacagggt

SEQ ID NO: 518853 - DNA, 20 bp, Artificial
  CRISPR gRNA sequence
gccacagggtgaggggcagc

SEQ ID NO: 518854 - DNA, 20 bp, Artificial
  CRISPR gRNA sequence
ccacagggtgaggggcagcc

SEQ ID NO: 518855 - DNA, 20 bp, Artificial
  CRISPR gRNA sequence
ctggcacagaggcagctggt

SEQ ID NO: 518856 - DNA, 20 bp, Artificial
  CRISPR gRNA sequence
gcacagaggcagctggtagc

SEQ ID NO: 518857 - DNA, 20 bp, Artificial
  CRISPR gRNA sequence
gtagcctgaatggcactcgc

SEQ ID NO: 518858 - DNA, 20 bp, Artificial
  CRISPR gRNA sequence
aatggcactcgcatacgttg

SEQ ID NO: 518859 - DNA, 20 bp, Artificial
  CRISPR gRNA sequence
gcatacgttgcagcggcacc

SEQ ID NO: 518860 - DNA, 20 bp, Artificial
  CRISPR gRNA sequence
cagcggcaccggccacgacc

SEQ ID NO: 518861 - DNA, 20 bp, Artificial
  CRISPR gRNA sequence
cactcaacacgccgcgggtt

SEQ ID NO: 518862 - DNA, 20 bp, Artificial
  CRISPR gRNA sequence
aacacgccgcgggttcaggc

SEQ ID NO: 518863 - DNA, 20 bp, Artificial
  CRISPR gRNA sequence
aggcagccctcagtggtcct

SEQ ID NO: 518864 - DNA, 20 bp, Artificial
  CRISPR gRNA sequence
agtggtcctctcgcactggc

SEQ ID NO: 518865 - DNA, 20 bp, Artificial
  CRISPR gRNA sequence
tcgcactggcacgctgagcc

SEQ ID NO: 518866 - DNA, 20 bp, Artificial
  CRISPR gRNA sequence
gcactggcacgctgagccct

SEQ ID NO: 518867 - DNA, 20 bp, Artificial
  CRISPR gRNA sequence
gcacgctgagccctcaaagc

SEQ ID NO: 518868 - DNA, 20 bp, Artificial
  CRISPR gRNA sequence
agccctcaaagcccgggtgg

SEQ ID NO: 518869 - DNA, 20 bp, Artificial
  CRISPR gRNA sequence
aaagcccgggtggcagcggc

SEQ ID NO: 518870 - DNA, 20 bp, Artificial
  CRISPR gRNA sequence
cccgcagaagcagagccccc

SEQ ID NO: 518871 - DNA, 20 bp, Artificial
  CRISPR gRNA sequence
ccgcagaagcagagccccct

SEQ ID NO: 518872 - DNA, 20 bp, Artificial
  CRISPR gRNA sequence
cctggaagacggggcagcac

SEQ ID NO: 518873 - DNA, 20 bp, Artificial
  CRISPR gRNA sequence
gaagacggggcagcacggct

SEQ ID NO: 518874 - DNA, 20 bp, Artificial
  CRISPR gRNA sequence
agctcctgcttggcctggga

SEQ ID NO: 518875 - DNA, 20 bp, Artificial
  CRISPR gRNA sequence
ctgcttggcctgggaaccga

SEQ ID NO: 518876 - DNA, 20 bp, Artificial
  CRISPR gRNA sequence
cttggcctgggaaccgagac

SEQ ID NO: 518877 - DNA, 20 bp, Artificial
  CRISPR gRNA sequence
ggcctgggaaccgagacccg

SEQ ID NO: 518878 - DNA, 20 bp, Artificial
  CRISPR gRNA sequence
gcctgggaaccgagacccgc

SEQ ID NO: 518879 - DNA, 20 bp, Artificial
  CRISPR gRNA sequence
ggaaccgagacccgcccgaa

SEQ ID NO: 518880 - DNA, 20 bp, Artificial
  CRISPR gRNA sequence
cggttgctccctccggcccg

SEQ ID NO: 518881 - DNA, 20 bp, Artificial
  CRISPR gRNA sequence
ctccctccggcccgcctgcc

SEQ ID NO: 518882 - DNA, 20 bp, Artificial
  CRISPR gRNA sequence
cctccggcccgcctgcctcc

SEQ ID NO: 518883 - DNA, 20 bp, Artificial
  CRISPR gRNA sequence
cggcccgcctgcctcctcca

SEQ ID NO: 518884 - DNA, 20 bp, Artificial
  CRISPR gRNA sequence
cctcctccagcctgggggat

SEQ ID NO: 518885 - DNA, 20 bp, Artificial
  CRISPR gRNA sequence
ctccagcctgggggatgttc

SEQ ID NO: 518886 - DNA, 20 bp, Artificial
  CRISPR gRNA sequence
cagcctgggggatgttcctg

SEQ ID NO: 518887 - DNA, 20 bp, Artificial
  CRISPR gRNA sequence
ggggatgttcctgagcaaaa

SEQ ID NO: 518888 - DNA, 20 bp, Artificial
  CRISPR gRNA sequence
ctgagcaaaaggcatggggc

SEQ ID NO: 518889 - DNA, 20 bp, Artificial
  CRISPR gRNA sequence
agcaaaaggcatggggccac

SEQ ID NO: 518890 - DNA, 20 bp, Artificial
  CRISPR gRNA sequence
gccaggcccttctgcccccg

SEQ ID NO: 518891 - DNA, 20 bp, Artificial
  CRISPR gRNA sequence
ctgcccccgccagccacgtg

SEQ ID NO: 518892 - DNA, 20 bp, Artificial
  CRISPR gRNA sequence
tgcccccgccagccacgtgg

SEQ ID NO: 518893 - DNA, 20 bp, Artificial
  CRISPR gRNA sequence
cccccgccagccacgtggcc

SEQ ID NO: 518894 - DNA, 20 bp, Artificial
  CRISPR gRNA sequence
ctggccagtctggacctccc

SEQ ID NO: 518895 - DNA, 20 bp, Artificial
  CRISPR gRNA sequence
gccagtctggacctcccctg

SEQ ID NO: 518896 - DNA, 20 bp, Artificial
  CRISPR gRNA sequence
gacctcccctgccctgctgt

SEQ ID NO: 518897 - DNA, 20 bp, Artificial
  CRISPR gRNA sequence
ccctgccctgctgtgaatgg

SEQ ID NO: 518898 - DNA, 20 bp, Artificial
  CRISPR gRNA sequence
ccctgctgtgaatgggacct

SEQ ID NO: 518899 - DNA, 20 bp, Artificial
  CRISPR gRNA sequence
ctgtgaatgggacctcaata

SEQ ID NO: 518900 - DNA, 20 bp, Artificial
  CRISPR gRNA sequence
tgaatgggacctcaataggg

SEQ ID NO: 518901 - DNA, 20 bp, Artificial
  CRISPR gRNA sequence
aatagggctatgaccgttcc

SEQ ID NO: 518902 - DNA, 20 bp, Artificial
  CRISPR gRNA sequence
tgaccgttcctcctgtgggc

SEQ ID NO: 518903 - DNA, 20 bp, Artificial
  CRISPR gRNA sequence
ctcctgtgggccctccccac

SEQ ID NO: 518904 - DNA, 20 bp, Artificial
  CRISPR gRNA sequence
ctgtgggccctccccacaag

SEQ ID NO: 518905 - DNA, 20 bp, Artificial
  CRISPR gRNA sequence
tgggccctccccacaaggac

SEQ ID NO: 518906 - DNA, 20 bp, Artificial
  CRISPR gRNA sequence
cccacaaggacgccttgtcc

SEQ ID NO: 518907 - DNA, 20 bp, Artificial
  CRISPR gRNA sequence
gtcctcatggacacagaaac

SEQ ID NO: 518908 - DNA, 20 bp, Artificial
  CRISPR gRNA sequence
tcctcatggacacagaaact

SEQ ID NO: 518909 - DNA, 20 bp, Artificial
  CRISPR gRNA sequence
atggacacagaaactgaggc

SEQ ID NO: 518910 - DNA, 20 bp, Artificial
  CRISPR gRNA sequence
aggcagggcggggtgcaggg

SEQ ID NO: 518911 - DNA, 20 bp, Artificial
  CRISPR gRNA sequence
ctgctgacgcccggtggctg

SEQ ID NO: 518912 - DNA, 20 bp, Artificial
  CRISPR gRNA sequence
ctgacgcccggtggctgggc

SEQ ID NO: 518913 - DNA, 20 bp, Artificial
  CRISPR gRNA sequence
acgcccggtggctgggcgag

SEQ ID NO: 518914 - DNA, 20 bp, Artificial
  CRISPR gRNA sequence
ggcgagacttgcactgtctg

SEQ ID NO: 518915 - DNA, 20 bp, Artificial
  CRISPR gRNA sequence
gcactgtctgtcctcaggat

SEQ ID NO: 518916 - DNA, 20 bp, Artificial
  CRISPR gRNA sequence
cactgtctgtcctcaggatc

SEQ ID NO: 518917 - DNA, 20 bp, Artificial
  CRISPR gRNA sequence
tctgtcctcaggatcccccc

SEQ ID NO: 518918 - DNA, 20 bp, Artificial
  CRISPR gRNA sequence
tcctcaggatcccccctttc

SEQ ID NO: 518919 - DNA, 20 bp, Artificial
  CRISPR gRNA sequence
aggatcccccctttctgttc

SEQ ID NO: 518920 - DNA, 20 bp, Artificial
  CRISPR gRNA sequence
tctgttccactcgttgaatg

SEQ ID NO: 518921 - DNA, 20 bp, Artificial
  CRISPR gRNA sequence
ctgttccactcgttgaatgg

SEQ ID NO: 518922 - DNA, 20 bp, Artificial
  CRISPR gRNA sequence
tgttccactcgttgaatggt

SEQ ID NO: 518923 - DNA, 20 bp, Artificial
  CRISPR gRNA sequence
ttccactcgttgaatggtcc

SEQ ID NO: 518924 - DNA, 20 bp, Artificial
  CRISPR gRNA sequence
cactcgttgaatggtccaga

SEQ ID NO: 518925 - DNA, 20 bp, Artificial
  CRISPR gRNA sequence
gttgaatggtccagaacgca

SEQ ID NO: 518926 - DNA, 20 bp, Artificial
  CRISPR gRNA sequence
aatggtccagaacgcacccc

SEQ ID NO: 518927 - DNA, 20 bp, Artificial
  CRISPR gRNA sequence
tgccgcaggacggccgttgt

SEQ ID NO: 518928 - DNA, 20 bp, Artificial
  CRISPR gRNA sequence
tccagcagggacccacgggc

SEQ ID NO: 518929 - DNA, 20 bp, Artificial
  CRISPR gRNA sequence
acccgggccgccgcagacct

SEQ ID NO: 518930 - DNA, 20 bp, Artificial
  CRISPR gRNA sequence
gccgttgtagcgctcacagt

SEQ ID NO: 518931 - DNA, 20 bp, Artificial
  CRISPR gRNA sequence
tagcgctcacagttgatggt

SEQ ID NO: 518932 - DNA, 20 bp, Artificial
  CRISPR gRNA sequence
acagttgatggtgtcacact

SEQ ID NO: 518933 - DNA, 20 bp, Artificial
  CRISPR gRNA sequence
atggtgtcacactcgcagta

SEQ ID NO: 518934 - DNA, 20 bp, Artificial
  CRISPR gRNA sequence
gcagtactgcccgtatatca

SEQ ID NO: 518935 - DNA, 20 bp, Artificial
  CRISPR gRNA sequence
cccgtatatcagcttgccgg

SEQ ID NO: 518936 - DNA, 20 bp, Artificial
  CRISPR gRNA sequence
gccggggacgtcgctggtgt

SEQ ID NO: 518937 - DNA, 20 bp, Artificial
  CRISPR gRNA sequence
ccggggacgtcgctggtgtg

SEQ ID NO: 518938 - DNA, 20 bp, Artificial
  CRISPR gRNA sequence
gtgtggcacaggcactgccc

SEQ ID NO: 518939 - DNA, 20 bp, Artificial
  CRISPR gRNA sequence
cccgcagacacagtccccca

SEQ ID NO: 518940 - DNA, 20 bp, Artificial
  CRISPR gRNA sequence
agcagatgatggagttgttg

SEQ ID NO: 518941 - DNA, 20 bp, Artificial
  CRISPR gRNA sequence
ttgtccttccggcagcttcc

SEQ ID NO: 518942 - DNA, 20 bp, Artificial
  CRISPR gRNA sequence
tccttccggcagcttccttc

SEQ ID NO: 518943 - DNA, 20 bp, Artificial
  CRISPR gRNA sequence
ccggcagcttccttccagct

SEQ ID NO: 518944 - DNA, 20 bp, Artificial
  CRISPR gRNA sequence
cggcagcttccttccagctc

SEQ ID NO: 518945 - DNA, 20 bp, Artificial
  CRISPR gRNA sequence
ccttccagctcctggctgct

SEQ ID NO: 518946 - DNA, 20 bp, Artificial
  CRISPR gRNA sequence
cttccagctcctggctgctc

SEQ ID NO: 518947 - DNA, 20 bp, Artificial
  CRISPR gRNA sequence
ccagctcctggctgctccgg

SEQ ID NO: 518948 - DNA, 20 bp, Artificial
  CRISPR gRNA sequence
cagctcctggctgctccggc

SEQ ID NO: 518949 - DNA, 20 bp, Artificial
  CRISPR gRNA sequence
ctggctgctccggccctgtg

SEQ ID NO: 518950 - DNA, 20 bp, Artificial
  CRISPR gRNA sequence
gctgctccggccctgtgtct

SEQ ID NO: 518951 - DNA, 20 bp, Artificial
  CRISPR gRNA sequence
ctccggccctgtgtctggca

SEQ ID NO: 518952 - DNA, 20 bp, Artificial
  CRISPR gRNA sequence
cggccctgtgtctggcactc

SEQ ID NO: 518953 - DNA, 20 bp, Artificial
  CRISPR gRNA sequence
tgtctggcactcacagtttt

SEQ ID NO: 518954 - DNA, 20 bp, Artificial
  CRISPR gRNA sequence
gcactcacagtttttcccaa

SEQ ID NO: 518955 - DNA, 20 bp, Artificial
  CRISPR gRNA sequence
acagtttttcccaatgtagc

SEQ ID NO: 518956 - DNA, 20 bp, Artificial
  CRISPR gRNA sequence
ttcccaatgtagccagtgtc

SEQ ID NO: 518957 - DNA, 20 bp, Artificial
  CRISPR gRNA sequence
tcccaatgtagccagtgtca

SEQ ID NO: 518958 - DNA, 20 bp, Artificial
  CRISPR gRNA sequence
cccaatgtagccagtgtcac

SEQ ID NO: 518959 - DNA, 20 bp, Artificial
  CRISPR gRNA sequence
ccaatgtagccagtgtcaca

SEQ ID NO: 518960 - DNA, 20 bp, Artificial
  CRISPR gRNA sequence
gggacaggaggggccccaag

SEQ ID NO: 518961 - DNA, 20 bp, Artificial
  CRISPR gRNA sequence
cccccagtgatgtgggacaa

SEQ ID NO: 518962 - DNA, 20 bp, Artificial
  CRISPR gRNA sequence
tcctccaggccccttgccct

SEQ ID NO: 518963 - DNA, 20 bp, Artificial
  CRISPR gRNA sequence
caggccccttgcccttggtg

SEQ ID NO: 518964 - DNA, 20 bp, Artificial
  CRISPR gRNA sequence
gcccttggtggagaacaccc

SEQ ID NO: 518965 - DNA, 20 bp, Artificial
  CRISPR gRNA sequence
cccttggtggagaacacccc

SEQ ID NO: 518966 - DNA, 20 bp, Artificial
  CRISPR gRNA sequence
ggtggagaacacccctatgg

SEQ ID NO: 518967 - DNA, 20 bp, Artificial
  CRISPR gRNA sequence
gtggagaacacccctatggc

SEQ ID NO: 518968 - DNA, 20 bp, Artificial
  CRISPR gRNA sequence
tggcacattttgctttcctc

SEQ ID NO: 518969 - DNA, 20 bp, Artificial
  CRISPR gRNA sequence
tgctttcctcgaggcctact

SEQ ID NO: 518970 - DNA, 20 bp, Artificial
  CRISPR gRNA sequence
gctttcctcgaggcctactg

SEQ ID NO: 518971 - DNA, 20 bp, Artificial
  CRISPR gRNA sequence
ctttcctcgaggcctactga

SEQ ID NO: 518972 - DNA, 20 bp, Artificial
  CRISPR gRNA sequence
tcctcgaggcctactgagca

SEQ ID NO: 518973 - DNA, 20 bp, Artificial
  CRISPR gRNA sequence
cctcgaggcctactgagcac

SEQ ID NO: 518974 - DNA, 20 bp, Artificial
  CRISPR gRNA sequence
ctcgaggcctactgagcact

SEQ ID NO: 518975 - DNA, 20 bp, Artificial
  CRISPR gRNA sequence
gaggcctactgagcacttgc

SEQ ID NO: 518976 - DNA, 20 bp, Artificial
  CRISPR gRNA sequence
ctgagcacttgccacggact

SEQ ID NO: 518977 - DNA, 20 bp, Artificial
  CRISPR gRNA sequence
agcacttgccacggactaaa

SEQ ID NO: 518978 - DNA, 20 bp, Artificial
  CRISPR gRNA sequence
gccacggactaaatgtgctc

SEQ ID NO: 518979 - DNA, 20 bp, Artificial
  CRISPR gRNA sequence
ccacggactaaatgtgctca

SEQ ID NO: 518980 - DNA, 20 bp, Artificial
  CRISPR gRNA sequence
aatgtgctcaaaacgtgcag

SEQ ID NO: 518981 - DNA, 20 bp, Artificial
  CRISPR gRNA sequence
aaaacgtgcaggggccccgc

SEQ ID NO: 518982 - DNA, 20 bp, Artificial
  CRISPR gRNA sequence
cctccccaggatgtcccgag

SEQ ID NO: 518983 - DNA, 20 bp, Artificial
  CRISPR gRNA sequence
cccaggatgtcccgagggga

SEQ ID NO: 518984 - DNA, 20 bp, Artificial
  CRISPR gRNA sequence
gccttggcctgcgcatgcag

SEQ ID NO: 518985 - DNA, 20 bp, Artificial
  CRISPR gRNA sequence
ggcctgcgcatgcagtggct

SEQ ID NO: 518986 - DNA, 20 bp, Artificial
  CRISPR gRNA sequence
gcctgcgcatgcagtggctc

SEQ ID NO: 518987 - DNA, 20 bp, Artificial
  CRISPR gRNA sequence
cgcatgcagtggctcggcag

SEQ ID NO: 518988 - DNA, 20 bp, Artificial
  CRISPR gRNA sequence
ggcaggctcactgtggagct

SEQ ID NO: 518989 - DNA, 20 bp, Artificial
  CRISPR gRNA sequence
actgtggagctgtgttgcag

SEQ ID NO: 518990 - DNA, 20 bp, Artificial
  CRISPR gRNA sequence
tggagctgtgttgcagccat

SEQ ID NO: 518991 - DNA, 20 bp, Artificial
  CRISPR gRNA sequence
tgttgcagccatgcacatgg

SEQ ID NO: 518992 - DNA, 20 bp, Artificial
  CRISPR gRNA sequence
cagccatgcacatggcctgt

SEQ ID NO: 518993 - DNA, 20 bp, Artificial
  CRISPR gRNA sequence
tgctgcgataccggtgctct

SEQ ID NO: 518994 - DNA, 20 bp, Artificial
  CRISPR gRNA sequence
cgataccggtgctctgtgag

SEQ ID NO: 518995 - DNA, 20 bp, Artificial
  CRISPR gRNA sequence
tgtgagtggctggtgtctgc

SEQ ID NO: 518996 - DNA, 20 bp, Artificial
  CRISPR gRNA sequence
tgagtggctggtgtctgctc

SEQ ID NO: 518997 - DNA, 20 bp, Artificial
  CRISPR gRNA sequence
gtgtctgctcctgcgtgccc

SEQ ID NO: 518998 - DNA, 20 bp, Artificial
  CRISPR gRNA sequence
ctcctgcgtgccccacatgg

SEQ ID NO: 518999 - DNA, 20 bp, Artificial
  CRISPR gRNA sequence
ctgcgtgccccacatggtgg

SEQ ID NO: 519000 - DNA, 20 bp, Artificial
  CRISPR gRNA sequence
cgtgccccacatggtggcca

SEQ ID NO: 519001 - DNA, 20 bp, Artificial
  CRISPR gRNA sequence
ggcactgcctcctgccacag

SEQ ID NO: 519002 - DNA, 20 bp, Artificial
  CRISPR gRNA sequence
cctcctgccacagccccgcc

SEQ ID NO: 519003 - DNA, 20 bp, Artificial
  CRISPR gRNA sequence
ctgccacagccccgccctcc

SEQ ID NO: 519004 - DNA, 20 bp, Artificial
  CRISPR gRNA sequence
ccacagccccgccctccctc

SEQ ID NO: 519005 - DNA, 20 bp, Artificial
  CRISPR gRNA sequence
cctcctgcgttcgtgcactg

SEQ ID NO: 519006 - DNA, 20 bp, Artificial
  CRISPR gRNA sequence
ctgcgttcgtgcactgacag

SEQ ID NO: 519007 - DNA, 20 bp, Artificial
  CRISPR gRNA sequence
cgttcgtgcactgacaggcc

SEQ ID NO: 519008 - DNA, 20 bp, Artificial
  CRISPR gRNA sequence
gtgcactgacaggccaggtt

SEQ ID NO: 519009 - DNA, 20 bp, Artificial
  CRISPR gRNA sequence
acaggccaggttgtgggaga

SEQ ID NO: 519010 - DNA, 20 bp, Artificial
  CRISPR gRNA sequence
tgggagaatgcagggacaag

SEQ ID NO: 519011 - DNA, 20 bp, Artificial
  CRISPR gRNA sequence
ttacagatgtggaagctggc

SEQ ID NO: 519012 - DNA, 20 bp, Artificial
  CRISPR gRNA sequence
tacagatgtggaagctggca

SEQ ID NO: 519013 - DNA, 20 bp, Artificial
  CRISPR gRNA sequence
acagatgtggaagctggcat

SEQ ID NO: 519014 - DNA, 20 bp, Artificial
  CRISPR gRNA sequence
cagatgtggaagctggcatc

SEQ ID NO: 519015 - DNA, 20 bp, Artificial
  CRISPR gRNA sequence
gcatcaagccgctggcaggc

SEQ ID NO: 519016 - DNA, 20 bp, Artificial
  CRISPR gRNA sequence
gcaggcaggagccacacaca

SEQ ID NO: 519017 - DNA, 20 bp, Artificial
  CRISPR gRNA sequence
aggcatcctcagagacggca

SEQ ID NO: 519018 - DNA, 20 bp, Artificial
  CRISPR gRNA sequence
agagacggcactgccacggg

SEQ ID NO: 519019 - DNA, 20 bp, Artificial
  CRISPR gRNA sequence
ccacgggctctcctgctccc

SEQ ID NO: 519020 - DNA, 20 bp, Artificial
  CRISPR gRNA sequence
tcctgctccccagaggagga

SEQ ID NO: 519021 - DNA, 20 bp, Artificial
  CRISPR gRNA sequence
ctgctccccagaggaggaag

SEQ ID NO: 519022 - DNA, 20 bp, Artificial
  CRISPR gRNA sequence
ctccccagaggaggaagctg

SEQ ID NO: 519023 - DNA, 20 bp, Artificial
  CRISPR gRNA sequence
cccagaggaggaagctgcag

SEQ ID NO: 519024 - DNA, 20 bp, Artificial
  CRISPR gRNA sequence
caggaccgagtgtctgagta

SEQ ID NO: 519025 - DNA, 20 bp, Artificial
  CRISPR gRNA sequence
agtacctgtggcagggcacc

SEQ ID NO: 519026 - DNA, 20 bp, Artificial
  CRISPR gRNA sequence
tggcagggcaccccccgaca

SEQ ID NO: 519027 - DNA, 20 bp, Artificial
  CRISPR gRNA sequence
ccaagtgttccgactgagtc

SEQ ID NO: 519028 - DNA, 20 bp, Artificial
  CRISPR gRNA sequence
cgactgagtcacccctacag

SEQ ID NO: 519029 - DNA, 20 bp, Artificial
  CRISPR gRNA sequence
agtcacccctacagtcccgt

SEQ ID NO: 519030 - DNA, 20 bp, Artificial
  CRISPR gRNA sequence
cagtcccgtgaagaggccgc

SEQ ID NO: 519031 - DNA, 20 bp, Artificial
  CRISPR gRNA sequence
cacacccaggacagtgggcg

SEQ ID NO: 519032 - DNA, 20 bp, Artificial
  CRISPR gRNA sequence
aggcacgaggacagcaacag

SEQ ID NO: 519033 - DNA, 20 bp, Artificial
  CRISPR gRNA sequence
tcctgagatatgggaggagg

SEQ ID NO: 519034 - DNA, 20 bp, Artificial
  CRISPR gRNA sequence
agatatgggaggaggctggg

SEQ ID NO: 519035 - DNA, 20 bp, Artificial
  CRISPR gRNA sequence
ggggcagcagggacctgaag

SEQ ID NO: 519036 - DNA, 20 bp, Artificial
  CRISPR gRNA sequence
aaggtgaggaagggcactgc

SEQ ID NO: 519037 - DNA, 20 bp, Artificial
  CRISPR gRNA sequence
ccaccaggacgtggattggc

SEQ ID NO: 519038 - DNA, 20 bp, Artificial
  CRISPR gRNA sequence
gcactgcggtcaggacaggg

SEQ ID NO: 519039 - DNA, 20 bp, Artificial
  CRISPR gRNA sequence
cggtcaggacaggggaggag

SEQ ID NO: 519040 - DNA, 20 bp, Artificial
  CRISPR gRNA sequence
ggaggtcagcctagcagctc

SEQ ID NO: 519041 - DNA, 20 bp, Artificial
  CRISPR gRNA sequence
gcagctctggccaggcaagc

SEQ ID NO: 519042 - DNA, 20 bp, Artificial
  CRISPR gRNA sequence
tggccaggcaagcaaggaaa

SEQ ID NO: 519043 - DNA, 20 bp, Artificial
  CRISPR gRNA sequence
gccaggcaagcaaggaaagg

SEQ ID NO: 519044 - DNA, 20 bp, Artificial
  CRISPR gRNA sequence
gctgagtgccatgtgaacct

SEQ ID NO: 519045 - DNA, 20 bp, Artificial
  CRISPR gRNA sequence
agtgccatgtgaacctcccc

SEQ ID NO: 519046 - DNA, 20 bp, Artificial
  CRISPR gRNA sequence
cccactgggtccacctgtcc

SEQ ID NO: 519047 - DNA, 20 bp, Artificial
  CRISPR gRNA sequence
ggtccacctgtcccccactt

SEQ ID NO: 519048 - DNA, 20 bp, Artificial
  CRISPR gRNA sequence
tcccccacttctccctgagg

SEQ ID NO: 519049 - DNA, 20 bp, Artificial
  CRISPR gRNA sequence
ctccctgaggtggggtgccc

SEQ ID NO: 519050 - DNA, 20 bp, Artificial
  CRISPR gRNA sequence
tccctgaggtggggtgccca

SEQ ID NO: 519051 - DNA, 20 bp, Artificial
  CRISPR gRNA sequence
cctgaggtggggtgcccacg

SEQ ID NO: 519052 - DNA, 20 bp, Artificial
  CRISPR gRNA sequence
aggtggggtgcccacgcctg

SEQ ID NO: 519053 - DNA, 20 bp, Artificial
  CRISPR gRNA sequence
gcagggggtgtgcacgccca

SEQ ID NO: 519054 - DNA, 20 bp, Artificial
  CRISPR gRNA sequence
tggggcccaggctcccagaa

SEQ ID NO: 519055 - DNA, 20 bp, Artificial
  CRISPR gRNA sequence
ccagaagccatcacctgtcc

SEQ ID NO: 519056 - DNA, 20 bp, Artificial
  CRISPR gRNA sequence
tcccaggaggctctctagcc

SEQ ID NO: 519057 - DNA, 20 bp, Artificial
  CRISPR gRNA sequence
tctagccacccatgccccag

SEQ ID NO: 519058 - DNA, 20 bp, Artificial
  CRISPR gRNA sequence
tagccacccatgccccaggg

SEQ ID NO: 519059 - DNA, 20 bp, Artificial
  CRISPR gRNA sequence
gccacccatgccccagggct

SEQ ID NO: 519060 - DNA, 20 bp, Artificial
  CRISPR gRNA sequence
ccagcctgatggccttgggt

SEQ ID NO: 519061 - DNA, 20 bp, Artificial
  CRISPR gRNA sequence
atggccttgggtccccaagg

SEQ ID NO: 519062 - DNA, 20 bp, Artificial
  CRISPR gRNA sequence
gggtccccaaggtcagagag

SEQ ID NO: 519063 - DNA, 20 bp, Artificial
  CRISPR gRNA sequence
ggtccccaaggtcagagaga

SEQ ID NO: 519064 - DNA, 20 bp, Artificial
  CRISPR gRNA sequence
ctagggtcaaggaaggtcgg

SEQ ID NO: 519065 - DNA, 20 bp, Artificial
  CRISPR gRNA sequence
gggtcaaggaaggtcgggca

SEQ ID NO: 519066 - DNA, 20 bp, Artificial
  CRISPR gRNA sequence
aaggccatgggcacgcccag

SEQ ID NO: 519067 - DNA, 20 bp, Artificial
  CRISPR gRNA sequence
cttgtgcccctgagatgggc

SEQ ID NO: 519068 - DNA, 20 bp, Artificial
  CRISPR gRNA sequence
gtgcccctgagatgggcctc

SEQ ID NO: 519069 - DNA, 20 bp, Artificial
  CRISPR gRNA sequence
tgcccctgagatgggcctcc

SEQ ID NO: 519070 - DNA, 20 bp, Artificial
  CRISPR gRNA sequence
agatgggcctccatcctctg

SEQ ID NO: 519071 - DNA, 20 bp, Artificial
  CRISPR gRNA sequence
catcctctggtgagggggtc

SEQ ID NO: 519072 - DNA, 20 bp, Artificial
  CRISPR gRNA sequence
tggtgagggggtcctcctgc

SEQ ID NO: 519073 - DNA, 20 bp, Artificial
  CRISPR gRNA sequence
gtgagggggtcctcctgccc

SEQ ID NO: 519074 - DNA, 20 bp, Artificial
  CRISPR gRNA sequence
ctgcccacaagtcccctgcc

SEQ ID NO: 519075 - DNA, 20 bp, Artificial
  CRISPR gRNA sequence
cccacaagtcccctgccttg

SEQ ID NO: 519076 - DNA, 20 bp, Artificial
  CRISPR gRNA sequence
ccttgggtcctccatggcca

SEQ ID NO: 519077 - DNA, 20 bp, Artificial
  CRISPR gRNA sequence
gggtcctccatggccagaga

SEQ ID NO: 519078 - DNA, 20 bp, Artificial
  CRISPR gRNA sequence
ggtcctccatggccagagag

SEQ ID NO: 519079 - DNA, 20 bp, Artificial
  CRISPR gRNA sequence
catggccagagagtgtagag

SEQ ID NO: 519080 - DNA, 20 bp, Artificial
  CRISPR gRNA sequence
gcattgctggtgccctggct

SEQ ID NO: 519081 - DNA, 20 bp, Artificial
  CRISPR gRNA sequence
ctggtgccctggctcaggag

SEQ ID NO: 519082 - DNA, 20 bp, Artificial
  CRISPR gRNA sequence
gtgccctggctcaggagcac

SEQ ID NO: 519083 - DNA, 20 bp, Artificial
  CRISPR gRNA sequence
gctcaggagcacgggtgagg

SEQ ID NO: 519084 - DNA, 20 bp, Artificial
  CRISPR gRNA sequence
aggagcacgggtgagggctt

SEQ ID NO: 519085 - DNA, 20 bp, Artificial
  CRISPR gRNA sequence
gccgaggggttctgggttcc

SEQ ID NO: 519086 - DNA, 20 bp, Artificial
  CRISPR gRNA sequence
ccgaggggttctgggttcca

SEQ ID NO: 519087 - DNA, 20 bp, Artificial
  CRISPR gRNA sequence
tgggttccaatcccaaatct

SEQ ID NO: 519088 - DNA, 20 bp, Artificial
  CRISPR gRNA sequence
ggttccaatcccaaatctcc

SEQ ID NO: 519089 - DNA, 20 bp, Artificial
  CRISPR gRNA sequence
caatcccaaatctccccacc

SEQ ID NO: 519090 - DNA, 20 bp, Artificial
  CRISPR gRNA sequence
cccacctcctgcagaagggg

SEQ ID NO: 519091 - DNA, 20 bp, Artificial
  CRISPR gRNA sequence
ctgcagaagggggcccccag

SEQ ID NO: 519092 - DNA, 20 bp, Artificial
  CRISPR gRNA sequence
cagaagggggcccccaggat

SEQ ID NO: 519093 - DNA, 20 bp, Artificial
  CRISPR gRNA sequence
ctccgtggggtgggggaagg

SEQ ID NO: 519094 - DNA, 20 bp, Artificial
  CRISPR gRNA sequence
cgtggggtgggggaagggat

SEQ ID NO: 519095 - DNA, 20 bp, Artificial
  CRISPR gRNA sequence
cacccacctcacctgccgac

SEQ ID NO: 519096 - DNA, 20 bp, Artificial
  CRISPR gRNA sequence
acctgccgacacctgccctg

SEQ ID NO: 519097 - DNA, 20 bp, Artificial
  CRISPR gRNA sequence
ccgacacctgccctgtgggg

SEQ ID NO: 519098 - DNA, 20 bp, Artificial
  CRISPR gRNA sequence
ccctgtggggtggggctcgg

SEQ ID NO: 519099 - DNA, 20 bp, Artificial
  CRISPR gRNA sequence
tggggtggggctcggggatg

SEQ ID NO: 519100 - DNA, 20 bp, Artificial
  CRISPR gRNA sequence
ggggatggttcaacagggac

SEQ ID NO: 519101 - DNA, 20 bp, Artificial
  CRISPR gRNA sequence
aacagggacctgcgcccgcc

SEQ ID NO: 519102 - DNA, 20 bp, Artificial
  CRISPR gRNA sequence
cgcccgcctcacctgcagat

SEQ ID NO: 519103 - DNA, 20 bp, Artificial
  CRISPR gRNA sequence
acctgcagatgccgcactcc

SEQ ID NO: 519104 - DNA, 20 bp, Artificial
  CRISPR gRNA sequence
cagatgccgcactccaagaa

SEQ ID NO: 519105 - DNA, 20 bp, Artificial
  CRISPR gRNA sequence
caagaagcccttgccatggc

SEQ ID NO: 519106 - DNA, 20 bp, Artificial
  CRISPR gRNA sequence
gccatggcagaggctgcggt

SEQ ID NO: 519107 - DNA, 20 bp, Artificial
  CRISPR gRNA sequence
ccatggcagaggctgcggtc

SEQ ID NO: 519108 - DNA, 20 bp, Artificial
  CRISPR gRNA sequence
cggtctctgctctggtcccg

SEQ ID NO: 519109 - DNA, 20 bp, Artificial
  CRISPR gRNA sequence
tgctctggtcccggcaccgg

SEQ ID NO: 519110 - DNA, 20 bp, Artificial
  CRISPR gRNA sequence
ctctggtcccggcaccggca

SEQ ID NO: 519111 - DNA, 20 bp, Artificial
  CRISPR gRNA sequence
tggtcccggcaccggcactc

SEQ ID NO: 519112 - DNA, 20 bp, Artificial
  CRISPR gRNA sequence
gtcccggcaccggcactcac

SEQ ID NO: 519113 - DNA, 20 bp, Artificial
  CRISPR gRNA sequence
acactggggaagaacctgca

SEQ ID NO: 519114 - DNA, 20 bp, Artificial
  CRISPR gRNA sequence
gggaagaacctgcacggtca

SEQ ID NO: 519115 - DNA, 20 bp, Artificial
  CRISPR gRNA sequence
cacggtcactatgtccgtga

SEQ ID NO: 519116 - DNA, 20 bp, Artificial
  CRISPR gRNA sequence
tgtccgtgaagcccagcgcc

SEQ ID NO: 519117 - DNA, 20 bp, Artificial
  CRISPR gRNA sequence
ctcctggatgcactctgtgg

SEQ ID NO: 519118 - DNA, 20 bp, Artificial
  CRISPR gRNA sequence
ctggatgcactctgtggccg

SEQ ID NO: 519119 - DNA, 20 bp, Artificial
  CRISPR gRNA sequence
gatgcactctgtggccgtga

SEQ ID NO: 519120 - DNA, 20 bp, Artificial
  CRISPR gRNA sequence
tgtggccgtgaccttcacct

SEQ ID NO: 519121 - DNA, 20 bp, Artificial
  CRISPR gRNA sequence
tggccgtgaccttcacctgg

SEQ ID NO: 519122 - DNA, 20 bp, Artificial
  CRISPR gRNA sequence
cacctggaaggtgatctgca

SEQ ID NO: 519123 - DNA, 20 bp, Artificial
  CRISPR gRNA sequence
acctggaaggtgatctgcag

SEQ ID NO: 519124 - DNA, 20 bp, Artificial
  CRISPR gRNA sequence
gaaggtgatctgcagggcag

SEQ ID NO: 519125 - DNA, 20 bp, Artificial
  CRISPR gRNA sequence
cagggcagtgctgggctcag

SEQ ID NO: 519126 - DNA, 20 bp, Artificial
  CRISPR gRNA sequence
ggctcaggtggggaccctcg

SEQ ID NO: 519127 - DNA, 20 bp, Artificial
  CRISPR gRNA sequence
aggtggggaccctcggtggc

SEQ ID NO: 519128 - DNA, 20 bp, Artificial
  CRISPR gRNA sequence
ggtggccagggtggcagccc

SEQ ID NO: 519129 - DNA, 20 bp, Artificial
  CRISPR gRNA sequence
ccaaccctcacctcctggcc

SEQ ID NO: 519130 - DNA, 20 bp, Artificial
  CRISPR gRNA sequence
acctcctggcctctgcaggg

SEQ ID NO: 519131 - DNA, 20 bp, Artificial
  CRISPR gRNA sequence
ctggcctctgcaggggtcct

SEQ ID NO: 519132 - DNA, 20 bp, Artificial
  CRISPR gRNA sequence
gcctctgcaggggtcctggg

SEQ ID NO: 519133 - DNA, 20 bp, Artificial
  CRISPR gRNA sequence
tgcaggggtcctggggggtt

SEQ ID NO: 519134 - DNA, 20 bp, Artificial
  CRISPR gRNA sequence
caggggtcctggggggttca

SEQ ID NO: 519135 - DNA, 20 bp, Artificial
  CRISPR gRNA sequence
gggggttcagcgtggggagg

SEQ ID NO: 519136 - DNA, 20 bp, Artificial
  CRISPR gRNA sequence
agcgtggggaggaaggggtg

SEQ ID NO: 519137 - DNA, 20 bp, Artificial
  CRISPR gRNA sequence
atgctcagatccgagagcca

SEQ ID NO: 519138 - DNA, 20 bp, Artificial
  CRISPR gRNA sequence
agatccgagagccaaagtca

SEQ ID NO: 519139 - DNA, 20 bp, Artificial
  CRISPR gRNA sequence
tgcccgcactcccgcactgg

SEQ ID NO: 519140 - DNA, 20 bp, Artificial
  CRISPR gRNA sequence
cccgcactcccgcactggcc

SEQ ID NO: 519141 - DNA, 20 bp, Artificial
  CRISPR gRNA sequence
ccgcactggccggcaccagg

SEQ ID NO: 519142 - DNA, 20 bp, Artificial
  CRISPR gRNA sequence
gccggcaccaggatctcccc

SEQ ID NO: 519143 - DNA, 20 bp, Artificial
  CRISPR gRNA sequence
cccggccacacatcagcaga

SEQ ID NO: 519144 - DNA, 20 bp, Artificial
  CRISPR gRNA sequence
agcacactcccactcagacc

SEQ ID NO: 519145 - DNA, 20 bp, Artificial
  CRISPR gRNA sequence
ccactcagaccacccaacat

SEQ ID NO: 519146 - DNA, 20 bp, Artificial
  CRISPR gRNA sequence
agaccacccaacatgaggga

SEQ ID NO: 519147 - DNA, 20 bp, Artificial
  CRISPR gRNA sequence
tggtgagaatccatgggaca

SEQ ID NO: 519148 - DNA, 20 bp, Artificial
  CRISPR gRNA sequence
gtgagaatccatgggacagc

SEQ ID NO: 519149 - DNA, 20 bp, Artificial
  CRISPR gRNA sequence
ggcgccgcggctcacgcctg

SEQ ID NO: 519150 - DNA, 20 bp, Artificial
  CRISPR gRNA sequence
acgcctgtaatcccagcact

SEQ ID NO: 519151 - DNA, 20 bp, Artificial
  CRISPR gRNA sequence
taatcccagcactgtgggag

SEQ ID NO: 519152 - DNA, 20 bp, Artificial
  CRISPR gRNA sequence
tgggaggccgaggcgggtag

SEQ ID NO: 519153 - DNA, 20 bp, Artificial
  CRISPR gRNA sequence
agggcaagagtttgagacca

SEQ ID NO: 519154 - DNA, 20 bp, Artificial
  CRISPR gRNA sequence
gagaccagcctggccaacat

SEQ ID NO: 519155 - DNA, 20 bp, Artificial
  CRISPR gRNA sequence
agaccagcctggccaacatg

SEQ ID NO: 519156 - DNA, 20 bp, Artificial
  CRISPR gRNA sequence
gccaacatggcgaaactctg

SEQ ID NO: 519157 - DNA, 20 bp, Artificial
  CRISPR gRNA sequence
tgtctctactaaaaatacaa

SEQ ID NO: 519158 - DNA, 20 bp, Artificial
  CRISPR gRNA sequence
tctctactaaaaatacaaaa

SEQ ID NO: 519159 - DNA, 20 bp, Artificial
  CRISPR gRNA sequence
tactaaaaatacaaaaatta

SEQ ID NO: 519160 - DNA, 20 bp, Artificial
  CRISPR gRNA sequence
ctaaaaatacaaaaattagc

SEQ ID NO: 519161 - DNA, 20 bp, Artificial
  CRISPR gRNA sequence
aaaatacaaaaattagccga

SEQ ID NO: 519162 - DNA, 20 bp, Artificial
  CRISPR gRNA sequence
gccgagcgtggtggcacacg

SEQ ID NO: 519163 - DNA, 20 bp, Artificial
  CRISPR gRNA sequence
tagtcccagctactcaggag

SEQ ID NO: 519164 - DNA, 20 bp, Artificial
  CRISPR gRNA sequence
ctcaggaggctgagtcagga

SEQ ID NO: 519165 - DNA, 20 bp, Artificial
  CRISPR gRNA sequence
aggaggctgagtcaggagaa

SEQ ID NO: 519166 - DNA, 20 bp, Artificial
  CRISPR gRNA sequence
agtcaggagaatcacttgga

SEQ ID NO: 519167 - DNA, 20 bp, Artificial
  CRISPR gRNA sequence
ggattgtagtgagccaagat

SEQ ID NO: 519168 - DNA, 20 bp, Artificial
  CRISPR gRNA sequence
gattgtagtgagccaagatc

SEQ ID NO: 519169 - DNA, 20 bp, Artificial
  CRISPR gRNA sequence
tagtgagccaagatcgcacc

SEQ ID NO: 519170 - DNA, 20 bp, Artificial
  CRISPR gRNA sequence
cagcctgggcgacagagcga

SEQ ID NO: 519171 - DNA, 20 bp, Artificial
  CRISPR gRNA sequence
ggcgacagagcgaaactcca

SEQ ID NO: 519172 - DNA, 20 bp, Artificial
  CRISPR gRNA sequence
catctcaaaaaaaaaaaaaa

SEQ ID NO: 519173 - DNA, 20 bp, Artificial
  CRISPR gRNA sequence
aaaaaaaaaaaaaaaaaaaa

SEQ ID NO: 519174 - DNA, 20 bp, Artificial
  CRISPR gRNA sequence
accaagaaacatgtttgaag

SEQ ID NO: 519175 - DNA, 20 bp, Artificial
  CRISPR gRNA sequence
ccaagaaacatgtttgaagg

SEQ ID NO: 519176 - DNA, 20 bp, Artificial
  CRISPR gRNA sequence
gaaggaattccaaagtcata

SEQ ID NO: 519177 - DNA, 20 bp, Artificial
  CRISPR gRNA sequence
aaggaattccaaagtcatat

SEQ ID NO: 519178 - DNA, 20 bp, Artificial
  CRISPR gRNA sequence
caaagtcatattaagaaaat

SEQ ID NO: 519179 - DNA, 20 bp, Artificial
  CRISPR gRNA sequence
agaaaatgcaatgaaagcaa

SEQ ID NO: 519180 - DNA, 20 bp, Artificial
  CRISPR gRNA sequence
gctgaatattatttcacagc

SEQ ID NO: 519181 - DNA, 20 bp, Artificial
  CRISPR gRNA sequence
ctgaatattatttcacagct

SEQ ID NO: 519182 - DNA, 20 bp, Artificial
  CRISPR gRNA sequence
aatattatttcacagctagc

SEQ ID NO: 519183 - DNA, 20 bp, Artificial
  CRISPR gRNA sequence
tttcacagctagcaaaaaaa

SEQ ID NO: 519184 - DNA, 20 bp, Artificial
  CRISPR gRNA sequence
cacagctagcaaaaaaaaaa

SEQ ID NO: 519185 - DNA, 20 bp, Artificial
  CRISPR gRNA sequence
acagctagcaaaaaaaaaaa

SEQ ID NO: 519186 - DNA, 20 bp, Artificial
  CRISPR gRNA sequence
gcaaaaaaaaaaacaaaaaa

SEQ ID NO: 519187 - DNA, 20 bp, Artificial
  CRISPR gRNA sequence
gataataaacttaaacctga

SEQ ID NO: 519188 - DNA, 20 bp, Artificial
  CRISPR gRNA sequence
aaacctgaaagattagagaa

SEQ ID NO: 519189 - DNA, 20 bp, Artificial
  CRISPR gRNA sequence
aacctgaaagattagagaag

SEQ ID NO: 519190 - DNA, 20 bp, Artificial
  CRISPR gRNA sequence
aaagattagagaaggaactc

SEQ ID NO: 519191 - DNA, 20 bp, Artificial
  CRISPR gRNA sequence
gagaaggaactcagtgtcca

SEQ ID NO: 519192 - DNA, 20 bp, Artificial
  CRISPR gRNA sequence
agtgtccattcctaaccacc

SEQ ID NO: 519193 - DNA, 20 bp, Artificial
  CRISPR gRNA sequence
ctaaccacctgtgtggccca

SEQ ID NO: 519194 - DNA, 20 bp, Artificial
  CRISPR gRNA sequence
accacctgtgtggcccatgc

SEQ ID NO: 519195 - DNA, 20 bp, Artificial
  CRISPR gRNA sequence
tgtggcccatgccttaatgt

SEQ ID NO: 519196 - DNA, 20 bp, Artificial
  CRISPR gRNA sequence
aatgtttctgtcaaaaaaac

SEQ ID NO: 519197 - DNA, 20 bp, Artificial
  CRISPR gRNA sequence
atgtttctgtcaaaaaaaca

SEQ ID NO: 519198 - DNA, 20 bp, Artificial
  CRISPR gRNA sequence
ctgtcaaaaaaacagaatga

SEQ ID NO: 519199 - DNA, 20 bp, Artificial
  CRISPR gRNA sequence
tgtcaaaaaaacagaatgaa

SEQ ID NO: 519200 - DNA, 20 bp, Artificial
  CRISPR gRNA sequence
tcaaaaaaacagaatgaaac

SEQ ID NO: 519201 - DNA, 20 bp, Artificial
  CRISPR gRNA sequence
accctacccaggtttgccgt

SEQ ID NO: 519202 - DNA, 20 bp, Artificial
  CRISPR gRNA sequence
cccaggtttgccgtttgcgc

SEQ ID NO: 519203 - DNA, 20 bp, Artificial
  CRISPR gRNA sequence
gccgtttgcgcctgttctgt

SEQ ID NO: 519204 - DNA, 20 bp, Artificial
  CRISPR gRNA sequence
ccgtttgcgcctgttctgtg

SEQ ID NO: 519205 - DNA, 20 bp, Artificial
  CRISPR gRNA sequence
gcgcctgttctgtgtgtccg

SEQ ID NO: 519206 - DNA, 20 bp, Artificial
  CRISPR gRNA sequence
cgcctgttctgtgtgtccgg

SEQ ID NO: 519207 - DNA, 20 bp, Artificial
  CRISPR gRNA sequence
ttctgtgtgtccggcgtctg

SEQ ID NO: 519208 - DNA, 20 bp, Artificial
  CRISPR gRNA sequence
tgtgtgtccggcgtctgccc

SEQ ID NO: 519209 - DNA, 20 bp, Artificial
  CRISPR gRNA sequence
tgtgtccggcgtctgccccc

SEQ ID NO: 519210 - DNA, 20 bp, Artificial
  CRISPR gRNA sequence
cccccagggggcgcagccat

SEQ ID NO: 519211 - DNA, 20 bp, Artificial
  CRISPR gRNA sequence
catccctcagtctgcagtgg

SEQ ID NO: 519212 - DNA, 20 bp, Artificial
  CRISPR gRNA sequence
agtctgcagtggcctgaccc

SEQ ID NO: 519213 - DNA, 20 bp, Artificial
  CRISPR gRNA sequence
cagtggcctgacccagggat

SEQ ID NO: 519214 - DNA, 20 bp, Artificial
  CRISPR gRNA sequence
acccagggatttgggctcca

SEQ ID NO: 519215 - DNA, 20 bp, Artificial
  CRISPR gRNA sequence
gggctccaggttgatgagta

SEQ ID NO: 519216 - DNA, 20 bp, Artificial
  CRISPR gRNA sequence
ggctccaggttgatgagtag

SEQ ID NO: 519217 - DNA, 20 bp, Artificial
  CRISPR gRNA sequence
caggttgatgagtaggactc

SEQ ID NO: 519218 - DNA, 20 bp, Artificial
  CRISPR gRNA sequence
atgagtaggactcttggggg

SEQ ID NO: 519219 - DNA, 20 bp, Artificial
  CRISPR gRNA sequence
ttgggggccaaggcgtgtgt

SEQ ID NO: 519220 - DNA, 20 bp, Artificial
  CRISPR gRNA sequence
gggggccaaggcgtgtgtga

SEQ ID NO: 519221 - DNA, 20 bp, Artificial
  CRISPR gRNA sequence
ggggccaaggcgtgtgtgaa

SEQ ID NO: 519222 - DNA, 20 bp, Artificial
  CRISPR gRNA sequence
ccagcaccctctcactgaga

SEQ ID NO: 519223 - DNA, 20 bp, Artificial
  CRISPR gRNA sequence
tcactgagaagcaccctctc

SEQ ID NO: 519224 - DNA, 20 bp, Artificial
  CRISPR gRNA sequence
actgagaagcaccctctcgg

SEQ ID NO: 519225 - DNA, 20 bp, Artificial
  CRISPR gRNA sequence
agaagcaccctctcggcacc

SEQ ID NO: 519226 - DNA, 20 bp, Artificial
  CRISPR gRNA sequence
tcggcaccctctcactgacg

SEQ ID NO: 519227 - DNA, 20 bp, Artificial
  CRISPR gRNA sequence
ggcaccctctcactgacgtt

SEQ ID NO: 519228 - DNA, 20 bp, Artificial
  CRISPR gRNA sequence
tcactgacgttcctgacatc

SEQ ID NO: 519229 - DNA, 20 bp, Artificial
  CRISPR gRNA sequence
actgacgttcctgacatcag

SEQ ID NO: 519230 - DNA, 20 bp, Artificial
  CRISPR gRNA sequence
acgttcctgacatcagcttc

SEQ ID NO: 519231 - DNA, 20 bp, Artificial
  CRISPR gRNA sequence
ctgacatcagcttcacaagg

SEQ ID NO: 519232 - DNA, 20 bp, Artificial
  CRISPR gRNA sequence
acatcagcttcacaaggaaa

SEQ ID NO: 519233 - DNA, 20 bp, Artificial
  CRISPR gRNA sequence
cacaaggaaagcgtctggcc

SEQ ID NO: 519234 - DNA, 20 bp, Artificial
  CRISPR gRNA sequence
acaaggaaagcgtctggcct

SEQ ID NO: 519235 - DNA, 20 bp, Artificial
  CRISPR gRNA sequence
gcctcggcagagaggatgtg

SEQ ID NO: 519236 - DNA, 20 bp, Artificial
  CRISPR gRNA sequence
ggcagagaggatgtgaagga

SEQ ID NO: 519237 - DNA, 20 bp, Artificial
  CRISPR gRNA sequence
ccagtggatgctgcctgctc

SEQ ID NO: 519238 - DNA, 20 bp, Artificial
  CRISPR gRNA sequence
cagtggatgctgcctgctcc

SEQ ID NO: 519239 - DNA, 20 bp, Artificial
  CRISPR gRNA sequence
cctgctcccagacagcctct

SEQ ID NO: 519240 - DNA, 20 bp, Artificial
  CRISPR gRNA sequence
ctcccagacagcctctgatg

SEQ ID NO: 519241 - DNA, 20 bp, Artificial
  CRISPR gRNA sequence
ccagacagcctctgatgcct

SEQ ID NO: 519242 - DNA, 20 bp, Artificial
  CRISPR gRNA sequence
tgatgcctgtgtgcccctcc

SEQ ID NO: 519243 - DNA, 20 bp, Artificial
  CRISPR gRNA sequence
atgcctgtgtgcccctccct

SEQ ID NO: 519244 - DNA, 20 bp, Artificial
  CRISPR gRNA sequence
tgtgcccctccctgcccccg

SEQ ID NO: 519245 - DNA, 20 bp, Artificial
  CRISPR gRNA sequence
cctgcccccgtcagagtgct

SEQ ID NO: 519246 - DNA, 20 bp, Artificial
  CRISPR gRNA sequence
cccccgtcagagtgctggga

SEQ ID NO: 519247 - DNA, 20 bp, Artificial
  CRISPR gRNA sequence
ggatggggaccctggctcct

SEQ ID NO: 519248 - DNA, 20 bp, Artificial
  CRISPR gRNA sequence
gctccttctggctgtcccca

SEQ ID NO: 519249 - DNA, 20 bp, Artificial
  CRISPR gRNA sequence
cttctggctgtccccaggac

SEQ ID NO: 519250 - DNA, 20 bp, Artificial
  CRISPR gRNA sequence
ctggctgtccccaggacccc

SEQ ID NO: 519251 - DNA, 20 bp, Artificial
  CRISPR gRNA sequence
tggctgtccccaggacccct

SEQ ID NO: 519252 - DNA, 20 bp, Artificial
  CRISPR gRNA sequence
gctgtccccaggacccctca

SEQ ID NO: 519253 - DNA, 20 bp, Artificial
  CRISPR gRNA sequence
tccccaggacccctcagtgt

SEQ ID NO: 519254 - DNA, 20 bp, Artificial
  CRISPR gRNA sequence
agtgtgctgggatggggacc

SEQ ID NO: 519255 - DNA, 20 bp, Artificial
  CRISPR gRNA sequence
ggatggggaccctggctcct

SEQ ID NO: 519256 - DNA, 20 bp, Artificial
  CRISPR gRNA sequence
gctccttctggctgtcccca

SEQ ID NO: 519257 - DNA, 20 bp, Artificial
  CRISPR gRNA sequence
cttctggctgtccccagagc

SEQ ID NO: 519258 - DNA, 20 bp, Artificial
  CRISPR gRNA sequence
ctggctgtccccagagcccc

SEQ ID NO: 519259 - DNA, 20 bp, Artificial
  CRISPR gRNA sequence
tggctgtccccagagcccct

SEQ ID NO: 519260 - DNA, 20 bp, Artificial
  CRISPR gRNA sequence
gctgtccccagagcccctca

SEQ ID NO: 519261 - DNA, 20 bp, Artificial
  CRISPR gRNA sequence
tccccagagcccctcagcaa

SEQ ID NO: 519262 - DNA, 20 bp, Artificial
  CRISPR gRNA sequence
agcaagctgggatggggacc

SEQ ID NO: 519263 - DNA, 20 bp, Artificial
  CRISPR gRNA sequence
ggatggggacccttgtggcc

SEQ ID NO: 519264 - DNA, 20 bp, Artificial
  CRISPR gRNA sequence
gtggccaggctcaccgggac

SEQ ID NO: 519265 - DNA, 20 bp, Artificial
  CRISPR gRNA sequence
tggccaggctcaccgggaca

SEQ ID NO: 519266 - DNA, 20 bp, Artificial
  CRISPR gRNA sequence
accgggacattgatctgcac

SEQ ID NO: 519267 - DNA, 20 bp, Artificial
  CRISPR gRNA sequence
atctgcacgccatcacagtc

SEQ ID NO: 519268 - DNA, 20 bp, Artificial
  CRISPR gRNA sequence
cacgccatcacagtcacctc

SEQ ID NO: 519269 - DNA, 20 bp, Artificial
  CRISPR gRNA sequence
tgggctggttcctgtgcgtc

SEQ ID NO: 519270 - DNA, 20 bp, Artificial
  CRISPR gRNA sequence
ggctggttcctgtgcgtcac

SEQ ID NO: 519271 - DNA, 20 bp, Artificial
  CRISPR gRNA sequence
gttcctgtgcgtcactccat

SEQ ID NO: 519272 - DNA, 20 bp, Artificial
  CRISPR gRNA sequence
ctgtgcgtcactccattgct

SEQ ID NO: 519273 - DNA, 20 bp, Artificial
  CRISPR gRNA sequence
tgcgtcactccattgctgca

SEQ ID NO: 519274 - DNA, 20 bp, Artificial
  CRISPR gRNA sequence
cattgctgcagaaggagtcg

SEQ ID NO: 519275 - DNA, 20 bp, Artificial
  CRISPR gRNA sequence
ctgcagaaggagtcgtaggt

SEQ ID NO: 519276 - DNA, 20 bp, Artificial
  CRISPR gRNA sequence
cagaaggagtcgtaggtgac

SEQ ID NO: 519277 - DNA, 20 bp, Artificial
  CRISPR gRNA sequence
tcagggtgtcggggagggcg

SEQ ID NO: 519278 - DNA, 20 bp, Artificial
  CRISPR gRNA sequence
cagggtgtcggggagggcgt

SEQ ID NO: 519279 - DNA, 20 bp, Artificial
  CRISPR gRNA sequence
agggtgtcggggagggcgtt

SEQ ID NO: 519280 - DNA, 20 bp, Artificial
  CRISPR gRNA sequence
tgatccaggaagaccctgga

SEQ ID NO: 519281 - DNA, 20 bp, Artificial
  CRISPR gRNA sequence
gaggagagtttctgcgggca

SEQ ID NO: 519282 - DNA, 20 bp, Artificial
  CRISPR gRNA sequence
ctgcgggcagagagcggtta

SEQ ID NO: 519283 - DNA, 20 bp, Artificial
  CRISPR gRNA sequence
tgcgggcagagagcggttac

SEQ ID NO: 519284 - DNA, 20 bp, Artificial
  CRISPR gRNA sequence
cgggcagagagcggttactc

SEQ ID NO: 519285 - DNA, 20 bp, Artificial
  CRISPR gRNA sequence
ctcttgggggcgagtgtttc

SEQ ID NO: 519286 - DNA, 20 bp, Artificial
  CRISPR gRNA sequence
ttgggggcgagtgtttctgt

SEQ ID NO: 519287 - DNA, 20 bp, Artificial
  CRISPR gRNA sequence
gggggcgagtgtttctgttg

SEQ ID NO: 519288 - DNA, 20 bp, Artificial
  CRISPR gRNA sequence
ggggcgagtgtttctgttgt

SEQ ID NO: 519289 - DNA, 20 bp, Artificial
  CRISPR gRNA sequence
ctgttgtcctggccctgcct

SEQ ID NO: 519290 - DNA, 20 bp, Artificial
  CRISPR gRNA sequence
tgttgtcctggccctgcctg

SEQ ID NO: 519291 - DNA, 20 bp, Artificial
  CRISPR gRNA sequence
ttgtcctggccctgcctggc

SEQ ID NO: 519292 - DNA, 20 bp, Artificial
  CRISPR gRNA sequence
tcctggccctgcctggccca

SEQ ID NO: 519293 - DNA, 20 bp, Artificial
  CRISPR gRNA sequence
gccctgcctggcccagcggt

SEQ ID NO: 519294 - DNA, 20 bp, Artificial
  CRISPR gRNA sequence
cctggcccagcggtttagac

SEQ ID NO: 519295 - DNA, 20 bp, Artificial
  CRISPR gRNA sequence
gcccagcggtttagacccgt

SEQ ID NO: 519296 - DNA, 20 bp, Artificial
  CRISPR gRNA sequence
agacccgtctccacttctcc

SEQ ID NO: 519297 - DNA, 20 bp, Artificial
  CRISPR gRNA sequence
gacccgtctccacttctcct

SEQ ID NO: 519298 - DNA, 20 bp, Artificial
  CRISPR gRNA sequence
cacttctcctctcagtgcaa

SEQ ID NO: 519299 - DNA, 20 bp, Artificial
  CRISPR gRNA sequence
ctcctctcagtgcaagtccc

SEQ ID NO: 519300 - DNA, 20 bp, Artificial
  CRISPR gRNA sequence
tcctctcagtgcaagtcccc

SEQ ID NO: 519301 - DNA, 20 bp, Artificial
  CRISPR gRNA sequence
ctctcagtgcaagtccccag

SEQ ID NO: 519302 - DNA, 20 bp, Artificial
  CRISPR gRNA sequence
tcagtgcaagtccccagtgt

SEQ ID NO: 519303 - DNA, 20 bp, Artificial
  CRISPR gRNA sequence
agtgcaagtccccagtgtca

SEQ ID NO: 519304 - DNA, 20 bp, Artificial
  CRISPR gRNA sequence
atgacacagaggagagcaca

SEQ ID NO: 519305 - DNA, 20 bp, Artificial
  CRISPR gRNA sequence
aggatggcagggctgccagg

SEQ ID NO: 519306 - DNA, 20 bp, Artificial
  CRISPR gRNA sequence
ccagggccacagtcctgccc

SEQ ID NO: 519307 - DNA, 20 bp, Artificial
  CRISPR gRNA sequence
ccctcgagacagcctgacca

SEQ ID NO: 519308 - DNA, 20 bp, Artificial
  CRISPR gRNA sequence
gagacagcctgaccacaggg

SEQ ID NO: 519309 - DNA, 20 bp, Artificial
  CRISPR gRNA sequence
accacagggactagcatgga

SEQ ID NO: 519310 - DNA, 20 bp, Artificial
  CRISPR gRNA sequence
gcatggagccagggtgtgag

SEQ ID NO: 519311 - DNA, 20 bp, Artificial
  CRISPR gRNA sequence
aggggtgggagcttctgctg

SEQ ID NO: 519312 - DNA, 20 bp, Artificial
  CRISPR gRNA sequence
ctgctgctcctcagccttga

SEQ ID NO: 519313 - DNA, 20 bp, Artificial
  CRISPR gRNA sequence
tgctgctcctcagccttgag

SEQ ID NO: 519314 - DNA, 20 bp, Artificial
  CRISPR gRNA sequence
ctgctcctcagccttgagtc

SEQ ID NO: 519315 - DNA, 20 bp, Artificial
  CRISPR gRNA sequence
ctcctcagccttgagtcccc

SEQ ID NO: 519316 - DNA, 20 bp, Artificial
  CRISPR gRNA sequence
ctcagccttgagtccccagg

SEQ ID NO: 519317 - DNA, 20 bp, Artificial
  CRISPR gRNA sequence
agccttgagtccccaggacc

SEQ ID NO: 519318 - DNA, 20 bp, Artificial
  CRISPR gRNA sequence
gagtccccaggacctagcac

SEQ ID NO: 519319 - DNA, 20 bp, Artificial
  CRISPR gRNA sequence
agtccccaggacctagcaca

SEQ ID NO: 519320 - DNA, 20 bp, Artificial
  CRISPR gRNA sequence
gcacagggcaggagctgcat

SEQ ID NO: 519321 - DNA, 20 bp, Artificial
  CRISPR gRNA sequence
cataaattgttcaagcgata

SEQ ID NO: 519322 - DNA, 20 bp, Artificial
  CRISPR gRNA sequence
ttcaagcgataagagagatg

SEQ ID NO: 519323 - DNA, 20 bp, Artificial
  CRISPR gRNA sequence
aagcgataagagagatgggg

SEQ ID NO: 519324 - DNA, 20 bp, Artificial
  CRISPR gRNA sequence
agagacagacggaaattgag

SEQ ID NO: 519325 - DNA, 20 bp, Artificial
  CRISPR gRNA sequence
agaggaggcagagggacagg

SEQ ID NO: 519326 - DNA, 20 bp, Artificial
  CRISPR gRNA sequence
ataggggcatcgggtgaatg

SEQ ID NO: 519327 - DNA, 20 bp, Artificial
  CRISPR gRNA sequence
catcctctgtgtaaggacag

SEQ ID NO: 519328 - DNA, 20 bp, Artificial
  CRISPR gRNA sequence
tgtgtaaggacagaaacacc

SEQ ID NO: 519329 - DNA, 20 bp, Artificial
  CRISPR gRNA sequence
tgtaaggacagaaacacctc

SEQ ID NO: 519330 - DNA, 20 bp, Artificial
  CRISPR gRNA sequence
gggcagtggctggcacccag

SEQ ID NO: 519331 - DNA, 20 bp, Artificial
  CRISPR gRNA sequence
gcacccaggagggtctgctc

SEQ ID NO: 519332 - DNA, 20 bp, Artificial
  CRISPR gRNA sequence
ctctgggggtttggggctca

SEQ ID NO: 519333 - DNA, 20 bp, Artificial
  CRISPR gRNA sequence
tgggggtttggggctcacgg

SEQ ID NO: 519334 - DNA, 20 bp, Artificial
  CRISPR gRNA sequence
ggggtttggggctcacggga

SEQ ID NO: 519335 - DNA, 20 bp, Artificial
  CRISPR gRNA sequence
ggggctcacgggaggctacg

SEQ ID NO: 519336 - DNA, 20 bp, Artificial
  CRISPR gRNA sequence
gggctcacgggaggctacga

SEQ ID NO: 519337 - DNA, 20 bp, Artificial
  CRISPR gRNA sequence
acgggaggctacgagaagca

SEQ ID NO: 519338 - DNA, 20 bp, Artificial
  CRISPR gRNA sequence
cgagaagcaaatggcacctc

SEQ ID NO: 519339 - DNA, 20 bp, Artificial
  CRISPR gRNA sequence
ctccacgggccttcagttta

SEQ ID NO: 519340 - DNA, 20 bp, Artificial
  CRISPR gRNA sequence
cacgggccttcagtttaatt

SEQ ID NO: 519341 - DNA, 20 bp, Artificial
  CRISPR gRNA sequence
cagtttaattcaatgaccca

SEQ ID NO: 519342 - DNA, 20 bp, Artificial
  CRISPR gRNA sequence
agtttaattcaatgacccaa

SEQ ID NO: 519343 - DNA, 20 bp, Artificial
  CRISPR gRNA sequence
aattcaatgacccaacgttt

SEQ ID NO: 519344 - DNA, 20 bp, Artificial
  CRISPR gRNA sequence
attcaatgacccaacgtttg

SEQ ID NO: 519345 - DNA, 20 bp, Artificial
  CRISPR gRNA sequence
aatgacccaacgtttgtcgg

SEQ ID NO: 519346 - DNA, 20 bp, Artificial
  CRISPR gRNA sequence
gtcggaggcgctaacgtgct

SEQ ID NO: 519347 - DNA, 20 bp, Artificial
  CRISPR gRNA sequence
tcggaggcgctaacgtgctg

SEQ ID NO: 519348 - DNA, 20 bp, Artificial
  CRISPR gRNA sequence
acgtgctgagctccctcaag

SEQ ID NO: 519349 - DNA, 20 bp, Artificial
  CRISPR gRNA sequence
agctccctcaagccagcagg

SEQ ID NO: 519350 - DNA, 20 bp, Artificial
  CRISPR gRNA sequence
cctcaagccagcaggacctt

SEQ ID NO: 519351 - DNA, 20 bp, Artificial
  CRISPR gRNA sequence
aagccagcaggacctttggc

SEQ ID NO: 519352 - DNA, 20 bp, Artificial
  CRISPR gRNA sequence
tggcctagaaggatccaggc

SEQ ID NO: 519353 - DNA, 20 bp, Artificial
  CRISPR gRNA sequence
ggcctagaaggatccaggcc

SEQ ID NO: 519354 - DNA, 20 bp, Artificial
  CRISPR gRNA sequence
gcctagaaggatccaggcca

SEQ ID NO: 519355 - DNA, 20 bp, Artificial
  CRISPR gRNA sequence
gaaggatccaggccagaatt

SEQ ID NO: 519356 - DNA, 20 bp, Artificial
  CRISPR gRNA sequence
tgagaacatctctcacctgg

SEQ ID NO: 519357 - DNA, 20 bp, Artificial
  CRISPR gRNA sequence
agaacatctctcacctgggg

SEQ ID NO: 519358 - DNA, 20 bp, Artificial
  CRISPR gRNA sequence
tcacctgggggtagatttcc

SEQ ID NO: 519359 - DNA, 20 bp, Artificial
  CRISPR gRNA sequence
acctgggggtagatttccag

SEQ ID NO: 519360 - DNA, 20 bp, Artificial
  CRISPR gRNA sequence
ggggtagatttccagagcag

SEQ ID NO: 519361 - DNA, 20 bp, Artificial
  CRISPR gRNA sequence
ccagagcagtcgggacctct

SEQ ID NO: 519362 - DNA, 20 bp, Artificial
  CRISPR gRNA sequence
cagagcagtcgggacctctg

SEQ ID NO: 519363 - DNA, 20 bp, Artificial
  CRISPR gRNA sequence
tggtgcctggggccctgaat

SEQ ID NO: 519364 - DNA, 20 bp, Artificial
  CRISPR gRNA sequence
gtgcctggggccctgaatgg

SEQ ID NO: 519365 - DNA, 20 bp, Artificial
  CRISPR gRNA sequence
gggccctgaatggcacctag

SEQ ID NO: 519366 - DNA, 20 bp, Artificial
  CRISPR gRNA sequence
aatggcacctagtgcgcacc

SEQ ID NO: 519367 - DNA, 20 bp, Artificial
  CRISPR gRNA sequence
gtgcgcacctatgcctacct

SEQ ID NO: 519368 - DNA, 20 bp, Artificial
  CRISPR gRNA sequence
tgcctacctatgcccaccag

SEQ ID NO: 519369 - DNA, 20 bp, Artificial
  CRISPR gRNA sequence
cctatgcccaccagggccat

SEQ ID NO: 519370 - DNA, 20 bp, Artificial
  CRISPR gRNA sequence
tgcccaccagggccatgggc

SEQ ID NO: 519371 - DNA, 20 bp, Artificial
  CRISPR gRNA sequence
cccaggggagcagcccaggg

SEQ ID NO: 519372 - DNA, 20 bp, Artificial
  CRISPR gRNA sequence
gatgggccgtgcaccaggga

SEQ ID NO: 519373 - DNA, 20 bp, Artificial
  CRISPR gRNA sequence
aggggttaagggcttctctg

SEQ ID NO: 519374 - DNA, 20 bp, Artificial
  CRISPR gRNA sequence
agggcttctctggagcttgc

SEQ ID NO: 519375 - DNA, 20 bp, Artificial
  CRISPR gRNA sequence
ctctggagcttgcccaggac

SEQ ID NO: 519376 - DNA, 20 bp, Artificial
  CRISPR gRNA sequence
tctggagcttgcccaggaca

SEQ ID NO: 519377 - DNA, 20 bp, Artificial
  CRISPR gRNA sequence
tggagcttgcccaggacagg

SEQ ID NO: 519378 - DNA, 20 bp, Artificial
  CRISPR gRNA sequence
gagcttgcccaggacaggtg

SEQ ID NO: 519379 - DNA, 20 bp, Artificial
  CRISPR gRNA sequence
gcccaggacaggtgaacaga

SEQ ID NO: 519380 - DNA, 20 bp, Artificial
  CRISPR gRNA sequence
cccaggacaggtgaacagag

SEQ ID NO: 519381 - DNA, 20 bp, Artificial
  CRISPR gRNA sequence
caccccccagggtgtcttcc

SEQ ID NO: 519382 - DNA, 20 bp, Artificial
  CRISPR gRNA sequence
cccagggcccaagtccactg

SEQ ID NO: 519383 - DNA, 20 bp, Artificial
  CRISPR gRNA sequence
ccagggcccaagtccactgt

SEQ ID NO: 519384 - DNA, 20 bp, Artificial
  CRISPR gRNA sequence
tgggggtttcctgtggcctc

SEQ ID NO: 519385 - DNA, 20 bp, Artificial
  CRISPR gRNA sequence
cctgtggcctcctcctgccc

SEQ ID NO: 519386 - DNA, 20 bp, Artificial
  CRISPR gRNA sequence
ctgtggcctcctcctgcccc

SEQ ID NO: 519387 - DNA, 20 bp, Artificial
  CRISPR gRNA sequence
tggcctcctcctgccccagc

SEQ ID NO: 519388 - DNA, 20 bp, Artificial
  CRISPR gRNA sequence
ctcctgccccagctgcactg

SEQ ID NO: 519389 - DNA, 20 bp, Artificial
  CRISPR gRNA sequence
ctgccccagctgcactgttt

SEQ ID NO: 519390 - DNA, 20 bp, Artificial
  CRISPR gRNA sequence
ccccagctgcactgtttgcc

SEQ ID NO: 519391 - DNA, 20 bp, Artificial
  CRISPR gRNA sequence
cactgtttgccaccagagct

SEQ ID NO: 519392 - DNA, 20 bp, Artificial
  CRISPR gRNA sequence
tttgccaccagagctgtcca

SEQ ID NO: 519393 - DNA, 20 bp, Artificial
  CRISPR gRNA sequence
gccaccagagctgtccacct

SEQ ID NO: 519394 - DNA, 20 bp, Artificial
  CRISPR gRNA sequence
ccaccagagctgtccacctc

SEQ ID NO: 519395 - DNA, 20 bp, Artificial
  CRISPR gRNA sequence
tccacctcccttctccatag

SEQ ID NO: 519396 - DNA, 20 bp, Artificial
  CRISPR gRNA sequence
ccttctccatagagacccgc

SEQ ID NO: 519397 - DNA, 20 bp, Artificial
  CRISPR gRNA sequence
ctccatagagacccgcagag

SEQ ID NO: 519398 - DNA, 20 bp, Artificial
  CRISPR gRNA sequence
tccatagagacccgcagaga

SEQ ID NO: 519399 - DNA, 20 bp, Artificial
  CRISPR gRNA sequence
catagagacccgcagagaag

SEQ ID NO: 519400 - DNA, 20 bp, Artificial
  CRISPR gRNA sequence
gaatgaagagtccggagctc

SEQ ID NO: 519401 - DNA, 20 bp, Artificial
  CRISPR gRNA sequence
aggtttcagggagcatcgcc

SEQ ID NO: 519402 - DNA, 20 bp, Artificial
  CRISPR gRNA sequence
cagggagcatcgcccacaac

SEQ ID NO: 519403 - DNA, 20 bp, Artificial
  CRISPR gRNA sequence
agggagcatcgcccacaaca

SEQ ID NO: 519404 - DNA, 20 bp, Artificial
  CRISPR gRNA sequence
cccgtggaagtgccgggcca

SEQ ID NO: 519405 - DNA, 20 bp, Artificial
  CRISPR gRNA sequence
gaggcctgagggcaggtcgg

SEQ ID NO: 519406 - DNA, 20 bp, Artificial
  CRISPR gRNA sequence
agggcaggtcgggaggctgc

SEQ ID NO: 519407 - DNA, 20 bp, Artificial
  CRISPR gRNA sequence
cagctggcccacggggcagg

SEQ ID NO: 519408 - DNA, 20 bp, Artificial
  CRISPR gRNA sequence
gcccacggggcaggggcttt

SEQ ID NO: 519409 - DNA, 20 bp, Artificial
  CRISPR gRNA sequence
tcctcccagaccaccctcct

SEQ ID NO: 519410 - DNA, 20 bp, Artificial
  CRISPR gRNA sequence
cctcccagaccaccctcctg

SEQ ID NO: 519411 - DNA, 20 bp, Artificial
  CRISPR gRNA sequence
ctcccagaccaccctcctgc

SEQ ID NO: 519412 - DNA, 20 bp, Artificial
  CRISPR gRNA sequence
ccagaccaccctcctgctga

SEQ ID NO: 519413 - DNA, 20 bp, Artificial
  CRISPR gRNA sequence
ctgctgacctgcagcaggag

SEQ ID NO: 519414 - DNA, 20 bp, Artificial
  CRISPR gRNA sequence
ctgacctgcagcaggagctg

SEQ ID NO: 519415 - DNA, 20 bp, Artificial
  CRISPR gRNA sequence
acctgcagcaggagctgacc

SEQ ID NO: 519416 - DNA, 20 bp, Artificial
  CRISPR gRNA sequence
cagcaggagctgacctgcag

SEQ ID NO: 519417 - DNA, 20 bp, Artificial
  CRISPR gRNA sequence
acctgcagtggggagattgc

SEQ ID NO: 519418 - DNA, 20 bp, Artificial
  CRISPR gRNA sequence
cagtggggagattgctggcc

SEQ ID NO: 519419 - DNA, 20 bp, Artificial
  CRISPR gRNA sequence
ctggccaccccatgggtccc

SEQ ID NO: 519420 - DNA, 20 bp, Artificial
  CRISPR gRNA sequence
gccaccccatgggtcccagc

SEQ ID NO: 519421 - DNA, 20 bp, Artificial
  CRISPR gRNA sequence
agtggtgcgggagactcaca

SEQ ID NO: 519422 - DNA, 20 bp, Artificial
  CRISPR gRNA sequence
acattgtaagcattcttaat

SEQ ID NO: 519423 - DNA, 20 bp, Artificial
  CRISPR gRNA sequence
taagcattcttaatgagatg

SEQ ID NO: 519424 - DNA, 20 bp, Artificial
  CRISPR gRNA sequence
ttaatgagatggaccacatt

SEQ ID NO: 519425 - DNA, 20 bp, Artificial
  CRISPR gRNA sequence
aatgagatggaccacattgc

SEQ ID NO: 519426 - DNA, 20 bp, Artificial
  CRISPR gRNA sequence
atgagatggaccacattgct

SEQ ID NO: 519427 - DNA, 20 bp, Artificial
  CRISPR gRNA sequence
ctggagtcctcagacagctc

SEQ ID NO: 519428 - DNA, 20 bp, Artificial
  CRISPR gRNA sequence
gagtcctcagacagctcccc

SEQ ID NO: 519429 - DNA, 20 bp, Artificial
  CRISPR gRNA sequence
agacagctcccccacggctg

SEQ ID NO: 519430 - DNA, 20 bp, Artificial
  CRISPR gRNA sequence
ccccacggctgacttgggga

SEQ ID NO: 519431 - DNA, 20 bp, Artificial
  CRISPR gRNA sequence
acttggggatgatctcggtg

SEQ ID NO: 519432 - DNA, 20 bp, Artificial
  CRISPR gRNA sequence
ggggatgatctcggtgagtt

SEQ ID NO: 519433 - DNA, 20 bp, Artificial
  CRISPR gRNA sequence
gggatgatctcggtgagttt

SEQ ID NO: 519434 - DNA, 20 bp, Artificial
  CRISPR gRNA sequence
ggtgagtttctgttgggcaa

SEQ ID NO: 519435 - DNA, 20 bp, Artificial
  CRISPR gRNA sequence
ctgttgggcaagaagaccag

SEQ ID NO: 519436 - DNA, 20 bp, Artificial
  CRISPR gRNA sequence
tgttgggcaagaagaccaga

SEQ ID NO: 519437 - DNA, 20 bp, Artificial
  CRISPR gRNA sequence
ttgggcaagaagaccagaca

SEQ ID NO: 519438 - DNA, 20 bp, Artificial
  CRISPR gRNA sequence
ggcaagaagaccagacatgg

SEQ ID NO: 519439 - DNA, 20 bp, Artificial
  CRISPR gRNA sequence
ggacctgtgccacggcatct

SEQ ID NO: 519440 - DNA, 20 bp, Artificial
  CRISPR gRNA sequence
tgccacggcatctccacgca

SEQ ID NO: 519441 - DNA, 20 bp, Artificial
  CRISPR gRNA sequence
cacgcactgggctcacccca

SEQ ID NO: 519442 - DNA, 20 bp, Artificial
  CRISPR gRNA sequence
ggctcaccccaggggcttct

SEQ ID NO: 519443 - DNA, 20 bp, Artificial
  CRISPR gRNA sequence
accccaggggcttctgcacc

SEQ ID NO: 519444 - DNA, 20 bp, Artificial
  CRISPR gRNA sequence
ctgcacctgcaaaatggctg

SEQ ID NO: 519445 - DNA, 20 bp, Artificial
  CRISPR gRNA sequence
tgcacctgcaaaatggctgg

SEQ ID NO: 519446 - DNA, 20 bp, Artificial
  CRISPR gRNA sequence
cacctgcaaaatggctggga

SEQ ID NO: 519447 - DNA, 20 bp, Artificial
  CRISPR gRNA sequence
caaaatggctgggacggtcc

SEQ ID NO: 519448 - DNA, 20 bp, Artificial
  CRISPR gRNA sequence
ggacggtcctcaacgcagtt

SEQ ID NO: 519449 - DNA, 20 bp, Artificial
  CRISPR gRNA sequence
aacgcagttttgcacttggt

SEQ ID NO: 519450 - DNA, 20 bp, Artificial
  CRISPR gRNA sequence
tgcacttggtccccagagtg

SEQ ID NO: 519451 - DNA, 20 bp, Artificial
  CRISPR gRNA sequence
gcacttggtccccagagtgt

SEQ ID NO: 519452 - DNA, 20 bp, Artificial
  CRISPR gRNA sequence
cacttggtccccagagtgtg

SEQ ID NO: 519453 - DNA, 20 bp, Artificial
  CRISPR gRNA sequence
ggtccccagagtgtgtggtc

SEQ ID NO: 519454 - DNA, 20 bp, Artificial
  CRISPR gRNA sequence
gtccccagagtgtgtggtca

SEQ ID NO: 519455 - DNA, 20 bp, Artificial
  CRISPR gRNA sequence
ttgggggtaaaaagccctga

SEQ ID NO: 519456 - DNA, 20 bp, Artificial
  CRISPR gRNA sequence
gggggtaaaaagccctgagc

SEQ ID NO: 519457 - DNA, 20 bp, Artificial
  CRISPR gRNA sequence
ggggtaaaaagccctgagct

SEQ ID NO: 519458 - DNA, 20 bp, Artificial
  CRISPR gRNA sequence
agctgcccaggggccacgcc

SEQ ID NO: 519459 - DNA, 20 bp, Artificial
  CRISPR gRNA sequence
cccaggggccacgcctggaa

SEQ ID NO: 519460 - DNA, 20 bp, Artificial
  CRISPR gRNA sequence
gaataccagtactcgggagg

SEQ ID NO: 519461 - DNA, 20 bp, Artificial
  CRISPR gRNA sequence
gggaggccgatgtgggaaga

SEQ ID NO: 519462 - DNA, 20 bp, Artificial
  CRISPR gRNA sequence
cctgagcccaggagttcagg

SEQ ID NO: 519463 - DNA, 20 bp, Artificial
  CRISPR gRNA sequence
agcccaggagttcaggacca

SEQ ID NO: 519464 - DNA, 20 bp, Artificial
  CRISPR gRNA sequence
aggaccagcctgggcaacat

SEQ ID NO: 519465 - DNA, 20 bp, Artificial
  CRISPR gRNA sequence
ggcaacataagaagacccca

SEQ ID NO: 519466 - DNA, 20 bp, Artificial
  CRISPR gRNA sequence
tacaaaaagtacaaatatta

SEQ ID NO: 519467 - DNA, 20 bp, Artificial
  CRISPR gRNA sequence
caaaaagtacaaatattaga

SEQ ID NO: 519468 - DNA, 20 bp, Artificial
  CRISPR gRNA sequence
gagtggtgtggcgtcacatg

SEQ ID NO: 519469 - DNA, 20 bp, Artificial
  CRISPR gRNA sequence
tagtaccagatactcgggag

SEQ ID NO: 519470 - DNA, 20 bp, Artificial
  CRISPR gRNA sequence
gggaggctgaggcaggagga

SEQ ID NO: 519471 - DNA, 20 bp, Artificial
  CRISPR gRNA sequence
aggcaggaggatcacttaaa

SEQ ID NO: 519472 - DNA, 20 bp, Artificial
  CRISPR gRNA sequence
aaacccaggaggtggaggtt

SEQ ID NO: 519473 - DNA, 20 bp, Artificial
  CRISPR gRNA sequence
aacccaggaggtggaggttg

SEQ ID NO: 519474 - DNA, 20 bp, Artificial
  CRISPR gRNA sequence
cagtgagctgagatcgcacc

SEQ ID NO: 519475 - DNA, 20 bp, Artificial
  CRISPR gRNA sequence
agatcgcaccactgcactcc

SEQ ID NO: 519476 - DNA, 20 bp, Artificial
  CRISPR gRNA sequence
cactccagcctgggcgacag

SEQ ID NO: 519477 - DNA, 20 bp, Artificial
  CRISPR gRNA sequence
cagcctgggcgacagagcaa

SEQ ID NO: 519478 - DNA, 20 bp, Artificial
  CRISPR gRNA sequence
ggcgacagagcaagaccttg

SEQ ID NO: 519479 - DNA, 20 bp, Artificial
  CRISPR gRNA sequence
gtctcaaaaaaacaaaacaa

SEQ ID NO: 519480 - DNA, 20 bp, Artificial
  CRISPR gRNA sequence
tctcaaaaaaacaaaacaaa

SEQ ID NO: 519481 - DNA, 20 bp, Artificial
  CRISPR gRNA sequence
aaaaaaacaaaacaaaacaa

SEQ ID NO: 519482 - DNA, 20 bp, Artificial
  CRISPR gRNA sequence
acgcctgtgatcccagcact

SEQ ID NO: 519483 - DNA, 20 bp, Artificial
  CRISPR gRNA sequence
tgatcccagcactttgggag

SEQ ID NO: 519484 - DNA, 20 bp, Artificial
  CRISPR gRNA sequence
tgggaggccaaagtgggtgg

SEQ ID NO: 519485 - DNA, 20 bp, Artificial
  CRISPR gRNA sequence
gggaggccaaagtgggtgga

SEQ ID NO: 519486 - DNA, 20 bp, Artificial
  CRISPR gRNA sequence
ggaggccaaagtgggtggat

SEQ ID NO: 519487 - DNA, 20 bp, Artificial
  CRISPR gRNA sequence
aggtcaggagtttgagacca

SEQ ID NO: 519488 - DNA, 20 bp, Artificial
  CRISPR gRNA sequence
gagaccagcctggccaacat

SEQ ID NO: 519489 - DNA, 20 bp, Artificial
  CRISPR gRNA sequence
agaccagcctggccaacatg

SEQ ID NO: 519490 - DNA, 20 bp, Artificial
  CRISPR gRNA sequence
gccaacatggtgaaaccccg

SEQ ID NO: 519491 - DNA, 20 bp, Artificial
  CRISPR gRNA sequence
tactaaaaatacaaaaatta

SEQ ID NO: 519492 - DNA, 20 bp, Artificial
  CRISPR gRNA sequence
ctaaaaatacaaaaattagc

SEQ ID NO: 519493 - DNA, 20 bp, Artificial
  CRISPR gRNA sequence
aaaatacaaaaattagctgg

SEQ ID NO: 519494 - DNA, 20 bp, Artificial
  CRISPR gRNA sequence
gctgggcgtggtggtgggca

SEQ ID NO: 519495 - DNA, 20 bp, Artificial
  CRISPR gRNA sequence
ggcgtggtggtgggcacctg

SEQ ID NO: 519496 - DNA, 20 bp, Artificial
  CRISPR gRNA sequence
taagcccagctactcaggag

SEQ ID NO: 519497 - DNA, 20 bp, Artificial
  CRISPR gRNA sequence
ctcaggagactgaggcagga

SEQ ID NO: 519498 - DNA, 20 bp, Artificial
  CRISPR gRNA sequence
aggagactgaggcaggagaa

SEQ ID NO: 519499 - DNA, 20 bp, Artificial
  CRISPR gRNA sequence
aggcaggagaacccaggagg

SEQ ID NO: 519500 - DNA, 20 bp, Artificial
  CRISPR gRNA sequence
agatcacaccatggcactcc

SEQ ID NO: 519501 - DNA, 20 bp, Artificial
  CRISPR gRNA sequence
cagcctgggcaacaagagca

SEQ ID NO: 519502 - DNA, 20 bp, Artificial
  CRISPR gRNA sequence
ggcaacaagagcaaaactct

SEQ ID NO: 519503 - DNA, 20 bp, Artificial
  CRISPR gRNA sequence
tgtctcaataaaataaaatg

SEQ ID NO: 519504 - DNA, 20 bp, Artificial
  CRISPR gRNA sequence
tctcaataaaataaaatgaa

SEQ ID NO: 519505 - DNA, 20 bp, Artificial
  CRISPR gRNA sequence
aataaaataaaatgaaatga

SEQ ID NO: 519506 - DNA, 20 bp, Artificial
  CRISPR gRNA sequence
ctgttgcatcatgaggataa

SEQ ID NO: 519507 - DNA, 20 bp, Artificial
  CRISPR gRNA sequence
ttgcatcatgaggataagaa

SEQ ID NO: 519508 - DNA, 20 bp, Artificial
  CRISPR gRNA sequence
catcatgaggataagaaaag

SEQ ID NO: 519509 - DNA, 20 bp, Artificial
  CRISPR gRNA sequence
agctgcagcattgtccaggc

SEQ ID NO: 519510 - DNA, 20 bp, Artificial
  CRISPR gRNA sequence
cagcattgtccaggcctgcc

SEQ ID NO: 519511 - DNA, 20 bp, Artificial
  CRISPR gRNA sequence
tccaggcctgcccgtgtgag

SEQ ID NO: 519512 - DNA, 20 bp, Artificial
  CRISPR gRNA sequence
cccgtgtgagtcctcctgcc

SEQ ID NO: 519513 - DNA, 20 bp, Artificial
  CRISPR gRNA sequence
ctgcctgcggtgtgagtgat

SEQ ID NO: 519514 - DNA, 20 bp, Artificial
  CRISPR gRNA sequence
cctgcggtgtgagtgatccc

SEQ ID NO: 519515 - DNA, 20 bp, Artificial
  CRISPR gRNA sequence
cggtgtgagtgatcccgcct

SEQ ID NO: 519516 - DNA, 20 bp, Artificial
  CRISPR gRNA sequence
cggtgtgagtgctcccgcct

SEQ ID NO: 519517 - DNA, 20 bp, Artificial
  CRISPR gRNA sequence
ccgcctgcggtgtgagtgat

SEQ ID NO: 519518 - DNA, 20 bp, Artificial
  CRISPR gRNA sequence
cggtgtgagtgatcccgcct

SEQ ID NO: 519519 - DNA, 20 bp, Artificial
  CRISPR gRNA sequence
cagtgtgagtgatcctgcct

SEQ ID NO: 519520 - DNA, 20 bp, Artificial
  CRISPR gRNA sequence
cctgcggtgtgactgctccc

SEQ ID NO: 519521 - DNA, 20 bp, Artificial
  CRISPR gRNA sequence
cggtgtgactgctcccgcct

SEQ ID NO: 519522 - DNA, 20 bp, Artificial
  CRISPR gRNA sequence
ctcccgcctgtggtgtgagt

SEQ ID NO: 519523 - DNA, 20 bp, Artificial
  CRISPR gRNA sequence
ccgcctgtggtgtgagtact

SEQ ID NO: 519524 - DNA, 20 bp, Artificial
  CRISPR gRNA sequence
tggtgtgagtactcctgcct

SEQ ID NO: 519525 - DNA, 20 bp, Artificial
  CRISPR gRNA sequence
ctgcctgtggtgtgagtgat

SEQ ID NO: 519526 - DNA, 20 bp, Artificial
  CRISPR gRNA sequence
cctgtggtgtgagtgatcct

SEQ ID NO: 519527 - DNA, 20 bp, Artificial
  CRISPR gRNA sequence
tggtgtgagtgatcctgcct

SEQ ID NO: 519528 - DNA, 20 bp, Artificial
  CRISPR gRNA sequence
cctggtggatttcaagctcg

SEQ ID NO: 519529 - DNA, 20 bp, Artificial
  CRISPR gRNA sequence
gtggatttcaagctcgcaat

SEQ ID NO: 519530 - DNA, 20 bp, Artificial
  CRISPR gRNA sequence
caagctcgcaatatcactgg

SEQ ID NO: 519531 - DNA, 20 bp, Artificial
  CRISPR gRNA sequence
aagctcgcaatatcactggg

SEQ ID NO: 519532 - DNA, 20 bp, Artificial
  CRISPR gRNA sequence
gcaatatcactgggttggga

SEQ ID NO: 519533 - DNA, 20 bp, Artificial
  CRISPR gRNA sequence
ggttgggaggacgtgcatgg

SEQ ID NO: 519534 - DNA, 20 bp, Artificial
  CRISPR gRNA sequence
ggaggacgtgcatggtggcc

SEQ ID NO: 519535 - DNA, 20 bp, Artificial
  CRISPR gRNA sequence
gccagaatttccaccacaca

SEQ ID NO: 519536 - DNA, 20 bp, Artificial
  CRISPR gRNA sequence
ccaccacacaggtagggaat

SEQ ID NO: 519537 - DNA, 20 bp, Artificial
  CRISPR gRNA sequence
caccacacaggtagggaatt

SEQ ID NO: 519538 - DNA, 20 bp, Artificial
  CRISPR gRNA sequence
ctaccaccacacagatggta

SEQ ID NO: 519539 - DNA, 20 bp, Artificial
  CRISPR gRNA sequence
ccaccacacagatggtaggc

SEQ ID NO: 519540 - DNA, 20 bp, Artificial
  CRISPR gRNA sequence
ttggcactctactgagtttc

SEQ ID NO: 519541 - DNA, 20 bp, Artificial
  CRISPR gRNA sequence
ggcactctactgagtttcca

SEQ ID NO: 519542 - DNA, 20 bp, Artificial
  CRISPR gRNA sequence
gcactctactgagtttccat

SEQ ID NO: 519543 - DNA, 20 bp, Artificial
  CRISPR gRNA sequence
tactgagtttccatgggtgt

SEQ ID NO: 519544 - DNA, 20 bp, Artificial
  CRISPR gRNA sequence
ctgagtttccatgggtgtta

SEQ ID NO: 519545 - DNA, 20 bp, Artificial
  CRISPR gRNA sequence
agtttccatgggtgttaaac

SEQ ID NO: 519546 - DNA, 20 bp, Artificial
  CRISPR gRNA sequence
ccatgggtgttaaacagccc

SEQ ID NO: 519547 - DNA, 20 bp, Artificial
  CRISPR gRNA sequence
catgggtgttaaacagcccg

SEQ ID NO: 519548 - DNA, 20 bp, Artificial
  CRISPR gRNA sequence
aacagcccggtgacatcggt

SEQ ID NO: 519549 - DNA, 20 bp, Artificial
  CRISPR gRNA sequence
tggccggccagatgcacagg

SEQ ID NO: 519550 - DNA, 20 bp, Artificial
  CRISPR gRNA sequence
gccggccagatgcacagggg

SEQ ID NO: 519551 - DNA, 20 bp, Artificial
  CRISPR gRNA sequence
ccccatgctcacacatgctc

SEQ ID NO: 519552 - DNA, 20 bp, Artificial
  CRISPR gRNA sequence
acacatgctcagcttctttc

SEQ ID NO: 519553 - DNA, 20 bp, Artificial
  CRISPR gRNA sequence
agcttctttcatggaagatt

SEQ ID NO: 519554 - DNA, 20 bp, Artificial
  CRISPR gRNA sequence
ctttcatggaagattgcggc

SEQ ID NO: 519555 - DNA, 20 bp, Artificial
  CRISPR gRNA sequence
tttcatggaagattgcggca

SEQ ID NO: 519556 - DNA, 20 bp, Artificial
  CRISPR gRNA sequence
tcatggaagattgcggcatc

SEQ ID NO: 519557 - DNA, 20 bp, Artificial
  CRISPR gRNA sequence
catggaagattgcggcatca

SEQ ID NO: 519558 - DNA, 20 bp, Artificial
  CRISPR gRNA sequence
atggaagattgcggcatcat

SEQ ID NO: 519559 - DNA, 20 bp, Artificial
  CRISPR gRNA sequence
cggcatcatttcaccttcca

SEQ ID NO: 519560 - DNA, 20 bp, Artificial
  CRISPR gRNA sequence
caccttccaggaacacggag

SEQ ID NO: 519561 - DNA, 20 bp, Artificial
  CRISPR gRNA sequence
accttccaggaacacggagc

SEQ ID NO: 519562 - DNA, 20 bp, Artificial
  CRISPR gRNA sequence
ccaggaacacggagcagatg

SEQ ID NO: 519563 - DNA, 20 bp, Artificial
  CRISPR gRNA sequence
caggaacacggagcagatgg

SEQ ID NO: 519564 - DNA, 20 bp, Artificial
  CRISPR gRNA sequence
cccgcccaaaccctcccatg

SEQ ID NO: 519565 - DNA, 20 bp, Artificial
  CRISPR gRNA sequence
ccatgactgccctgcatggg

SEQ ID NO: 519566 - DNA, 20 bp, Artificial
  CRISPR gRNA sequence
ccctgcatgggcccagtccc

SEQ ID NO: 519567 - DNA, 20 bp, Artificial
  CRISPR gRNA sequence
catgggcccagtcccttcca

SEQ ID NO: 519568 - DNA, 20 bp, Artificial
  CRISPR gRNA sequence
ccatggagctcctggggccg

SEQ ID NO: 519569 - DNA, 20 bp, Artificial
  CRISPR gRNA sequence
catggagctcctggggccgg

SEQ ID NO: 519570 - DNA, 20 bp, Artificial
  CRISPR gRNA sequence
ctggggccggtcacagcctg

SEQ ID NO: 519571 - DNA, 20 bp, Artificial
  CRISPR gRNA sequence
gggccggtcacagcctggcc

SEQ ID NO: 519572 - DNA, 20 bp, Artificial
  CRISPR gRNA sequence
gccaccaccctcctctgcgc

SEQ ID NO: 519573 - DNA, 20 bp, Artificial
  CRISPR gRNA sequence
ctctgcgccctccgcccacc

SEQ ID NO: 519574 - DNA, 20 bp, Artificial
  CRISPR gRNA sequence
tgcgccctccgcccaccgcc

SEQ ID NO: 519575 - DNA, 20 bp, Artificial
  CRISPR gRNA sequence
cgccctccgcccaccgccca

SEQ ID NO: 519576 - DNA, 20 bp, Artificial
  CRISPR gRNA sequence
cgcccaccgcccacttccat

SEQ ID NO: 519577 - DNA, 20 bp, Artificial
  CRISPR gRNA sequence
ccatccgtcccagtctgggg

SEQ ID NO: 519578 - DNA, 20 bp, Artificial
  CRISPR gRNA sequence
catccgtcccagtctggggc

SEQ ID NO: 519579 - DNA, 20 bp, Artificial
  CRISPR gRNA sequence
gggccatccctgtcttggga

SEQ ID NO: 519580 - DNA, 20 bp, Artificial
  CRISPR gRNA sequence
tcttgggagagctgggccct

SEQ ID NO: 519581 - DNA, 20 bp, Artificial
  CRISPR gRNA sequence
gggagagctgggccctccca

SEQ ID NO: 519582 - DNA, 20 bp, Artificial
  CRISPR gRNA sequence
ggagagctgggccctcccac

SEQ ID NO: 519583 - DNA, 20 bp, Artificial
  CRISPR gRNA sequence
ggccctcccacatcctgtcc

SEQ ID NO: 519584 - DNA, 20 bp, Artificial
  CRISPR gRNA sequence
ccacatcctgtcctgctgag

SEQ ID NO: 519585 - DNA, 20 bp, Artificial
  CRISPR gRNA sequence
tcctgctgagcctgctgtgc

SEQ ID NO: 519586 - DNA, 20 bp, Artificial
  CRISPR gRNA sequence
ctgagcctgctgtgcgcttg

SEQ ID NO: 519587 - DNA, 20 bp, Artificial
  CRISPR gRNA sequence
agcctgctgtgcgcttggtg

SEQ ID NO: 519588 - DNA, 20 bp, Artificial
  CRISPR gRNA sequence
ctgtgcgcttggtgcagaaa

SEQ ID NO: 519589 - DNA, 20 bp, Artificial
  CRISPR gRNA sequence
tgcgcttggtgcagaaacac

SEQ ID NO: 519590 - DNA, 20 bp, Artificial
  CRISPR gRNA sequence
ggtgcagaaacacactcgga

SEQ ID NO: 519591 - DNA, 20 bp, Artificial
  CRISPR gRNA sequence
gtgcagaaacacactcggag

SEQ ID NO: 519592 - DNA, 20 bp, Artificial
  CRISPR gRNA sequence
ggagggggcgtggcacgtgt

SEQ ID NO: 519593 - DNA, 20 bp, Artificial
  CRISPR gRNA sequence
gctgcctgttgccttgacca

SEQ ID NO: 519594 - DNA, 20 bp, Artificial
  CRISPR gRNA sequence
cctgttgccttgaccacccc

SEQ ID NO: 519595 - DNA, 20 bp, Artificial
  CRISPR gRNA sequence
ttgccttgaccacccccgaa

SEQ ID NO: 519596 - DNA, 20 bp, Artificial
  CRISPR gRNA sequence
ccttgaccacccccgaaggt

SEQ ID NO: 519597 - DNA, 20 bp, Artificial
  CRISPR gRNA sequence
gaccacccccgaaggtgacc

SEQ ID NO: 519598 - DNA, 20 bp, Artificial
  CRISPR gRNA sequence
accacccccgaaggtgacca

SEQ ID NO: 519599 - DNA, 20 bp, Artificial
  CRISPR gRNA sequence
aggaaggcttgtgtgcccca

SEQ ID NO: 519600 - DNA, 20 bp, Artificial
  CRISPR gRNA sequence
gtgtgccccaaggctcagca

SEQ ID NO: 519601 - DNA, 20 bp, Artificial
  CRISPR gRNA sequence
tgtgccccaaggctcagcag

SEQ ID NO: 519602 - DNA, 20 bp, Artificial
  CRISPR gRNA sequence
agcagtaggcatggggtgca

SEQ ID NO: 519603 - DNA, 20 bp, Artificial
  CRISPR gRNA sequence
tacctgcctccagtgcctgg

SEQ ID NO: 519604 - DNA, 20 bp, Artificial
  CRISPR gRNA sequence
cctgcctccagtgcctggcc

SEQ ID NO: 519605 - DNA, 20 bp, Artificial
  CRISPR gRNA sequence
cctccagtgcctggccctgg

SEQ ID NO: 519606 - DNA, 20 bp, Artificial
  CRISPR gRNA sequence
cagtgcctggccctggtgcc

SEQ ID NO: 519607 - DNA, 20 bp, Artificial
  CRISPR gRNA sequence
gccctggtgccacaccatcg

SEQ ID NO: 519608 - DNA, 20 bp, Artificial
  CRISPR gRNA sequence
gtgccacaccatcgcctgga

SEQ ID NO: 519609 - DNA, 20 bp, Artificial
  CRISPR gRNA sequence
gagtctggctgccatgacaa

SEQ ID NO: 519610 - DNA, 20 bp, Artificial
  CRISPR gRNA sequence
gctgccatgacaaatggcaa

SEQ ID NO: 519611 - DNA, 20 bp, Artificial
  CRISPR gRNA sequence
ccatgacaaatggcaaagga

SEQ ID NO: 519612 - DNA, 20 bp, Artificial
  CRISPR gRNA sequence
ggacctgctactgctggtga

SEQ ID NO: 519613 - DNA, 20 bp, Artificial
  CRISPR gRNA sequence
ctactgctggtgaggagggg

SEQ ID NO: 519614 - DNA, 20 bp, Artificial
  CRISPR gRNA sequence
ctgctggtgaggaggggacc

SEQ ID NO: 519615 - DNA, 20 bp, Artificial
  CRISPR gRNA sequence
ctggtgaggaggggaccgtc

SEQ ID NO: 519616 - DNA, 20 bp, Artificial
  CRISPR gRNA sequence
gtgaggaggggaccgtcatg

SEQ ID NO: 519617 - DNA, 20 bp, Artificial
  CRISPR gRNA sequence
cagatgggacacagggctgt

SEQ ID NO: 519618 - DNA, 20 bp, Artificial
  CRISPR gRNA sequence
tgacatcctgaccagcaggt

SEQ ID NO: 519619 - DNA, 20 bp, Artificial
  CRISPR gRNA sequence
accagcaggtggtctctgtg

SEQ ID NO: 519620 - DNA, 20 bp, Artificial
  CRISPR gRNA sequence
tgtggatgtccggccccagc

SEQ ID NO: 519621 - DNA, 20 bp, Artificial
  CRISPR gRNA sequence
tggatgtccggccccagccc

SEQ ID NO: 519622 - DNA, 20 bp, Artificial
  CRISPR gRNA sequence
ccctgcgctgacccactgtc

SEQ ID NO: 519623 - DNA, 20 bp, Artificial
  CRISPR gRNA sequence
cgctgacccactgtcccggc

SEQ ID NO: 519624 - DNA, 20 bp, Artificial
  CRISPR gRNA sequence
acccactgtcccggcagcct

SEQ ID NO: 519625 - DNA, 20 bp, Artificial
  CRISPR gRNA sequence
tcccggcagcctgaccagct

SEQ ID NO: 519626 - DNA, 20 bp, Artificial
  CRISPR gRNA sequence
accagctctgggtgcccact

SEQ ID NO: 519627 - DNA, 20 bp, Artificial
  CRISPR gRNA sequence
tgggtgcccactcggagggt

SEQ ID NO: 519628 - DNA, 20 bp, Artificial
  CRISPR gRNA sequence
ggtgcccactcggagggtcc

SEQ ID NO: 519629 - DNA, 20 bp, Artificial
  CRISPR gRNA sequence
ggagggtcccccagacacct

SEQ ID NO: 519630 - DNA, 20 bp, Artificial
  CRISPR gRNA sequence
cccccatcccgtgtctcccg

SEQ ID NO: 519631 - DNA, 20 bp, Artificial
  CRISPR gRNA sequence
ccgcagggtcctgctcccac

SEQ ID NO: 519632 - DNA, 20 bp, Artificial
  CRISPR gRNA sequence
ctcccactccagagcccggg

SEQ ID NO: 519633 - DNA, 20 bp, Artificial
  CRISPR gRNA sequence
ccactccagagcccggggaa

SEQ ID NO: 519634 - DNA, 20 bp, Artificial
  CRISPR gRNA sequence
cagagcccggggaacctatg

SEQ ID NO: 519635 - DNA, 20 bp, Artificial
  CRISPR gRNA sequence
tggcaggaaccgctggtctc

SEQ ID NO: 519636 - DNA, 20 bp, Artificial
  CRISPR gRNA sequence
gtctcgctgtcggccccaac

SEQ ID NO: 519637 - DNA, 20 bp, Artificial
  CRISPR gRNA sequence
gctgtcggccccaacacacc

SEQ ID NO: 519638 - DNA, 20 bp, Artificial
  CRISPR gRNA sequence
tcggccccaacacaccacga

SEQ ID NO: 519639 - DNA, 20 bp, Artificial
  CRISPR gRNA sequence
agcttgtagctgggatacgg

SEQ ID NO: 519640 - DNA, 20 bp, Artificial
  CRISPR gRNA sequence
gtagctgggatacgggcctg

SEQ ID NO: 519641 - DNA, 20 bp, Artificial
  CRISPR gRNA sequence
tagctgggatacgggcctga

SEQ ID NO: 519642 - DNA, 20 bp, Artificial
  CRISPR gRNA sequence
ggatacgggcctgacaatgg

SEQ ID NO: 519643 - DNA, 20 bp, Artificial
  CRISPR gRNA sequence
acaatggatccctgtagttc

SEQ ID NO: 519644 - DNA, 20 bp, Artificial
  CRISPR gRNA sequence
tagttcagcaaatgttcact

SEQ ID NO: 519645 - DNA, 20 bp, Artificial
  CRISPR gRNA sequence
agcaaatgttcactttacaa

SEQ ID NO: 519646 - DNA, 20 bp, Artificial
  CRISPR gRNA sequence
actttacaaaagcagcggcc

SEQ ID NO: 519647 - DNA, 20 bp, Artificial
  CRISPR gRNA sequence
tacaaaagcagcggccctcc

SEQ ID NO: 519648 - DNA, 20 bp, Artificial
  CRISPR gRNA sequence
acaaaagcagcggccctccc

SEQ ID NO: 519649 - DNA, 20 bp, Artificial
  CRISPR gRNA sequence
caaaagcagcggccctcccg

SEQ ID NO: 519650 - DNA, 20 bp, Artificial
  CRISPR gRNA sequence
ccgggcactttccttcccca

SEQ ID NO: 519651 - DNA, 20 bp, Artificial
  CRISPR gRNA sequence
tccttccccaaaccccgagt

SEQ ID NO: 519652 - DNA, 20 bp, Artificial
  CRISPR gRNA sequence
ccttccccaaaccccgagta

SEQ ID NO: 519653 - DNA, 20 bp, Artificial
  CRISPR gRNA sequence
cttccccaaaccccgagtat

SEQ ID NO: 519654 - DNA, 20 bp, Artificial
  CRISPR gRNA sequence
ccccaaaccccgagtatgtc

SEQ ID NO: 519655 - DNA, 20 bp, Artificial
  CRISPR gRNA sequence
cccaaaccccgagtatgtct

SEQ ID NO: 519656 - DNA, 20 bp, Artificial
  CRISPR gRNA sequence
ctcagcctaagcagcagggc

SEQ ID NO: 519657 - DNA, 20 bp, Artificial
  CRISPR gRNA sequence
agcctaagcagcagggcagg

SEQ ID NO: 519658 - DNA, 20 bp, Artificial
  CRISPR gRNA sequence
agcagcagggcaggggctgt

SEQ ID NO: 519659 - DNA, 20 bp, Artificial
  CRISPR gRNA sequence
tgaggctgcccagctgggca

SEQ ID NO: 519660 - DNA, 20 bp, Artificial
  CRISPR gRNA sequence
cccagctgggcagagcccca

SEQ ID NO: 519661 - DNA, 20 bp, Artificial
  CRISPR gRNA sequence
ggcagagccccaggcagggg

SEQ ID NO: 519662 - DNA, 20 bp, Artificial
  CRISPR gRNA sequence
gtttcctgcgtgccattttg

SEQ ID NO: 519663 - DNA, 20 bp, Artificial
  CRISPR gRNA sequence
cctgcgtgccattttgaaga

SEQ ID NO: 519664 - DNA, 20 bp, Artificial
  CRISPR gRNA sequence
ctgcgtgccattttgaagaa

SEQ ID NO: 519665 - DNA, 20 bp, Artificial
  CRISPR gRNA sequence
cgtgccattttgaagaagat

SEQ ID NO: 519666 - DNA, 20 bp, Artificial
  CRISPR gRNA sequence
tgaagaagatggcggtgatg

SEQ ID NO: 519667 - DNA, 20 bp, Artificial
  CRISPR gRNA sequence
gaagaagatggcggtgatgg

SEQ ID NO: 519668 - DNA, 20 bp, Artificial
  CRISPR gRNA sequence
aagaagatggcggtgatggc

SEQ ID NO: 519669 - DNA, 20 bp, Artificial
  CRISPR gRNA sequence
gaatggccagcaggtcggtc

SEQ ID NO: 519670 - DNA, 20 bp, Artificial
  CRISPR gRNA sequence
tccggatgaggataatcggg

SEQ ID NO: 519671 - DNA, 20 bp, Artificial
  CRISPR gRNA sequence
tagggcggctgctctgtgaa

SEQ ID NO: 519672 - DNA, 20 bp, Artificial
  CRISPR gRNA sequence
agggcggctgctctgtgaat

SEQ ID NO: 519673 - DNA, 20 bp, Artificial
  CRISPR gRNA sequence
gggcggctgctctgtgaatt

SEQ ID NO: 519674 - DNA, 20 bp, Artificial
  CRISPR gRNA sequence
ctctgtgaattccctgagtg

SEQ ID NO: 519675 - DNA, 20 bp, Artificial
  CRISPR gRNA sequence
tgtgaattccctgagtgggt

SEQ ID NO: 519676 - DNA, 20 bp, Artificial
  CRISPR gRNA sequence
tgaattccctgagtgggtga

SEQ ID NO: 519677 - DNA, 20 bp, Artificial
  CRISPR gRNA sequence
cctgagtgggtgagctcagt

SEQ ID NO: 519678 - DNA, 20 bp, Artificial
  CRISPR gRNA sequence
agtgggtgagctcagtaccc

SEQ ID NO: 519679 - DNA, 20 bp, Artificial
  CRISPR gRNA sequence
agtacccacgacgcactgcc

SEQ ID NO: 519680 - DNA, 20 bp, Artificial
  CRISPR gRNA sequence
cccgccgggcaccactaccc

SEQ ID NO: 519681 - DNA, 20 bp, Artificial
  CRISPR gRNA sequence
cccctttcacagatgaggaa

SEQ ID NO: 519682 - DNA, 20 bp, Artificial
  CRISPR gRNA sequence
tcacagatgaggaaactgag

SEQ ID NO: 519683 - DNA, 20 bp, Artificial
  CRISPR gRNA sequence
cacagatgaggaaactgagg

SEQ ID NO: 519684 - DNA, 20 bp, Artificial
  CRISPR gRNA sequence
acagatgaggaaactgaggg

SEQ ID NO: 519685 - DNA, 20 bp, Artificial
  CRISPR gRNA sequence
agggctcggggtaaggaagg

SEQ ID NO: 519686 - DNA, 20 bp, Artificial
  CRISPR gRNA sequence
ggggtaaggaagggcctggg

SEQ ID NO: 519687 - DNA, 20 bp, Artificial
  CRISPR gRNA sequence
gggcgtcctgtggtaagtaa

SEQ ID NO: 519688 - DNA, 20 bp, Artificial
  CRISPR gRNA sequence
tggtaagtaacagagctggg

SEQ ID NO: 519689 - DNA, 20 bp, Artificial
  CRISPR gRNA sequence
ggtgtgaggtgagccaccca

SEQ ID NO: 519690 - DNA, 20 bp, Artificial
  CRISPR gRNA sequence
tccaccctgaagaacggggc

SEQ ID NO: 519691 - DNA, 20 bp, Artificial
  CRISPR gRNA sequence
aagaacggggcacgtggctg

SEQ ID NO: 519692 - DNA, 20 bp, Artificial
  CRISPR gRNA sequence
tgtaaagtacaatgacaact

SEQ ID NO: 519693 - DNA, 20 bp, Artificial
  CRISPR gRNA sequence
tctcgttcctccagctccac

SEQ ID NO: 519694 - DNA, 20 bp, Artificial
  CRISPR gRNA sequence
gttcctccagctccaccctg

SEQ ID NO: 519695 - DNA, 20 bp, Artificial
  CRISPR gRNA sequence
ctccagctccaccctgaaga

SEQ ID NO: 519696 - DNA, 20 bp, Artificial
  CRISPR gRNA sequence
cagctccaccctgaagaacg

SEQ ID NO: 519697 - DNA, 20 bp, Artificial
  CRISPR gRNA sequence
caccctgaagaacggggcac

SEQ ID NO: 519698 - DNA, 20 bp, Artificial
  CRISPR gRNA sequence
aagaacggggcacgtggctg

SEQ ID NO: 519699 - DNA, 20 bp, Artificial
  CRISPR gRNA sequence
tgtaaagtacaatgacaacc

SEQ ID NO: 519700 - DNA, 20 bp, Artificial
  CRISPR gRNA sequence
cttcctccagctcagtcctt

SEQ ID NO: 519701 - DNA, 20 bp, Artificial
  CRISPR gRNA sequence
cctccagctcagtccttctg

SEQ ID NO: 519702 - DNA, 20 bp, Artificial
  CRISPR gRNA sequence
ctccagctcagtccttctgt

SEQ ID NO: 519703 - DNA, 20 bp, Artificial
  CRISPR gRNA sequence
cagctcagtccttctgtccc

SEQ ID NO: 519704 - DNA, 20 bp, Artificial
  CRISPR gRNA sequence
agtccttctgtccctgtggc

SEQ ID NO: 519705 - DNA, 20 bp, Artificial
  CRISPR gRNA sequence
ctgtccctgtggcctcaggg

SEQ ID NO: 519706 - DNA, 20 bp, Artificial
  CRISPR gRNA sequence
tgtccctgtggcctcagggc

SEQ ID NO: 519707 - DNA, 20 bp, Artificial
  CRISPR gRNA sequence
tccctgtggcctcagggcca

SEQ ID NO: 519708 - DNA, 20 bp, Artificial
  CRISPR gRNA sequence
tggcctcagggccacacact

SEQ ID NO: 519709 - DNA, 20 bp, Artificial
  CRISPR gRNA sequence
agggccacacactgtgcagg

SEQ ID NO: 519710 - DNA, 20 bp, Artificial
  CRISPR gRNA sequence
tgcaggctgctatgggcgga

SEQ ID NO: 519711 - DNA, 20 bp, Artificial
  CRISPR gRNA sequence
ctatgggcggaggctccttt

SEQ ID NO: 519712 - DNA, 20 bp, Artificial
  CRISPR gRNA sequence
tgggcggaggctcctttcag

SEQ ID NO: 519713 - DNA, 20 bp, Artificial
  CRISPR gRNA sequence
ctttcaggagggcgtgcagt

SEQ ID NO: 519714 - DNA, 20 bp, Artificial
  CRISPR gRNA sequence
tcaggagggcgtgcagtgtt

SEQ ID NO: 519715 - DNA, 20 bp, Artificial
  CRISPR gRNA sequence
caggagggcgtgcagtgttt

SEQ ID NO: 519716 - DNA, 20 bp, Artificial
  CRISPR gRNA sequence
aggagggcgtgcagtgtttc

SEQ ID NO: 519717 - DNA, 20 bp, Artificial
  CRISPR gRNA sequence
ccttccttctagcgaatccc

SEQ ID NO: 519718 - DNA, 20 bp, Artificial
  CRISPR gRNA sequence
cttccttctagcgaatccct

SEQ ID NO: 519719 - DNA, 20 bp, Artificial
  CRISPR gRNA sequence
ccttctagcgaatccctgtt

SEQ ID NO: 519720 - DNA, 20 bp, Artificial
  CRISPR gRNA sequence
cttctagcgaatccctgtta

SEQ ID NO: 519721 - DNA, 20 bp, Artificial
  CRISPR gRNA sequence
ctagcgaatccctgttacac

SEQ ID NO: 519722 - DNA, 20 bp, Artificial
  CRISPR gRNA sequence
tagcgaatccctgttacaca

SEQ ID NO: 519723 - DNA, 20 bp, Artificial
  CRISPR gRNA sequence
gcgaatccctgttacacagt

SEQ ID NO: 519724 - DNA, 20 bp, Artificial
  CRISPR gRNA sequence
ttacacagtcagggctccac

SEQ ID NO: 519725 - DNA, 20 bp, Artificial
  CRISPR gRNA sequence
cacagtcagggctccaccca

SEQ ID NO: 519726 - DNA, 20 bp, Artificial
  CRISPR gRNA sequence
cacccagcaggcctggctgg

SEQ ID NO: 519727 - DNA, 20 bp, Artificial
  CRISPR gRNA sequence
gctggccacaccccacacat

SEQ ID NO: 519728 - DNA, 20 bp, Artificial
  CRISPR gRNA sequence
gccacaccccacacatgcca

SEQ ID NO: 519729 - DNA, 20 bp, Artificial
  CRISPR gRNA sequence
agctcctgagaggtagcctc

SEQ ID NO: 519730 - DNA, 20 bp, Artificial
  CRISPR gRNA sequence
ctgagaggtagcctctgagc

SEQ ID NO: 519731 - DNA, 20 bp, Artificial
  CRISPR gRNA sequence
agaggtagcctctgagccct

SEQ ID NO: 519732 - DNA, 20 bp, Artificial
  CRISPR gRNA sequence
tgagcccttggtacatccta

SEQ ID NO: 519733 - DNA, 20 bp, Artificial
  CRISPR gRNA sequence
agcccttggtacatcctacc

SEQ ID NO: 519734 - DNA, 20 bp, Artificial
  CRISPR gRNA sequence
ggtacatcctacccgatggg

SEQ ID NO: 519735 - DNA, 20 bp, Artificial
  CRISPR gRNA sequence
gtacatcctacccgatgggg

SEQ ID NO: 519736 - DNA, 20 bp, Artificial
  CRISPR gRNA sequence
cccgatgggggtgtcattgt

SEQ ID NO: 519737 - DNA, 20 bp, Artificial
  CRISPR gRNA sequence
ttcctggggcctcaggtcac

SEQ ID NO: 519738 - DNA, 20 bp, Artificial
  CRISPR gRNA sequence
ctggggcctcaggtcacacc

SEQ ID NO: 519739 - DNA, 20 bp, Artificial
  CRISPR gRNA sequence
gggcctcaggtcacaccgga

SEQ ID NO: 519740 - DNA, 20 bp, Artificial
  CRISPR gRNA sequence
aggtcacaccggatagtccc

SEQ ID NO: 519741 - DNA, 20 bp, Artificial
  CRISPR gRNA sequence
ggggtggggccctggacagt

SEQ ID NO: 519742 - DNA, 20 bp, Artificial
  CRISPR gRNA sequence
gggtggggccctggacagtt

SEQ ID NO: 519743 - DNA, 20 bp, Artificial
  CRISPR gRNA sequence
gacagttttcagcttgacct

SEQ ID NO: 519744 - DNA, 20 bp, Artificial
  CRISPR gRNA sequence
tcagcttgacctctggaggg

SEQ ID NO: 519745 - DNA, 20 bp, Artificial
  CRISPR gRNA sequence
cagcttgacctctggagggc

SEQ ID NO: 519746 - DNA, 20 bp, Artificial
  CRISPR gRNA sequence
agcttgacctctggagggct

SEQ ID NO: 519747 - DNA, 20 bp, Artificial
  CRISPR gRNA sequence
gacctctggagggctagaga

SEQ ID NO: 519748 - DNA, 20 bp, Artificial
  CRISPR gRNA sequence
acctctggagggctagagac

SEQ ID NO: 519749 - DNA, 20 bp, Artificial
  CRISPR gRNA sequence
tggagggctagagactgagg

SEQ ID NO: 519750 - DNA, 20 bp, Artificial
  CRISPR gRNA sequence
gagggctagagactgaggtc

SEQ ID NO: 519751 - DNA, 20 bp, Artificial
  CRISPR gRNA sequence
gagactgaggtcagccatgg

SEQ ID NO: 519752 - DNA, 20 bp, Artificial
  CRISPR gRNA sequence
aggtcagccatggggtgtca

SEQ ID NO: 519753 - DNA, 20 bp, Artificial
  CRISPR gRNA sequence
tgactgacccccagtagaca

SEQ ID NO: 519754 - DNA, 20 bp, Artificial
  CRISPR gRNA sequence
acccccagtagacaccgagg

SEQ ID NO: 519755 - DNA, 20 bp, Artificial
  CRISPR gRNA sequence
aagagcctccttggggacca

SEQ ID NO: 519756 - DNA, 20 bp, Artificial
  CRISPR gRNA sequence
cttggggaccatgttctgtg

SEQ ID NO: 519757 - DNA, 20 bp, Artificial
  CRISPR gRNA sequence
ggggaccatgttctgtgcat

SEQ ID NO: 519758 - DNA, 20 bp, Artificial
  CRISPR gRNA sequence
gggaccatgttctgtgcatg

SEQ ID NO: 519759 - DNA, 20 bp, Artificial
  CRISPR gRNA sequence
tgtgcatgaggccacacatc

SEQ ID NO: 519760 - DNA, 20 bp, Artificial
  CRISPR gRNA sequence
tgcatgaggccacacatcat

SEQ ID NO: 519761 - DNA, 20 bp, Artificial
  CRISPR gRNA sequence
ggaggatggagcgccgccca

SEQ ID NO: 519762 - DNA, 20 bp, Artificial
  CRISPR gRNA sequence
cagggaggggacactgggag

SEQ ID NO: 519763 - DNA, 20 bp, Artificial
  CRISPR gRNA sequence
ggagctggtgcctggtttct

SEQ ID NO: 519764 - DNA, 20 bp, Artificial
  CRISPR gRNA sequence
gtgcctggtttctctcctgt

SEQ ID NO: 519765 - DNA, 20 bp, Artificial
  CRISPR gRNA sequence
gtttctctcctgtgcacctt

SEQ ID NO: 519766 - DNA, 20 bp, Artificial
  CRISPR gRNA sequence
ctctcctgtgcacctttgac

SEQ ID NO: 519767 - DNA, 20 bp, Artificial
  CRISPR gRNA sequence
tctcctgtgcacctttgacc

SEQ ID NO: 519768 - DNA, 20 bp, Artificial
  CRISPR gRNA sequence
tcctgtgcacctttgacctt

SEQ ID NO: 519769 - DNA, 20 bp, Artificial
  CRISPR gRNA sequence
ctgtgcacctttgacctttg

SEQ ID NO: 519770 - DNA, 20 bp, Artificial
  CRISPR gRNA sequence
tgcacctttgacctttgctg

SEQ ID NO: 519771 - DNA, 20 bp, Artificial
  CRISPR gRNA sequence
tgacctttgctgacttttgt

SEQ ID NO: 519772 - DNA, 20 bp, Artificial
  CRISPR gRNA sequence
gacctttgctgacttttgtc

SEQ ID NO: 519773 - DNA, 20 bp, Artificial
  CRISPR gRNA sequence
acctttgctgacttttgtct

SEQ ID NO: 519774 - DNA, 20 bp, Artificial
  CRISPR gRNA sequence
tgctgacttttgtctgtatc

SEQ ID NO: 519775 - DNA, 20 bp, Artificial
  CRISPR gRNA sequence
gctgacttttgtctgtatcc

SEQ ID NO: 519776 - DNA, 20 bp, Artificial
  CRISPR gRNA sequence
ctgacttttgtctgtatcct

SEQ ID NO: 519777 - DNA, 20 bp, Artificial
  CRISPR gRNA sequence
acttttgtctgtatcctccc

SEQ ID NO: 519778 - DNA, 20 bp, Artificial
  CRISPR gRNA sequence
ttgtctgtatcctcccacct

SEQ ID NO: 519779 - DNA, 20 bp, Artificial
  CRISPR gRNA sequence
tgtctgtatcctcccacctc

SEQ ID NO: 519780 - DNA, 20 bp, Artificial
  CRISPR gRNA sequence
gtctgtatcctcccacctcg

SEQ ID NO: 519781 - DNA, 20 bp, Artificial
  CRISPR gRNA sequence
tctgtatcctcccacctcgg

SEQ ID NO: 519782 - DNA, 20 bp, Artificial
  CRISPR gRNA sequence
tatcctcccacctcgggcag

SEQ ID NO: 519783 - DNA, 20 bp, Artificial
  CRISPR gRNA sequence
ccacctcgggcagcggctgg

SEQ ID NO: 519784 - DNA, 20 bp, Artificial
  CRISPR gRNA sequence
gggcagcggctggcacccag

SEQ ID NO: 519785 - DNA, 20 bp, Artificial
  CRISPR gRNA sequence
gcacccaggagggtcggctc

SEQ ID NO: 519786 - DNA, 20 bp, Artificial
  CRISPR gRNA sequence
tgcaataaactgtaactgtg

SEQ ID NO: 519787 - DNA, 20 bp, Artificial
  CRISPR gRNA sequence
caataaactgtaactgtgag

SEQ ID NO: 519788 - DNA, 20 bp, Artificial
  CRISPR gRNA sequence
taactgtgagtttactggtt

SEQ ID NO: 519789 - DNA, 20 bp, Artificial
  CRISPR gRNA sequence
tgagtttactggttcctgag

SEQ ID NO: 519790 - DNA, 20 bp, Artificial
  CRISPR gRNA sequence
actggttcctgagctctgca

SEQ ID NO: 519791 - DNA, 20 bp, Artificial
  CRISPR gRNA sequence
ctggttcctgagctctgcaa

SEQ ID NO: 519792 - DNA, 20 bp, Artificial
  CRISPR gRNA sequence
gttcctgagctctgcaagtc

SEQ ID NO: 519793 - DNA, 20 bp, Artificial
  CRISPR gRNA sequence
ctgagctctgcaagtccttc

SEQ ID NO: 519794 - DNA, 20 bp, Artificial
  CRISPR gRNA sequence
agctctgcaagtccttccgg

SEQ ID NO: 519795 - DNA, 20 bp, Artificial
  CRISPR gRNA sequence
tgcaagtccttccggcaaat

SEQ ID NO: 519796 - DNA, 20 bp, Artificial
  CRISPR gRNA sequence
caagtccttccggcaaatca

SEQ ID NO: 519797 - DNA, 20 bp, Artificial
  CRISPR gRNA sequence
ccggcaaatcactgatcctg

SEQ ID NO: 519798 - DNA, 20 bp, Artificial
  CRISPR gRNA sequence
cggcaaatcactgatcctga

SEQ ID NO: 519799 - DNA, 20 bp, Artificial
  CRISPR gRNA sequence
atcctgagaaaggtcttggg

SEQ ID NO: 519800 - DNA, 20 bp, Artificial
  CRISPR gRNA sequence
agaaaggtcttgggaacccc

SEQ ID NO: 519801 - DNA, 20 bp, Artificial
  CRISPR gRNA sequence
gggaaccccaacagcacctg

SEQ ID NO: 519802 - DNA, 20 bp, Artificial
  CRISPR gRNA sequence
ggaaccccaacagcacctga

SEQ ID NO: 519803 - DNA, 20 bp, Artificial
  CRISPR gRNA sequence
agcgtcttgacgcactgacc

SEQ ID NO: 519804 - DNA, 20 bp, Artificial
  CRISPR gRNA sequence
gacgcactgacctgctcagg

SEQ ID NO: 519805 - DNA, 20 bp, Artificial
  CRISPR gRNA sequence
acgcactgacctgctcaggc

SEQ ID NO: 519806 - DNA, 20 bp, Artificial
  CRISPR gRNA sequence
acctgctcaggctgaacaca

SEQ ID NO: 519807 - DNA, 20 bp, Artificial
  CRISPR gRNA sequence
ctcaggctgaacacatggca

SEQ ID NO: 519808 - DNA, 20 bp, Artificial
  CRISPR gRNA sequence
aggctgaacacatggcacta

SEQ ID NO: 519809 - DNA, 20 bp, Artificial
  CRISPR gRNA sequence
aacacatggcactagcagcg

SEQ ID NO: 519810 - DNA, 20 bp, Artificial
  CRISPR gRNA sequence
gcagcggaaatgcaggatga

SEQ ID NO: 519811 - DNA, 20 bp, Artificial
  CRISPR gRNA sequence
cactgggggcctctttttct

SEQ ID NO: 519812 - DNA, 20 bp, Artificial
  CRISPR gRNA sequence
actgggggcctctttttcta

SEQ ID NO: 519813 - DNA, 20 bp, Artificial
  CRISPR gRNA sequence
ggggcctctttttctaggag

SEQ ID NO: 519814 - DNA, 20 bp, Artificial
  CRISPR gRNA sequence
tttttctaggagcagaggct

SEQ ID NO: 519815 - DNA, 20 bp, Artificial
  CRISPR gRNA sequence
tttctaggagcagaggctgg

SEQ ID NO: 519816 - DNA, 20 bp, Artificial
  CRISPR gRNA sequence
ttctaggagcagaggctggt

SEQ ID NO: 519817 - DNA, 20 bp, Artificial
  CRISPR gRNA sequence
tctaggagcagaggctggtt

SEQ ID NO: 519818 - DNA, 20 bp, Artificial
  CRISPR gRNA sequence
ctaggagcagaggctggtta

SEQ ID NO: 519819 - DNA, 20 bp, Artificial
  CRISPR gRNA sequence
taggagcagaggctggttat

SEQ ID NO: 519820 - DNA, 20 bp, Artificial
  CRISPR gRNA sequence
ggagcagaggctggttatca

SEQ ID NO: 519821 - DNA, 20 bp, Artificial
  CRISPR gRNA sequence
gttatcagctgtgcttcctt

SEQ ID NO: 519822 - DNA, 20 bp, Artificial
  CRISPR gRNA sequence
tcagctgtgcttccttcgtg

SEQ ID NO: 519823 - DNA, 20 bp, Artificial
  CRISPR gRNA sequence
tgcttccttcgtgaaattca

SEQ ID NO: 519824 - DNA, 20 bp, Artificial
  CRISPR gRNA sequence
ccttcgtgaaattcatccca

SEQ ID NO: 519825 - DNA, 20 bp, Artificial
  CRISPR gRNA sequence
cttcgtgaaattcatcccac

SEQ ID NO: 519826 - DNA, 20 bp, Artificial
  CRISPR gRNA sequence
cgtgaaattcatcccactcc

SEQ ID NO: 519827 - DNA, 20 bp, Artificial
  CRISPR gRNA sequence
gtgaaattcatcccactccg

SEQ ID NO: 519828 - DNA, 20 bp, Artificial
  CRISPR gRNA sequence
atcccactccgcactccaag

SEQ ID NO: 519829 - DNA, 20 bp, Artificial
  CRISPR gRNA sequence
cgcactccaagcttgtgaac

SEQ ID NO: 519830 - DNA, 20 bp, Artificial
  CRISPR gRNA sequence
caagcttgtgaacgtttttg

SEQ ID NO: 519831 - DNA, 20 bp, Artificial
  CRISPR gRNA sequence
gtgaacgtttttgtgtaatt

SEQ ID NO: 519832 - DNA, 20 bp, Artificial
  CRISPR gRNA sequence
tgaacgtttttgtgtaattt

SEQ ID NO: 519833 - DNA, 20 bp, Artificial
  CRISPR gRNA sequence
ttgtgtaattttatcttcac

SEQ ID NO: 519834 - DNA, 20 bp, Artificial
  CRISPR gRNA sequence
tgtgtaattttatcttcacg

SEQ ID NO: 519835 - DNA, 20 bp, Artificial
  CRISPR gRNA sequence
gtgtaattttatcttcacgg

SEQ ID NO: 519836 - DNA, 20 bp, Artificial
  CRISPR gRNA sequence
tgtaattttatcttcacgga

SEQ ID NO: 519837 - DNA, 20 bp, Artificial
  CRISPR gRNA sequence
tatcttcacggagagtgttg

SEQ ID NO: 519838 - DNA, 20 bp, Artificial
  CRISPR gRNA sequence
atcttcacggagagtgttga

SEQ ID NO: 519839 - DNA, 20 bp, Artificial
  CRISPR gRNA sequence
tcttcacggagagtgttgat

SEQ ID NO: 519840 - DNA, 20 bp, Artificial
  CRISPR gRNA sequence
cacggagagtgttgatgttc

SEQ ID NO: 519841 - DNA, 20 bp, Artificial
  CRISPR gRNA sequence
acggagagtgttgatgttca

SEQ ID NO: 519842 - DNA, 20 bp, Artificial
  CRISPR gRNA sequence
atgttcaaatgtatgtgagc

SEQ ID NO: 519843 - DNA, 20 bp, Artificial
  CRISPR gRNA sequence
aaatgtatgtgagcataaaa

SEQ ID NO: 519844 - DNA, 20 bp, Artificial
  CRISPR gRNA sequence
ccataaaataaagaattgtg

SEQ ID NO: 519845 - DNA, 20 bp, Artificial
  CRISPR gRNA sequence
cataaaataaagaattgtgt

SEQ ID NO: 519846 - DNA, 20 bp, Artificial
  CRISPR gRNA sequence
tgttgtattccaggaaaaaa

SEQ ID NO: 519847 - DNA, 20 bp, Artificial
  CRISPR gRNA sequence
tattccaggaaaaaacagaa

SEQ ID NO: 519848 - DNA, 20 bp, Artificial
  CRISPR gRNA sequence
caggaaaaaacagaaatatc

SEQ ID NO: 519849 - DNA, 20 bp, Artificial
  CRISPR gRNA sequence
ttaacacagctgagtttcag

SEQ ID NO: 519850 - DNA, 20 bp, Artificial
  CRISPR gRNA sequence
acacagctgagtttcaggga

SEQ ID NO: 519851 - DNA, 20 bp, Artificial
  CRISPR gRNA sequence
agtttcagggacggggagga

SEQ ID NO: 519852 - DNA, 20 bp, Artificial
  CRISPR gRNA sequence
cagggacggggaggaattcc

SEQ ID NO: 519853 - DNA, 20 bp, Artificial
  CRISPR gRNA sequence
agggacggggaggaattcct

SEQ ID NO: 519854 - DNA, 20 bp, Artificial
  CRISPR gRNA sequence
ctcctcctatcgacacgcag

SEQ ID NO: 519855 - DNA, 20 bp, Artificial
  CRISPR gRNA sequence
ctcctatcgacacgcaggcg

SEQ ID NO: 519856 - DNA, 20 bp, Artificial
  CRISPR gRNA sequence
ctatcgacacgcaggcgtcc

SEQ ID NO: 519857 - DNA, 20 bp, Artificial
  CRISPR gRNA sequence
tcgacacgcaggcgtcctgt

SEQ ID NO: 519858 - DNA, 20 bp, Artificial
  CRISPR gRNA sequence
tccccgacgggaagcctcgg

SEQ ID NO: 519859 - DNA, 20 bp, Artificial
  CRISPR gRNA sequence
gggctcctcacctaggggga

SEQ ID NO: 519860 - DNA, 20 bp, Artificial
  CRISPR gRNA sequence
ctcacctagggggatccagg

SEQ ID NO: 519861 - DNA, 20 bp, Artificial
  CRISPR gRNA sequence
acctagggggatccaggacc

SEQ ID NO: 519862 - DNA, 20 bp, Artificial
  CRISPR gRNA sequence
gggggatccaggacctgggc

SEQ ID NO: 519863 - DNA, 20 bp, Artificial
  CRISPR gRNA sequence
ggccggctggttgctcacgt

SEQ ID NO: 519864 - DNA, 20 bp, Artificial
  CRISPR gRNA sequence
gttgctcacgtgcccagcat

SEQ ID NO: 519865 - DNA, 20 bp, Artificial
  CRISPR gRNA sequence
ctcacgtgcccagcatgcag

SEQ ID NO: 519866 - DNA, 20 bp, Artificial
  CRISPR gRNA sequence
acgtgcccagcatgcagagg

SEQ ID NO: 519867 - DNA, 20 bp, Artificial
  CRISPR gRNA sequence
agacctgcagtggcgctggg

SEQ ID NO: 519868 - DNA, 20 bp, Artificial
  CRISPR gRNA sequence
cagtggcgctgggtctggcc

SEQ ID NO: 519869 - DNA, 20 bp, Artificial
  CRISPR gRNA sequence
ggtctggcctgtggctgaaa

SEQ ID NO: 519870 - DNA, 20 bp, Artificial
  CRISPR gRNA sequence
gcctgtggctgaaacatgcc

SEQ ID NO: 519871 - DNA, 20 bp, Artificial
  CRISPR gRNA sequence
tggctgaaacatgcccccac

SEQ ID NO: 519872 - DNA, 20 bp, Artificial
  CRISPR gRNA sequence
aaacatgcccccacccaatg

SEQ ID NO: 519873 - DNA, 20 bp, Artificial
  CRISPR gRNA sequence
gggacccaacagcactcacc

SEQ ID NO: 519874 - DNA, 20 bp, Artificial
  CRISPR gRNA sequence
acctcgtaggtcttcaccat

SEQ ID NO: 519875 - DNA, 20 bp, Artificial
  CRISPR gRNA sequence
gtaggtcttcaccatcctac

SEQ ID NO: 519876 - DNA, 20 bp, Artificial
  CRISPR gRNA sequence
caccatcctactggtcaccg

SEQ ID NO: 519877 - DNA, 20 bp, Artificial
  CRISPR gRNA sequence
accatcctactggtcaccgc

SEQ ID NO: 519878 - DNA, 20 bp, Artificial
  CRISPR gRNA sequence
ctggtcaccgcgaagatggg

SEQ ID NO: 519879 - DNA, 20 bp, Artificial
  CRISPR gRNA sequence
gtcaccgcgaagatgggctg

SEQ ID NO: 519880 - DNA, 20 bp, Artificial
  CRISPR gRNA sequence
gatgttgttttcagccagct

SEQ ID NO: 519881 - DNA, 20 bp, Artificial
  CRISPR gRNA sequence
ttttcagccagcttgtgcgc

SEQ ID NO: 519882 - DNA, 20 bp, Artificial
  CRISPR gRNA sequence
tcagccagcttgtgcgccag

SEQ ID NO: 519883 - DNA, 20 bp, Artificial
  CRISPR gRNA sequence
cagccagcttgtgcgccagc

SEQ ID NO: 519884 - DNA, 20 bp, Artificial
  CRISPR gRNA sequence
agccagcttgtgcgccagct

SEQ ID NO: 519885 - DNA, 20 bp, Artificial
  CRISPR gRNA sequence
gtgcgccagctggcccaccg

SEQ ID NO: 519886 - DNA, 20 bp, Artificial
  CRISPR gRNA sequence
tgcgccagctggcccaccga

SEQ ID NO: 519887 - DNA, 20 bp, Artificial
  CRISPR gRNA sequence
gcccaccgatgggtagtcct

SEQ ID NO: 519888 - DNA, 20 bp, Artificial
  CRISPR gRNA sequence
gagagaggaggtcctgctca

SEQ ID NO: 519889 - DNA, 20 bp, Artificial
  CRISPR gRNA sequence
ctcagttggccccgagtcca

SEQ ID NO: 519890 - DNA, 20 bp, Artificial
  CRISPR gRNA sequence
agttggccccgagtccagga

SEQ ID NO: 519891 - DNA, 20 bp, Artificial
  CRISPR gRNA sequence
gccccgagtccaggacaagg

SEQ ID NO: 519892 - DNA, 20 bp, Artificial
  CRISPR gRNA sequence
ccaggtacccgcccctgtct

SEQ ID NO: 519893 - DNA, 20 bp, Artificial
  CRISPR gRNA sequence
caggtacccgcccctgtctg

SEQ ID NO: 519894 - DNA, 20 bp, Artificial
  CRISPR gRNA sequence
tctgccccgctcagcgtcag

SEQ ID NO: 519895 - DNA, 20 bp, Artificial
  CRISPR gRNA sequence
ccccgctcagcgtcagccct

SEQ ID NO: 519896 - DNA, 20 bp, Artificial
  CRISPR gRNA sequence
agcgtcagccctgcccgtgc

SEQ ID NO: 519897 - DNA, 20 bp, Artificial
  CRISPR gRNA sequence
cccgtgcttcgaaccctctc

SEQ ID NO: 519898 - DNA, 20 bp, Artificial
  CRISPR gRNA sequence
cgaaccctctctggggaagg

SEQ ID NO: 519899 - DNA, 20 bp, Artificial
  CRISPR gRNA sequence
gaaccctctctggggaaggc

SEQ ID NO: 519900 - DNA, 20 bp, Artificial
  CRISPR gRNA sequence
tctggggaaggctggagagg

SEQ ID NO: 519901 - DNA, 20 bp, Artificial
  CRISPR gRNA sequence
tggggaaggctggagaggca

SEQ ID NO: 519902 - DNA, 20 bp, Artificial
  CRISPR gRNA sequence
gggaaggctggagaggcaga

SEQ ID NO: 519903 - DNA, 20 bp, Artificial
  CRISPR gRNA sequence
gagaggcagaggctgccacg

SEQ ID NO: 519904 - DNA, 20 bp, Artificial
  CRISPR gRNA sequence
ccacgcaggagtgcagggca

SEQ ID NO: 519905 - DNA, 20 bp, Artificial
  CRISPR gRNA sequence
ccacgccctctgggcaatgt

SEQ ID NO: 519906 - DNA, 20 bp, Artificial
  CRISPR gRNA sequence
tgggcaatgtgtgcatagac

SEQ ID NO: 519907 - DNA, 20 bp, Artificial
  CRISPR gRNA sequence
ggcaatgtgtgcatagactc

SEQ ID NO: 519908 - DNA, 20 bp, Artificial
  CRISPR gRNA sequence
gggctttcagagtccaggca

SEQ ID NO: 519909 - DNA, 20 bp, Artificial
  CRISPR gRNA sequence
tcagagtccaggcatgagca

SEQ ID NO: 519910 - DNA, 20 bp, Artificial
  CRISPR gRNA sequence
cagagtccaggcatgagcag

SEQ ID NO: 519911 - DNA, 20 bp, Artificial
  CRISPR gRNA sequence
agagtccaggcatgagcagc

SEQ ID NO: 519912 - DNA, 20 bp, Artificial
  CRISPR gRNA sequence
gaggcgtctcaccgtgggac

SEQ ID NO: 519913 - DNA, 20 bp, Artificial
  CRISPR gRNA sequence
aggcgtctcaccgtgggact

SEQ ID NO: 519914 - DNA, 20 bp, Artificial
  CRISPR gRNA sequence
accgtgggactggggatgtc

SEQ ID NO: 519915 - DNA, 20 bp, Artificial
  CRISPR gRNA sequence
gggatgtccacgggggcaga

SEQ ID NO: 519916 - DNA, 20 bp, Artificial
  CRISPR gRNA sequence
ccccacacggtggacctgct

SEQ ID NO: 519917 - DNA, 20 bp, Artificial
  CRISPR gRNA sequence
cccacacggtggacctgctt

SEQ ID NO: 519918 - DNA, 20 bp, Artificial
  CRISPR gRNA sequence
ctttcgcactgagggacact

SEQ ID NO: 519919 - DNA, 20 bp, Artificial
  CRISPR gRNA sequence
tcgcactgagggacactcag

SEQ ID NO: 519920 - DNA, 20 bp, Artificial
  CRISPR gRNA sequence
cgcactgagggacactcagt

SEQ ID NO: 519921 - DNA, 20 bp, Artificial
  CRISPR gRNA sequence
gcactgagggacactcagtt

SEQ ID NO: 519922 - DNA, 20 bp, Artificial
  CRISPR gRNA sequence
agggacactcagtttcggta

SEQ ID NO: 519923 - DNA, 20 bp, Artificial
  CRISPR gRNA sequence
agtttcggtagaggccatga

SEQ ID NO: 519924 - DNA, 20 bp, Artificial
  CRISPR gRNA sequence
cggtagaggccatgagtgtc

SEQ ID NO: 519925 - DNA, 20 bp, Artificial
  CRISPR gRNA sequence
ggtagaggccatgagtgtca

SEQ ID NO: 519926 - DNA, 20 bp, Artificial
  CRISPR gRNA sequence
tccctacccgagttccggga

SEQ ID NO: 519927 - DNA, 20 bp, Artificial
  CRISPR gRNA sequence
cctacccgagttccgggacc

SEQ ID NO: 519928 - DNA, 20 bp, Artificial
  CRISPR gRNA sequence
cccgagttccgggacccgag

SEQ ID NO: 519929 - DNA, 20 bp, Artificial
  CRISPR gRNA sequence
cgggacccgagggccgtccc

SEQ ID NO: 519930 - DNA, 20 bp, Artificial
  CRISPR gRNA sequence
ccgtctgtggctcccggcgg

SEQ ID NO: 519931 - DNA, 20 bp, Artificial
  CRISPR gRNA sequence
tggctcccggcggaggacct

SEQ ID NO: 519932 - DNA, 20 bp, Artificial
  CRISPR gRNA sequence
ccggcggaggacctgagtct

SEQ ID NO: 519933 - DNA, 20 bp, Artificial
  CRISPR gRNA sequence
agtcttgtatctctaaagtc

SEQ ID NO: 519934 - DNA, 20 bp, Artificial
  CRISPR gRNA sequence
gtatctctaaagtcctttgc

SEQ ID NO: 519935 - DNA, 20 bp, Artificial
  CRISPR gRNA sequence
tatctctaaagtcctttgcg

SEQ ID NO: 519936 - DNA, 20 bp, Artificial
  CRISPR gRNA sequence
taaagtcctttgcggccccc

SEQ ID NO: 519937 - DNA, 20 bp, Artificial
  CRISPR gRNA sequence
aagtcctttgcggcccccag

SEQ ID NO: 519938 - DNA, 20 bp, Artificial
  CRISPR gRNA sequence
tgcggcccccagagcctaca

SEQ ID NO: 519939 - DNA, 20 bp, Artificial
  CRISPR gRNA sequence
gcggcccccagagcctacaa

SEQ ID NO: 519940 - DNA, 20 bp, Artificial
  CRISPR gRNA sequence
cggcccccagagcctacaac

SEQ ID NO: 519941 - DNA, 20 bp, Artificial
  CRISPR gRNA sequence
caacgtcaggctgcaagagc

SEQ ID NO: 519942 - DNA, 20 bp, Artificial
  CRISPR gRNA sequence
caagagcgtcgcactacggc

SEQ ID NO: 519943 - DNA, 20 bp, Artificial
  CRISPR gRNA sequence
cggccagcgaggacaagccc

SEQ ID NO: 519944 - DNA, 20 bp, Artificial
  CRISPR gRNA sequence
gtgaccagtggttgcctctc

SEQ ID NO: 519945 - DNA, 20 bp, Artificial
  CRISPR gRNA sequence
tgaccagtggttgcctctcg

SEQ ID NO: 519946 - DNA, 20 bp, Artificial
  CRISPR gRNA sequence
cctctcggcccacggctgat

SEQ ID NO: 519947 - DNA, 20 bp, Artificial
  CRISPR gRNA sequence
tcggcccacggctgatccca

SEQ ID NO: 519948 - DNA, 20 bp, Artificial
  CRISPR gRNA sequence
ggcccacggctgatcccagc

SEQ ID NO: 519949 - DNA, 20 bp, Artificial
  CRISPR gRNA sequence
atcccagccagaagtcctgg

SEQ ID NO: 519950 - DNA, 20 bp, Artificial
  CRISPR gRNA sequence
gcccctctgagccattgaga

SEQ ID NO: 519951 - DNA, 20 bp, Artificial
  CRISPR gRNA sequence
tgagccattgagatgcctcc

SEQ ID NO: 519952 - DNA, 20 bp, Artificial
  CRISPR gRNA sequence
agccattgagatgcctccgc

SEQ ID NO: 519953 - DNA, 20 bp, Artificial
  CRISPR gRNA sequence
agatgcctccgcagagaggc

SEQ ID NO: 519954 - DNA, 20 bp, Artificial
  CRISPR gRNA sequence
cgcagagaggctcatcctaa

SEQ ID NO: 519955 - DNA, 20 bp, Artificial
  CRISPR gRNA sequence
atcctaacccgtgcatcctg

SEQ ID NO: 519956 - DNA, 20 bp, Artificial
  CRISPR gRNA sequence
acccgtgcatcctgggctcc

SEQ ID NO: 519957 - DNA, 20 bp, Artificial
  CRISPR gRNA sequence
ggctccttctcgcctctgtc

SEQ ID NO: 519958 - DNA, 20 bp, Artificial
  CRISPR gRNA sequence
cttctcgcctctgtccctcc

SEQ ID NO: 519959 - DNA, 20 bp, Artificial
  CRISPR gRNA sequence
ctcgcctctgtccctccctg

SEQ ID NO: 519960 - DNA, 20 bp, Artificial
  CRISPR gRNA sequence
tcgcctctgtccctccctgc

SEQ ID NO: 519961 - DNA, 20 bp, Artificial
  CRISPR gRNA sequence
gcctctgtccctccctgcat

SEQ ID NO: 519962 - DNA, 20 bp, Artificial
  CRISPR gRNA sequence
tgtccctccctgcatgttcc

SEQ ID NO: 519963 - DNA, 20 bp, Artificial
  CRISPR gRNA sequence
tccctccctgcatgttcctc

SEQ ID NO: 519964 - DNA, 20 bp, Artificial
  CRISPR gRNA sequence
cctgcatgttcctcatggtc

SEQ ID NO: 519965 - DNA, 20 bp, Artificial
  CRISPR gRNA sequence
catgttcctcatggtccccg

SEQ ID NO: 519966 - DNA, 20 bp, Artificial
  CRISPR gRNA sequence
ctcatggtccccgcagccgc

SEQ ID NO: 519967 - DNA, 20 bp, Artificial
  CRISPR gRNA sequence
atggtccccgcagccgctca

SEQ ID NO: 519968 - DNA, 20 bp, Artificial
  CRISPR gRNA sequence
acccagctcaggcaatgggg

SEQ ID NO: 519969 - DNA, 20 bp, Artificial
  CRISPR gRNA sequence
aggcaatgggggcagggagg

SEQ ID NO: 519970 - DNA, 20 bp, Artificial
  CRISPR gRNA sequence
gaggaggcggactcaggggc

SEQ ID NO: 519971 - DNA, 20 bp, Artificial
  CRISPR gRNA sequence
aggggcagcagggaacgtac

SEQ ID NO: 519972 - DNA, 20 bp, Artificial
  CRISPR gRNA sequence
ggggatgggaccctggccag

SEQ ID NO: 519973 - DNA, 20 bp, Artificial
  CRISPR gRNA sequence
gggatgggaccctggccaga

SEQ ID NO: 519974 - DNA, 20 bp, Artificial
  CRISPR gRNA sequence
gccagaggcggggacggcag

SEQ ID NO: 519975 - DNA, 20 bp, Artificial
  CRISPR gRNA sequence
ggggcggttactatacctcc

SEQ ID NO: 519976 - DNA, 20 bp, Artificial
  CRISPR gRNA sequence
ctatacctccacagcagctg

SEQ ID NO: 519977 - DNA, 20 bp, Artificial
  CRISPR gRNA sequence
tacctccacagcagctgtca

SEQ ID NO: 519978 - DNA, 20 bp, Artificial
  CRISPR gRNA sequence
cacagcagctgtcagcccag

SEQ ID NO: 519979 - DNA, 20 bp, Artificial
  CRISPR gRNA sequence
tcagcccaggtaggggggca

SEQ ID NO: 519980 - DNA, 20 bp, Artificial
  CRISPR gRNA sequence
gagaccaacagagcctgggt

SEQ ID NO: 519981 - DNA, 20 bp, Artificial
  CRISPR gRNA sequence
ggtgtcccacaagggcgagg

SEQ ID NO: 519982 - DNA, 20 bp, Artificial
  CRISPR gRNA sequence
agcctggctgcccccaccaa

SEQ ID NO: 519983 - DNA, 20 bp, Artificial
  CRISPR gRNA sequence
gctgcccccaccaaccctac

SEQ ID NO: 519984 - DNA, 20 bp, Artificial
  CRISPR gRNA sequence
cccccaccaaccctaccctc

SEQ ID NO: 519985 - DNA, 20 bp, Artificial
  CRISPR gRNA sequence
ccctcccctggcctgaggcc

SEQ ID NO: 519986 - DNA, 20 bp, Artificial
  CRISPR gRNA sequence
ccctggcctgaggccagtcc

SEQ ID NO: 519987 - DNA, 20 bp, Artificial
  CRISPR gRNA sequence
gcctgaggccagtccgggga

SEQ ID NO: 519988 - DNA, 20 bp, Artificial
  CRISPR gRNA sequence
aggccagtccggggagaccc

SEQ ID NO: 519989 - DNA, 20 bp, Artificial
  CRISPR gRNA sequence
ccacttggggcttccagaag

SEQ ID NO: 519990 - DNA, 20 bp, Artificial
  CRISPR gRNA sequence
ggggcttccagaagtttcct

SEQ ID NO: 519991 - DNA, 20 bp, Artificial
  CRISPR gRNA sequence
gggcttccagaagtttcctc

SEQ ID NO: 519992 - DNA, 20 bp, Artificial
  CRISPR gRNA sequence
ccagaagtttcctcaggaat

SEQ ID NO: 519993 - DNA, 20 bp, Artificial
  CRISPR gRNA sequence
cagaagtttcctcaggaatc

SEQ ID NO: 519994 - DNA, 20 bp, Artificial
  CRISPR gRNA sequence
cctcaggaatctgctccttg

SEQ ID NO: 519995 - DNA, 20 bp, Artificial
  CRISPR gRNA sequence
ctcaggaatctgctccttgg

SEQ ID NO: 519996 - DNA, 20 bp, Artificial
  CRISPR gRNA sequence
aggaatctgctccttgggtc

SEQ ID NO: 519997 - DNA, 20 bp, Artificial
  CRISPR gRNA sequence
ctccttgggtcagaaggagg

SEQ ID NO: 519998 - DNA, 20 bp, Artificial
  CRISPR gRNA sequence
cttgggtcagaaggaggctc

SEQ ID NO: 519999 - DNA, 20 bp, Artificial
  CRISPR gRNA sequence
gggtcagaaggaggctctgt

SEQ ID NO: 520000 - DNA, 20 bp, Artificial
  CRISPR gRNA sequence
ggtcagaaggaggctctgtc

SEQ ID NO: 520001 - DNA, 20 bp, Artificial
  CRISPR gRNA sequence
tgtcaggtggagaccccacc

SEQ ID NO: 520002 - DNA, 20 bp, Artificial
  CRISPR gRNA sequence
tcaggtggagaccccaccct

SEQ ID NO: 520003 - DNA, 20 bp, Artificial
  CRISPR gRNA sequence
gtctcctccgtcagtggtgt

SEQ ID NO: 520004 - DNA, 20 bp, Artificial
  CRISPR gRNA sequence
tctcctccgtcagtggtgtc

SEQ ID NO: 520005 - DNA, 20 bp, Artificial
  CRISPR gRNA sequence
ctccgtcagtggtgtcctgc

SEQ ID NO: 520006 - DNA, 20 bp, Artificial
  CRISPR gRNA sequence
cgtcagtggtgtcctgccag

SEQ ID NO: 520007 - DNA, 20 bp, Artificial
  CRISPR gRNA sequence
ccaggcggtgcctgggtgcc

SEQ ID NO: 520008 - DNA, 20 bp, Artificial
  CRISPR gRNA sequence
ggtgcctggggtggggactt

SEQ ID NO: 520009 - DNA, 20 bp, Artificial
  CRISPR gRNA sequence
gggtggggacttacgaattc

SEQ ID NO: 520010 - DNA, 20 bp, Artificial
  CRISPR gRNA sequence
acgaattcgttgctcctctt

SEQ ID NO: 520011 - DNA, 20 bp, Artificial
  CRISPR gRNA sequence
cgaattcgttgctcctcttg

SEQ ID NO: 520012 - DNA, 20 bp, Artificial
  CRISPR gRNA sequence
gttgctcctcttgtacaagt

SEQ ID NO: 520013 - DNA, 20 bp, Artificial
  CRISPR gRNA sequence
ctcctcttgtacaagttgtc

SEQ ID NO: 520014 - DNA, 20 bp, Artificial
  CRISPR gRNA sequence
ctcttgtacaagttgtcctc

SEQ ID NO: 520015 - DNA, 20 bp, Artificial
  CRISPR gRNA sequence
ttgtacaagttgtcctccag

SEQ ID NO: 520016 - DNA, 20 bp, Artificial
  CRISPR gRNA sequence
gtacaagttgtcctccaggt

SEQ ID NO: 520017 - DNA, 20 bp, Artificial
  CRISPR gRNA sequence
tacaagttgtcctccaggtg

SEQ ID NO: 520018 - DNA, 20 bp, Artificial
  CRISPR gRNA sequence
tcctccaggtgacagcggcc

SEQ ID NO: 520019 - DNA, 20 bp, Artificial
  CRISPR gRNA sequence
caggtgacagcggccgtcgt

SEQ ID NO: 520020 - DNA, 20 bp, Artificial
  CRISPR gRNA sequence
ggggtcaggatggcgcccag

SEQ ID NO: 520021 - DNA, 20 bp, Artificial
  CRISPR gRNA sequence
cccgtcgcccgcgaaatgga

SEQ ID NO: 520022 - DNA, 20 bp, Artificial
  CRISPR gRNA sequence
ccgtcgcccgcgaaatggaa

SEQ ID NO: 520023 - DNA, 20 bp, Artificial
  CRISPR gRNA sequence
cgccagccgatttcctcctg

SEQ ID NO: 520024 - DNA, 20 bp, Artificial
  CRISPR gRNA sequence
cctcctgagaagaaggcgtg

SEQ ID NO: 520025 - DNA, 20 bp, Artificial
  CRISPR gRNA sequence
ctcctgagaagaaggcgtgg

SEQ ID NO: 520026 - DNA, 20 bp, Artificial
  CRISPR gRNA sequence
ctgagaagaaggcgtggggg

SEQ ID NO: 520027 - DNA, 20 bp, Artificial
  CRISPR gRNA sequence
agaagaaggcgtggggggca

SEQ ID NO: 520028 - DNA, 20 bp, Artificial
  CRISPR gRNA sequence
cctgcctcagtttcccagac

SEQ ID NO: 520029 - DNA, 20 bp, Artificial
  CRISPR gRNA sequence
cctcagtttcccagacccgg

SEQ ID NO: 520030 - DNA, 20 bp, Artificial
  CRISPR gRNA sequence
agtttcccagacccggccct

SEQ ID NO: 520031 - DNA, 20 bp, Artificial
  CRISPR gRNA sequence
cccagacccggccctctgga

SEQ ID NO: 520032 - DNA, 20 bp, Artificial
  CRISPR gRNA sequence
ccagacccggccctctggag

SEQ ID NO: 520033 - DNA, 20 bp, Artificial
  CRISPR gRNA sequence
tggagcagaggagacgatgc

SEQ ID NO: 520034 - DNA, 20 bp, Artificial
  CRISPR gRNA sequence
gagcagaggagacgatgcag

SEQ ID NO: 520035 - DNA, 20 bp, Artificial
  CRISPR gRNA sequence
gtggggtggcccggaggctg

SEQ ID NO: 520036 - DNA, 20 bp, Artificial
  CRISPR gRNA sequence
gtgtgggtccccctttcccc

SEQ ID NO: 520037 - DNA, 20 bp, Artificial
  CRISPR gRNA sequence
tcccctgggtctcagggacc

SEQ ID NO: 520038 - DNA, 20 bp, Artificial
  CRISPR gRNA sequence
cccctgggtctcagggaccc

SEQ ID NO: 520039 - DNA, 20 bp, Artificial
  CRISPR gRNA sequence
ccctgggtctcagggaccca

SEQ ID NO: 520040 - DNA, 20 bp, Artificial
  CRISPR gRNA sequence
ggtctcagggacccagctgt

SEQ ID NO: 520041 - DNA, 20 bp, Artificial
  CRISPR gRNA sequence
agggacccagctgtgttccc

SEQ ID NO: 520042 - DNA, 20 bp, Artificial
  CRISPR gRNA sequence
tgttcccccagacgccacgc

SEQ ID NO: 520043 - DNA, 20 bp, Artificial
  CRISPR gRNA sequence
ccccagacgccacgcccagg

SEQ ID NO: 520044 - DNA, 20 bp, Artificial
  CRISPR gRNA sequence
aaacaccccgtgcacatgtg

SEQ ID NO: 520045 - DNA, 20 bp, Artificial
  CRISPR gRNA sequence
cggtccctgcacttcagagc

SEQ ID NO: 520046 - DNA, 20 bp, Artificial
  CRISPR gRNA sequence
cacttcagagctgggaacaa

SEQ ID NO: 520047 - DNA, 20 bp, Artificial
  CRISPR gRNA sequence
cagagctgggaacaaaccct

SEQ ID NO: 520048 - DNA, 20 bp, Artificial
  CRISPR gRNA sequence
agagctgggaacaaaccctc

SEQ ID NO: 520049 - DNA, 20 bp, Artificial
  CRISPR gRNA sequence
ggaacaaaccctcaggaaac

SEQ ID NO: 520050 - DNA, 20 bp, Artificial
  CRISPR gRNA sequence
aggaaaccatccccaagggg

SEQ ID NO: 520051 - DNA, 20 bp, Artificial
  CRISPR gRNA sequence
gcagacgtgtgggccacacg

SEQ ID NO: 520052 - DNA, 20 bp, Artificial
  CRISPR gRNA sequence
aggggcccagcaggccttga

SEQ ID NO: 520053 - DNA, 20 bp, Artificial
  CRISPR gRNA sequence
gagtccaccattgacagccc

SEQ ID NO: 520054 - DNA, 20 bp, Artificial
  CRISPR gRNA sequence
agtccaccattgacagcccc

SEQ ID NO: 520055 - DNA, 20 bp, Artificial
  CRISPR gRNA sequence
acagcccctggcaggcgcat

SEQ ID NO: 520056 - DNA, 20 bp, Artificial
  CRISPR gRNA sequence
gcaggcgcatgtgggggccg

SEQ ID NO: 520057 - DNA, 20 bp, Artificial
  CRISPR gRNA sequence
ggctgtgacctcacactcgt

SEQ ID NO: 520058 - DNA, 20 bp, Artificial
  CRISPR gRNA sequence
tgacctcacactcgtgagca

SEQ ID NO: 520059 - DNA, 20 bp, Artificial
  CRISPR gRNA sequence
acactcgtgagcagtgtgtc

SEQ ID NO: 520060 - DNA, 20 bp, Artificial
  CRISPR gRNA sequence
gtgagcagtgtgtctgcgct

SEQ ID NO: 520061 - DNA, 20 bp, Artificial
  CRISPR gRNA sequence
cgctgggactgcagggaagc

SEQ ID NO: 520062 - DNA, 20 bp, Artificial
  CRISPR gRNA sequence
ggactgcagggaagcaggag

SEQ ID NO: 520063 - DNA, 20 bp, Artificial
  CRISPR gRNA sequence
cagggaagcaggagagctaa

SEQ ID NO: 520064 - DNA, 20 bp, Artificial
  CRISPR gRNA sequence
aggtgggttgtgaggggagg

SEQ ID NO: 520065 - DNA, 20 bp, Artificial
  CRISPR gRNA sequence
tgaggggaggacagtgcatg

SEQ ID NO: 520066 - DNA, 20 bp, Artificial
  CRISPR gRNA sequence
aacatggcccagggactgtg

SEQ ID NO: 520067 - DNA, 20 bp, Artificial
  CRISPR gRNA sequence
tggctgctctgttaggctga

SEQ ID NO: 520068 - DNA, 20 bp, Artificial
  CRISPR gRNA sequence
ctctgttaggctgacagtca

SEQ ID NO: 520069 - DNA, 20 bp, Artificial
  CRISPR gRNA sequence
tgttaggctgacagtcacaa

SEQ ID NO: 520070 - DNA, 20 bp, Artificial
  CRISPR gRNA sequence
ttaggctgacagtcacaaac

SEQ ID NO: 520071 - DNA, 20 bp, Artificial
  CRISPR gRNA sequence
ggctgacagtcacaaactgg

SEQ ID NO: 520072 - DNA, 20 bp, Artificial
  CRISPR gRNA sequence
acagtcacaaactgggtggg

SEQ ID NO: 520073 - DNA, 20 bp, Artificial
  CRISPR gRNA sequence
ggtgggcgggacgtggagag

SEQ ID NO: 520074 - DNA, 20 bp, Artificial
  CRISPR gRNA sequence
ggcagccagcgcccacccgg

SEQ ID NO: 520075 - DNA, 20 bp, Artificial
  CRISPR gRNA sequence
gagggaggagggtggttcca

SEQ ID NO: 520076 - DNA, 20 bp, Artificial
  CRISPR gRNA sequence
caccccaggaaccacgggac

SEQ ID NO: 520077 - DNA, 20 bp, Artificial
  CRISPR gRNA sequence
ctgcctagcggccctgttcc

SEQ ID NO: 520078 - DNA, 20 bp, Artificial
  CRISPR gRNA sequence
cctagcggccctgttccacc

SEQ ID NO: 520079 - DNA, 20 bp, Artificial
  CRISPR gRNA sequence
gcggccctgttccacccttg

SEQ ID NO: 520080 - DNA, 20 bp, Artificial
  CRISPR gRNA sequence
ttccacccttggccgctcgc

SEQ ID NO: 520081 - DNA, 20 bp, Artificial
  CRISPR gRNA sequence
cacccttggccgctcgcaaa

SEQ ID NO: 520082 - DNA, 20 bp, Artificial
  CRISPR gRNA sequence
ggccgctcgcaaaatgttta

SEQ ID NO: 520083 - DNA, 20 bp, Artificial
  CRISPR gRNA sequence
gccgctcgcaaaatgtttag

SEQ ID NO: 520084 - DNA, 20 bp, Artificial
  CRISPR gRNA sequence
gcaaaatgtttaggcttcat

SEQ ID NO: 520085 - DNA, 20 bp, Artificial
  CRISPR gRNA sequence
aggcttcataaggtttgccc

SEQ ID NO: 520086 - DNA, 20 bp, Artificial
  CRISPR gRNA sequence
ggcttcataaggtttgccca

SEQ ID NO: 520087 - DNA, 20 bp, Artificial
  CRISPR gRNA sequence
cataaggtttgcccagggtc

SEQ ID NO: 520088 - DNA, 20 bp, Artificial
  CRISPR gRNA sequence
ataaggtttgcccagggtca

SEQ ID NO: 520089 - DNA, 20 bp, Artificial
  CRISPR gRNA sequence
gcccagggtcacaaatttaa

SEQ ID NO: 520090 - DNA, 20 bp, Artificial
  CRISPR gRNA sequence
cccagggtcacaaatttaac

SEQ ID NO: 520091 - DNA, 20 bp, Artificial
  CRISPR gRNA sequence
aactcacagcaaacaatgaa

SEQ ID NO: 520092 - DNA, 20 bp, Artificial
  CRISPR gRNA sequence
actcacagcaaacaatgaaa

SEQ ID NO: 520093 - DNA, 20 bp, Artificial
  CRISPR gRNA sequence
acagcaaacaatgaaatcag

SEQ ID NO: 520094 - DNA, 20 bp, Artificial
  CRISPR gRNA sequence
tcgagccctcgtggtcaccc

SEQ ID NO: 520095 - DNA, 20 bp, Artificial
  CRISPR gRNA sequence
cgagccctcgtggtcaccct

SEQ ID NO: 520096 - DNA, 20 bp, Artificial
  CRISPR gRNA sequence
gagccctcgtggtcaccctc

SEQ ID NO: 520097 - DNA, 20 bp, Artificial
  CRISPR gRNA sequence
gtggtcaccctcccttcctc

SEQ ID NO: 520098 - DNA, 20 bp, Artificial
  CRISPR gRNA sequence
ccttcctcctgccctttcct

SEQ ID NO: 520099 - DNA, 20 bp, Artificial
  CRISPR gRNA sequence
cctcctgccctttcctgcat

SEQ ID NO: 520100 - DNA, 20 bp, Artificial
  CRISPR gRNA sequence
ctcctgccctttcctgcatg

SEQ ID NO: 520101 - DNA, 20 bp, Artificial
  CRISPR gRNA sequence
ctgccctttcctgcatgggc

SEQ ID NO: 520102 - DNA, 20 bp, Artificial
  CRISPR gRNA sequence
ccctttcctgcatgggcagc

SEQ ID NO: 520103 - DNA, 20 bp, Artificial
  CRISPR gRNA sequence
tcctgcatgggcagcagcag

SEQ ID NO: 520104 - DNA, 20 bp, Artificial
  CRISPR gRNA sequence
cctgcatgggcagcagcagg

SEQ ID NO: 520105 - DNA, 20 bp, Artificial
  CRISPR gRNA sequence
ctgcatgggcagcagcaggg

SEQ ID NO: 520106 - DNA, 20 bp, Artificial
  CRISPR gRNA sequence
catgggcagcagcagggtga

SEQ ID NO: 520107 - DNA, 20 bp, Artificial
  CRISPR gRNA sequence
ctctccccaggcccaggctg

SEQ ID NO: 520108 - DNA, 20 bp, Artificial
  CRISPR gRNA sequence
tccccaggcccaggctggag

SEQ ID NO: 520109 - DNA, 20 bp, Artificial
  CRISPR gRNA sequence
cccaggcccaggctggagtc

SEQ ID NO: 520110 - DNA, 20 bp, Artificial
  CRISPR gRNA sequence
gagtccctcagacgacctgc

SEQ ID NO: 520111 - DNA, 20 bp, Artificial
  CRISPR gRNA sequence
agacgacctgccggccaggg

SEQ ID NO: 520112 - DNA, 20 bp, Artificial
  CRISPR gRNA sequence
ccggccagggtacccccctg

SEQ ID NO: 520113 - DNA, 20 bp, Artificial
  CRISPR gRNA sequence
cccccacacagcgcctgaca

SEQ ID NO: 520114 - DNA, 20 bp, Artificial
  CRISPR gRNA sequence
acagagccccccacactggg

SEQ ID NO: 520115 - DNA, 20 bp, Artificial
  CRISPR gRNA sequence
ggggaacgtggggacccaag

SEQ ID NO: 520116 - DNA, 20 bp, Artificial
  CRISPR gRNA sequence
accgggcaggcggcgacctg

SEQ ID NO: 520117 - DNA, 20 bp, Artificial
  CRISPR gRNA sequence
catcatggcgtccagcccac

SEQ ID NO: 520118 - DNA, 20 bp, Artificial
  CRISPR gRNA sequence
gggtgcatccaggtttccgg

SEQ ID NO: 520119 - DNA, 20 bp, Artificial
  CRISPR gRNA sequence
ccggaaatcagctgcttccc

SEQ ID NO: 520120 - DNA, 20 bp, Artificial
  CRISPR gRNA sequence
cggaaatcagctgcttcccg

SEQ ID NO: 520121 - DNA, 20 bp, Artificial
  CRISPR gRNA sequence
cttcccgacctcggtctgaa

SEQ ID NO: 520122 - DNA, 20 bp, Artificial
  CRISPR gRNA sequence
cccgacctcggtctgaaact

SEQ ID NO: 520123 - DNA, 20 bp, Artificial
  CRISPR gRNA sequence
ccgacctcggtctgaaactg

SEQ ID NO: 520124 - DNA, 20 bp, Artificial
  CRISPR gRNA sequence
ggtctgaaactggttggagt

SEQ ID NO: 520125 - DNA, 20 bp, Artificial
  CRISPR gRNA sequence
aaactggttggagttgttgg

SEQ ID NO: 520126 - DNA, 20 bp, Artificial
  CRISPR gRNA sequence
gttggagttgttggtcagct

SEQ ID NO: 520127 - DNA, 20 bp, Artificial
  CRISPR gRNA sequence
gagttgttggtcagcttcag

SEQ ID NO: 520128 - DNA, 20 bp, Artificial
  CRISPR gRNA sequence
ttggtcagcttcagcacgtg

SEQ ID NO: 520129 - DNA, 20 bp, Artificial
  CRISPR gRNA sequence
gtcagcttcagcacgtgcct

SEQ ID NO: 520130 - DNA, 20 bp, Artificial
  CRISPR gRNA sequence
cagcacgtgcctgaaggcaa

SEQ ID NO: 520131 - DNA, 20 bp, Artificial
  CRISPR gRNA sequence
agcacgtgcctgaaggcaaa

SEQ ID NO: 520132 - DNA, 20 bp, Artificial
  CRISPR gRNA sequence
aaggcaaacgggggctggca

SEQ ID NO: 520133 - DNA, 20 bp, Artificial
  CRISPR gRNA sequence
gcactctttctccttgttgg

SEQ ID NO: 520134 - DNA, 20 bp, Artificial
  CRISPR gRNA sequence
tttctccttgttggggcatg

SEQ ID NO: 520135 - DNA, 20 bp, Artificial
  CRISPR gRNA sequence
tctccttgttggggcatggg

SEQ ID NO: 520136 - DNA, 20 bp, Artificial
  CRISPR gRNA sequence
ctccttgttggggcatgggt

SEQ ID NO: 520137 - DNA, 20 bp, Artificial
  CRISPR gRNA sequence
tccttgttggggcatgggtt

SEQ ID NO: 520138 - DNA, 20 bp, Artificial
  CRISPR gRNA sequence
cttgttggggcatgggtttc

SEQ ID NO: 520139 - DNA, 20 bp, Artificial
  CRISPR gRNA sequence
gttggggcatgggtttcgca

SEQ ID NO: 520140 - DNA, 20 bp, Artificial
  CRISPR gRNA sequence
ttggggcatgggtttcgcag

SEQ ID NO: 520141 - DNA, 20 bp, Artificial
  CRISPR gRNA sequence
gggcatgggtttcgcagctt

SEQ ID NO: 520142 - DNA, 20 bp, Artificial
  CRISPR gRNA sequence
cgcagcttatcagggtgcgt

SEQ ID NO: 520143 - DNA, 20 bp, Artificial
  CRISPR gRNA sequence
gcagcttatcagggtgcgtg

SEQ ID NO: 520144 - DNA, 20 bp, Artificial
  CRISPR gRNA sequence
atcagggtgcgtgttcacga

SEQ ID NO: 520145 - DNA, 20 bp, Artificial
  CRISPR gRNA sequence
tcagggtgcgtgttcacgaa

SEQ ID NO: 520146 - DNA, 20 bp, Artificial
  CRISPR gRNA sequence
acgaacggcagcacggtctt

SEQ ID NO: 520147 - DNA, 20 bp, Artificial
  CRISPR gRNA sequence
gtccacgaaggacccgaagc

SEQ ID NO: 520148 - DNA, 20 bp, Artificial
  CRISPR gRNA sequence
tccacgaaggacccgaagcc

SEQ ID NO: 520149 - DNA, 20 bp, Artificial
  CRISPR gRNA sequence
cagggcacatggaggggctg

SEQ ID NO: 520150 - DNA, 20 bp, Artificial
  CRISPR gRNA sequence
gggaggtggcaggctgggcc

SEQ ID NO: 520151 - DNA, 20 bp, Artificial
  CRISPR gRNA sequence
ggcccaggtgggagggccag

SEQ ID NO: 520152 - DNA, 20 bp, Artificial
  CRISPR gRNA sequence
caaaggggcacgagggcaag

SEQ ID NO: 520153 - DNA, 20 bp, Artificial
  CRISPR gRNA sequence
aaaggggcacgagggcaagc

SEQ ID NO: 520154 - DNA, 20 bp, Artificial
  CRISPR gRNA sequence
tttcctctctcctagcaggg

SEQ ID NO: 520155 - DNA, 20 bp, Artificial
  CRISPR gRNA sequence
cctctctcctagcagggagg

SEQ ID NO: 520156 - DNA, 20 bp, Artificial
  CRISPR gRNA sequence
ctctctcctagcagggaggt

SEQ ID NO: 520157 - DNA, 20 bp, Artificial
  CRISPR gRNA sequence
tctcctagcagggaggtgga

SEQ ID NO: 520158 - DNA, 20 bp, Artificial
  CRISPR gRNA sequence
tcctagcagggaggtggaga

SEQ ID NO: 520159 - DNA, 20 bp, Artificial
  CRISPR gRNA sequence
ctagcagggaggtggagaaa

SEQ ID NO: 520160 - DNA, 20 bp, Artificial
  CRISPR gRNA sequence
gcagggaggtggagaaagca

SEQ ID NO: 520161 - DNA, 20 bp, Artificial
  CRISPR gRNA sequence
tgcaagcacacatgtgaacg

SEQ ID NO: 520162 - DNA, 20 bp, Artificial
  CRISPR gRNA sequence
ggagtgtgcaatgtacatgg

SEQ ID NO: 520163 - DNA, 20 bp, Artificial
  CRISPR gRNA sequence
ctgcatgtatgtgtgtgacc

SEQ ID NO: 520164 - DNA, 20 bp, Artificial
  CRISPR gRNA sequence
catgtatgtgtgtgaccagg

SEQ ID NO: 520165 - DNA, 20 bp, Artificial
  CRISPR gRNA sequence
tgtgtgcagccatctgcatg

SEQ ID NO: 520166 - DNA, 20 bp, Artificial
  CRISPR gRNA sequence
catgtgtaaacatgagtgtg

SEQ ID NO: 520167 - DNA, 20 bp, Artificial
  CRISPR gRNA sequence
tgtgtgcacgtattcctgta

SEQ ID NO: 520168 - DNA, 20 bp, Artificial
  CRISPR gRNA sequence
ctgtatgcatgtgagcatgt

SEQ ID NO: 520169 - DNA, 20 bp, Artificial
  CRISPR gRNA sequence
tatgcatgtgagcatgttca

SEQ ID NO: 520170 - DNA, 20 bp, Artificial
  CRISPR gRNA sequence
aggtatggacacacctagtt

SEQ ID NO: 520171 - DNA, 20 bp, Artificial
  CRISPR gRNA sequence
gttcacgtaggtgaccaggt

SEQ ID NO: 520172 - DNA, 20 bp, Artificial
  CRISPR gRNA sequence
acgtaggtgaccaggtacat

SEQ ID NO: 520173 - DNA, 20 bp, Artificial
  CRISPR gRNA sequence
atgtacgatttatacatgtg

SEQ ID NO: 520174 - DNA, 20 bp, Artificial
  CRISPR gRNA sequence
tgtacgatttatacatgtga

SEQ ID NO: 520175 - DNA, 20 bp, Artificial
  CRISPR gRNA sequence
atacatgtgagtgaagacat

SEQ ID NO: 520176 - DNA, 20 bp, Artificial
  CRISPR gRNA sequence
tacatgtgagtgaagacata

SEQ ID NO: 520177 - DNA, 20 bp, Artificial
  CRISPR gRNA sequence
tgtgcacatgtggtcttgca

SEQ ID NO: 520178 - DNA, 20 bp, Artificial
  CRISPR gRNA sequence
gcacgtgtgtatgactgtgt

SEQ ID NO: 520179 - DNA, 20 bp, Artificial
  CRISPR gRNA sequence
cacgtgtgtatgactgtgtg

SEQ ID NO: 520180 - DNA, 20 bp, Artificial
  CRISPR gRNA sequence
tgtgtgcatgtgtgtgcaca

SEQ ID NO: 520181 - DNA, 20 bp, Artificial
  CRISPR gRNA sequence
atgtgtgtgagcatgcattt

SEQ ID NO: 520182 - DNA, 20 bp, Artificial
  CRISPR gRNA sequence
gtgtgtgagcgtgcattcac

SEQ ID NO: 520183 - DNA, 20 bp, Artificial
  CRISPR gRNA sequence
tgtgtgagcgtgcattcacg

SEQ ID NO: 520184 - DNA, 20 bp, Artificial
  CRISPR gRNA sequence
acgtgtgtgagcgtgcattt

SEQ ID NO: 520185 - DNA, 20 bp, Artificial
  CRISPR gRNA sequence
gtgcatgtgagcatacattc

SEQ ID NO: 520186 - DNA, 20 bp, Artificial
  CRISPR gRNA sequence
tgcatgtgagcatacattcg

SEQ ID NO: 520187 - DNA, 20 bp, Artificial
  CRISPR gRNA sequence
gcgtgtgtgagcatgcattt

SEQ ID NO: 520188 - DNA, 20 bp, Artificial
  CRISPR gRNA sequence
gcgtgtgagcatacattcat

SEQ ID NO: 520189 - DNA, 20 bp, Artificial
  CRISPR gRNA sequence
cgtgtgagcatacattcatg

SEQ ID NO: 520190 - DNA, 20 bp, Artificial
  CRISPR gRNA sequence
atgtgtgagcatacattcac

SEQ ID NO: 520191 - DNA, 20 bp, Artificial
  CRISPR gRNA sequence
acatgtgagagcatgcattt

SEQ ID NO: 520192 - DNA, 20 bp, Artificial
  CRISPR gRNA sequence
gtgtgtttgagcatgtgtgt

SEQ ID NO: 520193 - DNA, 20 bp, Artificial
  CRISPR gRNA sequence
tgtgtttgagcatgtgtgtg

SEQ ID NO: 520194 - DNA, 20 bp, Artificial
  CRISPR gRNA sequence
gagcatgtgtgtgagcatac

SEQ ID NO: 520195 - DNA, 20 bp, Artificial
  CRISPR gRNA sequence
agcatgtgtgtgagcataca

SEQ ID NO: 520196 - DNA, 20 bp, Artificial
  CRISPR gRNA sequence
acgtgtgtgagcatgcattc

SEQ ID NO: 520197 - DNA, 20 bp, Artificial
  CRISPR gRNA sequence
acgtgtgtgtgcatttgagt

SEQ ID NO: 520198 - DNA, 20 bp, Artificial
  CRISPR gRNA sequence
gagtttgggtgtgcttttgt

SEQ ID NO: 520199 - DNA, 20 bp, Artificial
  CRISPR gRNA sequence
agtttgggtgtgcttttgtg

SEQ ID NO: 520200 - DNA, 20 bp, Artificial
  CRISPR gRNA sequence
gggtgtgcttttgtgtgtga

SEQ ID NO: 520201 - DNA, 20 bp, Artificial
  CRISPR gRNA sequence
ggtgtgcttttgtgtgtgag

SEQ ID NO: 520202 - DNA, 20 bp, Artificial
  CRISPR gRNA sequence
ttgtgtgtgagcatgcattc

SEQ ID NO: 520203 - DNA, 20 bp, Artificial
  CRISPR gRNA sequence
tgtgtgtgagcatgcattcg

SEQ ID NO: 520204 - DNA, 20 bp, Artificial
  CRISPR gRNA sequence
gtgtgtgagcatgcattcgc

SEQ ID NO: 520205 - DNA, 20 bp, Artificial
  CRISPR gRNA sequence
tgtgtgagcatgcattcgcg

SEQ ID NO: 520206 - DNA, 20 bp, Artificial
  CRISPR gRNA sequence
gcgtgtgtgagcatccattt

SEQ ID NO: 520207 - DNA, 20 bp, Artificial
  CRISPR gRNA sequence
gtgcatgtgaggatacattc

SEQ ID NO: 520208 - DNA, 20 bp, Artificial
  CRISPR gRNA sequence
tgcatgtgaggatacattca

SEQ ID NO: 520209 - DNA, 20 bp, Artificial
  CRISPR gRNA sequence
atgtgtgagtgtgcattcgc

SEQ ID NO: 520210 - DNA, 20 bp, Artificial
  CRISPR gRNA sequence
gcatgtgtgagcgtgcattt

SEQ ID NO: 520211 - DNA, 20 bp, Artificial
  CRISPR gRNA sequence
gcgtttgagcatgcatttgt

SEQ ID NO: 520212 - DNA, 20 bp, Artificial
  CRISPR gRNA sequence
cgtttgagcatgcatttgtg

SEQ ID NO: 520213 - DNA, 20 bp, Artificial
  CRISPR gRNA sequence
gagcatgcatttgtgtgtga

SEQ ID NO: 520214 - DNA, 20 bp, Artificial
  CRISPR gRNA sequence
agcatgcatttgtgtgtgag

SEQ ID NO: 520215 - DNA, 20 bp, Artificial
  CRISPR gRNA sequence
gtgtgtgagtgtgcattgca

SEQ ID NO: 520216 - DNA, 20 bp, Artificial
  CRISPR gRNA sequence
tgtgtgagtgtgcattgcat

SEQ ID NO: 520217 - DNA, 20 bp, Artificial
  CRISPR gRNA sequence
catgtgtgaacatgcatttg

SEQ ID NO: 520218 - DNA, 20 bp, Artificial
  CRISPR gRNA sequence
gtgtgtgagcgtgcattcac

SEQ ID NO: 520219 - DNA, 20 bp, Artificial
  CRISPR gRNA sequence
tgtgtgagcgtgcattcacg

SEQ ID NO: 520220 - DNA, 20 bp, Artificial
  CRISPR gRNA sequence
acgtgcatgagcgtgcattt

SEQ ID NO: 520221 - DNA, 20 bp, Artificial
  CRISPR gRNA sequence
gtgtgtgagcgtgcatttgt

SEQ ID NO: 520222 - DNA, 20 bp, Artificial
  CRISPR gRNA sequence
tgtgtgagcgtgcatttgtg

SEQ ID NO: 520223 - DNA, 20 bp, Artificial
  CRISPR gRNA sequence
gtgtgagcatgcatttgctt

SEQ ID NO: 520224 - DNA, 20 bp, Artificial
  CRISPR gRNA sequence
tgtgagcatgcatttgcttg

SEQ ID NO: 520225 - DNA, 20 bp, Artificial
  CRISPR gRNA sequence
gcttgtgtgtgtgtgtgtta

SEQ ID NO: 520226 - DNA, 20 bp, Artificial
  CRISPR gRNA sequence
cttgtgtgtgtgtgtgttat

SEQ ID NO: 520227 - DNA, 20 bp, Artificial
  CRISPR gRNA sequence
gtgtgtgtgtgtgttatcgt

SEQ ID NO: 520228 - DNA, 20 bp, Artificial
  CRISPR gRNA sequence
tgtgtgtgtgtgttatcgtg

SEQ ID NO: 520229 - DNA, 20 bp, Artificial
  CRISPR gRNA sequence
tcgtgcatgtgtgcatcccc

SEQ ID NO: 520230 - DNA, 20 bp, Artificial
  CRISPR gRNA sequence
tgactgacacacacgtgtgc

SEQ ID NO: 520231 - DNA, 20 bp, Artificial
  CRISPR gRNA sequence
acacacacgtgtgctggaga

SEQ ID NO: 520232 - DNA, 20 bp, Artificial
  CRISPR gRNA sequence
gagacctgctctgtggcaag

SEQ ID NO: 520233 - DNA, 20 bp, Artificial
  CRISPR gRNA sequence
ctctgtggcaaggcagtgct

SEQ ID NO: 520234 - DNA, 20 bp, Artificial
  CRISPR gRNA sequence
tgtggcaaggcagtgctggt

SEQ ID NO: 520235 - DNA, 20 bp, Artificial
  CRISPR gRNA sequence
tggcaaggcagtgctggtgt

SEQ ID NO: 520236 - DNA, 20 bp, Artificial
  CRISPR gRNA sequence
gtgtagagcggagcccttgg

SEQ ID NO: 520237 - DNA, 20 bp, Artificial
  CRISPR gRNA sequence
ggcccagcagagcttgctgt

SEQ ID NO: 520238 - DNA, 20 bp, Artificial
  CRISPR gRNA sequence
gcccagcagagcttgctgtg

SEQ ID NO: 520239 - DNA, 20 bp, Artificial
  CRISPR gRNA sequence
gctgtgtggtttcttcagtg

SEQ ID NO: 520240 - DNA, 20 bp, Artificial
  CRISPR gRNA sequence
ctgtgtggtttcttcagtgc

SEQ ID NO: 520241 - DNA, 20 bp, Artificial
  CRISPR gRNA sequence
tgtggtttcttcagtgctgc

SEQ ID NO: 520242 - DNA, 20 bp, Artificial
  CRISPR gRNA sequence
cttcagtgctgccgtcgctg

SEQ ID NO: 520243 - DNA, 20 bp, Artificial
  CRISPR gRNA sequence
ttcagtgctgccgtcgctgt

SEQ ID NO: 520244 - DNA, 20 bp, Artificial
  CRISPR gRNA sequence
cagtgctgccgtcgctgtgc

SEQ ID NO: 520245 - DNA, 20 bp, Artificial
  CRISPR gRNA sequence
agtgctgccgtcgctgtgcc

SEQ ID NO: 520246 - DNA, 20 bp, Artificial
  CRISPR gRNA sequence
ccgtcgctgtgccgtctata

SEQ ID NO: 520247 - DNA, 20 bp, Artificial
  CRISPR gRNA sequence
tgccgtctatatgtgttgtg

SEQ ID NO: 520248 - DNA, 20 bp, Artificial
  CRISPR gRNA sequence
tatgtgttgtggtctttaat

SEQ ID NO: 520249 - DNA, 20 bp, Artificial
  CRISPR gRNA sequence
tggtctttaatgtttaataa

SEQ ID NO: 520250 - DNA, 20 bp, Artificial
  CRISPR gRNA sequence
taatgtttaataattggcac

SEQ ID NO: 520251 - DNA, 20 bp, Artificial
  CRISPR gRNA sequence
aatgtttaataattggcact

SEQ ID NO: 520252 - DNA, 20 bp, Artificial
  CRISPR gRNA sequence
atgtttaataattggcactg

SEQ ID NO: 520253 - DNA, 20 bp, Artificial
  CRISPR gRNA sequence
aataattggcactgtcagaa

SEQ ID NO: 520254 - DNA, 20 bp, Artificial
  CRISPR gRNA sequence
ataattggcactgtcagaat

SEQ ID NO: 520255 - DNA, 20 bp, Artificial
  CRISPR gRNA sequence
gcactgtcagaattttgtct

SEQ ID NO: 520256 - DNA, 20 bp, Artificial
  CRISPR gRNA sequence
tcagaattttgtcttttaaa

SEQ ID NO: 520257 - DNA, 20 bp, Artificial
  CRISPR gRNA sequence
tgtcttttaaacataccaag

SEQ ID NO: 520258 - DNA, 20 bp, Artificial
  CRISPR gRNA sequence
gtcttttaaacataccaaga

SEQ ID NO: 520259 - DNA, 20 bp, Artificial
  CRISPR gRNA sequence
tcttttaaacataccaagaa

SEQ ID NO: 520260 - DNA, 20 bp, Artificial
  CRISPR gRNA sequence
ttaaacataccaagaaataa

SEQ ID NO: 520261 - DNA, 20 bp, Artificial
  CRISPR gRNA sequence
taaacataccaagaaataaa

SEQ ID NO: 520262 - DNA, 20 bp, Artificial
  CRISPR gRNA sequence
aaacataccaagaaataaat

SEQ ID NO: 520263 - DNA, 20 bp, Artificial
  CRISPR gRNA sequence
aacataccaagaaataaata

SEQ ID NO: 520264 - DNA, 20 bp, Artificial
  CRISPR gRNA sequence
gacaatgtctacaagtgttg

SEQ ID NO: 520265 - DNA, 20 bp, Artificial
  CRISPR gRNA sequence
caagtgttggggagccaggg

SEQ ID NO: 520266 - DNA, 20 bp, Artificial
  CRISPR gRNA sequence
gggagccagggactgggtgt

SEQ ID NO: 520267 - DNA, 20 bp, Artificial
  CRISPR gRNA sequence
ggtgtggcccctggcaggga

SEQ ID NO: 520268 - DNA, 20 bp, Artificial
  CRISPR gRNA sequence
gcagggaggcaggccgactg

SEQ ID NO: 520269 - DNA, 20 bp, Artificial
  CRISPR gRNA sequence
cagccctgtggatgccctgg

SEQ ID NO: 520270 - DNA, 20 bp, Artificial
  CRISPR gRNA sequence
tggatgccctggggggacct

SEQ ID NO: 520271 - DNA, 20 bp, Artificial
  CRISPR gRNA sequence
gggggacctgcatctggggc

SEQ ID NO: 520272 - DNA, 20 bp, Artificial
  CRISPR gRNA sequence
catctggggcccccagatct

SEQ ID NO: 520273 - DNA, 20 bp, Artificial
  CRISPR gRNA sequence
gggcccccagatctaccctg

SEQ ID NO: 520274 - DNA, 20 bp, Artificial
  CRISPR gRNA sequence
ccctggggacctgagtgcga

SEQ ID NO: 520275 - DNA, 20 bp, Artificial
  CRISPR gRNA sequence
gggacctgagtgcgaggagt

SEQ ID NO: 520276 - DNA, 20 bp, Artificial
  CRISPR gRNA sequence
agtgcgaggagttgtgtggg

SEQ ID NO: 520277 - DNA, 20 bp, Artificial
  CRISPR gRNA sequence
tgtgggccacaggcaggagt

SEQ ID NO: 520278 - DNA, 20 bp, Artificial
  CRISPR gRNA sequence
ggaaaggactgggttttgtc

SEQ ID NO: 520279 - DNA, 20 bp, Artificial
  CRISPR gRNA sequence
ggttttgtcctgcagtgcct

SEQ ID NO: 520280 - DNA, 20 bp, Artificial
  CRISPR gRNA sequence
tgtcctgcagtgcctgggcc

SEQ ID NO: 520281 - DNA, 20 bp, Artificial
  CRISPR gRNA sequence
gtcctgcagtgcctgggcct

SEQ ID NO: 520282 - DNA, 20 bp, Artificial
  CRISPR gRNA sequence
tcctgcagtgcctgggcctc

SEQ ID NO: 520283 - DNA, 20 bp, Artificial
  CRISPR gRNA sequence
cagtgcctgggcctcaccaa

SEQ ID NO: 520284 - DNA, 20 bp, Artificial
  CRISPR gRNA sequence
ggcctcaccaatgcggccgg

SEQ ID NO: 520285 - DNA, 20 bp, Artificial
  CRISPR gRNA sequence
accaatgcggccggactcgg

SEQ ID NO: 520286 - DNA, 20 bp, Artificial
  CRISPR gRNA sequence
ggtgatctcgttgagggccc

SEQ ID NO: 520287 - DNA, 20 bp, Artificial
  CRISPR gRNA sequence
gttgagggcccggagcaggt

SEQ ID NO: 520288 - DNA, 20 bp, Artificial
  CRISPR gRNA sequence
agggcccggagcaggtcgcc

SEQ ID NO: 520289 - DNA, 20 bp, Artificial
  CRISPR gRNA sequence
gcttcttgacattcctgagg

SEQ ID NO: 520290 - DNA, 20 bp, Artificial
  CRISPR gRNA sequence
cttgacattcctgaggtcat

SEQ ID NO: 520291 - DNA, 20 bp, Artificial
  CRISPR gRNA sequence
ttgacattcctgaggtcatc

SEQ ID NO: 520292 - DNA, 20 bp, Artificial
  CRISPR gRNA sequence
gacattcctgaggtcatcaa

SEQ ID NO: 520293 - DNA, 20 bp, Artificial
  CRISPR gRNA sequence
acattcctgaggtcatcaag

SEQ ID NO: 520294 - DNA, 20 bp, Artificial
  CRISPR gRNA sequence
ctgaggtcatcaagcatgga

SEQ ID NO: 520295 - DNA, 20 bp, Artificial
  CRISPR gRNA sequence
aggtcatcaagcatggagta

SEQ ID NO: 520296 - DNA, 20 bp, Artificial
  CRISPR gRNA sequence
ggcccgccggaaggtcacgt

SEQ ID NO: 520297 - DNA, 20 bp, Artificial
  CRISPR gRNA sequence
gcccgccggaaggtcacgtt

SEQ ID NO: 520298 - DNA, 20 bp, Artificial
  CRISPR gRNA sequence
aacgctgctgcctggcctgc

SEQ ID NO: 520299 - DNA, 20 bp, Artificial
  CRISPR gRNA sequence
ctgcctggcctgccggtggg

SEQ ID NO: 520300 - DNA, 20 bp, Artificial
  CRISPR gRNA sequence
cctggcctgccggtggggac

SEQ ID NO: 520301 - DNA, 20 bp, Artificial
  CRISPR gRNA sequence
gcctgccggtggggacagaa

SEQ ID NO: 520302 - DNA, 20 bp, Artificial
  CRISPR gRNA sequence
ccggtggggacagaacaaaa

SEQ ID NO: 520303 - DNA, 20 bp, Artificial
  CRISPR gRNA sequence
acatctcacacagggtgtct

SEQ ID NO: 520304 - DNA, 20 bp, Artificial
  CRISPR gRNA sequence
acacagggtgtctgggggcg

SEQ ID NO: 520305 - DNA, 20 bp, Artificial
  CRISPR gRNA sequence
ggggcgtgtggccccgagcg

SEQ ID NO: 520306 - DNA, 20 bp, Artificial
  CRISPR gRNA sequence
tgcactggcaccctctcctc

SEQ ID NO: 520307 - DNA, 20 bp, Artificial
  CRISPR gRNA sequence
gcaccctctcctccagcccc

SEQ ID NO: 520308 - DNA, 20 bp, Artificial
  CRISPR gRNA sequence
tcctccagcccccaaatcct

SEQ ID NO: 520309 - DNA, 20 bp, Artificial
  CRISPR gRNA sequence
ctccagcccccaaatcctcc

SEQ ID NO: 520310 - DNA, 20 bp, Artificial
  CRISPR gRNA sequence
cagcccccaaatcctcctga

SEQ ID NO: 520311 - DNA, 20 bp, Artificial
  CRISPR gRNA sequence
ctgacctcccctctccccgc

SEQ ID NO: 520312 - DNA, 20 bp, Artificial
  CRISPR gRNA sequence
acctcccctctccccgcctg

SEQ ID NO: 520313 - DNA, 20 bp, Artificial
  CRISPR gRNA sequence
ccctctccccgcctggcagg

SEQ ID NO: 520314 - DNA, 20 bp, Artificial
  CRISPR gRNA sequence
tccccgcctggcaggagagc

SEQ ID NO: 520315 - DNA, 20 bp, Artificial
  CRISPR gRNA sequence
cccgcctggcaggagagctg

SEQ ID NO: 520316 - DNA, 20 bp, Artificial
  CRISPR gRNA sequence
gcaggagagctgaggaccag

SEQ ID NO: 520317 - DNA, 20 bp, Artificial
  CRISPR gRNA sequence
aggaccagacacaggacatc

SEQ ID NO: 520318 - DNA, 20 bp, Artificial
  CRISPR gRNA sequence
gagtttcagaggaaggacat

SEQ ID NO: 520319 - DNA, 20 bp, Artificial
  CRISPR gRNA sequence
cagaggaaggacatgactcc

SEQ ID NO: 520320 - DNA, 20 bp, Artificial
  CRISPR gRNA sequence
agaggaaggacatgactccc

SEQ ID NO: 520321 - DNA, 20 bp, Artificial
  CRISPR gRNA sequence
ccggacgcaggcatgtgcct

SEQ ID NO: 520322 - DNA, 20 bp, Artificial
  CRISPR gRNA sequence
gcagtgacactgaaacccgc

SEQ ID NO: 520323 - DNA, 20 bp, Artificial
  CRISPR gRNA sequence
aaacccgcctggggtgctta

SEQ ID NO: 520324 - DNA, 20 bp, Artificial
  CRISPR gRNA sequence
gggtgcttagagttgacgcc

SEQ ID NO: 520325 - DNA, 20 bp, Artificial
  CRISPR gRNA sequence
agagttgacgccagcgacat

SEQ ID NO: 520326 - DNA, 20 bp, Artificial
  CRISPR gRNA sequence
gagttgacgccagcgacatt

SEQ ID NO: 520327 - DNA, 20 bp, Artificial
  CRISPR gRNA sequence
acgccagcgacattggggac

SEQ ID NO: 520328 - DNA, 20 bp, Artificial
  CRISPR gRNA sequence
gggacgcctttcattgagag

SEQ ID NO: 520329 - DNA, 20 bp, Artificial
  CRISPR gRNA sequence
tcattgagagtggcagcggc

SEQ ID NO: 520330 - DNA, 20 bp, Artificial
  CRISPR gRNA sequence
cattgagagtggcagcggct

SEQ ID NO: 520331 - DNA, 20 bp, Artificial
  CRISPR gRNA sequence
attgagagtggcagcggctc

SEQ ID NO: 520332 - DNA, 20 bp, Artificial
  CRISPR gRNA sequence
agagtggcagcggctcacct

SEQ ID NO: 520333 - DNA, 20 bp, Artificial
  CRISPR gRNA sequence
acctgggctcacacctaacc

SEQ ID NO: 520334 - DNA, 20 bp, Artificial
  CRISPR gRNA sequence
ggctcacacctaacccggcc

SEQ ID NO: 520335 - DNA, 20 bp, Artificial
  CRISPR gRNA sequence
acacctaacccggccccatg

SEQ ID NO: 520336 - DNA, 20 bp, Artificial
  CRISPR gRNA sequence
acccggccccatgcctgcag

SEQ ID NO: 520337 - DNA, 20 bp, Artificial
  CRISPR gRNA sequence
cagtcccacgggcgccctca

SEQ ID NO: 520338 - DNA, 20 bp, Artificial
  CRISPR gRNA sequence
atcagcagccacatagacag

SEQ ID NO: 520339 - DNA, 20 bp, Artificial
  CRISPR gRNA sequence
gcacttcccagcaaggccca

SEQ ID NO: 520340 - DNA, 20 bp, Artificial
  CRISPR gRNA sequence
cccagcaaggcccacgcggg

SEQ ID NO: 520341 - DNA, 20 bp, Artificial
  CRISPR gRNA sequence
ccagcaaggcccacgcgggc

SEQ ID NO: 520342 - DNA, 20 bp, Artificial
  CRISPR gRNA sequence
tctccatcccagccctggac

SEQ ID NO: 520343 - DNA, 20 bp, Artificial
  CRISPR gRNA sequence
ctccatcccagccctggact

SEQ ID NO: 520344 - DNA, 20 bp, Artificial
  CRISPR gRNA sequence
tccatcccagccctggactt

SEQ ID NO: 520345 - DNA, 20 bp, Artificial
  CRISPR gRNA sequence
catcccagccctggacttcc

SEQ ID NO: 520346 - DNA, 20 bp, Artificial
  CRISPR gRNA sequence
gacttccgctcgcccgcgtc

SEQ ID NO: 520347 - DNA, 20 bp, Artificial
  CRISPR gRNA sequence
ccgctcgcccgcgtctcagt

SEQ ID NO: 520348 - DNA, 20 bp, Artificial
  CRISPR gRNA sequence
cgctcgcccgcgtctcagtc

SEQ ID NO: 520349 - DNA, 20 bp, Artificial
  CRISPR gRNA sequence
gcccgcgtctcagtcacacg

SEQ ID NO: 520350 - DNA, 20 bp, Artificial
  CRISPR gRNA sequence
agtcacacgtgcggttgtgt

SEQ ID NO: 520351 - DNA, 20 bp, Artificial
  CRISPR gRNA sequence
tgtagctgtctgtttacctg

SEQ ID NO: 520352 - DNA, 20 bp, Artificial
  CRISPR gRNA sequence
tctgtttacctgtcaccgca

SEQ ID NO: 520353 - DNA, 20 bp, Artificial
  CRISPR gRNA sequence
tttacctgtcaccgcaacca

SEQ ID NO: 520354 - DNA, 20 bp, Artificial
  CRISPR gRNA sequence
acctgtcaccgcaaccagcc

SEQ ID NO: 520355 - DNA, 20 bp, Artificial
  CRISPR gRNA sequence
cctgtcaccgcaaccagcct

SEQ ID NO: 520356 - DNA, 20 bp, Artificial
  CRISPR gRNA sequence
tcaccgcaaccagcctgtgt

SEQ ID NO: 520357 - DNA, 20 bp, Artificial
  CRISPR gRNA sequence
tgtccctggctcccagaacc

SEQ ID NO: 520358 - DNA, 20 bp, Artificial
  CRISPR gRNA sequence
gctcccagaaccgtgcctgg

SEQ ID NO: 520359 - DNA, 20 bp, Artificial
  CRISPR gRNA sequence
ccagaaccgtgcctggtaca

SEQ ID NO: 520360 - DNA, 20 bp, Artificial
  CRISPR gRNA sequence
gtacaagtcagctctccata

SEQ ID NO: 520361 - DNA, 20 bp, Artificial
  CRISPR gRNA sequence
tccataaacacacatcatgt

SEQ ID NO: 520362 - DNA, 20 bp, Artificial
  CRISPR gRNA sequence
cataaacacacatcatgtta

SEQ ID NO: 520363 - DNA, 20 bp, Artificial
  CRISPR gRNA sequence
atgaatgagcagggagggag

SEQ ID NO: 520364 - DNA, 20 bp, Artificial
  CRISPR gRNA sequence
tcccctctgccccaccctcc

SEQ ID NO: 520365 - DNA, 20 bp, Artificial
  CRISPR gRNA sequence
tgccccaccctccagccttc

SEQ ID NO: 520366 - DNA, 20 bp, Artificial
  CRISPR gRNA sequence
ccccaccctccagccttcag

SEQ ID NO: 520367 - DNA, 20 bp, Artificial
  CRISPR gRNA sequence
cagccttcagcccccctggg

SEQ ID NO: 520368 - DNA, 20 bp, Artificial
  CRISPR gRNA sequence
cagcccccctgggcggcagg

SEQ ID NO: 520369 - DNA, 20 bp, Artificial
  CRISPR gRNA sequence
agcccccctgggcggcagga

SEQ ID NO: 520370 - DNA, 20 bp, Artificial
  CRISPR gRNA sequence
ggcggcaggacaagtgcaga

SEQ ID NO: 520371 - DNA, 20 bp, Artificial
  CRISPR gRNA sequence
cacccccaacctgcctgctg

SEQ ID NO: 520372 - DNA, 20 bp, Artificial
  CRISPR gRNA sequence
cctgctgccacaccctggga

SEQ ID NO: 520373 - DNA, 20 bp, Artificial
  CRISPR gRNA sequence
ctgccacaccctgggagaaa

SEQ ID NO: 520374 - DNA, 20 bp, Artificial
  CRISPR gRNA sequence
ccacaccctgggagaaaggg

SEQ ID NO: 520375 - DNA, 20 bp, Artificial
  CRISPR gRNA sequence
ggagaaagggtatgtgcccc

SEQ ID NO: 520376 - DNA, 20 bp, Artificial
  CRISPR gRNA sequence
ctcacagacacacacacacg

SEQ ID NO: 520377 - DNA, 20 bp, Artificial
  CRISPR gRNA sequence
acagacacacacacacgcac

SEQ ID NO: 520378 - DNA, 20 bp, Artificial
  CRISPR gRNA sequence
ctacacataaatacaccaca

SEQ ID NO: 520379 - DNA, 20 bp, Artificial
  CRISPR gRNA sequence
cacataaatacaccacatgc

SEQ ID NO: 520380 - DNA, 20 bp, Artificial
  CRISPR gRNA sequence
acacacaaatataactcatg

SEQ ID NO: 520381 - DNA, 20 bp, Artificial
  CRISPR gRNA sequence
atgcacacacagtcacacgt

SEQ ID NO: 520382 - DNA, 20 bp, Artificial
  CRISPR gRNA sequence
acactcatacacaacaccag

SEQ ID NO: 520383 - DNA, 20 bp, Artificial
  CRISPR gRNA sequence
atacacaacaccagacacaa

SEQ ID NO: 520384 - DNA, 20 bp, Artificial
  CRISPR gRNA sequence
tatgtacttgttcatataca

SEQ ID NO: 520385 - DNA, 20 bp, Artificial
  CRISPR gRNA sequence
gttcatatacacaaacacac

SEQ ID NO: 520386 - DNA, 20 bp, Artificial
  CRISPR gRNA sequence
ttcatatacacaaacacacc

SEQ ID NO: 520387 - DNA, 20 bp, Artificial
  CRISPR gRNA sequence
atatacacaaacacaccaca

SEQ ID NO: 520388 - DNA, 20 bp, Artificial
  CRISPR gRNA sequence
gcacacacatacacacacca

SEQ ID NO: 520389 - DNA, 20 bp, Artificial
  CRISPR gRNA sequence
acgcacatacaccacacaca

SEQ ID NO: 520390 - DNA, 20 bp, Artificial
  CRISPR gRNA sequence
acatacacatgcatgccaca

SEQ ID NO: 520391 - DNA, 20 bp, Artificial
  CRISPR gRNA sequence
acacccatacacacacgtgc

SEQ ID NO: 520392 - DNA, 20 bp, Artificial
  CRISPR gRNA sequence
aacacatacataccacacac

SEQ ID NO: 520393 - DNA, 20 bp, Artificial
  CRISPR gRNA sequence
acacacacacacactcaccc

SEQ ID NO: 520394 - DNA, 20 bp, Artificial
  CRISPR gRNA sequence
acccacattcacacccggca

SEQ ID NO: 520395 - DNA, 20 bp, Artificial
  CRISPR gRNA sequence
acacccggcactcctggccc

SEQ ID NO: 520396 - DNA, 20 bp, Artificial
  CRISPR gRNA sequence
ctggccctggccctcgccct

SEQ ID NO: 520397 - DNA, 20 bp, Artificial
  CRISPR gRNA sequence
gccctggccctcgccctgct

SEQ ID NO: 520398 - DNA, 20 bp, Artificial
  CRISPR gRNA sequence
gccctcgccctgctgtgcct

SEQ ID NO: 520399 - DNA, 20 bp, Artificial
  CRISPR gRNA sequence
gccctgctgtgccttgcagc

SEQ ID NO: 520400 - DNA, 20 bp, Artificial
  CRISPR gRNA sequence
ctgtgccttgcagccctcag

SEQ ID NO: 520401 - DNA, 20 bp, Artificial
  CRISPR gRNA sequence
tgccttgcagccctcagagg

SEQ ID NO: 520402 - DNA, 20 bp, Artificial
  CRISPR gRNA sequence
gcagccctcagaggcttcac

SEQ ID NO: 520403 - DNA, 20 bp, Artificial
  CRISPR gRNA sequence
cagccctcagaggcttcact

SEQ ID NO: 520404 - DNA, 20 bp, Artificial
  CRISPR gRNA sequence
agaggcttcacttggcctct

SEQ ID NO: 520405 - DNA, 20 bp, Artificial
  CRISPR gRNA sequence
cacttggcctctgggccaag

SEQ ID NO: 520406 - DNA, 20 bp, Artificial
  CRISPR gRNA sequence
acttggcctctgggccaagg

SEQ ID NO: 520407 - DNA, 20 bp, Artificial
  CRISPR gRNA sequence
ggcctctgggccaaggaccc

SEQ ID NO: 520408 - DNA, 20 bp, Artificial
  CRISPR gRNA sequence
gcctctgggccaaggacccc

SEQ ID NO: 520409 - DNA, 20 bp, Artificial
  CRISPR gRNA sequence
tgggccaaggaccccaatca

SEQ ID NO: 520410 - DNA, 20 bp, Artificial
  CRISPR gRNA sequence
ggccaaggaccccaatcact

SEQ ID NO: 520411 - DNA, 20 bp, Artificial
  CRISPR gRNA sequence
tctatgaagggccagacagt

SEQ ID NO: 520412 - DNA, 20 bp, Artificial
  CRISPR gRNA sequence
ctatgaagggccagacagta

SEQ ID NO: 520413 - DNA, 20 bp, Artificial
  CRISPR gRNA sequence
tatgaagggccagacagtaa

SEQ ID NO: 520414 - DNA, 20 bp, Artificial
  CRISPR gRNA sequence
tgaagggccagacagtaaat

SEQ ID NO: 520415 - DNA, 20 bp, Artificial
  CRISPR gRNA sequence
ggctttgggggccgtgcggc

SEQ ID NO: 520416 - DNA, 20 bp, Artificial
  CRISPR gRNA sequence
gctttgggggccgtgcggcg

SEQ ID NO: 520417 - DNA, 20 bp, Artificial
  CRISPR gRNA sequence
tgggggccgtgcggcgtctg

SEQ ID NO: 520418 - DNA, 20 bp, Artificial
  CRISPR gRNA sequence
gggggccgtgcggcgtctgc

SEQ ID NO: 520419 - DNA, 20 bp, Artificial
  CRISPR gRNA sequence
ggggccgtgcggcgtctgca

SEQ ID NO: 520420 - DNA, 20 bp, Artificial
  CRISPR gRNA sequence
cagcgacatggaggaggcag

SEQ ID NO: 520421 - DNA, 20 bp, Artificial
  CRISPR gRNA sequence
cagtcaaagggcacagacat

SEQ ID NO: 520422 - DNA, 20 bp, Artificial
  CRISPR gRNA sequence
tggtggctgaccaaggggcc

SEQ ID NO: 520423 - DNA, 20 bp, Artificial
  CRISPR gRNA sequence
ggtggctgaccaaggggccc

SEQ ID NO: 520424 - DNA, 20 bp, Artificial
  CRISPR gRNA sequence
gtggctgaccaaggggcccc

SEQ ID NO: 520425 - DNA, 20 bp, Artificial
  CRISPR gRNA sequence
accaaggggccccgtccctt

SEQ ID NO: 520426 - DNA, 20 bp, Artificial
  CRISPR gRNA sequence
cccttccagagtagaggctc

SEQ ID NO: 520427 - DNA, 20 bp, Artificial
  CRISPR gRNA sequence
ccttccagagtagaggctca

SEQ ID NO: 520428 - DNA, 20 bp, Artificial
  CRISPR gRNA sequence
ccagagtagaggctcagcga

SEQ ID NO: 520429 - DNA, 20 bp, Artificial
  CRISPR gRNA sequence
cagagtagaggctcagcgaa

SEQ ID NO: 520430 - DNA, 20 bp, Artificial
  CRISPR gRNA sequence
agcgaagggccagcaggctg

SEQ ID NO: 520431 - DNA, 20 bp, Artificial
  CRISPR gRNA sequence
cgggggtagggccaggaccc

SEQ ID NO: 520432 - DNA, 20 bp, Artificial
  CRISPR gRNA sequence
cccagatcctgccgccctgc

SEQ ID NO: 520433 - DNA, 20 bp, Artificial
  CRISPR gRNA sequence
ccagatcctgccgccctgct

SEQ ID NO: 520434 - DNA, 20 bp, Artificial
  CRISPR gRNA sequence
ccgccctgctctgggagcct

SEQ ID NO: 520435 - DNA, 20 bp, Artificial
  CRISPR gRNA sequence
ctctgggagcctgtggccct

SEQ ID NO: 520436 - DNA, 20 bp, Artificial
  CRISPR gRNA sequence
tgggagcctgtggccctggg

SEQ ID NO: 520437 - DNA, 20 bp, Artificial
  CRISPR gRNA sequence
ggagcctgtggccctggggt

SEQ ID NO: 520438 - DNA, 20 bp, Artificial
  CRISPR gRNA sequence
tggccctggggtgctgttaa

SEQ ID NO: 520439 - DNA, 20 bp, Artificial
  CRISPR gRNA sequence
gggtgctgttaagatctctc

SEQ ID NO: 520440 - DNA, 20 bp, Artificial
  CRISPR gRNA sequence
ttaagatctctccctggtgc

SEQ ID NO: 520441 - DNA, 20 bp, Artificial
  CRISPR gRNA sequence
agatctctccctggtgctca

SEQ ID NO: 520442 - DNA, 20 bp, Artificial
  CRISPR gRNA sequence
tccctggtgctcacccgagt

SEQ ID NO: 520443 - DNA, 20 bp, Artificial
  CRISPR gRNA sequence
cctggtgctcacccgagttt

SEQ ID NO: 520444 - DNA, 20 bp, Artificial
  CRISPR gRNA sequence
gtgctcacccgagtttgcct

SEQ ID NO: 520445 - DNA, 20 bp, Artificial
  CRISPR gRNA sequence
acccgagtttgcctaccctc

SEQ ID NO: 520446 - DNA, 20 bp, Artificial
  CRISPR gRNA sequence
gcctaccctcacctgcatcc

SEQ ID NO: 520447 - DNA, 20 bp, Artificial
  CRISPR gRNA sequence
cctaccctcacctgcatcca

SEQ ID NO: 520448 - DNA, 20 bp, Artificial
  CRISPR gRNA sequence
ccctcacctgcatccacccg

SEQ ID NO: 520449 - DNA, 20 bp, Artificial
  CRISPR gRNA sequence
acctgcatccacccgagctc

SEQ ID NO: 520450 - DNA, 20 bp, Artificial
  CRISPR gRNA sequence
catccacccgagctcacctg

SEQ ID NO: 520451 - DNA, 20 bp, Artificial
  CRISPR gRNA sequence
acctgtgccctcccagaggc

SEQ ID NO: 520452 - DNA, 20 bp, Artificial
  CRISPR gRNA sequence
tgccctcccagaggccacag

SEQ ID NO: 520453 - DNA, 20 bp, Artificial
  CRISPR gRNA sequence
ccagaggccacagcatttgc

SEQ ID NO: 520454 - DNA, 20 bp, Artificial
  CRISPR gRNA sequence
gccccctgcacagtggggat

SEQ ID NO: 520455 - DNA, 20 bp, Artificial
  CRISPR gRNA sequence
ccccctgcacagtggggatg

SEQ ID NO: 520456 - DNA, 20 bp, Artificial
  CRISPR gRNA sequence
cacagtggggatgcatgcca

SEQ ID NO: 520457 - DNA, 20 bp, Artificial
  CRISPR gRNA sequence
ccccacccttccccacggca

SEQ ID NO: 520458 - DNA, 20 bp, Artificial
  CRISPR gRNA sequence
ccccacggcacaaggatgcc

SEQ ID NO: 520459 - DNA, 20 bp, Artificial
  CRISPR gRNA sequence
cccacggcacaaggatgccc

SEQ ID NO: 520460 - DNA, 20 bp, Artificial
  CRISPR gRNA sequence
aggcgcacccccaccctcca

SEQ ID NO: 520461 - DNA, 20 bp, Artificial
  CRISPR gRNA sequence
caggacgatccttcctgaca

SEQ ID NO: 520462 - DNA, 20 bp, Artificial
  CRISPR gRNA sequence
cctgacacctccagcaccac

SEQ ID NO: 520463 - DNA, 20 bp, Artificial
  CRISPR gRNA sequence
ctgacacctccagcaccaca

SEQ ID NO: 520464 - DNA, 20 bp, Artificial
  CRISPR gRNA sequence
acacctccagcaccacagag

SEQ ID NO: 520465 - DNA, 20 bp, Artificial
  CRISPR gRNA sequence
cagcaccacagagctgcaca

SEQ ID NO: 520466 - DNA, 20 bp, Artificial
  CRISPR gRNA sequence
cacaaactctggccacaggc

SEQ ID NO: 520467 - DNA, 20 bp, Artificial
  CRISPR gRNA sequence
tggccacaggcaacacctct

SEQ ID NO: 520468 - DNA, 20 bp, Artificial
  CRISPR gRNA sequence
gccacaggcaacacctctgt

SEQ ID NO: 520469 - DNA, 20 bp, Artificial
  CRISPR gRNA sequence
tgtcagcctcagtttcctca

SEQ ID NO: 520470 - DNA, 20 bp, Artificial
  CRISPR gRNA sequence
tcagcctcagtttcctcact

SEQ ID NO: 520471 - DNA, 20 bp, Artificial
  CRISPR gRNA sequence
agtttcctcactgtgaagtg

SEQ ID NO: 520472 - DNA, 20 bp, Artificial
  CRISPR gRNA sequence
cctcactgtgaagtggggcg

SEQ ID NO: 520473 - DNA, 20 bp, Artificial
  CRISPR gRNA sequence
ctcactgtgaagtggggcgt

SEQ ID NO: 520474 - DNA, 20 bp, Artificial
  CRISPR gRNA sequence
actgtgaagtggggcgtggg

SEQ ID NO: 520475 - DNA, 20 bp, Artificial
  CRISPR gRNA sequence
tgaagtggggcgtggggaaa

SEQ ID NO: 520476 - DNA, 20 bp, Artificial
  CRISPR gRNA sequence
cctccaggggccacagggcc

SEQ ID NO: 520477 - DNA, 20 bp, Artificial
  CRISPR gRNA sequence
caggggccacagggccaggc

SEQ ID NO: 520478 - DNA, 20 bp, Artificial
  CRISPR gRNA sequence
gagtttgaggtcagaggtgg

SEQ ID NO: 520479 - DNA, 20 bp, Artificial
  CRISPR gRNA sequence
gaggtcagaggtggaggttc

SEQ ID NO: 520480 - DNA, 20 bp, Artificial
  CRISPR gRNA sequence
aggtcagaggtggaggttcc

SEQ ID NO: 520481 - DNA, 20 bp, Artificial
  CRISPR gRNA sequence
cagcacgaaggggcttgtgc

SEQ ID NO: 520482 - DNA, 20 bp, Artificial
  CRISPR gRNA sequence
gtgcctgctcacggggcagc

SEQ ID NO: 520483 - DNA, 20 bp, Artificial
  CRISPR gRNA sequence
tgcctgctcacggggcagcg

SEQ ID NO: 520484 - DNA, 20 bp, Artificial
  CRISPR gRNA sequence
ctcacggggcagcgaggggc

SEQ ID NO: 520485 - DNA, 20 bp, Artificial
  CRISPR gRNA sequence
acggggcagcgaggggcagg

SEQ ID NO: 520486 - DNA, 20 bp, Artificial
  CRISPR gRNA sequence
accctaccaccagggtgggg

SEQ ID NO: 520487 - DNA, 20 bp, Artificial
  CRISPR gRNA sequence
ccaccagggtggggttttgt

SEQ ID NO: 520488 - DNA, 20 bp, Artificial
  CRISPR gRNA sequence
tgtcccctgctgcccccagg

SEQ ID NO: 520489 - DNA, 20 bp, Artificial
  CRISPR gRNA sequence
gtcccctgctgcccccaggg

SEQ ID NO: 520490 - DNA, 20 bp, Artificial
  CRISPR gRNA sequence
tcccctgctgcccccaggga

SEQ ID NO: 520491 - DNA, 20 bp, Artificial
  CRISPR gRNA sequence
ctgcccccagggacacctgg

SEQ ID NO: 520492 - DNA, 20 bp, Artificial
  CRISPR gRNA sequence
cccccagggacacctgggcc

SEQ ID NO: 520493 - DNA, 20 bp, Artificial
  CRISPR gRNA sequence
ggccctgctcctgcaggacc

SEQ ID NO: 520494 - DNA, 20 bp, Artificial
  CRISPR gRNA sequence
ctcctgcaggacctccccaa

SEQ ID NO: 520495 - DNA, 20 bp, Artificial
  CRISPR gRNA sequence
ctgcaggacctccccaatgg

SEQ ID NO: 520496 - DNA, 20 bp, Artificial
  CRISPR gRNA sequence
caggacctccccaatggctc

SEQ ID NO: 520497 - DNA, 20 bp, Artificial
  CRISPR gRNA sequence
cccaatggctcggccccatc

SEQ ID NO: 520498 - DNA, 20 bp, Artificial
  CRISPR gRNA sequence
ggccccatccctcactgtct

SEQ ID NO: 520499 - DNA, 20 bp, Artificial
  CRISPR gRNA sequence
actgtctcccagctgcctcc

SEQ ID NO: 520500 - DNA, 20 bp, Artificial
  CRISPR gRNA sequence
tctcccagctgcctccctcc

SEQ ID NO: 520501 - DNA, 20 bp, Artificial
  CRISPR gRNA sequence
ccagctgcctccctcccggc

SEQ ID NO: 520502 - DNA, 20 bp, Artificial
  CRISPR gRNA sequence
cctccctcccggctgctgct

SEQ ID NO: 520503 - DNA, 20 bp, Artificial
  CRISPR gRNA sequence
cctcccggctgctgctggct

SEQ ID NO: 520504 - DNA, 20 bp, Artificial
  CRISPR gRNA sequence
ccggctgctgctggctgtca

SEQ ID NO: 520505 - DNA, 20 bp, Artificial
  CRISPR gRNA sequence
ctgctggctgtcacctggcc

SEQ ID NO: 520506 - DNA, 20 bp, Artificial
  CRISPR gRNA sequence
ctggctgtcacctggccgcc

SEQ ID NO: 520507 - DNA, 20 bp, Artificial
  CRISPR gRNA sequence
gctgtcacctggccgcctgc

SEQ ID NO: 520508 - DNA, 20 bp, Artificial
  CRISPR gRNA sequence
tcacctggccgcctgcaccc

SEQ ID NO: 520509 - DNA, 20 bp, Artificial
  CRISPR gRNA sequence
gccgcctgcaccctgggcca

SEQ ID NO: 520510 - DNA, 20 bp, Artificial
  CRISPR gRNA sequence
caccctgggccactctgccc

SEQ ID NO: 520511 - DNA, 20 bp, Artificial
  CRISPR gRNA sequence
ggccactctgccccaaggct

SEQ ID NO: 520512 - DNA, 20 bp, Artificial
  CRISPR gRNA sequence
tgccccaaggctaactcagt

SEQ ID NO: 520513 - DNA, 20 bp, Artificial
  CRISPR gRNA sequence
ccccaaggctaactcagtgg

SEQ ID NO: 520514 - DNA, 20 bp, Artificial
  CRISPR gRNA sequence
actcagtggccgctgacctg

SEQ ID NO: 520515 - DNA, 20 bp, Artificial
  CRISPR gRNA sequence
agtggccgctgacctgggct

SEQ ID NO: 520516 - DNA, 20 bp, Artificial
  CRISPR gRNA sequence
acctgggcttcccctgaggg

SEQ ID NO: 520517 - DNA, 20 bp, Artificial
  CRISPR gRNA sequence
ggcttcccctgagggcagag

SEQ ID NO: 520518 - DNA, 20 bp, Artificial
  CRISPR gRNA sequence
cccctgagggcagagctctg

SEQ ID NO: 520519 - DNA, 20 bp, Artificial
  CRISPR gRNA sequence
ccctgagggcagagctctga

SEQ ID NO: 520520 - DNA, 20 bp, Artificial
  CRISPR gRNA sequence
agggcagagctctgagcccc

SEQ ID NO: 520521 - DNA, 20 bp, Artificial
  CRISPR gRNA sequence
tgagccccagcctgtccgac

SEQ ID NO: 520522 - DNA, 20 bp, Artificial
  CRISPR gRNA sequence
agccccagcctgtccgacac

SEQ ID NO: 520523 - DNA, 20 bp, Artificial
  CRISPR gRNA sequence
tccgacaccagctggttcct

SEQ ID NO: 520524 - DNA, 20 bp, Artificial
  CRISPR gRNA sequence
gttcctctaaagtcaccctg

SEQ ID NO: 520525 - DNA, 20 bp, Artificial
  CRISPR gRNA sequence
ctctaaagtcaccctggccc

SEQ ID NO: 520526 - DNA, 20 bp, Artificial
  CRISPR gRNA sequence
taaagtcaccctggccccgt

SEQ ID NO: 520527 - DNA, 20 bp, Artificial
  CRISPR gRNA sequence
aagtcaccctggccccgtct

SEQ ID NO: 520528 - DNA, 20 bp, Artificial
  CRISPR gRNA sequence
gccccgtctgcaccctctcc

SEQ ID NO: 520529 - DNA, 20 bp, Artificial
  CRISPR gRNA sequence
caccctctccctgggagatg

SEQ ID NO: 520530 - DNA, 20 bp, Artificial
  CRISPR gRNA sequence
tccctgggagatggcttccc

SEQ ID NO: 520531 - DNA, 20 bp, Artificial
  CRISPR gRNA sequence
cctgggagatggcttcccct

SEQ ID NO: 520532 - DNA, 20 bp, Artificial
  CRISPR gRNA sequence
ggagatggcttccccttcct

SEQ ID NO: 520533 - DNA, 20 bp, Artificial
  CRISPR gRNA sequence
ccccttccttccctggcctc

SEQ ID NO: 520534 - DNA, 20 bp, Artificial
  CRISPR gRNA sequence
cccttccttccctggcctca

SEQ ID NO: 520535 - DNA, 20 bp, Artificial
  CRISPR gRNA sequence
ccttccctggcctcactgtg

SEQ ID NO: 520536 - DNA, 20 bp, Artificial
  CRISPR gRNA sequence
cttccctggcctcactgtgg

SEQ ID NO: 520537 - DNA, 20 bp, Artificial
  CRISPR gRNA sequence
ccctggcctcactgtggcct

SEQ ID NO: 520538 - DNA, 20 bp, Artificial
  CRISPR gRNA sequence
cctggcctcactgtggcctg

SEQ ID NO: 520539 - DNA, 20 bp, Artificial
  CRISPR gRNA sequence
gcctcactgtggcctgggag

SEQ ID NO: 520540 - DNA, 20 bp, Artificial
  CRISPR gRNA sequence
actgtggcctgggaggtcac

SEQ ID NO: 520541 - DNA, 20 bp, Artificial
  CRISPR gRNA sequence
tggcctgggaggtcacaggt

SEQ ID NO: 520542 - DNA, 20 bp, Artificial
  CRISPR gRNA sequence
ggaggtcacaggtcggtggc

SEQ ID NO: 520543 - DNA, 20 bp, Artificial
  CRISPR gRNA sequence
cttctcccatctgctgcacc

SEQ ID NO: 520544 - DNA, 20 bp, Artificial
  CRISPR gRNA sequence
ctcccatctgctgcaccacc

SEQ ID NO: 520545 - DNA, 20 bp, Artificial
  CRISPR gRNA sequence
tcccatctgctgcaccacca

SEQ ID NO: 520546 - DNA, 20 bp, Artificial
  CRISPR gRNA sequence
ccatctgctgcaccaccaca

SEQ ID NO: 520547 - DNA, 20 bp, Artificial
  CRISPR gRNA sequence
ctgcaccaccacacctgcct

SEQ ID NO: 520548 - DNA, 20 bp, Artificial
  CRISPR gRNA sequence
caccaccacacctgccttcc

SEQ ID NO: 520549 - DNA, 20 bp, Artificial
  CRISPR gRNA sequence
ccttcctggagcaaggaggg

SEQ ID NO: 520550 - DNA, 20 bp, Artificial
  CRISPR gRNA sequence
cctggagcaaggagggagct

SEQ ID NO: 520551 - DNA, 20 bp, Artificial
  CRISPR gRNA sequence
ctggagcaaggagggagctt

SEQ ID NO: 520552 - DNA, 20 bp, Artificial
  CRISPR gRNA sequence
gagcaaggagggagcttcgt

SEQ ID NO: 520553 - DNA, 20 bp, Artificial
  CRISPR gRNA sequence
cgtttcttccctcccttccc

SEQ ID NO: 520554 - DNA, 20 bp, Artificial
  CRISPR gRNA sequence
gtttcttccctcccttcccc

SEQ ID NO: 520555 - DNA, 20 bp, Artificial
  CRISPR gRNA sequence
cttccctcccttccccttcc

SEQ ID NO: 520556 - DNA, 20 bp, Artificial
  CRISPR gRNA sequence
ttccctcccttccccttccc

SEQ ID NO: 520557 - DNA, 20 bp, Artificial
  CRISPR gRNA sequence
ccctcccttccccttccctc

SEQ ID NO: 520558 - DNA, 20 bp, Artificial
  CRISPR gRNA sequence
cctcccttccccttccctcc

SEQ ID NO: 520559 - DNA, 20 bp, Artificial
  CRISPR gRNA sequence
ccttccccttccctcccttc

SEQ ID NO: 520560 - DNA, 20 bp, Artificial
  CRISPR gRNA sequence
ccccttccctcccttccctc

SEQ ID NO: 520561 - DNA, 20 bp, Artificial
  CRISPR gRNA sequence
cccttccctcccttccctcc

SEQ ID NO: 520562 - DNA, 20 bp, Artificial
  CRISPR gRNA sequence
ccctcccttccctcccttcc

SEQ ID NO: 520563 - DNA, 20 bp, Artificial
  CRISPR gRNA sequence
cctcccttccctcccttccc

SEQ ID NO: 520564 - DNA, 20 bp, Artificial
  CRISPR gRNA sequence
ccttccctcccttccctccc

SEQ ID NO: 520565 - DNA, 20 bp, Artificial
  CRISPR gRNA sequence
ccctcccttccctccctccc

SEQ ID NO: 520566 - DNA, 20 bp, Artificial
  CRISPR gRNA sequence
cctcccttccctccctccct

SEQ ID NO: 520567 - DNA, 20 bp, Artificial
  CRISPR gRNA sequence
ccttccctccctcccttccc

SEQ ID NO: 520568 - DNA, 20 bp, Artificial
  CRISPR gRNA sequence
ccctccctcccttccctccc

SEQ ID NO: 520569 - DNA, 20 bp, Artificial
  CRISPR gRNA sequence
cctccctcccttccctcccc

SEQ ID NO: 520570 - DNA, 20 bp, Artificial
  CRISPR gRNA sequence
cctcccttccctccccttct

SEQ ID NO: 520571 - DNA, 20 bp, Artificial
  CRISPR gRNA sequence
ccttccctccccttctcttc

SEQ ID NO: 520572 - DNA, 20 bp, Artificial
  CRISPR gRNA sequence
ccctccccttctcttccctt

SEQ ID NO: 520573 - DNA, 20 bp, Artificial
  CRISPR gRNA sequence
cctccccttctcttcccttc

SEQ ID NO: 520574 - DNA, 20 bp, Artificial
  CRISPR gRNA sequence
cccttctcttcccttccttt

SEQ ID NO: 520575 - DNA, 20 bp, Artificial
  CRISPR gRNA sequence
ctcttcccttcctttctttt

SEQ ID NO: 520576 - DNA, 20 bp, Artificial
  CRISPR gRNA sequence
tcttcccttcctttcttttc

SEQ ID NO: 520577 - DNA, 20 bp, Artificial
  CRISPR gRNA sequence
ttcccttcctttcttttcat

SEQ ID NO: 520578 - DNA, 20 bp, Artificial
  CRISPR gRNA sequence
cccttcctttcttttcattt

SEQ ID NO: 520579 - DNA, 20 bp, Artificial
  CRISPR gRNA sequence
ccttcctttcttttcatttt

SEQ ID NO: 520580 - DNA, 20 bp, Artificial
  CRISPR gRNA sequence
cctttcttttcattttgaga

SEQ ID NO: 520581 - DNA, 20 bp, Artificial
  CRISPR gRNA sequence
ctttcttttcattttgagac

SEQ ID NO: 520582 - DNA, 20 bp, Artificial
  CRISPR gRNA sequence
tcttttcattttgagacaga

SEQ ID NO: 520583 - DNA, 20 bp, Artificial
  CRISPR gRNA sequence
cttttcattttgagacagaa

SEQ ID NO: 520584 - DNA, 20 bp, Artificial
  CRISPR gRNA sequence
ttttcattttgagacagaat

SEQ ID NO: 520585 - DNA, 20 bp, Artificial
  CRISPR gRNA sequence
ttcattttgagacagaatct

SEQ ID NO: 520586 - DNA, 20 bp, Artificial
  CRISPR gRNA sequence
tcattttgagacagaatctc

SEQ ID NO: 520587 - DNA, 20 bp, Artificial
  CRISPR gRNA sequence
cattttgagacagaatctcg

SEQ ID NO: 520588 - DNA, 20 bp, Artificial
  CRISPR gRNA sequence
attttgagacagaatctcgc

SEQ ID NO: 520589 - DNA, 20 bp, Artificial
  CRISPR gRNA sequence
tgagacagaatctcgccctg

SEQ ID NO: 520590 - DNA, 20 bp, Artificial
  CRISPR gRNA sequence
gagacagaatctcgccctgt

SEQ ID NO: 520591 - DNA, 20 bp, Artificial
  CRISPR gRNA sequence
agacagaatctcgccctgtc

SEQ ID NO: 520592 - DNA, 20 bp, Artificial
  CRISPR gRNA sequence
gccctgtcgcccaggctaaa

SEQ ID NO: 520593 - DNA, 20 bp, Artificial
  CRISPR gRNA sequence
tcgcccaggctaaagtgcag

SEQ ID NO: 520594 - DNA, 20 bp, Artificial
  CRISPR gRNA sequence
aagtgcagtggcacaatctt

SEQ ID NO: 520595 - DNA, 20 bp, Artificial
  CRISPR gRNA sequence
ggctcactgcaacctctgcc

SEQ ID NO: 520596 - DNA, 20 bp, Artificial
  CRISPR gRNA sequence
gctcactgcaacctctgcct

SEQ ID NO: 520597 - DNA, 20 bp, Artificial
  CRISPR gRNA sequence
actgcaacctctgcctccca

SEQ ID NO: 520598 - DNA, 20 bp, Artificial
  CRISPR gRNA sequence
caacctctgcctcccaggtt

SEQ ID NO: 520599 - DNA, 20 bp, Artificial
  CRISPR gRNA sequence
tgcctcccaggttcaagtga

SEQ ID NO: 520600 - DNA, 20 bp, Artificial
  CRISPR gRNA sequence
cctcccaggttcaagtgatt

SEQ ID NO: 520601 - DNA, 20 bp, Artificial
  CRISPR gRNA sequence
ccaggttcaagtgattctcc

SEQ ID NO: 520602 - DNA, 20 bp, Artificial
  CRISPR gRNA sequence
aagtgattctcctgccgcag

SEQ ID NO: 520603 - DNA, 20 bp, Artificial
  CRISPR gRNA sequence
tcctgccgcagcaggagaat

SEQ ID NO: 520604 - DNA, 20 bp, Artificial
  CRISPR gRNA sequence
ctgccgcagcaggagaatgt

SEQ ID NO: 520605 - DNA, 20 bp, Artificial
  CRISPR gRNA sequence
ccgcagcaggagaatgttgg

SEQ ID NO: 520606 - DNA, 20 bp, Artificial
  CRISPR gRNA sequence
gccaggctggtctcgaaccc

SEQ ID NO: 520607 - DNA, 20 bp, Artificial
  CRISPR gRNA sequence
gtctcgaacccccgacctca

SEQ ID NO: 520608 - DNA, 20 bp, Artificial
  CRISPR gRNA sequence
gaacccccgacctcaagtga

SEQ ID NO: 520609 - DNA, 20 bp, Artificial
  CRISPR gRNA sequence
aagtgatccacccgcctcgg

SEQ ID NO: 520610 - DNA, 20 bp, Artificial
  CRISPR gRNA sequence
ggcctcccaaagtgctggga

SEQ ID NO: 520611 - DNA, 20 bp, Artificial
  CRISPR gRNA sequence
ccaaagtgctgggattacag

SEQ ID NO: 520612 - DNA, 20 bp, Artificial
  CRISPR gRNA sequence
ggattacaggcgtgagccac

SEQ ID NO: 520613 - DNA, 20 bp, Artificial
  CRISPR gRNA sequence
caggcgtgagccaccgataa

SEQ ID NO: 520614 - DNA, 20 bp, Artificial
  CRISPR gRNA sequence
ctcaaagcactgacagggga

SEQ ID NO: 520615 - DNA, 20 bp, Artificial
  CRISPR gRNA sequence
tcaaagcactgacaggggac

SEQ ID NO: 520616 - DNA, 20 bp, Artificial
  CRISPR gRNA sequence
aaagcactgacaggggactg

SEQ ID NO: 520617 - DNA, 20 bp, Artificial
  CRISPR gRNA sequence
acaggggactgtgttctgaa

SEQ ID NO: 520618 - DNA, 20 bp, Artificial
  CRISPR gRNA sequence
tgttctgaaacaggtgctct

SEQ ID NO: 520619 - DNA, 20 bp, Artificial
  CRISPR gRNA sequence
tgaaacaggtgctctggtca

SEQ ID NO: 520620 - DNA, 20 bp, Artificial
  CRISPR gRNA sequence
aaacaggtgctctggtcaag

SEQ ID NO: 520621 - DNA, 20 bp, Artificial
  CRISPR gRNA sequence
tggtcaagtcgaaacaggtg

SEQ ID NO: 520622 - DNA, 20 bp, Artificial
  CRISPR gRNA sequence
gtcaagtcgaaacaggtgct

SEQ ID NO: 520623 - DNA, 20 bp, Artificial
  CRISPR gRNA sequence
tggtcaagtcagtttgggca

SEQ ID NO: 520624 - DNA, 20 bp, Artificial
  CRISPR gRNA sequence
gtcaagtcagtttgggcaac

SEQ ID NO: 520625 - DNA, 20 bp, Artificial
  CRISPR gRNA sequence
gggcaacactggtttaaaca

SEQ ID NO: 520626 - DNA, 20 bp, Artificial
  CRISPR gRNA sequence
ggcaacactggtttaaacag

SEQ ID NO: 520627 - DNA, 20 bp, Artificial
  CRISPR gRNA sequence
gtttaaacagttacttaggt

SEQ ID NO: 520628 - DNA, 20 bp, Artificial
  CRISPR gRNA sequence
aaacagttacttaggtctct

SEQ ID NO: 520629 - DNA, 20 bp, Artificial
  CRISPR gRNA sequence
aacagttacttaggtctctt

SEQ ID NO: 520630 - DNA, 20 bp, Artificial
  CRISPR gRNA sequence
cttaggtctcttggctgcaa

SEQ ID NO: 520631 - DNA, 20 bp, Artificial
  CRISPR gRNA sequence
aggtctcttggctgcaagac

SEQ ID NO: 520632 - DNA, 20 bp, Artificial
  CRISPR gRNA sequence
ggtctcttggctgcaagact

SEQ ID NO: 520633 - DNA, 20 bp, Artificial
  CRISPR gRNA sequence
ttggctgcaagactgatcag

SEQ ID NO: 520634 - DNA, 20 bp, Artificial
  CRISPR gRNA sequence
ggctgcaagactgatcagag

SEQ ID NO: 520635 - DNA, 20 bp, Artificial
  CRISPR gRNA sequence
gctgcaagactgatcagagc

SEQ ID NO: 520636 - DNA, 20 bp, Artificial
  CRISPR gRNA sequence
caagactgatcagagccttt

SEQ ID NO: 520637 - DNA, 20 bp, Artificial
  CRISPR gRNA sequence
atcagagcctttactcttct

SEQ ID NO: 520638 - DNA, 20 bp, Artificial
  CRISPR gRNA sequence
tactcttctaagagtaccct

SEQ ID NO: 520639 - DNA, 20 bp, Artificial
  CRISPR gRNA sequence
actcttctaagagtaccctg

SEQ ID NO: 520640 - DNA, 20 bp, Artificial
  CRISPR gRNA sequence
ctcttctaagagtaccctgg

SEQ ID NO: 520641 - DNA, 20 bp, Artificial
  CRISPR gRNA sequence
ttctaagagtaccctggcct

SEQ ID NO: 520642 - DNA, 20 bp, Artificial
  CRISPR gRNA sequence
ctaagagtaccctggccttc

SEQ ID NO: 520643 - DNA, 20 bp, Artificial
  CRISPR gRNA sequence
taagagtaccctggccttct

SEQ ID NO: 520644 - DNA, 20 bp, Artificial
  CRISPR gRNA sequence
agagtaccctggccttctga

SEQ ID NO: 520645 - DNA, 20 bp, Artificial
  CRISPR gRNA sequence
gccttctgagtgtgtaatgg

SEQ ID NO: 520646 - DNA, 20 bp, Artificial
  CRISPR gRNA sequence
ctgagtgtgtaatggaatag

SEQ ID NO: 520647 - DNA, 20 bp, Artificial
  CRISPR gRNA sequence
tgagtgtgtaatggaatagt

SEQ ID NO: 520648 - DNA, 20 bp, Artificial
  CRISPR gRNA sequence
agtgtgtaatggaatagtgt

SEQ ID NO: 520649 - DNA, 20 bp, Artificial
  CRISPR gRNA sequence
tgcaaatggtttggtctccc

SEQ ID NO: 520650 - DNA, 20 bp, Artificial
  CRISPR gRNA sequence
gcaaatggtttggtctccct

SEQ ID NO: 520651 - DNA, 20 bp, Artificial
  CRISPR gRNA sequence
caaatggtttggtctccctt

SEQ ID NO: 520652 - DNA, 20 bp, Artificial
  CRISPR gRNA sequence
ggtctccctttaaaaaaaaa

SEQ ID NO: 520653 - DNA, 20 bp, Artificial
  CRISPR gRNA sequence
gtctccctttaaaaaaaaaa

SEQ ID NO: 520654 - DNA, 20 bp, Artificial
  CRISPR gRNA sequence
cctttaaaaaaaaaaggtgc

SEQ ID NO: 520655 - DNA, 20 bp, Artificial
  CRISPR gRNA sequence
taaaaaaaaaaggtgcagaa

SEQ ID NO: 520656 - DNA, 20 bp, Artificial
  CRISPR gRNA sequence
aaaaaaaaaaggtgcagaac

SEQ ID NO: 520657 - DNA, 20 bp, Artificial
  CRISPR gRNA sequence
aaaaaaaaaggtgcagaacg

SEQ ID NO: 520658 - DNA, 20 bp, Artificial
  CRISPR gRNA sequence
cgagagagtgcagacactgg

SEQ ID NO: 520659 - DNA, 20 bp, Artificial
  CRISPR gRNA sequence
ggcaccgatggtaagggctg

SEQ ID NO: 520660 - DNA, 20 bp, Artificial
  CRISPR gRNA sequence
gggcagctccacctggggac

SEQ ID NO: 520661 - DNA, 20 bp, Artificial
  CRISPR gRNA sequence
cacctggggacagagcggaa

SEQ ID NO: 520662 - DNA, 20 bp, Artificial
  CRISPR gRNA sequence
gggacagagcggaagggcac

SEQ ID NO: 520663 - DNA, 20 bp, Artificial
  CRISPR gRNA sequence
aggagctcagctttccagca

SEQ ID NO: 520664 - DNA, 20 bp, Artificial
  CRISPR gRNA sequence
agctttccagcagccttggg

SEQ ID NO: 520665 - DNA, 20 bp, Artificial
  CRISPR gRNA sequence
tccagcagccttggggcttc

SEQ ID NO: 520666 - DNA, 20 bp, Artificial
  CRISPR gRNA sequence
ccagcagccttggggcttca

SEQ ID NO: 520667 - DNA, 20 bp, Artificial
  CRISPR gRNA sequence
cagcagccttggggcttcac

SEQ ID NO: 520668 - DNA, 20 bp, Artificial
  CRISPR gRNA sequence
ggggcttcactggcccacac

SEQ ID NO: 520669 - DNA, 20 bp, Artificial
  CRISPR gRNA sequence
gggcttcactggcccacaca

SEQ ID NO: 520670 - DNA, 20 bp, Artificial
  CRISPR gRNA sequence
cactggcccacacacccgtc

SEQ ID NO: 520671 - DNA, 20 bp, Artificial
  CRISPR gRNA sequence
actggcccacacacccgtcc

SEQ ID NO: 520672 - DNA, 20 bp, Artificial
  CRISPR gRNA sequence
gcccacacacccgtccgacc

SEQ ID NO: 520673 - DNA, 20 bp, Artificial
  CRISPR gRNA sequence
ctgggcagccctgacacccc

SEQ ID NO: 520674 - DNA, 20 bp, Artificial
  CRISPR gRNA sequence
tgggcagccctgacacccca

SEQ ID NO: 520675 - DNA, 20 bp, Artificial
  CRISPR gRNA sequence
ggcagccctgacaccccaga

SEQ ID NO: 520676 - DNA, 20 bp, Artificial
  CRISPR gRNA sequence
acaccccagagcagggccgg

SEQ ID NO: 520677 - DNA, 20 bp, Artificial
  CRISPR gRNA sequence
ccagccagagccaataacca

SEQ ID NO: 520678 - DNA, 20 bp, Artificial
  CRISPR gRNA sequence
gcaccaccaccgaggccaag

SEQ ID NO: 520679 - DNA, 20 bp, Artificial
  CRISPR gRNA sequence
cctggtcgcaggtaaagcgt

SEQ ID NO: 520680 - DNA, 20 bp, Artificial
  CRISPR gRNA sequence
gtcgcaggtaaagcgtcact

SEQ ID NO: 520681 - DNA, 20 bp, Artificial
  CRISPR gRNA sequence
tttgtggggacagctgcttc

SEQ ID NO: 520682 - DNA, 20 bp, Artificial
  CRISPR gRNA sequence
ttgtggggacagctgcttct

SEQ ID NO: 520683 - DNA, 20 bp, Artificial
  CRISPR gRNA sequence
tgtggggacagctgcttctg

SEQ ID NO: 520684 - DNA, 20 bp, Artificial
  CRISPR gRNA sequence
gtggggacagctgcttctgg

SEQ ID NO: 520685 - DNA, 20 bp, Artificial
  CRISPR gRNA sequence
tggggacagctgcttctggc

SEQ ID NO: 520686 - DNA, 20 bp, Artificial
  CRISPR gRNA sequence
cttctggcccccattgtggt

SEQ ID NO: 520687 - DNA, 20 bp, Artificial
  CRISPR gRNA sequence
ctggcccccattgtggtctt

SEQ ID NO: 520688 - DNA, 20 bp, Artificial
  CRISPR gRNA sequence
tggcccccattgtggtcttc

SEQ ID NO: 520689 - DNA, 20 bp, Artificial
  CRISPR gRNA sequence
gcccccattgtggtcttcct

SEQ ID NO: 520690 - DNA, 20 bp, Artificial
  CRISPR gRNA sequence
tggtcttcctgggtttcagc

SEQ ID NO: 520691 - DNA, 20 bp, Artificial
  CRISPR gRNA sequence
cctgggtttcagcgaggctt

SEQ ID NO: 520692 - DNA, 20 bp, Artificial
  CRISPR gRNA sequence
ctgggtttcagcgaggcttg

SEQ ID NO: 520693 - DNA, 20 bp, Artificial
  CRISPR gRNA sequence
ggtttcagcgaggcttgtgg

SEQ ID NO: 520694 - DNA, 20 bp, Artificial
  CRISPR gRNA sequence
cagcgaggcttgtggggtcc

SEQ ID NO: 520695 - DNA, 20 bp, Artificial
  CRISPR gRNA sequence
agcgaggcttgtggggtcca

SEQ ID NO: 520696 - DNA, 20 bp, Artificial
  CRISPR gRNA sequence
gtggggtccatgatgtcgtc

SEQ ID NO: 520697 - DNA, 20 bp, Artificial
  CRISPR gRNA sequence
tggggtccatgatgtcgtca

SEQ ID NO: 520698 - DNA, 20 bp, Artificial
  CRISPR gRNA sequence
atgagcagctgtggccgggt

SEQ ID NO: 520699 - DNA, 20 bp, Artificial
  CRISPR gRNA sequence
tggccgggtgtcgcagcgaa

SEQ ID NO: 520700 - DNA, 20 bp, Artificial
  CRISPR gRNA sequence
tgaagttctggggaggggga

SEQ ID NO: 520701 - DNA, 20 bp, Artificial
  CRISPR gRNA sequence
tggggagggggagtcagggg

SEQ ID NO: 520702 - DNA, 20 bp, Artificial
  CRISPR gRNA sequence
gggagggggagtcaggggtc

SEQ ID NO: 520703 - DNA, 20 bp, Artificial
  CRISPR gRNA sequence
cgggacctgcaggaggctga

SEQ ID NO: 520704 - DNA, 20 bp, Artificial
  CRISPR gRNA sequence
caggaggctgactggccatg

SEQ ID NO: 520705 - DNA, 20 bp, Artificial
  CRISPR gRNA sequence
actggccatggaggactgag

SEQ ID NO: 520706 - DNA, 20 bp, Artificial
  CRISPR gRNA sequence
gccatggaggactgaggacc

SEQ ID NO: 520707 - DNA, 20 bp, Artificial
  CRISPR gRNA sequence
aggacccaccctgtcccctc

SEQ ID NO: 520708 - DNA, 20 bp, Artificial
  CRISPR gRNA sequence
tcccctcctcctctgcgcct

SEQ ID NO: 520709 - DNA, 20 bp, Artificial
  CRISPR gRNA sequence
ctcctctgcgcctggaattt

SEQ ID NO: 520710 - DNA, 20 bp, Artificial
  CRISPR gRNA sequence
ctctgcgcctggaatttggg

SEQ ID NO: 520711 - DNA, 20 bp, Artificial
  CRISPR gRNA sequence
tgcgcctggaatttgggaca

SEQ ID NO: 520712 - DNA, 20 bp, Artificial
  CRISPR gRNA sequence
cgcctggaatttgggacaga

SEQ ID NO: 520713 - DNA, 20 bp, Artificial
  CRISPR gRNA sequence
gaatttgggacagaagtccc

SEQ ID NO: 520714 - DNA, 20 bp, Artificial
  CRISPR gRNA sequence
gggacagaagtccctgtgga

SEQ ID NO: 520715 - DNA, 20 bp, Artificial
  CRISPR gRNA sequence
ggacagaagtccctgtggac

SEQ ID NO: 520716 - DNA, 20 bp, Artificial
  CRISPR gRNA sequence
tggacagagacagggagctc

SEQ ID NO: 520717 - DNA, 20 bp, Artificial
  CRISPR gRNA sequence
cttcagcctcccagacagcc

SEQ ID NO: 520718 - DNA, 20 bp, Artificial
  CRISPR gRNA sequence
cagcctcccagacagcccct

SEQ ID NO: 520719 - DNA, 20 bp, Artificial
  CRISPR gRNA sequence
agcctcccagacagcccctc

SEQ ID NO: 520720 - DNA, 20 bp, Artificial
  CRISPR gRNA sequence
ccagacagcccctccctgaa

SEQ ID NO: 520721 - DNA, 20 bp, Artificial
  CRISPR gRNA sequence
cctgaaggctcccggccaca

SEQ ID NO: 520722 - DNA, 20 bp, Artificial
  CRISPR gRNA sequence
aaggctcccggccacagcag

SEQ ID NO: 520723 - DNA, 20 bp, Artificial
  CRISPR gRNA sequence
ccggccacagcagacccctg

SEQ ID NO: 520724 - DNA, 20 bp, Artificial
  CRISPR gRNA sequence
gggggcagggtatcgcctcc

SEQ ID NO: 520725 - DNA, 20 bp, Artificial
  CRISPR gRNA sequence
ctcctctgcctctagcggca

SEQ ID NO: 520726 - DNA, 20 bp, Artificial
  CRISPR gRNA sequence
ctctgcctctagcggcagaa

SEQ ID NO: 520727 - DNA, 20 bp, Artificial
  CRISPR gRNA sequence
tgcctctagcggcagaaagg

SEQ ID NO: 520728 - DNA, 20 bp, Artificial
  CRISPR gRNA sequence
cctctagcggcagaaaggac

SEQ ID NO: 520729 - DNA, 20 bp, Artificial
  CRISPR gRNA sequence
tagcggcagaaaggactcag

SEQ ID NO: 520730 - DNA, 20 bp, Artificial
  CRISPR gRNA sequence
gcggcagaaaggactcagga

SEQ ID NO: 520731 - DNA, 20 bp, Artificial
  CRISPR gRNA sequence
aggacctactctccagcccg

SEQ ID NO: 520732 - DNA, 20 bp, Artificial
  CRISPR gRNA sequence
ctctccagcccgaggctgac

SEQ ID NO: 520733 - DNA, 20 bp, Artificial
  CRISPR gRNA sequence
tccagcccgaggctgaccca

SEQ ID NO: 520734 - DNA, 20 bp, Artificial
  CRISPR gRNA sequence
cagcccgaggctgacccaag

SEQ ID NO: 520735 - DNA, 20 bp, Artificial
  CRISPR gRNA sequence
acccaagaggagaggcctca

SEQ ID NO: 520736 - DNA, 20 bp, Artificial
  CRISPR gRNA sequence
agcgtcctctagcagctggc

SEQ ID NO: 520737 - DNA, 20 bp, Artificial
  CRISPR gRNA sequence
tagcagctggcccaggggct

SEQ ID NO: 520738 - DNA, 20 bp, Artificial
  CRISPR gRNA sequence
gcagctggcccaggggcttc

SEQ ID NO: 520739 - DNA, 20 bp, Artificial
  CRISPR gRNA sequence
gcccaggggcttcaagccct

SEQ ID NO: 520740 - DNA, 20 bp, Artificial
  CRISPR gRNA sequence
caagcccttcatcagcagaa

SEQ ID NO: 520741 - DNA, 20 bp, Artificial
  CRISPR gRNA sequence
aagcccttcatcagcagaac

SEQ ID NO: 520742 - DNA, 20 bp, Artificial
  CRISPR gRNA sequence
catcagcagaacctttgtcc

SEQ ID NO: 520743 - DNA, 20 bp, Artificial
  CRISPR gRNA sequence
atcagcagaacctttgtcca

SEQ ID NO: 520744 - DNA, 20 bp, Artificial
  CRISPR gRNA sequence
tgtccaagggagttgctgtg

SEQ ID NO: 520745 - DNA, 20 bp, Artificial
  CRISPR gRNA sequence
gtccaagggagttgctgtgt

SEQ ID NO: 520746 - DNA, 20 bp, Artificial
  CRISPR gRNA sequence
tccaagggagttgctgtgtc

SEQ ID NO: 520747 - DNA, 20 bp, Artificial
  CRISPR gRNA sequence
ctgtgtcccaaaggaacgtg

SEQ ID NO: 520748 - DNA, 20 bp, Artificial
  CRISPR gRNA sequence
tgtcccaaaggaacgtggca

SEQ ID NO: 520749 - DNA, 20 bp, Artificial
  CRISPR gRNA sequence
ggcccccaagaaacccagaa

SEQ ID NO: 520750 - DNA, 20 bp, Artificial
  CRISPR gRNA sequence
tgggccaagcccctcaaagt

SEQ ID NO: 520751 - DNA, 20 bp, Artificial
  CRISPR gRNA sequence
ggccaagcccctcaaagttt

SEQ ID NO: 520752 - DNA, 20 bp, Artificial
  CRISPR gRNA sequence
aaagtttagaagaacaaaag

SEQ ID NO: 520753 - DNA, 20 bp, Artificial
  CRISPR gRNA sequence
agaagaacaaaagctggagg

SEQ ID NO: 520754 - DNA, 20 bp, Artificial
  CRISPR gRNA sequence
gaagaacaaaagctggaggg

SEQ ID NO: 520755 - DNA, 20 bp, Artificial
  CRISPR gRNA sequence
gaggggagcctgggaggcct

SEQ ID NO: 520756 - DNA, 20 bp, Artificial
  CRISPR gRNA sequence
ggaggcctgggcccagggcg

SEQ ID NO: 520757 - DNA, 20 bp, Artificial
  CRISPR gRNA sequence
ggcccagggcgctttcctct

SEQ ID NO: 520758 - DNA, 20 bp, Artificial
  CRISPR gRNA sequence
tcctctcagccactttgtcc

SEQ ID NO: 520759 - DNA, 20 bp, Artificial
  CRISPR gRNA sequence
cctctcagccactttgtccc

SEQ ID NO: 520760 - DNA, 20 bp, Artificial
  CRISPR gRNA sequence
ctctcagccactttgtccct

SEQ ID NO: 520761 - DNA, 20 bp, Artificial
  CRISPR gRNA sequence
tcagccactttgtccctgca

SEQ ID NO: 520762 - DNA, 20 bp, Artificial
  CRISPR gRNA sequence
agccactttgtccctgcaaa

SEQ ID NO: 520763 - DNA, 20 bp, Artificial
  CRISPR gRNA sequence
tgtccctgcaaatcccctgg

SEQ ID NO: 520764 - DNA, 20 bp, Artificial
  CRISPR gRNA sequence
gtccctgcaaatcccctgga

SEQ ID NO: 520765 - DNA, 20 bp, Artificial
  CRISPR gRNA sequence
tccctgcaaatcccctggat

SEQ ID NO: 520766 - DNA, 20 bp, Artificial
  CRISPR gRNA sequence
caaatcccctggattctgat

SEQ ID NO: 520767 - DNA, 20 bp, Artificial
  CRISPR gRNA sequence
gattctgatgagggctgtgt

SEQ ID NO: 520768 - DNA, 20 bp, Artificial
  CRISPR gRNA sequence
tgatgagggctgtgtttggt

SEQ ID NO: 520769 - DNA, 20 bp, Artificial
  CRISPR gRNA sequence
atgagggctgtgtttggtgg

SEQ ID NO: 520770 - DNA, 20 bp, Artificial
  CRISPR gRNA sequence
tgtttggtgggtcccgtcac

SEQ ID NO: 520771 - DNA, 20 bp, Artificial
  CRISPR gRNA sequence
ggtgggtcccgtcactggcc

SEQ ID NO: 520772 - DNA, 20 bp, Artificial
  CRISPR gRNA sequence
gtgggtcccgtcactggccc

SEQ ID NO: 520773 - DNA, 20 bp, Artificial
  CRISPR gRNA sequence
gccccgagcctgctgcctct

SEQ ID NO: 520774 - DNA, 20 bp, Artificial
  CRISPR gRNA sequence
ctgcctctacagggaagggt

SEQ ID NO: 520775 - DNA, 20 bp, Artificial
  CRISPR gRNA sequence
cctctacagggaagggtgct

SEQ ID NO: 520776 - DNA, 20 bp, Artificial
  CRISPR gRNA sequence
tacagggaagggtgctggtg

SEQ ID NO: 520777 - DNA, 20 bp, Artificial
  CRISPR gRNA sequence
cagggaagggtgctggtgat

SEQ ID NO: 520778 - DNA, 20 bp, Artificial
  CRISPR gRNA sequence
gtgatgcggggccagaagcg

SEQ ID NO: 520779 - DNA, 20 bp, Artificial
  CRISPR gRNA sequence
gtgcacttgctttcgtagag

SEQ ID NO: 520780 - DNA, 20 bp, Artificial
  CRISPR gRNA sequence
tgcacttgctttcgtagagg

SEQ ID NO: 520781 - DNA, 20 bp, Artificial
  CRISPR gRNA sequence
gctttcgtagagggaagctc

SEQ ID NO: 520782 - DNA, 20 bp, Artificial
  CRISPR gRNA sequence
ctttcgtagagggaagctca

SEQ ID NO: 520783 - DNA, 20 bp, Artificial
  CRISPR gRNA sequence
tcgtagagggaagctcagga

SEQ ID NO: 520784 - DNA, 20 bp, Artificial
  CRISPR gRNA sequence
cgtagagggaagctcaggag

SEQ ID NO: 520785 - DNA, 20 bp, Artificial
  CRISPR gRNA sequence
gtagagggaagctcaggagg

SEQ ID NO: 520786 - DNA, 20 bp, Artificial
  CRISPR gRNA sequence
aggaggataagcccggcccc

SEQ ID NO: 520787 - DNA, 20 bp, Artificial
  CRISPR gRNA sequence
gtgagtcccgcaggcagggg

SEQ ID NO: 520788 - DNA, 20 bp, Artificial
  CRISPR gRNA sequence
tttgtagggctctgactttt

SEQ ID NO: 520789 - DNA, 20 bp, Artificial
  CRISPR gRNA sequence
tgtagggctctgacttttgg

SEQ ID NO: 520790 - DNA, 20 bp, Artificial
  CRISPR gRNA sequence
gtagggctctgacttttgga

SEQ ID NO: 520791 - DNA, 20 bp, Artificial
  CRISPR gRNA sequence
tagggctctgacttttggaa

SEQ ID NO: 520792 - DNA, 20 bp, Artificial
  CRISPR gRNA sequence
tgacttttggaaccacagaa

SEQ ID NO: 520793 - DNA, 20 bp, Artificial
  CRISPR gRNA sequence
acttttggaaccacagaatt

SEQ ID NO: 520794 - DNA, 20 bp, Artificial
  CRISPR gRNA sequence
ttggaaccacagaatttttt

SEQ ID NO: 520795 - DNA, 20 bp, Artificial
  CRISPR gRNA sequence
tggaaccacagaatttttta

SEQ ID NO: 520796 - DNA, 20 bp, Artificial
  CRISPR gRNA sequence
ggaaccacagaattttttaa

SEQ ID NO: 520797 - DNA, 20 bp, Artificial
  CRISPR gRNA sequence
gaaccacagaattttttaaa

SEQ ID NO: 520798 - DNA, 20 bp, Artificial
  CRISPR gRNA sequence
tttaaagaagtcctccagaa

SEQ ID NO: 520799 - DNA, 20 bp, Artificial
  CRISPR gRNA sequence
ttaaagaagtcctccagaaa

SEQ ID NO: 520800 - DNA, 20 bp, Artificial
  CRISPR gRNA sequence
taaagaagtcctccagaaat

SEQ ID NO: 520801 - DNA, 20 bp, Artificial
  CRISPR gRNA sequence
aaagaagtcctccagaaata

SEQ ID NO: 520802 - DNA, 20 bp, Artificial
  CRISPR gRNA sequence
aagaagtcctccagaaataa

SEQ ID NO: 520803 - DNA, 20 bp, Artificial
  CRISPR gRNA sequence
cagaaataaaagtacatcag

SEQ ID NO: 520804 - DNA, 20 bp, Artificial
  CRISPR gRNA sequence
aatgtaatccacacagaaac

SEQ ID NO: 520805 - DNA, 20 bp, Artificial
  CRISPR gRNA sequence
actgaaaggtgtttatttca

SEQ ID NO: 520806 - DNA, 20 bp, Artificial
  CRISPR gRNA sequence
aaaggtgtttatttcagagg

SEQ ID NO: 520807 - DNA, 20 bp, Artificial
  CRISPR gRNA sequence
atttcagaggagctgaaaac

SEQ ID NO: 520808 - DNA, 20 bp, Artificial
  CRISPR gRNA sequence
tttcagaggagctgaaaacc

SEQ ID NO: 520809 - DNA, 20 bp, Artificial
  CRISPR gRNA sequence
cagaggagctgaaaacctcc

SEQ ID NO: 520810 - DNA, 20 bp, Artificial
  CRISPR gRNA sequence
agaggagctgaaaacctcca

SEQ ID NO: 520811 - DNA, 20 bp, Artificial
  CRISPR gRNA sequence
aaaacctccagaaaggggag

SEQ ID NO: 520812 - DNA, 20 bp, Artificial
  CRISPR gRNA sequence
cagaaaggggagggaaaaaa

SEQ ID NO: 520813 - DNA, 20 bp, Artificial
  CRISPR gRNA sequence
accaaggtagtttccacctg

SEQ ID NO: 520814 - DNA, 20 bp, Artificial
  CRISPR gRNA sequence
ccacctggggcctggccacc

SEQ ID NO: 520815 - DNA, 20 bp, Artificial
  CRISPR gRNA sequence
cacctggggcctggccaccc

SEQ ID NO: 520816 - DNA, 20 bp, Artificial
  CRISPR gRNA sequence
gggcctggccaccctgctca

SEQ ID NO: 520817 - DNA, 20 bp, Artificial
  CRISPR gRNA sequence
gccaccctgctcagtccgag

SEQ ID NO: 520818 - DNA, 20 bp, Artificial
  CRISPR gRNA sequence
ctcagtccgaggacagacgg

SEQ ID NO: 520819 - DNA, 20 bp, Artificial
  CRISPR gRNA sequence
agtccgaggacagacgggag

SEQ ID NO: 520820 - DNA, 20 bp, Artificial
  CRISPR gRNA sequence
ctcctccggggactgctcgc

SEQ ID NO: 520821 - DNA, 20 bp, Artificial
  CRISPR gRNA sequence
tcctccggggactgctcgcc

SEQ ID NO: 520822 - DNA, 20 bp, Artificial
  CRISPR gRNA sequence
ctccggggactgctcgccgc

SEQ ID NO: 520823 - DNA, 20 bp, Artificial
  CRISPR gRNA sequence
cggggactgctcgccgcggt

SEQ ID NO: 520824 - DNA, 20 bp, Artificial
  CRISPR gRNA sequence
ctcgccgcggtggcgtgggc

SEQ ID NO: 520825 - DNA, 20 bp, Artificial
  CRISPR gRNA sequence
gccgcggtggcgtgggctgg

SEQ ID NO: 520826 - DNA, 20 bp, Artificial
  CRISPR gRNA sequence
gaggacccaaagccgctccc

SEQ ID NO: 520827 - DNA, 20 bp, Artificial
  CRISPR gRNA sequence
cctgtgggacgcaaaattga

SEQ ID NO: 520828 - DNA, 20 bp, Artificial
  CRISPR gRNA sequence
tgggacgcaaaattgagaaa

SEQ ID NO: 520829 - DNA, 20 bp, Artificial
  CRISPR gRNA sequence
agaaatgaggaagctgctga

SEQ ID NO: 520830 - DNA, 20 bp, Artificial
  CRISPR gRNA sequence
ctgacggtaaggaatgagac

SEQ ID NO: 520831 - DNA, 20 bp, Artificial
  CRISPR gRNA sequence
acggtaaggaatgagacacc

SEQ ID NO: 520832 - DNA, 20 bp, Artificial
  CRISPR gRNA sequence
ctcctgctgccctccccttc

SEQ ID NO: 520833 - DNA, 20 bp, Artificial
  CRISPR gRNA sequence
tcctgctgccctccccttct

SEQ ID NO: 520834 - DNA, 20 bp, Artificial
  CRISPR gRNA sequence
ctgctgccctccccttcttc

SEQ ID NO: 520835 - DNA, 20 bp, Artificial
  CRISPR gRNA sequence
ctgccctccccttcttctcc

SEQ ID NO: 520836 - DNA, 20 bp, Artificial
  CRISPR gRNA sequence
ccctccccttcttctccacc

SEQ ID NO: 520837 - DNA, 20 bp, Artificial
  CRISPR gRNA sequence
cccttcttctccaccccctc

SEQ ID NO: 520838 - DNA, 20 bp, Artificial
  CRISPR gRNA sequence
cttctccaccccctcccctt

SEQ ID NO: 520839 - DNA, 20 bp, Artificial
  CRISPR gRNA sequence
ttctccaccccctccccttc

SEQ ID NO: 520840 - DNA, 20 bp, Artificial
  CRISPR gRNA sequence
ctccaccccctccccttctc

SEQ ID NO: 520841 - DNA, 20 bp, Artificial
  CRISPR gRNA sequence
tccaccccctccccttctct

SEQ ID NO: 520842 - DNA, 20 bp, Artificial
  CRISPR gRNA sequence
caccccctccccttctctag

SEQ ID NO: 520843 - DNA, 20 bp, Artificial
  CRISPR gRNA sequence
cccttctctagtttataaga

SEQ ID NO: 520844 - DNA, 20 bp, Artificial
  CRISPR gRNA sequence
ctctagtttataagacagga

SEQ ID NO: 520845 - DNA, 20 bp, Artificial
  CRISPR gRNA sequence
tctagtttataagacaggag

SEQ ID NO: 520846 - DNA, 20 bp, Artificial
  CRISPR gRNA sequence
tagtttataagacaggagaa

SEQ ID NO: 520847 - DNA, 20 bp, Artificial
  CRISPR gRNA sequence
gtttataagacaggagaaaa

SEQ ID NO: 520848 - DNA, 20 bp, Artificial
  CRISPR gRNA sequence
ataagacaggagaaaagaga

SEQ ID NO: 520849 - DNA, 20 bp, Artificial
  CRISPR gRNA sequence
taagacaggagaaaagagag

SEQ ID NO: 520850 - DNA, 20 bp, Artificial
  CRISPR gRNA sequence
gaaagaaacagaagtaagat

SEQ ID NO: 520851 - DNA, 20 bp, Artificial
  CRISPR gRNA sequence
ggcgccaccacccggccctg

SEQ ID NO: 520852 - DNA, 20 bp, Artificial
  CRISPR gRNA sequence
gcgccaccacccggccctgg

SEQ ID NO: 520853 - DNA, 20 bp, Artificial
  CRISPR gRNA sequence
gtggttaaactaataatatt

SEQ ID NO: 520854 - DNA, 20 bp, Artificial
  CRISPR gRNA sequence
aactaataatattattatta

SEQ ID NO: 520855 - DNA, 20 bp, Artificial
  CRISPR gRNA sequence
ataatattattattattatt

SEQ ID NO: 520856 - DNA, 20 bp, Artificial
  CRISPR gRNA sequence
ttattattattattattaac

SEQ ID NO: 520857 - DNA, 20 bp, Artificial
  CRISPR gRNA sequence
ttattattattattaacccc

SEQ ID NO: 520858 - DNA, 20 bp, Artificial
  CRISPR gRNA sequence
ttattattattaacccctga

SEQ ID NO: 520859 - DNA, 20 bp, Artificial
  CRISPR gRNA sequence
ttattattaacccctgacca

SEQ ID NO: 520860 - DNA, 20 bp, Artificial
  CRISPR gRNA sequence
ttattaacccctgaccaaaa

SEQ ID NO: 520861 - DNA, 20 bp, Artificial
  CRISPR gRNA sequence
ttaacccctgaccaaaacta

SEQ ID NO: 520862 - DNA, 20 bp, Artificial
  CRISPR gRNA sequence
acccctgaccaaaactactg

SEQ ID NO: 520863 - DNA, 20 bp, Artificial
  CRISPR gRNA sequence
accaaaactactggtgttat

SEQ ID NO: 520864 - DNA, 20 bp, Artificial
  CRISPR gRNA sequence
ctggtgttatctgtaaattc

SEQ ID NO: 520865 - DNA, 20 bp, Artificial
  CRISPR gRNA sequence
gtgttatctgtaaattccag

SEQ ID NO: 520866 - DNA, 20 bp, Artificial
  CRISPR gRNA sequence
tctgtaaattccagacattg

SEQ ID NO: 520867 - DNA, 20 bp, Artificial
  CRISPR gRNA sequence
taaattccagacattgtatg

SEQ ID NO: 520868 - DNA, 20 bp, Artificial
  CRISPR gRNA sequence
cagacattgtatgaaaaagc

SEQ ID NO: 520869 - DNA, 20 bp, Artificial
  CRISPR gRNA sequence
tatgaaaaagcattgcaaaa

SEQ ID NO: 520870 - DNA, 20 bp, Artificial
  CRISPR gRNA sequence
caaaactttctgttctgtca

SEQ ID NO: 520871 - DNA, 20 bp, Artificial
  CRISPR gRNA sequence
tctgttctgtcagctgatgc

SEQ ID NO: 520872 - DNA, 20 bp, Artificial
  CRISPR gRNA sequence
ctgttctgtcagctgatgca

SEQ ID NO: 520873 - DNA, 20 bp, Artificial
  CRISPR gRNA sequence
tgttctgtcagctgatgcat

SEQ ID NO: 520874 - DNA, 20 bp, Artificial
  CRISPR gRNA sequence
ttctgtcagctgatgcatgt

SEQ ID NO: 520875 - DNA, 20 bp, Artificial
  CRISPR gRNA sequence
tgtcagctgatgcatgtaac

SEQ ID NO: 520876 - DNA, 20 bp, Artificial
  CRISPR gRNA sequence
tcagctgatgcatgtaaccc

SEQ ID NO: 520877 - DNA, 20 bp, Artificial
  CRISPR gRNA sequence
atgcatgtaacccccagtca

SEQ ID NO: 520878 - DNA, 20 bp, Artificial
  CRISPR gRNA sequence
cccacacttgctctatctat

SEQ ID NO: 520879 - DNA, 20 bp, Artificial
  CRISPR gRNA sequence
gctctatctatcacaaccct

SEQ ID NO: 520880 - DNA, 20 bp, Artificial
  CRISPR gRNA sequence
ctctatctatcacaaccctt

SEQ ID NO: 520881 - DNA, 20 bp, Artificial
  CRISPR gRNA sequence
tatctatcacaaccctttca

SEQ ID NO: 520882 - DNA, 20 bp, Artificial
  CRISPR gRNA sequence
tctatcacaaccctttcatg

SEQ ID NO: 520883 - DNA, 20 bp, Artificial
  CRISPR gRNA sequence
tcacaaccctttcatgtgga

SEQ ID NO: 520884 - DNA, 20 bp, Artificial
  CRISPR gRNA sequence
tcatgtggaccccttagagt

SEQ ID NO: 520885 - DNA, 20 bp, Artificial
  CRISPR gRNA sequence
catgtggaccccttagagtt

SEQ ID NO: 520886 - DNA, 20 bp, Artificial
  CRISPR gRNA sequence
atgtggaccccttagagttg

SEQ ID NO: 520887 - DNA, 20 bp, Artificial
  CRISPR gRNA sequence
agagttgtaagcccttaaaa

SEQ ID NO: 520888 - DNA, 20 bp, Artificial
  CRISPR gRNA sequence
gagttgtaagcccttaaaag

SEQ ID NO: 520889 - DNA, 20 bp, Artificial
  CRISPR gRNA sequence
taagcccttaaaagggctag

SEQ ID NO: 520890 - DNA, 20 bp, Artificial
  CRISPR gRNA sequence
aaaagggctaggaatttctt

SEQ ID NO: 520891 - DNA, 20 bp, Artificial
  CRISPR gRNA sequence
aaagggctaggaatttcttt

SEQ ID NO: 520892 - DNA, 20 bp, Artificial
  CRISPR gRNA sequence
ggaatttctttttcggggag

SEQ ID NO: 520893 - DNA, 20 bp, Artificial
  CRISPR gRNA sequence
ctttttcggggagctcggct

SEQ ID NO: 520894 - DNA, 20 bp, Artificial
  CRISPR gRNA sequence
tttttcggggagctcggctc

SEQ ID NO: 520895 - DNA, 20 bp, Artificial
  CRISPR gRNA sequence
tttcggggagctcggctctt

SEQ ID NO: 520896 - DNA, 20 bp, Artificial
  CRISPR gRNA sequence
ttcggggagctcggctctta

SEQ ID NO: 520897 - DNA, 20 bp, Artificial
  CRISPR gRNA sequence
tcggggagctcggctcttaa

SEQ ID NO: 520898 - DNA, 20 bp, Artificial
  CRISPR gRNA sequence
cggggagctcggctcttaag

SEQ ID NO: 520899 - DNA, 20 bp, Artificial
  CRISPR gRNA sequence
ggggagctcggctcttaaga

SEQ ID NO: 520900 - DNA, 20 bp, Artificial
  CRISPR gRNA sequence
ggctcttaagacgcaagtct

SEQ ID NO: 520901 - DNA, 20 bp, Artificial
  CRISPR gRNA sequence
ttaagacgcaagtctgctga

SEQ ID NO: 520902 - DNA, 20 bp, Artificial
  CRISPR gRNA sequence
aagacgcaagtctgctgaca

SEQ ID NO: 520903 - DNA, 20 bp, Artificial
  CRISPR gRNA sequence
agacgcaagtctgctgacac

SEQ ID NO: 520904 - DNA, 20 bp, Artificial
  CRISPR gRNA sequence
ctgacactcctggccaaata

SEQ ID NO: 520905 - DNA, 20 bp, Artificial
  CRISPR gRNA sequence
acactcctggccaaataaag

SEQ ID NO: 520906 - DNA, 20 bp, Artificial
  CRISPR gRNA sequence
ctggccaaataaagcccttc

SEQ ID NO: 520907 - DNA, 20 bp, Artificial
  CRISPR gRNA sequence
gccaaataaagcccttcctt

SEQ ID NO: 520908 - DNA, 20 bp, Artificial
  CRISPR gRNA sequence
ccttctttaaccgagtgtct

SEQ ID NO: 520909 - DNA, 20 bp, Artificial
  CRISPR gRNA sequence
cttctttaaccgagtgtctg

SEQ ID NO: 520910 - DNA, 20 bp, Artificial
  CRISPR gRNA sequence
ctttaaccgagtgtctgagg

SEQ ID NO: 520911 - DNA, 20 bp, Artificial
  CRISPR gRNA sequence
tttaaccgagtgtctgagga

SEQ ID NO: 520912 - DNA, 20 bp, Artificial
  CRISPR gRNA sequence
taaccgagtgtctgaggaat

SEQ ID NO: 520913 - DNA, 20 bp, Artificial
  CRISPR gRNA sequence
aaccgagtgtctgaggaatt

SEQ ID NO: 520914 - DNA, 20 bp, Artificial
  CRISPR gRNA sequence
accgagtgtctgaggaattc

SEQ ID NO: 520915 - DNA, 20 bp, Artificial
  CRISPR gRNA sequence
aggaattctgtctgcggctt

SEQ ID NO: 520916 - DNA, 20 bp, Artificial
  CRISPR gRNA sequence
tgtctgcggcttgtccggct

SEQ ID NO: 520917 - DNA, 20 bp, Artificial
  CRISPR gRNA sequence
tctgcggcttgtccggctac

SEQ ID NO: 520918 - DNA, 20 bp, Artificial
  CRISPR gRNA sequence
cggcttgtccggctacaacg

SEQ ID NO: 520919 - DNA, 20 bp, Artificial
  CRISPR gRNA sequence
gtccggctacaacggtgctg

SEQ ID NO: 520920 - DNA, 20 bp, Artificial
  CRISPR gRNA sequence
tccggctacaacggtgctgg

SEQ ID NO: 520921 - DNA, 20 bp, Artificial
  CRISPR gRNA sequence
caacggtgctggagcccaga

SEQ ID NO: 520922 - DNA, 20 bp, Artificial
  CRISPR gRNA sequence
gagcccagactctcagggaa

SEQ ID NO: 520923 - DNA, 20 bp, Artificial
  CRISPR gRNA sequence
tcagggaaaggaacccgagc

SEQ ID NO: 520924 - DNA, 20 bp, Artificial
  CRISPR gRNA sequence
agggaaaggaacccgagccg

SEQ ID NO: 520925 - DNA, 20 bp, Artificial
  CRISPR gRNA sequence
attccaggctggggcaaggg

SEQ ID NO: 520926 - DNA, 20 bp, Artificial
  CRISPR gRNA sequence
caggctggggcaagggacat

SEQ ID NO: 520927 - DNA, 20 bp, Artificial
  CRISPR gRNA sequence
gggcaagggacatggagatg

SEQ ID NO: 520928 - DNA, 20 bp, Artificial
  CRISPR gRNA sequence
cagcatcatgttgctccaga

SEQ ID NO: 520929 - DNA, 20 bp, Artificial
  CRISPR gRNA sequence
ctccagaaagcaagaaagtg

SEQ ID NO: 520930 - DNA, 20 bp, Artificial
  CRISPR gRNA sequence
cagaaagcaagaaagtgctc

SEQ ID NO: 520931 - DNA, 20 bp, Artificial
  CRISPR gRNA sequence
agaacggtagaacggggatg

SEQ ID NO: 520932 - DNA, 20 bp, Artificial
  CRISPR gRNA sequence
gagcaactcggggaagaaag

SEQ ID NO: 520933 - DNA, 20 bp, Artificial
  CRISPR gRNA sequence
agcaactcggggaagaaagg

SEQ ID NO: 520934 - DNA, 20 bp, Artificial
  CRISPR gRNA sequence
ggggaagaaaggacagccac

SEQ ID NO: 520935 - DNA, 20 bp, Artificial
  CRISPR gRNA sequence
ctgaacaaaataaaactgtg

SEQ ID NO: 520936 - DNA, 20 bp, Artificial
  CRISPR gRNA sequence
aacaaaataaaactgtgggt

SEQ ID NO: 520937 - DNA, 20 bp, Artificial
  CRISPR gRNA sequence
tgggtcacgctgatgagaga

SEQ ID NO: 520938 - DNA, 20 bp, Artificial
  CRISPR gRNA sequence
atgagagagaggctgcagag

SEQ ID NO: 520939 - DNA, 20 bp, Artificial
  CRISPR gRNA sequence
cagagaaggagagacccttc

SEQ ID NO: 520940 - DNA, 20 bp, Artificial
  CRISPR gRNA sequence
ccttaggttggcagccgtga

SEQ ID NO: 520941 - DNA, 20 bp, Artificial
  CRISPR gRNA sequence
cttaggttggcagccgtgag

SEQ ID NO: 520942 - DNA, 20 bp, Artificial
  CRISPR gRNA sequence
aggttggcagccgtgagtgg

SEQ ID NO: 520943 - DNA, 20 bp, Artificial
  CRISPR gRNA sequence
ggttggcagccgtgagtggc

SEQ ID NO: 520944 - DNA, 20 bp, Artificial
  CRISPR gRNA sequence
gcagccgtgagtggcaggcg

SEQ ID NO: 520945 - DNA, 20 bp, Artificial
  CRISPR gRNA sequence
cagccatcgcagtgatggcg

SEQ ID NO: 520946 - DNA, 20 bp, Artificial
  CRISPR gRNA sequence
caggcggggacctccgcgga

SEQ ID NO: 520947 - DNA, 20 bp, Artificial
  CRISPR gRNA sequence
aggcggggacctccgcggat

SEQ ID NO: 520948 - DNA, 20 bp, Artificial
  CRISPR gRNA sequence
cgcggatgctgagcctgcgg

SEQ ID NO: 520949 - DNA, 20 bp, Artificial
  CRISPR gRNA sequence
agcctgcgggtgcgatttga

SEQ ID NO: 520950 - DNA, 20 bp, Artificial
  CRISPR gRNA sequence
cgggtgcgatttgatgaggg

SEQ ID NO: 520951 - DNA, 20 bp, Artificial
  CRISPR gRNA sequence
gatgagggcagaacctcacc

SEQ ID NO: 520952 - DNA, 20 bp, Artificial
  CRISPR gRNA sequence
atgagggcagaacctcacca

SEQ ID NO: 520953 - DNA, 20 bp, Artificial
  CRISPR gRNA sequence
accagcccacagtggctgcg

SEQ ID NO: 520954 - DNA, 20 bp, Artificial
  CRISPR gRNA sequence
cgaggggatcatgcagcggg

SEQ ID NO: 520955 - DNA, 20 bp, Artificial
  CRISPR gRNA sequence
agcagagccgtccacgctga

SEQ ID NO: 520956 - DNA, 20 bp, Artificial
  CRISPR gRNA sequence
acctcatcaagactgggacg

SEQ ID NO: 520957 - DNA, 20 bp, Artificial
  CRISPR gRNA sequence
atcaagactgggacggggcc

SEQ ID NO: 520958 - DNA, 20 bp, Artificial
  CRISPR gRNA sequence
ggacggggccacagcagtgc

SEQ ID NO: 520959 - DNA, 20 bp, Artificial
  CRISPR gRNA sequence
tcatgggcacttaggacacc

SEQ ID NO: 520960 - DNA, 20 bp, Artificial
  CRISPR gRNA sequence
atgggcacttaggacaccgt

SEQ ID NO: 520961 - DNA, 20 bp, Artificial
  CRISPR gRNA sequence
aggacaccgtcactgagggg

SEQ ID NO: 520962 - DNA, 20 bp, Artificial
  CRISPR gRNA sequence
ggacaccgtcactgaggggc

SEQ ID NO: 520963 - DNA, 20 bp, Artificial
  CRISPR gRNA sequence
aggggctcctgccaaagcac

SEQ ID NO: 520964 - DNA, 20 bp, Artificial
  CRISPR gRNA sequence
ctgccaaagcacacctgagt

SEQ ID NO: 520965 - DNA, 20 bp, Artificial
  CRISPR gRNA sequence
ccaaagcacacctgagtcca

SEQ ID NO: 520966 - DNA, 20 bp, Artificial
  CRISPR gRNA sequence
agtccaggcagaggaaactc

SEQ ID NO: 520967 - DNA, 20 bp, Artificial
  CRISPR gRNA sequence
cagacaagacccccgagggt

SEQ ID NO: 520968 - DNA, 20 bp, Artificial
  CRISPR gRNA sequence
caaagctgctctcctgactt

SEQ ID NO: 520969 - DNA, 20 bp, Artificial
  CRISPR gRNA sequence
ctctcctgacttcctcagaa

SEQ ID NO: 520970 - DNA, 20 bp, Artificial
  CRISPR gRNA sequence
tcctgacttcctcagaaacg

SEQ ID NO: 520971 - DNA, 20 bp, Artificial
  CRISPR gRNA sequence
ctgacttcctcagaaacgcc

SEQ ID NO: 520972 - DNA, 20 bp, Artificial
  CRISPR gRNA sequence
acttcctcagaaacgcccaa

SEQ ID NO: 520973 - DNA, 20 bp, Artificial
  CRISPR gRNA sequence
cctcagaaacgcccaaggac

SEQ ID NO: 520974 - DNA, 20 bp, Artificial
  CRISPR gRNA sequence
ctcagaaacgcccaaggaca

SEQ ID NO: 520975 - DNA, 20 bp, Artificial
  CRISPR gRNA sequence
agaaacgcccaaggacagga

SEQ ID NO: 520976 - DNA, 20 bp, Artificial
  CRISPR gRNA sequence
aggacttgtccagattcaag

SEQ ID NO: 520977 - DNA, 20 bp, Artificial
  CRISPR gRNA sequence
gtccagattcaagaagccca

SEQ ID NO: 520978 - DNA, 20 bp, Artificial
  CRISPR gRNA sequence
tccagattcaagaagcccaa

SEQ ID NO: 520979 - DNA, 20 bp, Artificial
  CRISPR gRNA sequence
aagaagcccaaggagacggc

SEQ ID NO: 520980 - DNA, 20 bp, Artificial
  CRISPR gRNA sequence
agcgtagggcgagcctgggt

SEQ ID NO: 520981 - DNA, 20 bp, Artificial
  CRISPR gRNA sequence
ggtgaggagattcagagcgt

SEQ ID NO: 520982 - DNA, 20 bp, Artificial
  CRISPR gRNA sequence
agagcgttagacggctgagc

SEQ ID NO: 520983 - DNA, 20 bp, Artificial
  CRISPR gRNA sequence
gacggctgagcgcagtgtgt

SEQ ID NO: 520984 - DNA, 20 bp, Artificial
  CRISPR gRNA sequence
agcgcagtgtgtgaacctgg

SEQ ID NO: 520985 - DNA, 20 bp, Artificial
  CRISPR gRNA sequence
ggttaggagatttggggcct

SEQ ID NO: 520986 - DNA, 20 bp, Artificial
  CRISPR gRNA sequence
ggagatttggggcctgagat

SEQ ID NO: 520987 - DNA, 20 bp, Artificial
  CRISPR gRNA sequence
ggggcctgagatggctgagt

SEQ ID NO: 520988 - DNA, 20 bp, Artificial
  CRISPR gRNA sequence
gggcctgagatggctgagtg

SEQ ID NO: 520989 - DNA, 20 bp, Artificial
  CRISPR gRNA sequence
agatggctgagtgcagggtg

SEQ ID NO: 520990 - DNA, 20 bp, Artificial
  CRISPR gRNA sequence
agtgcagggtgagcctgagt

SEQ ID NO: 520991 - DNA, 20 bp, Artificial
  CRISPR gRNA sequence
agtgaggagattctgagcct

SEQ ID NO: 520992 - DNA, 20 bp, Artificial
  CRISPR gRNA sequence
tgagcctgagacagctgagc

SEQ ID NO: 520993 - DNA, 20 bp, Artificial
  CRISPR gRNA sequence
agcctgagacagctgagcac

SEQ ID NO: 520994 - DNA, 20 bp, Artificial
  CRISPR gRNA sequence
agacagctgagcacagggtg

SEQ ID NO: 520995 - DNA, 20 bp, Artificial
  CRISPR gRNA sequence
agcacagggtgagcctgggt

SEQ ID NO: 520996 - DNA, 20 bp, Artificial
  CRISPR gRNA sequence
ggtgacaaaatccaccagga

SEQ ID NO: 520997 - DNA, 20 bp, Artificial
  CRISPR gRNA sequence
acgaagacatcattgggaca

SEQ ID NO: 520998 - DNA, 20 bp, Artificial
  CRISPR gRNA sequence
ggacaaccaataaaatatgc

SEQ ID NO: 520999 - DNA, 20 bp, Artificial
  CRISPR gRNA sequence
gatgataatgagataccaat

SEQ ID NO: 521000 - DNA, 20 bp, Artificial
  CRISPR gRNA sequence
atgataatgagataccaatg

SEQ ID NO: 521001 - DNA, 20 bp, Artificial
  CRISPR gRNA sequence
aatttcctgaatttgataca

SEQ ID NO: 521002 - DNA, 20 bp, Artificial
  CRISPR gRNA sequence
cctgaatttgatacatgaat

SEQ ID NO: 521003 - DNA, 20 bp, Artificial
  CRISPR gRNA sequence
ctgaatttgatacatgaatt

SEQ ID NO: 521004 - DNA, 20 bp, Artificial
  CRISPR gRNA sequence
aatttgatacatgaatttat

SEQ ID NO: 521005 - DNA, 20 bp, Artificial
  CRISPR gRNA sequence
gatacatgaatttatcaaat

SEQ ID NO: 521006 - DNA, 20 bp, Artificial
  CRISPR gRNA sequence
atacatgaatttatcaaata

SEQ ID NO: 521007 - DNA, 20 bp, Artificial
  CRISPR gRNA sequence
atcaaatatagatatacatg

SEQ ID NO: 521008 - DNA, 20 bp, Artificial
  CRISPR gRNA sequence
tcaaatatagatatacatgt

SEQ ID NO: 521009 - DNA, 20 bp, Artificial
  CRISPR gRNA sequence
acatcaaagtacatttcctc

SEQ ID NO: 521010 - DNA, 20 bp, Artificial
  CRISPR gRNA sequence
catcaaagtacatttcctct

SEQ ID NO: 521011 - DNA, 20 bp, Artificial
  CRISPR gRNA sequence
cctcttggccaccttgtccc

SEQ ID NO: 521012 - DNA, 20 bp, Artificial
  CRISPR gRNA sequence
ctcttggccaccttgtccct

SEQ ID NO: 521013 - DNA, 20 bp, Artificial
  CRISPR gRNA sequence
ttggccaccttgtccctgca

SEQ ID NO: 521014 - DNA, 20 bp, Artificial
  CRISPR gRNA sequence
ggccaccttgtccctgcaaa

SEQ ID NO: 521015 - DNA, 20 bp, Artificial
  CRISPR gRNA sequence
gccaccttgtccctgcaaag

SEQ ID NO: 521016 - DNA, 20 bp, Artificial
  CRISPR gRNA sequence
gtccctgcaaagcccctgga

SEQ ID NO: 521017 - DNA, 20 bp, Artificial
  CRISPR gRNA sequence
tccctgcaaagcccctggat

SEQ ID NO: 521018 - DNA, 20 bp, Artificial
  CRISPR gRNA sequence
caaagcccctggattctgat

SEQ ID NO: 521019 - DNA, 20 bp, Artificial
  CRISPR gRNA sequence
gattctgataagggctgtgt

SEQ ID NO: 521020 - DNA, 20 bp, Artificial
  CRISPR gRNA sequence
tgataagggctgtgtttggt

SEQ ID NO: 521021 - DNA, 20 bp, Artificial
  CRISPR gRNA sequence
ataagggctgtgtttggtgg

SEQ ID NO: 521022 - DNA, 20 bp, Artificial
  CRISPR gRNA sequence
tgtttggtgggtcccgtcac

SEQ ID NO: 521023 - DNA, 20 bp, Artificial
  CRISPR gRNA sequence
ggtgggtcccgtcactggcc

SEQ ID NO: 521024 - DNA, 20 bp, Artificial
  CRISPR gRNA sequence
gtgggtcccgtcactggccc

SEQ ID NO: 521025 - DNA, 20 bp, Artificial
  CRISPR gRNA sequence
gccccaaacctgctgactct

SEQ ID NO: 521026 - DNA, 20 bp, Artificial
  CRISPR gRNA sequence
ctgactctgcaggaaagcgt

SEQ ID NO: 521027 - DNA, 20 bp, Artificial
  CRISPR gRNA sequence
actctgcaggaaagcgtgct

SEQ ID NO: 521028 - DNA, 20 bp, Artificial
  CRISPR gRNA sequence
tgcaggaaagcgtgctggcg

SEQ ID NO: 521029 - DNA, 20 bp, Artificial
  CRISPR gRNA sequence
caggaaagcgtgctggcgat

SEQ ID NO: 521030 - DNA, 20 bp, Artificial
  CRISPR gRNA sequence
gcgatgcggggccagaagcg

SEQ ID NO: 521031 - DNA, 20 bp, Artificial
  CRISPR gRNA sequence
ctgcacttgcttacgtagtt

SEQ ID NO: 521032 - DNA, 20 bp, Artificial
  CRISPR gRNA sequence
tgcacttgcttacgtagttt

SEQ ID NO: 521033 - DNA, 20 bp, Artificial
  CRISPR gRNA sequence
cacttgcttacgtagttttg

SEQ ID NO: 521034 - DNA, 20 bp, Artificial
  CRISPR gRNA sequence
gcttacgtagttttgtaagt

SEQ ID NO: 521035 - DNA, 20 bp, Artificial
  CRISPR gRNA sequence
cttacgtagttttgtaagtg

SEQ ID NO: 521036 - DNA, 20 bp, Artificial
  CRISPR gRNA sequence
acgtagttttgtaagtgaaa

SEQ ID NO: 521037 - DNA, 20 bp, Artificial
  CRISPR gRNA sequence
cgtagttttgtaagtgaaaa

SEQ ID NO: 521038 - DNA, 20 bp, Artificial
  CRISPR gRNA sequence
tgtaagtgaaaaccttgttc

SEQ ID NO: 521039 - DNA, 20 bp, Artificial
  CRISPR gRNA sequence
gtaagtgaaaaccttgttct

SEQ ID NO: 521040 - DNA, 20 bp, Artificial
  CRISPR gRNA sequence
taagtgaaaaccttgttctt

SEQ ID NO: 521041 - DNA, 20 bp, Artificial
  CRISPR gRNA sequence
gttcttaagaaagacctccc

SEQ ID NO: 521042 - DNA, 20 bp, Artificial
  CRISPR gRNA sequence
ttcttaagaaagacctccct

SEQ ID NO: 521043 - DNA, 20 bp, Artificial
  CRISPR gRNA sequence
ttaagaaagacctcccttga

SEQ ID NO: 521044 - DNA, 20 bp, Artificial
  CRISPR gRNA sequence
aagaaagacctcccttgaag

SEQ ID NO: 521045 - DNA, 20 bp, Artificial
  CRISPR gRNA sequence
agaaagacctcccttgaagt

SEQ ID NO: 521046 - DNA, 20 bp, Artificial
  CRISPR gRNA sequence
ccttgaagtactaagagaca

SEQ ID NO: 521047 - DNA, 20 bp, Artificial
  CRISPR gRNA sequence
gaagtactaagagacaaagg

SEQ ID NO: 521048 - DNA, 20 bp, Artificial
  CRISPR gRNA sequence
aagtactaagagacaaaggg

SEQ ID NO: 521049 - DNA, 20 bp, Artificial
  CRISPR gRNA sequence
agagacaaagggctccatgt

SEQ ID NO: 521050 - DNA, 20 bp, Artificial
  CRISPR gRNA sequence
catgtctacaacctactcgg

SEQ ID NO: 521051 - DNA, 20 bp, Artificial
  CRISPR gRNA sequence
caacctactcggaaatggct

SEQ ID NO: 521052 - DNA, 20 bp, Artificial
  CRISPR gRNA sequence
ctcggaaatggctgagaaaa

SEQ ID NO: 521053 - DNA, 20 bp, Artificial
  CRISPR gRNA sequence
ggaaatggctgagaaaaaat

SEQ ID NO: 521054 - DNA, 20 bp, Artificial
  CRISPR gRNA sequence
agaaaaaatacaagtgtgtg

SEQ ID NO: 521055 - DNA, 20 bp, Artificial
  CRISPR gRNA sequence
tgtgtgtgtttccaaacaga

SEQ ID NO: 521056 - DNA, 20 bp, Artificial
  CRISPR gRNA sequence
tgtgtgtttccaaacagacc

SEQ ID NO: 521057 - DNA, 20 bp, Artificial
  CRISPR gRNA sequence
ccaaacagaccacacatcag

SEQ ID NO: 521058 - DNA, 20 bp, Artificial
  CRISPR gRNA sequence
caaacagaccacacatcaga

SEQ ID NO: 521059 - DNA, 20 bp, Artificial
  CRISPR gRNA sequence
aggggccccttgaggggagg

SEQ ID NO: 521060 - DNA, 20 bp, Artificial
  CRISPR gRNA sequence
gaggggagggtgaggccagg

SEQ ID NO: 521061 - DNA, 20 bp, Artificial
  CRISPR gRNA sequence
aggggagggtgaggccaggg

SEQ ID NO: 521062 - DNA, 20 bp, Artificial
  CRISPR gRNA sequence
gggaccccctcaaaaagaaa

SEQ ID NO: 521063 - DNA, 20 bp, Artificial
  CRISPR gRNA sequence
aaaaagaaaatggagttgtt

SEQ ID NO: 521064 - DNA, 20 bp, Artificial
  CRISPR gRNA sequence
ttggtcctctgggtgccact

SEQ ID NO: 521065 - DNA, 20 bp, Artificial
  CRISPR gRNA sequence
gtcctctgggtgccactggc

SEQ ID NO: 521066 - DNA, 20 bp, Artificial
  CRISPR gRNA sequence
tgggtgccactggcttcagg

SEQ ID NO: 521067 - DNA, 20 bp, Artificial
  CRISPR gRNA sequence
ggtgccactggcttcagggg

SEQ ID NO: 521068 - DNA, 20 bp, Artificial
  CRISPR gRNA sequence
gcttcaggggcaggaaaggg

SEQ ID NO: 521069 - DNA, 20 bp, Artificial
  CRISPR gRNA sequence
caggggcaggaaagggccct

SEQ ID NO: 521070 - DNA, 20 bp, Artificial
  CRISPR gRNA sequence
aggggcaggaaagggccctc

SEQ ID NO: 521071 - DNA, 20 bp, Artificial
  CRISPR gRNA sequence
acccaggagctgggcaggtg

SEQ ID NO: 521072 - DNA, 20 bp, Artificial
  CRISPR gRNA sequence
ggcaggtggggaggggtcca

SEQ ID NO: 521073 - DNA, 20 bp, Artificial
  CRISPR gRNA sequence
accagcttctggcaccaggt

SEQ ID NO: 521074 - DNA, 20 bp, Artificial
  CRISPR gRNA sequence
ccagcttctggcaccaggtg

SEQ ID NO: 521075 - DNA, 20 bp, Artificial
  CRISPR gRNA sequence
ctggcaccaggtgcagccgg

SEQ ID NO: 521076 - DNA, 20 bp, Artificial
  CRISPR gRNA sequence
tggcaccaggtgcagccggg

SEQ ID NO: 521077 - DNA, 20 bp, Artificial
  CRISPR gRNA sequence
gcaccaggtgcagccgggcc

SEQ ID NO: 521078 - DNA, 20 bp, Artificial
  CRISPR gRNA sequence
gatgcattcccggcagctgc

SEQ ID NO: 521079 - DNA, 20 bp, Artificial
  CRISPR gRNA sequence
ccggcagctgctgaccttga

SEQ ID NO: 521080 - DNA, 20 bp, Artificial
  CRISPR gRNA sequence
ctgaccttgaacttcgtgca

SEQ ID NO: 521081 - DNA, 20 bp, Artificial
  CRISPR gRNA sequence
accttgaacttcgtgcactc

SEQ ID NO: 521082 - DNA, 20 bp, Artificial
  CRISPR gRNA sequence
gaacttcgtgcactcctgag

SEQ ID NO: 521083 - DNA, 20 bp, Artificial
  CRISPR gRNA sequence
aacttcgtgcactcctgaga

SEQ ID NO: 521084 - DNA, 20 bp, Artificial
  CRISPR gRNA sequence
cgtgcactcctgagagagga

SEQ ID NO: 521085 - DNA, 20 bp, Artificial
  CRISPR gRNA sequence
gtgcactcctgagagaggac

SEQ ID NO: 521086 - DNA, 20 bp, Artificial
  CRISPR gRNA sequence
ctgagagaggactgagggac

SEQ ID NO: 521087 - DNA, 20 bp, Artificial
  CRISPR gRNA sequence
agagaggactgagggacgag

SEQ ID NO: 521088 - DNA, 20 bp, Artificial
  CRISPR gRNA sequence
agggacgaggccggctggtg

SEQ ID NO: 521089 - DNA, 20 bp, Artificial
  CRISPR gRNA sequence
gtgagtgggtgctctgggcc

SEQ ID NO: 521090 - DNA, 20 bp, Artificial
  CRISPR gRNA sequence
tgggccgccctgcccacacc

SEQ ID NO: 521091 - DNA, 20 bp, Artificial
  CRISPR gRNA sequence
ggccgccctgcccacaccca

SEQ ID NO: 521092 - DNA, 20 bp, Artificial
  CRISPR gRNA sequence
cccacacccaagggggagta

SEQ ID NO: 521093 - DNA, 20 bp, Artificial
  CRISPR gRNA sequence
caggaggagaccccgcattc

SEQ ID NO: 521094 - DNA, 20 bp, Artificial
  CRISPR gRNA sequence
gccaccacccccaggtgcaa

SEQ ID NO: 521095 - DNA, 20 bp, Artificial
  CRISPR gRNA sequence
gggaaacagcacagctacag

SEQ ID NO: 521096 - DNA, 20 bp, Artificial
  CRISPR gRNA sequence
cagcctcctggcacgtgcgg

SEQ ID NO: 521097 - DNA, 20 bp, Artificial
  CRISPR gRNA sequence
ctggcacgtgcggagacgag

SEQ ID NO: 521098 - DNA, 20 bp, Artificial
  CRISPR gRNA sequence
gcacgtgcggagacgaggcc

SEQ ID NO: 521099 - DNA, 20 bp, Artificial
  CRISPR gRNA sequence
agtccccgacctacccccag

SEQ ID NO: 521100 - DNA, 20 bp, Artificial
  CRISPR gRNA sequence
cccccagtggcaaggtcctt

SEQ ID NO: 521101 - DNA, 20 bp, Artificial
  CRISPR gRNA sequence
ccccagcctcccgggaactt

SEQ ID NO: 521102 - DNA, 20 bp, Artificial
  CRISPR gRNA sequence
cccagcctcccgggaacttc

SEQ ID NO: 521103 - DNA, 20 bp, Artificial
  CRISPR gRNA sequence
ccgggaacttctgtctatgg

SEQ ID NO: 521104 - DNA, 20 bp, Artificial
  CRISPR gRNA sequence
ctgtctatgggaaagtgagg

SEQ ID NO: 521105 - DNA, 20 bp, Artificial
  CRISPR gRNA sequence
tgtctatgggaaagtgaggg

SEQ ID NO: 521106 - DNA, 20 bp, Artificial
  CRISPR gRNA sequence
tctatgggaaagtgagggca

SEQ ID NO: 521107 - DNA, 20 bp, Artificial
  CRISPR gRNA sequence
tgggaaagtgagggcaggcc

SEQ ID NO: 521108 - DNA, 20 bp, Artificial
  CRISPR gRNA sequence
ttctccctgattggaatgtc

SEQ ID NO: 521109 - DNA, 20 bp, Artificial
  CRISPR gRNA sequence
tccctgattggaatgtcacg

SEQ ID NO: 521110 - DNA, 20 bp, Artificial
  CRISPR gRNA sequence
cctgattggaatgtcacgcg

SEQ ID NO: 521111 - DNA, 20 bp, Artificial
  CRISPR gRNA sequence
attggaatgtcacgcgtgga

SEQ ID NO: 521112 - DNA, 20 bp, Artificial
  CRISPR gRNA sequence
gaatgtcacgcgtggagtcc

SEQ ID NO: 521113 - DNA, 20 bp, Artificial
  CRISPR gRNA sequence
cgtggaacacagaactcacc

SEQ ID NO: 521114 - DNA, 20 bp, Artificial
  CRISPR gRNA sequence
accgcacccgagggagagca

SEQ ID NO: 521115 - DNA, 20 bp, Artificial
  CRISPR gRNA sequence
tggagggaaggggtcttggt

SEQ ID NO: 521116 - DNA, 20 bp, Artificial
  CRISPR gRNA sequence
ggtgacggtctcaggcccaa

SEQ ID NO: 521117 - DNA, 20 bp, Artificial
  CRISPR gRNA sequence
gtgacggtctcaggcccaac

SEQ ID NO: 521118 - DNA, 20 bp, Artificial
  CRISPR gRNA sequence
aggcccaacccctggggctg

SEQ ID NO: 521119 - DNA, 20 bp, Artificial
  CRISPR gRNA sequence
gggctgaccacccatgaagc

SEQ ID NO: 521120 - DNA, 20 bp, Artificial
  CRISPR gRNA sequence
accacccatgaagctcccct

SEQ ID NO: 521121 - DNA, 20 bp, Artificial
  CRISPR gRNA sequence
ccctccagctggcctgggac

SEQ ID NO: 521122 - DNA, 20 bp, Artificial
  CRISPR gRNA sequence
cagctggcctgggacaagga

SEQ ID NO: 521123 - DNA, 20 bp, Artificial
  CRISPR gRNA sequence
gcctgggacaaggagctggg

SEQ ID NO: 521124 - DNA, 20 bp, Artificial
  CRISPR gRNA sequence
ggacaaggagctggggccct

SEQ ID NO: 521125 - DNA, 20 bp, Artificial
  CRISPR gRNA sequence
gggccctgtccctgctgcag

SEQ ID NO: 521126 - DNA, 20 bp, Artificial
  CRISPR gRNA sequence
tccctgctgcagggggtggg

SEQ ID NO: 521127 - DNA, 20 bp, Artificial
  CRISPR gRNA sequence
ctgcagggggtgggttaggg

SEQ ID NO: 521128 - DNA, 20 bp, Artificial
  CRISPR gRNA sequence
cagggggtgggttagggtca

SEQ ID NO: 521129 - DNA, 20 bp, Artificial
  CRISPR gRNA sequence
gggtcaggccagcacagctg

SEQ ID NO: 521130 - DNA, 20 bp, Artificial
  CRISPR gRNA sequence
cactgggcccagctgccaac

SEQ ID NO: 521131 - DNA, 20 bp, Artificial
  CRISPR gRNA sequence
ggcccagctgccaacagcca

SEQ ID NO: 521132 - DNA, 20 bp, Artificial
  CRISPR gRNA sequence
ccaacagccagggagggagg

SEQ ID NO: 521133 - DNA, 20 bp, Artificial
  CRISPR gRNA sequence
agcagtgcgggcagcacacc

SEQ ID NO: 521134 - DNA, 20 bp, Artificial
  CRISPR gRNA sequence
ctcagccaggcacccaggac

SEQ ID NO: 521135 - DNA, 20 bp, Artificial
  CRISPR gRNA sequence
agccaggcacccaggacagc

SEQ ID NO: 521136 - DNA, 20 bp, Artificial
  CRISPR gRNA sequence
cagcgggcccctgcagaggc

SEQ ID NO: 521137 - DNA, 20 bp, Artificial
  CRISPR gRNA sequence
cagaggcacacaacacaggc

SEQ ID NO: 521138 - DNA, 20 bp, Artificial
  CRISPR gRNA sequence
actgcatgtacacaccacgt

SEQ ID NO: 521139 - DNA, 20 bp, Artificial
  CRISPR gRNA sequence
catgtacacaccacgtgcat

SEQ ID NO: 521140 - DNA, 20 bp, Artificial
  CRISPR gRNA sequence
acccacaccatactccccgc

SEQ ID NO: 521141 - DNA, 20 bp, Artificial
  CRISPR gRNA sequence
cccacaccatactccccgca

SEQ ID NO: 521142 - DNA, 20 bp, Artificial
  CRISPR gRNA sequence
cccgcaagacactacacacc

SEQ ID NO: 521143 - DNA, 20 bp, Artificial
  CRISPR gRNA sequence
cacaccacacacaaatatac

SEQ ID NO: 521144 - DNA, 20 bp, Artificial
  CRISPR gRNA sequence
tgccccagtgtgccccaggt

SEQ ID NO: 521145 - DNA, 20 bp, Artificial
  CRISPR gRNA sequence
ccccagtgtgccccaggtcc

SEQ ID NO: 521146 - DNA, 20 bp, Artificial
  CRISPR gRNA sequence
cgtgagcagagcctgtgctt

SEQ ID NO: 521147 - DNA, 20 bp, Artificial
  CRISPR gRNA sequence
tgcttggaggagagctgggc

SEQ ID NO: 521148 - DNA, 20 bp, Artificial
  CRISPR gRNA sequence
ggaggagagctgggcttggc

SEQ ID NO: 521149 - DNA, 20 bp, Artificial
  CRISPR gRNA sequence
gaggagagctgggcttggcc

SEQ ID NO: 521150 - DNA, 20 bp, Artificial
  CRISPR gRNA sequence
ggcttggccctgtctctctg

SEQ ID NO: 521151 - DNA, 20 bp, Artificial
  CRISPR gRNA sequence
ggccctgtctctctgtggca

SEQ ID NO: 521152 - DNA, 20 bp, Artificial
  CRISPR gRNA sequence
gccctgtctctctgtggcag

SEQ ID NO: 521153 - DNA, 20 bp, Artificial
  CRISPR gRNA sequence
tctctctgtggcagaaacat

SEQ ID NO: 521154 - DNA, 20 bp, Artificial
  CRISPR gRNA sequence
tctgtggcagaaacatagcc

SEQ ID NO: 521155 - DNA, 20 bp, Artificial
  CRISPR gRNA sequence
tgtggcagaaacatagccag

SEQ ID NO: 521156 - DNA, 20 bp, Artificial
  CRISPR gRNA sequence
tggcagaaacatagccagga

SEQ ID NO: 521157 - DNA, 20 bp, Artificial
  CRISPR gRNA sequence
gctggatgcccgcgggtgcc

SEQ ID NO: 521158 - DNA, 20 bp, Artificial
  CRISPR gRNA sequence
gatgcccgcgggtgccaggc

SEQ ID NO: 521159 - DNA, 20 bp, Artificial
  CRISPR gRNA sequence
tgtgccaggaagagaaagct

SEQ ID NO: 521160 - DNA, 20 bp, Artificial
  CRISPR gRNA sequence
gcttgatgcccgcgggtgcc

SEQ ID NO: 521161 - DNA, 20 bp, Artificial
  CRISPR gRNA sequence
gatgcccgcgggtgccaagc

SEQ ID NO: 521162 - DNA, 20 bp, Artificial
  CRISPR gRNA sequence
atgcccgcgggtgccaagct

SEQ ID NO: 521163 - DNA, 20 bp, Artificial
  CRISPR gRNA sequence
tgtgctaggcctgcccagga

SEQ ID NO: 521164 - DNA, 20 bp, Artificial
  CRISPR gRNA sequence
ggcctgcccaggagccctgc

SEQ ID NO: 521165 - DNA, 20 bp, Artificial
  CRISPR gRNA sequence
cccaggagccctgcagtccc

SEQ ID NO: 521166 - DNA, 20 bp, Artificial
  CRISPR gRNA sequence
cagtccctgccaggtgggaa

SEQ ID NO: 521167 - DNA, 20 bp, Artificial
  CRISPR gRNA sequence
ccaggtgggaaaaaaagtca

SEQ ID NO: 521168 - DNA, 20 bp, Artificial
  CRISPR gRNA sequence
acttgcccaagccaccagtt

SEQ ID NO: 521169 - DNA, 20 bp, Artificial
  CRISPR gRNA sequence
gcccaagccaccagttgccg

SEQ ID NO: 521170 - DNA, 20 bp, Artificial
  CRISPR gRNA sequence
cccaagccaccagttgccgg

SEQ ID NO: 521171 - DNA, 20 bp, Artificial
  CRISPR gRNA sequence
ccggggtcctgcccttttgt

SEQ ID NO: 521172 - DNA, 20 bp, Artificial
  CRISPR gRNA sequence
cccttttgtttccagataca

SEQ ID NO: 521173 - DNA, 20 bp, Artificial
  CRISPR gRNA sequence
ttgtttccagatacacaccc

SEQ ID NO: 521174 - DNA, 20 bp, Artificial
  CRISPR gRNA sequence
tgtttccagatacacaccca

SEQ ID NO: 521175 - DNA, 20 bp, Artificial
  CRISPR gRNA sequence
gtttccagatacacacccac

SEQ ID NO: 521176 - DNA, 20 bp, Artificial
  CRISPR gRNA sequence
tttccagatacacacccacc

SEQ ID NO: 521177 - DNA, 20 bp, Artificial
  CRISPR gRNA sequence
ccagatacacacccaccccg

SEQ ID NO: 521178 - DNA, 20 bp, Artificial
  CRISPR gRNA sequence
cagatacacacccaccccgt

SEQ ID NO: 521179 - DNA, 20 bp, Artificial
  CRISPR gRNA sequence
aacccacgcatccacagcca

SEQ ID NO: 521180 - DNA, 20 bp, Artificial
  CRISPR gRNA sequence
acccacgcatccacagccag

SEQ ID NO: 521181 - DNA, 20 bp, Artificial
  CRISPR gRNA sequence
agtggtcactcacaggccct

SEQ ID NO: 521182 - DNA, 20 bp, Artificial
  CRISPR gRNA sequence
acaggccctcggccccagag

SEQ ID NO: 521183 - DNA, 20 bp, Artificial
  CRISPR gRNA sequence
ggccccagaggcaaaatgac

SEQ ID NO: 521184 - DNA, 20 bp, Artificial
  CRISPR gRNA sequence
agcctggtgctggaggccgg

SEQ ID NO: 521185 - DNA, 20 bp, Artificial
  CRISPR gRNA sequence
gtgctggaggccggcagcac

SEQ ID NO: 521186 - DNA, 20 bp, Artificial
  CRISPR gRNA sequence
gaggccggcagcacctccta

SEQ ID NO: 521187 - DNA, 20 bp, Artificial
  CRISPR gRNA sequence
ctagcgggcagcagggccgt

SEQ ID NO: 521188 - DNA, 20 bp, Artificial
  CRISPR gRNA sequence
gcgggcagcagggccgttcc

SEQ ID NO: 521189 - DNA, 20 bp, Artificial
  CRISPR gRNA sequence
cacccctgggttcccttccc

SEQ ID NO: 521190 - DNA, 20 bp, Artificial
  CRISPR gRNA sequence
ggttcccttccctccatccg

SEQ ID NO: 521191 - DNA, 20 bp, Artificial
  CRISPR gRNA sequence
ccttccctccatccgggagg

SEQ ID NO: 521192 - DNA, 20 bp, Artificial
  CRISPR gRNA sequence
ccctccatccgggaggtgcc

SEQ ID NO: 521193 - DNA, 20 bp, Artificial
  CRISPR gRNA sequence
cctccatccgggaggtgccc

SEQ ID NO: 521194 - DNA, 20 bp, Artificial
  CRISPR gRNA sequence
catccgggaggtgcccaaac

SEQ ID NO: 521195 - DNA, 20 bp, Artificial
  CRISPR gRNA sequence
ggtcggctccttggggggtc

SEQ ID NO: 521196 - DNA, 20 bp, Artificial
  CRISPR gRNA sequence
cttggggggtcttagggctt

SEQ ID NO: 521197 - DNA, 20 bp, Artificial
  CRISPR gRNA sequence
ggggggtcttagggcttcct

SEQ ID NO: 521198 - DNA, 20 bp, Artificial
  CRISPR gRNA sequence
gggggtcttagggcttccta

SEQ ID NO: 521199 - DNA, 20 bp, Artificial
  CRISPR gRNA sequence
agggcttcctaggtggggtg

SEQ ID NO: 521200 - DNA, 20 bp, Artificial
  CRISPR gRNA sequence
gggcttcctaggtggggtgg

SEQ ID NO: 521201 - DNA, 20 bp, Artificial
  CRISPR gRNA sequence
cctaggtggggtgggcccct

SEQ ID NO: 521202 - DNA, 20 bp, Artificial
  CRISPR gRNA sequence
ctaggtggggtgggcccctg

SEQ ID NO: 521203 - DNA, 20 bp, Artificial
  CRISPR gRNA sequence
ggtggggtgggcccctgggt

SEQ ID NO: 521204 - DNA, 20 bp, Artificial
  CRISPR gRNA sequence
ggtctgacctcccaggacct

SEQ ID NO: 521205 - DNA, 20 bp, Artificial
  CRISPR gRNA sequence
acctcccaggacctgagaac

SEQ ID NO: 521206 - DNA, 20 bp, Artificial
  CRISPR gRNA sequence
ccaggacctgagaacattat

SEQ ID NO: 521207 - DNA, 20 bp, Artificial
  CRISPR gRNA sequence
agaacattatagctggctgg

SEQ ID NO: 521208 - DNA, 20 bp, Artificial
  CRISPR gRNA sequence
tagctggctgggaccctttt

SEQ ID NO: 521209 - DNA, 20 bp, Artificial
  CRISPR gRNA sequence
gctgggacccttttatctgg

SEQ ID NO: 521210 - DNA, 20 bp, Artificial
  CRISPR gRNA sequence
ggacccttttatctggcacc

SEQ ID NO: 521211 - DNA, 20 bp, Artificial
  CRISPR gRNA sequence
ttatctggcaccaagaaggt

SEQ ID NO: 521212 - DNA, 20 bp, Artificial
  CRISPR gRNA sequence
tatctggcaccaagaaggtg

SEQ ID NO: 521213 - DNA, 20 bp, Artificial
  CRISPR gRNA sequence
atctggcaccaagaaggtgg

SEQ ID NO: 521214 - DNA, 20 bp, Artificial
  CRISPR gRNA sequence
tctggcaccaagaaggtgga

SEQ ID NO: 521215 - DNA, 20 bp, Artificial
  CRISPR gRNA sequence
gcaccaagaaggtggagagg

SEQ ID NO: 521216 - DNA, 20 bp, Artificial
  CRISPR gRNA sequence
agaaggggtacccaggagcc

SEQ ID NO: 521217 - DNA, 20 bp, Artificial
  CRISPR gRNA sequence
cctgtcatggtgggcaggaa

SEQ ID NO: 521218 - DNA, 20 bp, Artificial
  CRISPR gRNA sequence
ctgtcatggtgggcaggaag

SEQ ID NO: 521219 - DNA, 20 bp, Artificial
  CRISPR gRNA sequence
tcatggtgggcaggaagaca

SEQ ID NO: 521220 - DNA, 20 bp, Artificial
  CRISPR gRNA sequence
ccgttaccctggggctgttg

SEQ ID NO: 521221 - DNA, 20 bp, Artificial
  CRISPR gRNA sequence
cgttaccctggggctgttgt

SEQ ID NO: 521222 - DNA, 20 bp, Artificial
  CRISPR gRNA sequence
ccctggggctgttgtcagaa

SEQ ID NO: 521223 - DNA, 20 bp, Artificial
  CRISPR gRNA sequence
gggctgttgtcagaagcaaa

SEQ ID NO: 521224 - DNA, 20 bp, Artificial
  CRISPR gRNA sequence
ttgtcagaagcaaagatcaa

SEQ ID NO: 521225 - DNA, 20 bp, Artificial
  CRISPR gRNA sequence
tcagaagcaaagatcaacac

SEQ ID NO: 521226 - DNA, 20 bp, Artificial
  CRISPR gRNA sequence
ctccagcaaatgccagttcc

SEQ ID NO: 521227 - DNA, 20 bp, Artificial
  CRISPR gRNA sequence
cagcaaatgccagttcctgt

SEQ ID NO: 521228 - DNA, 20 bp, Artificial
  CRISPR gRNA sequence
ctgtcacggcctcccaggct

SEQ ID NO: 521229 - DNA, 20 bp, Artificial
  CRISPR gRNA sequence
tcacggcctcccaggctgct

SEQ ID NO: 521230 - DNA, 20 bp, Artificial
  CRISPR gRNA sequence
ccaggctgctggggcgttcc

SEQ ID NO: 521231 - DNA, 20 bp, Artificial
  CRISPR gRNA sequence
ctggggcgttcctgccccac

SEQ ID NO: 521232 - DNA, 20 bp, Artificial
  CRISPR gRNA sequence
gggcgttcctgccccacacc

SEQ ID NO: 521233 - DNA, 20 bp, Artificial
  CRISPR gRNA sequence
ctgccccacacccttccctc

SEQ ID NO: 521234 - DNA, 20 bp, Artificial
  CRISPR gRNA sequence
ccccacacccttccctcggg

SEQ ID NO: 521235 - DNA, 20 bp, Artificial
  CRISPR gRNA sequence
ccctcgggtggtgctggcag

SEQ ID NO: 521236 - DNA, 20 bp, Artificial
  CRISPR gRNA sequence
cctcgggtggtgctggcagg

SEQ ID NO: 521237 - DNA, 20 bp, Artificial
  CRISPR gRNA sequence
gggtggtgctggcagggcca

SEQ ID NO: 521238 - DNA, 20 bp, Artificial
  CRISPR gRNA sequence
gcagggccacccaaggttca

SEQ ID NO: 521239 - DNA, 20 bp, Artificial
  CRISPR gRNA sequence
agtgggcagacccaagccag

SEQ ID NO: 521240 - DNA, 20 bp, Artificial
  CRISPR gRNA sequence
gggcctgccggctttgaaga

SEQ ID NO: 521241 - DNA, 20 bp, Artificial
  CRISPR gRNA sequence
ccggctttgaagacagcgct

SEQ ID NO: 521242 - DNA, 20 bp, Artificial
  CRISPR gRNA sequence
tgaagacagcgctgggtgct

SEQ ID NO: 521243 - DNA, 20 bp, Artificial
  CRISPR gRNA sequence
gaagacagcgctgggtgctg

SEQ ID NO: 521244 - DNA, 20 bp, Artificial
  CRISPR gRNA sequence
aagacagcgctgggtgctgt

SEQ ID NO: 521245 - DNA, 20 bp, Artificial
  CRISPR gRNA sequence
ggtgctgtgctgtggcccgg

SEQ ID NO: 521246 - DNA, 20 bp, Artificial
  CRISPR gRNA sequence
tgctgtggcccgggaggctc

SEQ ID NO: 521247 - DNA, 20 bp, Artificial
  CRISPR gRNA sequence
tggcccgggaggctcgggtg

SEQ ID NO: 521248 - DNA, 20 bp, Artificial
  CRISPR gRNA sequence
gggtgccctcagccacaggc

SEQ ID NO: 521249 - DNA, 20 bp, Artificial
  CRISPR gRNA sequence
agccacaggccctggctccc

SEQ ID NO: 521250 - DNA, 20 bp, Artificial
  CRISPR gRNA sequence
gctcccctccatcccccgaa

SEQ ID NO: 521251 - DNA, 20 bp, Artificial
  CRISPR gRNA sequence
ccctccatcccccgaaagcc

SEQ ID NO: 521252 - DNA, 20 bp, Artificial
  CRISPR gRNA sequence
catcccccgaaagccctgca

SEQ ID NO: 521253 - DNA, 20 bp, Artificial
  CRISPR gRNA sequence
cacctgtgctgggggctctg

SEQ ID NO: 521254 - DNA, 20 bp, Artificial
  CRISPR gRNA sequence
tgctgggggctctgaggcca

SEQ ID NO: 521255 - DNA, 20 bp, Artificial
  CRISPR gRNA sequence
ggggctctgaggccaacgga

SEQ ID NO: 521256 - DNA, 20 bp, Artificial
  CRISPR gRNA sequence
tgaggccaacggaacaccca

SEQ ID NO: 521257 - DNA, 20 bp, Artificial
  CRISPR gRNA sequence
aggccaacggaacacccacc

SEQ ID NO: 521258 - DNA, 20 bp, Artificial
  CRISPR gRNA sequence
aggatcccacagcttagacg

SEQ ID NO: 521259 - DNA, 20 bp, Artificial
  CRISPR gRNA sequence
agacgccccaacaagcccca

SEQ ID NO: 521260 - DNA, 20 bp, Artificial
  CRISPR gRNA sequence
gacgccccaacaagccccaa

SEQ ID NO: 521261 - DNA, 20 bp, Artificial
  CRISPR gRNA sequence
ttgttttggcagtgacctca

SEQ ID NO: 521262 - DNA, 20 bp, Artificial
  CRISPR gRNA sequence
ttttggcagtgacctcattc

SEQ ID NO: 521263 - DNA, 20 bp, Artificial
  CRISPR gRNA sequence
tggcagtgacctcattccct

SEQ ID NO: 521264 - DNA, 20 bp, Artificial
  CRISPR gRNA sequence
ggcagtgacctcattccctg

SEQ ID NO: 521265 - DNA, 20 bp, Artificial
  CRISPR gRNA sequence
gcagtgacctcattccctgg

SEQ ID NO: 521266 - DNA, 20 bp, Artificial
  CRISPR gRNA sequence
attccctggttcccagcaaa

SEQ ID NO: 521267 - DNA, 20 bp, Artificial
  CRISPR gRNA sequence
cctggttcccagcaaaatta

SEQ ID NO: 521268 - DNA, 20 bp, Artificial
  CRISPR gRNA sequence
gttcccagcaaaattataat

SEQ ID NO: 521269 - DNA, 20 bp, Artificial
  CRISPR gRNA sequence
ccagcaaaattataatcaga

SEQ ID NO: 521270 - DNA, 20 bp, Artificial
  CRISPR gRNA sequence
taatcagaatacaaaaatgt

SEQ ID NO: 521271 - DNA, 20 bp, Artificial
  CRISPR gRNA sequence
gatccttcccgtcctggggt

SEQ ID NO: 521272 - DNA, 20 bp, Artificial
  CRISPR gRNA sequence
atccttcccgtcctggggtc

SEQ ID NO: 521273 - DNA, 20 bp, Artificial
  CRISPR gRNA sequence
cccgtcctggggtcaaaaac

SEQ ID NO: 521274 - DNA, 20 bp, Artificial
  CRISPR gRNA sequence
ccgtcctggggtcaaaaaca

SEQ ID NO: 521275 - DNA, 20 bp, Artificial
  CRISPR gRNA sequence
gggtcaaaaacagaacctgc

SEQ ID NO: 521276 - DNA, 20 bp, Artificial
  CRISPR gRNA sequence
caccctgctgtaacttcctg

SEQ ID NO: 521277 - DNA, 20 bp, Artificial
  CRISPR gRNA sequence
ctgtaacttcctggaggagg

SEQ ID NO: 521278 - DNA, 20 bp, Artificial
  CRISPR gRNA sequence
taacttcctggaggaggtgg

SEQ ID NO: 521279 - DNA, 20 bp, Artificial
  CRISPR gRNA sequence
cctggaggaggtggttttgg

SEQ ID NO: 521280 - DNA, 20 bp, Artificial
  CRISPR gRNA sequence
ctggaggaggtggttttggt

SEQ ID NO: 521281 - DNA, 20 bp, Artificial
  CRISPR gRNA sequence
gaggaggtggttttggttca

SEQ ID NO: 521282 - DNA, 20 bp, Artificial
  CRISPR gRNA sequence
tggttcacattgggcccacc

SEQ ID NO: 521283 - DNA, 20 bp, Artificial
  CRISPR gRNA sequence
ggttcacattgggcccaccc

SEQ ID NO: 521284 - DNA, 20 bp, Artificial
  CRISPR gRNA sequence
gttcacattgggcccaccct

SEQ ID NO: 521285 - DNA, 20 bp, Artificial
  CRISPR gRNA sequence
acattgggcccaccctgtgt

SEQ ID NO: 521286 - DNA, 20 bp, Artificial
  CRISPR gRNA sequence
ggcccaccctgtgtctgaaa

SEQ ID NO: 521287 - DNA, 20 bp, Artificial
  CRISPR gRNA sequence
tgtctgaaagcccccatatc

SEQ ID NO: 521288 - DNA, 20 bp, Artificial
  CRISPR gRNA sequence
aaagcccccatatctctgat

SEQ ID NO: 521289 - DNA, 20 bp, Artificial
  CRISPR gRNA sequence
tgatcgttgggggttgtggt

SEQ ID NO: 521290 - DNA, 20 bp, Artificial
  CRISPR gRNA sequence
atcgttgggggttgtggttc

SEQ ID NO: 521291 - DNA, 20 bp, Artificial
  CRISPR gRNA sequence
ggggttgtggttcaggccga

SEQ ID NO: 521292 - DNA, 20 bp, Artificial
  CRISPR gRNA sequence
tggttcaggccgaggccagt

SEQ ID NO: 521293 - DNA, 20 bp, Artificial
  CRISPR gRNA sequence
aggccgaggccagttccagc

SEQ ID NO: 521294 - DNA, 20 bp, Artificial
  CRISPR gRNA sequence
cagctctccatctgggcccc

SEQ ID NO: 521295 - DNA, 20 bp, Artificial
  CRISPR gRNA sequence
tccatctgggccccctcaaa

SEQ ID NO: 521296 - DNA, 20 bp, Artificial
  CRISPR gRNA sequence
catctgggccccctcaaagt

SEQ ID NO: 521297 - DNA, 20 bp, Artificial
  CRISPR gRNA sequence
ggccccctcaaagtcctgcg

SEQ ID NO: 521298 - DNA, 20 bp, Artificial
  CRISPR gRNA sequence
aaagtcctgcgcctggactg

SEQ ID NO: 521299 - DNA, 20 bp, Artificial
  CRISPR gRNA sequence
cgcctggactgacctcggtg

SEQ ID NO: 521300 - DNA, 20 bp, Artificial
  CRISPR gRNA sequence
gactgacctcggtgccacga

SEQ ID NO: 521301 - DNA, 20 bp, Artificial
  CRISPR gRNA sequence
acctcggtgccacgagtgcc

SEQ ID NO: 521302 - DNA, 20 bp, Artificial
  CRISPR gRNA sequence
ggtgccacgagtgcccacca

SEQ ID NO: 521303 - DNA, 20 bp, Artificial
  CRISPR gRNA sequence
agctgatcggaggccctgtg

SEQ ID NO: 521304 - DNA, 20 bp, Artificial
  CRISPR gRNA sequence
atcggaggccctgtgcgtgc

SEQ ID NO: 521305 - DNA, 20 bp, Artificial
  CRISPR gRNA sequence
tgcgtgctggagctacccca

SEQ ID NO: 521306 - DNA, 20 bp, Artificial
  CRISPR gRNA sequence
gagctaccccagggtgcagg

SEQ ID NO: 521307 - DNA, 20 bp, Artificial
  CRISPR gRNA sequence
ccccagggtgcagggtccag

SEQ ID NO: 521308 - DNA, 20 bp, Artificial
  CRISPR gRNA sequence
caggactcccccagggtgca

SEQ ID NO: 521309 - DNA, 20 bp, Artificial
  CRISPR gRNA sequence
aggactcccccagggtgcag

SEQ ID NO: 521310 - DNA, 20 bp, Artificial
  CRISPR gRNA sequence
ccccagggtgcagggtccag

SEQ ID NO: 521311 - DNA, 20 bp, Artificial
  CRISPR gRNA sequence
caggactcccccagggtgca

SEQ ID NO: 521312 - DNA, 20 bp, Artificial
  CRISPR gRNA sequence
aggactcccccagggtgcag

SEQ ID NO: 521313 - DNA, 20 bp, Artificial
  CRISPR gRNA sequence
ccccagggtgcagggtccag

SEQ ID NO: 521314 - DNA, 20 bp, Artificial
  CRISPR gRNA sequence
caggactcccccagggtgca

SEQ ID NO: 521315 - DNA, 20 bp, Artificial
  CRISPR gRNA sequence
aggactcccccagggtgcag

SEQ ID NO: 521316 - DNA, 20 bp, Artificial
  CRISPR gRNA sequence
ccccagggtgcagggtccag

SEQ ID NO: 521317 - DNA, 20 bp, Artificial
  CRISPR gRNA sequence
caggactcccccagggtgca

SEQ ID NO: 521318 - DNA, 20 bp, Artificial
  CRISPR gRNA sequence
aggactcccccagggtgcag

SEQ ID NO: 521319 - DNA, 20 bp, Artificial
  CRISPR gRNA sequence
ccccagggtgcagggtccag

SEQ ID NO: 521320 - DNA, 20 bp, Artificial
  CRISPR gRNA sequence
caggactcccccagggtgca

SEQ ID NO: 521321 - DNA, 20 bp, Artificial
  CRISPR gRNA sequence
aggactcccccagggtgcag

SEQ ID NO: 521322 - DNA, 20 bp, Artificial
  CRISPR gRNA sequence
ccccagggtgcagggtccag

SEQ ID NO: 521323 - DNA, 20 bp, Artificial
  CRISPR gRNA sequence
caggactcccccagggtgca

SEQ ID NO: 521324 - DNA, 20 bp, Artificial
  CRISPR gRNA sequence
aggactcccccagggtgcag

SEQ ID NO: 521325 - DNA, 20 bp, Artificial
  CRISPR gRNA sequence
ccccagggtgcagggtccag

SEQ ID NO: 521326 - DNA, 20 bp, Artificial
  CRISPR gRNA sequence
caggactcccccagggtgca

SEQ ID NO: 521327 - DNA, 20 bp, Artificial
  CRISPR gRNA sequence
aggactcccccagggtgcag

SEQ ID NO: 521328 - DNA, 20 bp, Artificial
  CRISPR gRNA sequence
ccccagggtgcagggtccag

SEQ ID NO: 521329 - DNA, 20 bp, Artificial
  CRISPR gRNA sequence
caggactcccccagggtgca

SEQ ID NO: 521330 - DNA, 20 bp, Artificial
  CRISPR gRNA sequence
aggactcccccagggtgcag

SEQ ID NO: 521331 - DNA, 20 bp, Artificial
  CRISPR gRNA sequence
ccccagggtgcagggtccag

SEQ ID NO: 521332 - DNA, 20 bp, Artificial
  CRISPR gRNA sequence
caggactcccccagggtgca

SEQ ID NO: 521333 - DNA, 20 bp, Artificial
  CRISPR gRNA sequence
aggactcccccagggtgcag

SEQ ID NO: 521334 - DNA, 20 bp, Artificial
  CRISPR gRNA sequence
ccccagggtgcagggtccag

SEQ ID NO: 521335 - DNA, 20 bp, Artificial
  CRISPR gRNA sequence
caggactcccccagggtgca

SEQ ID NO: 521336 - DNA, 20 bp, Artificial
  CRISPR gRNA sequence
aggactcccccagggtgcag

SEQ ID NO: 521337 - DNA, 20 bp, Artificial
  CRISPR gRNA sequence
ccccagggtgcagggtccag

SEQ ID NO: 521338 - DNA, 20 bp, Artificial
  CRISPR gRNA sequence
caggactcccccaggtcgca

SEQ ID NO: 521339 - DNA, 20 bp, Artificial
  CRISPR gRNA sequence
aggactcccccaggtcgcag

SEQ ID NO: 521340 - DNA, 20 bp, Artificial
  CRISPR gRNA sequence
ccccaggtcgcagctgcgcc

SEQ ID NO: 521341 - DNA, 20 bp, Artificial
  CRISPR gRNA sequence
cgccaagtggggagggggtg

SEQ ID NO: 521342 - DNA, 20 bp, Artificial
  CRISPR gRNA sequence
ccctggcagccccagccagg

SEQ ID NO: 521343 - DNA, 20 bp, Artificial
  CRISPR gRNA sequence
gcagccccagccaggctggt

SEQ ID NO: 521344 - DNA, 20 bp, Artificial
  CRISPR gRNA sequence
gtaaggactcacaccccagc

SEQ ID NO: 521345 - DNA, 20 bp, Artificial
  CRISPR gRNA sequence
acaccccagctccacgctct

SEQ ID NO: 521346 - DNA, 20 bp, Artificial
  CRISPR gRNA sequence
cacgctctccctggggccgc

SEQ ID NO: 521347 - DNA, 20 bp, Artificial
  CRISPR gRNA sequence
tccctggggccgcagacatg

SEQ ID NO: 521348 - DNA, 20 bp, Artificial
  CRISPR gRNA sequence
cctggggccgcagacatgag

SEQ ID NO: 521349 - DNA, 20 bp, Artificial
  CRISPR gRNA sequence
gggccgcagacatgaggtct

SEQ ID NO: 521350 - DNA, 20 bp, Artificial
  CRISPR gRNA sequence
cgcccctaacacagtcgtga

SEQ ID NO: 521351 - DNA, 20 bp, Artificial
  CRISPR gRNA sequence
acacagtcgtgaccagtggc

SEQ ID NO: 521352 - DNA, 20 bp, Artificial
  CRISPR gRNA sequence
cataccctcaaatggggaaa

SEQ ID NO: 521353 - DNA, 20 bp, Artificial
  CRISPR gRNA sequence
ataccctcaaatggggaaac

SEQ ID NO: 521354 - DNA, 20 bp, Artificial
  CRISPR gRNA sequence
aaatggggaaactgagggcc

SEQ ID NO: 521355 - DNA, 20 bp, Artificial
  CRISPR gRNA sequence
agggccccagcagcagcaag

SEQ ID NO: 521356 - DNA, 20 bp, Artificial
  CRISPR gRNA sequence
gtgcccagttaccccgggca

SEQ ID NO: 521357 - DNA, 20 bp, Artificial
  CRISPR gRNA sequence
ccccgggcactcccacctgc

SEQ ID NO: 521358 - DNA, 20 bp, Artificial
  CRISPR gRNA sequence
ccacctgcccacagggagag

SEQ ID NO: 521359 - DNA, 20 bp, Artificial
  CRISPR gRNA sequence
cccacagggagagggggtgc

SEQ ID NO: 521360 - DNA, 20 bp, Artificial
  CRISPR gRNA sequence
gattccagcaggattggctc

SEQ ID NO: 521361 - DNA, 20 bp, Artificial
  CRISPR gRNA sequence
attccagcaggattggctca

SEQ ID NO: 521362 - DNA, 20 bp, Artificial
  CRISPR gRNA sequence
cagcaggattggctcagaga

SEQ ID NO: 521363 - DNA, 20 bp, Artificial
  CRISPR gRNA sequence
gctcagagaccacggcaccc

SEQ ID NO: 521364 - DNA, 20 bp, Artificial
  CRISPR gRNA sequence
agagaccacggcaccccaac

SEQ ID NO: 521365 - DNA, 20 bp, Artificial
  CRISPR gRNA sequence
gaccacaggaagggggctgg

SEQ ID NO: 521366 - DNA, 20 bp, Artificial
  CRISPR gRNA sequence
accacaggaagggggctggt

SEQ ID NO: 521367 - DNA, 20 bp, Artificial
  CRISPR gRNA sequence
gtggggagccaccttctccc

SEQ ID NO: 521368 - DNA, 20 bp, Artificial
  CRISPR gRNA sequence
ctccccactgttgctcctcc

SEQ ID NO: 521369 - DNA, 20 bp, Artificial
  CRISPR gRNA sequence
tccccactgttgctcctcca

SEQ ID NO: 521370 - DNA, 20 bp, Artificial
  CRISPR gRNA sequence
cccactgttgctcctccatg

SEQ ID NO: 521371 - DNA, 20 bp, Artificial
  CRISPR gRNA sequence
ttgctcctccatgagcagcc

SEQ ID NO: 521372 - DNA, 20 bp, Artificial
  CRISPR gRNA sequence
ctcctccatgagcagccctg

SEQ ID NO: 521373 - DNA, 20 bp, Artificial
  CRISPR gRNA sequence
ctccatgagcagccctgggg

SEQ ID NO: 521374 - DNA, 20 bp, Artificial
  CRISPR gRNA sequence
catgagcagccctggggggc

SEQ ID NO: 521375 - DNA, 20 bp, Artificial
  CRISPR gRNA sequence
gggggcttggagctgggggc

SEQ ID NO: 521376 - DNA, 20 bp, Artificial
  CRISPR gRNA sequence
ggagctgggggcacaagaga

SEQ ID NO: 521377 - DNA, 20 bp, Artificial
  CRISPR gRNA sequence
gagctgggggcacaagagaa

SEQ ID NO: 521378 - DNA, 20 bp, Artificial
  CRISPR gRNA sequence
ggggcacaagagaagccagg

SEQ ID NO: 521379 - DNA, 20 bp, Artificial
  CRISPR gRNA sequence
ccccaccccccaatgccagt

SEQ ID NO: 521380 - DNA, 20 bp, Artificial
  CRISPR gRNA sequence
agcccagacaaacagctggg

SEQ ID NO: 521381 - DNA, 20 bp, Artificial
  CRISPR gRNA sequence
gggatgaaggtccgctccag

SEQ ID NO: 521382 - DNA, 20 bp, Artificial
  CRISPR gRNA sequence
caggaggtaaggcagtgcac

SEQ ID NO: 521383 - DNA, 20 bp, Artificial
  CRISPR gRNA sequence
agcctggcagccagcctccc

SEQ ID NO: 521384 - DNA, 20 bp, Artificial
  CRISPR gRNA sequence
gcagccagcctcccttctgt

SEQ ID NO: 521385 - DNA, 20 bp, Artificial
  CRISPR gRNA sequence
ccttctgtgggagaacaggg

SEQ ID NO: 521386 - DNA, 20 bp, Artificial
  CRISPR gRNA sequence
ctgtgggagaacagggcagg

SEQ ID NO: 521387 - DNA, 20 bp, Artificial
  CRISPR gRNA sequence
tgtgggagaacagggcaggg

SEQ ID NO: 521388 - DNA, 20 bp, Artificial
  CRISPR gRNA sequence
tgggagaacagggcagggca

SEQ ID NO: 521389 - DNA, 20 bp, Artificial
  CRISPR gRNA sequence
tgcccagcagccaggatggc

SEQ ID NO: 521390 - DNA, 20 bp, Artificial
  CRISPR gRNA sequence
cccagcagccaggatggccc

SEQ ID NO: 521391 - DNA, 20 bp, Artificial
  CRISPR gRNA sequence
acctgaggcctgagagacca

SEQ ID NO: 521392 - DNA, 20 bp, Artificial
  CRISPR gRNA sequence
aggcctgagagaccaagacc

SEQ ID NO: 521393 - DNA, 20 bp, Artificial
  CRISPR gRNA sequence
agagaccaagaccccatcag

SEQ ID NO: 521394 - DNA, 20 bp, Artificial
  CRISPR gRNA sequence
tctgcctcagtttcctccat

SEQ ID NO: 521395 - DNA, 20 bp, Artificial
  CRISPR gRNA sequence
cctcagtttcctccatgtgc

SEQ ID NO: 521396 - DNA, 20 bp, Artificial
  CRISPR gRNA sequence
agtttcctccatgtgcctgg

SEQ ID NO: 521397 - DNA, 20 bp, Artificial
  CRISPR gRNA sequence
cctccatgtgcctggaggtg

SEQ ID NO: 521398 - DNA, 20 bp, Artificial
  CRISPR gRNA sequence
ctccatgtgcctggaggtgg

SEQ ID NO: 521399 - DNA, 20 bp, Artificial
  CRISPR gRNA sequence
catgtgcctggaggtggtcg

SEQ ID NO: 521400 - DNA, 20 bp, Artificial
  CRISPR gRNA sequence
gaggtggtcgaagggcctgt

SEQ ID NO: 521401 - DNA, 20 bp, Artificial
  CRISPR gRNA sequence
tgccagctccctgggggatg

SEQ ID NO: 521402 - DNA, 20 bp, Artificial
  CRISPR gRNA sequence
cctgggggatgggaatgggt

SEQ ID NO: 521403 - DNA, 20 bp, Artificial
  CRISPR gRNA sequence
ggggatgggaatgggtaagg

SEQ ID NO: 521404 - DNA, 20 bp, Artificial
  CRISPR gRNA sequence
gggcaaacaggtgcctggcc

SEQ ID NO: 521405 - DNA, 20 bp, Artificial
  CRISPR gRNA sequence
gccactgtcacctctggtgc

SEQ ID NO: 521406 - DNA, 20 bp, Artificial
  CRISPR gRNA sequence
tcacctctggtgccctgagg

SEQ ID NO: 521407 - DNA, 20 bp, Artificial
  CRISPR gRNA sequence
tggtgccctgaggctaagcc

SEQ ID NO: 521408 - DNA, 20 bp, Artificial
  CRISPR gRNA sequence
gtgccctgaggctaagccgg

SEQ ID NO: 521409 - DNA, 20 bp, Artificial
  CRISPR gRNA sequence
aggctaagccggcagagctg

SEQ ID NO: 521410 - DNA, 20 bp, Artificial
  CRISPR gRNA sequence
agccggcagagctgcagggc

SEQ ID NO: 521411 - DNA, 20 bp, Artificial
  CRISPR gRNA sequence
cagggcaggaggggaggaag

SEQ ID NO: 521412 - DNA, 20 bp, Artificial
  CRISPR gRNA sequence
agctggccccagagctctgg

SEQ ID NO: 521413 - DNA, 20 bp, Artificial
  CRISPR gRNA sequence
gccccagagctctggcctgg

SEQ ID NO: 521414 - DNA, 20 bp, Artificial
  CRISPR gRNA sequence
tggcctggagcctgatcacc

SEQ ID NO: 521415 - DNA, 20 bp, Artificial
  CRISPR gRNA sequence
gcctggagcctgatcaccct

SEQ ID NO: 521416 - DNA, 20 bp, Artificial
  CRISPR gRNA sequence
gagcctgatcaccctgaggc

SEQ ID NO: 521417 - DNA, 20 bp, Artificial
  CRISPR gRNA sequence
atcaccctgaggccctccct

SEQ ID NO: 521418 - DNA, 20 bp, Artificial
  CRISPR gRNA sequence
aggccctccctgctgcccca

SEQ ID NO: 521419 - DNA, 20 bp, Artificial
  CRISPR gRNA sequence
cctgctgccccacactgggg

SEQ ID NO: 521420 - DNA, 20 bp, Artificial
  CRISPR gRNA sequence
ctgccccacactgggggcag

SEQ ID NO: 521421 - DNA, 20 bp, Artificial
  CRISPR gRNA sequence
ccccacactgggggcaggtg

SEQ ID NO: 521422 - DNA, 20 bp, Artificial
  CRISPR gRNA sequence
ggggcaggtgccctcctcat

SEQ ID NO: 521423 - DNA, 20 bp, Artificial
  CRISPR gRNA sequence
ctcattctccaaggccctcc

SEQ ID NO: 521424 - DNA, 20 bp, Artificial
  CRISPR gRNA sequence
attctccaaggccctccctg

SEQ ID NO: 521425 - DNA, 20 bp, Artificial
  CRISPR gRNA sequence
tccaaggccctccctgctgc

SEQ ID NO: 521426 - DNA, 20 bp, Artificial
  CRISPR gRNA sequence
caaggccctccctgctgccc

SEQ ID NO: 521427 - DNA, 20 bp, Artificial
  CRISPR gRNA sequence
cctgctgccccacaccaggg

SEQ ID NO: 521428 - DNA, 20 bp, Artificial
  CRISPR gRNA sequence
ctgccccacaccaggggcgg

SEQ ID NO: 521429 - DNA, 20 bp, Artificial
  CRISPR gRNA sequence
ccccacaccaggggcgggtg

SEQ ID NO: 521430 - DNA, 20 bp, Artificial
  CRISPR gRNA sequence
ctcatcctccagctctggac

SEQ ID NO: 521431 - DNA, 20 bp, Artificial
  CRISPR gRNA sequence
atcctccagctctggacatc

SEQ ID NO: 521432 - DNA, 20 bp, Artificial
  CRISPR gRNA sequence
cagctctggacatcccccat

SEQ ID NO: 521433 - DNA, 20 bp, Artificial
  CRISPR gRNA sequence
tggacatcccccatctaagg

SEQ ID NO: 521434 - DNA, 20 bp, Artificial
  CRISPR gRNA sequence
gacatcccccatctaagggc

SEQ ID NO: 521435 - DNA, 20 bp, Artificial
  CRISPR gRNA sequence
agggcgggcgggtcccctta

SEQ ID NO: 521436 - DNA, 20 bp, Artificial
  CRISPR gRNA sequence
accaagacctaaggtgcaaa

SEQ ID NO: 521437 - DNA, 20 bp, Artificial
  CRISPR gRNA sequence
ccaagacctaaggtgcaaaa

SEQ ID NO: 521438 - DNA, 20 bp, Artificial
  CRISPR gRNA sequence
aggtgcaaaacccaaagctg

SEQ ID NO: 521439 - DNA, 20 bp, Artificial
  CRISPR gRNA sequence
aggctgcttaggaatccaca

SEQ ID NO: 521440 - DNA, 20 bp, Artificial
  CRISPR gRNA sequence
cttaggaatccacagcccca

SEQ ID NO: 521441 - DNA, 20 bp, Artificial
  CRISPR gRNA sequence
aggaatccacagccccacag

SEQ ID NO: 521442 - DNA, 20 bp, Artificial
  CRISPR gRNA sequence
ggaatccacagccccacagg

SEQ ID NO: 521443 - DNA, 20 bp, Artificial
  CRISPR gRNA sequence
tcagaaccttgcatcagagt

SEQ ID NO: 521444 - DNA, 20 bp, Artificial
  CRISPR gRNA sequence
agaaccttgcatcagagtcg

SEQ ID NO: 521445 - DNA, 20 bp, Artificial
  CRISPR gRNA sequence
gcatcagagtcgcccttgac

SEQ ID NO: 521446 - DNA, 20 bp, Artificial
  CRISPR gRNA sequence
catcagagtcgcccttgacc

SEQ ID NO: 521447 - DNA, 20 bp, Artificial
  CRISPR gRNA sequence
gacctcaaccctgcccgaga

SEQ ID NO: 521448 - DNA, 20 bp, Artificial
  CRISPR gRNA sequence
acctcaaccctgcccgagaa

SEQ ID NO: 521449 - DNA, 20 bp, Artificial
  CRISPR gRNA sequence
aaccctgcccgagaaggaag

SEQ ID NO: 521450 - DNA, 20 bp, Artificial
  CRISPR gRNA sequence
cccgagaaggaagtgctggt

SEQ ID NO: 521451 - DNA, 20 bp, Artificial
  CRISPR gRNA sequence
gtgcaaccccagcccagctg

SEQ ID NO: 521452 - DNA, 20 bp, Artificial
  CRISPR gRNA sequence
caggaagtggtacctgtcac

SEQ ID NO: 521453 - DNA, 20 bp, Artificial
  CRISPR gRNA sequence
tcaccaagtcccctgcacag

SEQ ID NO: 521454 - DNA, 20 bp, Artificial
  CRISPR gRNA sequence
cacaggggaagcagggggct

SEQ ID NO: 521455 - DNA, 20 bp, Artificial
  CRISPR gRNA sequence
agggggcaggaccaggggga

SEQ ID NO: 521456 - DNA, 20 bp, Artificial
  CRISPR gRNA sequence
ccccggagaacccctcaggg

SEQ ID NO: 521457 - DNA, 20 bp, Artificial
  CRISPR gRNA sequence
cccggagaacccctcagggg

SEQ ID NO: 521458 - DNA, 20 bp, Artificial
  CRISPR gRNA sequence
aggggccgggcgcccttccc

SEQ ID NO: 521459 - DNA, 20 bp, Artificial
  CRISPR gRNA sequence
ccctcccgggcaccaaatgg

SEQ ID NO: 521460 - DNA, 20 bp, Artificial
  CRISPR gRNA sequence
cctcccgggcaccaaatgga

SEQ ID NO: 521461 - DNA, 20 bp, Artificial
  CRISPR gRNA sequence
ccgggcaccaaatggacaca

SEQ ID NO: 521462 - DNA, 20 bp, Artificial
  CRISPR gRNA sequence
acaagaaccacacttcacgg

SEQ ID NO: 521463 - DNA, 20 bp, Artificial
  CRISPR gRNA sequence
cacggtgagcaaagctctga

SEQ ID NO: 521464 - DNA, 20 bp, Artificial
  CRISPR gRNA sequence
acggtgagcaaagctctgaa

SEQ ID NO: 521465 - DNA, 20 bp, Artificial
  CRISPR gRNA sequence
tgaacattcaggctctgaga

SEQ ID NO: 521466 - DNA, 20 bp, Artificial
  CRISPR gRNA sequence
aacattcaggctctgagaca

SEQ ID NO: 521467 - DNA, 20 bp, Artificial
  CRISPR gRNA sequence
aggctctgagacacgaaagc

SEQ ID NO: 521468 - DNA, 20 bp, Artificial
  CRISPR gRNA sequence
tgagacacgaaagcggcgtc

SEQ ID NO: 521469 - DNA, 20 bp, Artificial
  CRISPR gRNA sequence
agacacgaaagcggcgtcag

SEQ ID NO: 521470 - DNA, 20 bp, Artificial
  CRISPR gRNA sequence
cagcagatccgggccaaatc

SEQ ID NO: 521471 - DNA, 20 bp, Artificial
  CRISPR gRNA sequence
tcacagaagtcgaggacagg

SEQ ID NO: 521472 - DNA, 20 bp, Artificial
  CRISPR gRNA sequence
cacagaagtcgaggacagga

SEQ ID NO: 521473 - DNA, 20 bp, Artificial
  CRISPR gRNA sequence
acagaagtcgaggacaggag

SEQ ID NO: 521474 - DNA, 20 bp, Artificial
  CRISPR gRNA sequence
gtggctgacgcctgcaatcc

SEQ ID NO: 521475 - DNA, 20 bp, Artificial
  CRISPR gRNA sequence
acgcctgcaatcccagtgtt

SEQ ID NO: 521476 - DNA, 20 bp, Artificial
  CRISPR gRNA sequence
caatcccagtgttttgagag

SEQ ID NO: 521477 - DNA, 20 bp, Artificial
  CRISPR gRNA sequence
tgagaggccaaggcaggaga

SEQ ID NO: 521478 - DNA, 20 bp, Artificial
  CRISPR gRNA sequence
gagaggccaaggcaggagaa

SEQ ID NO: 521479 - DNA, 20 bp, Artificial
  CRISPR gRNA sequence
agaggccaaggcaggagaat

SEQ ID NO: 521480 - DNA, 20 bp, Artificial
  CRISPR gRNA sequence
gaggccaggagtttgagagc

SEQ ID NO: 521481 - DNA, 20 bp, Artificial
  CRISPR gRNA sequence
aggccaggagtttgagagca

SEQ ID NO: 521482 - DNA, 20 bp, Artificial
  CRISPR gRNA sequence
gagagcagcctgggcaacac

SEQ ID NO: 521483 - DNA, 20 bp, Artificial
  CRISPR gRNA sequence
agagcagcctgggcaacaca

SEQ ID NO: 521484 - DNA, 20 bp, Artificial
  CRISPR gRNA sequence
ggcaacacagtgagactcct

SEQ ID NO: 521485 - DNA, 20 bp, Artificial
  CRISPR gRNA sequence
ctacctctacaaaaaataaa

SEQ ID NO: 521486 - DNA, 20 bp, Artificial
  CRISPR gRNA sequence
cctctacaaaaaataaaaat

SEQ ID NO: 521487 - DNA, 20 bp, Artificial
  CRISPR gRNA sequence
tacaaaaaataaaaatagaa

SEQ ID NO: 521488 - DNA, 20 bp, Artificial
  CRISPR gRNA sequence
caaaaaataaaaatagaaaa

SEQ ID NO: 521489 - DNA, 20 bp, Artificial
  CRISPR gRNA sequence
gccagacatggtggcatgca

SEQ ID NO: 521490 - DNA, 20 bp, Artificial
  CRISPR gRNA sequence
tagtcccagttactcaggag

SEQ ID NO: 521491 - DNA, 20 bp, Artificial
  CRISPR gRNA sequence
gtcccagttactcaggaggc

SEQ ID NO: 521492 - DNA, 20 bp, Artificial
  CRISPR gRNA sequence
ctcaggaggctgaggcagga

SEQ ID NO: 521493 - DNA, 20 bp, Artificial
  CRISPR gRNA sequence
aggaggctgaggcaggagga

SEQ ID NO: 521494 - DNA, 20 bp, Artificial
  CRISPR gRNA sequence
aggcaggaggatcactcgcg

SEQ ID NO: 521495 - DNA, 20 bp, Artificial
  CRISPR gRNA sequence
gcgcccaggagggagagact

SEQ ID NO: 521496 - DNA, 20 bp, Artificial
  CRISPR gRNA sequence
cagtgaaccctaatggcact

SEQ ID NO: 521497 - DNA, 20 bp, Artificial
  CRISPR gRNA sequence
atggcactgctgaactccag

SEQ ID NO: 521498 - DNA, 20 bp, Artificial
  CRISPR gRNA sequence
ctgaactccagcctagttga

SEQ ID NO: 521499 - DNA, 20 bp, Artificial
  CRISPR gRNA sequence
aactccagcctagttgacag

SEQ ID NO: 521500 - DNA, 20 bp, Artificial
  CRISPR gRNA sequence
cagcctagttgacagaacga

SEQ ID NO: 521501 - DNA, 20 bp, Artificial
  CRISPR gRNA sequence
gttgacagaacgaggccctg

SEQ ID NO: 521502 - DNA, 20 bp, Artificial
  CRISPR gRNA sequence
acagaacgaggccctgtctc

SEQ ID NO: 521503 - DNA, 20 bp, Artificial
  CRISPR gRNA sequence
tctcaaaaaaaaaagaaaag

SEQ ID NO: 521504 - DNA, 20 bp, Artificial
  CRISPR gRNA sequence
aaaaaaaaaagaaaagaaaa

SEQ ID NO: 521505 - DNA, 20 bp, Artificial
  CRISPR gRNA sequence
taagcaagacagcagagaga

SEQ ID NO: 521506 - DNA, 20 bp, Artificial
  CRISPR gRNA sequence
aagcaagacagcagagagag

SEQ ID NO: 521507 - DNA, 20 bp, Artificial
  CRISPR gRNA sequence
agcaagacagcagagagagg

SEQ ID NO: 521508 - DNA, 20 bp, Artificial
  CRISPR gRNA sequence
tgctgggagaggaatccagc

SEQ ID NO: 521509 - DNA, 20 bp, Artificial
  CRISPR gRNA sequence
ggagaggaatccagcggggt

SEQ ID NO: 521510 - DNA, 20 bp, Artificial
  CRISPR gRNA sequence
cctttttatttttttgagac

SEQ ID NO: 521511 - DNA, 20 bp, Artificial
  CRISPR gRNA sequence
ctttttatttttttgagacg

SEQ ID NO: 521512 - DNA, 20 bp, Artificial
  CRISPR gRNA sequence
tttatttttttgagacggag

SEQ ID NO: 521513 - DNA, 20 bp, Artificial
  CRISPR gRNA sequence
ttatttttttgagacggagt

SEQ ID NO: 521514 - DNA, 20 bp, Artificial
  CRISPR gRNA sequence
tatttttttgagacggagtt

SEQ ID NO: 521515 - DNA, 20 bp, Artificial
  CRISPR gRNA sequence
atttttttgagacggagttg

SEQ ID NO: 521516 - DNA, 20 bp, Artificial
  CRISPR gRNA sequence
tttttttgagacggagttgc

SEQ ID NO: 521517 - DNA, 20 bp, Artificial
  CRISPR gRNA sequence
ttttgagacggagttgcgct

SEQ ID NO: 521518 - DNA, 20 bp, Artificial
  CRISPR gRNA sequence
tttgagacggagttgcgctg

SEQ ID NO: 521519 - DNA, 20 bp, Artificial
  CRISPR gRNA sequence
ttgagacggagttgcgctgt

SEQ ID NO: 521520 - DNA, 20 bp, Artificial
  CRISPR gRNA sequence
tgagacggagttgcgctgtc

SEQ ID NO: 521521 - DNA, 20 bp, Artificial
  CRISPR gRNA sequence
gagacggagttgcgctgtca

SEQ ID NO: 521522 - DNA, 20 bp, Artificial
  CRISPR gRNA sequence
agacggagttgcgctgtcac

SEQ ID NO: 521523 - DNA, 20 bp, Artificial
  CRISPR gRNA sequence
cgctgtcaccggcctggagt

SEQ ID NO: 521524 - DNA, 20 bp, Artificial
  CRISPR gRNA sequence
tcaccggcctggagtgcagt

SEQ ID NO: 521525 - DNA, 20 bp, Artificial
  CRISPR gRNA sequence
gagtgcagtggcgcgatctc

SEQ ID NO: 521526 - DNA, 20 bp, Artificial
  CRISPR gRNA sequence
agctcactgcaagctccgcc

SEQ ID NO: 521527 - DNA, 20 bp, Artificial
  CRISPR gRNA sequence
actgcaagctccgcctccca

SEQ ID NO: 521528 - DNA, 20 bp, Artificial
  CRISPR gRNA sequence
caagctccgcctcccaggtt

SEQ ID NO: 521529 - DNA, 20 bp, Artificial
  CRISPR gRNA sequence
cgcctcccaggttcatgcca

SEQ ID NO: 521530 - DNA, 20 bp, Artificial
  CRISPR gRNA sequence
ccaggttcatgccattctcc

SEQ ID NO: 521531 - DNA, 20 bp, Artificial
  CRISPR gRNA sequence
atgccattctcctgcctcag

SEQ ID NO: 521532 - DNA, 20 bp, Artificial
  CRISPR gRNA sequence
tcctgcctcagcttcctgag

SEQ ID NO: 521533 - DNA, 20 bp, Artificial
  CRISPR gRNA sequence
ctgcctcagcttcctgagta

SEQ ID NO: 521534 - DNA, 20 bp, Artificial
  CRISPR gRNA sequence
cctcagcttcctgagtagct

SEQ ID NO: 521535 - DNA, 20 bp, Artificial
  CRISPR gRNA sequence
agcttcctgagtagctggga

SEQ ID NO: 521536 - DNA, 20 bp, Artificial
  CRISPR gRNA sequence
cctgagtagctgggactaca

SEQ ID NO: 521537 - DNA, 20 bp, Artificial
  CRISPR gRNA sequence
ctgagtagctgggactacag

SEQ ID NO: 521538 - DNA, 20 bp, Artificial
  CRISPR gRNA sequence
agtagctgggactacaggct

SEQ ID NO: 521539 - DNA, 20 bp, Artificial
  CRISPR gRNA sequence
ggactacaggctcccacgac

SEQ ID NO: 521540 - DNA, 20 bp, Artificial
  CRISPR gRNA sequence
caggctcccacgaccacgcc

SEQ ID NO: 521541 - DNA, 20 bp, Artificial
  CRISPR gRNA sequence
ccacgaccacgcccagctaa

SEQ ID NO: 521542 - DNA, 20 bp, Artificial
  CRISPR gRNA sequence
atttttttgtgtttttagta

SEQ ID NO: 521543 - DNA, 20 bp, Artificial
  CRISPR gRNA sequence
ttttgtgtttttagtagaga

SEQ ID NO: 521544 - DNA, 20 bp, Artificial
  CRISPR gRNA sequence
tttgtgtttttagtagagac

SEQ ID NO: 521545 - DNA, 20 bp, Artificial
  CRISPR gRNA sequence
ttgtgtttttagtagagacg

SEQ ID NO: 521546 - DNA, 20 bp, Artificial
  CRISPR gRNA sequence
tgtgtttttagtagagacga

SEQ ID NO: 521547 - DNA, 20 bp, Artificial
  CRISPR gRNA sequence
gtgtttttagtagagacgag

SEQ ID NO: 521548 - DNA, 20 bp, Artificial
  CRISPR gRNA sequence
tgtttttagtagagacgagg

SEQ ID NO: 521549 - DNA, 20 bp, Artificial
  CRISPR gRNA sequence
ttagtagagacgaggtttca

SEQ ID NO: 521550 - DNA, 20 bp, Artificial
  CRISPR gRNA sequence
tagtagagacgaggtttcat

SEQ ID NO: 521551 - DNA, 20 bp, Artificial
  CRISPR gRNA sequence
agtagagacgaggtttcatc

SEQ ID NO: 521552 - DNA, 20 bp, Artificial
  CRISPR gRNA sequence
gtagagacgaggtttcatcg

SEQ ID NO: 521553 - DNA, 20 bp, Artificial
  CRISPR gRNA sequence
catcgtgttgatcaggatgg

SEQ ID NO: 521554 - DNA, 20 bp, Artificial
  CRISPR gRNA sequence
atcgtgttgatcaggatggt

SEQ ID NO: 521555 - DNA, 20 bp, Artificial
  CRISPR gRNA sequence
atcaggatggtctcgatctc

SEQ ID NO: 521556 - DNA, 20 bp, Artificial
  CRISPR gRNA sequence
gatctcctgacctcatgatc

SEQ ID NO: 521557 - DNA, 20 bp, Artificial
  CRISPR gRNA sequence
ctgacctcatgatccgccca

SEQ ID NO: 521558 - DNA, 20 bp, Artificial
  CRISPR gRNA sequence
acctcatgatccgcccacct

SEQ ID NO: 521559 - DNA, 20 bp, Artificial
  CRISPR gRNA sequence
atgatccgcccacctcggcc

SEQ ID NO: 521560 - DNA, 20 bp, Artificial
  CRISPR gRNA sequence
ggcctcccaaagtgctggga

SEQ ID NO: 521561 - DNA, 20 bp, Artificial
  CRISPR gRNA sequence
ccaaagtgctgggattacag

SEQ ID NO: 521562 - DNA, 20 bp, Artificial
  CRISPR gRNA sequence
ggattacaggcgtgagccac

SEQ ID NO: 521563 - DNA, 20 bp, Artificial
  CRISPR gRNA sequence
caggcgtgagccaccgtgcc

SEQ ID NO: 521564 - DNA, 20 bp, Artificial
  CRISPR gRNA sequence
aggcttcctttttgcaaccc

SEQ ID NO: 521565 - DNA, 20 bp, Artificial
  CRISPR gRNA sequence
cctttttgcaaccccgtaaa

SEQ ID NO: 521566 - DNA, 20 bp, Artificial
  CRISPR gRNA sequence
ctttttgcaaccccgtaaaa

SEQ ID NO: 521567 - DNA, 20 bp, Artificial
  CRISPR gRNA sequence
tttgcaaccccgtaaaaccc

SEQ ID NO: 521568 - DNA, 20 bp, Artificial
  CRISPR gRNA sequence
ttgcaaccccgtaaaaccct

SEQ ID NO: 521569 - DNA, 20 bp, Artificial
  CRISPR gRNA sequence
tgcaaccccgtaaaacccta

SEQ ID NO: 521570 - DNA, 20 bp, Artificial
  CRISPR gRNA sequence
gcaaccccgtaaaaccctaa

SEQ ID NO: 521571 - DNA, 20 bp, Artificial
  CRISPR gRNA sequence
caaccccgtaaaaccctaag

SEQ ID NO: 521572 - DNA, 20 bp, Artificial
  CRISPR gRNA sequence
agacgagactgcttgaggaa

SEQ ID NO: 521573 - DNA, 20 bp, Artificial
  CRISPR gRNA sequence
cttgaggaaccagaggcccc

SEQ ID NO: 521574 - DNA, 20 bp, Artificial
  CRISPR gRNA sequence
gaggaaccagaggccccgca

SEQ ID NO: 521575 - DNA, 20 bp, Artificial
  CRISPR gRNA sequence
aggaaccagaggccccgcag

SEQ ID NO: 521576 - DNA, 20 bp, Artificial
  CRISPR gRNA sequence
gaactttgcatcagagcttc

SEQ ID NO: 521577 - DNA, 20 bp, Artificial
  CRISPR gRNA sequence
tgcatcagagcttcctcctg

SEQ ID NO: 521578 - DNA, 20 bp, Artificial
  CRISPR gRNA sequence
gcatcagagcttcctcctgc

SEQ ID NO: 521579 - DNA, 20 bp, Artificial
  CRISPR gRNA sequence
catcagagcttcctcctgcc

SEQ ID NO: 521580 - DNA, 20 bp, Artificial
  CRISPR gRNA sequence
cctcctgcctgtgctgaaac

SEQ ID NO: 521581 - DNA, 20 bp, Artificial
  CRISPR gRNA sequence
ctcctgcctgtgctgaaacc

SEQ ID NO: 521582 - DNA, 20 bp, Artificial
  CRISPR gRNA sequence
ctgcctgtgctgaaacccac

SEQ ID NO: 521583 - DNA, 20 bp, Artificial
  CRISPR gRNA sequence
cctgtgctgaaacccacctt

SEQ ID NO: 521584 - DNA, 20 bp, Artificial
  CRISPR gRNA sequence
tgctgaaacccaccttgcgc

SEQ ID NO: 521585 - DNA, 20 bp, Artificial
  CRISPR gRNA sequence
aaacccaccttgcgctgtcc

SEQ ID NO: 521586 - DNA, 20 bp, Artificial
  CRISPR gRNA sequence
gcgctgtcctagaggagagg

SEQ ID NO: 521587 - DNA, 20 bp, Artificial
  CRISPR gRNA sequence
cgctgtcctagaggagaggc

SEQ ID NO: 521588 - DNA, 20 bp, Artificial
  CRISPR gRNA sequence
tcctagaggagaggcactcg

SEQ ID NO: 521589 - DNA, 20 bp, Artificial
  CRISPR gRNA sequence
gaggagaggcactcgcatca

SEQ ID NO: 521590 - DNA, 20 bp, Artificial
  CRISPR gRNA sequence
gcatcaaagtgactcggagg

SEQ ID NO: 521591 - DNA, 20 bp, Artificial
  CRISPR gRNA sequence
ggaggtgcgcgggaagtgat

SEQ ID NO: 521592 - DNA, 20 bp, Artificial
  CRISPR gRNA sequence
gaaggaagaggacatgggag

SEQ ID NO: 521593 - DNA, 20 bp, Artificial
  CRISPR gRNA sequence
cgctgggaactgaaggctca

SEQ ID NO: 521594 - DNA, 20 bp, Artificial
  CRISPR gRNA sequence
ggaactgaaggctcaaggga

SEQ ID NO: 521595 - DNA, 20 bp, Artificial
  CRISPR gRNA sequence
aaggctcaagggatgattat

SEQ ID NO: 521596 - DNA, 20 bp, Artificial
  CRISPR gRNA sequence
aagggatgattataaactag

SEQ ID NO: 521597 - DNA, 20 bp, Artificial
  CRISPR gRNA sequence
taaactaggcatccaccttt

SEQ ID NO: 521598 - DNA, 20 bp, Artificial
  CRISPR gRNA sequence
ggcatccaccttttaagcca

SEQ ID NO: 521599 - DNA, 20 bp, Artificial
  CRISPR gRNA sequence
ttaagccaaaagccagagca

SEQ ID NO: 521600 - DNA, 20 bp, Artificial
  CRISPR gRNA sequence
taagccaaaagccagagcat

SEQ ID NO: 521601 - DNA, 20 bp, Artificial
  CRISPR gRNA sequence
aagccaaaagccagagcatc

SEQ ID NO: 521602 - DNA, 20 bp, Artificial
  CRISPR gRNA sequence
agccaaaagccagagcatca

SEQ ID NO: 521603 - DNA, 20 bp, Artificial
  CRISPR gRNA sequence
atttctgctttgtaggaatg

SEQ ID NO: 521604 - DNA, 20 bp, Artificial
  CRISPR gRNA sequence
ctgctttgtaggaatgtgat

SEQ ID NO: 521605 - DNA, 20 bp, Artificial
  CRISPR gRNA sequence
tgctttgtaggaatgtgata

SEQ ID NO: 521606 - DNA, 20 bp, Artificial
  CRISPR gRNA sequence
ctttgtaggaatgtgataaa

SEQ ID NO: 521607 - DNA, 20 bp, Artificial
  CRISPR gRNA sequence
tgtaggaatgtgataaagaa

SEQ ID NO: 521608 - DNA, 20 bp, Artificial
  CRISPR gRNA sequence
gtaggaatgtgataaagaac

SEQ ID NO: 521609 - DNA, 20 bp, Artificial
  CRISPR gRNA sequence
taggaatgtgataaagaact

SEQ ID NO: 521610 - DNA, 20 bp, Artificial
  CRISPR gRNA sequence
gagagaagtgccgtcaggtg

SEQ ID NO: 521611 - DNA, 20 bp, Artificial
  CRISPR gRNA sequence
gaacactgtccttggatcac

SEQ ID NO: 521612 - DNA, 20 bp, Artificial
  CRISPR gRNA sequence
tccttggatcacagaggctc

SEQ ID NO: 521613 - DNA, 20 bp, Artificial
  CRISPR gRNA sequence
ggatcacagaggctccagga

SEQ ID NO: 521614 - DNA, 20 bp, Artificial
  CRISPR gRNA sequence
gatcacagaggctccaggaa

SEQ ID NO: 521615 - DNA, 20 bp, Artificial
  CRISPR gRNA sequence
caggaaatccagggacaaaa

SEQ ID NO: 521616 - DNA, 20 bp, Artificial
  CRISPR gRNA sequence
tgaacctgcgaccctgcaaa

SEQ ID NO: 521617 - DNA, 20 bp, Artificial
  CRISPR gRNA sequence
aacctgcgaccctgcaaaag

SEQ ID NO: 521618 - DNA, 20 bp, Artificial
  CRISPR gRNA sequence
cgaccctgcaaaagcgtatt

SEQ ID NO: 521619 - DNA, 20 bp, Artificial
  CRISPR gRNA sequence
caaaagcgtattttcccaag

SEQ ID NO: 521620 - DNA, 20 bp, Artificial
  CRISPR gRNA sequence
tcccaagggtcagggagacg

SEQ ID NO: 521621 - DNA, 20 bp, Artificial
  CRISPR gRNA sequence
cccaagggtcagggagacgt

SEQ ID NO: 521622 - DNA, 20 bp, Artificial
  CRISPR gRNA sequence
ccaagggtcagggagacgtg

SEQ ID NO: 521623 - DNA, 20 bp, Artificial
  CRISPR gRNA sequence
ctactgttggtttgactatc

SEQ ID NO: 521624 - DNA, 20 bp, Artificial
  CRISPR gRNA sequence
ctgttggtttgactatctgt

SEQ ID NO: 521625 - DNA, 20 bp, Artificial
  CRISPR gRNA sequence
ttggtttgactatctgtgaa

SEQ ID NO: 521626 - DNA, 20 bp, Artificial
  CRISPR gRNA sequence
gtttgactatctgtgaagtt

SEQ ID NO: 521627 - DNA, 20 bp, Artificial
  CRISPR gRNA sequence
gactatctgtgaagtttgat

SEQ ID NO: 521628 - DNA, 20 bp, Artificial
  CRISPR gRNA sequence
actatctgtgaagtttgata

SEQ ID NO: 521629 - DNA, 20 bp, Artificial
  CRISPR gRNA sequence
tctgtgaagtttgatagcac

SEQ ID NO: 521630 - DNA, 20 bp, Artificial
  CRISPR gRNA sequence
tgaagtttgatagcacagtt

SEQ ID NO: 521631 - DNA, 20 bp, Artificial
  CRISPR gRNA sequence
gatagcacagttttgtttgt

SEQ ID NO: 521632 - DNA, 20 bp, Artificial
  CRISPR gRNA sequence
atagcacagttttgtttgtt

SEQ ID NO: 521633 - DNA, 20 bp, Artificial
  CRISPR gRNA sequence
tgtttgtttgtttgtttttt

SEQ ID NO: 521634 - DNA, 20 bp, Artificial
  CRISPR gRNA sequence
gtttgtttgtttgttttttt

SEQ ID NO: 521635 - DNA, 20 bp, Artificial
  CRISPR gRNA sequence
tttgtttgtttgtttttttg

SEQ ID NO: 521636 - DNA, 20 bp, Artificial
  CRISPR gRNA sequence
gtttgtttgtttttttgaga

SEQ ID NO: 521637 - DNA, 20 bp, Artificial
  CRISPR gRNA sequence
tttgtttgtttttttgagat

SEQ ID NO: 521638 - DNA, 20 bp, Artificial
  CRISPR gRNA sequence
gtttgtttttttgagatgga

SEQ ID NO: 521639 - DNA, 20 bp, Artificial
  CRISPR gRNA sequence
tttgtttttttgagatggag

SEQ ID NO: 521640 - DNA, 20 bp, Artificial
  CRISPR gRNA sequence
gtttttttgagatggagtct

SEQ ID NO: 521641 - DNA, 20 bp, Artificial
  CRISPR gRNA sequence
tttttttgagatggagtctc

SEQ ID NO: 521642 - DNA, 20 bp, Artificial
  CRISPR gRNA sequence
ttttgagatggagtctcact

SEQ ID NO: 521643 - DNA, 20 bp, Artificial
  CRISPR gRNA sequence
tttgagatggagtctcactc

SEQ ID NO: 521644 - DNA, 20 bp, Artificial
  CRISPR gRNA sequence
ttgagatggagtctcactct

SEQ ID NO: 521645 - DNA, 20 bp, Artificial
  CRISPR gRNA sequence
tgagatggagtctcactctg

SEQ ID NO: 521646 - DNA, 20 bp, Artificial
  CRISPR gRNA sequence
gagatggagtctcactctgt

SEQ ID NO: 521647 - DNA, 20 bp, Artificial
  CRISPR gRNA sequence
agatggagtctcactctgtc

SEQ ID NO: 521648 - DNA, 20 bp, Artificial
  CRISPR gRNA sequence
actctgtcatccaggctgga

SEQ ID NO: 521649 - DNA, 20 bp, Artificial
  CRISPR gRNA sequence
tgtcatccaggctggagtgc

SEQ ID NO: 521650 - DNA, 20 bp, Artificial
  CRISPR gRNA sequence
tcatccaggctggagtgcaa

SEQ ID NO: 521651 - DNA, 20 bp, Artificial
  CRISPR gRNA sequence
gagtgcaatggctagatctc

SEQ ID NO: 521652 - DNA, 20 bp, Artificial
  CRISPR gRNA sequence
gatctcggctcactgcaacc

SEQ ID NO: 521653 - DNA, 20 bp, Artificial
  CRISPR gRNA sequence
ggctcactgcaacctccgcc

SEQ ID NO: 521654 - DNA, 20 bp, Artificial
  CRISPR gRNA sequence
actgcaacctccgcctccca

SEQ ID NO: 521655 - DNA, 20 bp, Artificial
  CRISPR gRNA sequence
caacctccgcctcccatgtt

SEQ ID NO: 521656 - DNA, 20 bp, Artificial
  CRISPR gRNA sequence
cgcctcccatgttcaagaaa

SEQ ID NO: 521657 - DNA, 20 bp, Artificial
  CRISPR gRNA sequence
ccatgttcaagaaattcttc

SEQ ID NO: 521658 - DNA, 20 bp, Artificial
  CRISPR gRNA sequence
aagaaattcttctgcctcag

SEQ ID NO: 521659 - DNA, 20 bp, Artificial
  CRISPR gRNA sequence
ttctgcctcagcctcctgag

SEQ ID NO: 521660 - DNA, 20 bp, Artificial
  CRISPR gRNA sequence
ctgcctcagcctcctgagta

SEQ ID NO: 521661 - DNA, 20 bp, Artificial
  CRISPR gRNA sequence
tgcctcagcctcctgagtag

SEQ ID NO: 521662 - DNA, 20 bp, Artificial
  CRISPR gRNA sequence
cctcagcctcctgagtagct

SEQ ID NO: 521663 - DNA, 20 bp, Artificial
  CRISPR gRNA sequence
agcctcctgagtagctggga

SEQ ID NO: 521664 - DNA, 20 bp, Artificial
  CRISPR gRNA sequence
ctgagtagctgggactatag

SEQ ID NO: 521665 - DNA, 20 bp, Artificial
  CRISPR gRNA sequence
agtagctgggactataggtg

SEQ ID NO: 521666 - DNA, 20 bp, Artificial
  CRISPR gRNA sequence
ggactataggtgcacaccac

SEQ ID NO: 521667 - DNA, 20 bp, Artificial
  CRISPR gRNA sequence
taggtgcacaccactaggcc

SEQ ID NO: 521668 - DNA, 20 bp, Artificial
  CRISPR gRNA sequence
ggcccagctaatttttgtat

SEQ ID NO: 521669 - DNA, 20 bp, Artificial
  CRISPR gRNA sequence
atttttgtatttttagtaga

SEQ ID NO: 521670 - DNA, 20 bp, Artificial
  CRISPR gRNA sequence
ttgtatttttagtagagatg

SEQ ID NO: 521671 - DNA, 20 bp, Artificial
  CRISPR gRNA sequence
tgtatttttagtagagatgg

SEQ ID NO: 521672 - DNA, 20 bp, Artificial
  CRISPR gRNA sequence
gtatttttagtagagatgga

SEQ ID NO: 521673 - DNA, 20 bp, Artificial
  CRISPR gRNA sequence
tatttttagtagagatggag

SEQ ID NO: 521674 - DNA, 20 bp, Artificial
  CRISPR gRNA sequence
ttagtagagatggagtttca

SEQ ID NO: 521675 - DNA, 20 bp, Artificial
  CRISPR gRNA sequence
tagtagagatggagtttcac

SEQ ID NO: 521676 - DNA, 20 bp, Artificial
  CRISPR gRNA sequence
agtagagatggagtttcacc

SEQ ID NO: 521677 - DNA, 20 bp, Artificial
  CRISPR gRNA sequence
gtagagatggagtttcacca

SEQ ID NO: 521678 - DNA, 20 bp, Artificial
  CRISPR gRNA sequence
caccatattggccaggctgg

SEQ ID NO: 521679 - DNA, 20 bp, Artificial
  CRISPR gRNA sequence
accatattggccaggctggt

SEQ ID NO: 521680 - DNA, 20 bp, Artificial
  CRISPR gRNA sequence
gccaggctggtctcgaactc

SEQ ID NO: 521681 - DNA, 20 bp, Artificial
  CRISPR gRNA sequence
gtctcgaactcctgacctcg

SEQ ID NO: 521682 - DNA, 20 bp, Artificial
  CRISPR gRNA sequence
gaactcctgacctcgtgatc

SEQ ID NO: 521683 - DNA, 20 bp, Artificial
  CRISPR gRNA sequence
ctgacctcgtgatccgcctg

SEQ ID NO: 521684 - DNA, 20 bp, Artificial
  CRISPR gRNA sequence
acctcgtgatccgcctgcct

SEQ ID NO: 521685 - DNA, 20 bp, Artificial
  CRISPR gRNA sequence
gtgatccgcctgcctcggcc

SEQ ID NO: 521686 - DNA, 20 bp, Artificial
  CRISPR gRNA sequence
cctcggcctcccaaagtgct

SEQ ID NO: 521687 - DNA, 20 bp, Artificial
  CRISPR gRNA sequence
ggcctcccaaagtgctggga

SEQ ID NO: 521688 - DNA, 20 bp, Artificial
  CRISPR gRNA sequence
ccaaagtgctgggattacag

SEQ ID NO: 521689 - DNA, 20 bp, Artificial
  CRISPR gRNA sequence
ggattacaggcgtgagccac

SEQ ID NO: 521690 - DNA, 20 bp, Artificial
  CRISPR gRNA sequence
caggcgtgagccactgcgcc

SEQ ID NO: 521691 - DNA, 20 bp, Artificial
  CRISPR gRNA sequence
cgcccggcctgatagcacaa

SEQ ID NO: 521692 - DNA, 20 bp, Artificial
  CRISPR gRNA sequence
atagcacaaattttaaaggc

SEQ ID NO: 521693 - DNA, 20 bp, Artificial
  CRISPR gRNA sequence
taaaggccacaatttctggc

SEQ ID NO: 521694 - DNA, 20 bp, Artificial
  CRISPR gRNA sequence
aaaggccacaatttctggcc

SEQ ID NO: 521695 - DNA, 20 bp, Artificial
  CRISPR gRNA sequence
aaggccacaatttctggcca

SEQ ID NO: 521696 - DNA, 20 bp, Artificial
  CRISPR gRNA sequence
ctggccaaatgaaataaaat

SEQ ID NO: 521697 - DNA, 20 bp, Artificial
  CRISPR gRNA sequence
tggccaaatgaaataaaatg

SEQ ID NO: 521698 - DNA, 20 bp, Artificial
  CRISPR gRNA sequence
gccaaatgaaataaaatgag

SEQ ID NO: 521699 - DNA, 20 bp, Artificial
  CRISPR gRNA sequence
ataaggaatgctaaagtact

SEQ ID NO: 521700 - DNA, 20 bp, Artificial
  CRISPR gRNA sequence
aagtactctgctaaatacct

SEQ ID NO: 521701 - DNA, 20 bp, Artificial
  CRISPR gRNA sequence
tgctaaatacctgaagtcaa

SEQ ID NO: 521702 - DNA, 20 bp, Artificial
  CRISPR gRNA sequence
ctaaatacctgaagtcaaag

SEQ ID NO: 521703 - DNA, 20 bp, Artificial
  CRISPR gRNA sequence
aatacctgaagtcaaaggga

SEQ ID NO: 521704 - DNA, 20 bp, Artificial
  CRISPR gRNA sequence
aagtcaaagggaaatcaaat

SEQ ID NO: 521705 - DNA, 20 bp, Artificial
  CRISPR gRNA sequence
acagcattttagacaagggg

SEQ ID NO: 521706 - DNA, 20 bp, Artificial
  CRISPR gRNA sequence
cagcattttagacaagggga

SEQ ID NO: 521707 - DNA, 20 bp, Artificial
  CRISPR gRNA sequence
tagacaaggggacaccactc

SEQ ID NO: 521708 - DNA, 20 bp, Artificial
  CRISPR gRNA sequence
agacaaggggacaccactcc

SEQ ID NO: 521709 - DNA, 20 bp, Artificial
  CRISPR gRNA sequence
gacaaggggacaccactcct

SEQ ID NO: 521710 - DNA, 20 bp, Artificial
  CRISPR gRNA sequence
ctccatctaacatgaaggag

SEQ ID NO: 521711 - DNA, 20 bp, Artificial
  CRISPR gRNA sequence
catctaacatgaaggagact

SEQ ID NO: 521712 - DNA, 20 bp, Artificial
  CRISPR gRNA sequence
acatgaaggagactgtctgt

SEQ ID NO: 521713 - DNA, 20 bp, Artificial
  CRISPR gRNA sequence
tctgttcctgggtggcgacg

SEQ ID NO: 521714 - DNA, 20 bp, Artificial
  CRISPR gRNA sequence
ttcctgggtggcgacgtgag

SEQ ID NO: 521715 - DNA, 20 bp, Artificial
  CRISPR gRNA sequence
ctgggtggcgacgtgaggcc

SEQ ID NO: 521716 - DNA, 20 bp, Artificial
  CRISPR gRNA sequence
ggtggcgacgtgaggccgag

SEQ ID NO: 521717 - DNA, 20 bp, Artificial
  CRISPR gRNA sequence
ttgctgtggacataaaagaa

SEQ ID NO: 521718 - DNA, 20 bp, Artificial
  CRISPR gRNA sequence
gctgtggacataaaagaatg

SEQ ID NO: 521719 - DNA, 20 bp, Artificial
  CRISPR gRNA sequence
ctgtggacataaaagaatgg

SEQ ID NO: 521720 - DNA, 20 bp, Artificial
  CRISPR gRNA sequence
tggacataaaagaatggcca

SEQ ID NO: 521721 - DNA, 20 bp, Artificial
  CRISPR gRNA sequence
cagttttagggaataaaaca

SEQ ID NO: 521722 - DNA, 20 bp, Artificial
  CRISPR gRNA sequence
agttttagggaataaaacaa

SEQ ID NO: 521723 - DNA, 20 bp, Artificial
  CRISPR gRNA sequence
tagggaataaaacaataaag

SEQ ID NO: 521724 - DNA, 20 bp, Artificial
  CRISPR gRNA sequence
agggaataaaacaataaagg

SEQ ID NO: 521725 - DNA, 20 bp, Artificial
  CRISPR gRNA sequence
gggaataaaacaataaagga

SEQ ID NO: 521726 - DNA, 20 bp, Artificial
  CRISPR gRNA sequence
agagtaaggaaacctcagca

SEQ ID NO: 521727 - DNA, 20 bp, Artificial
  CRISPR gRNA sequence
agcataaaagctaaggggag

SEQ ID NO: 521728 - DNA, 20 bp, Artificial
  CRISPR gRNA sequence
aggggaggccgggcatggtg

SEQ ID NO: 521729 - DNA, 20 bp, Artificial
  CRISPR gRNA sequence
atgcctgtaatcccagcact

SEQ ID NO: 521730 - DNA, 20 bp, Artificial
  CRISPR gRNA sequence
taatcccagcactttgggag

SEQ ID NO: 521731 - DNA, 20 bp, Artificial
  CRISPR gRNA sequence
tgggaggctgaggcaggcgg

SEQ ID NO: 521732 - DNA, 20 bp, Artificial
  CRISPR gRNA sequence
gggaggctgaggcaggcgga

SEQ ID NO: 521733 - DNA, 20 bp, Artificial
  CRISPR gRNA sequence
ggaggctgaggcaggcggat

SEQ ID NO: 521734 - DNA, 20 bp, Artificial
  CRISPR gRNA sequence
aggcaggcggatcacctgag

SEQ ID NO: 521735 - DNA, 20 bp, Artificial
  CRISPR gRNA sequence
aggtcaggagtttgagacca

SEQ ID NO: 521736 - DNA, 20 bp, Artificial
  CRISPR gRNA sequence
gagaccagcctgagcaacat

SEQ ID NO: 521737 - DNA, 20 bp, Artificial
  CRISPR gRNA sequence
agaccagcctgagcaacata

SEQ ID NO: 521738 - DNA, 20 bp, Artificial
  CRISPR gRNA sequence
agcaacatagtgaaacccca

SEQ ID NO: 521739 - DNA, 20 bp, Artificial
  CRISPR gRNA sequence
tactaaaaatacataaatta

SEQ ID NO: 521740 - DNA, 20 bp, Artificial
  CRISPR gRNA sequence
ctaaaaatacataaattagc

SEQ ID NO: 521741 - DNA, 20 bp, Artificial
  CRISPR gRNA sequence
aaaatacataaattagctgg

SEQ ID NO: 521742 - DNA, 20 bp, Artificial
  CRISPR gRNA sequence
gctgggcttggtggcgggcg

SEQ ID NO: 521743 - DNA, 20 bp, Artificial
  CRISPR gRNA sequence
ggcttggtggcgggcgcctg

SEQ ID NO: 521744 - DNA, 20 bp, Artificial
  CRISPR gRNA sequence
ggtggcgggcgcctgtaatc

SEQ ID NO: 521745 - DNA, 20 bp, Artificial
  CRISPR gRNA sequence
gtggcgggcgcctgtaatcc

SEQ ID NO: 521746 - DNA, 20 bp, Artificial
  CRISPR gRNA sequence
taatcccagctactcgcgag

SEQ ID NO: 521747 - DNA, 20 bp, Artificial
  CRISPR gRNA sequence
ctcgcgaggctgaggcagga

SEQ ID NO: 521748 - DNA, 20 bp, Artificial
  CRISPR gRNA sequence
gcgaggctgaggcaggagaa

SEQ ID NO: 521749 - DNA, 20 bp, Artificial
  CRISPR gRNA sequence
aggcaggagaatcacttgag

SEQ ID NO: 521750 - DNA, 20 bp, Artificial
  CRISPR gRNA sequence
gagcccgggaggcagagggt

SEQ ID NO: 521751 - DNA, 20 bp, Artificial
  CRISPR gRNA sequence
agcccgggaggcagagggtg

SEQ ID NO: 521752 - DNA, 20 bp, Artificial
  CRISPR gRNA sequence
agatctcacctctgcactcc

SEQ ID NO: 521753 - DNA, 20 bp, Artificial
  CRISPR gRNA sequence
acctctgcactccagcctgg

SEQ ID NO: 521754 - DNA, 20 bp, Artificial
  CRISPR gRNA sequence
tgcactccagcctgggcaac

SEQ ID NO: 521755 - DNA, 20 bp, Artificial
  CRISPR gRNA sequence
cactccagcctgggcaacaa

SEQ ID NO: 521756 - DNA, 20 bp, Artificial
  CRISPR gRNA sequence
cagcctgggcaacaagagtg

SEQ ID NO: 521757 - DNA, 20 bp, Artificial
  CRISPR gRNA sequence
ggcaacaagagtgaaactgt

SEQ ID NO: 521758 - DNA, 20 bp, Artificial
  CRISPR gRNA sequence
tctcaaaagaaaaaaaaaaa

SEQ ID NO: 521759 - DNA, 20 bp, Artificial
  CRISPR gRNA sequence
aaaagaaaaaaaaaaaaaaa

SEQ ID NO: 521760 - DNA, 20 bp, Artificial
  CRISPR gRNA sequence
agggggaaaatagcaagaag

SEQ ID NO: 521761 - DNA, 20 bp, Artificial
  CRISPR gRNA sequence
taaaaatggcacatgttgta

SEQ ID NO: 521762 - DNA, 20 bp, Artificial
  CRISPR gRNA sequence
aaaatggcacatgttgtact

SEQ ID NO: 521763 - DNA, 20 bp, Artificial
  CRISPR gRNA sequence
tactaacaaattgcatagag

SEQ ID NO: 521764 - DNA, 20 bp, Artificial
  CRISPR gRNA sequence
acaaattgcatagaggaaat

SEQ ID NO: 521765 - DNA, 20 bp, Artificial
  CRISPR gRNA sequence
catagaggaaatagctatta

SEQ ID NO: 521766 - DNA, 20 bp, Artificial
  CRISPR gRNA sequence
ttatctctctagtgcaaaag

SEQ ID NO: 521767 - DNA, 20 bp, Artificial
  CRISPR gRNA sequence
tctctctagtgcaaaaggta

SEQ ID NO: 521768 - DNA, 20 bp, Artificial
  CRISPR gRNA sequence
tctagtgcaaaaggtaaatg

SEQ ID NO: 521769 - DNA, 20 bp, Artificial
  CRISPR gRNA sequence
tagtgcaaaaggtaaatggt

SEQ ID NO: 521770 - DNA, 20 bp, Artificial
  CRISPR gRNA sequence
gtgcaaaaggtaaatggtaa

SEQ ID NO: 521771 - DNA, 20 bp, Artificial
  CRISPR gRNA sequence
catctctaaagagatcttag

SEQ ID NO: 521772 - DNA, 20 bp, Artificial
  CRISPR gRNA sequence
atctctaaagagatcttaga

SEQ ID NO: 521773 - DNA, 20 bp, Artificial
  CRISPR gRNA sequence
taaagagatcttagaaatta

SEQ ID NO: 521774 - DNA, 20 bp, Artificial
  CRISPR gRNA sequence
aagagatcttagaaattaat

SEQ ID NO: 521775 - DNA, 20 bp, Artificial
  CRISPR gRNA sequence
agaaattaataacaaaaagg

SEQ ID NO: 521776 - DNA, 20 bp, Artificial
  CRISPR gRNA sequence
gaaattaataacaaaaaggt

SEQ ID NO: 521777 - DNA, 20 bp, Artificial
  CRISPR gRNA sequence
ataacaaaaaggtaaatact

SEQ ID NO: 521778 - DNA, 20 bp, Artificial
  CRISPR gRNA sequence
cattcaaggatgtttcaagg

SEQ ID NO: 521779 - DNA, 20 bp, Artificial
  CRISPR gRNA sequence
aaggatgtttcaagggtgtg

SEQ ID NO: 521780 - DNA, 20 bp, Artificial
  CRISPR gRNA sequence
caagggtgtggcaccctgag

SEQ ID NO: 521781 - DNA, 20 bp, Artificial
  CRISPR gRNA sequence
aagggtgtggcaccctgagc

SEQ ID NO: 521782 - DNA, 20 bp, Artificial
  CRISPR gRNA sequence
agcaggtaattcacaaaaga

SEQ ID NO: 521783 - DNA, 20 bp, Artificial
  CRISPR gRNA sequence
acaaaagaaggaagaaaact

SEQ ID NO: 521784 - DNA, 20 bp, Artificial
  CRISPR gRNA sequence
gctaagaaacatatgagtca

SEQ ID NO: 521785 - DNA, 20 bp, Artificial
  CRISPR gRNA sequence
agaaacatatgagtcacccc

SEQ ID NO: 521786 - DNA, 20 bp, Artificial
  CRISPR gRNA sequence
cagccaaaatatcttgattc

SEQ ID NO: 521787 - DNA, 20 bp, Artificial
  CRISPR gRNA sequence
agccaaaatatcttgattcc

SEQ ID NO: 521788 - DNA, 20 bp, Artificial
  CRISPR gRNA sequence
gattccctgtgtagccgtca

SEQ ID NO: 521789 - DNA, 20 bp, Artificial
  CRISPR gRNA sequence
attccctgtgtagccgtcaa

SEQ ID NO: 521790 - DNA, 20 bp, Artificial
  CRISPR gRNA sequence
cctgtgtagccgtcaacgtg

SEQ ID NO: 521791 - DNA, 20 bp, Artificial
  CRISPR gRNA sequence
tgtagccgtcaacgtgtaag

SEQ ID NO: 521792 - DNA, 20 bp, Artificial
  CRISPR gRNA sequence
tggcggtttcggtgcctgcg

SEQ ID NO: 521793 - DNA, 20 bp, Artificial
  CRISPR gRNA sequence
ggcggtttcggtgcctgcgc

SEQ ID NO: 521794 - DNA, 20 bp, Artificial
  CRISPR gRNA sequence
gcggtttcggtgcctgcgct

SEQ ID NO: 521795 - DNA, 20 bp, Artificial
  CRISPR gRNA sequence
cggtgcctgcgctatggagt

SEQ ID NO: 521796 - DNA, 20 bp, Artificial
  CRISPR gRNA sequence
ggtgcctgcgctatggagtc

SEQ ID NO: 521797 - DNA, 20 bp, Artificial
  CRISPR gRNA sequence
cgctatggagtcccacacag

SEQ ID NO: 521798 - DNA, 20 bp, Artificial
  CRISPR gRNA sequence
tggagtcccacacagcaacg

SEQ ID NO: 521799 - DNA, 20 bp, Artificial
  CRISPR gRNA sequence
ctcagggcagcttggcttcg

SEQ ID NO: 521800 - DNA, 20 bp, Artificial
  CRISPR gRNA sequence
agggcagcttggcttcgtgg

SEQ ID NO: 521801 - DNA, 20 bp, Artificial
  CRISPR gRNA sequence
ggcttcgtggtaaaagtgaa

SEQ ID NO: 521802 - DNA, 20 bp, Artificial
  CRISPR gRNA sequence
gcttcgtggtaaaagtgaat

SEQ ID NO: 521803 - DNA, 20 bp, Artificial
  CRISPR gRNA sequence
cgtggtaaaagtgaatttat

SEQ ID NO: 521804 - DNA, 20 bp, Artificial
  CRISPR gRNA sequence
gtggtaaaagtgaatttatg

SEQ ID NO: 521805 - DNA, 20 bp, Artificial
  CRISPR gRNA sequence
atggggaaaaaaagagagac

SEQ ID NO: 521806 - DNA, 20 bp, Artificial
  CRISPR gRNA sequence
tggggaaaaaaagagagaca

SEQ ID NO: 521807 - DNA, 20 bp, Artificial
  CRISPR gRNA sequence
caaaatattctgcatttctc

SEQ ID NO: 521808 - DNA, 20 bp, Artificial
  CRISPR gRNA sequence
tgcatttctctgggtggtgg

SEQ ID NO: 521809 - DNA, 20 bp, Artificial
  CRISPR gRNA sequence
catttctctgggtggtggca

SEQ ID NO: 521810 - DNA, 20 bp, Artificial
  CRISPR gRNA sequence
ctctgggtggtggcactatg

SEQ ID NO: 521811 - DNA, 20 bp, Artificial
  CRISPR gRNA sequence
tctgggtggtggcactatga

SEQ ID NO: 521812 - DNA, 20 bp, Artificial
  CRISPR gRNA sequence
tgggtggtggcactatgagt

SEQ ID NO: 521813 - DNA, 20 bp, Artificial
  CRISPR gRNA sequence
ggtggtggcactatgagtat

SEQ ID NO: 521814 - DNA, 20 bp, Artificial
  CRISPR gRNA sequence
tgagtattttcaattttcat

SEQ ID NO: 521815 - DNA, 20 bp, Artificial
  CRISPR gRNA sequence
tcaattttcattattcctgt

SEQ ID NO: 521816 - DNA, 20 bp, Artificial
  CRISPR gRNA sequence
caattttcattattcctgtt

SEQ ID NO: 521817 - DNA, 20 bp, Artificial
  CRISPR gRNA sequence
aattttcattattcctgttt

SEQ ID NO: 521818 - DNA, 20 bp, Artificial
  CRISPR gRNA sequence
tcattattcctgtttgtatt

SEQ ID NO: 521819 - DNA, 20 bp, Artificial
  CRISPR gRNA sequence
cattattcctgtttgtattt

SEQ ID NO: 521820 - DNA, 20 bp, Artificial
  CRISPR gRNA sequence
attattcctgtttgtatttt

SEQ ID NO: 521821 - DNA, 20 bp, Artificial
  CRISPR gRNA sequence
ttcctgtttgtattttccac

SEQ ID NO: 521822 - DNA, 20 bp, Artificial
  CRISPR gRNA sequence
ctgtttgtattttccaccct

SEQ ID NO: 521823 - DNA, 20 bp, Artificial
  CRISPR gRNA sequence
tttgtattttccaccctttt

SEQ ID NO: 521824 - DNA, 20 bp, Artificial
  CRISPR gRNA sequence
gtattttccaccctttttgt

SEQ ID NO: 521825 - DNA, 20 bp, Artificial
  CRISPR gRNA sequence
tattttccaccctttttgtg

SEQ ID NO: 521826 - DNA, 20 bp, Artificial
  CRISPR gRNA sequence
tccaccctttttgtgataaa

SEQ ID NO: 521827 - DNA, 20 bp, Artificial
  CRISPR gRNA sequence
ccaccctttttgtgataaat

SEQ ID NO: 521828 - DNA, 20 bp, Artificial
  CRISPR gRNA sequence
caccctttttgtgataaatg

SEQ ID NO: 521829 - DNA, 20 bp, Artificial
  CRISPR gRNA sequence
tttgtgataaatgaataaag

SEQ ID NO: 521830 - DNA, 20 bp, Artificial
  CRISPR gRNA sequence
ttgtgataaatgaataaagg

SEQ ID NO: 521831 - DNA, 20 bp, Artificial
  CRISPR gRNA sequence
tgtgataaatgaataaagga

SEQ ID NO: 521832 - DNA, 20 bp, Artificial
  CRISPR gRNA sequence
gtgataaatgaataaaggac

SEQ ID NO: 521833 - DNA, 20 bp, Artificial
  CRISPR gRNA sequence
tgataaatgaataaaggaca

SEQ ID NO: 521834 - DNA, 20 bp, Artificial
  CRISPR gRNA sequence
taaaaatggaatttcatggt

SEQ ID NO: 521835 - DNA, 20 bp, Artificial
  CRISPR gRNA sequence
aaaaatggaatttcatggtg

SEQ ID NO: 521836 - DNA, 20 bp, Artificial
  CRISPR gRNA sequence
aaaatggaatttcatggtgg

SEQ ID NO: 521837 - DNA, 20 bp, Artificial
  CRISPR gRNA sequence
catggtggccgacgaattat

SEQ ID NO: 521838 - DNA, 20 bp, Artificial
  CRISPR gRNA sequence
atggtggccgacgaattatg

SEQ ID NO: 521839 - DNA, 20 bp, Artificial
  CRISPR gRNA sequence
tgctgaaattgctccttcgg

SEQ ID NO: 521840 - DNA, 20 bp, Artificial
  CRISPR gRNA sequence
aaattgctccttcggattcc

SEQ ID NO: 521841 - DNA, 20 bp, Artificial
  CRISPR gRNA sequence
ctccttcggattccaaagct

SEQ ID NO: 521842 - DNA, 20 bp, Artificial
  CRISPR gRNA sequence
cttcggattccaaagctact

SEQ ID NO: 521843 - DNA, 20 bp, Artificial
  CRISPR gRNA sequence
cggattccaaagctactggc

SEQ ID NO: 521844 - DNA, 20 bp, Artificial
  CRISPR gRNA sequence
ggattccaaagctactggct

SEQ ID NO: 521845 - DNA, 20 bp, Artificial
  CRISPR gRNA sequence
caaagctactggctttcttg

SEQ ID NO: 521846 - DNA, 20 bp, Artificial
  CRISPR gRNA sequence
ctggctttcttgttcccact

SEQ ID NO: 521847 - DNA, 20 bp, Artificial
  CRISPR gRNA sequence
gctttcttgttcccactgtg

SEQ ID NO: 521848 - DNA, 20 bp, Artificial
  CRISPR gRNA sequence
tcttgttcccactgtgacgt

SEQ ID NO: 521849 - DNA, 20 bp, Artificial
  CRISPR gRNA sequence
cttgttcccactgtgacgtt

SEQ ID NO: 521850 - DNA, 20 bp, Artificial
  CRISPR gRNA sequence
ttgttcccactgtgacgttg

SEQ ID NO: 521851 - DNA, 20 bp, Artificial
  CRISPR gRNA sequence
gttcccactgtgacgttgat

SEQ ID NO: 521852 - DNA, 20 bp, Artificial
  CRISPR gRNA sequence
ttcccactgtgacgttgatg

SEQ ID NO: 521853 - DNA, 20 bp, Artificial
  CRISPR gRNA sequence
ccactgtgacgttgatgagg

SEQ ID NO: 521854 - DNA, 20 bp, Artificial
  CRISPR gRNA sequence
tgacgttgatgaggacgctg

SEQ ID NO: 521855 - DNA, 20 bp, Artificial
  CRISPR gRNA sequence
atgaggacgctgcttcatgg

SEQ ID NO: 521856 - DNA, 20 bp, Artificial
  CRISPR gRNA sequence
cttcatggcagtgggacctc

SEQ ID NO: 521857 - DNA, 20 bp, Artificial
  CRISPR gRNA sequence
catggcagtgggacctccct

SEQ ID NO: 521858 - DNA, 20 bp, Artificial
  CRISPR gRNA sequence
atggcagtgggacctccctg

SEQ ID NO: 521859 - DNA, 20 bp, Artificial
  CRISPR gRNA sequence
cctgctggcatgggcttgtt

SEQ ID NO: 521860 - DNA, 20 bp, Artificial
  CRISPR gRNA sequence
ctggcatgggcttgttgcca

SEQ ID NO: 521861 - DNA, 20 bp, Artificial
  CRISPR gRNA sequence
gcatgggcttgttgccactg

SEQ ID NO: 521862 - DNA, 20 bp, Artificial
  CRISPR gRNA sequence
gttgccactgtcactcaccc

SEQ ID NO: 521863 - DNA, 20 bp, Artificial
  CRISPR gRNA sequence
ttgccactgtcactcaccca

SEQ ID NO: 521864 - DNA, 20 bp, Artificial
  CRISPR gRNA sequence
ccactgtcactcacccattc

SEQ ID NO: 521865 - DNA, 20 bp, Artificial
  CRISPR gRNA sequence
tcactcacccattcacccat

SEQ ID NO: 521866 - DNA, 20 bp, Artificial
  CRISPR gRNA sequence
acccattcacccatccatgg

SEQ ID NO: 521867 - DNA, 20 bp, Artificial
  CRISPR gRNA sequence
acccatccatgggacagggg

SEQ ID NO: 521868 - DNA, 20 bp, Artificial
  CRISPR gRNA sequence
gccagcctctcctctaggca

SEQ ID NO: 521869 - DNA, 20 bp, Artificial
  CRISPR gRNA sequence
ccagcctctcctctaggcac

SEQ ID NO: 521870 - DNA, 20 bp, Artificial
  CRISPR gRNA sequence
tcctctaggcacggcgcagg

SEQ ID NO: 521871 - DNA, 20 bp, Artificial
  CRISPR gRNA sequence
ctctaggcacggcgcagggg

SEQ ID NO: 521872 - DNA, 20 bp, Artificial
  CRISPR gRNA sequence
taggcacggcgcaggggctg

SEQ ID NO: 521873 - DNA, 20 bp, Artificial
  CRISPR gRNA sequence
ggcacggcgcaggggctgag

SEQ ID NO: 521874 - DNA, 20 bp, Artificial
  CRISPR gRNA sequence
agagctgcactccaggactc

SEQ ID NO: 521875 - DNA, 20 bp, Artificial
  CRISPR gRNA sequence
cactccaggactcctggact

SEQ ID NO: 521876 - DNA, 20 bp, Artificial
  CRISPR gRNA sequence
caggactcctggactctgcc

SEQ ID NO: 521877 - DNA, 20 bp, Artificial
  CRISPR gRNA sequence
ctggactctgccctctgctg

SEQ ID NO: 521878 - DNA, 20 bp, Artificial
  CRISPR gRNA sequence
gactctgccctctgctgaga

SEQ ID NO: 521879 - DNA, 20 bp, Artificial
  CRISPR gRNA sequence
tgccctctgctgagactctc

SEQ ID NO: 521880 - DNA, 20 bp, Artificial
  CRISPR gRNA sequence
ccctctgctgagactctcag

SEQ ID NO: 521881 - DNA, 20 bp, Artificial
  CRISPR gRNA sequence
tgctgagactctcagcacct

SEQ ID NO: 521882 - DNA, 20 bp, Artificial
  CRISPR gRNA sequence
ctgagactctcagcacctct

SEQ ID NO: 521883 - DNA, 20 bp, Artificial
  CRISPR gRNA sequence
agactctcagcacctctttt

SEQ ID NO: 521884 - DNA, 20 bp, Artificial
  CRISPR gRNA sequence
tcagcacctcttttccccaa

SEQ ID NO: 521885 - DNA, 20 bp, Artificial
  CRISPR gRNA sequence
agcacctcttttccccaaca

SEQ ID NO: 521886 - DNA, 20 bp, Artificial
  CRISPR gRNA sequence
ttttccccaacacctacccc

SEQ ID NO: 521887 - DNA, 20 bp, Artificial
  CRISPR gRNA sequence
ttccccaacacctaccccaa

SEQ ID NO: 521888 - DNA, 20 bp, Artificial
  CRISPR gRNA sequence
tccccaacacctaccccaag

SEQ ID NO: 521889 - DNA, 20 bp, Artificial
  CRISPR gRNA sequence
ccccaacacctaccccaagt

SEQ ID NO: 521890 - DNA, 20 bp, Artificial
  CRISPR gRNA sequence
cccaacacctaccccaagtt

SEQ ID NO: 521891 - DNA, 20 bp, Artificial
  CRISPR gRNA sequence
ccccaagtttccatcacaca

SEQ ID NO: 521892 - DNA, 20 bp, Artificial
  CRISPR gRNA sequence
ccatcacacacagaaacctc

SEQ ID NO: 521893 - DNA, 20 bp, Artificial
  CRISPR gRNA sequence
catcacacacagaaacctcc

SEQ ID NO: 521894 - DNA, 20 bp, Artificial
  CRISPR gRNA sequence
caccactcccaacaccaaca

SEQ ID NO: 521895 - DNA, 20 bp, Artificial
  CRISPR gRNA sequence
ccaacaccaacatgtgtccc

SEQ ID NO: 521896 - DNA, 20 bp, Artificial
  CRISPR gRNA sequence
tttacaaatcagctgggcag

SEQ ID NO: 521897 - DNA, 20 bp, Artificial
  CRISPR gRNA sequence
acaaatcagctgggcaggaa

SEQ ID NO: 521898 - DNA, 20 bp, Artificial
  CRISPR gRNA sequence
caaatcagctgggcaggaag

SEQ ID NO: 521899 - DNA, 20 bp, Artificial
  CRISPR gRNA sequence
ggcaggaaggtgttcccctg

SEQ ID NO: 521900 - DNA, 20 bp, Artificial
  CRISPR gRNA sequence
ccctggggctaactcttctg

SEQ ID NO: 521901 - DNA, 20 bp, Artificial
  CRISPR gRNA sequence
gggctaactcttctgcactc

SEQ ID NO: 521902 - DNA, 20 bp, Artificial
  CRISPR gRNA sequence
actcttctgcactctcagac

SEQ ID NO: 521903 - DNA, 20 bp, Artificial
  CRISPR gRNA sequence
ttctgcactctcagaccctg

SEQ ID NO: 521904 - DNA, 20 bp, Artificial
  CRISPR gRNA sequence
ctgcactctcagaccctgaa

SEQ ID NO: 521905 - DNA, 20 bp, Artificial
  CRISPR gRNA sequence
tgcactctcagaccctgaat

SEQ ID NO: 521906 - DNA, 20 bp, Artificial
  CRISPR gRNA sequence
cactctcagaccctgaatgg

SEQ ID NO: 521907 - DNA, 20 bp, Artificial
  CRISPR gRNA sequence
tcagaccctgaatggccgga

SEQ ID NO: 521908 - DNA, 20 bp, Artificial
  CRISPR gRNA sequence
agaccctgaatggccggaga

SEQ ID NO: 521909 - DNA, 20 bp, Artificial
  CRISPR gRNA sequence
aatggccggagagaacacgc

SEQ ID NO: 521910 - DNA, 20 bp, Artificial
  CRISPR gRNA sequence
agctcaggacagcaccaggg

SEQ ID NO: 521911 - DNA, 20 bp, Artificial
  CRISPR gRNA sequence
aggacagcaccagggccctc

SEQ ID NO: 521912 - DNA, 20 bp, Artificial
  CRISPR gRNA sequence
tgtgcttgctcagggcctgg

SEQ ID NO: 521913 - DNA, 20 bp, Artificial
  CRISPR gRNA sequence
tgcttgctcagggcctgggc

SEQ ID NO: 521914 - DNA, 20 bp, Artificial
  CRISPR gRNA sequence
gctcagggcctgggctccac

SEQ ID NO: 521915 - DNA, 20 bp, Artificial
  CRISPR gRNA sequence
ctcagggcctgggctccaca

SEQ ID NO: 521916 - DNA, 20 bp, Artificial
  CRISPR gRNA sequence
agggcctgggctccacacac

SEQ ID NO: 521917 - DNA, 20 bp, Artificial
  CRISPR gRNA sequence
ggctccacacacatgggctc

SEQ ID NO: 521918 - DNA, 20 bp, Artificial
  CRISPR gRNA sequence
cacacacatgggctcggaat

SEQ ID NO: 521919 - DNA, 20 bp, Artificial
  CRISPR gRNA sequence
ggaatcgacaaatgcaacca

SEQ ID NO: 521920 - DNA, 20 bp, Artificial
  CRISPR gRNA sequence
atcaatgccccgtgtcagtg

SEQ ID NO: 521921 - DNA, 20 bp, Artificial
  CRISPR gRNA sequence
gtgccaagcagaatgggagg

SEQ ID NO: 521922 - DNA, 20 bp, Artificial
  CRISPR gRNA sequence
tgccaagcagaatgggaggg

SEQ ID NO: 521923 - DNA, 20 bp, Artificial
  CRISPR gRNA sequence
ctggcaccaggtccggcttg

SEQ ID NO: 521924 - DNA, 20 bp, Artificial
  CRISPR gRNA sequence
gcaccaggtccggcttgggg

SEQ ID NO: 521925 - DNA, 20 bp, Artificial
  CRISPR gRNA sequence
ggggtgggtatcacccacag

SEQ ID NO: 521926 - DNA, 20 bp, Artificial
  CRISPR gRNA sequence
gggtgggtatcacccacagc

SEQ ID NO: 521927 - DNA, 20 bp, Artificial
  CRISPR gRNA sequence
cataattgctaggcgcccac

SEQ ID NO: 521928 - DNA, 20 bp, Artificial
  CRISPR gRNA sequence
ctaggcgcccactgcagagc

SEQ ID NO: 521929 - DNA, 20 bp, Artificial
  CRISPR gRNA sequence
ggcgcccactgcagagcccc

SEQ ID NO: 521930 - DNA, 20 bp, Artificial
  CRISPR gRNA sequence
cagagccccttgagttgggg

SEQ ID NO: 521931 - DNA, 20 bp, Artificial
  CRISPR gRNA sequence
gagttggggcttcccagcga

SEQ ID NO: 521932 - DNA, 20 bp, Artificial
  CRISPR gRNA sequence
agttggggcttcccagcgac

SEQ ID NO: 521933 - DNA, 20 bp, Artificial
  CRISPR gRNA sequence
gggcttcccagcgacctggc

SEQ ID NO: 521934 - DNA, 20 bp, Artificial
  CRISPR gRNA sequence
cccagcgacctggcctgtac

SEQ ID NO: 521935 - DNA, 20 bp, Artificial
  CRISPR gRNA sequence
ccagcgacctggcctgtacc

SEQ ID NO: 521936 - DNA, 20 bp, Artificial
  CRISPR gRNA sequence
gcctgtacctgctgggcaaa

SEQ ID NO: 521937 - DNA, 20 bp, Artificial
  CRISPR gRNA sequence
tacctgctgggcaaatgcct

SEQ ID NO: 521938 - DNA, 20 bp, Artificial
  CRISPR gRNA sequence
ctgggcaaatgcctgtgtca

SEQ ID NO: 521939 - DNA, 20 bp, Artificial
  CRISPR gRNA sequence
ggcaaatgcctgtgtcactg

SEQ ID NO: 521940 - DNA, 20 bp, Artificial
  CRISPR gRNA sequence
tgtcactgacccctgtggca

SEQ ID NO: 521941 - DNA, 20 bp, Artificial
  CRISPR gRNA sequence
acccctgtggcagctggcat

SEQ ID NO: 521942 - DNA, 20 bp, Artificial
  CRISPR gRNA sequence
tggcagctggcattctcctc

SEQ ID NO: 521943 - DNA, 20 bp, Artificial
  CRISPR gRNA sequence
gcattctcctccgggaacgg

SEQ ID NO: 521944 - DNA, 20 bp, Artificial
  CRISPR gRNA sequence
tcctccgggaacgggagcca

SEQ ID NO: 521945 - DNA, 20 bp, Artificial
  CRISPR gRNA sequence
ctccgggaacgggagccagc

SEQ ID NO: 521946 - DNA, 20 bp, Artificial
  CRISPR gRNA sequence
cgggaacgggagccagcctc

SEQ ID NO: 521947 - DNA, 20 bp, Artificial
  CRISPR gRNA sequence
cggtgacatggcctcaggca

SEQ ID NO: 521948 - DNA, 20 bp, Artificial
  CRISPR gRNA sequence
aggcaggaccacggttctct

SEQ ID NO: 521949 - DNA, 20 bp, Artificial
  CRISPR gRNA sequence
tctgacacaggacacgagtg

SEQ ID NO: 521950 - DNA, 20 bp, Artificial
  CRISPR gRNA sequence
tgacacaggacacgagtgca

SEQ ID NO: 521951 - DNA, 20 bp, Artificial
  CRISPR gRNA sequence
acacaggacacgagtgcagc

SEQ ID NO: 521952 - DNA, 20 bp, Artificial
  CRISPR gRNA sequence
ttccatggaatcgccacagg

SEQ ID NO: 521953 - DNA, 20 bp, Artificial
  CRISPR gRNA sequence
catggaatcgccacaggcgt

SEQ ID NO: 521954 - DNA, 20 bp, Artificial
  CRISPR gRNA sequence
ccccatccacagaggcaaat

SEQ ID NO: 521955 - DNA, 20 bp, Artificial
  CRISPR gRNA sequence
gtacctggtggggcccggcc

SEQ ID NO: 521956 - DNA, 20 bp, Artificial
  CRISPR gRNA sequence
gtggggcccggcctgggcca

SEQ ID NO: 521957 - DNA, 20 bp, Artificial
  CRISPR gRNA sequence
ggccagagtggacagacctg

SEQ ID NO: 521958 - DNA, 20 bp, Artificial
  CRISPR gRNA sequence
ggcctggcaggagccctggg

SEQ ID NO: 521959 - DNA, 20 bp, Artificial
  CRISPR gRNA sequence
gcaggagccctggggaagtg

SEQ ID NO: 521960 - DNA, 20 bp, Artificial
  CRISPR gRNA sequence
gggaagtgagttcaagttac

SEQ ID NO: 521961 - DNA, 20 bp, Artificial
  CRISPR gRNA sequence
aagttacacggttgactata

SEQ ID NO: 521962 - DNA, 20 bp, Artificial
  CRISPR gRNA sequence
cacggttgactatagagaca

SEQ ID NO: 521963 - DNA, 20 bp, Artificial
  CRISPR gRNA sequence
actatagagacagctggagt

SEQ ID NO: 521964 - DNA, 20 bp, Artificial
  CRISPR gRNA sequence
tagagacagctggagtgcgc

SEQ ID NO: 521965 - DNA, 20 bp, Artificial
  CRISPR gRNA sequence
gagtgcgcacaattggccag

SEQ ID NO: 521966 - DNA, 20 bp, Artificial
  CRISPR gRNA sequence
gccagaccacccctcctgtt

SEQ ID NO: 521967 - DNA, 20 bp, Artificial
  CRISPR gRNA sequence
ctgtttcacagatggggaaa

SEQ ID NO: 521968 - DNA, 20 bp, Artificial
  CRISPR gRNA sequence
tttcacagatggggaaactg

SEQ ID NO: 521969 - DNA, 20 bp, Artificial
  CRISPR gRNA sequence
cacagatggggaaactgagt

SEQ ID NO: 521970 - DNA, 20 bp, Artificial
  CRISPR gRNA sequence
acagatggggaaactgagtc

SEQ ID NO: 521971 - DNA, 20 bp, Artificial
  CRISPR gRNA sequence
agtcacgggggaccaaatag

SEQ ID NO: 521972 - DNA, 20 bp, Artificial
  CRISPR gRNA sequence
ctcaccccatgccccttcca

SEQ ID NO: 521973 - DNA, 20 bp, Artificial
  CRISPR gRNA sequence
accccatgccccttccagac

SEQ ID NO: 521974 - DNA, 20 bp, Artificial
  CRISPR gRNA sequence
ccagacagggtgcagatagg

SEQ ID NO: 521975 - DNA, 20 bp, Artificial
  CRISPR gRNA sequence
cagacagggtgcagataggg

SEQ ID NO: 521976 - DNA, 20 bp, Artificial
  CRISPR gRNA sequence
ccatctcctggatggccgcg

SEQ ID NO: 521977 - DNA, 20 bp, Artificial
  CRISPR gRNA sequence
ctggatggccgcggcccctg

SEQ ID NO: 521978 - DNA, 20 bp, Artificial
  CRISPR gRNA sequence
gatggccgcggcccctgtgc

SEQ ID NO: 521979 - DNA, 20 bp, Artificial
  CRISPR gRNA sequence
tgcagaacttccttcatggg

SEQ ID NO: 521980 - DNA, 20 bp, Artificial
  CRISPR gRNA sequence
ccttcatgggcacctcgctg

SEQ ID NO: 521981 - DNA, 20 bp, Artificial
  CRISPR gRNA sequence
cttcatgggcacctcgctgt

SEQ ID NO: 521982 - DNA, 20 bp, Artificial
  CRISPR gRNA sequence
catgggcacctcgctgtctg

SEQ ID NO: 521983 - DNA, 20 bp, Artificial
  CRISPR gRNA sequence
atgggcacctcgctgtctgg

SEQ ID NO: 521984 - DNA, 20 bp, Artificial
  CRISPR gRNA sequence
gctgtctgggggcctcttcc

SEQ ID NO: 521985 - DNA, 20 bp, Artificial
  CRISPR gRNA sequence
tctgggggcctcttccccag

SEQ ID NO: 521986 - DNA, 20 bp, Artificial
  CRISPR gRNA sequence
ggggcctcttccccagggag

SEQ ID NO: 521987 - DNA, 20 bp, Artificial
  CRISPR gRNA sequence
ttccccagggagtctcctgg

SEQ ID NO: 521988 - DNA, 20 bp, Artificial
  CRISPR gRNA sequence
ccccagggagtctcctggtg

SEQ ID NO: 521989 - DNA, 20 bp, Artificial
  CRISPR gRNA sequence
cccagggagtctcctggtgg

SEQ ID NO: 521990 - DNA, 20 bp, Artificial
  CRISPR gRNA sequence
ctggtggtggccgtgttgcc

SEQ ID NO: 521991 - DNA, 20 bp, Artificial
  CRISPR gRNA sequence
gtggtggccgtgttgcctca

SEQ ID NO: 521992 - DNA, 20 bp, Artificial
  CRISPR gRNA sequence
cctcaggctcactgtgcact

SEQ ID NO: 521993 - DNA, 20 bp, Artificial
  CRISPR gRNA sequence
aggctcactgtgcactaggc

SEQ ID NO: 521994 - DNA, 20 bp, Artificial
  CRISPR gRNA sequence
actgtgcactaggcaggtca

SEQ ID NO: 521995 - DNA, 20 bp, Artificial
  CRISPR gRNA sequence
tgcactaggcaggtcacgtc

SEQ ID NO: 521996 - DNA, 20 bp, Artificial
  CRISPR gRNA sequence
ggcaggtcacgtcgatgccg

SEQ ID NO: 521997 - DNA, 20 bp, Artificial
  CRISPR gRNA sequence
aggggcaggggttaccaccc

SEQ ID NO: 521998 - DNA, 20 bp, Artificial
  CRISPR gRNA sequence
ccaccctgtggttcaggtga

SEQ ID NO: 521999 - DNA, 20 bp, Artificial
  CRISPR gRNA sequence
tggttcaggtgagaagctcc

SEQ ID NO: 522000 - DNA, 20 bp, Artificial
  CRISPR gRNA sequence
aggtgagaagctccaggctc

SEQ ID NO: 522001 - DNA, 20 bp, Artificial
  CRISPR gRNA sequence
caggctcaggagtgtccagc

SEQ ID NO: 522002 - DNA, 20 bp, Artificial
  CRISPR gRNA sequence
aggagtgtccagctgcctgg

SEQ ID NO: 522003 - DNA, 20 bp, Artificial
  CRISPR gRNA sequence
cctgggcagtgtttggatct

SEQ ID NO: 522004 - DNA, 20 bp, Artificial
  CRISPR gRNA sequence
ggcagtgtttggatctcatg

SEQ ID NO: 522005 - DNA, 20 bp, Artificial
  CRISPR gRNA sequence
ggatctcatgccagcccctg

SEQ ID NO: 522006 - DNA, 20 bp, Artificial
  CRISPR gRNA sequence
gatctcatgccagcccctgc

SEQ ID NO: 522007 - DNA, 20 bp, Artificial
  CRISPR gRNA sequence
atgccagcccctgccaggag

SEQ ID NO: 522008 - DNA, 20 bp, Artificial
  CRISPR gRNA sequence
ccaggaggccctgcttctcc

SEQ ID NO: 522009 - DNA, 20 bp, Artificial
  CRISPR gRNA sequence
cttctccagcccagcccacg

SEQ ID NO: 522010 - DNA, 20 bp, Artificial
  CRISPR gRNA sequence
ctccagcccagcccacgccc

SEQ ID NO: 522011 - DNA, 20 bp, Artificial
  CRISPR gRNA sequence
tccagcccagcccacgccca

SEQ ID NO: 522012 - DNA, 20 bp, Artificial
  CRISPR gRNA sequence
cagcccagcccacgcccacc

SEQ ID NO: 522013 - DNA, 20 bp, Artificial
  CRISPR gRNA sequence
tttactcccttgaggcaaag

SEQ ID NO: 522014 - DNA, 20 bp, Artificial
  CRISPR gRNA sequence
actcccttgaggcaaaggcc

SEQ ID NO: 522015 - DNA, 20 bp, Artificial
  CRISPR gRNA sequence
ctcccttgaggcaaaggccc

SEQ ID NO: 522016 - DNA, 20 bp, Artificial
  CRISPR gRNA sequence
ccttgaggcaaaggcccttg

SEQ ID NO: 522017 - DNA, 20 bp, Artificial
  CRISPR gRNA sequence
gaggcaaaggcccttgggtg

SEQ ID NO: 522018 - DNA, 20 bp, Artificial
  CRISPR gRNA sequence
aggcaaaggcccttgggtgg

SEQ ID NO: 522019 - DNA, 20 bp, Artificial
  CRISPR gRNA sequence
gggtggctaagcgtcccctc

SEQ ID NO: 522020 - DNA, 20 bp, Artificial
  CRISPR gRNA sequence
ggtggctaagcgtcccctct

SEQ ID NO: 522021 - DNA, 20 bp, Artificial
  CRISPR gRNA sequence
agcgtcccctctcccagcac

SEQ ID NO: 522022 - DNA, 20 bp, Artificial
  CRISPR gRNA sequence
tcccagcactcggagctgag

SEQ ID NO: 522023 - DNA, 20 bp, Artificial
  CRISPR gRNA sequence
ccagcactcggagctgagcg

SEQ ID NO: 522024 - DNA, 20 bp, Artificial
  CRISPR gRNA sequence
ggagctgagcgtcccctctc

SEQ ID NO: 522025 - DNA, 20 bp, Artificial
  CRISPR gRNA sequence
agcgtcccctctcccagcac

SEQ ID NO: 522026 - DNA, 20 bp, Artificial
  CRISPR gRNA sequence
tcccagcactcggagctgag

SEQ ID NO: 522027 - DNA, 20 bp, Artificial
  CRISPR gRNA sequence
ccagcactcggagctgagca

SEQ ID NO: 522028 - DNA, 20 bp, Artificial
  CRISPR gRNA sequence
ggagctgagcattcccctct

SEQ ID NO: 522029 - DNA, 20 bp, Artificial
  CRISPR gRNA sequence
agcattcccctctcccagca

SEQ ID NO: 522030 - DNA, 20 bp, Artificial
  CRISPR gRNA sequence
ccctctcccagcactcggag

SEQ ID NO: 522031 - DNA, 20 bp, Artificial
  CRISPR gRNA sequence
tcccagcactcggaggcacc

SEQ ID NO: 522032 - DNA, 20 bp, Artificial
  CRISPR gRNA sequence
ccagcactcggaggcacctg

SEQ ID NO: 522033 - DNA, 20 bp, Artificial
  CRISPR gRNA sequence
ggaggcacctgcagttgctc

SEQ ID NO: 522034 - DNA, 20 bp, Artificial
  CRISPR gRNA sequence
cagttgctcagctgttcatt

SEQ ID NO: 522035 - DNA, 20 bp, Artificial
  CRISPR gRNA sequence
ctcagctgttcattgagtgc

SEQ ID NO: 522036 - DNA, 20 bp, Artificial
  CRISPR gRNA sequence
agctgttcattgagtgctgg

SEQ ID NO: 522037 - DNA, 20 bp, Artificial
  CRISPR gRNA sequence
ttcattgagtgctgggagtg

SEQ ID NO: 522038 - DNA, 20 bp, Artificial
  CRISPR gRNA sequence
attgagtgctgggagtggaa

SEQ ID NO: 522039 - DNA, 20 bp, Artificial
  CRISPR gRNA sequence
agtgctgggagtggaaactc

SEQ ID NO: 522040 - DNA, 20 bp, Artificial
  CRISPR gRNA sequence
ggagtggaaactcatacgct

SEQ ID NO: 522041 - DNA, 20 bp, Artificial
  CRISPR gRNA sequence
atacgctgagcggcagtgac

SEQ ID NO: 522042 - DNA, 20 bp, Artificial
  CRISPR gRNA sequence
agcggcagtgacgctgcgga

SEQ ID NO: 522043 - DNA, 20 bp, Artificial
  CRISPR gRNA sequence
cggagctgacaaaccccaca

SEQ ID NO: 522044 - DNA, 20 bp, Artificial
  CRISPR gRNA sequence
acaaaccccacagcccgccc

SEQ ID NO: 522045 - DNA, 20 bp, Artificial
  CRISPR gRNA sequence
cttcaccgagggccacagcc

SEQ ID NO: 522046 - DNA, 20 bp, Artificial
  CRISPR gRNA sequence
caccgagggccacagccccc

SEQ ID NO: 522047 - DNA, 20 bp, Artificial
  CRISPR gRNA sequence
accgagggccacagcccccc

SEQ ID NO: 522048 - DNA, 20 bp, Artificial
  CRISPR gRNA sequence
gccatgtgggacatctgttc

SEQ ID NO: 522049 - DNA, 20 bp, Artificial
  CRISPR gRNA sequence
ttctgtggccctgctcagga

SEQ ID NO: 522050 - DNA, 20 bp, Artificial
  CRISPR gRNA sequence
tgtggccctgctcaggatgg

SEQ ID NO: 522051 - DNA, 20 bp, Artificial
  CRISPR gRNA sequence
tggccctgctcaggatggca

SEQ ID NO: 522052 - DNA, 20 bp, Artificial
  CRISPR gRNA sequence
ctcaggatggcacccggcgg

SEQ ID NO: 522053 - DNA, 20 bp, Artificial
  CRISPR gRNA sequence
aggatggcacccggcgggga

SEQ ID NO: 522054 - DNA, 20 bp, Artificial
  CRISPR gRNA sequence
gccctggggccgaggcatgg

SEQ ID NO: 522055 - DNA, 20 bp, Artificial
  CRISPR gRNA sequence
gggccgaggcatgggctcag

SEQ ID NO: 522056 - DNA, 20 bp, Artificial
  CRISPR gRNA sequence
agccgccgccctgcagggac

SEQ ID NO: 522057 - DNA, 20 bp, Artificial
  CRISPR gRNA sequence
cagggacgtagccagggacc

SEQ ID NO: 522058 - DNA, 20 bp, Artificial
  CRISPR gRNA sequence
ttcccagcagagggactccc

SEQ ID NO: 522059 - DNA, 20 bp, Artificial
  CRISPR gRNA sequence
cccagcagagggactccccc

SEQ ID NO: 522060 - DNA, 20 bp, Artificial
  CRISPR gRNA sequence
ccagcagagggactccccca

SEQ ID NO: 522061 - DNA, 20 bp, Artificial
  CRISPR gRNA sequence
ccccactcatccccagaata

SEQ ID NO: 522062 - DNA, 20 bp, Artificial
  CRISPR gRNA sequence
atccccagaatactgagggg

SEQ ID NO: 522063 - DNA, 20 bp, Artificial
  CRISPR gRNA sequence
aggggcacgctgggtgccag

SEQ ID NO: 522064 - DNA, 20 bp, Artificial
  CRISPR gRNA sequence
ggtgccaggctggcagggac

SEQ ID NO: 522065 - DNA, 20 bp, Artificial
  CRISPR gRNA sequence
gcagggaccctggggattct

SEQ ID NO: 522066 - DNA, 20 bp, Artificial
  CRISPR gRNA sequence
gggattctgctgtgagctgg

SEQ ID NO: 522067 - DNA, 20 bp, Artificial
  CRISPR gRNA sequence
tgctgtgagctggatgggga

SEQ ID NO: 522068 - DNA, 20 bp, Artificial
  CRISPR gRNA sequence
ctgtgagctggatggggaag

SEQ ID NO: 522069 - DNA, 20 bp, Artificial
  CRISPR gRNA sequence
tgagctggatggggaaggag

SEQ ID NO: 522070 - DNA, 20 bp, Artificial
  CRISPR gRNA sequence
gatggggaaggagttccttc

SEQ ID NO: 522071 - DNA, 20 bp, Artificial
  CRISPR gRNA sequence
cttcctaaaatgtggagtct

SEQ ID NO: 522072 - DNA, 20 bp, Artificial
  CRISPR gRNA sequence
cctaaaatgtggagtctgga

SEQ ID NO: 522073 - DNA, 20 bp, Artificial
  CRISPR gRNA sequence
ctaaaatgtggagtctggag

SEQ ID NO: 522074 - DNA, 20 bp, Artificial
  CRISPR gRNA sequence
aaatgtggagtctggaggcc

SEQ ID NO: 522075 - DNA, 20 bp, Artificial
  CRISPR gRNA sequence
gaggccactcttggtaaagt

SEQ ID NO: 522076 - DNA, 20 bp, Artificial
  CRISPR gRNA sequence
ttggtaaagtgctggccccc

SEQ ID NO: 522077 - DNA, 20 bp, Artificial
  CRISPR gRNA sequence
ggtaaagtgctggcccccgg

SEQ ID NO: 522078 - DNA, 20 bp, Artificial
  CRISPR gRNA sequence
gtaaagtgctggcccccggg

SEQ ID NO: 522079 - DNA, 20 bp, Artificial
  CRISPR gRNA sequence
gcccccggggattctgcagt

SEQ ID NO: 522080 - DNA, 20 bp, Artificial
  CRISPR gRNA sequence
tgcagtgagctgggcatgga

SEQ ID NO: 522081 - DNA, 20 bp, Artificial
  CRISPR gRNA sequence
cagtgagctgggcatggatt

SEQ ID NO: 522082 - DNA, 20 bp, Artificial
  CRISPR gRNA sequence
ggcatggattctgcagtgag

SEQ ID NO: 522083 - DNA, 20 bp, Artificial
  CRISPR gRNA sequence
tgcagtgagctgggcttcac

SEQ ID NO: 522084 - DNA, 20 bp, Artificial
  CRISPR gRNA sequence
cagtgagctgggcttcactc

SEQ ID NO: 522085 - DNA, 20 bp, Artificial
  CRISPR gRNA sequence
ggcttcactcatggtgaaac

SEQ ID NO: 522086 - DNA, 20 bp, Artificial
  CRISPR gRNA sequence
cactcatggtgaaacgctgg

SEQ ID NO: 522087 - DNA, 20 bp, Artificial
  CRISPR gRNA sequence
actcatggtgaaacgctggg

SEQ ID NO: 522088 - DNA, 20 bp, Artificial
  CRISPR gRNA sequence
atggtgaaacgctggggtga

SEQ ID NO: 522089 - DNA, 20 bp, Artificial
  CRISPR gRNA sequence
gggtgacggcagacagccca

SEQ ID NO: 522090 - DNA, 20 bp, Artificial
  CRISPR gRNA sequence
ctagcagctcatttctgtga

SEQ ID NO: 522091 - DNA, 20 bp, Artificial
  CRISPR gRNA sequence
tagcagctcatttctgtgaa

SEQ ID NO: 522092 - DNA, 20 bp, Artificial
  CRISPR gRNA sequence
gcagctcatttctgtgaagc

SEQ ID NO: 522093 - DNA, 20 bp, Artificial
  CRISPR gRNA sequence
atttctgtgaagcctccaga

SEQ ID NO: 522094 - DNA, 20 bp, Artificial
  CRISPR gRNA sequence
ctgtgaagcctccagaatcc

SEQ ID NO: 522095 - DNA, 20 bp, Artificial
  CRISPR gRNA sequence
tgtgaagcctccagaatccg

SEQ ID NO: 522096 - DNA, 20 bp, Artificial
  CRISPR gRNA sequence
tgaagcctccagaatccggc

SEQ ID NO: 522097 - DNA, 20 bp, Artificial
  CRISPR gRNA sequence
cagaatccggcctcagcccc

SEQ ID NO: 522098 - DNA, 20 bp, Artificial
  CRISPR gRNA sequence
agcccccaaacccgcaggcg

SEQ ID NO: 522099 - DNA, 20 bp, Artificial
  CRISPR gRNA sequence
cgccaccgtcacggggaagg

SEQ ID NO: 522100 - DNA, 20 bp, Artificial
  CRISPR gRNA sequence
tgcccccacagctcgctccc

SEQ ID NO: 522101 - DNA, 20 bp, Artificial
  CRISPR gRNA sequence
gctcccaggctgagctctcc

SEQ ID NO: 522102 - DNA, 20 bp, Artificial
  CRISPR gRNA sequence
ccaggctgagctctccggcc

SEQ ID NO: 522103 - DNA, 20 bp, Artificial
  CRISPR gRNA sequence
agctctccggccatcccccc

SEQ ID NO: 522104 - DNA, 20 bp, Artificial
  CRISPR gRNA sequence
tccggccatccccccccttc

SEQ ID NO: 522105 - DNA, 20 bp, Artificial
  CRISPR gRNA sequence
cggccatccccccccttccc

SEQ ID NO: 522106 - DNA, 20 bp, Artificial
  CRISPR gRNA sequence
ccccattgcagccatgccac

SEQ ID NO: 522107 - DNA, 20 bp, Artificial
  CRISPR gRNA sequence
cccattgcagccatgccacc

SEQ ID NO: 522108 - DNA, 20 bp, Artificial
  CRISPR gRNA sequence
cagccatgccacccctcctt

SEQ ID NO: 522109 - DNA, 20 bp, Artificial
  CRISPR gRNA sequence
cttctccccacccaggaact

SEQ ID NO: 522110 - DNA, 20 bp, Artificial
  CRISPR gRNA sequence
ctccccacccaggaactgac

SEQ ID NO: 522111 - DNA, 20 bp, Artificial
  CRISPR gRNA sequence
tccccacccaggaactgaca

SEQ ID NO: 522112 - DNA, 20 bp, Artificial
  CRISPR gRNA sequence
cccacccaggaactgacaga

SEQ ID NO: 522113 - DNA, 20 bp, Artificial
  CRISPR gRNA sequence
acagaggagaggggccccgg

SEQ ID NO: 522114 - DNA, 20 bp, Artificial
  CRISPR gRNA sequence
ccagatccaggggagggggg

SEQ ID NO: 522115 - DNA, 20 bp, Artificial
  CRISPR gRNA sequence
ggtgtggggacggtggtgca

SEQ ID NO: 522116 - DNA, 20 bp, Artificial
  CRISPR gRNA sequence
gccccaagagtgcagtgttg

SEQ ID NO: 522117 - DNA, 20 bp, Artificial
  CRISPR gRNA sequence
ggggaagggggccaggtggg

SEQ ID NO: 522118 - DNA, 20 bp, Artificial
  CRISPR gRNA sequence
ggacccaggggcgtggcttc

SEQ ID NO: 522119 - DNA, 20 bp, Artificial
  CRISPR gRNA sequence
caatccccctcccaccagga

SEQ ID NO: 522120 - DNA, 20 bp, Artificial
  CRISPR gRNA sequence
aatccccctcccaccaggac

SEQ ID NO: 522121 - DNA, 20 bp, Artificial
  CRISPR gRNA sequence
ccaccaggaccttgggaatg

SEQ ID NO: 522122 - DNA, 20 bp, Artificial
  CRISPR gRNA sequence
gggaatggcctccaggagcc

SEQ ID NO: 522123 - DNA, 20 bp, Artificial
  CRISPR gRNA sequence
ggaatggcctccaggagcct

SEQ ID NO: 522124 - DNA, 20 bp, Artificial
  CRISPR gRNA sequence
caggagcctgttgtggggag

SEQ ID NO: 522125 - DNA, 20 bp, Artificial
  CRISPR gRNA sequence
ttgtggggaggccagggtca

SEQ ID NO: 522126 - DNA, 20 bp, Artificial
  CRISPR gRNA sequence
tggggaggccagggtcacca

SEQ ID NO: 522127 - DNA, 20 bp, Artificial
  CRISPR gRNA sequence
aaccaactcgaccagaatcg

SEQ ID NO: 522128 - DNA, 20 bp, Artificial
  CRISPR gRNA sequence
gaccagaatcgcacagcggt

SEQ ID NO: 522129 - DNA, 20 bp, Artificial
  CRISPR gRNA sequence
ccctacagcaagacgtcacc

SEQ ID NO: 522130 - DNA, 20 bp, Artificial
  CRISPR gRNA sequence
cagcaagacgtcacccaggg

SEQ ID NO: 522131 - DNA, 20 bp, Artificial
  CRISPR gRNA sequence
gagggtcccagaggagcatg

SEQ ID NO: 522132 - DNA, 20 bp, Artificial
  CRISPR gRNA sequence
cattacacatgtgcaccata

SEQ ID NO: 522133 - DNA, 20 bp, Artificial
  CRISPR gRNA sequence
cacatgtgcaccatacatgt

SEQ ID NO: 522134 - DNA, 20 bp, Artificial
  CRISPR gRNA sequence
cccacatcacatgcgcacac

SEQ ID NO: 522135 - DNA, 20 bp, Artificial
  CRISPR gRNA sequence
gcacaccatacatgcacaca

SEQ ID NO: 522136 - DNA, 20 bp, Artificial
  CRISPR gRNA sequence
cgctatgccacacacgtgca

SEQ ID NO: 522137 - DNA, 20 bp, Artificial
  CRISPR gRNA sequence
tgccacacacgtgcaccata

SEQ ID NO: 522138 - DNA, 20 bp, Artificial
  CRISPR gRNA sequence
cacacacgacactacacacc

SEQ ID NO: 522139 - DNA, 20 bp, Artificial
  CRISPR gRNA sequence
cacaccacgaaccacaccac

SEQ ID NO: 522140 - DNA, 20 bp, Artificial
  CRISPR gRNA sequence
cgagtcgatctggagatgga

SEQ ID NO: 522141 - DNA, 20 bp, Artificial
  CRISPR gRNA sequence
gagatggaatcgctgtagcc

SEQ ID NO: 522142 - DNA, 20 bp, Artificial
  CRISPR gRNA sequence
tagccaggcggggcagcatg

SEQ ID NO: 522143 - DNA, 20 bp, Artificial
  CRISPR gRNA sequence
acacaggcaggcgcagcagg

SEQ ID NO: 522144 - DNA, 20 bp, Artificial
  CRISPR gRNA sequence
acagaggaggccccgggaac

SEQ ID NO: 522145 - DNA, 20 bp, Artificial
  CRISPR gRNA sequence
cctcctgcccagcccggagc

SEQ ID NO: 522146 - DNA, 20 bp, Artificial
  CRISPR gRNA sequence
ctgcccagcccggagcacca

SEQ ID NO: 522147 - DNA, 20 bp, Artificial
  CRISPR gRNA sequence
cccagcccggagcaccagga

SEQ ID NO: 522148 - DNA, 20 bp, Artificial
  CRISPR gRNA sequence
ggggcttgtgggcccagcct

SEQ ID NO: 522149 - DNA, 20 bp, Artificial
  CRISPR gRNA sequence
gtgggcccagcctcttcctg

SEQ ID NO: 522150 - DNA, 20 bp, Artificial
  CRISPR gRNA sequence
tgggcccagcctcttcctgg

SEQ ID NO: 522151 - DNA, 20 bp, Artificial
  CRISPR gRNA sequence
ttcctggccttgccggcctc

SEQ ID NO: 522152 - DNA, 20 bp, Artificial
  CRISPR gRNA sequence
cctggccttgccggcctcac

SEQ ID NO: 522153 - DNA, 20 bp, Artificial
  CRISPR gRNA sequence
ctggccttgccggcctcaca

SEQ ID NO: 522154 - DNA, 20 bp, Artificial
  CRISPR gRNA sequence
gccttgccggcctcacagcc

SEQ ID NO: 522155 - DNA, 20 bp, Artificial
  CRISPR gRNA sequence
gccggcctcacagccccttg

SEQ ID NO: 522156 - DNA, 20 bp, Artificial
  CRISPR gRNA sequence
ccggcctcacagccccttgt

SEQ ID NO: 522157 - DNA, 20 bp, Artificial
  CRISPR gRNA sequence
acagccccttgtcctcccat

SEQ ID NO: 522158 - DNA, 20 bp, Artificial
  CRISPR gRNA sequence
gtcctcccatgccggcccca

SEQ ID NO: 522159 - DNA, 20 bp, Artificial
  CRISPR gRNA sequence
tcctcccatgccggccccat

SEQ ID NO: 522160 - DNA, 20 bp, Artificial
  CRISPR gRNA sequence
ccatgccggccccatcctca

SEQ ID NO: 522161 - DNA, 20 bp, Artificial
  CRISPR gRNA sequence
agccgcaagcgctcccagca

SEQ ID NO: 522162 - DNA, 20 bp, Artificial
  CRISPR gRNA sequence
ccagcacaccatgtggctct

SEQ ID NO: 522163 - DNA, 20 bp, Artificial
  CRISPR gRNA sequence
tgctcttggtggcaggcact

SEQ ID NO: 522164 - DNA, 20 bp, Artificial
  CRISPR gRNA sequence
ctcttggtggcaggcacttc

SEQ ID NO: 522165 - DNA, 20 bp, Artificial
  CRISPR gRNA sequence
ttggtggcaggcacttcccc

SEQ ID NO: 522166 - DNA, 20 bp, Artificial
  CRISPR gRNA sequence
ggtggcaggcacttcccctt

SEQ ID NO: 522167 - DNA, 20 bp, Artificial
  CRISPR gRNA sequence
gtggcaggcacttccccttg

SEQ ID NO: 522168 - DNA, 20 bp, Artificial
  CRISPR gRNA sequence
ccccttgccgggtctcaaag

SEQ ID NO: 522169 - DNA, 20 bp, Artificial
  CRISPR gRNA sequence
cccttgccgggtctcaaagg

SEQ ID NO: 522170 - DNA, 20 bp, Artificial
  CRISPR gRNA sequence
gccgggtctcaaaggggacc

SEQ ID NO: 522171 - DNA, 20 bp, Artificial
  CRISPR gRNA sequence
ccgggtctcaaaggggaccc

SEQ ID NO: 522172 - DNA, 20 bp, Artificial
  CRISPR gRNA sequence
aaaggggaccctggagcaga

SEQ ID NO: 522173 - DNA, 20 bp, Artificial
  CRISPR gRNA sequence
gagcagacggtctggagacc

SEQ ID NO: 522174 - DNA, 20 bp, Artificial
  CRISPR gRNA sequence
gagaccccttcctgccagac

SEQ ID NO: 522175 - DNA, 20 bp, Artificial
  CRISPR gRNA sequence
cctgccagacacccctgggc

SEQ ID NO: 522176 - DNA, 20 bp, Artificial
  CRISPR gRNA sequence
ctgccagacacccctgggcc

SEQ ID NO: 522177 - DNA, 20 bp, Artificial
  CRISPR gRNA sequence
ccagacacccctgggccggg

SEQ ID NO: 522178 - DNA, 20 bp, Artificial
  CRISPR gRNA sequence
ggccggggctataagcaggg

SEQ ID NO: 522179 - DNA, 20 bp, Artificial
  CRISPR gRNA sequence
taagcagggccaccagggtc

SEQ ID NO: 522180 - DNA, 20 bp, Artificial
  CRISPR gRNA sequence
caggctggggcaggagagtg

SEQ ID NO: 522181 - DNA, 20 bp, Artificial
  CRISPR gRNA sequence
gggcaggagagtgcttccct

SEQ ID NO: 522182 - DNA, 20 bp, Artificial
  CRISPR gRNA sequence
ccctccaaaaatcaccgtgg

SEQ ID NO: 522183 - DNA, 20 bp, Artificial
  CRISPR gRNA sequence
cctccaaaaatcaccgtgga

SEQ ID NO: 522184 - DNA, 20 bp, Artificial
  CRISPR gRNA sequence
caaaaatcaccgtggacata

SEQ ID NO: 522185 - DNA, 20 bp, Artificial
  CRISPR gRNA sequence
tgcacactcaccctcggtgt

SEQ ID NO: 522186 - DNA, 20 bp, Artificial
  CRISPR gRNA sequence
cacactcaccctcggtgtgc

SEQ ID NO: 522187 - DNA, 20 bp, Artificial
  CRISPR gRNA sequence
accctcggtgtgctggagtc

SEQ ID NO: 522188 - DNA, 20 bp, Artificial
  CRISPR gRNA sequence
ggtgtgctggagtcctcggc

SEQ ID NO: 522189 - DNA, 20 bp, Artificial
  CRISPR gRNA sequence
gagtcctcggcggtgctcct

SEQ ID NO: 522190 - DNA, 20 bp, Artificial
  CRISPR gRNA sequence
ggcggtgctcctggctgggc

SEQ ID NO: 522191 - DNA, 20 bp, Artificial
  CRISPR gRNA sequence
ctggctgggcgtgggggctt

SEQ ID NO: 522192 - DNA, 20 bp, Artificial
  CRISPR gRNA sequence
gctgggcgtgggggctttgc

SEQ ID NO: 522193 - DNA, 20 bp, Artificial
  CRISPR gRNA sequence
ggcgtgggggctttgctacc

SEQ ID NO: 522194 - DNA, 20 bp, Artificial
  CRISPR gRNA sequence
tgctaccagtctgccctggg

SEQ ID NO: 522195 - DNA, 20 bp, Artificial
  CRISPR gRNA sequence
gctaccagtctgccctgggt

SEQ ID NO: 522196 - DNA, 20 bp, Artificial
  CRISPR gRNA sequence
ctaccagtctgccctgggtc

SEQ ID NO: 522197 - DNA, 20 bp, Artificial
  CRISPR gRNA sequence
ccagtctgccctgggtcacg

SEQ ID NO: 522198 - DNA, 20 bp, Artificial
  CRISPR gRNA sequence
ccctgggtcacgtctagaaa

SEQ ID NO: 522199 - DNA, 20 bp, Artificial
  CRISPR gRNA sequence
ggtcacgtctagaaacctca

SEQ ID NO: 522200 - DNA, 20 bp, Artificial
  CRISPR gRNA sequence
gaaacctcagctggaggcgc

SEQ ID NO: 522201 - DNA, 20 bp, Artificial
  CRISPR gRNA sequence
agctggaggcgcgggtcgta

SEQ ID NO: 522202 - DNA, 20 bp, Artificial
  CRISPR gRNA sequence
gaggcgcgggtcgtaaagtc

SEQ ID NO: 522203 - DNA, 20 bp, Artificial
  CRISPR gRNA sequence
acacttcctgttcctctcag

SEQ ID NO: 522204 - DNA, 20 bp, Artificial
  CRISPR gRNA sequence
cctgttcctctcagctcctc

SEQ ID NO: 522205 - DNA, 20 bp, Artificial
  CRISPR gRNA sequence
ctgttcctctcagctcctcc

SEQ ID NO: 522206 - DNA, 20 bp, Artificial
  CRISPR gRNA sequence
ttcctctcagctcctccttg

SEQ ID NO: 522207 - DNA, 20 bp, Artificial
  CRISPR gRNA sequence
ctctcagctcctccttggag

SEQ ID NO: 522208 - DNA, 20 bp, Artificial
  CRISPR gRNA sequence
tcagctcctccttggaggaa

SEQ ID NO: 522209 - DNA, 20 bp, Artificial
  CRISPR gRNA sequence
agctcctccttggaggaagt

SEQ ID NO: 522210 - DNA, 20 bp, Artificial
  CRISPR gRNA sequence
ctccttggaggaagtggtgg

SEQ ID NO: 522211 - DNA, 20 bp, Artificial
  CRISPR gRNA sequence
cttggaggaagtggtgggtt

SEQ ID NO: 522212 - DNA, 20 bp, Artificial
  CRISPR gRNA sequence
ggaggaagtggtgggttgca

SEQ ID NO: 522213 - DNA, 20 bp, Artificial
  CRISPR gRNA sequence
gaggaagtggtgggttgcac

SEQ ID NO: 522214 - DNA, 20 bp, Artificial
  CRISPR gRNA sequence
caccaccgtggcccttcacc

SEQ ID NO: 522215 - DNA, 20 bp, Artificial
  CRISPR gRNA sequence
cacccctgcccctctccgct

SEQ ID NO: 522216 - DNA, 20 bp, Artificial
  CRISPR gRNA sequence
acccctgcccctctccgctc

SEQ ID NO: 522217 - DNA, 20 bp, Artificial
  CRISPR gRNA sequence
cccctctccgctctacagca

SEQ ID NO: 522218 - DNA, 20 bp, Artificial
  CRISPR gRNA sequence
tccgctctacagcagctctg

SEQ ID NO: 522219 - DNA, 20 bp, Artificial
  CRISPR gRNA sequence
cgctctacagcagctctgat

SEQ ID NO: 522220 - DNA, 20 bp, Artificial
  CRISPR gRNA sequence
tacagcagctctgatgtcag

SEQ ID NO: 522221 - DNA, 20 bp, Artificial
  CRISPR gRNA sequence
cagcagctctgatgtcagag

SEQ ID NO: 522222 - DNA, 20 bp, Artificial
  CRISPR gRNA sequence
tgacatcagagctgctgtag

SEQ ID NO: 522223 - DNA, 20 bp, Artificial
  CRISPR gRNA sequence
acatcagagctgctgtagag

SEQ ID NO: 522224 - DNA, 20 bp, Artificial
  CRISPR gRNA sequence
ctgtagagcggagaggggca

SEQ ID NO: 522225 - DNA, 20 bp, Artificial
  CRISPR gRNA sequence
tagagcggagaggggcaggg

SEQ ID NO: 522226 - DNA, 20 bp, Artificial
  CRISPR gRNA sequence
cctccaaggaggagctgaga

SEQ ID NO: 522227 - DNA, 20 bp, Artificial
  CRISPR gRNA sequence
ctccaaggaggagctgagag

SEQ ID NO: 522228 - DNA, 20 bp, Artificial
  CRISPR gRNA sequence
caaggaggagctgagaggaa

SEQ ID NO: 522229 - DNA, 20 bp, Artificial
  CRISPR gRNA sequence
agaggaacaggaagtgtcag

SEQ ID NO: 522230 - DNA, 20 bp, Artificial
  CRISPR gRNA sequence
tacgacccgcgcctccagct

SEQ ID NO: 522231 - DNA, 20 bp, Artificial
  CRISPR gRNA sequence
acgacccgcgcctccagctg

SEQ ID NO: 522232 - DNA, 20 bp, Artificial
  CRISPR gRNA sequence
cgacccgcgcctccagctga

SEQ ID NO: 522233 - DNA, 20 bp, Artificial
  CRISPR gRNA sequence
cagctgaggtttctagacgt

SEQ ID NO: 522234 - DNA, 20 bp, Artificial
  CRISPR gRNA sequence
aggtttctagacgtgaccca

SEQ ID NO: 522235 - DNA, 20 bp, Artificial
  CRISPR gRNA sequence
ctagacgtgacccagggcag

SEQ ID NO: 522236 - DNA, 20 bp, Artificial
  CRISPR gRNA sequence
tagacgtgacccagggcaga

SEQ ID NO: 522237 - DNA, 20 bp, Artificial
  CRISPR gRNA sequence
gacgtgacccagggcagact

SEQ ID NO: 522238 - DNA, 20 bp, Artificial
  CRISPR gRNA sequence
gtagcaaagcccccacgccc

SEQ ID NO: 522239 - DNA, 20 bp, Artificial
  CRISPR gRNA sequence
cagcacaccgagggtgagtg

SEQ ID NO: 522240 - DNA, 20 bp, Artificial
  CRISPR gRNA sequence
tgtccacggtgatttttgga

SEQ ID NO: 522241 - DNA, 20 bp, Artificial
  CRISPR gRNA sequence
ttggagggaagcactctcct

SEQ ID NO: 522242 - DNA, 20 bp, Artificial
  CRISPR gRNA sequence
tggagggaagcactctcctg

SEQ ID NO: 522243 - DNA, 20 bp, Artificial
  CRISPR gRNA sequence
ggagggaagcactctcctgc

SEQ ID NO: 522244 - DNA, 20 bp, Artificial
  CRISPR gRNA sequence
gagggaagcactctcctgcc

SEQ ID NO: 522245 - DNA, 20 bp, Artificial
  CRISPR gRNA sequence
tcctgccccagcctggagtg

SEQ ID NO: 522246 - DNA, 20 bp, Artificial
  CRISPR gRNA sequence
ctgccccagcctggagtgac

SEQ ID NO: 522247 - DNA, 20 bp, Artificial
  CRISPR gRNA sequence
ccccagcctggagtgaccct

SEQ ID NO: 522248 - DNA, 20 bp, Artificial
  CRISPR gRNA sequence
gagtgaccctggtggccctg

SEQ ID NO: 522249 - DNA, 20 bp, Artificial
  CRISPR gRNA sequence
gtggccctgcttatagcccc

SEQ ID NO: 522250 - DNA, 20 bp, Artificial
  CRISPR gRNA sequence
cttatagccccggcccaggg

SEQ ID NO: 522251 - DNA, 20 bp, Artificial
  CRISPR gRNA sequence
atagccccggcccaggggtg

SEQ ID NO: 522252 - DNA, 20 bp, Artificial
  CRISPR gRNA sequence
tagccccggcccaggggtgt

SEQ ID NO: 522253 - DNA, 20 bp, Artificial
  CRISPR gRNA sequence
gcaggaaggggtctccagac

SEQ ID NO: 522254 - DNA, 20 bp, Artificial
  CRISPR gRNA sequence
cagaccgtctgctccagggt

SEQ ID NO: 522255 - DNA, 20 bp, Artificial
  CRISPR gRNA sequence
ctccagggtcccctttgaga

SEQ ID NO: 522256 - DNA, 20 bp, Artificial
  CRISPR gRNA sequence
cagggtcccctttgagaccc

SEQ ID NO: 522257 - DNA, 20 bp, Artificial
  CRISPR gRNA sequence
tgagacccggcaaggggaag

SEQ ID NO: 522258 - DNA, 20 bp, Artificial
  CRISPR gRNA sequence
gagacccggcaaggggaagt

SEQ ID NO: 522259 - DNA, 20 bp, Artificial
  CRISPR gRNA sequence
agacccggcaaggggaagtg

SEQ ID NO: 522260 - DNA, 20 bp, Artificial
  CRISPR gRNA sequence
ccaccaagagcagagccaca

SEQ ID NO: 522261 - DNA, 20 bp, Artificial
  CRISPR gRNA sequence
ggagcgcttgcggctgagga

SEQ ID NO: 522262 - DNA, 20 bp, Artificial
  CRISPR gRNA sequence
gcggctgaggatggggccgg

SEQ ID NO: 522263 - DNA, 20 bp, Artificial
  CRISPR gRNA sequence
cggctgaggatggggccggc

SEQ ID NO: 522264 - DNA, 20 bp, Artificial
  CRISPR gRNA sequence
aggatggggccggcatggga

SEQ ID NO: 522265 - DNA, 20 bp, Artificial
  CRISPR gRNA sequence
tgaggccggcaaggccagga

SEQ ID NO: 522266 - DNA, 20 bp, Artificial
  CRISPR gRNA sequence
ggcccacaagcccctagggg

SEQ ID NO: 522267 - DNA, 20 bp, Artificial
  CRISPR gRNA sequence
gggggacggctggggggtcc

SEQ ID NO: 522268 - DNA, 20 bp, Artificial
  CRISPR gRNA sequence
gggggtcctggtgctccggg

SEQ ID NO: 522269 - DNA, 20 bp, Artificial
  CRISPR gRNA sequence
gtgctccgggctgggcagga

SEQ ID NO: 522270 - DNA, 20 bp, Artificial
  CRISPR gRNA sequence
cgggctgggcaggaggcagg

SEQ ID NO: 522271 - DNA, 20 bp, Artificial
  CRISPR gRNA sequence
ggcaggaggcaggttcccgg

SEQ ID NO: 522272 - DNA, 20 bp, Artificial
  CRISPR gRNA sequence
ccggggcctcctctgtgaac

SEQ ID NO: 522273 - DNA, 20 bp, Artificial
  CRISPR gRNA sequence
ctctgtgaacctgctgcgcc

SEQ ID NO: 522274 - DNA, 20 bp, Artificial
  CRISPR gRNA sequence
tgtgaacctgctgcgcctgc

SEQ ID NO: 522275 - DNA, 20 bp, Artificial
  CRISPR gRNA sequence
tgaacctgctgcgcctgcct

SEQ ID NO: 522276 - DNA, 20 bp, Artificial
  CRISPR gRNA sequence
ctgcgcctgcctgtgttagg

SEQ ID NO: 522277 - DNA, 20 bp, Artificial
  CRISPR gRNA sequence
cgcctgcctgtgttaggccc

SEQ ID NO: 522278 - DNA, 20 bp, Artificial
  CRISPR gRNA sequence
cctgtgttaggccctcctgt

SEQ ID NO: 522279 - DNA, 20 bp, Artificial
  CRISPR gRNA sequence
tgttaggccctcctgtctgc

SEQ ID NO: 522280 - DNA, 20 bp, Artificial
  CRISPR gRNA sequence
ggccctcctgtctgcatgct

SEQ ID NO: 522281 - DNA, 20 bp, Artificial
  CRISPR gRNA sequence
ctgtctgcatgctgccccgc

SEQ ID NO: 522282 - DNA, 20 bp, Artificial
  CRISPR gRNA sequence
tctgcatgctgccccgcctg

SEQ ID NO: 522283 - DNA, 20 bp, Artificial
  CRISPR gRNA sequence
catgctgccccgcctggcta

SEQ ID NO: 522284 - DNA, 20 bp, Artificial
  CRISPR gRNA sequence
ccccgcctggctacagcgat

SEQ ID NO: 522285 - DNA, 20 bp, Artificial
  CRISPR gRNA sequence
gctacagcgattccatctcc

SEQ ID NO: 522286 - DNA, 20 bp, Artificial
  CRISPR gRNA sequence
cagcgattccatctccagat

SEQ ID NO: 522287 - DNA, 20 bp, Artificial
  CRISPR gRNA sequence
catctccagatcgactcgca

SEQ ID NO: 522288 - DNA, 20 bp, Artificial
  CRISPR gRNA sequence
cagatcgactcgcagtgtgt

SEQ ID NO: 522289 - DNA, 20 bp, Artificial
  CRISPR gRNA sequence
gcagtgtgtggtgtgtgata

SEQ ID NO: 522290 - DNA, 20 bp, Artificial
  CRISPR gRNA sequence
gtggtgtgtagtgtcgtgtg

SEQ ID NO: 522291 - DNA, 20 bp, Artificial
  CRISPR gRNA sequence
ttgtatgtacatgtatggtg

SEQ ID NO: 522292 - DNA, 20 bp, Artificial
  CRISPR gRNA sequence
tatgtacatgtatggtgcac

SEQ ID NO: 522293 - DNA, 20 bp, Artificial
  CRISPR gRNA sequence
catgctcctctgggaccctc

SEQ ID NO: 522294 - DNA, 20 bp, Artificial
  CRISPR gRNA sequence
ctctgggaccctcgagcttc

SEQ ID NO: 522295 - DNA, 20 bp, Artificial
  CRISPR gRNA sequence
tgggaccctcgagcttccct

SEQ ID NO: 522296 - DNA, 20 bp, Artificial
  CRISPR gRNA sequence
ggaccctcgagcttccctgc

SEQ ID NO: 522297 - DNA, 20 bp, Artificial
  CRISPR gRNA sequence
gagcttccctgcctcctccg

SEQ ID NO: 522298 - DNA, 20 bp, Artificial
  CRISPR gRNA sequence
ccctgcctcctccgtgggga

SEQ ID NO: 522299 - DNA, 20 bp, Artificial
  CRISPR gRNA sequence
cctgcctcctccgtggggac

SEQ ID NO: 522300 - DNA, 20 bp, Artificial
  CRISPR gRNA sequence
cctcctccgtggggacccct

SEQ ID NO: 522301 - DNA, 20 bp, Artificial
  CRISPR gRNA sequence
ctccgtggggacccctgggt

SEQ ID NO: 522302 - DNA, 20 bp, Artificial
  CRISPR gRNA sequence
cgtggggacccctgggtgac

SEQ ID NO: 522303 - DNA, 20 bp, Artificial
  CRISPR gRNA sequence
ggtgacgtcttgctgtaggg

SEQ ID NO: 522304 - DNA, 20 bp, Artificial
  CRISPR gRNA sequence
gctgtaggggagcgggcacc

SEQ ID NO: 522305 - DNA, 20 bp, Artificial
  CRISPR gRNA sequence
ctgtaggggagcgggcaccg

SEQ ID NO: 522306 - DNA, 20 bp, Artificial
  CRISPR gRNA sequence
taggggagcgggcaccgctg

SEQ ID NO: 522307 - DNA, 20 bp, Artificial
  CRISPR gRNA sequence
tgcgattctggtcgagttgg

SEQ ID NO: 522308 - DNA, 20 bp, Artificial
  CRISPR gRNA sequence
tggtcgagttggttcagctg

SEQ ID NO: 522309 - DNA, 20 bp, Artificial
  CRISPR gRNA sequence
gtcgagttggttcagctggt

SEQ ID NO: 522310 - DNA, 20 bp, Artificial
  CRISPR gRNA sequence
gttcagctggtgaccctggc

SEQ ID NO: 522311 - DNA, 20 bp, Artificial
  CRISPR gRNA sequence
agctggtgaccctggcctcc

SEQ ID NO: 522312 - DNA, 20 bp, Artificial
  CRISPR gRNA sequence
gtgaccctggcctccccaca

SEQ ID NO: 522313 - DNA, 20 bp, Artificial
  CRISPR gRNA sequence
gcctccccacaacaggctcc

SEQ ID NO: 522314 - DNA, 20 bp, Artificial
  CRISPR gRNA sequence
cccacaacaggctcctggag

SEQ ID NO: 522315 - DNA, 20 bp, Artificial
  CRISPR gRNA sequence
ctggaggccattcccaaggt

SEQ ID NO: 522316 - DNA, 20 bp, Artificial
  CRISPR gRNA sequence
gaggccattcccaaggtcct

SEQ ID NO: 522317 - DNA, 20 bp, Artificial
  CRISPR gRNA sequence
ccaaggtcctggtgggaggg

SEQ ID NO: 522318 - DNA, 20 bp, Artificial
  CRISPR gRNA sequence
gtgggagggggattgaagcc

SEQ ID NO: 522319 - DNA, 20 bp, Artificial
  CRISPR gRNA sequence
aagccacgcccctgggtccc

SEQ ID NO: 522320 - DNA, 20 bp, Artificial
  CRISPR gRNA sequence
ggtcccaggcccacctggcc

SEQ ID NO: 522321 - DNA, 20 bp, Artificial
  CRISPR gRNA sequence
gcccccttcccccaacactg

SEQ ID NO: 522322 - DNA, 20 bp, Artificial
  CRISPR gRNA sequence
cccccaacactgcactcttg

SEQ ID NO: 522323 - DNA, 20 bp, Artificial
  CRISPR gRNA sequence
ccccaacactgcactcttgg

SEQ ID NO: 522324 - DNA, 20 bp, Artificial
  CRISPR gRNA sequence
cactcttggggccagccctc

SEQ ID NO: 522325 - DNA, 20 bp, Artificial
  CRISPR gRNA sequence
ttggggccagccctccccat

SEQ ID NO: 522326 - DNA, 20 bp, Artificial
  CRISPR gRNA sequence
ggggccagccctccccatgc

SEQ ID NO: 522327 - DNA, 20 bp, Artificial
  CRISPR gRNA sequence
gggccagccctccccatgca

SEQ ID NO: 522328 - DNA, 20 bp, Artificial
  CRISPR gRNA sequence
cccatgcatcctccacccct

SEQ ID NO: 522329 - DNA, 20 bp, Artificial
  CRISPR gRNA sequence
cacccctggcaccacccctt

SEQ ID NO: 522330 - DNA, 20 bp, Artificial
  CRISPR gRNA sequence
gcaccaccccttgcaccacc

SEQ ID NO: 522331 - DNA, 20 bp, Artificial
  CRISPR gRNA sequence
gcaccaccgtccccacaccc

SEQ ID NO: 522332 - DNA, 20 bp, Artificial
  CRISPR gRNA sequence
caccaccgtccccacaccca

SEQ ID NO: 522333 - DNA, 20 bp, Artificial
  CRISPR gRNA sequence
ccctggatctgggagctggg

SEQ ID NO: 522334 - DNA, 20 bp, Artificial
  CRISPR gRNA sequence
gatctgggagctgggattct

SEQ ID NO: 522335 - DNA, 20 bp, Artificial
  CRISPR gRNA sequence
ggagctgggattctgccctg

SEQ ID NO: 522336 - DNA, 20 bp, Artificial
  CRISPR gRNA sequence
ggattctgccctgctgtccc

SEQ ID NO: 522337 - DNA, 20 bp, Artificial
  CRISPR gRNA sequence
tgccctgctgtccctgtcca

SEQ ID NO: 522338 - DNA, 20 bp, Artificial
  CRISPR gRNA sequence
ccctgctgtccctgtccatc

SEQ ID NO: 522339 - DNA, 20 bp, Artificial
  CRISPR gRNA sequence
ctgtccctgtccatccgggg

SEQ ID NO: 522340 - DNA, 20 bp, Artificial
  CRISPR gRNA sequence
tccctgtccatccggggccc

SEQ ID NO: 522341 - DNA, 20 bp, Artificial
  CRISPR gRNA sequence
tccatccggggcccctctcc

SEQ ID NO: 522342 - DNA, 20 bp, Artificial
  CRISPR gRNA sequence
tcctctgtcagttcctgggt

SEQ ID NO: 522343 - DNA, 20 bp, Artificial
  CRISPR gRNA sequence
ctctgtcagttcctgggtgg

SEQ ID NO: 522344 - DNA, 20 bp, Artificial
  CRISPR gRNA sequence
tgtcagttcctgggtgggga

SEQ ID NO: 522345 - DNA, 20 bp, Artificial
  CRISPR gRNA sequence
tcagttcctgggtggggaga

SEQ ID NO: 522346 - DNA, 20 bp, Artificial
  CRISPR gRNA sequence
ctgggtggggagaaggaggg

SEQ ID NO: 522347 - DNA, 20 bp, Artificial
  CRISPR gRNA sequence
ggtggggagaaggaggggtg

SEQ ID NO: 522348 - DNA, 20 bp, Artificial
  CRISPR gRNA sequence
caatggggaaggggggggat

SEQ ID NO: 522349 - DNA, 20 bp, Artificial
  CRISPR gRNA sequence
agcctgggagcgagctgtgg

SEQ ID NO: 522350 - DNA, 20 bp, Artificial
  CRISPR gRNA sequence
ggagcgagctgtgggggcat

SEQ ID NO: 522351 - DNA, 20 bp, Artificial
  CRISPR gRNA sequence
tgggggcataggggacactc

SEQ ID NO: 522352 - DNA, 20 bp, Artificial
  CRISPR gRNA sequence
gctgtcactcgccttccccg

SEQ ID NO: 522353 - DNA, 20 bp, Artificial
  CRISPR gRNA sequence
tcactcgccttccccgtgac

SEQ ID NO: 522354 - DNA, 20 bp, Artificial
  CRISPR gRNA sequence
gccttccccgtgacggtggc

SEQ ID NO: 522355 - DNA, 20 bp, Artificial
  CRISPR gRNA sequence
ccccgtgacggtggcgcaac

SEQ ID NO: 522356 - DNA, 20 bp, Artificial
  CRISPR gRNA sequence
cccgtgacggtggcgcaacg

SEQ ID NO: 522357 - DNA, 20 bp, Artificial
  CRISPR gRNA sequence
cgggtttgggggctgaggcc

SEQ ID NO: 522358 - DNA, 20 bp, Artificial
  CRISPR gRNA sequence
gggggctgaggccggattct

SEQ ID NO: 522359 - DNA, 20 bp, Artificial
  CRISPR gRNA sequence
ggggctgaggccggattctg

SEQ ID NO: 522360 - DNA, 20 bp, Artificial
  CRISPR gRNA sequence
aggccggattctggaggctt

SEQ ID NO: 522361 - DNA, 20 bp, Artificial
  CRISPR gRNA sequence
tggaggcttcacagaaatga

SEQ ID NO: 522362 - DNA, 20 bp, Artificial
  CRISPR gRNA sequence
gaggcttcacagaaatgagc

SEQ ID NO: 522363 - DNA, 20 bp, Artificial
  CRISPR gRNA sequence
cacagaaatgagctgctaga

SEQ ID NO: 522364 - DNA, 20 bp, Artificial
  CRISPR gRNA sequence
acagaaatgagctgctagaa

SEQ ID NO: 522365 - DNA, 20 bp, Artificial
  CRISPR gRNA sequence
ctagaagctctgggctgtct

SEQ ID NO: 522366 - DNA, 20 bp, Artificial
  CRISPR gRNA sequence
gaagctctgggctgtctgcc

SEQ ID NO: 522367 - DNA, 20 bp, Artificial
  CRISPR gRNA sequence
tgggctgtctgccgtcaccc

SEQ ID NO: 522368 - DNA, 20 bp, Artificial
  CRISPR gRNA sequence
ggctgtctgccgtcacccca

SEQ ID NO: 522369 - DNA, 20 bp, Artificial
  CRISPR gRNA sequence
tctgccgtcaccccagcgtt

SEQ ID NO: 522370 - DNA, 20 bp, Artificial
  CRISPR gRNA sequence
ccgtcaccccagcgtttcac

SEQ ID NO: 522371 - DNA, 20 bp, Artificial
  CRISPR gRNA sequence
caccatgagtgaagcccagc

SEQ ID NO: 522372 - DNA, 20 bp, Artificial
  CRISPR gRNA sequence
accatgagtgaagcccagct

SEQ ID NO: 522373 - DNA, 20 bp, Artificial
  CRISPR gRNA sequence
actgcagaatccatgcccag

SEQ ID NO: 522374 - DNA, 20 bp, Artificial
  CRISPR gRNA sequence
cagaatccatgcccagctca

SEQ ID NO: 522375 - DNA, 20 bp, Artificial
  CRISPR gRNA sequence
actgcagaatccccgggggc

SEQ ID NO: 522376 - DNA, 20 bp, Artificial
  CRISPR gRNA sequence
cagaatccccgggggccagc

SEQ ID NO: 522377 - DNA, 20 bp, Artificial
  CRISPR gRNA sequence
taccaagagtggcctccaga

SEQ ID NO: 522378 - DNA, 20 bp, Artificial
  CRISPR gRNA sequence
accaagagtggcctccagac

SEQ ID NO: 522379 - DNA, 20 bp, Artificial
  CRISPR gRNA sequence
ccaagagtggcctccagact

SEQ ID NO: 522380 - DNA, 20 bp, Artificial
  CRISPR gRNA sequence
cagactccacattttaggaa

SEQ ID NO: 522381 - DNA, 20 bp, Artificial
  CRISPR gRNA sequence
cacattttaggaaggaactc

SEQ ID NO: 522382 - DNA, 20 bp, Artificial
  CRISPR gRNA sequence
taggaaggaactccttcccc

SEQ ID NO: 522383 - DNA, 20 bp, Artificial
  CRISPR gRNA sequence
aggaaggaactccttcccca

SEQ ID NO: 522384 - DNA, 20 bp, Artificial
  CRISPR gRNA sequence
ggaaggaactccttccccat

SEQ ID NO: 522385 - DNA, 20 bp, Artificial
  CRISPR gRNA sequence
cttccccatccagctcacag

SEQ ID NO: 522386 - DNA, 20 bp, Artificial
  CRISPR gRNA sequence
ccccatccagctcacagcag

SEQ ID NO: 522387 - DNA, 20 bp, Artificial
  CRISPR gRNA sequence
cccatccagctcacagcaga

SEQ ID NO: 522388 - DNA, 20 bp, Artificial
  CRISPR gRNA sequence
acagcagaatccccagggtc

SEQ ID NO: 522389 - DNA, 20 bp, Artificial
  CRISPR gRNA sequence
ccagcctggcacccagcgtg

SEQ ID NO: 522390 - DNA, 20 bp, Artificial
  CRISPR gRNA sequence
gcacccagcgtgcccctcag

SEQ ID NO: 522391 - DNA, 20 bp, Artificial
  CRISPR gRNA sequence
agtattctggggatgagtgg

SEQ ID NO: 522392 - DNA, 20 bp, Artificial
  CRISPR gRNA sequence
tggggatgagtgggggagtc

SEQ ID NO: 522393 - DNA, 20 bp, Artificial
  CRISPR gRNA sequence
gggatgagtgggggagtccc

SEQ ID NO: 522394 - DNA, 20 bp, Artificial
  CRISPR gRNA sequence
tgctgggaagaggtccctgg

SEQ ID NO: 522395 - DNA, 20 bp, Artificial
  CRISPR gRNA sequence
ctgggaagaggtccctggct

SEQ ID NO: 522396 - DNA, 20 bp, Artificial
  CRISPR gRNA sequence
ggaagaggtccctggctacg

SEQ ID NO: 522397 - DNA, 20 bp, Artificial
  CRISPR gRNA sequence
gctacgtccctgcagggcgg

SEQ ID NO: 522398 - DNA, 20 bp, Artificial
  CRISPR gRNA sequence
cgtccctgcagggcggcggc

SEQ ID NO: 522399 - DNA, 20 bp, Artificial
  CRISPR gRNA sequence
cagggcggcggctgagccca

SEQ ID NO: 522400 - DNA, 20 bp, Artificial
  CRISPR gRNA sequence
agcccatgcctcggccccag

SEQ ID NO: 522401 - DNA, 20 bp, Artificial
  CRISPR gRNA sequence
ggccccagggccagtccccg

SEQ ID NO: 522402 - DNA, 20 bp, Artificial
  CRISPR gRNA sequence
agcagggccacagaacagat

SEQ ID NO: 522403 - DNA, 20 bp, Artificial
  CRISPR gRNA sequence
tggccacctgaccccggggg

SEQ ID NO: 522404 - DNA, 20 bp, Artificial
  CRISPR gRNA sequence
accccgggggggctgtggcc

SEQ ID NO: 522405 - DNA, 20 bp, Artificial
  CRISPR gRNA sequence
tggccctcggtgaagcaggt

SEQ ID NO: 522406 - DNA, 20 bp, Artificial
  CRISPR gRNA sequence
ggtgaagcaggtgaccgggc

SEQ ID NO: 522407 - DNA, 20 bp, Artificial
  CRISPR gRNA sequence
tggggtttgtcagctccgca

SEQ ID NO: 522408 - DNA, 20 bp, Artificial
  CRISPR gRNA sequence
gtcagctccgcagcgtcact

SEQ ID NO: 522409 - DNA, 20 bp, Artificial
  CRISPR gRNA sequence
tcagctccgcagcgtcactg

SEQ ID NO: 522410 - DNA, 20 bp, Artificial
  CRISPR gRNA sequence
cgcagcgtcactgccgctca

SEQ ID NO: 522411 - DNA, 20 bp, Artificial
  CRISPR gRNA sequence
ccgctcagcgtatgagtttc

SEQ ID NO: 522412 - DNA, 20 bp, Artificial
  CRISPR gRNA sequence
agcgtatgagtttccactcc

SEQ ID NO: 522413 - DNA, 20 bp, Artificial
  CRISPR gRNA sequence
ccactcccagcactcaatga

SEQ ID NO: 522414 - DNA, 20 bp, Artificial
  CRISPR gRNA sequence
cactcccagcactcaatgaa

SEQ ID NO: 522415 - DNA, 20 bp, Artificial
  CRISPR gRNA sequence
ccagcactcaatgaacagct

SEQ ID NO: 522416 - DNA, 20 bp, Artificial
  CRISPR gRNA sequence
aatgaacagctgagcaactg

SEQ ID NO: 522417 - DNA, 20 bp, Artificial
  CRISPR gRNA sequence
agcaactgcaggtgcctccg

SEQ ID NO: 522418 - DNA, 20 bp, Artificial
  CRISPR gRNA sequence
caggtgcctccgagtgctgg

SEQ ID NO: 522419 - DNA, 20 bp, Artificial
  CRISPR gRNA sequence
cgagtgctgggagaggggaa

SEQ ID NO: 522420 - DNA, 20 bp, Artificial
  CRISPR gRNA sequence
ggagaggggaatgctcagct

SEQ ID NO: 522421 - DNA, 20 bp, Artificial
  CRISPR gRNA sequence
agctccgagtgctgggagag

SEQ ID NO: 522422 - DNA, 20 bp, Artificial
  CRISPR gRNA sequence
cgagtgctgggagaggggac

SEQ ID NO: 522423 - DNA, 20 bp, Artificial
  CRISPR gRNA sequence
ggagaggggacgctcagctc

SEQ ID NO: 522424 - DNA, 20 bp, Artificial
  CRISPR gRNA sequence
agctccgagtgctgggagag

SEQ ID NO: 522425 - DNA, 20 bp, Artificial
  CRISPR gRNA sequence
cgagtgctgggagaggggac

SEQ ID NO: 522426 - DNA, 20 bp, Artificial
  CRISPR gRNA sequence
ggagaggggacgcttagcca

SEQ ID NO: 522427 - DNA, 20 bp, Artificial
  CRISPR gRNA sequence
agccacccaagggcctttgc

SEQ ID NO: 522428 - DNA, 20 bp, Artificial
  CRISPR gRNA sequence
gccacccaagggcctttgcc

SEQ ID NO: 522429 - DNA, 20 bp, Artificial
  CRISPR gRNA sequence
tgcctcaagggagtaaatag

SEQ ID NO: 522430 - DNA, 20 bp, Artificial
  CRISPR gRNA sequence
gcctcaagggagtaaatagg

SEQ ID NO: 522431 - DNA, 20 bp, Artificial
  CRISPR gRNA sequence
cctcaagggagtaaataggg

SEQ ID NO: 522432 - DNA, 20 bp, Artificial
  CRISPR gRNA sequence
aagggagtaaataggggcat

SEQ ID NO: 522433 - DNA, 20 bp, Artificial
  CRISPR gRNA sequence
cctggtgggcgtgggctggg

SEQ ID NO: 522434 - DNA, 20 bp, Artificial
  CRISPR gRNA sequence
ctggtgggcgtgggctgggc

SEQ ID NO: 522435 - DNA, 20 bp, Artificial
  CRISPR gRNA sequence
gtgggcgtgggctgggctgg

SEQ ID NO: 522436 - DNA, 20 bp, Artificial
  CRISPR gRNA sequence
ggctggagaagcagggcctc

SEQ ID NO: 522437 - DNA, 20 bp, Artificial
  CRISPR gRNA sequence
gagaagcagggcctcctggc

SEQ ID NO: 522438 - DNA, 20 bp, Artificial
  CRISPR gRNA sequence
ctggcaggggctggcatgag

SEQ ID NO: 522439 - DNA, 20 bp, Artificial
  CRISPR gRNA sequence
gcaggggctggcatgagatc

SEQ ID NO: 522440 - DNA, 20 bp, Artificial
  CRISPR gRNA sequence
gcatgagatccaaacactgc

SEQ ID NO: 522441 - DNA, 20 bp, Artificial
  CRISPR gRNA sequence
cccaggcagctggacactcc

SEQ ID NO: 522442 - DNA, 20 bp, Artificial
  CRISPR gRNA sequence
gacactcctgagcctggagc

SEQ ID NO: 522443 - DNA, 20 bp, Artificial
  CRISPR gRNA sequence
ctgagcctggagcttctcac

SEQ ID NO: 522444 - DNA, 20 bp, Artificial
  CRISPR gRNA sequence
agcctggagcttctcacctg

SEQ ID NO: 522445 - DNA, 20 bp, Artificial
  CRISPR gRNA sequence
gagcttctcacctgaaccac

SEQ ID NO: 522446 - DNA, 20 bp, Artificial
  CRISPR gRNA sequence
ctcacctgaaccacagggtg

SEQ ID NO: 522447 - DNA, 20 bp, Artificial
  CRISPR gRNA sequence
tcacctgaaccacagggtgg

SEQ ID NO: 522448 - DNA, 20 bp, Artificial
  CRISPR gRNA sequence
acctgaaccacagggtggta

SEQ ID NO: 522449 - DNA, 20 bp, Artificial
  CRISPR gRNA sequence
aaccacagggtggtaacccc

SEQ ID NO: 522450 - DNA, 20 bp, Artificial
  CRISPR gRNA sequence
cccctcaggcggcatcgacg

SEQ ID NO: 522451 - DNA, 20 bp, Artificial
  CRISPR gRNA sequence
aggcggcatcgacgtgacct

SEQ ID NO: 522452 - DNA, 20 bp, Artificial
  CRISPR gRNA sequence
cctagtgcacagtgagcctg

SEQ ID NO: 522453 - DNA, 20 bp, Artificial
  CRISPR gRNA sequence
gtgcacagtgagcctgaggc

SEQ ID NO: 522454 - DNA, 20 bp, Artificial
  CRISPR gRNA sequence
aggcaacacggccaccacca

SEQ ID NO: 522455 - DNA, 20 bp, Artificial
  CRISPR gRNA sequence
cctggggaagaggcccccag

SEQ ID NO: 522456 - DNA, 20 bp, Artificial
  CRISPR gRNA sequence
gggaagaggcccccagacag

SEQ ID NO: 522457 - DNA, 20 bp, Artificial
  CRISPR gRNA sequence
tgcacaggggccgcggccat

SEQ ID NO: 522458 - DNA, 20 bp, Artificial
  CRISPR gRNA sequence
cacaggggccgcggccatcc

SEQ ID NO: 522459 - DNA, 20 bp, Artificial
  CRISPR gRNA sequence
tctgcaccctgtctggaagg

SEQ ID NO: 522460 - DNA, 20 bp, Artificial
  CRISPR gRNA sequence
caccctgtctggaaggggca

SEQ ID NO: 522461 - DNA, 20 bp, Artificial
  CRISPR gRNA sequence
tctggaaggggcatggggtg

SEQ ID NO: 522462 - DNA, 20 bp, Artificial
  CRISPR gRNA sequence
gaaggggcatggggtgagca

SEQ ID NO: 522463 - DNA, 20 bp, Artificial
  CRISPR gRNA sequence
tttggtcccccgtgactcag

SEQ ID NO: 522464 - DNA, 20 bp, Artificial
  CRISPR gRNA sequence
ggtcccccgtgactcagttt

SEQ ID NO: 522465 - DNA, 20 bp, Artificial
  CRISPR gRNA sequence
gtcccccgtgactcagtttc

SEQ ID NO: 522466 - DNA, 20 bp, Artificial
  CRISPR gRNA sequence
agtttccccatctgtgaaac

SEQ ID NO: 522467 - DNA, 20 bp, Artificial
  CRISPR gRNA sequence
ccccatctgtgaaacaggag

SEQ ID NO: 522468 - DNA, 20 bp, Artificial
  CRISPR gRNA sequence
cccatctgtgaaacaggagg

SEQ ID NO: 522469 - DNA, 20 bp, Artificial
  CRISPR gRNA sequence
tgaaacaggaggggtggtct

SEQ ID NO: 522470 - DNA, 20 bp, Artificial
  CRISPR gRNA sequence
gccaattgtgcgcactccag

SEQ ID NO: 522471 - DNA, 20 bp, Artificial
  CRISPR gRNA sequence
tgcgcactccagctgtctct

SEQ ID NO: 522472 - DNA, 20 bp, Artificial
  CRISPR gRNA sequence
cagctgtctctatagtcaac

SEQ ID NO: 522473 - DNA, 20 bp, Artificial
  CRISPR gRNA sequence
tctctatagtcaaccgtgta

SEQ ID NO: 522474 - DNA, 20 bp, Artificial
  CRISPR gRNA sequence
tatagtcaaccgtgtaactt

SEQ ID NO: 522475 - DNA, 20 bp, Artificial
  CRISPR gRNA sequence
tagtcaaccgtgtaacttga

SEQ ID NO: 522476 - DNA, 20 bp, Artificial
  CRISPR gRNA sequence
gaactcacttccccagggct

SEQ ID NO: 522477 - DNA, 20 bp, Artificial
  CRISPR gRNA sequence
aactcacttccccagggctc

SEQ ID NO: 522478 - DNA, 20 bp, Artificial
  CRISPR gRNA sequence
acttccccagggctcctgcc

SEQ ID NO: 522479 - DNA, 20 bp, Artificial
  CRISPR gRNA sequence
ccccagggctcctgccaggc

SEQ ID NO: 522480 - DNA, 20 bp, Artificial
  CRISPR gRNA sequence
cccagggctcctgccaggcc

SEQ ID NO: 522481 - DNA, 20 bp, Artificial
  CRISPR gRNA sequence
ctgccaggcccaggtctgtc

SEQ ID NO: 522482 - DNA, 20 bp, Artificial
  CRISPR gRNA sequence
ccaggcccaggtctgtccac

SEQ ID NO: 522483 - DNA, 20 bp, Artificial
  CRISPR gRNA sequence
tccactctggcccaggccgg

SEQ ID NO: 522484 - DNA, 20 bp, Artificial
  CRISPR gRNA sequence
tggcccaggccgggccccac

SEQ ID NO: 522485 - DNA, 20 bp, Artificial
  CRISPR gRNA sequence
gcccaggccgggccccacca

SEQ ID NO: 522486 - DNA, 20 bp, Artificial
  CRISPR gRNA sequence
tgggacatttgcctctgtgg

SEQ ID NO: 522487 - DNA, 20 bp, Artificial
  CRISPR gRNA sequence
gcctctgtggatggggcagc

SEQ ID NO: 522488 - DNA, 20 bp, Artificial
  CRISPR gRNA sequence
cctctgtggatggggcagcg

SEQ ID NO: 522489 - DNA, 20 bp, Artificial
  CRISPR gRNA sequence
tgtggatggggcagcgtgac

SEQ ID NO: 522490 - DNA, 20 bp, Artificial
  CRISPR gRNA sequence
tggatggggcagcgtgacgc

SEQ ID NO: 522491 - DNA, 20 bp, Artificial
  CRISPR gRNA sequence
tggcgattccatggaacagg

SEQ ID NO: 522492 - DNA, 20 bp, Artificial
  CRISPR gRNA sequence
catggaacaggtcctgtgtg

SEQ ID NO: 522493 - DNA, 20 bp, Artificial
  CRISPR gRNA sequence
tgtgggccccccttgctgca

SEQ ID NO: 522494 - DNA, 20 bp, Artificial
  CRISPR gRNA sequence
gctgcactcgtgtcctgtgt

SEQ ID NO: 522495 - DNA, 20 bp, Artificial
  CRISPR gRNA sequence
ctgcactcgtgtcctgtgtc

SEQ ID NO: 522496 - DNA, 20 bp, Artificial
  CRISPR gRNA sequence
cactcgtgtcctgtgtcaga

SEQ ID NO: 522497 - DNA, 20 bp, Artificial
  CRISPR gRNA sequence
gtgtcctgtgtcagagaacc

SEQ ID NO: 522498 - DNA, 20 bp, Artificial
  CRISPR gRNA sequence
tgtcagagaaccgtggtcct

SEQ ID NO: 522499 - DNA, 20 bp, Artificial
  CRISPR gRNA sequence
cctgaggccatgtcaccgga

SEQ ID NO: 522500 - DNA, 20 bp, Artificial
  CRISPR gRNA sequence
aggccatgtcaccggaggct

SEQ ID NO: 522501 - DNA, 20 bp, Artificial
  CRISPR gRNA sequence
gctcccgttcccggaggaga

SEQ ID NO: 522502 - DNA, 20 bp, Artificial
  CRISPR gRNA sequence
ccgttcccggaggagaatgc

SEQ ID NO: 522503 - DNA, 20 bp, Artificial
  CRISPR gRNA sequence
ccggaggagaatgccagctg

SEQ ID NO: 522504 - DNA, 20 bp, Artificial
  CRISPR gRNA sequence
ccacaggggtcagtgacaca

SEQ ID NO: 522505 - DNA, 20 bp, Artificial
  CRISPR gRNA sequence
gcccagcaggtacaggccag

SEQ ID NO: 522506 - DNA, 20 bp, Artificial
  CRISPR gRNA sequence
cccagcaggtacaggccagg

SEQ ID NO: 522507 - DNA, 20 bp, Artificial
  CRISPR gRNA sequence
ggaagccccaactcaagggg

SEQ ID NO: 522508 - DNA, 20 bp, Artificial
  CRISPR gRNA sequence
aaggggctctgcagtgggcg

SEQ ID NO: 522509 - DNA, 20 bp, Artificial
  CRISPR gRNA sequence
tgcagtgggcgcctagcaat

SEQ ID NO: 522510 - DNA, 20 bp, Artificial
  CRISPR gRNA sequence
cagtgggcgcctagcaatta

SEQ ID NO: 522511 - DNA, 20 bp, Artificial
  CRISPR gRNA sequence
gcaattatggagctgtgggt

SEQ ID NO: 522512 - DNA, 20 bp, Artificial
  CRISPR gRNA sequence
tggagctgtgggtgataccc

SEQ ID NO: 522513 - DNA, 20 bp, Artificial
  CRISPR gRNA sequence
tgggtgatacccaccccaag

SEQ ID NO: 522514 - DNA, 20 bp, Artificial
  CRISPR gRNA sequence
gtgccagcaattatccctcc

SEQ ID NO: 522515 - DNA, 20 bp, Artificial
  CRISPR gRNA sequence
tccctcccattctgcttggc

SEQ ID NO: 522516 - DNA, 20 bp, Artificial
  CRISPR gRNA sequence
ccattctgcttggcacaaac

SEQ ID NO: 522517 - DNA, 20 bp, Artificial
  CRISPR gRNA sequence
tgcttggcacaaactggcac

SEQ ID NO: 522518 - DNA, 20 bp, Artificial
  CRISPR gRNA sequence
cttggcacaaactggcactg

SEQ ID NO: 522519 - DNA, 20 bp, Artificial
  CRISPR gRNA sequence
ggcacaaactggcactgaca

SEQ ID NO: 522520 - DNA, 20 bp, Artificial
  CRISPR gRNA sequence
gcacaaactggcactgacac

SEQ ID NO: 522521 - DNA, 20 bp, Artificial
  CRISPR gRNA sequence
gcactgacacggggcattga

SEQ ID NO: 522522 - DNA, 20 bp, Artificial
  CRISPR gRNA sequence
acacggggcattgattaggt

SEQ ID NO: 522523 - DNA, 20 bp, Artificial
  CRISPR gRNA sequence
attaggtggttgcatttgtc

SEQ ID NO: 522524 - DNA, 20 bp, Artificial
  CRISPR gRNA sequence
ggtggttgcatttgtcgatt

SEQ ID NO: 522525 - DNA, 20 bp, Artificial
  CRISPR gRNA sequence
catttgtcgattccgagccc

SEQ ID NO: 522526 - DNA, 20 bp, Artificial
  CRISPR gRNA sequence
gtcgattccgagcccatgtg

SEQ ID NO: 522527 - DNA, 20 bp, Artificial
  CRISPR gRNA sequence
tcgattccgagcccatgtgt

SEQ ID NO: 522528 - DNA, 20 bp, Artificial
  CRISPR gRNA sequence
cgagcccatgtgtgtggagc

SEQ ID NO: 522529 - DNA, 20 bp, Artificial
  CRISPR gRNA sequence
agcaagcacagagggccctg

SEQ ID NO: 522530 - DNA, 20 bp, Artificial
  CRISPR gRNA sequence
gtgctgtcctgagctgaggc

SEQ ID NO: 522531 - DNA, 20 bp, Artificial
  CRISPR gRNA sequence
tcctgagctgaggcccctgc

SEQ ID NO: 522532 - DNA, 20 bp, Artificial
  CRISPR gRNA sequence
agctgaggcccctgcccacc

SEQ ID NO: 522533 - DNA, 20 bp, Artificial
  CRISPR gRNA sequence
aggcccctgcccaccccggg

SEQ ID NO: 522534 - DNA, 20 bp, Artificial
  CRISPR gRNA sequence
cccaccccgggctgcgtgtt

SEQ ID NO: 522535 - DNA, 20 bp, Artificial
  CRISPR gRNA sequence
cgtgttctctccggccattc

SEQ ID NO: 522536 - DNA, 20 bp, Artificial
  CRISPR gRNA sequence
tctccggccattcagggtct

SEQ ID NO: 522537 - DNA, 20 bp, Artificial
  CRISPR gRNA sequence
tccggccattcagggtctga

SEQ ID NO: 522538 - DNA, 20 bp, Artificial
  CRISPR gRNA sequence
cggccattcagggtctgaga

SEQ ID NO: 522539 - DNA, 20 bp, Artificial
  CRISPR gRNA sequence
agggtctgagagtgcagaag

SEQ ID NO: 522540 - DNA, 20 bp, Artificial
  CRISPR gRNA sequence
agagtgcagaagagttagcc

SEQ ID NO: 522541 - DNA, 20 bp, Artificial
  CRISPR gRNA sequence
gccccaggggaacaccttcc

SEQ ID NO: 522542 - DNA, 20 bp, Artificial
  CRISPR gRNA sequence
cctgcccagctgatttgtaa

SEQ ID NO: 522543 - DNA, 20 bp, Artificial
  CRISPR gRNA sequence
ctgcccagctgatttgtaaa

SEQ ID NO: 522544 - DNA, 20 bp, Artificial
  CRISPR gRNA sequence
cccagctgatttgtaaacag

SEQ ID NO: 522545 - DNA, 20 bp, Artificial
  CRISPR gRNA sequence
atttgtaaacagcctcgctg

SEQ ID NO: 522546 - DNA, 20 bp, Artificial
  CRISPR gRNA sequence
gtaaacagcctcgctgggga

SEQ ID NO: 522547 - DNA, 20 bp, Artificial
  CRISPR gRNA sequence
taaacagcctcgctggggac

SEQ ID NO: 522548 - DNA, 20 bp, Artificial
  CRISPR gRNA sequence
gctggggacacatgttggtg

SEQ ID NO: 522549 - DNA, 20 bp, Artificial
  CRISPR gRNA sequence
gggacacatgttggtgttgg

SEQ ID NO: 522550 - DNA, 20 bp, Artificial
  CRISPR gRNA sequence
gtgttgggagtggtggaggt

SEQ ID NO: 522551 - DNA, 20 bp, Artificial
  CRISPR gRNA sequence
ggagtggtggaggtttctgt

SEQ ID NO: 522552 - DNA, 20 bp, Artificial
  CRISPR gRNA sequence
ctgtgtgtgatggaaacttg

SEQ ID NO: 522553 - DNA, 20 bp, Artificial
  CRISPR gRNA sequence
tgtgtgtgatggaaacttgg

SEQ ID NO: 522554 - DNA, 20 bp, Artificial
  CRISPR gRNA sequence
tgtgtgatggaaacttgggg

SEQ ID NO: 522555 - DNA, 20 bp, Artificial
  CRISPR gRNA sequence
ggggtaggtgttggggaaaa

SEQ ID NO: 522556 - DNA, 20 bp, Artificial
  CRISPR gRNA sequence
gggtaggtgttggggaaaag

SEQ ID NO: 522557 - DNA, 20 bp, Artificial
  CRISPR gRNA sequence
gggaaaagaggtgctgagag

SEQ ID NO: 522558 - DNA, 20 bp, Artificial
  CRISPR gRNA sequence
agagtctcagcagagggcag

SEQ ID NO: 522559 - DNA, 20 bp, Artificial
  CRISPR gRNA sequence
agcagagggcagagtccagg

SEQ ID NO: 522560 - DNA, 20 bp, Artificial
  CRISPR gRNA sequence
gagtgcagctctcagcccct

SEQ ID NO: 522561 - DNA, 20 bp, Artificial
  CRISPR gRNA sequence
tcagcccctgcgccgtgcct

SEQ ID NO: 522562 - DNA, 20 bp, Artificial
  CRISPR gRNA sequence
agcccctgcgccgtgcctag

SEQ ID NO: 522563 - DNA, 20 bp, Artificial
  CRISPR gRNA sequence
cgccgtgcctagaggagagg

SEQ ID NO: 522564 - DNA, 20 bp, Artificial
  CRISPR gRNA sequence
gaggagaggctggcaagccc

SEQ ID NO: 522565 - DNA, 20 bp, Artificial
  CRISPR gRNA sequence
gcaagcccctgtcccatgga

SEQ ID NO: 522566 - DNA, 20 bp, Artificial
  CRISPR gRNA sequence
tcccatggatgggtgaatgg

SEQ ID NO: 522567 - DNA, 20 bp, Artificial
  CRISPR gRNA sequence
ccatgaagcagcgtcctcat

SEQ ID NO: 522568 - DNA, 20 bp, Artificial
  CRISPR gRNA sequence
atcaacgtcacagtgggaac

SEQ ID NO: 522569 - DNA, 20 bp, Artificial
  CRISPR gRNA sequence
tggaatccgaaggagcaatt

SEQ ID NO: 522570 - DNA, 20 bp, Artificial
  CRISPR gRNA sequence
ggaatccgaaggagcaattt

SEQ ID NO: 522571 - DNA, 20 bp, Artificial
  CRISPR gRNA sequence
gaatccgaaggagcaatttc

SEQ ID NO: 522572 - DNA, 20 bp, Artificial
  CRISPR gRNA sequence
cagcataattcgtcggccac

SEQ ID NO: 522573 - DNA, 20 bp, Artificial
  CRISPR gRNA sequence
agcataattcgtcggccacc

SEQ ID NO: 522574 - DNA, 20 bp, Artificial
  CRISPR gRNA sequence
gtcggccaccatgaaattcc

SEQ ID NO: 522575 - DNA, 20 bp, Artificial
  CRISPR gRNA sequence
catttttaaaatgtccttta

SEQ ID NO: 522576 - DNA, 20 bp, Artificial
  CRISPR gRNA sequence
ttaaaatgtcctttattcat

SEQ ID NO: 522577 - DNA, 20 bp, Artificial
  CRISPR gRNA sequence
taaaatgtcctttattcatt

SEQ ID NO: 522578 - DNA, 20 bp, Artificial
  CRISPR gRNA sequence
aaaatgtcctttattcattt

SEQ ID NO: 522579 - DNA, 20 bp, Artificial
  CRISPR gRNA sequence
aaatgtcctttattcattta

SEQ ID NO: 522580 - DNA, 20 bp, Artificial
  CRISPR gRNA sequence
tattcatttatcacaaaaag

SEQ ID NO: 522581 - DNA, 20 bp, Artificial
  CRISPR gRNA sequence
attcatttatcacaaaaagg

SEQ ID NO: 522582 - DNA, 20 bp, Artificial
  CRISPR gRNA sequence
ttcatttatcacaaaaaggg

SEQ ID NO: 522583 - DNA, 20 bp, Artificial
  CRISPR gRNA sequence
atttatcacaaaaagggtgg

SEQ ID NO: 522584 - DNA, 20 bp, Artificial
  CRISPR gRNA sequence
atcacaaaaagggtggaaaa

SEQ ID NO: 522585 - DNA, 20 bp, Artificial
  CRISPR gRNA sequence
tcacaaaaagggtggaaaat

SEQ ID NO: 522586 - DNA, 20 bp, Artificial
  CRISPR gRNA sequence
aaaatactcatagtgccacc

SEQ ID NO: 522587 - DNA, 20 bp, Artificial
  CRISPR gRNA sequence
atagtgccaccacccagaga

SEQ ID NO: 522588 - DNA, 20 bp, Artificial
  CRISPR gRNA sequence
tggaactgtgtctctctttt

SEQ ID NO: 522589 - DNA, 20 bp, Artificial
  CRISPR gRNA sequence
ggaactgtgtctctcttttt

SEQ ID NO: 522590 - DNA, 20 bp, Artificial
  CRISPR gRNA sequence
gaactgtgtctctctttttt

SEQ ID NO: 522591 - DNA, 20 bp, Artificial
  CRISPR gRNA sequence
tgtctctctttttttcccca

SEQ ID NO: 522592 - DNA, 20 bp, Artificial
  CRISPR gRNA sequence
tctttttttccccataaatt

SEQ ID NO: 522593 - DNA, 20 bp, Artificial
  CRISPR gRNA sequence
tttttttccccataaattca

SEQ ID NO: 522594 - DNA, 20 bp, Artificial
  CRISPR gRNA sequence
tttttccccataaattcact

SEQ ID NO: 522595 - DNA, 20 bp, Artificial
  CRISPR gRNA sequence
ttttccccataaattcactt

SEQ ID NO: 522596 - DNA, 20 bp, Artificial
  CRISPR gRNA sequence
tttccccataaattcacttt

SEQ ID NO: 522597 - DNA, 20 bp, Artificial
  CRISPR gRNA sequence
ttccccataaattcactttt

SEQ ID NO: 522598 - DNA, 20 bp, Artificial
  CRISPR gRNA sequence
tccccataaattcactttta

SEQ ID NO: 522599 - DNA, 20 bp, Artificial
  CRISPR gRNA sequence
ccccataaattcacttttac

SEQ ID NO: 522600 - DNA, 20 bp, Artificial
  CRISPR gRNA sequence
cccataaattcacttttacc

SEQ ID NO: 522601 - DNA, 20 bp, Artificial
  CRISPR gRNA sequence
acttttaccacgaagccaag

SEQ ID NO: 522602 - DNA, 20 bp, Artificial
  CRISPR gRNA sequence
ttaccacgaagccaagctgc

SEQ ID NO: 522603 - DNA, 20 bp, Artificial
  CRISPR gRNA sequence
taccacgaagccaagctgcc

SEQ ID NO: 522604 - DNA, 20 bp, Artificial
  CRISPR gRNA sequence
accacgaagccaagctgccc

SEQ ID NO: 522605 - DNA, 20 bp, Artificial
  CRISPR gRNA sequence
ccacgaagccaagctgccct

SEQ ID NO: 522606 - DNA, 20 bp, Artificial
  CRISPR gRNA sequence
ccctgagcagctgtttgcat

SEQ ID NO: 522607 - DNA, 20 bp, Artificial
  CRISPR gRNA sequence
agcagctgtttgcatgtttt

SEQ ID NO: 522608 - DNA, 20 bp, Artificial
  CRISPR gRNA sequence
tttgcatgttttcgttgctg

SEQ ID NO: 522609 - DNA, 20 bp, Artificial
  CRISPR gRNA sequence
gcatgttttcgttgctgtgt

SEQ ID NO: 522610 - DNA, 20 bp, Artificial
  CRISPR gRNA sequence
catgttttcgttgctgtgtg

SEQ ID NO: 522611 - DNA, 20 bp, Artificial
  CRISPR gRNA sequence
tcgttgctgtgtgggactcc

SEQ ID NO: 522612 - DNA, 20 bp, Artificial
  CRISPR gRNA sequence
cgttgctgtgtgggactcca

SEQ ID NO: 522613 - DNA, 20 bp, Artificial
  CRISPR gRNA sequence
gttgctgtgtgggactccat

SEQ ID NO: 522614 - DNA, 20 bp, Artificial
  CRISPR gRNA sequence
ctgtgtgggactccatagcg

SEQ ID NO: 522615 - DNA, 20 bp, Artificial
  CRISPR gRNA sequence
tgtgggactccatagcgcag

SEQ ID NO: 522616 - DNA, 20 bp, Artificial
  CRISPR gRNA sequence
catagcgcaggcaccgaaac

SEQ ID NO: 522617 - DNA, 20 bp, Artificial
  CRISPR gRNA sequence
acacgttgacggctacacag

SEQ ID NO: 522618 - DNA, 20 bp, Artificial
  CRISPR gRNA sequence
cacgttgacggctacacagg

SEQ ID NO: 522619 - DNA, 20 bp, Artificial
  CRISPR gRNA sequence
acggctacacagggaatcaa

SEQ ID NO: 522620 - DNA, 20 bp, Artificial
  CRISPR gRNA sequence
cacagggaatcaagatattt

SEQ ID NO: 522621 - DNA, 20 bp, Artificial
  CRISPR gRNA sequence
tggctgaaatccctggttct

SEQ ID NO: 522622 - DNA, 20 bp, Artificial
  CRISPR gRNA sequence
ggctgaaatccctggttctt

SEQ ID NO: 522623 - DNA, 20 bp, Artificial
  CRISPR gRNA sequence
gctgaaatccctggttcttt

SEQ ID NO: 522624 - DNA, 20 bp, Artificial
  CRISPR gRNA sequence
aaatccctggttctttcctg

SEQ ID NO: 522625 - DNA, 20 bp, Artificial
  CRISPR gRNA sequence
gttctttcctggggtgactc

SEQ ID NO: 522626 - DNA, 20 bp, Artificial
  CRISPR gRNA sequence
tttcctggggtgactcatat

SEQ ID NO: 522627 - DNA, 20 bp, Artificial
  CRISPR gRNA sequence
tcctggggtgactcatatgt

SEQ ID NO: 522628 - DNA, 20 bp, Artificial
  CRISPR gRNA sequence
cctggggtgactcatatgtt

SEQ ID NO: 522629 - DNA, 20 bp, Artificial
  CRISPR gRNA sequence
ctggggtgactcatatgttt

SEQ ID NO: 522630 - DNA, 20 bp, Artificial
  CRISPR gRNA sequence
gggtgactcatatgtttctt

SEQ ID NO: 522631 - DNA, 20 bp, Artificial
  CRISPR gRNA sequence
atatgtttcttagccagttt

SEQ ID NO: 522632 - DNA, 20 bp, Artificial
  CRISPR gRNA sequence
cttagccagttttcttcctt

SEQ ID NO: 522633 - DNA, 20 bp, Artificial
  CRISPR gRNA sequence
ttagccagttttcttccttc

SEQ ID NO: 522634 - DNA, 20 bp, Artificial
  CRISPR gRNA sequence
agccagttttcttccttctt

SEQ ID NO: 522635 - DNA, 20 bp, Artificial
  CRISPR gRNA sequence
gccagttttcttccttcttt

SEQ ID NO: 522636 - DNA, 20 bp, Artificial
  CRISPR gRNA sequence
tcttccttcttttgtgaatt

SEQ ID NO: 522637 - DNA, 20 bp, Artificial
  CRISPR gRNA sequence
cttccttcttttgtgaatta

SEQ ID NO: 522638 - DNA, 20 bp, Artificial
  CRISPR gRNA sequence
ttccttcttttgtgaattac

SEQ ID NO: 522639 - DNA, 20 bp, Artificial
  CRISPR gRNA sequence
ccttcttttgtgaattacct

SEQ ID NO: 522640 - DNA, 20 bp, Artificial
  CRISPR gRNA sequence
cttcttttgtgaattacctg

SEQ ID NO: 522641 - DNA, 20 bp, Artificial
  CRISPR gRNA sequence
cttttgtgaattacctgctc

SEQ ID NO: 522642 - DNA, 20 bp, Artificial
  CRISPR gRNA sequence
ttttgtgaattacctgctca

SEQ ID NO: 522643 - DNA, 20 bp, Artificial
  CRISPR gRNA sequence
ttgtgaattacctgctcagg

SEQ ID NO: 522644 - DNA, 20 bp, Artificial
  CRISPR gRNA sequence
tgtgaattacctgctcaggg

SEQ ID NO: 522645 - DNA, 20 bp, Artificial
  CRISPR gRNA sequence
gtgaattacctgctcagggt

SEQ ID NO: 522646 - DNA, 20 bp, Artificial
  CRISPR gRNA sequence
tgaattacctgctcagggtg

SEQ ID NO: 522647 - DNA, 20 bp, Artificial
  CRISPR gRNA sequence
cctgctcagggtgccacacc

SEQ ID NO: 522648 - DNA, 20 bp, Artificial
  CRISPR gRNA sequence
ctcagggtgccacacccttg

SEQ ID NO: 522649 - DNA, 20 bp, Artificial
  CRISPR gRNA sequence
agggtgccacacccttgaaa

SEQ ID NO: 522650 - DNA, 20 bp, Artificial
  CRISPR gRNA sequence
gaaacatccttgaatggagt

SEQ ID NO: 522651 - DNA, 20 bp, Artificial
  CRISPR gRNA sequence
aaacatccttgaatggagta

SEQ ID NO: 522652 - DNA, 20 bp, Artificial
  CRISPR gRNA sequence
gaatggagtatttacctttt

SEQ ID NO: 522653 - DNA, 20 bp, Artificial
  CRISPR gRNA sequence
aatggagtatttaccttttt

SEQ ID NO: 522654 - DNA, 20 bp, Artificial
  CRISPR gRNA sequence
acctttttgttattaatttc

SEQ ID NO: 522655 - DNA, 20 bp, Artificial
  CRISPR gRNA sequence
cctttttgttattaatttct

SEQ ID NO: 522656 - DNA, 20 bp, Artificial
  CRISPR gRNA sequence
tttgttattaatttctaaga

SEQ ID NO: 522657 - DNA, 20 bp, Artificial
  CRISPR gRNA sequence
ttgttattaatttctaagat

SEQ ID NO: 522658 - DNA, 20 bp, Artificial
  CRISPR gRNA sequence
tgttattaatttctaagatc

SEQ ID NO: 522659 - DNA, 20 bp, Artificial
  CRISPR gRNA sequence
gttattaatttctaagatct

SEQ ID NO: 522660 - DNA, 20 bp, Artificial
  CRISPR gRNA sequence
ttattaatttctaagatctc

SEQ ID NO: 522661 - DNA, 20 bp, Artificial
  CRISPR gRNA sequence
ttaatttctaagatctcttt

SEQ ID NO: 522662 - DNA, 20 bp, Artificial
  CRISPR gRNA sequence
atttctaagatctctttaga

SEQ ID NO: 522663 - DNA, 20 bp, Artificial
  CRISPR gRNA sequence
ctaagatctctttagagatg

SEQ ID NO: 522664 - DNA, 20 bp, Artificial
  CRISPR gRNA sequence
taagatctctttagagatga

SEQ ID NO: 522665 - DNA, 20 bp, Artificial
  CRISPR gRNA sequence
agatctctttagagatgaag

SEQ ID NO: 522666 - DNA, 20 bp, Artificial
  CRISPR gRNA sequence
tttagagatgaagattacca

SEQ ID NO: 522667 - DNA, 20 bp, Artificial
  CRISPR gRNA sequence
tagagatgaagattaccatt

SEQ ID NO: 522668 - DNA, 20 bp, Artificial
  CRISPR gRNA sequence
agagatgaagattaccattt

SEQ ID NO: 522669 - DNA, 20 bp, Artificial
  CRISPR gRNA sequence
gagatgaagattaccattta

SEQ ID NO: 522670 - DNA, 20 bp, Artificial
  CRISPR gRNA sequence
ccatttaccttttgcactag

SEQ ID NO: 522671 - DNA, 20 bp, Artificial
  CRISPR gRNA sequence
accttttgcactagagagat

SEQ ID NO: 522672 - DNA, 20 bp, Artificial
  CRISPR gRNA sequence
ccttttgcactagagagata

SEQ ID NO: 522673 - DNA, 20 bp, Artificial
  CRISPR gRNA sequence
ttgcactagagagataatag

SEQ ID NO: 522674 - DNA, 20 bp, Artificial
  CRISPR gRNA sequence
tgcactagagagataatagc

SEQ ID NO: 522675 - DNA, 20 bp, Artificial
  CRISPR gRNA sequence
gcactagagagataatagct

SEQ ID NO: 522676 - DNA, 20 bp, Artificial
  CRISPR gRNA sequence
cactagagagataatagcta

SEQ ID NO: 522677 - DNA, 20 bp, Artificial
  CRISPR gRNA sequence
gagagataatagctatttcc

SEQ ID NO: 522678 - DNA, 20 bp, Artificial
  CRISPR gRNA sequence
tttcctctatgcaatttgtt

SEQ ID NO: 522679 - DNA, 20 bp, Artificial
  CRISPR gRNA sequence
cctctatgcaatttgttagt

SEQ ID NO: 522680 - DNA, 20 bp, Artificial
  CRISPR gRNA sequence
ctctatgcaatttgttagta

SEQ ID NO: 522681 - DNA, 20 bp, Artificial
  CRISPR gRNA sequence
tatgcaatttgttagtacaa

SEQ ID NO: 522682 - DNA, 20 bp, Artificial
  CRISPR gRNA sequence
tgcaatttgttagtacaaca

SEQ ID NO: 522683 - DNA, 20 bp, Artificial
  CRISPR gRNA sequence
gttagtacaacatgtgccat

SEQ ID NO: 522684 - DNA, 20 bp, Artificial
  CRISPR gRNA sequence
ttagtacaacatgtgccatt

SEQ ID NO: 522685 - DNA, 20 bp, Artificial
  CRISPR gRNA sequence
gtacaacatgtgccattttt

SEQ ID NO: 522686 - DNA, 20 bp, Artificial
  CRISPR gRNA sequence
ttagagtctgtcttcttgct

SEQ ID NO: 522687 - DNA, 20 bp, Artificial
  CRISPR gRNA sequence
tagagtctgtcttcttgcta

SEQ ID NO: 522688 - DNA, 20 bp, Artificial
  CRISPR gRNA sequence
agagtctgtcttcttgctat

SEQ ID NO: 522689 - DNA, 20 bp, Artificial
  CRISPR gRNA sequence
gagtctgtcttcttgctatt

SEQ ID NO: 522690 - DNA, 20 bp, Artificial
  CRISPR gRNA sequence
tcttcttgctattttccccc

SEQ ID NO: 522691 - DNA, 20 bp, Artificial
  CRISPR gRNA sequence
cttgctattttcccccttag

SEQ ID NO: 522692 - DNA, 20 bp, Artificial
  CRISPR gRNA sequence
ttgctattttcccccttagc

SEQ ID NO: 522693 - DNA, 20 bp, Artificial
  CRISPR gRNA sequence
gctattttcccccttagctt

SEQ ID NO: 522694 - DNA, 20 bp, Artificial
  CRISPR gRNA sequence
ctattttcccccttagcttt

SEQ ID NO: 522695 - DNA, 20 bp, Artificial
  CRISPR gRNA sequence
ttttcccccttagctttttt

SEQ ID NO: 522696 - DNA, 20 bp, Artificial
  CRISPR gRNA sequence
tcccccttagcttttttttt

SEQ ID NO: 522697 - DNA, 20 bp, Artificial
  CRISPR gRNA sequence
cccccttagctttttttttt

SEQ ID NO: 522698 - DNA, 20 bp, Artificial
  CRISPR gRNA sequence
ccccttagcttttttttttt

SEQ ID NO: 522699 - DNA, 20 bp, Artificial
  CRISPR gRNA sequence
agctttttttttttttttct

SEQ ID NO: 522700 - DNA, 20 bp, Artificial
  CRISPR gRNA sequence
gctttttttttttttttctt

SEQ ID NO: 522701 - DNA, 20 bp, Artificial
  CRISPR gRNA sequence
tttttttttttttcttttga

SEQ ID NO: 522702 - DNA, 20 bp, Artificial
  CRISPR gRNA sequence
ttttttttttttcttttgag

SEQ ID NO: 522703 - DNA, 20 bp, Artificial
  CRISPR gRNA sequence
tttttttttttcttttgaga

SEQ ID NO: 522704 - DNA, 20 bp, Artificial
  CRISPR gRNA sequence
ttttttttttcttttgagac

SEQ ID NO: 522705 - DNA, 20 bp, Artificial
  CRISPR gRNA sequence
tttttttttcttttgagaca

SEQ ID NO: 522706 - DNA, 20 bp, Artificial
  CRISPR gRNA sequence
ttttttttcttttgagacag

SEQ ID NO: 522707 - DNA, 20 bp, Artificial
  CRISPR gRNA sequence
tttttttcttttgagacagt

SEQ ID NO: 522708 - DNA, 20 bp, Artificial
  CRISPR gRNA sequence
ttttttcttttgagacagtt

SEQ ID NO: 522709 - DNA, 20 bp, Artificial
  CRISPR gRNA sequence
tttttcttttgagacagttt

SEQ ID NO: 522710 - DNA, 20 bp, Artificial
  CRISPR gRNA sequence
ttttcttttgagacagtttc

SEQ ID NO: 522711 - DNA, 20 bp, Artificial
  CRISPR gRNA sequence
tttcttttgagacagtttca

SEQ ID NO: 522712 - DNA, 20 bp, Artificial
  CRISPR gRNA sequence
ttcttttgagacagtttcac

SEQ ID NO: 522713 - DNA, 20 bp, Artificial
  CRISPR gRNA sequence
tcttttgagacagtttcact

SEQ ID NO: 522714 - DNA, 20 bp, Artificial
  CRISPR gRNA sequence
cttttgagacagtttcactc

SEQ ID NO: 522715 - DNA, 20 bp, Artificial
  CRISPR gRNA sequence
ttttgagacagtttcactct

SEQ ID NO: 522716 - DNA, 20 bp, Artificial
  CRISPR gRNA sequence
ttgagacagtttcactcttg

SEQ ID NO: 522717 - DNA, 20 bp, Artificial
  CRISPR gRNA sequence
tgagacagtttcactcttgt

SEQ ID NO: 522718 - DNA, 20 bp, Artificial
  CRISPR gRNA sequence
gagacagtttcactcttgtt

SEQ ID NO: 522719 - DNA, 20 bp, Artificial
  CRISPR gRNA sequence
agacagtttcactcttgttg

SEQ ID NO: 522720 - DNA, 20 bp, Artificial
  CRISPR gRNA sequence
cactcttgttgcccaggctg

SEQ ID NO: 522721 - DNA, 20 bp, Artificial
  CRISPR gRNA sequence
actcttgttgcccaggctgg

SEQ ID NO: 522722 - DNA, 20 bp, Artificial
  CRISPR gRNA sequence
ttgttgcccaggctggagtg

SEQ ID NO: 522723 - DNA, 20 bp, Artificial
  CRISPR gRNA sequence
gttgcccaggctggagtgca

SEQ ID NO: 522724 - DNA, 20 bp, Artificial
  CRISPR gRNA sequence
ttgcccaggctggagtgcag

SEQ ID NO: 522725 - DNA, 20 bp, Artificial
  CRISPR gRNA sequence
cccaggctggagtgcagagg

SEQ ID NO: 522726 - DNA, 20 bp, Artificial
  CRISPR gRNA sequence
gagtgcagaggtgagatctc

SEQ ID NO: 522727 - DNA, 20 bp, Artificial
  CRISPR gRNA sequence
agctcactgcaccctctgcc

SEQ ID NO: 522728 - DNA, 20 bp, Artificial
  CRISPR gRNA sequence
actgcaccctctgcctcccg

SEQ ID NO: 522729 - DNA, 20 bp, Artificial
  CRISPR gRNA sequence
caccctctgcctcccgggct

SEQ ID NO: 522730 - DNA, 20 bp, Artificial
  CRISPR gRNA sequence
tgcctcccgggctcaagtga

SEQ ID NO: 522731 - DNA, 20 bp, Artificial
  CRISPR gRNA sequence
cctcccgggctcaagtgatt

SEQ ID NO: 522732 - DNA, 20 bp, Artificial
  CRISPR gRNA sequence
ccgggctcaagtgattctcc

SEQ ID NO: 522733 - DNA, 20 bp, Artificial
  CRISPR gRNA sequence
aagtgattctcctgcctcag

SEQ ID NO: 522734 - DNA, 20 bp, Artificial
  CRISPR gRNA sequence
tcctgcctcagcctcgcgag

SEQ ID NO: 522735 - DNA, 20 bp, Artificial
  CRISPR gRNA sequence
ctgcctcagcctcgcgagta

SEQ ID NO: 522736 - DNA, 20 bp, Artificial
  CRISPR gRNA sequence
cctcagcctcgcgagtagct

SEQ ID NO: 522737 - DNA, 20 bp, Artificial
  CRISPR gRNA sequence
agcctcgcgagtagctggga

SEQ ID NO: 522738 - DNA, 20 bp, Artificial
  CRISPR gRNA sequence
gcgagtagctgggattacag

SEQ ID NO: 522739 - DNA, 20 bp, Artificial
  CRISPR gRNA sequence
ggattacaggcgcccgccac

SEQ ID NO: 522740 - DNA, 20 bp, Artificial
  CRISPR gRNA sequence
caggcgcccgccaccaagcc

SEQ ID NO: 522741 - DNA, 20 bp, Artificial
  CRISPR gRNA sequence
atttatgtatttttagtaga

SEQ ID NO: 522742 - DNA, 20 bp, Artificial
  CRISPR gRNA sequence
atgtatttttagtagagatg

SEQ ID NO: 522743 - DNA, 20 bp, Artificial
  CRISPR gRNA sequence
tgtatttttagtagagatgg

SEQ ID NO: 522744 - DNA, 20 bp, Artificial
  CRISPR gRNA sequence
ttagtagagatggggtttca

SEQ ID NO: 522745 - DNA, 20 bp, Artificial
  CRISPR gRNA sequence
tagtagagatggggtttcac

SEQ ID NO: 522746 - DNA, 20 bp, Artificial
  CRISPR gRNA sequence
agtagagatggggtttcact

SEQ ID NO: 522747 - DNA, 20 bp, Artificial
  CRISPR gRNA sequence
gtagagatggggtttcacta

SEQ ID NO: 522748 - DNA, 20 bp, Artificial
  CRISPR gRNA sequence
cactatgttgctcaggctgg

SEQ ID NO: 522749 - DNA, 20 bp, Artificial
  CRISPR gRNA sequence
actatgttgctcaggctggt

SEQ ID NO: 522750 - DNA, 20 bp, Artificial
  CRISPR gRNA sequence
tgttgctcaggctggtctca

SEQ ID NO: 522751 - DNA, 20 bp, Artificial
  CRISPR gRNA sequence
ctcaggctggtctcaaactc

SEQ ID NO: 522752 - DNA, 20 bp, Artificial
  CRISPR gRNA sequence
aggctggtctcaaactcctg

SEQ ID NO: 522753 - DNA, 20 bp, Artificial
  CRISPR gRNA sequence
gtctcaaactcctgacctca

SEQ ID NO: 522754 - DNA, 20 bp, Artificial
  CRISPR gRNA sequence
aaactcctgacctcaggtga

SEQ ID NO: 522755 - DNA, 20 bp, Artificial
  CRISPR gRNA sequence
ctgacctcaggtgatccgcc

SEQ ID NO: 522756 - DNA, 20 bp, Artificial
  CRISPR gRNA sequence
acctcaggtgatccgcctgc

SEQ ID NO: 522757 - DNA, 20 bp, Artificial
  CRISPR gRNA sequence
aggtgatccgcctgcctcag

SEQ ID NO: 522758 - DNA, 20 bp, Artificial
  CRISPR gRNA sequence
cctcagcctcccaaagtgct

SEQ ID NO: 522759 - DNA, 20 bp, Artificial
  CRISPR gRNA sequence
agcctcccaaagtgctggga

SEQ ID NO: 522760 - DNA, 20 bp, Artificial
  CRISPR gRNA sequence
ccaaagtgctgggattacag

SEQ ID NO: 522761 - DNA, 20 bp, Artificial
  CRISPR gRNA sequence
ggattacaggcatgagccac

SEQ ID NO: 522762 - DNA, 20 bp, Artificial
  CRISPR gRNA sequence
caggcatgagccaccatgcc

SEQ ID NO: 522763 - DNA, 20 bp, Artificial
  CRISPR gRNA sequence
cccttagcttttatgctgag

SEQ ID NO: 522764 - DNA, 20 bp, Artificial
  CRISPR gRNA sequence
agcttttatgctgaggtttc

SEQ ID NO: 522765 - DNA, 20 bp, Artificial
  CRISPR gRNA sequence
gcttttatgctgaggtttcc

SEQ ID NO: 522766 - DNA, 20 bp, Artificial
  CRISPR gRNA sequence
ttatgctgaggtttccttac

SEQ ID NO: 522767 - DNA, 20 bp, Artificial
  CRISPR gRNA sequence
tatgctgaggtttccttact

SEQ ID NO: 522768 - DNA, 20 bp, Artificial
  CRISPR gRNA sequence
atgctgaggtttccttactc

SEQ ID NO: 522769 - DNA, 20 bp, Artificial
  CRISPR gRNA sequence
tgctgaggtttccttactct

SEQ ID NO: 522770 - DNA, 20 bp, Artificial
  CRISPR gRNA sequence
aggtttccttactcttagat

SEQ ID NO: 522771 - DNA, 20 bp, Artificial
  CRISPR gRNA sequence
ccttactcttagatacctat

SEQ ID NO: 522772 - DNA, 20 bp, Artificial
  CRISPR gRNA sequence
cttactcttagatacctatt

SEQ ID NO: 522773 - DNA, 20 bp, Artificial
  CRISPR gRNA sequence
actcttagatacctattctt

SEQ ID NO: 522774 - DNA, 20 bp, Artificial
  CRISPR gRNA sequence
ctcttagatacctattcttc

SEQ ID NO: 522775 - DNA, 20 bp, Artificial
  CRISPR gRNA sequence
ttagatacctattcttctat

SEQ ID NO: 522776 - DNA, 20 bp, Artificial
  CRISPR gRNA sequence
agatacctattcttctattt

SEQ ID NO: 522777 - DNA, 20 bp, Artificial
  CRISPR gRNA sequence
gatacctattcttctatttc

SEQ ID NO: 522778 - DNA, 20 bp, Artificial
  CRISPR gRNA sequence
ttcttctatttcctttattg

SEQ ID NO: 522779 - DNA, 20 bp, Artificial
  CRISPR gRNA sequence
ttctatttcctttattgttt

SEQ ID NO: 522780 - DNA, 20 bp, Artificial
  CRISPR gRNA sequence
ctatttcctttattgtttta

SEQ ID NO: 522781 - DNA, 20 bp, Artificial
  CRISPR gRNA sequence
tatttcctttattgttttat

SEQ ID NO: 522782 - DNA, 20 bp, Artificial
  CRISPR gRNA sequence
tttcctttattgttttattc

SEQ ID NO: 522783 - DNA, 20 bp, Artificial
  CRISPR gRNA sequence
cctttattgttttattccct

SEQ ID NO: 522784 - DNA, 20 bp, Artificial
  CRISPR gRNA sequence
ctttattgttttattcccta

SEQ ID NO: 522785 - DNA, 20 bp, Artificial
  CRISPR gRNA sequence
tattgttttattccctaaaa

SEQ ID NO: 522786 - DNA, 20 bp, Artificial
  CRISPR gRNA sequence
attgttttattccctaaaac

SEQ ID NO: 522787 - DNA, 20 bp, Artificial
  CRISPR gRNA sequence
ttgttttattccctaaaact

SEQ ID NO: 522788 - DNA, 20 bp, Artificial
  CRISPR gRNA sequence
ttttattccctaaaactgaa

SEQ ID NO: 522789 - DNA, 20 bp, Artificial
  CRISPR gRNA sequence
tattccctaaaactgaagtc

SEQ ID NO: 522790 - DNA, 20 bp, Artificial
  CRISPR gRNA sequence
attccctaaaactgaagtcc

SEQ ID NO: 522791 - DNA, 20 bp, Artificial
  CRISPR gRNA sequence
ttccctaaaactgaagtcct

SEQ ID NO: 522792 - DNA, 20 bp, Artificial
  CRISPR gRNA sequence
cctaaaactgaagtcctaca

SEQ ID NO: 522793 - DNA, 20 bp, Artificial
  CRISPR gRNA sequence
aaactgaagtcctacacatt

SEQ ID NO: 522794 - DNA, 20 bp, Artificial
  CRISPR gRNA sequence
aagtcctacacatttgtggc

SEQ ID NO: 522795 - DNA, 20 bp, Artificial
  CRISPR gRNA sequence
cacatttgtggccattcttt

SEQ ID NO: 522796 - DNA, 20 bp, Artificial
  CRISPR gRNA sequence
gtggccattcttttatgtcc

SEQ ID NO: 522797 - DNA, 20 bp, Artificial
  CRISPR gRNA sequence
tggccattcttttatgtcca

SEQ ID NO: 522798 - DNA, 20 bp, Artificial
  CRISPR gRNA sequence
ttttatgtccacagcaagag

SEQ ID NO: 522799 - DNA, 20 bp, Artificial
  CRISPR gRNA sequence
ttatgtccacagcaagagtg

SEQ ID NO: 522800 - DNA, 20 bp, Artificial
  CRISPR gRNA sequence
tatgtccacagcaagagtgt

SEQ ID NO: 522801 - DNA, 20 bp, Artificial
  CRISPR gRNA sequence
atgtccacagcaagagtgtc

SEQ ID NO: 522802 - DNA, 20 bp, Artificial
  CRISPR gRNA sequence
tgtccacagcaagagtgtcc

SEQ ID NO: 522803 - DNA, 20 bp, Artificial
  CRISPR gRNA sequence
ggcctcacgtcgccacccag

SEQ ID NO: 522804 - DNA, 20 bp, Artificial
  CRISPR gRNA sequence
acgtcgccacccaggaacag

SEQ ID NO: 522805 - DNA, 20 bp, Artificial
  CRISPR gRNA sequence
cttcatgttagatggaggag

SEQ ID NO: 522806 - DNA, 20 bp, Artificial
  CRISPR gRNA sequence
catgttagatggaggagtgg

SEQ ID NO: 522807 - DNA, 20 bp, Artificial
  CRISPR gRNA sequence
atgttagatggaggagtggt

SEQ ID NO: 522808 - DNA, 20 bp, Artificial
  CRISPR gRNA sequence
gatggaggagtggtgtcccc

SEQ ID NO: 522809 - DNA, 20 bp, Artificial
  CRISPR gRNA sequence
gtctaaaatgctgtaaatat

SEQ ID NO: 522810 - DNA, 20 bp, Artificial
  CRISPR gRNA sequence
tctaaaatgctgtaaatatc

SEQ ID NO: 522811 - DNA, 20 bp, Artificial
  CRISPR gRNA sequence
aaatgctgtaaatatcattt

SEQ ID NO: 522812 - DNA, 20 bp, Artificial
  CRISPR gRNA sequence
taaatatcatttgatttccc

SEQ ID NO: 522813 - DNA, 20 bp, Artificial
  CRISPR gRNA sequence
gatttccctttgacttcagg

SEQ ID NO: 522814 - DNA, 20 bp, Artificial
  CRISPR gRNA sequence
atttccctttgacttcaggt

SEQ ID NO: 522815 - DNA, 20 bp, Artificial
  CRISPR gRNA sequence
ccctttgacttcaggtattt

SEQ ID NO: 522816 - DNA, 20 bp, Artificial
  CRISPR gRNA sequence
cctttgacttcaggtattta

SEQ ID NO: 522817 - DNA, 20 bp, Artificial
  CRISPR gRNA sequence
tgacttcaggtatttagcag

SEQ ID NO: 522818 - DNA, 20 bp, Artificial
  CRISPR gRNA sequence
gacttcaggtatttagcaga

SEQ ID NO: 522819 - DNA, 20 bp, Artificial
  CRISPR gRNA sequence
acttcaggtatttagcagag

SEQ ID NO: 522820 - DNA, 20 bp, Artificial
  CRISPR gRNA sequence
caggtatttagcagagtact

SEQ ID NO: 522821 - DNA, 20 bp, Artificial
  CRISPR gRNA sequence
aggtatttagcagagtactt

SEQ ID NO: 522822 - DNA, 20 bp, Artificial
  CRISPR gRNA sequence
agcagagtactttagcattc

SEQ ID NO: 522823 - DNA, 20 bp, Artificial
  CRISPR gRNA sequence
gcagagtactttagcattcc

SEQ ID NO: 522824 - DNA, 20 bp, Artificial
  CRISPR gRNA sequence
tagcattccttattaatatg

SEQ ID NO: 522825 - DNA, 20 bp, Artificial
  CRISPR gRNA sequence
agcattccttattaatatgt

SEQ ID NO: 522826 - DNA, 20 bp, Artificial
  CRISPR gRNA sequence
gcattccttattaatatgtg

SEQ ID NO: 522827 - DNA, 20 bp, Artificial
  CRISPR gRNA sequence
cttattaatatgtgtgtgtc

SEQ ID NO: 522828 - DNA, 20 bp, Artificial
  CRISPR gRNA sequence
attaatatgtgtgtgtcggg

SEQ ID NO: 522829 - DNA, 20 bp, Artificial
  CRISPR gRNA sequence
ttaatatgtgtgtgtcgggg

SEQ ID NO: 522830 - DNA, 20 bp, Artificial
  CRISPR gRNA sequence
atatgtgtgtgtcggggggg

SEQ ID NO: 522831 - DNA, 20 bp, Artificial
  CRISPR gRNA sequence
attttatttcatttggccag

SEQ ID NO: 522832 - DNA, 20 bp, Artificial
  CRISPR gRNA sequence
tatttcatttggccagaaat

SEQ ID NO: 522833 - DNA, 20 bp, Artificial
  CRISPR gRNA sequence
atttcatttggccagaaatt

SEQ ID NO: 522834 - DNA, 20 bp, Artificial
  CRISPR gRNA sequence
tttcatttggccagaaattg

SEQ ID NO: 522835 - DNA, 20 bp, Artificial
  CRISPR gRNA sequence
catttggccagaaattgtgg

SEQ ID NO: 522836 - DNA, 20 bp, Artificial
  CRISPR gRNA sequence
atttggccagaaattgtggc

SEQ ID NO: 522837 - DNA, 20 bp, Artificial
  CRISPR gRNA sequence
ggccagaaattgtggccttt

SEQ ID NO: 522838 - DNA, 20 bp, Artificial
  CRISPR gRNA sequence
gccagaaattgtggccttta

SEQ ID NO: 522839 - DNA, 20 bp, Artificial
  CRISPR gRNA sequence
tggcctttaaaatttgtgct

SEQ ID NO: 522840 - DNA, 20 bp, Artificial
  CRISPR gRNA sequence
taaaatttgtgctatcaggc

SEQ ID NO: 522841 - DNA, 20 bp, Artificial
  CRISPR gRNA sequence
aaaatttgtgctatcaggcc

SEQ ID NO: 522842 - DNA, 20 bp, Artificial
  CRISPR gRNA sequence
aaatttgtgctatcaggccg

SEQ ID NO: 522843 - DNA, 20 bp, Artificial
  CRISPR gRNA sequence
gtgctatcaggccgggcgca

SEQ ID NO: 522844 - DNA, 20 bp, Artificial
  CRISPR gRNA sequence
tgctatcaggccgggcgcag

SEQ ID NO: 522845 - DNA, 20 bp, Artificial
  CRISPR gRNA sequence
tcaggccgggcgcagtggct

SEQ ID NO: 522846 - DNA, 20 bp, Artificial
  CRISPR gRNA sequence
acgcctgtaatcccagcact

SEQ ID NO: 522847 - DNA, 20 bp, Artificial
  CRISPR gRNA sequence
taatcccagcactttgggag

SEQ ID NO: 522848 - DNA, 20 bp, Artificial
  CRISPR gRNA sequence
tgggaggccgaggcaggcgg

SEQ ID NO: 522849 - DNA, 20 bp, Artificial
  CRISPR gRNA sequence
gggaggccgaggcaggcgga

SEQ ID NO: 522850 - DNA, 20 bp, Artificial
  CRISPR gRNA sequence
ggaggccgaggcaggcggat

SEQ ID NO: 522851 - DNA, 20 bp, Artificial
  CRISPR gRNA sequence
gagaccagcctggccaatat

SEQ ID NO: 522852 - DNA, 20 bp, Artificial
  CRISPR gRNA sequence
gccaatatggtgaaactcca

SEQ ID NO: 522853 - DNA, 20 bp, Artificial
  CRISPR gRNA sequence
catctctactaaaaatacaa

SEQ ID NO: 522854 - DNA, 20 bp, Artificial
  CRISPR gRNA sequence
tactaaaaatacaaaaatta

SEQ ID NO: 522855 - DNA, 20 bp, Artificial
  CRISPR gRNA sequence
ctaaaaatacaaaaattagc

SEQ ID NO: 522856 - DNA, 20 bp, Artificial
  CRISPR gRNA sequence
aaaatacaaaaattagctgg

SEQ ID NO: 522857 - DNA, 20 bp, Artificial
  CRISPR gRNA sequence
gctgggcctagtggtgtgca

SEQ ID NO: 522858 - DNA, 20 bp, Artificial
  CRISPR gRNA sequence
ggcctagtggtgtgcaccta

SEQ ID NO: 522859 - DNA, 20 bp, Artificial
  CRISPR gRNA sequence
gtggtgtgcacctatagtcc

SEQ ID NO: 522860 - DNA, 20 bp, Artificial
  CRISPR gRNA sequence
tagtcccagctactcaggag

SEQ ID NO: 522861 - DNA, 20 bp, Artificial
  CRISPR gRNA sequence
ctcaggaggctgaggcagaa

SEQ ID NO: 522862 - DNA, 20 bp, Artificial
  CRISPR gRNA sequence
aggaggctgaggcagaagaa

SEQ ID NO: 522863 - DNA, 20 bp, Artificial
  CRISPR gRNA sequence
aggcagaagaatttcttgaa

SEQ ID NO: 522864 - DNA, 20 bp, Artificial
  CRISPR gRNA sequence
cttgaacatgggaggcggag

SEQ ID NO: 522865 - DNA, 20 bp, Artificial
  CRISPR gRNA sequence
ttgaacatgggaggcggagg

SEQ ID NO: 522866 - DNA, 20 bp, Artificial
  CRISPR gRNA sequence
gaacatgggaggcggaggtt

SEQ ID NO: 522867 - DNA, 20 bp, Artificial
  CRISPR gRNA sequence
aacatgggaggcggaggttg

SEQ ID NO: 522868 - DNA, 20 bp, Artificial
  CRISPR gRNA sequence
cagtgagccgagatctagcc

SEQ ID NO: 522869 - DNA, 20 bp, Artificial
  CRISPR gRNA sequence
gccattgcactccagcctgg

SEQ ID NO: 522870 - DNA, 20 bp, Artificial
  CRISPR gRNA sequence
cactccagcctggatgacag

SEQ ID NO: 522871 - DNA, 20 bp, Artificial
  CRISPR gRNA sequence
cagcctggatgacagagtga

SEQ ID NO: 522872 - DNA, 20 bp, Artificial
  CRISPR gRNA sequence
gatgacagagtgagactcca

SEQ ID NO: 522873 - DNA, 20 bp, Artificial
  CRISPR gRNA sequence
catctcaaaaaaacaaacaa

SEQ ID NO: 522874 - DNA, 20 bp, Artificial
  CRISPR gRNA sequence
aaaaaaacaaacaaacaaac

SEQ ID NO: 522875 - DNA, 20 bp, Artificial
  CRISPR gRNA sequence
tgctatcaaacttcacagat

SEQ ID NO: 522876 - DNA, 20 bp, Artificial
  CRISPR gRNA sequence
tcaaacttcacagatagtca

SEQ ID NO: 522877 - DNA, 20 bp, Artificial
  CRISPR gRNA sequence
cacagatagtcaaaccaaca

SEQ ID NO: 522878 - DNA, 20 bp, Artificial
  CRISPR gRNA sequence
acagatagtcaaaccaacag

SEQ ID NO: 522879 - DNA, 20 bp, Artificial
  CRISPR gRNA sequence
cctgacccttgggaaaatac

SEQ ID NO: 522880 - DNA, 20 bp, Artificial
  CRISPR gRNA sequence
acccttgggaaaatacgctt

SEQ ID NO: 522881 - DNA, 20 bp, Artificial
  CRISPR gRNA sequence
gggaaaatacgcttttgcag

SEQ ID NO: 522882 - DNA, 20 bp, Artificial
  CRISPR gRNA sequence
ggaaaatacgcttttgcagg

SEQ ID NO: 522883 - DNA, 20 bp, Artificial
  CRISPR gRNA sequence
ttgcagggtcgcaggttcag

SEQ ID NO: 522884 - DNA, 20 bp, Artificial
  CRISPR gRNA sequence
tgcagggtcgcaggttcaga

SEQ ID NO: 522885 - DNA, 20 bp, Artificial
  CRISPR gRNA sequence
gcagggtcgcaggttcagag

SEQ ID NO: 522886 - DNA, 20 bp, Artificial
  CRISPR gRNA sequence
cagggtcgcaggttcagagg

SEQ ID NO: 522887 - DNA, 20 bp, Artificial
  CRISPR gRNA sequence
agaggcgacatgggctgggt

SEQ ID NO: 522888 - DNA, 20 bp, Artificial
  CRISPR gRNA sequence
ggttttcctgcatcctctct

SEQ ID NO: 522889 - DNA, 20 bp, Artificial
  CRISPR gRNA sequence
tcctgcatcctctctgctcc

SEQ ID NO: 522890 - DNA, 20 bp, Artificial
  CRISPR gRNA sequence
cctgcatcctctctgctccg

SEQ ID NO: 522891 - DNA, 20 bp, Artificial
  CRISPR gRNA sequence
ctgcatcctctctgctccga

SEQ ID NO: 522892 - DNA, 20 bp, Artificial
  CRISPR gRNA sequence
catcctctctgctccgactt

SEQ ID NO: 522893 - DNA, 20 bp, Artificial
  CRISPR gRNA sequence
tctgctccgacttgttccta

SEQ ID NO: 522894 - DNA, 20 bp, Artificial
  CRISPR gRNA sequence
tgctccgacttgttcctatt

SEQ ID NO: 522895 - DNA, 20 bp, Artificial
  CRISPR gRNA sequence
ctccgacttgttcctatttg

SEQ ID NO: 522896 - DNA, 20 bp, Artificial
  CRISPR gRNA sequence
cgacttgttcctatttgatc

SEQ ID NO: 522897 - DNA, 20 bp, Artificial
  CRISPR gRNA sequence
gttcctatttgatctgacct

SEQ ID NO: 522898 - DNA, 20 bp, Artificial
  CRISPR gRNA sequence
ttcctatttgatctgacctg

SEQ ID NO: 522899 - DNA, 20 bp, Artificial
  CRISPR gRNA sequence
ctatttgatctgacctgttt

SEQ ID NO: 522900 - DNA, 20 bp, Artificial
  CRISPR gRNA sequence
tttgatctgacctgtttttg

SEQ ID NO: 522901 - DNA, 20 bp, Artificial
  CRISPR gRNA sequence
gatctgacctgtttttgtcc

SEQ ID NO: 522902 - DNA, 20 bp, Artificial
  CRISPR gRNA sequence
atctgacctgtttttgtccc

SEQ ID NO: 522903 - DNA, 20 bp, Artificial
  CRISPR gRNA sequence
acctgtttttgtccctggat

SEQ ID NO: 522904 - DNA, 20 bp, Artificial
  CRISPR gRNA sequence
tttttgtccctggatttcct

SEQ ID NO: 522905 - DNA, 20 bp, Artificial
  CRISPR gRNA sequence
ttgtccctggatttcctgga

SEQ ID NO: 522906 - DNA, 20 bp, Artificial
  CRISPR gRNA sequence
tgtccctggatttcctggag

SEQ ID NO: 522907 - DNA, 20 bp, Artificial
  CRISPR gRNA sequence
gtccctggatttcctggagc

SEQ ID NO: 522908 - DNA, 20 bp, Artificial
  CRISPR gRNA sequence
tccctggatttcctggagcc

SEQ ID NO: 522909 - DNA, 20 bp, Artificial
  CRISPR gRNA sequence
gatttcctggagcctctgtg

SEQ ID NO: 522910 - DNA, 20 bp, Artificial
  CRISPR gRNA sequence
cctggagcctctgtgatcca

SEQ ID NO: 522911 - DNA, 20 bp, Artificial
  CRISPR gRNA sequence
ctggagcctctgtgatccaa

SEQ ID NO: 522912 - DNA, 20 bp, Artificial
  CRISPR gRNA sequence
gagcctctgtgatccaagga

SEQ ID NO: 522913 - DNA, 20 bp, Artificial
  CRISPR gRNA sequence
tgtgatccaaggacagtgtt

SEQ ID NO: 522914 - DNA, 20 bp, Artificial
  CRISPR gRNA sequence
tgatccaaggacagtgttcc

SEQ ID NO: 522915 - DNA, 20 bp, Artificial
  CRISPR gRNA sequence
cagtccccacctgacggcac

SEQ ID NO: 522916 - DNA, 20 bp, Artificial
  CRISPR gRNA sequence
acggcacttctctccagttc

SEQ ID NO: 522917 - DNA, 20 bp, Artificial
  CRISPR gRNA sequence
ctctccagttctttatcaca

SEQ ID NO: 522918 - DNA, 20 bp, Artificial
  CRISPR gRNA sequence
tctccagttctttatcacat

SEQ ID NO: 522919 - DNA, 20 bp, Artificial
  CRISPR gRNA sequence
tccagttctttatcacattc

SEQ ID NO: 522920 - DNA, 20 bp, Artificial
  CRISPR gRNA sequence
cagttctttatcacattcct

SEQ ID NO: 522921 - DNA, 20 bp, Artificial
  CRISPR gRNA sequence
tttatcacattcctacaaag

SEQ ID NO: 522922 - DNA, 20 bp, Artificial
  CRISPR gRNA sequence
tatcacattcctacaaagca

SEQ ID NO: 522923 - DNA, 20 bp, Artificial
  CRISPR gRNA sequence
atcacattcctacaaagcag

SEQ ID NO: 522924 - DNA, 20 bp, Artificial
  CRISPR gRNA sequence
tcacattcctacaaagcaga

SEQ ID NO: 522925 - DNA, 20 bp, Artificial
  CRISPR gRNA sequence
ctacaaagcagaaatgagtc

SEQ ID NO: 522926 - DNA, 20 bp, Artificial
  CRISPR gRNA sequence
caaagcagaaatgagtccat

SEQ ID NO: 522927 - DNA, 20 bp, Artificial
  CRISPR gRNA sequence
gatgctctggcttttggctt

SEQ ID NO: 522928 - DNA, 20 bp, Artificial
  CRISPR gRNA sequence
atgctctggcttttggctta

SEQ ID NO: 522929 - DNA, 20 bp, Artificial
  CRISPR gRNA sequence
tggcttttggcttaaaaggt

SEQ ID NO: 522930 - DNA, 20 bp, Artificial
  CRISPR gRNA sequence
gcttttggcttaaaaggtgg

SEQ ID NO: 522931 - DNA, 20 bp, Artificial
  CRISPR gRNA sequence
ttggcttaaaaggtggatgc

SEQ ID NO: 522932 - DNA, 20 bp, Artificial
  CRISPR gRNA sequence
tggcttaaaaggtggatgcc

SEQ ID NO: 522933 - DNA, 20 bp, Artificial
  CRISPR gRNA sequence
ggcttaaaaggtggatgcct

SEQ ID NO: 522934 - DNA, 20 bp, Artificial
  CRISPR gRNA sequence
gcttaaaaggtggatgccta

SEQ ID NO: 522935 - DNA, 20 bp, Artificial
  CRISPR gRNA sequence
aaaaggtggatgcctagttt

SEQ ID NO: 522936 - DNA, 20 bp, Artificial
  CRISPR gRNA sequence
aaaggtggatgcctagttta

SEQ ID NO: 522937 - DNA, 20 bp, Artificial
  CRISPR gRNA sequence
gtttataatcatcccttgag

SEQ ID NO: 522938 - DNA, 20 bp, Artificial
  CRISPR gRNA sequence
ataatcatcccttgagcctt

SEQ ID NO: 522939 - DNA, 20 bp, Artificial
  CRISPR gRNA sequence
taatcatcccttgagccttc

SEQ ID NO: 522940 - DNA, 20 bp, Artificial
  CRISPR gRNA sequence
gagccttcagttcccagcgc

SEQ ID NO: 522941 - DNA, 20 bp, Artificial
  CRISPR gRNA sequence
agccttcagttcccagcgca

SEQ ID NO: 522942 - DNA, 20 bp, Artificial
  CRISPR gRNA sequence
cagttcccagcgcaggggtt

SEQ ID NO: 522943 - DNA, 20 bp, Artificial
  CRISPR gRNA sequence
agttcccagcgcaggggttg

SEQ ID NO: 522944 - DNA, 20 bp, Artificial
  CRISPR gRNA sequence
ccagcgcaggggttggctcc

SEQ ID NO: 522945 - DNA, 20 bp, Artificial
  CRISPR gRNA sequence
gctcccatgtcctcttcctt

SEQ ID NO: 522946 - DNA, 20 bp, Artificial
  CRISPR gRNA sequence
ccatgtcctcttccttccaa

SEQ ID NO: 522947 - DNA, 20 bp, Artificial
  CRISPR gRNA sequence
ttccttccaaccttgtcccc

SEQ ID NO: 522948 - DNA, 20 bp, Artificial
  CRISPR gRNA sequence
ccttccaaccttgtcccctg

SEQ ID NO: 522949 - DNA, 20 bp, Artificial
  CRISPR gRNA sequence
cttccaaccttgtcccctgg

SEQ ID NO: 522950 - DNA, 20 bp, Artificial
  CRISPR gRNA sequence
ccaaccttgtcccctggcgg

SEQ ID NO: 522951 - DNA, 20 bp, Artificial
  CRISPR gRNA sequence
caaccttgtcccctggcggc

SEQ ID NO: 522952 - DNA, 20 bp, Artificial
  CRISPR gRNA sequence
gtcccctggcggcatcgtcc

SEQ ID NO: 522953 - DNA, 20 bp, Artificial
  CRISPR gRNA sequence
tcccctggcggcatcgtcca

SEQ ID NO: 522954 - DNA, 20 bp, Artificial
  CRISPR gRNA sequence
gcggcatcgtccatcacttc

SEQ ID NO: 522955 - DNA, 20 bp, Artificial
  CRISPR gRNA sequence
cccgcgcacctccgagtcac

SEQ ID NO: 522956 - DNA, 20 bp, Artificial
  CRISPR gRNA sequence
ccgcgcacctccgagtcact

SEQ ID NO: 522957 - DNA, 20 bp, Artificial
  CRISPR gRNA sequence
cgagtcactttgatgcgagt

SEQ ID NO: 522958 - DNA, 20 bp, Artificial
  CRISPR gRNA sequence
tgatgcgagtgcctctcctc

SEQ ID NO: 522959 - DNA, 20 bp, Artificial
  CRISPR gRNA sequence
gatgcgagtgcctctcctct

SEQ ID NO: 522960 - DNA, 20 bp, Artificial
  CRISPR gRNA sequence
atgcgagtgcctctcctcta

SEQ ID NO: 522961 - DNA, 20 bp, Artificial
  CRISPR gRNA sequence
tcctctaggacagcgcaagg

SEQ ID NO: 522962 - DNA, 20 bp, Artificial
  CRISPR gRNA sequence
ctctaggacagcgcaaggtg

SEQ ID NO: 522963 - DNA, 20 bp, Artificial
  CRISPR gRNA sequence
taggacagcgcaaggtgggt

SEQ ID NO: 522964 - DNA, 20 bp, Artificial
  CRISPR gRNA sequence
ggacagcgcaaggtgggttt

SEQ ID NO: 522965 - DNA, 20 bp, Artificial
  CRISPR gRNA sequence
cagcacaggcaggaggaagc

SEQ ID NO: 522966 - DNA, 20 bp, Artificial
  CRISPR gRNA sequence
agcacaggcaggaggaagct

SEQ ID NO: 522967 - DNA, 20 bp, Artificial
  CRISPR gRNA sequence
tgatgcaaagttccaatggg

SEQ ID NO: 522968 - DNA, 20 bp, Artificial
  CRISPR gRNA sequence
atgcaaagttccaatgggtc

SEQ ID NO: 522969 - DNA, 20 bp, Artificial
  CRISPR gRNA sequence
caatgggtctgcggggcctc

SEQ ID NO: 522970 - DNA, 20 bp, Artificial
  CRISPR gRNA sequence
cggggcctctggttcctcaa

SEQ ID NO: 522971 - DNA, 20 bp, Artificial
  CRISPR gRNA sequence
tggttcctcaagcagtctcg

SEQ ID NO: 522972 - DNA, 20 bp, Artificial
  CRISPR gRNA sequence
gttcctcaagcagtctcgtc

SEQ ID NO: 522973 - DNA, 20 bp, Artificial
  CRISPR gRNA sequence
ctcaagcagtctcgtcttag

SEQ ID NO: 522974 - DNA, 20 bp, Artificial
  CRISPR gRNA sequence
aagcagtctcgtcttagggt

SEQ ID NO: 522975 - DNA, 20 bp, Artificial
  CRISPR gRNA sequence
gtcttagggttttacggggt

SEQ ID NO: 522976 - DNA, 20 bp, Artificial
  CRISPR gRNA sequence
agggttttacggggttgcaa

SEQ ID NO: 522977 - DNA, 20 bp, Artificial
  CRISPR gRNA sequence
gggttttacggggttgcaaa

SEQ ID NO: 522978 - DNA, 20 bp, Artificial
  CRISPR gRNA sequence
tacggggttgcaaaaaggaa

SEQ ID NO: 522979 - DNA, 20 bp, Artificial
  CRISPR gRNA sequence
acggggttgcaaaaaggaag

SEQ ID NO: 522980 - DNA, 20 bp, Artificial
  CRISPR gRNA sequence
cggggttgcaaaaaggaagc

SEQ ID NO: 522981 - DNA, 20 bp, Artificial
  CRISPR gRNA sequence
caaaaaggaagcctgagact

SEQ ID NO: 522982 - DNA, 20 bp, Artificial
  CRISPR gRNA sequence
agactgggcacggtggctca

SEQ ID NO: 522983 - DNA, 20 bp, Artificial
  CRISPR gRNA sequence
ggcacggtggctcacgcctg

SEQ ID NO: 522984 - DNA, 20 bp, Artificial
  CRISPR gRNA sequence
acgcctgtaatcccagcact

SEQ ID NO: 522985 - DNA, 20 bp, Artificial
  CRISPR gRNA sequence
taatcccagcactttgggag

SEQ ID NO: 522986 - DNA, 20 bp, Artificial
  CRISPR gRNA sequence
tgggaggccgaggtgggcgg

SEQ ID NO: 522987 - DNA, 20 bp, Artificial
  CRISPR gRNA sequence
gggaggccgaggtgggcgga

SEQ ID NO: 522988 - DNA, 20 bp, Artificial
  CRISPR gRNA sequence
ggaggccgaggtgggcggat

SEQ ID NO: 522989 - DNA, 20 bp, Artificial
  CRISPR gRNA sequence
atcaacacgatgaaacctcg

SEQ ID NO: 522990 - DNA, 20 bp, Artificial
  CRISPR gRNA sequence
gtctctactaaaaacacaaa

SEQ ID NO: 522991 - DNA, 20 bp, Artificial
  CRISPR gRNA sequence
tactaaaaacacaaaaaaat

SEQ ID NO: 522992 - DNA, 20 bp, Artificial
  CRISPR gRNA sequence
ctaaaaacacaaaaaaatta

SEQ ID NO: 522993 - DNA, 20 bp, Artificial
  CRISPR gRNA sequence
aaaacacaaaaaaattagct

SEQ ID NO: 522994 - DNA, 20 bp, Artificial
  CRISPR gRNA sequence
gctgggcgtggtcgtgggag

SEQ ID NO: 522995 - DNA, 20 bp, Artificial
  CRISPR gRNA sequence
ggcgtggtcgtgggagcctg

SEQ ID NO: 522996 - DNA, 20 bp, Artificial
  CRISPR gRNA sequence
tagtcccagctactcaggaa

SEQ ID NO: 522997 - DNA, 20 bp, Artificial
  CRISPR gRNA sequence
ctcaggaagctgaggcagga

SEQ ID NO: 522998 - DNA, 20 bp, Artificial
  CRISPR gRNA sequence
aggaagctgaggcaggagaa

SEQ ID NO: 522999 - DNA, 20 bp, Artificial
  CRISPR gRNA sequence
aggcaggagaatggcatgaa

SEQ ID NO: 523000 - DNA, 20 bp, Artificial
  CRISPR gRNA sequence
ggaggcggagcttgcagtga

SEQ ID NO: 523001 - DNA, 20 bp, Artificial
  CRISPR gRNA sequence
gcagtgagctgagatcgcgc

SEQ ID NO: 523002 - DNA, 20 bp, Artificial
  CRISPR gRNA sequence
cagtgagctgagatcgcgcc

SEQ ID NO: 523003 - DNA, 20 bp, Artificial
  CRISPR gRNA sequence
agatcgcgccactgcactcc

SEQ ID NO: 523004 - DNA, 20 bp, Artificial
  CRISPR gRNA sequence
cactccaggccggtgacagc

SEQ ID NO: 523005 - DNA, 20 bp, Artificial
  CRISPR gRNA sequence
caggccggtgacagcgcaac

SEQ ID NO: 523006 - DNA, 20 bp, Artificial
  CRISPR gRNA sequence
cgtctcaaaaaaataaaaag

SEQ ID NO: 523007 - DNA, 20 bp, Artificial
  CRISPR gRNA sequence
aaaaaaataaaaaggaagcc

SEQ ID NO: 523008 - DNA, 20 bp, Artificial
  CRISPR gRNA sequence
accccgctggattcctctcc

SEQ ID NO: 523009 - DNA, 20 bp, Artificial
  CRISPR gRNA sequence
gattcctctcccagcatagg

SEQ ID NO: 523010 - DNA, 20 bp, Artificial
  CRISPR gRNA sequence
ctctcccagcataggctctg

SEQ ID NO: 523011 - DNA, 20 bp, Artificial
  CRISPR gRNA sequence
tcccagcataggctctgccc

SEQ ID NO: 523012 - DNA, 20 bp, Artificial
  CRISPR gRNA sequence
ccagcataggctctgccctc

SEQ ID NO: 523013 - DNA, 20 bp, Artificial
  CRISPR gRNA sequence
tgccctctctctgctgtctt

SEQ ID NO: 523014 - DNA, 20 bp, Artificial
  CRISPR gRNA sequence
ccctctctctgctgtcttgc

SEQ ID NO: 523015 - DNA, 20 bp, Artificial
  CRISPR gRNA sequence
tctctgctgtcttgcttaaa

SEQ ID NO: 523016 - DNA, 20 bp, Artificial
  CRISPR gRNA sequence
tctgctgtcttgcttaaagt

SEQ ID NO: 523017 - DNA, 20 bp, Artificial
  CRISPR gRNA sequence
tgctgtcttgcttaaagttt

SEQ ID NO: 523018 - DNA, 20 bp, Artificial
  CRISPR gRNA sequence
ctgtcttgcttaaagtttcc

SEQ ID NO: 523019 - DNA, 20 bp, Artificial
  CRISPR gRNA sequence
tcttgcttaaagtttccttt

SEQ ID NO: 523020 - DNA, 20 bp, Artificial
  CRISPR gRNA sequence
gcttaaagtttcctttcttt

SEQ ID NO: 523021 - DNA, 20 bp, Artificial
  CRISPR gRNA sequence
cttaaagtttcctttctttt

SEQ ID NO: 523022 - DNA, 20 bp, Artificial
  CRISPR gRNA sequence
aaagtttcctttctttttct

SEQ ID NO: 523023 - DNA, 20 bp, Artificial
  CRISPR gRNA sequence
aagtttcctttctttttctt

SEQ ID NO: 523024 - DNA, 20 bp, Artificial
  CRISPR gRNA sequence
cctttctttttcttttcttt

SEQ ID NO: 523025 - DNA, 20 bp, Artificial
  CRISPR gRNA sequence
ctttctttttcttttctttt

SEQ ID NO: 523026 - DNA, 20 bp, Artificial
  CRISPR gRNA sequence
tctttttcttttcttttttt

SEQ ID NO: 523027 - DNA, 20 bp, Artificial
  CRISPR gRNA sequence
ctttttcttttctttttttt

SEQ ID NO: 523028 - DNA, 20 bp, Artificial
  CRISPR gRNA sequence
tttttcttttcttttttttt

SEQ ID NO: 523029 - DNA, 20 bp, Artificial
  CRISPR gRNA sequence
tttcttttcttttttttttg

SEQ ID NO: 523030 - DNA, 20 bp, Artificial
  CRISPR gRNA sequence
ttcttttcttttttttttga

SEQ ID NO: 523031 - DNA, 20 bp, Artificial
  CRISPR gRNA sequence
tcttttcttttttttttgag

SEQ ID NO: 523032 - DNA, 20 bp, Artificial
  CRISPR gRNA sequence
cttttcttttttttttgaga

SEQ ID NO: 523033 - DNA, 20 bp, Artificial
  CRISPR gRNA sequence
ttttcttttttttttgagac

SEQ ID NO: 523034 - DNA, 20 bp, Artificial
  CRISPR gRNA sequence
ttcttttttttttgagacag

SEQ ID NO: 523035 - DNA, 20 bp, Artificial
  CRISPR gRNA sequence
tcttttttttttgagacagg

SEQ ID NO: 523036 - DNA, 20 bp, Artificial
  CRISPR gRNA sequence
cttttttttttgagacaggg

SEQ ID NO: 523037 - DNA, 20 bp, Artificial
  CRISPR gRNA sequence
ttttttttttgagacagggc

SEQ ID NO: 523038 - DNA, 20 bp, Artificial
  CRISPR gRNA sequence
ttttttttgagacagggcct

SEQ ID NO: 523039 - DNA, 20 bp, Artificial
  CRISPR gRNA sequence
tttttttgagacagggcctc

SEQ ID NO: 523040 - DNA, 20 bp, Artificial
  CRISPR gRNA sequence
ttttttgagacagggcctcg

SEQ ID NO: 523041 - DNA, 20 bp, Artificial
  CRISPR gRNA sequence
tttttgagacagggcctcgt

SEQ ID NO: 523042 - DNA, 20 bp, Artificial
  CRISPR gRNA sequence
ttttgagacagggcctcgtt

SEQ ID NO: 523043 - DNA, 20 bp, Artificial
  CRISPR gRNA sequence
tttgagacagggcctcgttc

SEQ ID NO: 523044 - DNA, 20 bp, Artificial
  CRISPR gRNA sequence
ttgagacagggcctcgttct

SEQ ID NO: 523045 - DNA, 20 bp, Artificial
  CRISPR gRNA sequence
tgagacagggcctcgttctg

SEQ ID NO: 523046 - DNA, 20 bp, Artificial
  CRISPR gRNA sequence
gagacagggcctcgttctgt

SEQ ID NO: 523047 - DNA, 20 bp, Artificial
  CRISPR gRNA sequence
agacagggcctcgttctgtc

SEQ ID NO: 523048 - DNA, 20 bp, Artificial
  CRISPR gRNA sequence
gttctgtcaactaggctgga

SEQ ID NO: 523049 - DNA, 20 bp, Artificial
  CRISPR gRNA sequence
tgtcaactaggctggagttc

SEQ ID NO: 523050 - DNA, 20 bp, Artificial
  CRISPR gRNA sequence
tcaactaggctggagttcag

SEQ ID NO: 523051 - DNA, 20 bp, Artificial
  CRISPR gRNA sequence
ggctggagttcagcagtgcc

SEQ ID NO: 523052 - DNA, 20 bp, Artificial
  CRISPR gRNA sequence
gagttcagcagtgccattag

SEQ ID NO: 523053 - DNA, 20 bp, Artificial
  CRISPR gRNA sequence
agcagtgccattagggttca

SEQ ID NO: 523054 - DNA, 20 bp, Artificial
  CRISPR gRNA sequence
gggttcactgcagtctctcc

SEQ ID NO: 523055 - DNA, 20 bp, Artificial
  CRISPR gRNA sequence
actgcagtctctccctcctg

SEQ ID NO: 523056 - DNA, 20 bp, Artificial
  CRISPR gRNA sequence
cagtctctccctcctgggcg

SEQ ID NO: 523057 - DNA, 20 bp, Artificial
  CRISPR gRNA sequence
tccctcctgggcgcgagtga

SEQ ID NO: 523058 - DNA, 20 bp, Artificial
  CRISPR gRNA sequence
cctcctgggcgcgagtgatc

SEQ ID NO: 523059 - DNA, 20 bp, Artificial
  CRISPR gRNA sequence
ctgggcgcgagtgatcctcc

SEQ ID NO: 523060 - DNA, 20 bp, Artificial
  CRISPR gRNA sequence
ggcgcgagtgatcctcctgc

SEQ ID NO: 523061 - DNA, 20 bp, Artificial
  CRISPR gRNA sequence
ctgcctcagcctcctgagta

SEQ ID NO: 523062 - DNA, 20 bp, Artificial
  CRISPR gRNA sequence
cctcagcctcctgagtaact

SEQ ID NO: 523063 - DNA, 20 bp, Artificial
  CRISPR gRNA sequence
agcctcctgagtaactggga

SEQ ID NO: 523064 - DNA, 20 bp, Artificial
  CRISPR gRNA sequence
ctgagtaactgggactagag

SEQ ID NO: 523065 - DNA, 20 bp, Artificial
  CRISPR gRNA sequence
agtaactgggactagagatg

SEQ ID NO: 523066 - DNA, 20 bp, Artificial
  CRISPR gRNA sequence
ggactagagatgcatgccac

SEQ ID NO: 523067 - DNA, 20 bp, Artificial
  CRISPR gRNA sequence
gagatgcatgccaccatgtc

SEQ ID NO: 523068 - DNA, 20 bp, Artificial
  CRISPR gRNA sequence
gctaatttattttctatttt

SEQ ID NO: 523069 - DNA, 20 bp, Artificial
  CRISPR gRNA sequence
atttattttctatttttatt

SEQ ID NO: 523070 - DNA, 20 bp, Artificial
  CRISPR gRNA sequence
attttctatttttatttttt

SEQ ID NO: 523071 - DNA, 20 bp, Artificial
  CRISPR gRNA sequence
ttttctatttttattttttg

SEQ ID NO: 523072 - DNA, 20 bp, Artificial
  CRISPR gRNA sequence
tctatttttattttttgtag

SEQ ID NO: 523073 - DNA, 20 bp, Artificial
  CRISPR gRNA sequence
ctatttttattttttgtaga

SEQ ID NO: 523074 - DNA, 20 bp, Artificial
  CRISPR gRNA sequence
tatttttattttttgtagag

SEQ ID NO: 523075 - DNA, 20 bp, Artificial
  CRISPR gRNA sequence
tttttattttttgtagaggt

SEQ ID NO: 523076 - DNA, 20 bp, Artificial
  CRISPR gRNA sequence
ttattttttgtagaggtagg

SEQ ID NO: 523077 - DNA, 20 bp, Artificial
  CRISPR gRNA sequence
tattttttgtagaggtagga

SEQ ID NO: 523078 - DNA, 20 bp, Artificial
  CRISPR gRNA sequence
attttttgtagaggtaggag

SEQ ID NO: 523079 - DNA, 20 bp, Artificial
  CRISPR gRNA sequence
ttttttgtagaggtaggagt

SEQ ID NO: 523080 - DNA, 20 bp, Artificial
  CRISPR gRNA sequence
tttgtagaggtaggagtctc

SEQ ID NO: 523081 - DNA, 20 bp, Artificial
  CRISPR gRNA sequence
ttgtagaggtaggagtctca

SEQ ID NO: 523082 - DNA, 20 bp, Artificial
  CRISPR gRNA sequence
tgtagaggtaggagtctcac

SEQ ID NO: 523083 - DNA, 20 bp, Artificial
  CRISPR gRNA sequence
gtagaggtaggagtctcact

SEQ ID NO: 523084 - DNA, 20 bp, Artificial
  CRISPR gRNA sequence
tagaggtaggagtctcactg

SEQ ID NO: 523085 - DNA, 20 bp, Artificial
  CRISPR gRNA sequence
actgtgttgcccaggctgct

SEQ ID NO: 523086 - DNA, 20 bp, Artificial
  CRISPR gRNA sequence
tgttgcccaggctgctctca

SEQ ID NO: 523087 - DNA, 20 bp, Artificial
  CRISPR gRNA sequence
cccaggctgctctcaaactc

SEQ ID NO: 523088 - DNA, 20 bp, Artificial
  CRISPR gRNA sequence
ctctcaaactcctggcctca

SEQ ID NO: 523089 - DNA, 20 bp, Artificial
  CRISPR gRNA sequence
tcaaactcctggcctcaagt

SEQ ID NO: 523090 - DNA, 20 bp, Artificial
  CRISPR gRNA sequence
aaactcctggcctcaagtga

SEQ ID NO: 523091 - DNA, 20 bp, Artificial
  CRISPR gRNA sequence
ctggcctcaagtgattctcc

SEQ ID NO: 523092 - DNA, 20 bp, Artificial
  CRISPR gRNA sequence
gcctcaagtgattctcctgc

SEQ ID NO: 523093 - DNA, 20 bp, Artificial
  CRISPR gRNA sequence
aagtgattctcctgccttgg

SEQ ID NO: 523094 - DNA, 20 bp, Artificial
  CRISPR gRNA sequence
tcctgccttggcctctcaaa

SEQ ID NO: 523095 - DNA, 20 bp, Artificial
  CRISPR gRNA sequence
ctgccttggcctctcaaaac

SEQ ID NO: 523096 - DNA, 20 bp, Artificial
  CRISPR gRNA sequence
ccttggcctctcaaaacact

SEQ ID NO: 523097 - DNA, 20 bp, Artificial
  CRISPR gRNA sequence
ggcctctcaaaacactggga

SEQ ID NO: 523098 - DNA, 20 bp, Artificial
  CRISPR gRNA sequence
gcctctcaaaacactgggat

SEQ ID NO: 523099 - DNA, 20 bp, Artificial
  CRISPR gRNA sequence
tcaaaacactgggattgcag

SEQ ID NO: 523100 - DNA, 20 bp, Artificial
  CRISPR gRNA sequence
aaaacactgggattgcaggc

SEQ ID NO: 523101 - DNA, 20 bp, Artificial
  CRISPR gRNA sequence
ggattgcaggcgtcagccac

SEQ ID NO: 523102 - DNA, 20 bp, Artificial
  CRISPR gRNA sequence
caggcgtcagccaccaggct

SEQ ID NO: 523103 - DNA, 20 bp, Artificial
  CRISPR gRNA sequence
gcctcttcctttcctgtgtt

SEQ ID NO: 523104 - DNA, 20 bp, Artificial
  CRISPR gRNA sequence
ttcctttcctgtgtttgctc

SEQ ID NO: 523105 - DNA, 20 bp, Artificial
  CRISPR gRNA sequence
cctttcctgtgtttgctcct

SEQ ID NO: 523106 - DNA, 20 bp, Artificial
  CRISPR gRNA sequence
ctttcctgtgtttgctcctg

SEQ ID NO: 523107 - DNA, 20 bp, Artificial
  CRISPR gRNA sequence
tcctgtgtttgctcctgttc

SEQ ID NO: 523108 - DNA, 20 bp, Artificial
  CRISPR gRNA sequence
cctgtgtttgctcctgttct

SEQ ID NO: 523109 - DNA, 20 bp, Artificial
  CRISPR gRNA sequence
ctgtgtttgctcctgttctc

SEQ ID NO: 523110 - DNA, 20 bp, Artificial
  CRISPR gRNA sequence
tgtttgctcctgttctcctg

SEQ ID NO: 523111 - DNA, 20 bp, Artificial
  CRISPR gRNA sequence
gctcctgttctcctgtcctc

SEQ ID NO: 523112 - DNA, 20 bp, Artificial
  CRISPR gRNA sequence
ctcctgttctcctgtcctcg

SEQ ID NO: 523113 - DNA, 20 bp, Artificial
  CRISPR gRNA sequence
ctgttctcctgtcctcgact

SEQ ID NO: 523114 - DNA, 20 bp, Artificial
  CRISPR gRNA sequence
ttctcctgtcctcgacttct

SEQ ID NO: 523115 - DNA, 20 bp, Artificial
  CRISPR gRNA sequence
tcctgtcctcgacttctgtg

SEQ ID NO: 523116 - DNA, 20 bp, Artificial
  CRISPR gRNA sequence
ctgtcctcgacttctgtgaa

SEQ ID NO: 523117 - DNA, 20 bp, Artificial
  CRISPR gRNA sequence
tcctcgacttctgtgaaagg

SEQ ID NO: 523118 - DNA, 20 bp, Artificial
  CRISPR gRNA sequence
gacttctgtgaaagggtgtg

SEQ ID NO: 523119 - DNA, 20 bp, Artificial
  CRISPR gRNA sequence
ctgtgaaagggtgtgtgtga

SEQ ID NO: 523120 - DNA, 20 bp, Artificial
  CRISPR gRNA sequence
tgtgaaagggtgtgtgtgat

SEQ ID NO: 523121 - DNA, 20 bp, Artificial
  CRISPR gRNA sequence
tgaaagggtgtgtgtgattt

SEQ ID NO: 523122 - DNA, 20 bp, Artificial
  CRISPR gRNA sequence
ggcccggatctgctgcaggt

SEQ ID NO: 523123 - DNA, 20 bp, Artificial
  CRISPR gRNA sequence
gcccggatctgctgcaggtc

SEQ ID NO: 523124 - DNA, 20 bp, Artificial
  CRISPR gRNA sequence
ctgcaggtctcttctgacgc

SEQ ID NO: 523125 - DNA, 20 bp, Artificial
  CRISPR gRNA sequence
caggtctcttctgacgccgc

SEQ ID NO: 523126 - DNA, 20 bp, Artificial
  CRISPR gRNA sequence
ttctgacgccgctttcgtgt

SEQ ID NO: 523127 - DNA, 20 bp, Artificial
  CRISPR gRNA sequence
ctgacgccgctttcgtgtct

SEQ ID NO: 523128 - DNA, 20 bp, Artificial
  CRISPR gRNA sequence
tgacgccgctttcgtgtctc

SEQ ID NO: 523129 - DNA, 20 bp, Artificial
  CRISPR gRNA sequence
acgccgctttcgtgtctcag

SEQ ID NO: 523130 - DNA, 20 bp, Artificial
  CRISPR gRNA sequence
tcgtgtctcagagcctgaat

SEQ ID NO: 523131 - DNA, 20 bp, Artificial
  CRISPR gRNA sequence
cgtgtctcagagcctgaatg

SEQ ID NO: 523132 - DNA, 20 bp, Artificial
  CRISPR gRNA sequence
gtgtctcagagcctgaatgt

SEQ ID NO: 523133 - DNA, 20 bp, Artificial
  CRISPR gRNA sequence
agagcctgaatgttcagagc

SEQ ID NO: 523134 - DNA, 20 bp, Artificial
  CRISPR gRNA sequence
aatgttcagagctttgctca

SEQ ID NO: 523135 - DNA, 20 bp, Artificial
  CRISPR gRNA sequence
agagctttgctcaccgtgaa

SEQ ID NO: 523136 - DNA, 20 bp, Artificial
  CRISPR gRNA sequence
tgctcaccgtgaagtgtggt

SEQ ID NO: 523137 - DNA, 20 bp, Artificial
  CRISPR gRNA sequence
gctcaccgtgaagtgtggtt

SEQ ID NO: 523138 - DNA, 20 bp, Artificial
  CRISPR gRNA sequence
ctcaccgtgaagtgtggttc

SEQ ID NO: 523139 - DNA, 20 bp, Artificial
  CRISPR gRNA sequence
accgtgaagtgtggttcttg

SEQ ID NO: 523140 - DNA, 20 bp, Artificial
  CRISPR gRNA sequence
ttgttagctgtgtccatttg

SEQ ID NO: 523141 - DNA, 20 bp, Artificial
  CRISPR gRNA sequence
gttagctgtgtccatttggt

SEQ ID NO: 523142 - DNA, 20 bp, Artificial
  CRISPR gRNA sequence
ttagctgtgtccatttggtg

SEQ ID NO: 523143 - DNA, 20 bp, Artificial
  CRISPR gRNA sequence
gctgtgtccatttggtgccc

SEQ ID NO: 523144 - DNA, 20 bp, Artificial
  CRISPR gRNA sequence
tgtccatttggtgcccggga

SEQ ID NO: 523145 - DNA, 20 bp, Artificial
  CRISPR gRNA sequence
ggtgcccgggagggaagggc

SEQ ID NO: 523146 - DNA, 20 bp, Artificial
  CRISPR gRNA sequence
gtgcccgggagggaagggcg

SEQ ID NO: 523147 - DNA, 20 bp, Artificial
  CRISPR gRNA sequence
aggggttctccggggaagga

SEQ ID NO: 523148 - DNA, 20 bp, Artificial
  CRISPR gRNA sequence
tccggggaaggatgacctcg

SEQ ID NO: 523149 - DNA, 20 bp, Artificial
  CRISPR gRNA sequence
cggggaaggatgacctcgtc

SEQ ID NO: 523150 - DNA, 20 bp, Artificial
  CRISPR gRNA sequence
gtccccctggtcctgccccc

SEQ ID NO: 523151 - DNA, 20 bp, Artificial
  CRISPR gRNA sequence
gtcctgccccctcagccccc

SEQ ID NO: 523152 - DNA, 20 bp, Artificial
  CRISPR gRNA sequence
ccccctcagccccctgcttc

SEQ ID NO: 523153 - DNA, 20 bp, Artificial
  CRISPR gRNA sequence
agccccctgcttcccctgtg

SEQ ID NO: 523154 - DNA, 20 bp, Artificial
  CRISPR gRNA sequence
cttcccctgtgcaggggact

SEQ ID NO: 523155 - DNA, 20 bp, Artificial
  CRISPR gRNA sequence
cccctgtgcaggggacttgg

SEQ ID NO: 523156 - DNA, 20 bp, Artificial
  CRISPR gRNA sequence
ccctgtgcaggggacttggt

SEQ ID NO: 523157 - DNA, 20 bp, Artificial
  CRISPR gRNA sequence
tgcaggggacttggtgacag

SEQ ID NO: 523158 - DNA, 20 bp, Artificial
  CRISPR gRNA sequence
ggtgacaggtaccacttcct

SEQ ID NO: 523159 - DNA, 20 bp, Artificial
  CRISPR gRNA sequence
gtgacaggtaccacttcctg

SEQ ID NO: 523160 - DNA, 20 bp, Artificial
  CRISPR gRNA sequence
cctgcagctgggctggggtt

SEQ ID NO: 523161 - DNA, 20 bp, Artificial
  CRISPR gRNA sequence
ctgcagctgggctggggttg

SEQ ID NO: 523162 - DNA, 20 bp, Artificial
  CRISPR gRNA sequence
cagctgggctggggttgcac

SEQ ID NO: 523163 - DNA, 20 bp, Artificial
  CRISPR gRNA sequence
ggctggggttgcaccagcac

SEQ ID NO: 523164 - DNA, 20 bp, Artificial
  CRISPR gRNA sequence
gggttgcaccagcacttcct

SEQ ID NO: 523165 - DNA, 20 bp, Artificial
  CRISPR gRNA sequence
caccagcacttccttctcgg

SEQ ID NO: 523166 - DNA, 20 bp, Artificial
  CRISPR gRNA sequence
ccttctcgggcagggttgag

SEQ ID NO: 523167 - DNA, 20 bp, Artificial
  CRISPR gRNA sequence
cttctcgggcagggttgagg

SEQ ID NO: 523168 - DNA, 20 bp, Artificial
  CRISPR gRNA sequence
ctcgggcagggttgaggtca

SEQ ID NO: 523169 - DNA, 20 bp, Artificial
  CRISPR gRNA sequence
tcgggcagggttgaggtcaa

SEQ ID NO: 523170 - DNA, 20 bp, Artificial
  CRISPR gRNA sequence
gggcagggttgaggtcaagg

SEQ ID NO: 523171 - DNA, 20 bp, Artificial
  CRISPR gRNA sequence
aggtcaagggcgactctgat

SEQ ID NO: 523172 - DNA, 20 bp, Artificial
  CRISPR gRNA sequence
tgatgcaaggttctgagagg

SEQ ID NO: 523173 - DNA, 20 bp, Artificial
  CRISPR gRNA sequence
atgcaaggttctgagaggcc

SEQ ID NO: 523174 - DNA, 20 bp, Artificial
  CRISPR gRNA sequence
tgagaggcctgtggggctgt

SEQ ID NO: 523175 - DNA, 20 bp, Artificial
  CRISPR gRNA sequence
agaggcctgtggggctgtgg

SEQ ID NO: 523176 - DNA, 20 bp, Artificial
  CRISPR gRNA sequence
tggggctgtggattcctaag

SEQ ID NO: 523177 - DNA, 20 bp, Artificial
  CRISPR gRNA sequence
tggattcctaagcagcctca

SEQ ID NO: 523178 - DNA, 20 bp, Artificial
  CRISPR gRNA sequence
ctaagcagcctcagctttgg

SEQ ID NO: 523179 - DNA, 20 bp, Artificial
  CRISPR gRNA sequence
agcagcctcagctttgggtt

SEQ ID NO: 523180 - DNA, 20 bp, Artificial
  CRISPR gRNA sequence
agctttgggttttgcacctt

SEQ ID NO: 523181 - DNA, 20 bp, Artificial
  CRISPR gRNA sequence
tgggttttgcaccttaggtc

SEQ ID NO: 523182 - DNA, 20 bp, Artificial
  CRISPR gRNA sequence
gggttttgcaccttaggtct

SEQ ID NO: 523183 - DNA, 20 bp, Artificial
  CRISPR gRNA sequence
ggttttgcaccttaggtctt

SEQ ID NO: 523184 - DNA, 20 bp, Artificial
  CRISPR gRNA sequence
tgcaccttaggtcttggtaa

SEQ ID NO: 523185 - DNA, 20 bp, Artificial
  CRISPR gRNA sequence
gcaccttaggtcttggtaag

SEQ ID NO: 523186 - DNA, 20 bp, Artificial
  CRISPR gRNA sequence
caccttaggtcttggtaagg

SEQ ID NO: 523187 - DNA, 20 bp, Artificial
  CRISPR gRNA sequence
aggtcttggtaaggggaccc

SEQ ID NO: 523188 - DNA, 20 bp, Artificial
  CRISPR gRNA sequence
ggtcttggtaaggggacccg

SEQ ID NO: 523189 - DNA, 20 bp, Artificial
  CRISPR gRNA sequence
ggtaaggggacccgcccgcc

SEQ ID NO: 523190 - DNA, 20 bp, Artificial
  CRISPR gRNA sequence
gtaaggggacccgcccgccc

SEQ ID NO: 523191 - DNA, 20 bp, Artificial
  CRISPR gRNA sequence
agatgggggatgtccagagc

SEQ ID NO: 523192 - DNA, 20 bp, Artificial
  CRISPR gRNA sequence
gatgggggatgtccagagct

SEQ ID NO: 523193 - DNA, 20 bp, Artificial
  CRISPR gRNA sequence
gaggatgaggagggcacccg

SEQ ID NO: 523194 - DNA, 20 bp, Artificial
  CRISPR gRNA sequence
gtgtggggcagcagggaggg

SEQ ID NO: 523195 - DNA, 20 bp, Artificial
  CRISPR gRNA sequence
ggagaatgaggagggcacct

SEQ ID NO: 523196 - DNA, 20 bp, Artificial
  CRISPR gRNA sequence
gagaatgaggagggcacctg

SEQ ID NO: 523197 - DNA, 20 bp, Artificial
  CRISPR gRNA sequence
cccccagtgtggggcagcag

SEQ ID NO: 523198 - DNA, 20 bp, Artificial
  CRISPR gRNA sequence
agggtgatcaggctccaggc

SEQ ID NO: 523199 - DNA, 20 bp, Artificial
  CRISPR gRNA sequence
caggccagagctctggggcc

SEQ ID NO: 523200 - DNA, 20 bp, Artificial
  CRISPR gRNA sequence
tggggccagctcaggggctg

SEQ ID NO: 523201 - DNA, 20 bp, Artificial
  CRISPR gRNA sequence
gggccagctcaggggctggg

SEQ ID NO: 523202 - DNA, 20 bp, Artificial
  CRISPR gRNA sequence
aggggctggggtggggggtg

SEQ ID NO: 523203 - DNA, 20 bp, Artificial
  CRISPR gRNA sequence
gggtggggggtgtctgtgct

SEQ ID NO: 523204 - DNA, 20 bp, Artificial
  CRISPR gRNA sequence
tgctcttcctcccctcctgc

SEQ ID NO: 523205 - DNA, 20 bp, Artificial
  CRISPR gRNA sequence
ttcctcccctcctgccctgc

SEQ ID NO: 523206 - DNA, 20 bp, Artificial
  CRISPR gRNA sequence
cctcccctcctgccctgcag

SEQ ID NO: 523207 - DNA, 20 bp, Artificial
  CRISPR gRNA sequence
ctcccctcctgccctgcagc

SEQ ID NO: 523208 - DNA, 20 bp, Artificial
  CRISPR gRNA sequence
ccctcctgccctgcagctct

SEQ ID NO: 523209 - DNA, 20 bp, Artificial
  CRISPR gRNA sequence
ctgccctgcagctctgccgg

SEQ ID NO: 523210 - DNA, 20 bp, Artificial
  CRISPR gRNA sequence
ccctgcagctctgccggctt

SEQ ID NO: 523211 - DNA, 20 bp, Artificial
  CRISPR gRNA sequence
cagctctgccggcttagcct

SEQ ID NO: 523212 - DNA, 20 bp, Artificial
  CRISPR gRNA sequence
tgccggcttagcctcagggc

SEQ ID NO: 523213 - DNA, 20 bp, Artificial
  CRISPR gRNA sequence
ccggcttagcctcagggcac

SEQ ID NO: 523214 - DNA, 20 bp, Artificial
  CRISPR gRNA sequence
agcctcagggcaccagaggt

SEQ ID NO: 523215 - DNA, 20 bp, Artificial
  CRISPR gRNA sequence
gcctcagggcaccagaggtg

SEQ ID NO: 523216 - DNA, 20 bp, Artificial
  CRISPR gRNA sequence
agggcaccagaggtgacagt

SEQ ID NO: 523217 - DNA, 20 bp, Artificial
  CRISPR gRNA sequence
tttgcccgaatgctgcccta

SEQ ID NO: 523218 - DNA, 20 bp, Artificial
  CRISPR gRNA sequence
gcccgaatgctgccctacat

SEQ ID NO: 523219 - DNA, 20 bp, Artificial
  CRISPR gRNA sequence
cccgaatgctgccctacatc

SEQ ID NO: 523220 - DNA, 20 bp, Artificial
  CRISPR gRNA sequence
ccctacatctgtgccttacc

SEQ ID NO: 523221 - DNA, 20 bp, Artificial
  CRISPR gRNA sequence
catctgtgccttacccattc

SEQ ID NO: 523222 - DNA, 20 bp, Artificial
  CRISPR gRNA sequence
tgccttacccattcccatcc

SEQ ID NO: 523223 - DNA, 20 bp, Artificial
  CRISPR gRNA sequence
acccattcccatcccccagg

SEQ ID NO: 523224 - DNA, 20 bp, Artificial
  CRISPR gRNA sequence
cccattcccatcccccaggg

SEQ ID NO: 523225 - DNA, 20 bp, Artificial
  CRISPR gRNA sequence
ccatcccccagggagctggc

SEQ ID NO: 523226 - DNA, 20 bp, Artificial
  CRISPR gRNA sequence
gcacaggcccttcgaccacc

SEQ ID NO: 523227 - DNA, 20 bp, Artificial
  CRISPR gRNA sequence
cgaccacctccaggcacatg

SEQ ID NO: 523228 - DNA, 20 bp, Artificial
  CRISPR gRNA sequence
gaccacctccaggcacatgg

SEQ ID NO: 523229 - DNA, 20 bp, Artificial
  CRISPR gRNA sequence
caggcacatggaggaaactg

SEQ ID NO: 523230 - DNA, 20 bp, Artificial
  CRISPR gRNA sequence
aggcagataggcctgatggg

SEQ ID NO: 523231 - DNA, 20 bp, Artificial
  CRISPR gRNA sequence
atggggtcttggtctctcag

SEQ ID NO: 523232 - DNA, 20 bp, Artificial
  CRISPR gRNA sequence
ggtctctcaggcctcaggtg

SEQ ID NO: 523233 - DNA, 20 bp, Artificial
  CRISPR gRNA sequence
gtctctcaggcctcaggtga

SEQ ID NO: 523234 - DNA, 20 bp, Artificial
  CRISPR gRNA sequence
tcaggcctcaggtgaggccc

SEQ ID NO: 523235 - DNA, 20 bp, Artificial
  CRISPR gRNA sequence
aggcctcaggtgaggccctg

SEQ ID NO: 523236 - DNA, 20 bp, Artificial
  CRISPR gRNA sequence
aggtgaggccctggacctcc

SEQ ID NO: 523237 - DNA, 20 bp, Artificial
  CRISPR gRNA sequence
gacctccgtgggccatcctg

SEQ ID NO: 523238 - DNA, 20 bp, Artificial
  CRISPR gRNA sequence
cgtgggccatcctggctgct

SEQ ID NO: 523239 - DNA, 20 bp, Artificial
  CRISPR gRNA sequence
gctgctgggcagaggggctg

SEQ ID NO: 523240 - DNA, 20 bp, Artificial
  CRISPR gRNA sequence
ctgggcagaggggctgccct

SEQ ID NO: 523241 - DNA, 20 bp, Artificial
  CRISPR gRNA sequence
ggcagaggggctgccctgcc

SEQ ID NO: 523242 - DNA, 20 bp, Artificial
  CRISPR gRNA sequence
ccctgccctgttctcccaca

SEQ ID NO: 523243 - DNA, 20 bp, Artificial
  CRISPR gRNA sequence
ccctgttctcccacagaagg

SEQ ID NO: 523244 - DNA, 20 bp, Artificial
  CRISPR gRNA sequence
ttctcccacagaagggaggc

SEQ ID NO: 523245 - DNA, 20 bp, Artificial
  CRISPR gRNA sequence
tcccacagaagggaggctgg

SEQ ID NO: 523246 - DNA, 20 bp, Artificial
  CRISPR gRNA sequence
ccacagaagggaggctggct

SEQ ID NO: 523247 - DNA, 20 bp, Artificial
  CRISPR gRNA sequence
gctgccaggctcagtgcact

SEQ ID NO: 523248 - DNA, 20 bp, Artificial
  CRISPR gRNA sequence
ccaggctcagtgcactgcct

SEQ ID NO: 523249 - DNA, 20 bp, Artificial
  CRISPR gRNA sequence
agtgcactgccttacctcct

SEQ ID NO: 523250 - DNA, 20 bp, Artificial
  CRISPR gRNA sequence
ccttacctcctggagcggac

SEQ ID NO: 523251 - DNA, 20 bp, Artificial
  CRISPR gRNA sequence
acctcctggagcggaccttc

SEQ ID NO: 523252 - DNA, 20 bp, Artificial
  CRISPR gRNA sequence
cctcctggagcggaccttca

SEQ ID NO: 523253 - DNA, 20 bp, Artificial
  CRISPR gRNA sequence
ctggagcggaccttcatccc

SEQ ID NO: 523254 - DNA, 20 bp, Artificial
  CRISPR gRNA sequence
gagcggaccttcatccccag

SEQ ID NO: 523255 - DNA, 20 bp, Artificial
  CRISPR gRNA sequence
catccccagctgtttgtctg

SEQ ID NO: 523256 - DNA, 20 bp, Artificial
  CRISPR gRNA sequence
atccccagctgtttgtctgg

SEQ ID NO: 523257 - DNA, 20 bp, Artificial
  CRISPR gRNA sequence
tttgtctgggctcagccact

SEQ ID NO: 523258 - DNA, 20 bp, Artificial
  CRISPR gRNA sequence
gtctgggctcagccactggc

SEQ ID NO: 523259 - DNA, 20 bp, Artificial
  CRISPR gRNA sequence
tctgggctcagccactggca

SEQ ID NO: 523260 - DNA, 20 bp, Artificial
  CRISPR gRNA sequence
ggctcagccactggcattgg

SEQ ID NO: 523261 - DNA, 20 bp, Artificial
  CRISPR gRNA sequence
agccactggcattggggggt

SEQ ID NO: 523262 - DNA, 20 bp, Artificial
  CRISPR gRNA sequence
gcattggggggtggggcagg

SEQ ID NO: 523263 - DNA, 20 bp, Artificial
  CRISPR gRNA sequence
gggggtggggcagggcctgg

SEQ ID NO: 523264 - DNA, 20 bp, Artificial
  CRISPR gRNA sequence
gcttctcttgtgcccccagc

SEQ ID NO: 523265 - DNA, 20 bp, Artificial
  CRISPR gRNA sequence
ctcttgtgcccccagctcca

SEQ ID NO: 523266 - DNA, 20 bp, Artificial
  CRISPR gRNA sequence
tcttgtgcccccagctccaa

SEQ ID NO: 523267 - DNA, 20 bp, Artificial
  CRISPR gRNA sequence
ttgtgcccccagctccaagc

SEQ ID NO: 523268 - DNA, 20 bp, Artificial
  CRISPR gRNA sequence
gtgcccccagctccaagccc

SEQ ID NO: 523269 - DNA, 20 bp, Artificial
  CRISPR gRNA sequence
tgcccccagctccaagcccc

SEQ ID NO: 523270 - DNA, 20 bp, Artificial
  CRISPR gRNA sequence
caagccccccagggctgctc

SEQ ID NO: 523271 - DNA, 20 bp, Artificial
  CRISPR gRNA sequence
ctcatggaggagcaacagtg

SEQ ID NO: 523272 - DNA, 20 bp, Artificial
  CRISPR gRNA sequence
atggaggagcaacagtgggg

SEQ ID NO: 523273 - DNA, 20 bp, Artificial
  CRISPR gRNA sequence
cccaccagcccccttcctgt

SEQ ID NO: 523274 - DNA, 20 bp, Artificial
  CRISPR gRNA sequence
cctgtggtcaaggttggggt

SEQ ID NO: 523275 - DNA, 20 bp, Artificial
  CRISPR gRNA sequence
ctgtggtcaaggttggggtg

SEQ ID NO: 523276 - DNA, 20 bp, Artificial
  CRISPR gRNA sequence
tggtcaaggttggggtgccg

SEQ ID NO: 523277 - DNA, 20 bp, Artificial
  CRISPR gRNA sequence
gggtgccgtggtctctgagc

SEQ ID NO: 523278 - DNA, 20 bp, Artificial
  CRISPR gRNA sequence
tgagccaatcctgctggaat

SEQ ID NO: 523279 - DNA, 20 bp, Artificial
  CRISPR gRNA sequence
agccaatcctgctggaatca

SEQ ID NO: 523280 - DNA, 20 bp, Artificial
  CRISPR gRNA sequence
ctggaatcaaggtgcacccc

SEQ ID NO: 523281 - DNA, 20 bp, Artificial
  CRISPR gRNA sequence
gaatcaaggtgcaccccctc

SEQ ID NO: 523282 - DNA, 20 bp, Artificial
  CRISPR gRNA sequence
tccctgtgggcaggtgggag

SEQ ID NO: 523283 - DNA, 20 bp, Artificial
  CRISPR gRNA sequence
cctgtgggcaggtgggagtg

SEQ ID NO: 523284 - DNA, 20 bp, Artificial
  CRISPR gRNA sequence
tgggcaggtgggagtgcccg

SEQ ID NO: 523285 - DNA, 20 bp, Artificial
  CRISPR gRNA sequence
ggcaccaggtccatatcttg

SEQ ID NO: 523286 - DNA, 20 bp, Artificial
  CRISPR gRNA sequence
gctgctgctggggccctcag

SEQ ID NO: 523287 - DNA, 20 bp, Artificial
  CRISPR gRNA sequence
ctgctgctggggccctcagt

SEQ ID NO: 523288 - DNA, 20 bp, Artificial
  CRISPR gRNA sequence
ctgctggggccctcagtttc

SEQ ID NO: 523289 - DNA, 20 bp, Artificial
  CRISPR gRNA sequence
ctggggccctcagtttcccc

SEQ ID NO: 523290 - DNA, 20 bp, Artificial
  CRISPR gRNA sequence
gggccctcagtttccccatt

SEQ ID NO: 523291 - DNA, 20 bp, Artificial
  CRISPR gRNA sequence
agtttccccatttgagggta

SEQ ID NO: 523292 - DNA, 20 bp, Artificial
  CRISPR gRNA sequence
ccccatttgagggtatgaag

SEQ ID NO: 523293 - DNA, 20 bp, Artificial
  CRISPR gRNA sequence
cccatttgagggtatgaagt

SEQ ID NO: 523294 - DNA, 20 bp, Artificial
  CRISPR gRNA sequence
gagggtatgaagtgtttgca

SEQ ID NO: 523295 - DNA, 20 bp, Artificial
  CRISPR gRNA sequence
agggtatgaagtgtttgcat

SEQ ID NO: 523296 - DNA, 20 bp, Artificial
  CRISPR gRNA sequence
gcatgccactggtcacgact

SEQ ID NO: 523297 - DNA, 20 bp, Artificial
  CRISPR gRNA sequence
catgccactggtcacgactg

SEQ ID NO: 523298 - DNA, 20 bp, Artificial
  CRISPR gRNA sequence
gtcacgactgtgttaggggc

SEQ ID NO: 523299 - DNA, 20 bp, Artificial
  CRISPR gRNA sequence
tgttaggggcggagacctca

SEQ ID NO: 523300 - DNA, 20 bp, Artificial
  CRISPR gRNA sequence
ggggcggagacctcatgtct

SEQ ID NO: 523301 - DNA, 20 bp, Artificial
  CRISPR gRNA sequence
atgtctgcggccccagggag

SEQ ID NO: 523302 - DNA, 20 bp, Artificial
  CRISPR gRNA sequence
cggccccagggagagcgtgg

SEQ ID NO: 523303 - DNA, 20 bp, Artificial
  CRISPR gRNA sequence
gggtgtgagtccttaccagc

SEQ ID NO: 523304 - DNA, 20 bp, Artificial
  CRISPR gRNA sequence
accagcctggctggggctgc

SEQ ID NO: 523305 - DNA, 20 bp, Artificial
  CRISPR gRNA sequence
ccagcctggctggggctgcc

SEQ ID NO: 523306 - DNA, 20 bp, Artificial
  CRISPR gRNA sequence
gctggggctgccaggggagg

SEQ ID NO: 523307 - DNA, 20 bp, Artificial
  CRISPR gRNA sequence
gggctgccaggggaggtctg

SEQ ID NO: 523308 - DNA, 20 bp, Artificial
  CRISPR gRNA sequence
ccaggggaggtctgcacccc

SEQ ID NO: 523309 - DNA, 20 bp, Artificial
  CRISPR gRNA sequence
caccccctccccacttggcg

SEQ ID NO: 523310 - DNA, 20 bp, Artificial
  CRISPR gRNA sequence
cccacttggcgcagctgcga

SEQ ID NO: 523311 - DNA, 20 bp, Artificial
  CRISPR gRNA sequence
ggcgcagctgcgacctgggg

SEQ ID NO: 523312 - DNA, 20 bp, Artificial
  CRISPR gRNA sequence
gcgcagctgcgacctggggg

SEQ ID NO: 523313 - DNA, 20 bp, Artificial
  CRISPR gRNA sequence
cgacctgggggagtcctgaa

SEQ ID NO: 523314 - DNA, 20 bp, Artificial
  CRISPR gRNA sequence
ggggagtcctgaagccggct

SEQ ID NO: 523315 - DNA, 20 bp, Artificial
  CRISPR gRNA sequence
aagccggctggaccctgcac

SEQ ID NO: 523316 - DNA, 20 bp, Artificial
  CRISPR gRNA sequence
gaccctgcaccctgggggag

SEQ ID NO: 523317 - DNA, 20 bp, Artificial
  CRISPR gRNA sequence
caccctgggggagtcctgaa

SEQ ID NO: 523318 - DNA, 20 bp, Artificial
  CRISPR gRNA sequence
ggggagtcctgaagccggct

SEQ ID NO: 523319 - DNA, 20 bp, Artificial
  CRISPR gRNA sequence
aagccggctggaccctgcac

SEQ ID NO: 523320 - DNA, 20 bp, Artificial
  CRISPR gRNA sequence
gaccctgcaccctgggggag

SEQ ID NO: 523321 - DNA, 20 bp, Artificial
  CRISPR gRNA sequence
caccctgggggagtcctgaa

SEQ ID NO: 523322 - DNA, 20 bp, Artificial
  CRISPR gRNA sequence
ggggagtcctgaagccggct

SEQ ID NO: 523323 - DNA, 20 bp, Artificial
  CRISPR gRNA sequence
aagccggctggaccctgcac

SEQ ID NO: 523324 - DNA, 20 bp, Artificial
  CRISPR gRNA sequence
gaccctgcaccctgggggag

SEQ ID NO: 523325 - DNA, 20 bp, Artificial
  CRISPR gRNA sequence
caccctgggggagtcctgaa

SEQ ID NO: 523326 - DNA, 20 bp, Artificial
  CRISPR gRNA sequence
ggggagtcctgaagccggct

SEQ ID NO: 523327 - DNA, 20 bp, Artificial
  CRISPR gRNA sequence
aagccggctggaccctgcac

SEQ ID NO: 523328 - DNA, 20 bp, Artificial
  CRISPR gRNA sequence
gaccctgcaccctgggggag

SEQ ID NO: 523329 - DNA, 20 bp, Artificial
  CRISPR gRNA sequence
caccctgggggagtcctgaa

SEQ ID NO: 523330 - DNA, 20 bp, Artificial
  CRISPR gRNA sequence
ggggagtcctgaagccggct

SEQ ID NO: 523331 - DNA, 20 bp, Artificial
  CRISPR gRNA sequence
aagccggctggaccctgcac

SEQ ID NO: 523332 - DNA, 20 bp, Artificial
  CRISPR gRNA sequence
gaccctgcaccctgggggag

SEQ ID NO: 523333 - DNA, 20 bp, Artificial
  CRISPR gRNA sequence
caccctgggggagtcctgaa

SEQ ID NO: 523334 - DNA, 20 bp, Artificial
  CRISPR gRNA sequence
ggggagtcctgaagccggct

SEQ ID NO: 523335 - DNA, 20 bp, Artificial
  CRISPR gRNA sequence
aagccggctggaccctgcac

SEQ ID NO: 523336 - DNA, 20 bp, Artificial
  CRISPR gRNA sequence
gaccctgcaccctgggggag

SEQ ID NO: 523337 - DNA, 20 bp, Artificial
  CRISPR gRNA sequence
caccctgggggagtcctgaa

SEQ ID NO: 523338 - DNA, 20 bp, Artificial
  CRISPR gRNA sequence
ggggagtcctgaagccggct

SEQ ID NO: 523339 - DNA, 20 bp, Artificial
  CRISPR gRNA sequence
aagccggctggaccctgcac

SEQ ID NO: 523340 - DNA, 20 bp, Artificial
  CRISPR gRNA sequence
gaccctgcaccctgggggag

SEQ ID NO: 523341 - DNA, 20 bp, Artificial
  CRISPR gRNA sequence
caccctgggggagtcctgaa

SEQ ID NO: 523342 - DNA, 20 bp, Artificial
  CRISPR gRNA sequence
ggggagtcctgaagccggct

SEQ ID NO: 523343 - DNA, 20 bp, Artificial
  CRISPR gRNA sequence
aagccggctggaccctgcac

SEQ ID NO: 523344 - DNA, 20 bp, Artificial
  CRISPR gRNA sequence
gaccctgcaccctgggggag

SEQ ID NO: 523345 - DNA, 20 bp, Artificial
  CRISPR gRNA sequence
caccctgggggagtcctgaa

SEQ ID NO: 523346 - DNA, 20 bp, Artificial
  CRISPR gRNA sequence
ggggagtcctgaagccggct

SEQ ID NO: 523347 - DNA, 20 bp, Artificial
  CRISPR gRNA sequence
aagccggctggaccctgcac

SEQ ID NO: 523348 - DNA, 20 bp, Artificial
  CRISPR gRNA sequence
gaccctgcaccctgggggag

SEQ ID NO: 523349 - DNA, 20 bp, Artificial
  CRISPR gRNA sequence
caccctgggggagtcctgaa

SEQ ID NO: 523350 - DNA, 20 bp, Artificial
  CRISPR gRNA sequence
ggggagtcctgaagccggct

SEQ ID NO: 523351 - DNA, 20 bp, Artificial
  CRISPR gRNA sequence
aagccggctggaccctgcac

SEQ ID NO: 523352 - DNA, 20 bp, Artificial
  CRISPR gRNA sequence
gaccctgcaccctgggggag

SEQ ID NO: 523353 - DNA, 20 bp, Artificial
  CRISPR gRNA sequence
caccctgggggagtcctgaa

SEQ ID NO: 523354 - DNA, 20 bp, Artificial
  CRISPR gRNA sequence
ggggagtcctgaagctggct

SEQ ID NO: 523355 - DNA, 20 bp, Artificial
  CRISPR gRNA sequence
aagctggctggaccctgcac

SEQ ID NO: 523356 - DNA, 20 bp, Artificial
  CRISPR gRNA sequence
gctggaccctgcaccctggg

SEQ ID NO: 523357 - DNA, 20 bp, Artificial
  CRISPR gRNA sequence
gaccctgcaccctggggtag

SEQ ID NO: 523358 - DNA, 20 bp, Artificial
  CRISPR gRNA sequence
caccctggggtagctccagc

SEQ ID NO: 523359 - DNA, 20 bp, Artificial
  CRISPR gRNA sequence
gggtagctccagcacgcaca

SEQ ID NO: 523360 - DNA, 20 bp, Artificial
  CRISPR gRNA sequence
cagcacgcacagggcctccg

SEQ ID NO: 523361 - DNA, 20 bp, Artificial
  CRISPR gRNA sequence
cgatcagctgaggggctggt

SEQ ID NO: 523362 - DNA, 20 bp, Artificial
  CRISPR gRNA sequence
aggggctggtgggcactcgt

SEQ ID NO: 523363 - DNA, 20 bp, Artificial
  CRISPR gRNA sequence
gtgggcactcgtggcaccga

SEQ ID NO: 523364 - DNA, 20 bp, Artificial
  CRISPR gRNA sequence
gtggcaccgaggtcagtcca

SEQ ID NO: 523365 - DNA, 20 bp, Artificial
  CRISPR gRNA sequence
tgagggggcccagatggaga

SEQ ID NO: 523366 - DNA, 20 bp, Artificial
  CRISPR gRNA sequence
gagggggcccagatggagag

SEQ ID NO: 523367 - DNA, 20 bp, Artificial
  CRISPR gRNA sequence
agggggcccagatggagagc

SEQ ID NO: 523368 - DNA, 20 bp, Artificial
  CRISPR gRNA sequence
gaactggcctcggcctgaac

SEQ ID NO: 523369 - DNA, 20 bp, Artificial
  CRISPR gRNA sequence
gcctcggcctgaaccacaac

SEQ ID NO: 523370 - DNA, 20 bp, Artificial
  CRISPR gRNA sequence
ggcctgaaccacaaccccca

SEQ ID NO: 523371 - DNA, 20 bp, Artificial
  CRISPR gRNA sequence
aaccacaacccccaacgatc

SEQ ID NO: 523372 - DNA, 20 bp, Artificial
  CRISPR gRNA sequence
tcagacacagggtgggccca

SEQ ID NO: 523373 - DNA, 20 bp, Artificial
  CRISPR gRNA sequence
cagacacagggtgggcccaa

SEQ ID NO: 523374 - DNA, 20 bp, Artificial
  CRISPR gRNA sequence
agacacagggtgggcccaat

SEQ ID NO: 523375 - DNA, 20 bp, Artificial
  CRISPR gRNA sequence
ctccaggaagttacagcagg

SEQ ID NO: 523376 - DNA, 20 bp, Artificial
  CRISPR gRNA sequence
caggaagttacagcagggtg

SEQ ID NO: 523377 - DNA, 20 bp, Artificial
  CRISPR gRNA sequence
cagcagggtgcaggttctgt

SEQ ID NO: 523378 - DNA, 20 bp, Artificial
  CRISPR gRNA sequence
tgtttttgaccccaggacgg

SEQ ID NO: 523379 - DNA, 20 bp, Artificial
  CRISPR gRNA sequence
tttttgaccccaggacggga

SEQ ID NO: 523380 - DNA, 20 bp, Artificial
  CRISPR gRNA sequence
ttgaccccaggacgggaagg

SEQ ID NO: 523381 - DNA, 20 bp, Artificial
  CRISPR gRNA sequence
tgaccccaggacgggaagga

SEQ ID NO: 523382 - DNA, 20 bp, Artificial
  CRISPR gRNA sequence
gaccccaggacgggaaggat

SEQ ID NO: 523383 - DNA, 20 bp, Artificial
  CRISPR gRNA sequence
accccaggacgggaaggatc

SEQ ID NO: 523384 - DNA, 20 bp, Artificial
  CRISPR gRNA sequence
ccttttgacatttttgtatt

SEQ ID NO: 523385 - DNA, 20 bp, Artificial
  CRISPR gRNA sequence
ttgacatttttgtattctga

SEQ ID NO: 523386 - DNA, 20 bp, Artificial
  CRISPR gRNA sequence
tgacatttttgtattctgat

SEQ ID NO: 523387 - DNA, 20 bp, Artificial
  CRISPR gRNA sequence
gacatttttgtattctgatt

SEQ ID NO: 523388 - DNA, 20 bp, Artificial
  CRISPR gRNA sequence
acatttttgtattctgatta

SEQ ID NO: 523389 - DNA, 20 bp, Artificial
  CRISPR gRNA sequence
ttgtattctgattataattt

SEQ ID NO: 523390 - DNA, 20 bp, Artificial
  CRISPR gRNA sequence
tgtattctgattataatttt

SEQ ID NO: 523391 - DNA, 20 bp, Artificial
  CRISPR gRNA sequence
gtattctgattataattttg

SEQ ID NO: 523392 - DNA, 20 bp, Artificial
  CRISPR gRNA sequence
tattctgattataattttgc

SEQ ID NO: 523393 - DNA, 20 bp, Artificial
  CRISPR gRNA sequence
tgattataattttgctggga

SEQ ID NO: 523394 - DNA, 20 bp, Artificial
  CRISPR gRNA sequence
attataattttgctgggaac

SEQ ID NO: 523395 - DNA, 20 bp, Artificial
  CRISPR gRNA sequence
taattttgctgggaaccagg

SEQ ID NO: 523396 - DNA, 20 bp, Artificial
  CRISPR gRNA sequence
tgctgggaaccagggaatga

SEQ ID NO: 523397 - DNA, 20 bp, Artificial
  CRISPR gRNA sequence
gctgggaaccagggaatgag

SEQ ID NO: 523398 - DNA, 20 bp, Artificial
  CRISPR gRNA sequence
ctgggaaccagggaatgagg

SEQ ID NO: 523399 - DNA, 20 bp, Artificial
  CRISPR gRNA sequence
ggaaccagggaatgaggtca

SEQ ID NO: 523400 - DNA, 20 bp, Artificial
  CRISPR gRNA sequence
ccaaaacaacaggaccttgg

SEQ ID NO: 523401 - DNA, 20 bp, Artificial
  CRISPR gRNA sequence
ggggcttgttggggcgtcta

SEQ ID NO: 523402 - DNA, 20 bp, Artificial
  CRISPR gRNA sequence
gggcttgttggggcgtctaa

SEQ ID NO: 523403 - DNA, 20 bp, Artificial
  CRISPR gRNA sequence
gttggggcgtctaagctgtg

SEQ ID NO: 523404 - DNA, 20 bp, Artificial
  CRISPR gRNA sequence
ttggggcgtctaagctgtgg

SEQ ID NO: 523405 - DNA, 20 bp, Artificial
  CRISPR gRNA sequence
gggcgtctaagctgtgggat

SEQ ID NO: 523406 - DNA, 20 bp, Artificial
  CRISPR gRNA sequence
agctgtgggatcctcagatg

SEQ ID NO: 523407 - DNA, 20 bp, Artificial
  CRISPR gRNA sequence
tgggatcctcagatgggccc

SEQ ID NO: 523408 - DNA, 20 bp, Artificial
  CRISPR gRNA sequence
agatgggcccctggtgggtg

SEQ ID NO: 523409 - DNA, 20 bp, Artificial
  CRISPR gRNA sequence
gtgggtgttccgttggcctc

SEQ ID NO: 523410 - DNA, 20 bp, Artificial
  CRISPR gRNA sequence
cgttggcctcagagccccca

SEQ ID NO: 523411 - DNA, 20 bp, Artificial
  CRISPR gRNA sequence
gcctcagagcccccagcaca

SEQ ID NO: 523412 - DNA, 20 bp, Artificial
  CRISPR gRNA sequence
agagcccccagcacaggtgc

SEQ ID NO: 523413 - DNA, 20 bp, Artificial
  CRISPR gRNA sequence
tcgggggatggaggggagcc

SEQ ID NO: 523414 - DNA, 20 bp, Artificial
  CRISPR gRNA sequence
cgggggatggaggggagcca

SEQ ID NO: 523415 - DNA, 20 bp, Artificial
  CRISPR gRNA sequence
gggggatggaggggagccag

SEQ ID NO: 523416 - DNA, 20 bp, Artificial
  CRISPR gRNA sequence
tggctgagggcacccgagcc

SEQ ID NO: 523417 - DNA, 20 bp, Artificial
  CRISPR gRNA sequence
agggcacccgagcctcccgg

SEQ ID NO: 523418 - DNA, 20 bp, Artificial
  CRISPR gRNA sequence
ccgggccacagcacagcacc

SEQ ID NO: 523419 - DNA, 20 bp, Artificial
  CRISPR gRNA sequence
tcttcaaagccggcaggccc

SEQ ID NO: 523420 - DNA, 20 bp, Artificial
  CRISPR gRNA sequence
caaagccggcaggccctagt

SEQ ID NO: 523421 - DNA, 20 bp, Artificial
  CRISPR gRNA sequence
aaagccggcaggccctagtt

SEQ ID NO: 523422 - DNA, 20 bp, Artificial
  CRISPR gRNA sequence
gtttggggctctgctggctt

SEQ ID NO: 523423 - DNA, 20 bp, Artificial
  CRISPR gRNA sequence
ggggctctgctggcttgggt

SEQ ID NO: 523424 - DNA, 20 bp, Artificial
  CRISPR gRNA sequence
gggctctgctggcttgggtc

SEQ ID NO: 523425 - DNA, 20 bp, Artificial
  CRISPR gRNA sequence
tgctggcttgggtctgccca

SEQ ID NO: 523426 - DNA, 20 bp, Artificial
  CRISPR gRNA sequence
ctggcttgggtctgcccact

SEQ ID NO: 523427 - DNA, 20 bp, Artificial
  CRISPR gRNA sequence
gcttgggtctgcccactgaa

SEQ ID NO: 523428 - DNA, 20 bp, Artificial
  CRISPR gRNA sequence
gggtctgcccactgaacctt

SEQ ID NO: 523429 - DNA, 20 bp, Artificial
  CRISPR gRNA sequence
ggtctgcccactgaaccttg

SEQ ID NO: 523430 - DNA, 20 bp, Artificial
  CRISPR gRNA sequence
cccactgaaccttgggtggc

SEQ ID NO: 523431 - DNA, 20 bp, Artificial
  CRISPR gRNA sequence
aaccttgggtggccctgcca

SEQ ID NO: 523432 - DNA, 20 bp, Artificial
  CRISPR gRNA sequence
gggtggccctgccagcacca

SEQ ID NO: 523433 - DNA, 20 bp, Artificial
  CRISPR gRNA sequence
ggtggccctgccagcaccac

SEQ ID NO: 523434 - DNA, 20 bp, Artificial
  CRISPR gRNA sequence
ccagcaccacccgagggaag

SEQ ID NO: 523435 - DNA, 20 bp, Artificial
  CRISPR gRNA sequence
ggaggccgtgacaggaactg

SEQ ID NO: 523436 - DNA, 20 bp, Artificial
  CRISPR gRNA sequence
gcatttgctggaggaggtgt

SEQ ID NO: 523437 - DNA, 20 bp, Artificial
  CRISPR gRNA sequence
gctggaggaggtgtgttgat

SEQ ID NO: 523438 - DNA, 20 bp, Artificial
  CRISPR gRNA sequence
ctggaggaggtgtgttgatc

SEQ ID NO: 523439 - DNA, 20 bp, Artificial
  CRISPR gRNA sequence
gaggaggtgtgttgatcttt

SEQ ID NO: 523440 - DNA, 20 bp, Artificial
  CRISPR gRNA sequence
atctttgcttctgacaacag

SEQ ID NO: 523441 - DNA, 20 bp, Artificial
  CRISPR gRNA sequence
tgcttctgacaacagcccca

SEQ ID NO: 523442 - DNA, 20 bp, Artificial
  CRISPR gRNA sequence
gcttctgacaacagccccag

SEQ ID NO: 523443 - DNA, 20 bp, Artificial
  CRISPR gRNA sequence
cttctgacaacagccccagg

SEQ ID NO: 523444 - DNA, 20 bp, Artificial
  CRISPR gRNA sequence
ctgacaacagccccagggta

SEQ ID NO: 523445 - DNA, 20 bp, Artificial
  CRISPR gRNA sequence
tgacaacagccccagggtaa

SEQ ID NO: 523446 - DNA, 20 bp, Artificial
  CRISPR gRNA sequence
acaacagccccagggtaacg

SEQ ID NO: 523447 - DNA, 20 bp, Artificial
  CRISPR gRNA sequence
cctgcccaccatgacaggaa

SEQ ID NO: 523448 - DNA, 20 bp, Artificial
  CRISPR gRNA sequence
ctgcccaccatgacaggaag

SEQ ID NO: 523449 - DNA, 20 bp, Artificial
  CRISPR gRNA sequence
cccaccatgacaggaaggct

SEQ ID NO: 523450 - DNA, 20 bp, Artificial
  CRISPR gRNA sequence
ctgggtaccccttctcagta

SEQ ID NO: 523451 - DNA, 20 bp, Artificial
  CRISPR gRNA sequence
ggtaccccttctcagtacct

SEQ ID NO: 523452 - DNA, 20 bp, Artificial
  CRISPR gRNA sequence
ctcagtacctctccaccttc

SEQ ID NO: 523453 - DNA, 20 bp, Artificial
  CRISPR gRNA sequence
tcagtacctctccaccttct

SEQ ID NO: 523454 - DNA, 20 bp, Artificial
  CRISPR gRNA sequence
agtacctctccaccttcttg

SEQ ID NO: 523455 - DNA, 20 bp, Artificial
  CRISPR gRNA sequence
tccaccttcttggtgccaga

SEQ ID NO: 523456 - DNA, 20 bp, Artificial
  CRISPR gRNA sequence
caccttcttggtgccagata

SEQ ID NO: 523457 - DNA, 20 bp, Artificial
  CRISPR gRNA sequence
cttggtgccagataaaaggg

SEQ ID NO: 523458 - DNA, 20 bp, Artificial
  CRISPR gRNA sequence
ttggtgccagataaaagggt

SEQ ID NO: 523459 - DNA, 20 bp, Artificial
  CRISPR gRNA sequence
ggtgccagataaaagggtcc

SEQ ID NO: 523460 - DNA, 20 bp, Artificial
  CRISPR gRNA sequence
gtgccagataaaagggtccc

SEQ ID NO: 523461 - DNA, 20 bp, Artificial
  CRISPR gRNA sequence
taatgttctcaggtcctggg

SEQ ID NO: 523462 - DNA, 20 bp, Artificial
  CRISPR gRNA sequence
tcaggtcctgggaggtcaga

SEQ ID NO: 523463 - DNA, 20 bp, Artificial
  CRISPR gRNA sequence
aggtcctgggaggtcagacc

SEQ ID NO: 523464 - DNA, 20 bp, Artificial
  CRISPR gRNA sequence
ggaggtcagacccaggggcc

SEQ ID NO: 523465 - DNA, 20 bp, Artificial
  CRISPR gRNA sequence
ggaagccctaagacccccca

SEQ ID NO: 523466 - DNA, 20 bp, Artificial
  CRISPR gRNA sequence
agaccccccaaggagccgac

SEQ ID NO: 523467 - DNA, 20 bp, Artificial
  CRISPR gRNA sequence
ggcctggtttgggcacctcc

SEQ ID NO: 523468 - DNA, 20 bp, Artificial
  CRISPR gRNA sequence
gtttgggcacctcccggatg

SEQ ID NO: 523469 - DNA, 20 bp, Artificial
  CRISPR gRNA sequence
gggcacctcccggatggagg

SEQ ID NO: 523470 - DNA, 20 bp, Artificial
  CRISPR gRNA sequence
ggcacctcccggatggaggg

SEQ ID NO: 523471 - DNA, 20 bp, Artificial
  CRISPR gRNA sequence
ccggatggagggaagggaac

SEQ ID NO: 523472 - DNA, 20 bp, Artificial
  CRISPR gRNA sequence
ctgcccgctaggaggtgctg

SEQ ID NO: 523473 - DNA, 20 bp, Artificial
  CRISPR gRNA sequence
cccgctaggaggtgctgccg

SEQ ID NO: 523474 - DNA, 20 bp, Artificial
  CRISPR gRNA sequence
ggaggtgctgccggcctcca

SEQ ID NO: 523475 - DNA, 20 bp, Artificial
  CRISPR gRNA sequence
ccggcctccagcaccaggct

SEQ ID NO: 523476 - DNA, 20 bp, Artificial
  CRISPR gRNA sequence
cagcaccaggctgaggcctg

SEQ ID NO: 523477 - DNA, 20 bp, Artificial
  CRISPR gRNA sequence
aggcctgcttccgtcatttt

SEQ ID NO: 523478 - DNA, 20 bp, Artificial
  CRISPR gRNA sequence
cttccgtcattttgcctctg

SEQ ID NO: 523479 - DNA, 20 bp, Artificial
  CRISPR gRNA sequence
ccgtcattttgcctctgggg

SEQ ID NO: 523480 - DNA, 20 bp, Artificial
  CRISPR gRNA sequence
cgtcattttgcctctggggc

SEQ ID NO: 523481 - DNA, 20 bp, Artificial
  CRISPR gRNA sequence
tgcctctggggccgagggcc

SEQ ID NO: 523482 - DNA, 20 bp, Artificial
  CRISPR gRNA sequence
gcctctggggccgagggcct

SEQ ID NO: 523483 - DNA, 20 bp, Artificial
  CRISPR gRNA sequence
cctctggggccgagggcctg

SEQ ID NO: 523484 - DNA, 20 bp, Artificial
  CRISPR gRNA sequence
tggggccgagggcctgtgag

SEQ ID NO: 523485 - DNA, 20 bp, Artificial
  CRISPR gRNA sequence
gggccgagggcctgtgagtg

SEQ ID NO: 523486 - DNA, 20 bp, Artificial
  CRISPR gRNA sequence
tgagtgaccactgagccgcc

SEQ ID NO: 523487 - DNA, 20 bp, Artificial
  CRISPR gRNA sequence
agccgcccctggctgtggat

SEQ ID NO: 523488 - DNA, 20 bp, Artificial
  CRISPR gRNA sequence
gctgtggatgcgtgggttaa

SEQ ID NO: 523489 - DNA, 20 bp, Artificial
  CRISPR gRNA sequence
tggatgcgtgggttaaggac

SEQ ID NO: 523490 - DNA, 20 bp, Artificial
  CRISPR gRNA sequence
aggacggggtgggtgtgtat

SEQ ID NO: 523491 - DNA, 20 bp, Artificial
  CRISPR gRNA sequence
gaaacaaaagggcaggaccc

SEQ ID NO: 523492 - DNA, 20 bp, Artificial
  CRISPR gRNA sequence
gtggcttgggcaagtcaggt

SEQ ID NO: 523493 - DNA, 20 bp, Artificial
  CRISPR gRNA sequence
gggcaagtcaggtgactttt

SEQ ID NO: 523494 - DNA, 20 bp, Artificial
  CRISPR gRNA sequence
ggcaagtcaggtgacttttt

SEQ ID NO: 523495 - DNA, 20 bp, Artificial
  CRISPR gRNA sequence
tttttcccacctggcaggga

SEQ ID NO: 523496 - DNA, 20 bp, Artificial
  CRISPR gRNA sequence
ttttcccacctggcagggac

SEQ ID NO: 523497 - DNA, 20 bp, Artificial
  CRISPR gRNA sequence
tttcccacctggcagggact

SEQ ID NO: 523498 - DNA, 20 bp, Artificial
  CRISPR gRNA sequence
ttcccacctggcagggactg

SEQ ID NO: 523499 - DNA, 20 bp, Artificial
  CRISPR gRNA sequence
tcccacctggcagggactgc

SEQ ID NO: 523500 - DNA, 20 bp, Artificial
  CRISPR gRNA sequence
cccacctggcagggactgca

SEQ ID NO: 523501 - DNA, 20 bp, Artificial
  CRISPR gRNA sequence
ccacctggcagggactgcag

SEQ ID NO: 523502 - DNA, 20 bp, Artificial
  CRISPR gRNA sequence
gcagggactgcagggctcct

SEQ ID NO: 523503 - DNA, 20 bp, Artificial
  CRISPR gRNA sequence
cagggctcctgggcaggcct

SEQ ID NO: 523504 - DNA, 20 bp, Artificial
  CRISPR gRNA sequence
ctgggcaggcctagcacaca

SEQ ID NO: 523505 - DNA, 20 bp, Artificial
  CRISPR gRNA sequence
ggcaggcctagcacacagct

SEQ ID NO: 523506 - DNA, 20 bp, Artificial
  CRISPR gRNA sequence
gcacacagcttggcacccgc

SEQ ID NO: 523507 - DNA, 20 bp, Artificial
  CRISPR gRNA sequence
ggcacccgcgggcatcaagc

SEQ ID NO: 523508 - DNA, 20 bp, Artificial
  CRISPR gRNA sequence
gcacccgcgggcatcaagcc

SEQ ID NO: 523509 - DNA, 20 bp, Artificial
  CRISPR gRNA sequence
tctcttcctggcacacagcc

SEQ ID NO: 523510 - DNA, 20 bp, Artificial
  CRISPR gRNA sequence
ctcttcctggcacacagcct

SEQ ID NO: 523511 - DNA, 20 bp, Artificial
  CRISPR gRNA sequence
tcttcctggcacacagcctg

SEQ ID NO: 523512 - DNA, 20 bp, Artificial
  CRISPR gRNA sequence
ttcctggcacacagcctggc

SEQ ID NO: 523513 - DNA, 20 bp, Artificial
  CRISPR gRNA sequence
cctggcacacagcctggcac

SEQ ID NO: 523514 - DNA, 20 bp, Artificial
  CRISPR gRNA sequence
ctggcacacagcctggcacc

SEQ ID NO: 523515 - DNA, 20 bp, Artificial
  CRISPR gRNA sequence
gcacacagcctggcacccgc

SEQ ID NO: 523516 - DNA, 20 bp, Artificial
  CRISPR gRNA sequence
gcacccgcgggcatccagcc

SEQ ID NO: 523517 - DNA, 20 bp, Artificial
  CRISPR gRNA sequence
tctcttcctggctatgtttc

SEQ ID NO: 523518 - DNA, 20 bp, Artificial
  CRISPR gRNA sequence
ctcttcctggctatgtttct

SEQ ID NO: 523519 - DNA, 20 bp, Artificial
  CRISPR gRNA sequence
tcttcctggctatgtttctg

SEQ ID NO: 523520 - DNA, 20 bp, Artificial
  CRISPR gRNA sequence
ttcctggctatgtttctgcc

SEQ ID NO: 523521 - DNA, 20 bp, Artificial
  CRISPR gRNA sequence
cctggctatgtttctgccac

SEQ ID NO: 523522 - DNA, 20 bp, Artificial
  CRISPR gRNA sequence
ctggctatgtttctgccaca

SEQ ID NO: 523523 - DNA, 20 bp, Artificial
  CRISPR gRNA sequence
gctatgtttctgccacagag

SEQ ID NO: 523524 - DNA, 20 bp, Artificial
  CRISPR gRNA sequence
tgtttctgccacagagagac

SEQ ID NO: 523525 - DNA, 20 bp, Artificial
  CRISPR gRNA sequence
ctgccacagagagacagggc

SEQ ID NO: 523526 - DNA, 20 bp, Artificial
  CRISPR gRNA sequence
tgccacagagagacagggcc

SEQ ID NO: 523527 - DNA, 20 bp, Artificial
  CRISPR gRNA sequence
ccacagagagacagggccaa

SEQ ID NO: 523528 - DNA, 20 bp, Artificial
  CRISPR gRNA sequence
tcctccaagcacaggctctg

SEQ ID NO: 523529 - DNA, 20 bp, Artificial
  CRISPR gRNA sequence
ctccaagcacaggctctgct

SEQ ID NO: 523530 - DNA, 20 bp, Artificial
  CRISPR gRNA sequence
caagcacaggctctgctcac

SEQ ID NO: 523531 - DNA, 20 bp, Artificial
  CRISPR gRNA sequence
tgctcacggaggacctgggg

SEQ ID NO: 523532 - DNA, 20 bp, Artificial
  CRISPR gRNA sequence
ctcacggaggacctggggca

SEQ ID NO: 523533 - DNA, 20 bp, Artificial
  CRISPR gRNA sequence
acggaggacctggggcacac

SEQ ID NO: 523534 - DNA, 20 bp, Artificial
  CRISPR gRNA sequence
gggcacactggggcagagtg

SEQ ID NO: 523535 - DNA, 20 bp, Artificial
  CRISPR gRNA sequence
gggcagagtgcacacaccgg

SEQ ID NO: 523536 - DNA, 20 bp, Artificial
  CRISPR gRNA sequence
tggtgtttgtgtgcgtgtac

SEQ ID NO: 523537 - DNA, 20 bp, Artificial
  CRISPR gRNA sequence
gtgtttgtgtgcgtgtacat

SEQ ID NO: 523538 - DNA, 20 bp, Artificial
  CRISPR gRNA sequence
gtgtgcgtgtacatttgcac

SEQ ID NO: 523539 - DNA, 20 bp, Artificial
  CRISPR gRNA sequence
tgtgcgtgtacatttgcacg

SEQ ID NO: 523540 - DNA, 20 bp, Artificial
  CRISPR gRNA sequence
gcacgtgtgtatggtgtgtg

SEQ ID NO: 523541 - DNA, 20 bp, Artificial
  CRISPR gRNA sequence
cacgtgtgtatggtgtgtgc

SEQ ID NO: 523542 - DNA, 20 bp, Artificial
  CRISPR gRNA sequence
tgtggtgtgtatgtgtgtgt

SEQ ID NO: 523543 - DNA, 20 bp, Artificial
  CRISPR gRNA sequence
gtgtgtggtgtgtagtgtct

SEQ ID NO: 523544 - DNA, 20 bp, Artificial
  CRISPR gRNA sequence
tgtgtggtgtgtagtgtctt

SEQ ID NO: 523545 - DNA, 20 bp, Artificial
  CRISPR gRNA sequence
gcggggagtatggtgtgggt

SEQ ID NO: 523546 - DNA, 20 bp, Artificial
  CRISPR gRNA sequence
cggggagtatggtgtgggta

SEQ ID NO: 523547 - DNA, 20 bp, Artificial
  CRISPR gRNA sequence
tgtgtgtacatatgtgtggt

SEQ ID NO: 523548 - DNA, 20 bp, Artificial
  CRISPR gRNA sequence
tgtgtacatatgtgtggtgt

SEQ ID NO: 523549 - DNA, 20 bp, Artificial
  CRISPR gRNA sequence
tatgcacgtacacgtgcatg

SEQ ID NO: 523550 - DNA, 20 bp, Artificial
  CRISPR gRNA sequence
catgtgtgtgtgtgcctgtg

SEQ ID NO: 523551 - DNA, 20 bp, Artificial
  CRISPR gRNA sequence
tgttgtgtgcctctgcaggg

SEQ ID NO: 523552 - DNA, 20 bp, Artificial
  CRISPR gRNA sequence
tgtgcctctgcaggggcccg

SEQ ID NO: 523553 - DNA, 20 bp, Artificial
  CRISPR gRNA sequence
tgcaggggcccgctgcagct

SEQ ID NO: 523554 - DNA, 20 bp, Artificial
  CRISPR gRNA sequence
caggggcccgctgcagctgt

SEQ ID NO: 523555 - DNA, 20 bp, Artificial
  CRISPR gRNA sequence
cagctgtcctgggtgcctgg

SEQ ID NO: 523556 - DNA, 20 bp, Artificial
  CRISPR gRNA sequence
tcctgggtgcctggctgagc

SEQ ID NO: 523557 - DNA, 20 bp, Artificial
  CRISPR gRNA sequence
ggtgcctggctgagcaggtg

SEQ ID NO: 523558 - DNA, 20 bp, Artificial
  CRISPR gRNA sequence
gctgagcaggtgtgctgccc

SEQ ID NO: 523559 - DNA, 20 bp, Artificial
  CRISPR gRNA sequence
agcaggtgtgctgcccgcac

SEQ ID NO: 523560 - DNA, 20 bp, Artificial
  CRISPR gRNA sequence
cccgcactgctgagcccggg

SEQ ID NO: 523561 - DNA, 20 bp, Artificial
  CRISPR gRNA sequence
ctgagcccgggatccctccc

SEQ ID NO: 523562 - DNA, 20 bp, Artificial
  CRISPR gRNA sequence
agcccgggatccctccctcc

SEQ ID NO: 523563 - DNA, 20 bp, Artificial
  CRISPR gRNA sequence
cctccctggctgttggcagc

SEQ ID NO: 523564 - DNA, 20 bp, Artificial
  CRISPR gRNA sequence
cctggctgttggcagctggg

SEQ ID NO: 523565 - DNA, 20 bp, Artificial
  CRISPR gRNA sequence
gctgttggcagctgggccca

SEQ ID NO: 523566 - DNA, 20 bp, Artificial
  CRISPR gRNA sequence
ttggcagctgggcccagtgc

SEQ ID NO: 523567 - DNA, 20 bp, Artificial
  CRISPR gRNA sequence
gcagctgggcccagtgcagc

SEQ ID NO: 523568 - DNA, 20 bp, Artificial
  CRISPR gRNA sequence
ggcccagtgcagctgtgctg

SEQ ID NO: 523569 - DNA, 20 bp, Artificial
  CRISPR gRNA sequence
tgctggcctgaccctaaccc

SEQ ID NO: 523570 - DNA, 20 bp, Artificial
  CRISPR gRNA sequence
gcctgaccctaacccacccc

SEQ ID NO: 523571 - DNA, 20 bp, Artificial
  CRISPR gRNA sequence
accctaacccaccccctgca

SEQ ID NO: 523572 - DNA, 20 bp, Artificial
  CRISPR gRNA sequence
acccaccccctgcagcaggg

SEQ ID NO: 523573 - DNA, 20 bp, Artificial
  CRISPR gRNA sequence
cagcagggacagggccccag

SEQ ID NO: 523574 - DNA, 20 bp, Artificial
  CRISPR gRNA sequence
cttgtcccaggccagctgga

SEQ ID NO: 523575 - DNA, 20 bp, Artificial
  CRISPR gRNA sequence
gtcccaggccagctggaggg

SEQ ID NO: 523576 - DNA, 20 bp, Artificial
  CRISPR gRNA sequence
tcccaggccagctggagggg

SEQ ID NO: 523577 - DNA, 20 bp, Artificial
  CRISPR gRNA sequence
gaggggagcttcatgggtgg

SEQ ID NO: 523578 - DNA, 20 bp, Artificial
  CRISPR gRNA sequence
catgggtggtcagccccagg

SEQ ID NO: 523579 - DNA, 20 bp, Artificial
  CRISPR gRNA sequence
atgggtggtcagccccaggg

SEQ ID NO: 523580 - DNA, 20 bp, Artificial
  CRISPR gRNA sequence
ggcctgagaccgtcaccaag

SEQ ID NO: 523581 - DNA, 20 bp, Artificial
  CRISPR gRNA sequence
agaccgtcaccaagacccct

SEQ ID NO: 523582 - DNA, 20 bp, Artificial
  CRISPR gRNA sequence
ccctccacaggacatgctgg

SEQ ID NO: 523583 - DNA, 20 bp, Artificial
  CRISPR gRNA sequence
cctccacaggacatgctggg

SEQ ID NO: 523584 - DNA, 20 bp, Artificial
  CRISPR gRNA sequence
cacaggacatgctgggcctg

SEQ ID NO: 523585 - DNA, 20 bp, Artificial
  CRISPR gRNA sequence
ggcctgcgccccccactgct

SEQ ID NO: 523586 - DNA, 20 bp, Artificial
  CRISPR gRNA sequence
cgccccccactgctcgccct

SEQ ID NO: 523587 - DNA, 20 bp, Artificial
  CRISPR gRNA sequence
ctcgccctggtggggctgct

SEQ ID NO: 523588 - DNA, 20 bp, Artificial
  CRISPR gRNA sequence
gccctggtggggctgctctc

SEQ ID NO: 523589 - DNA, 20 bp, Artificial
  CRISPR gRNA sequence
gtggggctgctctccctcgg

SEQ ID NO: 523590 - DNA, 20 bp, Artificial
  CRISPR gRNA sequence
ctctccctcgggtgcggtga

SEQ ID NO: 523591 - DNA, 20 bp, Artificial
  CRISPR gRNA sequence
tccctcgggtgcggtgagtt

SEQ ID NO: 523592 - DNA, 20 bp, Artificial
  CRISPR gRNA sequence
cctcgggtgcggtgagttct

SEQ ID NO: 523593 - DNA, 20 bp, Artificial
  CRISPR gRNA sequence
gggtgcggtgagttctgtgt

SEQ ID NO: 523594 - DNA, 20 bp, Artificial
  CRISPR gRNA sequence
tgtgttccacggaggggact

SEQ ID NO: 523595 - DNA, 20 bp, Artificial
  CRISPR gRNA sequence
tgttccacggaggggactcc

SEQ ID NO: 523596 - DNA, 20 bp, Artificial
  CRISPR gRNA sequence
cacggaggggactccacgcg

SEQ ID NO: 523597 - DNA, 20 bp, Artificial
  CRISPR gRNA sequence
cacgcgtgacattccaatca

SEQ ID NO: 523598 - DNA, 20 bp, Artificial
  CRISPR gRNA sequence
caatcagggagaacagggcc

SEQ ID NO: 523599 - DNA, 20 bp, Artificial
  CRISPR gRNA sequence
ccctcactttcccatagaca

SEQ ID NO: 523600 - DNA, 20 bp, Artificial
  CRISPR gRNA sequence
actttcccatagacagaagt

SEQ ID NO: 523601 - DNA, 20 bp, Artificial
  CRISPR gRNA sequence
tcccatagacagaagttccc

SEQ ID NO: 523602 - DNA, 20 bp, Artificial
  CRISPR gRNA sequence
cccatagacagaagttcccg

SEQ ID NO: 523603 - DNA, 20 bp, Artificial
  CRISPR gRNA sequence
ccatagacagaagttcccgg

SEQ ID NO: 523604 - DNA, 20 bp, Artificial
  CRISPR gRNA sequence
ccgggaggctggggaaggac

SEQ ID NO: 523605 - DNA, 20 bp, Artificial
  CRISPR gRNA sequence
gggaaggaccttgccactgg

SEQ ID NO: 523606 - DNA, 20 bp, Artificial
  CRISPR gRNA sequence
gccactgggggtaggtcggg

SEQ ID NO: 523607 - DNA, 20 bp, Artificial
  CRISPR gRNA sequence
ccactgggggtaggtcgggg

SEQ ID NO: 523608 - DNA, 20 bp, Artificial
  CRISPR gRNA sequence
ggggtaggtcggggactcag

SEQ ID NO: 523609 - DNA, 20 bp, Artificial
  CRISPR gRNA sequence
aggcctcgtctccgcacgtg

SEQ ID NO: 523610 - DNA, 20 bp, Artificial
  CRISPR gRNA sequence
gtctccgcacgtgccaggag

SEQ ID NO: 523611 - DNA, 20 bp, Artificial
  CRISPR gRNA sequence
cgcacgtgccaggaggctgt

SEQ ID NO: 523612 - DNA, 20 bp, Artificial
  CRISPR gRNA sequence
tagctgtgctgtttcccgag

SEQ ID NO: 523613 - DNA, 20 bp, Artificial
  CRISPR gRNA sequence
tgctgtttcccgagggcccc

SEQ ID NO: 523614 - DNA, 20 bp, Artificial
  CRISPR gRNA sequence
tttcccgagggcccctcttt

SEQ ID NO: 523615 - DNA, 20 bp, Artificial
  CRISPR gRNA sequence
cccgagggcccctctttgca

SEQ ID NO: 523616 - DNA, 20 bp, Artificial
  CRISPR gRNA sequence
ccgagggcccctctttgcac

SEQ ID NO: 523617 - DNA, 20 bp, Artificial
  CRISPR gRNA sequence
tttgcacctgggggtggtgg

SEQ ID NO: 523618 - DNA, 20 bp, Artificial
  CRISPR gRNA sequence
tgcacctgggggtggtggcg

SEQ ID NO: 523619 - DNA, 20 bp, Artificial
  CRISPR gRNA sequence
gcacctgggggtggtggcga

SEQ ID NO: 523620 - DNA, 20 bp, Artificial
  CRISPR gRNA sequence
cacctgggggtggtggcgaa

SEQ ID NO: 523621 - DNA, 20 bp, Artificial
  CRISPR gRNA sequence
ggggtggtggcgaatgcggg

SEQ ID NO: 523622 - DNA, 20 bp, Artificial
  CRISPR gRNA sequence
ctcctggaggctgcctccct

SEQ ID NO: 523623 - DNA, 20 bp, Artificial
  CRISPR gRNA sequence
ctggaggctgcctccctgtc

SEQ ID NO: 523624 - DNA, 20 bp, Artificial
  CRISPR gRNA sequence
gaggctgcctccctgtcttt

SEQ ID NO: 523625 - DNA, 20 bp, Artificial
  CRISPR gRNA sequence
cctccctgtctttttgggcc

SEQ ID NO: 523626 - DNA, 20 bp, Artificial
  CRISPR gRNA sequence
cctgtctttttgggcctcct

SEQ ID NO: 523627 - DNA, 20 bp, Artificial
  CRISPR gRNA sequence
tctttttgggcctcctctga

SEQ ID NO: 523628 - DNA, 20 bp, Artificial
  CRISPR gRNA sequence
tttgggcctcctctgacctt

SEQ ID NO: 523629 - DNA, 20 bp, Artificial
  CRISPR gRNA sequence
ttgggcctcctctgaccttc

SEQ ID NO: 523630 - DNA, 20 bp, Artificial
  CRISPR gRNA sequence
tgggcctcctctgaccttcc

SEQ ID NO: 523631 - DNA, 20 bp, Artificial
  CRISPR gRNA sequence
gggcctcctctgaccttcct

SEQ ID NO: 523632 - DNA, 20 bp, Artificial
  CRISPR gRNA sequence
ggcctcctctgaccttcctg

SEQ ID NO: 523633 - DNA, 20 bp, Artificial
  CRISPR gRNA sequence
ctctgaccttcctgctctac

SEQ ID NO: 523634 - DNA, 20 bp, Artificial
  CRISPR gRNA sequence
tgaccttcctgctctactcc

SEQ ID NO: 523635 - DNA, 20 bp, Artificial
  CRISPR gRNA sequence
accttcctgctctactcccc

SEQ ID NO: 523636 - DNA, 20 bp, Artificial
  CRISPR gRNA sequence
cctgctctactcccccttgg

SEQ ID NO: 523637 - DNA, 20 bp, Artificial
  CRISPR gRNA sequence
ctgctctactcccccttggg

SEQ ID NO: 523638 - DNA, 20 bp, Artificial
  CRISPR gRNA sequence
ctctactcccccttgggtgt

SEQ ID NO: 523639 - DNA, 20 bp, Artificial
  CRISPR gRNA sequence
tactcccccttgggtgtggg

SEQ ID NO: 523640 - DNA, 20 bp, Artificial
  CRISPR gRNA sequence
ctcccccttgggtgtgggca

SEQ ID NO: 523641 - DNA, 20 bp, Artificial
  CRISPR gRNA sequence
ccccttgggtgtgggcaggg

SEQ ID NO: 523642 - DNA, 20 bp, Artificial
  CRISPR gRNA sequence
gggtgtgggcagggcggccc

SEQ ID NO: 523643 - DNA, 20 bp, Artificial
  CRISPR gRNA sequence
ggtgtgggcagggcggccca

SEQ ID NO: 523644 - DNA, 20 bp, Artificial
  CRISPR gRNA sequence
accagccggcctcgtccctc

SEQ ID NO: 523645 - DNA, 20 bp, Artificial
  CRISPR gRNA sequence
gtccctcagtcctctctcag

SEQ ID NO: 523646 - DNA, 20 bp, Artificial
  CRISPR gRNA sequence
agtcctctctcaggagtgca

SEQ ID NO: 523647 - DNA, 20 bp, Artificial
  CRISPR gRNA sequence
tctcaggagtgcacgaagtt

SEQ ID NO: 523648 - DNA, 20 bp, Artificial
  CRISPR gRNA sequence
tcaggagtgcacgaagttca

SEQ ID NO: 523649 - DNA, 20 bp, Artificial
  CRISPR gRNA sequence
aggagtgcacgaagttcaag

SEQ ID NO: 523650 - DNA, 20 bp, Artificial
  CRISPR gRNA sequence
aaggtcagcagctgccggga

SEQ ID NO: 523651 - DNA, 20 bp, Artificial
  CRISPR gRNA sequence
ccgggaatgcatcgagtcgg

SEQ ID NO: 523652 - DNA, 20 bp, Artificial
  CRISPR gRNA sequence
cacctggtgccagaagctgg

SEQ ID NO: 523653 - DNA, 20 bp, Artificial
  CRISPR gRNA sequence
gtgccagaagctggtaagtg

SEQ ID NO: 523654 - DNA, 20 bp, Artificial
  CRISPR gRNA sequence
gtaagtgcctcctggacccc

SEQ ID NO: 523655 - DNA, 20 bp, Artificial
  CRISPR gRNA sequence
ctggacccctccccacctgc

SEQ ID NO: 523656 - DNA, 20 bp, Artificial
  CRISPR gRNA sequence
gacccctccccacctgccca

SEQ ID NO: 523657 - DNA, 20 bp, Artificial
  CRISPR gRNA sequence
cccacctgcccagctcctgg

SEQ ID NO: 523658 - DNA, 20 bp, Artificial
  CRISPR gRNA sequence
cccagctcctgggtgagggc

SEQ ID NO: 523659 - DNA, 20 bp, Artificial
  CRISPR gRNA sequence
ctgggtgagggccctttcct

SEQ ID NO: 523660 - DNA, 20 bp, Artificial
  CRISPR gRNA sequence
ggtgagggccctttcctgcc

SEQ ID NO: 523661 - DNA, 20 bp, Artificial
  CRISPR gRNA sequence
tcctgcccctgaagccagtg

SEQ ID NO: 523662 - DNA, 20 bp, Artificial
  CRISPR gRNA sequence
cctgcccctgaagccagtgg

SEQ ID NO: 523663 - DNA, 20 bp, Artificial
  CRISPR gRNA sequence
ctgcccctgaagccagtggc

SEQ ID NO: 523664 - DNA, 20 bp, Artificial
  CRISPR gRNA sequence
cccctgaagccagtggcacc

SEQ ID NO: 523665 - DNA, 20 bp, Artificial
  CRISPR gRNA sequence
aagccagtggcacccagagg

SEQ ID NO: 523666 - DNA, 20 bp, Artificial
  CRISPR gRNA sequence
cattttctttttgagggggt

SEQ ID NO: 523667 - DNA, 20 bp, Artificial
  CRISPR gRNA sequence
tctttttgagggggtcccca

SEQ ID NO: 523668 - DNA, 20 bp, Artificial
  CRISPR gRNA sequence
ctttttgagggggtccccag

SEQ ID NO: 523669 - DNA, 20 bp, Artificial
  CRISPR gRNA sequence
tttttgagggggtccccaga

SEQ ID NO: 523670 - DNA, 20 bp, Artificial
  CRISPR gRNA sequence
tttgagggggtccccagacc

SEQ ID NO: 523671 - DNA, 20 bp, Artificial
  CRISPR gRNA sequence
ttgagggggtccccagaccc

SEQ ID NO: 523672 - DNA, 20 bp, Artificial
  CRISPR gRNA sequence
tgagggggtccccagaccct

SEQ ID NO: 523673 - DNA, 20 bp, Artificial
  CRISPR gRNA sequence
gagggggtccccagaccctg

SEQ ID NO: 523674 - DNA, 20 bp, Artificial
  CRISPR gRNA sequence
agggggtccccagaccctgg

SEQ ID NO: 523675 - DNA, 20 bp, Artificial
  CRISPR gRNA sequence
gcctcaccctcccctcaagg

SEQ ID NO: 523676 - DNA, 20 bp, Artificial
  CRISPR gRNA sequence
accctcccctcaaggggccc

SEQ ID NO: 523677 - DNA, 20 bp, Artificial
  CRISPR gRNA sequence
ccctcaaggggcccctgagg

SEQ ID NO: 523678 - DNA, 20 bp, Artificial
  CRISPR gRNA sequence
aaggggcccctgaggttctg

SEQ ID NO: 523679 - DNA, 20 bp, Artificial
  CRISPR gRNA sequence
aggttctgatgtgtggtctg

SEQ ID NO: 523680 - DNA, 20 bp, Artificial
  CRISPR gRNA sequence
tgatgtgtggtctgtttgga

SEQ ID NO: 523681 - DNA, 20 bp, Artificial
  CRISPR gRNA sequence
atgtgtggtctgtttggaaa

SEQ ID NO: 523682 - DNA, 20 bp, Artificial
  CRISPR gRNA sequence
tttggaaacacacacagaac

SEQ ID NO: 523683 - DNA, 20 bp, Artificial
  CRISPR gRNA sequence
ggaaacacacacagaacaca

SEQ ID NO: 523684 - DNA, 20 bp, Artificial
  CRISPR gRNA sequence
gaaacacacacagaacacac

SEQ ID NO: 523685 - DNA, 20 bp, Artificial
  CRISPR gRNA sequence
gtattttttctcagccattt

SEQ ID NO: 523686 - DNA, 20 bp, Artificial
  CRISPR gRNA sequence
tattttttctcagccatttc

SEQ ID NO: 523687 - DNA, 20 bp, Artificial
  CRISPR gRNA sequence
tttctcagccatttccgagt

SEQ ID NO: 523688 - DNA, 20 bp, Artificial
  CRISPR gRNA sequence
ttctcagccatttccgagta

SEQ ID NO: 523689 - DNA, 20 bp, Artificial
  CRISPR gRNA sequence
tctcagccatttccgagtag

SEQ ID NO: 523690 - DNA, 20 bp, Artificial
  CRISPR gRNA sequence
ctcagccatttccgagtagg

SEQ ID NO: 523691 - DNA, 20 bp, Artificial
  CRISPR gRNA sequence
tcagccatttccgagtaggt

SEQ ID NO: 523692 - DNA, 20 bp, Artificial
  CRISPR gRNA sequence
agccatttccgagtaggttg

SEQ ID NO: 523693 - DNA, 20 bp, Artificial
  CRISPR gRNA sequence
ccgagtaggttgtagacatg

SEQ ID NO: 523694 - DNA, 20 bp, Artificial
  CRISPR gRNA sequence
cgagtaggttgtagacatgg

SEQ ID NO: 523695 - DNA, 20 bp, Artificial
  CRISPR gRNA sequence
tagacatggagccctttgtc

SEQ ID NO: 523696 - DNA, 20 bp, Artificial
  CRISPR gRNA sequence
tgtctcttagtacttcaagg

SEQ ID NO: 523697 - DNA, 20 bp, Artificial
  CRISPR gRNA sequence
gtctcttagtacttcaaggg

SEQ ID NO: 523698 - DNA, 20 bp, Artificial
  CRISPR gRNA sequence
tctcttagtacttcaaggga

SEQ ID NO: 523699 - DNA, 20 bp, Artificial
  CRISPR gRNA sequence
ttagtacttcaagggaggtc

SEQ ID NO: 523700 - DNA, 20 bp, Artificial
  CRISPR gRNA sequence
agtacttcaagggaggtctt

SEQ ID NO: 523701 - DNA, 20 bp, Artificial
  CRISPR gRNA sequence
gtacttcaagggaggtcttt

SEQ ID NO: 523702 - DNA, 20 bp, Artificial
  CRISPR gRNA sequence
caagggaggtctttcttaag

SEQ ID NO: 523703 - DNA, 20 bp, Artificial
  CRISPR gRNA sequence
aagggaggtctttcttaaga

SEQ ID NO: 523704 - DNA, 20 bp, Artificial
  CRISPR gRNA sequence
tcttaagaacaaggttttca

SEQ ID NO: 523705 - DNA, 20 bp, Artificial
  CRISPR gRNA sequence
cttaagaacaaggttttcac

SEQ ID NO: 523706 - DNA, 20 bp, Artificial
  CRISPR gRNA sequence
ttaagaacaaggttttcact

SEQ ID NO: 523707 - DNA, 20 bp, Artificial
  CRISPR gRNA sequence
aagaacaaggttttcactta

SEQ ID NO: 523708 - DNA, 20 bp, Artificial
  CRISPR gRNA sequence
agaacaaggttttcacttac

SEQ ID NO: 523709 - DNA, 20 bp, Artificial
  CRISPR gRNA sequence
tcacttacaaaactacgtaa

SEQ ID NO: 523710 - DNA, 20 bp, Artificial
  CRISPR gRNA sequence
cacttacaaaactacgtaag

SEQ ID NO: 523711 - DNA, 20 bp, Artificial
  CRISPR gRNA sequence
acttacaaaactacgtaagc

SEQ ID NO: 523712 - DNA, 20 bp, Artificial
  CRISPR gRNA sequence
acaaaactacgtaagcaagt

SEQ ID NO: 523713 - DNA, 20 bp, Artificial
  CRISPR gRNA sequence
caaaactacgtaagcaagtg

SEQ ID NO: 523714 - DNA, 20 bp, Artificial
  CRISPR gRNA sequence
cgtaagcaagtgcagaaaca

SEQ ID NO: 523715 - DNA, 20 bp, Artificial
  CRISPR gRNA sequence
ctggccccgcatcgccagca

SEQ ID NO: 523716 - DNA, 20 bp, Artificial
  CRISPR gRNA sequence
tggccccgcatcgccagcac

SEQ ID NO: 523717 - DNA, 20 bp, Artificial
  CRISPR gRNA sequence
gccccgcatcgccagcacgc

SEQ ID NO: 523718 - DNA, 20 bp, Artificial
  CRISPR gRNA sequence
tcctgcagagtcagcaggtt

SEQ ID NO: 523719 - DNA, 20 bp, Artificial
  CRISPR gRNA sequence
cctgcagagtcagcaggttt

SEQ ID NO: 523720 - DNA, 20 bp, Artificial
  CRISPR gRNA sequence
ctgcagagtcagcaggtttg

SEQ ID NO: 523721 - DNA, 20 bp, Artificial
  CRISPR gRNA sequence
cagagtcagcaggtttgggg

SEQ ID NO: 523722 - DNA, 20 bp, Artificial
  CRISPR gRNA sequence
ggggccagtgacgggaccca

SEQ ID NO: 523723 - DNA, 20 bp, Artificial
  CRISPR gRNA sequence
gggccagtgacgggacccac

SEQ ID NO: 523724 - DNA, 20 bp, Artificial
  CRISPR gRNA sequence
atcagaatccaggggctttg

SEQ ID NO: 523725 - DNA, 20 bp, Artificial
  CRISPR gRNA sequence
tcagaatccaggggctttgc

SEQ ID NO: 523726 - DNA, 20 bp, Artificial
  CRISPR gRNA sequence
tgcagggacaaggtggccaa

SEQ ID NO: 523727 - DNA, 20 bp, Artificial
  CRISPR gRNA sequence
gcagggacaaggtggccaag

SEQ ID NO: 523728 - DNA, 20 bp, Artificial
  CRISPR gRNA sequence
cagggacaaggtggccaaga

SEQ ID NO: 523729 - DNA, 20 bp, Artificial
  CRISPR gRNA sequence
tgatgtaaatgtattttgat

SEQ ID NO: 523730 - DNA, 20 bp, Artificial
  CRISPR gRNA sequence
gatgtaaatgtattttgata

SEQ ID NO: 523731 - DNA, 20 bp, Artificial
  CRISPR gRNA sequence
atgtaaatgtattttgatac

SEQ ID NO: 523732 - DNA, 20 bp, Artificial
  CRISPR gRNA sequence
tgatacatgtatatctatat

SEQ ID NO: 523733 - DNA, 20 bp, Artificial
  CRISPR gRNA sequence
gatacatgtatatctatatt

SEQ ID NO: 523734 - DNA, 20 bp, Artificial
  CRISPR gRNA sequence
atacatgtatatctatattt

SEQ ID NO: 523735 - DNA, 20 bp, Artificial
  CRISPR gRNA sequence
tatttgataaattcatgtat

SEQ ID NO: 523736 - DNA, 20 bp, Artificial
  CRISPR gRNA sequence
gataaattcatgtatcaaat

SEQ ID NO: 523737 - DNA, 20 bp, Artificial
  CRISPR gRNA sequence
ataaattcatgtatcaaatt

SEQ ID NO: 523738 - DNA, 20 bp, Artificial
  CRISPR gRNA sequence
atgtatcaaattcaggaaat

SEQ ID NO: 523739 - DNA, 20 bp, Artificial
  CRISPR gRNA sequence
aggaaattcagcattggtat

SEQ ID NO: 523740 - DNA, 20 bp, Artificial
  CRISPR gRNA sequence
agcattggtatctcattatc

SEQ ID NO: 523741 - DNA, 20 bp, Artificial
  CRISPR gRNA sequence
gtatctcattatcatcaaac

SEQ ID NO: 523742 - DNA, 20 bp, Artificial
  CRISPR gRNA sequence
attatcatcaaacctacaca

SEQ ID NO: 523743 - DNA, 20 bp, Artificial
  CRISPR gRNA sequence
tcatcaaacctacacactac

SEQ ID NO: 523744 - DNA, 20 bp, Artificial
  CRISPR gRNA sequence
cacactacgcatattttatt

SEQ ID NO: 523745 - DNA, 20 bp, Artificial
  CRISPR gRNA sequence
cgcatattttattggttgtc

SEQ ID NO: 523746 - DNA, 20 bp, Artificial
  CRISPR gRNA sequence
tattggttgtcccaatgatg

SEQ ID NO: 523747 - DNA, 20 bp, Artificial
  CRISPR gRNA sequence
attggttgtcccaatgatgt

SEQ ID NO: 523748 - DNA, 20 bp, Artificial
  CRISPR gRNA sequence
ttggttgtcccaatgatgtc

SEQ ID NO: 523749 - DNA, 20 bp, Artificial
  CRISPR gRNA sequence
gttgtcccaatgatgtcttc

SEQ ID NO: 523750 - DNA, 20 bp, Artificial
  CRISPR gRNA sequence
tcccaatgatgtcttcgtga

SEQ ID NO: 523751 - DNA, 20 bp, Artificial
  CRISPR gRNA sequence
cgtgagcatattttcctggt

SEQ ID NO: 523752 - DNA, 20 bp, Artificial
  CRISPR gRNA sequence
gtgagcatattttcctggtg

SEQ ID NO: 523753 - DNA, 20 bp, Artificial
  CRISPR gRNA sequence
tcctggtggattttgtcacc

SEQ ID NO: 523754 - DNA, 20 bp, Artificial
  CRISPR gRNA sequence
cctggtggattttgtcaccc

SEQ ID NO: 523755 - DNA, 20 bp, Artificial
  CRISPR gRNA sequence
ctggtggattttgtcaccca

SEQ ID NO: 523756 - DNA, 20 bp, Artificial
  CRISPR gRNA sequence
gtggattttgtcacccaggc

SEQ ID NO: 523757 - DNA, 20 bp, Artificial
  CRISPR gRNA sequence
tgtcacccaggctcaccctg

SEQ ID NO: 523758 - DNA, 20 bp, Artificial
  CRISPR gRNA sequence
gtcacccaggctcaccctgt

SEQ ID NO: 523759 - DNA, 20 bp, Artificial
  CRISPR gRNA sequence
tcacccaggctcaccctgtg

SEQ ID NO: 523760 - DNA, 20 bp, Artificial
  CRISPR gRNA sequence
accctgtgctcagctgtctc

SEQ ID NO: 523761 - DNA, 20 bp, Artificial
  CRISPR gRNA sequence
tgctcagctgtctcaggctc

SEQ ID NO: 523762 - DNA, 20 bp, Artificial
  CRISPR gRNA sequence
agctgtctcaggctcagaat

SEQ ID NO: 523763 - DNA, 20 bp, Artificial
  CRISPR gRNA sequence
tctcaggctcagaatctcct

SEQ ID NO: 523764 - DNA, 20 bp, Artificial
  CRISPR gRNA sequence
aggctcagaatctcctcact

SEQ ID NO: 523765 - DNA, 20 bp, Artificial
  CRISPR gRNA sequence
agaatctcctcactcaggct

SEQ ID NO: 523766 - DNA, 20 bp, Artificial
  CRISPR gRNA sequence
ctcactcaggctcaccctgc

SEQ ID NO: 523767 - DNA, 20 bp, Artificial
  CRISPR gRNA sequence
actcaggctcaccctgcact

SEQ ID NO: 523768 - DNA, 20 bp, Artificial
  CRISPR gRNA sequence
aggctcaccctgcactcagc

SEQ ID NO: 523769 - DNA, 20 bp, Artificial
  CRISPR gRNA sequence
accctgcactcagccatctc

SEQ ID NO: 523770 - DNA, 20 bp, Artificial
  CRISPR gRNA sequence
cactcagccatctcaggccc

SEQ ID NO: 523771 - DNA, 20 bp, Artificial
  CRISPR gRNA sequence
agccatctcaggccccaaat

SEQ ID NO: 523772 - DNA, 20 bp, Artificial
  CRISPR gRNA sequence
aggccccaaatctcctaacc

SEQ ID NO: 523773 - DNA, 20 bp, Artificial
  CRISPR gRNA sequence
ctaacccaggttcacacact

SEQ ID NO: 523774 - DNA, 20 bp, Artificial
  CRISPR gRNA sequence
acccaggttcacacactgcg

SEQ ID NO: 523775 - DNA, 20 bp, Artificial
  CRISPR gRNA sequence
acacactgcgctcagccgtc

SEQ ID NO: 523776 - DNA, 20 bp, Artificial
  CRISPR gRNA sequence
cgctcagccgtctaacgctc

SEQ ID NO: 523777 - DNA, 20 bp, Artificial
  CRISPR gRNA sequence
agccgtctaacgctctgaat

SEQ ID NO: 523778 - DNA, 20 bp, Artificial
  CRISPR gRNA sequence
acgctctgaatctcctcacc

SEQ ID NO: 523779 - DNA, 20 bp, Artificial
  CRISPR gRNA sequence
tgaatctcctcacccaggct

SEQ ID NO: 523780 - DNA, 20 bp, Artificial
  CRISPR gRNA sequence
aatctcctcacccaggctcg

SEQ ID NO: 523781 - DNA, 20 bp, Artificial
  CRISPR gRNA sequence
ctcacccaggctcgccctac

SEQ ID NO: 523782 - DNA, 20 bp, Artificial
  CRISPR gRNA sequence
acccaggctcgccctacgct

SEQ ID NO: 523783 - DNA, 20 bp, Artificial
  CRISPR gRNA sequence
gccctacgctcagccgtctc

SEQ ID NO: 523784 - DNA, 20 bp, Artificial
  CRISPR gRNA sequence
cgctcagccgtctccttggg

SEQ ID NO: 523785 - DNA, 20 bp, Artificial
  CRISPR gRNA sequence
agccgtctccttgggcttct

SEQ ID NO: 523786 - DNA, 20 bp, Artificial
  CRISPR gRNA sequence
cttgggcttcttgaatctgg

SEQ ID NO: 523787 - DNA, 20 bp, Artificial
  CRISPR gRNA sequence
gggcttcttgaatctggaca

SEQ ID NO: 523788 - DNA, 20 bp, Artificial
  CRISPR gRNA sequence
ggcttcttgaatctggacaa

SEQ ID NO: 523789 - DNA, 20 bp, Artificial
  CRISPR gRNA sequence
cttgaatctggacaagtcct

SEQ ID NO: 523790 - DNA, 20 bp, Artificial
  CRISPR gRNA sequence
ttgaatctggacaagtcctc

SEQ ID NO: 523791 - DNA, 20 bp, Artificial
  CRISPR gRNA sequence
gaatctggacaagtcctcag

SEQ ID NO: 523792 - DNA, 20 bp, Artificial
  CRISPR gRNA sequence
aatctggacaagtcctcagc

SEQ ID NO: 523793 - DNA, 20 bp, Artificial
  CRISPR gRNA sequence
gacaagtcctcagctttctt

SEQ ID NO: 523794 - DNA, 20 bp, Artificial
  CRISPR gRNA sequence
agctttctttgtctttcctg

SEQ ID NO: 523795 - DNA, 20 bp, Artificial
  CRISPR gRNA sequence
tctttgtctttcctgtcctt

SEQ ID NO: 523796 - DNA, 20 bp, Artificial
  CRISPR gRNA sequence
ctttgtctttcctgtccttg

SEQ ID NO: 523797 - DNA, 20 bp, Artificial
  CRISPR gRNA sequence
tttgtctttcctgtccttgg

SEQ ID NO: 523798 - DNA, 20 bp, Artificial
  CRISPR gRNA sequence
tgtctttcctgtccttgggc

SEQ ID NO: 523799 - DNA, 20 bp, Artificial
  CRISPR gRNA sequence
gtctttcctgtccttgggcg

SEQ ID NO: 523800 - DNA, 20 bp, Artificial
  CRISPR gRNA sequence
tctttcctgtccttgggcgt

SEQ ID NO: 523801 - DNA, 20 bp, Artificial
  CRISPR gRNA sequence
tcctgtccttgggcgtttct

SEQ ID NO: 523802 - DNA, 20 bp, Artificial
  CRISPR gRNA sequence
cctgtccttgggcgtttctg

SEQ ID NO: 523803 - DNA, 20 bp, Artificial
  CRISPR gRNA sequence
ctgtccttgggcgtttctga

SEQ ID NO: 523804 - DNA, 20 bp, Artificial
  CRISPR gRNA sequence
tccttgggcgtttctgagga

SEQ ID NO: 523805 - DNA, 20 bp, Artificial
  CRISPR gRNA sequence
gggcgtttctgaggaagtca

SEQ ID NO: 523806 - DNA, 20 bp, Artificial
  CRISPR gRNA sequence
ggcgtttctgaggaagtcag

SEQ ID NO: 523807 - DNA, 20 bp, Artificial
  CRISPR gRNA sequence
ctgaggaagtcaggagagca

SEQ ID NO: 523808 - DNA, 20 bp, Artificial
  CRISPR gRNA sequence
tgaggaagtcaggagagcag

SEQ ID NO: 523809 - DNA, 20 bp, Artificial
  CRISPR gRNA sequence
aggaagtcaggagagcagct

SEQ ID NO: 523810 - DNA, 20 bp, Artificial
  CRISPR gRNA sequence
tgtagcatgaccctcggggg

SEQ ID NO: 523811 - DNA, 20 bp, Artificial
  CRISPR gRNA sequence
gtagcatgaccctcgggggt

SEQ ID NO: 523812 - DNA, 20 bp, Artificial
  CRISPR gRNA sequence
tagcatgaccctcgggggtc

SEQ ID NO: 523813 - DNA, 20 bp, Artificial
  CRISPR gRNA sequence
gggggtcttgtctggagttt

SEQ ID NO: 523814 - DNA, 20 bp, Artificial
  CRISPR gRNA sequence
gtctggagtttcctctgcct

SEQ ID NO: 523815 - DNA, 20 bp, Artificial
  CRISPR gRNA sequence
tctggagtttcctctgcctg

SEQ ID NO: 523816 - DNA, 20 bp, Artificial
  CRISPR gRNA sequence
gagtttcctctgcctggact

SEQ ID NO: 523817 - DNA, 20 bp, Artificial
  CRISPR gRNA sequence
cctctgcctggactcaggtg

SEQ ID NO: 523818 - DNA, 20 bp, Artificial
  CRISPR gRNA sequence
ctctgcctggactcaggtgt

SEQ ID NO: 523819 - DNA, 20 bp, Artificial
  CRISPR gRNA sequence
tgcctggactcaggtgtgct

SEQ ID NO: 523820 - DNA, 20 bp, Artificial
  CRISPR gRNA sequence
cctggactcaggtgtgcttt

SEQ ID NO: 523821 - DNA, 20 bp, Artificial
  CRISPR gRNA sequence
gactcaggtgtgctttggca

SEQ ID NO: 523822 - DNA, 20 bp, Artificial
  CRISPR gRNA sequence
aggtgtgctttggcaggagc

SEQ ID NO: 523823 - DNA, 20 bp, Artificial
  CRISPR gRNA sequence
tggcaggagcccctcagtga

SEQ ID NO: 523824 - DNA, 20 bp, Artificial
  CRISPR gRNA sequence
ggcaggagcccctcagtgac

SEQ ID NO: 523825 - DNA, 20 bp, Artificial
  CRISPR gRNA sequence
gcaggagcccctcagtgacg

SEQ ID NO: 523826 - DNA, 20 bp, Artificial
  CRISPR gRNA sequence
agtgacggtgtcctaagtgc

SEQ ID NO: 523827 - DNA, 20 bp, Artificial
  CRISPR gRNA sequence
agtgcccatgagaggcactg

SEQ ID NO: 523828 - DNA, 20 bp, Artificial
  CRISPR gRNA sequence
ctgtggccccgtcccagtct

SEQ ID NO: 523829 - DNA, 20 bp, Artificial
  CRISPR gRNA sequence
tggccccgtcccagtcttga

SEQ ID NO: 523830 - DNA, 20 bp, Artificial
  CRISPR gRNA sequence
gatgaggtcagcgtggacgg

SEQ ID NO: 523831 - DNA, 20 bp, Artificial
  CRISPR gRNA sequence
atgaggtcagcgtggacggc

SEQ ID NO: 523832 - DNA, 20 bp, Artificial
  CRISPR gRNA sequence
tgctgagacggcatcccccc

SEQ ID NO: 523833 - DNA, 20 bp, Artificial
  CRISPR gRNA sequence
ctgagacggcatccccccgg

SEQ ID NO: 523834 - DNA, 20 bp, Artificial
  CRISPR gRNA sequence
agacggcatccccccggcct

SEQ ID NO: 523835 - DNA, 20 bp, Artificial
  CRISPR gRNA sequence
cccatcccgctgcatgatcc

SEQ ID NO: 523836 - DNA, 20 bp, Artificial
  CRISPR gRNA sequence
catgatcccctcgcagccac

SEQ ID NO: 523837 - DNA, 20 bp, Artificial
  CRISPR gRNA sequence
gcagccactgtgggctggtg

SEQ ID NO: 523838 - DNA, 20 bp, Artificial
  CRISPR gRNA sequence
tgggctggtgaggttctgcc

SEQ ID NO: 523839 - DNA, 20 bp, Artificial
  CRISPR gRNA sequence
gtgaggttctgccctcatca

SEQ ID NO: 523840 - DNA, 20 bp, Artificial
  CRISPR gRNA sequence
tgccctcatcaaatcgcacc

SEQ ID NO: 523841 - DNA, 20 bp, Artificial
  CRISPR gRNA sequence
ccctcatcaaatcgcacccg

SEQ ID NO: 523842 - DNA, 20 bp, Artificial
  CRISPR gRNA sequence
atcaaatcgcacccgcaggc

SEQ ID NO: 523843 - DNA, 20 bp, Artificial
  CRISPR gRNA sequence
agcatccgcggaggtccccg

SEQ ID NO: 523844 - DNA, 20 bp, Artificial
  CRISPR gRNA sequence
aagccgccatcactgcgatg

SEQ ID NO: 523845 - DNA, 20 bp, Artificial
  CRISPR gRNA sequence
cgatggctgcagattggtgc

SEQ ID NO: 523846 - DNA, 20 bp, Artificial
  CRISPR gRNA sequence
cagattggtgccgtgctggt

SEQ ID NO: 523847 - DNA, 20 bp, Artificial
  CRISPR gRNA sequence
gtgccgtgctggtccccgcc

SEQ ID NO: 523848 - DNA, 20 bp, Artificial
  CRISPR gRNA sequence
gtccccgcctgccactcacg

SEQ ID NO: 523849 - DNA, 20 bp, Artificial
  CRISPR gRNA sequence
ccactcacggctgccaacct

SEQ ID NO: 523850 - DNA, 20 bp, Artificial
  CRISPR gRNA sequence
acggctgccaacctaaggaa

SEQ ID NO: 523851 - DNA, 20 bp, Artificial
  CRISPR gRNA sequence
ccaacctaaggaagggtctc

SEQ ID NO: 523852 - DNA, 20 bp, Artificial
  CRISPR gRNA sequence
aggaagggtctctccttctc

SEQ ID NO: 523853 - DNA, 20 bp, Artificial
  CRISPR gRNA sequence
tccttctctgcagcctctct

SEQ ID NO: 523854 - DNA, 20 bp, Artificial
  CRISPR gRNA sequence
cttctctgcagcctctctct

SEQ ID NO: 523855 - DNA, 20 bp, Artificial
  CRISPR gRNA sequence
ctctgcagcctctctctcat

SEQ ID NO: 523856 - DNA, 20 bp, Artificial
  CRISPR gRNA sequence
tctgcagcctctctctcatc

SEQ ID NO: 523857 - DNA, 20 bp, Artificial
  CRISPR gRNA sequence
tgcagcctctctctcatcag

SEQ ID NO: 523858 - DNA, 20 bp, Artificial
  CRISPR gRNA sequence
cagcctctctctcatcagcg

SEQ ID NO: 523859 - DNA, 20 bp, Artificial
  CRISPR gRNA sequence
tctctcatcagcgtgaccca

SEQ ID NO: 523860 - DNA, 20 bp, Artificial
  CRISPR gRNA sequence
tctcatcagcgtgacccaca

SEQ ID NO: 523861 - DNA, 20 bp, Artificial
  CRISPR gRNA sequence
tcatcagcgtgacccacagt

SEQ ID NO: 523862 - DNA, 20 bp, Artificial
  CRISPR gRNA sequence
atcagcgtgacccacagttt

SEQ ID NO: 523863 - DNA, 20 bp, Artificial
  CRISPR gRNA sequence
tattttgttcagtagtgcat

SEQ ID NO: 523864 - DNA, 20 bp, Artificial
  CRISPR gRNA sequence
attttgttcagtagtgcatg

SEQ ID NO: 523865 - DNA, 20 bp, Artificial
  CRISPR gRNA sequence
ttttgttcagtagtgcatga

SEQ ID NO: 523866 - DNA, 20 bp, Artificial
  CRISPR gRNA sequence
tgttcagtagtgcatgatct

SEQ ID NO: 523867 - DNA, 20 bp, Artificial
  CRISPR gRNA sequence
gttcagtagtgcatgatctg

SEQ ID NO: 523868 - DNA, 20 bp, Artificial
  CRISPR gRNA sequence
ttcagtagtgcatgatctgt

SEQ ID NO: 523869 - DNA, 20 bp, Artificial
  CRISPR gRNA sequence
agtagtgcatgatctgtggc

SEQ ID NO: 523870 - DNA, 20 bp, Artificial
  CRISPR gRNA sequence
tggctgtcctttcttccccg

SEQ ID NO: 523871 - DNA, 20 bp, Artificial
  CRISPR gRNA sequence
tcctttcttccccgagttgc

SEQ ID NO: 523872 - DNA, 20 bp, Artificial
  CRISPR gRNA sequence
tcttccccgagttgctcaaa

SEQ ID NO: 523873 - DNA, 20 bp, Artificial
  CRISPR gRNA sequence
cttccccgagttgctcaaat

SEQ ID NO: 523874 - DNA, 20 bp, Artificial
  CRISPR gRNA sequence
ttccccgagttgctcaaatc

SEQ ID NO: 523875 - DNA, 20 bp, Artificial
  CRISPR gRNA sequence
ccccgagttgctcaaatccg

SEQ ID NO: 523876 - DNA, 20 bp, Artificial
  CRISPR gRNA sequence
cccgagttgctcaaatccgc

SEQ ID NO: 523877 - DNA, 20 bp, Artificial
  CRISPR gRNA sequence
ctcaaatccgctgggtctgg

SEQ ID NO: 523878 - DNA, 20 bp, Artificial
  CRISPR gRNA sequence
aaatccgctgggtctggctg

SEQ ID NO: 523879 - DNA, 20 bp, Artificial
  CRISPR gRNA sequence
ggtctggctgcgtgtcctgt

SEQ ID NO: 523880 - DNA, 20 bp, Artificial
  CRISPR gRNA sequence
gctgcgtgtcctgtccatgc

SEQ ID NO: 523881 - DNA, 20 bp, Artificial
  CRISPR gRNA sequence
cgtgtcctgtccatgcatcc

SEQ ID NO: 523882 - DNA, 20 bp, Artificial
  CRISPR gRNA sequence
tccatgcatccccgttctac

SEQ ID NO: 523883 - DNA, 20 bp, Artificial
  CRISPR gRNA sequence
taccgttctgagcactttct

SEQ ID NO: 523884 - DNA, 20 bp, Artificial
  CRISPR gRNA sequence
ccgttctgagcactttcttg

SEQ ID NO: 523885 - DNA, 20 bp, Artificial
  CRISPR gRNA sequence
tgagcactttcttgctttct

SEQ ID NO: 523886 - DNA, 20 bp, Artificial
  CRISPR gRNA sequence
agcactttcttgctttctgg

SEQ ID NO: 523887 - DNA, 20 bp, Artificial
  CRISPR gRNA sequence
tcttgctttctggagcaaca

SEQ ID NO: 523888 - DNA, 20 bp, Artificial
  CRISPR gRNA sequence
cttgctttctggagcaacat

SEQ ID NO: 523889 - DNA, 20 bp, Artificial
  CRISPR gRNA sequence
ttgctttctggagcaacatg

SEQ ID NO: 523890 - DNA, 20 bp, Artificial
  CRISPR gRNA sequence
gctttctggagcaacatgat

SEQ ID NO: 523891 - DNA, 20 bp, Artificial
  CRISPR gRNA sequence
ctttctggagcaacatgatg

SEQ ID NO: 523892 - DNA, 20 bp, Artificial
  CRISPR gRNA sequence
tctggagcaacatgatgctg

SEQ ID NO: 523893 - DNA, 20 bp, Artificial
  CRISPR gRNA sequence
ctggagcaacatgatgctgc

SEQ ID NO: 523894 - DNA, 20 bp, Artificial
  CRISPR gRNA sequence
tggagcaacatgatgctgca

SEQ ID NO: 523895 - DNA, 20 bp, Artificial
  CRISPR gRNA sequence
gagcaacatgatgctgcagg

SEQ ID NO: 523896 - DNA, 20 bp, Artificial
  CRISPR gRNA sequence
caggcccatctccatgtccc

SEQ ID NO: 523897 - DNA, 20 bp, Artificial
  CRISPR gRNA sequence
catgtcccttgccccagcct

SEQ ID NO: 523898 - DNA, 20 bp, Artificial
  CRISPR gRNA sequence
gccccagcctggaatcagat

SEQ ID NO: 523899 - DNA, 20 bp, Artificial
  CRISPR gRNA sequence
ccccagcctggaatcagatg

SEQ ID NO: 523900 - DNA, 20 bp, Artificial
  CRISPR gRNA sequence
gaatcagatggttttctgac

SEQ ID NO: 523901 - DNA, 20 bp, Artificial
  CRISPR gRNA sequence
tctgacggctcgggttcctt

SEQ ID NO: 523902 - DNA, 20 bp, Artificial
  CRISPR gRNA sequence
ctgacggctcgggttccttt

SEQ ID NO: 523903 - DNA, 20 bp, Artificial
  CRISPR gRNA sequence
tgacggctcgggttcctttc

SEQ ID NO: 523904 - DNA, 20 bp, Artificial
  CRISPR gRNA sequence
acggctcgggttcctttccc

SEQ ID NO: 523905 - DNA, 20 bp, Artificial
  CRISPR gRNA sequence
gggttcctttccctgagagt

SEQ ID NO: 523906 - DNA, 20 bp, Artificial
  CRISPR gRNA sequence
ctttccctgagagtctgggc

SEQ ID NO: 523907 - DNA, 20 bp, Artificial
  CRISPR gRNA sequence
tccctgagagtctgggctcc

SEQ ID NO: 523908 - DNA, 20 bp, Artificial
  CRISPR gRNA sequence
ccctgagagtctgggctcca

SEQ ID NO: 523909 - DNA, 20 bp, Artificial
  CRISPR gRNA sequence
cctgagagtctgggctccag

SEQ ID NO: 523910 - DNA, 20 bp, Artificial
  CRISPR gRNA sequence
agagtctgggctccagcacc

SEQ ID NO: 523911 - DNA, 20 bp, Artificial
  CRISPR gRNA sequence
ggctccagcaccgttgtagc

SEQ ID NO: 523912 - DNA, 20 bp, Artificial
  CRISPR gRNA sequence
cagcaccgttgtagccggac

SEQ ID NO: 523913 - DNA, 20 bp, Artificial
  CRISPR gRNA sequence
tagccggacaagccgcagac

SEQ ID NO: 523914 - DNA, 20 bp, Artificial
  CRISPR gRNA sequence
ctcagacactcggttaaaga

SEQ ID NO: 523915 - DNA, 20 bp, Artificial
  CRISPR gRNA sequence
agacactcggttaaagaagg

SEQ ID NO: 523916 - DNA, 20 bp, Artificial
  CRISPR gRNA sequence
ggttaaagaaggaagggctt

SEQ ID NO: 523917 - DNA, 20 bp, Artificial
  CRISPR gRNA sequence
aagaaggaagggctttattt

SEQ ID NO: 523918 - DNA, 20 bp, Artificial
  CRISPR gRNA sequence
tatttggccaggagtgtcag

SEQ ID NO: 523919 - DNA, 20 bp, Artificial
  CRISPR gRNA sequence
atttggccaggagtgtcagc

SEQ ID NO: 523920 - DNA, 20 bp, Artificial
  CRISPR gRNA sequence
tttggccaggagtgtcagca

SEQ ID NO: 523921 - DNA, 20 bp, Artificial
  CRISPR gRNA sequence
ggccaggagtgtcagcagac

SEQ ID NO: 523922 - DNA, 20 bp, Artificial
  CRISPR gRNA sequence
gccaggagtgtcagcagact

SEQ ID NO: 523923 - DNA, 20 bp, Artificial
  CRISPR gRNA sequence
gcgtcttaagagccgagctc

SEQ ID NO: 523924 - DNA, 20 bp, Artificial
  CRISPR gRNA sequence
cgtcttaagagccgagctcc

SEQ ID NO: 523925 - DNA, 20 bp, Artificial
  CRISPR gRNA sequence
aagagccgagctccccgaaa

SEQ ID NO: 523926 - DNA, 20 bp, Artificial
  CRISPR gRNA sequence
agagccgagctccccgaaaa

SEQ ID NO: 523927 - DNA, 20 bp, Artificial
  CRISPR gRNA sequence
cccgaaaaagaaattcctag

SEQ ID NO: 523928 - DNA, 20 bp, Artificial
  CRISPR gRNA sequence
ctagcccttttaagggctta

SEQ ID NO: 523929 - DNA, 20 bp, Artificial
  CRISPR gRNA sequence
gcccttttaagggcttacaa

SEQ ID NO: 523930 - DNA, 20 bp, Artificial
  CRISPR gRNA sequence
ttaagggcttacaactctaa

SEQ ID NO: 523931 - DNA, 20 bp, Artificial
  CRISPR gRNA sequence
taagggcttacaactctaag

SEQ ID NO: 523932 - DNA, 20 bp, Artificial
  CRISPR gRNA sequence
aagggcttacaactctaagg

SEQ ID NO: 523933 - DNA, 20 bp, Artificial
  CRISPR gRNA sequence
agggcttacaactctaaggg

SEQ ID NO: 523934 - DNA, 20 bp, Artificial
  CRISPR gRNA sequence
acaactctaaggggtccaca

SEQ ID NO: 523935 - DNA, 20 bp, Artificial
  CRISPR gRNA sequence
caactctaaggggtccacat

SEQ ID NO: 523936 - DNA, 20 bp, Artificial
  CRISPR gRNA sequence
taaggggtccacatgaaagg

SEQ ID NO: 523937 - DNA, 20 bp, Artificial
  CRISPR gRNA sequence
aggggtccacatgaaagggt

SEQ ID NO: 523938 - DNA, 20 bp, Artificial
  CRISPR gRNA sequence
tgatagatagagcaagtgtg

SEQ ID NO: 523939 - DNA, 20 bp, Artificial
  CRISPR gRNA sequence
gactgggggttacatgcatc

SEQ ID NO: 523940 - DNA, 20 bp, Artificial
  CRISPR gRNA sequence
actgggggttacatgcatca

SEQ ID NO: 523941 - DNA, 20 bp, Artificial
  CRISPR gRNA sequence
ggggttacatgcatcagctg

SEQ ID NO: 523942 - DNA, 20 bp, Artificial
  CRISPR gRNA sequence
catgcatcagctgacagaac

SEQ ID NO: 523943 - DNA, 20 bp, Artificial
  CRISPR gRNA sequence
acagaacagaaagttttgca

SEQ ID NO: 523944 - DNA, 20 bp, Artificial
  CRISPR gRNA sequence
tgcaatgctttttcatacaa

SEQ ID NO: 523945 - DNA, 20 bp, Artificial
  CRISPR gRNA sequence
gcaatgctttttcatacaat

SEQ ID NO: 523946 - DNA, 20 bp, Artificial
  CRISPR gRNA sequence
caatgctttttcatacaatg

SEQ ID NO: 523947 - DNA, 20 bp, Artificial
  CRISPR gRNA sequence
tttcatacaatgtctggaat

SEQ ID NO: 523948 - DNA, 20 bp, Artificial
  CRISPR gRNA sequence
ttcatacaatgtctggaatt

SEQ ID NO: 523949 - DNA, 20 bp, Artificial
  CRISPR gRNA sequence
tcatacaatgtctggaattt

SEQ ID NO: 523950 - DNA, 20 bp, Artificial
  CRISPR gRNA sequence
catacaatgtctggaattta

SEQ ID NO: 523951 - DNA, 20 bp, Artificial
  CRISPR gRNA sequence
atacaatgtctggaatttac

SEQ ID NO: 523952 - DNA, 20 bp, Artificial
  CRISPR gRNA sequence
gaatttacagataacaccag

SEQ ID NO: 523953 - DNA, 20 bp, Artificial
  CRISPR gRNA sequence
acagataacaccagtagttt

SEQ ID NO: 523954 - DNA, 20 bp, Artificial
  CRISPR gRNA sequence
cagataacaccagtagtttt

SEQ ID NO: 523955 - DNA, 20 bp, Artificial
  CRISPR gRNA sequence
tggtcaggggttaataataa

SEQ ID NO: 523956 - DNA, 20 bp, Artificial
  CRISPR gRNA sequence
ggtcaggggttaataataat

SEQ ID NO: 523957 - DNA, 20 bp, Artificial
  CRISPR gRNA sequence
gtcaggggttaataataata

SEQ ID NO: 523958 - DNA, 20 bp, Artificial
  CRISPR gRNA sequence
ataataataataataataat

SEQ ID NO: 523959 - DNA, 20 bp, Artificial
  CRISPR gRNA sequence
ttagtttaaccaccagggcc

SEQ ID NO: 523960 - DNA, 20 bp, Artificial
  CRISPR gRNA sequence
gtttaaccaccagggccggg

SEQ ID NO: 523961 - DNA, 20 bp, Artificial
  CRISPR gRNA sequence
aaccaccagggccgggtggt

SEQ ID NO: 523962 - DNA, 20 bp, Artificial
  CRISPR gRNA sequence
accaccagggccgggtggtg

SEQ ID NO: 523963 - DNA, 20 bp, Artificial
  CRISPR gRNA sequence
gctatttatcttacttctgt

SEQ ID NO: 523964 - DNA, 20 bp, Artificial
  CRISPR gRNA sequence
tttatcttacttctgtttct

SEQ ID NO: 523965 - DNA, 20 bp, Artificial
  CRISPR gRNA sequence
atcttacttctgtttctttc

SEQ ID NO: 523966 - DNA, 20 bp, Artificial
  CRISPR gRNA sequence
tcttacttctgtttctttcc

SEQ ID NO: 523967 - DNA, 20 bp, Artificial
  CRISPR gRNA sequence
acttctgtttctttccaact

SEQ ID NO: 523968 - DNA, 20 bp, Artificial
  CRISPR gRNA sequence
cttctgtttctttccaactt

SEQ ID NO: 523969 - DNA, 20 bp, Artificial
  CRISPR gRNA sequence
ctgtttctttccaacttttt

SEQ ID NO: 523970 - DNA, 20 bp, Artificial
  CRISPR gRNA sequence
tgtttctttccaactttttg

SEQ ID NO: 523971 - DNA, 20 bp, Artificial
  CRISPR gRNA sequence
tttctttccaactttttgct

SEQ ID NO: 523972 - DNA, 20 bp, Artificial
  CRISPR gRNA sequence
ctttccaactttttgctttc

SEQ ID NO: 523973 - DNA, 20 bp, Artificial
  CRISPR gRNA sequence
tttccaactttttgctttct

SEQ ID NO: 523974 - DNA, 20 bp, Artificial
  CRISPR gRNA sequence
tccaactttttgctttctct

SEQ ID NO: 523975 - DNA, 20 bp, Artificial
  CRISPR gRNA sequence
ccaactttttgctttctctc

SEQ ID NO: 523976 - DNA, 20 bp, Artificial
  CRISPR gRNA sequence
caactttttgctttctctct

SEQ ID NO: 523977 - DNA, 20 bp, Artificial
  CRISPR gRNA sequence
tttgctttctctcttttctc

SEQ ID NO: 523978 - DNA, 20 bp, Artificial
  CRISPR gRNA sequence
ttgctttctctcttttctcc

SEQ ID NO: 523979 - DNA, 20 bp, Artificial
  CRISPR gRNA sequence
tgctttctctcttttctcct

SEQ ID NO: 523980 - DNA, 20 bp, Artificial
  CRISPR gRNA sequence
gctttctctcttttctcctg

SEQ ID NO: 523981 - DNA, 20 bp, Artificial
  CRISPR gRNA sequence
ctttctctcttttctcctgt

SEQ ID NO: 523982 - DNA, 20 bp, Artificial
  CRISPR gRNA sequence
tctctcttttctcctgtctt

SEQ ID NO: 523983 - DNA, 20 bp, Artificial
  CRISPR gRNA sequence
ctctcttttctcctgtctta

SEQ ID NO: 523984 - DNA, 20 bp, Artificial
  CRISPR gRNA sequence
tctcttttctcctgtcttat

SEQ ID NO: 523985 - DNA, 20 bp, Artificial
  CRISPR gRNA sequence
tcttttctcctgtcttataa

SEQ ID NO: 523986 - DNA, 20 bp, Artificial
  CRISPR gRNA sequence
ttttctcctgtcttataaac

SEQ ID NO: 523987 - DNA, 20 bp, Artificial
  CRISPR gRNA sequence
ttctcctgtcttataaacta

SEQ ID NO: 523988 - DNA, 20 bp, Artificial
  CRISPR gRNA sequence
tctcctgtcttataaactag

SEQ ID NO: 523989 - DNA, 20 bp, Artificial
  CRISPR gRNA sequence
ctcctgtcttataaactaga

SEQ ID NO: 523990 - DNA, 20 bp, Artificial
  CRISPR gRNA sequence
tcctgtcttataaactagag

SEQ ID NO: 523991 - DNA, 20 bp, Artificial
  CRISPR gRNA sequence
ctgtcttataaactagagaa

SEQ ID NO: 523992 - DNA, 20 bp, Artificial
  CRISPR gRNA sequence
tcttataaactagagaaggg

SEQ ID NO: 523993 - DNA, 20 bp, Artificial
  CRISPR gRNA sequence
ataaactagagaaggggagg

SEQ ID NO: 523994 - DNA, 20 bp, Artificial
  CRISPR gRNA sequence
taaactagagaaggggaggg

SEQ ID NO: 523995 - DNA, 20 bp, Artificial
  CRISPR gRNA sequence
gagaaggggagggggtggag

SEQ ID NO: 523996 - DNA, 20 bp, Artificial
  CRISPR gRNA sequence
attccttaccgtcagcagct

SEQ ID NO: 523997 - DNA, 20 bp, Artificial
  CRISPR gRNA sequence
cttaccgtcagcagcttcct

SEQ ID NO: 523998 - DNA, 20 bp, Artificial
  CRISPR gRNA sequence
accgtcagcagcttcctcat

SEQ ID NO: 523999 - DNA, 20 bp, Artificial
  CRISPR gRNA sequence
ccgtcagcagcttcctcatt

SEQ ID NO: 524000 - DNA, 20 bp, Artificial
  CRISPR gRNA sequence
cctcatttctcaattttgcg

SEQ ID NO: 524001 - DNA, 20 bp, Artificial
  CRISPR gRNA sequence
ctcatttctcaattttgcgt

SEQ ID NO: 524002 - DNA, 20 bp, Artificial
  CRISPR gRNA sequence
atttctcaattttgcgtccc

SEQ ID NO: 524003 - DNA, 20 bp, Artificial
  CRISPR gRNA sequence
ctcaattttgcgtcccacag

SEQ ID NO: 524004 - DNA, 20 bp, Artificial
  CRISPR gRNA sequence
tcaattttgcgtcccacagg

SEQ ID NO: 524005 - DNA, 20 bp, Artificial
  CRISPR gRNA sequence
aattttgcgtcccacaggga

SEQ ID NO: 524006 - DNA, 20 bp, Artificial
  CRISPR gRNA sequence
tgcgtcccacagggagcggc

SEQ ID NO: 524007 - DNA, 20 bp, Artificial
  CRISPR gRNA sequence
gcgtcccacagggagcggct

SEQ ID NO: 524008 - DNA, 20 bp, Artificial
  CRISPR gRNA sequence
cgtcccacagggagcggctt

SEQ ID NO: 524009 - DNA, 20 bp, Artificial
  CRISPR gRNA sequence
tgggtcctccagcccacgcc

SEQ ID NO: 524010 - DNA, 20 bp, Artificial
  CRISPR gRNA sequence
gggtcctccagcccacgcca

SEQ ID NO: 524011 - DNA, 20 bp, Artificial
  CRISPR gRNA sequence
ggtcctccagcccacgccac

SEQ ID NO: 524012 - DNA, 20 bp, Artificial
  CRISPR gRNA sequence
cagcccacgccaccgcggcg

SEQ ID NO: 524013 - DNA, 20 bp, Artificial
  CRISPR gRNA sequence
ccgtctgtcctcggactgag

SEQ ID NO: 524014 - DNA, 20 bp, Artificial
  CRISPR gRNA sequence
tcctcggactgagcagggtg

SEQ ID NO: 524015 - DNA, 20 bp, Artificial
  CRISPR gRNA sequence
ggactgagcagggtggccag

SEQ ID NO: 524016 - DNA, 20 bp, Artificial
  CRISPR gRNA sequence
agcagggtggccaggcccca

SEQ ID NO: 524017 - DNA, 20 bp, Artificial
  CRISPR gRNA sequence
ccttggtcaggctgggtttt

SEQ ID NO: 524018 - DNA, 20 bp, Artificial
  CRISPR gRNA sequence
ggtcaggctgggttttttcc

SEQ ID NO: 524019 - DNA, 20 bp, Artificial
  CRISPR gRNA sequence
gtcaggctgggttttttccc

SEQ ID NO: 524020 - DNA, 20 bp, Artificial
  CRISPR gRNA sequence
ggttttttccctcccctttc

SEQ ID NO: 524021 - DNA, 20 bp, Artificial
  CRISPR gRNA sequence
tttccctcccctttctggag

SEQ ID NO: 524022 - DNA, 20 bp, Artificial
  CRISPR gRNA sequence
ttccctcccctttctggagg

SEQ ID NO: 524023 - DNA, 20 bp, Artificial
  CRISPR gRNA sequence
tccctcccctttctggaggt

SEQ ID NO: 524024 - DNA, 20 bp, Artificial
  CRISPR gRNA sequence
ccctcccctttctggaggtt

SEQ ID NO: 524025 - DNA, 20 bp, Artificial
  CRISPR gRNA sequence
cctcccctttctggaggttt

SEQ ID NO: 524026 - DNA, 20 bp, Artificial
  CRISPR gRNA sequence
ccctttctggaggttttcag

SEQ ID NO: 524027 - DNA, 20 bp, Artificial
  CRISPR gRNA sequence
tctggaggttttcagctcct

SEQ ID NO: 524028 - DNA, 20 bp, Artificial
  CRISPR gRNA sequence
ctggaggttttcagctcctc

SEQ ID NO: 524029 - DNA, 20 bp, Artificial
  CRISPR gRNA sequence
tggaggttttcagctcctct

SEQ ID NO: 524030 - DNA, 20 bp, Artificial
  CRISPR gRNA sequence
gaggttttcagctcctctga

SEQ ID NO: 524031 - DNA, 20 bp, Artificial
  CRISPR gRNA sequence
tcagctcctctgaaataaac

SEQ ID NO: 524032 - DNA, 20 bp, Artificial
  CRISPR gRNA sequence
cagctcctctgaaataaaca

SEQ ID NO: 524033 - DNA, 20 bp, Artificial
  CRISPR gRNA sequence
agctcctctgaaataaacac

SEQ ID NO: 524034 - DNA, 20 bp, Artificial
  CRISPR gRNA sequence
ctctgaaataaacacctttc

SEQ ID NO: 524035 - DNA, 20 bp, Artificial
  CRISPR gRNA sequence
tgaaataaacacctttcagt

SEQ ID NO: 524036 - DNA, 20 bp, Artificial
  CRISPR gRNA sequence
aaataaacacctttcagtga

SEQ ID NO: 524037 - DNA, 20 bp, Artificial
  CRISPR gRNA sequence
tcagtgagatttgtttgttt

SEQ ID NO: 524038 - DNA, 20 bp, Artificial
  CRISPR gRNA sequence
cagtgagatttgtttgtttc

SEQ ID NO: 524039 - DNA, 20 bp, Artificial
  CRISPR gRNA sequence
agtgagatttgtttgtttct

SEQ ID NO: 524040 - DNA, 20 bp, Artificial
  CRISPR gRNA sequence
gtttgtttctgtgtggatta

SEQ ID NO: 524041 - DNA, 20 bp, Artificial
  CRISPR gRNA sequence
tttgtttctgtgtggattac

SEQ ID NO: 524042 - DNA, 20 bp, Artificial
  CRISPR gRNA sequence
gtttctgtgtggattacatt

SEQ ID NO: 524043 - DNA, 20 bp, Artificial
  CRISPR gRNA sequence
tttctgtgtggattacattt

SEQ ID NO: 524044 - DNA, 20 bp, Artificial
  CRISPR gRNA sequence
ctgtgtggattacatttagg

SEQ ID NO: 524045 - DNA, 20 bp, Artificial
  CRISPR gRNA sequence
tgtgtggattacatttaggc

SEQ ID NO: 524046 - DNA, 20 bp, Artificial
  CRISPR gRNA sequence
tgtggattacatttaggctt

SEQ ID NO: 524047 - DNA, 20 bp, Artificial
  CRISPR gRNA sequence
catttaggctttcttttctc

SEQ ID NO: 524048 - DNA, 20 bp, Artificial
  CRISPR gRNA sequence
aggctttcttttctctcttg

SEQ ID NO: 524049 - DNA, 20 bp, Artificial
  CRISPR gRNA sequence
ggctttcttttctctcttgc

SEQ ID NO: 524050 - DNA, 20 bp, Artificial
  CRISPR gRNA sequence
tcttttctctcttgctggga

SEQ ID NO: 524051 - DNA, 20 bp, Artificial
  CRISPR gRNA sequence
cttttctctcttgctgggat

SEQ ID NO: 524052 - DNA, 20 bp, Artificial
  CRISPR gRNA sequence
ttttctctcttgctgggata

SEQ ID NO: 524053 - DNA, 20 bp, Artificial
  CRISPR gRNA sequence
ttctctcttgctgggatact

SEQ ID NO: 524054 - DNA, 20 bp, Artificial
  CRISPR gRNA sequence
tctctcttgctgggatactt

SEQ ID NO: 524055 - DNA, 20 bp, Artificial
  CRISPR gRNA sequence
ctctcttgctgggatacttg

SEQ ID NO: 524056 - DNA, 20 bp, Artificial
  CRISPR gRNA sequence
tctcttgctgggatacttgc

SEQ ID NO: 524057 - DNA, 20 bp, Artificial
  CRISPR gRNA sequence
tcttgctgggatacttgctg

SEQ ID NO: 524058 - DNA, 20 bp, Artificial
  CRISPR gRNA sequence
ttgctgggatacttgctgat

SEQ ID NO: 524059 - DNA, 20 bp, Artificial
  CRISPR gRNA sequence
gctgggatacttgctgatgt

SEQ ID NO: 524060 - DNA, 20 bp, Artificial
  CRISPR gRNA sequence
ctgggatacttgctgatgta

SEQ ID NO: 524061 - DNA, 20 bp, Artificial
  CRISPR gRNA sequence
ggatacttgctgatgtactt

SEQ ID NO: 524062 - DNA, 20 bp, Artificial
  CRISPR gRNA sequence
gctgatgtacttttatttct

SEQ ID NO: 524063 - DNA, 20 bp, Artificial
  CRISPR gRNA sequence
ctgatgtacttttatttctg

SEQ ID NO: 524064 - DNA, 20 bp, Artificial
  CRISPR gRNA sequence
atgtacttttatttctggag

SEQ ID NO: 524065 - DNA, 20 bp, Artificial
  CRISPR gRNA sequence
ttatttctggaggacttctt

SEQ ID NO: 524066 - DNA, 20 bp, Artificial
  CRISPR gRNA sequence
tatttctggaggacttcttt

SEQ ID NO: 524067 - DNA, 20 bp, Artificial
  CRISPR gRNA sequence
atttctggaggacttcttta

SEQ ID NO: 524068 - DNA, 20 bp, Artificial
  CRISPR gRNA sequence
tttctggaggacttctttaa

SEQ ID NO: 524069 - DNA, 20 bp, Artificial
  CRISPR gRNA sequence
ctggaggacttctttaaaaa

SEQ ID NO: 524070 - DNA, 20 bp, Artificial
  CRISPR gRNA sequence
tggaggacttctttaaaaaa

SEQ ID NO: 524071 - DNA, 20 bp, Artificial
  CRISPR gRNA sequence
gaggacttctttaaaaaatt

SEQ ID NO: 524072 - DNA, 20 bp, Artificial
  CRISPR gRNA sequence
ctttaaaaaattctgtggtt

SEQ ID NO: 524073 - DNA, 20 bp, Artificial
  CRISPR gRNA sequence
tttaaaaaattctgtggttc

SEQ ID NO: 524074 - DNA, 20 bp, Artificial
  CRISPR gRNA sequence
taaaaaattctgtggttcca

SEQ ID NO: 524075 - DNA, 20 bp, Artificial
  CRISPR gRNA sequence
aaaaaattctgtggttccaa

SEQ ID NO: 524076 - DNA, 20 bp, Artificial
  CRISPR gRNA sequence
aaaaattctgtggttccaaa

SEQ ID NO: 524077 - DNA, 20 bp, Artificial
  CRISPR gRNA sequence
tgtggttccaaaagtcagag

SEQ ID NO: 524078 - DNA, 20 bp, Artificial
  CRISPR gRNA sequence
tggttccaaaagtcagagcc

SEQ ID NO: 524079 - DNA, 20 bp, Artificial
  CRISPR gRNA sequence
caaaagtcagagccctacaa

SEQ ID NO: 524080 - DNA, 20 bp, Artificial
  CRISPR gRNA sequence
caaagaggcaccctggggac

SEQ ID NO: 524081 - DNA, 20 bp, Artificial
  CRISPR gRNA sequence
gggactgtcgccctcccctc

SEQ ID NO: 524082 - DNA, 20 bp, Artificial
  CRISPR gRNA sequence
tcgccctcccctcccacctg

SEQ ID NO: 524083 - DNA, 20 bp, Artificial
  CRISPR gRNA sequence
ccctcccacctgcccccctg

SEQ ID NO: 524084 - DNA, 20 bp, Artificial
  CRISPR gRNA sequence
ccacctgcccccctgcctgc

SEQ ID NO: 524085 - DNA, 20 bp, Artificial
  CRISPR gRNA sequence
cccccctgcctgcgggactc

SEQ ID NO: 524086 - DNA, 20 bp, Artificial
  CRISPR gRNA sequence
cctgcgggactcaccagcct

SEQ ID NO: 524087 - DNA, 20 bp, Artificial
  CRISPR gRNA sequence
cgggactcaccagcctctgg

SEQ ID NO: 524088 - DNA, 20 bp, Artificial
  CRISPR gRNA sequence
accagcctctgggggccggg

SEQ ID NO: 524089 - DNA, 20 bp, Artificial
  CRISPR gRNA sequence
tgggggccgggcttatcctc

SEQ ID NO: 524090 - DNA, 20 bp, Artificial
  CRISPR gRNA sequence
ggggccgggcttatcctcct

SEQ ID NO: 524091 - DNA, 20 bp, Artificial
  CRISPR gRNA sequence
atcctcctgagcttccctct

SEQ ID NO: 524092 - DNA, 20 bp, Artificial
  CRISPR gRNA sequence
tcctcctgagcttccctcta

SEQ ID NO: 524093 - DNA, 20 bp, Artificial
  CRISPR gRNA sequence
ctgagcttccctctacgaaa

SEQ ID NO: 524094 - DNA, 20 bp, Artificial
  CRISPR gRNA sequence
agcttccctctacgaaagca

SEQ ID NO: 524095 - DNA, 20 bp, Artificial
  CRISPR gRNA sequence
ccctctacgaaagcaagtgc

SEQ ID NO: 524096 - DNA, 20 bp, Artificial
  CRISPR gRNA sequence
cctctacgaaagcaagtgca

SEQ ID NO: 524097 - DNA, 20 bp, Artificial
  CRISPR gRNA sequence
tacgaaagcaagtgcacaaa

SEQ ID NO: 524098 - DNA, 20 bp, Artificial
  CRISPR gRNA sequence
cgaaagcaagtgcacaaaca

SEQ ID NO: 524099 - DNA, 20 bp, Artificial
  CRISPR gRNA sequence
ctggccccgcatcaccagca

SEQ ID NO: 524100 - DNA, 20 bp, Artificial
  CRISPR gRNA sequence
tggccccgcatcaccagcac

SEQ ID NO: 524101 - DNA, 20 bp, Artificial
  CRISPR gRNA sequence
gccccgcatcaccagcaccc

SEQ ID NO: 524102 - DNA, 20 bp, Artificial
  CRISPR gRNA sequence
ccctgtagaggcagcaggct

SEQ ID NO: 524103 - DNA, 20 bp, Artificial
  CRISPR gRNA sequence
cctgtagaggcagcaggctc

SEQ ID NO: 524104 - DNA, 20 bp, Artificial
  CRISPR gRNA sequence
tagaggcagcaggctcgggg

SEQ ID NO: 524105 - DNA, 20 bp, Artificial
  CRISPR gRNA sequence
ggggccagtgacgggaccca

SEQ ID NO: 524106 - DNA, 20 bp, Artificial
  CRISPR gRNA sequence
atcagaatccaggggatttg

SEQ ID NO: 524107 - DNA, 20 bp, Artificial
  CRISPR gRNA sequence
gcagggacaaagtggctgag

SEQ ID NO: 524108 - DNA, 20 bp, Artificial
  CRISPR gRNA sequence
cagggacaaagtggctgaga

SEQ ID NO: 524109 - DNA, 20 bp, Artificial
  CRISPR gRNA sequence
agaggaaagcgccctgggcc

SEQ ID NO: 524110 - DNA, 20 bp, Artificial
  CRISPR gRNA sequence
ggcccaggcctcccaggctc

SEQ ID NO: 524111 - DNA, 20 bp, Artificial
  CRISPR gRNA sequence
ccaggctcccctccagcttt

SEQ ID NO: 524112 - DNA, 20 bp, Artificial
  CRISPR gRNA sequence
ccctccagcttttgttcttc

SEQ ID NO: 524113 - DNA, 20 bp, Artificial
  CRISPR gRNA sequence
cagcttttgttcttctaaac

SEQ ID NO: 524114 - DNA, 20 bp, Artificial
  CRISPR gRNA sequence
ttgttcttctaaactttgag

SEQ ID NO: 524115 - DNA, 20 bp, Artificial
  CRISPR gRNA sequence
tgttcttctaaactttgagg

SEQ ID NO: 524116 - DNA, 20 bp, Artificial
  CRISPR gRNA sequence
gttcttctaaactttgaggg

SEQ ID NO: 524117 - DNA, 20 bp, Artificial
  CRISPR gRNA sequence
ttcttctaaactttgagggg

SEQ ID NO: 524118 - DNA, 20 bp, Artificial
  CRISPR gRNA sequence
ttctaaactttgaggggctt

SEQ ID NO: 524119 - DNA, 20 bp, Artificial
  CRISPR gRNA sequence
ctaaactttgaggggcttgg

SEQ ID NO: 524120 - DNA, 20 bp, Artificial
  CRISPR gRNA sequence
taaactttgaggggcttggc

SEQ ID NO: 524121 - DNA, 20 bp, Artificial
  CRISPR gRNA sequence
aactttgaggggcttggccc

SEQ ID NO: 524122 - DNA, 20 bp, Artificial
  CRISPR gRNA sequence
tgaggggcttggcccagaac

SEQ ID NO: 524123 - DNA, 20 bp, Artificial
  CRISPR gRNA sequence
gaggggcttggcccagaacc

SEQ ID NO: 524124 - DNA, 20 bp, Artificial
  CRISPR gRNA sequence
aggggcttggcccagaaccc

SEQ ID NO: 524125 - DNA, 20 bp, Artificial
  CRISPR gRNA sequence
ggcccagaaccctgcccatg

SEQ ID NO: 524126 - DNA, 20 bp, Artificial
  CRISPR gRNA sequence
gcccagaaccctgcccatgt

SEQ ID NO: 524127 - DNA, 20 bp, Artificial
  CRISPR gRNA sequence
cccatgttctgggtttcttg

SEQ ID NO: 524128 - DNA, 20 bp, Artificial
  CRISPR gRNA sequence
tgggtttcttgggggcctag

SEQ ID NO: 524129 - DNA, 20 bp, Artificial
  CRISPR gRNA sequence
ggtttcttgggggcctaggg

SEQ ID NO: 524130 - DNA, 20 bp, Artificial
  CRISPR gRNA sequence
cttgggggcctagggactgc

SEQ ID NO: 524131 - DNA, 20 bp, Artificial
  CRISPR gRNA sequence
ttgggggcctagggactgcc

SEQ ID NO: 524132 - DNA, 20 bp, Artificial
  CRISPR gRNA sequence
gggggcctagggactgccac

SEQ ID NO: 524133 - DNA, 20 bp, Artificial
  CRISPR gRNA sequence
ggggcctagggactgccacg

SEQ ID NO: 524134 - DNA, 20 bp, Artificial
  CRISPR gRNA sequence
gggactgccacgttcctttg

SEQ ID NO: 524135 - DNA, 20 bp, Artificial
  CRISPR gRNA sequence
ccacgttcctttgggacaca

SEQ ID NO: 524136 - DNA, 20 bp, Artificial
  CRISPR gRNA sequence
ctttgggacacagcaactcc

SEQ ID NO: 524137 - DNA, 20 bp, Artificial
  CRISPR gRNA sequence
tgggacacagcaactccctt

SEQ ID NO: 524138 - DNA, 20 bp, Artificial
  CRISPR gRNA sequence
gggacacagcaactcccttg

SEQ ID NO: 524139 - DNA, 20 bp, Artificial
  CRISPR gRNA sequence
ggacacagcaactcccttgg

SEQ ID NO: 524140 - DNA, 20 bp, Artificial
  CRISPR gRNA sequence
ccttggacaaaggttctgct

SEQ ID NO: 524141 - DNA, 20 bp, Artificial
  CRISPR gRNA sequence
ggacaaaggttctgctgatg

SEQ ID NO: 524142 - DNA, 20 bp, Artificial
  CRISPR gRNA sequence
gacaaaggttctgctgatga

SEQ ID NO: 524143 - DNA, 20 bp, Artificial
  CRISPR gRNA sequence
tgctgatgaagggcttgaag

SEQ ID NO: 524144 - DNA, 20 bp, Artificial
  CRISPR gRNA sequence
ctgatgaagggcttgaagcc

SEQ ID NO: 524145 - DNA, 20 bp, Artificial
  CRISPR gRNA sequence
atgaagggcttgaagcccct

SEQ ID NO: 524146 - DNA, 20 bp, Artificial
  CRISPR gRNA sequence
gaagcccctgggccagctgc

SEQ ID NO: 524147 - DNA, 20 bp, Artificial
  CRISPR gRNA sequence
aagcccctgggccagctgct

SEQ ID NO: 524148 - DNA, 20 bp, Artificial
  CRISPR gRNA sequence
ggccagctgctagaggacgc

SEQ ID NO: 524149 - DNA, 20 bp, Artificial
  CRISPR gRNA sequence
ctagaggacgctgaggcctc

SEQ ID NO: 524150 - DNA, 20 bp, Artificial
  CRISPR gRNA sequence
gaggacgctgaggcctctcc

SEQ ID NO: 524151 - DNA, 20 bp, Artificial
  CRISPR gRNA sequence
aggcctctcctcttgggtca

SEQ ID NO: 524152 - DNA, 20 bp, Artificial
  CRISPR gRNA sequence
tcctcttgggtcagcctcgg

SEQ ID NO: 524153 - DNA, 20 bp, Artificial
  CRISPR gRNA sequence
ctcttgggtcagcctcgggc

SEQ ID NO: 524154 - DNA, 20 bp, Artificial
  CRISPR gRNA sequence
ttgggtcagcctcgggctgg

SEQ ID NO: 524155 - DNA, 20 bp, Artificial
  CRISPR gRNA sequence
gggtcagcctcgggctggag

SEQ ID NO: 524156 - DNA, 20 bp, Artificial
  CRISPR gRNA sequence
ggtcagcctcgggctggaga

SEQ ID NO: 524157 - DNA, 20 bp, Artificial
  CRISPR gRNA sequence
gggctggagagtaggtcctg

SEQ ID NO: 524158 - DNA, 20 bp, Artificial
  CRISPR gRNA sequence
gagagtaggtcctgagtcct

SEQ ID NO: 524159 - DNA, 20 bp, Artificial
  CRISPR gRNA sequence
agtcctttctgccgctagag

SEQ ID NO: 524160 - DNA, 20 bp, Artificial
  CRISPR gRNA sequence
tctgccgctagaggcagagg

SEQ ID NO: 524161 - DNA, 20 bp, Artificial
  CRISPR gRNA sequence
ctgccgctagaggcagagga

SEQ ID NO: 524162 - DNA, 20 bp, Artificial
  CRISPR gRNA sequence
tgccgctagaggcagaggag

SEQ ID NO: 524163 - DNA, 20 bp, Artificial
  CRISPR gRNA sequence
ccgctagaggcagaggagga

SEQ ID NO: 524164 - DNA, 20 bp, Artificial
  CRISPR gRNA sequence
gaggcagaggaggaggcgat

SEQ ID NO: 524165 - DNA, 20 bp, Artificial
  CRISPR gRNA sequence
ccccccaggggtctgctgtg

SEQ ID NO: 524166 - DNA, 20 bp, Artificial
  CRISPR gRNA sequence
ctgtggccgggagccttcag

SEQ ID NO: 524167 - DNA, 20 bp, Artificial
  CRISPR gRNA sequence
tggccgggagccttcaggga

SEQ ID NO: 524168 - DNA, 20 bp, Artificial
  CRISPR gRNA sequence
cagggaggggctgtctggga

SEQ ID NO: 524169 - DNA, 20 bp, Artificial
  CRISPR gRNA sequence
agggaggggctgtctgggag

SEQ ID NO: 524170 - DNA, 20 bp, Artificial
  CRISPR gRNA sequence
tctgggaggctgaaggagct

SEQ ID NO: 524171 - DNA, 20 bp, Artificial
  CRISPR gRNA sequence
ggaggctgaaggagctccct

SEQ ID NO: 524172 - DNA, 20 bp, Artificial
  CRISPR gRNA sequence
aaggagctccctgtctctgt

SEQ ID NO: 524173 - DNA, 20 bp, Artificial
  CRISPR gRNA sequence
cctgtctctgtccacaggga

SEQ ID NO: 524174 - DNA, 20 bp, Artificial
  CRISPR gRNA sequence
tctctgtccacagggacttc

SEQ ID NO: 524175 - DNA, 20 bp, Artificial
  CRISPR gRNA sequence
tgtccacagggacttctgtc

SEQ ID NO: 524176 - DNA, 20 bp, Artificial
  CRISPR gRNA sequence
tccacagggacttctgtccc

SEQ ID NO: 524177 - DNA, 20 bp, Artificial
  CRISPR gRNA sequence
ctgtcccaaattccaggcgc

SEQ ID NO: 524178 - DNA, 20 bp, Artificial
  CRISPR gRNA sequence
tgtcccaaattccaggcgca

SEQ ID NO: 524179 - DNA, 20 bp, Artificial
  CRISPR gRNA sequence
tcccaaattccaggcgcaga

SEQ ID NO: 524180 - DNA, 20 bp, Artificial
  CRISPR gRNA sequence
caggcgcagaggaggagggg

SEQ ID NO: 524181 - DNA, 20 bp, Artificial
  CRISPR gRNA sequence
agtcctccatggccagtcag

SEQ ID NO: 524182 - DNA, 20 bp, Artificial
  CRISPR gRNA sequence
catggccagtcagcctcctg

SEQ ID NO: 524183 - DNA, 20 bp, Artificial
  CRISPR gRNA sequence
ctgcaggtcccgcagtgtgg

SEQ ID NO: 524184 - DNA, 20 bp, Artificial
  CRISPR gRNA sequence
caggtcccgcagtgtggccc

SEQ ID NO: 524185 - DNA, 20 bp, Artificial
  CRISPR gRNA sequence
ctgacccctgactccccctc

SEQ ID NO: 524186 - DNA, 20 bp, Artificial
  CRISPR gRNA sequence
acccctgactccccctcccc

SEQ ID NO: 524187 - DNA, 20 bp, Artificial
  CRISPR gRNA sequence
actccccctccccagaactt

SEQ ID NO: 524188 - DNA, 20 bp, Artificial
  CRISPR gRNA sequence
cccctccccagaacttcaca

SEQ ID NO: 524189 - DNA, 20 bp, Artificial
  CRISPR gRNA sequence
cccagaacttcacagggccg

SEQ ID NO: 524190 - DNA, 20 bp, Artificial
  CRISPR gRNA sequence
cacagggccgggggatcctg

SEQ ID NO: 524191 - DNA, 20 bp, Artificial
  CRISPR gRNA sequence
acagggccgggggatcctga

SEQ ID NO: 524192 - DNA, 20 bp, Artificial
  CRISPR gRNA sequence
actccattcgctgcgacacc

SEQ ID NO: 524193 - DNA, 20 bp, Artificial
  CRISPR gRNA sequence
cattcgctgcgacacccggc

SEQ ID NO: 524194 - DNA, 20 bp, Artificial
  CRISPR gRNA sequence
gctgcgacacccggccacag

SEQ ID NO: 524195 - DNA, 20 bp, Artificial
  CRISPR gRNA sequence
cgacacccggccacagctgc

SEQ ID NO: 524196 - DNA, 20 bp, Artificial
  CRISPR gRNA sequence
ctcatgaggggctgtgcggc

SEQ ID NO: 524197 - DNA, 20 bp, Artificial
  CRISPR gRNA sequence
atgaggggctgtgcggctga

SEQ ID NO: 524198 - DNA, 20 bp, Artificial
  CRISPR gRNA sequence
tgcggctgacgacatcatgg

SEQ ID NO: 524199 - DNA, 20 bp, Artificial
  CRISPR gRNA sequence
acgacatcatggaccccaca

SEQ ID NO: 524200 - DNA, 20 bp, Artificial
  CRISPR gRNA sequence
gctgaaacccaggaagacca

SEQ ID NO: 524201 - DNA, 20 bp, Artificial
  CRISPR gRNA sequence
aaacccaggaagaccacaat

SEQ ID NO: 524202 - DNA, 20 bp, Artificial
  CRISPR gRNA sequence
tccccacaaaaagtgacgct

SEQ ID NO: 524203 - DNA, 20 bp, Artificial
  CRISPR gRNA sequence
tacctgcgaccaggtaggct

SEQ ID NO: 524204 - DNA, 20 bp, Artificial
  CRISPR gRNA sequence
acctgcgaccaggtaggctt

SEQ ID NO: 524205 - DNA, 20 bp, Artificial
  CRISPR gRNA sequence
cctgcgaccaggtaggcttg

SEQ ID NO: 524206 - DNA, 20 bp, Artificial
  CRISPR gRNA sequence
cgaccaggtaggcttggcct

SEQ ID NO: 524207 - DNA, 20 bp, Artificial
  CRISPR gRNA sequence
ggcctcggtggtggtgccag

SEQ ID NO: 524208 - DNA, 20 bp, Artificial
  CRISPR gRNA sequence
gcctcggtggtggtgccagg

SEQ ID NO: 524209 - DNA, 20 bp, Artificial
  CRISPR gRNA sequence
ggtggtggtgccaggcaccg

SEQ ID NO: 524210 - DNA, 20 bp, Artificial
  CRISPR gRNA sequence
tgctggttattggctctggc

SEQ ID NO: 524211 - DNA, 20 bp, Artificial
  CRISPR gRNA sequence
gttattggctctggctggga

SEQ ID NO: 524212 - DNA, 20 bp, Artificial
  CRISPR gRNA sequence
ttggctctggctgggagtcc

SEQ ID NO: 524213 - DNA, 20 bp, Artificial
  CRISPR gRNA sequence
gctctggctgggagtccggc

SEQ ID NO: 524214 - DNA, 20 bp, Artificial
  CRISPR gRNA sequence
tggctgggagtccggccctg

SEQ ID NO: 524215 - DNA, 20 bp, Artificial
  CRISPR gRNA sequence
gctgggagtccggccctgct

SEQ ID NO: 524216 - DNA, 20 bp, Artificial
  CRISPR gRNA sequence
ggagtccggccctgctctgg

SEQ ID NO: 524217 - DNA, 20 bp, Artificial
  CRISPR gRNA sequence
ctctggggtgtcagggctgc

SEQ ID NO: 524218 - DNA, 20 bp, Artificial
  CRISPR gRNA sequence
tggggtgtcagggctgccca

SEQ ID NO: 524219 - DNA, 20 bp, Artificial
  CRISPR gRNA sequence
gggtgtcagggctgcccaga

SEQ ID NO: 524220 - DNA, 20 bp, Artificial
  CRISPR gRNA sequence
cccagaaggcatgtgtccgg

SEQ ID NO: 524221 - DNA, 20 bp, Artificial
  CRISPR gRNA sequence
ctggaaagctgagctcctca

SEQ ID NO: 524222 - DNA, 20 bp, Artificial
  CRISPR gRNA sequence
gaaagctgagctcctcagtg

SEQ ID NO: 524223 - DNA, 20 bp, Artificial
  CRISPR gRNA sequence
agctcctcagtgcccttccg

SEQ ID NO: 524224 - DNA, 20 bp, Artificial
  CRISPR gRNA sequence
ctcagtgcccttccgctctg

SEQ ID NO: 524225 - DNA, 20 bp, Artificial
  CRISPR gRNA sequence
agtgcccttccgctctgtcc

SEQ ID NO: 524226 - DNA, 20 bp, Artificial
  CRISPR gRNA sequence
ccgctctgtccccaggtgga

SEQ ID NO: 524227 - DNA, 20 bp, Artificial
  CRISPR gRNA sequence
cgctctgtccccaggtggag

SEQ ID NO: 524228 - DNA, 20 bp, Artificial
  CRISPR gRNA sequence
tgtccccaggtggagctgcc

SEQ ID NO: 524229 - DNA, 20 bp, Artificial
  CRISPR gRNA sequence
tccccaggtggagctgcccc

SEQ ID NO: 524230 - DNA, 20 bp, Artificial
  CRISPR gRNA sequence
ccccagcccttaccatcggt

SEQ ID NO: 524231 - DNA, 20 bp, Artificial
  CRISPR gRNA sequence
accatcggtgcccagtgtct

SEQ ID NO: 524232 - DNA, 20 bp, Artificial
  CRISPR gRNA sequence
ccatcggtgcccagtgtctg

SEQ ID NO: 524233 - DNA, 20 bp, Artificial
  CRISPR gRNA sequence
cactctctcgcagcccgacg

SEQ ID NO: 524234 - DNA, 20 bp, Artificial
  CRISPR gRNA sequence
tctcgcagcccgacgttctg

SEQ ID NO: 524235 - DNA, 20 bp, Artificial
  CRISPR gRNA sequence
tcgcagcccgacgttctgca

SEQ ID NO: 524236 - DNA, 20 bp, Artificial
  CRISPR gRNA sequence
gcagcccgacgttctgcacc

SEQ ID NO: 524237 - DNA, 20 bp, Artificial
  CRISPR gRNA sequence
tgcaccttttttttttaaag

SEQ ID NO: 524238 - DNA, 20 bp, Artificial
  CRISPR gRNA sequence
caccttttttttttaaaggg

SEQ ID NO: 524239 - DNA, 20 bp, Artificial
  CRISPR gRNA sequence
ttttttttaaagggagacca

SEQ ID NO: 524240 - DNA, 20 bp, Artificial
  CRISPR gRNA sequence
tttttttaaagggagaccaa

SEQ ID NO: 524241 - DNA, 20 bp, Artificial
  CRISPR gRNA sequence
ttttttaaagggagaccaaa

SEQ ID NO: 524242 - DNA, 20 bp, Artificial
  CRISPR gRNA sequence
tttttaaagggagaccaaac

SEQ ID NO: 524243 - DNA, 20 bp, Artificial
  CRISPR gRNA sequence
ttttaaagggagaccaaacc

SEQ ID NO: 524244 - DNA, 20 bp, Artificial
  CRISPR gRNA sequence
tttaaagggagaccaaacca

SEQ ID NO: 524245 - DNA, 20 bp, Artificial
  CRISPR gRNA sequence
ttaaagggagaccaaaccat

SEQ ID NO: 524246 - DNA, 20 bp, Artificial
  CRISPR gRNA sequence
taaagggagaccaaaccatt

SEQ ID NO: 524247 - DNA, 20 bp, Artificial
  CRISPR gRNA sequence
aaagggagaccaaaccattt

SEQ ID NO: 524248 - DNA, 20 bp, Artificial
  CRISPR gRNA sequence
aagggagaccaaaccatttg

SEQ ID NO: 524249 - DNA, 20 bp, Artificial
  CRISPR gRNA sequence
gcaaaacactattccattac

SEQ ID NO: 524250 - DNA, 20 bp, Artificial
  CRISPR gRNA sequence
caaaacactattccattaca

SEQ ID NO: 524251 - DNA, 20 bp, Artificial
  CRISPR gRNA sequence
ttccattacacactcagaag

SEQ ID NO: 524252 - DNA, 20 bp, Artificial
  CRISPR gRNA sequence
cattacacactcagaaggcc

SEQ ID NO: 524253 - DNA, 20 bp, Artificial
  CRISPR gRNA sequence
cacactcagaaggccagggt

SEQ ID NO: 524254 - DNA, 20 bp, Artificial
  CRISPR gRNA sequence
agaaggccagggtactctta

SEQ ID NO: 524255 - DNA, 20 bp, Artificial
  CRISPR gRNA sequence
ttagaagagtaaaggctctg

SEQ ID NO: 524256 - DNA, 20 bp, Artificial
  CRISPR gRNA sequence
agaagagtaaaggctctgat

SEQ ID NO: 524257 - DNA, 20 bp, Artificial
  CRISPR gRNA sequence
gaagagtaaaggctctgatc

SEQ ID NO: 524258 - DNA, 20 bp, Artificial
  CRISPR gRNA sequence
tgatcagtcttgcagccaag

SEQ ID NO: 524259 - DNA, 20 bp, Artificial
  CRISPR gRNA sequence
atcagtcttgcagccaagag

SEQ ID NO: 524260 - DNA, 20 bp, Artificial
  CRISPR gRNA sequence
gcagccaagagacctaagta

SEQ ID NO: 524261 - DNA, 20 bp, Artificial
  CRISPR gRNA sequence
cagccaagagacctaagtaa

SEQ ID NO: 524262 - DNA, 20 bp, Artificial
  CRISPR gRNA sequence
agtaactgtttaaaccagtg

SEQ ID NO: 524263 - DNA, 20 bp, Artificial
  CRISPR gRNA sequence
tttaaaccagtgttgcccaa

SEQ ID NO: 524264 - DNA, 20 bp, Artificial
  CRISPR gRNA sequence
aaaccagtgttgcccaaact

SEQ ID NO: 524265 - DNA, 20 bp, Artificial
  CRISPR gRNA sequence
aaccagtgttgcccaaactg

SEQ ID NO: 524266 - DNA, 20 bp, Artificial
  CRISPR gRNA sequence
cccaaactgacttgaccaga

SEQ ID NO: 524267 - DNA, 20 bp, Artificial
  CRISPR gRNA sequence
acttgaccagagcacctgtt

SEQ ID NO: 524268 - DNA, 20 bp, Artificial
  CRISPR gRNA sequence
gaccagagcacctgtttcga

SEQ ID NO: 524269 - DNA, 20 bp, Artificial
  CRISPR gRNA sequence
accagagcacctgtttcgac

SEQ ID NO: 524270 - DNA, 20 bp, Artificial
  CRISPR gRNA sequence
tttcgacttgaccagagcac

SEQ ID NO: 524271 - DNA, 20 bp, Artificial
  CRISPR gRNA sequence
cgacttgaccagagcacctg

SEQ ID NO: 524272 - DNA, 20 bp, Artificial
  CRISPR gRNA sequence
gacttgaccagagcacctgt

SEQ ID NO: 524273 - DNA, 20 bp, Artificial
  CRISPR gRNA sequence
gaccagagcacctgtttcag

SEQ ID NO: 524274 - DNA, 20 bp, Artificial
  CRISPR gRNA sequence
accagagcacctgtttcaga

SEQ ID NO: 524275 - DNA, 20 bp, Artificial
  CRISPR gRNA sequence
tttcagaacacagtcccctg

SEQ ID NO: 524276 - DNA, 20 bp, Artificial
  CRISPR gRNA sequence
cagaacacagtcccctgtca

SEQ ID NO: 524277 - DNA, 20 bp, Artificial
  CRISPR gRNA sequence
agaacacagtcccctgtcag

SEQ ID NO: 524278 - DNA, 20 bp, Artificial
  CRISPR gRNA sequence
tcagtgctttgagaaacgcc

SEQ ID NO: 524279 - DNA, 20 bp, Artificial
  CRISPR gRNA sequence
tgagaaacgccctccttatc

SEQ ID NO: 524280 - DNA, 20 bp, Artificial
  CRISPR gRNA sequence
gagaaacgccctccttatcg

SEQ ID NO: 524281 - DNA, 20 bp, Artificial
  CRISPR gRNA sequence
agaaacgccctccttatcgg

SEQ ID NO: 524282 - DNA, 20 bp, Artificial
  CRISPR gRNA sequence
cttatcggtggctcacgcct

SEQ ID NO: 524283 - DNA, 20 bp, Artificial
  CRISPR gRNA sequence
atcggtggctcacgcctgta

SEQ ID NO: 524284 - DNA, 20 bp, Artificial
  CRISPR gRNA sequence
tcggtggctcacgcctgtaa

SEQ ID NO: 524285 - DNA, 20 bp, Artificial
  CRISPR gRNA sequence
acgcctgtaatcccagcact

SEQ ID NO: 524286 - DNA, 20 bp, Artificial
  CRISPR gRNA sequence
taatcccagcactttgggag

SEQ ID NO: 524287 - DNA, 20 bp, Artificial
  CRISPR gRNA sequence
tgggaggccgaggcgggtgg

SEQ ID NO: 524288 - DNA, 20 bp, Artificial
  CRISPR gRNA sequence
gggaggccgaggcgggtgga

SEQ ID NO: 524289 - DNA, 20 bp, Artificial
  CRISPR gRNA sequence
ggaggccgaggcgggtggat

SEQ ID NO: 524290 - DNA, 20 bp, Artificial
  CRISPR gRNA sequence
gaggtcgggggttcgagacc

SEQ ID NO: 524291 - DNA, 20 bp, Artificial
  CRISPR gRNA sequence
aggtcgggggttcgagacca

SEQ ID NO: 524292 - DNA, 20 bp, Artificial
  CRISPR gRNA sequence
gagaccagcctggccaacat

SEQ ID NO: 524293 - DNA, 20 bp, Artificial
  CRISPR gRNA sequence
gccaacattctcctgctgcg

SEQ ID NO: 524294 - DNA, 20 bp, Artificial
  CRISPR gRNA sequence
tcctgctgcggcaggagaat

SEQ ID NO: 524295 - DNA, 20 bp, Artificial
  CRISPR gRNA sequence
ctgctgcggcaggagaatca

SEQ ID NO: 524296 - DNA, 20 bp, Artificial
  CRISPR gRNA sequence
ctgcggcaggagaatcactt

SEQ ID NO: 524297 - DNA, 20 bp, Artificial
  CRISPR gRNA sequence
cggcaggagaatcacttgaa

SEQ ID NO: 524298 - DNA, 20 bp, Artificial
  CRISPR gRNA sequence
gaacctgggaggcagaggtt

SEQ ID NO: 524299 - DNA, 20 bp, Artificial
  CRISPR gRNA sequence
aacctgggaggcagaggttg

SEQ ID NO: 524300 - DNA, 20 bp, Artificial
  CRISPR gRNA sequence
ggaggcagaggttgcagtga

SEQ ID NO: 524301 - DNA, 20 bp, Artificial
  CRISPR gRNA sequence
cagtgagccaagattgtgcc

SEQ ID NO: 524302 - DNA, 20 bp, Artificial
  CRISPR gRNA sequence
tgccactgcactttagcctg

SEQ ID NO: 524303 - DNA, 20 bp, Artificial
  CRISPR gRNA sequence
cactttagcctgggcgacag

SEQ ID NO: 524304 - DNA, 20 bp, Artificial
  CRISPR gRNA sequence
tagcctgggcgacagggcga

SEQ ID NO: 524305 - DNA, 20 bp, Artificial
  CRISPR gRNA sequence
agcctgggcgacagggcgag

SEQ ID NO: 524306 - DNA, 20 bp, Artificial
  CRISPR gRNA sequence
gcctgggcgacagggcgaga

SEQ ID NO: 524307 - DNA, 20 bp, Artificial
  CRISPR gRNA sequence
ggcgacagggcgagattctg

SEQ ID NO: 524308 - DNA, 20 bp, Artificial
  CRISPR gRNA sequence
tgtctcaaaatgaaaagaaa

SEQ ID NO: 524309 - DNA, 20 bp, Artificial
  CRISPR gRNA sequence
tctcaaaatgaaaagaaagg

SEQ ID NO: 524310 - DNA, 20 bp, Artificial
  CRISPR gRNA sequence
aaaatgaaaagaaaggaagg

SEQ ID NO: 524311 - DNA, 20 bp, Artificial
  CRISPR gRNA sequence
cctccttgctccaggaaggc

SEQ ID NO: 524312 - DNA, 20 bp, Artificial
  CRISPR gRNA sequence
cttgctccaggaaggcaggt

SEQ ID NO: 524313 - DNA, 20 bp, Artificial
  CRISPR gRNA sequence
gctccaggaaggcaggtgtg

SEQ ID NO: 524314 - DNA, 20 bp, Artificial
  CRISPR gRNA sequence
ctccaggaaggcaggtgtgg

SEQ ID NO: 524315 - DNA, 20 bp, Artificial
  CRISPR gRNA sequence
caggaaggcaggtgtggtgg

SEQ ID NO: 524316 - DNA, 20 bp, Artificial
  CRISPR gRNA sequence
gtgtggccaccgacctgtga

SEQ ID NO: 524317 - DNA, 20 bp, Artificial
  CRISPR gRNA sequence
tgacctcccaggccacagtg

SEQ ID NO: 524318 - DNA, 20 bp, Artificial
  CRISPR gRNA sequence
ccaggccacagtgaggccag

SEQ ID NO: 524319 - DNA, 20 bp, Artificial
  CRISPR gRNA sequence
ccagggagagggtgcagacg

SEQ ID NO: 524320 - DNA, 20 bp, Artificial
  CRISPR gRNA sequence
tagaggaaccagctggtgtc

SEQ ID NO: 524321 - DNA, 20 bp, Artificial
  CRISPR gRNA sequence
agaggaaccagctggtgtcg

SEQ ID NO: 524322 - DNA, 20 bp, Artificial
  CRISPR gRNA sequence
gaggaaccagctggtgtcgg

SEQ ID NO: 524323 - DNA, 20 bp, Artificial
  CRISPR gRNA sequence
gtgtcggacaggctggggct

SEQ ID NO: 524324 - DNA, 20 bp, Artificial
  CRISPR gRNA sequence
gggctcagagctctgccctc

SEQ ID NO: 524325 - DNA, 20 bp, Artificial
  CRISPR gRNA sequence
agagctctgccctcagggga

SEQ ID NO: 524326 - DNA, 20 bp, Artificial
  CRISPR gRNA sequence
tgccctcaggggaagcccag

SEQ ID NO: 524327 - DNA, 20 bp, Artificial
  CRISPR gRNA sequence
ccctcaggggaagcccaggt

SEQ ID NO: 524328 - DNA, 20 bp, Artificial
  CRISPR gRNA sequence
aggggaagcccaggtcagcg

SEQ ID NO: 524329 - DNA, 20 bp, Artificial
  CRISPR gRNA sequence
agttagccttggggcagagt

SEQ ID NO: 524330 - DNA, 20 bp, Artificial
  CRISPR gRNA sequence
gccttggggcagagtggccc

SEQ ID NO: 524331 - DNA, 20 bp, Artificial
  CRISPR gRNA sequence
ggggcagagtggcccagggt

SEQ ID NO: 524332 - DNA, 20 bp, Artificial
  CRISPR gRNA sequence
gggcagagtggcccagggtg

SEQ ID NO: 524333 - DNA, 20 bp, Artificial
  CRISPR gRNA sequence
ggagacagtgagggatgggg

SEQ ID NO: 524334 - DNA, 20 bp, Artificial
  CRISPR gRNA sequence
gggaggtcctgcaggagcag

SEQ ID NO: 524335 - DNA, 20 bp, Artificial
  CRISPR gRNA sequence
caggagcagggcccaggtgt

SEQ ID NO: 524336 - DNA, 20 bp, Artificial
  CRISPR gRNA sequence
ggggcagcaggggacaaaac

SEQ ID NO: 524337 - DNA, 20 bp, Artificial
  CRISPR gRNA sequence
gtggtagggtcaggcctgcc

SEQ ID NO: 524338 - DNA, 20 bp, Artificial
  CRISPR gRNA sequence
cccctcgctgccccgtgagc

SEQ ID NO: 524339 - DNA, 20 bp, Artificial
  CRISPR gRNA sequence
gctgccccgtgagcaggcac

SEQ ID NO: 524340 - DNA, 20 bp, Artificial
  CRISPR gRNA sequence
ccccgtgagcaggcacaagc

SEQ ID NO: 524341 - DNA, 20 bp, Artificial
  CRISPR gRNA sequence
cgtgctggaacctccacctc

SEQ ID NO: 524342 - DNA, 20 bp, Artificial
  CRISPR gRNA sequence
gtgctggaacctccacctct

SEQ ID NO: 524343 - DNA, 20 bp, Artificial
  CRISPR gRNA sequence
gaacctccacctctgacctc

SEQ ID NO: 524344 - DNA, 20 bp, Artificial
  CRISPR gRNA sequence
cacctctgacctcaaactcg

SEQ ID NO: 524345 - DNA, 20 bp, Artificial
  CRISPR gRNA sequence
tgacctcaaactcgagggcc

SEQ ID NO: 524346 - DNA, 20 bp, Artificial
  CRISPR gRNA sequence
acctcaaactcgagggcctg

SEQ ID NO: 524347 - DNA, 20 bp, Artificial
  CRISPR gRNA sequence
aaactcgagggcctggccct

SEQ ID NO: 524348 - DNA, 20 bp, Artificial
  CRISPR gRNA sequence
gagggcctggccctgtggcc

SEQ ID NO: 524349 - DNA, 20 bp, Artificial
  CRISPR gRNA sequence
gccctgtggcccctggaggc

SEQ ID NO: 524350 - DNA, 20 bp, Artificial
  CRISPR gRNA sequence
tggcccctggaggcagctct

SEQ ID NO: 524351 - DNA, 20 bp, Artificial
  CRISPR gRNA sequence
gaggcagctctgatgtattt

SEQ ID NO: 524352 - DNA, 20 bp, Artificial
  CRISPR gRNA sequence
tgatgtattttccccacgcc

SEQ ID NO: 524353 - DNA, 20 bp, Artificial
  CRISPR gRNA sequence
atgtattttccccacgcccc

SEQ ID NO: 524354 - DNA, 20 bp, Artificial
  CRISPR gRNA sequence
tccccacgccccacttcaca

SEQ ID NO: 524355 - DNA, 20 bp, Artificial
  CRISPR gRNA sequence
ccccacgccccacttcacag

SEQ ID NO: 524356 - DNA, 20 bp, Artificial
  CRISPR gRNA sequence
cccacgccccacttcacagt

SEQ ID NO: 524357 - DNA, 20 bp, Artificial
  CRISPR gRNA sequence
cacagtgaggaaactgaggc

SEQ ID NO: 524358 - DNA, 20 bp, Artificial
  CRISPR gRNA sequence
acagtgaggaaactgaggct

SEQ ID NO: 524359 - DNA, 20 bp, Artificial
  CRISPR gRNA sequence
aggctgacagaggtgttgcc

SEQ ID NO: 524360 - DNA, 20 bp, Artificial
  CRISPR gRNA sequence
acagaggtgttgcctgtggc

SEQ ID NO: 524361 - DNA, 20 bp, Artificial
  CRISPR gRNA sequence
cctgtggccagagtttgtgc

SEQ ID NO: 524362 - DNA, 20 bp, Artificial
  CRISPR gRNA sequence
tggccagagtttgtgcagct

SEQ ID NO: 524363 - DNA, 20 bp, Artificial
  CRISPR gRNA sequence
gtgcagctctgtggtgctgg

SEQ ID NO: 524364 - DNA, 20 bp, Artificial
  CRISPR gRNA sequence
tgcagctctgtggtgctgga

SEQ ID NO: 524365 - DNA, 20 bp, Artificial
  CRISPR gRNA sequence
tgtggtgctggaggtgtcag

SEQ ID NO: 524366 - DNA, 20 bp, Artificial
  CRISPR gRNA sequence
tggtgctggaggtgtcagga

SEQ ID NO: 524367 - DNA, 20 bp, Artificial
  CRISPR gRNA sequence
gaggtgtcaggaaggatcgt

SEQ ID NO: 524368 - DNA, 20 bp, Artificial
  CRISPR gRNA sequence
gagggtgggggtgcgcctga

SEQ ID NO: 524369 - DNA, 20 bp, Artificial
  CRISPR gRNA sequence
agtgggggcatccttgtgcc

SEQ ID NO: 524370 - DNA, 20 bp, Artificial
  CRISPR gRNA sequence
gtgccgtggggaagggtggg

SEQ ID NO: 524371 - DNA, 20 bp, Artificial
  CRISPR gRNA sequence
tgccgtggggaagggtgggg

SEQ ID NO: 524372 - DNA, 20 bp, Artificial
  CRISPR gRNA sequence
cccacggcctggcatgcatc

SEQ ID NO: 524373 - DNA, 20 bp, Artificial
  CRISPR gRNA sequence
gcatgcatccccactgtgca

SEQ ID NO: 524374 - DNA, 20 bp, Artificial
  CRISPR gRNA sequence
tgcagggggcaaatgctgtg

SEQ ID NO: 524375 - DNA, 20 bp, Artificial
  CRISPR gRNA sequence
tggcctctgggagggcacag

SEQ ID NO: 524376 - DNA, 20 bp, Artificial
  CRISPR gRNA sequence
tgggagggcacaggtgagct

SEQ ID NO: 524377 - DNA, 20 bp, Artificial
  CRISPR gRNA sequence
ggagggcacaggtgagctcg

SEQ ID NO: 524378 - DNA, 20 bp, Artificial
  CRISPR gRNA sequence
gggtggatgcaggtgagggt

SEQ ID NO: 524379 - DNA, 20 bp, Artificial
  CRISPR gRNA sequence
gggtgagcaccagggagaga

SEQ ID NO: 524380 - DNA, 20 bp, Artificial
  CRISPR gRNA sequence
aacagcaccccagggccaca

SEQ ID NO: 524381 - DNA, 20 bp, Artificial
  CRISPR gRNA sequence
acagcaccccagggccacag

SEQ ID NO: 524382 - DNA, 20 bp, Artificial
  CRISPR gRNA sequence
ccagagcagggcggcaggat

SEQ ID NO: 524383 - DNA, 20 bp, Artificial
  CRISPR gRNA sequence
ggaagggactgtcctctcgc

SEQ ID NO: 524384 - DNA, 20 bp, Artificial
  CRISPR gRNA sequence
tcctctcgcggggtcctggc

SEQ ID NO: 524385 - DNA, 20 bp, Artificial
  CRISPR gRNA sequence
tcgcggggtcctggccctac

SEQ ID NO: 524386 - DNA, 20 bp, Artificial
  CRISPR gRNA sequence
gcggggtcctggccctaccc

SEQ ID NO: 524387 - DNA, 20 bp, Artificial
  CRISPR gRNA sequence
gccctacccccgcagcctgc

SEQ ID NO: 524388 - DNA, 20 bp, Artificial
  CRISPR gRNA sequence
cccccgcagcctgctggccc

SEQ ID NO: 524389 - DNA, 20 bp, Artificial
  CRISPR gRNA sequence
ctggcccttcgctgagcctc

SEQ ID NO: 524390 - DNA, 20 bp, Artificial
  CRISPR gRNA sequence
gcccttcgctgagcctctac

SEQ ID NO: 524391 - DNA, 20 bp, Artificial
  CRISPR gRNA sequence
cgctgagcctctactctgga

SEQ ID NO: 524392 - DNA, 20 bp, Artificial
  CRISPR gRNA sequence
gctgagcctctactctggaa

SEQ ID NO: 524393 - DNA, 20 bp, Artificial
  CRISPR gRNA sequence
agcctctactctggaaggga

SEQ ID NO: 524394 - DNA, 20 bp, Artificial
  CRISPR gRNA sequence
tactctggaagggaagggac

SEQ ID NO: 524395 - DNA, 20 bp, Artificial
  CRISPR gRNA sequence
ctctggaagggaagggacgg

SEQ ID NO: 524396 - DNA, 20 bp, Artificial
  CRISPR gRNA sequence
tggaagggaagggacggggc

SEQ ID NO: 524397 - DNA, 20 bp, Artificial
  CRISPR gRNA sequence
gaagggaagggacggggccc

SEQ ID NO: 524398 - DNA, 20 bp, Artificial
  CRISPR gRNA sequence
ggtcagccaccaaaggccta

SEQ ID NO: 524399 - DNA, 20 bp, Artificial
  CRISPR gRNA sequence
gtcagccaccaaaggcctat

SEQ ID NO: 524400 - DNA, 20 bp, Artificial
  CRISPR gRNA sequence
tgtctgtgccctttgactgc

SEQ ID NO: 524401 - DNA, 20 bp, Artificial
  CRISPR gRNA sequence
tgccctttgactgcagcatg

SEQ ID NO: 524402 - DNA, 20 bp, Artificial
  CRISPR gRNA sequence
tgactgcagcatggccacat

SEQ ID NO: 524403 - DNA, 20 bp, Artificial
  CRISPR gRNA sequence
gactgcagcatggccacatt

SEQ ID NO: 524404 - DNA, 20 bp, Artificial
  CRISPR gRNA sequence
actgcagcatggccacattg

SEQ ID NO: 524405 - DNA, 20 bp, Artificial
  CRISPR gRNA sequence
cagcatggccacattgctcg

SEQ ID NO: 524406 - DNA, 20 bp, Artificial
  CRISPR gRNA sequence
ctcgtggggacatggtcttg

SEQ ID NO: 524407 - DNA, 20 bp, Artificial
  CRISPR gRNA sequence
gtggggacatggtcttggct

SEQ ID NO: 524408 - DNA, 20 bp, Artificial
  CRISPR gRNA sequence
ggctgcctcctccatgtcgc

SEQ ID NO: 524409 - DNA, 20 bp, Artificial
  CRISPR gRNA sequence
gctgcctcctccatgtcgct

SEQ ID NO: 524410 - DNA, 20 bp, Artificial
  CRISPR gRNA sequence
cctcctccatgtcgctgcag

SEQ ID NO: 524411 - DNA, 20 bp, Artificial
  CRISPR gRNA sequence
ctccatgtcgctgcagacgc

SEQ ID NO: 524412 - DNA, 20 bp, Artificial
  CRISPR gRNA sequence
catgtcgctgcagacgccgc

SEQ ID NO: 524413 - DNA, 20 bp, Artificial
  CRISPR gRNA sequence
cagacgccgcacggccccca

SEQ ID NO: 524414 - DNA, 20 bp, Artificial
  CRISPR gRNA sequence
actgtctggcccttcataga

SEQ ID NO: 524415 - DNA, 20 bp, Artificial
  CRISPR gRNA sequence
ctgtctggcccttcatagaa

SEQ ID NO: 524416 - DNA, 20 bp, Artificial
  CRISPR gRNA sequence
tctggcccttcatagaaagt

SEQ ID NO: 524417 - DNA, 20 bp, Artificial
  CRISPR gRNA sequence
gcccttcatagaaagtgatt

SEQ ID NO: 524418 - DNA, 20 bp, Artificial
  CRISPR gRNA sequence
catagaaagtgattggggtc

SEQ ID NO: 524419 - DNA, 20 bp, Artificial
  CRISPR gRNA sequence
atagaaagtgattggggtcc

SEQ ID NO: 524420 - DNA, 20 bp, Artificial
  CRISPR gRNA sequence
gggtccttggcccagaggcc

SEQ ID NO: 524421 - DNA, 20 bp, Artificial
  CRISPR gRNA sequence
ggcccagaggccaagtgaag

SEQ ID NO: 524422 - DNA, 20 bp, Artificial
  CRISPR gRNA sequence
gcccagaggccaagtgaagc

SEQ ID NO: 524423 - DNA, 20 bp, Artificial
  CRISPR gRNA sequence
tgagggctgcaaggcacagc

SEQ ID NO: 524424 - DNA, 20 bp, Artificial
  CRISPR gRNA sequence
agggctgcaaggcacagcag

SEQ ID NO: 524425 - DNA, 20 bp, Artificial
  CRISPR gRNA sequence
caaggcacagcagggcgagg

SEQ ID NO: 524426 - DNA, 20 bp, Artificial
  CRISPR gRNA sequence
agcattgtgtggggtgtgtg

SEQ ID NO: 524427 - DNA, 20 bp, Artificial
  CRISPR gRNA sequence
gcattgtgtggggtgtgtgt

SEQ ID NO: 524428 - DNA, 20 bp, Artificial
  CRISPR gRNA sequence
tgtggggtgtgtgtatatgt

SEQ ID NO: 524429 - DNA, 20 bp, Artificial
  CRISPR gRNA sequence
ggtgtgtgtatgtgtgtgcg

SEQ ID NO: 524430 - DNA, 20 bp, Artificial
  CRISPR gRNA sequence
gtgtgtgtatgtgtgtgcga

SEQ ID NO: 524431 - DNA, 20 bp, Artificial
  CRISPR gRNA sequence
gtgtatatgaacaagtacat

SEQ ID NO: 524432 - DNA, 20 bp, Artificial
  CRISPR gRNA sequence
tgtatatgaacaagtacata

SEQ ID NO: 524433 - DNA, 20 bp, Artificial
  CRISPR gRNA sequence
tgtgtctggtgttgtgtatg

SEQ ID NO: 524434 - DNA, 20 bp, Artificial
  CRISPR gRNA sequence
gtgtctggtgttgtgtatga

SEQ ID NO: 524435 - DNA, 20 bp, Artificial
  CRISPR gRNA sequence
tgtctggtgttgtgtatgag

SEQ ID NO: 524436 - DNA, 20 bp, Artificial
  CRISPR gRNA sequence
gtgttgtgtatgagtgtgag

SEQ ID NO: 524437 - DNA, 20 bp, Artificial
  CRISPR gRNA sequence
tgtatgagtgtgaggtgtgt

SEQ ID NO: 524438 - DNA, 20 bp, Artificial
  CRISPR gRNA sequence
gtgtttgtggtgtgtgtgca

SEQ ID NO: 524439 - DNA, 20 bp, Artificial
  CRISPR gRNA sequence
gtggtgtgtgtgcatatttg

SEQ ID NO: 524440 - DNA, 20 bp, Artificial
  CRISPR gRNA sequence
tggtgtgtgtgcatatttgt

SEQ ID NO: 524441 - DNA, 20 bp, Artificial
  CRISPR gRNA sequence
gtggtgtgtttgctgtgtgt

SEQ ID NO: 524442 - DNA, 20 bp, Artificial
  CRISPR gRNA sequence
tggtgtgtttgctgtgtgtg

SEQ ID NO: 524443 - DNA, 20 bp, Artificial
  CRISPR gRNA sequence
gctgtgtgtgggtgccatgt

SEQ ID NO: 524444 - DNA, 20 bp, Artificial
  CRISPR gRNA sequence
ctgtgtgtgggtgccatgtg

SEQ ID NO: 524445 - DNA, 20 bp, Artificial
  CRISPR gRNA sequence
tgtgtgggtgccatgtgcgt

SEQ ID NO: 524446 - DNA, 20 bp, Artificial
  CRISPR gRNA sequence
cgtgtgactgtgtgtgcatg

SEQ ID NO: 524447 - DNA, 20 bp, Artificial
  CRISPR gRNA sequence
tgtgtgcatgagttatattt

SEQ ID NO: 524448 - DNA, 20 bp, Artificial
  CRISPR gRNA sequence
tatttgtgtgtgagtattgt

SEQ ID NO: 524449 - DNA, 20 bp, Artificial
  CRISPR gRNA sequence
gtgtgtgagtattgtgtgtg

SEQ ID NO: 524450 - DNA, 20 bp, Artificial
  CRISPR gRNA sequence
tgtgtgagtattgtgtgtgt

SEQ ID NO: 524451 - DNA, 20 bp, Artificial
  CRISPR gRNA sequence
tgtgtgtgcatatatgtggg

SEQ ID NO: 524452 - DNA, 20 bp, Artificial
  CRISPR gRNA sequence
tgtgtgcatgtggtgtattt

SEQ ID NO: 524453 - DNA, 20 bp, Artificial
  CRISPR gRNA sequence
atgtgtaggagtgcgtgtgt

SEQ ID NO: 524454 - DNA, 20 bp, Artificial
  CRISPR gRNA sequence
tgtgtaggagtgcgtgtgtg

SEQ ID NO: 524455 - DNA, 20 bp, Artificial
  CRISPR gRNA sequence
tgaggaggggcacataccct

SEQ ID NO: 524456 - DNA, 20 bp, Artificial
  CRISPR gRNA sequence
tctcccagggtgtggcagca

SEQ ID NO: 524457 - DNA, 20 bp, Artificial
  CRISPR gRNA sequence
ctcccagggtgtggcagcag

SEQ ID NO: 524458 - DNA, 20 bp, Artificial
  CRISPR gRNA sequence
tcccagggtgtggcagcagg

SEQ ID NO: 524459 - DNA, 20 bp, Artificial
  CRISPR gRNA sequence
ccagggtgtggcagcaggca

SEQ ID NO: 524460 - DNA, 20 bp, Artificial
  CRISPR gRNA sequence
ggggtggagtgggctctgca

SEQ ID NO: 524461 - DNA, 20 bp, Artificial
  CRISPR gRNA sequence
tgcacttgtcctgccgccca

SEQ ID NO: 524462 - DNA, 20 bp, Artificial
  CRISPR gRNA sequence
cacttgtcctgccgcccagg

SEQ ID NO: 524463 - DNA, 20 bp, Artificial
  CRISPR gRNA sequence
gtcctgccgcccaggggggc

SEQ ID NO: 524464 - DNA, 20 bp, Artificial
  CRISPR gRNA sequence
tcctgccgcccaggggggct

SEQ ID NO: 524465 - DNA, 20 bp, Artificial
  CRISPR gRNA sequence
ccgcccaggggggctgaagg

SEQ ID NO: 524466 - DNA, 20 bp, Artificial
  CRISPR gRNA sequence
aaggctggagggtggggcag

SEQ ID NO: 524467 - DNA, 20 bp, Artificial
  CRISPR gRNA sequence
gagggtggggcagaggggac

SEQ ID NO: 524468 - DNA, 20 bp, Artificial
  CRISPR gRNA sequence
cgtcaccctccctccctgct

SEQ ID NO: 524469 - DNA, 20 bp, Artificial
  CRISPR gRNA sequence
gtcaccctccctccctgctc

SEQ ID NO: 524470 - DNA, 20 bp, Artificial
  CRISPR gRNA sequence
cctccctgctcattcattaa

SEQ ID NO: 524471 - DNA, 20 bp, Artificial
  CRISPR gRNA sequence
cctgctcattcattaacatg

SEQ ID NO: 524472 - DNA, 20 bp, Artificial
  CRISPR gRNA sequence
ctcattcattaacatgatgt

SEQ ID NO: 524473 - DNA, 20 bp, Artificial
  CRISPR gRNA sequence
attcattaacatgatgtgtg

SEQ ID NO: 524474 - DNA, 20 bp, Artificial
  CRISPR gRNA sequence
attaacatgatgtgtgttta

SEQ ID NO: 524475 - DNA, 20 bp, Artificial
  CRISPR gRNA sequence
acatgatgtgtgtttatgga

SEQ ID NO: 524476 - DNA, 20 bp, Artificial
  CRISPR gRNA sequence
atggagagctgacttgtacc

SEQ ID NO: 524477 - DNA, 20 bp, Artificial
  CRISPR gRNA sequence
tggagagctgacttgtacca

SEQ ID NO: 524478 - DNA, 20 bp, Artificial
  CRISPR gRNA sequence
acttgtaccaggcacggttc

SEQ ID NO: 524479 - DNA, 20 bp, Artificial
  CRISPR gRNA sequence
gtaccaggcacggttctggg

SEQ ID NO: 524480 - DNA, 20 bp, Artificial
  CRISPR gRNA sequence
taccaggcacggttctggga

SEQ ID NO: 524481 - DNA, 20 bp, Artificial
  CRISPR gRNA sequence
tgggagccagggacacaggc

SEQ ID NO: 524482 - DNA, 20 bp, Artificial
  CRISPR gRNA sequence
ggagccagggacacaggctg

SEQ ID NO: 524483 - DNA, 20 bp, Artificial
  CRISPR gRNA sequence
gttgcggtgacaggtaaaca

SEQ ID NO: 524484 - DNA, 20 bp, Artificial
  CRISPR gRNA sequence
cggtgacaggtaaacagaca

SEQ ID NO: 524485 - DNA, 20 bp, Artificial
  CRISPR gRNA sequence
cacaaccgcacgtgtgactg

SEQ ID NO: 524486 - DNA, 20 bp, Artificial
  CRISPR gRNA sequence
agacgcgggcgagcggaagt

SEQ ID NO: 524487 - DNA, 20 bp, Artificial
  CRISPR gRNA sequence
ggatggagaaaggggcctcc

SEQ ID NO: 524488 - DNA, 20 bp, Artificial
  CRISPR gRNA sequence
ctggggacggcccgcgtggg

SEQ ID NO: 524489 - DNA, 20 bp, Artificial
  CRISPR gRNA sequence
gggacggcccgcgtgggcct

SEQ ID NO: 524490 - DNA, 20 bp, Artificial
  CRISPR gRNA sequence
gctgggaagtgccaggttcg

SEQ ID NO: 524491 - DNA, 20 bp, Artificial
  CRISPR gRNA sequence
ctgggaagtgccaggttcgt

SEQ ID NO: 524492 - DNA, 20 bp, Artificial
  CRISPR gRNA sequence
ggaagtgccaggttcgtgtg

SEQ ID NO: 524493 - DNA, 20 bp, Artificial
  CRISPR gRNA sequence
gtgtgatgcctgtctatgtg

SEQ ID NO: 524494 - DNA, 20 bp, Artificial
  CRISPR gRNA sequence
tctatgtggctgctgatgag

SEQ ID NO: 524495 - DNA, 20 bp, Artificial
  CRISPR gRNA sequence
tgtggctgctgatgagggcg

SEQ ID NO: 524496 - DNA, 20 bp, Artificial
  CRISPR gRNA sequence
ctgatgagggcgcccgtggg

SEQ ID NO: 524497 - DNA, 20 bp, Artificial
  CRISPR gRNA sequence
atgagggcgcccgtgggact

SEQ ID NO: 524498 - DNA, 20 bp, Artificial
  CRISPR gRNA sequence
caggcatggggccgggttag

SEQ ID NO: 524499 - DNA, 20 bp, Artificial
  CRISPR gRNA sequence
ggtgtgagcccaggtgagcc

SEQ ID NO: 524500 - DNA, 20 bp, Artificial
  CRISPR gRNA sequence
ccactctcaatgaaaggcgt

SEQ ID NO: 524501 - DNA, 20 bp, Artificial
  CRISPR gRNA sequence
tcaatgaaaggcgtccccaa

SEQ ID NO: 524502 - DNA, 20 bp, Artificial
  CRISPR gRNA sequence
aatgaaaggcgtccccaatg

SEQ ID NO: 524503 - DNA, 20 bp, Artificial
  CRISPR gRNA sequence
gcgtcaactctaagcacccc

SEQ ID NO: 524504 - DNA, 20 bp, Artificial
  CRISPR gRNA sequence
taagcaccccaggcgggttt

SEQ ID NO: 524505 - DNA, 20 bp, Artificial
  CRISPR gRNA sequence
agcaccccaggcgggtttca

SEQ ID NO: 524506 - DNA, 20 bp, Artificial
  CRISPR gRNA sequence
cagtgtcactgcgaggcaca

SEQ ID NO: 524507 - DNA, 20 bp, Artificial
  CRISPR gRNA sequence
agtgtcactgcgaggcacat

SEQ ID NO: 524508 - DNA, 20 bp, Artificial
  CRISPR gRNA sequence
cgaggcacatgcctgcgtcc

SEQ ID NO: 524509 - DNA, 20 bp, Artificial
  CRISPR gRNA sequence
cgtccgggagtcatgtcctt

SEQ ID NO: 524510 - DNA, 20 bp, Artificial
  CRISPR gRNA sequence
cctctgaaactccagcctgc

SEQ ID NO: 524511 - DNA, 20 bp, Artificial
  CRISPR gRNA sequence
ctctgaaactccagcctgcc

SEQ ID NO: 524512 - DNA, 20 bp, Artificial
  CRISPR gRNA sequence
tgaaactccagcctgcctgg

SEQ ID NO: 524513 - DNA, 20 bp, Artificial
  CRISPR gRNA sequence
aaactccagcctgcctggat

SEQ ID NO: 524514 - DNA, 20 bp, Artificial
  CRISPR gRNA sequence
cagcctgcctggatgtcctg

SEQ ID NO: 524515 - DNA, 20 bp, Artificial
  CRISPR gRNA sequence
cctggatgtcctgtgtctgg

SEQ ID NO: 524516 - DNA, 20 bp, Artificial
  CRISPR gRNA sequence
gatgtcctgtgtctggtcct

SEQ ID NO: 524517 - DNA, 20 bp, Artificial
  CRISPR gRNA sequence
tgtctggtcctcagctctcc

SEQ ID NO: 524518 - DNA, 20 bp, Artificial
  CRISPR gRNA sequence
gtcctcagctctcctgccag

SEQ ID NO: 524519 - DNA, 20 bp, Artificial
  CRISPR gRNA sequence
agctctcctgccaggcgggg

SEQ ID NO: 524520 - DNA, 20 bp, Artificial
  CRISPR gRNA sequence
tcctgccaggcggggagagg

SEQ ID NO: 524521 - DNA, 20 bp, Artificial
  CRISPR gRNA sequence
ctgccaggcggggagagggg

SEQ ID NO: 524522 - DNA, 20 bp, Artificial
  CRISPR gRNA sequence
ccaggcggggagaggggagg

SEQ ID NO: 524523 - DNA, 20 bp, Artificial
  CRISPR gRNA sequence
gggggctggaggagagggtg

SEQ ID NO: 524524 - DNA, 20 bp, Artificial
  CRISPR gRNA sequence
ggggctggaggagagggtgc

SEQ ID NO: 524525 - DNA, 20 bp, Artificial
  CRISPR gRNA sequence
gaggagagggtgccagtgca

SEQ ID NO: 524526 - DNA, 20 bp, Artificial
  CRISPR gRNA sequence
ggggccacacgcccccagac

SEQ ID NO: 524527 - DNA, 20 bp, Artificial
  CRISPR gRNA sequence
tgtgagatgtgaggtgtggc

SEQ ID NO: 524528 - DNA, 20 bp, Artificial
  CRISPR gRNA sequence
cttttgttctgtccccaccg

SEQ ID NO: 524529 - DNA, 20 bp, Artificial
  CRISPR gRNA sequence
ttgttctgtccccaccggca

SEQ ID NO: 524530 - DNA, 20 bp, Artificial
  CRISPR gRNA sequence
tgttctgtccccaccggcag

SEQ ID NO: 524531 - DNA, 20 bp, Artificial
  CRISPR gRNA sequence
gttctgtccccaccggcagg

SEQ ID NO: 524532 - DNA, 20 bp, Artificial
  CRISPR gRNA sequence
ttctgtccccaccggcaggc

SEQ ID NO: 524533 - DNA, 20 bp, Artificial
  CRISPR gRNA sequence
tgtccccaccggcaggccag

SEQ ID NO: 524534 - DNA, 20 bp, Artificial
  CRISPR gRNA sequence
tccccaccggcaggccaggc

SEQ ID NO: 524535 - DNA, 20 bp, Artificial
  CRISPR gRNA sequence
aacgtgaccttccggcgggc

SEQ ID NO: 524536 - DNA, 20 bp, Artificial
  CRISPR gRNA sequence
ccggcgggccaagggctacc

SEQ ID NO: 524537 - DNA, 20 bp, Artificial
  CRISPR gRNA sequence
cggcgggccaagggctaccc

SEQ ID NO: 524538 - DNA, 20 bp, Artificial
  CRISPR gRNA sequence
ccccatcgacctgtactatc

SEQ ID NO: 524539 - DNA, 20 bp, Artificial
  CRISPR gRNA sequence
tactatctgatggacctctc

SEQ ID NO: 524540 - DNA, 20 bp, Artificial
  CRISPR gRNA sequence
tctgatggacctctcctact

SEQ ID NO: 524541 - DNA, 20 bp, Artificial
  CRISPR gRNA sequence
atggacctctcctactccat

SEQ ID NO: 524542 - DNA, 20 bp, Artificial
  CRISPR gRNA sequence
tcctactccatgcttgatga

SEQ ID NO: 524543 - DNA, 20 bp, Artificial
  CRISPR gRNA sequence
ctactccatgcttgatgacc

SEQ ID NO: 524544 - DNA, 20 bp, Artificial
  CRISPR gRNA sequence
ctccatgcttgatgacctca

SEQ ID NO: 524545 - DNA, 20 bp, Artificial
  CRISPR gRNA sequence
catgcttgatgacctcagga

SEQ ID NO: 524546 - DNA, 20 bp, Artificial
  CRISPR gRNA sequence
gatgacctcaggaatgtcaa

SEQ ID NO: 524547 - DNA, 20 bp, Artificial
  CRISPR gRNA sequence
atgacctcaggaatgtcaag

SEQ ID NO: 524548 - DNA, 20 bp, Artificial
  CRISPR gRNA sequence
aggaatgtcaagaagctagg

SEQ ID NO: 524549 - DNA, 20 bp, Artificial
  CRISPR gRNA sequence
ggtggcgacctgctccgggc

SEQ ID NO: 524550 - DNA, 20 bp, Artificial
  CRISPR gRNA sequence
ctccgggccctcaacgagat

SEQ ID NO: 524551 - DNA, 20 bp, Artificial
  CRISPR gRNA sequence
cgggccctcaacgagatcac

SEQ ID NO: 524552 - DNA, 20 bp, Artificial
  CRISPR gRNA sequence
aacgagatcaccgagtccgg

SEQ ID NO: 524553 - DNA, 20 bp, Artificial
  CRISPR gRNA sequence
gtgaggcccaggcactgcag

SEQ ID NO: 524554 - DNA, 20 bp, Artificial
  CRISPR gRNA sequence
caggacaaaacccagtcctt

SEQ ID NO: 524555 - DNA, 20 bp, Artificial
  CRISPR gRNA sequence
tcccagaccctggccactcc

SEQ ID NO: 524556 - DNA, 20 bp, Artificial
  CRISPR gRNA sequence
cccagaccctggccactcct

SEQ ID NO: 524557 - DNA, 20 bp, Artificial
  CRISPR gRNA sequence
ccagaccctggccactcctg

SEQ ID NO: 524558 - DNA, 20 bp, Artificial
  CRISPR gRNA sequence
gccactcctgcctgtggccc

SEQ ID NO: 524559 - DNA, 20 bp, Artificial
  CRISPR gRNA sequence
ctgcctgtggcccacacaac

SEQ ID NO: 524560 - DNA, 20 bp, Artificial
  CRISPR gRNA sequence
cctgtggcccacacaactcc

SEQ ID NO: 524561 - DNA, 20 bp, Artificial
  CRISPR gRNA sequence
tggcccacacaactcctcgc

SEQ ID NO: 524562 - DNA, 20 bp, Artificial
  CRISPR gRNA sequence
ctcgcactcaggtccccagg

SEQ ID NO: 524563 - DNA, 20 bp, Artificial
  CRISPR gRNA sequence
gcactcaggtccccagggta

SEQ ID NO: 524564 - DNA, 20 bp, Artificial
  CRISPR gRNA sequence
aggtccccagggtagatctg

SEQ ID NO: 524565 - DNA, 20 bp, Artificial
  CRISPR gRNA sequence
ggggccccagatgcaggtcc

SEQ ID NO: 524566 - DNA, 20 bp, Artificial
  CRISPR gRNA sequence
cagtcggcctgcctccctgc

SEQ ID NO: 524567 - DNA, 20 bp, Artificial
  CRISPR gRNA sequence
cctccctgccaggggccaca

SEQ ID NO: 524568 - DNA, 20 bp, Artificial
  CRISPR gRNA sequence
cctgccaggggccacaccca

SEQ ID NO: 524569 - DNA, 20 bp, Artificial
  CRISPR gRNA sequence
ccaggggccacacccagtcc

SEQ ID NO: 524570 - DNA, 20 bp, Artificial
  CRISPR gRNA sequence
gctccccaacacttgtagac

SEQ ID NO: 524571 - DNA, 20 bp, Artificial
  CRISPR gRNA sequence
cccaacacttgtagacattg

SEQ ID NO: 524572 - DNA, 20 bp, Artificial
  CRISPR gRNA sequence
gtagacattgtccagccctc

SEQ ID NO: 524573 - DNA, 20 bp, Artificial
  CRISPR gRNA sequence
tagacattgtccagccctcc

SEQ ID NO: 524574 - DNA, 20 bp, Artificial
  CRISPR gRNA sequence
tccagccctccacttcccct

SEQ ID NO: 524575 - DNA, 20 bp, Artificial
  CRISPR gRNA sequence
cacttccccttccatcttct

SEQ ID NO: 524576 - DNA, 20 bp, Artificial
  CRISPR gRNA sequence
ccccttccatcttctacttc

SEQ ID NO: 524577 - DNA, 20 bp, Artificial
  CRISPR gRNA sequence
cccttccatcttctacttcc

SEQ ID NO: 524578 - DNA, 20 bp, Artificial
  CRISPR gRNA sequence
ccatcttctacttcctttat

SEQ ID NO: 524579 - DNA, 20 bp, Artificial
  CRISPR gRNA sequence
catcttctacttcctttatt

SEQ ID NO: 524580 - DNA, 20 bp, Artificial
  CRISPR gRNA sequence
ctacttcctttatttatttc

SEQ ID NO: 524581 - DNA, 20 bp, Artificial
  CRISPR gRNA sequence
tacttcctttatttatttct

SEQ ID NO: 524582 - DNA, 20 bp, Artificial
  CRISPR gRNA sequence
cttcctttatttatttcttg

SEQ ID NO: 524583 - DNA, 20 bp, Artificial
  CRISPR gRNA sequence
cctttatttatttcttggta

SEQ ID NO: 524584 - DNA, 20 bp, Artificial
  CRISPR gRNA sequence
ctttatttatttcttggtat

SEQ ID NO: 524585 - DNA, 20 bp, Artificial
  CRISPR gRNA sequence
tatttatttcttggtatgtt

SEQ ID NO: 524586 - DNA, 20 bp, Artificial
  CRISPR gRNA sequence
atttatttcttggtatgttt

SEQ ID NO: 524587 - DNA, 20 bp, Artificial
  CRISPR gRNA sequence
tttatttcttggtatgttta

SEQ ID NO: 524588 - DNA, 20 bp, Artificial
  CRISPR gRNA sequence
atttcttggtatgtttaaaa

SEQ ID NO: 524589 - DNA, 20 bp, Artificial
  CRISPR gRNA sequence
tttcttggtatgtttaaaag

SEQ ID NO: 524590 - DNA, 20 bp, Artificial
  CRISPR gRNA sequence
cttggtatgtttaaaagaca

SEQ ID NO: 524591 - DNA, 20 bp, Artificial
  CRISPR gRNA sequence
ttggtatgtttaaaagacaa

SEQ ID NO: 524592 - DNA, 20 bp, Artificial
  CRISPR gRNA sequence
ggtatgtttaaaagacaaaa

SEQ ID NO: 524593 - DNA, 20 bp, Artificial
  CRISPR gRNA sequence
gtatgtttaaaagacaaaat

SEQ ID NO: 524594 - DNA, 20 bp, Artificial
  CRISPR gRNA sequence
aaaagacaaaattctgacag

SEQ ID NO: 524595 - DNA, 20 bp, Artificial
  CRISPR gRNA sequence
aaagacaaaattctgacagt

SEQ ID NO: 524596 - DNA, 20 bp, Artificial
  CRISPR gRNA sequence
tgacagtgccaattattaaa

SEQ ID NO: 524597 - DNA, 20 bp, Artificial
  CRISPR gRNA sequence
acagtgccaattattaaaca

SEQ ID NO: 524598 - DNA, 20 bp, Artificial
  CRISPR gRNA sequence
ttaaacattaaagaccacaa

SEQ ID NO: 524599 - DNA, 20 bp, Artificial
  CRISPR gRNA sequence
aacattaaagaccacaacac

SEQ ID NO: 524600 - DNA, 20 bp, Artificial
  CRISPR gRNA sequence
aagaccacaacacatataga

SEQ ID NO: 524601 - DNA, 20 bp, Artificial
  CRISPR gRNA sequence
aagaaaccacacagcaagct

SEQ ID NO: 524602 - DNA, 20 bp, Artificial
  CRISPR gRNA sequence
tgctgggccaagggctccgc

SEQ ID NO: 524603 - DNA, 20 bp, Artificial
  CRISPR gRNA sequence
ctgggccaagggctccgctc

SEQ ID NO: 524604 - DNA, 20 bp, Artificial
  CRISPR gRNA sequence
ggccaagggctccgctctac

SEQ ID NO: 524605 - DNA, 20 bp, Artificial
  CRISPR gRNA sequence
cgctctacaccagcactgcc

SEQ ID NO: 524606 - DNA, 20 bp, Artificial
  CRISPR gRNA sequence
tacaccagcactgccttgcc

SEQ ID NO: 524607 - DNA, 20 bp, Artificial
  CRISPR gRNA sequence
caccagcactgccttgccac

SEQ ID NO: 524608 - DNA, 20 bp, Artificial
  CRISPR gRNA sequence
ccttgccacagagcaggtct

SEQ ID NO: 524609 - DNA, 20 bp, Artificial
  CRISPR gRNA sequence
gccacagagcaggtctccag

SEQ ID NO: 524610 - DNA, 20 bp, Artificial
  CRISPR gRNA sequence
ccacagagcaggtctccagc

SEQ ID NO: 524611 - DNA, 20 bp, Artificial
  CRISPR gRNA sequence
cagcacacgtgtgtgtcagt

SEQ ID NO: 524612 - DNA, 20 bp, Artificial
  CRISPR gRNA sequence
ccccgccggccgtggcttct

SEQ ID NO: 524613 - DNA, 20 bp, Artificial
  CRISPR gRNA sequence
cccgccggccgtggcttctc

SEQ ID NO: 524614 - DNA, 20 bp, Artificial
  CRISPR gRNA sequence
ctcacatcggcactctgcca

SEQ ID NO: 524615 - DNA, 20 bp, Artificial
  CRISPR gRNA sequence
tcacatcggcactctgccac

SEQ ID NO: 524616 - DNA, 20 bp, Artificial
  CRISPR gRNA sequence
acatcggcactctgccacct

SEQ ID NO: 524617 - DNA, 20 bp, Artificial
  CRISPR gRNA sequence
tgccaccttccctacatgcg

SEQ ID NO: 524618 - DNA, 20 bp, Artificial
  CRISPR gRNA sequence
ccaccttccctacatgcggg

SEQ ID NO: 524619 - DNA, 20 bp, Artificial
  CRISPR gRNA sequence
ccctacatgcggggatgcac

SEQ ID NO: 524620 - DNA, 20 bp, Artificial
  CRISPR gRNA sequence
cctacatgcggggatgcaca

SEQ ID NO: 524621 - DNA, 20 bp, Artificial
  CRISPR gRNA sequence
catgcggggatgcacacatg

SEQ ID NO: 524622 - DNA, 20 bp, Artificial
  CRISPR gRNA sequence
acacaaatgcacgctcacac

SEQ ID NO: 524623 - DNA, 20 bp, Artificial
  CRISPR gRNA sequence
acacacaaatgcacgctcat

SEQ ID NO: 524624 - DNA, 20 bp, Artificial
  CRISPR gRNA sequence
atgcacgtgaatgcacgctc

SEQ ID NO: 524625 - DNA, 20 bp, Artificial
  CRISPR gRNA sequence
acacacaaatgcatgttcac

SEQ ID NO: 524626 - DNA, 20 bp, Artificial
  CRISPR gRNA sequence
acacatgcaatgcacactca

SEQ ID NO: 524627 - DNA, 20 bp, Artificial
  CRISPR gRNA sequence
acacacaaatgcatgctcaa

SEQ ID NO: 524628 - DNA, 20 bp, Artificial
  CRISPR gRNA sequence
aaacgcaaatgcacgctcac

SEQ ID NO: 524629 - DNA, 20 bp, Artificial
  CRISPR gRNA sequence
acacatgcgaatgcacactc

SEQ ID NO: 524630 - DNA, 20 bp, Artificial
  CRISPR gRNA sequence
acacatgaatgtatcctcac

SEQ ID NO: 524631 - DNA, 20 bp, Artificial
  CRISPR gRNA sequence
acatgcacaaatggatgctc

SEQ ID NO: 524632 - DNA, 20 bp, Artificial
  CRISPR gRNA sequence
acacacgcgaatgcatgctc

SEQ ID NO: 524633 - DNA, 20 bp, Artificial
  CRISPR gRNA sequence
acacacaaaagcacacccaa

SEQ ID NO: 524634 - DNA, 20 bp, Artificial
  CRISPR gRNA sequence
aaatgcacacacacgtgaat

SEQ ID NO: 524635 - DNA, 20 bp, Artificial
  CRISPR gRNA sequence
acacacgtgaatgtatgctc

SEQ ID NO: 524636 - DNA, 20 bp, Artificial
  CRISPR gRNA sequence
acacacatgctcaaacacac

SEQ ID NO: 524637 - DNA, 20 bp, Artificial
  CRISPR gRNA sequence
aaacacacaaatgcatgctc

SEQ ID NO: 524638 - DNA, 20 bp, Artificial
  CRISPR gRNA sequence
tcacatgtgaatgtatgctc

SEQ ID NO: 524639 - DNA, 20 bp, Artificial
  CRISPR gRNA sequence
acatgtgaatgtatgctcac

SEQ ID NO: 524640 - DNA, 20 bp, Artificial
  CRISPR gRNA sequence
acacatgaatgtatgctcac

SEQ ID NO: 524641 - DNA, 20 bp, Artificial
  CRISPR gRNA sequence
acacgcaaatgcatgctcac

SEQ ID NO: 524642 - DNA, 20 bp, Artificial
  CRISPR gRNA sequence
acacacgcgaatgtatgctc

SEQ ID NO: 524643 - DNA, 20 bp, Artificial
  CRISPR gRNA sequence
acatgcacaaatgcacgctc

SEQ ID NO: 524644 - DNA, 20 bp, Artificial
  CRISPR gRNA sequence
acacacgtgaatgcacgctc

SEQ ID NO: 524645 - DNA, 20 bp, Artificial
  CRISPR gRNA sequence
acacacaaatgcatgctcac

SEQ ID NO: 524646 - DNA, 20 bp, Artificial
  CRISPR gRNA sequence
acacacatgaatgcatgctc

SEQ ID NO: 524647 - DNA, 20 bp, Artificial
  CRISPR gRNA sequence
acacttgcatgtgcacacac

SEQ ID NO: 524648 - DNA, 20 bp, Artificial
  CRISPR gRNA sequence
gcatgtgcacacacatgcac

SEQ ID NO: 524649 - DNA, 20 bp, Artificial
  CRISPR gRNA sequence
catgtgcacacacatgcaca

SEQ ID NO: 524650 - DNA, 20 bp, Artificial
  CRISPR gRNA sequence
acatgcacactcatgatcac

SEQ ID NO: 524651 - DNA, 20 bp, Artificial
  CRISPR gRNA sequence
atgatcacccatgtatgtct

SEQ ID NO: 524652 - DNA, 20 bp, Artificial
  CRISPR gRNA sequence
cactcacatgtataaatcgt

SEQ ID NO: 524653 - DNA, 20 bp, Artificial
  CRISPR gRNA sequence
actcacatgtataaatcgta

SEQ ID NO: 524654 - DNA, 20 bp, Artificial
  CRISPR gRNA sequence
acatgtataaatcgtacata

SEQ ID NO: 524655 - DNA, 20 bp, Artificial
  CRISPR gRNA sequence
gtcacctacgtgaactaggt

SEQ ID NO: 524656 - DNA, 20 bp, Artificial
  CRISPR gRNA sequence
cgtgaactaggtgtgtccat

SEQ ID NO: 524657 - DNA, 20 bp, Artificial
  CRISPR gRNA sequence
ggtgtgtccatacctgaaca

SEQ ID NO: 524658 - DNA, 20 bp, Artificial
  CRISPR gRNA sequence
aacatgctcacatgcataca

SEQ ID NO: 524659 - DNA, 20 bp, Artificial
  CRISPR gRNA sequence
acatgcatacaggaatacgt

SEQ ID NO: 524660 - DNA, 20 bp, Artificial
  CRISPR gRNA sequence
tgctacgcatgtacacactc

SEQ ID NO: 524661 - DNA, 20 bp, Artificial
  CRISPR gRNA sequence
cgcatgtacacactcatgtt

SEQ ID NO: 524662 - DNA, 20 bp, Artificial
  CRISPR gRNA sequence
atgtttacacatgcagatgg

SEQ ID NO: 524663 - DNA, 20 bp, Artificial
  CRISPR gRNA sequence
acacatgcagatggctgcac

SEQ ID NO: 524664 - DNA, 20 bp, Artificial
  CRISPR gRNA sequence
cacatgcagatggctgcaca

SEQ ID NO: 524665 - DNA, 20 bp, Artificial
  CRISPR gRNA sequence
cacacacagatacacatacg

SEQ ID NO: 524666 - DNA, 20 bp, Artificial
  CRISPR gRNA sequence
ttcacatgcccacatgtata

SEQ ID NO: 524667 - DNA, 20 bp, Artificial
  CRISPR gRNA sequence
acatgcccacatgtatacct

SEQ ID NO: 524668 - DNA, 20 bp, Artificial
  CRISPR gRNA sequence
gtcacacacatacatgcagg

SEQ ID NO: 524669 - DNA, 20 bp, Artificial
  CRISPR gRNA sequence
atgctcatccatgtacattg

SEQ ID NO: 524670 - DNA, 20 bp, Artificial
  CRISPR gRNA sequence
tgctcatccatgtacattgc

SEQ ID NO: 524671 - DNA, 20 bp, Artificial
  CRISPR gRNA sequence
atccatgtacattgcacact

SEQ ID NO: 524672 - DNA, 20 bp, Artificial
  CRISPR gRNA sequence
cacactcccaggttcacaca

SEQ ID NO: 524673 - DNA, 20 bp, Artificial
  CRISPR gRNA sequence
ccaggttcacacacacgccc

SEQ ID NO: 524674 - DNA, 20 bp, Artificial
  CRISPR gRNA sequence
acacacacgcccacatacgt

SEQ ID NO: 524675 - DNA, 20 bp, Artificial
  CRISPR gRNA sequence
acatgtgtgcttgcacaacg

SEQ ID NO: 524676 - DNA, 20 bp, Artificial
  CRISPR gRNA sequence
gcacaacgcacatgctcaca

SEQ ID NO: 524677 - DNA, 20 bp, Artificial
  CRISPR gRNA sequence
cacaacgcacatgctcacac

SEQ ID NO: 524678 - DNA, 20 bp, Artificial
  CRISPR gRNA sequence
acacacacactccacatgtg

SEQ ID NO: 524679 - DNA, 20 bp, Artificial
  CRISPR gRNA sequence
cacatgtgccatcttgcttt

SEQ ID NO: 524680 - DNA, 20 bp, Artificial
  CRISPR gRNA sequence
gctttctccacctccctgct

SEQ ID NO: 524681 - DNA, 20 bp, Artificial
  CRISPR gRNA sequence
ctttctccacctccctgcta

SEQ ID NO: 524682 - DNA, 20 bp, Artificial
  CRISPR gRNA sequence
tctccacctccctgctagga

SEQ ID NO: 524683 - DNA, 20 bp, Artificial
  CRISPR gRNA sequence
ctccacctccctgctaggag

SEQ ID NO: 524684 - DNA, 20 bp, Artificial
  CRISPR gRNA sequence
tccacctccctgctaggaga

SEQ ID NO: 524685 - DNA, 20 bp, Artificial
  CRISPR gRNA sequence
cacctccctgctaggagaga

SEQ ID NO: 524686 - DNA, 20 bp, Artificial
  CRISPR gRNA sequence
cctgctaggagagaggaaac

SEQ ID NO: 524687 - DNA, 20 bp, Artificial
  CRISPR gRNA sequence
ctaggagagaggaaacaggc

SEQ ID NO: 524688 - DNA, 20 bp, Artificial
  CRISPR gRNA sequence
ggagagaggaaacaggcttg

SEQ ID NO: 524689 - DNA, 20 bp, Artificial
  CRISPR gRNA sequence
gccctcgtgcccctttgaag

SEQ ID NO: 524690 - DNA, 20 bp, Artificial
  CRISPR gRNA sequence
ccctcgtgcccctttgaagc

SEQ ID NO: 524691 - DNA, 20 bp, Artificial
  CRISPR gRNA sequence
gtgcccctttgaagctggcc

SEQ ID NO: 524692 - DNA, 20 bp, Artificial
  CRISPR gRNA sequence
tgaagctggccctcccacct

SEQ ID NO: 524693 - DNA, 20 bp, Artificial
  CRISPR gRNA sequence
gaagctggccctcccacctg

SEQ ID NO: 524694 - DNA, 20 bp, Artificial
  CRISPR gRNA sequence
aagctggccctcccacctgg

SEQ ID NO: 524695 - DNA, 20 bp, Artificial
  CRISPR gRNA sequence
gccctcccacctgggcccag

SEQ ID NO: 524696 - DNA, 20 bp, Artificial
  CRISPR gRNA sequence
ccacctgggcccagcctgcc

SEQ ID NO: 524697 - DNA, 20 bp, Artificial
  CRISPR gRNA sequence
ggcccagcctgccacctccc

SEQ ID NO: 524698 - DNA, 20 bp, Artificial
  CRISPR gRNA sequence
ccacctccccagcccctcca

SEQ ID NO: 524699 - DNA, 20 bp, Artificial
  CRISPR gRNA sequence
cccagcccctccatgtgccc

SEQ ID NO: 524700 - DNA, 20 bp, Artificial
  CRISPR gRNA sequence
catgtgccctgcaggcttcg

SEQ ID NO: 524701 - DNA, 20 bp, Artificial
  CRISPR gRNA sequence
caggcttcgggtccttcgtg

SEQ ID NO: 524702 - DNA, 20 bp, Artificial
  CRISPR gRNA sequence
cgggtccttcgtggacaaga

SEQ ID NO: 524703 - DNA, 20 bp, Artificial
  CRISPR gRNA sequence
gggtccttcgtggacaagac

SEQ ID NO: 524704 - DNA, 20 bp, Artificial
  CRISPR gRNA sequence
cgtggacaagaccgtgctgc

SEQ ID NO: 524705 - DNA, 20 bp, Artificial
  CRISPR gRNA sequence
gtggacaagaccgtgctgcc

SEQ ID NO: 524706 - DNA, 20 bp, Artificial
  CRISPR gRNA sequence
ccgttcgtgaacacgcaccc

SEQ ID NO: 524707 - DNA, 20 bp, Artificial
  CRISPR gRNA sequence
gtgaacacgcaccctgataa

SEQ ID NO: 524708 - DNA, 20 bp, Artificial
  CRISPR gRNA sequence
ataagctgcgaaacccatgc

SEQ ID NO: 524709 - DNA, 20 bp, Artificial
  CRISPR gRNA sequence
cgaaacccatgccccaacaa

SEQ ID NO: 524710 - DNA, 20 bp, Artificial
  CRISPR gRNA sequence
gccttcaggcacgtgctgaa

SEQ ID NO: 524711 - DNA, 20 bp, Artificial
  CRISPR gRNA sequence
ccttcaggcacgtgctgaag

SEQ ID NO: 524712 - DNA, 20 bp, Artificial
  CRISPR gRNA sequence
caggcacgtgctgaagctga

SEQ ID NO: 524713 - DNA, 20 bp, Artificial
  CRISPR gRNA sequence
aggcacgtgctgaagctgac

SEQ ID NO: 524714 - DNA, 20 bp, Artificial
  CRISPR gRNA sequence
aagctgaccaacaactccaa

SEQ ID NO: 524715 - DNA, 20 bp, Artificial
  CRISPR gRNA sequence
accaacaactccaaccagtt

SEQ ID NO: 524716 - DNA, 20 bp, Artificial
  CRISPR gRNA sequence
caaccagtttcagaccgagg

SEQ ID NO: 524717 - DNA, 20 bp, Artificial
  CRISPR gRNA sequence
cagaccgaggtcgggaagca

SEQ ID NO: 524718 - DNA, 20 bp, Artificial
  CRISPR gRNA sequence
agaccgaggtcgggaagcag

SEQ ID NO: 524719 - DNA, 20 bp, Artificial
  CRISPR gRNA sequence
atttccggaaacctggatgc

SEQ ID NO: 524720 - DNA, 20 bp, Artificial
  CRISPR gRNA sequence
ccggaaacctggatgcaccc

SEQ ID NO: 524721 - DNA, 20 bp, Artificial
  CRISPR gRNA sequence
cggaaacctggatgcacccg

SEQ ID NO: 524722 - DNA, 20 bp, Artificial
  CRISPR gRNA sequence
gatgcacccgagggtgggct

SEQ ID NO: 524723 - DNA, 20 bp, Artificial
  CRISPR gRNA sequence
gacgccatgatgcaggtcgc

SEQ ID NO: 524724 - DNA, 20 bp, Artificial
  CRISPR gRNA sequence
cccggtgaggccgctgcccc

SEQ ID NO: 524725 - DNA, 20 bp, Artificial
  CRISPR gRNA sequence
cccctgcttgggtccccacg

SEQ ID NO: 524726 - DNA, 20 bp, Artificial
  CRISPR gRNA sequence
cttgggtccccacgttcccc

SEQ ID NO: 524727 - DNA, 20 bp, Artificial
  CRISPR gRNA sequence
gggtccccacgttcccccag

SEQ ID NO: 524728 - DNA, 20 bp, Artificial
  CRISPR gRNA sequence
ggtccccacgttcccccagt

SEQ ID NO: 524729 - DNA, 20 bp, Artificial
  CRISPR gRNA sequence
ccccagtgtggggggctctg

SEQ ID NO: 524730 - DNA, 20 bp, Artificial
  CRISPR gRNA sequence
tgtcaggcgctgtgtggggg

SEQ ID NO: 524731 - DNA, 20 bp, Artificial
  CRISPR gRNA sequence
tcaggcgctgtgtgggggca

SEQ ID NO: 524732 - DNA, 20 bp, Artificial
  CRISPR gRNA sequence
tgtgggggcaggggggtacc

SEQ ID NO: 524733 - DNA, 20 bp, Artificial
  CRISPR gRNA sequence
gccggcaggtcgtctgaggg

SEQ ID NO: 524734 - DNA, 20 bp, Artificial
  CRISPR gRNA sequence
agggactccagcctgggcct

SEQ ID NO: 524735 - DNA, 20 bp, Artificial
  CRISPR gRNA sequence
cagcctgggcctggggagag

SEQ ID NO: 524736 - DNA, 20 bp, Artificial
  CRISPR gRNA sequence
ggcctggggagagcagctcc

SEQ ID NO: 524737 - DNA, 20 bp, Artificial
  CRISPR gRNA sequence
gggagagcagctcctcaccc

SEQ ID NO: 524738 - DNA, 20 bp, Artificial
  CRISPR gRNA sequence
ctcaccctgctgctgcccat

SEQ ID NO: 524739 - DNA, 20 bp, Artificial
  CRISPR gRNA sequence
accctgctgctgcccatgca

SEQ ID NO: 524740 - DNA, 20 bp, Artificial
  CRISPR gRNA sequence
ctgctgcccatgcaggaaag

SEQ ID NO: 524741 - DNA, 20 bp, Artificial
  CRISPR gRNA sequence
ctgcccatgcaggaaagggc

SEQ ID NO: 524742 - DNA, 20 bp, Artificial
  CRISPR gRNA sequence
cccatgcaggaaagggcagg

SEQ ID NO: 524743 - DNA, 20 bp, Artificial
  CRISPR gRNA sequence
gaaaatcatgcgctgatttc

SEQ ID NO: 524744 - DNA, 20 bp, Artificial
  CRISPR gRNA sequence
atttcattgtttgctgtgag

SEQ ID NO: 524745 - DNA, 20 bp, Artificial
  CRISPR gRNA sequence
cattgtttgctgtgagttaa

SEQ ID NO: 524746 - DNA, 20 bp, Artificial
  CRISPR gRNA sequence
attgtttgctgtgagttaaa

SEQ ID NO: 524747 - DNA, 20 bp, Artificial
  CRISPR gRNA sequence
tttgctgtgagttaaatttg

SEQ ID NO: 524748 - DNA, 20 bp, Artificial
  CRISPR gRNA sequence
gctgtgagttaaatttgtga

SEQ ID NO: 524749 - DNA, 20 bp, Artificial
  CRISPR gRNA sequence
ctgtgagttaaatttgtgac

SEQ ID NO: 524750 - DNA, 20 bp, Artificial
  CRISPR gRNA sequence
tgagttaaatttgtgaccct

SEQ ID NO: 524751 - DNA, 20 bp, Artificial
  CRISPR gRNA sequence
aatttgtgaccctgggcaaa

SEQ ID NO: 524752 - DNA, 20 bp, Artificial
  CRISPR gRNA sequence
gtgaccctgggcaaacctta

SEQ ID NO: 524753 - DNA, 20 bp, Artificial
  CRISPR gRNA sequence
tgaccctgggcaaaccttat

SEQ ID NO: 524754 - DNA, 20 bp, Artificial
  CRISPR gRNA sequence
ggcaaaccttatgaagccta

SEQ ID NO: 524755 - DNA, 20 bp, Artificial
  CRISPR gRNA sequence
atgaagcctaaacattttgc

SEQ ID NO: 524756 - DNA, 20 bp, Artificial
  CRISPR gRNA sequence
tgaagcctaaacattttgcg

SEQ ID NO: 524757 - DNA, 20 bp, Artificial
  CRISPR gRNA sequence
aacattttgcgagcggccaa

SEQ ID NO: 524758 - DNA, 20 bp, Artificial
  CRISPR gRNA sequence
tgcgagcggccaagggtgga

SEQ ID NO: 524759 - DNA, 20 bp, Artificial
  CRISPR gRNA sequence
gcgagcggccaagggtggaa

SEQ ID NO: 524760 - DNA, 20 bp, Artificial
  CRISPR gRNA sequence
cgagcggccaagggtggaac

SEQ ID NO: 524761 - DNA, 20 bp, Artificial
  CRISPR gRNA sequence
ggcagcaggtcccgtggttc

SEQ ID NO: 524762 - DNA, 20 bp, Artificial
  CRISPR gRNA sequence
ctggggtggaaccaccctcc

SEQ ID NO: 524763 - DNA, 20 bp, Artificial
  CRISPR gRNA sequence
gggtggaaccaccctcctcc

SEQ ID NO: 524764 - DNA, 20 bp, Artificial
  CRISPR gRNA sequence
ctccctccaggccgggtggg

SEQ ID NO: 524765 - DNA, 20 bp, Artificial
  CRISPR gRNA sequence
cctccaggccgggtgggcgc

SEQ ID NO: 524766 - DNA, 20 bp, Artificial
  CRISPR gRNA sequence
caggccgggtgggcgctggc

SEQ ID NO: 524767 - DNA, 20 bp, Artificial
  CRISPR gRNA sequence
gctgcccagtgtgtgtcgct

SEQ ID NO: 524768 - DNA, 20 bp, Artificial
  CRISPR gRNA sequence
cccagtgtgtgtcgctctcc

SEQ ID NO: 524769 - DNA, 20 bp, Artificial
  CRISPR gRNA sequence
tccacgtcccgcccacccag

SEQ ID NO: 524770 - DNA, 20 bp, Artificial
  CRISPR gRNA sequence
cacgtcccgcccacccagtt

SEQ ID NO: 524771 - DNA, 20 bp, Artificial
  CRISPR gRNA sequence
gtgactgtcagcctaacaga

SEQ ID NO: 524772 - DNA, 20 bp, Artificial
  CRISPR gRNA sequence
tgactgtcagcctaacagag

SEQ ID NO: 524773 - DNA, 20 bp, Artificial
  CRISPR gRNA sequence
tcagcctaacagagcagcca

SEQ ID NO: 524774 - DNA, 20 bp, Artificial
  CRISPR gRNA sequence
acagagcagccacagtccct

SEQ ID NO: 524775 - DNA, 20 bp, Artificial
  CRISPR gRNA sequence
ggccatgttgaggccacatg

SEQ ID NO: 524776 - DNA, 20 bp, Artificial
  CRISPR gRNA sequence
aggccacatgcactgtcctc

SEQ ID NO: 524777 - DNA, 20 bp, Artificial
  CRISPR gRNA sequence
tcctcccctcacaacccacc

SEQ ID NO: 524778 - DNA, 20 bp, Artificial
  CRISPR gRNA sequence
ccctcacaacccaccttagc

SEQ ID NO: 524779 - DNA, 20 bp, Artificial
  CRISPR gRNA sequence
acaacccaccttagctctcc

SEQ ID NO: 524780 - DNA, 20 bp, Artificial
  CRISPR gRNA sequence
agctctcctgcttccctgca

SEQ ID NO: 524781 - DNA, 20 bp, Artificial
  CRISPR gRNA sequence
gctctcctgcttccctgcag

SEQ ID NO: 524782 - DNA, 20 bp, Artificial
  CRISPR gRNA sequence
tcctgcttccctgcagtccc

SEQ ID NO: 524783 - DNA, 20 bp, Artificial
  CRISPR gRNA sequence
ctgcttccctgcagtcccag

SEQ ID NO: 524784 - DNA, 20 bp, Artificial
  CRISPR gRNA sequence
cttccctgcagtcccagcgc

SEQ ID NO: 524785 - DNA, 20 bp, Artificial
  CRISPR gRNA sequence
ccctgcagtcccagcgcaga

SEQ ID NO: 524786 - DNA, 20 bp, Artificial
  CRISPR gRNA sequence
cctgcagtcccagcgcagac

SEQ ID NO: 524787 - DNA, 20 bp, Artificial
  CRISPR gRNA sequence
cagtcccagcgcagacacac

SEQ ID NO: 524788 - DNA, 20 bp, Artificial
  CRISPR gRNA sequence
ctcacgagtgtgaggtcaca

SEQ ID NO: 524789 - DNA, 20 bp, Artificial
  CRISPR gRNA sequence
acgagtgtgaggtcacagcc

SEQ ID NO: 524790 - DNA, 20 bp, Artificial
  CRISPR gRNA sequence
ggacacgcacggcccccaca

SEQ ID NO: 524791 - DNA, 20 bp, Artificial
  CRISPR gRNA sequence
ccaggggctgtcaatggtgg

SEQ ID NO: 524792 - DNA, 20 bp, Artificial
  CRISPR gRNA sequence
tcaatggtggactcaaggcc

SEQ ID NO: 524793 - DNA, 20 bp, Artificial
  CRISPR gRNA sequence
aaggcctgctgggcccctca

SEQ ID NO: 524794 - DNA, 20 bp, Artificial
  CRISPR gRNA sequence
ctgggcccctcaggctcgtt

SEQ ID NO: 524795 - DNA, 20 bp, Artificial
  CRISPR gRNA sequence
ggcccctcaggctcgttttc

SEQ ID NO: 524796 - DNA, 20 bp, Artificial
  CRISPR gRNA sequence
aggctcgttttcctccatgt

SEQ ID NO: 524797 - DNA, 20 bp, Artificial
  CRISPR gRNA sequence
gttttcctccatgttgcact

SEQ ID NO: 524798 - DNA, 20 bp, Artificial
  CRISPR gRNA sequence
tcctccatgttgcactcgtt

SEQ ID NO: 524799 - DNA, 20 bp, Artificial
  CRISPR gRNA sequence
cctccatgttgcactcgttc

SEQ ID NO: 524800 - DNA, 20 bp, Artificial
  CRISPR gRNA sequence
ctccatgttgcactcgttct

SEQ ID NO: 524801 - DNA, 20 bp, Artificial
  CRISPR gRNA sequence
catgttgcactcgttctgcg

SEQ ID NO: 524802 - DNA, 20 bp, Artificial
  CRISPR gRNA sequence
cactcgttctgcgtgtggcc

SEQ ID NO: 524803 - DNA, 20 bp, Artificial
  CRISPR gRNA sequence
gttctgcgtgtggcccacac

SEQ ID NO: 524804 - DNA, 20 bp, Artificial
  CRISPR gRNA sequence
tgcgtgtggcccacacgtct

SEQ ID NO: 524805 - DNA, 20 bp, Artificial
  CRISPR gRNA sequence
cgtgtggcccacacgtctgc

SEQ ID NO: 524806 - DNA, 20 bp, Artificial
  CRISPR gRNA sequence
cgagggtttttccccttggg

SEQ ID NO: 524807 - DNA, 20 bp, Artificial
  CRISPR gRNA sequence
ttccccttggggatggtttc

SEQ ID NO: 524808 - DNA, 20 bp, Artificial
  CRISPR gRNA sequence
tccccttggggatggtttcc

SEQ ID NO: 524809 - DNA, 20 bp, Artificial
  CRISPR gRNA sequence
ccccttggggatggtttcct

SEQ ID NO: 524810 - DNA, 20 bp, Artificial
  CRISPR gRNA sequence
cccttggggatggtttcctg

SEQ ID NO: 524811 - DNA, 20 bp, Artificial
  CRISPR gRNA sequence
ggggatggtttcctgagggt

SEQ ID NO: 524812 - DNA, 20 bp, Artificial
  CRISPR gRNA sequence
gggatggtttcctgagggtt

SEQ ID NO: 524813 - DNA, 20 bp, Artificial
  CRISPR gRNA sequence
cctgagggtttgttcccagc

SEQ ID NO: 524814 - DNA, 20 bp, Artificial
  CRISPR gRNA sequence
ctgagggtttgttcccagct

SEQ ID NO: 524815 - DNA, 20 bp, Artificial
  CRISPR gRNA sequence
agggtttgttcccagctctg

SEQ ID NO: 524816 - DNA, 20 bp, Artificial
  CRISPR gRNA sequence
gttcccagctctgaagtgca

SEQ ID NO: 524817 - DNA, 20 bp, Artificial
  CRISPR gRNA sequence
ttcccagctctgaagtgcag

SEQ ID NO: 524818 - DNA, 20 bp, Artificial
  CRISPR gRNA sequence
ccagctctgaagtgcaggga

SEQ ID NO: 524819 - DNA, 20 bp, Artificial
  CRISPR gRNA sequence
tgaagtgcagggaccgcagc

SEQ ID NO: 524820 - DNA, 20 bp, Artificial
  CRISPR gRNA sequence
aagtgcagggaccgcagccg

SEQ ID NO: 524821 - DNA, 20 bp, Artificial
  CRISPR gRNA sequence
tctccttgcctttccacacg

SEQ ID NO: 524822 - DNA, 20 bp, Artificial
  CRISPR gRNA sequence
tccttgcctttccacacgtg

SEQ ID NO: 524823 - DNA, 20 bp, Artificial
  CRISPR gRNA sequence
cttgcctttccacacgtgcc

SEQ ID NO: 524824 - DNA, 20 bp, Artificial
  CRISPR gRNA sequence
gcctttccacacgtgcctcc

SEQ ID NO: 524825 - DNA, 20 bp, Artificial
  CRISPR gRNA sequence
cctttccacacgtgcctcca

SEQ ID NO: 524826 - DNA, 20 bp, Artificial
  CRISPR gRNA sequence
tccacacgtgcctccactcc

SEQ ID NO: 524827 - DNA, 20 bp, Artificial
  CRISPR gRNA sequence
ccacacgtgcctccactccc

SEQ ID NO: 524828 - DNA, 20 bp, Artificial
  CRISPR gRNA sequence
cacacgtgcctccactccct

SEQ ID NO: 524829 - DNA, 20 bp, Artificial
  CRISPR gRNA sequence
cactccctgcgcctcacatg

SEQ ID NO: 524830 - DNA, 20 bp, Artificial
  CRISPR gRNA sequence
cctgcgcctcacatgtgcac

SEQ ID NO: 524831 - DNA, 20 bp, Artificial
  CRISPR gRNA sequence
cgcctcacatgtgcacgggg

SEQ ID NO: 524832 - DNA, 20 bp, Artificial
  CRISPR gRNA sequence
acatgtgcacggggtgtttg

SEQ ID NO: 524833 - DNA, 20 bp, Artificial
  CRISPR gRNA sequence
gagggccgttgtctcctcct

SEQ ID NO: 524834 - DNA, 20 bp, Artificial
  CRISPR gRNA sequence
agggccgttgtctcctcctg

SEQ ID NO: 524835 - DNA, 20 bp, Artificial
  CRISPR gRNA sequence
tctcctcctgggcgtggcgt

SEQ ID NO: 524836 - DNA, 20 bp, Artificial
  CRISPR gRNA sequence
ctcctgggcgtggcgtctgg

SEQ ID NO: 524837 - DNA, 20 bp, Artificial
  CRISPR gRNA sequence
ctgggcgtggcgtctggggg

SEQ ID NO: 524838 - DNA, 20 bp, Artificial
  CRISPR gRNA sequence
ggcgtggcgtctgggggaac

SEQ ID NO: 524839 - DNA, 20 bp, Artificial
  CRISPR gRNA sequence
ggggaacacagctgggtccc

SEQ ID NO: 524840 - DNA, 20 bp, Artificial
  CRISPR gRNA sequence
ggtccctgagacccagggga

SEQ ID NO: 524841 - DNA, 20 bp, Artificial
  CRISPR gRNA sequence
agacccaggggaaaggggga

SEQ ID NO: 524842 - DNA, 20 bp, Artificial
  CRISPR gRNA sequence
cgggccaccccaccagctct

SEQ ID NO: 524843 - DNA, 20 bp, Artificial
  CRISPR gRNA sequence
tgcatcgtctcctctgctcc

SEQ ID NO: 524844 - DNA, 20 bp, Artificial
  CRISPR gRNA sequence
catcgtctcctctgctccag

SEQ ID NO: 524845 - DNA, 20 bp, Artificial
  CRISPR gRNA sequence
ctctgctccagagggccggg

SEQ ID NO: 524846 - DNA, 20 bp, Artificial
  CRISPR gRNA sequence
tgctccagagggccgggtct

SEQ ID NO: 524847 - DNA, 20 bp, Artificial
  CRISPR gRNA sequence
ctccagagggccgggtctgg

SEQ ID NO: 524848 - DNA, 20 bp, Artificial
  CRISPR gRNA sequence
cagagggccgggtctgggaa

SEQ ID NO: 524849 - DNA, 20 bp, Artificial
  CRISPR gRNA sequence
ggaaactgaggcaggtaacc

SEQ ID NO: 524850 - DNA, 20 bp, Artificial
  CRISPR gRNA sequence
aggcaggtaaccctgccccc

SEQ ID NO: 524851 - DNA, 20 bp, Artificial
  CRISPR gRNA sequence
ccccccacgccttcttctca

SEQ ID NO: 524852 - DNA, 20 bp, Artificial
  CRISPR gRNA sequence
cttctcaggaggaaatcggc

SEQ ID NO: 524853 - DNA, 20 bp, Artificial
  CRISPR gRNA sequence
ttctcaggaggaaatcggct

SEQ ID NO: 524854 - DNA, 20 bp, Artificial
  CRISPR gRNA sequence
ctcaggaggaaatcggctgg

SEQ ID NO: 524855 - DNA, 20 bp, Artificial
  CRISPR gRNA sequence
tcaggaggaaatcggctggc

SEQ ID NO: 524856 - DNA, 20 bp, Artificial
  CRISPR gRNA sequence
aggaggaaatcggctggcgc

SEQ ID NO: 524857 - DNA, 20 bp, Artificial
  CRISPR gRNA sequence
gcgcaacgtcacgcggctgc

SEQ ID NO: 524858 - DNA, 20 bp, Artificial
  CRISPR gRNA sequence
ctggtgtttgccactgatga

SEQ ID NO: 524859 - DNA, 20 bp, Artificial
  CRISPR gRNA sequence
gtgtttgccactgatgacgg

SEQ ID NO: 524860 - DNA, 20 bp, Artificial
  CRISPR gRNA sequence
gccactgatgacggcttcca

SEQ ID NO: 524861 - DNA, 20 bp, Artificial
  CRISPR gRNA sequence
ccactgatgacggcttccat

SEQ ID NO: 524862 - DNA, 20 bp, Artificial
  CRISPR gRNA sequence
atgacggcttccatttcgcg

SEQ ID NO: 524863 - DNA, 20 bp, Artificial
  CRISPR gRNA sequence
ccatttcgcgggcgacggga

SEQ ID NO: 524864 - DNA, 20 bp, Artificial
  CRISPR gRNA sequence
catttcgcgggcgacgggaa

SEQ ID NO: 524865 - DNA, 20 bp, Artificial
  CRISPR gRNA sequence
cgcgggcgacgggaagctgg

SEQ ID NO: 524866 - DNA, 20 bp, Artificial
  CRISPR gRNA sequence
gcgggcgacgggaagctggg

SEQ ID NO: 524867 - DNA, 20 bp, Artificial
  CRISPR gRNA sequence
ggcgccatcctgacccccaa

SEQ ID NO: 524868 - DNA, 20 bp, Artificial
  CRISPR gRNA sequence
acccccaacgacggccgctg

SEQ ID NO: 524869 - DNA, 20 bp, Artificial
  CRISPR gRNA sequence
tcacctggaggacaacttgt

SEQ ID NO: 524870 - DNA, 20 bp, Artificial
  CRISPR gRNA sequence
gaggacaacttgtacaagag

SEQ ID NO: 524871 - DNA, 20 bp, Artificial
  CRISPR gRNA sequence
gtacaagaggagcaacgaat

SEQ ID NO: 524872 - DNA, 20 bp, Artificial
  CRISPR gRNA sequence
tacaagaggagcaacgaatt

SEQ ID NO: 524873 - DNA, 20 bp, Artificial
  CRISPR gRNA sequence
gtaagtccccaccccaggca

SEQ ID NO: 524874 - DNA, 20 bp, Artificial
  CRISPR gRNA sequence
gcaggacaccactgacggag

SEQ ID NO: 524875 - DNA, 20 bp, Artificial
  CRISPR gRNA sequence
acggaggagacaagggtggg

SEQ ID NO: 524876 - DNA, 20 bp, Artificial
  CRISPR gRNA sequence
cacctgacagagcctccttc

SEQ ID NO: 524877 - DNA, 20 bp, Artificial
  CRISPR gRNA sequence
acagagcctccttctgaccc

SEQ ID NO: 524878 - DNA, 20 bp, Artificial
  CRISPR gRNA sequence
cttctgacccaaggagcaga

SEQ ID NO: 524879 - DNA, 20 bp, Artificial
  CRISPR gRNA sequence
ctgacccaaggagcagattc

SEQ ID NO: 524880 - DNA, 20 bp, Artificial
  CRISPR gRNA sequence
tgacccaaggagcagattcc

SEQ ID NO: 524881 - DNA, 20 bp, Artificial
  CRISPR gRNA sequence
acccaaggagcagattcctg

SEQ ID NO: 524882 - DNA, 20 bp, Artificial
  CRISPR gRNA sequence
ctgaggaaacttctggaagc

SEQ ID NO: 524883 - DNA, 20 bp, Artificial
  CRISPR gRNA sequence
aggaaacttctggaagcccc

SEQ ID NO: 524884 - DNA, 20 bp, Artificial
  CRISPR gRNA sequence
ctggaagccccaagtggcag

SEQ ID NO: 524885 - DNA, 20 bp, Artificial
  CRISPR gRNA sequence
tggaagccccaagtggcagc

SEQ ID NO: 524886 - DNA, 20 bp, Artificial
  CRISPR gRNA sequence
gaagccccaagtggcagcgt

SEQ ID NO: 524887 - DNA, 20 bp, Artificial
  CRISPR gRNA sequence
cccggactggcctcaggcca

SEQ ID NO: 524888 - DNA, 20 bp, Artificial
  CRISPR gRNA sequence
gcctcaggccaggggagggt

SEQ ID NO: 524889 - DNA, 20 bp, Artificial
  CRISPR gRNA sequence
aggccaggggagggtagggt

SEQ ID NO: 524890 - DNA, 20 bp, Artificial
  CRISPR gRNA sequence
gtgggggcagccaggctgag

SEQ ID NO: 524891 - DNA, 20 bp, Artificial
  CRISPR gRNA sequence
aggcccggcctcgcccttgt

SEQ ID NO: 524892 - DNA, 20 bp, Artificial
  CRISPR gRNA sequence
gcccttgtgggacacccagg

SEQ ID NO: 524893 - DNA, 20 bp, Artificial
  CRISPR gRNA sequence
gtgggacacccaggctctgt

SEQ ID NO: 524894 - DNA, 20 bp, Artificial
  CRISPR gRNA sequence
tgggacacccaggctctgtt

SEQ ID NO: 524895 - DNA, 20 bp, Artificial
  CRISPR gRNA sequence
tgttggtctccagccccact

SEQ ID NO: 524896 - DNA, 20 bp, Artificial
  CRISPR gRNA sequence
ttggtctccagccccactgc

SEQ ID NO: 524897 - DNA, 20 bp, Artificial
  CRISPR gRNA sequence
gtctccagccccactgcccc

SEQ ID NO: 524898 - DNA, 20 bp, Artificial
  CRISPR gRNA sequence
cagccccactgcccccctac

SEQ ID NO: 524899 - DNA, 20 bp, Artificial
  CRISPR gRNA sequence
cccccctacctgggctgaca

SEQ ID NO: 524900 - DNA, 20 bp, Artificial
  CRISPR gRNA sequence
cctgggctgacagctgctgt

SEQ ID NO: 524901 - DNA, 20 bp, Artificial
  CRISPR gRNA sequence
ggctgacagctgctgtggag

SEQ ID NO: 524902 - DNA, 20 bp, Artificial
  CRISPR gRNA sequence
acagctgctgtggaggtata

SEQ ID NO: 524903 - DNA, 20 bp, Artificial
  CRISPR gRNA sequence
ctgtggaggtatagtaaccg

SEQ ID NO: 524904 - DNA, 20 bp, Artificial
  CRISPR gRNA sequence
tggaggtatagtaaccgccc

SEQ ID NO: 524905 - DNA, 20 bp, Artificial
  CRISPR gRNA sequence
cggctgcaccctgccgtccc

SEQ ID NO: 524906 - DNA, 20 bp, Artificial
  CRISPR gRNA sequence
caccctgccgtccccgcctc

SEQ ID NO: 524907 - DNA, 20 bp, Artificial
  CRISPR gRNA sequence
ccgtccccgcctctggccag

SEQ ID NO: 524908 - DNA, 20 bp, Artificial
  CRISPR gRNA sequence
tggccagggtcccatcccca

SEQ ID NO: 524909 - DNA, 20 bp, Artificial
  CRISPR gRNA sequence
gccagggtcccatccccaag

SEQ ID NO: 524910 - DNA, 20 bp, Artificial
  CRISPR gRNA sequence
ctccccctcccggcctccac

SEQ ID NO: 524911 - DNA, 20 bp, Artificial
  CRISPR gRNA sequence
cccctcccggcctccactgt

SEQ ID NO: 524912 - DNA, 20 bp, Artificial
  CRISPR gRNA sequence
ccggcctccactgtacgttc

SEQ ID NO: 524913 - DNA, 20 bp, Artificial
  CRISPR gRNA sequence
cactgtacgttccctgctgc

SEQ ID NO: 524914 - DNA, 20 bp, Artificial
  CRISPR gRNA sequence
tacgttccctgctgcccctg

SEQ ID NO: 524915 - DNA, 20 bp, Artificial
  CRISPR gRNA sequence
cctgctgcccctgagtccgc

SEQ ID NO: 524916 - DNA, 20 bp, Artificial
  CRISPR gRNA sequence
ctgcccctgagtccgcctcc

SEQ ID NO: 524917 - DNA, 20 bp, Artificial
  CRISPR gRNA sequence
cccctgagtccgcctcctcc

SEQ ID NO: 524918 - DNA, 20 bp, Artificial
  CRISPR gRNA sequence
agtccgcctcctccagtgtg

SEQ ID NO: 524919 - DNA, 20 bp, Artificial
  CRISPR gRNA sequence
ctccagtgtggcccctccct

SEQ ID NO: 524920 - DNA, 20 bp, Artificial
  CRISPR gRNA sequence
cagtgtggcccctccctgcc

SEQ ID NO: 524921 - DNA, 20 bp, Artificial
  CRISPR gRNA sequence
cctgcccccattgcctgagc

SEQ ID NO: 524922 - DNA, 20 bp, Artificial
  CRISPR gRNA sequence
cccccattgcctgagctggg

SEQ ID NO: 524923 - DNA, 20 bp, Artificial
  CRISPR gRNA sequence
cctgagctgggtgagcggct

SEQ ID NO: 524924 - DNA, 20 bp, Artificial
  CRISPR gRNA sequence
agctgggtgagcggctgcgg

SEQ ID NO: 524925 - DNA, 20 bp, Artificial
  CRISPR gRNA sequence
ggtgagcggctgcggggacc

SEQ ID NO: 524926 - DNA, 20 bp, Artificial
  CRISPR gRNA sequence
cggggaccatgaggaacatg

SEQ ID NO: 524927 - DNA, 20 bp, Artificial
  CRISPR gRNA sequence
ggatgagcctctctgcggag

SEQ ID NO: 524928 - DNA, 20 bp, Artificial
  CRISPR gRNA sequence
tctgcggaggcatctcaatg

SEQ ID NO: 524929 - DNA, 20 bp, Artificial
  CRISPR gRNA sequence
tgcggaggcatctcaatggc

SEQ ID NO: 524930 - DNA, 20 bp, Artificial
  CRISPR gRNA sequence
cggaggcatctcaatggctc

SEQ ID NO: 524931 - DNA, 20 bp, Artificial
  CRISPR gRNA sequence
aatggctcagaggggccagg

SEQ ID NO: 524932 - DNA, 20 bp, Artificial
  CRISPR gRNA sequence
agaggggccaggacttctgg

SEQ ID NO: 524933 - DNA, 20 bp, Artificial
  CRISPR gRNA sequence
ctggctgggatcagccgtgg

SEQ ID NO: 524934 - DNA, 20 bp, Artificial
  CRISPR gRNA sequence
tggctgggatcagccgtggg

SEQ ID NO: 524935 - DNA, 20 bp, Artificial
  CRISPR gRNA sequence
gctgggatcagccgtgggcc

SEQ ID NO: 524936 - DNA, 20 bp, Artificial
  CRISPR gRNA sequence
ggatcagccgtgggccgaga

SEQ ID NO: 524937 - DNA, 20 bp, Artificial
  CRISPR gRNA sequence
gtcacaaggggcttgtcctc

SEQ ID NO: 524938 - DNA, 20 bp, Artificial
  CRISPR gRNA sequence
gtcctcgctggccgtagtgc

SEQ ID NO: 524939 - DNA, 20 bp, Artificial
  CRISPR gRNA sequence
tcctcgctggccgtagtgcg

SEQ ID NO: 524940 - DNA, 20 bp, Artificial
  CRISPR gRNA sequence
gctggccgtagtgcgacgct

SEQ ID NO: 524941 - DNA, 20 bp, Artificial
  CRISPR gRNA sequence
gccgtagtgcgacgctcttg

SEQ ID NO: 524942 - DNA, 20 bp, Artificial
  CRISPR gRNA sequence
ttgcagcctgacgttgtagg

SEQ ID NO: 524943 - DNA, 20 bp, Artificial
  CRISPR gRNA sequence
gcagcctgacgttgtaggct

SEQ ID NO: 524944 - DNA, 20 bp, Artificial
  CRISPR gRNA sequence
cagcctgacgttgtaggctc

SEQ ID NO: 524945 - DNA, 20 bp, Artificial
  CRISPR gRNA sequence
acgttgtaggctctgggggc

SEQ ID NO: 524946 - DNA, 20 bp, Artificial
  CRISPR gRNA sequence
taggctctgggggccgcaaa

SEQ ID NO: 524947 - DNA, 20 bp, Artificial
  CRISPR gRNA sequence
tgggggccgcaaaggacttt

SEQ ID NO: 524948 - DNA, 20 bp, Artificial
  CRISPR gRNA sequence
ggggccgcaaaggactttag

SEQ ID NO: 524949 - DNA, 20 bp, Artificial
  CRISPR gRNA sequence
tagagatacaagactcaggt

SEQ ID NO: 524950 - DNA, 20 bp, Artificial
  CRISPR gRNA sequence
agagatacaagactcaggtc

SEQ ID NO: 524951 - DNA, 20 bp, Artificial
  CRISPR gRNA sequence
gagatacaagactcaggtcc

SEQ ID NO: 524952 - DNA, 20 bp, Artificial
  CRISPR gRNA sequence
aggtcctccgccgggagcca

SEQ ID NO: 524953 - DNA, 20 bp, Artificial
  CRISPR gRNA sequence
cgccgggagccacagacggg

SEQ ID NO: 524954 - DNA, 20 bp, Artificial
  CRISPR gRNA sequence
gggtcccggaactcgggtag

SEQ ID NO: 524955 - DNA, 20 bp, Artificial
  CRISPR gRNA sequence
gggtagggagagccgcacct

SEQ ID NO: 524956 - DNA, 20 bp, Artificial
  CRISPR gRNA sequence
acactcatggcctctaccga

SEQ ID NO: 524957 - DNA, 20 bp, Artificial
  CRISPR gRNA sequence
atggcctctaccgaaactga

SEQ ID NO: 524958 - DNA, 20 bp, Artificial
  CRISPR gRNA sequence
taccgaaactgagtgtccct

SEQ ID NO: 524959 - DNA, 20 bp, Artificial
  CRISPR gRNA sequence
ccgaaactgagtgtccctca

SEQ ID NO: 524960 - DNA, 20 bp, Artificial
  CRISPR gRNA sequence
agtgtccctcagtgcgaaag

SEQ ID NO: 524961 - DNA, 20 bp, Artificial
  CRISPR gRNA sequence
agtgcgaaagcaggtccacc

SEQ ID NO: 524962 - DNA, 20 bp, Artificial
  CRISPR gRNA sequence
ggattctgcccccgtggaca

SEQ ID NO: 524963 - DNA, 20 bp, Artificial
  CRISPR gRNA sequence
tgcccccgtggacatcccca

SEQ ID NO: 524964 - DNA, 20 bp, Artificial
  CRISPR gRNA sequence
cccccgtggacatccccagt

SEQ ID NO: 524965 - DNA, 20 bp, Artificial
  CRISPR gRNA sequence
aaatgctgctcatgcctgga

SEQ ID NO: 524966 - DNA, 20 bp, Artificial
  CRISPR gRNA sequence
ctcatgcctggactctgaaa

SEQ ID NO: 524967 - DNA, 20 bp, Artificial
  CRISPR gRNA sequence
atgcctggactctgaaagcc

SEQ ID NO: 524968 - DNA, 20 bp, Artificial
  CRISPR gRNA sequence
gactctgaaagcccgagtct

SEQ ID NO: 524969 - DNA, 20 bp, Artificial
  CRISPR gRNA sequence
tgaaagcccgagtctatgca

SEQ ID NO: 524970 - DNA, 20 bp, Artificial
  CRISPR gRNA sequence
aaagcccgagtctatgcaca

SEQ ID NO: 524971 - DNA, 20 bp, Artificial
  CRISPR gRNA sequence
tgcacacattgcccagaggg

SEQ ID NO: 524972 - DNA, 20 bp, Artificial
  CRISPR gRNA sequence
cccagagggcgtggcagctc

SEQ ID NO: 524973 - DNA, 20 bp, Artificial
  CRISPR gRNA sequence
tctgccctgcactcctgcgt

SEQ ID NO: 524974 - DNA, 20 bp, Artificial
  CRISPR gRNA sequence
tgccctgcactcctgcgtgg

SEQ ID NO: 524975 - DNA, 20 bp, Artificial
  CRISPR gRNA sequence
ccctgcactcctgcgtggca

SEQ ID NO: 524976 - DNA, 20 bp, Artificial
  CRISPR gRNA sequence
cactcctgcgtggcagcctc

SEQ ID NO: 524977 - DNA, 20 bp, Artificial
  CRISPR gRNA sequence
ctgcgtggcagcctctgcct

SEQ ID NO: 524978 - DNA, 20 bp, Artificial
  CRISPR gRNA sequence
cgtggcagcctctgcctctc

SEQ ID NO: 524979 - DNA, 20 bp, Artificial
  CRISPR gRNA sequence
tgcctctccagccttcccca

SEQ ID NO: 524980 - DNA, 20 bp, Artificial
  CRISPR gRNA sequence
cctctccagccttccccaga

SEQ ID NO: 524981 - DNA, 20 bp, Artificial
  CRISPR gRNA sequence
tccagccttccccagagagg

SEQ ID NO: 524982 - DNA, 20 bp, Artificial
  CRISPR gRNA sequence
cagccttccccagagagggt

SEQ ID NO: 524983 - DNA, 20 bp, Artificial
  CRISPR gRNA sequence
ccccagagagggttcgaagc

SEQ ID NO: 524984 - DNA, 20 bp, Artificial
  CRISPR gRNA sequence
cccagagagggttcgaagca

SEQ ID NO: 524985 - DNA, 20 bp, Artificial
  CRISPR gRNA sequence
gaagcacgggcagggctgac

SEQ ID NO: 524986 - DNA, 20 bp, Artificial
  CRISPR gRNA sequence
acgctgagcggggcagacag

SEQ ID NO: 524987 - DNA, 20 bp, Artificial
  CRISPR gRNA sequence
agcggggcagacaggggcgg

SEQ ID NO: 524988 - DNA, 20 bp, Artificial
  CRISPR gRNA sequence
gaagccttgtcctggactcg

SEQ ID NO: 524989 - DNA, 20 bp, Artificial
  CRISPR gRNA sequence
gtcctggactcggggccaac

SEQ ID NO: 524990 - DNA, 20 bp, Artificial
  CRISPR gRNA sequence
tcctggactcggggccaact

SEQ ID NO: 524991 - DNA, 20 bp, Artificial
  CRISPR gRNA sequence
gactcggggccaactgagca

SEQ ID NO: 524992 - DNA, 20 bp, Artificial
  CRISPR gRNA sequence
ggggccaactgagcaggacc

SEQ ID NO: 524993 - DNA, 20 bp, Artificial
  CRISPR gRNA sequence
agcaggacctcctctctcca

SEQ ID NO: 524994 - DNA, 20 bp, Artificial
  CRISPR gRNA sequence
ctctctccaggactacccat

SEQ ID NO: 524995 - DNA, 20 bp, Artificial
  CRISPR gRNA sequence
tctccaggactacccatcgg

SEQ ID NO: 524996 - DNA, 20 bp, Artificial
  CRISPR gRNA sequence
tccaggactacccatcggtg

SEQ ID NO: 524997 - DNA, 20 bp, Artificial
  CRISPR gRNA sequence
caggactacccatcggtggg

SEQ ID NO: 524998 - DNA, 20 bp, Artificial
  CRISPR gRNA sequence
cccatcggtgggccagctgg

SEQ ID NO: 524999 - DNA, 20 bp, Artificial
  CRISPR gRNA sequence
gcgcacaagctggctgaaaa

SEQ ID NO: 525000 - DNA, 20 bp, Artificial
  CRISPR gRNA sequence
gctgaaaacaacatccagcc

SEQ ID NO: 525001 - DNA, 20 bp, Artificial
  CRISPR gRNA sequence
aaaacaacatccagcccatc

SEQ ID NO: 525002 - DNA, 20 bp, Artificial
  CRISPR gRNA sequence
cgcggtgaccagtaggatgg

SEQ ID NO: 525003 - DNA, 20 bp, Artificial
  CRISPR gRNA sequence
gcggtgaccagtaggatggt

SEQ ID NO: 525004 - DNA, 20 bp, Artificial
  CRISPR gRNA sequence
cgaggtgagtgctgttgggt

SEQ ID NO: 525005 - DNA, 20 bp, Artificial
  CRISPR gRNA sequence
ttgggtcccgagcatccatt

SEQ ID NO: 525006 - DNA, 20 bp, Artificial
  CRISPR gRNA sequence
ggtcccgagcatccattggg

SEQ ID NO: 525007 - DNA, 20 bp, Artificial
  CRISPR gRNA sequence
ggtgggggcatgtttcagcc

SEQ ID NO: 525008 - DNA, 20 bp, Artificial
  CRISPR gRNA sequence
cagccacaggccagacccag

SEQ ID NO: 525009 - DNA, 20 bp, Artificial
  CRISPR gRNA sequence
agccacaggccagacccagc

SEQ ID NO: 525010 - DNA, 20 bp, Artificial
  CRISPR gRNA sequence
caggtctgagcgccacctct

SEQ ID NO: 525011 - DNA, 20 bp, Artificial
  CRISPR gRNA sequence
agcgccacctctgcatgctg

SEQ ID NO: 525012 - DNA, 20 bp, Artificial
  CRISPR gRNA sequence
tgcatgctgggcacgtgagc

SEQ ID NO: 525013 - DNA, 20 bp, Artificial
  CRISPR gRNA sequence
catgctgggcacgtgagcaa

SEQ ID NO: 525014 - DNA, 20 bp, Artificial
  CRISPR gRNA sequence
ggcacgtgagcaaccagccg

SEQ ID NO: 525015 - DNA, 20 bp, Artificial
  CRISPR gRNA sequence
gatccccctaggtgaggagc

SEQ ID NO: 525016 - DNA, 20 bp, Artificial
  CRISPR gRNA sequence
ggtgaggagcccgaggcttc

SEQ ID NO: 525017 - DNA, 20 bp, Artificial
  CRISPR gRNA sequence
cccgtcggggacaggacgcc

SEQ ID NO: 525018 - DNA, 20 bp, Artificial
  CRISPR gRNA sequence
ccgtcggggacaggacgcct

SEQ ID NO: 525019 - DNA, 20 bp, Artificial
  CRISPR gRNA sequence
cgtgtcgataggaggaggaa

SEQ ID NO: 525020 - DNA, 20 bp, Artificial
  CRISPR gRNA sequence
ctccccgtccctgaaactca

SEQ ID NO: 525021 - DNA, 20 bp, Artificial
  CRISPR gRNA sequence
cccgtccctgaaactcagct

SEQ ID NO: 525022 - DNA, 20 bp, Artificial
  CRISPR gRNA sequence
aaactcagctgtgttaacag

SEQ ID NO: 525023 - DNA, 20 bp, Artificial
  CRISPR gRNA sequence
agctgtgttaacagcatgtc

SEQ ID NO: 525024 - DNA, 20 bp, Artificial
  CRISPR gRNA sequence
tgttaacagcatgtcttggc

SEQ ID NO: 525025 - DNA, 20 bp, Artificial
  CRISPR gRNA sequence
acagcatgtcttggcattgg

SEQ ID NO: 525026 - DNA, 20 bp, Artificial
  CRISPR gRNA sequence
ggcattggtgatatttctgt

SEQ ID NO: 525027 - DNA, 20 bp, Artificial
  CRISPR gRNA sequence
gcattggtgatatttctgtt

SEQ ID NO: 525028 - DNA, 20 bp, Artificial
  CRISPR gRNA sequence
gtgatatttctgttttttcc

SEQ ID NO: 525029 - DNA, 20 bp, Artificial
  CRISPR gRNA sequence
ctgttttttcctggaataca

SEQ ID NO: 525030 - DNA, 20 bp, Artificial
  CRISPR gRNA sequence
tgttttttcctggaatacaa

SEQ ID NO: 525031 - DNA, 20 bp, Artificial
  CRISPR gRNA sequence
ttttttcctggaatacaaca

SEQ ID NO: 525032 - DNA, 20 bp, Artificial
  CRISPR gRNA sequence
tttcctggaatacaacacaa

SEQ ID NO: 525033 - DNA, 20 bp, Artificial
  CRISPR gRNA sequence
ttcctggaatacaacacaat

SEQ ID NO: 525034 - DNA, 20 bp, Artificial
  CRISPR gRNA sequence
tcctggaatacaacacaatt

SEQ ID NO: 525035 - DNA, 20 bp, Artificial
  CRISPR gRNA sequence
cctggaatacaacacaattc

SEQ ID NO: 525036 - DNA, 20 bp, Artificial
  CRISPR gRNA sequence
ctggaatacaacacaattct

SEQ ID NO: 525037 - DNA, 20 bp, Artificial
  CRISPR gRNA sequence
gaatacaacacaattcttta

SEQ ID NO: 525038 - DNA, 20 bp, Artificial
  CRISPR gRNA sequence
tttattttatggaaacacac

SEQ ID NO: 525039 - DNA, 20 bp, Artificial
  CRISPR gRNA sequence
tattttatggaaacacactt

SEQ ID NO: 525040 - DNA, 20 bp, Artificial
  CRISPR gRNA sequence
attttatggaaacacactta

SEQ ID NO: 525041 - DNA, 20 bp, Artificial
  CRISPR gRNA sequence
ttttatggaaacacacttat

SEQ ID NO: 525042 - DNA, 20 bp, Artificial
  CRISPR gRNA sequence
tatggaaacacacttatttt

SEQ ID NO: 525043 - DNA, 20 bp, Artificial
  CRISPR gRNA sequence
atggaaacacacttatttta

SEQ ID NO: 525044 - DNA, 20 bp, Artificial
  CRISPR gRNA sequence
tggaaacacacttattttat

SEQ ID NO: 525045 - DNA, 20 bp, Artificial
  CRISPR gRNA sequence
attttatgctcacatacatt

SEQ ID NO: 525046 - DNA, 20 bp, Artificial
  CRISPR gRNA sequence
ttttatgctcacatacattt

SEQ ID NO: 525047 - DNA, 20 bp, Artificial
  CRISPR gRNA sequence
tatgctcacatacatttgaa

SEQ ID NO: 525048 - DNA, 20 bp, Artificial
  CRISPR gRNA sequence
atgctcacatacatttgaac

SEQ ID NO: 525049 - DNA, 20 bp, Artificial
  CRISPR gRNA sequence
tgctcacatacatttgaaca

SEQ ID NO: 525050 - DNA, 20 bp, Artificial
  CRISPR gRNA sequence
acatacatttgaacatcaac

SEQ ID NO: 525051 - DNA, 20 bp, Artificial
  CRISPR gRNA sequence
gaacatcaacactctccgtg

SEQ ID NO: 525052 - DNA, 20 bp, Artificial
  CRISPR gRNA sequence
aacatcaacactctccgtga

SEQ ID NO: 525053 - DNA, 20 bp, Artificial
  CRISPR gRNA sequence
tccgtgaagataaaattaca

SEQ ID NO: 525054 - DNA, 20 bp, Artificial
  CRISPR gRNA sequence
cgtgaagataaaattacaca

SEQ ID NO: 525055 - DNA, 20 bp, Artificial
  CRISPR gRNA sequence
cacaaaaacgttcacaagct

SEQ ID NO: 525056 - DNA, 20 bp, Artificial
  CRISPR gRNA sequence
acaagcttggagtgcggagt

SEQ ID NO: 525057 - DNA, 20 bp, Artificial
  CRISPR gRNA sequence
ggagtgcggagtgggatgaa

SEQ ID NO: 525058 - DNA, 20 bp, Artificial
  CRISPR gRNA sequence
gagtgcggagtgggatgaat

SEQ ID NO: 525059 - DNA, 20 bp, Artificial
  CRISPR gRNA sequence
cacgaaggaagcacagctga

SEQ ID NO: 525060 - DNA, 20 bp, Artificial
  CRISPR gRNA sequence
acgaaggaagcacagctgat

SEQ ID NO: 525061 - DNA, 20 bp, Artificial
  CRISPR gRNA sequence
ataaccagcctctgctccta

SEQ ID NO: 525062 - DNA, 20 bp, Artificial
  CRISPR gRNA sequence
tgctcctagaaaaagaggcc

SEQ ID NO: 525063 - DNA, 20 bp, Artificial
  CRISPR gRNA sequence
ctcctagaaaaagaggcccc

SEQ ID NO: 525064 - DNA, 20 bp, Artificial
  CRISPR gRNA sequence
ctagaaaaagaggcccccag

SEQ ID NO: 525065 - DNA, 20 bp, Artificial
  CRISPR gRNA sequence
gaaaaagaggcccccagtga

SEQ ID NO: 525066 - DNA, 20 bp, Artificial
  CRISPR gRNA sequence
atcctgcatttccgctgcta

SEQ ID NO: 525067 - DNA, 20 bp, Artificial
  CRISPR gRNA sequence
catttccgctgctagtgcca

SEQ ID NO: 525068 - DNA, 20 bp, Artificial
  CRISPR gRNA sequence
ccgctgctagtgccatgtgt

SEQ ID NO: 525069 - DNA, 20 bp, Artificial
  CRISPR gRNA sequence
cgctgctagtgccatgtgtt

SEQ ID NO: 525070 - DNA, 20 bp, Artificial
  CRISPR gRNA sequence
ctagtgccatgtgttcagcc

SEQ ID NO: 525071 - DNA, 20 bp, Artificial
  CRISPR gRNA sequence
gtgccatgtgttcagcctga

SEQ ID NO: 525072 - DNA, 20 bp, Artificial
  CRISPR gRNA sequence
agcctgagcaggtcagtgcg

SEQ ID NO: 525073 - DNA, 20 bp, Artificial
  CRISPR gRNA sequence
agcaggtcagtgcgtcaaga

SEQ ID NO: 525074 - DNA, 20 bp, Artificial
  CRISPR gRNA sequence
aggtgctgttggggttccca

SEQ ID NO: 525075 - DNA, 20 bp, Artificial
  CRISPR gRNA sequence
ttggggttcccaagaccttt

SEQ ID NO: 525076 - DNA, 20 bp, Artificial
  CRISPR gRNA sequence
gggttcccaagacctttctc

SEQ ID NO: 525077 - DNA, 20 bp, Artificial
  CRISPR gRNA sequence
ccaagacctttctcaggatc

SEQ ID NO: 525078 - DNA, 20 bp, Artificial
  CRISPR gRNA sequence
tctcaggatcagtgatttgc

SEQ ID NO: 525079 - DNA, 20 bp, Artificial
  CRISPR gRNA sequence
ctcaggatcagtgatttgcc

SEQ ID NO: 525080 - DNA, 20 bp, Artificial
  CRISPR gRNA sequence
tcaggatcagtgatttgccg

SEQ ID NO: 525081 - DNA, 20 bp, Artificial
  CRISPR gRNA sequence
aggatcagtgatttgccgga

SEQ ID NO: 525082 - DNA, 20 bp, Artificial
  CRISPR gRNA sequence
gccggaaggacttgcagagc

SEQ ID NO: 525083 - DNA, 20 bp, Artificial
  CRISPR gRNA sequence
ccggaaggacttgcagagct

SEQ ID NO: 525084 - DNA, 20 bp, Artificial
  CRISPR gRNA sequence
gcagagctcaggaaccagta

SEQ ID NO: 525085 - DNA, 20 bp, Artificial
  CRISPR gRNA sequence
cagagctcaggaaccagtaa

SEQ ID NO: 525086 - DNA, 20 bp, Artificial
  CRISPR gRNA sequence
aggaaccagtaaactcacag

SEQ ID NO: 525087 - DNA, 20 bp, Artificial
  CRISPR gRNA sequence
acagttacagtttattgcag

SEQ ID NO: 525088 - DNA, 20 bp, Artificial
  CRISPR gRNA sequence
cagtttattgcagagccgac

SEQ ID NO: 525089 - DNA, 20 bp, Artificial
  CRISPR gRNA sequence
attgcagagccgaccctcct

SEQ ID NO: 525090 - DNA, 20 bp, Artificial
  CRISPR gRNA sequence
ttgcagagccgaccctcctg

SEQ ID NO: 525091 - DNA, 20 bp, Artificial
  CRISPR gRNA sequence
cagagccgaccctcctgggt

SEQ ID NO: 525092 - DNA, 20 bp, Artificial
  CRISPR gRNA sequence
ctgggtgccagccgctgccc

SEQ ID NO: 525093 - DNA, 20 bp, Artificial
  CRISPR gRNA sequence
ggtgccagccgctgcccgag

SEQ ID NO: 525094 - DNA, 20 bp, Artificial
  CRISPR gRNA sequence
cccgaggtgggaggatacag

SEQ ID NO: 525095 - DNA, 20 bp, Artificial
  CRISPR gRNA sequence
ccagtgtcccctccctgcag

SEQ ID NO: 525096 - DNA, 20 bp, Artificial
  CRISPR gRNA sequence
cctgcaggggtgtgggcggc

SEQ ID NO: 525097 - DNA, 20 bp, Artificial
  CRISPR gRNA sequence
caggggtgtgggcggcgctc

SEQ ID NO: 525098 - DNA, 20 bp, Artificial
  CRISPR gRNA sequence
catcctcccagcgatgatgt

SEQ ID NO: 525099 - DNA, 20 bp, Artificial
  CRISPR gRNA sequence
ccagcgatgatgtgtggcct

SEQ ID NO: 525100 - DNA, 20 bp, Artificial
  CRISPR gRNA sequence
atgcacagaacatggtcccc

SEQ ID NO: 525101 - DNA, 20 bp, Artificial
  CRISPR gRNA sequence
ttgagcctcggtgtctactg

SEQ ID NO: 525102 - DNA, 20 bp, Artificial
  CRISPR gRNA sequence
gagcctcggtgtctactggg

SEQ ID NO: 525103 - DNA, 20 bp, Artificial
  CRISPR gRNA sequence
agcctcggtgtctactgggg

SEQ ID NO: 525104 - DNA, 20 bp, Artificial
  CRISPR gRNA sequence
ggtgtctactgggggtcagt

SEQ ID NO: 525105 - DNA, 20 bp, Artificial
  CRISPR gRNA sequence
ctgggggtcagtcacagcgg

SEQ ID NO: 525106 - DNA, 20 bp, Artificial
  CRISPR gRNA sequence
ggggtcagtcacagcggcgc

SEQ ID NO: 525107 - DNA, 20 bp, Artificial
  CRISPR gRNA sequence
acaccccatggctgacctca

SEQ ID NO: 525108 - DNA, 20 bp, Artificial
  CRISPR gRNA sequence
acctcagtctctagccctcc

SEQ ID NO: 525109 - DNA, 20 bp, Artificial
  CRISPR gRNA sequence
agtctctagccctccagagg

SEQ ID NO: 525110 - DNA, 20 bp, Artificial
  CRISPR gRNA sequence
tagccctccagaggtcaagc

SEQ ID NO: 525111 - DNA, 20 bp, Artificial
  CRISPR gRNA sequence
gccctccagaggtcaagctg

SEQ ID NO: 525112 - DNA, 20 bp, Artificial
  CRISPR gRNA sequence
cagaggtcaagctgaaaact

SEQ ID NO: 525113 - DNA, 20 bp, Artificial
  CRISPR gRNA sequence
aaaactgtccagggccccac

SEQ ID NO: 525114 - DNA, 20 bp, Artificial
  CRISPR gRNA sequence
tccagggccccaccccaaat

SEQ ID NO: 525115 - DNA, 20 bp, Artificial
  CRISPR gRNA sequence
tgggactatccggtgtgacc

SEQ ID NO: 525116 - DNA, 20 bp, Artificial
  CRISPR gRNA sequence
tccggtgtgacctgaggccc

SEQ ID NO: 525117 - DNA, 20 bp, Artificial
  CRISPR gRNA sequence
aggccccaggaacaatgaca

SEQ ID NO: 525118 - DNA, 20 bp, Artificial
  CRISPR gRNA sequence
agaggctacctctcaggagc

SEQ ID NO: 525119 - DNA, 20 bp, Artificial
  CRISPR gRNA sequence
cctctcaggagctcagccgg

SEQ ID NO: 525120 - DNA, 20 bp, Artificial
  CRISPR gRNA sequence
tcaggagctcagccggggtc

SEQ ID NO: 525121 - DNA, 20 bp, Artificial
  CRISPR gRNA sequence
aggagctcagccggggtcta

SEQ ID NO: 525122 - DNA, 20 bp, Artificial
  CRISPR gRNA sequence
agccggggtctaccactctt

SEQ ID NO: 525123 - DNA, 20 bp, Artificial
  CRISPR gRNA sequence
ccactctttggcatgtgtgg

SEQ ID NO: 525124 - DNA, 20 bp, Artificial
  CRISPR gRNA sequence
tttggcatgtgtggggtgtg

SEQ ID NO: 525125 - DNA, 20 bp, Artificial
  CRISPR gRNA sequence
tggcatgtgtggggtgtggc

SEQ ID NO: 525126 - DNA, 20 bp, Artificial
  CRISPR gRNA sequence
ggcatgtgtggggtgtggcc

SEQ ID NO: 525127 - DNA, 20 bp, Artificial
  CRISPR gRNA sequence
gcatgtgtggggtgtggcca

SEQ ID NO: 525128 - DNA, 20 bp, Artificial
  CRISPR gRNA sequence
ctgggtggagccctgactgt

SEQ ID NO: 525129 - DNA, 20 bp, Artificial
  CRISPR gRNA sequence
ggtggagccctgactgtgta

SEQ ID NO: 525130 - DNA, 20 bp, Artificial
  CRISPR gRNA sequence
actgtgtaacagggattcgc

SEQ ID NO: 525131 - DNA, 20 bp, Artificial
  CRISPR gRNA sequence
tgtaacagggattcgctaga

SEQ ID NO: 525132 - DNA, 20 bp, Artificial
  CRISPR gRNA sequence
gctagaaggaaggaaacact

SEQ ID NO: 525133 - DNA, 20 bp, Artificial
  CRISPR gRNA sequence
gaaggaaggaaacactgcac

SEQ ID NO: 525134 - DNA, 20 bp, Artificial
  CRISPR gRNA sequence
cacgccctcctgaaaggagc

SEQ ID NO: 525135 - DNA, 20 bp, Artificial
  CRISPR gRNA sequence
ctgaaaggagcctccgccca

SEQ ID NO: 525136 - DNA, 20 bp, Artificial
  CRISPR gRNA sequence
aaaggagcctccgcccatag

SEQ ID NO: 525137 - DNA, 20 bp, Artificial
  CRISPR gRNA sequence
cgcccatagcagcctgcaca

SEQ ID NO: 525138 - DNA, 20 bp, Artificial
  CRISPR gRNA sequence
cacagtgtgtggccctgagg

SEQ ID NO: 525139 - DNA, 20 bp, Artificial
  CRISPR gRNA sequence
aggccacagggacagaagga

SEQ ID NO: 525140 - DNA, 20 bp, Artificial
  CRISPR gRNA sequence
agctggaggaaggaggtggt

SEQ ID NO: 525141 - DNA, 20 bp, Artificial
  CRISPR gRNA sequence
gaggaaggaggtggttgtca

SEQ ID NO: 525142 - DNA, 20 bp, Artificial
  CRISPR gRNA sequence
tcattgtactttacacagcc

SEQ ID NO: 525143 - DNA, 20 bp, Artificial
  CRISPR gRNA sequence
tactttacacagccacgtgc

SEQ ID NO: 525144 - DNA, 20 bp, Artificial
  CRISPR gRNA sequence
tacacagccacgtgccccgt

SEQ ID NO: 525145 - DNA, 20 bp, Artificial
  CRISPR gRNA sequence
acacagccacgtgccccgtt

SEQ ID NO: 525146 - DNA, 20 bp, Artificial
  CRISPR gRNA sequence
cacagccacgtgccccgttc

SEQ ID NO: 525147 - DNA, 20 bp, Artificial
  CRISPR gRNA sequence
ttcagggtggagctggagga

SEQ ID NO: 525148 - DNA, 20 bp, Artificial
  CRISPR gRNA sequence
cagggtggagctggaggaac

SEQ ID NO: 525149 - DNA, 20 bp, Artificial
  CRISPR gRNA sequence
agggtggagctggaggaacg

SEQ ID NO: 525150 - DNA, 20 bp, Artificial
  CRISPR gRNA sequence
gaggaacgagatagttgtca

SEQ ID NO: 525151 - DNA, 20 bp, Artificial
  CRISPR gRNA sequence
tcattgtactttacacagcc

SEQ ID NO: 525152 - DNA, 20 bp, Artificial
  CRISPR gRNA sequence
tactttacacagccacgtgc

SEQ ID NO: 525153 - DNA, 20 bp, Artificial
  CRISPR gRNA sequence
tacacagccacgtgccccgt

SEQ ID NO: 525154 - DNA, 20 bp, Artificial
  CRISPR gRNA sequence
acacagccacgtgccccgtt

SEQ ID NO: 525155 - DNA, 20 bp, Artificial
  CRISPR gRNA sequence
cacagccacgtgccccgttc

SEQ ID NO: 525156 - DNA, 20 bp, Artificial
  CRISPR gRNA sequence
ttcagggtggacagggccct

SEQ ID NO: 525157 - DNA, 20 bp, Artificial
  CRISPR gRNA sequence
cagggtggacagggccctgg

SEQ ID NO: 525158 - DNA, 20 bp, Artificial
  CRISPR gRNA sequence
agggtggacagggccctggg

SEQ ID NO: 525159 - DNA, 20 bp, Artificial
  CRISPR gRNA sequence
ggtggctcacctcacaccca

SEQ ID NO: 525160 - DNA, 20 bp, Artificial
  CRISPR gRNA sequence
acctcacacccagctctgtt

SEQ ID NO: 525161 - DNA, 20 bp, Artificial
  CRISPR gRNA sequence
acacccagctctgttactta

SEQ ID NO: 525162 - DNA, 20 bp, Artificial
  CRISPR gRNA sequence
tgttacttaccacaggacgc

SEQ ID NO: 525163 - DNA, 20 bp, Artificial
  CRISPR gRNA sequence
ttacttaccacaggacgccc

SEQ ID NO: 525164 - DNA, 20 bp, Artificial
  CRISPR gRNA sequence
cttaccacaggacgccccag

SEQ ID NO: 525165 - DNA, 20 bp, Artificial
  CRISPR gRNA sequence
accacaggacgccccaggcc

SEQ ID NO: 525166 - DNA, 20 bp, Artificial
  CRISPR gRNA sequence
ccacaggacgccccaggccc

SEQ ID NO: 525167 - DNA, 20 bp, Artificial
  CRISPR gRNA sequence
ccttaccccgagccctcagt

SEQ ID NO: 525168 - DNA, 20 bp, Artificial
  CRISPR gRNA sequence
cttaccccgagccctcagtt

SEQ ID NO: 525169 - DNA, 20 bp, Artificial
  CRISPR gRNA sequence
accccgagccctcagtttcc

SEQ ID NO: 525170 - DNA, 20 bp, Artificial
  CRISPR gRNA sequence
ccccgagccctcagtttcct

SEQ ID NO: 525171 - DNA, 20 bp, Artificial
  CRISPR gRNA sequence
agtttcctcatctgtgaaag

SEQ ID NO: 525172 - DNA, 20 bp, Artificial
  CRISPR gRNA sequence
cctcatctgtgaaaggggta

SEQ ID NO: 525173 - DNA, 20 bp, Artificial
  CRISPR gRNA sequence
ctcatctgtgaaaggggtag

SEQ ID NO: 525174 - DNA, 20 bp, Artificial
  CRISPR gRNA sequence
atctgtgaaaggggtagtgg

SEQ ID NO: 525175 - DNA, 20 bp, Artificial
  CRISPR gRNA sequence
tgaaaggggtagtggtgccc

SEQ ID NO: 525176 - DNA, 20 bp, Artificial
  CRISPR gRNA sequence
agctcacccactcagggaat

SEQ ID NO: 525177 - DNA, 20 bp, Artificial
  CRISPR gRNA sequence
acccactcagggaattcaca

SEQ ID NO: 525178 - DNA, 20 bp, Artificial
  CRISPR gRNA sequence
agggaattcacagagcagcc

SEQ ID NO: 525179 - DNA, 20 bp, Artificial
  CRISPR gRNA sequence
acagagcagccgccctaaag

SEQ ID NO: 525180 - DNA, 20 bp, Artificial
  CRISPR gRNA sequence
aagggcccgattatcctcat

SEQ ID NO: 525181 - DNA, 20 bp, Artificial
  CRISPR gRNA sequence
tcctcatccggacagtgacc

SEQ ID NO: 525182 - DNA, 20 bp, Artificial
  CRISPR gRNA sequence
atccggacagtgaccgacct

SEQ ID NO: 525183 - DNA, 20 bp, Artificial
  CRISPR gRNA sequence
ctggccattccagggccatc

SEQ ID NO: 525184 - DNA, 20 bp, Artificial
  CRISPR gRNA sequence
gccattccagggccatcacc

SEQ ID NO: 525185 - DNA, 20 bp, Artificial
  CRISPR gRNA sequence
cagggccatcaccgccatct

SEQ ID NO: 525186 - DNA, 20 bp, Artificial
  CRISPR gRNA sequence
cttcaaaatggcacgcagga

SEQ ID NO: 525187 - DNA, 20 bp, Artificial
  CRISPR gRNA sequence
ttcaaaatggcacgcaggaa

SEQ ID NO: 525188 - DNA, 20 bp, Artificial
  CRISPR gRNA sequence
caaaatggcacgcaggaaac

SEQ ID NO: 525189 - DNA, 20 bp, Artificial
  CRISPR gRNA sequence
aaaatggcacgcaggaaacc

SEQ ID NO: 525190 - DNA, 20 bp, Artificial
  CRISPR gRNA sequence
ttccccctgcctggggctct

SEQ ID NO: 525191 - DNA, 20 bp, Artificial
  CRISPR gRNA sequence
ccccctgcctggggctctgc

SEQ ID NO: 525192 - DNA, 20 bp, Artificial
  CRISPR gRNA sequence
cccctgcctggggctctgcc

SEQ ID NO: 525193 - DNA, 20 bp, Artificial
  CRISPR gRNA sequence
cctggggctctgcccagctg

SEQ ID NO: 525194 - DNA, 20 bp, Artificial
  CRISPR gRNA sequence
gggctctgcccagctgggca

SEQ ID NO: 525195 - DNA, 20 bp, Artificial
  CRISPR gRNA sequence
tgcccagctgggcagcctca

SEQ ID NO: 525196 - DNA, 20 bp, Artificial
  CRISPR gRNA sequence
cccagctgggcagcctcaca

SEQ ID NO: 525197 - DNA, 20 bp, Artificial
  CRISPR gRNA sequence
ggcagcctcacagcccctgc

SEQ ID NO: 525198 - DNA, 20 bp, Artificial
  CRISPR gRNA sequence
acagcccctgccctgctgct

SEQ ID NO: 525199 - DNA, 20 bp, Artificial
  CRISPR gRNA sequence
ccctgctgcttaggctgagg

SEQ ID NO: 525200 - DNA, 20 bp, Artificial
  CRISPR gRNA sequence
ctgcttaggctgaggagaca

SEQ ID NO: 525201 - DNA, 20 bp, Artificial
  CRISPR gRNA sequence
cttaggctgaggagacatac

SEQ ID NO: 525202 - DNA, 20 bp, Artificial
  CRISPR gRNA sequence
aggctgaggagacatactcg

SEQ ID NO: 525203 - DNA, 20 bp, Artificial
  CRISPR gRNA sequence
ggctgaggagacatactcgg

SEQ ID NO: 525204 - DNA, 20 bp, Artificial
  CRISPR gRNA sequence
aggagacatactcggggttt

SEQ ID NO: 525205 - DNA, 20 bp, Artificial
  CRISPR gRNA sequence
ggggtttggggaaggaaagt

SEQ ID NO: 525206 - DNA, 20 bp, Artificial
  CRISPR gRNA sequence
ggggaaggaaagtgcccggg

SEQ ID NO: 525207 - DNA, 20 bp, Artificial
  CRISPR gRNA sequence
gggaaggaaagtgcccggga

SEQ ID NO: 525208 - DNA, 20 bp, Artificial
  CRISPR gRNA sequence
cttttgtaaagtgaacattt

SEQ ID NO: 525209 - DNA, 20 bp, Artificial
  CRISPR gRNA sequence
ttgtaaagtgaacatttgct

SEQ ID NO: 525210 - DNA, 20 bp, Artificial
  CRISPR gRNA sequence
tgtaaagtgaacatttgctg

SEQ ID NO: 525211 - DNA, 20 bp, Artificial
  CRISPR gRNA sequence
gtaaagtgaacatttgctga

SEQ ID NO: 525212 - DNA, 20 bp, Artificial
  CRISPR gRNA sequence
taaagtgaacatttgctgaa

SEQ ID NO: 525213 - DNA, 20 bp, Artificial
  CRISPR gRNA sequence
gctgaactacagggatccat

SEQ ID NO: 525214 - DNA, 20 bp, Artificial
  CRISPR gRNA sequence
ctgaactacagggatccatt

SEQ ID NO: 525215 - DNA, 20 bp, Artificial
  CRISPR gRNA sequence
aactacagggatccattgtc

SEQ ID NO: 525216 - DNA, 20 bp, Artificial
  CRISPR gRNA sequence
cagggatccattgtcaggcc

SEQ ID NO: 525217 - DNA, 20 bp, Artificial
  CRISPR gRNA sequence
tcaggcccgtatcccagcta

SEQ ID NO: 525218 - DNA, 20 bp, Artificial
  CRISPR gRNA sequence
caagctcaacctcgtggtgt

SEQ ID NO: 525219 - DNA, 20 bp, Artificial
  CRISPR gRNA sequence
aacctcgtggtgtgttgggg

SEQ ID NO: 525220 - DNA, 20 bp, Artificial
  CRISPR gRNA sequence
gtggtgtgttggggccgaca

SEQ ID NO: 525221 - DNA, 20 bp, Artificial
  CRISPR gRNA sequence
gggccgacagcgagaccagc

SEQ ID NO: 525222 - DNA, 20 bp, Artificial
  CRISPR gRNA sequence
ctgccataggttccccgggc

SEQ ID NO: 525223 - DNA, 20 bp, Artificial
  CRISPR gRNA sequence
ccataggttccccgggctct

SEQ ID NO: 525224 - DNA, 20 bp, Artificial
  CRISPR gRNA sequence
cccgggctctggagtgggag

SEQ ID NO: 525225 - DNA, 20 bp, Artificial
  CRISPR gRNA sequence
tggagtgggagcaggaccct

SEQ ID NO: 525226 - DNA, 20 bp, Artificial
  CRISPR gRNA sequence
gagtgggagcaggaccctgc

SEQ ID NO: 525227 - DNA, 20 bp, Artificial
  CRISPR gRNA sequence
cgggagacacgggatggggg

SEQ ID NO: 525228 - DNA, 20 bp, Artificial
  CRISPR gRNA sequence
ggggaccctccgagtgggca

SEQ ID NO: 525229 - DNA, 20 bp, Artificial
  CRISPR gRNA sequence
cgagtgggcacccagagctg

SEQ ID NO: 525230 - DNA, 20 bp, Artificial
  CRISPR gRNA sequence
gtcaggctgccgggacagtg

SEQ ID NO: 525231 - DNA, 20 bp, Artificial
  CRISPR gRNA sequence
ccgggacagtgggtcagcgc

SEQ ID NO: 525232 - DNA, 20 bp, Artificial
  CRISPR gRNA sequence
gggccggacatccacagaga

SEQ ID NO: 525233 - DNA, 20 bp, Artificial
  CRISPR gRNA sequence
ctggtcaggatgtcacagcc

SEQ ID NO: 525234 - DNA, 20 bp, Artificial
  CRISPR gRNA sequence
gtcaggatgtcacagccctg

SEQ ID NO: 525235 - DNA, 20 bp, Artificial
  CRISPR gRNA sequence
tgtcccatctgtaggtggcc

SEQ ID NO: 525236 - DNA, 20 bp, Artificial
  CRISPR gRNA sequence
taggtggccatgacggtccc

SEQ ID NO: 525237 - DNA, 20 bp, Artificial
  CRISPR gRNA sequence
ctcaccagcagtagcaggtc

SEQ ID NO: 525238 - DNA, 20 bp, Artificial
  CRISPR gRNA sequence
accagcagtagcaggtccca

SEQ ID NO: 525239 - DNA, 20 bp, Artificial
  CRISPR gRNA sequence
tgccatttgtcatggcagcc

SEQ ID NO: 525240 - DNA, 20 bp, Artificial
  CRISPR gRNA sequence
gccatttgtcatggcagcca

SEQ ID NO: 525241 - DNA, 20 bp, Artificial
  CRISPR gRNA sequence
ccatttgtcatggcagccag

SEQ ID NO: 525242 - DNA, 20 bp, Artificial
  CRISPR gRNA sequence
gtcatggcagccagactcca

SEQ ID NO: 525243 - DNA, 20 bp, Artificial
  CRISPR gRNA sequence
tcatggcagccagactccag

SEQ ID NO: 525244 - DNA, 20 bp, Artificial
  CRISPR gRNA sequence
caggcgatggtgtggcacca

SEQ ID NO: 525245 - DNA, 20 bp, Artificial
  CRISPR gRNA sequence
gaggcaggtagagtgcaccc

SEQ ID NO: 525246 - DNA, 20 bp, Artificial
  CRISPR gRNA sequence
ctgctgagccttggggcaca

SEQ ID NO: 525247 - DNA, 20 bp, Artificial
  CRISPR gRNA sequence
ctgagccttggggcacacaa

SEQ ID NO: 525248 - DNA, 20 bp, Artificial
  CRISPR gRNA sequence
agccttggggcacacaagcc

SEQ ID NO: 525249 - DNA, 20 bp, Artificial
  CRISPR gRNA sequence
ggggcacacaagccttcctc

SEQ ID NO: 525250 - DNA, 20 bp, Artificial
  CRISPR gRNA sequence
gggcacacaagccttcctca

SEQ ID NO: 525251 - DNA, 20 bp, Artificial
  CRISPR gRNA sequence
cctcagcctttcctggtcac

SEQ ID NO: 525252 - DNA, 20 bp, Artificial
  CRISPR gRNA sequence
ctcagcctttcctggtcacc

SEQ ID NO: 525253 - DNA, 20 bp, Artificial
  CRISPR gRNA sequence
agcctttcctggtcaccttc

SEQ ID NO: 525254 - DNA, 20 bp, Artificial
  CRISPR gRNA sequence
tcctggtcaccttcgggggt

SEQ ID NO: 525255 - DNA, 20 bp, Artificial
  CRISPR gRNA sequence
cctggtcaccttcgggggtg

SEQ ID NO: 525256 - DNA, 20 bp, Artificial
  CRISPR gRNA sequence
ctggtcaccttcgggggtgg

SEQ ID NO: 525257 - DNA, 20 bp, Artificial
  CRISPR gRNA sequence
gtcaccttcgggggtggtca

SEQ ID NO: 525258 - DNA, 20 bp, Artificial
  CRISPR gRNA sequence
cgggggtggtcaaggcaaca

SEQ ID NO: 525259 - DNA, 20 bp, Artificial
  CRISPR gRNA sequence
gggggtggtcaaggcaacag

SEQ ID NO: 525260 - DNA, 20 bp, Artificial
  CRISPR gRNA sequence
cgagtgtgtttctgcaccaa

SEQ ID NO: 525261 - DNA, 20 bp, Artificial
  CRISPR gRNA sequence
ctgcaccaagcgcacagcag

SEQ ID NO: 525262 - DNA, 20 bp, Artificial
  CRISPR gRNA sequence
tgcaccaagcgcacagcagg

SEQ ID NO: 525263 - DNA, 20 bp, Artificial
  CRISPR gRNA sequence
caccaagcgcacagcaggct

SEQ ID NO: 525264 - DNA, 20 bp, Artificial
  CRISPR gRNA sequence
agcaggacaggatgtgggag

SEQ ID NO: 525265 - DNA, 20 bp, Artificial
  CRISPR gRNA sequence
tcccaagacagggatggccc

SEQ ID NO: 525266 - DNA, 20 bp, Artificial
  CRISPR gRNA sequence
ccaagacagggatggcccca

SEQ ID NO: 525267 - DNA, 20 bp, Artificial
  CRISPR gRNA sequence
ggacggatggaagtgggcgg

SEQ ID NO: 525268 - DNA, 20 bp, Artificial
  CRISPR gRNA sequence
tgaccggccccaggagctcc

SEQ ID NO: 525269 - DNA, 20 bp, Artificial
  CRISPR gRNA sequence
catggaagggactgggccca

SEQ ID NO: 525270 - DNA, 20 bp, Artificial
  CRISPR gRNA sequence
ggcccatgcagggcagtcat

SEQ ID NO: 525271 - DNA, 20 bp, Artificial
  CRISPR gRNA sequence
gggcggggaggtgacccgac

SEQ ID NO: 525272 - DNA, 20 bp, Artificial
  CRISPR gRNA sequence
ggcggggaggtgacccgacc

SEQ ID NO: 525273 - DNA, 20 bp, Artificial
  CRISPR gRNA sequence
ctccgtgttcctggaaggtg

SEQ ID NO: 525274 - DNA, 20 bp, Artificial
  CRISPR gRNA sequence
cgtgttcctggaaggtgaaa

SEQ ID NO: 525275 - DNA, 20 bp, Artificial
  CRISPR gRNA sequence
ctggaaggtgaaatgatgcc

SEQ ID NO: 525276 - DNA, 20 bp, Artificial
  CRISPR gRNA sequence
gaaggtgaaatgatgccgca

SEQ ID NO: 525277 - DNA, 20 bp, Artificial
  CRISPR gRNA sequence
ccatgaaagaagctgagcat

SEQ ID NO: 525278 - DNA, 20 bp, Artificial
  CRISPR gRNA sequence
catgaaagaagctgagcatg

SEQ ID NO: 525279 - DNA, 20 bp, Artificial
  CRISPR gRNA sequence
agcatgtgtgagcatggggg

SEQ ID NO: 525280 - DNA, 20 bp, Artificial
  CRISPR gRNA sequence
gctgcgcccctgtgcatctg

SEQ ID NO: 525281 - DNA, 20 bp, Artificial
  CRISPR gRNA sequence
cgcccctgtgcatctggccg

SEQ ID NO: 525282 - DNA, 20 bp, Artificial
  CRISPR gRNA sequence
tgcatctggccggccagaac

SEQ ID NO: 525283 - DNA, 20 bp, Artificial
  CRISPR gRNA sequence
gccggccagaaccgatgtca

SEQ ID NO: 525284 - DNA, 20 bp, Artificial
  CRISPR gRNA sequence
tttaacacccatggaaactc

SEQ ID NO: 525285 - DNA, 20 bp, Artificial
  CRISPR gRNA sequence
aacacccatggaaactcagt

SEQ ID NO: 525286 - DNA, 20 bp, Artificial
  CRISPR gRNA sequence
acacccatggaaactcagta

SEQ ID NO: 525287 - DNA, 20 bp, Artificial
  CRISPR gRNA sequence
agtagagtgccaagagccga

SEQ ID NO: 525288 - DNA, 20 bp, Artificial
  CRISPR gRNA sequence
cctggtgattttactgtgat

SEQ ID NO: 525289 - DNA, 20 bp, Artificial
  CRISPR gRNA sequence
ctggtgattttactgtgatc

SEQ ID NO: 525290 - DNA, 20 bp, Artificial
  CRISPR gRNA sequence
gtgattttactgtgatccac

SEQ ID NO: 525291 - DNA, 20 bp, Artificial
  CRISPR gRNA sequence
tactgtgatccaccctcgtg

SEQ ID NO: 525292 - DNA, 20 bp, Artificial
  CRISPR gRNA sequence
actgtgatccaccctcgtgg

SEQ ID NO: 525293 - DNA, 20 bp, Artificial
  CRISPR gRNA sequence
ctgtgatccaccctcgtggg

SEQ ID NO: 525294 - DNA, 20 bp, Artificial
  CRISPR gRNA sequence
tgatccaccctcgtggggct

SEQ ID NO: 525295 - DNA, 20 bp, Artificial
  CRISPR gRNA sequence
gtggggctacttccgcctac

SEQ ID NO: 525296 - DNA, 20 bp, Artificial
  CRISPR gRNA sequence
cttccgcctaccatctgtgt

SEQ ID NO: 525297 - DNA, 20 bp, Artificial
  CRISPR gRNA sequence
ccgcctaccatctgtgtggt

SEQ ID NO: 525298 - DNA, 20 bp, Artificial
  CRISPR gRNA sequence
cgcctaccatctgtgtggtg

SEQ ID NO: 525299 - DNA, 20 bp, Artificial
  CRISPR gRNA sequence
ccatctgtgtggtggtagga

SEQ ID NO: 525300 - DNA, 20 bp, Artificial
  CRISPR gRNA sequence
tgtggtggtaggaattccct

SEQ ID NO: 525301 - DNA, 20 bp, Artificial
  CRISPR gRNA sequence
cctacctgtgtggtggaaat

SEQ ID NO: 525302 - DNA, 20 bp, Artificial
  CRISPR gRNA sequence
cctgtgtggtggaaattctg

SEQ ID NO: 525303 - DNA, 20 bp, Artificial
  CRISPR gRNA sequence
tgtggtggaaattctggcca

SEQ ID NO: 525304 - DNA, 20 bp, Artificial
  CRISPR gRNA sequence
tggccaacactggccaccat

SEQ ID NO: 525305 - DNA, 20 bp, Artificial
  CRISPR gRNA sequence
gccaacactggccaccatgc

SEQ ID NO: 525306 - DNA, 20 bp, Artificial
  CRISPR gRNA sequence
gccaccatgcacgtcctccc

SEQ ID NO: 525307 - DNA, 20 bp, Artificial
  CRISPR gRNA sequence
ccaacccagtgatattgcga

SEQ ID NO: 525308 - DNA, 20 bp, Artificial
  CRISPR gRNA sequence
cgagcttgaaatccaccagg

SEQ ID NO: 525309 - DNA, 20 bp, Artificial
  CRISPR gRNA sequence
gaaatccaccaggcaggatc

SEQ ID NO: 525310 - DNA, 20 bp, Artificial
  CRISPR gRNA sequence
aaatccaccaggcaggatca

SEQ ID NO: 525311 - DNA, 20 bp, Artificial
  CRISPR gRNA sequence
acaccacaggcaggagtact

SEQ ID NO: 525312 - DNA, 20 bp, Artificial
  CRISPR gRNA sequence
acaccacaggcgggagcagt

SEQ ID NO: 525313 - DNA, 20 bp, Artificial
  CRISPR gRNA sequence
acactgcaggcgggatcact

SEQ ID NO: 525314 - DNA, 20 bp, Artificial
  CRISPR gRNA sequence
caggcgggatcactcacacc

SEQ ID NO: 525315 - DNA, 20 bp, Artificial
  CRISPR gRNA sequence
acaccgcaggcgggagcact

SEQ ID NO: 525316 - DNA, 20 bp, Artificial
  CRISPR gRNA sequence
acaccgcaggcgggatcact

SEQ ID NO: 525317 - DNA, 20 bp, Artificial
  CRISPR gRNA sequence
acaccgcaggcaggaggact

SEQ ID NO: 525318 - DNA, 20 bp, Artificial
  CRISPR gRNA sequence
acacgggcaggcctggacaa

SEQ ID NO: 525319 - DNA, 20 bp, Artificial
  CRISPR gRNA sequence
gacaatgctgcagctcaggg

SEQ ID NO: 525320 - DNA, 20 bp, Artificial
  CRISPR gRNA sequence
cagctcagggctttgctttc

SEQ ID NO: 525321 - DNA, 20 bp, Artificial
  CRISPR gRNA sequence
agggctttgctttcttttct

SEQ ID NO: 525322 - DNA, 20 bp, Artificial
  CRISPR gRNA sequence
tgctttcttttcttatcctc

SEQ ID NO: 525323 - DNA, 20 bp, Artificial
  CRISPR gRNA sequence
gctttcttttcttatcctca

SEQ ID NO: 525324 - DNA, 20 bp, Artificial
  CRISPR gRNA sequence
ctttcttttcttatcctcat

SEQ ID NO: 525325 - DNA, 20 bp, Artificial
  CRISPR gRNA sequence
tcttttcttatcctcatgat

SEQ ID NO: 525326 - DNA, 20 bp, Artificial
  CRISPR gRNA sequence
cttttcttatcctcatgatg

SEQ ID NO: 525327 - DNA, 20 bp, Artificial
  CRISPR gRNA sequence
ttttcttatcctcatgatgc

SEQ ID NO: 525328 - DNA, 20 bp, Artificial
  CRISPR gRNA sequence
ttcttatcctcatgatgcaa

SEQ ID NO: 525329 - DNA, 20 bp, Artificial
  CRISPR gRNA sequence
tcttatcctcatgatgcaac

SEQ ID NO: 525330 - DNA, 20 bp, Artificial
  CRISPR gRNA sequence
cttatcctcatgatgcaaca

SEQ ID NO: 525331 - DNA, 20 bp, Artificial
  CRISPR gRNA sequence
ttatcctcatgatgcaacag

SEQ ID NO: 525332 - DNA, 20 bp, Artificial
  CRISPR gRNA sequence
atcctcatgatgcaacagta

SEQ ID NO: 525333 - DNA, 20 bp, Artificial
  CRISPR gRNA sequence
tcctcatgatgcaacagtaa

SEQ ID NO: 525334 - DNA, 20 bp, Artificial
  CRISPR gRNA sequence
atgatgcaacagtaattttt

SEQ ID NO: 525335 - DNA, 20 bp, Artificial
  CRISPR gRNA sequence
tttttttattttttatttat

SEQ ID NO: 525336 - DNA, 20 bp, Artificial
  CRISPR gRNA sequence
ttttttattttttatttatt

SEQ ID NO: 525337 - DNA, 20 bp, Artificial
  CRISPR gRNA sequence
tttttattttttatttattt

SEQ ID NO: 525338 - DNA, 20 bp, Artificial
  CRISPR gRNA sequence
ttttattttttatttatttt

SEQ ID NO: 525339 - DNA, 20 bp, Artificial
  CRISPR gRNA sequence
tttattttttatttatttta

SEQ ID NO: 525340 - DNA, 20 bp, Artificial
  CRISPR gRNA sequence
ttattttttatttattttat

SEQ ID NO: 525341 - DNA, 20 bp, Artificial
  CRISPR gRNA sequence
tattttttatttattttatt

SEQ ID NO: 525342 - DNA, 20 bp, Artificial
  CRISPR gRNA sequence
attttttatttattttattt

SEQ ID NO: 525343 - DNA, 20 bp, Artificial
  CRISPR gRNA sequence
ttttttatttattttatttt

SEQ ID NO: 525344 - DNA, 20 bp, Artificial
  CRISPR gRNA sequence
tttatttattttattttatt

SEQ ID NO: 525345 - DNA, 20 bp, Artificial
  CRISPR gRNA sequence
ttatttattttattttattt

SEQ ID NO: 525346 - DNA, 20 bp, Artificial
  CRISPR gRNA sequence
tatttattttattttatttt

SEQ ID NO: 525347 - DNA, 20 bp, Artificial
  CRISPR gRNA sequence
atttattttattttatttta

SEQ ID NO: 525348 - DNA, 20 bp, Artificial
  CRISPR gRNA sequence
tttattttattttattttat

SEQ ID NO: 525349 - DNA, 20 bp, Artificial
  CRISPR gRNA sequence
attttattttattttattta

SEQ ID NO: 525350 - DNA, 20 bp, Artificial
  CRISPR gRNA sequence
ttttattttattttatttat

SEQ ID NO: 525351 - DNA, 20 bp, Artificial
  CRISPR gRNA sequence
tattttattttatttatttt

SEQ ID NO: 525352 - DNA, 20 bp, Artificial
  CRISPR gRNA sequence
attttattttatttattttt

SEQ ID NO: 525353 - DNA, 20 bp, Artificial
  CRISPR gRNA sequence
ttttattttatttatttttt

SEQ ID NO: 525354 - DNA, 20 bp, Artificial
  CRISPR gRNA sequence
tattttatttatttttttat

SEQ ID NO: 525355 - DNA, 20 bp, Artificial
  CRISPR gRNA sequence
attttatttatttttttatt

SEQ ID NO: 525356 - DNA, 20 bp, Artificial
  CRISPR gRNA sequence
ttttatttatttttttattt

SEQ ID NO: 525357 - DNA, 20 bp, Artificial
  CRISPR gRNA sequence
tatttatttttttatttcat

SEQ ID NO: 525358 - DNA, 20 bp, Artificial
  CRISPR gRNA sequence
atttatttttttatttcatt

SEQ ID NO: 525359 - DNA, 20 bp, Artificial
  CRISPR gRNA sequence
tttatttttttatttcattt

SEQ ID NO: 525360 - DNA, 20 bp, Artificial
  CRISPR gRNA sequence
atttttttatttcatttcat

SEQ ID NO: 525361 - DNA, 20 bp, Artificial
  CRISPR gRNA sequence
tttttttatttcatttcatt

SEQ ID NO: 525362 - DNA, 20 bp, Artificial
  CRISPR gRNA sequence
ttttatttcatttcatttca

SEQ ID NO: 525363 - DNA, 20 bp, Artificial
  CRISPR gRNA sequence
tttatttcatttcatttcat

SEQ ID NO: 525364 - DNA, 20 bp, Artificial
  CRISPR gRNA sequence
ttatttcatttcatttcatt

SEQ ID NO: 525365 - DNA, 20 bp, Artificial
  CRISPR gRNA sequence
tatttcatttcatttcattt

SEQ ID NO: 525366 - DNA, 20 bp, Artificial
  CRISPR gRNA sequence
atttcatttcatttcatttc

SEQ ID NO: 525367 - DNA, 20 bp, Artificial
  CRISPR gRNA sequence
tttcatttcatttcatttca

SEQ ID NO: 525368 - DNA, 20 bp, Artificial
  CRISPR gRNA sequence
catttcatttcatttcattt

SEQ ID NO: 525369 - DNA, 20 bp, Artificial
  CRISPR gRNA sequence
atttcatttcatttcatttc

SEQ ID NO: 525370 - DNA, 20 bp, Artificial
  CRISPR gRNA sequence
catttcatttcatttcattt

SEQ ID NO: 525371 - DNA, 20 bp, Artificial
  CRISPR gRNA sequence
atttcatttcatttcatttc

SEQ ID NO: 525372 - DNA, 20 bp, Artificial
  CRISPR gRNA sequence
catttcatttcatttcattt

SEQ ID NO: 525373 - DNA, 20 bp, Artificial
  CRISPR gRNA sequence
atttcatttcatttcatttt

SEQ ID NO: 525374 - DNA, 20 bp, Artificial
  CRISPR gRNA sequence
catttcatttcattttattt

SEQ ID NO: 525375 - DNA, 20 bp, Artificial
  CRISPR gRNA sequence
atttcatttcattttatttt

SEQ ID NO: 525376 - DNA, 20 bp, Artificial
  CRISPR gRNA sequence
catttcattttattttattg

SEQ ID NO: 525377 - DNA, 20 bp, Artificial
  CRISPR gRNA sequence
atttcattttattttattga

SEQ ID NO: 525378 - DNA, 20 bp, Artificial
  CRISPR gRNA sequence
cattttattttattgagaca

SEQ ID NO: 525379 - DNA, 20 bp, Artificial
  CRISPR gRNA sequence
attttattttattgagacag

SEQ ID NO: 525380 - DNA, 20 bp, Artificial
  CRISPR gRNA sequence
tattttattgagacagagtt

SEQ ID NO: 525381 - DNA, 20 bp, Artificial
  CRISPR gRNA sequence
attttattgagacagagttt

SEQ ID NO: 525382 - DNA, 20 bp, Artificial
  CRISPR gRNA sequence
ttttattgagacagagtttt

SEQ ID NO: 525383 - DNA, 20 bp, Artificial
  CRISPR gRNA sequence
tattgagacagagttttgct

SEQ ID NO: 525384 - DNA, 20 bp, Artificial
  CRISPR gRNA sequence
attgagacagagttttgctc

SEQ ID NO: 525385 - DNA, 20 bp, Artificial
  CRISPR gRNA sequence
ttgagacagagttttgctct

SEQ ID NO: 525386 - DNA, 20 bp, Artificial
  CRISPR gRNA sequence
agacagagttttgctcttgt

SEQ ID NO: 525387 - DNA, 20 bp, Artificial
  CRISPR gRNA sequence
tgctcttgttgcccaggctg

SEQ ID NO: 525388 - DNA, 20 bp, Artificial
  CRISPR gRNA sequence
gctcttgttgcccaggctgg

SEQ ID NO: 525389 - DNA, 20 bp, Artificial
  CRISPR gRNA sequence
ctcttgttgcccaggctgga

SEQ ID NO: 525390 - DNA, 20 bp, Artificial
  CRISPR gRNA sequence
ttgttgcccaggctggagtg

SEQ ID NO: 525391 - DNA, 20 bp, Artificial
  CRISPR gRNA sequence
gttgcccaggctggagtgcc

SEQ ID NO: 525392 - DNA, 20 bp, Artificial
  CRISPR gRNA sequence
ttgcccaggctggagtgcca

SEQ ID NO: 525393 - DNA, 20 bp, Artificial
  CRISPR gRNA sequence
cccaggctggagtgccatgg

SEQ ID NO: 525394 - DNA, 20 bp, Artificial
  CRISPR gRNA sequence
gagtgccatggtgtgatctc

SEQ ID NO: 525395 - DNA, 20 bp, Artificial
  CRISPR gRNA sequence
agctcattgcgacctccgcc

SEQ ID NO: 525396 - DNA, 20 bp, Artificial
  CRISPR gRNA sequence
attgcgacctccgcctcctg

SEQ ID NO: 525397 - DNA, 20 bp, Artificial
  CRISPR gRNA sequence
cgacctccgcctcctgggtt

SEQ ID NO: 525398 - DNA, 20 bp, Artificial
  CRISPR gRNA sequence
cgcctcctgggttctcctgc

SEQ ID NO: 525399 - DNA, 20 bp, Artificial
  CRISPR gRNA sequence
ctgggttctcctgcctcagt

SEQ ID NO: 525400 - DNA, 20 bp, Artificial
  CRISPR gRNA sequence
ggttctcctgcctcagtctc

SEQ ID NO: 525401 - DNA, 20 bp, Artificial
  CRISPR gRNA sequence
tcctgcctcagtctcctgag

SEQ ID NO: 525402 - DNA, 20 bp, Artificial
  CRISPR gRNA sequence
ctgcctcagtctcctgagta

SEQ ID NO: 525403 - DNA, 20 bp, Artificial
  CRISPR gRNA sequence
cctcagtctcctgagtagct

SEQ ID NO: 525404 - DNA, 20 bp, Artificial
  CRISPR gRNA sequence
agtctcctgagtagctgggc

SEQ ID NO: 525405 - DNA, 20 bp, Artificial
  CRISPR gRNA sequence
ctgagtagctgggcttacag

SEQ ID NO: 525406 - DNA, 20 bp, Artificial
  CRISPR gRNA sequence
agtagctgggcttacaggtg

SEQ ID NO: 525407 - DNA, 20 bp, Artificial
  CRISPR gRNA sequence
ggcttacaggtgcccaccac

SEQ ID NO: 525408 - DNA, 20 bp, Artificial
  CRISPR gRNA sequence
acaggtgcccaccaccacgc

SEQ ID NO: 525409 - DNA, 20 bp, Artificial
  CRISPR gRNA sequence
caggtgcccaccaccacgcc

SEQ ID NO: 525410 - DNA, 20 bp, Artificial
  CRISPR gRNA sequence
atttttgtatttttagtaga

SEQ ID NO: 525411 - DNA, 20 bp, Artificial
  CRISPR gRNA sequence
ttgtatttttagtagagacg

SEQ ID NO: 525412 - DNA, 20 bp, Artificial
  CRISPR gRNA sequence
tgtatttttagtagagacgg

SEQ ID NO: 525413 - DNA, 20 bp, Artificial
  CRISPR gRNA sequence
gtatttttagtagagacggg

SEQ ID NO: 525414 - DNA, 20 bp, Artificial
  CRISPR gRNA sequence
tatttttagtagagacgggg

SEQ ID NO: 525415 - DNA, 20 bp, Artificial
  CRISPR gRNA sequence
ttagtagagacggggtttca

SEQ ID NO: 525416 - DNA, 20 bp, Artificial
  CRISPR gRNA sequence
tagtagagacggggtttcac

SEQ ID NO: 525417 - DNA, 20 bp, Artificial
  CRISPR gRNA sequence
agtagagacggggtttcacc

SEQ ID NO: 525418 - DNA, 20 bp, Artificial
  CRISPR gRNA sequence
gtagagacggggtttcacca

SEQ ID NO: 525419 - DNA, 20 bp, Artificial
  CRISPR gRNA sequence
caccatgttggccaggctgg

SEQ ID NO: 525420 - DNA, 20 bp, Artificial
  CRISPR gRNA sequence
accatgttggccaggctggt

SEQ ID NO: 525421 - DNA, 20 bp, Artificial
  CRISPR gRNA sequence
gccaggctggtctcaaactc

SEQ ID NO: 525422 - DNA, 20 bp, Artificial
  CRISPR gRNA sequence
gtctcaaactcctgacctca

SEQ ID NO: 525423 - DNA, 20 bp, Artificial
  CRISPR gRNA sequence
aaactcctgacctcagtgat

SEQ ID NO: 525424 - DNA, 20 bp, Artificial
  CRISPR gRNA sequence
ctgacctcagtgatccaccc

SEQ ID NO: 525425 - DNA, 20 bp, Artificial
  CRISPR gRNA sequence
acctcagtgatccacccact

SEQ ID NO: 525426 - DNA, 20 bp, Artificial
  CRISPR gRNA sequence
agtgatccacccactttggc

SEQ ID NO: 525427 - DNA, 20 bp, Artificial
  CRISPR gRNA sequence
tggcctcccaaagtgctggg

SEQ ID NO: 525428 - DNA, 20 bp, Artificial
  CRISPR gRNA sequence
ggcctcccaaagtgctggga

SEQ ID NO: 525429 - DNA, 20 bp, Artificial
  CRISPR gRNA sequence
gcctcccaaagtgctgggat

SEQ ID NO: 525430 - DNA, 20 bp, Artificial
  CRISPR gRNA sequence
ccaaagtgctgggatcacag

SEQ ID NO: 525431 - DNA, 20 bp, Artificial
  CRISPR gRNA sequence
ggatcacaggcgtgagccat

SEQ ID NO: 525432 - DNA, 20 bp, Artificial
  CRISPR gRNA sequence
gcctgggttttttttgtttt

SEQ ID NO: 525433 - DNA, 20 bp, Artificial
  CRISPR gRNA sequence
ggttttttttgttttgtttt

SEQ ID NO: 525434 - DNA, 20 bp, Artificial
  CRISPR gRNA sequence
tttttgttttgttttgtttt

SEQ ID NO: 525435 - DNA, 20 bp, Artificial
  CRISPR gRNA sequence
ttttgttttgttttgttttt

SEQ ID NO: 525436 - DNA, 20 bp, Artificial
  CRISPR gRNA sequence
tttgttttgttttgtttttt

SEQ ID NO: 525437 - DNA, 20 bp, Artificial
  CRISPR gRNA sequence
ttgttttgttttgttttttt

SEQ ID NO: 525438 - DNA, 20 bp, Artificial
  CRISPR gRNA sequence
tgttttgttttgtttttttg

SEQ ID NO: 525439 - DNA, 20 bp, Artificial
  CRISPR gRNA sequence
gttttgttttgtttttttga

SEQ ID NO: 525440 - DNA, 20 bp, Artificial
  CRISPR gRNA sequence
ttttgttttgtttttttgag

SEQ ID NO: 525441 - DNA, 20 bp, Artificial
  CRISPR gRNA sequence
tgttttgtttttttgagaca

SEQ ID NO: 525442 - DNA, 20 bp, Artificial
  CRISPR gRNA sequence
gttttgtttttttgagacaa

SEQ ID NO: 525443 - DNA, 20 bp, Artificial
  CRISPR gRNA sequence
ttttgtttttttgagacaag

SEQ ID NO: 525444 - DNA, 20 bp, Artificial
  CRISPR gRNA sequence
tgtttttttgagacaaggtc

SEQ ID NO: 525445 - DNA, 20 bp, Artificial
  CRISPR gRNA sequence
gtttttttgagacaaggtct

SEQ ID NO: 525446 - DNA, 20 bp, Artificial
  CRISPR gRNA sequence
tttttttgagacaaggtctt

SEQ ID NO: 525447 - DNA, 20 bp, Artificial
  CRISPR gRNA sequence
ttttgagacaaggtcttgct

SEQ ID NO: 525448 - DNA, 20 bp, Artificial
  CRISPR gRNA sequence
tttgagacaaggtcttgctc

SEQ ID NO: 525449 - DNA, 20 bp, Artificial
  CRISPR gRNA sequence
ttgagacaaggtcttgctct

SEQ ID NO: 525450 - DNA, 20 bp, Artificial
  CRISPR gRNA sequence
tgagacaaggtcttgctctg

SEQ ID NO: 525451 - DNA, 20 bp, Artificial
  CRISPR gRNA sequence
gagacaaggtcttgctctgt

SEQ ID NO: 525452 - DNA, 20 bp, Artificial
  CRISPR gRNA sequence
agacaaggtcttgctctgtc

SEQ ID NO: 525453 - DNA, 20 bp, Artificial
  CRISPR gRNA sequence
gctctgtcgcccaggctgga

SEQ ID NO: 525454 - DNA, 20 bp, Artificial
  CRISPR gRNA sequence
ctctgtcgcccaggctggag

SEQ ID NO: 525455 - DNA, 20 bp, Artificial
  CRISPR gRNA sequence
tgtcgcccaggctggagtgc

SEQ ID NO: 525456 - DNA, 20 bp, Artificial
  CRISPR gRNA sequence
tcgcccaggctggagtgcag

SEQ ID NO: 525457 - DNA, 20 bp, Artificial
  CRISPR gRNA sequence
gagtgcagtggtgcgatctc

SEQ ID NO: 525458 - DNA, 20 bp, Artificial
  CRISPR gRNA sequence
agctcactgcaacctccacc

SEQ ID NO: 525459 - DNA, 20 bp, Artificial
  CRISPR gRNA sequence
actgcaacctccacctcctg

SEQ ID NO: 525460 - DNA, 20 bp, Artificial
  CRISPR gRNA sequence
caacctccacctcctgggtt

SEQ ID NO: 525461 - DNA, 20 bp, Artificial
  CRISPR gRNA sequence
cacctcctgggtttaagtga

SEQ ID NO: 525462 - DNA, 20 bp, Artificial
  CRISPR gRNA sequence
ctgggtttaagtgatcctcc

SEQ ID NO: 525463 - DNA, 20 bp, Artificial
  CRISPR gRNA sequence
ggtttaagtgatcctcctgc

SEQ ID NO: 525464 - DNA, 20 bp, Artificial
  CRISPR gRNA sequence
aagtgatcctcctgcctcag

SEQ ID NO: 525465 - DNA, 20 bp, Artificial
  CRISPR gRNA sequence
agtgatcctcctgcctcagc

SEQ ID NO: 525466 - DNA, 20 bp, Artificial
  CRISPR gRNA sequence
ctgcctcagcctcccgagta

SEQ ID NO: 525467 - DNA, 20 bp, Artificial
  CRISPR gRNA sequence
cctcagcctcccgagtatct

SEQ ID NO: 525468 - DNA, 20 bp, Artificial
  CRISPR gRNA sequence
agcctcccgagtatctggta

SEQ ID NO: 525469 - DNA, 20 bp, Artificial
  CRISPR gRNA sequence
ccgagtatctggtactacag

SEQ ID NO: 525470 - DNA, 20 bp, Artificial
  CRISPR gRNA sequence
gtactacaggcatgtgacgc

SEQ ID NO: 525471 - DNA, 20 bp, Artificial
  CRISPR gRNA sequence
caggcatgtgacgccacacc

SEQ ID NO: 525472 - DNA, 20 bp, Artificial
  CRISPR gRNA sequence
taatatttgtactttttgta

SEQ ID NO: 525473 - DNA, 20 bp, Artificial
  CRISPR gRNA sequence
atatttgtactttttgtaga

SEQ ID NO: 525474 - DNA, 20 bp, Artificial
  CRISPR gRNA sequence
gtactttttgtagagatggg

SEQ ID NO: 525475 - DNA, 20 bp, Artificial
  CRISPR gRNA sequence
tactttttgtagagatgggg

SEQ ID NO: 525476 - DNA, 20 bp, Artificial
  CRISPR gRNA sequence
tttgtagagatggggtcttc

SEQ ID NO: 525477 - DNA, 20 bp, Artificial
  CRISPR gRNA sequence
ttgtagagatggggtcttct

SEQ ID NO: 525478 - DNA, 20 bp, Artificial
  CRISPR gRNA sequence
tgtagagatggggtcttctt

SEQ ID NO: 525479 - DNA, 20 bp, Artificial
  CRISPR gRNA sequence
gtagagatggggtcttctta

SEQ ID NO: 525480 - DNA, 20 bp, Artificial
  CRISPR gRNA sequence
tagagatggggtcttcttat

SEQ ID NO: 525481 - DNA, 20 bp, Artificial
  CRISPR gRNA sequence
cttatgttgcccaggctggt

SEQ ID NO: 525482 - DNA, 20 bp, Artificial
  CRISPR gRNA sequence
ttatgttgcccaggctggtc

SEQ ID NO: 525483 - DNA, 20 bp, Artificial
  CRISPR gRNA sequence
atgttgcccaggctggtcct

SEQ ID NO: 525484 - DNA, 20 bp, Artificial
  CRISPR gRNA sequence
tgttgcccaggctggtcctg

SEQ ID NO: 525485 - DNA, 20 bp, Artificial
  CRISPR gRNA sequence
cccaggctggtcctgaactc

SEQ ID NO: 525486 - DNA, 20 bp, Artificial
  CRISPR gRNA sequence
gtcctgaactcctgggctca

SEQ ID NO: 525487 - DNA, 20 bp, Artificial
  CRISPR gRNA sequence
aactcctgggctcaggcaat

SEQ ID NO: 525488 - DNA, 20 bp, Artificial
  CRISPR gRNA sequence
ctgggctcaggcaatcttcc

SEQ ID NO: 525489 - DNA, 20 bp, Artificial
  CRISPR gRNA sequence
ggctcaggcaatcttcccac

SEQ ID NO: 525490 - DNA, 20 bp, Artificial
  CRISPR gRNA sequence
aggcaatcttcccacatcgg

SEQ ID NO: 525491 - DNA, 20 bp, Artificial
  CRISPR gRNA sequence
cccacatcggcctcccgagt

SEQ ID NO: 525492 - DNA, 20 bp, Artificial
  CRISPR gRNA sequence
ccacatcggcctcccgagta

SEQ ID NO: 525493 - DNA, 20 bp, Artificial
  CRISPR gRNA sequence
ccgagtactggtattccagg

SEQ ID NO: 525494 - DNA, 20 bp, Artificial
  CRISPR gRNA sequence
gtattccaggcgtggcccct

SEQ ID NO: 525495 - DNA, 20 bp, Artificial
  CRISPR gRNA sequence
caggcgtggcccctgggcag

SEQ ID NO: 525496 - DNA, 20 bp, Artificial
  CRISPR gRNA sequence
ggcagctcagggctttttac

SEQ ID NO: 525497 - DNA, 20 bp, Artificial
  CRISPR gRNA sequence
agggctttttacccccaaga

SEQ ID NO: 525498 - DNA, 20 bp, Artificial
  CRISPR gRNA sequence
tttacccccaagaacctctt

SEQ ID NO: 525499 - DNA, 20 bp, Artificial
  CRISPR gRNA sequence
ttacccccaagaacctctta

SEQ ID NO: 525500 - DNA, 20 bp, Artificial
  CRISPR gRNA sequence
tacccccaagaacctcttac

SEQ ID NO: 525501 - DNA, 20 bp, Artificial
  CRISPR gRNA sequence
acccccaagaacctcttacc

SEQ ID NO: 525502 - DNA, 20 bp, Artificial
  CRISPR gRNA sequence
cccccaagaacctcttacca

SEQ ID NO: 525503 - DNA, 20 bp, Artificial
  CRISPR gRNA sequence
ttaccacacatcactgacca

SEQ ID NO: 525504 - DNA, 20 bp, Artificial
  CRISPR gRNA sequence
accacacatcactgaccaca

SEQ ID NO: 525505 - DNA, 20 bp, Artificial
  CRISPR gRNA sequence
ccacacatcactgaccacac

SEQ ID NO: 525506 - DNA, 20 bp, Artificial
  CRISPR gRNA sequence
accacacactctggggacca

SEQ ID NO: 525507 - DNA, 20 bp, Artificial
  CRISPR gRNA sequence
tggggaccaagtgcaaaact

SEQ ID NO: 525508 - DNA, 20 bp, Artificial
  CRISPR gRNA sequence
gggaccaagtgcaaaactgc

SEQ ID NO: 525509 - DNA, 20 bp, Artificial
  CRISPR gRNA sequence
cgttgaggaccgtcccagcc

SEQ ID NO: 525510 - DNA, 20 bp, Artificial
  CRISPR gRNA sequence
aggaccgtcccagccatttt

SEQ ID NO: 525511 - DNA, 20 bp, Artificial
  CRISPR gRNA sequence
tgcaggtgcagaagcccctg

SEQ ID NO: 525512 - DNA, 20 bp, Artificial
  CRISPR gRNA sequence
gcaggtgcagaagcccctgg

SEQ ID NO: 525513 - DNA, 20 bp, Artificial
  CRISPR gRNA sequence
caggtgcagaagcccctggg

SEQ ID NO: 525514 - DNA, 20 bp, Artificial
  CRISPR gRNA sequence
gggtgagcccagtgcgtgga

SEQ ID NO: 525515 - DNA, 20 bp, Artificial
  CRISPR gRNA sequence
gccgtgccatgtctggtctt

SEQ ID NO: 525516 - DNA, 20 bp, Artificial
  CRISPR gRNA sequence
gtcttcttgcccaacagaaa

SEQ ID NO: 525517 - DNA, 20 bp, Artificial
  CRISPR gRNA sequence
cttgcccaacagaaactcac

SEQ ID NO: 525518 - DNA, 20 bp, Artificial
  CRISPR gRNA sequence
ttgcccaacagaaactcacc

SEQ ID NO: 525519 - DNA, 20 bp, Artificial
  CRISPR gRNA sequence
gcccaacagaaactcaccga

SEQ ID NO: 525520 - DNA, 20 bp, Artificial
  CRISPR gRNA sequence
cccaacagaaactcaccgag

SEQ ID NO: 525521 - DNA, 20 bp, Artificial
  CRISPR gRNA sequence
accgagatcatccccaagtc

SEQ ID NO: 525522 - DNA, 20 bp, Artificial
  CRISPR gRNA sequence
tctgaggactccagcaatgt

SEQ ID NO: 525523 - DNA, 20 bp, Artificial
  CRISPR gRNA sequence
aggactccagcaatgtggtc

SEQ ID NO: 525524 - DNA, 20 bp, Artificial
  CRISPR gRNA sequence
cagcaatgtggtccatctca

SEQ ID NO: 525525 - DNA, 20 bp, Artificial
  CRISPR gRNA sequence
attaagaatgcttacaatgt

SEQ ID NO: 525526 - DNA, 20 bp, Artificial
  CRISPR gRNA sequence
agaatgcttacaatgtgagt

SEQ ID NO: 525527 - DNA, 20 bp, Artificial
  CRISPR gRNA sequence
acaatgtgagtctcccgcac

SEQ ID NO: 525528 - DNA, 20 bp, Artificial
  CRISPR gRNA sequence
caatgtgagtctcccgcacc

SEQ ID NO: 525529 - DNA, 20 bp, Artificial
  CRISPR gRNA sequence
ccgcaccactcagctgggac

SEQ ID NO: 525530 - DNA, 20 bp, Artificial
  CRISPR gRNA sequence
agctgggacccatggggtgg

SEQ ID NO: 525531 - DNA, 20 bp, Artificial
  CRISPR gRNA sequence
ggacccatggggtggccagc

SEQ ID NO: 525532 - DNA, 20 bp, Artificial
  CRISPR gRNA sequence
cccactgcaggtcagctcct

SEQ ID NO: 525533 - DNA, 20 bp, Artificial
  CRISPR gRNA sequence
caggtcagctcctgctgcag

SEQ ID NO: 525534 - DNA, 20 bp, Artificial
  CRISPR gRNA sequence
ctgctgcaggtcagcaggag

SEQ ID NO: 525535 - DNA, 20 bp, Artificial
  CRISPR gRNA sequence
ctgcaggtcagcaggagggt

SEQ ID NO: 525536 - DNA, 20 bp, Artificial
  CRISPR gRNA sequence
caggtcagcaggagggtggt

SEQ ID NO: 525537 - DNA, 20 bp, Artificial
  CRISPR gRNA sequence
ggaggaaagcccctgccccg

SEQ ID NO: 525538 - DNA, 20 bp, Artificial
  CRISPR gRNA sequence
ccccgtgggccagctgcagc

SEQ ID NO: 525539 - DNA, 20 bp, Artificial
  CRISPR gRNA sequence
cagcctcccgacctgccctc

SEQ ID NO: 525540 - DNA, 20 bp, Artificial
  CRISPR gRNA sequence
ccgacctgccctcaggcctc

SEQ ID NO: 525541 - DNA, 20 bp, Artificial
  CRISPR gRNA sequence
ccctcaggcctccaggacac

SEQ ID NO: 525542 - DNA, 20 bp, Artificial
  CRISPR gRNA sequence
aggcctccaggacaccctgg

SEQ ID NO: 525543 - DNA, 20 bp, Artificial
  CRISPR gRNA sequence
caggacaccctggcccggca

SEQ ID NO: 525544 - DNA, 20 bp, Artificial
  CRISPR gRNA sequence
gcccggcacttccacgggga

SEQ ID NO: 525545 - DNA, 20 bp, Artificial
  CRISPR gRNA sequence
ccacggggagctctgggtcc

SEQ ID NO: 525546 - DNA, 20 bp, Artificial
  CRISPR gRNA sequence
cacggggagctctgggtcct

SEQ ID NO: 525547 - DNA, 20 bp, Artificial
  CRISPR gRNA sequence
tgggtcctctctcgttgatg

SEQ ID NO: 525548 - DNA, 20 bp, Artificial
  CRISPR gRNA sequence
ggtcctctctcgttgatgtt

SEQ ID NO: 525549 - DNA, 20 bp, Artificial
  CRISPR gRNA sequence
tctcgttgatgttgtgggcg

SEQ ID NO: 525550 - DNA, 20 bp, Artificial
  CRISPR gRNA sequence
tcgttgatgttgtgggcgat

SEQ ID NO: 525551 - DNA, 20 bp, Artificial
  CRISPR gRNA sequence
gttgatgttgtgggcgatgc

SEQ ID NO: 525552 - DNA, 20 bp, Artificial
  CRISPR gRNA sequence
atgttgtgggcgatgctccc

SEQ ID NO: 525553 - DNA, 20 bp, Artificial
  CRISPR gRNA sequence
tgggcgatgctccctgaaac

SEQ ID NO: 525554 - DNA, 20 bp, Artificial
  CRISPR gRNA sequence
cctgaaacctgagctccgga

SEQ ID NO: 525555 - DNA, 20 bp, Artificial
  CRISPR gRNA sequence
aaacctgagctccggactct

SEQ ID NO: 525556 - DNA, 20 bp, Artificial
  CRISPR gRNA sequence
agctccggactcttcattcc

SEQ ID NO: 525557 - DNA, 20 bp, Artificial
  CRISPR gRNA sequence
cggactcttcattccagact

SEQ ID NO: 525558 - DNA, 20 bp, Artificial
  CRISPR gRNA sequence
ttcattccagactcttctct

SEQ ID NO: 525559 - DNA, 20 bp, Artificial
  CRISPR gRNA sequence
cattccagactcttctctgc

SEQ ID NO: 525560 - DNA, 20 bp, Artificial
  CRISPR gRNA sequence
attccagactcttctctgcg

SEQ ID NO: 525561 - DNA, 20 bp, Artificial
  CRISPR gRNA sequence
cagactcttctctgcgggtc

SEQ ID NO: 525562 - DNA, 20 bp, Artificial
  CRISPR gRNA sequence
ttctctgcgggtctctatgg

SEQ ID NO: 525563 - DNA, 20 bp, Artificial
  CRISPR gRNA sequence
ctctgcgggtctctatggag

SEQ ID NO: 525564 - DNA, 20 bp, Artificial
  CRISPR gRNA sequence
tctgcgggtctctatggaga

SEQ ID NO: 525565 - DNA, 20 bp, Artificial
  CRISPR gRNA sequence
tgcgggtctctatggagaag

SEQ ID NO: 525566 - DNA, 20 bp, Artificial
  CRISPR gRNA sequence
cgggtctctatggagaaggg

SEQ ID NO: 525567 - DNA, 20 bp, Artificial
  CRISPR gRNA sequence
tatggagaagggaggtggac

SEQ ID NO: 525568 - DNA, 20 bp, Artificial
  CRISPR gRNA sequence
tggagaagggaggtggacag

SEQ ID NO: 525569 - DNA, 20 bp, Artificial
  CRISPR gRNA sequence
tggtggcaaacagtgcagct

SEQ ID NO: 525570 - DNA, 20 bp, Artificial
  CRISPR gRNA sequence
gtggcaaacagtgcagctgg

SEQ ID NO: 525571 - DNA, 20 bp, Artificial
  CRISPR gRNA sequence
gggcaggaggaggccacagg

SEQ ID NO: 525572 - DNA, 20 bp, Artificial
  CRISPR gRNA sequence
gggccctgggaagacaccct

SEQ ID NO: 525573 - DNA, 20 bp, Artificial
  CRISPR gRNA sequence
ggccctgggaagacaccctg

SEQ ID NO: 525574 - DNA, 20 bp, Artificial
  CRISPR gRNA sequence
ggaagacaccctggggggtg

SEQ ID NO: 525575 - DNA, 20 bp, Artificial
  CRISPR gRNA sequence
gggggtggaattcctcttgc

SEQ ID NO: 525576 - DNA, 20 bp, Artificial
  CRISPR gRNA sequence
ctcttgctctgttcacctgt

SEQ ID NO: 525577 - DNA, 20 bp, Artificial
  CRISPR gRNA sequence
ttgctctgttcacctgtcct

SEQ ID NO: 525578 - DNA, 20 bp, Artificial
  CRISPR gRNA sequence
gctctgttcacctgtcctgg

SEQ ID NO: 525579 - DNA, 20 bp, Artificial
  CRISPR gRNA sequence
ctctgttcacctgtcctggg

SEQ ID NO: 525580 - DNA, 20 bp, Artificial
  CRISPR gRNA sequence
tgttcacctgtcctgggcaa

SEQ ID NO: 525581 - DNA, 20 bp, Artificial
  CRISPR gRNA sequence
ttcacctgtcctgggcaagc

SEQ ID NO: 525582 - DNA, 20 bp, Artificial
  CRISPR gRNA sequence
acctgtcctgggcaagctcc

SEQ ID NO: 525583 - DNA, 20 bp, Artificial
  CRISPR gRNA sequence
tcctgggcaagctccagaga

SEQ ID NO: 525584 - DNA, 20 bp, Artificial
  CRISPR gRNA sequence
ggcaagctccagagaagccc

SEQ ID NO: 525585 - DNA, 20 bp, Artificial
  CRISPR gRNA sequence
cagagaagcccttaacccct

SEQ ID NO: 525586 - DNA, 20 bp, Artificial
  CRISPR gRNA sequence
aacccctgaatttctccctg

SEQ ID NO: 525587 - DNA, 20 bp, Artificial
  CRISPR gRNA sequence
acccctgaatttctccctgg

SEQ ID NO: 525588 - DNA, 20 bp, Artificial
  CRISPR gRNA sequence
aatttctccctggtgcacgg

SEQ ID NO: 525589 - DNA, 20 bp, Artificial
  CRISPR gRNA sequence
ctccctggtgcacggcccat

SEQ ID NO: 525590 - DNA, 20 bp, Artificial
  CRISPR gRNA sequence
tccctggtgcacggcccatc

SEQ ID NO: 525591 - DNA, 20 bp, Artificial
  CRISPR gRNA sequence
cctggtgcacggcccatcga

SEQ ID NO: 525592 - DNA, 20 bp, Artificial
  CRISPR gRNA sequence
gtgcacggcccatcgagctg

SEQ ID NO: 525593 - DNA, 20 bp, Artificial
  CRISPR gRNA sequence
caccctgggctgctcccctg

SEQ ID NO: 525594 - DNA, 20 bp, Artificial
  CRISPR gRNA sequence
ggctgctcccctggggagcc

SEQ ID NO: 525595 - DNA, 20 bp, Artificial
  CRISPR gRNA sequence
ctcccctggggagcccatgg

SEQ ID NO: 525596 - DNA, 20 bp, Artificial
  CRISPR gRNA sequence
ccctggggagcccatggccc

SEQ ID NO: 525597 - DNA, 20 bp, Artificial
  CRISPR gRNA sequence
gggagcccatggccctggtg

SEQ ID NO: 525598 - DNA, 20 bp, Artificial
  CRISPR gRNA sequence
gtgggcataggtaggcatag

SEQ ID NO: 525599 - DNA, 20 bp, Artificial
  CRISPR gRNA sequence
ggtgccattcagggccccag

SEQ ID NO: 525600 - DNA, 20 bp, Artificial
  CRISPR gRNA sequence
agggccccaggcaccagagg

SEQ ID NO: 525601 - DNA, 20 bp, Artificial
  CRISPR gRNA sequence
ctctggaaatctacccccag

SEQ ID NO: 525602 - DNA, 20 bp, Artificial
  CRISPR gRNA sequence
tggaaatctacccccaggtg

SEQ ID NO: 525603 - DNA, 20 bp, Artificial
  CRISPR gRNA sequence
gaaatctacccccaggtgag

SEQ ID NO: 525604 - DNA, 20 bp, Artificial
  CRISPR gRNA sequence
cccccaggtgagagatgttc

SEQ ID NO: 525605 - DNA, 20 bp, Artificial
  CRISPR gRNA sequence
tcagaattctggcctggatc

SEQ ID NO: 525606 - DNA, 20 bp, Artificial
  CRISPR gRNA sequence
agaattctggcctggatcct

SEQ ID NO: 525607 - DNA, 20 bp, Artificial
  CRISPR gRNA sequence
tggcctggatccttctaggc

SEQ ID NO: 525608 - DNA, 20 bp, Artificial
  CRISPR gRNA sequence
gcctggatccttctaggcca

SEQ ID NO: 525609 - DNA, 20 bp, Artificial
  CRISPR gRNA sequence
gatccttctaggccaaaggt

SEQ ID NO: 525610 - DNA, 20 bp, Artificial
  CRISPR gRNA sequence
ctaggccaaaggtcctgctg

SEQ ID NO: 525611 - DNA, 20 bp, Artificial
  CRISPR gRNA sequence
taggccaaaggtcctgctgg

SEQ ID NO: 525612 - DNA, 20 bp, Artificial
  CRISPR gRNA sequence
ggccaaaggtcctgctggct

SEQ ID NO: 525613 - DNA, 20 bp, Artificial
  CRISPR gRNA sequence
ctggcttgagggagctcagc

SEQ ID NO: 525614 - DNA, 20 bp, Artificial
  CRISPR gRNA sequence
gcttgagggagctcagcacg

SEQ ID NO: 525615 - DNA, 20 bp, Artificial
  CRISPR gRNA sequence
gagggagctcagcacgttag

SEQ ID NO: 525616 - DNA, 20 bp, Artificial
  CRISPR gRNA sequence
agggagctcagcacgttagc

SEQ ID NO: 525617 - DNA, 20 bp, Artificial
  CRISPR gRNA sequence
agcacgttagcgcctccgac

SEQ ID NO: 525618 - DNA, 20 bp, Artificial
  CRISPR gRNA sequence
gcgcctccgacaaacgttgg

SEQ ID NO: 525619 - DNA, 20 bp, Artificial
  CRISPR gRNA sequence
cgacaaacgttgggtcattg

SEQ ID NO: 525620 - DNA, 20 bp, Artificial
  CRISPR gRNA sequence
ggtcattgaattaaactgaa

SEQ ID NO: 525621 - DNA, 20 bp, Artificial
  CRISPR gRNA sequence
aattaaactgaaggcccgtg

SEQ ID NO: 525622 - DNA, 20 bp, Artificial
  CRISPR gRNA sequence
aactgaaggcccgtggagga

SEQ ID NO: 525623 - DNA, 20 bp, Artificial
  CRISPR gRNA sequence
aaggcccgtggaggaggtgc

SEQ ID NO: 525624 - DNA, 20 bp, Artificial
  CRISPR gRNA sequence
gcttctcgtagcctcccgtg

SEQ ID NO: 525625 - DNA, 20 bp, Artificial
  CRISPR gRNA sequence
cttctcgtagcctcccgtga

SEQ ID NO: 525626 - DNA, 20 bp, Artificial
  CRISPR gRNA sequence
ctcgtagcctcccgtgagcc

SEQ ID NO: 525627 - DNA, 20 bp, Artificial
  CRISPR gRNA sequence
tcgtagcctcccgtgagccc

SEQ ID NO: 525628 - DNA, 20 bp, Artificial
  CRISPR gRNA sequence
gtagcctcccgtgagcccca

SEQ ID NO: 525629 - DNA, 20 bp, Artificial
  CRISPR gRNA sequence
ccgtgagccccaaaccccca

SEQ ID NO: 525630 - DNA, 20 bp, Artificial
  CRISPR gRNA sequence
ctgggtgccagccactgccc

SEQ ID NO: 525631 - DNA, 20 bp, Artificial
  CRISPR gRNA sequence
ggtgccagccactgcccgag

SEQ ID NO: 525632 - DNA, 20 bp, Artificial
  CRISPR gRNA sequence
cccgaggtgtttctgtcctt

SEQ ID NO: 525633 - DNA, 20 bp, Artificial
  CRISPR gRNA sequence
ctgtccttacacagaggatg

SEQ ID NO: 525634 - DNA, 20 bp, Artificial
  CRISPR gRNA sequence
tgtccttacacagaggatgc

SEQ ID NO: 525635 - DNA, 20 bp, Artificial
  CRISPR gRNA sequence
tccttacacagaggatgcag

SEQ ID NO: 525636 - DNA, 20 bp, Artificial
  CRISPR gRNA sequence
acacagaggatgcaggtgac

SEQ ID NO: 525637 - DNA, 20 bp, Artificial
  CRISPR gRNA sequence
cacagaggatgcaggtgacg

SEQ ID NO: 525638 - DNA, 20 bp, Artificial
  CRISPR gRNA sequence
ccctggccattcacccgatg

SEQ ID NO: 525639 - DNA, 20 bp, Artificial
  CRISPR gRNA sequence
gccattcacccgatgcccct

SEQ ID NO: 525640 - DNA, 20 bp, Artificial
  CRISPR gRNA sequence
acccgatgcccctatgaacc

SEQ ID NO: 525641 - DNA, 20 bp, Artificial
  CRISPR gRNA sequence
tgaacctgtccctctgcctc

SEQ ID NO: 525642 - DNA, 20 bp, Artificial
  CRISPR gRNA sequence
tccctctgcctcctctcaat

SEQ ID NO: 525643 - DNA, 20 bp, Artificial
  CRISPR gRNA sequence
tgcctcctctcaatttccgt

SEQ ID NO: 525644 - DNA, 20 bp, Artificial
  CRISPR gRNA sequence
cctcctctcaatttccgtct

SEQ ID NO: 525645 - DNA, 20 bp, Artificial
  CRISPR gRNA sequence
ctctcaatttccgtctgtct

SEQ ID NO: 525646 - DNA, 20 bp, Artificial
  CRISPR gRNA sequence
tcaatttccgtctgtctctc

SEQ ID NO: 525647 - DNA, 20 bp, Artificial
  CRISPR gRNA sequence
aatttccgtctgtctctcag

SEQ ID NO: 525648 - DNA, 20 bp, Artificial
  CRISPR gRNA sequence
ccgtctgtctctcagtcttt

SEQ ID NO: 525649 - DNA, 20 bp, Artificial
  CRISPR gRNA sequence
cgtctgtctctcagtctttg

SEQ ID NO: 525650 - DNA, 20 bp, Artificial
  CRISPR gRNA sequence
tctctcagtctttgtctctc

SEQ ID NO: 525651 - DNA, 20 bp, Artificial
  CRISPR gRNA sequence
tcagtctttgtctctctttc

SEQ ID NO: 525652 - DNA, 20 bp, Artificial
  CRISPR gRNA sequence
agtctttgtctctctttctc

SEQ ID NO: 525653 - DNA, 20 bp, Artificial
  CRISPR gRNA sequence
tgtctctctttctctgtctc

SEQ ID NO: 525654 - DNA, 20 bp, Artificial
  CRISPR gRNA sequence
gtctctctttctctgtctct

SEQ ID NO: 525655 - DNA, 20 bp, Artificial
  CRISPR gRNA sequence
tctctctttctctgtctctc

SEQ ID NO: 525656 - DNA, 20 bp, Artificial
  CRISPR gRNA sequence
tctttctctgtctctctctg

SEQ ID NO: 525657 - DNA, 20 bp, Artificial
  CRISPR gRNA sequence
tttctctgtctctctctgtc

SEQ ID NO: 525658 - DNA, 20 bp, Artificial
  CRISPR gRNA sequence
tctctgtctctctctgtctg

SEQ ID NO: 525659 - DNA, 20 bp, Artificial
  CRISPR gRNA sequence
ctctgtctctctctgtctgt

SEQ ID NO: 525660 - DNA, 20 bp, Artificial
  CRISPR gRNA sequence
tctgtctctctctgtctgtc

SEQ ID NO: 525661 - DNA, 20 bp, Artificial
  CRISPR gRNA sequence
tgtctctctctgtctgtctc

SEQ ID NO: 525662 - DNA, 20 bp, Artificial
  CRISPR gRNA sequence
tctctctctgtctgtctctc

SEQ ID NO: 525663 - DNA, 20 bp, Artificial
  CRISPR gRNA sequence
tctctgtctgtctctctctg

SEQ ID NO: 525664 - DNA, 20 bp, Artificial
  CRISPR gRNA sequence
tctgtctgtctctctctgtc

SEQ ID NO: 525665 - DNA, 20 bp, Artificial
  CRISPR gRNA sequence
tgtctgtctctctctgtctc

SEQ ID NO: 525666 - DNA, 20 bp, Artificial
  CRISPR gRNA sequence
tctgtctctctctgtctctg

SEQ ID NO: 525667 - DNA, 20 bp, Artificial
  CRISPR gRNA sequence
tctctctctgtctctgcccc

SEQ ID NO: 525668 - DNA, 20 bp, Artificial
  CRISPR gRNA sequence
tctctgtctctgccccatct

SEQ ID NO: 525669 - DNA, 20 bp, Artificial
  CRISPR gRNA sequence
tctgtctctgccccatctct

SEQ ID NO: 525670 - DNA, 20 bp, Artificial
  CRISPR gRNA sequence
tgtctctgccccatctctgt

SEQ ID NO: 525671 - DNA, 20 bp, Artificial
  CRISPR gRNA sequence
tctctgccccatctctgtct

SEQ ID NO: 525672 - DNA, 20 bp, Artificial
  CRISPR gRNA sequence
tgccccatctctgtctgtct

SEQ ID NO: 525673 - DNA, 20 bp, Artificial
  CRISPR gRNA sequence
ccccatctctgtctgtctct

SEQ ID NO: 525674 - DNA, 20 bp, Artificial
  CRISPR gRNA sequence
tgtctgtctctgtctctgcc

SEQ ID NO: 525675 - DNA, 20 bp, Artificial
  CRISPR gRNA sequence
tctgtctctgtctctgcctc

SEQ ID NO: 525676 - DNA, 20 bp, Artificial
  CRISPR gRNA sequence
tctctgtctctgcctctctc

SEQ ID NO: 525677 - DNA, 20 bp, Artificial
  CRISPR gRNA sequence
tgtctctgcctctctctgtt

SEQ ID NO: 525678 - DNA, 20 bp, Artificial
  CRISPR gRNA sequence
tctctgcctctctctgtttc

SEQ ID NO: 525679 - DNA, 20 bp, Artificial
  CRISPR gRNA sequence
tgcctctctctgtttctctc

SEQ ID NO: 525680 - DNA, 20 bp, Artificial
  CRISPR gRNA sequence
cctctctctgtttctctcca

SEQ ID NO: 525681 - DNA, 20 bp, Artificial
  CRISPR gRNA sequence
tctctgtttctctccatctc

SEQ ID NO: 525682 - DNA, 20 bp, Artificial
  CRISPR gRNA sequence
tctgtttctctccatctctc

SEQ ID NO: 525683 - DNA, 20 bp, Artificial
  CRISPR gRNA sequence
tgtttctctccatctctctg

SEQ ID NO: 525684 - DNA, 20 bp, Artificial
  CRISPR gRNA sequence
tttctctccatctctctgtc

SEQ ID NO: 525685 - DNA, 20 bp, Artificial
  CRISPR gRNA sequence
ctctccatctctctgtctct

SEQ ID NO: 525686 - DNA, 20 bp, Artificial
  CRISPR gRNA sequence
tctccatctctctgtctctg

SEQ ID NO: 525687 - DNA, 20 bp, Artificial
  CRISPR gRNA sequence
tccatctctctgtctctggc

SEQ ID NO: 525688 - DNA, 20 bp, Artificial
  CRISPR gRNA sequence
catctctctgtctctggctc

SEQ ID NO: 525689 - DNA, 20 bp, Artificial
  CRISPR gRNA sequence
tctgtctctggctctggctc

SEQ ID NO: 525690 - DNA, 20 bp, Artificial
  CRISPR gRNA sequence
tgtctctggctctggctctg

SEQ ID NO: 525691 - DNA, 20 bp, Artificial
  CRISPR gRNA sequence
tctctggctctggctctgcc

SEQ ID NO: 525692 - DNA, 20 bp, Artificial
  CRISPR gRNA sequence
tggctctggctctgcccatc

SEQ ID NO: 525693 - DNA, 20 bp, Artificial
  CRISPR gRNA sequence
gctctggctctgcccatctc

SEQ ID NO: 525694 - DNA, 20 bp, Artificial
  CRISPR gRNA sequence
tggctctgcccatctctgtc

SEQ ID NO: 525695 - DNA, 20 bp, Artificial
  CRISPR gRNA sequence
gctctgcccatctctgtctg

SEQ ID NO: 525696 - DNA, 20 bp, Artificial
  CRISPR gRNA sequence
tgcccatctctgtctgtctc

SEQ ID NO: 525697 - DNA, 20 bp, Artificial
  CRISPR gRNA sequence
cccatctctgtctgtctctg

SEQ ID NO: 525698 - DNA, 20 bp, Artificial
  CRISPR gRNA sequence
tgtctgtctctgcctctctc

SEQ ID NO: 525699 - DNA, 20 bp, Artificial
  CRISPR gRNA sequence
tctgtctctgcctctctctg

SEQ ID NO: 525700 - DNA, 20 bp, Artificial
  CRISPR gRNA sequence
tctctgcctctctctgtttc

SEQ ID NO: 525701 - DNA, 20 bp, Artificial
  CRISPR gRNA sequence
tgcctctctctgtttctccc

SEQ ID NO: 525702 - DNA, 20 bp, Artificial
  CRISPR gRNA sequence
cctctctctgtttctcccca

SEQ ID NO: 525703 - DNA, 20 bp, Artificial
  CRISPR gRNA sequence
tctctgtttctccccatctc

SEQ ID NO: 525704 - DNA, 20 bp, Artificial
  CRISPR gRNA sequence
tctgtttctccccatctctc

SEQ ID NO: 525705 - DNA, 20 bp, Artificial
  CRISPR gRNA sequence
tgtttctccccatctctctt

SEQ ID NO: 525706 - DNA, 20 bp, Artificial
  CRISPR gRNA sequence
tttctccccatctctcttat

SEQ ID NO: 525707 - DNA, 20 bp, Artificial
  CRISPR gRNA sequence
ctccccatctctcttatcgc

SEQ ID NO: 525708 - DNA, 20 bp, Artificial
  CRISPR gRNA sequence
tccccatctctcttatcgct

SEQ ID NO: 525709 - DNA, 20 bp, Artificial
  CRISPR gRNA sequence
cccatctctcttatcgcttg

SEQ ID NO: 525710 - DNA, 20 bp, Artificial
  CRISPR gRNA sequence
tcttatcgcttgaacaattt

SEQ ID NO: 525711 - DNA, 20 bp, Artificial
  CRISPR gRNA sequence
ttatcgcttgaacaatttat

SEQ ID NO: 525712 - DNA, 20 bp, Artificial
  CRISPR gRNA sequence
atcgcttgaacaatttatgc

SEQ ID NO: 525713 - DNA, 20 bp, Artificial
  CRISPR gRNA sequence
tcgcttgaacaatttatgca

SEQ ID NO: 525714 - DNA, 20 bp, Artificial
  CRISPR gRNA sequence
gaacaatttatgcagctcct

SEQ ID NO: 525715 - DNA, 20 bp, Artificial
  CRISPR gRNA sequence
aacaatttatgcagctcctg

SEQ ID NO: 525716 - DNA, 20 bp, Artificial
  CRISPR gRNA sequence
atgcagctcctgccctgtgc

SEQ ID NO: 525717 - DNA, 20 bp, Artificial
  CRISPR gRNA sequence
tgcagctcctgccctgtgct

SEQ ID NO: 525718 - DNA, 20 bp, Artificial
  CRISPR gRNA sequence
ctgccctgtgctaggtcctg

SEQ ID NO: 525719 - DNA, 20 bp, Artificial
  CRISPR gRNA sequence
ccctgtgctaggtcctgggg

SEQ ID NO: 525720 - DNA, 20 bp, Artificial
  CRISPR gRNA sequence
tgctaggtcctggggactca

SEQ ID NO: 525721 - DNA, 20 bp, Artificial
  CRISPR gRNA sequence
ggtcctggggactcaaggct

SEQ ID NO: 525722 - DNA, 20 bp, Artificial
  CRISPR gRNA sequence
gggactcaaggctgaggagc

SEQ ID NO: 525723 - DNA, 20 bp, Artificial
  CRISPR gRNA sequence
aaggctgaggagcagcagaa

SEQ ID NO: 525724 - DNA, 20 bp, Artificial
  CRISPR gRNA sequence
aggagcagcagaagctccca

SEQ ID NO: 525725 - DNA, 20 bp, Artificial
  CRISPR gRNA sequence
ccacccctgaggctcacacc

SEQ ID NO: 525726 - DNA, 20 bp, Artificial
  CRISPR gRNA sequence
aggctcacaccctggctcca

SEQ ID NO: 525727 - DNA, 20 bp, Artificial
  CRISPR gRNA sequence
acaccctggctccatgctag

SEQ ID NO: 525728 - DNA, 20 bp, Artificial
  CRISPR gRNA sequence
gctccatgctagtccctgtg

SEQ ID NO: 525729 - DNA, 20 bp, Artificial
  CRISPR gRNA sequence
catgctagtccctgtggtca

SEQ ID NO: 525730 - DNA, 20 bp, Artificial
  CRISPR gRNA sequence
gtccctgtggtcaggctgtc

SEQ ID NO: 525731 - DNA, 20 bp, Artificial
  CRISPR gRNA sequence
tggtcaggctgtctcgaggg

SEQ ID NO: 525732 - DNA, 20 bp, Artificial
  CRISPR gRNA sequence
tctcgagggcaggactgtgg

SEQ ID NO: 525733 - DNA, 20 bp, Artificial
  CRISPR gRNA sequence
gagggcaggactgtggccct

SEQ ID NO: 525734 - DNA, 20 bp, Artificial
  CRISPR gRNA sequence
tggccctggcagccctgcca

SEQ ID NO: 525735 - DNA, 20 bp, Artificial
  CRISPR gRNA sequence
gcagccctgccatcctcagc

SEQ ID NO: 525736 - DNA, 20 bp, Artificial
  CRISPR gRNA sequence
ccatcctcagcacatcctgc

SEQ ID NO: 525737 - DNA, 20 bp, Artificial
  CRISPR gRNA sequence
agcacatcctgctgtgctct

SEQ ID NO: 525738 - DNA, 20 bp, Artificial
  CRISPR gRNA sequence
ctgtgctctcctctgtgtca

SEQ ID NO: 525739 - DNA, 20 bp, Artificial
  CRISPR gRNA sequence
tgctctcctctgtgtcatta

SEQ ID NO: 525740 - DNA, 20 bp, Artificial
  CRISPR gRNA sequence
tcctctgtgtcattagctga

SEQ ID NO: 525741 - DNA, 20 bp, Artificial
  CRISPR gRNA sequence
ctctgtgtcattagctgaca

SEQ ID NO: 525742 - DNA, 20 bp, Artificial
  CRISPR gRNA sequence
tgtgtcattagctgacactg

SEQ ID NO: 525743 - DNA, 20 bp, Artificial
  CRISPR gRNA sequence
tgtcattagctgacactggg

SEQ ID NO: 525744 - DNA, 20 bp, Artificial
  CRISPR gRNA sequence
gctgacactggggacttgca

SEQ ID NO: 525745 - DNA, 20 bp, Artificial
  CRISPR gRNA sequence
acactggggacttgcactga

SEQ ID NO: 525746 - DNA, 20 bp, Artificial
  CRISPR gRNA sequence
gggacttgcactgagaggag

SEQ ID NO: 525747 - DNA, 20 bp, Artificial
  CRISPR gRNA sequence
gcactgagaggagaagtgga

SEQ ID NO: 525748 - DNA, 20 bp, Artificial
  CRISPR gRNA sequence
cactgagaggagaagtggag

SEQ ID NO: 525749 - DNA, 20 bp, Artificial
  CRISPR gRNA sequence
agaggagaagtggagacggg

SEQ ID NO: 525750 - DNA, 20 bp, Artificial
  CRISPR gRNA sequence
aaccgctgggccaggcaggg

SEQ ID NO: 525751 - DNA, 20 bp, Artificial
  CRISPR gRNA sequence
ggccaggcagggccaggaca

SEQ ID NO: 525752 - DNA, 20 bp, Artificial
  CRISPR gRNA sequence
gcccccaagagtaaccgctc

SEQ ID NO: 525753 - DNA, 20 bp, Artificial
  CRISPR gRNA sequence
tctgcccgcagaaactctcc

SEQ ID NO: 525754 - DNA, 20 bp, Artificial
  CRISPR gRNA sequence
tgcccgcagaaactctcctc

SEQ ID NO: 525755 - DNA, 20 bp, Artificial
  CRISPR gRNA sequence
cccgcagaaactctcctcca

SEQ ID NO: 525756 - DNA, 20 bp, Artificial
  CRISPR gRNA sequence
tcctccagggtcttcctgga

SEQ ID NO: 525757 - DNA, 20 bp, Artificial
  CRISPR gRNA sequence
ctccagggtcttcctggatc

SEQ ID NO: 525758 - DNA, 20 bp, Artificial
  CRISPR gRNA sequence
cagggtcttcctggatcaca

SEQ ID NO: 525759 - DNA, 20 bp, Artificial
  CRISPR gRNA sequence
cctggatcacaacgccctcc

SEQ ID NO: 525760 - DNA, 20 bp, Artificial
  CRISPR gRNA sequence
ctggatcacaacgccctccc

SEQ ID NO: 525761 - DNA, 20 bp, Artificial
  CRISPR gRNA sequence
gatcacaacgccctccccga

SEQ ID NO: 525762 - DNA, 20 bp, Artificial
  CRISPR gRNA sequence
cccgacaccctgaaagtcac

SEQ ID NO: 525763 - DNA, 20 bp, Artificial
  CRISPR gRNA sequence
aaagtcacctacgactcctt

SEQ ID NO: 525764 - DNA, 20 bp, Artificial
  CRISPR gRNA sequence
cgactccttctgcagcaatg

SEQ ID NO: 525765 - DNA, 20 bp, Artificial
  CRISPR gRNA sequence
cttctgcagcaatggagtga

SEQ ID NO: 525766 - DNA, 20 bp, Artificial
  CRISPR gRNA sequence
ctgcagcaatggagtgacgc

SEQ ID NO: 525767 - DNA, 20 bp, Artificial
  CRISPR gRNA sequence
tgcagcaatggagtgacgca

SEQ ID NO: 525768 - DNA, 20 bp, Artificial
  CRISPR gRNA sequence
cagcaatggagtgacgcaca

SEQ ID NO: 525769 - DNA, 20 bp, Artificial
  CRISPR gRNA sequence
tgatggcgtgcagatcaatg

SEQ ID NO: 525770 - DNA, 20 bp, Artificial
  CRISPR gRNA sequence
gccacaagggtccccatccc

SEQ ID NO: 525771 - DNA, 20 bp, Artificial
  CRISPR gRNA sequence
gctgaggggctctggggaca

SEQ ID NO: 525772 - DNA, 20 bp, Artificial
  CRISPR gRNA sequence
ctgaggggctctggggacag

SEQ ID NO: 525773 - DNA, 20 bp, Artificial
  CRISPR gRNA sequence
aggggctctggggacagcca

SEQ ID NO: 525774 - DNA, 20 bp, Artificial
  CRISPR gRNA sequence
tggggacagccagaaggagc

SEQ ID NO: 525775 - DNA, 20 bp, Artificial
  CRISPR gRNA sequence
gggacagccagaaggagcca

SEQ ID NO: 525776 - DNA, 20 bp, Artificial
  CRISPR gRNA sequence
aggggtcctggggacagcca

SEQ ID NO: 525777 - DNA, 20 bp, Artificial
  CRISPR gRNA sequence
gggacagccagaaggagcca

SEQ ID NO: 525778 - DNA, 20 bp, Artificial
  CRISPR gRNA sequence
tgacgggggcagggaggggc

SEQ ID NO: 525779 - DNA, 20 bp, Artificial
  CRISPR gRNA sequence
acgggggcagggaggggcac

SEQ ID NO: 525780 - DNA, 20 bp, Artificial
  CRISPR gRNA sequence
tctgggagcaggcagcatcc

SEQ ID NO: 525781 - DNA, 20 bp, Artificial
  CRISPR gRNA sequence
ggagcaggcagcatccactg

SEQ ID NO: 525782 - DNA, 20 bp, Artificial
  CRISPR gRNA sequence
gaaggaccctgtttctttcc

SEQ ID NO: 525783 - DNA, 20 bp, Artificial
  CRISPR gRNA sequence
tttctttccttcacatcctc

SEQ ID NO: 525784 - DNA, 20 bp, Artificial
  CRISPR gRNA sequence
ctttccttcacatcctctct

SEQ ID NO: 525785 - DNA, 20 bp, Artificial
  CRISPR gRNA sequence
tttccttcacatcctctctg

SEQ ID NO: 525786 - DNA, 20 bp, Artificial
  CRISPR gRNA sequence
tccttcacatcctctctgcc

SEQ ID NO: 525787 - DNA, 20 bp, Artificial
  CRISPR gRNA sequence
ccttcacatcctctctgccg

SEQ ID NO: 525788 - DNA, 20 bp, Artificial
  CRISPR gRNA sequence
cttcacatcctctctgccga

SEQ ID NO: 525789 - DNA, 20 bp, Artificial
  CRISPR gRNA sequence
cacatcctctctgccgaggc

SEQ ID NO: 525790 - DNA, 20 bp, Artificial
  CRISPR gRNA sequence
acatcctctctgccgaggcc

SEQ ID NO: 525791 - DNA, 20 bp, Artificial
  CRISPR gRNA sequence
tctgccgaggccagacgctt

SEQ ID NO: 525792 - DNA, 20 bp, Artificial
  CRISPR gRNA sequence
tgccgaggccagacgctttc

SEQ ID NO: 525793 - DNA, 20 bp, Artificial
  CRISPR gRNA sequence
ccgaggccagacgctttcct

SEQ ID NO: 525794 - DNA, 20 bp, Artificial
  CRISPR gRNA sequence
tccttgtgaagctgatgtca

SEQ ID NO: 525795 - DNA, 20 bp, Artificial
  CRISPR gRNA sequence
ccttgtgaagctgatgtcag

SEQ ID NO: 525796 - DNA, 20 bp, Artificial
  CRISPR gRNA sequence
cttgtgaagctgatgtcagg

SEQ ID NO: 525797 - DNA, 20 bp, Artificial
  CRISPR gRNA sequence
gtgaagctgatgtcaggaac

SEQ ID NO: 525798 - DNA, 20 bp, Artificial
  CRISPR gRNA sequence
tgaagctgatgtcaggaacg

SEQ ID NO: 525799 - DNA, 20 bp, Artificial
  CRISPR gRNA sequence
atgtcaggaacgtcagtgag

SEQ ID NO: 525800 - DNA, 20 bp, Artificial
  CRISPR gRNA sequence
ctcagtgagagggtgctggg

SEQ ID NO: 525801 - DNA, 20 bp, Artificial
  CRISPR gRNA sequence
tcagtgagagggtgctggga

SEQ ID NO: 525802 - DNA, 20 bp, Artificial
  CRISPR gRNA sequence
agtgagagggtgctgggagg

SEQ ID NO: 525803 - DNA, 20 bp, Artificial
  CRISPR gRNA sequence
ggagggttcttcacacacgc

SEQ ID NO: 525804 - DNA, 20 bp, Artificial
  CRISPR gRNA sequence
ttcacacacgccttggcccc

SEQ ID NO: 525805 - DNA, 20 bp, Artificial
  CRISPR gRNA sequence
cacacacgccttggccccca

SEQ ID NO: 525806 - DNA, 20 bp, Artificial
  CRISPR gRNA sequence
acacacgccttggcccccaa

SEQ ID NO: 525807 - DNA, 20 bp, Artificial
  CRISPR gRNA sequence
ggcccccaagagtcctactc

SEQ ID NO: 525808 - DNA, 20 bp, Artificial
  CRISPR gRNA sequence
gcccccaagagtcctactca

SEQ ID NO: 525809 - DNA, 20 bp, Artificial
  CRISPR gRNA sequence
ctcatcaacctggagcccaa

SEQ ID NO: 525810 - DNA, 20 bp, Artificial
  CRISPR gRNA sequence
atcaacctggagcccaaatc

SEQ ID NO: 525811 - DNA, 20 bp, Artificial
  CRISPR gRNA sequence
gagcccaaatccctgggtca

SEQ ID NO: 525812 - DNA, 20 bp, Artificial
  CRISPR gRNA sequence
ggtcaggccactgcagactg

SEQ ID NO: 525813 - DNA, 20 bp, Artificial
  CRISPR gRNA sequence
cagactgagggatggagtga

SEQ ID NO: 525814 - DNA, 20 bp, Artificial
  CRISPR gRNA sequence
agggatggagtgatggctgc

SEQ ID NO: 525815 - DNA, 20 bp, Artificial
  CRISPR gRNA sequence
cgccccctgggggcagacgc

SEQ ID NO: 525816 - DNA, 20 bp, Artificial
  CRISPR gRNA sequence
ggggcagacgccggacacac

SEQ ID NO: 525817 - DNA, 20 bp, Artificial
  CRISPR gRNA sequence
ggtagggttagttgtcatga

SEQ ID NO: 525818 - DNA, 20 bp, Artificial
  CRISPR gRNA sequence
gttgtcatgattttctgcgt

SEQ ID NO: 525819 - DNA, 20 bp, Artificial
  CRISPR gRNA sequence
tcatgattttctgcgtgttt

SEQ ID NO: 525820 - DNA, 20 bp, Artificial
  CRISPR gRNA sequence
tctgcgtgtttcattctgtt

SEQ ID NO: 525821 - DNA, 20 bp, Artificial
  CRISPR gRNA sequence
ctgcgtgtttcattctgttt

SEQ ID NO: 525822 - DNA, 20 bp, Artificial
  CRISPR gRNA sequence
tgcgtgtttcattctgtttt

SEQ ID NO: 525823 - DNA, 20 bp, Artificial
  CRISPR gRNA sequence
cgtgtttcattctgtttttt

SEQ ID NO: 525824 - DNA, 20 bp, Artificial
  CRISPR gRNA sequence
cattctgtttttttgacaga

SEQ ID NO: 525825 - DNA, 20 bp, Artificial
  CRISPR gRNA sequence
attctgtttttttgacagaa

SEQ ID NO: 525826 - DNA, 20 bp, Artificial
  CRISPR gRNA sequence
tgtttttttgacagaaacat

SEQ ID NO: 525827 - DNA, 20 bp, Artificial
  CRISPR gRNA sequence
tttttttgacagaaacatta

SEQ ID NO: 525828 - DNA, 20 bp, Artificial
  CRISPR gRNA sequence
ttttgacagaaacattaagg

SEQ ID NO: 525829 - DNA, 20 bp, Artificial
  CRISPR gRNA sequence
tttgacagaaacattaaggc

SEQ ID NO: 525830 - DNA, 20 bp, Artificial
  CRISPR gRNA sequence
ttgacagaaacattaaggca

SEQ ID NO: 525831 - DNA, 20 bp, Artificial
  CRISPR gRNA sequence
tgacagaaacattaaggcat

SEQ ID NO: 525832 - DNA, 20 bp, Artificial
  CRISPR gRNA sequence
gacagaaacattaaggcatg

SEQ ID NO: 525833 - DNA, 20 bp, Artificial
  CRISPR gRNA sequence
acagaaacattaaggcatgg

SEQ ID NO: 525834 - DNA, 20 bp, Artificial
  CRISPR gRNA sequence
aggcatgggccacacaggtg

SEQ ID NO: 525835 - DNA, 20 bp, Artificial
  CRISPR gRNA sequence
ggaatggacactgagttcct

SEQ ID NO: 525836 - DNA, 20 bp, Artificial
  CRISPR gRNA sequence
agttccttctctaatctttc

SEQ ID NO: 525837 - DNA, 20 bp, Artificial
  CRISPR gRNA sequence
cttctctaatctttcaggtt

SEQ ID NO: 525838 - DNA, 20 bp, Artificial
  CRISPR gRNA sequence
ctctaatctttcaggtttaa

SEQ ID NO: 525839 - DNA, 20 bp, Artificial
  CRISPR gRNA sequence
tctaatctttcaggtttaag

SEQ ID NO: 525840 - DNA, 20 bp, Artificial
  CRISPR gRNA sequence
taatctttcaggtttaagtt

SEQ ID NO: 525841 - DNA, 20 bp, Artificial
  CRISPR gRNA sequence
atctttcaggtttaagttta

SEQ ID NO: 525842 - DNA, 20 bp, Artificial
  CRISPR gRNA sequence
tcaggtttaagtttattatc

SEQ ID NO: 525843 - DNA, 20 bp, Artificial
  CRISPR gRNA sequence
caggtttaagtttattatcc

SEQ ID NO: 525844 - DNA, 20 bp, Artificial
  CRISPR gRNA sequence
aggtttaagtttattatcca

SEQ ID NO: 525845 - DNA, 20 bp, Artificial
  CRISPR gRNA sequence
aagtttattatccaatcatt

SEQ ID NO: 525846 - DNA, 20 bp, Artificial
  CRISPR gRNA sequence
agtttattatccaatcattt

SEQ ID NO: 525847 - DNA, 20 bp, Artificial
  CRISPR gRNA sequence
attatccaatcatttgttgt

SEQ ID NO: 525848 - DNA, 20 bp, Artificial
  CRISPR gRNA sequence
ttatccaatcatttgttgtt

SEQ ID NO: 525849 - DNA, 20 bp, Artificial
  CRISPR gRNA sequence
tccaatcatttgttgtttct

SEQ ID NO: 525850 - DNA, 20 bp, Artificial
  CRISPR gRNA sequence
gttgtttctttttgtttttt

SEQ ID NO: 525851 - DNA, 20 bp, Artificial
  CRISPR gRNA sequence
ttgtttctttttgttttttg

SEQ ID NO: 525852 - DNA, 20 bp, Artificial
  CRISPR gRNA sequence
tttctttttgttttttgttt

SEQ ID NO: 525853 - DNA, 20 bp, Artificial
  CRISPR gRNA sequence
ctttttgttttttgtttttt

SEQ ID NO: 525854 - DNA, 20 bp, Artificial
  CRISPR gRNA sequence
tttttgttttttgttttttg

SEQ ID NO: 525855 - DNA, 20 bp, Artificial
  CRISPR gRNA sequence
tttgttttttgttttttgtt

SEQ ID NO: 525856 - DNA, 20 bp, Artificial
  CRISPR gRNA sequence
ttgttttttgttttttgttt

SEQ ID NO: 525857 - DNA, 20 bp, Artificial
  CRISPR gRNA sequence
tgttttttgttttttgtttt

SEQ ID NO: 525858 - DNA, 20 bp, Artificial
  CRISPR gRNA sequence
gttttttgttttttgttttt

SEQ ID NO: 525859 - DNA, 20 bp, Artificial
  CRISPR gRNA sequence
ttttttgttttttgtttttt

SEQ ID NO: 525860 - DNA, 20 bp, Artificial
  CRISPR gRNA sequence
tttgttttttgttttttttt

SEQ ID NO: 525861 - DNA, 20 bp, Artificial
  CRISPR gRNA sequence
ttgttttttgtttttttttt

SEQ ID NO: 525862 - DNA, 20 bp, Artificial
  CRISPR gRNA sequence
tgttttttgttttttttttt

SEQ ID NO: 525863 - DNA, 20 bp, Artificial
  CRISPR gRNA sequence
gttttttgtttttttttttg

SEQ ID NO: 525864 - DNA, 20 bp, Artificial
  CRISPR gRNA sequence
ttttttgtttttttttttgc

SEQ ID NO: 525865 - DNA, 20 bp, Artificial
  CRISPR gRNA sequence
tttgtttttttttttgctag

SEQ ID NO: 525866 - DNA, 20 bp, Artificial
  CRISPR gRNA sequence
ttgtttttttttttgctagc

SEQ ID NO: 525867 - DNA, 20 bp, Artificial
  CRISPR gRNA sequence
tgtttttttttttgctagct

SEQ ID NO: 525868 - DNA, 20 bp, Artificial
  CRISPR gRNA sequence
gtttttttttttgctagctg

SEQ ID NO: 525869 - DNA, 20 bp, Artificial
  CRISPR gRNA sequence
tttttttttttgctagctgt

SEQ ID NO: 525870 - DNA, 20 bp, Artificial
  CRISPR gRNA sequence
ttttttttgctagctgtgaa

SEQ ID NO: 525871 - DNA, 20 bp, Artificial
  CRISPR gRNA sequence
tttttttgctagctgtgaaa

SEQ ID NO: 525872 - DNA, 20 bp, Artificial
  CRISPR gRNA sequence
ttttttgctagctgtgaaat

SEQ ID NO: 525873 - DNA, 20 bp, Artificial
  CRISPR gRNA sequence
tttttgctagctgtgaaata

SEQ ID NO: 525874 - DNA, 20 bp, Artificial
  CRISPR gRNA sequence
ttttgctagctgtgaaataa

SEQ ID NO: 525875 - DNA, 20 bp, Artificial
  CRISPR gRNA sequence
tttgctagctgtgaaataat

SEQ ID NO: 525876 - DNA, 20 bp, Artificial
  CRISPR gRNA sequence
ttgctagctgtgaaataata

SEQ ID NO: 525877 - DNA, 20 bp, Artificial
  CRISPR gRNA sequence
tgctagctgtgaaataatat

SEQ ID NO: 525878 - DNA, 20 bp, Artificial
  CRISPR gRNA sequence
gctagctgtgaaataatatt

SEQ ID NO: 525879 - DNA, 20 bp, Artificial
  CRISPR gRNA sequence
ctagctgtgaaataatattc

SEQ ID NO: 525880 - DNA, 20 bp, Artificial
  CRISPR gRNA sequence
gctgtgaaataatattcagc

SEQ ID NO: 525881 - DNA, 20 bp, Artificial
  CRISPR gRNA sequence
tgaaataatattcagcaaga

SEQ ID NO: 525882 - DNA, 20 bp, Artificial
  CRISPR gRNA sequence
agcaagacacttgctttcat

SEQ ID NO: 525883 - DNA, 20 bp, Artificial
  CRISPR gRNA sequence
gctttcattgcattttctta

SEQ ID NO: 525884 - DNA, 20 bp, Artificial
  CRISPR gRNA sequence
ctttcattgcattttcttaa

SEQ ID NO: 525885 - DNA, 20 bp, Artificial
  CRISPR gRNA sequence
tcattgcattttcttaatat

SEQ ID NO: 525886 - DNA, 20 bp, Artificial
  CRISPR gRNA sequence
cattgcattttcttaatatg

SEQ ID NO: 525887 - DNA, 20 bp, Artificial
  CRISPR gRNA sequence
attgcattttcttaatatga

SEQ ID NO: 525888 - DNA, 20 bp, Artificial
  CRISPR gRNA sequence
cattttcttaatatgacttt

SEQ ID NO: 525889 - DNA, 20 bp, Artificial
  CRISPR gRNA sequence
tcttaatatgactttggaat

SEQ ID NO: 525890 - DNA, 20 bp, Artificial
  CRISPR gRNA sequence
cttaatatgactttggaatt

SEQ ID NO: 525891 - DNA, 20 bp, Artificial
  CRISPR gRNA sequence
ttaatatgactttggaattc

SEQ ID NO: 525892 - DNA, 20 bp, Artificial
  CRISPR gRNA sequence
aatatgactttggaattcct

SEQ ID NO: 525893 - DNA, 20 bp, Artificial
  CRISPR gRNA sequence
atatgactttggaattcctt

SEQ ID NO: 525894 - DNA, 20 bp, Artificial
  CRISPR gRNA sequence
tggaattccttcaaacatgt

SEQ ID NO: 525895 - DNA, 20 bp, Artificial
  CRISPR gRNA sequence
ggaattccttcaaacatgtt

SEQ ID NO: 525896 - DNA, 20 bp, Artificial
  CRISPR gRNA sequence
gaattccttcaaacatgttt

SEQ ID NO: 525897 - DNA, 20 bp, Artificial
  CRISPR gRNA sequence
cttcaaacatgtttcttggt

SEQ ID NO: 525898 - DNA, 20 bp, Artificial
  CRISPR gRNA sequence
caaacatgtttcttggtaaa

SEQ ID NO: 525899 - DNA, 20 bp, Artificial
  CRISPR gRNA sequence
aaacatgtttcttggtaaat

SEQ ID NO: 525900 - DNA, 20 bp, Artificial
  CRISPR gRNA sequence
cttggtaaatgttgcctgtg

SEQ ID NO: 525901 - DNA, 20 bp, Artificial
  CRISPR gRNA sequence
ttggtaaatgttgcctgtgg

SEQ ID NO: 525902 - DNA, 20 bp, Artificial
  CRISPR gRNA sequence
ggtaaatgttgcctgtggat

SEQ ID NO: 525903 - DNA, 20 bp, Artificial
  CRISPR gRNA sequence
gtaaatgttgcctgtggatt

SEQ ID NO: 525904 - DNA, 20 bp, Artificial
  CRISPR gRNA sequence
cctgtggatttttttttttt

SEQ ID NO: 525905 - DNA, 20 bp, Artificial
  CRISPR gRNA sequence
tggatttttttttttttttt

SEQ ID NO: 525906 - DNA, 20 bp, Artificial
  CRISPR gRNA sequence
tttttttttttttttttttt

SEQ ID NO: 525907 - DNA, 20 bp, Artificial
  CRISPR gRNA sequence
tttttttttttttttttttg

SEQ ID NO: 525908 - DNA, 20 bp, Artificial
  CRISPR gRNA sequence
ttttttttttttttttttga

SEQ ID NO: 525909 - DNA, 20 bp, Artificial
  CRISPR gRNA sequence
tttttttttttttttttgag

SEQ ID NO: 525910 - DNA, 20 bp, Artificial
  CRISPR gRNA sequence
ttttttttttttttttgaga

SEQ ID NO: 525911 - DNA, 20 bp, Artificial
  CRISPR gRNA sequence
tttttttttttttttgagat

SEQ ID NO: 525912 - DNA, 20 bp, Artificial
  CRISPR gRNA sequence
ttttttttttttttgagatg

SEQ ID NO: 525913 - DNA, 20 bp, Artificial
  CRISPR gRNA sequence
tttttttttttttgagatgg

SEQ ID NO: 525914 - DNA, 20 bp, Artificial
  CRISPR gRNA sequence
ttttttttttttgagatgga

SEQ ID NO: 525915 - DNA, 20 bp, Artificial
  CRISPR gRNA sequence
tttttttttttgagatggag

SEQ ID NO: 525916 - DNA, 20 bp, Artificial
  CRISPR gRNA sequence
ttttttttttgagatggagt

SEQ ID NO: 525917 - DNA, 20 bp, Artificial
  CRISPR gRNA sequence
tttttttttgagatggagtt

SEQ ID NO: 525918 - DNA, 20 bp, Artificial
  CRISPR gRNA sequence
ttttttttgagatggagttt

SEQ ID NO: 525919 - DNA, 20 bp, Artificial
  CRISPR gRNA sequence
tttttttgagatggagtttc

SEQ ID NO: 525920 - DNA, 20 bp, Artificial
  CRISPR gRNA sequence
ttttttgagatggagtttcg

SEQ ID NO: 525921 - DNA, 20 bp, Artificial
  CRISPR gRNA sequence
tttttgagatggagtttcgc

SEQ ID NO: 525922 - DNA, 20 bp, Artificial
  CRISPR gRNA sequence
ttttgagatggagtttcgct

SEQ ID NO: 525923 - DNA, 20 bp, Artificial
  CRISPR gRNA sequence
tttgagatggagtttcgctc

SEQ ID NO: 525924 - DNA, 20 bp, Artificial
  CRISPR gRNA sequence
ttgagatggagtttcgctct

SEQ ID NO: 525925 - DNA, 20 bp, Artificial
  CRISPR gRNA sequence
tgagatggagtttcgctctg

SEQ ID NO: 525926 - DNA, 20 bp, Artificial
  CRISPR gRNA sequence
gagatggagtttcgctctgt

SEQ ID NO: 525927 - DNA, 20 bp, Artificial
  CRISPR gRNA sequence
agatggagtttcgctctgtc

SEQ ID NO: 525928 - DNA, 20 bp, Artificial
  CRISPR gRNA sequence
cgctctgtcgcccaggctgg

SEQ ID NO: 525929 - DNA, 20 bp, Artificial
  CRISPR gRNA sequence
gctctgtcgcccaggctgga

SEQ ID NO: 525930 - DNA, 20 bp, Artificial
  CRISPR gRNA sequence
tgtcgcccaggctggagtgc

SEQ ID NO: 525931 - DNA, 20 bp, Artificial
  CRISPR gRNA sequence
tcgcccaggctggagtgcac

SEQ ID NO: 525932 - DNA, 20 bp, Artificial
  CRISPR gRNA sequence
gagtgcactggtgcgatctt

SEQ ID NO: 525933 - DNA, 20 bp, Artificial
  CRISPR gRNA sequence
gtgcgatcttggctcactac

SEQ ID NO: 525934 - DNA, 20 bp, Artificial
  CRISPR gRNA sequence
ggctcactacaatccaagtg

SEQ ID NO: 525935 - DNA, 20 bp, Artificial
  CRISPR gRNA sequence
gctcactacaatccaagtga

SEQ ID NO: 525936 - DNA, 20 bp, Artificial
  CRISPR gRNA sequence
actacaatccaagtgattct

SEQ ID NO: 525937 - DNA, 20 bp, Artificial
  CRISPR gRNA sequence
caatccaagtgattctcctg

SEQ ID NO: 525938 - DNA, 20 bp, Artificial
  CRISPR gRNA sequence
tcctgactcagcctcctgag

SEQ ID NO: 525939 - DNA, 20 bp, Artificial
  CRISPR gRNA sequence
ctgactcagcctcctgagta

SEQ ID NO: 525940 - DNA, 20 bp, Artificial
  CRISPR gRNA sequence
actcagcctcctgagtagct

SEQ ID NO: 525941 - DNA, 20 bp, Artificial
  CRISPR gRNA sequence
agcctcctgagtagctggga

SEQ ID NO: 525942 - DNA, 20 bp, Artificial
  CRISPR gRNA sequence
ctgagtagctgggactacag

SEQ ID NO: 525943 - DNA, 20 bp, Artificial
  CRISPR gRNA sequence
agtagctgggactacaggcg

SEQ ID NO: 525944 - DNA, 20 bp, Artificial
  CRISPR gRNA sequence
ggactacaggcgtgtgccac

SEQ ID NO: 525945 - DNA, 20 bp, Artificial
  CRISPR gRNA sequence
caggcgtgtgccaccacgct

SEQ ID NO: 525946 - DNA, 20 bp, Artificial
  CRISPR gRNA sequence
ggctaatttttgtattttta

SEQ ID NO: 525947 - DNA, 20 bp, Artificial
  CRISPR gRNA sequence
atttttgtatttttagtaga

SEQ ID NO: 525948 - DNA, 20 bp, Artificial
  CRISPR gRNA sequence
ttgtatttttagtagagaca

SEQ ID NO: 525949 - DNA, 20 bp, Artificial
  CRISPR gRNA sequence
tgtatttttagtagagacag

SEQ ID NO: 525950 - DNA, 20 bp, Artificial
  CRISPR gRNA sequence
gtatttttagtagagacaga

SEQ ID NO: 525951 - DNA, 20 bp, Artificial
  CRISPR gRNA sequence
tatttttagtagagacagag

SEQ ID NO: 525952 - DNA, 20 bp, Artificial
  CRISPR gRNA sequence
ttagtagagacagagtttcg

SEQ ID NO: 525953 - DNA, 20 bp, Artificial
  CRISPR gRNA sequence
tagtagagacagagtttcgc

SEQ ID NO: 525954 - DNA, 20 bp, Artificial
  CRISPR gRNA sequence
agtagagacagagtttcgcc

SEQ ID NO: 525955 - DNA, 20 bp, Artificial
  CRISPR gRNA sequence
gtagagacagagtttcgcca

SEQ ID NO: 525956 - DNA, 20 bp, Artificial
  CRISPR gRNA sequence
cgccatgttggccaggctgg

SEQ ID NO: 525957 - DNA, 20 bp, Artificial
  CRISPR gRNA sequence
gccatgttggccaggctggt

SEQ ID NO: 525958 - DNA, 20 bp, Artificial
  CRISPR gRNA sequence
gccaggctggtctcaaactc

SEQ ID NO: 525959 - DNA, 20 bp, Artificial
  CRISPR gRNA sequence
gtctcaaactcttgccctca

SEQ ID NO: 525960 - DNA, 20 bp, Artificial
  CRISPR gRNA sequence
aaactcttgccctcagatga

SEQ ID NO: 525961 - DNA, 20 bp, Artificial
  CRISPR gRNA sequence
ttgccctcagatgatctacc

SEQ ID NO: 525962 - DNA, 20 bp, Artificial
  CRISPR gRNA sequence
gccctcagatgatctacccg

SEQ ID NO: 525963 - DNA, 20 bp, Artificial
  CRISPR gRNA sequence
ccctcagatgatctacccgc

SEQ ID NO: 525964 - DNA, 20 bp, Artificial
  CRISPR gRNA sequence
agatgatctacccgcctcgg

SEQ ID NO: 525965 - DNA, 20 bp, Artificial
  CRISPR gRNA sequence
cccgcctcggcctcccacag

SEQ ID NO: 525966 - DNA, 20 bp, Artificial
  CRISPR gRNA sequence
ggcctcccacagtgctggga

SEQ ID NO: 525967 - DNA, 20 bp, Artificial
  CRISPR gRNA sequence
ccacagtgctgggattacag

SEQ ID NO: 525968 - DNA, 20 bp, Artificial
  CRISPR gRNA sequence
ggattacaggcgtgagccgc

SEQ ID NO: 525969 - DNA, 20 bp, Artificial
  CRISPR gRNA sequence
caggcgtgagccgcggcgcc

SEQ ID NO: 525970 - DNA, 20 bp, Artificial
  CRISPR gRNA sequence
tcccatggattctcaccaga

SEQ ID NO: 525971 - DNA, 20 bp, Artificial
  CRISPR gRNA sequence
tcaccagaacgtttccctca

SEQ ID NO: 525972 - DNA, 20 bp, Artificial
  CRISPR gRNA sequence
accagaacgtttccctcatg

SEQ ID NO: 525973 - DNA, 20 bp, Artificial
  CRISPR gRNA sequence
ccctcatgttgggtggtctg

SEQ ID NO: 525974 - DNA, 20 bp, Artificial
  CRISPR gRNA sequence
cctcatgttgggtggtctga

SEQ ID NO: 525975 - DNA, 20 bp, Artificial
  CRISPR gRNA sequence
atgttgggtggtctgagtgg

SEQ ID NO: 525976 - DNA, 20 bp, Artificial
  CRISPR gRNA sequence
ggtggtctgagtgggagtgt

SEQ ID NO: 525977 - DNA, 20 bp, Artificial
  CRISPR gRNA sequence
agtgggagtgtgctcagctt

SEQ ID NO: 525978 - DNA, 20 bp, Artificial
  CRISPR gRNA sequence
agcttctcctgatttgctgt

SEQ ID NO: 525979 - DNA, 20 bp, Artificial
  CRISPR gRNA sequence
ctcctgatttgctgtctgcg

SEQ ID NO: 525980 - DNA, 20 bp, Artificial
  CRISPR gRNA sequence
tcctgatttgctgtctgcgt

SEQ ID NO: 525981 - DNA, 20 bp, Artificial
  CRISPR gRNA sequence
ctgatttgctgtctgcgtgt

SEQ ID NO: 525982 - DNA, 20 bp, Artificial
  CRISPR gRNA sequence
atttgctgtctgcgtgtcac

SEQ ID NO: 525983 - DNA, 20 bp, Artificial
  CRISPR gRNA sequence
gctgtctgcgtgtcacatgt

SEQ ID NO: 525984 - DNA, 20 bp, Artificial
  CRISPR gRNA sequence
ctgtctgcgtgtcacatgtc

SEQ ID NO: 525985 - DNA, 20 bp, Artificial
  CRISPR gRNA sequence
tctgcgtgtcacatgtctct

SEQ ID NO: 525986 - DNA, 20 bp, Artificial
  CRISPR gRNA sequence
cgtgtcacatgtctctgctg

SEQ ID NO: 525987 - DNA, 20 bp, Artificial
  CRISPR gRNA sequence
tgctgatgtgtggccgggga

SEQ ID NO: 525988 - DNA, 20 bp, Artificial
  CRISPR gRNA sequence
ctgatgtgtggccggggaga

SEQ ID NO: 525989 - DNA, 20 bp, Artificial
  CRISPR gRNA sequence
atgtgtggccggggagatcc

SEQ ID NO: 525990 - DNA, 20 bp, Artificial
  CRISPR gRNA sequence
gtgccggccagtgcgggagt

SEQ ID NO: 525991 - DNA, 20 bp, Artificial
  CRISPR gRNA sequence
cttgccggctgactttggct

SEQ ID NO: 525992 - DNA, 20 bp, Artificial
  CRISPR gRNA sequence
gccggctgactttggctctc

SEQ ID NO: 525993 - DNA, 20 bp, Artificial
  CRISPR gRNA sequence
ccggctgactttggctctcg

SEQ ID NO: 525994 - DNA, 20 bp, Artificial
  CRISPR gRNA sequence
actttggctctcggatctga

SEQ ID NO: 525995 - DNA, 20 bp, Artificial
  CRISPR gRNA sequence
tggctctcggatctgagcat

SEQ ID NO: 525996 - DNA, 20 bp, Artificial
  CRISPR gRNA sequence
ggctctcggatctgagcatc

SEQ ID NO: 525997 - DNA, 20 bp, Artificial
  CRISPR gRNA sequence
gctctcggatctgagcatca

SEQ ID NO: 525998 - DNA, 20 bp, Artificial
  CRISPR gRNA sequence
tcggatctgagcatcagctc

SEQ ID NO: 525999 - DNA, 20 bp, Artificial
  CRISPR gRNA sequence
ggatctgagcatcagctctt

SEQ ID NO: 526000 - DNA, 20 bp, Artificial
  CRISPR gRNA sequence
agcatcagctcttcctgctc

SEQ ID NO: 526001 - DNA, 20 bp, Artificial
  CRISPR gRNA sequence
ttcctgctcctggtcacccc

SEQ ID NO: 526002 - DNA, 20 bp, Artificial
  CRISPR gRNA sequence
cctgctcctggtcacccctt

SEQ ID NO: 526003 - DNA, 20 bp, Artificial
  CRISPR gRNA sequence
ctgctcctggtcaccccttc

SEQ ID NO: 526004 - DNA, 20 bp, Artificial
  CRISPR gRNA sequence
ctcctggtcaccccttcctc

SEQ ID NO: 526005 - DNA, 20 bp, Artificial
  CRISPR gRNA sequence
ctggtcaccccttcctcccc

SEQ ID NO: 526006 - DNA, 20 bp, Artificial
  CRISPR gRNA sequence
gtcaccccttcctccccacg

SEQ ID NO: 526007 - DNA, 20 bp, Artificial
  CRISPR gRNA sequence
cctccccacgctgaaccccc

SEQ ID NO: 526008 - DNA, 20 bp, Artificial
  CRISPR gRNA sequence
ctccccacgctgaacccccc

SEQ ID NO: 526009 - DNA, 20 bp, Artificial
  CRISPR gRNA sequence
cccacgctgaaccccccagg

SEQ ID NO: 526010 - DNA, 20 bp, Artificial
  CRISPR gRNA sequence
aaccccccaggacccctgca

SEQ ID NO: 526011 - DNA, 20 bp, Artificial
  CRISPR gRNA sequence
cagaggccaggaggtgaggg

SEQ ID NO: 526012 - DNA, 20 bp, Artificial
  CRISPR gRNA sequence
ggagctgggctgccaccctg

SEQ ID NO: 526013 - DNA, 20 bp, Artificial
  CRISPR gRNA sequence
ggctgccaccctggccaccg

SEQ ID NO: 526014 - DNA, 20 bp, Artificial
  CRISPR gRNA sequence
ccaccctggccaccgagggt

SEQ ID NO: 526015 - DNA, 20 bp, Artificial
  CRISPR gRNA sequence
gccaccgagggtccccacct

SEQ ID NO: 526016 - DNA, 20 bp, Artificial
  CRISPR gRNA sequence
agcccagcactgccctgcag

SEQ ID NO: 526017 - DNA, 20 bp, Artificial
  CRISPR gRNA sequence
ccctgcagatcaccttccag

SEQ ID NO: 526018 - DNA, 20 bp, Artificial
  CRISPR gRNA sequence
cagatcaccttccaggtgaa

SEQ ID NO: 526019 - DNA, 20 bp, Artificial
  CRISPR gRNA sequence
ccaggtgaaggtcacggcca

SEQ ID NO: 526020 - DNA, 20 bp, Artificial
  CRISPR gRNA sequence
caggtgaaggtcacggccac

SEQ ID NO: 526021 - DNA, 20 bp, Artificial
  CRISPR gRNA sequence
gtcatccgggcgctgggctt

SEQ ID NO: 526022 - DNA, 20 bp, Artificial
  CRISPR gRNA sequence
tcatccgggcgctgggcttc

SEQ ID NO: 526023 - DNA, 20 bp, Artificial
  CRISPR gRNA sequence
ggcttcacggacatagtgac

SEQ ID NO: 526024 - DNA, 20 bp, Artificial
  CRISPR gRNA sequence
cacggacatagtgaccgtgc

SEQ ID NO: 526025 - DNA, 20 bp, Artificial
  CRISPR gRNA sequence
acggacatagtgaccgtgca

SEQ ID NO: 526026 - DNA, 20 bp, Artificial
  CRISPR gRNA sequence
ttccccagtgtgagtgccgg

SEQ ID NO: 526027 - DNA, 20 bp, Artificial
  CRISPR gRNA sequence
ccccagtgtgagtgccggtg

SEQ ID NO: 526028 - DNA, 20 bp, Artificial
  CRISPR gRNA sequence
cccagtgtgagtgccggtgc

SEQ ID NO: 526029 - DNA, 20 bp, Artificial
  CRISPR gRNA sequence
tgccatggcaagggcttctt

SEQ ID NO: 526030 - DNA, 20 bp, Artificial
  CRISPR gRNA sequence
ccatggcaagggcttcttgg

SEQ ID NO: 526031 - DNA, 20 bp, Artificial
  CRISPR gRNA sequence
cttggagtgcggcatctgca

SEQ ID NO: 526032 - DNA, 20 bp, Artificial
  CRISPR gRNA sequence
ttggagtgcggcatctgcag

SEQ ID NO: 526033 - DNA, 20 bp, Artificial
  CRISPR gRNA sequence
ggagtgcggcatctgcaggt

SEQ ID NO: 526034 - DNA, 20 bp, Artificial
  CRISPR gRNA sequence
gagtgcggcatctgcaggtg

SEQ ID NO: 526035 - DNA, 20 bp, Artificial
  CRISPR gRNA sequence
caggtgaggcgggcgcaggt

SEQ ID NO: 526036 - DNA, 20 bp, Artificial
  CRISPR gRNA sequence
ttgaaccatccccgagcccc

SEQ ID NO: 526037 - DNA, 20 bp, Artificial
  CRISPR gRNA sequence
aaccatccccgagccccacc

SEQ ID NO: 526038 - DNA, 20 bp, Artificial
  CRISPR gRNA sequence
catcccttcccccaccccac

SEQ ID NO: 526039 - DNA, 20 bp, Artificial
  CRISPR gRNA sequence
cccccaccccacggagcagg

SEQ ID NO: 526040 - DNA, 20 bp, Artificial
  CRISPR gRNA sequence
ccccaccccacggagcaggc

SEQ ID NO: 526041 - DNA, 20 bp, Artificial
  CRISPR gRNA sequence
ggggcccccttctgcaggag

SEQ ID NO: 526042 - DNA, 20 bp, Artificial
  CRISPR gRNA sequence
ctgcaggaggtggggagatt

SEQ ID NO: 526043 - DNA, 20 bp, Artificial
  CRISPR gRNA sequence
tgcaggaggtggggagattt

SEQ ID NO: 526044 - DNA, 20 bp, Artificial
  CRISPR gRNA sequence
caggaggtggggagatttgg

SEQ ID NO: 526045 - DNA, 20 bp, Artificial
  CRISPR gRNA sequence
gggattggaacccagaaccc

SEQ ID NO: 526046 - DNA, 20 bp, Artificial
  CRISPR gRNA sequence
ggattggaacccagaacccc

SEQ ID NO: 526047 - DNA, 20 bp, Artificial
  CRISPR gRNA sequence
gaacccagaacccctcggca

SEQ ID NO: 526048 - DNA, 20 bp, Artificial
  CRISPR gRNA sequence
ggcaagccctcacccgtgct

SEQ ID NO: 526049 - DNA, 20 bp, Artificial
  CRISPR gRNA sequence
acccgtgctcctgagccagg

SEQ ID NO: 526050 - DNA, 20 bp, Artificial
  CRISPR gRNA sequence
ctgagccagggcaccagcaa

SEQ ID NO: 526051 - DNA, 20 bp, Artificial
  CRISPR gRNA sequence
agccagggcaccagcaatgc

SEQ ID NO: 526052 - DNA, 20 bp, Artificial
  CRISPR gRNA sequence
tactctacactctctggcca

SEQ ID NO: 526053 - DNA, 20 bp, Artificial
  CRISPR gRNA sequence
tacactctctggccatggag

SEQ ID NO: 526054 - DNA, 20 bp, Artificial
  CRISPR gRNA sequence
cactctctggccatggagga

SEQ ID NO: 526055 - DNA, 20 bp, Artificial
  CRISPR gRNA sequence
tctggccatggaggacccaa

SEQ ID NO: 526056 - DNA, 20 bp, Artificial
  CRISPR gRNA sequence
tggccatggaggacccaagg

SEQ ID NO: 526057 - DNA, 20 bp, Artificial
  CRISPR gRNA sequence
gccatggaggacccaaggca

SEQ ID NO: 526058 - DNA, 20 bp, Artificial
  CRISPR gRNA sequence
gtgggcaggaggaccccctc

SEQ ID NO: 526059 - DNA, 20 bp, Artificial
  CRISPR gRNA sequence
tgggcaggaggaccccctca

SEQ ID NO: 526060 - DNA, 20 bp, Artificial
  CRISPR gRNA sequence
accagaggatggaggcccat

SEQ ID NO: 526061 - DNA, 20 bp, Artificial
  CRISPR gRNA sequence
aggggcacaaggagtccccg

SEQ ID NO: 526062 - DNA, 20 bp, Artificial
  CRISPR gRNA sequence
ggcgtgcccatggccttgag

SEQ ID NO: 526063 - DNA, 20 bp, Artificial
  CRISPR gRNA sequence
gagtgggtcactttctctgc

SEQ ID NO: 526064 - DNA, 20 bp, Artificial
  CRISPR gRNA sequence
agtgggtcactttctctgcc

SEQ ID NO: 526065 - DNA, 20 bp, Artificial
  CRISPR gRNA sequence
tctctgcccgaccttccttg

SEQ ID NO: 526066 - DNA, 20 bp, Artificial
  CRISPR gRNA sequence
ctctgcccgaccttccttga

SEQ ID NO: 526067 - DNA, 20 bp, Artificial
  CRISPR gRNA sequence
tctgcccgaccttccttgac

SEQ ID NO: 526068 - DNA, 20 bp, Artificial
  CRISPR gRNA sequence
tgcccgaccttccttgaccc

SEQ ID NO: 526069 - DNA, 20 bp, Artificial
  CRISPR gRNA sequence
cccgaccttccttgacccta

SEQ ID NO: 526070 - DNA, 20 bp, Artificial
  CRISPR gRNA sequence
ccttgaccctaggagctggc

SEQ ID NO: 526071 - DNA, 20 bp, Artificial
  CRISPR gRNA sequence
cttgaccctaggagctggct

SEQ ID NO: 526072 - DNA, 20 bp, Artificial
  CRISPR gRNA sequence
gaccctaggagctggcttct

SEQ ID NO: 526073 - DNA, 20 bp, Artificial
  CRISPR gRNA sequence
accctaggagctggcttctc

SEQ ID NO: 526074 - DNA, 20 bp, Artificial
  CRISPR gRNA sequence
ggagctggcttctctctgac

SEQ ID NO: 526075 - DNA, 20 bp, Artificial
  CRISPR gRNA sequence
gcttctctctgaccttgggg

SEQ ID NO: 526076 - DNA, 20 bp, Artificial
  CRISPR gRNA sequence
ctctctgaccttggggaccc

SEQ ID NO: 526077 - DNA, 20 bp, Artificial
  CRISPR gRNA sequence
tctctgaccttggggaccca

SEQ ID NO: 526078 - DNA, 20 bp, Artificial
  CRISPR gRNA sequence
tctgaccttggggacccaag

SEQ ID NO: 526079 - DNA, 20 bp, Artificial
  CRISPR gRNA sequence
tgaccttggggacccaaggc

SEQ ID NO: 526080 - DNA, 20 bp, Artificial
  CRISPR gRNA sequence
accttggggacccaaggcca

SEQ ID NO: 526081 - DNA, 20 bp, Artificial
  CRISPR gRNA sequence
ggggacccaaggccatcagg

SEQ ID NO: 526082 - DNA, 20 bp, Artificial
  CRISPR gRNA sequence
gggacccaaggccatcaggc

SEQ ID NO: 526083 - DNA, 20 bp, Artificial
  CRISPR gRNA sequence
gcagccctggggcatgggtg

SEQ ID NO: 526084 - DNA, 20 bp, Artificial
  CRISPR gRNA sequence
gggcatgggtggctagagag

SEQ ID NO: 526085 - DNA, 20 bp, Artificial
  CRISPR gRNA sequence
gagagcctcctgggacaggt

SEQ ID NO: 526086 - DNA, 20 bp, Artificial
  CRISPR gRNA sequence
ctgggacaggtgatggcttc

SEQ ID NO: 526087 - DNA, 20 bp, Artificial
  CRISPR gRNA sequence
ggacaggtgatggcttctgg

SEQ ID NO: 526088 - DNA, 20 bp, Artificial
  CRISPR gRNA sequence
ctgggagcctgggccccata

SEQ ID NO: 526089 - DNA, 20 bp, Artificial
  CRISPR gRNA sequence
tgggagcctgggccccatag

SEQ ID NO: 526090 - DNA, 20 bp, Artificial
  CRISPR gRNA sequence
ggagcctgggccccataggc

SEQ ID NO: 526091 - DNA, 20 bp, Artificial
  CRISPR gRNA sequence
ggccccataggccacctctt

SEQ ID NO: 526092 - DNA, 20 bp, Artificial
  CRISPR gRNA sequence
ttgggcgtgcacaccccctg

SEQ ID NO: 526093 - DNA, 20 bp, Artificial
  CRISPR gRNA sequence
gggcgtgcacaccccctgcc

SEQ ID NO: 526094 - DNA, 20 bp, Artificial
  CRISPR gRNA sequence
ggcgtgcacaccccctgcca

SEQ ID NO: 526095 - DNA, 20 bp, Artificial
  CRISPR gRNA sequence
ccaggcgtgggcaccccacc

SEQ ID NO: 526096 - DNA, 20 bp, Artificial
  CRISPR gRNA sequence
agggagaagtgggggacagg

SEQ ID NO: 526097 - DNA, 20 bp, Artificial
  CRISPR gRNA sequence
acatggcactcagccaggcg

SEQ ID NO: 526098 - DNA, 20 bp, Artificial
  CRISPR gRNA sequence
agccaggcggcctgcccggg

SEQ ID NO: 526099 - DNA, 20 bp, Artificial
  CRISPR gRNA sequence
cccgggggctggatggctgt

SEQ ID NO: 526100 - DNA, 20 bp, Artificial
  CRISPR gRNA sequence
gatggctgtccccctttcct

SEQ ID NO: 526101 - DNA, 20 bp, Artificial
  CRISPR gRNA sequence
tccccctttccttgcttgcc

SEQ ID NO: 526102 - DNA, 20 bp, Artificial
  CRISPR gRNA sequence
tccttgcttgcctggccaga

SEQ ID NO: 526103 - DNA, 20 bp, Artificial
  CRISPR gRNA sequence
ccttgcttgcctggccagag

SEQ ID NO: 526104 - DNA, 20 bp, Artificial
  CRISPR gRNA sequence
cttgcttgcctggccagagc

SEQ ID NO: 526105 - DNA, 20 bp, Artificial
  CRISPR gRNA sequence
gcttgcctggccagagctgc

SEQ ID NO: 526106 - DNA, 20 bp, Artificial
  CRISPR gRNA sequence
cttgcctggccagagctgct

SEQ ID NO: 526107 - DNA, 20 bp, Artificial
  CRISPR gRNA sequence
gcctggccagagctgctagg

SEQ ID NO: 526108 - DNA, 20 bp, Artificial
  CRISPR gRNA sequence
cctggccagagctgctaggc

SEQ ID NO: 526109 - DNA, 20 bp, Artificial
  CRISPR gRNA sequence
gccagagctgctaggctgac

SEQ ID NO: 526110 - DNA, 20 bp, Artificial
  CRISPR gRNA sequence
ctaggctgacctcccaggac

SEQ ID NO: 526111 - DNA, 20 bp, Artificial
  CRISPR gRNA sequence
ggctgacctcccaggactct

SEQ ID NO: 526112 - DNA, 20 bp, Artificial
  CRISPR gRNA sequence
acctcccaggactctgcccc

SEQ ID NO: 526113 - DNA, 20 bp, Artificial
  CRISPR gRNA sequence
ccaggactctgccccctttg

SEQ ID NO: 526114 - DNA, 20 bp, Artificial
  CRISPR gRNA sequence
tgccccctttgctctggtca

SEQ ID NO: 526115 - DNA, 20 bp, Artificial
  CRISPR gRNA sequence
ccccctttgctctggtcacc

SEQ ID NO: 526116 - DNA, 20 bp, Artificial
  CRISPR gRNA sequence
tgctctggtcacctcctccc

SEQ ID NO: 526117 - DNA, 20 bp, Artificial
  CRISPR gRNA sequence
gctctggtcacctcctcccc

SEQ ID NO: 526118 - DNA, 20 bp, Artificial
  CRISPR gRNA sequence
ctctggtcacctcctcccct

SEQ ID NO: 526119 - DNA, 20 bp, Artificial
  CRISPR gRNA sequence
tggtcacctcctcccctgtc

SEQ ID NO: 526120 - DNA, 20 bp, Artificial
  CRISPR gRNA sequence
gtcacctcctcccctgtcct

SEQ ID NO: 526121 - DNA, 20 bp, Artificial
  CRISPR gRNA sequence
ctcccctgtcctgaccgcag

SEQ ID NO: 526122 - DNA, 20 bp, Artificial
  CRISPR gRNA sequence
ccctgtcctgaccgcagtgc

SEQ ID NO: 526123 - DNA, 20 bp, Artificial
  CRISPR gRNA sequence
tcctgaccgcagtgccaatc

SEQ ID NO: 526124 - DNA, 20 bp, Artificial
  CRISPR gRNA sequence
accgcagtgccaatccacgt

SEQ ID NO: 526125 - DNA, 20 bp, Artificial
  CRISPR gRNA sequence
gtggcagtgcccttcctcac

SEQ ID NO: 526126 - DNA, 20 bp, Artificial
  CRISPR gRNA sequence
cctcaccttcaggtccctgc

SEQ ID NO: 526127 - DNA, 20 bp, Artificial
  CRISPR gRNA sequence
ctcaccttcaggtccctgct

SEQ ID NO: 526128 - DNA, 20 bp, Artificial
  CRISPR gRNA sequence
accttcaggtccctgctgcc

SEQ ID NO: 526129 - DNA, 20 bp, Artificial
  CRISPR gRNA sequence
caggtccctgctgcccccag

SEQ ID NO: 526130 - DNA, 20 bp, Artificial
  CRISPR gRNA sequence
aggtccctgctgcccccagc

SEQ ID NO: 526131 - DNA, 20 bp, Artificial
  CRISPR gRNA sequence
ctgcccccagcctcctccca

SEQ ID NO: 526132 - DNA, 20 bp, Artificial
  CRISPR gRNA sequence
cccccagcctcctcccatat

SEQ ID NO: 526133 - DNA, 20 bp, Artificial
  CRISPR gRNA sequence
ctcccatatctcaggacaat

SEQ ID NO: 526134 - DNA, 20 bp, Artificial
  CRISPR gRNA sequence
ccatatctcaggacaatgat

SEQ ID NO: 526135 - DNA, 20 bp, Artificial
  CRISPR gRNA sequence
aggacaatgatggtctctgt

SEQ ID NO: 526136 - DNA, 20 bp, Artificial
  CRISPR gRNA sequence
tgtggtcttggtggtctctg

SEQ ID NO: 526137 - DNA, 20 bp, Artificial
  CRISPR gRNA sequence
tggtcttggtggtctctgtt

SEQ ID NO: 526138 - DNA, 20 bp, Artificial
  CRISPR gRNA sequence
ggtggtctctgttgctgtcc

SEQ ID NO: 526139 - DNA, 20 bp, Artificial
  CRISPR gRNA sequence
gtggtctctgttgctgtcct

SEQ ID NO: 526140 - DNA, 20 bp, Artificial
  CRISPR gRNA sequence
tgttgctgtcctcgtgcctc

SEQ ID NO: 526141 - DNA, 20 bp, Artificial
  CRISPR gRNA sequence
ttgctgtcctcgtgcctcag

SEQ ID NO: 526142 - DNA, 20 bp, Artificial
  CRISPR gRNA sequence
ctgtcctcgtgcctcagtgg

SEQ ID NO: 526143 - DNA, 20 bp, Artificial
  CRISPR gRNA sequence
tcctcgtgcctcagtggcca

SEQ ID NO: 526144 - DNA, 20 bp, Artificial
  CRISPR gRNA sequence
gtgcctcagtggccaccccg

SEQ ID NO: 526145 - DNA, 20 bp, Artificial
  CRISPR gRNA sequence
agtggccaccccgcccactg

SEQ ID NO: 526146 - DNA, 20 bp, Artificial
  CRISPR gRNA sequence
tcctgggtgtgcagccctgg

SEQ ID NO: 526147 - DNA, 20 bp, Artificial
  CRISPR gRNA sequence
ggtgtgcagccctggggcgg

SEQ ID NO: 526148 - DNA, 20 bp, Artificial
  CRISPR gRNA sequence
gggcggcctcttcacgggac

SEQ ID NO: 526149 - DNA, 20 bp, Artificial
  CRISPR gRNA sequence
ttcacgggactgtaggggtg

SEQ ID NO: 526150 - DNA, 20 bp, Artificial
  CRISPR gRNA sequence
cacgggactgtaggggtgac

SEQ ID NO: 526151 - DNA, 20 bp, Artificial
  CRISPR gRNA sequence
acgggactgtaggggtgact

SEQ ID NO: 526152 - DNA, 20 bp, Artificial
  CRISPR gRNA sequence
taggggtgactcagtcggaa

SEQ ID NO: 526153 - DNA, 20 bp, Artificial
  CRISPR gRNA sequence
agtcggaacacttggcaggt

SEQ ID NO: 526154 - DNA, 20 bp, Artificial
  CRISPR gRNA sequence
ggcaggtgtcggggggtgcc

SEQ ID NO: 526155 - DNA, 20 bp, Artificial
  CRISPR gRNA sequence
gcaggtgtcggggggtgccc

SEQ ID NO: 526156 - DNA, 20 bp, Artificial
  CRISPR gRNA sequence
ccacaggtactcagacactc

SEQ ID NO: 526157 - DNA, 20 bp, Artificial
  CRISPR gRNA sequence
agacactcggtcctgcagct

SEQ ID NO: 526158 - DNA, 20 bp, Artificial
  CRISPR gRNA sequence
ggtcctgcagcttcctcctc

SEQ ID NO: 526159 - DNA, 20 bp, Artificial
  CRISPR gRNA sequence
cagcttcctcctctggggag

SEQ ID NO: 526160 - DNA, 20 bp, Artificial
  CRISPR gRNA sequence
cctcctctggggagcaggag

SEQ ID NO: 526161 - DNA, 20 bp, Artificial
  CRISPR gRNA sequence
ctcctctggggagcaggaga

SEQ ID NO: 526162 - DNA, 20 bp, Artificial
  CRISPR gRNA sequence
ctctggggagcaggagagcc

SEQ ID NO: 526163 - DNA, 20 bp, Artificial
  CRISPR gRNA sequence
tggggagcaggagagcccgt

SEQ ID NO: 526164 - DNA, 20 bp, Artificial
  CRISPR gRNA sequence
gggagcaggagagcccgtgg

SEQ ID NO: 526165 - DNA, 20 bp, Artificial
  CRISPR gRNA sequence
tgaggatgcctcagggtgtg

SEQ ID NO: 526166 - DNA, 20 bp, Artificial
  CRISPR gRNA sequence
aggatgcctcagggtgtgtg

SEQ ID NO: 526167 - DNA, 20 bp, Artificial
  CRISPR gRNA sequence
agggtgtgtgtggctcctgc

SEQ ID NO: 526168 - DNA, 20 bp, Artificial
  CRISPR gRNA sequence
ctgcctgccagcggcttgat

SEQ ID NO: 526169 - DNA, 20 bp, Artificial
  CRISPR gRNA sequence
cctgccagcggcttgatgcc

SEQ ID NO: 526170 - DNA, 20 bp, Artificial
  CRISPR gRNA sequence
ccagcggcttgatgccagct

SEQ ID NO: 526171 - DNA, 20 bp, Artificial
  CRISPR gRNA sequence
gatgccagcttccacatctg

SEQ ID NO: 526172 - DNA, 20 bp, Artificial
  CRISPR gRNA sequence
atgccagcttccacatctgt

SEQ ID NO: 526173 - DNA, 20 bp, Artificial
  CRISPR gRNA sequence
ccacatctgtaaaaacccct

SEQ ID NO: 526174 - DNA, 20 bp, Artificial
  CRISPR gRNA sequence
cacatctgtaaaaacccctt

SEQ ID NO: 526175 - DNA, 20 bp, Artificial
  CRISPR gRNA sequence
taaaaaccccttgtccctgc

SEQ ID NO: 526176 - DNA, 20 bp, Artificial
  CRISPR gRNA sequence
gtccctgcattctcccacaa

SEQ ID NO: 526177 - DNA, 20 bp, Artificial
  CRISPR gRNA sequence
tccctgcattctcccacaac

SEQ ID NO: 526178 - DNA, 20 bp, Artificial
  CRISPR gRNA sequence
cattctcccacaacctggcc

SEQ ID NO: 526179 - DNA, 20 bp, Artificial
  CRISPR gRNA sequence
tcccacaacctggcctgtca

SEQ ID NO: 526180 - DNA, 20 bp, Artificial
  CRISPR gRNA sequence
ccacaacctggcctgtcagt

SEQ ID NO: 526181 - DNA, 20 bp, Artificial
  CRISPR gRNA sequence
gcctgtcagtgcacgaacgc

SEQ ID NO: 526182 - DNA, 20 bp, Artificial
  CRISPR gRNA sequence
tcagtgcacgaacgcaggag

SEQ ID NO: 526183 - DNA, 20 bp, Artificial
  CRISPR gRNA sequence
tggcaggaggcagtgccgag

SEQ ID NO: 526184 - DNA, 20 bp, Artificial
  CRISPR gRNA sequence
gccaccatgtggggcacgca

SEQ ID NO: 526185 - DNA, 20 bp, Artificial
  CRISPR gRNA sequence
acagagcaccggtatcgcag

SEQ ID NO: 526186 - DNA, 20 bp, Artificial
  CRISPR gRNA sequence
caacacagctccacagtgag

SEQ ID NO: 526187 - DNA, 20 bp, Artificial
  CRISPR gRNA sequence
cacagtgagcctgccgagcc

SEQ ID NO: 526188 - DNA, 20 bp, Artificial
  CRISPR gRNA sequence
ccgagccactgcatgcgcag

SEQ ID NO: 526189 - DNA, 20 bp, Artificial
  CRISPR gRNA sequence
catgcgcaggccaaggccag

SEQ ID NO: 526190 - DNA, 20 bp, Artificial
  CRISPR gRNA sequence
ctttcccctcgggacatcct

SEQ ID NO: 526191 - DNA, 20 bp, Artificial
  CRISPR gRNA sequence
tcccctcgggacatcctggg

SEQ ID NO: 526192 - DNA, 20 bp, Artificial
  CRISPR gRNA sequence
cccctcgggacatcctgggg

SEQ ID NO: 526193 - DNA, 20 bp, Artificial
  CRISPR gRNA sequence
ccctcgggacatcctgggga

SEQ ID NO: 526194 - DNA, 20 bp, Artificial
  CRISPR gRNA sequence
gggacatcctggggagggaa

SEQ ID NO: 526195 - DNA, 20 bp, Artificial
  CRISPR gRNA sequence
gggagggaacgcggggcccc

SEQ ID NO: 526196 - DNA, 20 bp, Artificial
  CRISPR gRNA sequence
cacgttttgagcacatttag

SEQ ID NO: 526197 - DNA, 20 bp, Artificial
  CRISPR gRNA sequence
tgagcacatttagtccgtgg

SEQ ID NO: 526198 - DNA, 20 bp, Artificial
  CRISPR gRNA sequence
gagcacatttagtccgtggc

SEQ ID NO: 526199 - DNA, 20 bp, Artificial
  CRISPR gRNA sequence
agcacatttagtccgtggca

SEQ ID NO: 526200 - DNA, 20 bp, Artificial
  CRISPR gRNA sequence
agtccgtggcaagtgctcag

SEQ ID NO: 526201 - DNA, 20 bp, Artificial
  CRISPR gRNA sequence
gtccgtggcaagtgctcagt

SEQ ID NO: 526202 - DNA, 20 bp, Artificial
  CRISPR gRNA sequence
agtaggcctcgaggaaagca

SEQ ID NO: 526203 - DNA, 20 bp, Artificial
  CRISPR gRNA sequence
gaggaaagcaaaatgtgcca

SEQ ID NO: 526204 - DNA, 20 bp, Artificial
  CRISPR gRNA sequence
tccaccaagggcaaggggcc

SEQ ID NO: 526205 - DNA, 20 bp, Artificial
  CRISPR gRNA sequence
caccaagggcaaggggcctg

SEQ ID NO: 526206 - DNA, 20 bp, Artificial
  CRISPR gRNA sequence
gaggacagggcggctgtccc

SEQ ID NO: 526207 - DNA, 20 bp, Artificial
  CRISPR gRNA sequence
tcccttgtcccacatcactg

SEQ ID NO: 526208 - DNA, 20 bp, Artificial
  CRISPR gRNA sequence
gtcccacatcactgggggga

SEQ ID NO: 526209 - DNA, 20 bp, Artificial
  CRISPR gRNA sequence
tcccacatcactggggggag

SEQ ID NO: 526210 - DNA, 20 bp, Artificial
  CRISPR gRNA sequence
gggggagcctgaccttgggg

SEQ ID NO: 526211 - DNA, 20 bp, Artificial
  CRISPR gRNA sequence
accttggggcccctcctgtc

SEQ ID NO: 526212 - DNA, 20 bp, Artificial
  CRISPR gRNA sequence
ggggcccctcctgtccccag

SEQ ID NO: 526213 - DNA, 20 bp, Artificial
  CRISPR gRNA sequence
gggcccctcctgtccccagg

SEQ ID NO: 526214 - DNA, 20 bp, Artificial
  CRISPR gRNA sequence
ctgtccccaggtgtgacact

SEQ ID NO: 526215 - DNA, 20 bp, Artificial
  CRISPR gRNA sequence
tccccaggtgtgacactggc

SEQ ID NO: 526216 - DNA, 20 bp, Artificial
  CRISPR gRNA sequence
gctacattgggaaaaactgt

SEQ ID NO: 526217 - DNA, 20 bp, Artificial
  CRISPR gRNA sequence
cattgggaaaaactgtgagt

SEQ ID NO: 526218 - DNA, 20 bp, Artificial
  CRISPR gRNA sequence
ggaaaaactgtgagtgccag

SEQ ID NO: 526219 - DNA, 20 bp, Artificial
  CRISPR gRNA sequence
tgagtgccagacacagggcc

SEQ ID NO: 526220 - DNA, 20 bp, Artificial
  CRISPR gRNA sequence
gaaggaagctgccggaagga

SEQ ID NO: 526221 - DNA, 20 bp, Artificial
  CRISPR gRNA sequence
ccggaaggacaacaactcca

SEQ ID NO: 526222 - DNA, 20 bp, Artificial
  CRISPR gRNA sequence
catcatctgctcagggctgg

SEQ ID NO: 526223 - DNA, 20 bp, Artificial
  CRISPR gRNA sequence
ctcagggctgggggactgtg

SEQ ID NO: 526224 - DNA, 20 bp, Artificial
  CRISPR gRNA sequence
agggctgggggactgtgtct

SEQ ID NO: 526225 - DNA, 20 bp, Artificial
  CRISPR gRNA sequence
ggggactgtgtctgcgggca

SEQ ID NO: 526226 - DNA, 20 bp, Artificial
  CRISPR gRNA sequence
tgtctgcgggcagtgcctgt

SEQ ID NO: 526227 - DNA, 20 bp, Artificial
  CRISPR gRNA sequence
cgggcagtgcctgtgccaca

SEQ ID NO: 526228 - DNA, 20 bp, Artificial
  CRISPR gRNA sequence
tgccacaccagcgacgtccc

SEQ ID NO: 526229 - DNA, 20 bp, Artificial
  CRISPR gRNA sequence
atatacgggcagtactgcga

SEQ ID NO: 526230 - DNA, 20 bp, Artificial
  CRISPR gRNA sequence
cgagtgtgacaccatcaact

SEQ ID NO: 526231 - DNA, 20 bp, Artificial
  CRISPR gRNA sequence
tgagcgctacaacggccagg

SEQ ID NO: 526232 - DNA, 20 bp, Artificial
  CRISPR gRNA sequence
caacggccaggtctgcggcg

SEQ ID NO: 526233 - DNA, 20 bp, Artificial
  CRISPR gRNA sequence
cggcggcccgggtgagcccg

SEQ ID NO: 526234 - DNA, 20 bp, Artificial
  CRISPR gRNA sequence
ctggacaacggccgtcctgc

SEQ ID NO: 526235 - DNA, 20 bp, Artificial
  CRISPR gRNA sequence
gacaacggccgtcctgcggc

SEQ ID NO: 526236 - DNA, 20 bp, Artificial
  CRISPR gRNA sequence
cggcacagacttggtgttgg

SEQ ID NO: 526237 - DNA, 20 bp, Artificial
  CRISPR gRNA sequence
ggtgttggggggtgcgttct

SEQ ID NO: 526238 - DNA, 20 bp, Artificial
  CRISPR gRNA sequence
gtgttggggggtgcgttctg

SEQ ID NO: 526239 - DNA, 20 bp, Artificial
  CRISPR gRNA sequence
gggggtgcgttctggaccat

SEQ ID NO: 526240 - DNA, 20 bp, Artificial
  CRISPR gRNA sequence
tggaccattcaacgagtgga

SEQ ID NO: 526241 - DNA, 20 bp, Artificial
  CRISPR gRNA sequence
gaccattcaacgagtggaac

SEQ ID NO: 526242 - DNA, 20 bp, Artificial
  CRISPR gRNA sequence
aacgagtggaacagaaaggg

SEQ ID NO: 526243 - DNA, 20 bp, Artificial
  CRISPR gRNA sequence
aggacagacagtgcaagtct

SEQ ID NO: 526244 - DNA, 20 bp, Artificial
  CRISPR gRNA sequence
gcccagccaccgggcgtcag

SEQ ID NO: 526245 - DNA, 20 bp, Artificial
  CRISPR gRNA sequence
ggatggccctgcaccccgcc

SEQ ID NO: 526246 - DNA, 20 bp, Artificial
  CRISPR gRNA sequence
gatggccctgcaccccgccc

SEQ ID NO: 526247 - DNA, 20 bp, Artificial
  CRISPR gRNA sequence
caccccgccctgcctcagtt

SEQ ID NO: 526248 - DNA, 20 bp, Artificial
  CRISPR gRNA sequence
cctcagtttctgtgtccatg

SEQ ID NO: 526249 - DNA, 20 bp, Artificial
  CRISPR gRNA sequence
agtttctgtgtccatgagga

SEQ ID NO: 526250 - DNA, 20 bp, Artificial
  CRISPR gRNA sequence
ctgtgtccatgaggacaagg

SEQ ID NO: 526251 - DNA, 20 bp, Artificial
  CRISPR gRNA sequence
tgtgtccatgaggacaaggc

SEQ ID NO: 526252 - DNA, 20 bp, Artificial
  CRISPR gRNA sequence
tgtccatgaggacaaggcgt

SEQ ID NO: 526253 - DNA, 20 bp, Artificial
  CRISPR gRNA sequence
gtggggagggcccacaggag

SEQ ID NO: 526254 - DNA, 20 bp, Artificial
  CRISPR gRNA sequence
tggggagggcccacaggagg

SEQ ID NO: 526255 - DNA, 20 bp, Artificial
  CRISPR gRNA sequence
ttgaggtcccattcacagca

SEQ ID NO: 526256 - DNA, 20 bp, Artificial
  CRISPR gRNA sequence
aggtcccattcacagcaggg

SEQ ID NO: 526257 - DNA, 20 bp, Artificial
  CRISPR gRNA sequence
acagcagggcaggggaggtc

SEQ ID NO: 526258 - DNA, 20 bp, Artificial
  CRISPR gRNA sequence
gccaggaggcggccacgtgg

SEQ ID NO: 526259 - DNA, 20 bp, Artificial
  CRISPR gRNA sequence
gcgggggcagaagggcctgg

SEQ ID NO: 526260 - DNA, 20 bp, Artificial
  CRISPR gRNA sequence
gctagtggccccatgccttt

SEQ ID NO: 526261 - DNA, 20 bp, Artificial
  CRISPR gRNA sequence
gtggccccatgccttttgct

SEQ ID NO: 526262 - DNA, 20 bp, Artificial
  CRISPR gRNA sequence
ttgctcaggaacatccccca

SEQ ID NO: 526263 - DNA, 20 bp, Artificial
  CRISPR gRNA sequence
tgctcaggaacatcccccag

SEQ ID NO: 526264 - DNA, 20 bp, Artificial
  CRISPR gRNA sequence
gctcaggaacatcccccagg

SEQ ID NO: 526265 - DNA, 20 bp, Artificial
  CRISPR gRNA sequence
ctcaggaacatcccccaggc

SEQ ID NO: 526266 - DNA, 20 bp, Artificial
  CRISPR gRNA sequence
aggaacatcccccaggctgg

SEQ ID NO: 526267 - DNA, 20 bp, Artificial
  CRISPR gRNA sequence
gaggaggcaggcgggccgga

SEQ ID NO: 526268 - DNA, 20 bp, Artificial
  CRISPR gRNA sequence
cgggcgggtctcggttccca

SEQ ID NO: 526269 - DNA, 20 bp, Artificial
  CRISPR gRNA sequence
gggcgggtctcggttcccag

SEQ ID NO: 526270 - DNA, 20 bp, Artificial
  CRISPR gRNA sequence
ggttcccaggccaagcagga

SEQ ID NO: 526271 - DNA, 20 bp, Artificial
  CRISPR gRNA sequence
ccaggccaagcaggagctta

SEQ ID NO: 526272 - DNA, 20 bp, Artificial
  CRISPR gRNA sequence
agccgtgctgccccgtcttc

SEQ ID NO: 526273 - DNA, 20 bp, Artificial
  CRISPR gRNA sequence
gccgtgctgccccgtcttcc

SEQ ID NO: 526274 - DNA, 20 bp, Artificial
  CRISPR gRNA sequence
ccccgtcttccagggagggg

SEQ ID NO: 526275 - DNA, 20 bp, Artificial
  CRISPR gRNA sequence
ccagggagggggctctgctt

SEQ ID NO: 526276 - DNA, 20 bp, Artificial
  CRISPR gRNA sequence
cagggagggggctctgcttc

SEQ ID NO: 526277 - DNA, 20 bp, Artificial
  CRISPR gRNA sequence
tgcttctgcgggaagtgccg

SEQ ID NO: 526278 - DNA, 20 bp, Artificial
  CRISPR gRNA sequence
cttctgcgggaagtgccgct

SEQ ID NO: 526279 - DNA, 20 bp, Artificial
  CRISPR gRNA sequence
ctgcgggaagtgccgctgcc

SEQ ID NO: 526280 - DNA, 20 bp, Artificial
  CRISPR gRNA sequence
tgcgggaagtgccgctgcca

SEQ ID NO: 526281 - DNA, 20 bp, Artificial
  CRISPR gRNA sequence
cgggaagtgccgctgccacc

SEQ ID NO: 526282 - DNA, 20 bp, Artificial
  CRISPR gRNA sequence
ccacccgggctttgagggct

SEQ ID NO: 526283 - DNA, 20 bp, Artificial
  CRISPR gRNA sequence
tgagggctcagcgtgccagt

SEQ ID NO: 526284 - DNA, 20 bp, Artificial
  CRISPR gRNA sequence
gagggctcagcgtgccagtg

SEQ ID NO: 526285 - DNA, 20 bp, Artificial
  CRISPR gRNA sequence
agggctcagcgtgccagtgc

SEQ ID NO: 526286 - DNA, 20 bp, Artificial
  CRISPR gRNA sequence
agcgtgccagtgcgagagga

SEQ ID NO: 526287 - DNA, 20 bp, Artificial
  CRISPR gRNA sequence
agggctgcctgaacccgcgg

SEQ ID NO: 526288 - DNA, 20 bp, Artificial
  CRISPR gRNA sequence
cctgaacccgcggcgtgttg

SEQ ID NO: 526289 - DNA, 20 bp, Artificial
  CRISPR gRNA sequence
aacccgcggcgtgttgagtg

SEQ ID NO: 526290 - DNA, 20 bp, Artificial
  CRISPR gRNA sequence
agtgtagtggtcgtggccgg

SEQ ID NO: 526291 - DNA, 20 bp, Artificial
  CRISPR gRNA sequence
caacgtatgcgagtgccatt

SEQ ID NO: 526292 - DNA, 20 bp, Artificial
  CRISPR gRNA sequence
aggctaccagctgcctctgt

SEQ ID NO: 526293 - DNA, 20 bp, Artificial
  CRISPR gRNA sequence
ccagctgcctctgtgccagg

SEQ ID NO: 526294 - DNA, 20 bp, Artificial
  CRISPR gRNA sequence
cctctgtgccaggagtgccc

SEQ ID NO: 526295 - DNA, 20 bp, Artificial
  CRISPR gRNA sequence
tgtgccaggagtgccccggc

SEQ ID NO: 526296 - DNA, 20 bp, Artificial
  CRISPR gRNA sequence
tgccaggagtgccccggctg

SEQ ID NO: 526297 - DNA, 20 bp, Artificial
  CRISPR gRNA sequence
cccctcaccctgtggcaagt

SEQ ID NO: 526298 - DNA, 20 bp, Artificial
  CRISPR gRNA sequence
accctgtggcaagtacatgt

SEQ ID NO: 526299 - DNA, 20 bp, Artificial
  CRISPR gRNA sequence
tggcaagtacatgtgagtgc

SEQ ID NO: 526300 - DNA, 20 bp, Artificial
  CRISPR gRNA sequence
cccggccacctacccagcag

SEQ ID NO: 526301 - DNA, 20 bp, Artificial
  CRISPR gRNA sequence
cccagcagccgggctcactc

SEQ ID NO: 526302 - DNA, 20 bp, Artificial
  CRISPR gRNA sequence
actcggggaccccagtgagc

SEQ ID NO: 526303 - DNA, 20 bp, Artificial
  CRISPR gRNA sequence
ggggaccccagtgagcacct

SEQ ID NO: 526304 - DNA, 20 bp, Artificial
  CRISPR gRNA sequence
tgcaccgcggggttctctgc

SEQ ID NO: 526305 - DNA, 20 bp, Artificial
  CRISPR gRNA sequence
caccgcggggttctctgcgg

SEQ ID NO: 526306 - DNA, 20 bp, Artificial
  CRISPR gRNA sequence
tctgcgggtgcgtctggact

SEQ ID NO: 526307 - DNA, 20 bp, Artificial
  CRISPR gRNA sequence
tgcgggtgcgtctggactga

SEQ ID NO: 526308 - DNA, 20 bp, Artificial
  CRISPR gRNA sequence
cgggtgcgtctggactgagg

SEQ ID NO: 526309 - DNA, 20 bp, Artificial
  CRISPR gRNA sequence
gactgaggggccctccgcgg

SEQ ID NO: 526310 - DNA, 20 bp, Artificial
  CRISPR gRNA sequence
aggggccctccgcggccgcc

SEQ ID NO: 526311 - DNA, 20 bp, Artificial
  CRISPR gRNA sequence
cgcggccgccgtgcccctgt

SEQ ID NO: 526312 - DNA, 20 bp, Artificial
  CRISPR gRNA sequence
tgtccctcctccctcctgtg

SEQ ID NO: 526313 - DNA, 20 bp, Artificial
  CRISPR gRNA sequence
ctccctcctgtgcgcacctg

SEQ ID NO: 526314 - DNA, 20 bp, Artificial
  CRISPR gRNA sequence
cctcctgtgcgcacctgccg

SEQ ID NO: 526315 - DNA, 20 bp, Artificial
  CRISPR gRNA sequence
ctgtgcgcacctgccgcggg

SEQ ID NO: 526316 - DNA, 20 bp, Artificial
  CRISPR gRNA sequence
tgcgcacctgccgcgggccc

SEQ ID NO: 526317 - DNA, 20 bp, Artificial
  CRISPR gRNA sequence
ccgcgggccctgggatcagg

SEQ ID NO: 526318 - DNA, 20 bp, Artificial
  CRISPR gRNA sequence
ggatcaggcttccagttcac

SEQ ID NO: 526319 - DNA, 20 bp, Artificial
  CRISPR gRNA sequence
ccagttcacccgctgcaccc

SEQ ID NO: 526320 - DNA, 20 bp, Artificial
  CRISPR gRNA sequence
cagttcacccgctgcacccg

SEQ ID NO: 526321 - DNA, 20 bp, Artificial
  CRISPR gRNA sequence
acccgctgcacccgcatctg

SEQ ID NO: 526322 - DNA, 20 bp, Artificial
  CRISPR gRNA sequence
cacccgcatctgccccactt

SEQ ID NO: 526323 - DNA, 20 bp, Artificial
  CRISPR gRNA sequence
ccccacttgggccccctcct

SEQ ID NO: 526324 - DNA, 20 bp, Artificial
  CRISPR gRNA sequence
gggccccctccttggcctga

SEQ ID NO: 526325 - DNA, 20 bp, Artificial
  CRISPR gRNA sequence
ggccccctccttggcctgag

SEQ ID NO: 526326 - DNA, 20 bp, Artificial
  CRISPR gRNA sequence
cttggcctgagggcgcccca

SEQ ID NO: 526327 - DNA, 20 bp, Artificial
  CRISPR gRNA sequence
ggcctgagggcgccccaacc

SEQ ID NO: 526328 - DNA, 20 bp, Artificial
  CRISPR gRNA sequence
gcctgagggcgccccaaccc

SEQ ID NO: 526329 - DNA, 20 bp, Artificial
  CRISPR gRNA sequence
agggcgccccaaccccacct

SEQ ID NO: 526330 - DNA, 20 bp, Artificial
  CRISPR gRNA sequence
ccccccctggtggacacaca

SEQ ID NO: 526331 - DNA, 20 bp, Artificial
  CRISPR gRNA sequence
gtggacacacacccaagccc

SEQ ID NO: 526332 - DNA, 20 bp, Artificial
  CRISPR gRNA sequence
ccggagcccccgcacaccct

SEQ ID NO: 526333 - DNA, 20 bp, Artificial
  CRISPR gRNA sequence
gcaccgatgctcacacctgg

SEQ ID NO: 526334 - DNA, 20 bp, Artificial
  CRISPR gRNA sequence
acacctggctccccgcagct

SEQ ID NO: 526335 - DNA, 20 bp, Artificial
  CRISPR gRNA sequence
gctccccgcagctcctgcgc

SEQ ID NO: 526336 - DNA, 20 bp, Artificial
  CRISPR gRNA sequence
cccgcagctcctgcgccgag

SEQ ID NO: 526337 - DNA, 20 bp, Artificial
  CRISPR gRNA sequence
ctgcgccgagtgcctgaagt

SEQ ID NO: 526338 - DNA, 20 bp, Artificial
  CRISPR gRNA sequence
cgccgagtgcctgaagttcg

SEQ ID NO: 526339 - DNA, 20 bp, Artificial
  CRISPR gRNA sequence
aagttcgaaaagggcccctt

SEQ ID NO: 526340 - DNA, 20 bp, Artificial
  CRISPR gRNA sequence
gaaaagggcccctttgggaa

SEQ ID NO: 526341 - DNA, 20 bp, Artificial
  CRISPR gRNA sequence
tgggaagaactgcagcgcgg

SEQ ID NO: 526342 - DNA, 20 bp, Artificial
  CRISPR gRNA sequence
gggaagaactgcagcgcggc

SEQ ID NO: 526343 - DNA, 20 bp, Artificial
  CRISPR gRNA sequence
ggaagaactgcagcgcggcg

SEQ ID NO: 526344 - DNA, 20 bp, Artificial
  CRISPR gRNA sequence
cagcgcggcgtgtccgggcc

SEQ ID NO: 526345 - DNA, 20 bp, Artificial
  CRISPR gRNA sequence
cagctgtcgaacaaccccgt

SEQ ID NO: 526346 - DNA, 20 bp, Artificial
  CRISPR gRNA sequence
tcgaacaaccccgtgaaggg

SEQ ID NO: 526347 - DNA, 20 bp, Artificial
  CRISPR gRNA sequence
caaggagagggactcagagg

SEQ ID NO: 526348 - DNA, 20 bp, Artificial
  CRISPR gRNA sequence
agagggctgctgggtggcct

SEQ ID NO: 526349 - DNA, 20 bp, Artificial
  CRISPR gRNA sequence
ctgggtggcctacacgctgg

SEQ ID NO: 526350 - DNA, 20 bp, Artificial
  CRISPR gRNA sequence
ggtggcctacacgctggagc

SEQ ID NO: 526351 - DNA, 20 bp, Artificial
  CRISPR gRNA sequence
cacgctggagcagcaggacg

SEQ ID NO: 526352 - DNA, 20 bp, Artificial
  CRISPR gRNA sequence
gagcagcaggacgggatgga

SEQ ID NO: 526353 - DNA, 20 bp, Artificial
  CRISPR gRNA sequence
cctcatctatgtggatgaga

SEQ ID NO: 526354 - DNA, 20 bp, Artificial
  CRISPR gRNA sequence
atctatgtggatgagagccg

SEQ ID NO: 526355 - DNA, 20 bp, Artificial
  CRISPR gRNA sequence
tgtggatgagagccgaggtg

SEQ ID NO: 526356 - DNA, 20 bp, Artificial
  CRISPR gRNA sequence
gggtgcagcggggaccggct

SEQ ID NO: 526357 - DNA, 20 bp, Artificial
  CRISPR gRNA sequence
cagagctccggctgcggggt

SEQ ID NO: 526358 - DNA, 20 bp, Artificial
  CRISPR gRNA sequence
cggctgcggggtctccgcag

SEQ ID NO: 526359 - DNA, 20 bp, Artificial
  CRISPR gRNA sequence
cggggtctccgcagaggcga

SEQ ID NO: 526360 - DNA, 20 bp, Artificial
  CRISPR gRNA sequence
cgcagaggcgagggtggtgc

SEQ ID NO: 526361 - DNA, 20 bp, Artificial
  CRISPR gRNA sequence
acctccagtgttgtgggccc

SEQ ID NO: 526362 - DNA, 20 bp, Artificial
  CRISPR gRNA sequence
cagtgttgtgggcccagcag

SEQ ID NO: 526363 - DNA, 20 bp, Artificial
  CRISPR gRNA sequence
tgggcccagcagggtggatg

SEQ ID NO: 526364 - DNA, 20 bp, Artificial
  CRISPR gRNA sequence
ggcattgcaaggaggccaga

SEQ ID NO: 526365 - DNA, 20 bp, Artificial
  CRISPR gRNA sequence
gcattgcaaggaggccagag

SEQ ID NO: 526366 - DNA, 20 bp, Artificial
  CRISPR gRNA sequence
caaggaggccagaggccggt

SEQ ID NO: 526367 - DNA, 20 bp, Artificial
  CRISPR gRNA sequence
acccccagcagcctcccctt

SEQ ID NO: 526368 - DNA, 20 bp, Artificial
  CRISPR gRNA sequence
ccctttccctcccctcctca

SEQ ID NO: 526369 - DNA, 20 bp, Artificial
  CRISPR gRNA sequence
tccctcccctcctcacctga

SEQ ID NO: 526370 - DNA, 20 bp, Artificial
  CRISPR gRNA sequence
ccctcccctcctcacctgac

SEQ ID NO: 526371 - DNA, 20 bp, Artificial
  CRISPR gRNA sequence
cctcccctcctcacctgacc

SEQ ID NO: 526372 - DNA, 20 bp, Artificial
  CRISPR gRNA sequence
ccctcctcacctgaccccac

SEQ ID NO: 526373 - DNA, 20 bp, Artificial
  CRISPR gRNA sequence
ctcacctgaccccacatcaa

SEQ ID NO: 526374 - DNA, 20 bp, Artificial
  CRISPR gRNA sequence
acctgaccccacatcaagct

SEQ ID NO: 526375 - DNA, 20 bp, Artificial
  CRISPR gRNA sequence
accccacatcaagctgggca

SEQ ID NO: 526376 - DNA, 20 bp, Artificial
  CRISPR gRNA sequence
ggcagcagacggcctgctcc

SEQ ID NO: 526377 - DNA, 20 bp, Artificial
  CRISPR gRNA sequence
ctccctgggggcaccactgc

SEQ ID NO: 526378 - DNA, 20 bp, Artificial
  CRISPR gRNA sequence
cctgggggcaccactgctcc

SEQ ID NO: 526379 - DNA, 20 bp, Artificial
  CRISPR gRNA sequence
ggggcaccactgctccacac

SEQ ID NO: 526380 - DNA, 20 bp, Artificial
  CRISPR gRNA sequence
ctccacaccgggcaggccca

SEQ ID NO: 526381 - DNA, 20 bp, Artificial
  CRISPR gRNA sequence
cacaccgggcaggcccacca

SEQ ID NO: 526382 - DNA, 20 bp, Artificial
  CRISPR gRNA sequence
ccgctggatgcctcatgggg

SEQ ID NO: 526383 - DNA, 20 bp, Artificial
  CRISPR gRNA sequence
gatgcctcatggggcaaggc

SEQ ID NO: 526384 - DNA, 20 bp, Artificial
  CRISPR gRNA sequence
atggggcaaggcttgcagtt

SEQ ID NO: 526385 - DNA, 20 bp, Artificial
  CRISPR gRNA sequence
gcagttgcaggtccccaggg

SEQ ID NO: 526386 - DNA, 20 bp, Artificial
  CRISPR gRNA sequence
cagttgcaggtccccagggg

SEQ ID NO: 526387 - DNA, 20 bp, Artificial
  CRISPR gRNA sequence
caggtccccaggggtggccc

SEQ ID NO: 526388 - DNA, 20 bp, Artificial
  CRISPR gRNA sequence
ctgcgtgaggctcctttgag

SEQ ID NO: 526389 - DNA, 20 bp, Artificial
  CRISPR gRNA sequence
cgtgaggctcctttgagggg

SEQ ID NO: 526390 - DNA, 20 bp, Artificial
  CRISPR gRNA sequence
ctttgaggggattgggagat

SEQ ID NO: 526391 - DNA, 20 bp, Artificial
  CRISPR gRNA sequence
tgaggggattgggagatcct

SEQ ID NO: 526392 - DNA, 20 bp, Artificial
  CRISPR gRNA sequence
gaggggattgggagatcctg

SEQ ID NO: 526393 - DNA, 20 bp, Artificial
  CRISPR gRNA sequence
aggggattgggagatcctgg

SEQ ID NO: 526394 - DNA, 20 bp, Artificial
  CRISPR gRNA sequence
ggagatcctggtgctcggct

SEQ ID NO: 526395 - DNA, 20 bp, Artificial
  CRISPR gRNA sequence
gtgctcggctctcagccctg

SEQ ID NO: 526396 - DNA, 20 bp, Artificial
  CRISPR gRNA sequence
ggctctcagccctggagggg

SEQ ID NO: 526397 - DNA, 20 bp, Artificial
  CRISPR gRNA sequence
tcagccctggaggggcccag

SEQ ID NO: 526398 - DNA, 20 bp, Artificial
  CRISPR gRNA sequence
agccctggaggggcccaggg

SEQ ID NO: 526399 - DNA, 20 bp, Artificial
  CRISPR gRNA sequence
gaggggcccagggccaccag

SEQ ID NO: 526400 - DNA, 20 bp, Artificial
  CRISPR gRNA sequence
gttcggctccagtccagtcg

SEQ ID NO: 526401 - DNA, 20 bp, Artificial
  CRISPR gRNA sequence
ggctccagtccagtcggaac

SEQ ID NO: 526402 - DNA, 20 bp, Artificial
  CRISPR gRNA sequence
cagtccagtcggaaccagtc

SEQ ID NO: 526403 - DNA, 20 bp, Artificial
  CRISPR gRNA sequence
ggtggcactgaccctgtctc

SEQ ID NO: 526404 - DNA, 20 bp, Artificial
  CRISPR gRNA sequence
gtggcactgaccctgtctca

SEQ ID NO: 526405 - DNA, 20 bp, Artificial
  CRISPR gRNA sequence
accctgtctcattcggctcc

SEQ ID NO: 526406 - DNA, 20 bp, Artificial
  CRISPR gRNA sequence
tctcattcggctccagtcgg

SEQ ID NO: 526407 - DNA, 20 bp, Artificial
  CRISPR gRNA sequence
attcggctccagtcggaacc

SEQ ID NO: 526408 - DNA, 20 bp, Artificial
  CRISPR gRNA sequence
ggctccagtcggaaccagtc

SEQ ID NO: 526409 - DNA, 20 bp, Artificial
  CRISPR gRNA sequence
cagtcggaaccagtcccagc

SEQ ID NO: 526410 - DNA, 20 bp, Artificial
  CRISPR gRNA sequence
ggtggcactgaccctgtctc

SEQ ID NO: 526411 - DNA, 20 bp, Artificial
  CRISPR gRNA sequence
gtggcactgaccctgtctca

SEQ ID NO: 526412 - DNA, 20 bp, Artificial
  CRISPR gRNA sequence
accctgtctcattcagctcc

SEQ ID NO: 526413 - DNA, 20 bp, Artificial
  CRISPR gRNA sequence
tctcattcagctccagttgg

SEQ ID NO: 526414 - DNA, 20 bp, Artificial
  CRISPR gRNA sequence
attcagctccagttggaacc

SEQ ID NO: 526415 - DNA, 20 bp, Artificial
  CRISPR gRNA sequence
agctccagttggaaccaggc

SEQ ID NO: 526416 - DNA, 20 bp, Artificial
  CRISPR gRNA sequence
cagttggaaccaggcccagc

SEQ ID NO: 526417 - DNA, 20 bp, Artificial
  CRISPR gRNA sequence
gaaccaggcccagccccacg

SEQ ID NO: 526418 - DNA, 20 bp, Artificial
  CRISPR gRNA sequence
ggtgacactggccctgcttc

SEQ ID NO: 526419 - DNA, 20 bp, Artificial
  CRISPR gRNA sequence
gtgacactggccctgcttct

SEQ ID NO: 526420 - DNA, 20 bp, Artificial
  CRISPR gRNA sequence
gccctgcttcttcaggtctc

SEQ ID NO: 526421 - DNA, 20 bp, Artificial
  CRISPR gRNA sequence
cttcttcaggtctcatgttc

SEQ ID NO: 526422 - DNA, 20 bp, Artificial
  CRISPR gRNA sequence
cttcaggtctcatgttccac

SEQ ID NO: 526423 - DNA, 20 bp, Artificial
  CRISPR gRNA sequence
ttcaggtctcatgttccaca

SEQ ID NO: 526424 - DNA, 20 bp, Artificial
  CRISPR gRNA sequence
caggtctcatgttccacagg

SEQ ID NO: 526425 - DNA, 20 bp, Artificial
  CRISPR gRNA sequence
aggtctcatgttccacaggc

SEQ ID NO: 526426 - DNA, 20 bp, Artificial
  CRISPR gRNA sequence
atgttccacaggctcctgag

SEQ ID NO: 526427 - DNA, 20 bp, Artificial
  CRISPR gRNA sequence
cacaggctcctgagaggcag

SEQ ID NO: 526428 - DNA, 20 bp, Artificial
  CRISPR gRNA sequence
ctgagaggcagaggggctgg

SEQ ID NO: 526429 - DNA, 20 bp, Artificial
  CRISPR gRNA sequence
agaggcagaggggctggggc

SEQ ID NO: 526430 - DNA, 20 bp, Artificial
  CRISPR gRNA sequence
gggctggggggccgctggcg

SEQ ID NO: 526431 - DNA, 20 bp, Artificial
  CRISPR gRNA sequence
gggggccgctggcggactcc

SEQ ID NO: 526432 - DNA, 20 bp, Artificial
  CRISPR gRNA sequence
gcggactccatcaggcatgg

SEQ ID NO: 526433 - DNA, 20 bp, Artificial
  CRISPR gRNA sequence
catcaggcatggccagcagc

SEQ ID NO: 526434 - DNA, 20 bp, Artificial
  CRISPR gRNA sequence
ttgcagaactgagacctggg

SEQ ID NO: 526435 - DNA, 20 bp, Artificial
  CRISPR gRNA sequence
gcagaactgagacctgggag

SEQ ID NO: 526436 - DNA, 20 bp, Artificial
  CRISPR gRNA sequence
cagaactgagacctgggagc

SEQ ID NO: 526437 - DNA, 20 bp, Artificial
  CRISPR gRNA sequence
agacctgggagctcctccct

SEQ ID NO: 526438 - DNA, 20 bp, Artificial
  CRISPR gRNA sequence
ggagctcctccctcaccagg

SEQ ID NO: 526439 - DNA, 20 bp, Artificial
  CRISPR gRNA sequence
ctccctcaccaggaagggac

SEQ ID NO: 526440 - DNA, 20 bp, Artificial
  CRISPR gRNA sequence
cctcaccaggaagggacccg

SEQ ID NO: 526441 - DNA, 20 bp, Artificial
  CRISPR gRNA sequence
accaggaagggacccgaggc

SEQ ID NO: 526442 - DNA, 20 bp, Artificial
  CRISPR gRNA sequence
tgagcctgtaggtgacatgc

SEQ ID NO: 526443 - DNA, 20 bp, Artificial
  CRISPR gRNA sequence
agcctgtaggtgacatgcct

SEQ ID NO: 526444 - DNA, 20 bp, Artificial
  CRISPR gRNA sequence
taggtgacatgcctggagct

SEQ ID NO: 526445 - DNA, 20 bp, Artificial
  CRISPR gRNA sequence
gagctcacaacccacatgtg

SEQ ID NO: 526446 - DNA, 20 bp, Artificial
  CRISPR gRNA sequence
acaacccacatgtgggcctg

SEQ ID NO: 526447 - DNA, 20 bp, Artificial
  CRISPR gRNA sequence
gggctgcagacccccacctg

SEQ ID NO: 526448 - DNA, 20 bp, Artificial
  CRISPR gRNA sequence
cagacccccacctgccaggg

SEQ ID NO: 526449 - DNA, 20 bp, Artificial
  CRISPR gRNA sequence
ccagggcaggaacccctgcg

SEQ ID NO: 526450 - DNA, 20 bp, Artificial
  CRISPR gRNA sequence
cgggccactttgagggacag

SEQ ID NO: 526451 - DNA, 20 bp, Artificial
  CRISPR gRNA sequence
tgagggacagacttgggtca

SEQ ID NO: 526452 - DNA, 20 bp, Artificial
  CRISPR gRNA sequence
gagggacagacttgggtcac

SEQ ID NO: 526453 - DNA, 20 bp, Artificial
  CRISPR gRNA sequence
agggacagacttgggtcacg

SEQ ID NO: 526454 - DNA, 20 bp, Artificial
  CRISPR gRNA sequence
gggtcacgtctggtttgtgc

SEQ ID NO: 526455 - DNA, 20 bp, Artificial
  CRISPR gRNA sequence
ggtcacgtctggtttgtgca

SEQ ID NO: 526456 - DNA, 20 bp, Artificial
  CRISPR gRNA sequence
gtttgtgcaatcctggccaa

SEQ ID NO: 526457 - DNA, 20 bp, Artificial
  CRISPR gRNA sequence
gtgcaatcctggccaagtca

SEQ ID NO: 526458 - DNA, 20 bp, Artificial
  CRISPR gRNA sequence
tgcaatcctggccaagtcac

SEQ ID NO: 526459 - DNA, 20 bp, Artificial
  CRISPR gRNA sequence
gccaagtcacttcacctttg

SEQ ID NO: 526460 - DNA, 20 bp, Artificial
  CRISPR gRNA sequence
cacctttgaggacaggtgaa

SEQ ID NO: 526461 - DNA, 20 bp, Artificial
  CRISPR gRNA sequence
acctttgaggacaggtgaag

SEQ ID NO: 526462 - DNA, 20 bp, Artificial
  CRISPR gRNA sequence
tgaggacaggtgaaggaagg

SEQ ID NO: 526463 - DNA, 20 bp, Artificial
  CRISPR gRNA sequence
gaggacaggtgaaggaaggc

SEQ ID NO: 526464 - DNA, 20 bp, Artificial
  CRISPR gRNA sequence
aggacaggtgaaggaaggca

SEQ ID NO: 526465 - DNA, 20 bp, Artificial
  CRISPR gRNA sequence
cactgaacgctagtgtctgt

SEQ ID NO: 526466 - DNA, 20 bp, Artificial
  CRISPR gRNA sequence
aacgctagtgtctgtcccag

SEQ ID NO: 526467 - DNA, 20 bp, Artificial
  CRISPR gRNA sequence
gtgtctgtcccagggtcagc

SEQ ID NO: 526468 - DNA, 20 bp, Artificial
  CRISPR gRNA sequence
tcccagggtcagcagctgtg

SEQ ID NO: 526469 - DNA, 20 bp, Artificial
  CRISPR gRNA sequence
tgggcctggcccactatggc

SEQ ID NO: 526470 - DNA, 20 bp, Artificial
  CRISPR gRNA sequence
gcccactatggcccacagtc

SEQ ID NO: 526471 - DNA, 20 bp, Artificial
  CRISPR gRNA sequence
tggcccacagtccccatgct

SEQ ID NO: 526472 - DNA, 20 bp, Artificial
  CRISPR gRNA sequence
aggaggtgggcacagctgcc

SEQ ID NO: 526473 - DNA, 20 bp, Artificial
  CRISPR gRNA sequence
ccgtgggaaccaggaccttg

SEQ ID NO: 526474 - DNA, 20 bp, Artificial
  CRISPR gRNA sequence
gcgttgctcatcctggcacc

SEQ ID NO: 526475 - DNA, 20 bp, Artificial
  CRISPR gRNA sequence
cgttgctcatcctggcaccg

SEQ ID NO: 526476 - DNA, 20 bp, Artificial
  CRISPR gRNA sequence
ctcatcctggcaccggcctc

SEQ ID NO: 526477 - DNA, 20 bp, Artificial
  CRISPR gRNA sequence
atcctggcaccggcctcacc

SEQ ID NO: 526478 - DNA, 20 bp, Artificial
  CRISPR gRNA sequence
gcaccggcctcacctgctga

SEQ ID NO: 526479 - DNA, 20 bp, Artificial
  CRISPR gRNA sequence
acctgctgagctctggtctc

SEQ ID NO: 526480 - DNA, 20 bp, Artificial
  CRISPR gRNA sequence
ctgagctctggtctctggtc

SEQ ID NO: 526481 - DNA, 20 bp, Artificial
  CRISPR gRNA sequence
agctctggtctctggtcttg

SEQ ID NO: 526482 - DNA, 20 bp, Artificial
  CRISPR gRNA sequence
tggtctctggtcttgtcctt

SEQ ID NO: 526483 - DNA, 20 bp, Artificial
  CRISPR gRNA sequence
gtctctggtcttgtccttga

SEQ ID NO: 526484 - DNA, 20 bp, Artificial
  CRISPR gRNA sequence
tggtcttgtccttgacgacc

SEQ ID NO: 526485 - DNA, 20 bp, Artificial
  CRISPR gRNA sequence
gtcttgtccttgacgaccac

SEQ ID NO: 526486 - DNA, 20 bp, Artificial
  CRISPR gRNA sequence
gtccttgacgaccacaaatc

SEQ ID NO: 526487 - DNA, 20 bp, Artificial
  CRISPR gRNA sequence
tccttgacgaccacaaatca

SEQ ID NO: 526488 - DNA, 20 bp, Artificial
  CRISPR gRNA sequence
gacgaccacaaatcactttc

SEQ ID NO: 526489 - DNA, 20 bp, Artificial
  CRISPR gRNA sequence
acgaccacaaatcactttca

SEQ ID NO: 526490 - DNA, 20 bp, Artificial
  CRISPR gRNA sequence
tcacagtatggggagtgaac

SEQ ID NO: 526491 - DNA, 20 bp, Artificial
  CRISPR gRNA sequence
cacagtatggggagtgaact

SEQ ID NO: 526492 - DNA, 20 bp, Artificial
  CRISPR gRNA sequence
acagtatggggagtgaactc

SEQ ID NO: 526493 - DNA, 20 bp, Artificial
  CRISPR gRNA sequence
cagcagggaccctgagcctg

SEQ ID NO: 526494 - DNA, 20 bp, Artificial
  CRISPR gRNA sequence
agcctggttctgaactctgc

SEQ ID NO: 526495 - DNA, 20 bp, Artificial
  CRISPR gRNA sequence
gttctgaactctgctgtagg

SEQ ID NO: 526496 - DNA, 20 bp, Artificial
  CRISPR gRNA sequence
tgaactctgctgtaggagag

SEQ ID NO: 526497 - DNA, 20 bp, Artificial
  CRISPR gRNA sequence
aactctgctgtaggagagcg

SEQ ID NO: 526498 - DNA, 20 bp, Artificial
  CRISPR gRNA sequence
tgctgtaggagagcggggtc

SEQ ID NO: 526499 - DNA, 20 bp, Artificial
  CRISPR gRNA sequence
ctgtaggagagcggggtccc

SEQ ID NO: 526500 - DNA, 20 bp, Artificial
  CRISPR gRNA sequence
taggagagcggggtccctcg

SEQ ID NO: 526501 - DNA, 20 bp, Artificial
  CRISPR gRNA sequence
gcactgtgtcctacccccca

SEQ ID NO: 526502 - DNA, 20 bp, Artificial
  CRISPR gRNA sequence
tgtcctaccccccagtatta

SEQ ID NO: 526503 - DNA, 20 bp, Artificial
  CRISPR gRNA sequence
ccccccagtattagcactct

SEQ ID NO: 526504 - DNA, 20 bp, Artificial
  CRISPR gRNA sequence
gcactctgtcctggctgccc

SEQ ID NO: 526505 - DNA, 20 bp, Artificial
  CRISPR gRNA sequence
tgtcctggctgcccggtacc

SEQ ID NO: 526506 - DNA, 20 bp, Artificial
  CRISPR gRNA sequence
tcctggctgcccggtaccct

SEQ ID NO: 526507 - DNA, 20 bp, Artificial
  CRISPR gRNA sequence
gctgcccggtaccctggccc

SEQ ID NO: 526508 - DNA, 20 bp, Artificial
  CRISPR gRNA sequence
cccggtaccctggccctgcc

SEQ ID NO: 526509 - DNA, 20 bp, Artificial
  CRISPR gRNA sequence
gccctgccttcttctctgtc

SEQ ID NO: 526510 - DNA, 20 bp, Artificial
  CRISPR gRNA sequence
ccttcttctctgtcagcagg

SEQ ID NO: 526511 - DNA, 20 bp, Artificial
  CRISPR gRNA sequence
cttctctgtcagcaggggtg

SEQ ID NO: 526512 - DNA, 20 bp, Artificial
  CRISPR gRNA sequence
ttctctgtcagcaggggtgg

SEQ ID NO: 526513 - DNA, 20 bp, Artificial
  CRISPR gRNA sequence
ctctgtcagcaggggtggtg

SEQ ID NO: 526514 - DNA, 20 bp, Artificial
  CRISPR gRNA sequence
tctgtcagcaggggtggtgg

SEQ ID NO: 526515 - DNA, 20 bp, Artificial
  CRISPR gRNA sequence
tgtcagcaggggtggtggca

SEQ ID NO: 526516 - DNA, 20 bp, Artificial
  CRISPR gRNA sequence
tcagcaggggtggtggcaat

SEQ ID NO: 526517 - DNA, 20 bp, Artificial
  CRISPR gRNA sequence
aggtttcatttggaaccaca

SEQ ID NO: 526518 - DNA, 20 bp, Artificial
  CRISPR gRNA sequence
ggtttcatttggaaccacag

SEQ ID NO: 526519 - DNA, 20 bp, Artificial
  CRISPR gRNA sequence
catttggaaccacagggcct

SEQ ID NO: 526520 - DNA, 20 bp, Artificial
  CRISPR gRNA sequence
atttggaaccacagggcctg

SEQ ID NO: 526521 - DNA, 20 bp, Artificial
  CRISPR gRNA sequence
ggaaccacagggcctggcct

SEQ ID NO: 526522 - DNA, 20 bp, Artificial
  CRISPR gRNA sequence
gaaccacagggcctggcctg

SEQ ID NO: 526523 - DNA, 20 bp, Artificial
  CRISPR gRNA sequence
gcctggaatccagcaggggc

SEQ ID NO: 526524 - DNA, 20 bp, Artificial
  CRISPR gRNA sequence
gaatccagcaggggctgggc

SEQ ID NO: 526525 - DNA, 20 bp, Artificial
  CRISPR gRNA sequence
ggccaggttctcactgaccc

SEQ ID NO: 526526 - DNA, 20 bp, Artificial
  CRISPR gRNA sequence
tcactgacccctggccatgg

SEQ ID NO: 526527 - DNA, 20 bp, Artificial
  CRISPR gRNA sequence
actgacccctggccatggtg

SEQ ID NO: 526528 - DNA, 20 bp, Artificial
  CRISPR gRNA sequence
acccctggccatggtgatgg

SEQ ID NO: 526529 - DNA, 20 bp, Artificial
  CRISPR gRNA sequence
gccatggtgatggatggtga

SEQ ID NO: 526530 - DNA, 20 bp, Artificial
  CRISPR gRNA sequence
ggaacctccgtctctctaag

SEQ ID NO: 526531 - DNA, 20 bp, Artificial
  CRISPR gRNA sequence
cgtctctctaagtgctgtgt

SEQ ID NO: 526532 - DNA, 20 bp, Artificial
  CRISPR gRNA sequence
tctaagtgctgtgttgtggg

SEQ ID NO: 526533 - DNA, 20 bp, Artificial
  CRISPR gRNA sequence
taagtgctgtgttgtggggt

SEQ ID NO: 526534 - DNA, 20 bp, Artificial
  CRISPR gRNA sequence
agtgctgtgttgtggggtga

SEQ ID NO: 526535 - DNA, 20 bp, Artificial
  CRISPR gRNA sequence
tgttgtggggtgacctcgga

SEQ ID NO: 526536 - DNA, 20 bp, Artificial
  CRISPR gRNA sequence
tggggtgacctcggacctgt

SEQ ID NO: 526537 - DNA, 20 bp, Artificial
  CRISPR gRNA sequence
ggacctgtgggcacacggct

SEQ ID NO: 526538 - DNA, 20 bp, Artificial
  CRISPR gRNA sequence
tgggcacacggctcagtgag

SEQ ID NO: 526539 - DNA, 20 bp, Artificial
  CRISPR gRNA sequence
agtgagatggggctggactg

SEQ ID NO: 526540 - DNA, 20 bp, Artificial
  CRISPR gRNA sequence
gactgacgctcaggtgtgct

SEQ ID NO: 526541 - DNA, 20 bp, Artificial
  CRISPR gRNA sequence
acgctcaggtgtgctgcttc

SEQ ID NO: 526542 - DNA, 20 bp, Artificial
  CRISPR gRNA sequence
aggtgtgctgcttcttccct

SEQ ID NO: 526543 - DNA, 20 bp, Artificial
  CRISPR gRNA sequence
cttcttccctagagtgtgtg

SEQ ID NO: 526544 - DNA, 20 bp, Artificial
  CRISPR gRNA sequence
cttccctagagtgtgtggca

SEQ ID NO: 526545 - DNA, 20 bp, Artificial
  CRISPR gRNA sequence
ttccctagagtgtgtggcag

SEQ ID NO: 526546 - DNA, 20 bp, Artificial
  CRISPR gRNA sequence
ccctagagtgtgtggcaggc

SEQ ID NO: 526547 - DNA, 20 bp, Artificial
  CRISPR gRNA sequence
cctagagtgtgtggcaggcc

SEQ ID NO: 526548 - DNA, 20 bp, Artificial
  CRISPR gRNA sequence
gagtgtgtggcaggccccaa

SEQ ID NO: 526549 - DNA, 20 bp, Artificial
  CRISPR gRNA sequence
atcggcattctcctgctggt

SEQ ID NO: 526550 - DNA, 20 bp, Artificial
  CRISPR gRNA sequence
tcctgctggtcatctggaag

SEQ ID NO: 526551 - DNA, 20 bp, Artificial
  CRISPR gRNA sequence
ctgctggtcatctggaaggc

SEQ ID NO: 526552 - DNA, 20 bp, Artificial
  CRISPR gRNA sequence
ctggtcatctggaaggctct

SEQ ID NO: 526553 - DNA, 20 bp, Artificial
  CRISPR gRNA sequence
gtcatctggaaggctctgat

SEQ ID NO: 526554 - DNA, 20 bp, Artificial
  CRISPR gRNA sequence
gaaggctctgatccacctga

SEQ ID NO: 526555 - DNA, 20 bp, Artificial
  CRISPR gRNA sequence
tgatccacctgagcgacctc

SEQ ID NO: 526556 - DNA, 20 bp, Artificial
  CRISPR gRNA sequence
atccacctgagcgacctccg

SEQ ID NO: 526557 - DNA, 20 bp, Artificial
  CRISPR gRNA sequence
agcgacctccgggagtacag

SEQ ID NO: 526558 - DNA, 20 bp, Artificial
  CRISPR gRNA sequence
cgggagtacaggcgctttga

SEQ ID NO: 526559 - DNA, 20 bp, Artificial
  CRISPR gRNA sequence
tgagaaggagaagctcaagt

SEQ ID NO: 526560 - DNA, 20 bp, Artificial
  CRISPR gRNA sequence
gagaaggagaagctcaagtc

SEQ ID NO: 526561 - DNA, 20 bp, Artificial
  CRISPR gRNA sequence
agaaggagaagctcaagtcc

SEQ ID NO: 526562 - DNA, 20 bp, Artificial
  CRISPR gRNA sequence
aagtcccagtggaacaatgt

SEQ ID NO: 526563 - DNA, 20 bp, Artificial
  CRISPR gRNA sequence
gggggtcccacgcagagggg

SEQ ID NO: 526564 - DNA, 20 bp, Artificial
  CRISPR gRNA sequence
ggggtcccacgcagaggggc

SEQ ID NO: 526565 - DNA, 20 bp, Artificial
  CRISPR gRNA sequence
tgcgacctcctgctgcggga

SEQ ID NO: 526566 - DNA, 20 bp, Artificial
  CRISPR gRNA sequence
ctgctgcgggaggccgtgga

SEQ ID NO: 526567 - DNA, 20 bp, Artificial
  CRISPR gRNA sequence
ctgcgggaggccgtggacac

SEQ ID NO: 526568 - DNA, 20 bp, Artificial
  CRISPR gRNA sequence
cgggaggccgtggacacccg

SEQ ID NO: 526569 - DNA, 20 bp, Artificial
  CRISPR gRNA sequence
caccccggcctccccaggca

SEQ ID NO: 526570 - DNA, 20 bp, Artificial
  CRISPR gRNA sequence
cccaggcagcttgtcctctg

SEQ ID NO: 526571 - DNA, 20 bp, Artificial
  CRISPR gRNA sequence
gtcctctgggcgtccgccgc

SEQ ID NO: 526572 - DNA, 20 bp, Artificial
  CRISPR gRNA sequence
tcctctgggcgtccgccgct

SEQ ID NO: 526573 - DNA, 20 bp, Artificial
  CRISPR gRNA sequence
tgggcgtccgccgctgtggg

SEQ ID NO: 526574 - DNA, 20 bp, Artificial
  CRISPR gRNA sequence
ggcgtccgccgctgtgggtg

SEQ ID NO: 526575 - DNA, 20 bp, Artificial
  CRISPR gRNA sequence
tgggtgagcttggctgccgg

SEQ ID NO: 526576 - DNA, 20 bp, Artificial
  CRISPR gRNA sequence
ggctgccggtgctgggaccc

SEQ ID NO: 526577 - DNA, 20 bp, Artificial
  CRISPR gRNA sequence
gctgccggtgctgggaccct

SEQ ID NO: 526578 - DNA, 20 bp, Artificial
  CRISPR gRNA sequence
ccggtgctgggaccctgggg

SEQ ID NO: 526579 - DNA, 20 bp, Artificial
  CRISPR gRNA sequence
ggaccctgggggggctgccc

SEQ ID NO: 526580 - DNA, 20 bp, Artificial
  CRISPR gRNA sequence
ggggggctgccccacgtcta

SEQ ID NO: 526581 - DNA, 20 bp, Artificial
  CRISPR gRNA sequence
ccccacgtctagctcttcct

SEQ ID NO: 526582 - DNA, 20 bp, Artificial
  CRISPR gRNA sequence
gctcttcctcaaagtgacgg

SEQ ID NO: 526583 - DNA, 20 bp, Artificial
  CRISPR gRNA sequence
ttcctcaaagtgacggcttc

SEQ ID NO: 526584 - DNA, 20 bp, Artificial
  CRISPR gRNA sequence
cctcaaagtgacggcttcca

SEQ ID NO: 526585 - DNA, 20 bp, Artificial
  CRISPR gRNA sequence
ctcaaagtgacggcttccat

SEQ ID NO: 526586 - DNA, 20 bp, Artificial
  CRISPR gRNA sequence
aaagtgacggcttccatgcg

SEQ ID NO: 526587 - DNA, 20 bp, Artificial
  CRISPR gRNA sequence
ccatgcggggagtgtcctca

SEQ ID NO: 526588 - DNA, 20 bp, Artificial
  CRISPR gRNA sequence
catgcggggagtgtcctcag

SEQ ID NO: 526589 - DNA, 20 bp, Artificial
  CRISPR gRNA sequence
agggagaaagattctgctct

SEQ ID NO: 526590 - DNA, 20 bp, Artificial
  CRISPR gRNA sequence
tgctctgaaaacctcccaca

SEQ ID NO: 526591 - DNA, 20 bp, Artificial
  CRISPR gRNA sequence
ctctgaaaacctcccacact

SEQ ID NO: 526592 - DNA, 20 bp, Artificial
  CRISPR gRNA sequence
tgaaaacctcccacactcac

SEQ ID NO: 526593 - DNA, 20 bp, Artificial
  CRISPR gRNA sequence
aaaacctcccacactcacaa

SEQ ID NO: 526594 - DNA, 20 bp, Artificial
  CRISPR gRNA sequence
ccacactcacaagcccctgt

SEQ ID NO: 526595 - DNA, 20 bp, Artificial
  CRISPR gRNA sequence
acaagcccctgtttgcattt

SEQ ID NO: 526596 - DNA, 20 bp, Artificial
  CRISPR gRNA sequence
tttgcatttcccaccaggat

SEQ ID NO: 526597 - DNA, 20 bp, Artificial
  CRISPR gRNA sequence
gcatttcccaccaggataat

SEQ ID NO: 526598 - DNA, 20 bp, Artificial
  CRISPR gRNA sequence
catttcccaccaggataatc

SEQ ID NO: 526599 - DNA, 20 bp, Artificial
  CRISPR gRNA sequence
cccaccaggataatcccctt

SEQ ID NO: 526600 - DNA, 20 bp, Artificial
  CRISPR gRNA sequence
ccaccaggataatccccttt

SEQ ID NO: 526601 - DNA, 20 bp, Artificial
  CRISPR gRNA sequence
ttcaagagcgccaccacgac

SEQ ID NO: 526602 - DNA, 20 bp, Artificial
  CRISPR gRNA sequence
tcaagagcgccaccacgacg

SEQ ID NO: 526603 - DNA, 20 bp, Artificial
  CRISPR gRNA sequence
caagagcgccaccacgacgg

SEQ ID NO: 526604 - DNA, 20 bp, Artificial
  CRISPR gRNA sequence
aagagcgccaccacgacggt

SEQ ID NO: 526605 - DNA, 20 bp, Artificial
  CRISPR gRNA sequence
gctgagagttaggagcactt

SEQ ID NO: 526606 - DNA, 20 bp, Artificial
  CRISPR gRNA sequence
ctgagagttaggagcacttg

SEQ ID NO: 526607 - DNA, 20 bp, Artificial
  CRISPR gRNA sequence
agagttaggagcacttggtg

SEQ ID NO: 526608 - DNA, 20 bp, Artificial
  CRISPR gRNA sequence
ggagcacttggtgaagacaa

SEQ ID NO: 526609 - DNA, 20 bp, Artificial
  CRISPR gRNA sequence
ggtgaagacaaggccgtcag

SEQ ID NO: 526610 - DNA, 20 bp, Artificial
  CRISPR gRNA sequence
gtgaagacaaggccgtcagg

SEQ ID NO: 526611 - DNA, 20 bp, Artificial
  CRISPR gRNA sequence
ccccatcacgcggccgagac

SEQ ID NO: 526612 - DNA, 20 bp, Artificial
  CRISPR gRNA sequence
gccacagctcttgaggatgt

SEQ ID NO: 526613 - DNA, 20 bp, Artificial
  CRISPR gRNA sequence
ccacagctcttgaggatgtc

SEQ ID NO: 526614 - DNA, 20 bp, Artificial
  CRISPR gRNA sequence
ttgaggatgtcaccaattaa

SEQ ID NO: 526615 - DNA, 20 bp, Artificial
  CRISPR gRNA sequence
gaggatgtcaccaattaacc

SEQ ID NO: 526616 - DNA, 20 bp, Artificial
  CRISPR gRNA sequence
aggatgtcaccaattaacca

SEQ ID NO: 526617 - DNA, 20 bp, Artificial
  CRISPR gRNA sequence
accagaaatccagttatttt

SEQ ID NO: 526618 - DNA, 20 bp, Artificial
  CRISPR gRNA sequence
ttttccgccctcaaaatgac

SEQ ID NO: 526619 - DNA, 20 bp, Artificial
  CRISPR gRNA sequence
tccgccctcaaaatgacagc

SEQ ID NO: 526620 - DNA, 20 bp, Artificial
  CRISPR gRNA sequence
ccgccctcaaaatgacagcc

SEQ ID NO: 526621 - DNA, 20 bp, Artificial
  CRISPR gRNA sequence
cgccctcaaaatgacagcca

SEQ ID NO: 526622 - DNA, 20 bp, Artificial
  CRISPR gRNA sequence
aaaatgacagccatggccgg

SEQ ID NO: 526623 - DNA, 20 bp, Artificial
  CRISPR gRNA sequence
ctgggggctcgtcgggggga

SEQ ID NO: 526624 - DNA, 20 bp, Artificial
  CRISPR gRNA sequence
tgggggctcgtcggggggac

SEQ ID NO: 526625 - DNA, 20 bp, Artificial
  CRISPR gRNA sequence
ggggctcgtcggggggacag

SEQ ID NO: 526626 - DNA, 20 bp, Artificial
  CRISPR gRNA sequence
gtcggggggacagctccact

SEQ ID NO: 526627 - DNA, 20 bp, Artificial
  CRISPR gRNA sequence
cactctgactggcacagtct

SEQ ID NO: 526628 - DNA, 20 bp, Artificial
  CRISPR gRNA sequence
tgactggcacagtctttgca

SEQ ID NO: 526629 - DNA, 20 bp, Artificial
  CRISPR gRNA sequence
actggcacagtctttgcatg

SEQ ID NO: 526630 - DNA, 20 bp, Artificial
  CRISPR gRNA sequence
gcacagtctttgcatggaga

SEQ ID NO: 526631 - DNA, 20 bp, Artificial
  CRISPR gRNA sequence
tgcatggagacttgaggagg

SEQ ID NO: 526632 - DNA, 20 bp, Artificial
  CRISPR gRNA sequence
gcatggagacttgaggaggg

SEQ ID NO: 526633 - DNA, 20 bp, Artificial
  CRISPR gRNA sequence
catggagacttgaggaggga

SEQ ID NO: 526634 - DNA, 20 bp, Artificial
  CRISPR gRNA sequence
gaggagggagggcttgaggt

SEQ ID NO: 526635 - DNA, 20 bp, Artificial
  CRISPR gRNA sequence
aggagggagggcttgaggtt

SEQ ID NO: 526636 - DNA, 20 bp, Artificial
  CRISPR gRNA sequence
gaggttggtgaggttaggtg

SEQ ID NO: 526637 - DNA, 20 bp, Artificial
  CRISPR gRNA sequence
aggttggtgaggttaggtgc

SEQ ID NO: 526638 - DNA, 20 bp, Artificial
  CRISPR gRNA sequence
gtgaggttaggtgcgtgttt

SEQ ID NO: 526639 - DNA, 20 bp, Artificial
  CRISPR gRNA sequence
ggtgcgtgtttcctgtgcaa

SEQ ID NO: 526640 - DNA, 20 bp, Artificial
  CRISPR gRNA sequence
cctgtgcaagtcaggacatc

SEQ ID NO: 526641 - DNA, 20 bp, Artificial
  CRISPR gRNA sequence
ctgtgcaagtcaggacatca

SEQ ID NO: 526642 - DNA, 20 bp, Artificial
  CRISPR gRNA sequence
tgcaagtcaggacatcagtc

SEQ ID NO: 526643 - DNA, 20 bp, Artificial
  CRISPR gRNA sequence
attaaaggtggtgccaattt

SEQ ID NO: 526644 - DNA, 20 bp, Artificial
  CRISPR gRNA sequence
aaggtggtgccaatttattt

SEQ ID NO: 526645 - DNA, 20 bp, Artificial
  CRISPR gRNA sequence
atttacatttaaacttgtca

SEQ ID NO: 526646 - DNA, 20 bp, Artificial
  CRISPR gRNA sequence
tttacatttaaacttgtcag

SEQ ID NO: 526647 - DNA, 20 bp, Artificial
  CRISPR gRNA sequence
acatttaaacttgtcagggt

SEQ ID NO: 526648 - DNA, 20 bp, Artificial
  CRISPR gRNA sequence
catttaaacttgtcagggta

SEQ ID NO: 526649 - DNA, 20 bp, Artificial
  CRISPR gRNA sequence
aaacttgtcagggtataaaa

SEQ ID NO: 526650 - DNA, 20 bp, Artificial
  CRISPR gRNA sequence
aacttgtcagggtataaaat

SEQ ID NO: 526651 - DNA, 20 bp, Artificial
  CRISPR gRNA sequence
gtcagggtataaaatgacat

SEQ ID NO: 526652 - DNA, 20 bp, Artificial
  CRISPR gRNA sequence
tcagggtataaaatgacatc

SEQ ID NO: 526653 - DNA, 20 bp, Artificial
  CRISPR gRNA sequence
attatattgttaatcaatca

SEQ ID NO: 526654 - DNA, 20 bp, Artificial
  CRISPR gRNA sequence
tattgttaatcaatcacgtg

SEQ ID NO: 526655 - DNA, 20 bp, Artificial
  CRISPR gRNA sequence
ttaatcaatcacgtgtatag

SEQ ID NO: 526656 - DNA, 20 bp, Artificial
  CRISPR gRNA sequence
atcaatcacgtgtatagaaa

SEQ ID NO: 526657 - DNA, 20 bp, Artificial
  CRISPR gRNA sequence
caatacaggctgtccatgga

SEQ ID NO: 526658 - DNA, 20 bp, Artificial
  CRISPR gRNA sequence
aatacaggctgtccatggaa

SEQ ID NO: 526659 - DNA, 20 bp, Artificial
  CRISPR gRNA sequence
tccatggaaactgggcactg

SEQ ID NO: 526660 - DNA, 20 bp, Artificial
  CRISPR gRNA sequence
ggcactgtgtccgctgtatt

SEQ ID NO: 526661 - DNA, 20 bp, Artificial
  CRISPR gRNA sequence
tgtccgctgtattcccccga

SEQ ID NO: 526662 - DNA, 20 bp, Artificial
  CRISPR gRNA sequence
tattcccccgactggcaagg

SEQ ID NO: 526663 - DNA, 20 bp, Artificial
  CRISPR gRNA sequence
ccccgactggcaaggtggcc

SEQ ID NO: 526664 - DNA, 20 bp, Artificial
  CRISPR gRNA sequence
gcaaggtggccaggcacacg

SEQ ID NO: 526665 - DNA, 20 bp, Artificial
  CRISPR gRNA sequence
tcctgcccgctgacctttgc

SEQ ID NO: 526666 - DNA, 20 bp, Artificial
  CRISPR gRNA sequence
cccgctgacctttgccacac

SEQ ID NO: 526667 - DNA, 20 bp, Artificial
  CRISPR gRNA sequence
acctttgccacacaggcaca

SEQ ID NO: 526668 - DNA, 20 bp, Artificial
  CRISPR gRNA sequence
tgccacacaggcacacagct

SEQ ID NO: 526669 - DNA, 20 bp, Artificial
  CRISPR gRNA sequence
gccacacaggcacacagctg

SEQ ID NO: 526670 - DNA, 20 bp, Artificial
  CRISPR gRNA sequence
ccacacaggcacacagctgg

SEQ ID NO: 526671 - DNA, 20 bp, Artificial
  CRISPR gRNA sequence
atgttactgtaaaagatgta

SEQ ID NO: 526672 - DNA, 20 bp, Artificial
  CRISPR gRNA sequence
gttactgtaaaagatgtaaa

SEQ ID NO: 526673 - DNA, 20 bp, Artificial
  CRISPR gRNA sequence
tactgtaaaagatgtaaaga

SEQ ID NO: 526674 - DNA, 20 bp, Artificial
  CRISPR gRNA sequence
actgtaaaagatgtaaagag

SEQ ID NO: 526675 - DNA, 20 bp, Artificial
  CRISPR gRNA sequence
aagatgtaaagagaggcacg

SEQ ID NO: 526676 - DNA, 20 bp, Artificial
  CRISPR gRNA sequence
gtaaagagaggcacgtggtt

SEQ ID NO: 526677 - DNA, 20 bp, Artificial
  CRISPR gRNA sequence
gaggcacgtggttaagctct

SEQ ID NO: 526678 - DNA, 20 bp, Artificial
  CRISPR gRNA sequence
aggcacgtggttaagctctc

SEQ ID NO: 526679 - DNA, 20 bp, Artificial
  CRISPR gRNA sequence
ggcacgtggttaagctctcg

SEQ ID NO: 526680 - DNA, 20 bp, Artificial
  CRISPR gRNA sequence
gtggttaagctctcggggtg

SEQ ID NO: 526681 - DNA, 20 bp, Artificial
  CRISPR gRNA sequence
tctcggggtgtggactccac

SEQ ID NO: 526682 - DNA, 20 bp, Artificial
  CRISPR gRNA sequence
ggactccaccagtctcactt

SEQ ID NO: 526683 - DNA, 20 bp, Artificial
  CRISPR gRNA sequence
acttcagttccttttgcatg

SEQ ID NO: 526684 - DNA, 20 bp, Artificial
  CRISPR gRNA sequence
ttcagttccttttgcatgaa

SEQ ID NO: 526685 - DNA, 20 bp, Artificial
  CRISPR gRNA sequence
ttccttttgcatgaagagct

SEQ ID NO: 526686 - DNA, 20 bp, Artificial
  CRISPR gRNA sequence
catgaagagctcagaatcaa

SEQ ID NO: 526687 - DNA, 20 bp, Artificial
  CRISPR gRNA sequence
tgaagagctcagaatcaaaa

SEQ ID NO: 526688 - DNA, 20 bp, Artificial
  CRISPR gRNA sequence
gaagagctcagaatcaaaag

SEQ ID NO: 526689 - DNA, 20 bp, Artificial
  CRISPR gRNA sequence
aaaagaggaaaccaacccct

SEQ ID NO: 526690 - DNA, 20 bp, Artificial
  CRISPR gRNA sequence
aggaaaccaacccctaagat

SEQ ID NO: 526691 - DNA, 20 bp, Artificial
  CRISPR gRNA sequence
gagctttccatgtaaatttg

SEQ ID NO: 526692 - DNA, 20 bp, Artificial
  CRISPR gRNA sequence
tttccatgtaaatttgtagc

SEQ ID NO: 526693 - DNA, 20 bp, Artificial
  CRISPR gRNA sequence
gattttcaatgtttcttcca

SEQ ID NO: 526694 - DNA, 20 bp, Artificial
  CRISPR gRNA sequence
attttcaatgtttcttccaa

SEQ ID NO: 526695 - DNA, 20 bp, Artificial
  CRISPR gRNA sequence
tcaatgtttcttccaaaggt

SEQ ID NO: 526696 - DNA, 20 bp, Artificial
  CRISPR gRNA sequence
tttcttccaaaggtaagcat

SEQ ID NO: 526697 - DNA, 20 bp, Artificial
  CRISPR gRNA sequence
tcttccaaaggtaagcataa

SEQ ID NO: 526698 - DNA, 20 bp, Artificial
  CRISPR gRNA sequence
aaaggtaagcataagagtca

SEQ ID NO: 526699 - DNA, 20 bp, Artificial
  CRISPR gRNA sequence
ggtaagcataagagtcaaag

SEQ ID NO: 526700 - DNA, 20 bp, Artificial
  CRISPR gRNA sequence
gagtcaaagaagtcccaacc

SEQ ID NO: 526701 - DNA, 20 bp, Artificial
  CRISPR gRNA sequence
cccaacccagctttccctga

SEQ ID NO: 526702 - DNA, 20 bp, Artificial
  CRISPR gRNA sequence
ctttccctgaaagtgactct

SEQ ID NO: 526703 - DNA, 20 bp, Artificial
  CRISPR gRNA sequence
agtaactcttttgcttttta

SEQ ID NO: 526704 - DNA, 20 bp, Artificial
  CRISPR gRNA sequence
gtaactcttttgctttttat

SEQ ID NO: 526705 - DNA, 20 bp, Artificial
  CRISPR gRNA sequence
tcttttgctttttataggtg

SEQ ID NO: 526706 - DNA, 20 bp, Artificial
  CRISPR gRNA sequence
ttttataggtgcagtctcca

SEQ ID NO: 526707 - DNA, 20 bp, Artificial
  CRISPR gRNA sequence
ttataggtgcagtctccaaa

SEQ ID NO: 526708 - DNA, 20 bp, Artificial
  CRISPR gRNA sequence
caaagagattacgaatgcct

SEQ ID NO: 526709 - DNA, 20 bp, Artificial
  CRISPR gRNA sequence
ttacgaatgccttggaaacc

SEQ ID NO: 526710 - DNA, 20 bp, Artificial
  CRISPR gRNA sequence
tacgaatgccttggaaacct

SEQ ID NO: 526711 - DNA, 20 bp, Artificial
  CRISPR gRNA sequence
acgaatgccttggaaacctg

SEQ ID NO: 526712 - DNA, 20 bp, Artificial
  CRISPR gRNA sequence
cttggaaacctggggtgcct

SEQ ID NO: 526713 - DNA, 20 bp, Artificial
  CRISPR gRNA sequence
ttggaaacctggggtgcctt

SEQ ID NO: 526714 - DNA, 20 bp, Artificial
  CRISPR gRNA sequence
aaacctggggtgccttgggt

SEQ ID NO: 526715 - DNA, 20 bp, Artificial
  CRISPR gRNA sequence
aacctggggtgccttgggtc

SEQ ID NO: 526716 - DNA, 20 bp, Artificial
  CRISPR gRNA sequence
cttgggtcaggacatcaact

SEQ ID NO: 526717 - DNA, 20 bp, Artificial
  CRISPR gRNA sequence
gacatcaacttggacattcc

SEQ ID NO: 526718 - DNA, 20 bp, Artificial
  CRISPR gRNA sequence
gacattcctagttttcaaat

SEQ ID NO: 526719 - DNA, 20 bp, Artificial
  CRISPR gRNA sequence
atgatattgacgatataaaa

SEQ ID NO: 526720 - DNA, 20 bp, Artificial
  CRISPR gRNA sequence
tgatattgacgatataaaat

SEQ ID NO: 526721 - DNA, 20 bp, Artificial
  CRISPR gRNA sequence
tataaaatgggaaaaaactt

SEQ ID NO: 526722 - DNA, 20 bp, Artificial
  CRISPR gRNA sequence
aatgggaaaaaacttcagac

SEQ ID NO: 526723 - DNA, 20 bp, Artificial
  CRISPR gRNA sequence
aaaaaacttcagacaagaaa

SEQ ID NO: 526724 - DNA, 20 bp, Artificial
  CRISPR gRNA sequence
aagaaaaagattgcacaatt

SEQ ID NO: 526725 - DNA, 20 bp, Artificial
  CRISPR gRNA sequence
aaagattgcacaattcagaa

SEQ ID NO: 526726 - DNA, 20 bp, Artificial
  CRISPR gRNA sequence
agattgcacaattcagaaaa

SEQ ID NO: 526727 - DNA, 20 bp, Artificial
  CRISPR gRNA sequence
tgcacaattcagaaaagaga

SEQ ID NO: 526728 - DNA, 20 bp, Artificial
  CRISPR gRNA sequence
cacaattcagaaaagagaaa

SEQ ID NO: 526729 - DNA, 20 bp, Artificial
  CRISPR gRNA sequence
gaaaagagaaagagactttc

SEQ ID NO: 526730 - DNA, 20 bp, Artificial
  CRISPR gRNA sequence
aaaagagaaagagactttca

SEQ ID NO: 526731 - DNA, 20 bp, Artificial
  CRISPR gRNA sequence
gaaagagactttcaaggaaa

SEQ ID NO: 526732 - DNA, 20 bp, Artificial
  CRISPR gRNA sequence
tcaaggaaaaagatacatat

SEQ ID NO: 526733 - DNA, 20 bp, Artificial
  CRISPR gRNA sequence
acatataagctatttaaaaa

SEQ ID NO: 526734 - DNA, 20 bp, Artificial
  CRISPR gRNA sequence
aaaatggaactctgaaaatt

SEQ ID NO: 526735 - DNA, 20 bp, Artificial
  CRISPR gRNA sequence
ctctgaaaattaagcatctg

SEQ ID NO: 526736 - DNA, 20 bp, Artificial
  CRISPR gRNA sequence
agcatctgaagaccgatgat

SEQ ID NO: 526737 - DNA, 20 bp, Artificial
  CRISPR gRNA sequence
gcatctgaagaccgatgatc

SEQ ID NO: 526738 - DNA, 20 bp, Artificial
  CRISPR gRNA sequence
ccgatgatcaggatatctac

SEQ ID NO: 526739 - DNA, 20 bp, Artificial
  CRISPR gRNA sequence
cgatgatcaggatatctaca

SEQ ID NO: 526740 - DNA, 20 bp, Artificial
  CRISPR gRNA sequence
ggtatcaatatatgatacaa

SEQ ID NO: 526741 - DNA, 20 bp, Artificial
  CRISPR gRNA sequence
gtatcaatatatgatacaaa

SEQ ID NO: 526742 - DNA, 20 bp, Artificial
  CRISPR gRNA sequence
tacaaaaggaaaaaatgtgt

SEQ ID NO: 526743 - DNA, 20 bp, Artificial
  CRISPR gRNA sequence
tggaaaaaatatttgatttg

SEQ ID NO: 526744 - DNA, 20 bp, Artificial
  CRISPR gRNA sequence
aatatttgatttgaagattc

SEQ ID NO: 526745 - DNA, 20 bp, Artificial
  CRISPR gRNA sequence
atatttgatttgaagattca

SEQ ID NO: 526746 - DNA, 20 bp, Artificial
  CRISPR gRNA sequence
ttgatttgaagattcaaggt

SEQ ID NO: 526747 - DNA, 20 bp, Artificial
  CRISPR gRNA sequence
ttcccttaattgctttattt

SEQ ID NO: 526748 - DNA, 20 bp, Artificial
  CRISPR gRNA sequence
ttaattgctttatttcagtg

SEQ ID NO: 526749 - DNA, 20 bp, Artificial
  CRISPR gRNA sequence
taattgctttatttcagtgt

SEQ ID NO: 526750 - DNA, 20 bp, Artificial
  CRISPR gRNA sequence
atttcagtgtgggtgctatt

SEQ ID NO: 526751 - DNA, 20 bp, Artificial
  CRISPR gRNA sequence
cagtgtgggtgctatttggc

SEQ ID NO: 526752 - DNA, 20 bp, Artificial
  CRISPR gRNA sequence
gtgggtgctatttggcaagt

SEQ ID NO: 526753 - DNA, 20 bp, Artificial
  CRISPR gRNA sequence
ctatttggcaagttggaaaa

SEQ ID NO: 526754 - DNA, 20 bp, Artificial
  CRISPR gRNA sequence
atagcatttctaatattccc

SEQ ID NO: 526755 - DNA, 20 bp, Artificial
  CRISPR gRNA sequence
ccagcgctgacctctgcctc

SEQ ID NO: 526756 - DNA, 20 bp, Artificial
  CRISPR gRNA sequence
cagcgctgacctctgcctcc

SEQ ID NO: 526757 - DNA, 20 bp, Artificial
  CRISPR gRNA sequence
agcgctgacctctgcctcca

SEQ ID NO: 526758 - DNA, 20 bp, Artificial
  CRISPR gRNA sequence
gcgctgacctctgcctccag

SEQ ID NO: 526759 - DNA, 20 bp, Artificial
  CRISPR gRNA sequence
cgctgacctctgcctccagg

SEQ ID NO: 526760 - DNA, 20 bp, Artificial
  CRISPR gRNA sequence
gctgacctctgcctccaggg

SEQ ID NO: 526761 - DNA, 20 bp, Artificial
  CRISPR gRNA sequence
ctgcctccaggggggctata

SEQ ID NO: 526762 - DNA, 20 bp, Artificial
  CRISPR gRNA sequence
tgcctccaggggggctatac

SEQ ID NO: 526763 - DNA, 20 bp, Artificial
  CRISPR gRNA sequence
aggggggctatacaggaaac

SEQ ID NO: 526764 - DNA, 20 bp, Artificial
  CRISPR gRNA sequence
cagatgcatgtctcctgccc

SEQ ID NO: 526765 - DNA, 20 bp, Artificial
  CRISPR gRNA sequence
atgcatgtctcctgccccag

SEQ ID NO: 526766 - DNA, 20 bp, Artificial
  CRISPR gRNA sequence
gcatgtctcctgccccagtg

SEQ ID NO: 526767 - DNA, 20 bp, Artificial
  CRISPR gRNA sequence
tcctgccccagtggagactg

SEQ ID NO: 526768 - DNA, 20 bp, Artificial
  CRISPR gRNA sequence
gtggagactgtggtccaatg

SEQ ID NO: 526769 - DNA, 20 bp, Artificial
  CRISPR gRNA sequence
tggagactgtggtccaatgc

SEQ ID NO: 526770 - DNA, 20 bp, Artificial
  CRISPR gRNA sequence
actgtggtccaatgcgggaa

SEQ ID NO: 526771 - DNA, 20 bp, Artificial
  CRISPR gRNA sequence
ctgtggtccaatgcgggaat

SEQ ID NO: 526772 - DNA, 20 bp, Artificial
  CRISPR gRNA sequence
aatgggatccacacatctga

SEQ ID NO: 526773 - DNA, 20 bp, Artificial
  CRISPR gRNA sequence
cacacatctgatagaccctc

SEQ ID NO: 526774 - DNA, 20 bp, Artificial
  CRISPR gRNA sequence
cctgcctacaactctgtctt

SEQ ID NO: 526775 - DNA, 20 bp, Artificial
  CRISPR gRNA sequence
ctgcctacaactctgtcttc

SEQ ID NO: 526776 - DNA, 20 bp, Artificial
  CRISPR gRNA sequence
cctacaactctgtcttcagg

SEQ ID NO: 526777 - DNA, 20 bp, Artificial
  CRISPR gRNA sequence
actctgtcttcaggtggtta

SEQ ID NO: 526778 - DNA, 20 bp, Artificial
  CRISPR gRNA sequence
ctctgtcttcaggtggttac

SEQ ID NO: 526779 - DNA, 20 bp, Artificial
  CRISPR gRNA sequence
ttcaggtggttacaggaatg

SEQ ID NO: 526780 - DNA, 20 bp, Artificial
  CRISPR gRNA sequence
tcaggtggttacaggaatgt

SEQ ID NO: 526781 - DNA, 20 bp, Artificial
  CRISPR gRNA sequence
caggtggttacaggaatgtg

SEQ ID NO: 526782 - DNA, 20 bp, Artificial
  CRISPR gRNA sequence
tggttacaggaatgtggggt

SEQ ID NO: 526783 - DNA, 20 bp, Artificial
  CRISPR gRNA sequence
ggttacaggaatgtggggtt

SEQ ID NO: 526784 - DNA, 20 bp, Artificial
  CRISPR gRNA sequence
caggaatgtggggttgggtg

SEQ ID NO: 526785 - DNA, 20 bp, Artificial
  CRISPR gRNA sequence
gtggggttgggtgaagaacc

SEQ ID NO: 526786 - DNA, 20 bp, Artificial
  CRISPR gRNA sequence
ttgggtgaagaacctggatt

SEQ ID NO: 526787 - DNA, 20 bp, Artificial
  CRISPR gRNA sequence
tgggtgaagaacctggatta

SEQ ID NO: 526788 - DNA, 20 bp, Artificial
  CRISPR gRNA sequence
gtgaagaacctggattaagg

SEQ ID NO: 526789 - DNA, 20 bp, Artificial
  CRISPR gRNA sequence
tggattaaggtggcattaat

SEQ ID NO: 526790 - DNA, 20 bp, Artificial
  CRISPR gRNA sequence
ggattaaggtggcattaatc

SEQ ID NO: 526791 - DNA, 20 bp, Artificial
  CRISPR gRNA sequence
attaaggtggcattaatcgg

SEQ ID NO: 526792 - DNA, 20 bp, Artificial
  CRISPR gRNA sequence
ttaaggtggcattaatcggg

SEQ ID NO: 526793 - DNA, 20 bp, Artificial
  CRISPR gRNA sequence
taaggtggcattaatcggga

SEQ ID NO: 526794 - DNA, 20 bp, Artificial
  CRISPR gRNA sequence
aaggtggcattaatcgggag

SEQ ID NO: 526795 - DNA, 20 bp, Artificial
  CRISPR gRNA sequence
aggtggcattaatcgggagg

SEQ ID NO: 526796 - DNA, 20 bp, Artificial
  CRISPR gRNA sequence
cattaatcgggagggggaca

SEQ ID NO: 526797 - DNA, 20 bp, Artificial
  CRISPR gRNA sequence
attaatcgggagggggacac

SEQ ID NO: 526798 - DNA, 20 bp, Artificial
  CRISPR gRNA sequence
aatcgggagggggacacagg

SEQ ID NO: 526799 - DNA, 20 bp, Artificial
  CRISPR gRNA sequence
atcgggagggggacacaggt

SEQ ID NO: 526800 - DNA, 20 bp, Artificial
  CRISPR gRNA sequence
gagggggacacaggtaggcc

SEQ ID NO: 526801 - DNA, 20 bp, Artificial
  CRISPR gRNA sequence
agggggacacaggtaggccg

SEQ ID NO: 526802 - DNA, 20 bp, Artificial
  CRISPR gRNA sequence
gggggacacaggtaggccga

SEQ ID NO: 526803 - DNA, 20 bp, Artificial
  CRISPR gRNA sequence
acacaggtaggccgagggaa

SEQ ID NO: 526804 - DNA, 20 bp, Artificial
  CRISPR gRNA sequence
cacaggtaggccgagggaaa

SEQ ID NO: 526805 - DNA, 20 bp, Artificial
  CRISPR gRNA sequence
gagggaaaaggcaactgttc

SEQ ID NO: 526806 - DNA, 20 bp, Artificial
  CRISPR gRNA sequence
agggaaaaggcaactgttcc

SEQ ID NO: 526807 - DNA, 20 bp, Artificial
  CRISPR gRNA sequence
gttccaggttgctgatgaat

SEQ ID NO: 526808 - DNA, 20 bp, Artificial
  CRISPR gRNA sequence
caggttgctgatgaatcggc

SEQ ID NO: 526809 - DNA, 20 bp, Artificial
  CRISPR gRNA sequence
tgctgatgaatcggcgagct

SEQ ID NO: 526810 - DNA, 20 bp, Artificial
  CRISPR gRNA sequence
ctgatgaatcggcgagctaa

SEQ ID NO: 526811 - DNA, 20 bp, Artificial
  CRISPR gRNA sequence
atgaatcggcgagctaagag

SEQ ID NO: 526812 - DNA, 20 bp, Artificial
  CRISPR gRNA sequence
tgaatcggcgagctaagagt

SEQ ID NO: 526813 - DNA, 20 bp, Artificial
  CRISPR gRNA sequence
gaatcggcgagctaagagtg

SEQ ID NO: 526814 - DNA, 20 bp, Artificial
  CRISPR gRNA sequence
cggcgagctaagagtggggc

SEQ ID NO: 526815 - DNA, 20 bp, Artificial
  CRISPR gRNA sequence
cgagctaagagtggggcgag

SEQ ID NO: 526816 - DNA, 20 bp, Artificial
  CRISPR gRNA sequence
gctaagagtggggcgagaag

SEQ ID NO: 526817 - DNA, 20 bp, Artificial
  CRISPR gRNA sequence
taagagtggggcgagaagaa

SEQ ID NO: 526818 - DNA, 20 bp, Artificial
  CRISPR gRNA sequence
aagagtggggcgagaagaag

SEQ ID NO: 526819 - DNA, 20 bp, Artificial
  CRISPR gRNA sequence
ggcgagaagaagaggctgac

SEQ ID NO: 526820 - DNA, 20 bp, Artificial
  CRISPR gRNA sequence
cgagaagaagaggctgactg

SEQ ID NO: 526821 - DNA, 20 bp, Artificial
  CRISPR gRNA sequence
agaagaagaggctgactgga

SEQ ID NO: 526822 - DNA, 20 bp, Artificial
  CRISPR gRNA sequence
agaagaggctgactggagag

SEQ ID NO: 526823 - DNA, 20 bp, Artificial
  CRISPR gRNA sequence
agaggctgactggagagcag

SEQ ID NO: 526824 - DNA, 20 bp, Artificial
  CRISPR gRNA sequence
gaggctgactggagagcagc

SEQ ID NO: 526825 - DNA, 20 bp, Artificial
  CRISPR gRNA sequence
agcagcgggcctttcatcga

SEQ ID NO: 526826 - DNA, 20 bp, Artificial
  CRISPR gRNA sequence
cagcgggcctttcatcgaca

SEQ ID NO: 526827 - DNA, 20 bp, Artificial
  CRISPR gRNA sequence
tcatcgacagagcccatttc

SEQ ID NO: 526828 - DNA, 20 bp, Artificial
  CRISPR gRNA sequence
cgacagagcccatttcaagc

SEQ ID NO: 526829 - DNA, 20 bp, Artificial
  CRISPR gRNA sequence
gacagagcccatttcaagcc

SEQ ID NO: 526830 - DNA, 20 bp, Artificial
  CRISPR gRNA sequence
tttcaagccaggctgccctg

SEQ ID NO: 526831 - DNA, 20 bp, Artificial
  CRISPR gRNA sequence
ttcaagccaggctgccctga

SEQ ID NO: 526832 - DNA, 20 bp, Artificial
  CRISPR gRNA sequence
caagccaggctgccctgaag

SEQ ID NO: 526833 - DNA, 20 bp, Artificial
  CRISPR gRNA sequence
aagccaggctgccctgaagg

SEQ ID NO: 526834 - DNA, 20 bp, Artificial
  CRISPR gRNA sequence
gccaggctgccctgaaggag

SEQ ID NO: 526835 - DNA, 20 bp, Artificial
  CRISPR gRNA sequence
gccctgaaggaggagttata

SEQ ID NO: 526836 - DNA, 20 bp, Artificial
  CRISPR gRNA sequence
ctgaaggaggagttatatgg

SEQ ID NO: 526837 - DNA, 20 bp, Artificial
  CRISPR gRNA sequence
ggaggagttatatggcagaa

SEQ ID NO: 526838 - DNA, 20 bp, Artificial
  CRISPR gRNA sequence
gaggagttatatggcagaaa

SEQ ID NO: 526839 - DNA, 20 bp, Artificial
  CRISPR gRNA sequence
aggagttatatggcagaaaa

SEQ ID NO: 526840 - DNA, 20 bp, Artificial
  CRISPR gRNA sequence
gttatatggcagaaaagggc

SEQ ID NO: 526841 - DNA, 20 bp, Artificial
  CRISPR gRNA sequence
gggctggaaacaacatattt

SEQ ID NO: 526842 - DNA, 20 bp, Artificial
  CRISPR gRNA sequence
ggctggaaacaacatattta

SEQ ID NO: 526843 - DNA, 20 bp, Artificial
  CRISPR gRNA sequence
acaacatatttaaggatgaa

SEQ ID NO: 526844 - DNA, 20 bp, Artificial
  CRISPR gRNA sequence
aggatgaacagcccttattt

SEQ ID NO: 526845 - DNA, 20 bp, Artificial
  CRISPR gRNA sequence
cttattttggatctgcttgt

SEQ ID NO: 526846 - DNA, 20 bp, Artificial
  CRISPR gRNA sequence
tattttggatctgcttgtca

SEQ ID NO: 526847 - DNA, 20 bp, Artificial
  CRISPR gRNA sequence
tctgcttgtcagagtgatac

SEQ ID NO: 526848 - DNA, 20 bp, Artificial
  CRISPR gRNA sequence
ctgcttgtcagagtgataca

SEQ ID NO: 526849 - DNA, 20 bp, Artificial
  CRISPR gRNA sequence
cttgtcagagtgatacaagg

SEQ ID NO: 526850 - DNA, 20 bp, Artificial
  CRISPR gRNA sequence
gtcagagtgatacaaggtgg

SEQ ID NO: 526851 - DNA, 20 bp, Artificial
  CRISPR gRNA sequence
tcagagtgatacaaggtggc

SEQ ID NO: 526852 - DNA, 20 bp, Artificial
  CRISPR gRNA sequence
gtgatttttgctgatatgtg

SEQ ID NO: 526853 - DNA, 20 bp, Artificial
  CRISPR gRNA sequence
atttttgctgatatgtgtag

SEQ ID NO: 526854 - DNA, 20 bp, Artificial
  CRISPR gRNA sequence
gatatgtgtagaagatgcac

SEQ ID NO: 526855 - DNA, 20 bp, Artificial
  CRISPR gRNA sequence
atatgtgtagaagatgcaca

SEQ ID NO: 526856 - DNA, 20 bp, Artificial
  CRISPR gRNA sequence
tgtagaagatgcacaaggtg

SEQ ID NO: 526857 - DNA, 20 bp, Artificial
  CRISPR gRNA sequence
ttgtatatctctgcctgtac

SEQ ID NO: 526858 - DNA, 20 bp, Artificial
  CRISPR gRNA sequence
tgtatatctctgcctgtact

SEQ ID NO: 526859 - DNA, 20 bp, Artificial
  CRISPR gRNA sequence
tatatctctgcctgtactgg

SEQ ID NO: 526860 - DNA, 20 bp, Artificial
  CRISPR gRNA sequence
atatctctgcctgtactggg

SEQ ID NO: 526861 - DNA, 20 bp, Artificial
  CRISPR gRNA sequence
ctctgcctgtactgggagga

SEQ ID NO: 526862 - DNA, 20 bp, Artificial
  CRISPR gRNA sequence
tctgcctgtactgggaggac

SEQ ID NO: 526863 - DNA, 20 bp, Artificial
  CRISPR gRNA sequence
tgcctgtactgggaggacag

SEQ ID NO: 526864 - DNA, 20 bp, Artificial
  CRISPR gRNA sequence
ctgtactgggaggacaggag

SEQ ID NO: 526865 - DNA, 20 bp, Artificial
  CRISPR gRNA sequence
ggaggacaggagtggatatt

SEQ ID NO: 526866 - DNA, 20 bp, Artificial
  CRISPR gRNA sequence
gaggacaggagtggatattg

SEQ ID NO: 526867 - DNA, 20 bp, Artificial
  CRISPR gRNA sequence
acaggagtggatattgagga

SEQ ID NO: 526868 - DNA, 20 bp, Artificial
  CRISPR gRNA sequence
caggagtggatattgaggat

SEQ ID NO: 526869 - DNA, 20 bp, Artificial
  CRISPR gRNA sequence
aggagtggatattgaggatg

SEQ ID NO: 526870 - DNA, 20 bp, Artificial
  CRISPR gRNA sequence
gtggatattgaggatggggt

SEQ ID NO: 526871 - DNA, 20 bp, Artificial
  CRISPR gRNA sequence
tggatattgaggatggggtt

SEQ ID NO: 526872 - DNA, 20 bp, Artificial
  CRISPR gRNA sequence
ggatattgaggatggggtta

SEQ ID NO: 526873 - DNA, 20 bp, Artificial
  CRISPR gRNA sequence
atattgaggatggggttagg

SEQ ID NO: 526874 - DNA, 20 bp, Artificial
  CRISPR gRNA sequence
gaggatggggttagggagac

SEQ ID NO: 526875 - DNA, 20 bp, Artificial
  CRISPR gRNA sequence
atggggttagggagactagt

SEQ ID NO: 526876 - DNA, 20 bp, Artificial
  CRISPR gRNA sequence
ggttagggagactagttaga

SEQ ID NO: 526877 - DNA, 20 bp, Artificial
  CRISPR gRNA sequence
gaaagctgctgctgtaatcc

SEQ ID NO: 526878 - DNA, 20 bp, Artificial
  CRISPR gRNA sequence
agctgctgctgtaatccaag

SEQ ID NO: 526879 - DNA, 20 bp, Artificial
  CRISPR gRNA sequence
ctgctgctgtaatccaagtg

SEQ ID NO: 526880 - DNA, 20 bp, Artificial
  CRISPR gRNA sequence
tgctgtaatccaagtggagt

SEQ ID NO: 526881 - DNA, 20 bp, Artificial
  CRISPR gRNA sequence
gctgtaatccaagtggagtg

SEQ ID NO: 526882 - DNA, 20 bp, Artificial
  CRISPR gRNA sequence
ggagtgaggaccaattaaat

SEQ ID NO: 526883 - DNA, 20 bp, Artificial
  CRISPR gRNA sequence
aatcagattttttttgcatg

SEQ ID NO: 526884 - DNA, 20 bp, Artificial
  CRISPR gRNA sequence
gattttttttgcatgcggcc

SEQ ID NO: 526885 - DNA, 20 bp, Artificial
  CRISPR gRNA sequence
attttttttgcatgcggcct

SEQ ID NO: 526886 - DNA, 20 bp, Artificial
  CRISPR gRNA sequence
gcatgcggcctgggtatcat

SEQ ID NO: 526887 - DNA, 20 bp, Artificial
  CRISPR gRNA sequence
catgcggcctgggtatcatt

SEQ ID NO: 526888 - DNA, 20 bp, Artificial
  CRISPR gRNA sequence
ctgggtatcattaggttcta

SEQ ID NO: 526889 - DNA, 20 bp, Artificial
  CRISPR gRNA sequence
cattaggttctaaagctccc

SEQ ID NO: 526890 - DNA, 20 bp, Artificial
  CRISPR gRNA sequence
attaggttctaaagctccct

SEQ ID NO: 526891 - DNA, 20 bp, Artificial
  CRISPR gRNA sequence
ttaggttctaaagctccctg

SEQ ID NO: 526892 - DNA, 20 bp, Artificial
  CRISPR gRNA sequence
taggttctaaagctccctgg

SEQ ID NO: 526893 - DNA, 20 bp, Artificial
  CRISPR gRNA sequence
gctccctgggggattctaat

SEQ ID NO: 526894 - DNA, 20 bp, Artificial
  CRISPR gRNA sequence
gggattctaatgagctgcca

SEQ ID NO: 526895 - DNA, 20 bp, Artificial
  CRISPR gRNA sequence
ctgccaaagtcaatcgccac

SEQ ID NO: 526896 - DNA, 20 bp, Artificial
  CRISPR gRNA sequence
aaagtcaatcgccactggcc

SEQ ID NO: 526897 - DNA, 20 bp, Artificial
  CRISPR gRNA sequence
atcgccactggcctagacca

SEQ ID NO: 526898 - DNA, 20 bp, Artificial
  CRISPR gRNA sequence
tcgccactggcctagaccaa

SEQ ID NO: 526899 - DNA, 20 bp, Artificial
  CRISPR gRNA sequence
cgccactggcctagaccaaa

SEQ ID NO: 526900 - DNA, 20 bp, Artificial
  CRISPR gRNA sequence
accaaagggtgcctctaaaa

SEQ ID NO: 526901 - DNA, 20 bp, Artificial
  CRISPR gRNA sequence
ccaaagggtgcctctaaaat

SEQ ID NO: 526902 - DNA, 20 bp, Artificial
  CRISPR gRNA sequence
aagggtgcctctaaaatagg

SEQ ID NO: 526903 - DNA, 20 bp, Artificial
  CRISPR gRNA sequence
gcctctaaaataggaagaat

SEQ ID NO: 526904 - DNA, 20 bp, Artificial
  CRISPR gRNA sequence
cctctaaaataggaagaatg

SEQ ID NO: 526905 - DNA, 20 bp, Artificial
  CRISPR gRNA sequence
ataggaagaatgaggataat

SEQ ID NO: 526906 - DNA, 20 bp, Artificial
  CRISPR gRNA sequence
taggaagaatgaggataata

SEQ ID NO: 526907 - DNA, 20 bp, Artificial
  CRISPR gRNA sequence
aggaagaatgaggataataa

SEQ ID NO: 526908 - DNA, 20 bp, Artificial
  CRISPR gRNA sequence
agaatgaggataataagggt

SEQ ID NO: 526909 - DNA, 20 bp, Artificial
  CRISPR gRNA sequence
gaatgaggataataagggtc

SEQ ID NO: 526910 - DNA, 20 bp, Artificial
  CRISPR gRNA sequence
aggataataagggtcaggca

SEQ ID NO: 526911 - DNA, 20 bp, Artificial
  CRISPR gRNA sequence
gataataagggtcaggcata

SEQ ID NO: 526912 - DNA, 20 bp, Artificial
  CRISPR gRNA sequence
ataagggtcaggcatagaga

SEQ ID NO: 526913 - DNA, 20 bp, Artificial
  CRISPR gRNA sequence
taagggtcaggcatagagaa

SEQ ID NO: 526914 - DNA, 20 bp, Artificial
  CRISPR gRNA sequence
gggtcaggcatagagaaagg

SEQ ID NO: 526915 - DNA, 20 bp, Artificial
  CRISPR gRNA sequence
aggcatagagaaaggtggct

SEQ ID NO: 526916 - DNA, 20 bp, Artificial
  CRISPR gRNA sequence
ggcatagagaaaggtggctt

SEQ ID NO: 526917 - DNA, 20 bp, Artificial
  CRISPR gRNA sequence
tagagaaaggtggcttaggc

SEQ ID NO: 526918 - DNA, 20 bp, Artificial
  CRISPR gRNA sequence
agagaaaggtggcttaggca

SEQ ID NO: 526919 - DNA, 20 bp, Artificial
  CRISPR gRNA sequence
gagaaaggtggcttaggcaa

SEQ ID NO: 526920 - DNA, 20 bp, Artificial
  CRISPR gRNA sequence
gaaaggtggcttaggcaagg

SEQ ID NO: 526921 - DNA, 20 bp, Artificial
  CRISPR gRNA sequence
aaggtggcttaggcaaggga

SEQ ID NO: 526922 - DNA, 20 bp, Artificial
  CRISPR gRNA sequence
gtggcttaggcaagggagag

SEQ ID NO: 526923 - DNA, 20 bp, Artificial
  CRISPR gRNA sequence
tggcttaggcaagggagaga

SEQ ID NO: 526924 - DNA, 20 bp, Artificial
  CRISPR gRNA sequence
cttaggcaagggagagaagg

SEQ ID NO: 526925 - DNA, 20 bp, Artificial
  CRISPR gRNA sequence
taggcaagggagagaaggta

SEQ ID NO: 526926 - DNA, 20 bp, Artificial
  CRISPR gRNA sequence
caagggagagaaggtagaga

SEQ ID NO: 526927 - DNA, 20 bp, Artificial
  CRISPR gRNA sequence
gggagagaaggtagagaaag

SEQ ID NO: 526928 - DNA, 20 bp, Artificial
  CRISPR gRNA sequence
gtggaatcgaaatgccattg

SEQ ID NO: 526929 - DNA, 20 bp, Artificial
  CRISPR gRNA sequence
cgaaatgccattgaagttga

SEQ ID NO: 526930 - DNA, 20 bp, Artificial
  CRISPR gRNA sequence
tgccattgaagttgaaagcc

SEQ ID NO: 526931 - DNA, 20 bp, Artificial
  CRISPR gRNA sequence
gccattgaagttgaaagccc

SEQ ID NO: 526932 - DNA, 20 bp, Artificial
  CRISPR gRNA sequence
ccattgaagttgaaagcccg

SEQ ID NO: 526933 - DNA, 20 bp, Artificial
  CRISPR gRNA sequence
cattgaagttgaaagcccgg

SEQ ID NO: 526934 - DNA, 20 bp, Artificial
  CRISPR gRNA sequence
attgaagttgaaagcccggg

SEQ ID NO: 526935 - DNA, 20 bp, Artificial
  CRISPR gRNA sequence
ttgaaagcccggggggatgc

SEQ ID NO: 526936 - DNA, 20 bp, Artificial
  CRISPR gRNA sequence
tgaaagcccggggggatgct

SEQ ID NO: 526937 - DNA, 20 bp, Artificial
  CRISPR gRNA sequence
gaaagcccggggggatgctg

SEQ ID NO: 526938 - DNA, 20 bp, Artificial
  CRISPR gRNA sequence
agcccggggggatgctgggg

SEQ ID NO: 526939 - DNA, 20 bp, Artificial
  CRISPR gRNA sequence
ccggggggatgctggggaag

SEQ ID NO: 526940 - DNA, 20 bp, Artificial
  CRISPR gRNA sequence
gatgctggggaagtagtgac

SEQ ID NO: 526941 - DNA, 20 bp, Artificial
  CRISPR gRNA sequence
gctggggaagtagtgacaag

SEQ ID NO: 526942 - DNA, 20 bp, Artificial
  CRISPR gRNA sequence
ctggggaagtagtgacaaga

SEQ ID NO: 526943 - DNA, 20 bp, Artificial
  CRISPR gRNA sequence
tggggaagtagtgacaagaa

SEQ ID NO: 526944 - DNA, 20 bp, Artificial
  CRISPR gRNA sequence
aagtagtgacaagaagggaa

SEQ ID NO: 526945 - DNA, 20 bp, Artificial
  CRISPR gRNA sequence
tagtgacaagaagggaaaag

SEQ ID NO: 526946 - DNA, 20 bp, Artificial
  CRISPR gRNA sequence
tgacaagaagggaaaagaag

SEQ ID NO: 526947 - DNA, 20 bp, Artificial
  CRISPR gRNA sequence
agaagaagctgcgcttgact

SEQ ID NO: 526948 - DNA, 20 bp, Artificial
  CRISPR gRNA sequence
gaagaagctgcgcttgactt

SEQ ID NO: 526949 - DNA, 20 bp, Artificial
  CRISPR gRNA sequence
aagaagctgcgcttgacttg

SEQ ID NO: 526950 - DNA, 20 bp, Artificial
  CRISPR gRNA sequence
gaagctgcgcttgacttggg

SEQ ID NO: 526951 - DNA, 20 bp, Artificial
  CRISPR gRNA sequence
aagctgcgcttgacttgggg

SEQ ID NO: 526952 - DNA, 20 bp, Artificial
  CRISPR gRNA sequence
ctgcgcttgacttggggagg

SEQ ID NO: 526953 - DNA, 20 bp, Artificial
  CRISPR gRNA sequence
gcttgacttggggaggcaga

SEQ ID NO: 526954 - DNA, 20 bp, Artificial
  CRISPR gRNA sequence
cttgacttggggaggcagac

SEQ ID NO: 526955 - DNA, 20 bp, Artificial
  CRISPR gRNA sequence
ggggaggcagacaggaaccc

SEQ ID NO: 526956 - DNA, 20 bp, Artificial
  CRISPR gRNA sequence
gcagacaggaaccccagcat

SEQ ID NO: 526957 - DNA, 20 bp, Artificial
  CRISPR gRNA sequence
caggaaccccagcatgagca

SEQ ID NO: 526958 - DNA, 20 bp, Artificial
  CRISPR gRNA sequence
aggaaccccagcatgagcac

SEQ ID NO: 526959 - DNA, 20 bp, Artificial
  CRISPR gRNA sequence
accccagcatgagcacaggc

SEQ ID NO: 526960 - DNA, 20 bp, Artificial
  CRISPR gRNA sequence
atgagcacaggccagccatt

SEQ ID NO: 526961 - DNA, 20 bp, Artificial
  CRISPR gRNA sequence
gcacaggccagccattcagt

SEQ ID NO: 526962 - DNA, 20 bp, Artificial
  CRISPR gRNA sequence
cagccattcagtgagcaaat

SEQ ID NO: 526963 - DNA, 20 bp, Artificial
  CRISPR gRNA sequence
aagcatttctgtgcttcaca

SEQ ID NO: 526964 - DNA, 20 bp, Artificial
  CRISPR gRNA sequence
cttcacacagaaaatatcac

SEQ ID NO: 526965 - DNA, 20 bp, Artificial
  CRISPR gRNA sequence
cacacagaaaatatcaccag

SEQ ID NO: 526966 - DNA, 20 bp, Artificial
  CRISPR gRNA sequence
acagaaaatatcaccagaag

SEQ ID NO: 526967 - DNA, 20 bp, Artificial
  CRISPR gRNA sequence
cagaaaatatcaccagaagc

SEQ ID NO: 526968 - DNA, 20 bp, Artificial
  CRISPR gRNA sequence
agaaaatatcaccagaagca

SEQ ID NO: 526969 - DNA, 20 bp, Artificial
  CRISPR gRNA sequence
accttcttcctctctgtctc

SEQ ID NO: 526970 - DNA, 20 bp, Artificial
  CRISPR gRNA sequence
tctgtctccagccccatctt

SEQ ID NO: 526971 - DNA, 20 bp, Artificial
  CRISPR gRNA sequence
ccagccccatcttcagcacc

SEQ ID NO: 526972 - DNA, 20 bp, Artificial
  CRISPR gRNA sequence
cagccccatcttcagcacct

SEQ ID NO: 526973 - DNA, 20 bp, Artificial
  CRISPR gRNA sequence
tcttcagcacctgggcctac

SEQ ID NO: 526974 - DNA, 20 bp, Artificial
  CRISPR gRNA sequence
cctgggcctaccagcaatcc

SEQ ID NO: 526975 - DNA, 20 bp, Artificial
  CRISPR gRNA sequence
ggcctaccagcaatcccaga

SEQ ID NO: 526976 - DNA, 20 bp, Artificial
  CRISPR gRNA sequence
ccagcaatcccagatagtgt

SEQ ID NO: 526977 - DNA, 20 bp, Artificial
  CRISPR gRNA sequence
tagtgtcagattgcccactc

SEQ ID NO: 526978 - DNA, 20 bp, Artificial
  CRISPR gRNA sequence
attgcccactccagcaatcc

SEQ ID NO: 526979 - DNA, 20 bp, Artificial
  CRISPR gRNA sequence
ccagcaatcccagacactgt

SEQ ID NO: 526980 - DNA, 20 bp, Artificial
  CRISPR gRNA sequence
agacactgtcagctcccctg

SEQ ID NO: 526981 - DNA, 20 bp, Artificial
  CRISPR gRNA sequence
agtgacaactttccacaccc

SEQ ID NO: 526982 - DNA, 20 bp, Artificial
  CRISPR gRNA sequence
caccctagtcctgcaacctt

SEQ ID NO: 526983 - DNA, 20 bp, Artificial
  CRISPR gRNA sequence
cctagtcctgcaaccttgag

SEQ ID NO: 526984 - DNA, 20 bp, Artificial
  CRISPR gRNA sequence
tagtcctgcaaccttgagtg

SEQ ID NO: 526985 - DNA, 20 bp, Artificial
  CRISPR gRNA sequence
gtcctgcaaccttgagtgga

SEQ ID NO: 526986 - DNA, 20 bp, Artificial
  CRISPR gRNA sequence
cttgagtggagagcaccttg

SEQ ID NO: 526987 - DNA, 20 bp, Artificial
  CRISPR gRNA sequence
gagagcaccttgtagaaatg

SEQ ID NO: 526988 - DNA, 20 bp, Artificial
  CRISPR gRNA sequence
agcaccttgtagaaatgtag

SEQ ID NO: 526989 - DNA, 20 bp, Artificial
  CRISPR gRNA sequence
gcaccttgtagaaatgtagt

SEQ ID NO: 526990 - DNA, 20 bp, Artificial
  CRISPR gRNA sequence
caccttgtagaaatgtagtg

SEQ ID NO: 526991 - DNA, 20 bp, Artificial
  CRISPR gRNA sequence
tgtagaaatgtagtggggtt

SEQ ID NO: 526992 - DNA, 20 bp, Artificial
  CRISPR gRNA sequence
aaatgtagtggggttgagca

SEQ ID NO: 526993 - DNA, 20 bp, Artificial
  CRISPR gRNA sequence
gggttgagcatggcgctgaa

SEQ ID NO: 526994 - DNA, 20 bp, Artificial
  CRISPR gRNA sequence
ggttgagcatggcgctgaaa

SEQ ID NO: 526995 - DNA, 20 bp, Artificial
  CRISPR gRNA sequence
gttgagcatggcgctgaaaa

SEQ ID NO: 526996 - DNA, 20 bp, Artificial
  CRISPR gRNA sequence
ctgaaaagggcctctgatta

SEQ ID NO: 526997 - DNA, 20 bp, Artificial
  CRISPR gRNA sequence
tgaaaagggcctctgattat

SEQ ID NO: 526998 - DNA, 20 bp, Artificial
  CRISPR gRNA sequence
gggcctctgattatgggctc

SEQ ID NO: 526999 - DNA, 20 bp, Artificial
  CRISPR gRNA sequence
attatgggctctggaaacca

SEQ ID NO: 527000 - DNA, 20 bp, Artificial
  CRISPR gRNA sequence
gctctggaaaccacagatct

SEQ ID NO: 527001 - DNA, 20 bp, Artificial
  CRISPR gRNA sequence
ctctggaaaccacagatctc

SEQ ID NO: 527002 - DNA, 20 bp, Artificial
  CRISPR gRNA sequence
acagatctcaggactccaaa

SEQ ID NO: 527003 - DNA, 20 bp, Artificial
  CRISPR gRNA sequence
ctccaaacagcacaaaactc

SEQ ID NO: 527004 - DNA, 20 bp, Artificial
  CRISPR gRNA sequence
aaactcgagtgtcctgtttt

SEQ ID NO: 527005 - DNA, 20 bp, Artificial
  CRISPR gRNA sequence
gagtgtcctgttttgagtgt

SEQ ID NO: 527006 - DNA, 20 bp, Artificial
  CRISPR gRNA sequence
ttttgagtgtgagccctacg

SEQ ID NO: 527007 - DNA, 20 bp, Artificial
  CRISPR gRNA sequence
tttgagtgtgagccctacgc

SEQ ID NO: 527008 - DNA, 20 bp, Artificial
  CRISPR gRNA sequence
ttgagtgtgagccctacgcg

SEQ ID NO: 527009 - DNA, 20 bp, Artificial
  CRISPR gRNA sequence
tgagtgtgagccctacgcgg

SEQ ID NO: 527010 - DNA, 20 bp, Artificial
  CRISPR gRNA sequence
ccctacgcgggggaccatgc

SEQ ID NO: 527011 - DNA, 20 bp, Artificial
  CRISPR gRNA sequence
catgctggtgttttcacatt

SEQ ID NO: 527012 - DNA, 20 bp, Artificial
  CRISPR gRNA sequence
atgctggtgttttcacattt

SEQ ID NO: 527013 - DNA, 20 bp, Artificial
  CRISPR gRNA sequence
tttcacatttgggtcgcatt

SEQ ID NO: 527014 - DNA, 20 bp, Artificial
  CRISPR gRNA sequence
ttgggtcgcatttagcattg

SEQ ID NO: 527015 - DNA, 20 bp, Artificial
  CRISPR gRNA sequence
ggtcgcatttagcattgcgg

SEQ ID NO: 527016 - DNA, 20 bp, Artificial
  CRISPR gRNA sequence
tagcattgcggcggaaataa

SEQ ID NO: 527017 - DNA, 20 bp, Artificial
  CRISPR gRNA sequence
gcggcggaaataatggctac

SEQ ID NO: 527018 - DNA, 20 bp, Artificial
  CRISPR gRNA sequence
cggaaataatggctaccagt

SEQ ID NO: 527019 - DNA, 20 bp, Artificial
  CRISPR gRNA sequence
ggaaataatggctaccagtt

SEQ ID NO: 527020 - DNA, 20 bp, Artificial
  CRISPR gRNA sequence
gaaataatggctaccagtta

SEQ ID NO: 527021 - DNA, 20 bp, Artificial
  CRISPR gRNA sequence
aaataatggctaccagttag

SEQ ID NO: 527022 - DNA, 20 bp, Artificial
  CRISPR gRNA sequence
atggctaccagttaggggtc

SEQ ID NO: 527023 - DNA, 20 bp, Artificial
  CRISPR gRNA sequence
tgcttacatgatcttattta

SEQ ID NO: 527024 - DNA, 20 bp, Artificial
  CRISPR gRNA sequence
ttaaagcgcccaacaatact

SEQ ID NO: 527025 - DNA, 20 bp, Artificial
  CRISPR gRNA sequence
cgcccaacaatactgagacc

SEQ ID NO: 527026 - DNA, 20 bp, Artificial
  CRISPR gRNA sequence
attatctccttgttatatat

SEQ ID NO: 527027 - DNA, 20 bp, Artificial
  CRISPR gRNA sequence
ccttgttatatataagaaaa

SEQ ID NO: 527028 - DNA, 20 bp, Artificial
  CRISPR gRNA sequence
ttgttatatataagaaaaca

SEQ ID NO: 527029 - DNA, 20 bp, Artificial
  CRISPR gRNA sequence
tatataagaaaacagagacc

SEQ ID NO: 527030 - DNA, 20 bp, Artificial
  CRISPR gRNA sequence
taagaaaacagagacctagt

SEQ ID NO: 527031 - DNA, 20 bp, Artificial
  CRISPR gRNA sequence
gaaaacagagacctagtcag

SEQ ID NO: 527032 - DNA, 20 bp, Artificial
  CRISPR gRNA sequence
aacagagacctagtcagaag

SEQ ID NO: 527033 - DNA, 20 bp, Artificial
  CRISPR gRNA sequence
tagtcagaagcagcttgtcc

SEQ ID NO: 527034 - DNA, 20 bp, Artificial
  CRISPR gRNA sequence
agtcagaagcagcttgtcca

SEQ ID NO: 527035 - DNA, 20 bp, Artificial
  CRISPR gRNA sequence
tccaaggtctcattgcttga

SEQ ID NO: 527036 - DNA, 20 bp, Artificial
  CRISPR gRNA sequence
ccaaggtctcattgcttgac

SEQ ID NO: 527037 - DNA, 20 bp, Artificial
  CRISPR gRNA sequence
aaggtctcattgcttgacag

SEQ ID NO: 527038 - DNA, 20 bp, Artificial
  CRISPR gRNA sequence
ctcattgcttgacaggagca

SEQ ID NO: 527039 - DNA, 20 bp, Artificial
  CRISPR gRNA sequence
ttgcttgacaggagcaaagt

SEQ ID NO: 527040 - DNA, 20 bp, Artificial
  CRISPR gRNA sequence
tgcttgacaggagcaaagtc

SEQ ID NO: 527041 - DNA, 20 bp, Artificial
  CRISPR gRNA sequence
gcaaagtcaggattcaaact

SEQ ID NO: 527042 - DNA, 20 bp, Artificial
  CRISPR gRNA sequence
aaagtcaggattcaaactca

SEQ ID NO: 527043 - DNA, 20 bp, Artificial
  CRISPR gRNA sequence
aagtcaggattcaaactcag

SEQ ID NO: 527044 - DNA, 20 bp, Artificial
  CRISPR gRNA sequence
ttcaaactcagaggtctttt

SEQ ID NO: 527045 - DNA, 20 bp, Artificial
  CRISPR gRNA sequence
aactcagaggtctttttggc

SEQ ID NO: 527046 - DNA, 20 bp, Artificial
  CRISPR gRNA sequence
gaccttttctttttttttcc

SEQ ID NO: 527047 - DNA, 20 bp, Artificial
  CRISPR gRNA sequence
cttttctttttttttccaag

SEQ ID NO: 527048 - DNA, 20 bp, Artificial
  CRISPR gRNA sequence
tttttccaagcagcttcatt

SEQ ID NO: 527049 - DNA, 20 bp, Artificial
  CRISPR gRNA sequence
aatttgtccatatactaaaa

SEQ ID NO: 527050 - DNA, 20 bp, Artificial
  CRISPR gRNA sequence
ccatatactaaaatggcctt

SEQ ID NO: 527051 - DNA, 20 bp, Artificial
  CRISPR gRNA sequence
aaaatggccttcagtatatt

SEQ ID NO: 527052 - DNA, 20 bp, Artificial
  CRISPR gRNA sequence
aatggccttcagtatattca

SEQ ID NO: 527053 - DNA, 20 bp, Artificial
  CRISPR gRNA sequence
aacattttcattgccccaaa

SEQ ID NO: 527054 - DNA, 20 bp, Artificial
  CRISPR gRNA sequence
aaaagaaacccttcaccctt

SEQ ID NO: 527055 - DNA, 20 bp, Artificial
  CRISPR gRNA sequence
acccttcaccctttagccga

SEQ ID NO: 527056 - DNA, 20 bp, Artificial
  CRISPR gRNA sequence
ttcaccctttagccgaaaga

SEQ ID NO: 527057 - DNA, 20 bp, Artificial
  CRISPR gRNA sequence
caacatcttgattcaacttg

SEQ ID NO: 527058 - DNA, 20 bp, Artificial
  CRISPR gRNA sequence
atcttgattcaacttgtagt

SEQ ID NO: 527059 - DNA, 20 bp, Artificial
  CRISPR gRNA sequence
ttgtagttggtcactattac

SEQ ID NO: 527060 - DNA, 20 bp, Artificial
  CRISPR gRNA sequence
tggtcactattaccagactt

SEQ ID NO: 527061 - DNA, 20 bp, Artificial
  CRISPR gRNA sequence
ggtcactattaccagactta

SEQ ID NO: 527062 - DNA, 20 bp, Artificial
  CRISPR gRNA sequence
taccagacttaaggtgacca

SEQ ID NO: 527063 - DNA, 20 bp, Artificial
  CRISPR gRNA sequence
acttaaggtgaccatggcct

SEQ ID NO: 527064 - DNA, 20 bp, Artificial
  CRISPR gRNA sequence
cttaaggtgaccatggcctt

SEQ ID NO: 527065 - DNA, 20 bp, Artificial
  CRISPR gRNA sequence
gcaaattccctatctgctgt

SEQ ID NO: 527066 - DNA, 20 bp, Artificial
  CRISPR gRNA sequence
gcttttccaatgacaacttc

SEQ ID NO: 527067 - DNA, 20 bp, Artificial
  CRISPR gRNA sequence
cttttccaatgacaacttca

SEQ ID NO: 527068 - DNA, 20 bp, Artificial
  CRISPR gRNA sequence
ttttccaatgacaacttcaa

SEQ ID NO: 527069 - DNA, 20 bp, Artificial
  CRISPR gRNA sequence
tgacaacttcaagggatatt

SEQ ID NO: 527070 - DNA, 20 bp, Artificial
  CRISPR gRNA sequence
aacttcaagggatattcagt

SEQ ID NO: 527071 - DNA, 20 bp, Artificial
  CRISPR gRNA sequence
caagggatattcagtgagac

SEQ ID NO: 527072 - DNA, 20 bp, Artificial
  CRISPR gRNA sequence
aagggatattcagtgagaca

SEQ ID NO: 527073 - DNA, 20 bp, Artificial
  CRISPR gRNA sequence
cagtgagacaaggtgtgtac

SEQ ID NO: 527074 - DNA, 20 bp, Artificial
  CRISPR gRNA sequence
aggtgtgtacaagtgtcctg

SEQ ID NO: 527075 - DNA, 20 bp, Artificial
  CRISPR gRNA sequence
tacaagtgtcctgcagtgcc

SEQ ID NO: 527076 - DNA, 20 bp, Artificial
  CRISPR gRNA sequence
acaagtgtcctgcagtgcct

SEQ ID NO: 527077 - DNA, 20 bp, Artificial
  CRISPR gRNA sequence
caagtgtcctgcagtgcctg

SEQ ID NO: 527078 - DNA, 20 bp, Artificial
  CRISPR gRNA sequence
gggcacaatgcctgttttct

SEQ ID NO: 527079 - DNA, 20 bp, Artificial
  CRISPR gRNA sequence
ccacatctctttgtttctcc

SEQ ID NO: 527080 - DNA, 20 bp, Artificial
  CRISPR gRNA sequence
ttttttttttttttttaatt

SEQ ID NO: 527081 - DNA, 20 bp, Artificial
  CRISPR gRNA sequence
ttttttttttttaattgaga

SEQ ID NO: 527082 - DNA, 20 bp, Artificial
  CRISPR gRNA sequence
tggcatcttgctctgttgcc

SEQ ID NO: 527083 - DNA, 20 bp, Artificial
  CRISPR gRNA sequence
ggcatcttgctctgttgccc

SEQ ID NO: 527084 - DNA, 20 bp, Artificial
  CRISPR gRNA sequence
tcttgctctgttgcccaggc

SEQ ID NO: 527085 - DNA, 20 bp, Artificial
  CRISPR gRNA sequence
ttgctctgttgcccaggctg

SEQ ID NO: 527086 - DNA, 20 bp, Artificial
  CRISPR gRNA sequence
ttgcccaggctggagtgcac

SEQ ID NO: 527087 - DNA, 20 bp, Artificial
  CRISPR gRNA sequence
ggagtgcactggcatgatct

SEQ ID NO: 527088 - DNA, 20 bp, Artificial
  CRISPR gRNA sequence
ggcatgatctcagctcactg

SEQ ID NO: 527089 - DNA, 20 bp, Artificial
  CRISPR gRNA sequence
tcactgcagcctctgcctcc

SEQ ID NO: 527090 - DNA, 20 bp, Artificial
  CRISPR gRNA sequence
cactgcagcctctgcctccc

SEQ ID NO: 527091 - DNA, 20 bp, Artificial
  CRISPR gRNA sequence
agcctctgcctcccaggttc

SEQ ID NO: 527092 - DNA, 20 bp, Artificial
  CRISPR gRNA sequence
ttcaagcgattctcctgcct

SEQ ID NO: 527093 - DNA, 20 bp, Artificial
  CRISPR gRNA sequence
ttctcctgcctcagcctccc

SEQ ID NO: 527094 - DNA, 20 bp, Artificial
  CRISPR gRNA sequence
tcctgcctcagcctcccaag

SEQ ID NO: 527095 - DNA, 20 bp, Artificial
  CRISPR gRNA sequence
gcctcagcctcccaagtagc

SEQ ID NO: 527096 - DNA, 20 bp, Artificial
  CRISPR gRNA sequence
cctcagcctcccaagtagct

SEQ ID NO: 527097 - DNA, 20 bp, Artificial
  CRISPR gRNA sequence
ctcccaagtagctgggatta

SEQ ID NO: 527098 - DNA, 20 bp, Artificial
  CRISPR gRNA sequence
tcccaagtagctgggattac

SEQ ID NO: 527099 - DNA, 20 bp, Artificial
  CRISPR gRNA sequence
caggcatgtaccaccacgtc

SEQ ID NO: 527100 - DNA, 20 bp, Artificial
  CRISPR gRNA sequence
ccggctaatttttgtatttt

SEQ ID NO: 527101 - DNA, 20 bp, Artificial
  CRISPR gRNA sequence
gctaatttttgtatttttag

SEQ ID NO: 527102 - DNA, 20 bp, Artificial
  CRISPR gRNA sequence
taatttttgtatttttagta

SEQ ID NO: 527103 - DNA, 20 bp, Artificial
  CRISPR gRNA sequence
ttttgtatttttagtagaga

SEQ ID NO: 527104 - DNA, 20 bp, Artificial
  CRISPR gRNA sequence
tttgtatttttagtagagac

SEQ ID NO: 527105 - DNA, 20 bp, Artificial
  CRISPR gRNA sequence
ttgtatttttagtagagacg

SEQ ID NO: 527106 - DNA, 20 bp, Artificial
  CRISPR gRNA sequence
gagacggggtttcgccatgt

SEQ ID NO: 527107 - DNA, 20 bp, Artificial
  CRISPR gRNA sequence
cggggtttcgccatgttggt

SEQ ID NO: 527108 - DNA, 20 bp, Artificial
  CRISPR gRNA sequence
ggggtttcgccatgttggtc

SEQ ID NO: 527109 - DNA, 20 bp, Artificial
  CRISPR gRNA sequence
tttcgccatgttggtcaggc

SEQ ID NO: 527110 - DNA, 20 bp, Artificial
  CRISPR gRNA sequence
tggtctcaaactcctgacct

SEQ ID NO: 527111 - DNA, 20 bp, Artificial
  CRISPR gRNA sequence
ggtctcaaactcctgacctc

SEQ ID NO: 527112 - DNA, 20 bp, Artificial
  CRISPR gRNA sequence
gtctcaaactcctgacctca

SEQ ID NO: 527113 - DNA, 20 bp, Artificial
  CRISPR gRNA sequence
tctcaaactcctgacctcag

SEQ ID NO: 527114 - DNA, 20 bp, Artificial
  CRISPR gRNA sequence
ctcaggggatccgcctgcat

SEQ ID NO: 527115 - DNA, 20 bp, Artificial
  CRISPR gRNA sequence
ccgcctgcatcggcctccca

SEQ ID NO: 527116 - DNA, 20 bp, Artificial
  CRISPR gRNA sequence
gcatcggcctcccaaagtgc

SEQ ID NO: 527117 - DNA, 20 bp, Artificial
  CRISPR gRNA sequence
catcggcctcccaaagtgct

SEQ ID NO: 527118 - DNA, 20 bp, Artificial
  CRISPR gRNA sequence
ctcccaaagtgctgggatta

SEQ ID NO: 527119 - DNA, 20 bp, Artificial
  CRISPR gRNA sequence
tcccaaagtgctgggattac

SEQ ID NO: 527120 - DNA, 20 bp, Artificial
  CRISPR gRNA sequence
acaggtgtgaaccacgcacc

SEQ ID NO: 527121 - DNA, 20 bp, Artificial
  CRISPR gRNA sequence
cctccaaacttctcaaactc

SEQ ID NO: 527122 - DNA, 20 bp, Artificial
  CRISPR gRNA sequence
ccaaacttctcaaactccag

SEQ ID NO: 527123 - DNA, 20 bp, Artificial
  CRISPR gRNA sequence
tgtgcctgcatttccttcat

SEQ ID NO: 527124 - DNA, 20 bp, Artificial
  CRISPR gRNA sequence
gtgcctgcatttccttcatg

SEQ ID NO: 527125 - DNA, 20 bp, Artificial
  CRISPR gRNA sequence
tgcctgcatttccttcatga

SEQ ID NO: 527126 - DNA, 20 bp, Artificial
  CRISPR gRNA sequence
cctgcatttccttcatgagg

SEQ ID NO: 527127 - DNA, 20 bp, Artificial
  CRISPR gRNA sequence
tcatgagggagttgctgctg

SEQ ID NO: 527128 - DNA, 20 bp, Artificial
  CRISPR gRNA sequence
catgagggagttgctgctgc

SEQ ID NO: 527129 - DNA, 20 bp, Artificial
  CRISPR gRNA sequence
ggagttgctgctgcaggctg

SEQ ID NO: 527130 - DNA, 20 bp, Artificial
  CRISPR gRNA sequence
agttgctgctgcaggctgaa

SEQ ID NO: 527131 - DNA, 20 bp, Artificial
  CRISPR gRNA sequence
gttgctgctgcaggctgaag

SEQ ID NO: 527132 - DNA, 20 bp, Artificial
  CRISPR gRNA sequence
gctgcaggctgaagaggcaa

SEQ ID NO: 527133 - DNA, 20 bp, Artificial
  CRISPR gRNA sequence
tgcaggctgaagaggcaatg

SEQ ID NO: 527134 - DNA, 20 bp, Artificial
  CRISPR gRNA sequence
gcaggctgaagaggcaatgg

SEQ ID NO: 527135 - DNA, 20 bp, Artificial
  CRISPR gRNA sequence
caggctgaagaggcaatgga

SEQ ID NO: 527136 - DNA, 20 bp, Artificial
  CRISPR gRNA sequence
agaggcaatggagggcccct

SEQ ID NO: 527137 - DNA, 20 bp, Artificial
  CRISPR gRNA sequence
ggcaatggagggccccttag

SEQ ID NO: 527138 - DNA, 20 bp, Artificial
  CRISPR gRNA sequence
aatggagggccccttagaag

SEQ ID NO: 527139 - DNA, 20 bp, Artificial
  CRISPR gRNA sequence
ggccccttagaagcagatgc

SEQ ID NO: 527140 - DNA, 20 bp, Artificial
  CRISPR gRNA sequence
cccttagaagcagatgctag

SEQ ID NO: 527141 - DNA, 20 bp, Artificial
  CRISPR gRNA sequence
ccttagaagcagatgctagt

SEQ ID NO: 527142 - DNA, 20 bp, Artificial
  CRISPR gRNA sequence
cttagaagcagatgctagta

SEQ ID NO: 527143 - DNA, 20 bp, Artificial
  CRISPR gRNA sequence
agaagcagatgctagtaggg

SEQ ID NO: 527144 - DNA, 20 bp, Artificial
  CRISPR gRNA sequence
gaagcagatgctagtaggga

SEQ ID NO: 527145 - DNA, 20 bp, Artificial
  CRISPR gRNA sequence
aagcagatgctagtagggaa

SEQ ID NO: 527146 - DNA, 20 bp, Artificial
  CRISPR gRNA sequence
agcagatgctagtagggaag

SEQ ID NO: 527147 - DNA, 20 bp, Artificial
  CRISPR gRNA sequence
agtagggaaggggttaatcc

SEQ ID NO: 527148 - DNA, 20 bp, Artificial
  CRISPR gRNA sequence
aggggttaatcccagcaact

SEQ ID NO: 527149 - DNA, 20 bp, Artificial
  CRISPR gRNA sequence
aatcccagcaactcagaatt

SEQ ID NO: 527150 - DNA, 20 bp, Artificial
  CRISPR gRNA sequence
atcccagcaactcagaatta

SEQ ID NO: 527151 - DNA, 20 bp, Artificial
  CRISPR gRNA sequence
cccagcaactcagaattaag

SEQ ID NO: 527152 - DNA, 20 bp, Artificial
  CRISPR gRNA sequence
aattaaggagttctcatcca

SEQ ID NO: 527153 - DNA, 20 bp, Artificial
  CRISPR gRNA sequence
taaggagttctcatccatgg

SEQ ID NO: 527154 - DNA, 20 bp, Artificial
  CRISPR gRNA sequence
aaggagttctcatccatgga

SEQ ID NO: 527155 - DNA, 20 bp, Artificial
  CRISPR gRNA sequence
ttctcatccatggaaggcct

SEQ ID NO: 527156 - DNA, 20 bp, Artificial
  CRISPR gRNA sequence
tctcatccatggaaggcctt

SEQ ID NO: 527157 - DNA, 20 bp, Artificial
  CRISPR gRNA sequence
atccatggaaggccttaggt

SEQ ID NO: 527158 - DNA, 20 bp, Artificial
  CRISPR gRNA sequence
tggaaggccttaggttggat

SEQ ID NO: 527159 - DNA, 20 bp, Artificial
  CRISPR gRNA sequence
ccttaggttggatcagttct

SEQ ID NO: 527160 - DNA, 20 bp, Artificial
  CRISPR gRNA sequence
tcagttctaagacgctatct

SEQ ID NO: 527161 - DNA, 20 bp, Artificial
  CRISPR gRNA sequence
gctatcttagtgaatgtata

SEQ ID NO: 527162 - DNA, 20 bp, Artificial
  CRISPR gRNA sequence
tatcttagtgaatgtatacg

SEQ ID NO: 527163 - DNA, 20 bp, Artificial
  CRISPR gRNA sequence
atcttagtgaatgtatacgg

SEQ ID NO: 527164 - DNA, 20 bp, Artificial
  CRISPR gRNA sequence
atacggaggtactactccac

SEQ ID NO: 527165 - DNA, 20 bp, Artificial
  CRISPR gRNA sequence
tacggaggtactactccaca

SEQ ID NO: 527166 - DNA, 20 bp, Artificial
  CRISPR gRNA sequence
acggaggtactactccacaa

SEQ ID NO: 527167 - DNA, 20 bp, Artificial
  CRISPR gRNA sequence
catcactgcattattcatgt

SEQ ID NO: 527168 - DNA, 20 bp, Artificial
  CRISPR gRNA sequence
tattcatgttagcgaaatac

SEQ ID NO: 527169 - DNA, 20 bp, Artificial
  CRISPR gRNA sequence
atgttagcgaaatactagaa

SEQ ID NO: 527170 - DNA, 20 bp, Artificial
  CRISPR gRNA sequence
tagcgaaatactagaacagt

SEQ ID NO: 527171 - DNA, 20 bp, Artificial
  CRISPR gRNA sequence
cgaaatactagaacagtcag

SEQ ID NO: 527172 - DNA, 20 bp, Artificial
  CRISPR gRNA sequence
atactagaacagtcagcagt

SEQ ID NO: 527173 - DNA, 20 bp, Artificial
  CRISPR gRNA sequence
gcagttagaaacttattaat

SEQ ID NO: 527174 - DNA, 20 bp, Artificial
  CRISPR gRNA sequence
acttattaatcagttaaatt

SEQ ID NO: 527175 - DNA, 20 bp, Artificial
  CRISPR gRNA sequence
ttaagaatgcatcctttaaa

SEQ ID NO: 527176 - DNA, 20 bp, Artificial
  CRISPR gRNA sequence
tgcatttattgatgttcatt

SEQ ID NO: 527177 - DNA, 20 bp, Artificial
  CRISPR gRNA sequence
ttattgatgttcattaagaa

SEQ ID NO: 527178 - DNA, 20 bp, Artificial
  CRISPR gRNA sequence
cataatataatttcacaata

SEQ ID NO: 527179 - DNA, 20 bp, Artificial
  CRISPR gRNA sequence
ataatataatttcacaataa

SEQ ID NO: 527180 - DNA, 20 bp, Artificial
  CRISPR gRNA sequence
taatataatttcacaataaa

SEQ ID NO: 527181 - DNA, 20 bp, Artificial
  CRISPR gRNA sequence
aatataatttcacaataaag

SEQ ID NO: 527182 - DNA, 20 bp, Artificial
  CRISPR gRNA sequence
aatttcacaataaaggggaa

SEQ ID NO: 527183 - DNA, 20 bp, Artificial
  CRISPR gRNA sequence
atttcacaataaaggggaaa

SEQ ID NO: 527184 - DNA, 20 bp, Artificial
  CRISPR gRNA sequence
tcacaataaaggggaaaagg

SEQ ID NO: 527185 - DNA, 20 bp, Artificial
  CRISPR gRNA sequence
aaggggaaaaggcagactgt

SEQ ID NO: 527186 - DNA, 20 bp, Artificial
  CRISPR gRNA sequence
gactgtaagatcacataaat

SEQ ID NO: 527187 - DNA, 20 bp, Artificial
  CRISPR gRNA sequence
aaatattacatatatatata

SEQ ID NO: 527188 - DNA, 20 bp, Artificial
  CRISPR gRNA sequence
atattacatatatatatata

SEQ ID NO: 527189 - DNA, 20 bp, Artificial
  CRISPR gRNA sequence
attacatatatatatataga

SEQ ID NO: 527190 - DNA, 20 bp, Artificial
  CRISPR gRNA sequence
tacatatatatatatagaga

SEQ ID NO: 527191 - DNA, 20 bp, Artificial
  CRISPR gRNA sequence
catatatatatatagagaga

SEQ ID NO: 527192 - DNA, 20 bp, Artificial
  CRISPR gRNA sequence
tatatatatatagagagaga

SEQ ID NO: 527193 - DNA, 20 bp, Artificial
  CRISPR gRNA sequence
tatatatatagagagagaga

SEQ ID NO: 527194 - DNA, 20 bp, Artificial
  CRISPR gRNA sequence
tatatatagagagagagaga

SEQ ID NO: 527195 - DNA, 20 bp, Artificial
  CRISPR gRNA sequence
tatatagagagagagagaga

SEQ ID NO: 527196 - DNA, 20 bp, Artificial
  CRISPR gRNA sequence
tatagagagagagagagaga

SEQ ID NO: 527197 - DNA, 20 bp, Artificial
  CRISPR gRNA sequence
tagagagagagagagagaga

SEQ ID NO: 527198 - DNA, 20 bp, Artificial
  CRISPR gRNA sequence
gagagagagagagagagaga

SEQ ID NO: 527199 - DNA, 20 bp, Artificial
  CRISPR gRNA sequence
agagagagagagagagagag

SEQ ID NO: 527200 - DNA, 20 bp, Artificial
  CRISPR gRNA sequence
gagagagagagagagagagg

SEQ ID NO: 527201 - DNA, 20 bp, Artificial
  CRISPR gRNA sequence
gagagagagagagaggcaga

SEQ ID NO: 527202 - DNA, 20 bp, Artificial
  CRISPR gRNA sequence
gagagagagaggcagacaga

SEQ ID NO: 527203 - DNA, 20 bp, Artificial
  CRISPR gRNA sequence
gagagagaggcagacagaaa

SEQ ID NO: 527204 - DNA, 20 bp, Artificial
  CRISPR gRNA sequence
gagaggcagacagaaagaga

SEQ ID NO: 527205 - DNA, 20 bp, Artificial
  CRISPR gRNA sequence
agaggcagacagaaagagac

SEQ ID NO: 527206 - DNA, 20 bp, Artificial
  CRISPR gRNA sequence
gaggcagacagaaagagaca

SEQ ID NO: 527207 - DNA, 20 bp, Artificial
  CRISPR gRNA sequence
cagggtctcactctgtcgtc

SEQ ID NO: 527208 - DNA, 20 bp, Artificial
  CRISPR gRNA sequence
tctcactctgtcgtccagcc

SEQ ID NO: 527209 - DNA, 20 bp, Artificial
  CRISPR gRNA sequence
tcactctgtcgtccagcctg

SEQ ID NO: 527210 - DNA, 20 bp, Artificial
  CRISPR gRNA sequence
ctgtcgtccagcctggagtg

SEQ ID NO: 527211 - DNA, 20 bp, Artificial
  CRISPR gRNA sequence
tcgtccagcctggagtgcag

SEQ ID NO: 527212 - DNA, 20 bp, Artificial
  CRISPR gRNA sequence
ggagtgcagtggtgaaatat

SEQ ID NO: 527213 - DNA, 20 bp, Artificial
  CRISPR gRNA sequence
ggtgaaatattggctcactg

SEQ ID NO: 527214 - DNA, 20 bp, Artificial
  CRISPR gRNA sequence
tcactgcagcctctgcctct

SEQ ID NO: 527215 - DNA, 20 bp, Artificial
  CRISPR gRNA sequence
cactgcagcctctgcctctt

SEQ ID NO: 527216 - DNA, 20 bp, Artificial
  CRISPR gRNA sequence
agcctctgcctcttgggttc

SEQ ID NO: 527217 - DNA, 20 bp, Artificial
  CRISPR gRNA sequence
ttcaagcaattctcatgcct

SEQ ID NO: 527218 - DNA, 20 bp, Artificial
  CRISPR gRNA sequence
ttctcatgcctcagcctcct

SEQ ID NO: 527219 - DNA, 20 bp, Artificial
  CRISPR gRNA sequence
tcatgcctcagcctcctgag

SEQ ID NO: 527220 - DNA, 20 bp, Artificial
  CRISPR gRNA sequence
cctcagcctcctgagtagtt

SEQ ID NO: 527221 - DNA, 20 bp, Artificial
  CRISPR gRNA sequence
gcctcctgagtagtttggat

SEQ ID NO: 527222 - DNA, 20 bp, Artificial
  CRISPR gRNA sequence
ctcctgagtagtttggatta

SEQ ID NO: 527223 - DNA, 20 bp, Artificial
  CRISPR gRNA sequence
tcctgagtagtttggattag

SEQ ID NO: 527224 - DNA, 20 bp, Artificial
  CRISPR gRNA sequence
gaggcgcatgccaacacacc

SEQ ID NO: 527225 - DNA, 20 bp, Artificial
  CRISPR gRNA sequence
ctggctaatcttcatatttt

SEQ ID NO: 527226 - DNA, 20 bp, Artificial
  CRISPR gRNA sequence
gctaatcttcatatttttag

SEQ ID NO: 527227 - DNA, 20 bp, Artificial
  CRISPR gRNA sequence
taatcttcatatttttagta

SEQ ID NO: 527228 - DNA, 20 bp, Artificial
  CRISPR gRNA sequence
agagatgtatttcaccatgt

SEQ ID NO: 527229 - DNA, 20 bp, Artificial
  CRISPR gRNA sequence
atgtatttcaccatgttggc

SEQ ID NO: 527230 - DNA, 20 bp, Artificial
  CRISPR gRNA sequence
tgtatttcaccatgttggcc

SEQ ID NO: 527231 - DNA, 20 bp, Artificial
  CRISPR gRNA sequence
ccaggctactcttgaactcc

SEQ ID NO: 527232 - DNA, 20 bp, Artificial
  CRISPR gRNA sequence
actcttgaactcctggcctc

SEQ ID NO: 527233 - DNA, 20 bp, Artificial
  CRISPR gRNA sequence
tcttgaactcctggcctcaa

SEQ ID NO: 527234 - DNA, 20 bp, Artificial
  CRISPR gRNA sequence
ctcaagagatccgcccacct

SEQ ID NO: 527235 - DNA, 20 bp, Artificial
  CRISPR gRNA sequence
ccgcccaccttagcctccca

SEQ ID NO: 527236 - DNA, 20 bp, Artificial
  CRISPR gRNA sequence
accttagcctcccaaagtgc

SEQ ID NO: 527237 - DNA, 20 bp, Artificial
  CRISPR gRNA sequence
cctcccaaagtgctggatta

SEQ ID NO: 527238 - DNA, 20 bp, Artificial
  CRISPR gRNA sequence
ctcccaaagtgctggattac

SEQ ID NO: 527239 - DNA, 20 bp, Artificial
  CRISPR gRNA sequence
aagtgctggattacaggcat

SEQ ID NO: 527240 - DNA, 20 bp, Artificial
  CRISPR gRNA sequence
caggcatgagccacctctcc

SEQ ID NO: 527241 - DNA, 20 bp, Artificial
  CRISPR gRNA sequence
tttatatatatacatataaa

SEQ ID NO: 527242 - DNA, 20 bp, Artificial
  CRISPR gRNA sequence
taaatagaaaatatctgcta

SEQ ID NO: 527243 - DNA, 20 bp, Artificial
  CRISPR gRNA sequence
tattattcattattgacttt

SEQ ID NO: 527244 - DNA, 20 bp, Artificial
  CRISPR gRNA sequence
tattcattattgactttgag

SEQ ID NO: 527245 - DNA, 20 bp, Artificial
  CRISPR gRNA sequence
tcattattgactttgagtgg

SEQ ID NO: 527246 - DNA, 20 bp, Artificial
  CRISPR gRNA sequence
gactttgagtggtggcgttg

SEQ ID NO: 527247 - DNA, 20 bp, Artificial
  CRISPR gRNA sequence
actttgagtggtggcgttgt

SEQ ID NO: 527248 - DNA, 20 bp, Artificial
  CRISPR gRNA sequence
aacttttaaaaatattttat

SEQ ID NO: 527249 - DNA, 20 bp, Artificial
  CRISPR gRNA sequence
ttatcagcttgtacaatgat

SEQ ID NO: 527250 - DNA, 20 bp, Artificial
  CRISPR gRNA sequence
atcagcttgtacaatgattg

SEQ ID NO: 527251 - DNA, 20 bp, Artificial
  CRISPR gRNA sequence
tgtacaatgattggagttga

SEQ ID NO: 527252 - DNA, 20 bp, Artificial
  CRISPR gRNA sequence
tgattggagttgaaagccca

SEQ ID NO: 527253 - DNA, 20 bp, Artificial
  CRISPR gRNA sequence
agttgaaagcccacggatgc

SEQ ID NO: 527254 - DNA, 20 bp, Artificial
  CRISPR gRNA sequence
gttgaaagcccacggatgct

SEQ ID NO: 527255 - DNA, 20 bp, Artificial
  CRISPR gRNA sequence
gaaagcccacggatgctggg

SEQ ID NO: 527256 - DNA, 20 bp, Artificial
  CRISPR gRNA sequence
aaagcccacggatgctgggc

SEQ ID NO: 527257 - DNA, 20 bp, Artificial
  CRISPR gRNA sequence
aagcccacggatgctgggca

SEQ ID NO: 527258 - DNA, 20 bp, Artificial
  CRISPR gRNA sequence
gcccacggatgctgggcagg

SEQ ID NO: 527259 - DNA, 20 bp, Artificial
  CRISPR gRNA sequence
gatgctgggcagggagtgat

SEQ ID NO: 527260 - DNA, 20 bp, Artificial
  CRISPR gRNA sequence
gctgggcagggagtgataag

SEQ ID NO: 527261 - DNA, 20 bp, Artificial
  CRISPR gRNA sequence
ctgggcagggagtgataaga

SEQ ID NO: 527262 - DNA, 20 bp, Artificial
  CRISPR gRNA sequence
tgggcagggagtgataagaa

SEQ ID NO: 527263 - DNA, 20 bp, Artificial
  CRISPR gRNA sequence
agggagtgataagaagggaa

SEQ ID NO: 527264 - DNA, 20 bp, Artificial
  CRISPR gRNA sequence
ggagtgataagaagggaaaa

SEQ ID NO: 527265 - DNA, 20 bp, Artificial
  CRISPR gRNA sequence
gagtgataagaagggaaaag

SEQ ID NO: 527266 - DNA, 20 bp, Artificial
  CRISPR gRNA sequence
tgataagaagggaaaagagg

SEQ ID NO: 527267 - DNA, 20 bp, Artificial
  CRISPR gRNA sequence
aagaagggaaaagaggaagc

SEQ ID NO: 527268 - DNA, 20 bp, Artificial
  CRISPR gRNA sequence
gggaaaagaggaagctggct

SEQ ID NO: 527269 - DNA, 20 bp, Artificial
  CRISPR gRNA sequence
ggaaaagaggaagctggctt

SEQ ID NO: 527270 - DNA, 20 bp, Artificial
  CRISPR gRNA sequence
gaaaagaggaagctggcttg

SEQ ID NO: 527271 - DNA, 20 bp, Artificial
  CRISPR gRNA sequence
aaagaggaagctggcttggg

SEQ ID NO: 527272 - DNA, 20 bp, Artificial
  CRISPR gRNA sequence
aagaggaagctggcttgggg

SEQ ID NO: 527273 - DNA, 20 bp, Artificial
  CRISPR gRNA sequence
aggaagctggcttggggagg

SEQ ID NO: 527274 - DNA, 20 bp, Artificial
  CRISPR gRNA sequence
agctggcttggggaggaaga

SEQ ID NO: 527275 - DNA, 20 bp, Artificial
  CRISPR gRNA sequence
gctggcttggggaggaagac

SEQ ID NO: 527276 - DNA, 20 bp, Artificial
  CRISPR gRNA sequence
ggggaggaagacaggaaccc

SEQ ID NO: 527277 - DNA, 20 bp, Artificial
  CRISPR gRNA sequence
gaagacaggaaccccagcat

SEQ ID NO: 527278 - DNA, 20 bp, Artificial
  CRISPR gRNA sequence
caggaaccccagcatgagca

SEQ ID NO: 527279 - DNA, 20 bp, Artificial
  CRISPR gRNA sequence
aggaaccccagcatgagcac

SEQ ID NO: 527280 - DNA, 20 bp, Artificial
  CRISPR gRNA sequence
accccagcatgagcacaggc

SEQ ID NO: 527281 - DNA, 20 bp, Artificial
  CRISPR gRNA sequence
atgagcacaggccagccatt

SEQ ID NO: 527282 - DNA, 20 bp, Artificial
  CRISPR gRNA sequence
gcacaggccagccattcagt

SEQ ID NO: 527283 - DNA, 20 bp, Artificial
  CRISPR gRNA sequence
cagccattcagtgagcaaat

SEQ ID NO: 527284 - DNA, 20 bp, Artificial
  CRISPR gRNA sequence
aagcatttctgtgcttcaca

SEQ ID NO: 527285 - DNA, 20 bp, Artificial
  CRISPR gRNA sequence
cttcacacagaaaatgtcgc

SEQ ID NO: 527286 - DNA, 20 bp, Artificial
  CRISPR gRNA sequence
cacacagaaaatgtcgccag

SEQ ID NO: 527287 - DNA, 20 bp, Artificial
  CRISPR gRNA sequence
acagaaaatgtcgccagaag

SEQ ID NO: 527288 - DNA, 20 bp, Artificial
  CRISPR gRNA sequence
cagaaaatgtcgccagaagc

SEQ ID NO: 527289 - DNA, 20 bp, Artificial
  CRISPR gRNA sequence
agaaaatgtcgccagaagca

SEQ ID NO: 527290 - DNA, 20 bp, Artificial
  CRISPR gRNA sequence
accttcttcctctctgtctc

SEQ ID NO: 527291 - DNA, 20 bp, Artificial
  CRISPR gRNA sequence
tctgtctccagccccatctt

SEQ ID NO: 527292 - DNA, 20 bp, Artificial
  CRISPR gRNA sequence
ccagccccatcttcagcacc

SEQ ID NO: 527293 - DNA, 20 bp, Artificial
  CRISPR gRNA sequence
cagccccatcttcagcacct

SEQ ID NO: 527294 - DNA, 20 bp, Artificial
  CRISPR gRNA sequence
tcttcagcacctgggcctac

SEQ ID NO: 527295 - DNA, 20 bp, Artificial
  CRISPR gRNA sequence
cctgggcctaccagcaatcc

SEQ ID NO: 527296 - DNA, 20 bp, Artificial
  CRISPR gRNA sequence
ggcctaccagcaatcccaga

SEQ ID NO: 527297 - DNA, 20 bp, Artificial
  CRISPR gRNA sequence
ccagcaatcccagatagtgt

SEQ ID NO: 527298 - DNA, 20 bp, Artificial
  CRISPR gRNA sequence
tagtgtcagattgcccactc

SEQ ID NO: 527299 - DNA, 20 bp, Artificial
  CRISPR gRNA sequence
attgcccactccagcaatcc

SEQ ID NO: 527300 - DNA, 20 bp, Artificial
  CRISPR gRNA sequence
ccagcaatcccagacactgt

SEQ ID NO: 527301 - DNA, 20 bp, Artificial
  CRISPR gRNA sequence
agacactgtcagctcccctg

SEQ ID NO: 527302 - DNA, 20 bp, Artificial
  CRISPR gRNA sequence
agtgacaactttccacaccc

SEQ ID NO: 527303 - DNA, 20 bp, Artificial
  CRISPR gRNA sequence
caccctagtcctgcaacctt

SEQ ID NO: 527304 - DNA, 20 bp, Artificial
  CRISPR gRNA sequence
cctagtcctgcaaccttgag

SEQ ID NO: 527305 - DNA, 20 bp, Artificial
  CRISPR gRNA sequence
tagtcctgcaaccttgagtg

SEQ ID NO: 527306 - DNA, 20 bp, Artificial
  CRISPR gRNA sequence
gtcctgcaaccttgagtgga

SEQ ID NO: 527307 - DNA, 20 bp, Artificial
  CRISPR gRNA sequence
cttgagtggagagcaccttg

SEQ ID NO: 527308 - DNA, 20 bp, Artificial
  CRISPR gRNA sequence
gagagcaccttgtagaaatg

SEQ ID NO: 527309 - DNA, 20 bp, Artificial
  CRISPR gRNA sequence
agcaccttgtagaaatgtag

SEQ ID NO: 527310 - DNA, 20 bp, Artificial
  CRISPR gRNA sequence
gcaccttgtagaaatgtagt

SEQ ID NO: 527311 - DNA, 20 bp, Artificial
  CRISPR gRNA sequence
caccttgtagaaatgtagtg

SEQ ID NO: 527312 - DNA, 20 bp, Artificial
  CRISPR gRNA sequence
tgtagaaatgtagtggggtt

SEQ ID NO: 527313 - DNA, 20 bp, Artificial
  CRISPR gRNA sequence
aaatgtagtggggttgagca

SEQ ID NO: 527314 - DNA, 20 bp, Artificial
  CRISPR gRNA sequence
gggttgagcatggcgctgaa

SEQ ID NO: 527315 - DNA, 20 bp, Artificial
  CRISPR gRNA sequence
gttgagcatggcgctgaaaa

SEQ ID NO: 527316 - DNA, 20 bp, Artificial
  CRISPR gRNA sequence
ctgaaaagagcctctgatta

SEQ ID NO: 527317 - DNA, 20 bp, Artificial
  CRISPR gRNA sequence
tgaaaagagcctctgattat

SEQ ID NO: 527318 - DNA, 20 bp, Artificial
  CRISPR gRNA sequence
gagcctctgattatgggctc

SEQ ID NO: 527319 - DNA, 20 bp, Artificial
  CRISPR gRNA sequence
attatgggctctggaaacca

SEQ ID NO: 527320 - DNA, 20 bp, Artificial
  CRISPR gRNA sequence
gctctggaaaccacagatct

SEQ ID NO: 527321 - DNA, 20 bp, Artificial
  CRISPR gRNA sequence
ctctggaaaccacagatctc

SEQ ID NO: 527322 - DNA, 20 bp, Artificial
  CRISPR gRNA sequence
acagatctcaggactccaaa

SEQ ID NO: 527323 - DNA, 20 bp, Artificial
  CRISPR gRNA sequence
tctcaggactccaaacagca

SEQ ID NO: 527324 - DNA, 20 bp, Artificial
  CRISPR gRNA sequence
ctccaaacagcacagaactc

SEQ ID NO: 527325 - DNA, 20 bp, Artificial
  CRISPR gRNA sequence
gaactcgagtgtcctgtttt

SEQ ID NO: 527326 - DNA, 20 bp, Artificial
  CRISPR gRNA sequence
gagtgtcctgttttgagtgt

SEQ ID NO: 527327 - DNA, 20 bp, Artificial
  CRISPR gRNA sequence
ttttgagtgtgagccctaca

SEQ ID NO: 527328 - DNA, 20 bp, Artificial
  CRISPR gRNA sequence
tttgagtgtgagccctacat

SEQ ID NO: 527329 - DNA, 20 bp, Artificial
  CRISPR gRNA sequence
ttgagtgtgagccctacatg

SEQ ID NO: 527330 - DNA, 20 bp, Artificial
  CRISPR gRNA sequence
tgagtgtgagccctacatgg

SEQ ID NO: 527331 - DNA, 20 bp, Artificial
  CRISPR gRNA sequence
ccctacatgggggaccatgt

SEQ ID NO: 527332 - DNA, 20 bp, Artificial
  CRISPR gRNA sequence
catgttggtgttttcacatt

SEQ ID NO: 527333 - DNA, 20 bp, Artificial
  CRISPR gRNA sequence
atgttggtgttttcacattt

SEQ ID NO: 527334 - DNA, 20 bp, Artificial
  CRISPR gRNA sequence
tttcacatttgggtcacatt

SEQ ID NO: 527335 - DNA, 20 bp, Artificial
  CRISPR gRNA sequence
ttgggtcacatttagcattg

SEQ ID NO: 527336 - DNA, 20 bp, Artificial
  CRISPR gRNA sequence
ggtcacatttagcattgcgg

SEQ ID NO: 527337 - DNA, 20 bp, Artificial
  CRISPR gRNA sequence
tagcattgcggcggaaataa

SEQ ID NO: 527338 - DNA, 20 bp, Artificial
  CRISPR gRNA sequence
gcggcggaaataatggctac

SEQ ID NO: 527339 - DNA, 20 bp, Artificial
  CRISPR gRNA sequence
cggaaataatggctaccagt

SEQ ID NO: 527340 - DNA, 20 bp, Artificial
  CRISPR gRNA sequence
ggaaataatggctaccagtt

SEQ ID NO: 527341 - DNA, 20 bp, Artificial
  CRISPR gRNA sequence
gaaataatggctaccagtta

SEQ ID NO: 527342 - DNA, 20 bp, Artificial
  CRISPR gRNA sequence
aaataatggctaccagttag

SEQ ID NO: 527343 - DNA, 20 bp, Artificial
  CRISPR gRNA sequence
atggctaccagttaggggtc

SEQ ID NO: 527344 - DNA, 20 bp, Artificial
  CRISPR gRNA sequence
tgcttacatgatcttattta

SEQ ID NO: 527345 - DNA, 20 bp, Artificial
  CRISPR gRNA sequence
ttaaagcgcccaacaatact

SEQ ID NO: 527346 - DNA, 20 bp, Artificial
  CRISPR gRNA sequence
cgcccaacaatactgagacc

SEQ ID NO: 527347 - DNA, 20 bp, Artificial
  CRISPR gRNA sequence
attatctccttgttatatat

SEQ ID NO: 527348 - DNA, 20 bp, Artificial
  CRISPR gRNA sequence
ccttgttatatataagaaaa

SEQ ID NO: 527349 - DNA, 20 bp, Artificial
  CRISPR gRNA sequence
ttgttatatataagaaaaca

SEQ ID NO: 527350 - DNA, 20 bp, Artificial
  CRISPR gRNA sequence
tatataagaaaacagagacc

SEQ ID NO: 527351 - DNA, 20 bp, Artificial
  CRISPR gRNA sequence
taagaaaacagagacctagt

SEQ ID NO: 527352 - DNA, 20 bp, Artificial
  CRISPR gRNA sequence
gaaaacagagacctagtcag

SEQ ID NO: 527353 - DNA, 20 bp, Artificial
  CRISPR gRNA sequence
aacagagacctagtcagaag

SEQ ID NO: 527354 - DNA, 20 bp, Artificial
  CRISPR gRNA sequence
tagtcagaagcagcttgtcc

SEQ ID NO: 527355 - DNA, 20 bp, Artificial
  CRISPR gRNA sequence
agtcagaagcagcttgtcca

SEQ ID NO: 527356 - DNA, 20 bp, Artificial
  CRISPR gRNA sequence
tccaaggtctcattgcttga

SEQ ID NO: 527357 - DNA, 20 bp, Artificial
  CRISPR gRNA sequence
ccaaggtctcattgcttgac

SEQ ID NO: 527358 - DNA, 20 bp, Artificial
  CRISPR gRNA sequence
aaggtctcattgcttgacag

SEQ ID NO: 527359 - DNA, 20 bp, Artificial
  CRISPR gRNA sequence
ctcattgcttgacaggagca

SEQ ID NO: 527360 - DNA, 20 bp, Artificial
  CRISPR gRNA sequence
ttgcttgacaggagcaaagt

SEQ ID NO: 527361 - DNA, 20 bp, Artificial
  CRISPR gRNA sequence
tgcttgacaggagcaaagtc

SEQ ID NO: 527362 - DNA, 20 bp, Artificial
  CRISPR gRNA sequence
gcaaagtcaggattcaaact

SEQ ID NO: 527363 - DNA, 20 bp, Artificial
  CRISPR gRNA sequence
aaagtcaggattcaaactca

SEQ ID NO: 527364 - DNA, 20 bp, Artificial
  CRISPR gRNA sequence
aagtcaggattcaaactcag

SEQ ID NO: 527365 - DNA, 20 bp, Artificial
  CRISPR gRNA sequence
ttcaaactcagaggtctttt

SEQ ID NO: 527366 - DNA, 20 bp, Artificial
  CRISPR gRNA sequence
aactcagaggtctttttggc

SEQ ID NO: 527367 - DNA, 20 bp, Artificial
  CRISPR gRNA sequence
actcagaggtctttttggca

SEQ ID NO: 527368 - DNA, 20 bp, Artificial
  CRISPR gRNA sequence
ccttttcttttttttctaaa

SEQ ID NO: 527369 - DNA, 20 bp, Artificial
  CRISPR gRNA sequence
tttttctaaacagcttcatt

SEQ ID NO: 527370 - DNA, 20 bp, Artificial
  CRISPR gRNA sequence
aatttgtccatacactaaaa

SEQ ID NO: 527371 - DNA, 20 bp, Artificial
  CRISPR gRNA sequence
ccatacactaaaacggcctt

SEQ ID NO: 527372 - DNA, 20 bp, Artificial
  CRISPR gRNA sequence
aaaacggcctttagtatatt

SEQ ID NO: 527373 - DNA, 20 bp, Artificial
  CRISPR gRNA sequence
aacggcctttagtatattca

SEQ ID NO: 527374 - DNA, 20 bp, Artificial
  CRISPR gRNA sequence
tgttactgtgttgctgttat

SEQ ID NO: 527375 - DNA, 20 bp, Artificial
  CRISPR gRNA sequence
tactgtgttgctgttataag

SEQ ID NO: 527376 - DNA, 20 bp, Artificial
  CRISPR gRNA sequence
aaaaaaatatttccattctg

SEQ ID NO: 527377 - DNA, 20 bp, Artificial
  CRISPR gRNA sequence
aaaaatatttccattctgaa

SEQ ID NO: 527378 - DNA, 20 bp, Artificial
  CRISPR gRNA sequence
atatttccattctgaagaga

SEQ ID NO: 527379 - DNA, 20 bp, Artificial
  CRISPR gRNA sequence
tatttccattctgaagagac

SEQ ID NO: 527380 - DNA, 20 bp, Artificial
  CRISPR gRNA sequence
aaacttcgtgacccaacctc

SEQ ID NO: 527381 - DNA, 20 bp, Artificial
  CRISPR gRNA sequence
atttccattttcttccttct

SEQ ID NO: 527382 - DNA, 20 bp, Artificial
  CRISPR gRNA sequence
tttcttccttctcagtaacg

SEQ ID NO: 527383 - DNA, 20 bp, Artificial
  CRISPR gRNA sequence
ttctcagtaacgcagaatct

SEQ ID NO: 527384 - DNA, 20 bp, Artificial
  CRISPR gRNA sequence
tctcagtaacgcagaatctt

SEQ ID NO: 527385 - DNA, 20 bp, Artificial
  CRISPR gRNA sequence
gtaacgcagaatcttgggat

SEQ ID NO: 527386 - DNA, 20 bp, Artificial
  CRISPR gRNA sequence
acgcagaatcttgggatgag

SEQ ID NO: 527387 - DNA, 20 bp, Artificial
  CRISPR gRNA sequence
ttctgcatgcctatatatat

SEQ ID NO: 527388 - DNA, 20 bp, Artificial
  CRISPR gRNA sequence
tctgcatgcctatatatatc

SEQ ID NO: 527389 - DNA, 20 bp, Artificial
  CRISPR gRNA sequence
tatatatcgggacataaatg

SEQ ID NO: 527390 - DNA, 20 bp, Artificial
  CRISPR gRNA sequence
acataaatgaagtttgacta

SEQ ID NO: 527391 - DNA, 20 bp, Artificial
  CRISPR gRNA sequence
agtttgactatggtgttcca

SEQ ID NO: 527392 - DNA, 20 bp, Artificial
  CRISPR gRNA sequence
gtttgactatggtgttccat

SEQ ID NO: 527393 - DNA, 20 bp, Artificial
  CRISPR gRNA sequence
tttgactatggtgttccatg

SEQ ID NO: 527394 - DNA, 20 bp, Artificial
  CRISPR gRNA sequence
gtgttccatggggaaaatat

SEQ ID NO: 527395 - DNA, 20 bp, Artificial
  CRISPR gRNA sequence
atggggaaaatattggtgtc

SEQ ID NO: 527396 - DNA, 20 bp, Artificial
  CRISPR gRNA sequence
gggaaaatattggtgtctgg

SEQ ID NO: 527397 - DNA, 20 bp, Artificial
  CRISPR gRNA sequence
aaatattggtgtctggaagt

SEQ ID NO: 527398 - DNA, 20 bp, Artificial
  CRISPR gRNA sequence
atattggtgtctggaagtca

SEQ ID NO: 527399 - DNA, 20 bp, Artificial
  CRISPR gRNA sequence
ttggtgtctggaagtcagag

SEQ ID NO: 527400 - DNA, 20 bp, Artificial
  CRISPR gRNA sequence
tggtgtctggaagtcagagt

SEQ ID NO: 527401 - DNA, 20 bp, Artificial
  CRISPR gRNA sequence
gtgtctggaagtcagagtgg

SEQ ID NO: 527402 - DNA, 20 bp, Artificial
  CRISPR gRNA sequence
tgtctggaagtcagagtggg

SEQ ID NO: 527403 - DNA, 20 bp, Artificial
  CRISPR gRNA sequence
gtctggaagtcagagtggga

SEQ ID NO: 527404 - DNA, 20 bp, Artificial
  CRISPR gRNA sequence
ggagggaatcattgaaaaat

SEQ ID NO: 527405 - DNA, 20 bp, Artificial
  CRISPR gRNA sequence
ggaatcattgaaaaataagc

SEQ ID NO: 527406 - DNA, 20 bp, Artificial
  CRISPR gRNA sequence
tagtccatctatattatgaa

SEQ ID NO: 527407 - DNA, 20 bp, Artificial
  CRISPR gRNA sequence
gtccatctatattatgaatg

SEQ ID NO: 527408 - DNA, 20 bp, Artificial
  CRISPR gRNA sequence
ccatctatattatgaatgga

SEQ ID NO: 527409 - DNA, 20 bp, Artificial
  CRISPR gRNA sequence
attatgaatggagagaaact

SEQ ID NO: 527410 - DNA, 20 bp, Artificial
  CRISPR gRNA sequence
tatgaatggagagaaactga

SEQ ID NO: 527411 - DNA, 20 bp, Artificial
  CRISPR gRNA sequence
atgaatggagagaaactgag

SEQ ID NO: 527412 - DNA, 20 bp, Artificial
  CRISPR gRNA sequence
tgaatggagagaaactgaga

SEQ ID NO: 527413 - DNA, 20 bp, Artificial
  CRISPR gRNA sequence
ggagagaaactgagagggaa

SEQ ID NO: 527414 - DNA, 20 bp, Artificial
  CRISPR gRNA sequence
gagaaactgagagggaaaag

SEQ ID NO: 527415 - DNA, 20 bp, Artificial
  CRISPR gRNA sequence
aactgagagggaaaagtggc

SEQ ID NO: 527416 - DNA, 20 bp, Artificial
  CRISPR gRNA sequence
agagggaaaagtggcaagtc

SEQ ID NO: 527417 - DNA, 20 bp, Artificial
  CRISPR gRNA sequence
gagggaaaagtggcaagtct

SEQ ID NO: 527418 - DNA, 20 bp, Artificial
  CRISPR gRNA sequence
agggaaaagtggcaagtctg

SEQ ID NO: 527419 - DNA, 20 bp, Artificial
  CRISPR gRNA sequence
gggaaaagtggcaagtctgg

SEQ ID NO: 527420 - DNA, 20 bp, Artificial
  CRISPR gRNA sequence
ggaaaagtggcaagtctggg

SEQ ID NO: 527421 - DNA, 20 bp, Artificial
  CRISPR gRNA sequence
tggcaagtctggggggaaca

SEQ ID NO: 527422 - DNA, 20 bp, Artificial
  CRISPR gRNA sequence
agtctggggggaacaaagta

SEQ ID NO: 527423 - DNA, 20 bp, Artificial
  CRISPR gRNA sequence
gggggaacaaagtaaagaat

SEQ ID NO: 527424 - DNA, 20 bp, Artificial
  CRISPR gRNA sequence
agaatgagaaaaaaaaaaaa

SEQ ID NO: 527425 - DNA, 20 bp, Artificial
  CRISPR gRNA sequence
atgagaaaaaaaaaaaacag

SEQ ID NO: 527426 - DNA, 20 bp, Artificial
  CRISPR gRNA sequence
aaaaaaaaaaaacagaagac

SEQ ID NO: 527427 - DNA, 20 bp, Artificial
  CRISPR gRNA sequence
aaaaaaaaaaacagaagacg

SEQ ID NO: 527428 - DNA, 20 bp, Artificial
  CRISPR gRNA sequence
aaaaaacagaagacgaggaa

SEQ ID NO: 527429 - DNA, 20 bp, Artificial
  CRISPR gRNA sequence
aaaaacagaagacgaggaaa

SEQ ID NO: 527430 - DNA, 20 bp, Artificial
  CRISPR gRNA sequence
cagaagacgaggaaaaggaa

SEQ ID NO: 527431 - DNA, 20 bp, Artificial
  CRISPR gRNA sequence
aggaaaaggaaaagttcaca

SEQ ID NO: 527432 - DNA, 20 bp, Artificial
  CRISPR gRNA sequence
aaaggaaaagttcacacagc

SEQ ID NO: 527433 - DNA, 20 bp, Artificial
  CRISPR gRNA sequence
aaggaaaagttcacacagct

SEQ ID NO: 527434 - DNA, 20 bp, Artificial
  CRISPR gRNA sequence
gaaaagttcacacagctagg

SEQ ID NO: 527435 - DNA, 20 bp, Artificial
  CRISPR gRNA sequence
ttcacacagctaggaagtga

SEQ ID NO: 527436 - DNA, 20 bp, Artificial
  CRISPR gRNA sequence
tcacacagctaggaagtgat

SEQ ID NO: 527437 - DNA, 20 bp, Artificial
  CRISPR gRNA sequence
cacacagctaggaagtgatg

SEQ ID NO: 527438 - DNA, 20 bp, Artificial
  CRISPR gRNA sequence
agctaggaagtgatggggct

SEQ ID NO: 527439 - DNA, 20 bp, Artificial
  CRISPR gRNA sequence
gaagtgatggggctaagatg

SEQ ID NO: 527440 - DNA, 20 bp, Artificial
  CRISPR gRNA sequence
tggggctaagatgtagacct

SEQ ID NO: 527441 - DNA, 20 bp, Artificial
  CRISPR gRNA sequence
agacctgagccatctaatgc

SEQ ID NO: 527442 - DNA, 20 bp, Artificial
  CRISPR gRNA sequence
gacctgagccatctaatgct

SEQ ID NO: 527443 - DNA, 20 bp, Artificial
  CRISPR gRNA sequence
gagccatctaatgctaggcc

SEQ ID NO: 527444 - DNA, 20 bp, Artificial
  CRISPR gRNA sequence
agccatctaatgctaggcct

SEQ ID NO: 527445 - DNA, 20 bp, Artificial
  CRISPR gRNA sequence
gcctaggcattttccttttg

SEQ ID NO: 527446 - DNA, 20 bp, Artificial
  CRISPR gRNA sequence
tttgtggtgcaatctctgtg

SEQ ID NO: 527447 - DNA, 20 bp, Artificial
  CRISPR gRNA sequence
ttgtggtgcaatctctgtgc

SEQ ID NO: 527448 - DNA, 20 bp, Artificial
  CRISPR gRNA sequence
gtggtgcaatctctgtgcgg

SEQ ID NO: 527449 - DNA, 20 bp, Artificial
  CRISPR gRNA sequence
ggtgcaatctctgtgcggga

SEQ ID NO: 527450 - DNA, 20 bp, Artificial
  CRISPR gRNA sequence
gtgcaatctctgtgcgggag

SEQ ID NO: 527451 - DNA, 20 bp, Artificial
  CRISPR gRNA sequence
aatctctgtgcgggagaggc

SEQ ID NO: 527452 - DNA, 20 bp, Artificial
  CRISPR gRNA sequence
tctctgtgcgggagaggcaa

SEQ ID NO: 527453 - DNA, 20 bp, Artificial
  CRISPR gRNA sequence
ctctgtgcgggagaggcaag

SEQ ID NO: 527454 - DNA, 20 bp, Artificial
  CRISPR gRNA sequence
tgaattaccactaataatgt

SEQ ID NO: 527455 - DNA, 20 bp, Artificial
  CRISPR gRNA sequence
tcagtgcctaacgatctgcc

SEQ ID NO: 527456 - DNA, 20 bp, Artificial
  CRISPR gRNA sequence
cagtgcctaacgatctgccc

SEQ ID NO: 527457 - DNA, 20 bp, Artificial
  CRISPR gRNA sequence
agtgcctaacgatctgccca

SEQ ID NO: 527458 - DNA, 20 bp, Artificial
  CRISPR gRNA sequence
acatgttgctccttttgtga

SEQ ID NO: 527459 - DNA, 20 bp, Artificial
  CRISPR gRNA sequence
catgttgctccttttgtgac

SEQ ID NO: 527460 - DNA, 20 bp, Artificial
  CRISPR gRNA sequence
gttgctccttttgtgacagg

SEQ ID NO: 527461 - DNA, 20 bp, Artificial
  CRISPR gRNA sequence
ttgctccttttgtgacaggt

SEQ ID NO: 527462 - DNA, 20 bp, Artificial
  CRISPR gRNA sequence
tgctccttttgtgacaggta

SEQ ID NO: 527463 - DNA, 20 bp, Artificial
  CRISPR gRNA sequence
tgatccttttctgatgctct

SEQ ID NO: 527464 - DNA, 20 bp, Artificial
  CRISPR gRNA sequence
gatccttttctgatgctctg

SEQ ID NO: 527465 - DNA, 20 bp, Artificial
  CRISPR gRNA sequence
tccttttctgatgctctgag

SEQ ID NO: 527466 - DNA, 20 bp, Artificial
  CRISPR gRNA sequence
ccttttctgatgctctgagg

SEQ ID NO: 527467 - DNA, 20 bp, Artificial
  CRISPR gRNA sequence
cttttctgatgctctgagga

SEQ ID NO: 527468 - DNA, 20 bp, Artificial
  CRISPR gRNA sequence
tctgatgctctgaggagggc

SEQ ID NO: 527469 - DNA, 20 bp, Artificial
  CRISPR gRNA sequence
tgctctgaggagggccagcg

SEQ ID NO: 527470 - DNA, 20 bp, Artificial
  CRISPR gRNA sequence
agggccagcgtagaccctgt

SEQ ID NO: 527471 - DNA, 20 bp, Artificial
  CRISPR gRNA sequence
cgtagaccctgtgagcaact

SEQ ID NO: 527472 - DNA, 20 bp, Artificial
  CRISPR gRNA sequence
agaccctgtgagcaactgag

SEQ ID NO: 527473 - DNA, 20 bp, Artificial
  CRISPR gRNA sequence
tgtgagcaactgagcagctc

SEQ ID NO: 527474 - DNA, 20 bp, Artificial
  CRISPR gRNA sequence
gtgagcaactgagcagctct

SEQ ID NO: 527475 - DNA, 20 bp, Artificial
  CRISPR gRNA sequence
gcaactgagcagctctgggc

SEQ ID NO: 527476 - DNA, 20 bp, Artificial
  CRISPR gRNA sequence
caactgagcagctctgggct

SEQ ID NO: 527477 - DNA, 20 bp, Artificial
  CRISPR gRNA sequence
gagcagctctgggctgggaa

SEQ ID NO: 527478 - DNA, 20 bp, Artificial
  CRISPR gRNA sequence
agcagctctgggctgggaaa

SEQ ID NO: 527479 - DNA, 20 bp, Artificial
  CRISPR gRNA sequence
agctctgggctgggaaaagg

SEQ ID NO: 527480 - DNA, 20 bp, Artificial
  CRISPR gRNA sequence
ggctgggaaaaggcagaatc

SEQ ID NO: 527481 - DNA, 20 bp, Artificial
  CRISPR gRNA sequence
aaaaggcagaatcaagtctc

SEQ ID NO: 527482 - DNA, 20 bp, Artificial
  CRISPR gRNA sequence
agaatcaagtctctggttcc

SEQ ID NO: 527483 - DNA, 20 bp, Artificial
  CRISPR gRNA sequence
gaatcaagtctctggttccc

SEQ ID NO: 527484 - DNA, 20 bp, Artificial
  CRISPR gRNA sequence
tcaagtctctggttcccagg

SEQ ID NO: 527485 - DNA, 20 bp, Artificial
  CRISPR gRNA sequence
caagtctctggttcccaggc

SEQ ID NO: 527486 - DNA, 20 bp, Artificial
  CRISPR gRNA sequence
aggcaggtgctctttttccc

SEQ ID NO: 527487 - DNA, 20 bp, Artificial
  CRISPR gRNA sequence
gcaggtgctctttttcccta

SEQ ID NO: 527488 - DNA, 20 bp, Artificial
  CRISPR gRNA sequence
ctctttttccctagagcttt

SEQ ID NO: 527489 - DNA, 20 bp, Artificial
  CRISPR gRNA sequence
ccctagagctttgagctcct

SEQ ID NO: 527490 - DNA, 20 bp, Artificial
  CRISPR gRNA sequence
cacactcacatatacccacc

SEQ ID NO: 527491 - DNA, 20 bp, Artificial
  CRISPR gRNA sequence
acccacctggcccactgctc

SEQ ID NO: 527492 - DNA, 20 bp, Artificial
  CRISPR gRNA sequence
cccacctggcccactgctcc

SEQ ID NO: 527493 - DNA, 20 bp, Artificial
  CRISPR gRNA sequence
ggcccactgctccaggaact

SEQ ID NO: 527494 - DNA, 20 bp, Artificial
  CRISPR gRNA sequence
ccactgctccaggaacttgg

SEQ ID NO: 527495 - DNA, 20 bp, Artificial
  CRISPR gRNA sequence
cactgctccaggaacttggt

SEQ ID NO: 527496 - DNA, 20 bp, Artificial
  CRISPR gRNA sequence
actgctccaggaacttggtg

SEQ ID NO: 527497 - DNA, 20 bp, Artificial
  CRISPR gRNA sequence
ctgctccaggaacttggtgg

SEQ ID NO: 527498 - DNA, 20 bp, Artificial
  CRISPR gRNA sequence
ctccaggaacttggtggggg

SEQ ID NO: 527499 - DNA, 20 bp, Artificial
  CRISPR gRNA sequence
ccaggaacttggtgggggca

SEQ ID NO: 527500 - DNA, 20 bp, Artificial
  CRISPR gRNA sequence
caggaacttggtgggggcag

SEQ ID NO: 527501 - DNA, 20 bp, Artificial
  CRISPR gRNA sequence
tggtgggggcagaggtatcc

SEQ ID NO: 527502 - DNA, 20 bp, Artificial
  CRISPR gRNA sequence
ggtgggggcagaggtatcca

SEQ ID NO: 527503 - DNA, 20 bp, Artificial
  CRISPR gRNA sequence
gcagaggtatccaaggtccc

SEQ ID NO: 527504 - DNA, 20 bp, Artificial
  CRISPR gRNA sequence
tccccagtcacatgtcaatg

SEQ ID NO: 527505 - DNA, 20 bp, Artificial
  CRISPR gRNA sequence
tgtcaatgtggtgattcctc

SEQ ID NO: 527506 - DNA, 20 bp, Artificial
  CRISPR gRNA sequence
gtcaatgtggtgattcctcc

SEQ ID NO: 527507 - DNA, 20 bp, Artificial
  CRISPR gRNA sequence
atgtggtgattcctccagga

SEQ ID NO: 527508 - DNA, 20 bp, Artificial
  CRISPR gRNA sequence
tgtggtgattcctccaggat

SEQ ID NO: 527509 - DNA, 20 bp, Artificial
  CRISPR gRNA sequence
gtggtgattcctccaggatg

SEQ ID NO: 527510 - DNA, 20 bp, Artificial
  CRISPR gRNA sequence
ttcctccaggatggggttcc

SEQ ID NO: 527511 - DNA, 20 bp, Artificial
  CRISPR gRNA sequence
ggggttcctggctgctgtta

SEQ ID NO: 527512 - DNA, 20 bp, Artificial
  CRISPR gRNA sequence
gcattgcctttctcaaactc

SEQ ID NO: 527513 - DNA, 20 bp, Artificial
  CRISPR gRNA sequence
attgcctttctcaaactctg

SEQ ID NO: 527514 - DNA, 20 bp, Artificial
  CRISPR gRNA sequence
ttgcctttctcaaactctgg

SEQ ID NO: 527515 - DNA, 20 bp, Artificial
  CRISPR gRNA sequence
aaaccctgactgccatgttt

SEQ ID NO: 527516 - DNA, 20 bp, Artificial
  CRISPR gRNA sequence
aaccctgactgccatgtttt

SEQ ID NO: 527517 - DNA, 20 bp, Artificial
  CRISPR gRNA sequence
cctgactgccatgttttagg

SEQ ID NO: 527518 - DNA, 20 bp, Artificial
  CRISPR gRNA sequence
catgttttaggtggtgcccc

SEQ ID NO: 527519 - DNA, 20 bp, Artificial
  CRISPR gRNA sequence
ggtgccccaagaccacctac

SEQ ID NO: 527520 - DNA, 20 bp, Artificial
  CRISPR gRNA sequence
agaccacctactggacctct

SEQ ID NO: 527521 - DNA, 20 bp, Artificial
  CRISPR gRNA sequence
accacctactggacctctca

SEQ ID NO: 527522 - DNA, 20 bp, Artificial
  CRISPR gRNA sequence
ttgaacattttgtctgtaaa

SEQ ID NO: 527523 - DNA, 20 bp, Artificial
  CRISPR gRNA sequence
tgaacattttgtctgtaaat

SEQ ID NO: 527524 - DNA, 20 bp, Artificial
  CRISPR gRNA sequence
acattttgtctgtaaatggg

SEQ ID NO: 527525 - DNA, 20 bp, Artificial
  CRISPR gRNA sequence
gtaaatgggaagaaaaacat

SEQ ID NO: 527526 - DNA, 20 bp, Artificial
  CRISPR gRNA sequence
aaaaacatcagcctgtctgt

SEQ ID NO: 527527 - DNA, 20 bp, Artificial
  CRISPR gRNA sequence
aaaacatcagcctgtctgtt

SEQ ID NO: 527528 - DNA, 20 bp, Artificial
  CRISPR gRNA sequence
aaacatcagcctgtctgtta

SEQ ID NO: 527529 - DNA, 20 bp, Artificial
  CRISPR gRNA sequence
tcagcctgtctgttagggtt

SEQ ID NO: 527530 - DNA, 20 bp, Artificial
  CRISPR gRNA sequence
aagtgatgtcatatatgtga

SEQ ID NO: 527531 - DNA, 20 bp, Artificial
  CRISPR gRNA sequence
catatatgtgaaagcatttt

SEQ ID NO: 527532 - DNA, 20 bp, Artificial
  CRISPR gRNA sequence
atatatgtgaaagcatttta

SEQ ID NO: 527533 - DNA, 20 bp, Artificial
  CRISPR gRNA sequence
gtgaaagcattttaaggtat

SEQ ID NO: 527534 - DNA, 20 bp, Artificial
  CRISPR gRNA sequence
aagcattttaaggtataaga

SEQ ID NO: 527535 - DNA, 20 bp, Artificial
  CRISPR gRNA sequence
attacatatgatacactatt

SEQ ID NO: 527536 - DNA, 20 bp, Artificial
  CRISPR gRNA sequence
acatatgatacactatttag

SEQ ID NO: 527537 - DNA, 20 bp, Artificial
  CRISPR gRNA sequence
aatgtatctgtgaatgtcat

SEQ ID NO: 527538 - DNA, 20 bp, Artificial
  CRISPR gRNA sequence
taaaataaaataatttccaa

SEQ ID NO: 527539 - DNA, 20 bp, Artificial
  CRISPR gRNA sequence
aaataatttccaaaagttgc

SEQ ID NO: 527540 - DNA, 20 bp, Artificial
  CRISPR gRNA sequence
ataatttccaaaagttgcta

SEQ ID NO: 527541 - DNA, 20 bp, Artificial
  CRISPR gRNA sequence
taatttccaaaagttgctag

SEQ ID NO: 527542 - DNA, 20 bp, Artificial
  CRISPR gRNA sequence
tccatcccccactgtataaa

SEQ ID NO: 527543 - DNA, 20 bp, Artificial
  CRISPR gRNA sequence
atagatatgtttattaaaat

SEQ ID NO: 527544 - DNA, 20 bp, Artificial
  CRISPR gRNA sequence
ctgaatctttactttctttt

SEQ ID NO: 527545 - DNA, 20 bp, Artificial
  CRISPR gRNA sequence
gaatctttactttcttttta

SEQ ID NO: 527546 - DNA, 20 bp, Artificial
  CRISPR gRNA sequence
atctttactttctttttaga

SEQ ID NO: 527547 - DNA, 20 bp, Artificial
  CRISPR gRNA sequence
tctttactttctttttagag

SEQ ID NO: 527548 - DNA, 20 bp, Artificial
  CRISPR gRNA sequence
ctttactttctttttagaga

SEQ ID NO: 527549 - DNA, 20 bp, Artificial
  CRISPR gRNA sequence
tagagagggtctcaaaacca

SEQ ID NO: 527550 - DNA, 20 bp, Artificial
  CRISPR gRNA sequence
tctcaaaaccaaagatctcc

SEQ ID NO: 527551 - DNA, 20 bp, Artificial
  CRISPR gRNA sequence
tcaacacaaccctgacctgt

SEQ ID NO: 527552 - DNA, 20 bp, Artificial
  CRISPR gRNA sequence
caacacaaccctgacctgtg

SEQ ID NO: 527553 - DNA, 20 bp, Artificial
  CRISPR gRNA sequence
ctgacctgtgaggtaatgaa

SEQ ID NO: 527554 - DNA, 20 bp, Artificial
  CRISPR gRNA sequence
ccccgaattaaacctgtatc

SEQ ID NO: 527555 - DNA, 20 bp, Artificial
  CRISPR gRNA sequence
gaattaaacctgtatcaaga

SEQ ID NO: 527556 - DNA, 20 bp, Artificial
  CRISPR gRNA sequence
aattaaacctgtatcaagat

SEQ ID NO: 527557 - DNA, 20 bp, Artificial
  CRISPR gRNA sequence
ggaaacatctaaaactttct

SEQ ID NO: 527558 - DNA, 20 bp, Artificial
  CRISPR gRNA sequence
aaacatctaaaactttctca

SEQ ID NO: 527559 - DNA, 20 bp, Artificial
  CRISPR gRNA sequence
aacatctaaaactttctcag

SEQ ID NO: 527560 - DNA, 20 bp, Artificial
  CRISPR gRNA sequence
acatctaaaactttctcaga

SEQ ID NO: 527561 - DNA, 20 bp, Artificial
  CRISPR gRNA sequence
ctcagagggtcatcacacac

SEQ ID NO: 527562 - DNA, 20 bp, Artificial
  CRISPR gRNA sequence
agagggtcatcacacacaag

SEQ ID NO: 527563 - DNA, 20 bp, Artificial
  CRISPR gRNA sequence
atcacacacaagtggaccac

SEQ ID NO: 527564 - DNA, 20 bp, Artificial
  CRISPR gRNA sequence
cacaagtggaccaccagcct

SEQ ID NO: 527565 - DNA, 20 bp, Artificial
  CRISPR gRNA sequence
ccagcctgagtgcaaaattc

SEQ ID NO: 527566 - DNA, 20 bp, Artificial
  CRISPR gRNA sequence
gagtgcaaaattcaagtgca

SEQ ID NO: 527567 - DNA, 20 bp, Artificial
  CRISPR gRNA sequence
tgcaaaattcaagtgcacag

SEQ ID NO: 527568 - DNA, 20 bp, Artificial
  CRISPR gRNA sequence
gcaaaattcaagtgcacagc

SEQ ID NO: 527569 - DNA, 20 bp, Artificial
  CRISPR gRNA sequence
caaaattcaagtgcacagca

SEQ ID NO: 527570 - DNA, 20 bp, Artificial
  CRISPR gRNA sequence
caagtgcacagcagggaaca

SEQ ID NO: 527571 - DNA, 20 bp, Artificial
  CRISPR gRNA sequence
tgcacagcagggaacaaagt

SEQ ID NO: 527572 - DNA, 20 bp, Artificial
  CRISPR gRNA sequence
cagcagggaacaaagtcagc

SEQ ID NO: 527573 - DNA, 20 bp, Artificial
  CRISPR gRNA sequence
agcagggaacaaagtcagca

SEQ ID NO: 527574 - DNA, 20 bp, Artificial
  CRISPR gRNA sequence
aacaaagtcagcaaggaatc

SEQ ID NO: 527575 - DNA, 20 bp, Artificial
  CRISPR gRNA sequence
tcagcaaggaatccagtgtc

SEQ ID NO: 527576 - DNA, 20 bp, Artificial
  CRISPR gRNA sequence
gaatccagtgtcgagcctgt

SEQ ID NO: 527577 - DNA, 20 bp, Artificial
  CRISPR gRNA sequence
tgtcgagcctgtcagctgtc

SEQ ID NO: 527578 - DNA, 20 bp, Artificial
  CRISPR gRNA sequence
gtcgagcctgtcagctgtcc

SEQ ID NO: 527579 - DNA, 20 bp, Artificial
  CRISPR gRNA sequence
ctgtcagctgtccaggtgcg

SEQ ID NO: 527580 - DNA, 20 bp, Artificial
  CRISPR gRNA sequence
tcagctgtccaggtgcgtgg

SEQ ID NO: 527581 - DNA, 20 bp, Artificial
  CRISPR gRNA sequence
cagctgtccaggtgcgtggc

SEQ ID NO: 527582 - DNA, 20 bp, Artificial
  CRISPR gRNA sequence
cgggcatcacttcacaaaca

SEQ ID NO: 527583 - DNA, 20 bp, Artificial
  CRISPR gRNA sequence
acttcacaaacacagcctgc

SEQ ID NO: 527584 - DNA, 20 bp, Artificial
  CRISPR gRNA sequence
cttcacaaacacagcctgcc

SEQ ID NO: 527585 - DNA, 20 bp, Artificial
  CRISPR gRNA sequence
aacacagcctgccaggccct

SEQ ID NO: 527586 - DNA, 20 bp, Artificial
  CRISPR gRNA sequence
acagcctgccaggccctcag

SEQ ID NO: 527587 - DNA, 20 bp, Artificial
  CRISPR gRNA sequence
cagcctgccaggccctcagt

SEQ ID NO: 527588 - DNA, 20 bp, Artificial
  CRISPR gRNA sequence
cctgccaggccctcagtagg

SEQ ID NO: 527589 - DNA, 20 bp, Artificial
  CRISPR gRNA sequence
tgccaggccctcagtaggca

SEQ ID NO: 527590 - DNA, 20 bp, Artificial
  CRISPR gRNA sequence
gccaggccctcagtaggcag

SEQ ID NO: 527591 - DNA, 20 bp, Artificial
  CRISPR gRNA sequence
taggcagaggcatgctgctc

SEQ ID NO: 527592 - DNA, 20 bp, Artificial
  CRISPR gRNA sequence
aggcagaggcatgctgctcc

SEQ ID NO: 527593 - DNA, 20 bp, Artificial
  CRISPR gRNA sequence
aggcatgctgctccaggtca

SEQ ID NO: 527594 - DNA, 20 bp, Artificial
  CRISPR gRNA sequence
ggcatgctgctccaggtcac

SEQ ID NO: 527595 - DNA, 20 bp, Artificial
  CRISPR gRNA sequence
caggtcacaggtgctcatgc

SEQ ID NO: 527596 - DNA, 20 bp, Artificial
  CRISPR gRNA sequence
aggtcacaggtgctcatgct

SEQ ID NO: 527597 - DNA, 20 bp, Artificial
  CRISPR gRNA sequence
gtcacaggtgctcatgctgg

SEQ ID NO: 527598 - DNA, 20 bp, Artificial
  CRISPR gRNA sequence
tcacaggtgctcatgctggg

SEQ ID NO: 527599 - DNA, 20 bp, Artificial
  CRISPR gRNA sequence
caggtgctcatgctgggagg

SEQ ID NO: 527600 - DNA, 20 bp, Artificial
  CRISPR gRNA sequence
ctcatgctgggaggcagccc

SEQ ID NO: 527601 - DNA, 20 bp, Artificial
  CRISPR gRNA sequence
gctgggaggcagccctggct

SEQ ID NO: 527602 - DNA, 20 bp, Artificial
  CRISPR gRNA sequence
ctgggaggcagccctggctc

SEQ ID NO: 527603 - DNA, 20 bp, Artificial
  CRISPR gRNA sequence
aggcagccctggctcaggat

SEQ ID NO: 527604 - DNA, 20 bp, Artificial
  CRISPR gRNA sequence
ggcagccctggctcaggatg

SEQ ID NO: 527605 - DNA, 20 bp, Artificial
  CRISPR gRNA sequence
tggctcaggatgaggcatga

SEQ ID NO: 527606 - DNA, 20 bp, Artificial
  CRISPR gRNA sequence
gaaagcatatctcttcctcc

SEQ ID NO: 527607 - DNA, 20 bp, Artificial
  CRISPR gRNA sequence
tcttcctcctggaaaccttc

SEQ ID NO: 527608 - DNA, 20 bp, Artificial
  CRISPR gRNA sequence
cttcctcctggaaaccttca

SEQ ID NO: 527609 - DNA, 20 bp, Artificial
  CRISPR gRNA sequence
ttcctcctggaaaccttcaa

SEQ ID NO: 527610 - DNA, 20 bp, Artificial
  CRISPR gRNA sequence
ctcctggaaaccttcaaggg

SEQ ID NO: 527611 - DNA, 20 bp, Artificial
  CRISPR gRNA sequence
gaaaccttcaagggaagcat

SEQ ID NO: 527612 - DNA, 20 bp, Artificial
  CRISPR gRNA sequence
aaaccttcaagggaagcatc

SEQ ID NO: 527613 - DNA, 20 bp, Artificial
  CRISPR gRNA sequence
aaccttcaagggaagcatca

SEQ ID NO: 527614 - DNA, 20 bp, Artificial
  CRISPR gRNA sequence
accttcaagggaagcatcag

SEQ ID NO: 527615 - DNA, 20 bp, Artificial
  CRISPR gRNA sequence
cttcaagggaagcatcaggg

SEQ ID NO: 527616 - DNA, 20 bp, Artificial
  CRISPR gRNA sequence
ttcaagggaagcatcagggg

SEQ ID NO: 527617 - DNA, 20 bp, Artificial
  CRISPR gRNA sequence
aagggaagcatcaggggagg

SEQ ID NO: 527618 - DNA, 20 bp, Artificial
  CRISPR gRNA sequence
tcaggggaggtggtgttcta

SEQ ID NO: 527619 - DNA, 20 bp, Artificial
  CRISPR gRNA sequence
tgttctatggttttccatcc

SEQ ID NO: 527620 - DNA, 20 bp, Artificial
  CRISPR gRNA sequence
gttctatggttttccatcct

SEQ ID NO: 527621 - DNA, 20 bp, Artificial
  CRISPR gRNA sequence
tctatggttttccatcctgg

SEQ ID NO: 527622 - DNA, 20 bp, Artificial
  CRISPR gRNA sequence
atcctgggagtcctcccact

SEQ ID NO: 527623 - DNA, 20 bp, Artificial
  CRISPR gRNA sequence
actgagcacaatttgaccac

SEQ ID NO: 527624 - DNA, 20 bp, Artificial
  CRISPR gRNA sequence
tttgaccacaagaaatttta

SEQ ID NO: 527625 - DNA, 20 bp, Artificial
  CRISPR gRNA sequence
aaattttaaagatcctcttc

SEQ ID NO: 527626 - DNA, 20 bp, Artificial
  CRISPR gRNA sequence
aattttaaagatcctcttct

SEQ ID NO: 527627 - DNA, 20 bp, Artificial
  CRISPR gRNA sequence
ttttaaagatcctcttctag

SEQ ID NO: 527628 - DNA, 20 bp, Artificial
  CRISPR gRNA sequence
aaagatcctcttctaggaga

SEQ ID NO: 527629 - DNA, 20 bp, Artificial
  CRISPR gRNA sequence
gagaaagaattgcaaaactg

SEQ ID NO: 527630 - DNA, 20 bp, Artificial
  CRISPR gRNA sequence
aaagaattgcaaaactgaag

SEQ ID NO: 527631 - DNA, 20 bp, Artificial
  CRISPR gRNA sequence
aagaattgcaaaactgaaga

SEQ ID NO: 527632 - DNA, 20 bp, Artificial
  CRISPR gRNA sequence
gaattgcaaaactgaagaag

SEQ ID NO: 527633 - DNA, 20 bp, Artificial
  CRISPR gRNA sequence
aattgcaaaactgaagaagg

SEQ ID NO: 527634 - DNA, 20 bp, Artificial
  CRISPR gRNA sequence
ttgcaaaactgaagaaggag

SEQ ID NO: 527635 - DNA, 20 bp, Artificial
  CRISPR gRNA sequence
aactgaagaaggaggagctg

SEQ ID NO: 527636 - DNA, 20 bp, Artificial
  CRISPR gRNA sequence
ctgaagaaggaggagctgta

SEQ ID NO: 527637 - DNA, 20 bp, Artificial
  CRISPR gRNA sequence
gaagaaggaggagctgtaga

SEQ ID NO: 527638 - DNA, 20 bp, Artificial
  CRISPR gRNA sequence
tgtagagagtatctcatgca

SEQ ID NO: 527639 - DNA, 20 bp, Artificial
  CRISPR gRNA sequence
tcatgcaaagccccattttc

SEQ ID NO: 527640 - DNA, 20 bp, Artificial
  CRISPR gRNA sequence
atgcaaagccccattttcca

SEQ ID NO: 527641 - DNA, 20 bp, Artificial
  CRISPR gRNA sequence
gcaaagccccattttccaga

SEQ ID NO: 527642 - DNA, 20 bp, Artificial
  CRISPR gRNA sequence
caaagccccattttccagag

SEQ ID NO: 527643 - DNA, 20 bp, Artificial
  CRISPR gRNA sequence
aaagccccattttccagaga

SEQ ID NO: 527644 - DNA, 20 bp, Artificial
  CRISPR gRNA sequence
agagggaaactgacttgccc

SEQ ID NO: 527645 - DNA, 20 bp, Artificial
  CRISPR gRNA sequence
gagggaaactgacttgccca

SEQ ID NO: 527646 - DNA, 20 bp, Artificial
  CRISPR gRNA sequence
ctgacttgcccaaggtccct

SEQ ID NO: 527647 - DNA, 20 bp, Artificial
  CRISPR gRNA sequence
cttgcccaaggtcccttggc

SEQ ID NO: 527648 - DNA, 20 bp, Artificial
  CRISPR gRNA sequence
cccaaggtcccttggctagt

SEQ ID NO: 527649 - DNA, 20 bp, Artificial
  CRISPR gRNA sequence
tgattccaactgctccccta

SEQ ID NO: 527650 - DNA, 20 bp, Artificial
  CRISPR gRNA sequence
tccaactgctcccctaaaga

SEQ ID NO: 527651 - DNA, 20 bp, Artificial
  CRISPR gRNA sequence
actgctcccctaaagatggt

SEQ ID NO: 527652 - DNA, 20 bp, Artificial
  CRISPR gRNA sequence
gctcccctaaagatggttag

SEQ ID NO: 527653 - DNA, 20 bp, Artificial
  CRISPR gRNA sequence
ccctaaagatggttagtggt

SEQ ID NO: 527654 - DNA, 20 bp, Artificial
  CRISPR gRNA sequence
tagtggtcagcacctcccat

SEQ ID NO: 527655 - DNA, 20 bp, Artificial
  CRISPR gRNA sequence
agtggtcagcacctcccatc

SEQ ID NO: 527656 - DNA, 20 bp, Artificial
  CRISPR gRNA sequence
tggtcagcacctcccatcag

SEQ ID NO: 527657 - DNA, 20 bp, Artificial
  CRISPR gRNA sequence
agcacctcccatcaggagta

SEQ ID NO: 527658 - DNA, 20 bp, Artificial
  CRISPR gRNA sequence
gcacctcccatcaggagtaa

SEQ ID NO: 527659 - DNA, 20 bp, Artificial
  CRISPR gRNA sequence
cctcccatcaggagtaaagg

SEQ ID NO: 527660 - DNA, 20 bp, Artificial
  CRISPR gRNA sequence
ccatcaggagtaaaggtaga

SEQ ID NO: 527661 - DNA, 20 bp, Artificial
  CRISPR gRNA sequence
catcaggagtaaaggtagaa

SEQ ID NO: 527662 - DNA, 20 bp, Artificial
  CRISPR gRNA sequence
gagtaaaggtagaaaggctg

SEQ ID NO: 527663 - DNA, 20 bp, Artificial
  CRISPR gRNA sequence
tagaaaggctgcagaaaccc

SEQ ID NO: 527664 - DNA, 20 bp, Artificial
  CRISPR gRNA sequence
agaaaggctgcagaaaccct

SEQ ID NO: 527665 - DNA, 20 bp, Artificial
  CRISPR gRNA sequence
gaaaggctgcagaaaccctg

SEQ ID NO: 527666 - DNA, 20 bp, Artificial
  CRISPR gRNA sequence
aaaggctgcagaaaccctgg

SEQ ID NO: 527667 - DNA, 20 bp, Artificial
  CRISPR gRNA sequence
aaggctgcagaaaccctggg

SEQ ID NO: 527668 - DNA, 20 bp, Artificial
  CRISPR gRNA sequence
gctgcagaaaccctgggggg

SEQ ID NO: 527669 - DNA, 20 bp, Artificial
  CRISPR gRNA sequence
ctgcagaaaccctggggggc

SEQ ID NO: 527670 - DNA, 20 bp, Artificial
  CRISPR gRNA sequence
tgcagaaaccctggggggca

SEQ ID NO: 527671 - DNA, 20 bp, Artificial
  CRISPR gRNA sequence
aaccctggggggcagggtca

SEQ ID NO: 527672 - DNA, 20 bp, Artificial
  CRISPR gRNA sequence
accctggggggcagggtcat

SEQ ID NO: 527673 - DNA, 20 bp, Artificial
  CRISPR gRNA sequence
ccctggggggcagggtcatg

SEQ ID NO: 527674 - DNA, 20 bp, Artificial
  CRISPR gRNA sequence
cctggggggcagggtcatgg

SEQ ID NO: 527675 - DNA, 20 bp, Artificial
  CRISPR gRNA sequence
ggggcagggtcatgggggaa

SEQ ID NO: 527676 - DNA, 20 bp, Artificial
  CRISPR gRNA sequence
ggcagggtcatgggggaatg

SEQ ID NO: 527677 - DNA, 20 bp, Artificial
  CRISPR gRNA sequence
catgggggaatggagccctt

SEQ ID NO: 527678 - DNA, 20 bp, Artificial
  CRISPR gRNA sequence
atgggggaatggagcccttg

SEQ ID NO: 527679 - DNA, 20 bp, Artificial
  CRISPR gRNA sequence
gaatggagcccttgaggcca

SEQ ID NO: 527680 - DNA, 20 bp, Artificial
  CRISPR gRNA sequence
atggagcccttgaggccaaa

SEQ ID NO: 527681 - DNA, 20 bp, Artificial
  CRISPR gRNA sequence
tggagcccttgaggccaaag

SEQ ID NO: 527682 - DNA, 20 bp, Artificial
  CRISPR gRNA sequence
cttgaggccaaagaggactg

SEQ ID NO: 527683 - DNA, 20 bp, Artificial
  CRISPR gRNA sequence
aggccaaagaggactgtgga

SEQ ID NO: 527684 - DNA, 20 bp, Artificial
  CRISPR gRNA sequence
caaagaggactgtggacagc

SEQ ID NO: 527685 - DNA, 20 bp, Artificial
  CRISPR gRNA sequence
aaagaggactgtggacagca

SEQ ID NO: 527686 - DNA, 20 bp, Artificial
  CRISPR gRNA sequence
ggacagcaaggcaacactcc

SEQ ID NO: 527687 - DNA, 20 bp, Artificial
  CRISPR gRNA sequence
gcaacactcctggcacacaa

SEQ ID NO: 527688 - DNA, 20 bp, Artificial
  CRISPR gRNA sequence
caacactcctggcacacaac

SEQ ID NO: 527689 - DNA, 20 bp, Artificial
  CRISPR gRNA sequence
actcctggcacacaacagga

SEQ ID NO: 527690 - DNA, 20 bp, Artificial
  CRISPR gRNA sequence
ctggcacacaacaggacggc

SEQ ID NO: 527691 - DNA, 20 bp, Artificial
  CRISPR gRNA sequence
tggcacacaacaggacggca

SEQ ID NO: 527692 - DNA, 20 bp, Artificial
  CRISPR gRNA sequence
cacaacaggacggcaaggct

SEQ ID NO: 527693 - DNA, 20 bp, Artificial
  CRISPR gRNA sequence
acaacaggacggcaaggctt

SEQ ID NO: 527694 - DNA, 20 bp, Artificial
  CRISPR gRNA sequence
caacaggacggcaaggcttg

SEQ ID NO: 527695 - DNA, 20 bp, Artificial
  CRISPR gRNA sequence
ggacggcaaggcttggggac

SEQ ID NO: 527696 - DNA, 20 bp, Artificial
  CRISPR gRNA sequence
caaggcttggggactagctc

SEQ ID NO: 527697 - DNA, 20 bp, Artificial
  CRISPR gRNA sequence
ccagaaaatctcaaaactcc

SEQ ID NO: 527698 - DNA, 20 bp, Artificial
  CRISPR gRNA sequence
tcaaaactccaagaccataa

SEQ ID NO: 527699 - DNA, 20 bp, Artificial
  CRISPR gRNA sequence
ccaagaccataatggatccc

SEQ ID NO: 527700 - DNA, 20 bp, Artificial
  CRISPR gRNA sequence
ataatggatccccagtgtcc

SEQ ID NO: 527701 - DNA, 20 bp, Artificial
  CRISPR gRNA sequence
tcccagcctgatgtgacctc

SEQ ID NO: 527702 - DNA, 20 bp, Artificial
  CRISPR gRNA sequence
cagcctgatgtgacctccag

SEQ ID NO: 527703 - DNA, 20 bp, Artificial
  CRISPR gRNA sequence
tgacctccagaagtatttct

SEQ ID NO: 527704 - DNA, 20 bp, Artificial
  CRISPR gRNA sequence
acctccagaagtatttctga

SEQ ID NO: 527705 - DNA, 20 bp, Artificial
  CRISPR gRNA sequence
cctccagaagtatttctgag

SEQ ID NO: 527706 - DNA, 20 bp, Artificial
  CRISPR gRNA sequence
ccagaagtatttctgagagg

SEQ ID NO: 527707 - DNA, 20 bp, Artificial
  CRISPR gRNA sequence
ttctgagaggcagccttcta

SEQ ID NO: 527708 - DNA, 20 bp, Artificial
  CRISPR gRNA sequence
ggcagccttctatagtgccc

SEQ ID NO: 527709 - DNA, 20 bp, Artificial
  CRISPR gRNA sequence
atagtgcccaagctctcgcc

SEQ ID NO: 527710 - DNA, 20 bp, Artificial
  CRISPR gRNA sequence
tagtgcccaagctctcgcct

SEQ ID NO: 527711 - DNA, 20 bp, Artificial
  CRISPR gRNA sequence
gtgcccaagctctcgcctgg

SEQ ID NO: 527712 - DNA, 20 bp, Artificial
  CRISPR gRNA sequence
cccaagctctcgcctgggag

SEQ ID NO: 527713 - DNA, 20 bp, Artificial
  CRISPR gRNA sequence
caagctctcgcctgggagta

SEQ ID NO: 527714 - DNA, 20 bp, Artificial
  CRISPR gRNA sequence
aagctctcgcctgggagtag

SEQ ID NO: 527715 - DNA, 20 bp, Artificial
  CRISPR gRNA sequence
ctcgcctgggagtagaggtc

SEQ ID NO: 527716 - DNA, 20 bp, Artificial
  CRISPR gRNA sequence
ggagtagaggtctggacttc

SEQ ID NO: 527717 - DNA, 20 bp, Artificial
  CRISPR gRNA sequence
agaggtctggacttctagtt

SEQ ID NO: 527718 - DNA, 20 bp, Artificial
  CRISPR gRNA sequence
gaggtctggacttctagttt

SEQ ID NO: 527719 - DNA, 20 bp, Artificial
  CRISPR gRNA sequence
agtttgggtctgtccaaatt

SEQ ID NO: 527720 - DNA, 20 bp, Artificial
  CRISPR gRNA sequence
tgggtctgtccaaatttagc

SEQ ID NO: 527721 - DNA, 20 bp, Artificial
  CRISPR gRNA sequence
ggtctgtccaaatttagcca

SEQ ID NO: 527722 - DNA, 20 bp, Artificial
  CRISPR gRNA sequence
atttagccagagaatcttga

SEQ ID NO: 527723 - DNA, 20 bp, Artificial
  CRISPR gRNA sequence
ttagccagagaatcttgaca

SEQ ID NO: 527724 - DNA, 20 bp, Artificial
  CRISPR gRNA sequence
acagagtttcttcccctctc

SEQ ID NO: 527725 - DNA, 20 bp, Artificial
  CRISPR gRNA sequence
cagagtttcttcccctctct

SEQ ID NO: 527726 - DNA, 20 bp, Artificial
  CRISPR gRNA sequence
ttcttcccctctctaggctt

SEQ ID NO: 527727 - DNA, 20 bp, Artificial
  CRISPR gRNA sequence
ctctctaggcttcagcttcc

SEQ ID NO: 527728 - DNA, 20 bp, Artificial
  CRISPR gRNA sequence
cttcagcttcctggcccaca

SEQ ID NO: 527729 - DNA, 20 bp, Artificial
  CRISPR gRNA sequence
tcctggcccacaaagaaaat

SEQ ID NO: 527730 - DNA, 20 bp, Artificial
  CRISPR gRNA sequence
gaaaataagcaccatgttca

SEQ ID NO: 527731 - DNA, 20 bp, Artificial
  CRISPR gRNA sequence
gcaccatgttcacagactat

SEQ ID NO: 527732 - DNA, 20 bp, Artificial
  CRISPR gRNA sequence
atgttcacagactattagat

SEQ ID NO: 527733 - DNA, 20 bp, Artificial
  CRISPR gRNA sequence
ttcacagactattagatgag

SEQ ID NO: 527734 - DNA, 20 bp, Artificial
  CRISPR gRNA sequence
tcacagactattagatgagt

SEQ ID NO: 527735 - DNA, 20 bp, Artificial
  CRISPR gRNA sequence
ctattagatgagtaggctct

SEQ ID NO: 527736 - DNA, 20 bp, Artificial
  CRISPR gRNA sequence
aggctcttggatccacttcc

SEQ ID NO: 527737 - DNA, 20 bp, Artificial
  CRISPR gRNA sequence
cacttccaagttcattcatg

SEQ ID NO: 527738 - DNA, 20 bp, Artificial
  CRISPR gRNA sequence
acttccaagttcattcatgt

SEQ ID NO: 527739 - DNA, 20 bp, Artificial
  CRISPR gRNA sequence
agttcattcatgtgggccgt

SEQ ID NO: 527740 - DNA, 20 bp, Artificial
  CRISPR gRNA sequence
gttcattcatgtgggccgtt

SEQ ID NO: 527741 - DNA, 20 bp, Artificial
  CRISPR gRNA sequence
cgttgggctgcctcacaata

SEQ ID NO: 527742 - DNA, 20 bp, Artificial
  CRISPR gRNA sequence
tgggctgcctcacaatatgg

SEQ ID NO: 527743 - DNA, 20 bp, Artificial
  CRISPR gRNA sequence
ctgcctcacaatatggcagc

SEQ ID NO: 527744 - DNA, 20 bp, Artificial
  CRISPR gRNA sequence
atatggcagctagcttccct

SEQ ID NO: 527745 - DNA, 20 bp, Artificial
  CRISPR gRNA sequence
atggcagctagcttccctca

SEQ ID NO: 527746 - DNA, 20 bp, Artificial
  CRISPR gRNA sequence
agcttccctcagagccctct

SEQ ID NO: 527747 - DNA, 20 bp, Artificial
  CRISPR gRNA sequence
tccctcagagccctctaaga

SEQ ID NO: 527748 - DNA, 20 bp, Artificial
  CRISPR gRNA sequence
cctcagagccctctaagaaa

SEQ ID NO: 527749 - DNA, 20 bp, Artificial
  CRISPR gRNA sequence
cagagccctctaagaaagag

SEQ ID NO: 527750 - DNA, 20 bp, Artificial
  CRISPR gRNA sequence
agagccctctaagaaagagc

SEQ ID NO: 527751 - DNA, 20 bp, Artificial
  CRISPR gRNA sequence
ctctaagaaagagcaggaat

SEQ ID NO: 527752 - DNA, 20 bp, Artificial
  CRISPR gRNA sequence
aaagagcaggaataagtgcc

SEQ ID NO: 527753 - DNA, 20 bp, Artificial
  CRISPR gRNA sequence
aagagcaggaataagtgccc

SEQ ID NO: 527754 - DNA, 20 bp, Artificial
  CRISPR gRNA sequence
ggaataagtgcccaggacaa

SEQ ID NO: 527755 - DNA, 20 bp, Artificial
  CRISPR gRNA sequence
agtgcccaggacaaaagtcg

SEQ ID NO: 527756 - DNA, 20 bp, Artificial
  CRISPR gRNA sequence
gtctttttgtaacttaatct

SEQ ID NO: 527757 - DNA, 20 bp, Artificial
  CRISPR gRNA sequence
tctttttgtaacttaatctc

SEQ ID NO: 527758 - DNA, 20 bp, Artificial
  CRISPR gRNA sequence
tttttgtaacttaatctcag

SEQ ID NO: 527759 - DNA, 20 bp, Artificial
  CRISPR gRNA sequence
ttctgctgtgttctgttcat

SEQ ID NO: 527760 - DNA, 20 bp, Artificial
  CRISPR gRNA sequence
tgctgtgttctgttcattag

SEQ ID NO: 527761 - DNA, 20 bp, Artificial
  CRISPR gRNA sequence
gtgttctgttcattagaagc

SEQ ID NO: 527762 - DNA, 20 bp, Artificial
  CRISPR gRNA sequence
ttcattagaagcaagttaat

SEQ ID NO: 527763 - DNA, 20 bp, Artificial
  CRISPR gRNA sequence
tagaagcaagttaataagtc

SEQ ID NO: 527764 - DNA, 20 bp, Artificial
  CRISPR gRNA sequence
aagtctagcccacattcaat

SEQ ID NO: 527765 - DNA, 20 bp, Artificial
  CRISPR gRNA sequence
gtctagcccacattcaatca

SEQ ID NO: 527766 - DNA, 20 bp, Artificial
  CRISPR gRNA sequence
tctagcccacattcaatcag

SEQ ID NO: 527767 - DNA, 20 bp, Artificial
  CRISPR gRNA sequence
ctagcccacattcaatcaga

SEQ ID NO: 527768 - DNA, 20 bp, Artificial
  CRISPR gRNA sequence
tagcccacattcaatcagag

SEQ ID NO: 527769 - DNA, 20 bp, Artificial
  CRISPR gRNA sequence
caatcagaggggattgcaca

SEQ ID NO: 527770 - DNA, 20 bp, Artificial
  CRISPR gRNA sequence
aatcagaggggattgcacat

SEQ ID NO: 527771 - DNA, 20 bp, Artificial
  CRISPR gRNA sequence
agaggggattgcacataggt

SEQ ID NO: 527772 - DNA, 20 bp, Artificial
  CRISPR gRNA sequence
ttgcacataggtgagaatac

SEQ ID NO: 527773 - DNA, 20 bp, Artificial
  CRISPR gRNA sequence
tgcacataggtgagaatacc

SEQ ID NO: 527774 - DNA, 20 bp, Artificial
  CRISPR gRNA sequence
acataggtgagaataccagg

SEQ ID NO: 527775 - DNA, 20 bp, Artificial
  CRISPR gRNA sequence
taggtgagaataccaggaag

SEQ ID NO: 527776 - DNA, 20 bp, Artificial
  CRISPR gRNA sequence
aggtgagaataccaggaagc

SEQ ID NO: 527777 - DNA, 20 bp, Artificial
  CRISPR gRNA sequence
ggtgagaataccaggaagca

SEQ ID NO: 527778 - DNA, 20 bp, Artificial
  CRISPR gRNA sequence
gtgagaataccaggaagcag

SEQ ID NO: 527779 - DNA, 20 bp, Artificial
  CRISPR gRNA sequence
ccaggaagcaggggtcattg

SEQ ID NO: 527780 - DNA, 20 bp, Artificial
  CRISPR gRNA sequence
caggaagcaggggtcattga

SEQ ID NO: 527781 - DNA, 20 bp, Artificial
  CRISPR gRNA sequence
aggggtcattgaaggcatct

SEQ ID NO: 527782 - DNA, 20 bp, Artificial
  CRISPR gRNA sequence
gggtcattgaaggcatctga

SEQ ID NO: 527783 - DNA, 20 bp, Artificial
  CRISPR gRNA sequence
ctgccaatcaccaacttgac

SEQ ID NO: 527784 - DNA, 20 bp, Artificial
  CRISPR gRNA sequence
gaccagcatcacttcacccc

SEQ ID NO: 527785 - DNA, 20 bp, Artificial
  CRISPR gRNA sequence
ttcacccccggttttcccac

SEQ ID NO: 527786 - DNA, 20 bp, Artificial
  CRISPR gRNA sequence
tcccacattcccccatcact

SEQ ID NO: 527787 - DNA, 20 bp, Artificial
  CRISPR gRNA sequence
cccacattcccccatcacta

SEQ ID NO: 527788 - DNA, 20 bp, Artificial
  CRISPR gRNA sequence
attcccccatcactaaggca

SEQ ID NO: 527789 - DNA, 20 bp, Artificial
  CRISPR gRNA sequence
ccccatcactaaggcacagt

SEQ ID NO: 527790 - DNA, 20 bp, Artificial
  CRISPR gRNA sequence
tcactaaggcacagtaagtg

SEQ ID NO: 527791 - DNA, 20 bp, Artificial
  CRISPR gRNA sequence
ttgacttcgcaacttttttt

SEQ ID NO: 527792 - DNA, 20 bp, Artificial
  CRISPR gRNA sequence
cttcgcaactttttttgaga

SEQ ID NO: 527793 - DNA, 20 bp, Artificial
  CRISPR gRNA sequence
ttcgcaactttttttgagac

SEQ ID NO: 527794 - DNA, 20 bp, Artificial
  CRISPR gRNA sequence
tcgcaactttttttgagaca

SEQ ID NO: 527795 - DNA, 20 bp, Artificial
  CRISPR gRNA sequence
cagggttttgctctgttgcc

SEQ ID NO: 527796 - DNA, 20 bp, Artificial
  CRISPR gRNA sequence
agggttttgctctgttgcca

SEQ ID NO: 527797 - DNA, 20 bp, Artificial
  CRISPR gRNA sequence
ttttgctctgttgccaaggc

SEQ ID NO: 527798 - DNA, 20 bp, Artificial
  CRISPR gRNA sequence
ttgctctgttgccaaggctg

SEQ ID NO: 527799 - DNA, 20 bp, Artificial
  CRISPR gRNA sequence
ctgttgccaaggctggagtg

SEQ ID NO: 527800 - DNA, 20 bp, Artificial
  CRISPR gRNA sequence
ttgccaaggctggagtgtgg

SEQ ID NO: 527801 - DNA, 20 bp, Artificial
  CRISPR gRNA sequence
ggagtgtggtagtatgatca

SEQ ID NO: 527802 - DNA, 20 bp, Artificial
  CRISPR gRNA sequence
ggtagtatgatcatagctct

SEQ ID NO: 527803 - DNA, 20 bp, Artificial
  CRISPR gRNA sequence
agtatgatcatagctctcag

SEQ ID NO: 527804 - DNA, 20 bp, Artificial
  CRISPR gRNA sequence
tctcagcagcctccacctcc

SEQ ID NO: 527805 - DNA, 20 bp, Artificial
  CRISPR gRNA sequence
ctcagcagcctccacctccc

SEQ ID NO: 527806 - DNA, 20 bp, Artificial
  CRISPR gRNA sequence
agcctccacctcccaggctc

SEQ ID NO: 527807 - DNA, 20 bp, Artificial
  CRISPR gRNA sequence
ctcaagcaatcctcccacct

SEQ ID NO: 527808 - DNA, 20 bp, Artificial
  CRISPR gRNA sequence
tcctcccacctcagcctccc

SEQ ID NO: 527809 - DNA, 20 bp, Artificial
  CRISPR gRNA sequence
tcccacctcagcctccccag

SEQ ID NO: 527810 - DNA, 20 bp, Artificial
  CRISPR gRNA sequence
cctcagcctccccagtagct

SEQ ID NO: 527811 - DNA, 20 bp, Artificial
  CRISPR gRNA sequence
ctccccagtagctgagatta

SEQ ID NO: 527812 - DNA, 20 bp, Artificial
  CRISPR gRNA sequence
tccccagtagctgagattac

SEQ ID NO: 527813 - DNA, 20 bp, Artificial
  CRISPR gRNA sequence
cccagtagctgagattacag

SEQ ID NO: 527814 - DNA, 20 bp, Artificial
  CRISPR gRNA sequence
caggagcatgccaccacacc

SEQ ID NO: 527815 - DNA, 20 bp, Artificial
  CRISPR gRNA sequence
agctaatttttaaaattttg

SEQ ID NO: 527816 - DNA, 20 bp, Artificial
  CRISPR gRNA sequence
ctaatttttaaaattttgta

SEQ ID NO: 527817 - DNA, 20 bp, Artificial
  CRISPR gRNA sequence
ttttaaaattttgtagagat

SEQ ID NO: 527818 - DNA, 20 bp, Artificial
  CRISPR gRNA sequence
tttaaaattttgtagagata

SEQ ID NO: 527819 - DNA, 20 bp, Artificial
  CRISPR gRNA sequence
taaggtctcactctgttgcc

SEQ ID NO: 527820 - DNA, 20 bp, Artificial
  CRISPR gRNA sequence
aaggtctcactctgttgccc

SEQ ID NO: 527821 - DNA, 20 bp, Artificial
  CRISPR gRNA sequence
tctcactctgttgcccaggc

SEQ ID NO: 527822 - DNA, 20 bp, Artificial
  CRISPR gRNA sequence
ctcaaactatcctcccacct

SEQ ID NO: 527823 - DNA, 20 bp, Artificial
  CRISPR gRNA sequence
cctcccacctcagcctccca

SEQ ID NO: 527824 - DNA, 20 bp, Artificial
  CRISPR gRNA sequence
acctcagcctcccaaagtgc

SEQ ID NO: 527825 - DNA, 20 bp, Artificial
  CRISPR gRNA sequence
cctcagcctcccaaagtgct

SEQ ID NO: 527826 - DNA, 20 bp, Artificial
  CRISPR gRNA sequence
ctcccaaagtgctgggatta

SEQ ID NO: 527827 - DNA, 20 bp, Artificial
  CRISPR gRNA sequence
tcccaaagtgctgggattat

SEQ ID NO: 527828 - DNA, 20 bp, Artificial
  CRISPR gRNA sequence
agtgctgggattataggcat

SEQ ID NO: 527829 - DNA, 20 bp, Artificial
  CRISPR gRNA sequence
attataggcatgagtcactg

SEQ ID NO: 527830 - DNA, 20 bp, Artificial
  CRISPR gRNA sequence
ataggcatgagtcactgcag

SEQ ID NO: 527831 - DNA, 20 bp, Artificial
  CRISPR gRNA sequence
atgagtcactgcagtggcct

SEQ ID NO: 527832 - DNA, 20 bp, Artificial
  CRISPR gRNA sequence
tgagtcactgcagtggcctc

SEQ ID NO: 527833 - DNA, 20 bp, Artificial
  CRISPR gRNA sequence
agtcactgcagtggcctcgg

SEQ ID NO: 527834 - DNA, 20 bp, Artificial
  CRISPR gRNA sequence
ggcctcgggagatctttgat

SEQ ID NO: 527835 - DNA, 20 bp, Artificial
  CRISPR gRNA sequence
cctcgggagatctttgatta

SEQ ID NO: 527836 - DNA, 20 bp, Artificial
  CRISPR gRNA sequence
agatctttgattagagttgc

SEQ ID NO: 527837 - DNA, 20 bp, Artificial
  CRISPR gRNA sequence
ttgattagagttgccagata

SEQ ID NO: 527838 - DNA, 20 bp, Artificial
  CRISPR gRNA sequence
agatatagcaaataaaaata

SEQ ID NO: 527839 - DNA, 20 bp, Artificial
  CRISPR gRNA sequence
agcaaataaaaatacagcat

SEQ ID NO: 527840 - DNA, 20 bp, Artificial
  CRISPR gRNA sequence
aatacagcataagtacgttt

SEQ ID NO: 527841 - DNA, 20 bp, Artificial
  CRISPR gRNA sequence
agtacgtttcagatattgca

SEQ ID NO: 527842 - DNA, 20 bp, Artificial
  CRISPR gRNA sequence
tgcatggaacatacttatgc

SEQ ID NO: 527843 - DNA, 20 bp, Artificial
  CRISPR gRNA sequence
atctgaaattcaaatttaac

SEQ ID NO: 527844 - DNA, 20 bp, Artificial
  CRISPR gRNA sequence
tctgaaattcaaatttaact

SEQ ID NO: 527845 - DNA, 20 bp, Artificial
  CRISPR gRNA sequence
tgggtgttttgcattatatc

SEQ ID NO: 527846 - DNA, 20 bp, Artificial
  CRISPR gRNA sequence
cttttcatgtttattttaac

SEQ ID NO: 527847 - DNA, 20 bp, Artificial
  CRISPR gRNA sequence
tttcatgtttattttaactg

SEQ ID NO: 527848 - DNA, 20 bp, Artificial
  CRISPR gRNA sequence
ttattttaactggagcccac

SEQ ID NO: 527849 - DNA, 20 bp, Artificial
  CRISPR gRNA sequence
gtataaatatgtgtgtgtat

SEQ ID NO: 527850 - DNA, 20 bp, Artificial
  CRISPR gRNA sequence
tataaatatgtgtgtgtatt

SEQ ID NO: 527851 - DNA, 20 bp, Artificial
  CRISPR gRNA sequence
ataaatatgtgtgtgtatta

SEQ ID NO: 527852 - DNA, 20 bp, Artificial
  CRISPR gRNA sequence
atatgtgtgtgtattaggga

SEQ ID NO: 527853 - DNA, 20 bp, Artificial
  CRISPR gRNA sequence
tgtgtgtgtattagggatgg

SEQ ID NO: 527854 - DNA, 20 bp, Artificial
  CRISPR gRNA sequence
gtgtgtgtattagggatgga

SEQ ID NO: 527855 - DNA, 20 bp, Artificial
  CRISPR gRNA sequence
gtgtgtattagggatggaag

SEQ ID NO: 527856 - DNA, 20 bp, Artificial
  CRISPR gRNA sequence
tgtgtattagggatggaagg

SEQ ID NO: 527857 - DNA, 20 bp, Artificial
  CRISPR gRNA sequence
gtgtattagggatggaagga

SEQ ID NO: 527858 - DNA, 20 bp, Artificial
  CRISPR gRNA sequence
gtattagggatggaaggagg

SEQ ID NO: 527859 - DNA, 20 bp, Artificial
  CRISPR gRNA sequence
attagggatggaaggaggga

SEQ ID NO: 527860 - DNA, 20 bp, Artificial
  CRISPR gRNA sequence
tagggatggaaggagggaga

SEQ ID NO: 527861 - DNA, 20 bp, Artificial
  CRISPR gRNA sequence
agggatggaaggagggagag

SEQ ID NO: 527862 - DNA, 20 bp, Artificial
  CRISPR gRNA sequence
gggatggaaggagggagaga

SEQ ID NO: 527863 - DNA, 20 bp, Artificial
  CRISPR gRNA sequence
gatggaaggagggagagagg

SEQ ID NO: 527864 - DNA, 20 bp, Artificial
  CRISPR gRNA sequence
atggaaggagggagagaggg

SEQ ID NO: 527865 - DNA, 20 bp, Artificial
  CRISPR gRNA sequence
gagggagagagggaggacct

SEQ ID NO: 527866 - DNA, 20 bp, Artificial
  CRISPR gRNA sequence
agggagagagggaggacctt

SEQ ID NO: 527867 - DNA, 20 bp, Artificial
  CRISPR gRNA sequence
ggagagagggaggaccttgg

SEQ ID NO: 527868 - DNA, 20 bp, Artificial
  CRISPR gRNA sequence
gagagggaggaccttgggag

SEQ ID NO: 527869 - DNA, 20 bp, Artificial
  CRISPR gRNA sequence
ggaggaccttgggagcagcc

SEQ ID NO: 527870 - DNA, 20 bp, Artificial
  CRISPR gRNA sequence
gaggaccttgggagcagcca

SEQ ID NO: 527871 - DNA, 20 bp, Artificial
  CRISPR gRNA sequence
ttgggagcagccaaggtttg

SEQ ID NO: 527872 - DNA, 20 bp, Artificial
  CRISPR gRNA sequence
tgggagcagccaaggtttga

SEQ ID NO: 527873 - DNA, 20 bp, Artificial
  CRISPR gRNA sequence
agcagccaaggtttgaaggc

SEQ ID NO: 527874 - DNA, 20 bp, Artificial
  CRISPR gRNA sequence
cacttatgtcccttactcta

SEQ ID NO: 527875 - DNA, 20 bp, Artificial
  CRISPR gRNA sequence
atgtcccttactctatggtg

SEQ ID NO: 527876 - DNA, 20 bp, Artificial
  CRISPR gRNA sequence
gtcccttactctatggtgca

SEQ ID NO: 527877 - DNA, 20 bp, Artificial
  CRISPR gRNA sequence
ccttactctatggtgcagag

SEQ ID NO: 527878 - DNA, 20 bp, Artificial
  CRISPR gRNA sequence
tactctatggtgcagagcag

SEQ ID NO: 527879 - DNA, 20 bp, Artificial
  CRISPR gRNA sequence
gcagagcagaagctcattgc

SEQ ID NO: 527880 - DNA, 20 bp, Artificial
  CRISPR gRNA sequence
gagcagaagctcattgcgag

SEQ ID NO: 527881 - DNA, 20 bp, Artificial
  CRISPR gRNA sequence
agcagaagctcattgcgaga

SEQ ID NO: 527882 - DNA, 20 bp, Artificial
  CRISPR gRNA sequence
ctcattgcgagaaggaccac

SEQ ID NO: 527883 - DNA, 20 bp, Artificial
  CRISPR gRNA sequence
tcattgcgagaaggaccact

SEQ ID NO: 527884 - DNA, 20 bp, Artificial
  CRISPR gRNA sequence
cattgcgagaaggaccacta

SEQ ID NO: 527885 - DNA, 20 bp, Artificial
  CRISPR gRNA sequence
ttgcgagaaggaccactagg

SEQ ID NO: 527886 - DNA, 20 bp, Artificial
  CRISPR gRNA sequence
gagaaggaccactagggaga

SEQ ID NO: 527887 - DNA, 20 bp, Artificial
  CRISPR gRNA sequence
agaaggaccactagggagat

SEQ ID NO: 527888 - DNA, 20 bp, Artificial
  CRISPR gRNA sequence
aggaccactagggagatggg

SEQ ID NO: 527889 - DNA, 20 bp, Artificial
  CRISPR gRNA sequence
agggagatgggaagaatacc

SEQ ID NO: 527890 - DNA, 20 bp, Artificial
  CRISPR gRNA sequence
gggagatgggaagaatacct

SEQ ID NO: 527891 - DNA, 20 bp, Artificial
  CRISPR gRNA sequence
ggagatgggaagaatacctg

SEQ ID NO: 527892 - DNA, 20 bp, Artificial
  CRISPR gRNA sequence
agatgggaagaatacctggg

SEQ ID NO: 527893 - DNA, 20 bp, Artificial
  CRISPR gRNA sequence
atgggaagaatacctgggga

SEQ ID NO: 527894 - DNA, 20 bp, Artificial
  CRISPR gRNA sequence
aagaatacctggggagagat

SEQ ID NO: 527895 - DNA, 20 bp, Artificial
  CRISPR gRNA sequence
agaatacctggggagagatt

SEQ ID NO: 527896 - DNA, 20 bp, Artificial
  CRISPR gRNA sequence
gaatacctggggagagatta

SEQ ID NO: 527897 - DNA, 20 bp, Artificial
  CRISPR gRNA sequence
tacctggggagagattaggg

SEQ ID NO: 527898 - DNA, 20 bp, Artificial
  CRISPR gRNA sequence
cctggggagagattagggtg

SEQ ID NO: 527899 - DNA, 20 bp, Artificial
  CRISPR gRNA sequence
ctggggagagattagggtgg

SEQ ID NO: 527900 - DNA, 20 bp, Artificial
  CRISPR gRNA sequence
ggggagagattagggtggag

SEQ ID NO: 527901 - DNA, 20 bp, Artificial
  CRISPR gRNA sequence
gggtggaggagctgctcttg

SEQ ID NO: 527902 - DNA, 20 bp, Artificial
  CRISPR gRNA sequence
gctgctcttgaagacccgaa

SEQ ID NO: 527903 - DNA, 20 bp, Artificial
  CRISPR gRNA sequence
ctgctcttgaagacccgaaa

SEQ ID NO: 527904 - DNA, 20 bp, Artificial
  CRISPR gRNA sequence
tgctcttgaagacccgaaaa

SEQ ID NO: 527905 - DNA, 20 bp, Artificial
  CRISPR gRNA sequence
tgaagacccgaaaagggatt

SEQ ID NO: 527906 - DNA, 20 bp, Artificial
  CRISPR gRNA sequence
agacccgaaaagggatttgg

SEQ ID NO: 527907 - DNA, 20 bp, Artificial
  CRISPR gRNA sequence
atttggaagttttattctga

SEQ ID NO: 527908 - DNA, 20 bp, Artificial
  CRISPR gRNA sequence
tttggaagttttattctgaa

SEQ ID NO: 527909 - DNA, 20 bp, Artificial
  CRISPR gRNA sequence
aagttttattctgaaaggcc

SEQ ID NO: 527910 - DNA, 20 bp, Artificial
  CRISPR gRNA sequence
agttttattctgaaaggcca

SEQ ID NO: 527911 - DNA, 20 bp, Artificial
  CRISPR gRNA sequence
tttattctgaaaggccaagg

SEQ ID NO: 527912 - DNA, 20 bp, Artificial
  CRISPR gRNA sequence
tattctgaaaggccaaggca

SEQ ID NO: 527913 - DNA, 20 bp, Artificial
  CRISPR gRNA sequence
ttctgaaaggccaaggcaga

SEQ ID NO: 527914 - DNA, 20 bp, Artificial
  CRISPR gRNA sequence
tctgaaaggccaaggcagag

SEQ ID NO: 527915 - DNA, 20 bp, Artificial
  CRISPR gRNA sequence
tgaaaggccaaggcagagag

SEQ ID NO: 527916 - DNA, 20 bp, Artificial
  CRISPR gRNA sequence
gccaaggcagagaggagcaa

SEQ ID NO: 527917 - DNA, 20 bp, Artificial
  CRISPR gRNA sequence
aggcagagaggagcaatggt

SEQ ID NO: 527918 - DNA, 20 bp, Artificial
  CRISPR gRNA sequence
gcagagaggagcaatggtca

SEQ ID NO: 527919 - DNA, 20 bp, Artificial
  CRISPR gRNA sequence
atggtcagagtctgaccatt

SEQ ID NO: 527920 - DNA, 20 bp, Artificial
  CRISPR gRNA sequence
cagagtctgaccatttggct

SEQ ID NO: 527921 - DNA, 20 bp, Artificial
  CRISPR gRNA sequence
tctgaccatttggctcagat

SEQ ID NO: 527922 - DNA, 20 bp, Artificial
  CRISPR gRNA sequence
ctgaccatttggctcagatt

SEQ ID NO: 527923 - DNA, 20 bp, Artificial
  CRISPR gRNA sequence
ccatttggctcagattaggt

SEQ ID NO: 527924 - DNA, 20 bp, Artificial
  CRISPR gRNA sequence
catacttaaaatcaaaatac

SEQ ID NO: 527925 - DNA, 20 bp, Artificial
  CRISPR gRNA sequence
atacttaaaatcaaaatact

SEQ ID NO: 527926 - DNA, 20 bp, Artificial
  CRISPR gRNA sequence
acttaaaatcaaaatactag

SEQ ID NO: 527927 - DNA, 20 bp, Artificial
  CRISPR gRNA sequence
cttaaaatcaaaatactagg

SEQ ID NO: 527928 - DNA, 20 bp, Artificial
  CRISPR gRNA sequence
aaaatcaaaatactaggagg

SEQ ID NO: 527929 - DNA, 20 bp, Artificial
  CRISPR gRNA sequence
aaatcaaaatactaggagga

SEQ ID NO: 527930 - DNA, 20 bp, Artificial
  CRISPR gRNA sequence
aaaatactaggaggaaggaa

SEQ ID NO: 527931 - DNA, 20 bp, Artificial
  CRISPR gRNA sequence
ctaggaggaaggaacagatt

SEQ ID NO: 527932 - DNA, 20 bp, Artificial
  CRISPR gRNA sequence
taatttgtcacataaactca

SEQ ID NO: 527933 - DNA, 20 bp, Artificial
  CRISPR gRNA sequence
aatttgtcacataaactcat

SEQ ID NO: 527934 - DNA, 20 bp, Artificial
  CRISPR gRNA sequence
ctcatgggcatgtgatctcc

SEQ ID NO: 527935 - DNA, 20 bp, Artificial
  CRISPR gRNA sequence
catgggcatgtgatctccaa

SEQ ID NO: 527936 - DNA, 20 bp, Artificial
  CRISPR gRNA sequence
tgatctccaagagatactgt

SEQ ID NO: 527937 - DNA, 20 bp, Artificial
  CRISPR gRNA sequence
tctccaagagatactgttgg

SEQ ID NO: 527938 - DNA, 20 bp, Artificial
  CRISPR gRNA sequence
caagagatactgttggaaga

SEQ ID NO: 527939 - DNA, 20 bp, Artificial
  CRISPR gRNA sequence
ctgttggaagatagtatgcc

SEQ ID NO: 527940 - DNA, 20 bp, Artificial
  CRISPR gRNA sequence
gaagatagtatgcctggatt

SEQ ID NO: 527941 - DNA, 20 bp, Artificial
  CRISPR gRNA sequence
aagatagtatgcctggattt

SEQ ID NO: 527942 - DNA, 20 bp, Artificial
  CRISPR gRNA sequence
gtatgcctggatttaggaac

SEQ ID NO: 527943 - DNA, 20 bp, Artificial
  CRISPR gRNA sequence
tatgcctggatttaggaact

SEQ ID NO: 527944 - DNA, 20 bp, Artificial
  CRISPR gRNA sequence
tgcctggatttaggaactgg

SEQ ID NO: 527945 - DNA, 20 bp, Artificial
  CRISPR gRNA sequence
gcctggatttaggaactggg

SEQ ID NO: 527946 - DNA, 20 bp, Artificial
  CRISPR gRNA sequence
cctggatttaggaactggga

SEQ ID NO: 527947 - DNA, 20 bp, Artificial
  CRISPR gRNA sequence
gagggcatatttttgactga

SEQ ID NO: 527948 - DNA, 20 bp, Artificial
  CRISPR gRNA sequence
ccgctgcttctgaaacatga

SEQ ID NO: 527949 - DNA, 20 bp, Artificial
  CRISPR gRNA sequence
gatggaacattccccaccaa

SEQ ID NO: 527950 - DNA, 20 bp, Artificial
  CRISPR gRNA sequence
ttccccaccaaaagtactac

SEQ ID NO: 527951 - DNA, 20 bp, Artificial
  CRISPR gRNA sequence
tccccaccaaaagtactacc

SEQ ID NO: 527952 - DNA, 20 bp, Artificial
  CRISPR gRNA sequence
aaaagtactaccaggtgccc

SEQ ID NO: 527953 - DNA, 20 bp, Artificial
  CRISPR gRNA sequence
aaagtactaccaggtgcccc

SEQ ID NO: 527954 - DNA, 20 bp, Artificial
  CRISPR gRNA sequence
aagtactaccaggtgcccca

SEQ ID NO: 527955 - DNA, 20 bp, Artificial
  CRISPR gRNA sequence
ggtgccccagggcaccaccc

SEQ ID NO: 527956 - DNA, 20 bp, Artificial
  CRISPR gRNA sequence
gggcaccaccctggacaaac

SEQ ID NO: 527957 - DNA, 20 bp, Artificial
  CRISPR gRNA sequence
gcaccaccctggacaaactg

SEQ ID NO: 527958 - DNA, 20 bp, Artificial
  CRISPR gRNA sequence
accaccctggacaaactgga

SEQ ID NO: 527959 - DNA, 20 bp, Artificial
  CRISPR gRNA sequence
accctggacaaactggagag

SEQ ID NO: 527960 - DNA, 20 bp, Artificial
  CRISPR gRNA sequence
ccctggacaaactggagagc

SEQ ID NO: 527961 - DNA, 20 bp, Artificial
  CRISPR gRNA sequence
aactggagagcaggctgtgt

SEQ ID NO: 527962 - DNA, 20 bp, Artificial
  CRISPR gRNA sequence
actggagagcaggctgtgta

SEQ ID NO: 527963 - DNA, 20 bp, Artificial
  CRISPR gRNA sequence
ctacattcctgcatgtgccc

SEQ ID NO: 527964 - DNA, 20 bp, Artificial
  CRISPR gRNA sequence
atgtgcccaagataaaattg

SEQ ID NO: 527965 - DNA, 20 bp, Artificial
  CRISPR gRNA sequence
ggccaccctacccgatgact

SEQ ID NO: 527966 - DNA, 20 bp, Artificial
  CRISPR gRNA sequence
ccaccctacccgatgacttg

SEQ ID NO: 527967 - DNA, 20 bp, Artificial
  CRISPR gRNA sequence
caccctacccgatgacttgg

SEQ ID NO: 527968 - DNA, 20 bp, Artificial
  CRISPR gRNA sequence
accctacccgatgacttgga

SEQ ID NO: 527969 - DNA, 20 bp, Artificial
  CRISPR gRNA sequence
ctacccgatgacttggaggg

SEQ ID NO: 527970 - DNA, 20 bp, Artificial
  CRISPR gRNA sequence
ccgatgacttggagggaaga

SEQ ID NO: 527971 - DNA, 20 bp, Artificial
  CRISPR gRNA sequence
gatgacttggagggaagatg

SEQ ID NO: 527972 - DNA, 20 bp, Artificial
  CRISPR gRNA sequence
acttggagggaagatggagc

SEQ ID NO: 527973 - DNA, 20 bp, Artificial
  CRISPR gRNA sequence
tggagggaagatggagctgg

SEQ ID NO: 527974 - DNA, 20 bp, Artificial
  CRISPR gRNA sequence
gagctggtggctgcatgact

SEQ ID NO: 527975 - DNA, 20 bp, Artificial
  CRISPR gRNA sequence
acttagccatgtgctcccca

SEQ ID NO: 527976 - DNA, 20 bp, Artificial
  CRISPR gRNA sequence
atgtgctccccaaagcattt

SEQ ID NO: 527977 - DNA, 20 bp, Artificial
  CRISPR gRNA sequence
tgtgctccccaaagcatttc

SEQ ID NO: 527978 - DNA, 20 bp, Artificial
  CRISPR gRNA sequence
aggcctgccctgccccaccc

SEQ ID NO: 527979 - DNA, 20 bp, Artificial
  CRISPR gRNA sequence
ggcctgccctgccccacccc

SEQ ID NO: 527980 - DNA, 20 bp, Artificial
  CRISPR gRNA sequence
caccccgggtcaaatctgaa

SEQ ID NO: 527981 - DNA, 20 bp, Artificial
  CRISPR gRNA sequence
gtcaaatctgaaaagttctc

SEQ ID NO: 527982 - DNA, 20 bp, Artificial
  CRISPR gRNA sequence
atctgaaaagttctcaagct

SEQ ID NO: 527983 - DNA, 20 bp, Artificial
  CRISPR gRNA sequence
tgaaaagttctcaagctcag

SEQ ID NO: 527984 - DNA, 20 bp, Artificial
  CRISPR gRNA sequence
gaaaagttctcaagctcagc

SEQ ID NO: 527985 - DNA, 20 bp, Artificial
  CRISPR gRNA sequence
aagttctcaagctcagcagg

SEQ ID NO: 527986 - DNA, 20 bp, Artificial
  CRISPR gRNA sequence
ttctcaagctcagcaggaag

SEQ ID NO: 527987 - DNA, 20 bp, Artificial
  CRISPR gRNA sequence
gctcagcaggaagtggcctc

SEQ ID NO: 527988 - DNA, 20 bp, Artificial
  CRISPR gRNA sequence
gtatctcctgcccctcgtcc

SEQ ID NO: 527989 - DNA, 20 bp, Artificial
  CRISPR gRNA sequence
ctcctgcccctcgtccaagc

SEQ ID NO: 527990 - DNA, 20 bp, Artificial
  CRISPR gRNA sequence
ctgcccctcgtccaagccag

SEQ ID NO: 527991 - DNA, 20 bp, Artificial
  CRISPR gRNA sequence
tgcccctcgtccaagccagc

SEQ ID NO: 527992 - DNA, 20 bp, Artificial
  CRISPR gRNA sequence
gcccctcgtccaagccagca

SEQ ID NO: 527993 - DNA, 20 bp, Artificial
  CRISPR gRNA sequence
gtccaagccagcagggccta

SEQ ID NO: 527994 - DNA, 20 bp, Artificial
  CRISPR gRNA sequence
tccaagccagcagggcctaa

SEQ ID NO: 527995 - DNA, 20 bp, Artificial
  CRISPR gRNA sequence
ccaagccagcagggcctaaa

SEQ ID NO: 527996 - DNA, 20 bp, Artificial
  CRISPR gRNA sequence
ctttactgacccaatttcaa

SEQ ID NO: 527997 - DNA, 20 bp, Artificial
  CRISPR gRNA sequence
tgacccaatttcaatggttt

SEQ ID NO: 527998 - DNA, 20 bp, Artificial
  CRISPR gRNA sequence
taagattatgtctgcttctc

SEQ ID NO: 527999 - DNA, 20 bp, Artificial
  CRISPR gRNA sequence
gattatgtctgcttctctgg

SEQ ID NO: 528000 - DNA, 20 bp, Artificial
  CRISPR gRNA sequence
ttatgtctgcttctctggtg

SEQ ID NO: 528001 - DNA, 20 bp, Artificial
  CRISPR gRNA sequence
tatgtctgcttctctggtgg

SEQ ID NO: 528002 - DNA, 20 bp, Artificial
  CRISPR gRNA sequence
tctggtggaggcctcttcat

SEQ ID NO: 528003 - DNA, 20 bp, Artificial
  CRISPR gRNA sequence
ggtggaggcctcttcatcag

SEQ ID NO: 528004 - DNA, 20 bp, Artificial
  CRISPR gRNA sequence
tggaggcctcttcatcagta

SEQ ID NO: 528005 - DNA, 20 bp, Artificial
  CRISPR gRNA sequence
gcctcttcatcagtagagct

SEQ ID NO: 528006 - DNA, 20 bp, Artificial
  CRISPR gRNA sequence
ctcttcatcagtagagctta

SEQ ID NO: 528007 - DNA, 20 bp, Artificial
  CRISPR gRNA sequence
cttcatcagtagagcttaga

SEQ ID NO: 528008 - DNA, 20 bp, Artificial
  CRISPR gRNA sequence
agcttagagagttgtgtaac

SEQ ID NO: 528009 - DNA, 20 bp, Artificial
  CRISPR gRNA sequence
ttagagagttgtgtaactgg

SEQ ID NO: 528010 - DNA, 20 bp, Artificial
  CRISPR gRNA sequence
tagagagttgtgtaactggc

SEQ ID NO: 528011 - DNA, 20 bp, Artificial
  CRISPR gRNA sequence
agttgtgtaactggcaggca

SEQ ID NO: 528012 - DNA, 20 bp, Artificial
  CRISPR gRNA sequence
tgtaactggcaggcaaagaa

SEQ ID NO: 528013 - DNA, 20 bp, Artificial
  CRISPR gRNA sequence
gtaactggcaggcaaagaat

SEQ ID NO: 528014 - DNA, 20 bp, Artificial
  CRISPR gRNA sequence
ctggcaggcaaagaatgggt

SEQ ID NO: 528015 - DNA, 20 bp, Artificial
  CRISPR gRNA sequence
ggcaggcaaagaatgggtca

SEQ ID NO: 528016 - DNA, 20 bp, Artificial
  CRISPR gRNA sequence
caggcaaagaatgggtcaga

SEQ ID NO: 528017 - DNA, 20 bp, Artificial
  CRISPR gRNA sequence
ggcaaagaatgggtcagaga

SEQ ID NO: 528018 - DNA, 20 bp, Artificial
  CRISPR gRNA sequence
aatgggtcagagagagactc

SEQ ID NO: 528019 - DNA, 20 bp, Artificial
  CRISPR gRNA sequence
atgggtcagagagagactcg

SEQ ID NO: 528020 - DNA, 20 bp, Artificial
  CRISPR gRNA sequence
gtcagagagagactcgagga

SEQ ID NO: 528021 - DNA, 20 bp, Artificial
  CRISPR gRNA sequence
gagagagactcgaggaaaga

SEQ ID NO: 528022 - DNA, 20 bp, Artificial
  CRISPR gRNA sequence
agactcgaggaaagaaagcc

SEQ ID NO: 528023 - DNA, 20 bp, Artificial
  CRISPR gRNA sequence
ccaagatgaataaaccacca

SEQ ID NO: 528024 - DNA, 20 bp, Artificial
  CRISPR gRNA sequence
gtttgatgatctgttaaact

SEQ ID NO: 528025 - DNA, 20 bp, Artificial
  CRISPR gRNA sequence
atctgttaaacttggtttct

SEQ ID NO: 528026 - DNA, 20 bp, Artificial
  CRISPR gRNA sequence
tgagcctctgaccctctcct

SEQ ID NO: 528027 - DNA, 20 bp, Artificial
  CRISPR gRNA sequence
gagcctctgaccctctcctt

SEQ ID NO: 528028 - DNA, 20 bp, Artificial
  CRISPR gRNA sequence
agcctctgaccctctccttg

SEQ ID NO: 528029 - DNA, 20 bp, Artificial
  CRISPR gRNA sequence
cctctccttggggcccatcc

SEQ ID NO: 528030 - DNA, 20 bp, Artificial
  CRISPR gRNA sequence
ctctccttggggcccatcct

SEQ ID NO: 528031 - DNA, 20 bp, Artificial
  CRISPR gRNA sequence
atcctgggcttcatgtataa

SEQ ID NO: 528032 - DNA, 20 bp, Artificial
  CRISPR gRNA sequence
catgtataacagtgtctccc

SEQ ID NO: 528033 - DNA, 20 bp, Artificial
  CRISPR gRNA sequence
ctccctggtatgtttttgcc

SEQ ID NO: 528034 - DNA, 20 bp, Artificial
  CRISPR gRNA sequence
ccctggtatgtttttgcctg

SEQ ID NO: 528035 - DNA, 20 bp, Artificial
  CRISPR gRNA sequence
tggtatgtttttgcctggag

SEQ ID NO: 528036 - DNA, 20 bp, Artificial
  CRISPR gRNA sequence
aagcatttcttttgtgatgc

SEQ ID NO: 528037 - DNA, 20 bp, Artificial
  CRISPR gRNA sequence
agcatttcttttgtgatgct

SEQ ID NO: 528038 - DNA, 20 bp, Artificial
  CRISPR gRNA sequence
ttcttttgtgatgctgggcc

SEQ ID NO: 528039 - DNA, 20 bp, Artificial
  CRISPR gRNA sequence
tgtgatgctgggccaagttc

SEQ ID NO: 528040 - DNA, 20 bp, Artificial
  CRISPR gRNA sequence
ccaagttccagtttgttctt

SEQ ID NO: 528041 - DNA, 20 bp, Artificial
  CRISPR gRNA sequence
atgaccccgtcccctgaccc

SEQ ID NO: 528042 - DNA, 20 bp, Artificial
  CRISPR gRNA sequence
ctaactgctattgactcaca

SEQ ID NO: 528043 - DNA, 20 bp, Artificial
  CRISPR gRNA sequence
taactgctattgactcacaa

SEQ ID NO: 528044 - DNA, 20 bp, Artificial
  CRISPR gRNA sequence
aactgctattgactcacaaa

SEQ ID NO: 528045 - DNA, 20 bp, Artificial
  CRISPR gRNA sequence
tgctattgactcacaaaggg

SEQ ID NO: 528046 - DNA, 20 bp, Artificial
  CRISPR gRNA sequence
attgactcacaaagggcaga

SEQ ID NO: 528047 - DNA, 20 bp, Artificial
  CRISPR gRNA sequence
tcacaaagggcagacagccc

SEQ ID NO: 528048 - DNA, 20 bp, Artificial
  CRISPR gRNA sequence
cctcctgtttcccctgttgc

SEQ ID NO: 528049 - DNA, 20 bp, Artificial
  CRISPR gRNA sequence
ctcctgtttcccctgttgct

SEQ ID NO: 528050 - DNA, 20 bp, Artificial
  CRISPR gRNA sequence
tttcccctgttgctgggaaa

SEQ ID NO: 528051 - DNA, 20 bp, Artificial
  CRISPR gRNA sequence
tgttgctgggaaacagctcc

SEQ ID NO: 528052 - DNA, 20 bp, Artificial
  CRISPR gRNA sequence
gaaacagctcccagaaacac

SEQ ID NO: 528053 - DNA, 20 bp, Artificial
  CRISPR gRNA sequence
gctcccagaaacaccagtgc

SEQ ID NO: 528054 - DNA, 20 bp, Artificial
  CRISPR gRNA sequence
aaacaccagtgcgagaacac

SEQ ID NO: 528055 - DNA, 20 bp, Artificial
  CRISPR gRNA sequence
accagtgcgagaacactagt

SEQ ID NO: 528056 - DNA, 20 bp, Artificial
  CRISPR gRNA sequence
cagtgcgagaacactagtaa

SEQ ID NO: 528057 - DNA, 20 bp, Artificial
  CRISPR gRNA sequence
gcgagaacactagtaagagc

SEQ ID NO: 528058 - DNA, 20 bp, Artificial
  CRISPR gRNA sequence
ctcacatttgtgttgtttta

SEQ ID NO: 528059 - DNA, 20 bp, Artificial
  CRISPR gRNA sequence
gtgttgttttacagtttaca

SEQ ID NO: 528060 - DNA, 20 bp, Artificial
  CRISPR gRNA sequence
attatctgattgacttccaa

SEQ ID NO: 528061 - DNA, 20 bp, Artificial
  CRISPR gRNA sequence
ccaacagccaccctatgatg

SEQ ID NO: 528062 - DNA, 20 bp, Artificial
  CRISPR gRNA sequence
caacagccaccctatgatgt

SEQ ID NO: 528063 - DNA, 20 bp, Artificial
  CRISPR gRNA sequence
ttcattatctccactttaca

SEQ ID NO: 528064 - DNA, 20 bp, Artificial
  CRISPR gRNA sequence
attatctccactttacaaag

SEQ ID NO: 528065 - DNA, 20 bp, Artificial
  CRISPR gRNA sequence
ttatctccactttacaaaga

SEQ ID NO: 528066 - DNA, 20 bp, Artificial
  CRISPR gRNA sequence
ccactttacaaagaaggaaa

SEQ ID NO: 528067 - DNA, 20 bp, Artificial
  CRISPR gRNA sequence
cactttacaaagaaggaaac

SEQ ID NO: 528068 - DNA, 20 bp, Artificial
  CRISPR gRNA sequence
tacaaagaaggaaacaggct

SEQ ID NO: 528069 - DNA, 20 bp, Artificial
  CRISPR gRNA sequence
caaagaaggaaacaggctca

SEQ ID NO: 528070 - DNA, 20 bp, Artificial
  CRISPR gRNA sequence
aagaaggaaacaggctcaga

SEQ ID NO: 528071 - DNA, 20 bp, Artificial
  CRISPR gRNA sequence
agaaggaaacaggctcagag

SEQ ID NO: 528072 - DNA, 20 bp, Artificial
  CRISPR gRNA sequence
gaaacaggctcagagaggtg

SEQ ID NO: 528073 - DNA, 20 bp, Artificial
  CRISPR gRNA sequence
agaggtgaagtaactctcca

SEQ ID NO: 528074 - DNA, 20 bp, Artificial
  CRISPR gRNA sequence
gtaactctccaaagttcaca

SEQ ID NO: 528075 - DNA, 20 bp, Artificial
  CRISPR gRNA sequence
cacacagctcctgcctaaaa

SEQ ID NO: 528076 - DNA, 20 bp, Artificial
  CRISPR gRNA sequence
agctcctgcctaaaaaagcc

SEQ ID NO: 528077 - DNA, 20 bp, Artificial
  CRISPR gRNA sequence
acccatttcccttaacacca

SEQ ID NO: 528078 - DNA, 20 bp, Artificial
  CRISPR gRNA sequence
ctgttttcctcattgcatta

SEQ ID NO: 528079 - DNA, 20 bp, Artificial
  CRISPR gRNA sequence
tcattgcattacagtgactg

SEQ ID NO: 528080 - DNA, 20 bp, Artificial
  CRISPR gRNA sequence
cattgcattacagtgactga

SEQ ID NO: 528081 - DNA, 20 bp, Artificial
  CRISPR gRNA sequence
cattacagtgactgaaggtc

SEQ ID NO: 528082 - DNA, 20 bp, Artificial
  CRISPR gRNA sequence
gactgaaggtccagcaactg

SEQ ID NO: 528083 - DNA, 20 bp, Artificial
  CRISPR gRNA sequence
aggtccagcaactgaagact

SEQ ID NO: 528084 - DNA, 20 bp, Artificial
  CRISPR gRNA sequence
ttactaacgcactgtgcacc

SEQ ID NO: 528085 - DNA, 20 bp, Artificial
  CRISPR gRNA sequence
tactaacgcactgtgcaccc

SEQ ID NO: 528086 - DNA, 20 bp, Artificial
  CRISPR gRNA sequence
gtgcacccgggtttctctcg

SEQ ID NO: 528087 - DNA, 20 bp, Artificial
  CRISPR gRNA sequence
ccgggtttctctcgtggctc

SEQ ID NO: 528088 - DNA, 20 bp, Artificial
  CRISPR gRNA sequence
cgggtttctctcgtggctcc

SEQ ID NO: 528089 - DNA, 20 bp, Artificial
  CRISPR gRNA sequence
gggtttctctcgtggctcca

SEQ ID NO: 528090 - DNA, 20 bp, Artificial
  CRISPR gRNA sequence
tggctccagggaaactctgt

SEQ ID NO: 528091 - DNA, 20 bp, Artificial
  CRISPR gRNA sequence
gctccagggaaactctgtga

SEQ ID NO: 528092 - DNA, 20 bp, Artificial
  CRISPR gRNA sequence
ctccagggaaactctgtgag

SEQ ID NO: 528093 - DNA, 20 bp, Artificial
  CRISPR gRNA sequence
tccagggaaactctgtgaga

SEQ ID NO: 528094 - DNA, 20 bp, Artificial
  CRISPR gRNA sequence
gaaactctgtgagagggtgc

SEQ ID NO: 528095 - DNA, 20 bp, Artificial
  CRISPR gRNA sequence
tgtgagagggtgctggccgt

SEQ ID NO: 528096 - DNA, 20 bp, Artificial
  CRISPR gRNA sequence
gtgagagggtgctggccgtg

SEQ ID NO: 528097 - DNA, 20 bp, Artificial
  CRISPR gRNA sequence
gagggtgctggccgtgaggt

SEQ ID NO: 528098 - DNA, 20 bp, Artificial
  CRISPR gRNA sequence
gggtgctggccgtgaggtca

SEQ ID NO: 528099 - DNA, 20 bp, Artificial
  CRISPR gRNA sequence
tggccgtgaggtcagagtgc

SEQ ID NO: 528100 - DNA, 20 bp, Artificial
  CRISPR gRNA sequence
ggccgtgaggtcagagtgct

SEQ ID NO: 528101 - DNA, 20 bp, Artificial
  CRISPR gRNA sequence
gtgaggtcagagtgctgggc

SEQ ID NO: 528102 - DNA, 20 bp, Artificial
  CRISPR gRNA sequence
gtcagagtgctgggctggac

SEQ ID NO: 528103 - DNA, 20 bp, Artificial
  CRISPR gRNA sequence
acaagtgaaatatttaccct

SEQ ID NO: 528104 - DNA, 20 bp, Artificial
  CRISPR gRNA sequence
aaatatttaccctgagtgtt

SEQ ID NO: 528105 - DNA, 20 bp, Artificial
  CRISPR gRNA sequence
ctgagtgtttggaaactgcc

SEQ ID NO: 528106 - DNA, 20 bp, Artificial
  CRISPR gRNA sequence
agtgtttggaaactgcctgg

SEQ ID NO: 528107 - DNA, 20 bp, Artificial
  CRISPR gRNA sequence
tgtttggaaactgcctggta

SEQ ID NO: 528108 - DNA, 20 bp, Artificial
  CRISPR gRNA sequence
tggaaactgcctggtagaga

SEQ ID NO: 528109 - DNA, 20 bp, Artificial
  CRISPR gRNA sequence
aactgcctggtagagacagt

SEQ ID NO: 528110 - DNA, 20 bp, Artificial
  CRISPR gRNA sequence
tgcctggtagagacagtgag

SEQ ID NO: 528111 - DNA, 20 bp, Artificial
  CRISPR gRNA sequence
gcctggtagagacagtgaga

SEQ ID NO: 528112 - DNA, 20 bp, Artificial
  CRISPR gRNA sequence
gagacagtgagaaggaatca

SEQ ID NO: 528113 - DNA, 20 bp, Artificial
  CRISPR gRNA sequence
agtgagaaggaatcatggtg

SEQ ID NO: 528114 - DNA, 20 bp, Artificial
  CRISPR gRNA sequence
gagaaggaatcatggtgcag

SEQ ID NO: 528115 - DNA, 20 bp, Artificial
  CRISPR gRNA sequence
agaaggaatcatggtgcagt

SEQ ID NO: 528116 - DNA, 20 bp, Artificial
  CRISPR gRNA sequence
gaaggaatcatggtgcagtg

SEQ ID NO: 528117 - DNA, 20 bp, Artificial
  CRISPR gRNA sequence
aaggaatcatggtgcagtgg

SEQ ID NO: 528118 - DNA, 20 bp, Artificial
  CRISPR gRNA sequence
gaatcatggtgcagtggggg

SEQ ID NO: 528119 - DNA, 20 bp, Artificial
  CRISPR gRNA sequence
catggtgcagtgggggtagc

SEQ ID NO: 528120 - DNA, 20 bp, Artificial
  CRISPR gRNA sequence
tggtgcagtgggggtagcca

SEQ ID NO: 528121 - DNA, 20 bp, Artificial
  CRISPR gRNA sequence
cagtgggggtagccagagac

SEQ ID NO: 528122 - DNA, 20 bp, Artificial
  CRISPR gRNA sequence
gtgggggtagccagagacga

SEQ ID NO: 528123 - DNA, 20 bp, Artificial
  CRISPR gRNA sequence
ggggtagccagagacgagag

SEQ ID NO: 528124 - DNA, 20 bp, Artificial
  CRISPR gRNA sequence
gggtagccagagacgagagc

SEQ ID NO: 528125 - DNA, 20 bp, Artificial
  CRISPR gRNA sequence
agagacgagagcaggatcaa

SEQ ID NO: 528126 - DNA, 20 bp, Artificial
  CRISPR gRNA sequence
cgagagcaggatcaacagtg

SEQ ID NO: 528127 - DNA, 20 bp, Artificial
  CRISPR gRNA sequence
atcaacagtgcagaaacacc

SEQ ID NO: 528128 - DNA, 20 bp, Artificial
  CRISPR gRNA sequence
cagtgcagaaacaccgagac

SEQ ID NO: 528129 - DNA, 20 bp, Artificial
  CRISPR gRNA sequence
agtgcagaaacaccgagaca

SEQ ID NO: 528130 - DNA, 20 bp, Artificial
  CRISPR gRNA sequence
gtgcagaaacaccgagacaa

SEQ ID NO: 528131 - DNA, 20 bp, Artificial
  CRISPR gRNA sequence
tgcagaaacaccgagacaag

SEQ ID NO: 528132 - DNA, 20 bp, Artificial
  CRISPR gRNA sequence
accgagacaaggggctgctt

SEQ ID NO: 528133 - DNA, 20 bp, Artificial
  CRISPR gRNA sequence
ccgagacaaggggctgctta

SEQ ID NO: 528134 - DNA, 20 bp, Artificial
  CRISPR gRNA sequence
cgagacaaggggctgcttaa

SEQ ID NO: 528135 - DNA, 20 bp, Artificial
  CRISPR gRNA sequence
ggctgcttaagggaaatgct

SEQ ID NO: 528136 - DNA, 20 bp, Artificial
  CRISPR gRNA sequence
gctgcttaagggaaatgctc

SEQ ID NO: 528137 - DNA, 20 bp, Artificial
  CRISPR gRNA sequence
ttaagggaaatgctcaggaa

SEQ ID NO: 528138 - DNA, 20 bp, Artificial
  CRISPR gRNA sequence
gctcaggaacagatattgtg

SEQ ID NO: 528139 - DNA, 20 bp, Artificial
  CRISPR gRNA sequence
gaacagatattgtgtggctt

SEQ ID NO: 528140 - DNA, 20 bp, Artificial
  CRISPR gRNA sequence
aacagatattgtgtggcttc

SEQ ID NO: 528141 - DNA, 20 bp, Artificial
  CRISPR gRNA sequence
gggcaactcattctccctct

SEQ ID NO: 528142 - DNA, 20 bp, Artificial
  CRISPR gRNA sequence
ggcaactcattctccctctc

SEQ ID NO: 528143 - DNA, 20 bp, Artificial
  CRISPR gRNA sequence
gcaactcattctccctctca

SEQ ID NO: 528144 - DNA, 20 bp, Artificial
  CRISPR gRNA sequence
ctctcagggcctcatgtttg

SEQ ID NO: 528145 - DNA, 20 bp, Artificial
  CRISPR gRNA sequence
cagggcctcatgtttgaagc

SEQ ID NO: 528146 - DNA, 20 bp, Artificial
  CRISPR gRNA sequence
gggcctcatgtttgaagcta

SEQ ID NO: 528147 - DNA, 20 bp, Artificial
  CRISPR gRNA sequence
ggcctcatgtttgaagctag

SEQ ID NO: 528148 - DNA, 20 bp, Artificial
  CRISPR gRNA sequence
ttgaagctagaggttgcatt

SEQ ID NO: 528149 - DNA, 20 bp, Artificial
  CRISPR gRNA sequence
gaagctagaggttgcattta

SEQ ID NO: 528150 - DNA, 20 bp, Artificial
  CRISPR gRNA sequence
gttgcatttagagtatctct

SEQ ID NO: 528151 - DNA, 20 bp, Artificial
  CRISPR gRNA sequence
tagagtatctctaagatcct

SEQ ID NO: 528152 - DNA, 20 bp, Artificial
  CRISPR gRNA sequence
tttcgtgatgctttccatga

SEQ ID NO: 528153 - DNA, 20 bp, Artificial
  CRISPR gRNA sequence
ttcgtgatgctttccatgac

SEQ ID NO: 528154 - DNA, 20 bp, Artificial
  CRISPR gRNA sequence
tcgtgatgctttccatgacg

SEQ ID NO: 528155 - DNA, 20 bp, Artificial
  CRISPR gRNA sequence
cgtgatgctttccatgacgg

SEQ ID NO: 528156 - DNA, 20 bp, Artificial
  CRISPR gRNA sequence
gatgctttccatgacggggg

SEQ ID NO: 528157 - DNA, 20 bp, Artificial
  CRISPR gRNA sequence
gctttccatgacgggggcag

SEQ ID NO: 528158 - DNA, 20 bp, Artificial
  CRISPR gRNA sequence
ctttccatgacgggggcagt

SEQ ID NO: 528159 - DNA, 20 bp, Artificial
  CRISPR gRNA sequence
tccatgacgggggcagtggg

SEQ ID NO: 528160 - DNA, 20 bp, Artificial
  CRISPR gRNA sequence
ccatgacgggggcagtgggc

SEQ ID NO: 528161 - DNA, 20 bp, Artificial
  CRISPR gRNA sequence
gacgggggcagtgggcaggc

SEQ ID NO: 528162 - DNA, 20 bp, Artificial
  CRISPR gRNA sequence
ggcagtgggcaggccggcct

SEQ ID NO: 528163 - DNA, 20 bp, Artificial
  CRISPR gRNA sequence
ggccttggtgcatgaacaat

SEQ ID NO: 528164 - DNA, 20 bp, Artificial
  CRISPR gRNA sequence
gccttggtgcatgaacaatc

SEQ ID NO: 528165 - DNA, 20 bp, Artificial
  CRISPR gRNA sequence
catgaacaatcaggcatttc

SEQ ID NO: 528166 - DNA, 20 bp, Artificial
  CRISPR gRNA sequence
atcaggcatttctagcccct

SEQ ID NO: 528167 - DNA, 20 bp, Artificial
  CRISPR gRNA sequence
caggcatttctagcccctga

SEQ ID NO: 528168 - DNA, 20 bp, Artificial
  CRISPR gRNA sequence
gcatttctagcccctgagag

SEQ ID NO: 528169 - DNA, 20 bp, Artificial
  CRISPR gRNA sequence
cccctgagagcagtttccca

SEQ ID NO: 528170 - DNA, 20 bp, Artificial
  CRISPR gRNA sequence
cctgagagcagtttcccaaa

SEQ ID NO: 528171 - DNA, 20 bp, Artificial
  CRISPR gRNA sequence
gcagtttcccaaagagcctg

SEQ ID NO: 528172 - DNA, 20 bp, Artificial
  CRISPR gRNA sequence
agtttcccaaagagcctgca

SEQ ID NO: 528173 - DNA, 20 bp, Artificial
  CRISPR gRNA sequence
gtttcccaaagagcctgcag

SEQ ID NO: 528174 - DNA, 20 bp, Artificial
  CRISPR gRNA sequence
tttcccaaagagcctgcaga

SEQ ID NO: 528175 - DNA, 20 bp, Artificial
  CRISPR gRNA sequence
tcccaaagagcctgcagagg

SEQ ID NO: 528176 - DNA, 20 bp, Artificial
  CRISPR gRNA sequence
gcctgcagagggagcttccc

SEQ ID NO: 528177 - DNA, 20 bp, Artificial
  CRISPR gRNA sequence
cctgcagagggagcttccca

SEQ ID NO: 528178 - DNA, 20 bp, Artificial
  CRISPR gRNA sequence
agggagcttcccaaggacct

SEQ ID NO: 528179 - DNA, 20 bp, Artificial
  CRISPR gRNA sequence
gggagcttcccaaggacctt

SEQ ID NO: 528180 - DNA, 20 bp, Artificial
  CRISPR gRNA sequence
ccaaggaccttgggtccttc

SEQ ID NO: 528181 - DNA, 20 bp, Artificial
  CRISPR gRNA sequence
caaggaccttgggtccttcc

SEQ ID NO: 528182 - DNA, 20 bp, Artificial
  CRISPR gRNA sequence
aaggaccttgggtccttcca

SEQ ID NO: 528183 - DNA, 20 bp, Artificial
  CRISPR gRNA sequence
caccactcaccaccctctgt

SEQ ID NO: 528184 - DNA, 20 bp, Artificial
  CRISPR gRNA sequence
ctcaccaccctctgtgagcc

SEQ ID NO: 528185 - DNA, 20 bp, Artificial
  CRISPR gRNA sequence
tcaccaccctctgtgagcct

SEQ ID NO: 528186 - DNA, 20 bp, Artificial
  CRISPR gRNA sequence
accaccctctgtgagcctgg

SEQ ID NO: 528187 - DNA, 20 bp, Artificial
  CRISPR gRNA sequence
ctctgtgagcctgggagtta

SEQ ID NO: 528188 - DNA, 20 bp, Artificial
  CRISPR gRNA sequence
tctgtgagcctgggagttat

SEQ ID NO: 528189 - DNA, 20 bp, Artificial
  CRISPR gRNA sequence
ctgtgagcctgggagttatg

SEQ ID NO: 528190 - DNA, 20 bp, Artificial
  CRISPR gRNA sequence
gcctgggagttatggggtga

SEQ ID NO: 528191 - DNA, 20 bp, Artificial
  CRISPR gRNA sequence
cctgggagttatggggtgaa

SEQ ID NO: 528192 - DNA, 20 bp, Artificial
  CRISPR gRNA sequence
atggggtgaaaggtcccaac

SEQ ID NO: 528193 - DNA, 20 bp, Artificial
  CRISPR gRNA sequence
gctcttctatctgcttgatg

SEQ ID NO: 528194 - DNA, 20 bp, Artificial
  CRISPR gRNA sequence
ctcttctatctgcttgatgc

SEQ ID NO: 528195 - DNA, 20 bp, Artificial
  CRISPR gRNA sequence
cttctatctgcttgatgcag

SEQ ID NO: 528196 - DNA, 20 bp, Artificial
  CRISPR gRNA sequence
ttctatctgcttgatgcagg

SEQ ID NO: 528197 - DNA, 20 bp, Artificial
  CRISPR gRNA sequence
tatctgcttgatgcaggagg

SEQ ID NO: 528198 - DNA, 20 bp, Artificial
  CRISPR gRNA sequence
gatgcaggaggcagcatcct

SEQ ID NO: 528199 - DNA, 20 bp, Artificial
  CRISPR gRNA sequence
caggaggcagcatccttggc

SEQ ID NO: 528200 - DNA, 20 bp, Artificial
  CRISPR gRNA sequence
ggaggcagcatccttggcca

SEQ ID NO: 528201 - DNA, 20 bp, Artificial
  CRISPR gRNA sequence
agcatccttggccagagtaa

SEQ ID NO: 528202 - DNA, 20 bp, Artificial
  CRISPR gRNA sequence
gcatccttggccagagtaat

SEQ ID NO: 528203 - DNA, 20 bp, Artificial
  CRISPR gRNA sequence
agagtaatgggctctctgcc

SEQ ID NO: 528204 - DNA, 20 bp, Artificial
  CRISPR gRNA sequence
ctctctgcctggacccctcc

SEQ ID NO: 528205 - DNA, 20 bp, Artificial
  CRISPR gRNA sequence
tcccacttctcttccttttg

SEQ ID NO: 528206 - DNA, 20 bp, Artificial
  CRISPR gRNA sequence
ccacttctcttccttttgca

SEQ ID NO: 528207 - DNA, 20 bp, Artificial
  CRISPR gRNA sequence
ttctcttccttttgcagaga

SEQ ID NO: 528208 - DNA, 20 bp, Artificial
  CRISPR gRNA sequence
tctcttccttttgcagagaa

SEQ ID NO: 528209 - DNA, 20 bp, Artificial
  CRISPR gRNA sequence
tccttttgcagagaaaggtc

SEQ ID NO: 528210 - DNA, 20 bp, Artificial
  CRISPR gRNA sequence
ctggacatctatctcatcat

SEQ ID NO: 528211 - DNA, 20 bp, Artificial
  CRISPR gRNA sequence
tatctcatcattggcatatg

SEQ ID NO: 528212 - DNA, 20 bp, Artificial
  CRISPR gRNA sequence
tctcatcattggcatatgtg

SEQ ID NO: 528213 - DNA, 20 bp, Artificial
  CRISPR gRNA sequence
ctcatcattggcatatgtgg

SEQ ID NO: 528214 - DNA, 20 bp, Artificial
  CRISPR gRNA sequence
catcattggcatatgtggag

SEQ ID NO: 528215 - DNA, 20 bp, Artificial
  CRISPR gRNA sequence
atcattggcatatgtggagg

SEQ ID NO: 528216 - DNA, 20 bp, Artificial
  CRISPR gRNA sequence
attggcatatgtggaggagg

SEQ ID NO: 528217 - DNA, 20 bp, Artificial
  CRISPR gRNA sequence
tggaggaggcagcctcttga

SEQ ID NO: 528218 - DNA, 20 bp, Artificial
  CRISPR gRNA sequence
cagcctcttgatggtctttg

SEQ ID NO: 528219 - DNA, 20 bp, Artificial
  CRISPR gRNA sequence
ctcgttttctatatcaccaa

SEQ ID NO: 528220 - DNA, 20 bp, Artificial
  CRISPR gRNA sequence
tcgttttctatatcaccaaa

SEQ ID NO: 528221 - DNA, 20 bp, Artificial
  CRISPR gRNA sequence
atatcaccaaaaggaaaaaa

SEQ ID NO: 528222 - DNA, 20 bp, Artificial
  CRISPR gRNA sequence
atcaccaaaaggaaaaaaca

SEQ ID NO: 528223 - DNA, 20 bp, Artificial
  CRISPR gRNA sequence
tcaccaaaaggaaaaaacag

SEQ ID NO: 528224 - DNA, 20 bp, Artificial
  CRISPR gRNA sequence
accaaaaggaaaaaacagag

SEQ ID NO: 528225 - DNA, 20 bp, Artificial
  CRISPR gRNA sequence
aaaggaaaaaacagaggagt

SEQ ID NO: 528226 - DNA, 20 bp, Artificial
  CRISPR gRNA sequence
aggaaaaaacagaggagtcg

SEQ ID NO: 528227 - DNA, 20 bp, Artificial
  CRISPR gRNA sequence
aaacagaggagtcggagaaa

SEQ ID NO: 528228 - DNA, 20 bp, Artificial
  CRISPR gRNA sequence
agaggagtcggagaaatggt

SEQ ID NO: 528229 - DNA, 20 bp, Artificial
  CRISPR gRNA sequence
ccccctcttttgtcccaccg

SEQ ID NO: 528230 - DNA, 20 bp, Artificial
  CRISPR gRNA sequence
cccctcttttgtcccaccgc

SEQ ID NO: 528231 - DNA, 20 bp, Artificial
  CRISPR gRNA sequence
ttttgtcccaccgcaggccc

SEQ ID NO: 528232 - DNA, 20 bp, Artificial
  CRISPR gRNA sequence
ccagcaaaatccccatgaaa

SEQ ID NO: 528233 - DNA, 20 bp, Artificial
  CRISPR gRNA sequence
aatccccatgaaacagctca

SEQ ID NO: 528234 - DNA, 20 bp, Artificial
  CRISPR gRNA sequence
atccccatgaaacagctcat

SEQ ID NO: 528235 - DNA, 20 bp, Artificial
  CRISPR gRNA sequence
tccccatgaaacagctcatg

SEQ ID NO: 528236 - DNA, 20 bp, Artificial
  CRISPR gRNA sequence
gggatgacaccttgaatctg

SEQ ID NO: 528237 - DNA, 20 bp, Artificial
  CRISPR gRNA sequence
gatgacaccttgaatctgca

SEQ ID NO: 528238 - DNA, 20 bp, Artificial
  CRISPR gRNA sequence
tgaatctgcagagaaaatga

SEQ ID NO: 528239 - DNA, 20 bp, Artificial
  CRISPR gRNA sequence
tgcagagaaaatgatggaaa

SEQ ID NO: 528240 - DNA, 20 bp, Artificial
  CRISPR gRNA sequence
gcagagaaaatgatggaaat

SEQ ID NO: 528241 - DNA, 20 bp, Artificial
  CRISPR gRNA sequence
gagaaaatgatggaaatagg

SEQ ID NO: 528242 - DNA, 20 bp, Artificial
  CRISPR gRNA sequence
atgatggaaataggtagttt

SEQ ID NO: 528243 - DNA, 20 bp, Artificial
  CRISPR gRNA sequence
aataggtagtttcggaatgt

SEQ ID NO: 528244 - DNA, 20 bp, Artificial
  CRISPR gRNA sequence
ataggtagtttcggaatgtc

SEQ ID NO: 528245 - DNA, 20 bp, Artificial
  CRISPR gRNA sequence
taggtagtttcggaatgtca

SEQ ID NO: 528246 - DNA, 20 bp, Artificial
  CRISPR gRNA sequence
gtttcggaatgtcagggttg

SEQ ID NO: 528247 - DNA, 20 bp, Artificial
  CRISPR gRNA sequence
cggaatgtcagggttgtagt

SEQ ID NO: 528248 - DNA, 20 bp, Artificial
  CRISPR gRNA sequence
aatgtcagggttgtagtcag

SEQ ID NO: 528249 - DNA, 20 bp, Artificial
  CRISPR gRNA sequence
agggttgtagtcagcggtta

SEQ ID NO: 528250 - DNA, 20 bp, Artificial
  CRISPR gRNA sequence
ttatagcttgtttcattttg

SEQ ID NO: 528251 - DNA, 20 bp, Artificial
  CRISPR gRNA sequence
agcttgtttcattttgtggt

SEQ ID NO: 528252 - DNA, 20 bp, Artificial
  CRISPR gRNA sequence
atttttgaaaaacaaattct

SEQ ID NO: 528253 - DNA, 20 bp, Artificial
  CRISPR gRNA sequence
tttgaaaaacaaattcttag

SEQ ID NO: 528254 - DNA, 20 bp, Artificial
  CRISPR gRNA sequence
aattcttagtggtgacaatg

SEQ ID NO: 528255 - DNA, 20 bp, Artificial
  CRISPR gRNA sequence
attcttagtggtgacaatgt

SEQ ID NO: 528256 - DNA, 20 bp, Artificial
  CRISPR gRNA sequence
tcttagtggtgacaatgtgg

SEQ ID NO: 528257 - DNA, 20 bp, Artificial
  CRISPR gRNA sequence
ggtgacaatgtgggagcttt

SEQ ID NO: 528258 - DNA, 20 bp, Artificial
  CRISPR gRNA sequence
gagctttgagacactgaatc

SEQ ID NO: 528259 - DNA, 20 bp, Artificial
  CRISPR gRNA sequence
tttgagacactgaatccagt

SEQ ID NO: 528260 - DNA, 20 bp, Artificial
  CRISPR gRNA sequence
ctgaatccagttggcctcat

SEQ ID NO: 528261 - DNA, 20 bp, Artificial
  CRISPR gRNA sequence
cctcattggaatccaccact

SEQ ID NO: 528262 - DNA, 20 bp, Artificial
  CRISPR gRNA sequence
ctcattggaatccaccactg

SEQ ID NO: 528263 - DNA, 20 bp, Artificial
  CRISPR gRNA sequence
atccaccactgaggcctact

SEQ ID NO: 528264 - DNA, 20 bp, Artificial
  CRISPR gRNA sequence
cactgaggcctacttggtga

SEQ ID NO: 528265 - DNA, 20 bp, Artificial
  CRISPR gRNA sequence
actgaggcctacttggtgac

SEQ ID NO: 528266 - DNA, 20 bp, Artificial
  CRISPR gRNA sequence
aatgtgaacatcttttgaat

SEQ ID NO: 528267 - DNA, 20 bp, Artificial
  CRISPR gRNA sequence
atgagccacacttctctaca

SEQ ID NO: 528268 - DNA, 20 bp, Artificial
  CRISPR gRNA sequence
tgagccacacttctctacat

SEQ ID NO: 528269 - DNA, 20 bp, Artificial
  CRISPR gRNA sequence
gccacacttctctacatagg

SEQ ID NO: 528270 - DNA, 20 bp, Artificial
  CRISPR gRNA sequence
cacttctctacataggcaga

SEQ ID NO: 528271 - DNA, 20 bp, Artificial
  CRISPR gRNA sequence
acttctctacataggcagaa

SEQ ID NO: 528272 - DNA, 20 bp, Artificial
  CRISPR gRNA sequence
ctctacataggcagaaaggt

SEQ ID NO: 528273 - DNA, 20 bp, Artificial
  CRISPR gRNA sequence
tagctccaaaacaccgtttc

SEQ ID NO: 528274 - DNA, 20 bp, Artificial
  CRISPR gRNA sequence
agctccaaaacaccgtttct

SEQ ID NO: 528275 - DNA, 20 bp, Artificial
  CRISPR gRNA sequence
aggaataaatgtcctatcta

SEQ ID NO: 528276 - DNA, 20 bp, Artificial
  CRISPR gRNA sequence
ggaataaatgtcctatctat

SEQ ID NO: 528277 - DNA, 20 bp, Artificial
  CRISPR gRNA sequence
ataaatgtcctatctatggg

SEQ ID NO: 528278 - DNA, 20 bp, Artificial
  CRISPR gRNA sequence
gtcctatctatgggtggccc

SEQ ID NO: 528279 - DNA, 20 bp, Artificial
  CRISPR gRNA sequence
tcctatctatgggtggccca

SEQ ID NO: 528280 - DNA, 20 bp, Artificial
  CRISPR gRNA sequence
atctatgggtggcccaaggt

SEQ ID NO: 528281 - DNA, 20 bp, Artificial
  CRISPR gRNA sequence
tgggtggcccaaggtgagtt

SEQ ID NO: 528282 - DNA, 20 bp, Artificial
  CRISPR gRNA sequence
gggtggcccaaggtgagttc

SEQ ID NO: 528283 - DNA, 20 bp, Artificial
  CRISPR gRNA sequence
cccaaggtgagttcaggacc

SEQ ID NO: 528284 - DNA, 20 bp, Artificial
  CRISPR gRNA sequence
tgagttcaggaccaagctcc

SEQ ID NO: 528285 - DNA, 20 bp, Artificial
  CRISPR gRNA sequence
ggaccaagctcctagaaaca

SEQ ID NO: 528286 - DNA, 20 bp, Artificial
  CRISPR gRNA sequence
gaccaagctcctagaaacac

SEQ ID NO: 528287 - DNA, 20 bp, Artificial
  CRISPR gRNA sequence
accaagctcctagaaacaca

SEQ ID NO: 528288 - DNA, 20 bp, Artificial
  CRISPR gRNA sequence
gaaacacagggaaaatcatt

SEQ ID NO: 528289 - DNA, 20 bp, Artificial
  CRISPR gRNA sequence
aaacacagggaaaatcattc

SEQ ID NO: 528290 - DNA, 20 bp, Artificial
  CRISPR gRNA sequence
gggaaaatcattcaggtcat

SEQ ID NO: 528291 - DNA, 20 bp, Artificial
  CRISPR gRNA sequence
ggaaaatcattcaggtcatc

SEQ ID NO: 528292 - DNA, 20 bp, Artificial
  CRISPR gRNA sequence
aaatcattcaggtcatcagg

SEQ ID NO: 528293 - DNA, 20 bp, Artificial
  CRISPR gRNA sequence
ttcaggtcatcaggtagtca

SEQ ID NO: 528294 - DNA, 20 bp, Artificial
  CRISPR gRNA sequence
tcaggtcatcaggtagtcac

SEQ ID NO: 528295 - DNA, 20 bp, Artificial
  CRISPR gRNA sequence
atcaggtagtcacaggaaaa

SEQ ID NO: 528296 - DNA, 20 bp, Artificial
  CRISPR gRNA sequence
acaggaaaacagctgttcta

SEQ ID NO: 528297 - DNA, 20 bp, Artificial
  CRISPR gRNA sequence
ggaaaacagctgttctaaag

SEQ ID NO: 528298 - DNA, 20 bp, Artificial
  CRISPR gRNA sequence
gaaaacagctgttctaaagc

SEQ ID NO: 528299 - DNA, 20 bp, Artificial
  CRISPR gRNA sequence
aaaacagctgttctaaagca

SEQ ID NO: 528300 - DNA, 20 bp, Artificial
  CRISPR gRNA sequence
cctttgctaattctctgttc

SEQ ID NO: 528301 - DNA, 20 bp, Artificial
  CRISPR gRNA sequence
ctttgctaattctctgttcg

SEQ ID NO: 528302 - DNA, 20 bp, Artificial
  CRISPR gRNA sequence
tttgctaattctctgttcga

SEQ ID NO: 528303 - DNA, 20 bp, Artificial
  CRISPR gRNA sequence
tctctgttcgagggatgtgt

SEQ ID NO: 528304 - DNA, 20 bp, Artificial
  CRISPR gRNA sequence
ctctgttcgagggatgtgtt

SEQ ID NO: 528305 - DNA, 20 bp, Artificial
  CRISPR gRNA sequence
tctgttcgagggatgtgtta

SEQ ID NO: 528306 - DNA, 20 bp, Artificial
  CRISPR gRNA sequence
tcgagggatgtgttagggtt

SEQ ID NO: 528307 - DNA, 20 bp, Artificial
  CRISPR gRNA sequence
gagggatgtgttagggttga

SEQ ID NO: 528308 - DNA, 20 bp, Artificial
  CRISPR gRNA sequence
tagggttgagagtttttcct

SEQ ID NO: 528309 - DNA, 20 bp, Artificial
  CRISPR gRNA sequence
ttgagagtttttcctcagat

SEQ ID NO: 528310 - DNA, 20 bp, Artificial
  CRISPR gRNA sequence
tgagagtttttcctcagatc

SEQ ID NO: 528311 - DNA, 20 bp, Artificial
  CRISPR gRNA sequence
aggcctgtctgacaatctat

SEQ ID NO: 528312 - DNA, 20 bp, Artificial
  CRISPR gRNA sequence
gacaatctatcagcaatgaa

SEQ ID NO: 528313 - DNA, 20 bp, Artificial
  CRISPR gRNA sequence
acaatctatcagcaatgaaa

SEQ ID NO: 528314 - DNA, 20 bp, Artificial
  CRISPR gRNA sequence
aatgaaaaggttatgcttgc

SEQ ID NO: 528315 - DNA, 20 bp, Artificial
  CRISPR gRNA sequence
gaaaaggttatgcttgcaag

SEQ ID NO: 528316 - DNA, 20 bp, Artificial
  CRISPR gRNA sequence
aaaaggttatgcttgcaagt

SEQ ID NO: 528317 - DNA, 20 bp, Artificial
  CRISPR gRNA sequence
aaaggttatgcttgcaagtg

SEQ ID NO: 528318 - DNA, 20 bp, Artificial
  CRISPR gRNA sequence
aggttatgcttgcaagtggg

SEQ ID NO: 528319 - DNA, 20 bp, Artificial
  CRISPR gRNA sequence
tatgcttgcaagtggggagc

SEQ ID NO: 528320 - DNA, 20 bp, Artificial
  CRISPR gRNA sequence
ttgcaagtggggagccggct

SEQ ID NO: 528321 - DNA, 20 bp, Artificial
  CRISPR gRNA sequence
tgcaagtggggagccggctt

SEQ ID NO: 528322 - DNA, 20 bp, Artificial
  CRISPR gRNA sequence
gcaagtggggagccggctta

SEQ ID NO: 528323 - DNA, 20 bp, Artificial
  CRISPR gRNA sequence
aagtggggagccggcttagg

SEQ ID NO: 528324 - DNA, 20 bp, Artificial
  CRISPR gRNA sequence
gagccggcttagggagcatc

SEQ ID NO: 528325 - DNA, 20 bp, Artificial
  CRISPR gRNA sequence
agccggcttagggagcatcc

SEQ ID NO: 528326 - DNA, 20 bp, Artificial
  CRISPR gRNA sequence
agggagcatccaggccaccc

SEQ ID NO: 528327 - DNA, 20 bp, Artificial
  CRISPR gRNA sequence
gggagcatccaggccaccca

SEQ ID NO: 528328 - DNA, 20 bp, Artificial
  CRISPR gRNA sequence
agcatccaggccacccaagg

SEQ ID NO: 528329 - DNA, 20 bp, Artificial
  CRISPR gRNA sequence
ccacccaaggcagaacactt

SEQ ID NO: 528330 - DNA, 20 bp, Artificial
  CRISPR gRNA sequence
acccaaggcagaacacttca

SEQ ID NO: 528331 - DNA, 20 bp, Artificial
  CRISPR gRNA sequence
aggcagaacacttcagagaa

SEQ ID NO: 528332 - DNA, 20 bp, Artificial
  CRISPR gRNA sequence
acttcagagaatggccaacc

SEQ ID NO: 528333 - DNA, 20 bp, Artificial
  CRISPR gRNA sequence
cttcagagaatggccaaccc

SEQ ID NO: 528334 - DNA, 20 bp, Artificial
  CRISPR gRNA sequence
ttcagagaatggccaacccg

SEQ ID NO: 528335 - DNA, 20 bp, Artificial
  CRISPR gRNA sequence
tggccaacccggggtcactg

SEQ ID NO: 528336 - DNA, 20 bp, Artificial
  CRISPR gRNA sequence
ggccaacccggggtcactgt

SEQ ID NO: 528337 - DNA, 20 bp, Artificial
  CRISPR gRNA sequence
gccaacccggggtcactgtg

SEQ ID NO: 528338 - DNA, 20 bp, Artificial
  CRISPR gRNA sequence
ccaacccggggtcactgtgg

SEQ ID NO: 528339 - DNA, 20 bp, Artificial
  CRISPR gRNA sequence
caacccggggtcactgtggg

SEQ ID NO: 528340 - DNA, 20 bp, Artificial
  CRISPR gRNA sequence
cggggtcactgtggggggca

SEQ ID NO: 528341 - DNA, 20 bp, Artificial
  CRISPR gRNA sequence
tcactgtggggggcacagat

SEQ ID NO: 528342 - DNA, 20 bp, Artificial
  CRISPR gRNA sequence
cactgtggggggcacagatg

SEQ ID NO: 528343 - DNA, 20 bp, Artificial
  CRISPR gRNA sequence
actgtggggggcacagatga

SEQ ID NO: 528344 - DNA, 20 bp, Artificial
  CRISPR gRNA sequence
gggggcacagatgagggtgt

SEQ ID NO: 528345 - DNA, 20 bp, Artificial
  CRISPR gRNA sequence
cagatgagggtgtcagccat

SEQ ID NO: 528346 - DNA, 20 bp, Artificial
  CRISPR gRNA sequence
atgagggtgtcagccattgg

SEQ ID NO: 528347 - DNA, 20 bp, Artificial
  CRISPR gRNA sequence
tgagggtgtcagccattggc

SEQ ID NO: 528348 - DNA, 20 bp, Artificial
  CRISPR gRNA sequence
tcagccattggcgggacttg

SEQ ID NO: 528349 - DNA, 20 bp, Artificial
  CRISPR gRNA sequence
cattggcgggacttgcagcc

SEQ ID NO: 528350 - DNA, 20 bp, Artificial
  CRISPR gRNA sequence
attggcgggacttgcagcca

SEQ ID NO: 528351 - DNA, 20 bp, Artificial
  CRISPR gRNA sequence
ttggcgggacttgcagccaa

SEQ ID NO: 528352 - DNA, 20 bp, Artificial
  CRISPR gRNA sequence
gggacttgcagccaagggaa

SEQ ID NO: 528353 - DNA, 20 bp, Artificial
  CRISPR gRNA sequence
ggacttgcagccaagggaac

SEQ ID NO: 528354 - DNA, 20 bp, Artificial
  CRISPR gRNA sequence
gcagccaagggaacaggccc

SEQ ID NO: 528355 - DNA, 20 bp, Artificial
  CRISPR gRNA sequence
cagccaagggaacaggccct

SEQ ID NO: 528356 - DNA, 20 bp, Artificial
  CRISPR gRNA sequence
agccaagggaacaggccctg

SEQ ID NO: 528357 - DNA, 20 bp, Artificial
  CRISPR gRNA sequence
ttctctgcaattcacgttca

SEQ ID NO: 528358 - DNA, 20 bp, Artificial
  CRISPR gRNA sequence
tctgcaattcacgttcacag

SEQ ID NO: 528359 - DNA, 20 bp, Artificial
  CRISPR gRNA sequence
ctgcaattcacgttcacagc

SEQ ID NO: 528360 - DNA, 20 bp, Artificial
  CRISPR gRNA sequence
ttcacgttcacagcaggact

SEQ ID NO: 528361 - DNA, 20 bp, Artificial
  CRISPR gRNA sequence
agcaggacttggtctctccc

SEQ ID NO: 528362 - DNA, 20 bp, Artificial
  CRISPR gRNA sequence
acttggtctctccctagaac

SEQ ID NO: 528363 - DNA, 20 bp, Artificial
  CRISPR gRNA sequence
tggtctctccctagaaccgg

SEQ ID NO: 528364 - DNA, 20 bp, Artificial
  CRISPR gRNA sequence
ggtctctccctagaaccggc

SEQ ID NO: 528365 - DNA, 20 bp, Artificial
  CRISPR gRNA sequence
ctccctagaaccggcaggca

SEQ ID NO: 528366 - DNA, 20 bp, Artificial
  CRISPR gRNA sequence
accggcaggcacagccacac

SEQ ID NO: 528367 - DNA, 20 bp, Artificial
  CRISPR gRNA sequence
acagccacaccagctgcttc

SEQ ID NO: 528368 - DNA, 20 bp, Artificial
  CRISPR gRNA sequence
cagctgcttccagtgctgcc

SEQ ID NO: 528369 - DNA, 20 bp, Artificial
  CRISPR gRNA sequence
agctgcttccagtgctgccc

SEQ ID NO: 528370 - DNA, 20 bp, Artificial
  CRISPR gRNA sequence
gctgcttccagtgctgccca

SEQ ID NO: 528371 - DNA, 20 bp, Artificial
  CRISPR gRNA sequence
tgcttccagtgctgcccagg

SEQ ID NO: 528372 - DNA, 20 bp, Artificial
  CRISPR gRNA sequence
gcttccagtgctgcccaggg

SEQ ID NO: 528373 - DNA, 20 bp, Artificial
  CRISPR gRNA sequence
tccagtgctgcccagggagg

SEQ ID NO: 528374 - DNA, 20 bp, Artificial
  CRISPR gRNA sequence
ggaggtggtccaaacttccc

SEQ ID NO: 528375 - DNA, 20 bp, Artificial
  CRISPR gRNA sequence
gaggtggtccaaacttcccc

SEQ ID NO: 528376 - DNA, 20 bp, Artificial
  CRISPR gRNA sequence
gtccaaacttccccaggcac

SEQ ID NO: 528377 - DNA, 20 bp, Artificial
  CRISPR gRNA sequence
caaacttccccaggcaccgg

SEQ ID NO: 528378 - DNA, 20 bp, Artificial
  CRISPR gRNA sequence
tccccaggcaccggtggcct

SEQ ID NO: 528379 - DNA, 20 bp, Artificial
  CRISPR gRNA sequence
ccccaggcaccggtggcctt

SEQ ID NO: 528380 - DNA, 20 bp, Artificial
  CRISPR gRNA sequence
gccttgggccccgtgccctc

SEQ ID NO: 528381 - DNA, 20 bp, Artificial
  CRISPR gRNA sequence
ggccccgtgccctctggatt

SEQ ID NO: 528382 - DNA, 20 bp, Artificial
  CRISPR gRNA sequence
tggatttggcttctttacct

SEQ ID NO: 528383 - DNA, 20 bp, Artificial
  CRISPR gRNA sequence
tttacctcagatttcttcct

SEQ ID NO: 528384 - DNA, 20 bp, Artificial
  CRISPR gRNA sequence
ttctccttctgcctccccat

SEQ ID NO: 528385 - DNA, 20 bp, Artificial
  CRISPR gRNA sequence
tctccttctgcctccccatc

SEQ ID NO: 528386 - DNA, 20 bp, Artificial
  CRISPR gRNA sequence
tctgcctccccatcaggctg

SEQ ID NO: 528387 - DNA, 20 bp, Artificial
  CRISPR gRNA sequence
cccatcaggctgcggtccct

SEQ ID NO: 528388 - DNA, 20 bp, Artificial
  CRISPR gRNA sequence
tcccatcacgtcactacccc

SEQ ID NO: 528389 - DNA, 20 bp, Artificial
  CRISPR gRNA sequence
tcacgtcactacccccagcc

SEQ ID NO: 528390 - DNA, 20 bp, Artificial
  CRISPR gRNA sequence
cacgtcactacccccagccc

SEQ ID NO: 528391 - DNA, 20 bp, Artificial
  CRISPR gRNA sequence
ccgaaacatcatcctgaact

SEQ ID NO: 528392 - DNA, 20 bp, Artificial
  CRISPR gRNA sequence
ctgtcccacactttccacca

SEQ ID NO: 528393 - DNA, 20 bp, Artificial
  CRISPR gRNA sequence
ccacactttccaccacagca

SEQ ID NO: 528394 - DNA, 20 bp, Artificial
  CRISPR gRNA sequence
cactttccaccacagcacag

SEQ ID NO: 528395 - DNA, 20 bp, Artificial
  CRISPR gRNA sequence
ccacagcacagcagaatcgc

SEQ ID NO: 528396 - DNA, 20 bp, Artificial
  CRISPR gRNA sequence
cagcacagcagaatcgctgg

SEQ ID NO: 528397 - DNA, 20 bp, Artificial
  CRISPR gRNA sequence
agcacagcagaatcgctggc

SEQ ID NO: 528398 - DNA, 20 bp, Artificial
  CRISPR gRNA sequence
gcacagcagaatcgctggca

SEQ ID NO: 528399 - DNA, 20 bp, Artificial
  CRISPR gRNA sequence
agaatcgctggcagggccct

SEQ ID NO: 528400 - DNA, 20 bp, Artificial
  CRISPR gRNA sequence
gaatcgctggcagggccctt

SEQ ID NO: 528401 - DNA, 20 bp, Artificial
  CRISPR gRNA sequence
gcagggcccttaggcatgcc

SEQ ID NO: 528402 - DNA, 20 bp, Artificial
  CRISPR gRNA sequence
ggcttatcctcctctgtgcc

SEQ ID NO: 528403 - DNA, 20 bp, Artificial
  CRISPR gRNA sequence
tcctcctctgtgcccagctc

SEQ ID NO: 528404 - DNA, 20 bp, Artificial
  CRISPR gRNA sequence
gctccttctccattgactaa

SEQ ID NO: 528405 - DNA, 20 bp, Artificial
  CRISPR gRNA sequence
tctccattgactaatggtca

SEQ ID NO: 528406 - DNA, 20 bp, Artificial
  CRISPR gRNA sequence
caaagaccatatcttcttcc

SEQ ID NO: 528407 - DNA, 20 bp, Artificial
  CRISPR gRNA sequence
aaagaccatatcttcttcca

SEQ ID NO: 528408 - DNA, 20 bp, Artificial
  CRISPR gRNA sequence
gaccatatcttcttccaagg

SEQ ID NO: 528409 - DNA, 20 bp, Artificial
  CRISPR gRNA sequence
tggacctcacttgtcacccc

SEQ ID NO: 528410 - DNA, 20 bp, Artificial
  CRISPR gRNA sequence
ctcacttgtcaccccaagac

SEQ ID NO: 528411 - DNA, 20 bp, Artificial
  CRISPR gRNA sequence
tcacttgtcaccccaagaca

SEQ ID NO: 528412 - DNA, 20 bp, Artificial
  CRISPR gRNA sequence
aaggcaatctctgccatcac

SEQ ID NO: 528413 - DNA, 20 bp, Artificial
  CRISPR gRNA sequence
aggcaatctctgccatcacc

SEQ ID NO: 528414 - DNA, 20 bp, Artificial
  CRISPR gRNA sequence
atctctgccatcaccaggct

SEQ ID NO: 528415 - DNA, 20 bp, Artificial
  CRISPR gRNA sequence
tctgccatcaccaggctgag

SEQ ID NO: 528416 - DNA, 20 bp, Artificial
  CRISPR gRNA sequence
caccaggctgagaagaatga

SEQ ID NO: 528417 - DNA, 20 bp, Artificial
  CRISPR gRNA sequence
aggctgagaagaatgatggt

SEQ ID NO: 528418 - DNA, 20 bp, Artificial
  CRISPR gRNA sequence
gttagctcatgctgataaaa

SEQ ID NO: 528419 - DNA, 20 bp, Artificial
  CRISPR gRNA sequence
catgctgataaaaaagtcgt

SEQ ID NO: 528420 - DNA, 20 bp, Artificial
  CRISPR gRNA sequence
tctctgtgttttatgtctat

SEQ ID NO: 528421 - DNA, 20 bp, Artificial
  CRISPR gRNA sequence
tttatgtctattagtgcatc

SEQ ID NO: 528422 - DNA, 20 bp, Artificial
  CRISPR gRNA sequence
ctattagtgcatccagcttt

SEQ ID NO: 528423 - DNA, 20 bp, Artificial
  CRISPR gRNA sequence
attagtgcatccagctttca

SEQ ID NO: 528424 - DNA, 20 bp, Artificial
  CRISPR gRNA sequence
tccagctttcagagtgatct

SEQ ID NO: 528425 - DNA, 20 bp, Artificial
  CRISPR gRNA sequence
ccagctttcagagtgatctt

SEQ ID NO: 528426 - DNA, 20 bp, Artificial
  CRISPR gRNA sequence
agctttcagagtgatcttag

SEQ ID NO: 528427 - DNA, 20 bp, Artificial
  CRISPR gRNA sequence
ttcagagtgatcttaggaga

SEQ ID NO: 528428 - DNA, 20 bp, Artificial
  CRISPR gRNA sequence
ttaggagatagataacaaca

SEQ ID NO: 528429 - DNA, 20 bp, Artificial
  CRISPR gRNA sequence
agatagataacaacacagat

SEQ ID NO: 528430 - DNA, 20 bp, Artificial
  CRISPR gRNA sequence
gatagataacaacacagatg

SEQ ID NO: 528431 - DNA, 20 bp, Artificial
  CRISPR gRNA sequence
agataacaacacagatgagg

SEQ ID NO: 528432 - DNA, 20 bp, Artificial
  CRISPR gRNA sequence
caacacagatgaggaagctt

SEQ ID NO: 528433 - DNA, 20 bp, Artificial
  CRISPR gRNA sequence
cagatgaggaagcttaagtt

SEQ ID NO: 528434 - DNA, 20 bp, Artificial
  CRISPR gRNA sequence
tgaggaagcttaagttcagt

SEQ ID NO: 528435 - DNA, 20 bp, Artificial
  CRISPR gRNA sequence
gaggaagcttaagttcagtg

SEQ ID NO: 528436 - DNA, 20 bp, Artificial
  CRISPR gRNA sequence
attatttgccttaaatccta

SEQ ID NO: 528437 - DNA, 20 bp, Artificial
  CRISPR gRNA sequence
tttgccttaaatcctatggc

SEQ ID NO: 528438 - DNA, 20 bp, Artificial
  CRISPR gRNA sequence
gccttaaatcctatggccag

SEQ ID NO: 528439 - DNA, 20 bp, Artificial
  CRISPR gRNA sequence
ccttaaatcctatggccagt

SEQ ID NO: 528440 - DNA, 20 bp, Artificial
  CRISPR gRNA sequence
ctatggccagtaggttgact

SEQ ID NO: 528441 - DNA, 20 bp, Artificial
  CRISPR gRNA sequence
tatggccagtaggttgactc

SEQ ID NO: 528442 - DNA, 20 bp, Artificial
  CRISPR gRNA sequence
ccagtaggttgactcaggcc

SEQ ID NO: 528443 - DNA, 20 bp, Artificial
  CRISPR gRNA sequence
cagtaggttgactcaggcct

SEQ ID NO: 528444 - DNA, 20 bp, Artificial
  CRISPR gRNA sequence
ggttgactcaggcctaggcc

SEQ ID NO: 528445 - DNA, 20 bp, Artificial
  CRISPR gRNA sequence
gttgactcaggcctaggccg

SEQ ID NO: 528446 - DNA, 20 bp, Artificial
  CRISPR gRNA sequence
actcaggcctaggccgaggc

SEQ ID NO: 528447 - DNA, 20 bp, Artificial
  CRISPR gRNA sequence
ctcaggcctaggccgaggca

SEQ ID NO: 528448 - DNA, 20 bp, Artificial
  CRISPR gRNA sequence
caggcctaggccgaggcaag

SEQ ID NO: 528449 - DNA, 20 bp, Artificial
  CRISPR gRNA sequence
ctaggccgaggcaaggagcc

SEQ ID NO: 528450 - DNA, 20 bp, Artificial
  CRISPR gRNA sequence
aggcaaggagcccagaattt

SEQ ID NO: 528451 - DNA, 20 bp, Artificial
  CRISPR gRNA sequence
ggcaaggagcccagaattta

SEQ ID NO: 528452 - DNA, 20 bp, Artificial
  CRISPR gRNA sequence
ggagcccagaatttaaggca

SEQ ID NO: 528453 - DNA, 20 bp, Artificial
  CRISPR gRNA sequence
gaatttaaggcatagaattt

SEQ ID NO: 528454 - DNA, 20 bp, Artificial
  CRISPR gRNA sequence
aatttaaggcatagaattta

SEQ ID NO: 528455 - DNA, 20 bp, Artificial
  CRISPR gRNA sequence
tttaaggcatagaatttaag

SEQ ID NO: 528456 - DNA, 20 bp, Artificial
  CRISPR gRNA sequence
ttaaggcatagaatttaagg

SEQ ID NO: 528457 - DNA, 20 bp, Artificial
  CRISPR gRNA sequence
ggcatagaatttaaggaggc

SEQ ID NO: 528458 - DNA, 20 bp, Artificial
  CRISPR gRNA sequence
cctgcccttgcacaacctga

SEQ ID NO: 528459 - DNA, 20 bp, Artificial
  CRISPR gRNA sequence
cccttgcacaacctgaaagt

SEQ ID NO: 528460 - DNA, 20 bp, Artificial
  CRISPR gRNA sequence
tctttaaactgcatgcctgt

SEQ ID NO: 528461 - DNA, 20 bp, Artificial
  CRISPR gRNA sequence
cagcctcgcttgcctcattc

SEQ ID NO: 528462 - DNA, 20 bp, Artificial
  CRISPR gRNA sequence
gcctcattccagtcatgccc

SEQ ID NO: 528463 - DNA, 20 bp, Artificial
  CRISPR gRNA sequence
cctcattccagtcatgccct

SEQ ID NO: 528464 - DNA, 20 bp, Artificial
  CRISPR gRNA sequence
ttccagtcatgccctgggtt

SEQ ID NO: 528465 - DNA, 20 bp, Artificial
  CRISPR gRNA sequence
catgccctgggttgagtaac

SEQ ID NO: 528466 - DNA, 20 bp, Artificial
  CRISPR gRNA sequence
atgccctgggttgagtaacc

SEQ ID NO: 528467 - DNA, 20 bp, Artificial
  CRISPR gRNA sequence
gccctgggttgagtaaccag

SEQ ID NO: 528468 - DNA, 20 bp, Artificial
  CRISPR gRNA sequence
agtaaccaggagatgcaaac

SEQ ID NO: 528469 - DNA, 20 bp, Artificial
  CRISPR gRNA sequence
gtaaccaggagatgcaaaca

SEQ ID NO: 528470 - DNA, 20 bp, Artificial
  CRISPR gRNA sequence
taaccaggagatgcaaacaa

SEQ ID NO: 528471 - DNA, 20 bp, Artificial
  CRISPR gRNA sequence
accaggagatgcaaacaagg

SEQ ID NO: 528472 - DNA, 20 bp, Artificial
  CRISPR gRNA sequence
aggagatgcaaacaagggag

SEQ ID NO: 528473 - DNA, 20 bp, Artificial
  CRISPR gRNA sequence
ggagatgcaaacaagggaga

SEQ ID NO: 528474 - DNA, 20 bp, Artificial
  CRISPR gRNA sequence
aaacaagggagaaggacaat

SEQ ID NO: 528475 - DNA, 20 bp, Artificial
  CRISPR gRNA sequence
agggagaaggacaatgagcc

SEQ ID NO: 528476 - DNA, 20 bp, Artificial
  CRISPR gRNA sequence
ggagaaggacaatgagcctg

SEQ ID NO: 528477 - DNA, 20 bp, Artificial
  CRISPR gRNA sequence
gagaaggacaatgagcctgg

SEQ ID NO: 528478 - DNA, 20 bp, Artificial
  CRISPR gRNA sequence
aatgagcctggaggaattcc

SEQ ID NO: 528479 - DNA, 20 bp, Artificial
  CRISPR gRNA sequence
atgagcctggaggaattcct

SEQ ID NO: 528480 - DNA, 20 bp, Artificial
  CRISPR gRNA sequence
gagcctggaggaattcctgg

SEQ ID NO: 528481 - DNA, 20 bp, Artificial
  CRISPR gRNA sequence
aattcctgggagcacacatt

SEQ ID NO: 528482 - DNA, 20 bp, Artificial
  CRISPR gRNA sequence
attcctgggagcacacattt

SEQ ID NO: 528483 - DNA, 20 bp, Artificial
  CRISPR gRNA sequence
gggagcacacatttaggcgc

SEQ ID NO: 528484 - DNA, 20 bp, Artificial
  CRISPR gRNA sequence
acacatttaggcgccagctg

SEQ ID NO: 528485 - DNA, 20 bp, Artificial
  CRISPR gRNA sequence
taggcgccagctgcagctgc

SEQ ID NO: 528486 - DNA, 20 bp, Artificial
  CRISPR gRNA sequence
ggcgccagctgcagctgctg

SEQ ID NO: 528487 - DNA, 20 bp, Artificial
  CRISPR gRNA sequence
gccagctgcagctgctggag

SEQ ID NO: 528488 - DNA, 20 bp, Artificial
  CRISPR gRNA sequence
ccagctgcagctgctggagt

SEQ ID NO: 528489 - DNA, 20 bp, Artificial
  CRISPR gRNA sequence
gctgcagctgctggagtggg

SEQ ID NO: 528490 - DNA, 20 bp, Artificial
  CRISPR gRNA sequence
ctgcagctgctggagtgggt

SEQ ID NO: 528491 - DNA, 20 bp, Artificial
  CRISPR gRNA sequence
gctgctggagtgggtaggct

SEQ ID NO: 528492 - DNA, 20 bp, Artificial
  CRISPR gRNA sequence
ctgctggagtgggtaggctg

SEQ ID NO: 528493 - DNA, 20 bp, Artificial
  CRISPR gRNA sequence
acccactgtcctgcttgaac

SEQ ID NO: 528494 - DNA, 20 bp, Artificial
  CRISPR gRNA sequence
cccactgtcctgcttgaacc

SEQ ID NO: 528495 - DNA, 20 bp, Artificial
  CRISPR gRNA sequence
actgtcctgcttgaaccagg

SEQ ID NO: 528496 - DNA, 20 bp, Artificial
  CRISPR gRNA sequence
ctgtcctgcttgaaccaggc

SEQ ID NO: 528497 - DNA, 20 bp, Artificial
  CRISPR gRNA sequence
tgtcctgcttgaaccaggca

SEQ ID NO: 528498 - DNA, 20 bp, Artificial
  CRISPR gRNA sequence
cttgaaccaggcagggtgca

SEQ ID NO: 528499 - DNA, 20 bp, Artificial
  CRISPR gRNA sequence
tgaaccaggcagggtgcaca

SEQ ID NO: 528500 - DNA, 20 bp, Artificial
  CRISPR gRNA sequence
aggcagggtgcacagagccg

SEQ ID NO: 528501 - DNA, 20 bp, Artificial
  CRISPR gRNA sequence
tgtctgtccaaccctgcctg

SEQ ID NO: 528502 - DNA, 20 bp, Artificial
  CRISPR gRNA sequence
tccaaccctgcctgcagtct

SEQ ID NO: 528503 - DNA, 20 bp, Artificial
  CRISPR gRNA sequence
tgcctgcagtctcagccatg

SEQ ID NO: 528504 - DNA, 20 bp, Artificial
  CRISPR gRNA sequence
ctacaccccattcctcctac

SEQ ID NO: 528505 - DNA, 20 bp, Artificial
  CRISPR gRNA sequence
acaccccattcctcctacca

SEQ ID NO: 528506 - DNA, 20 bp, Artificial
  CRISPR gRNA sequence
gtgcctctgtctacactttc

SEQ ID NO: 528507 - DNA, 20 bp, Artificial
  CRISPR gRNA sequence
cctctgtctacactttctgg

SEQ ID NO: 528508 - DNA, 20 bp, Artificial
  CRISPR gRNA sequence
tctacactttctggtggccc

SEQ ID NO: 528509 - DNA, 20 bp, Artificial
  CRISPR gRNA sequence
ctacactttctggtggccct

SEQ ID NO: 528510 - DNA, 20 bp, Artificial
  CRISPR gRNA sequence
tggtggccctgggctcttca

SEQ ID NO: 528511 - DNA, 20 bp, Artificial
  CRISPR gRNA sequence
gaaattgacattgcgatttt

SEQ ID NO: 528512 - DNA, 20 bp, Artificial
  CRISPR gRNA sequence
gtttgcctcttacttgattt

SEQ ID NO: 528513 - DNA, 20 bp, Artificial
  CRISPR gRNA sequence
tttgcctcttacttgatttt

SEQ ID NO: 528514 - DNA, 20 bp, Artificial
  CRISPR gRNA sequence
tacttgattttaggcttcct

SEQ ID NO: 528515 - DNA, 20 bp, Artificial
  CRISPR gRNA sequence
acttgattttaggcttcctg

SEQ ID NO: 528516 - DNA, 20 bp, Artificial
  CRISPR gRNA sequence
cctgaggacaatttgtgtct

SEQ ID NO: 528517 - DNA, 20 bp, Artificial
  CRISPR gRNA sequence
tcacaatgacacttaacact

SEQ ID NO: 528518 - DNA, 20 bp, Artificial
  CRISPR gRNA sequence
caatgacacttaacacttgg

SEQ ID NO: 528519 - DNA, 20 bp, Artificial
  CRISPR gRNA sequence
acacttaacacttggaagat

SEQ ID NO: 528520 - DNA, 20 bp, Artificial
  CRISPR gRNA sequence
cacttaacacttggaagatg

SEQ ID NO: 528521 - DNA, 20 bp, Artificial
  CRISPR gRNA sequence
ggaagatgaggaataaatgt

SEQ ID NO: 528522 - DNA, 20 bp, Artificial
  CRISPR gRNA sequence
agatgaggaataaatgttgg

SEQ ID NO: 528523 - DNA, 20 bp, Artificial
  CRISPR gRNA sequence
gatgaggaataaatgttgga

SEQ ID NO: 528524 - DNA, 20 bp, Artificial
  CRISPR gRNA sequence
ggaaggacaaatgaaccaaa

SEQ ID NO: 528525 - DNA, 20 bp, Artificial
  CRISPR gRNA sequence
caaatgaaccaaatggtgta

SEQ ID NO: 528526 - DNA, 20 bp, Artificial
  CRISPR gRNA sequence
aaatgaaccaaatggtgtat

SEQ ID NO: 528527 - DNA, 20 bp, Artificial
  CRISPR gRNA sequence
aaccaaatggtgtatgggcc

SEQ ID NO: 528528 - DNA, 20 bp, Artificial
  CRISPR gRNA sequence
aatggtgtatgggccaagtg

SEQ ID NO: 528529 - DNA, 20 bp, Artificial
  CRISPR gRNA sequence
ggtgtatgggccaagtgtgg

SEQ ID NO: 528530 - DNA, 20 bp, Artificial
  CRISPR gRNA sequence
gtggctcatatctgtaatct

SEQ ID NO: 528531 - DNA, 20 bp, Artificial
  CRISPR gRNA sequence
tatctgtaatctcagcactt

SEQ ID NO: 528532 - DNA, 20 bp, Artificial
  CRISPR gRNA sequence
atctgtaatctcagcacttt

SEQ ID NO: 528533 - DNA, 20 bp, Artificial
  CRISPR gRNA sequence
ctgtaatctcagcactttgg

SEQ ID NO: 528534 - DNA, 20 bp, Artificial
  CRISPR gRNA sequence
tgtaatctcagcactttggg

SEQ ID NO: 528535 - DNA, 20 bp, Artificial
  CRISPR gRNA sequence
tctcagcactttgggaggcc

SEQ ID NO: 528536 - DNA, 20 bp, Artificial
  CRISPR gRNA sequence
ctcagcactttgggaggccg

SEQ ID NO: 528537 - DNA, 20 bp, Artificial
  CRISPR gRNA sequence
agcactttgggaggccgagg

SEQ ID NO: 528538 - DNA, 20 bp, Artificial
  CRISPR gRNA sequence
gcactttgggaggccgaggc

SEQ ID NO: 528539 - DNA, 20 bp, Artificial
  CRISPR gRNA sequence
actttgggaggccgaggcag

SEQ ID NO: 528540 - DNA, 20 bp, Artificial
  CRISPR gRNA sequence
ctttgggaggccgaggcagg

SEQ ID NO: 528541 - DNA, 20 bp, Artificial
  CRISPR gRNA sequence
ccgaggcaggaggatcattt

SEQ ID NO: 528542 - DNA, 20 bp, Artificial
  CRISPR gRNA sequence
gcaggaggatcatttgagct

SEQ ID NO: 528543 - DNA, 20 bp, Artificial
  CRISPR gRNA sequence
caggaggatcatttgagctc

SEQ ID NO: 528544 - DNA, 20 bp, Artificial
  CRISPR gRNA sequence
ggaggatcatttgagctcag

SEQ ID NO: 528545 - DNA, 20 bp, Artificial
  CRISPR gRNA sequence
atcatttgagctcaggagtt

SEQ ID NO: 528546 - DNA, 20 bp, Artificial
  CRISPR gRNA sequence
tcatttgagctcaggagttt

SEQ ID NO: 528547 - DNA, 20 bp, Artificial
  CRISPR gRNA sequence
tgagctcaggagtttgggac

SEQ ID NO: 528548 - DNA, 20 bp, Artificial
  CRISPR gRNA sequence
tcaggagtttgggaccagcc

SEQ ID NO: 528549 - DNA, 20 bp, Artificial
  CRISPR gRNA sequence
caggagtttgggaccagcct

SEQ ID NO: 528550 - DNA, 20 bp, Artificial
  CRISPR gRNA sequence
tgggaccagcctgggcaata

SEQ ID NO: 528551 - DNA, 20 bp, Artificial
  CRISPR gRNA sequence
accagcctgggcaatatagt

SEQ ID NO: 528552 - DNA, 20 bp, Artificial
  CRISPR gRNA sequence
ctgggcaatatagtgagacc

SEQ ID NO: 528553 - DNA, 20 bp, Artificial
  CRISPR gRNA sequence
taaaaaaaaaacttaaaaat

SEQ ID NO: 528554 - DNA, 20 bp, Artificial
  CRISPR gRNA sequence
aaaaaaaaaacttaaaaatt

SEQ ID NO: 528555 - DNA, 20 bp, Artificial
  CRISPR gRNA sequence
aaaaaaacttaaaaattagg

SEQ ID NO: 528556 - DNA, 20 bp, Artificial
  CRISPR gRNA sequence
aaaaaacttaaaaattaggt

SEQ ID NO: 528557 - DNA, 20 bp, Artificial
  CRISPR gRNA sequence
taaaaattaggtgggtgcat

SEQ ID NO: 528558 - DNA, 20 bp, Artificial
  CRISPR gRNA sequence
ggtgcattggtgtatgcctg

SEQ ID NO: 528559 - DNA, 20 bp, Artificial
  CRISPR gRNA sequence
ttggtgtatgcctgtagtcc

SEQ ID NO: 528560 - DNA, 20 bp, Artificial
  CRISPR gRNA sequence
tgtatgcctgtagtcccagc

SEQ ID NO: 528561 - DNA, 20 bp, Artificial
  CRISPR gRNA sequence
tgcctgtagtcccagctagt

SEQ ID NO: 528562 - DNA, 20 bp, Artificial
  CRISPR gRNA sequence
gcctgtagtcccagctagtc

SEQ ID NO: 528563 - DNA, 20 bp, Artificial
  CRISPR gRNA sequence
ctgtagtcccagctagtcag

SEQ ID NO: 528564 - DNA, 20 bp, Artificial
  CRISPR gRNA sequence
tgtagtcccagctagtcagg

SEQ ID NO: 528565 - DNA, 20 bp, Artificial
  CRISPR gRNA sequence
tcccagctagtcaggaggct

SEQ ID NO: 528566 - DNA, 20 bp, Artificial
  CRISPR gRNA sequence
cccagctagtcaggaggctg

SEQ ID NO: 528567 - DNA, 20 bp, Artificial
  CRISPR gRNA sequence
agctagtcaggaggctgagg

SEQ ID NO: 528568 - DNA, 20 bp, Artificial
  CRISPR gRNA sequence
gctagtcaggaggctgaggt

SEQ ID NO: 528569 - DNA, 20 bp, Artificial
  CRISPR gRNA sequence
ctgaggtgggtgaatcattt

SEQ ID NO: 528570 - DNA, 20 bp, Artificial
  CRISPR gRNA sequence
gtgggtgaatcatttcagcc

SEQ ID NO: 528571 - DNA, 20 bp, Artificial
  CRISPR gRNA sequence
tgggtgaatcatttcagccc

SEQ ID NO: 528572 - DNA, 20 bp, Artificial
  CRISPR gRNA sequence
ggtgaatcatttcagcccgg

SEQ ID NO: 528573 - DNA, 20 bp, Artificial
  CRISPR gRNA sequence
tcatttcagcccgggagatc

SEQ ID NO: 528574 - DNA, 20 bp, Artificial
  CRISPR gRNA sequence
agcccgggagatcaagaatg

SEQ ID NO: 528575 - DNA, 20 bp, Artificial
  CRISPR gRNA sequence
cgggagatcaagaatgcagt

SEQ ID NO: 528576 - DNA, 20 bp, Artificial
  CRISPR gRNA sequence
tacgatcacacactgcactc

SEQ ID NO: 528577 - DNA, 20 bp, Artificial
  CRISPR gRNA sequence
tcacacactgcactccagtc

SEQ ID NO: 528578 - DNA, 20 bp, Artificial
  CRISPR gRNA sequence
cacacactgcactccagtct

SEQ ID NO: 528579 - DNA, 20 bp, Artificial
  CRISPR gRNA sequence
ctgcactccagtctgggcaa

SEQ ID NO: 528580 - DNA, 20 bp, Artificial
  CRISPR gRNA sequence
gcactccagtctgggcaaca

SEQ ID NO: 528581 - DNA, 20 bp, Artificial
  CRISPR gRNA sequence
tccagtctgggcaacagagc

SEQ ID NO: 528582 - DNA, 20 bp, Artificial
  CRISPR gRNA sequence
ccagtctgggcaacagagca

SEQ ID NO: 528583 - DNA, 20 bp, Artificial
  CRISPR gRNA sequence
aaacaaataaaaaacaaaaa

SEQ ID NO: 528584 - DNA, 20 bp, Artificial
  CRISPR gRNA sequence
caaataaaaaacaaaaatag

SEQ ID NO: 528585 - DNA, 20 bp, Artificial
  CRISPR gRNA sequence
aaataaaaaacaaaaatagt

SEQ ID NO: 528586 - DNA, 20 bp, Artificial
  CRISPR gRNA sequence
aaacaaaaatagtgggtgaa

SEQ ID NO: 528587 - DNA, 20 bp, Artificial
  CRISPR gRNA sequence
acaaaaatagtgggtgaaca

SEQ ID NO: 528588 - DNA, 20 bp, Artificial
  CRISPR gRNA sequence
aaaatagtgggtgaacagag

SEQ ID NO: 528589 - DNA, 20 bp, Artificial
  CRISPR gRNA sequence
tgaacagagtagtaaaccaa

SEQ ID NO: 528590 - DNA, 20 bp, Artificial
  CRISPR gRNA sequence
cagagtagtaaaccaatggc

SEQ ID NO: 528591 - DNA, 20 bp, Artificial
  CRISPR gRNA sequence
agtaaaccaatggccagtgc

SEQ ID NO: 528592 - DNA, 20 bp, Artificial
  CRISPR gRNA sequence
gccagtgcaagcttgccaca

SEQ ID NO: 528593 - DNA, 20 bp, Artificial
  CRISPR gRNA sequence
ccagtgcaagcttgccacat

SEQ ID NO: 528594 - DNA, 20 bp, Artificial
  CRISPR gRNA sequence
agtgcaagcttgccacatag

SEQ ID NO: 528595 - DNA, 20 bp, Artificial
  CRISPR gRNA sequence
agcttgccacataggagatg

SEQ ID NO: 528596 - DNA, 20 bp, Artificial
  CRISPR gRNA sequence
ttgccacataggagatgaag

SEQ ID NO: 528597 - DNA, 20 bp, Artificial
  CRISPR gRNA sequence
tgccacataggagatgaaga

SEQ ID NO: 528598 - DNA, 20 bp, Artificial
  CRISPR gRNA sequence
ccacccactgccccataatt

SEQ ID NO: 528599 - DNA, 20 bp, Artificial
  CRISPR gRNA sequence
actgccccataattcagaac

SEQ ID NO: 528600 - DNA, 20 bp, Artificial
  CRISPR gRNA sequence
ctgccccataattcagaact

SEQ ID NO: 528601 - DNA, 20 bp, Artificial
  CRISPR gRNA sequence
tgccccataattcagaacta

SEQ ID NO: 528602 - DNA, 20 bp, Artificial
  CRISPR gRNA sequence
ccataattcagaactagggc

SEQ ID NO: 528603 - DNA, 20 bp, Artificial
  CRISPR gRNA sequence
cataattcagaactagggcc

SEQ ID NO: 528604 - DNA, 20 bp, Artificial
  CRISPR gRNA sequence
ataattcagaactagggcca

SEQ ID NO: 528605 - DNA, 20 bp, Artificial
  CRISPR gRNA sequence
taattcagaactagggccag

SEQ ID NO: 528606 - DNA, 20 bp, Artificial
  CRISPR gRNA sequence
tcagaactagggccaggggt

SEQ ID NO: 528607 - DNA, 20 bp, Artificial
  CRISPR gRNA sequence
agaactagggccaggggtta

SEQ ID NO: 528608 - DNA, 20 bp, Artificial
  CRISPR gRNA sequence
aggggttagagccctctcca

SEQ ID NO: 528609 - DNA, 20 bp, Artificial
  CRISPR gRNA sequence
gagccctctccacagtctac

SEQ ID NO: 528610 - DNA, 20 bp, Artificial
  CRISPR gRNA sequence
cagtctactggacataacct

SEQ ID NO: 528611 - DNA, 20 bp, Artificial
  CRISPR gRNA sequence
cataacctaagcaatgactg

SEQ ID NO: 528612 - DNA, 20 bp, Artificial
  CRISPR gRNA sequence
ataacctaagcaatgactgc

SEQ ID NO: 528613 - DNA, 20 bp, Artificial
  CRISPR gRNA sequence
taacctaagcaatgactgca

SEQ ID NO: 528614 - DNA, 20 bp, Artificial
  CRISPR gRNA sequence
taagcaatgactgcagggca

SEQ ID NO: 528615 - DNA, 20 bp, Artificial
  CRISPR gRNA sequence
gcaatgactgcagggcacgg

SEQ ID NO: 528616 - DNA, 20 bp, Artificial
  CRISPR gRNA sequence
tgactgcagggcacggaaga

SEQ ID NO: 528617 - DNA, 20 bp, Artificial
  CRISPR gRNA sequence
gcagggcacggaagatggca

SEQ ID NO: 528618 - DNA, 20 bp, Artificial
  CRISPR gRNA sequence
agggcacggaagatggcata

SEQ ID NO: 528619 - DNA, 20 bp, Artificial
  CRISPR gRNA sequence
gggcacggaagatggcatag

SEQ ID NO: 528620 - DNA, 20 bp, Artificial
  CRISPR gRNA sequence
aggatgtgttttgtcctttc

SEQ ID NO: 528621 - DNA, 20 bp, Artificial
  CRISPR gRNA sequence
gatgtgttttgtcctttctg

SEQ ID NO: 528622 - DNA, 20 bp, Artificial
  CRISPR gRNA sequence
atgtgttttgtcctttctgg

SEQ ID NO: 528623 - DNA, 20 bp, Artificial
  CRISPR gRNA sequence
ggccctttcctctttgtgct

SEQ ID NO: 528624 - DNA, 20 bp, Artificial
  CRISPR gRNA sequence
ccctttcctctttgtgctta

SEQ ID NO: 528625 - DNA, 20 bp, Artificial
  CRISPR gRNA sequence
tctttgtgcttagagcacac

SEQ ID NO: 528626 - DNA, 20 bp, Artificial
  CRISPR gRNA sequence
cttagagcacacgagccatt

SEQ ID NO: 528627 - DNA, 20 bp, Artificial
  CRISPR gRNA sequence
ttagagcacacgagccattt

SEQ ID NO: 528628 - DNA, 20 bp, Artificial
  CRISPR gRNA sequence
taactttgactctacactca

SEQ ID NO: 528629 - DNA, 20 bp, Artificial
  CRISPR gRNA sequence
tctgatgctcacatttcatg

SEQ ID NO: 528630 - DNA, 20 bp, Artificial
  CRISPR gRNA sequence
atgctcacatttcatgtagt

SEQ ID NO: 528631 - DNA, 20 bp, Artificial
  CRISPR gRNA sequence
gctcacatttcatgtagtca

SEQ ID NO: 528632 - DNA, 20 bp, Artificial
  CRISPR gRNA sequence
ctcacatttcatgtagtcag

SEQ ID NO: 528633 - DNA, 20 bp, Artificial
  CRISPR gRNA sequence
cacatttcatgtagtcagag

SEQ ID NO: 528634 - DNA, 20 bp, Artificial
  CRISPR gRNA sequence
acatttcatgtagtcagagg

SEQ ID NO: 528635 - DNA, 20 bp, Artificial
  CRISPR gRNA sequence
tgtagtcagaggaggccatc

SEQ ID NO: 528636 - DNA, 20 bp, Artificial
  CRISPR gRNA sequence
atctggtttgaatcaacatc

SEQ ID NO: 528637 - DNA, 20 bp, Artificial
  CRISPR gRNA sequence
tggtttgaatcaacatccgg

SEQ ID NO: 528638 - DNA, 20 bp, Artificial
  CRISPR gRNA sequence
gaatcaacatccggaagtta

SEQ ID NO: 528639 - DNA, 20 bp, Artificial
  CRISPR gRNA sequence
aatcaacatccggaagttac

SEQ ID NO: 528640 - DNA, 20 bp, Artificial
  CRISPR gRNA sequence
atcaacatccggaagttaca

SEQ ID NO: 528641 - DNA, 20 bp, Artificial
  CRISPR gRNA sequence
ggaagttacagggtgatgct

SEQ ID NO: 528642 - DNA, 20 bp, Artificial
  CRISPR gRNA sequence
aagttacagggtgatgctta

SEQ ID NO: 528643 - DNA, 20 bp, Artificial
  CRISPR gRNA sequence
gttacagggtgatgcttaga

SEQ ID NO: 528644 - DNA, 20 bp, Artificial
  CRISPR gRNA sequence
ttacagggtgatgcttagag

SEQ ID NO: 528645 - DNA, 20 bp, Artificial
  CRISPR gRNA sequence
tacagggtgatgcttagaga

SEQ ID NO: 528646 - DNA, 20 bp, Artificial
  CRISPR gRNA sequence
agagagggcttgtgcttccc

SEQ ID NO: 528647 - DNA, 20 bp, Artificial
  CRISPR gRNA sequence
cccagccacacatctccata

SEQ ID NO: 528648 - DNA, 20 bp, Artificial
  CRISPR gRNA sequence
acacatctccataaagatgt

SEQ ID NO: 528649 - DNA, 20 bp, Artificial
  CRISPR gRNA sequence
acatctccataaagatgtaa

SEQ ID NO: 528650 - DNA, 20 bp, Artificial
  CRISPR gRNA sequence
catctccataaagatgtaag

SEQ ID NO: 528651 - DNA, 20 bp, Artificial
  CRISPR gRNA sequence
gatgtaagaggtaattattt

SEQ ID NO: 528652 - DNA, 20 bp, Artificial
  CRISPR gRNA sequence
taagaggtaattatttcagc

SEQ ID NO: 528653 - DNA, 20 bp, Artificial
  CRISPR gRNA sequence
aagaggtaattatttcagct

SEQ ID NO: 528654 - DNA, 20 bp, Artificial
  CRISPR gRNA sequence
gtaattatttcagctgggtg

SEQ ID NO: 528655 - DNA, 20 bp, Artificial
  CRISPR gRNA sequence
attatttcagctgggtgcgg

SEQ ID NO: 528656 - DNA, 20 bp, Artificial
  CRISPR gRNA sequence
gtggctcatacctgtaatcc

SEQ ID NO: 528657 - DNA, 20 bp, Artificial
  CRISPR gRNA sequence
tacctgtaatcccagcactt

SEQ ID NO: 528658 - DNA, 20 bp, Artificial
  CRISPR gRNA sequence
acctgtaatcccagcacttt

SEQ ID NO: 528659 - DNA, 20 bp, Artificial
  CRISPR gRNA sequence
ctgtaatcccagcactttgg

SEQ ID NO: 528660 - DNA, 20 bp, Artificial
  CRISPR gRNA sequence
tgtaatcccagcactttggg

SEQ ID NO: 528661 - DNA, 20 bp, Artificial
  CRISPR gRNA sequence
tcccagcactttgggaggcc

SEQ ID NO: 528662 - DNA, 20 bp, Artificial
  CRISPR gRNA sequence
cccagcactttgggaggcca

SEQ ID NO: 528663 - DNA, 20 bp, Artificial
  CRISPR gRNA sequence
agcactttgggaggccaagg

SEQ ID NO: 528664 - DNA, 20 bp, Artificial
  CRISPR gRNA sequence
gcactttgggaggccaaggc

SEQ ID NO: 528665 - DNA, 20 bp, Artificial
  CRISPR gRNA sequence
ctttgggaggccaaggcagg

SEQ ID NO: 528666 - DNA, 20 bp, Artificial
  CRISPR gRNA sequence
gccaaggcaggcagatcacc

SEQ ID NO: 528667 - DNA, 20 bp, Artificial
  CRISPR gRNA sequence
aggcaggcagatcacctggt

SEQ ID NO: 528668 - DNA, 20 bp, Artificial
  CRISPR gRNA sequence
ggcaggcagatcacctggtc

SEQ ID NO: 528669 - DNA, 20 bp, Artificial
  CRISPR gRNA sequence
caggcagatcacctggtcgg

SEQ ID NO: 528670 - DNA, 20 bp, Artificial
  CRISPR gRNA sequence
gatcacctggtcgggagttc

SEQ ID NO: 528671 - DNA, 20 bp, Artificial
  CRISPR gRNA sequence
cctggtcgggagttcgagac

SEQ ID NO: 528672 - DNA, 20 bp, Artificial
  CRISPR gRNA sequence
cgagaccagcctgaccaaca

SEQ ID NO: 528673 - DNA, 20 bp, Artificial
  CRISPR gRNA sequence
agaccagcctgaccaacatg

SEQ ID NO: 528674 - DNA, 20 bp, Artificial
  CRISPR gRNA sequence
ctctactaaaaatacaatat

SEQ ID NO: 528675 - DNA, 20 bp, Artificial
  CRISPR gRNA sequence
actaaaaatacaatattagc

SEQ ID NO: 528676 - DNA, 20 bp, Artificial
  CRISPR gRNA sequence
ctaaaaatacaatattagcc

SEQ ID NO: 528677 - DNA, 20 bp, Artificial
  CRISPR gRNA sequence
aatacaatattagccgggcg

SEQ ID NO: 528678 - DNA, 20 bp, Artificial
  CRISPR gRNA sequence
acaatattagccgggcgtgg

SEQ ID NO: 528679 - DNA, 20 bp, Artificial
  CRISPR gRNA sequence
gtggtgaacgcctgtaatcc

SEQ ID NO: 528680 - DNA, 20 bp, Artificial
  CRISPR gRNA sequence
cgcctgtaatcccagctact

SEQ ID NO: 528681 - DNA, 20 bp, Artificial
  CRISPR gRNA sequence
gcctgtaatcccagctactc

SEQ ID NO: 528682 - DNA, 20 bp, Artificial
  CRISPR gRNA sequence
ctgtaatcccagctactcag

SEQ ID NO: 528683 - DNA, 20 bp, Artificial
  CRISPR gRNA sequence
tgtaatcccagctactcagg

SEQ ID NO: 528684 - DNA, 20 bp, Artificial
  CRISPR gRNA sequence
tcccagctactcaggaggcc

SEQ ID NO: 528685 - DNA, 20 bp, Artificial
  CRISPR gRNA sequence
cccagctactcaggaggccg

SEQ ID NO: 528686 - DNA, 20 bp, Artificial
  CRISPR gRNA sequence
agctactcaggaggccgagg

SEQ ID NO: 528687 - DNA, 20 bp, Artificial
  CRISPR gRNA sequence
gctactcaggaggccgaggc

SEQ ID NO: 528688 - DNA, 20 bp, Artificial
  CRISPR gRNA sequence
tactcaggaggccgaggcag

SEQ ID NO: 528689 - DNA, 20 bp, Artificial
  CRISPR gRNA sequence
gcaggagaattgtttgaacc

SEQ ID NO: 528690 - DNA, 20 bp, Artificial
  CRISPR gRNA sequence
caggagaattgtttgaacct

SEQ ID NO: 528691 - DNA, 20 bp, Artificial
  CRISPR gRNA sequence
ggagaattgtttgaacctgg

SEQ ID NO: 528692 - DNA, 20 bp, Artificial
  CRISPR gRNA sequence
gagaattgtttgaacctggg

SEQ ID NO: 528693 - DNA, 20 bp, Artificial
  CRISPR gRNA sequence
aattgtttgaacctgggagg

SEQ ID NO: 528694 - DNA, 20 bp, Artificial
  CRISPR gRNA sequence
ttgtttgaacctgggaggca

SEQ ID NO: 528695 - DNA, 20 bp, Artificial
  CRISPR gRNA sequence
tgtttgaacctgggaggcag

SEQ ID NO: 528696 - DNA, 20 bp, Artificial
  CRISPR gRNA sequence
aacctgggaggcagaggctg

SEQ ID NO: 528697 - DNA, 20 bp, Artificial
  CRISPR gRNA sequence
tgggaggcagaggctgcagt

SEQ ID NO: 528698 - DNA, 20 bp, Artificial
  CRISPR gRNA sequence
ggcagaggctgcagtgagcc

SEQ ID NO: 528699 - DNA, 20 bp, Artificial
  CRISPR gRNA sequence
aagatcgcaccattgcactc

SEQ ID NO: 528700 - DNA, 20 bp, Artificial
  CRISPR gRNA sequence
cgcaccattgcactctagcc

SEQ ID NO: 528701 - DNA, 20 bp, Artificial
  CRISPR gRNA sequence
gcaccattgcactctagcct

SEQ ID NO: 528702 - DNA, 20 bp, Artificial
  CRISPR gRNA sequence
tgcactctagcctgggcaac

SEQ ID NO: 528703 - DNA, 20 bp, Artificial
  CRISPR gRNA sequence
cactctagcctgggcaacaa

SEQ ID NO: 528704 - DNA, 20 bp, Artificial
  CRISPR gRNA sequence
aactcaaaaaaaaaaaaaaa

SEQ ID NO: 528705 - DNA, 20 bp, Artificial
  CRISPR gRNA sequence
ctcaaaaaaaaaaaaaaaaa

SEQ ID NO: 528706 - DNA, 20 bp, Artificial
  CRISPR gRNA sequence
tcaaaaaaaaaaaaaaaaag

SEQ ID NO: 528707 - DNA, 20 bp, Artificial
  CRISPR gRNA sequence
aagaggtaattatttcaccc

SEQ ID NO: 528708 - DNA, 20 bp, Artificial
  CRISPR gRNA sequence
agaggtaattatttcacccc

SEQ ID NO: 528709 - DNA, 20 bp, Artificial
  CRISPR gRNA sequence
gaggtaattatttcacccca

SEQ ID NO: 528710 - DNA, 20 bp, Artificial
  CRISPR gRNA sequence
cttctcttcctacctccctc

SEQ ID NO: 528711 - DNA, 20 bp, Artificial
  CRISPR gRNA sequence
tctcttcctacctccctctg

SEQ ID NO: 528712 - DNA, 20 bp, Artificial
  CRISPR gRNA sequence
ctccctctggagccactgca

SEQ ID NO: 528713 - DNA, 20 bp, Artificial
  CRISPR gRNA sequence
ctctggagccactgcaaaga

SEQ ID NO: 528714 - DNA, 20 bp, Artificial
  CRISPR gRNA sequence
agccactgcaaagacggcct

SEQ ID NO: 528715 - DNA, 20 bp, Artificial
  CRISPR gRNA sequence
gccactgcaaagacggcctt

SEQ ID NO: 528716 - DNA, 20 bp, Artificial
  CRISPR gRNA sequence
tgcaaagacggccttgggtg

SEQ ID NO: 528717 - DNA, 20 bp, Artificial
  CRISPR gRNA sequence
gcaaagacggccttgggtgc

SEQ ID NO: 528718 - DNA, 20 bp, Artificial
  CRISPR gRNA sequence
caaagacggccttgggtgca

SEQ ID NO: 528719 - DNA, 20 bp, Artificial
  CRISPR gRNA sequence
ggactgaaatacctaactta

SEQ ID NO: 528720 - DNA, 20 bp, Artificial
  CRISPR gRNA sequence
aatacctaacttacagccta

SEQ ID NO: 528721 - DNA, 20 bp, Artificial
  CRISPR gRNA sequence
atacctaacttacagcctaa

SEQ ID NO: 528722 - DNA, 20 bp, Artificial
  CRISPR gRNA sequence
acctaacttacagcctaaag

SEQ ID NO: 528723 - DNA, 20 bp, Artificial
  CRISPR gRNA sequence
acttacagcctaaaggagtc

SEQ ID NO: 528724 - DNA, 20 bp, Artificial
  CRISPR gRNA sequence
ttacagcctaaaggagtcca

SEQ ID NO: 528725 - DNA, 20 bp, Artificial
  CRISPR gRNA sequence
tacagcctaaaggagtccag

SEQ ID NO: 528726 - DNA, 20 bp, Artificial
  CRISPR gRNA sequence
acagcctaaaggagtccaga

SEQ ID NO: 528727 - DNA, 20 bp, Artificial
  CRISPR gRNA sequence
cagcctaaaggagtccagag

SEQ ID NO: 528728 - DNA, 20 bp, Artificial
  CRISPR gRNA sequence
ctaaaggagtccagaggggc

SEQ ID NO: 528729 - DNA, 20 bp, Artificial
  CRISPR gRNA sequence
aaggagtccagaggggccag

SEQ ID NO: 528730 - DNA, 20 bp, Artificial
  CRISPR gRNA sequence
aggagtccagaggggccagc

SEQ ID NO: 528731 - DNA, 20 bp, Artificial
  CRISPR gRNA sequence
ggagtccagaggggccagca

SEQ ID NO: 528732 - DNA, 20 bp, Artificial
  CRISPR gRNA sequence
gaggggccagcagggtgctc

SEQ ID NO: 528733 - DNA, 20 bp, Artificial
  CRISPR gRNA sequence
aggggccagcagggtgctcc

SEQ ID NO: 528734 - DNA, 20 bp, Artificial
  CRISPR gRNA sequence
agcagggtgctccaggcctc

SEQ ID NO: 528735 - DNA, 20 bp, Artificial
  CRISPR gRNA sequence
agggtgctccaggcctctag

SEQ ID NO: 528736 - DNA, 20 bp, Artificial
  CRISPR gRNA sequence
tgctccaggcctctagcagc

SEQ ID NO: 528737 - DNA, 20 bp, Artificial
  CRISPR gRNA sequence
gctccaggcctctagcagct

SEQ ID NO: 528738 - DNA, 20 bp, Artificial
  CRISPR gRNA sequence
ctagcagctgggcaccttca

SEQ ID NO: 528739 - DNA, 20 bp, Artificial
  CRISPR gRNA sequence
cacagattccctgtgatttt

SEQ ID NO: 528740 - DNA, 20 bp, Artificial
  CRISPR gRNA sequence
cagattccctgtgattttaa

SEQ ID NO: 528741 - DNA, 20 bp, Artificial
  CRISPR gRNA sequence
tccctgtgattttaagagta

SEQ ID NO: 528742 - DNA, 20 bp, Artificial
  CRISPR gRNA sequence
ccctgtgattttaagagtac

SEQ ID NO: 528743 - DNA, 20 bp, Artificial
  CRISPR gRNA sequence
tacaggaaaaactacattac

SEQ ID NO: 528744 - DNA, 20 bp, Artificial
  CRISPR gRNA sequence
aggaaaaactacattacgag

SEQ ID NO: 528745 - DNA, 20 bp, Artificial
  CRISPR gRNA sequence
aactacattacgagtagctg

SEQ ID NO: 528746 - DNA, 20 bp, Artificial
  CRISPR gRNA sequence
actacattacgagtagctgt

SEQ ID NO: 528747 - DNA, 20 bp, Artificial
  CRISPR gRNA sequence
tagctgtaggcctgctttca

SEQ ID NO: 528748 - DNA, 20 bp, Artificial
  CRISPR gRNA sequence
aggcctgctttcatggactg

SEQ ID NO: 528749 - DNA, 20 bp, Artificial
  CRISPR gRNA sequence
tcatggactgaagtcacaca

SEQ ID NO: 528750 - DNA, 20 bp, Artificial
  CRISPR gRNA sequence
tggactgaagtcacacaaag

SEQ ID NO: 528751 - DNA, 20 bp, Artificial
  CRISPR gRNA sequence
acacaaagaagaaaatcctg

SEQ ID NO: 528752 - DNA, 20 bp, Artificial
  CRISPR gRNA sequence
cacaaagaagaaaatcctga

SEQ ID NO: 528753 - DNA, 20 bp, Artificial
  CRISPR gRNA sequence
acaaagaagaaaatcctgaa

SEQ ID NO: 528754 - DNA, 20 bp, Artificial
  CRISPR gRNA sequence
agaagaaaatcctgaagggt

SEQ ID NO: 528755 - DNA, 20 bp, Artificial
  CRISPR gRNA sequence
gaagaaaatcctgaagggtg

SEQ ID NO: 528756 - DNA, 20 bp, Artificial
  CRISPR gRNA sequence
agaaaatcctgaagggtgag

SEQ ID NO: 528757 - DNA, 20 bp, Artificial
  CRISPR gRNA sequence
aaaatcctgaagggtgagga

SEQ ID NO: 528758 - DNA, 20 bp, Artificial
  CRISPR gRNA sequence
aaatcctgaagggtgaggag

SEQ ID NO: 528759 - DNA, 20 bp, Artificial
  CRISPR gRNA sequence
atcctgaagggtgaggagag

SEQ ID NO: 528760 - DNA, 20 bp, Artificial
  CRISPR gRNA sequence
tcctgaagggtgaggagagg

SEQ ID NO: 528761 - DNA, 20 bp, Artificial
  CRISPR gRNA sequence
ctgaagggtgaggagaggag

SEQ ID NO: 528762 - DNA, 20 bp, Artificial
  CRISPR gRNA sequence
ggaggagttctttccctcct

SEQ ID NO: 528763 - DNA, 20 bp, Artificial
  CRISPR gRNA sequence
gaggagttctttccctccta

SEQ ID NO: 528764 - DNA, 20 bp, Artificial
  CRISPR gRNA sequence
gttctttccctcctaaggcc

SEQ ID NO: 528765 - DNA, 20 bp, Artificial
  CRISPR gRNA sequence
ccctcctaaggccaagaaca

SEQ ID NO: 528766 - DNA, 20 bp, Artificial
  CRISPR gRNA sequence
cctcctaaggccaagaacat

SEQ ID NO: 528767 - DNA, 20 bp, Artificial
  CRISPR gRNA sequence
aacataggtcttgaatttct

SEQ ID NO: 528768 - DNA, 20 bp, Artificial
  CRISPR gRNA sequence
ataggtcttgaatttctgag

SEQ ID NO: 528769 - DNA, 20 bp, Artificial
  CRISPR gRNA sequence
gtcttgaatttctgagaagc

SEQ ID NO: 528770 - DNA, 20 bp, Artificial
  CRISPR gRNA sequence
tgagaagcgagtaaatttct

SEQ ID NO: 528771 - DNA, 20 bp, Artificial
  CRISPR gRNA sequence
gagaagcgagtaaatttcta

SEQ ID NO: 528772 - DNA, 20 bp, Artificial
  CRISPR gRNA sequence
agtaaatttctaaggacaaa

SEQ ID NO: 528773 - DNA, 20 bp, Artificial
  CRISPR gRNA sequence
catgtgttccaacctcttgc

SEQ ID NO: 528774 - DNA, 20 bp, Artificial
  CRISPR gRNA sequence
gtgttccaacctcttgccgg

SEQ ID NO: 528775 - DNA, 20 bp, Artificial
  CRISPR gRNA sequence
tgttccaacctcttgccgga

SEQ ID NO: 528776 - DNA, 20 bp, Artificial
  CRISPR gRNA sequence
tccaacctcttgccggaagg

SEQ ID NO: 528777 - DNA, 20 bp, Artificial
  CRISPR gRNA sequence
ccggaaggtggattgcatga

SEQ ID NO: 528778 - DNA, 20 bp, Artificial
  CRISPR gRNA sequence
gaaggtggattgcatgacag

SEQ ID NO: 528779 - DNA, 20 bp, Artificial
  CRISPR gRNA sequence
ggattgcatgacagtagaat

SEQ ID NO: 528780 - DNA, 20 bp, Artificial
  CRISPR gRNA sequence
gattgcatgacagtagaatt

SEQ ID NO: 528781 - DNA, 20 bp, Artificial
  CRISPR gRNA sequence
attgcatgacagtagaattg

SEQ ID NO: 528782 - DNA, 20 bp, Artificial
  CRISPR gRNA sequence
ttgcatgacagtagaattgg

SEQ ID NO: 528783 - DNA, 20 bp, Artificial
  CRISPR gRNA sequence
atgacagtagaattggggga

SEQ ID NO: 528784 - DNA, 20 bp, Artificial
  CRISPR gRNA sequence
tgacagtagaattgggggaa

SEQ ID NO: 528785 - DNA, 20 bp, Artificial
  CRISPR gRNA sequence
cagtagaattgggggaaagg

SEQ ID NO: 528786 - DNA, 20 bp, Artificial
  CRISPR gRNA sequence
ggggaaaggcagatctaaca

SEQ ID NO: 528787 - DNA, 20 bp, Artificial
  CRISPR gRNA sequence
gatctaacatagaaatgcct

SEQ ID NO: 528788 - DNA, 20 bp, Artificial
  CRISPR gRNA sequence
ctaacatagaaatgcctcag

SEQ ID NO: 528789 - DNA, 20 bp, Artificial
  CRISPR gRNA sequence
taacatagaaatgcctcaga

SEQ ID NO: 528790 - DNA, 20 bp, Artificial
  CRISPR gRNA sequence
gaaatgcctcagaaggaatg

SEQ ID NO: 528791 - DNA, 20 bp, Artificial
  CRISPR gRNA sequence
ttcccatgcgctctaaccat

SEQ ID NO: 528792 - DNA, 20 bp, Artificial
  CRISPR gRNA sequence
tcccatgcgctctaaccatg

SEQ ID NO: 528793 - DNA, 20 bp, Artificial
  CRISPR gRNA sequence
aaccatgaggttcttgctct

SEQ ID NO: 528794 - DNA, 20 bp, Artificial
  CRISPR gRNA sequence
accatgaggttcttgctctc

SEQ ID NO: 528795 - DNA, 20 bp, Artificial
  CRISPR gRNA sequence
ccatgaggttcttgctctca

SEQ ID NO: 528796 - DNA, 20 bp, Artificial
  CRISPR gRNA sequence
tgctctcagggaacaatttc

SEQ ID NO: 528797 - DNA, 20 bp, Artificial
  CRISPR gRNA sequence
gctctcagggaacaatttct

SEQ ID NO: 528798 - DNA, 20 bp, Artificial
  CRISPR gRNA sequence
tcagggaacaatttctaggt

SEQ ID NO: 528799 - DNA, 20 bp, Artificial
  CRISPR gRNA sequence
gaacaatttctaggtcagca

SEQ ID NO: 528800 - DNA, 20 bp, Artificial
  CRISPR gRNA sequence
acaatttctaggtcagcaca

SEQ ID NO: 528801 - DNA, 20 bp, Artificial
  CRISPR gRNA sequence
caatttctaggtcagcacag

SEQ ID NO: 528802 - DNA, 20 bp, Artificial
  CRISPR gRNA sequence
tttctaggtcagcacagagg

SEQ ID NO: 528803 - DNA, 20 bp, Artificial
  CRISPR gRNA sequence
ttctaggtcagcacagaggt

SEQ ID NO: 528804 - DNA, 20 bp, Artificial
  CRISPR gRNA sequence
tctaggtcagcacagaggta

SEQ ID NO: 528805 - DNA, 20 bp, Artificial
  CRISPR gRNA sequence
tcagcacagaggtagggttc

SEQ ID NO: 528806 - DNA, 20 bp, Artificial
  CRISPR gRNA sequence
cagcacagaggtagggttcc

SEQ ID NO: 528807 - DNA, 20 bp, Artificial
  CRISPR gRNA sequence
ctgcgtgctctctctgatca

SEQ ID NO: 528808 - DNA, 20 bp, Artificial
  CRISPR gRNA sequence
tgcgtgctctctctgatcat

SEQ ID NO: 528809 - DNA, 20 bp, Artificial
  CRISPR gRNA sequence
cgtgctctctctgatcatgg

SEQ ID NO: 528810 - DNA, 20 bp, Artificial
  CRISPR gRNA sequence
ctctctgatcatgggagccc

SEQ ID NO: 528811 - DNA, 20 bp, Artificial
  CRISPR gRNA sequence
tctctgatcatgggagcccc

SEQ ID NO: 528812 - DNA, 20 bp, Artificial
  CRISPR gRNA sequence
tcatgggagccccaggcaca

SEQ ID NO: 528813 - DNA, 20 bp, Artificial
  CRISPR gRNA sequence
cttcttcctgctgattcctt

SEQ ID NO: 528814 - DNA, 20 bp, Artificial
  CRISPR gRNA sequence
ttccttgagttctcttgtcc

SEQ ID NO: 528815 - DNA, 20 bp, Artificial
  CRISPR gRNA sequence
tccttgagttctcttgtcct

SEQ ID NO: 528816 - DNA, 20 bp, Artificial
  CRISPR gRNA sequence
taggctttcactctacctta

SEQ ID NO: 528817 - DNA, 20 bp, Artificial
  CRISPR gRNA sequence
ctttcactctaccttatggt

SEQ ID NO: 528818 - DNA, 20 bp, Artificial
  CRISPR gRNA sequence
agcacttctttctctcctac

SEQ ID NO: 528819 - DNA, 20 bp, Artificial
  CRISPR gRNA sequence
ttctttctctcctacaagct

SEQ ID NO: 528820 - DNA, 20 bp, Artificial
  CRISPR gRNA sequence
ctttctctcctacaagctta

SEQ ID NO: 528821 - DNA, 20 bp, Artificial
  CRISPR gRNA sequence
tcctacaagcttagagttct

SEQ ID NO: 528822 - DNA, 20 bp, Artificial
  CRISPR gRNA sequence
acaagcttagagttctcaga

SEQ ID NO: 528823 - DNA, 20 bp, Artificial
  CRISPR gRNA sequence
agcttagagttctcagatag

SEQ ID NO: 528824 - DNA, 20 bp, Artificial
  CRISPR gRNA sequence
gcttagagttctcagatagt

SEQ ID NO: 528825 - DNA, 20 bp, Artificial
  CRISPR gRNA sequence
cttagagttctcagatagta

SEQ ID NO: 528826 - DNA, 20 bp, Artificial
  CRISPR gRNA sequence
ttagagttctcagatagtag

SEQ ID NO: 528827 - DNA, 20 bp, Artificial
  CRISPR gRNA sequence
cttcctcattgcatccccca

SEQ ID NO: 528828 - DNA, 20 bp, Artificial
  CRISPR gRNA sequence
cctcattgcatcccccaaag

SEQ ID NO: 528829 - DNA, 20 bp, Artificial
  CRISPR gRNA sequence
attgcatcccccaaagcagc

SEQ ID NO: 528830 - DNA, 20 bp, Artificial
  CRISPR gRNA sequence
atcccccaaagcagctagca

SEQ ID NO: 528831 - DNA, 20 bp, Artificial
  CRISPR gRNA sequence
gcatggcgccttgcatataa

SEQ ID NO: 528832 - DNA, 20 bp, Artificial
  CRISPR gRNA sequence
catggcgccttgcatataaa

SEQ ID NO: 528833 - DNA, 20 bp, Artificial
  CRISPR gRNA sequence
atatttacattgatttcacc

SEQ ID NO: 528834 - DNA, 20 bp, Artificial
  CRISPR gRNA sequence
tacattgatttcacctggcc

SEQ ID NO: 528835 - DNA, 20 bp, Artificial
  CRISPR gRNA sequence
tggccaagatgaactctatt

SEQ ID NO: 528836 - DNA, 20 bp, Artificial
  CRISPR gRNA sequence
ggccaagatgaactctattg

SEQ ID NO: 528837 - DNA, 20 bp, Artificial
  CRISPR gRNA sequence
ctattgaggttttgttgttg

SEQ ID NO: 528838 - DNA, 20 bp, Artificial
  CRISPR gRNA sequence
gaggttttgttgttgcagat

SEQ ID NO: 528839 - DNA, 20 bp, Artificial
  CRISPR gRNA sequence
aggttttgttgttgcagatg

SEQ ID NO: 528840 - DNA, 20 bp, Artificial
  CRISPR gRNA sequence
gttttgttgttgcagatgag

SEQ ID NO: 528841 - DNA, 20 bp, Artificial
  CRISPR gRNA sequence
tgttgttgcagatgaggagc

SEQ ID NO: 528842 - DNA, 20 bp, Artificial
  CRISPR gRNA sequence
ttgttgcagatgaggagctg

SEQ ID NO: 528843 - DNA, 20 bp, Artificial
  CRISPR gRNA sequence
gcagatgaggagctggagac

SEQ ID NO: 528844 - DNA, 20 bp, Artificial
  CRISPR gRNA sequence
agatgaggagctggagacaa

SEQ ID NO: 528845 - DNA, 20 bp, Artificial
  CRISPR gRNA sequence
gagctggagacaagagccca

SEQ ID NO: 528846 - DNA, 20 bp, Artificial
  CRISPR gRNA sequence
gctggagacaagagcccaca

SEQ ID NO: 528847 - DNA, 20 bp, Artificial
  CRISPR gRNA sequence
ggagacaagagcccacagag

SEQ ID NO: 528848 - DNA, 20 bp, Artificial
  CRISPR gRNA sequence
agcccacagagtagctactg

SEQ ID NO: 528849 - DNA, 20 bp, Artificial
  CRISPR gRNA sequence
cacagagtagctactgaaga

SEQ ID NO: 528850 - DNA, 20 bp, Artificial
  CRISPR gRNA sequence
acagagtagctactgaagaa

SEQ ID NO: 528851 - DNA, 20 bp, Artificial
  CRISPR gRNA sequence
cagagtagctactgaagaaa

SEQ ID NO: 528852 - DNA, 20 bp, Artificial
  CRISPR gRNA sequence
agagtagctactgaagaaag

SEQ ID NO: 528853 - DNA, 20 bp, Artificial
  CRISPR gRNA sequence
tagctactgaagaaaggggc

SEQ ID NO: 528854 - DNA, 20 bp, Artificial
  CRISPR gRNA sequence
ctactgaagaaaggggccgg

SEQ ID NO: 528855 - DNA, 20 bp, Artificial
  CRISPR gRNA sequence
ccggaagccccaccaaattc

SEQ ID NO: 528856 - DNA, 20 bp, Artificial
  CRISPR gRNA sequence
aaattccagcttcaacccct

SEQ ID NO: 528857 - DNA, 20 bp, Artificial
  CRISPR gRNA sequence
agcttcaacccctcagaatc

SEQ ID NO: 528858 - DNA, 20 bp, Artificial
  CRISPR gRNA sequence
caacatcctcctccaccacc

SEQ ID NO: 528859 - DNA, 20 bp, Artificial
  CRISPR gRNA sequence
caccacctggtcatcgttcc

SEQ ID NO: 528860 - DNA, 20 bp, Artificial
  CRISPR gRNA sequence
accacctggtcatcgttccc

SEQ ID NO: 528861 - DNA, 20 bp, Artificial
  CRISPR gRNA sequence
ggtcatcgttcccaggcacc

SEQ ID NO: 528862 - DNA, 20 bp, Artificial
  CRISPR gRNA sequence
agtcatcgtcccccgcctcc

SEQ ID NO: 528863 - DNA, 20 bp, Artificial
  CRISPR gRNA sequence
cgcctcctggacaccgtgtt

SEQ ID NO: 528864 - DNA, 20 bp, Artificial
  CRISPR gRNA sequence
ctggacaccgtgttcagcac

SEQ ID NO: 528865 - DNA, 20 bp, Artificial
  CRISPR gRNA sequence
accgtgttcagcaccagcct

SEQ ID NO: 528866 - DNA, 20 bp, Artificial
  CRISPR gRNA sequence
gtgttcagcaccagcctcag

SEQ ID NO: 528867 - DNA, 20 bp, Artificial
  CRISPR gRNA sequence
gttcagcaccagcctcagaa

SEQ ID NO: 528868 - DNA, 20 bp, Artificial
  CRISPR gRNA sequence
ttcagcaccagcctcagaag

SEQ ID NO: 528869 - DNA, 20 bp, Artificial
  CRISPR gRNA sequence
gaagaggcctcctgctccgt

SEQ ID NO: 528870 - DNA, 20 bp, Artificial
  CRISPR gRNA sequence
aagaggcctcctgctccgtc

SEQ ID NO: 528871 - DNA, 20 bp, Artificial
  CRISPR gRNA sequence
tcctgctccgtcgggcacac

SEQ ID NO: 528872 - DNA, 20 bp, Artificial
  CRISPR gRNA sequence
cgtcgggcacacaagttcac

SEQ ID NO: 528873 - DNA, 20 bp, Artificial
  CRISPR gRNA sequence
cgggcacacaagttcaccag

SEQ ID NO: 528874 - DNA, 20 bp, Artificial
  CRISPR gRNA sequence
cacacaagttcaccagcaga

SEQ ID NO: 528875 - DNA, 20 bp, Artificial
  CRISPR gRNA sequence
acacaagttcaccagcagaa

SEQ ID NO: 528876 - DNA, 20 bp, Artificial
  CRISPR gRNA sequence
cagaaaggcccgcccctccc

SEQ ID NO: 528877 - DNA, 20 bp, Artificial
  CRISPR gRNA sequence
cccgcccctccccagacctc

SEQ ID NO: 528878 - DNA, 20 bp, Artificial
  CRISPR gRNA sequence
ccctccccagacctcgagtt

SEQ ID NO: 528879 - DNA, 20 bp, Artificial
  CRISPR gRNA sequence
gttcagccaaaacctcccca

SEQ ID NO: 528880 - DNA, 20 bp, Artificial
  CRISPR gRNA sequence
ttcagccaaaacctccccat

SEQ ID NO: 528881 - DNA, 20 bp, Artificial
  CRISPR gRNA sequence
tcagccaaaacctccccatg

SEQ ID NO: 528882 - DNA, 20 bp, Artificial
  CRISPR gRNA sequence
gccaaaacctccccatgggg

SEQ ID NO: 528883 - DNA, 20 bp, Artificial
  CRISPR gRNA sequence
aaaacctccccatggggcag

SEQ ID NO: 528884 - DNA, 20 bp, Artificial
  CRISPR gRNA sequence
tccccttcctctaattaaaa

SEQ ID NO: 528885 - DNA, 20 bp, Artificial
  CRISPR gRNA sequence
cttcctctaattaaaaaaga

SEQ ID NO: 528886 - DNA, 20 bp, Artificial
  CRISPR gRNA sequence
aaactgtctttttcaataaa

SEQ ID NO: 528887 - DNA, 20 bp, Artificial
  CRISPR gRNA sequence
tttttcaataaaaagcactg

SEQ ID NO: 528888 - DNA, 20 bp, Artificial
  CRISPR gRNA sequence
gtgcatatccgtacttccat

SEQ ID NO: 528889 - DNA, 20 bp, Artificial
  CRISPR gRNA sequence
tgcatatccgtacttccatg

SEQ ID NO: 528890 - DNA, 20 bp, Artificial
  CRISPR gRNA sequence
catgaggtgttttctgtgtg

SEQ ID NO: 528891 - DNA, 20 bp, Artificial
  CRISPR gRNA sequence
gcagaacattgtcacctcct

SEQ ID NO: 528892 - DNA, 20 bp, Artificial
  CRISPR gRNA sequence
cagaacattgtcacctcctg

SEQ ID NO: 528893 - DNA, 20 bp, Artificial
  CRISPR gRNA sequence
attgtcacctcctgaggctg

SEQ ID NO: 528894 - DNA, 20 bp, Artificial
  CRISPR gRNA sequence
ttgtcacctcctgaggctgt

SEQ ID NO: 528895 - DNA, 20 bp, Artificial
  CRISPR gRNA sequence
cctcctgaggctgtgggcca

SEQ ID NO: 528896 - DNA, 20 bp, Artificial
  CRISPR gRNA sequence
cacctctgcatcttcgaact

SEQ ID NO: 528897 - DNA, 20 bp, Artificial
  CRISPR gRNA sequence
catcttcgaactcagccatg

SEQ ID NO: 528898 - DNA, 20 bp, Artificial
  CRISPR gRNA sequence
tcagccatgtggtcaacatc

SEQ ID NO: 528899 - DNA, 20 bp, Artificial
  CRISPR gRNA sequence
agccatgtggtcaacatctg

SEQ ID NO: 528900 - DNA, 20 bp, Artificial
  CRISPR gRNA sequence
tggtcaacatctggagtttt

SEQ ID NO: 528901 - DNA, 20 bp, Artificial
  CRISPR gRNA sequence
tctggagtttttggtctcct

SEQ ID NO: 528902 - DNA, 20 bp, Artificial
  CRISPR gRNA sequence
tggagtttttggtctcctca

SEQ ID NO: 528903 - DNA, 20 bp, Artificial
  CRISPR gRNA sequence
gagtttttggtctcctcaga

SEQ ID NO: 528904 - DNA, 20 bp, Artificial
  CRISPR gRNA sequence
ctcagagagctccatcacac

SEQ ID NO: 528905 - DNA, 20 bp, Artificial
  CRISPR gRNA sequence
gagagctccatcacaccagt

SEQ ID NO: 528906 - DNA, 20 bp, Artificial
  CRISPR gRNA sequence
agagctccatcacaccagta

SEQ ID NO: 528907 - DNA, 20 bp, Artificial
  CRISPR gRNA sequence
agctccatcacaccagtaag

SEQ ID NO: 528908 - DNA, 20 bp, Artificial
  CRISPR gRNA sequence
tccatcacaccagtaaggag

SEQ ID NO: 528909 - DNA, 20 bp, Artificial
  CRISPR gRNA sequence
ccagtaaggagaagcaatat

SEQ ID NO: 528910 - DNA, 20 bp, Artificial
  CRISPR gRNA sequence
agcaatataagtgtgattgc

SEQ ID NO: 528911 - DNA, 20 bp, Artificial
  CRISPR gRNA sequence
tataagtgtgattgcaagaa

SEQ ID NO: 528912 - DNA, 20 bp, Artificial
  CRISPR gRNA sequence
aagtgtgattgcaagaatgg

SEQ ID NO: 528913 - DNA, 20 bp, Artificial
  CRISPR gRNA sequence
gtgtgattgcaagaatggta

SEQ ID NO: 528914 - DNA, 20 bp, Artificial
  CRISPR gRNA sequence
tgtgattgcaagaatggtag

SEQ ID NO: 528915 - DNA, 20 bp, Artificial
  CRISPR gRNA sequence
tgcaagaatggtagaggacc

SEQ ID NO: 528916 - DNA, 20 bp, Artificial
  CRISPR gRNA sequence
gaatggtagaggaccgagca

SEQ ID NO: 528917 - DNA, 20 bp, Artificial
  CRISPR gRNA sequence
aggaccgagcacagaaatct

SEQ ID NO: 528918 - DNA, 20 bp, Artificial
  CRISPR gRNA sequence
gaccgagcacagaaatctta

SEQ ID NO: 528919 - DNA, 20 bp, Artificial
  CRISPR gRNA sequence
agagatttcttgtcccctct

SEQ ID NO: 528920 - DNA, 20 bp, Artificial
  CRISPR gRNA sequence
gagatttcttgtcccctctc

SEQ ID NO: 528921 - DNA, 20 bp, Artificial
  CRISPR gRNA sequence
gtcccctctcaggtcatgtg

SEQ ID NO: 528922 - DNA, 20 bp, Artificial
  CRISPR gRNA sequence
atgtgtagatgcgataaatc

SEQ ID NO: 528923 - DNA, 20 bp, Artificial
  CRISPR gRNA sequence
gatgcgataaatcaagtgat

SEQ ID NO: 528924 - DNA, 20 bp, Artificial
  CRISPR gRNA sequence
aatcaagtgattggtgtgcc

SEQ ID NO: 528925 - DNA, 20 bp, Artificial
  CRISPR gRNA sequence
atcaagtgattggtgtgcct

SEQ ID NO: 528926 - DNA, 20 bp, Artificial
  CRISPR gRNA sequence
gtgtgcctgggtctcactac

SEQ ID NO: 528927 - DNA, 20 bp, Artificial
  CRISPR gRNA sequence
tgcctgggtctcactacaag

SEQ ID NO: 528928 - DNA, 20 bp, Artificial
  CRISPR gRNA sequence
tacaagcagcctatctgctt

SEQ ID NO: 528929 - DNA, 20 bp, Artificial
  CRISPR gRNA sequence
caagcagcctatctgcttaa

SEQ ID NO: 528930 - DNA, 20 bp, Artificial
  CRISPR gRNA sequence
cctatctgcttaagagactc

SEQ ID NO: 528931 - DNA, 20 bp, Artificial
  CRISPR gRNA sequence
tatctgcttaagagactctg

SEQ ID NO: 528932 - DNA, 20 bp, Artificial
  CRISPR gRNA sequence
ctggagtttcttatgtgccc

SEQ ID NO: 528933 - DNA, 20 bp, Artificial
  CRISPR gRNA sequence
gagtttcttatgtgccctgg

SEQ ID NO: 528934 - DNA, 20 bp, Artificial
  CRISPR gRNA sequence
acacttgcccaccatcctgt

SEQ ID NO: 528935 - DNA, 20 bp, Artificial
  CRISPR gRNA sequence
gcccaccatcctgtgagtaa

SEQ ID NO: 528936 - DNA, 20 bp, Artificial
  CRISPR gRNA sequence
tgtgagtaaaagtgaaataa

SEQ ID NO: 528937 - DNA, 20 bp, Artificial
  CRISPR gRNA sequence
agtgaaataaaagctttgac

SEQ ID NO: 528938 - DNA, 20 bp, Artificial
  CRISPR gRNA sequence
ccgtgtctgctcattgtgtg

SEQ ID NO: 528939 - DNA, 20 bp, Artificial
  CRISPR gRNA sequence
cgtgtctgctcattgtgtga

SEQ ID NO: 528940 - DNA, 20 bp, Artificial
  CRISPR gRNA sequence
gctcattgtgtgaaggatcc

SEQ ID NO: 528941 - DNA, 20 bp, Artificial
  CRISPR gRNA sequence
gtgtgaaggatcccagtgtc

SEQ ID NO: 528942 - DNA, 20 bp, Artificial
  CRISPR gRNA sequence
tgtgaaggatcccagtgtcg

SEQ ID NO: 528943 - DNA, 20 bp, Artificial
  CRISPR gRNA sequence
tgaaggatcccagtgtcgag

SEQ ID NO: 528944 - DNA, 20 bp, Artificial
  CRISPR gRNA sequence
aaggatcccagtgtcgagga

SEQ ID NO: 528945 - DNA, 20 bp, Artificial
  CRISPR gRNA sequence
aggatcccagtgtcgaggag

SEQ ID NO: 528946 - DNA, 20 bp, Artificial
  CRISPR gRNA sequence
atcccagtgtcgaggagagg

SEQ ID NO: 528947 - DNA, 20 bp, Artificial
  CRISPR gRNA sequence
aggagaggaagctgccgaat

SEQ ID NO: 528948 - DNA, 20 bp, Artificial
  CRISPR gRNA sequence
gaggaagctgccgaataaga

SEQ ID NO: 528949 - DNA, 20 bp, Artificial
  CRISPR gRNA sequence
ggaagctgccgaataagaaa

SEQ ID NO: 528950 - DNA, 20 bp, Artificial
  CRISPR gRNA sequence
cgaataagaaagagcctcgc

SEQ ID NO: 528951 - DNA, 20 bp, Artificial
  CRISPR gRNA sequence
aaagagcctcgctggtgtga

SEQ ID NO: 528952 - DNA, 20 bp, Artificial
  CRISPR gRNA sequence
gagcctcgctggtgtgacag

SEQ ID NO: 528953 - DNA, 20 bp, Artificial
  CRISPR gRNA sequence
agcctcgctggtgtgacagc

SEQ ID NO: 528954 - DNA, 20 bp, Artificial
  CRISPR gRNA sequence
tgtgacagcaggatcaaatt

SEQ ID NO: 528955 - DNA, 20 bp, Artificial
  CRISPR gRNA sequence
atttgatcctgctgtcacac

SEQ ID NO: 528956 - DNA, 20 bp, Artificial
  CRISPR gRNA sequence
gatcctgctgtcacaccagc

SEQ ID NO: 528957 - DNA, 20 bp, Artificial
  CRISPR gRNA sequence
atcctgctgtcacaccagcg

SEQ ID NO: 528958 - DNA, 20 bp, Artificial
  CRISPR gRNA sequence
cagcgaggctctttcttatt

SEQ ID NO: 528959 - DNA, 20 bp, Artificial
  CRISPR gRNA sequence
cgaggctctttcttattcgg

SEQ ID NO: 528960 - DNA, 20 bp, Artificial
  CRISPR gRNA sequence
cagcttcctctcctcgacac

SEQ ID NO: 528961 - DNA, 20 bp, Artificial
  CRISPR gRNA sequence
agcttcctctcctcgacact

SEQ ID NO: 528962 - DNA, 20 bp, Artificial
  CRISPR gRNA sequence
actgggatccttcacacaat

SEQ ID NO: 528963 - DNA, 20 bp, Artificial
  CRISPR gRNA sequence
gggatccttcacacaatgag

SEQ ID NO: 528964 - DNA, 20 bp, Artificial
  CRISPR gRNA sequence
cttcacacaatgagcagaca

SEQ ID NO: 528965 - DNA, 20 bp, Artificial
  CRISPR gRNA sequence
ttcacacaatgagcagacac

SEQ ID NO: 528966 - DNA, 20 bp, Artificial
  CRISPR gRNA sequence
acaatgagcagacacgggtc

SEQ ID NO: 528967 - DNA, 20 bp, Artificial
  CRISPR gRNA sequence
agcagacacgggtctagtca

SEQ ID NO: 528968 - DNA, 20 bp, Artificial
  CRISPR gRNA sequence
ttttatttcacttttactca

SEQ ID NO: 528969 - DNA, 20 bp, Artificial
  CRISPR gRNA sequence
tttatttcacttttactcac

SEQ ID NO: 528970 - DNA, 20 bp, Artificial
  CRISPR gRNA sequence
tttcacttttactcacagga

SEQ ID NO: 528971 - DNA, 20 bp, Artificial
  CRISPR gRNA sequence
cacttttactcacaggatgg

SEQ ID NO: 528972 - DNA, 20 bp, Artificial
  CRISPR gRNA sequence
acttttactcacaggatggt

SEQ ID NO: 528973 - DNA, 20 bp, Artificial
  CRISPR gRNA sequence
ttactcacaggatggtgggc

SEQ ID NO: 528974 - DNA, 20 bp, Artificial
  CRISPR gRNA sequence
gatggtgggcaagtgtccac

SEQ ID NO: 528975 - DNA, 20 bp, Artificial
  CRISPR gRNA sequence
atggtgggcaagtgtccacc

SEQ ID NO: 528976 - DNA, 20 bp, Artificial
  CRISPR gRNA sequence
tggtgggcaagtgtccacca

SEQ ID NO: 528977 - DNA, 20 bp, Artificial
  CRISPR gRNA sequence
aagtgtccaccagggcacat

SEQ ID NO: 528978 - DNA, 20 bp, Artificial
  CRISPR gRNA sequence
ccagggcacataagaaactc

SEQ ID NO: 528979 - DNA, 20 bp, Artificial
  CRISPR gRNA sequence
agggcacataagaaactcca

SEQ ID NO: 528980 - DNA, 20 bp, Artificial
  CRISPR gRNA sequence
aagaaactccagagtctctt

SEQ ID NO: 528981 - DNA, 20 bp, Artificial
  CRISPR gRNA sequence
aaactccagagtctcttaag

SEQ ID NO: 528982 - DNA, 20 bp, Artificial
  CRISPR gRNA sequence
tccagagtctcttaagcaga

SEQ ID NO: 528983 - DNA, 20 bp, Artificial
  CRISPR gRNA sequence
ccagagtctcttaagcagat

SEQ ID NO: 528984 - DNA, 20 bp, Artificial
  CRISPR gRNA sequence
ttaagcagataggctgcttg

SEQ ID NO: 528985 - DNA, 20 bp, Artificial
  CRISPR gRNA sequence
gcagataggctgcttgtagt

SEQ ID NO: 528986 - DNA, 20 bp, Artificial
  CRISPR gRNA sequence
aggctgcttgtagtgagacc

SEQ ID NO: 528987 - DNA, 20 bp, Artificial
  CRISPR gRNA sequence
ggctgcttgtagtgagaccc

SEQ ID NO: 528988 - DNA, 20 bp, Artificial
  CRISPR gRNA sequence
atcgcatctacacatgacct

SEQ ID NO: 528989 - DNA, 20 bp, Artificial
  CRISPR gRNA sequence
cgcatctacacatgacctga

SEQ ID NO: 528990 - DNA, 20 bp, Artificial
  CRISPR gRNA sequence
gcatctacacatgacctgag

SEQ ID NO: 528991 - DNA, 20 bp, Artificial
  CRISPR gRNA sequence
catctacacatgacctgaga

SEQ ID NO: 528992 - DNA, 20 bp, Artificial
  CRISPR gRNA sequence
atctacacatgacctgagag

SEQ ID NO: 528993 - DNA, 20 bp, Artificial
  CRISPR gRNA sequence
cacatgacctgagaggggac

SEQ ID NO: 528994 - DNA, 20 bp, Artificial
  CRISPR gRNA sequence
agaggggacaagaaatctct

SEQ ID NO: 528995 - DNA, 20 bp, Artificial
  CRISPR gRNA sequence
atctctaagatttctgtgct

SEQ ID NO: 528996 - DNA, 20 bp, Artificial
  CRISPR gRNA sequence
cttatattgcttctccttac

SEQ ID NO: 528997 - DNA, 20 bp, Artificial
  CRISPR gRNA sequence
gcttctccttactggtgtga

SEQ ID NO: 528998 - DNA, 20 bp, Artificial
  CRISPR gRNA sequence
ttctccttactggtgtgatg

SEQ ID NO: 528999 - DNA, 20 bp, Artificial
  CRISPR gRNA sequence
ctggtgtgatggagctctct

SEQ ID NO: 529000 - DNA, 20 bp, Artificial
  CRISPR gRNA sequence
tggtgtgatggagctctctg

SEQ ID NO: 529001 - DNA, 20 bp, Artificial
  CRISPR gRNA sequence
gtgtgatggagctctctgag

SEQ ID NO: 529002 - DNA, 20 bp, Artificial
  CRISPR gRNA sequence
tctgaggagaccaaaaactc

SEQ ID NO: 529003 - DNA, 20 bp, Artificial
  CRISPR gRNA sequence
aactccagatgttgaccaca

SEQ ID NO: 529004 - DNA, 20 bp, Artificial
  CRISPR gRNA sequence
cagatgttgaccacatggct

SEQ ID NO: 529005 - DNA, 20 bp, Artificial
  CRISPR gRNA sequence
tgaccacatggctgagttcg

SEQ ID NO: 529006 - DNA, 20 bp, Artificial
  CRISPR gRNA sequence
catggctgagttcgaagatg

SEQ ID NO: 529007 - DNA, 20 bp, Artificial
  CRISPR gRNA sequence
tggctgagttcgaagatgca

SEQ ID NO: 529008 - DNA, 20 bp, Artificial
  CRISPR gRNA sequence
ggctgagttcgaagatgcag

SEQ ID NO: 529009 - DNA, 20 bp, Artificial
  CRISPR gRNA sequence
tgagttcgaagatgcagagg

SEQ ID NO: 529010 - DNA, 20 bp, Artificial
  CRISPR gRNA sequence
cgaagatgcagaggtggctg

SEQ ID NO: 529011 - DNA, 20 bp, Artificial
  CRISPR gRNA sequence
gcagaggtggctgtggccca

SEQ ID NO: 529012 - DNA, 20 bp, Artificial
  CRISPR gRNA sequence
gtggctgtggcccacagcct

SEQ ID NO: 529013 - DNA, 20 bp, Artificial
  CRISPR gRNA sequence
tggctgtggcccacagcctc

SEQ ID NO: 529014 - DNA, 20 bp, Artificial
  CRISPR gRNA sequence
gctgtggcccacagcctcag

SEQ ID NO: 529015 - DNA, 20 bp, Artificial
  CRISPR gRNA sequence
ctgtggcccacagcctcagg

SEQ ID NO: 529016 - DNA, 20 bp, Artificial
  CRISPR gRNA sequence
aggtgacaatgttctgcaca

SEQ ID NO: 529017 - DNA, 20 bp, Artificial
  CRISPR gRNA sequence
tgcacacagaaaacacctca

SEQ ID NO: 529018 - DNA, 20 bp, Artificial
  CRISPR gRNA sequence
acacagaaaacacctcatgg

SEQ ID NO: 529019 - DNA, 20 bp, Artificial
  CRISPR gRNA sequence
gaaaacacctcatggaagta

SEQ ID NO: 529020 - DNA, 20 bp, Artificial
  CRISPR gRNA sequence
ggaagtacggatatgcacat

SEQ ID NO: 529021 - DNA, 20 bp, Artificial
  CRISPR gRNA sequence
gaagtacggatatgcacatc

SEQ ID NO: 529022 - DNA, 20 bp, Artificial
  CRISPR gRNA sequence
agtacggatatgcacatcag

SEQ ID NO: 529023 - DNA, 20 bp, Artificial
  CRISPR gRNA sequence
gtacggatatgcacatcagg

SEQ ID NO: 529024 - DNA, 20 bp, Artificial
  CRISPR gRNA sequence
tacggatatgcacatcagga

SEQ ID NO: 529025 - DNA, 20 bp, Artificial
  CRISPR gRNA sequence
ggatatgcacatcaggaggg

SEQ ID NO: 529026 - DNA, 20 bp, Artificial
  CRISPR gRNA sequence
atcaggagggcagaaatcca

SEQ ID NO: 529027 - DNA, 20 bp, Artificial
  CRISPR gRNA sequence
cacagtgctttttattgaaa

SEQ ID NO: 529028 - DNA, 20 bp, Artificial
  CRISPR gRNA sequence
gtgctttttattgaaaaaga

SEQ ID NO: 529029 - DNA, 20 bp, Artificial
  CRISPR gRNA sequence
cagtttctatcttttttaat

SEQ ID NO: 529030 - DNA, 20 bp, Artificial
  CRISPR gRNA sequence
gtttctatcttttttaatta

SEQ ID NO: 529031 - DNA, 20 bp, Artificial
  CRISPR gRNA sequence
tttctatcttttttaattag

SEQ ID NO: 529032 - DNA, 20 bp, Artificial
  CRISPR gRNA sequence
ctatcttttttaattagagg

SEQ ID NO: 529033 - DNA, 20 bp, Artificial
  CRISPR gRNA sequence
tatcttttttaattagagga

SEQ ID NO: 529034 - DNA, 20 bp, Artificial
  CRISPR gRNA sequence
atcttttttaattagaggaa

SEQ ID NO: 529035 - DNA, 20 bp, Artificial
  CRISPR gRNA sequence
tcttttttaattagaggaag

SEQ ID NO: 529036 - DNA, 20 bp, Artificial
  CRISPR gRNA sequence
aattagaggaaggggacaat

SEQ ID NO: 529037 - DNA, 20 bp, Artificial
  CRISPR gRNA sequence
atgagttttctgctgcccca

SEQ ID NO: 529038 - DNA, 20 bp, Artificial
  CRISPR gRNA sequence
tgagttttctgctgccccat

SEQ ID NO: 529039 - DNA, 20 bp, Artificial
  CRISPR gRNA sequence
gagttttctgctgccccatg

SEQ ID NO: 529040 - DNA, 20 bp, Artificial
  CRISPR gRNA sequence
gttttctgctgccccatggg

SEQ ID NO: 529041 - DNA, 20 bp, Artificial
  CRISPR gRNA sequence
ttttctgctgccccatgggg

SEQ ID NO: 529042 - DNA, 20 bp, Artificial
  CRISPR gRNA sequence
gctgccccatggggaggttt

SEQ ID NO: 529043 - DNA, 20 bp, Artificial
  CRISPR gRNA sequence
gggaggttttggctgaactc

SEQ ID NO: 529044 - DNA, 20 bp, Artificial
  CRISPR gRNA sequence
ggaggttttggctgaactcg

SEQ ID NO: 529045 - DNA, 20 bp, Artificial
  CRISPR gRNA sequence
ttttggctgaactcgaggtc

SEQ ID NO: 529046 - DNA, 20 bp, Artificial
  CRISPR gRNA sequence
tttggctgaactcgaggtct

SEQ ID NO: 529047 - DNA, 20 bp, Artificial
  CRISPR gRNA sequence
ttggctgaactcgaggtctg

SEQ ID NO: 529048 - DNA, 20 bp, Artificial
  CRISPR gRNA sequence
ggctgaactcgaggtctggg

SEQ ID NO: 529049 - DNA, 20 bp, Artificial
  CRISPR gRNA sequence
gctgaactcgaggtctgggg

SEQ ID NO: 529050 - DNA, 20 bp, Artificial
  CRISPR gRNA sequence
ctgaactcgaggtctgggga

SEQ ID NO: 529051 - DNA, 20 bp, Artificial
  CRISPR gRNA sequence
tgaactcgaggtctggggag

SEQ ID NO: 529052 - DNA, 20 bp, Artificial
  CRISPR gRNA sequence
actcgaggtctggggagggg

SEQ ID NO: 529053 - DNA, 20 bp, Artificial
  CRISPR gRNA sequence
ctcgaggtctggggaggggc

SEQ ID NO: 529054 - DNA, 20 bp, Artificial
  CRISPR gRNA sequence
ggaggggcgggcctttctgc

SEQ ID NO: 529055 - DNA, 20 bp, Artificial
  CRISPR gRNA sequence
tggtgaacttgtgtgcccga

SEQ ID NO: 529056 - DNA, 20 bp, Artificial
  CRISPR gRNA sequence
gtgaacttgtgtgcccgacg

SEQ ID NO: 529057 - DNA, 20 bp, Artificial
  CRISPR gRNA sequence
aacttgtgtgcccgacggag

SEQ ID NO: 529058 - DNA, 20 bp, Artificial
  CRISPR gRNA sequence
acttgtgtgcccgacggagc

SEQ ID NO: 529059 - DNA, 20 bp, Artificial
  CRISPR gRNA sequence
ttgtgtgcccgacggagcag

SEQ ID NO: 529060 - DNA, 20 bp, Artificial
  CRISPR gRNA sequence
tgtgtgcccgacggagcagg

SEQ ID NO: 529061 - DNA, 20 bp, Artificial
  CRISPR gRNA sequence
cggagcaggaggcctcttct

SEQ ID NO: 529062 - DNA, 20 bp, Artificial
  CRISPR gRNA sequence
ggagcaggaggcctcttctg

SEQ ID NO: 529063 - DNA, 20 bp, Artificial
  CRISPR gRNA sequence
caggaggcctcttctgaggc

SEQ ID NO: 529064 - DNA, 20 bp, Artificial
  CRISPR gRNA sequence
tctgaggctggtgctgaaca

SEQ ID NO: 529065 - DNA, 20 bp, Artificial
  CRISPR gRNA sequence
ctggtgctgaacacggtgtc

SEQ ID NO: 529066 - DNA, 20 bp, Artificial
  CRISPR gRNA sequence
tggtgctgaacacggtgtcc

SEQ ID NO: 529067 - DNA, 20 bp, Artificial
  CRISPR gRNA sequence
gtgctgaacacggtgtccag

SEQ ID NO: 529068 - DNA, 20 bp, Artificial
  CRISPR gRNA sequence
tgctgaacacggtgtccagg

SEQ ID NO: 529069 - DNA, 20 bp, Artificial
  CRISPR gRNA sequence
tgaacacggtgtccaggagg

SEQ ID NO: 529070 - DNA, 20 bp, Artificial
  CRISPR gRNA sequence
gaacacggtgtccaggaggc

SEQ ID NO: 529071 - DNA, 20 bp, Artificial
  CRISPR gRNA sequence
aacacggtgtccaggaggcg

SEQ ID NO: 529072 - DNA, 20 bp, Artificial
  CRISPR gRNA sequence
acacggtgtccaggaggcgg

SEQ ID NO: 529073 - DNA, 20 bp, Artificial
  CRISPR gRNA sequence
aggaggcgggggacgatgac

SEQ ID NO: 529074 - DNA, 20 bp, Artificial
  CRISPR gRNA sequence
ggaggcgggggacgatgact

SEQ ID NO: 529075 - DNA, 20 bp, Artificial
  CRISPR gRNA sequence
ggggacgatgactaggtgcc

SEQ ID NO: 529076 - DNA, 20 bp, Artificial
  CRISPR gRNA sequence
gggacgatgactaggtgcct

SEQ ID NO: 529077 - DNA, 20 bp, Artificial
  CRISPR gRNA sequence
aggtgcctgggaacgatgac

SEQ ID NO: 529078 - DNA, 20 bp, Artificial
  CRISPR gRNA sequence
ggtgcctgggaacgatgacc

SEQ ID NO: 529079 - DNA, 20 bp, Artificial
  CRISPR gRNA sequence
gcctgggaacgatgaccagg

SEQ ID NO: 529080 - DNA, 20 bp, Artificial
  CRISPR gRNA sequence
tgggaacgatgaccaggtgg

SEQ ID NO: 529081 - DNA, 20 bp, Artificial
  CRISPR gRNA sequence
ggaacgatgaccaggtggtg

SEQ ID NO: 529082 - DNA, 20 bp, Artificial
  CRISPR gRNA sequence
gaacgatgaccaggtggtgg

SEQ ID NO: 529083 - DNA, 20 bp, Artificial
  CRISPR gRNA sequence
acgatgaccaggtggtggag

SEQ ID NO: 529084 - DNA, 20 bp, Artificial
  CRISPR gRNA sequence
cgatgaccaggtggtggagg

SEQ ID NO: 529085 - DNA, 20 bp, Artificial
  CRISPR gRNA sequence
caggtggtggaggaggatgt

SEQ ID NO: 529086 - DNA, 20 bp, Artificial
  CRISPR gRNA sequence
aggtggtggaggaggatgtt

SEQ ID NO: 529087 - DNA, 20 bp, Artificial
  CRISPR gRNA sequence
tggtggaggaggatgttggg

SEQ ID NO: 529088 - DNA, 20 bp, Artificial
  CRISPR gRNA sequence
ggaggatgttgggaagttgc

SEQ ID NO: 529089 - DNA, 20 bp, Artificial
  CRISPR gRNA sequence
ttgggaagttgctggattct

SEQ ID NO: 529090 - DNA, 20 bp, Artificial
  CRISPR gRNA sequence
tgggaagttgctggattctg

SEQ ID NO: 529091 - DNA, 20 bp, Artificial
  CRISPR gRNA sequence
gggaagttgctggattctga

SEQ ID NO: 529092 - DNA, 20 bp, Artificial
  CRISPR gRNA sequence
ggaagttgctggattctgag

SEQ ID NO: 529093 - DNA, 20 bp, Artificial
  CRISPR gRNA sequence
tgctggattctgaggggttg

SEQ ID NO: 529094 - DNA, 20 bp, Artificial
  CRISPR gRNA sequence
ggattctgaggggttgaagc

SEQ ID NO: 529095 - DNA, 20 bp, Artificial
  CRISPR gRNA sequence
gaggggttgaagctggaatt

SEQ ID NO: 529096 - DNA, 20 bp, Artificial
  CRISPR gRNA sequence
gggttgaagctggaatttgg

SEQ ID NO: 529097 - DNA, 20 bp, Artificial
  CRISPR gRNA sequence
ggttgaagctggaatttggt

SEQ ID NO: 529098 - DNA, 20 bp, Artificial
  CRISPR gRNA sequence
gttgaagctggaatttggtg

SEQ ID NO: 529099 - DNA, 20 bp, Artificial
  CRISPR gRNA sequence
ctggaatttggtggggcttc

SEQ ID NO: 529100 - DNA, 20 bp, Artificial
  CRISPR gRNA sequence
gggcttccggcccctttctt

SEQ ID NO: 529101 - DNA, 20 bp, Artificial
  CRISPR gRNA sequence
cttccggcccctttcttcag

SEQ ID NO: 529102 - DNA, 20 bp, Artificial
  CRISPR gRNA sequence
tttcttcagtagctactctg

SEQ ID NO: 529103 - DNA, 20 bp, Artificial
  CRISPR gRNA sequence
ttcttcagtagctactctgt

SEQ ID NO: 529104 - DNA, 20 bp, Artificial
  CRISPR gRNA sequence
actctgtgggctcttgtctc

SEQ ID NO: 529105 - DNA, 20 bp, Artificial
  CRISPR gRNA sequence
ctgcaacaacaaaacctcaa

SEQ ID NO: 529106 - DNA, 20 bp, Artificial
  CRISPR gRNA sequence
gcaacaacaaaacctcaata

SEQ ID NO: 529107 - DNA, 20 bp, Artificial
  CRISPR gRNA sequence
aacctcaatagagttcatct

SEQ ID NO: 529108 - DNA, 20 bp, Artificial
  CRISPR gRNA sequence
tcaatagagttcatcttggc

SEQ ID NO: 529109 - DNA, 20 bp, Artificial
  CRISPR gRNA sequence
caatagagttcatcttggcc

SEQ ID NO: 529110 - DNA, 20 bp, Artificial
  CRISPR gRNA sequence
gtgaaatcaatgtaaatatt

SEQ ID NO: 529111 - DNA, 20 bp, Artificial
  CRISPR gRNA sequence
attgagtaccttttatatgc

SEQ ID NO: 529112 - DNA, 20 bp, Artificial
  CRISPR gRNA sequence
ttgagtaccttttatatgca

SEQ ID NO: 529113 - DNA, 20 bp, Artificial
  CRISPR gRNA sequence
ttatatgcaaggcgccatgc

SEQ ID NO: 529114 - DNA, 20 bp, Artificial
  CRISPR gRNA sequence
aggcgccatgctagctgctt

SEQ ID NO: 529115 - DNA, 20 bp, Artificial
  CRISPR gRNA sequence
ggcgccatgctagctgcttt

SEQ ID NO: 529116 - DNA, 20 bp, Artificial
  CRISPR gRNA sequence
gcgccatgctagctgctttg

SEQ ID NO: 529117 - DNA, 20 bp, Artificial
  CRISPR gRNA sequence
cgccatgctagctgctttgg

SEQ ID NO: 529118 - DNA, 20 bp, Artificial
  CRISPR gRNA sequence
gctgctttgggggatgcaat

SEQ ID NO: 529119 - DNA, 20 bp, Artificial
  CRISPR gRNA sequence
ctgctttgggggatgcaatg

SEQ ID NO: 529120 - DNA, 20 bp, Artificial
  CRISPR gRNA sequence
ctttgggggatgcaatgagg

SEQ ID NO: 529121 - DNA, 20 bp, Artificial
  CRISPR gRNA sequence
tgggggatgcaatgaggaag

SEQ ID NO: 529122 - DNA, 20 bp, Artificial
  CRISPR gRNA sequence
gggatgcaatgaggaagcag

SEQ ID NO: 529123 - DNA, 20 bp, Artificial
  CRISPR gRNA sequence
agaagttgcccctactatct

SEQ ID NO: 529124 - DNA, 20 bp, Artificial
  CRISPR gRNA sequence
ccctactatctgagaactct

SEQ ID NO: 529125 - DNA, 20 bp, Artificial
  CRISPR gRNA sequence
atctgagaactctaagcttg

SEQ ID NO: 529126 - DNA, 20 bp, Artificial
  CRISPR gRNA sequence
tctgagaactctaagcttgt

SEQ ID NO: 529127 - DNA, 20 bp, Artificial
  CRISPR gRNA sequence
tgagaactctaagcttgtag

SEQ ID NO: 529128 - DNA, 20 bp, Artificial
  CRISPR gRNA sequence
agaactctaagcttgtagga

SEQ ID NO: 529129 - DNA, 20 bp, Artificial
  CRISPR gRNA sequence
ctctaagcttgtaggagaga

SEQ ID NO: 529130 - DNA, 20 bp, Artificial
  CRISPR gRNA sequence
taagcttgtaggagagaaag

SEQ ID NO: 529131 - DNA, 20 bp, Artificial
  CRISPR gRNA sequence
gagaaagaagtgctcaccat

SEQ ID NO: 529132 - DNA, 20 bp, Artificial
  CRISPR gRNA sequence
agaaagaagtgctcaccata

SEQ ID NO: 529133 - DNA, 20 bp, Artificial
  CRISPR gRNA sequence
aagaagtgctcaccataagg

SEQ ID NO: 529134 - DNA, 20 bp, Artificial
  CRISPR gRNA sequence
gaagtgctcaccataaggta

SEQ ID NO: 529135 - DNA, 20 bp, Artificial
  CRISPR gRNA sequence
ctcaccataaggtagagtga

SEQ ID NO: 529136 - DNA, 20 bp, Artificial
  CRISPR gRNA sequence
cataaggtagagtgaaagcc

SEQ ID NO: 529137 - DNA, 20 bp, Artificial
  CRISPR gRNA sequence
ataaggtagagtgaaagcct

SEQ ID NO: 529138 - DNA, 20 bp, Artificial
  CRISPR gRNA sequence
gtagagtgaaagcctaggac

SEQ ID NO: 529139 - DNA, 20 bp, Artificial
  CRISPR gRNA sequence
agagtgaaagcctaggacaa

SEQ ID NO: 529140 - DNA, 20 bp, Artificial
  CRISPR gRNA sequence
agcctaggacaagagaactc

SEQ ID NO: 529141 - DNA, 20 bp, Artificial
  CRISPR gRNA sequence
gcctaggacaagagaactca

SEQ ID NO: 529142 - DNA, 20 bp, Artificial
  CRISPR gRNA sequence
gacaagagaactcaaggaat

SEQ ID NO: 529143 - DNA, 20 bp, Artificial
  CRISPR gRNA sequence
aagagaactcaaggaatcag

SEQ ID NO: 529144 - DNA, 20 bp, Artificial
  CRISPR gRNA sequence
agagaactcaaggaatcagc

SEQ ID NO: 529145 - DNA, 20 bp, Artificial
  CRISPR gRNA sequence
gaactcaaggaatcagcagg

SEQ ID NO: 529146 - DNA, 20 bp, Artificial
  CRISPR gRNA sequence
ctcaaggaatcagcaggaag

SEQ ID NO: 529147 - DNA, 20 bp, Artificial
  CRISPR gRNA sequence
atcagcaggaagaagacaca

SEQ ID NO: 529148 - DNA, 20 bp, Artificial
  CRISPR gRNA sequence
tcagcaggaagaagacacat

SEQ ID NO: 529149 - DNA, 20 bp, Artificial
  CRISPR gRNA sequence
gcaggaagaagacacatggg

SEQ ID NO: 529150 - DNA, 20 bp, Artificial
  CRISPR gRNA sequence
aggaagaagacacatgggtg

SEQ ID NO: 529151 - DNA, 20 bp, Artificial
  CRISPR gRNA sequence
ggaagaagacacatgggtgg

SEQ ID NO: 529152 - DNA, 20 bp, Artificial
  CRISPR gRNA sequence
gaagaagacacatgggtgga

SEQ ID NO: 529153 - DNA, 20 bp, Artificial
  CRISPR gRNA sequence
tgggtggagggctttgtgcc

SEQ ID NO: 529154 - DNA, 20 bp, Artificial
  CRISPR gRNA sequence
gggtggagggctttgtgcct

SEQ ID NO: 529155 - DNA, 20 bp, Artificial
  CRISPR gRNA sequence
ggtggagggctttgtgcctg

SEQ ID NO: 529156 - DNA, 20 bp, Artificial
  CRISPR gRNA sequence
gtgcctggggctcccatgat

SEQ ID NO: 529157 - DNA, 20 bp, Artificial
  CRISPR gRNA sequence
gcctggggctcccatgatca

SEQ ID NO: 529158 - DNA, 20 bp, Artificial
  CRISPR gRNA sequence
ctggggctcccatgatcaga

SEQ ID NO: 529159 - DNA, 20 bp, Artificial
  CRISPR gRNA sequence
ggggctcccatgatcagaga

SEQ ID NO: 529160 - DNA, 20 bp, Artificial
  CRISPR gRNA sequence
ccatgatcagagagagcacg

SEQ ID NO: 529161 - DNA, 20 bp, Artificial
  CRISPR gRNA sequence
tcagagagagcacgcagacc

SEQ ID NO: 529162 - DNA, 20 bp, Artificial
  CRISPR gRNA sequence
accctacctctgtgctgacc

SEQ ID NO: 529163 - DNA, 20 bp, Artificial
  CRISPR gRNA sequence
tgacctagaaattgttccct

SEQ ID NO: 529164 - DNA, 20 bp, Artificial
  CRISPR gRNA sequence
acctagaaattgttccctga

SEQ ID NO: 529165 - DNA, 20 bp, Artificial
  CRISPR gRNA sequence
agaaattgttccctgagagc

SEQ ID NO: 529166 - DNA, 20 bp, Artificial
  CRISPR gRNA sequence
ccctgagagcaagaacctca

SEQ ID NO: 529167 - DNA, 20 bp, Artificial
  CRISPR gRNA sequence
gagagcaagaacctcatggt

SEQ ID NO: 529168 - DNA, 20 bp, Artificial
  CRISPR gRNA sequence
gagcaagaacctcatggtta

SEQ ID NO: 529169 - DNA, 20 bp, Artificial
  CRISPR gRNA sequence
aacctcatggttagagcgca

SEQ ID NO: 529170 - DNA, 20 bp, Artificial
  CRISPR gRNA sequence
acctcatggttagagcgcat

SEQ ID NO: 529171 - DNA, 20 bp, Artificial
  CRISPR gRNA sequence
tcatggttagagcgcatggg

SEQ ID NO: 529172 - DNA, 20 bp, Artificial
  CRISPR gRNA sequence
catggttagagcgcatggga

SEQ ID NO: 529173 - DNA, 20 bp, Artificial
  CRISPR gRNA sequence
atggttagagcgcatgggaa

SEQ ID NO: 529174 - DNA, 20 bp, Artificial
  CRISPR gRNA sequence
tggttagagcgcatgggaag

SEQ ID NO: 529175 - DNA, 20 bp, Artificial
  CRISPR gRNA sequence
agcgcatgggaaggggttat

SEQ ID NO: 529176 - DNA, 20 bp, Artificial
  CRISPR gRNA sequence
gcatgggaaggggttatgag

SEQ ID NO: 529177 - DNA, 20 bp, Artificial
  CRISPR gRNA sequence
gaaggggttatgagcagtca

SEQ ID NO: 529178 - DNA, 20 bp, Artificial
  CRISPR gRNA sequence
aggggttatgagcagtcatg

SEQ ID NO: 529179 - DNA, 20 bp, Artificial
  CRISPR gRNA sequence
ggggttatgagcagtcatgg

SEQ ID NO: 529180 - DNA, 20 bp, Artificial
  CRISPR gRNA sequence
tgagcagtcatggaggatat

SEQ ID NO: 529181 - DNA, 20 bp, Artificial
  CRISPR gRNA sequence
ttagtaactacattccttct

SEQ ID NO: 529182 - DNA, 20 bp, Artificial
  CRISPR gRNA sequence
tagtaactacattccttctg

SEQ ID NO: 529183 - DNA, 20 bp, Artificial
  CRISPR gRNA sequence
cttctgaggcatttctatgt

SEQ ID NO: 529184 - DNA, 20 bp, Artificial
  CRISPR gRNA sequence
ctgtcatgcaatccaccttc

SEQ ID NO: 529185 - DNA, 20 bp, Artificial
  CRISPR gRNA sequence
catgcaatccaccttccggc

SEQ ID NO: 529186 - DNA, 20 bp, Artificial
  CRISPR gRNA sequence
tgcaatccaccttccggcaa

SEQ ID NO: 529187 - DNA, 20 bp, Artificial
  CRISPR gRNA sequence
gcaatccaccttccggcaag

SEQ ID NO: 529188 - DNA, 20 bp, Artificial
  CRISPR gRNA sequence
tccaccttccggcaagaggt

SEQ ID NO: 529189 - DNA, 20 bp, Artificial
  CRISPR gRNA sequence
caagaggttggaacacatgc

SEQ ID NO: 529190 - DNA, 20 bp, Artificial
  CRISPR gRNA sequence
aagaggttggaacacatgca

SEQ ID NO: 529191 - DNA, 20 bp, Artificial
  CRISPR gRNA sequence
tgcaaggaactttttgtcct

SEQ ID NO: 529192 - DNA, 20 bp, Artificial
  CRISPR gRNA sequence
ttagaaatttactcgcttct

SEQ ID NO: 529193 - DNA, 20 bp, Artificial
  CRISPR gRNA sequence
tactcgcttctcagaaattc

SEQ ID NO: 529194 - DNA, 20 bp, Artificial
  CRISPR gRNA sequence
aaattcaagacctatgttct

SEQ ID NO: 529195 - DNA, 20 bp, Artificial
  CRISPR gRNA sequence
aagacctatgttcttggcct

SEQ ID NO: 529196 - DNA, 20 bp, Artificial
  CRISPR gRNA sequence
agacctatgttcttggcctt

SEQ ID NO: 529197 - DNA, 20 bp, Artificial
  CRISPR gRNA sequence
acctatgttcttggccttag

SEQ ID NO: 529198 - DNA, 20 bp, Artificial
  CRISPR gRNA sequence
cctatgttcttggccttagg

SEQ ID NO: 529199 - DNA, 20 bp, Artificial
  CRISPR gRNA sequence
ctatgttcttggccttagga

SEQ ID NO: 529200 - DNA, 20 bp, Artificial
  CRISPR gRNA sequence
gttcttggccttaggaggga

SEQ ID NO: 529201 - DNA, 20 bp, Artificial
  CRISPR gRNA sequence
ctcctcctctcctcaccctt

SEQ ID NO: 529202 - DNA, 20 bp, Artificial
  CRISPR gRNA sequence
tcctcctctcctcacccttc

SEQ ID NO: 529203 - DNA, 20 bp, Artificial
  CRISPR gRNA sequence
ttttcttctttgtgtgactt

SEQ ID NO: 529204 - DNA, 20 bp, Artificial
  CRISPR gRNA sequence
tgtgtgacttcagtccatga

SEQ ID NO: 529205 - DNA, 20 bp, Artificial
  CRISPR gRNA sequence
gtgacttcagtccatgaaag

SEQ ID NO: 529206 - DNA, 20 bp, Artificial
  CRISPR gRNA sequence
tgacttcagtccatgaaagc

SEQ ID NO: 529207 - DNA, 20 bp, Artificial
  CRISPR gRNA sequence
agtccatgaaagcaggccta

SEQ ID NO: 529208 - DNA, 20 bp, Artificial
  CRISPR gRNA sequence
gcctacagctactcgtaatg

SEQ ID NO: 529209 - DNA, 20 bp, Artificial
  CRISPR gRNA sequence
ttcctgtactcttaaaatca

SEQ ID NO: 529210 - DNA, 20 bp, Artificial
  CRISPR gRNA sequence
tcctgtactcttaaaatcac

SEQ ID NO: 529211 - DNA, 20 bp, Artificial
  CRISPR gRNA sequence
cctgtactcttaaaatcaca

SEQ ID NO: 529212 - DNA, 20 bp, Artificial
  CRISPR gRNA sequence
aaaatcacagggaatctgtg

SEQ ID NO: 529213 - DNA, 20 bp, Artificial
  CRISPR gRNA sequence
aaatcacagggaatctgtga

SEQ ID NO: 529214 - DNA, 20 bp, Artificial
  CRISPR gRNA sequence
agggaatctgtgaaggtgcc

SEQ ID NO: 529215 - DNA, 20 bp, Artificial
  CRISPR gRNA sequence
ctgtgaaggtgcccagctgc

SEQ ID NO: 529216 - DNA, 20 bp, Artificial
  CRISPR gRNA sequence
gtgaaggtgcccagctgcta

SEQ ID NO: 529217 - DNA, 20 bp, Artificial
  CRISPR gRNA sequence
tgaaggtgcccagctgctag

SEQ ID NO: 529218 - DNA, 20 bp, Artificial
  CRISPR gRNA sequence
gtgcccagctgctagaggcc

SEQ ID NO: 529219 - DNA, 20 bp, Artificial
  CRISPR gRNA sequence
gcccagctgctagaggcctg

SEQ ID NO: 529220 - DNA, 20 bp, Artificial
  CRISPR gRNA sequence
agaggcctggagcaccctgc

SEQ ID NO: 529221 - DNA, 20 bp, Artificial
  CRISPR gRNA sequence
gagcaccctgctggcccctc

SEQ ID NO: 529222 - DNA, 20 bp, Artificial
  CRISPR gRNA sequence
ctggcccctctggactcctt

SEQ ID NO: 529223 - DNA, 20 bp, Artificial
  CRISPR gRNA sequence
tggcccctctggactccttt

SEQ ID NO: 529224 - DNA, 20 bp, Artificial
  CRISPR gRNA sequence
tctggactcctttaggctgt

SEQ ID NO: 529225 - DNA, 20 bp, Artificial
  CRISPR gRNA sequence
gactcctttaggctgtaagt

SEQ ID NO: 529226 - DNA, 20 bp, Artificial
  CRISPR gRNA sequence
actcctttaggctgtaagtt

SEQ ID NO: 529227 - DNA, 20 bp, Artificial
  CRISPR gRNA sequence
aggctgtaagttaggtattt

SEQ ID NO: 529228 - DNA, 20 bp, Artificial
  CRISPR gRNA sequence
gtatttcagtccctgcaccc

SEQ ID NO: 529229 - DNA, 20 bp, Artificial
  CRISPR gRNA sequence
tatttcagtccctgcaccca

SEQ ID NO: 529230 - DNA, 20 bp, Artificial
  CRISPR gRNA sequence
tgcacccaaggccgtctttg

SEQ ID NO: 529231 - DNA, 20 bp, Artificial
  CRISPR gRNA sequence
acccaaggccgtctttgcag

SEQ ID NO: 529232 - DNA, 20 bp, Artificial
  CRISPR gRNA sequence
ggccgtctttgcagtggctc

SEQ ID NO: 529233 - DNA, 20 bp, Artificial
  CRISPR gRNA sequence
ccgtctttgcagtggctcca

SEQ ID NO: 529234 - DNA, 20 bp, Artificial
  CRISPR gRNA sequence
cgtctttgcagtggctccag

SEQ ID NO: 529235 - DNA, 20 bp, Artificial
  CRISPR gRNA sequence
gtctttgcagtggctccaga

SEQ ID NO: 529236 - DNA, 20 bp, Artificial
  CRISPR gRNA sequence
ctttgcagtggctccagagg

SEQ ID NO: 529237 - DNA, 20 bp, Artificial
  CRISPR gRNA sequence
tttgcagtggctccagaggg

SEQ ID NO: 529238 - DNA, 20 bp, Artificial
  CRISPR gRNA sequence
gcagtggctccagagggagg

SEQ ID NO: 529239 - DNA, 20 bp, Artificial
  CRISPR gRNA sequence
cagtggctccagagggaggt

SEQ ID NO: 529240 - DNA, 20 bp, Artificial
  CRISPR gRNA sequence
tggctccagagggaggtagg

SEQ ID NO: 529241 - DNA, 20 bp, Artificial
  CRISPR gRNA sequence
gctccagagggaggtaggaa

SEQ ID NO: 529242 - DNA, 20 bp, Artificial
  CRISPR gRNA sequence
ccagagggaggtaggaagag

SEQ ID NO: 529243 - DNA, 20 bp, Artificial
  CRISPR gRNA sequence
taggaagagaagtttttccc

SEQ ID NO: 529244 - DNA, 20 bp, Artificial
  CRISPR gRNA sequence
aggaagagaagtttttccct

SEQ ID NO: 529245 - DNA, 20 bp, Artificial
  CRISPR gRNA sequence
ggaagagaagtttttccctg

SEQ ID NO: 529246 - DNA, 20 bp, Artificial
  CRISPR gRNA sequence
ctcttttttttttttttttt

SEQ ID NO: 529247 - DNA, 20 bp, Artificial
  CRISPR gRNA sequence
ttttttttttttttgagttg

SEQ ID NO: 529248 - DNA, 20 bp, Artificial
  CRISPR gRNA sequence
gaagtttcactcttgttgcc

SEQ ID NO: 529249 - DNA, 20 bp, Artificial
  CRISPR gRNA sequence
aagtttcactcttgttgccc

SEQ ID NO: 529250 - DNA, 20 bp, Artificial
  CRISPR gRNA sequence
ttcactcttgttgcccaggc

SEQ ID NO: 529251 - DNA, 20 bp, Artificial
  CRISPR gRNA sequence
cactcttgttgcccaggcta

SEQ ID NO: 529252 - DNA, 20 bp, Artificial
  CRISPR gRNA sequence
ttgcccaggctagagtgcaa

SEQ ID NO: 529253 - DNA, 20 bp, Artificial
  CRISPR gRNA sequence
agagtgcaatggtgcgatct

SEQ ID NO: 529254 - DNA, 20 bp, Artificial
  CRISPR gRNA sequence
ggtgcgatcttggctcactg

SEQ ID NO: 529255 - DNA, 20 bp, Artificial
  CRISPR gRNA sequence
tcactgcagcctctgcctcc

SEQ ID NO: 529256 - DNA, 20 bp, Artificial
  CRISPR gRNA sequence
cactgcagcctctgcctccc

SEQ ID NO: 529257 - DNA, 20 bp, Artificial
  CRISPR gRNA sequence
ttcaaacaattctcctgcct

SEQ ID NO: 529258 - DNA, 20 bp, Artificial
  CRISPR gRNA sequence
ttctcctgcctcggcctcct

SEQ ID NO: 529259 - DNA, 20 bp, Artificial
  CRISPR gRNA sequence
tcctgcctcggcctcctgag

SEQ ID NO: 529260 - DNA, 20 bp, Artificial
  CRISPR gRNA sequence
gcctcggcctcctgagtagc

SEQ ID NO: 529261 - DNA, 20 bp, Artificial
  CRISPR gRNA sequence
cctcggcctcctgagtagct

SEQ ID NO: 529262 - DNA, 20 bp, Artificial
  CRISPR gRNA sequence
ctcctgagtagctgggatta

SEQ ID NO: 529263 - DNA, 20 bp, Artificial
  CRISPR gRNA sequence
tcctgagtagctgggattac

SEQ ID NO: 529264 - DNA, 20 bp, Artificial
  CRISPR gRNA sequence
caggcgttcaccaccacgcc

SEQ ID NO: 529265 - DNA, 20 bp, Artificial
  CRISPR gRNA sequence
cccggctaatattgtatttt

SEQ ID NO: 529266 - DNA, 20 bp, Artificial
  CRISPR gRNA sequence
ggctaatattgtatttttag

SEQ ID NO: 529267 - DNA, 20 bp, Artificial
  CRISPR gRNA sequence
ctaatattgtatttttagta

SEQ ID NO: 529268 - DNA, 20 bp, Artificial
  CRISPR gRNA sequence
tattgtatttttagtagaga

SEQ ID NO: 529269 - DNA, 20 bp, Artificial
  CRISPR gRNA sequence
gagatggcgtttctccatgt

SEQ ID NO: 529270 - DNA, 20 bp, Artificial
  CRISPR gRNA sequence
tggcgtttctccatgttggt

SEQ ID NO: 529271 - DNA, 20 bp, Artificial
  CRISPR gRNA sequence
ggcgtttctccatgttggtc

SEQ ID NO: 529272 - DNA, 20 bp, Artificial
  CRISPR gRNA sequence
tttctccatgttggtcaggc

SEQ ID NO: 529273 - DNA, 20 bp, Artificial
  CRISPR gRNA sequence
gctggtctcgaactcccgac

SEQ ID NO: 529274 - DNA, 20 bp, Artificial
  CRISPR gRNA sequence
ctggtctcgaactcccgacc

SEQ ID NO: 529275 - DNA, 20 bp, Artificial
  CRISPR gRNA sequence
accaggtgatctgcctgcct

SEQ ID NO: 529276 - DNA, 20 bp, Artificial
  CRISPR gRNA sequence
ctgcctgccttggcctccca

SEQ ID NO: 529277 - DNA, 20 bp, Artificial
  CRISPR gRNA sequence
gccttggcctcccaaagtgc

SEQ ID NO: 529278 - DNA, 20 bp, Artificial
  CRISPR gRNA sequence
ccttggcctcccaaagtgct

SEQ ID NO: 529279 - DNA, 20 bp, Artificial
  CRISPR gRNA sequence
ctcccaaagtgctgggatta

SEQ ID NO: 529280 - DNA, 20 bp, Artificial
  CRISPR gRNA sequence
tcccaaagtgctgggattac

SEQ ID NO: 529281 - DNA, 20 bp, Artificial
  CRISPR gRNA sequence
agtgctgggattacaggtat

SEQ ID NO: 529282 - DNA, 20 bp, Artificial
  CRISPR gRNA sequence
caggtatgagccaccgcacc

SEQ ID NO: 529283 - DNA, 20 bp, Artificial
  CRISPR gRNA sequence
aattacctcttacatcttta

SEQ ID NO: 529284 - DNA, 20 bp, Artificial
  CRISPR gRNA sequence
ttacctcttacatctttatg

SEQ ID NO: 529285 - DNA, 20 bp, Artificial
  CRISPR gRNA sequence
tacatctttatggagatgtg

SEQ ID NO: 529286 - DNA, 20 bp, Artificial
  CRISPR gRNA sequence
tctttatggagatgtgtggc

SEQ ID NO: 529287 - DNA, 20 bp, Artificial
  CRISPR gRNA sequence
ctttatggagatgtgtggct

SEQ ID NO: 529288 - DNA, 20 bp, Artificial
  CRISPR gRNA sequence
tttatggagatgtgtggctg

SEQ ID NO: 529289 - DNA, 20 bp, Artificial
  CRISPR gRNA sequence
atggagatgtgtggctgggg

SEQ ID NO: 529290 - DNA, 20 bp, Artificial
  CRISPR gRNA sequence
atgtgtggctggggaagcac

SEQ ID NO: 529291 - DNA, 20 bp, Artificial
  CRISPR gRNA sequence
gggaagcacaagccctctct

SEQ ID NO: 529292 - DNA, 20 bp, Artificial
  CRISPR gRNA sequence
aagcatcaccctgtaacttc

SEQ ID NO: 529293 - DNA, 20 bp, Artificial
  CRISPR gRNA sequence
ttccggatgttgattcaaac

SEQ ID NO: 529294 - DNA, 20 bp, Artificial
  CRISPR gRNA sequence
ggatgttgattcaaaccaga

SEQ ID NO: 529295 - DNA, 20 bp, Artificial
  CRISPR gRNA sequence
cctctgactacatgaaatgt

SEQ ID NO: 529296 - DNA, 20 bp, Artificial
  CRISPR gRNA sequence
actacatgaaatgtgagcat

SEQ ID NO: 529297 - DNA, 20 bp, Artificial
  CRISPR gRNA sequence
catgaaatgtgagcatcaga

SEQ ID NO: 529298 - DNA, 20 bp, Artificial
  CRISPR gRNA sequence
tgtgagcatcagatggcttt

SEQ ID NO: 529299 - DNA, 20 bp, Artificial
  CRISPR gRNA sequence
gcatcagatggctttgagtg

SEQ ID NO: 529300 - DNA, 20 bp, Artificial
  CRISPR gRNA sequence
atcagatggctttgagtgta

SEQ ID NO: 529301 - DNA, 20 bp, Artificial
  CRISPR gRNA sequence
tggctttgagtgtagagtca

SEQ ID NO: 529302 - DNA, 20 bp, Artificial
  CRISPR gRNA sequence
tttgagtgtagagtcaaagt

SEQ ID NO: 529303 - DNA, 20 bp, Artificial
  CRISPR gRNA sequence
atgtgattttgatacctaaa

SEQ ID NO: 529304 - DNA, 20 bp, Artificial
  CRISPR gRNA sequence
ctaaatggctcgtgtgctct

SEQ ID NO: 529305 - DNA, 20 bp, Artificial
  CRISPR gRNA sequence
gctcgtgtgctctaagcaca

SEQ ID NO: 529306 - DNA, 20 bp, Artificial
  CRISPR gRNA sequence
tcgtgtgctctaagcacaaa

SEQ ID NO: 529307 - DNA, 20 bp, Artificial
  CRISPR gRNA sequence
cgtgtgctctaagcacaaag

SEQ ID NO: 529308 - DNA, 20 bp, Artificial
  CRISPR gRNA sequence
tgctctaagcacaaagagga

SEQ ID NO: 529309 - DNA, 20 bp, Artificial
  CRISPR gRNA sequence
gctctaagcacaaagaggaa

SEQ ID NO: 529310 - DNA, 20 bp, Artificial
  CRISPR gRNA sequence
ctctaagcacaaagaggaaa

SEQ ID NO: 529311 - DNA, 20 bp, Artificial
  CRISPR gRNA sequence
cacaaagaggaaagggcctc

SEQ ID NO: 529312 - DNA, 20 bp, Artificial
  CRISPR gRNA sequence
aagaggaaagggcctccaga

SEQ ID NO: 529313 - DNA, 20 bp, Artificial
  CRISPR gRNA sequence
agaggaaagggcctccagaa

SEQ ID NO: 529314 - DNA, 20 bp, Artificial
  CRISPR gRNA sequence
atgccatcttccgtgccctg

SEQ ID NO: 529315 - DNA, 20 bp, Artificial
  CRISPR gRNA sequence
cgtgccctgcagtcattgct

SEQ ID NO: 529316 - DNA, 20 bp, Artificial
  CRISPR gRNA sequence
gtgccctgcagtcattgctt

SEQ ID NO: 529317 - DNA, 20 bp, Artificial
  CRISPR gRNA sequence
gtcattgcttaggttatgtc

SEQ ID NO: 529318 - DNA, 20 bp, Artificial
  CRISPR gRNA sequence
attgcttaggttatgtccag

SEQ ID NO: 529319 - DNA, 20 bp, Artificial
  CRISPR gRNA sequence
aggttatgtccagtagactg

SEQ ID NO: 529320 - DNA, 20 bp, Artificial
  CRISPR gRNA sequence
gttatgtccagtagactgtg

SEQ ID NO: 529321 - DNA, 20 bp, Artificial
  CRISPR gRNA sequence
tatgtccagtagactgtgga

SEQ ID NO: 529322 - DNA, 20 bp, Artificial
  CRISPR gRNA sequence
atgtccagtagactgtggag

SEQ ID NO: 529323 - DNA, 20 bp, Artificial
  CRISPR gRNA sequence
tgtccagtagactgtggaga

SEQ ID NO: 529324 - DNA, 20 bp, Artificial
  CRISPR gRNA sequence
gtggagagggctctaacccc

SEQ ID NO: 529325 - DNA, 20 bp, Artificial
  CRISPR gRNA sequence
agggctctaacccctggccc

SEQ ID NO: 529326 - DNA, 20 bp, Artificial
  CRISPR gRNA sequence
ctggccctagttctgaatta

SEQ ID NO: 529327 - DNA, 20 bp, Artificial
  CRISPR gRNA sequence
tggccctagttctgaattat

SEQ ID NO: 529328 - DNA, 20 bp, Artificial
  CRISPR gRNA sequence
ggccctagttctgaattatg

SEQ ID NO: 529329 - DNA, 20 bp, Artificial
  CRISPR gRNA sequence
cctagttctgaattatgggg

SEQ ID NO: 529330 - DNA, 20 bp, Artificial
  CRISPR gRNA sequence
agttctgaattatggggcag

SEQ ID NO: 529331 - DNA, 20 bp, Artificial
  CRISPR gRNA sequence
gttctgaattatggggcagt

SEQ ID NO: 529332 - DNA, 20 bp, Artificial
  CRISPR gRNA sequence
ctgaattatggggcagtggg

SEQ ID NO: 529333 - DNA, 20 bp, Artificial
  CRISPR gRNA sequence
gtccttcttcatctcctatg

SEQ ID NO: 529334 - DNA, 20 bp, Artificial
  CRISPR gRNA sequence
ttcttcatctcctatgtggc

SEQ ID NO: 529335 - DNA, 20 bp, Artificial
  CRISPR gRNA sequence
cctatgtggcaagcttgcac

SEQ ID NO: 529336 - DNA, 20 bp, Artificial
  CRISPR gRNA sequence
ggcaagcttgcactggccat

SEQ ID NO: 529337 - DNA, 20 bp, Artificial
  CRISPR gRNA sequence
tttatttgttttgttttttt

SEQ ID NO: 529338 - DNA, 20 bp, Artificial
  CRISPR gRNA sequence
tttgttttgtttttttgaga

SEQ ID NO: 529339 - DNA, 20 bp, Artificial
  CRISPR gRNA sequence
ttgttttgtttttttgagac

SEQ ID NO: 529340 - DNA, 20 bp, Artificial
  CRISPR gRNA sequence
tgttttgtttttttgagaca

SEQ ID NO: 529341 - DNA, 20 bp, Artificial
  CRISPR gRNA sequence
cagggccttgctctgttgcc

SEQ ID NO: 529342 - DNA, 20 bp, Artificial
  CRISPR gRNA sequence
ccttgctctgttgcccagac

SEQ ID NO: 529343 - DNA, 20 bp, Artificial
  CRISPR gRNA sequence
ttgctctgttgcccagactg

SEQ ID NO: 529344 - DNA, 20 bp, Artificial
  CRISPR gRNA sequence
ctgttgcccagactggagtg

SEQ ID NO: 529345 - DNA, 20 bp, Artificial
  CRISPR gRNA sequence
tcactgcattcttgatctcc

SEQ ID NO: 529346 - DNA, 20 bp, Artificial
  CRISPR gRNA sequence
cactgcattcttgatctccc

SEQ ID NO: 529347 - DNA, 20 bp, Artificial
  CRISPR gRNA sequence
ctgaaatgattcacccacct

SEQ ID NO: 529348 - DNA, 20 bp, Artificial
  CRISPR gRNA sequence
acccacctcagcctcctgac

SEQ ID NO: 529349 - DNA, 20 bp, Artificial
  CRISPR gRNA sequence
acctcagcctcctgactagc

SEQ ID NO: 529350 - DNA, 20 bp, Artificial
  CRISPR gRNA sequence
cctcagcctcctgactagct

SEQ ID NO: 529351 - DNA, 20 bp, Artificial
  CRISPR gRNA sequence
ctcctgactagctgggacta

SEQ ID NO: 529352 - DNA, 20 bp, Artificial
  CRISPR gRNA sequence
tcctgactagctgggactac

SEQ ID NO: 529353 - DNA, 20 bp, Artificial
  CRISPR gRNA sequence
aatgcacccacctaattttt

SEQ ID NO: 529354 - DNA, 20 bp, Artificial
  CRISPR gRNA sequence
atttttaagtttttttttta

SEQ ID NO: 529355 - DNA, 20 bp, Artificial
  CRISPR gRNA sequence
tttaagttttttttttaaag

SEQ ID NO: 529356 - DNA, 20 bp, Artificial
  CRISPR gRNA sequence
taagttttttttttaaagta

SEQ ID NO: 529357 - DNA, 20 bp, Artificial
  CRISPR gRNA sequence
tttttttttaaagtagagac

SEQ ID NO: 529358 - DNA, 20 bp, Artificial
  CRISPR gRNA sequence
ttttttttaaagtagagacc

SEQ ID NO: 529359 - DNA, 20 bp, Artificial
  CRISPR gRNA sequence
ccaggtctcactatattgcc

SEQ ID NO: 529360 - DNA, 20 bp, Artificial
  CRISPR gRNA sequence
caggtctcactatattgccc

SEQ ID NO: 529361 - DNA, 20 bp, Artificial
  CRISPR gRNA sequence
tctcactatattgcccaggc

SEQ ID NO: 529362 - DNA, 20 bp, Artificial
  CRISPR gRNA sequence
caggctggtcccaaactcct

SEQ ID NO: 529363 - DNA, 20 bp, Artificial
  CRISPR gRNA sequence
ctcaaatgatcctcctgcct

SEQ ID NO: 529364 - DNA, 20 bp, Artificial
  CRISPR gRNA sequence
cctcctgcctcggcctccca

SEQ ID NO: 529365 - DNA, 20 bp, Artificial
  CRISPR gRNA sequence
cctcggcctcccaaagtgct

SEQ ID NO: 529366 - DNA, 20 bp, Artificial
  CRISPR gRNA sequence
ctcccaaagtgctgagatta

SEQ ID NO: 529367 - DNA, 20 bp, Artificial
  CRISPR gRNA sequence
agtgctgagattacagatat

SEQ ID NO: 529368 - DNA, 20 bp, Artificial
  CRISPR gRNA sequence
cagatatgagccaccacact

SEQ ID NO: 529369 - DNA, 20 bp, Artificial
  CRISPR gRNA sequence
cacttggcccatacaccatt

SEQ ID NO: 529370 - DNA, 20 bp, Artificial
  CRISPR gRNA sequence
acatttattcctcatcttcc

SEQ ID NO: 529371 - DNA, 20 bp, Artificial
  CRISPR gRNA sequence
ttcctcatcttccaagtgtt

SEQ ID NO: 529372 - DNA, 20 bp, Artificial
  CRISPR gRNA sequence
tgttaagtgtcattgtgact

SEQ ID NO: 529373 - DNA, 20 bp, Artificial
  CRISPR gRNA sequence
acttagacacaaattgtcct

SEQ ID NO: 529374 - DNA, 20 bp, Artificial
  CRISPR gRNA sequence
cttagacacaaattgtcctc

SEQ ID NO: 529375 - DNA, 20 bp, Artificial
  CRISPR gRNA sequence
agacacaaattgtcctcagg

SEQ ID NO: 529376 - DNA, 20 bp, Artificial
  CRISPR gRNA sequence
tcctcaggaagcctaaaatc

SEQ ID NO: 529377 - DNA, 20 bp, Artificial
  CRISPR gRNA sequence
caggaagcctaaaatcaagt

SEQ ID NO: 529378 - DNA, 20 bp, Artificial
  CRISPR gRNA sequence
ggaagcctaaaatcaagtaa

SEQ ID NO: 529379 - DNA, 20 bp, Artificial
  CRISPR gRNA sequence
gaagcctaaaatcaagtaag

SEQ ID NO: 529380 - DNA, 20 bp, Artificial
  CRISPR gRNA sequence
aaatcaagtaagaggcaaac

SEQ ID NO: 529381 - DNA, 20 bp, Artificial
  CRISPR gRNA sequence
tcgcaatgtcaatttctgtg

SEQ ID NO: 529382 - DNA, 20 bp, Artificial
  CRISPR gRNA sequence
gcaatgtcaatttctgtgaa

SEQ ID NO: 529383 - DNA, 20 bp, Artificial
  CRISPR gRNA sequence
gtcaatttctgtgaagagcc

SEQ ID NO: 529384 - DNA, 20 bp, Artificial
  CRISPR gRNA sequence
tcaatttctgtgaagagccc

SEQ ID NO: 529385 - DNA, 20 bp, Artificial
  CRISPR gRNA sequence
caatttctgtgaagagccca

SEQ ID NO: 529386 - DNA, 20 bp, Artificial
  CRISPR gRNA sequence
tgtgaagagcccagggccac

SEQ ID NO: 529387 - DNA, 20 bp, Artificial
  CRISPR gRNA sequence
aagagcccagggccaccaga

SEQ ID NO: 529388 - DNA, 20 bp, Artificial
  CRISPR gRNA sequence
cccagggccaccagaaagtg

SEQ ID NO: 529389 - DNA, 20 bp, Artificial
  CRISPR gRNA sequence
gggccaccagaaagtgtaga

SEQ ID NO: 529390 - DNA, 20 bp, Artificial
  CRISPR gRNA sequence
gccaccagaaagtgtagaca

SEQ ID NO: 529391 - DNA, 20 bp, Artificial
  CRISPR gRNA sequence
ccaccagaaagtgtagacag

SEQ ID NO: 529392 - DNA, 20 bp, Artificial
  CRISPR gRNA sequence
aagtgtagacagaggcacat

SEQ ID NO: 529393 - DNA, 20 bp, Artificial
  CRISPR gRNA sequence
agacagaggcacatgagctc

SEQ ID NO: 529394 - DNA, 20 bp, Artificial
  CRISPR gRNA sequence
cagaggcacatgagctctgg

SEQ ID NO: 529395 - DNA, 20 bp, Artificial
  CRISPR gRNA sequence
agaggcacatgagctctggt

SEQ ID NO: 529396 - DNA, 20 bp, Artificial
  CRISPR gRNA sequence
aggcacatgagctctggtag

SEQ ID NO: 529397 - DNA, 20 bp, Artificial
  CRISPR gRNA sequence
ggcacatgagctctggtagg

SEQ ID NO: 529398 - DNA, 20 bp, Artificial
  CRISPR gRNA sequence
atgagctctggtaggaggaa

SEQ ID NO: 529399 - DNA, 20 bp, Artificial
  CRISPR gRNA sequence
tgagctctggtaggaggaat

SEQ ID NO: 529400 - DNA, 20 bp, Artificial
  CRISPR gRNA sequence
gagctctggtaggaggaatg

SEQ ID NO: 529401 - DNA, 20 bp, Artificial
  CRISPR gRNA sequence
ctggtaggaggaatggggtg

SEQ ID NO: 529402 - DNA, 20 bp, Artificial
  CRISPR gRNA sequence
aggaatggggtgtagccaca

SEQ ID NO: 529403 - DNA, 20 bp, Artificial
  CRISPR gRNA sequence
tggggtgtagccacatggct

SEQ ID NO: 529404 - DNA, 20 bp, Artificial
  CRISPR gRNA sequence
tagccacatggctgagactg

SEQ ID NO: 529405 - DNA, 20 bp, Artificial
  CRISPR gRNA sequence
agccacatggctgagactgc

SEQ ID NO: 529406 - DNA, 20 bp, Artificial
  CRISPR gRNA sequence
cacatggctgagactgcagg

SEQ ID NO: 529407 - DNA, 20 bp, Artificial
  CRISPR gRNA sequence
acatggctgagactgcaggc

SEQ ID NO: 529408 - DNA, 20 bp, Artificial
  CRISPR gRNA sequence
catggctgagactgcaggca

SEQ ID NO: 529409 - DNA, 20 bp, Artificial
  CRISPR gRNA sequence
gctgagactgcaggcagggt

SEQ ID NO: 529410 - DNA, 20 bp, Artificial
  CRISPR gRNA sequence
agactgcaggcagggttgga

SEQ ID NO: 529411 - DNA, 20 bp, Artificial
  CRISPR gRNA sequence
gcaggcagggttggacagac

SEQ ID NO: 529412 - DNA, 20 bp, Artificial
  CRISPR gRNA sequence
caggcagggttggacagaca

SEQ ID NO: 529413 - DNA, 20 bp, Artificial
  CRISPR gRNA sequence
cagggttggacagacaaggt

SEQ ID NO: 529414 - DNA, 20 bp, Artificial
  CRISPR gRNA sequence
tggacagacaaggttggcta

SEQ ID NO: 529415 - DNA, 20 bp, Artificial
  CRISPR gRNA sequence
acggctctgtgcaccctgcc

SEQ ID NO: 529416 - DNA, 20 bp, Artificial
  CRISPR gRNA sequence
ctgtgcaccctgcctggttc

SEQ ID NO: 529417 - DNA, 20 bp, Artificial
  CRISPR gRNA sequence
tgcaccctgcctggttcaag

SEQ ID NO: 529418 - DNA, 20 bp, Artificial
  CRISPR gRNA sequence
gcaccctgcctggttcaagc

SEQ ID NO: 529419 - DNA, 20 bp, Artificial
  CRISPR gRNA sequence
cctgcctggttcaagcagga

SEQ ID NO: 529420 - DNA, 20 bp, Artificial
  CRISPR gRNA sequence
gcctggttcaagcaggacag

SEQ ID NO: 529421 - DNA, 20 bp, Artificial
  CRISPR gRNA sequence
cctggttcaagcaggacagt

SEQ ID NO: 529422 - DNA, 20 bp, Artificial
  CRISPR gRNA sequence
caagcaggacagtgggtcct

SEQ ID NO: 529423 - DNA, 20 bp, Artificial
  CRISPR gRNA sequence
ggtcctcagcctacccactc

SEQ ID NO: 529424 - DNA, 20 bp, Artificial
  CRISPR gRNA sequence
cctcagcctacccactccag

SEQ ID NO: 529425 - DNA, 20 bp, Artificial
  CRISPR gRNA sequence
cctacccactccagcagctg

SEQ ID NO: 529426 - DNA, 20 bp, Artificial
  CRISPR gRNA sequence
cccactccagcagctgcagc

SEQ ID NO: 529427 - DNA, 20 bp, Artificial
  CRISPR gRNA sequence
ggcgcctaaatgtgtgctcc

SEQ ID NO: 529428 - DNA, 20 bp, Artificial
  CRISPR gRNA sequence
gcgcctaaatgtgtgctccc

SEQ ID NO: 529429 - DNA, 20 bp, Artificial
  CRISPR gRNA sequence
tgtgctcccaggaattcctc

SEQ ID NO: 529430 - DNA, 20 bp, Artificial
  CRISPR gRNA sequence
gtgctcccaggaattcctcc

SEQ ID NO: 529431 - DNA, 20 bp, Artificial
  CRISPR gRNA sequence
tctcccttgtttgcatctcc

SEQ ID NO: 529432 - DNA, 20 bp, Artificial
  CRISPR gRNA sequence
catctcctggttactcaacc

SEQ ID NO: 529433 - DNA, 20 bp, Artificial
  CRISPR gRNA sequence
atctcctggttactcaaccc

SEQ ID NO: 529434 - DNA, 20 bp, Artificial
  CRISPR gRNA sequence
tctcctggttactcaaccca

SEQ ID NO: 529435 - DNA, 20 bp, Artificial
  CRISPR gRNA sequence
tactcaacccagggcatgac

SEQ ID NO: 529436 - DNA, 20 bp, Artificial
  CRISPR gRNA sequence
acccagggcatgactggaat

SEQ ID NO: 529437 - DNA, 20 bp, Artificial
  CRISPR gRNA sequence
cccagggcatgactggaatg

SEQ ID NO: 529438 - DNA, 20 bp, Artificial
  CRISPR gRNA sequence
gggcatgactggaatgaggc

SEQ ID NO: 529439 - DNA, 20 bp, Artificial
  CRISPR gRNA sequence
atgactggaatgaggcaagc

SEQ ID NO: 529440 - DNA, 20 bp, Artificial
  CRISPR gRNA sequence
tgactggaatgaggcaagcg

SEQ ID NO: 529441 - DNA, 20 bp, Artificial
  CRISPR gRNA sequence
aatgaggcaagcgaggctga

SEQ ID NO: 529442 - DNA, 20 bp, Artificial
  CRISPR gRNA sequence
atgaggcaagcgaggctgac

SEQ ID NO: 529443 - DNA, 20 bp, Artificial
  CRISPR gRNA sequence
aagcgaggctgacaggcatg

SEQ ID NO: 529444 - DNA, 20 bp, Artificial
  CRISPR gRNA sequence
gctgacaggcatgcagttta

SEQ ID NO: 529445 - DNA, 20 bp, Artificial
  CRISPR gRNA sequence
tttaaagacacaccaacttt

SEQ ID NO: 529446 - DNA, 20 bp, Artificial
  CRISPR gRNA sequence
ttaaagacacaccaactttc

SEQ ID NO: 529447 - DNA, 20 bp, Artificial
  CRISPR gRNA sequence
caccaactttcaggttgtgc

SEQ ID NO: 529448 - DNA, 20 bp, Artificial
  CRISPR gRNA sequence
accaactttcaggttgtgca

SEQ ID NO: 529449 - DNA, 20 bp, Artificial
  CRISPR gRNA sequence
ccaactttcaggttgtgcaa

SEQ ID NO: 529450 - DNA, 20 bp, Artificial
  CRISPR gRNA sequence
actttcaggttgtgcaaggg

SEQ ID NO: 529451 - DNA, 20 bp, Artificial
  CRISPR gRNA sequence
ctttcaggttgtgcaagggc

SEQ ID NO: 529452 - DNA, 20 bp, Artificial
  CRISPR gRNA sequence
caggttgtgcaagggcaggc

SEQ ID NO: 529453 - DNA, 20 bp, Artificial
  CRISPR gRNA sequence
aaattctatgccttaaattc

SEQ ID NO: 529454 - DNA, 20 bp, Artificial
  CRISPR gRNA sequence
aattctatgccttaaattct

SEQ ID NO: 529455 - DNA, 20 bp, Artificial
  CRISPR gRNA sequence
aaattctgggctccttgcct

SEQ ID NO: 529456 - DNA, 20 bp, Artificial
  CRISPR gRNA sequence
ctgggctccttgcctcggcc

SEQ ID NO: 529457 - DNA, 20 bp, Artificial
  CRISPR gRNA sequence
tgggctccttgcctcggcct

SEQ ID NO: 529458 - DNA, 20 bp, Artificial
  CRISPR gRNA sequence
ccttgcctcggcctaggcct

SEQ ID NO: 529459 - DNA, 20 bp, Artificial
  CRISPR gRNA sequence
ctaggcctgagtcaacctac

SEQ ID NO: 529460 - DNA, 20 bp, Artificial
  CRISPR gRNA sequence
ctgagtcaacctactggcca

SEQ ID NO: 529461 - DNA, 20 bp, Artificial
  CRISPR gRNA sequence
tgagtcaacctactggccat

SEQ ID NO: 529462 - DNA, 20 bp, Artificial
  CRISPR gRNA sequence
acctactggccataggattt

SEQ ID NO: 529463 - DNA, 20 bp, Artificial
  CRISPR gRNA sequence
cctactggccataggattta

SEQ ID NO: 529464 - DNA, 20 bp, Artificial
  CRISPR gRNA sequence
aattgaacctcactgaactt

SEQ ID NO: 529465 - DNA, 20 bp, Artificial
  CRISPR gRNA sequence
tgtgttgttatctatctcct

SEQ ID NO: 529466 - DNA, 20 bp, Artificial
  CRISPR gRNA sequence
atctcctaagatcactctga

SEQ ID NO: 529467 - DNA, 20 bp, Artificial
  CRISPR gRNA sequence
cctaagatcactctgaaagc

SEQ ID NO: 529468 - DNA, 20 bp, Artificial
  CRISPR gRNA sequence
ctgaaagctggatgcactaa

SEQ ID NO: 529469 - DNA, 20 bp, Artificial
  CRISPR gRNA sequence
gcactaatagacataaaaca

SEQ ID NO: 529470 - DNA, 20 bp, Artificial
  CRISPR gRNA sequence
actaatagacataaaacaca

SEQ ID NO: 529471 - DNA, 20 bp, Artificial
  CRISPR gRNA sequence
gagactaacgacttttttat

SEQ ID NO: 529472 - DNA, 20 bp, Artificial
  CRISPR gRNA sequence
aacgacttttttatcagcat

SEQ ID NO: 529473 - DNA, 20 bp, Artificial
  CRISPR gRNA sequence
gagctaaccatcattcttct

SEQ ID NO: 529474 - DNA, 20 bp, Artificial
  CRISPR gRNA sequence
aaccatcattcttctcagcc

SEQ ID NO: 529475 - DNA, 20 bp, Artificial
  CRISPR gRNA sequence
cattcttctcagcctggtga

SEQ ID NO: 529476 - DNA, 20 bp, Artificial
  CRISPR gRNA sequence
tcttctcagcctggtgatgg

SEQ ID NO: 529477 - DNA, 20 bp, Artificial
  CRISPR gRNA sequence
ttctcagcctggtgatggca

SEQ ID NO: 529478 - DNA, 20 bp, Artificial
  CRISPR gRNA sequence
tggcagagattgccttgtct

SEQ ID NO: 529479 - DNA, 20 bp, Artificial
  CRISPR gRNA sequence
ggcagagattgccttgtctt

SEQ ID NO: 529480 - DNA, 20 bp, Artificial
  CRISPR gRNA sequence
gcagagattgccttgtcttg

SEQ ID NO: 529481 - DNA, 20 bp, Artificial
  CRISPR gRNA sequence
ttgccttgtcttggggtgac

SEQ ID NO: 529482 - DNA, 20 bp, Artificial
  CRISPR gRNA sequence
cttgtcttggggtgacaagt

SEQ ID NO: 529483 - DNA, 20 bp, Artificial
  CRISPR gRNA sequence
ttgtcttggggtgacaagtg

SEQ ID NO: 529484 - DNA, 20 bp, Artificial
  CRISPR gRNA sequence
gtgacaagtgaggtccacct

SEQ ID NO: 529485 - DNA, 20 bp, Artificial
  CRISPR gRNA sequence
acaagtgaggtccaccttgg

SEQ ID NO: 529486 - DNA, 20 bp, Artificial
  CRISPR gRNA sequence
agtgaggtccaccttggaag

SEQ ID NO: 529487 - DNA, 20 bp, Artificial
  CRISPR gRNA sequence
gtccaccttggaagaagata

SEQ ID NO: 529488 - DNA, 20 bp, Artificial
  CRISPR gRNA sequence
aagatatggtctttgaccat

SEQ ID NO: 529489 - DNA, 20 bp, Artificial
  CRISPR gRNA sequence
ggtctttgaccattagtcaa

SEQ ID NO: 529490 - DNA, 20 bp, Artificial
  CRISPR gRNA sequence
tctttgaccattagtcaatg

SEQ ID NO: 529491 - DNA, 20 bp, Artificial
  CRISPR gRNA sequence
ttgaccattagtcaatggag

SEQ ID NO: 529492 - DNA, 20 bp, Artificial
  CRISPR gRNA sequence
tgaccattagtcaatggaga

SEQ ID NO: 529493 - DNA, 20 bp, Artificial
  CRISPR gRNA sequence
accattagtcaatggagaag

SEQ ID NO: 529494 - DNA, 20 bp, Artificial
  CRISPR gRNA sequence
tagtcaatggagaaggagca

SEQ ID NO: 529495 - DNA, 20 bp, Artificial
  CRISPR gRNA sequence
gtcaatggagaaggagcatg

SEQ ID NO: 529496 - DNA, 20 bp, Artificial
  CRISPR gRNA sequence
caatggagaaggagcatgga

SEQ ID NO: 529497 - DNA, 20 bp, Artificial
  CRISPR gRNA sequence
aatggagaaggagcatggag

SEQ ID NO: 529498 - DNA, 20 bp, Artificial
  CRISPR gRNA sequence
tggagaaggagcatggagag

SEQ ID NO: 529499 - DNA, 20 bp, Artificial
  CRISPR gRNA sequence
aaggagcatggagaggagca

SEQ ID NO: 529500 - DNA, 20 bp, Artificial
  CRISPR gRNA sequence
ggagcatggagaggagcatg

SEQ ID NO: 529501 - DNA, 20 bp, Artificial
  CRISPR gRNA sequence
atggagaggagcatggagaa

SEQ ID NO: 529502 - DNA, 20 bp, Artificial
  CRISPR gRNA sequence
agaggagcatggagaacagc

SEQ ID NO: 529503 - DNA, 20 bp, Artificial
  CRISPR gRNA sequence
aggagcatggagaacagcca

SEQ ID NO: 529504 - DNA, 20 bp, Artificial
  CRISPR gRNA sequence
gcatggagaacagccagagc

SEQ ID NO: 529505 - DNA, 20 bp, Artificial
  CRISPR gRNA sequence
catggagaacagccagagct

SEQ ID NO: 529506 - DNA, 20 bp, Artificial
  CRISPR gRNA sequence
agaacagccagagctgggca

SEQ ID NO: 529507 - DNA, 20 bp, Artificial
  CRISPR gRNA sequence
aacagccagagctgggcaca

SEQ ID NO: 529508 - DNA, 20 bp, Artificial
  CRISPR gRNA sequence
acagccagagctgggcacag

SEQ ID NO: 529509 - DNA, 20 bp, Artificial
  CRISPR gRNA sequence
agccagagctgggcacagag

SEQ ID NO: 529510 - DNA, 20 bp, Artificial
  CRISPR gRNA sequence
gccagagctgggcacagagg

SEQ ID NO: 529511 - DNA, 20 bp, Artificial
  CRISPR gRNA sequence
agctgggcacagaggaggat

SEQ ID NO: 529512 - DNA, 20 bp, Artificial
  CRISPR gRNA sequence
gggcacagaggaggataagc

SEQ ID NO: 529513 - DNA, 20 bp, Artificial
  CRISPR gRNA sequence
ggcacagaggaggataagcc

SEQ ID NO: 529514 - DNA, 20 bp, Artificial
  CRISPR gRNA sequence
aggataagccaggcatgcct

SEQ ID NO: 529515 - DNA, 20 bp, Artificial
  CRISPR gRNA sequence
ggataagccaggcatgccta

SEQ ID NO: 529516 - DNA, 20 bp, Artificial
  CRISPR gRNA sequence
gataagccaggcatgcctaa

SEQ ID NO: 529517 - DNA, 20 bp, Artificial
  CRISPR gRNA sequence
ggcatgcctaagggccctgc

SEQ ID NO: 529518 - DNA, 20 bp, Artificial
  CRISPR gRNA sequence
ccagcgattctgctgtgctg

SEQ ID NO: 529519 - DNA, 20 bp, Artificial
  CRISPR gRNA sequence
gcgattctgctgtgctgtgg

SEQ ID NO: 529520 - DNA, 20 bp, Artificial
  CRISPR gRNA sequence
ttctgctgtgctgtggtgga

SEQ ID NO: 529521 - DNA, 20 bp, Artificial
  CRISPR gRNA sequence
ctgtgctgtggtggaaagtg

SEQ ID NO: 529522 - DNA, 20 bp, Artificial
  CRISPR gRNA sequence
tgtgctgtggtggaaagtgt

SEQ ID NO: 529523 - DNA, 20 bp, Artificial
  CRISPR gRNA sequence
ctgtggtggaaagtgtggga

SEQ ID NO: 529524 - DNA, 20 bp, Artificial
  CRISPR gRNA sequence
tggaaagtgtgggacagtcg

SEQ ID NO: 529525 - DNA, 20 bp, Artificial
  CRISPR gRNA sequence
aaagtgtgggacagtcgtgg

SEQ ID NO: 529526 - DNA, 20 bp, Artificial
  CRISPR gRNA sequence
aagtgtgggacagtcgtggt

SEQ ID NO: 529527 - DNA, 20 bp, Artificial
  CRISPR gRNA sequence
tgtgggacagtcgtggtggg

SEQ ID NO: 529528 - DNA, 20 bp, Artificial
  CRISPR gRNA sequence
gacagtcgtggtgggaagaa

SEQ ID NO: 529529 - DNA, 20 bp, Artificial
  CRISPR gRNA sequence
acagtcgtggtgggaagaat

SEQ ID NO: 529530 - DNA, 20 bp, Artificial
  CRISPR gRNA sequence
gtggtgggaagaatgggact

SEQ ID NO: 529531 - DNA, 20 bp, Artificial
  CRISPR gRNA sequence
gggaagaatgggactaagtt

SEQ ID NO: 529532 - DNA, 20 bp, Artificial
  CRISPR gRNA sequence
ggaagaatgggactaagttc

SEQ ID NO: 529533 - DNA, 20 bp, Artificial
  CRISPR gRNA sequence
ctaagttcaggatgatgttt

SEQ ID NO: 529534 - DNA, 20 bp, Artificial
  CRISPR gRNA sequence
taagttcaggatgatgtttc

SEQ ID NO: 529535 - DNA, 20 bp, Artificial
  CRISPR gRNA sequence
aagttcaggatgatgtttcg

SEQ ID NO: 529536 - DNA, 20 bp, Artificial
  CRISPR gRNA sequence
caggatgatgtttcggggcc

SEQ ID NO: 529537 - DNA, 20 bp, Artificial
  CRISPR gRNA sequence
aggatgatgtttcggggcct

SEQ ID NO: 529538 - DNA, 20 bp, Artificial
  CRISPR gRNA sequence
tgatgtttcggggcctgggc

SEQ ID NO: 529539 - DNA, 20 bp, Artificial
  CRISPR gRNA sequence
gatgtttcggggcctgggct

SEQ ID NO: 529540 - DNA, 20 bp, Artificial
  CRISPR gRNA sequence
atgtttcggggcctgggctg

SEQ ID NO: 529541 - DNA, 20 bp, Artificial
  CRISPR gRNA sequence
tgtttcggggcctgggctgg

SEQ ID NO: 529542 - DNA, 20 bp, Artificial
  CRISPR gRNA sequence
ttcggggcctgggctggggg

SEQ ID NO: 529543 - DNA, 20 bp, Artificial
  CRISPR gRNA sequence
ggctgggggtagtgacgtga

SEQ ID NO: 529544 - DNA, 20 bp, Artificial
  CRISPR gRNA sequence
gctgggggtagtgacgtgat

SEQ ID NO: 529545 - DNA, 20 bp, Artificial
  CRISPR gRNA sequence
ggtagtgacgtgatgggacg

SEQ ID NO: 529546 - DNA, 20 bp, Artificial
  CRISPR gRNA sequence
gtagtgacgtgatgggacgt

SEQ ID NO: 529547 - DNA, 20 bp, Artificial
  CRISPR gRNA sequence
tagtgacgtgatgggacgtg

SEQ ID NO: 529548 - DNA, 20 bp, Artificial
  CRISPR gRNA sequence
acgtgatgggacgtggggct

SEQ ID NO: 529549 - DNA, 20 bp, Artificial
  CRISPR gRNA sequence
cgtgatgggacgtggggctg

SEQ ID NO: 529550 - DNA, 20 bp, Artificial
  CRISPR gRNA sequence
gtgatgggacgtggggctga

SEQ ID NO: 529551 - DNA, 20 bp, Artificial
  CRISPR gRNA sequence
gacgtggggctgagggaccg

SEQ ID NO: 529552 - DNA, 20 bp, Artificial
  CRISPR gRNA sequence
gctgagggaccgcagcctga

SEQ ID NO: 529553 - DNA, 20 bp, Artificial
  CRISPR gRNA sequence
ctgagggaccgcagcctgat

SEQ ID NO: 529554 - DNA, 20 bp, Artificial
  CRISPR gRNA sequence
tgagggaccgcagcctgatg

SEQ ID NO: 529555 - DNA, 20 bp, Artificial
  CRISPR gRNA sequence
agggaccgcagcctgatggg

SEQ ID NO: 529556 - DNA, 20 bp, Artificial
  CRISPR gRNA sequence
gggaccgcagcctgatgggg

SEQ ID NO: 529557 - DNA, 20 bp, Artificial
  CRISPR gRNA sequence
accgcagcctgatggggagg

SEQ ID NO: 529558 - DNA, 20 bp, Artificial
  CRISPR gRNA sequence
gcagcctgatggggaggcag

SEQ ID NO: 529559 - DNA, 20 bp, Artificial
  CRISPR gRNA sequence
cagcctgatggggaggcaga

SEQ ID NO: 529560 - DNA, 20 bp, Artificial
  CRISPR gRNA sequence
gcctgatggggaggcagaag

SEQ ID NO: 529561 - DNA, 20 bp, Artificial
  CRISPR gRNA sequence
ggggaggcagaaggagaact

SEQ ID NO: 529562 - DNA, 20 bp, Artificial
  CRISPR gRNA sequence
gggaggcagaaggagaactg

SEQ ID NO: 529563 - DNA, 20 bp, Artificial
  CRISPR gRNA sequence
aggcagaaggagaactgagg

SEQ ID NO: 529564 - DNA, 20 bp, Artificial
  CRISPR gRNA sequence
gagaactgaggaagaaatct

SEQ ID NO: 529565 - DNA, 20 bp, Artificial
  CRISPR gRNA sequence
agaactgaggaagaaatctg

SEQ ID NO: 529566 - DNA, 20 bp, Artificial
  CRISPR gRNA sequence
tgaggaagaaatctgaggta

SEQ ID NO: 529567 - DNA, 20 bp, Artificial
  CRISPR gRNA sequence
ggaagaaatctgaggtaaag

SEQ ID NO: 529568 - DNA, 20 bp, Artificial
  CRISPR gRNA sequence
tgaggtaaagaagccaaatc

SEQ ID NO: 529569 - DNA, 20 bp, Artificial
  CRISPR gRNA sequence
aggtaaagaagccaaatcca

SEQ ID NO: 529570 - DNA, 20 bp, Artificial
  CRISPR gRNA sequence
ggtaaagaagccaaatccag

SEQ ID NO: 529571 - DNA, 20 bp, Artificial
  CRISPR gRNA sequence
gtaaagaagccaaatccaga

SEQ ID NO: 529572 - DNA, 20 bp, Artificial
  CRISPR gRNA sequence
gaagccaaatccagagggca

SEQ ID NO: 529573 - DNA, 20 bp, Artificial
  CRISPR gRNA sequence
aagccaaatccagagggcac

SEQ ID NO: 529574 - DNA, 20 bp, Artificial
  CRISPR gRNA sequence
agccaaatccagagggcacg

SEQ ID NO: 529575 - DNA, 20 bp, Artificial
  CRISPR gRNA sequence
atccagagggcacggggccc

SEQ ID NO: 529576 - DNA, 20 bp, Artificial
  CRISPR gRNA sequence
tccagagggcacggggccca

SEQ ID NO: 529577 - DNA, 20 bp, Artificial
  CRISPR gRNA sequence
ggcacggggcccaaggccac

SEQ ID NO: 529578 - DNA, 20 bp, Artificial
  CRISPR gRNA sequence
ggcccaaggccaccggtgcc

SEQ ID NO: 529579 - DNA, 20 bp, Artificial
  CRISPR gRNA sequence
gcccaaggccaccggtgcct

SEQ ID NO: 529580 - DNA, 20 bp, Artificial
  CRISPR gRNA sequence
cccaaggccaccggtgcctg

SEQ ID NO: 529581 - DNA, 20 bp, Artificial
  CRISPR gRNA sequence
aaggccaccggtgcctgggg

SEQ ID NO: 529582 - DNA, 20 bp, Artificial
  CRISPR gRNA sequence
caccggtgcctggggaagtt

SEQ ID NO: 529583 - DNA, 20 bp, Artificial
  CRISPR gRNA sequence
ggaagtttggaccacctccc

SEQ ID NO: 529584 - DNA, 20 bp, Artificial
  CRISPR gRNA sequence
gaagtttggaccacctccct

SEQ ID NO: 529585 - DNA, 20 bp, Artificial
  CRISPR gRNA sequence
gtttggaccacctccctggg

SEQ ID NO: 529586 - DNA, 20 bp, Artificial
  CRISPR gRNA sequence
accacctccctgggcagcac

SEQ ID NO: 529587 - DNA, 20 bp, Artificial
  CRISPR gRNA sequence
acctccctgggcagcactgg

SEQ ID NO: 529588 - DNA, 20 bp, Artificial
  CRISPR gRNA sequence
tccctgggcagcactggaag

SEQ ID NO: 529589 - DNA, 20 bp, Artificial
  CRISPR gRNA sequence
tgggcagcactggaagcagc

SEQ ID NO: 529590 - DNA, 20 bp, Artificial
  CRISPR gRNA sequence
agcactggaagcagctggtg

SEQ ID NO: 529591 - DNA, 20 bp, Artificial
  CRISPR gRNA sequence
gctggtgtggctgtgcctgc

SEQ ID NO: 529592 - DNA, 20 bp, Artificial
  CRISPR gRNA sequence
gtggctgtgcctgccggttc

SEQ ID NO: 529593 - DNA, 20 bp, Artificial
  CRISPR gRNA sequence
tggctgtgcctgccggttct

SEQ ID NO: 529594 - DNA, 20 bp, Artificial
  CRISPR gRNA sequence
ggctgtgcctgccggttcta

SEQ ID NO: 529595 - DNA, 20 bp, Artificial
  CRISPR gRNA sequence
ctgtgcctgccggttctagg

SEQ ID NO: 529596 - DNA, 20 bp, Artificial
  CRISPR gRNA sequence
gtgcctgccggttctaggga

SEQ ID NO: 529597 - DNA, 20 bp, Artificial
  CRISPR gRNA sequence
gccggttctagggagagacc

SEQ ID NO: 529598 - DNA, 20 bp, Artificial
  CRISPR gRNA sequence
cctgctgtgaacgtgaattg

SEQ ID NO: 529599 - DNA, 20 bp, Artificial
  CRISPR gRNA sequence
tgctgtgaacgtgaattgca

SEQ ID NO: 529600 - DNA, 20 bp, Artificial
  CRISPR gRNA sequence
acgtgaattgcagagaaccc

SEQ ID NO: 529601 - DNA, 20 bp, Artificial
  CRISPR gRNA sequence
cgtgaattgcagagaacccc

SEQ ID NO: 529602 - DNA, 20 bp, Artificial
  CRISPR gRNA sequence
gtgaattgcagagaacccca

SEQ ID NO: 529603 - DNA, 20 bp, Artificial
  CRISPR gRNA sequence
aaccccagggcctgttccct

SEQ ID NO: 529604 - DNA, 20 bp, Artificial
  CRISPR gRNA sequence
gggcctgttcccttggctgc

SEQ ID NO: 529605 - DNA, 20 bp, Artificial
  CRISPR gRNA sequence
ttggctgcaagtcccgccaa

SEQ ID NO: 529606 - DNA, 20 bp, Artificial
  CRISPR gRNA sequence
accctcatctgtgcccccca

SEQ ID NO: 529607 - DNA, 20 bp, Artificial
  CRISPR gRNA sequence
tgtgccccccacagtgaccc

SEQ ID NO: 529608 - DNA, 20 bp, Artificial
  CRISPR gRNA sequence
gtgccccccacagtgacccc

SEQ ID NO: 529609 - DNA, 20 bp, Artificial
  CRISPR gRNA sequence
cccccacagtgaccccgggt

SEQ ID NO: 529610 - DNA, 20 bp, Artificial
  CRISPR gRNA sequence
cccgggttggccattctctg

SEQ ID NO: 529611 - DNA, 20 bp, Artificial
  CRISPR gRNA sequence
ttctctgaagtgttctgcct

SEQ ID NO: 529612 - DNA, 20 bp, Artificial
  CRISPR gRNA sequence
tctctgaagtgttctgcctt

SEQ ID NO: 529613 - DNA, 20 bp, Artificial
  CRISPR gRNA sequence
ctgaagtgttctgccttggg

SEQ ID NO: 529614 - DNA, 20 bp, Artificial
  CRISPR gRNA sequence
gtgttctgccttgggtggcc

SEQ ID NO: 529615 - DNA, 20 bp, Artificial
  CRISPR gRNA sequence
gggtggcctggatgctccct

SEQ ID NO: 529616 - DNA, 20 bp, Artificial
  CRISPR gRNA sequence
ggcctggatgctccctaagc

SEQ ID NO: 529617 - DNA, 20 bp, Artificial
  CRISPR gRNA sequence
taagccggctccccacttgc

SEQ ID NO: 529618 - DNA, 20 bp, Artificial
  CRISPR gRNA sequence
cataaccttttcattgctga

SEQ ID NO: 529619 - DNA, 20 bp, Artificial
  CRISPR gRNA sequence
tttcattgctgatagattgt

SEQ ID NO: 529620 - DNA, 20 bp, Artificial
  CRISPR gRNA sequence
attgctgatagattgtcaga

SEQ ID NO: 529621 - DNA, 20 bp, Artificial
  CRISPR gRNA sequence
ttgctgatagattgtcagac

SEQ ID NO: 529622 - DNA, 20 bp, Artificial
  CRISPR gRNA sequence
ttgtcagacaggcctgatct

SEQ ID NO: 529623 - DNA, 20 bp, Artificial
  CRISPR gRNA sequence
tgtcagacaggcctgatctg

SEQ ID NO: 529624 - DNA, 20 bp, Artificial
  CRISPR gRNA sequence
accctaacacatccctcgaa

SEQ ID NO: 529625 - DNA, 20 bp, Artificial
  CRISPR gRNA sequence
cctaacacatccctcgaaca

SEQ ID NO: 529626 - DNA, 20 bp, Artificial
  CRISPR gRNA sequence
acatccctcgaacagagaat

SEQ ID NO: 529627 - DNA, 20 bp, Artificial
  CRISPR gRNA sequence
cctcgaacagagaattagca

SEQ ID NO: 529628 - DNA, 20 bp, Artificial
  CRISPR gRNA sequence
ctcgaacagagaattagcaa

SEQ ID NO: 529629 - DNA, 20 bp, Artificial
  CRISPR gRNA sequence
tcgaacagagaattagcaaa

SEQ ID NO: 529630 - DNA, 20 bp, Artificial
  CRISPR gRNA sequence
cgaacagagaattagcaaag

SEQ ID NO: 529631 - DNA, 20 bp, Artificial
  CRISPR gRNA sequence
gaacagagaattagcaaagg

SEQ ID NO: 529632 - DNA, 20 bp, Artificial
  CRISPR gRNA sequence
gagaattagcaaagggggca

SEQ ID NO: 529633 - DNA, 20 bp, Artificial
  CRISPR gRNA sequence
agaattagcaaagggggcac

SEQ ID NO: 529634 - DNA, 20 bp, Artificial
  CRISPR gRNA sequence
ggggcacaggcaccctgctt

SEQ ID NO: 529635 - DNA, 20 bp, Artificial
  CRISPR gRNA sequence
acaggcaccctgctttagaa

SEQ ID NO: 529636 - DNA, 20 bp, Artificial
  CRISPR gRNA sequence
aatgattttccctgtgtttc

SEQ ID NO: 529637 - DNA, 20 bp, Artificial
  CRISPR gRNA sequence
atgattttccctgtgtttct

SEQ ID NO: 529638 - DNA, 20 bp, Artificial
  CRISPR gRNA sequence
gattttccctgtgtttctag

SEQ ID NO: 529639 - DNA, 20 bp, Artificial
  CRISPR gRNA sequence
tccctgtgtttctaggagct

SEQ ID NO: 529640 - DNA, 20 bp, Artificial
  CRISPR gRNA sequence
gcttggtcctgaactcacct

SEQ ID NO: 529641 - DNA, 20 bp, Artificial
  CRISPR gRNA sequence
cttggtcctgaactcacctt

SEQ ID NO: 529642 - DNA, 20 bp, Artificial
  CRISPR gRNA sequence
aactcaccttgggccaccca

SEQ ID NO: 529643 - DNA, 20 bp, Artificial
  CRISPR gRNA sequence
caccttgggccacccataga

SEQ ID NO: 529644 - DNA, 20 bp, Artificial
  CRISPR gRNA sequence
accttgggccacccatagat

SEQ ID NO: 529645 - DNA, 20 bp, Artificial
  CRISPR gRNA sequence
atagataggacatttattcc

SEQ ID NO: 529646 - DNA, 20 bp, Artificial
  CRISPR gRNA sequence
aggacatttattcctagaaa

SEQ ID NO: 529647 - DNA, 20 bp, Artificial
  CRISPR gRNA sequence
tattcctagaaacggtgttt

SEQ ID NO: 529648 - DNA, 20 bp, Artificial
  CRISPR gRNA sequence
ttcctagaaacggtgttttg

SEQ ID NO: 529649 - DNA, 20 bp, Artificial
  CRISPR gRNA sequence
agctaacctttctgcctatg

SEQ ID NO: 529650 - DNA, 20 bp, Artificial
  CRISPR gRNA sequence
ctaacctttctgcctatgta

SEQ ID NO: 529651 - DNA, 20 bp, Artificial
  CRISPR gRNA sequence
acctttctgcctatgtagag

SEQ ID NO: 529652 - DNA, 20 bp, Artificial
  CRISPR gRNA sequence
tctgcctatgtagagaagtg

SEQ ID NO: 529653 - DNA, 20 bp, Artificial
  CRISPR gRNA sequence
gagaagtgtggctcattcaa

SEQ ID NO: 529654 - DNA, 20 bp, Artificial
  CRISPR gRNA sequence
cattcaaaagatgttcacat

SEQ ID NO: 529655 - DNA, 20 bp, Artificial
  CRISPR gRNA sequence
gttcacattagcctgtcacc

SEQ ID NO: 529656 - DNA, 20 bp, Artificial
  CRISPR gRNA sequence
cacattagcctgtcaccaag

SEQ ID NO: 529657 - DNA, 20 bp, Artificial
  CRISPR gRNA sequence
acattagcctgtcaccaagt

SEQ ID NO: 529658 - DNA, 20 bp, Artificial
  CRISPR gRNA sequence
gcctgtcaccaagtaggcct

SEQ ID NO: 529659 - DNA, 20 bp, Artificial
  CRISPR gRNA sequence
tgtcaccaagtaggcctcag

SEQ ID NO: 529660 - DNA, 20 bp, Artificial
  CRISPR gRNA sequence
caccaagtaggcctcagtgg

SEQ ID NO: 529661 - DNA, 20 bp, Artificial
  CRISPR gRNA sequence
cctcagtggtggattccaat

SEQ ID NO: 529662 - DNA, 20 bp, Artificial
  CRISPR gRNA sequence
ctcagtggtggattccaatg

SEQ ID NO: 529663 - DNA, 20 bp, Artificial
  CRISPR gRNA sequence
tggattccaatgaggccaac

SEQ ID NO: 529664 - DNA, 20 bp, Artificial
  CRISPR gRNA sequence
ccaatgaggccaactggatt

SEQ ID NO: 529665 - DNA, 20 bp, Artificial
  CRISPR gRNA sequence
caactggattcagtgtctca

SEQ ID NO: 529666 - DNA, 20 bp, Artificial
  CRISPR gRNA sequence
gctcccacattgtcaccact

SEQ ID NO: 529667 - DNA, 20 bp, Artificial
  CRISPR gRNA sequence
gaatttgtttttcaaaaatc

SEQ ID NO: 529668 - DNA, 20 bp, Artificial
  CRISPR gRNA sequence
agctaaccacaaaatgaaac

SEQ ID NO: 529669 - DNA, 20 bp, Artificial
  CRISPR gRNA sequence
tatttccatcattttctctg

SEQ ID NO: 529670 - DNA, 20 bp, Artificial
  CRISPR gRNA sequence
atcattttctctgcagattc

SEQ ID NO: 529671 - DNA, 20 bp, Artificial
  CRISPR gRNA sequence
tcattttctctgcagattca

SEQ ID NO: 529672 - DNA, 20 bp, Artificial
  CRISPR gRNA sequence
attcaaggtgtcatccccat

SEQ ID NO: 529673 - DNA, 20 bp, Artificial
  CRISPR gRNA sequence
catccccatgagctgtttca

SEQ ID NO: 529674 - DNA, 20 bp, Artificial
  CRISPR gRNA sequence
atccccatgagctgtttcat

SEQ ID NO: 529675 - DNA, 20 bp, Artificial
  CRISPR gRNA sequence
tccccatgagctgtttcatg

SEQ ID NO: 529676 - DNA, 20 bp, Artificial
  CRISPR gRNA sequence
ctgtttcatggggattttgc

SEQ ID NO: 529677 - DNA, 20 bp, Artificial
  CRISPR gRNA sequence
tgtttcatggggattttgct

SEQ ID NO: 529678 - DNA, 20 bp, Artificial
  CRISPR gRNA sequence
gtttcatggggattttgctg

SEQ ID NO: 529679 - DNA, 20 bp, Artificial
  CRISPR gRNA sequence
ggggattttgctggggcctg

SEQ ID NO: 529680 - DNA, 20 bp, Artificial
  CRISPR gRNA sequence
gattttgctggggcctgcgg

SEQ ID NO: 529681 - DNA, 20 bp, Artificial
  CRISPR gRNA sequence
attttgctggggcctgcggt

SEQ ID NO: 529682 - DNA, 20 bp, Artificial
  CRISPR gRNA sequence
tggggcctgcggtgggacaa

SEQ ID NO: 529683 - DNA, 20 bp, Artificial
  CRISPR gRNA sequence
gggcctgcggtgggacaaaa

SEQ ID NO: 529684 - DNA, 20 bp, Artificial
  CRISPR gRNA sequence
ggcctgcggtgggacaaaag

SEQ ID NO: 529685 - DNA, 20 bp, Artificial
  CRISPR gRNA sequence
gcctgcggtgggacaaaaga

SEQ ID NO: 529686 - DNA, 20 bp, Artificial
  CRISPR gRNA sequence
cctgcggtgggacaaaagag

SEQ ID NO: 529687 - DNA, 20 bp, Artificial
  CRISPR gRNA sequence
ctgcggtgggacaaaagagg

SEQ ID NO: 529688 - DNA, 20 bp, Artificial
  CRISPR gRNA sequence
gcggtgggacaaaagagggg

SEQ ID NO: 529689 - DNA, 20 bp, Artificial
  CRISPR gRNA sequence
actcctctgttttttccttt

SEQ ID NO: 529690 - DNA, 20 bp, Artificial
  CRISPR gRNA sequence
gttttttccttttggtgata

SEQ ID NO: 529691 - DNA, 20 bp, Artificial
  CRISPR gRNA sequence
cttttggtgatatagaaaac

SEQ ID NO: 529692 - DNA, 20 bp, Artificial
  CRISPR gRNA sequence
ttggtgatatagaaaacgag

SEQ ID NO: 529693 - DNA, 20 bp, Artificial
  CRISPR gRNA sequence
agaaaacgagcagtgccaca

SEQ ID NO: 529694 - DNA, 20 bp, Artificial
  CRISPR gRNA sequence
gcagtgccacaaagaccatc

SEQ ID NO: 529695 - DNA, 20 bp, Artificial
  CRISPR gRNA sequence
agtgccacaaagaccatcaa

SEQ ID NO: 529696 - DNA, 20 bp, Artificial
  CRISPR gRNA sequence
gtgccacaaagaccatcaag

SEQ ID NO: 529697 - DNA, 20 bp, Artificial
  CRISPR gRNA sequence
cctccacatatgccaatgat

SEQ ID NO: 529698 - DNA, 20 bp, Artificial
  CRISPR gRNA sequence
cacatatgccaatgatgaga

SEQ ID NO: 529699 - DNA, 20 bp, Artificial
  CRISPR gRNA sequence
ccaatgatgagatagatgtc

SEQ ID NO: 529700 - DNA, 20 bp, Artificial
  CRISPR gRNA sequence
gtccagacctttctctgcaa

SEQ ID NO: 529701 - DNA, 20 bp, Artificial
  CRISPR gRNA sequence
tccagacctttctctgcaaa

SEQ ID NO: 529702 - DNA, 20 bp, Artificial
  CRISPR gRNA sequence
agacctttctctgcaaaagg

SEQ ID NO: 529703 - DNA, 20 bp, Artificial
  CRISPR gRNA sequence
acctttctctgcaaaaggaa

SEQ ID NO: 529704 - DNA, 20 bp, Artificial
  CRISPR gRNA sequence
tttctctgcaaaaggaagag

SEQ ID NO: 529705 - DNA, 20 bp, Artificial
  CRISPR gRNA sequence
ctctgcaaaaggaagagaag

SEQ ID NO: 529706 - DNA, 20 bp, Artificial
  CRISPR gRNA sequence
tctgcaaaaggaagagaagt

SEQ ID NO: 529707 - DNA, 20 bp, Artificial
  CRISPR gRNA sequence
caaaaggaagagaagtggga

SEQ ID NO: 529708 - DNA, 20 bp, Artificial
  CRISPR gRNA sequence
aggaagagaagtgggatggc

SEQ ID NO: 529709 - DNA, 20 bp, Artificial
  CRISPR gRNA sequence
ggaagagaagtgggatggct

SEQ ID NO: 529710 - DNA, 20 bp, Artificial
  CRISPR gRNA sequence
aagagaagtgggatggctgg

SEQ ID NO: 529711 - DNA, 20 bp, Artificial
  CRISPR gRNA sequence
agagaagtgggatggctggg

SEQ ID NO: 529712 - DNA, 20 bp, Artificial
  CRISPR gRNA sequence
gagaagtgggatggctggga

SEQ ID NO: 529713 - DNA, 20 bp, Artificial
  CRISPR gRNA sequence
agaagtgggatggctgggag

SEQ ID NO: 529714 - DNA, 20 bp, Artificial
  CRISPR gRNA sequence
tgggatggctgggaggggtc

SEQ ID NO: 529715 - DNA, 20 bp, Artificial
  CRISPR gRNA sequence
gggatggctgggaggggtcc

SEQ ID NO: 529716 - DNA, 20 bp, Artificial
  CRISPR gRNA sequence
atggctgggaggggtccagg

SEQ ID NO: 529717 - DNA, 20 bp, Artificial
  CRISPR gRNA sequence
ggctgggaggggtccaggca

SEQ ID NO: 529718 - DNA, 20 bp, Artificial
  CRISPR gRNA sequence
ctgggaggggtccaggcaga

SEQ ID NO: 529719 - DNA, 20 bp, Artificial
  CRISPR gRNA sequence
aggcagagagcccattactc

SEQ ID NO: 529720 - DNA, 20 bp, Artificial
  CRISPR gRNA sequence
gagagcccattactctggcc

SEQ ID NO: 529721 - DNA, 20 bp, Artificial
  CRISPR gRNA sequence
agagcccattactctggcca

SEQ ID NO: 529722 - DNA, 20 bp, Artificial
  CRISPR gRNA sequence
aggatgctgcctcctgcatc

SEQ ID NO: 529723 - DNA, 20 bp, Artificial
  CRISPR gRNA sequence
atgctgcctcctgcatcaag

SEQ ID NO: 529724 - DNA, 20 bp, Artificial
  CRISPR gRNA sequence
tgcctcctgcatcaagcaga

SEQ ID NO: 529725 - DNA, 20 bp, Artificial
  CRISPR gRNA sequence
ctcctgcatcaagcagatag

SEQ ID NO: 529726 - DNA, 20 bp, Artificial
  CRISPR gRNA sequence
cctgcatcaagcagatagaa

SEQ ID NO: 529727 - DNA, 20 bp, Artificial
  CRISPR gRNA sequence
aagcagatagaagagcttgt

SEQ ID NO: 529728 - DNA, 20 bp, Artificial
  CRISPR gRNA sequence
agcagatagaagagcttgtt

SEQ ID NO: 529729 - DNA, 20 bp, Artificial
  CRISPR gRNA sequence
acctttcaccccataactcc

SEQ ID NO: 529730 - DNA, 20 bp, Artificial
  CRISPR gRNA sequence
cctttcaccccataactccc

SEQ ID NO: 529731 - DNA, 20 bp, Artificial
  CRISPR gRNA sequence
ccccataactcccaggctca

SEQ ID NO: 529732 - DNA, 20 bp, Artificial
  CRISPR gRNA sequence
ccataactcccaggctcaca

SEQ ID NO: 529733 - DNA, 20 bp, Artificial
  CRISPR gRNA sequence
cataactcccaggctcacag

SEQ ID NO: 529734 - DNA, 20 bp, Artificial
  CRISPR gRNA sequence
ataactcccaggctcacaga

SEQ ID NO: 529735 - DNA, 20 bp, Artificial
  CRISPR gRNA sequence
actcccaggctcacagaggg

SEQ ID NO: 529736 - DNA, 20 bp, Artificial
  CRISPR gRNA sequence
ccaggctcacagagggtggt

SEQ ID NO: 529737 - DNA, 20 bp, Artificial
  CRISPR gRNA sequence
ggctcacagagggtggtgag

SEQ ID NO: 529738 - DNA, 20 bp, Artificial
  CRISPR gRNA sequence
gtggtgagtggtgtcaaccc

SEQ ID NO: 529739 - DNA, 20 bp, Artificial
  CRISPR gRNA sequence
gtgagtggtgtcaaccctgg

SEQ ID NO: 529740 - DNA, 20 bp, Artificial
  CRISPR gRNA sequence
tgagtggtgtcaaccctgga

SEQ ID NO: 529741 - DNA, 20 bp, Artificial
  CRISPR gRNA sequence
tgtcaaccctggaaggaccc

SEQ ID NO: 529742 - DNA, 20 bp, Artificial
  CRISPR gRNA sequence
gtcaaccctggaaggaccca

SEQ ID NO: 529743 - DNA, 20 bp, Artificial
  CRISPR gRNA sequence
ctggaaggacccaaggtcct

SEQ ID NO: 529744 - DNA, 20 bp, Artificial
  CRISPR gRNA sequence
tggaaggacccaaggtcctt

SEQ ID NO: 529745 - DNA, 20 bp, Artificial
  CRISPR gRNA sequence
aaggacccaaggtccttggg

SEQ ID NO: 529746 - DNA, 20 bp, Artificial
  CRISPR gRNA sequence
tccttgggaagctccctctg

SEQ ID NO: 529747 - DNA, 20 bp, Artificial
  CRISPR gRNA sequence
ccttgggaagctccctctgc

SEQ ID NO: 529748 - DNA, 20 bp, Artificial
  CRISPR gRNA sequence
agctccctctgcaggctctt

SEQ ID NO: 529749 - DNA, 20 bp, Artificial
  CRISPR gRNA sequence
gctccctctgcaggctcttt

SEQ ID NO: 529750 - DNA, 20 bp, Artificial
  CRISPR gRNA sequence
gctctttgggaaactgctct

SEQ ID NO: 529751 - DNA, 20 bp, Artificial
  CRISPR gRNA sequence
ctctttgggaaactgctctc

SEQ ID NO: 529752 - DNA, 20 bp, Artificial
  CRISPR gRNA sequence
tctttgggaaactgctctca

SEQ ID NO: 529753 - DNA, 20 bp, Artificial
  CRISPR gRNA sequence
ctttgggaaactgctctcag

SEQ ID NO: 529754 - DNA, 20 bp, Artificial
  CRISPR gRNA sequence
gggaaactgctctcaggggc

SEQ ID NO: 529755 - DNA, 20 bp, Artificial
  CRISPR gRNA sequence
tgcctgattgttcatgcacc

SEQ ID NO: 529756 - DNA, 20 bp, Artificial
  CRISPR gRNA sequence
gcctgattgttcatgcacca

SEQ ID NO: 529757 - DNA, 20 bp, Artificial
  CRISPR gRNA sequence
gattgttcatgcaccaaggc

SEQ ID NO: 529758 - DNA, 20 bp, Artificial
  CRISPR gRNA sequence
cctgcccactgcccccgtca

SEQ ID NO: 529759 - DNA, 20 bp, Artificial
  CRISPR gRNA sequence
cccactgcccccgtcatgga

SEQ ID NO: 529760 - DNA, 20 bp, Artificial
  CRISPR gRNA sequence
tggaaagcatcacgaaattt

SEQ ID NO: 529761 - DNA, 20 bp, Artificial
  CRISPR gRNA sequence
catcacgaaattttagatcc

SEQ ID NO: 529762 - DNA, 20 bp, Artificial
  CRISPR gRNA sequence
atcacgaaattttagatccg

SEQ ID NO: 529763 - DNA, 20 bp, Artificial
  CRISPR gRNA sequence
aattttagatccgaggatct

SEQ ID NO: 529764 - DNA, 20 bp, Artificial
  CRISPR gRNA sequence
ttttagatccgaggatctta

SEQ ID NO: 529765 - DNA, 20 bp, Artificial
  CRISPR gRNA sequence
gatactctaaatgcaacctc

SEQ ID NO: 529766 - DNA, 20 bp, Artificial
  CRISPR gRNA sequence
caacctctagcttcaaacat

SEQ ID NO: 529767 - DNA, 20 bp, Artificial
  CRISPR gRNA sequence
aacctctagcttcaaacatg

SEQ ID NO: 529768 - DNA, 20 bp, Artificial
  CRISPR gRNA sequence
agcttcaaacatgaggccct

SEQ ID NO: 529769 - DNA, 20 bp, Artificial
  CRISPR gRNA sequence
cttcaaacatgaggccctga

SEQ ID NO: 529770 - DNA, 20 bp, Artificial
  CRISPR gRNA sequence
ttcaaacatgaggccctgag

SEQ ID NO: 529771 - DNA, 20 bp, Artificial
  CRISPR gRNA sequence
tcaaacatgaggccctgaga

SEQ ID NO: 529772 - DNA, 20 bp, Artificial
  CRISPR gRNA sequence
aaacatgaggccctgagagg

SEQ ID NO: 529773 - DNA, 20 bp, Artificial
  CRISPR gRNA sequence
gaggccctgagagggagaat

SEQ ID NO: 529774 - DNA, 20 bp, Artificial
  CRISPR gRNA sequence
gagggagaatgagttgcccg

SEQ ID NO: 529775 - DNA, 20 bp, Artificial
  CRISPR gRNA sequence
gccacacaatatctgttcct

SEQ ID NO: 529776 - DNA, 20 bp, Artificial
  CRISPR gRNA sequence
tgttcctgagcatttccctt

SEQ ID NO: 529777 - DNA, 20 bp, Artificial
  CRISPR gRNA sequence
tcctgagcatttcccttaag

SEQ ID NO: 529778 - DNA, 20 bp, Artificial
  CRISPR gRNA sequence
ccttaagcagccccttgtct

SEQ ID NO: 529779 - DNA, 20 bp, Artificial
  CRISPR gRNA sequence
gttgatcctgctctcgtctc

SEQ ID NO: 529780 - DNA, 20 bp, Artificial
  CRISPR gRNA sequence
ttccttctcactgtctctac

SEQ ID NO: 529781 - DNA, 20 bp, Artificial
  CRISPR gRNA sequence
tccttctcactgtctctacc

SEQ ID NO: 529782 - DNA, 20 bp, Artificial
  CRISPR gRNA sequence
ttctcactgtctctaccagg

SEQ ID NO: 529783 - DNA, 20 bp, Artificial
  CRISPR gRNA sequence
ccaggcagtttccaaacact

SEQ ID NO: 529784 - DNA, 20 bp, Artificial
  CRISPR gRNA sequence
caggcagtttccaaacactc

SEQ ID NO: 529785 - DNA, 20 bp, Artificial
  CRISPR gRNA sequence
aggcagtttccaaacactca

SEQ ID NO: 529786 - DNA, 20 bp, Artificial
  CRISPR gRNA sequence
gggtaaatatttcacttgtc

SEQ ID NO: 529787 - DNA, 20 bp, Artificial
  CRISPR gRNA sequence
aatatttcacttgtccagcc

SEQ ID NO: 529788 - DNA, 20 bp, Artificial
  CRISPR gRNA sequence
agcccagcactctgacctca

SEQ ID NO: 529789 - DNA, 20 bp, Artificial
  CRISPR gRNA sequence
cagcactctgacctcacggc

SEQ ID NO: 529790 - DNA, 20 bp, Artificial
  CRISPR gRNA sequence
tcacggccagcaccctctca

SEQ ID NO: 529791 - DNA, 20 bp, Artificial
  CRISPR gRNA sequence
acggccagcaccctctcaca

SEQ ID NO: 529792 - DNA, 20 bp, Artificial
  CRISPR gRNA sequence
accctctcacagagtttccc

SEQ ID NO: 529793 - DNA, 20 bp, Artificial
  CRISPR gRNA sequence
cctctcacagagtttccctg

SEQ ID NO: 529794 - DNA, 20 bp, Artificial
  CRISPR gRNA sequence
cagagtttccctggagccac

SEQ ID NO: 529795 - DNA, 20 bp, Artificial
  CRISPR gRNA sequence
gagtttccctggagccacga

SEQ ID NO: 529796 - DNA, 20 bp, Artificial
  CRISPR gRNA sequence
ctggagccacgagagaaacc

SEQ ID NO: 529797 - DNA, 20 bp, Artificial
  CRISPR gRNA sequence
tggagccacgagagaaaccc

SEQ ID NO: 529798 - DNA, 20 bp, Artificial
  CRISPR gRNA sequence
acgagagaaacccgggtgca

SEQ ID NO: 529799 - DNA, 20 bp, Artificial
  CRISPR gRNA sequence
aacccgggtgcacagtgcgt

SEQ ID NO: 529800 - DNA, 20 bp, Artificial
  CRISPR gRNA sequence
ggtgcacagtgcgttagtaa

SEQ ID NO: 529801 - DNA, 20 bp, Artificial
  CRISPR gRNA sequence
gcacagtgcgttagtaacag

SEQ ID NO: 529802 - DNA, 20 bp, Artificial
  CRISPR gRNA sequence
cagtgcgttagtaacagcag

SEQ ID NO: 529803 - DNA, 20 bp, Artificial
  CRISPR gRNA sequence
agtgcgttagtaacagcagt

SEQ ID NO: 529804 - DNA, 20 bp, Artificial
  CRISPR gRNA sequence
gttagtaacagcagtgggct

SEQ ID NO: 529805 - DNA, 20 bp, Artificial
  CRISPR gRNA sequence
acagcagtgggcttagtctt

SEQ ID NO: 529806 - DNA, 20 bp, Artificial
  CRISPR gRNA sequence
tgggcttagtcttcagttgc

SEQ ID NO: 529807 - DNA, 20 bp, Artificial
  CRISPR gRNA sequence
gtcttcagttgctggacctt

SEQ ID NO: 529808 - DNA, 20 bp, Artificial
  CRISPR gRNA sequence
ttcagtcactgtaatgcaat

SEQ ID NO: 529809 - DNA, 20 bp, Artificial
  CRISPR gRNA sequence
tcagtcactgtaatgcaatg

SEQ ID NO: 529810 - DNA, 20 bp, Artificial
  CRISPR gRNA sequence
ctgtaatgcaatgaggaaaa

SEQ ID NO: 529811 - DNA, 20 bp, Artificial
  CRISPR gRNA sequence
aatgaggaaaacagtgactt

SEQ ID NO: 529812 - DNA, 20 bp, Artificial
  CRISPR gRNA sequence
aaaacagtgactttggtgtt

SEQ ID NO: 529813 - DNA, 20 bp, Artificial
  CRISPR gRNA sequence
aaacagtgactttggtgtta

SEQ ID NO: 529814 - DNA, 20 bp, Artificial
  CRISPR gRNA sequence
aacagtgactttggtgttaa

SEQ ID NO: 529815 - DNA, 20 bp, Artificial
  CRISPR gRNA sequence
gactttggtgttaagggaaa

SEQ ID NO: 529816 - DNA, 20 bp, Artificial
  CRISPR gRNA sequence
actttggtgttaagggaaat

SEQ ID NO: 529817 - DNA, 20 bp, Artificial
  CRISPR gRNA sequence
ggtgttaagggaaatgggtt

SEQ ID NO: 529818 - DNA, 20 bp, Artificial
  CRISPR gRNA sequence
taagggaaatgggtttggtc

SEQ ID NO: 529819 - DNA, 20 bp, Artificial
  CRISPR gRNA sequence
aagggaaatgggtttggtct

SEQ ID NO: 529820 - DNA, 20 bp, Artificial
  CRISPR gRNA sequence
gggtttggtctaggcttttt

SEQ ID NO: 529821 - DNA, 20 bp, Artificial
  CRISPR gRNA sequence
ggtttggtctaggctttttt

SEQ ID NO: 529822 - DNA, 20 bp, Artificial
  CRISPR gRNA sequence
ttggtctaggcttttttagg

SEQ ID NO: 529823 - DNA, 20 bp, Artificial
  CRISPR gRNA sequence
tggtctaggcttttttaggc

SEQ ID NO: 529824 - DNA, 20 bp, Artificial
  CRISPR gRNA sequence
gtctaggcttttttaggcag

SEQ ID NO: 529825 - DNA, 20 bp, Artificial
  CRISPR gRNA sequence
ggcaggagctgtgtgaactt

SEQ ID NO: 529826 - DNA, 20 bp, Artificial
  CRISPR gRNA sequence
caggagctgtgtgaactttg

SEQ ID NO: 529827 - DNA, 20 bp, Artificial
  CRISPR gRNA sequence
ggagctgtgtgaactttgga

SEQ ID NO: 529828 - DNA, 20 bp, Artificial
  CRISPR gRNA sequence
gagagttacttcacctctct

SEQ ID NO: 529829 - DNA, 20 bp, Artificial
  CRISPR gRNA sequence
agcctgtttccttctttgta

SEQ ID NO: 529830 - DNA, 20 bp, Artificial
  CRISPR gRNA sequence
ctgtttccttctttgtaaag

SEQ ID NO: 529831 - DNA, 20 bp, Artificial
  CRISPR gRNA sequence
gtttccttctttgtaaagtg

SEQ ID NO: 529832 - DNA, 20 bp, Artificial
  CRISPR gRNA sequence
agataatgaaacctacatca

SEQ ID NO: 529833 - DNA, 20 bp, Artificial
  CRISPR gRNA sequence
gataatgaaacctacatcat

SEQ ID NO: 529834 - DNA, 20 bp, Artificial
  CRISPR gRNA sequence
ataatgaaacctacatcata

SEQ ID NO: 529835 - DNA, 20 bp, Artificial
  CRISPR gRNA sequence
atgaaacctacatcataggg

SEQ ID NO: 529836 - DNA, 20 bp, Artificial
  CRISPR gRNA sequence
ctacatcatagggtggctgt

SEQ ID NO: 529837 - DNA, 20 bp, Artificial
  CRISPR gRNA sequence
catcatagggtggctgttgg

SEQ ID NO: 529838 - DNA, 20 bp, Artificial
  CRISPR gRNA sequence
ggtggctgttggaagtcaat

SEQ ID NO: 529839 - DNA, 20 bp, Artificial
  CRISPR gRNA sequence
gttggaagtcaatcagataa

SEQ ID NO: 529840 - DNA, 20 bp, Artificial
  CRISPR gRNA sequence
caatcagataatggatatga

SEQ ID NO: 529841 - DNA, 20 bp, Artificial
  CRISPR gRNA sequence
ctgtaaaacaacacaaatgt

SEQ ID NO: 529842 - DNA, 20 bp, Artificial
  CRISPR gRNA sequence
tgtaaaacaacacaaatgtg

SEQ ID NO: 529843 - DNA, 20 bp, Artificial
  CRISPR gRNA sequence
atgtgaggtcttgctcttac

SEQ ID NO: 529844 - DNA, 20 bp, Artificial
  CRISPR gRNA sequence
tcttactagtgttctcgcac

SEQ ID NO: 529845 - DNA, 20 bp, Artificial
  CRISPR gRNA sequence
tgttctcgcactggtgtttc

SEQ ID NO: 529846 - DNA, 20 bp, Artificial
  CRISPR gRNA sequence
gttctcgcactggtgtttct

SEQ ID NO: 529847 - DNA, 20 bp, Artificial
  CRISPR gRNA sequence
tctcgcactggtgtttctgg

SEQ ID NO: 529848 - DNA, 20 bp, Artificial
  CRISPR gRNA sequence
tgtttctgggagctgtttcc

SEQ ID NO: 529849 - DNA, 20 bp, Artificial
  CRISPR gRNA sequence
tgggagctgtttcccagcaa

SEQ ID NO: 529850 - DNA, 20 bp, Artificial
  CRISPR gRNA sequence
gggagctgtttcccagcaac

SEQ ID NO: 529851 - DNA, 20 bp, Artificial
  CRISPR gRNA sequence
ggagctgtttcccagcaaca

SEQ ID NO: 529852 - DNA, 20 bp, Artificial
  CRISPR gRNA sequence
gagctgtttcccagcaacag

SEQ ID NO: 529853 - DNA, 20 bp, Artificial
  CRISPR gRNA sequence
tttcccagcaacaggggaaa

SEQ ID NO: 529854 - DNA, 20 bp, Artificial
  CRISPR gRNA sequence
ttcccagcaacaggggaaac

SEQ ID NO: 529855 - DNA, 20 bp, Artificial
  CRISPR gRNA sequence
cccagcaacaggggaaacag

SEQ ID NO: 529856 - DNA, 20 bp, Artificial
  CRISPR gRNA sequence
ccagcaacaggggaaacagg

SEQ ID NO: 529857 - DNA, 20 bp, Artificial
  CRISPR gRNA sequence
cagcaacaggggaaacagga

SEQ ID NO: 529858 - DNA, 20 bp, Artificial
  CRISPR gRNA sequence
agcaacaggggaaacaggag

SEQ ID NO: 529859 - DNA, 20 bp, Artificial
  CRISPR gRNA sequence
aggggaaacaggaggggttc

SEQ ID NO: 529860 - DNA, 20 bp, Artificial
  CRISPR gRNA sequence
ggggaaacaggaggggttct

SEQ ID NO: 529861 - DNA, 20 bp, Artificial
  CRISPR gRNA sequence
gggaaacaggaggggttcta

SEQ ID NO: 529862 - DNA, 20 bp, Artificial
  CRISPR gRNA sequence
tagggctgtctgccctttgt

SEQ ID NO: 529863 - DNA, 20 bp, Artificial
  CRISPR gRNA sequence
gtctgccctttgtgagtcaa

SEQ ID NO: 529864 - DNA, 20 bp, Artificial
  CRISPR gRNA sequence
tgccctttgtgagtcaatag

SEQ ID NO: 529865 - DNA, 20 bp, Artificial
  CRISPR gRNA sequence
ctttgtgagtcaatagcagt

SEQ ID NO: 529866 - DNA, 20 bp, Artificial
  CRISPR gRNA sequence
tgagtcaatagcagttagaa

SEQ ID NO: 529867 - DNA, 20 bp, Artificial
  CRISPR gRNA sequence
gtcaatagcagttagaaaag

SEQ ID NO: 529868 - DNA, 20 bp, Artificial
  CRISPR gRNA sequence
aatagcagttagaaaagcag

SEQ ID NO: 529869 - DNA, 20 bp, Artificial
  CRISPR gRNA sequence
agcagttagaaaagcagcag

SEQ ID NO: 529870 - DNA, 20 bp, Artificial
  CRISPR gRNA sequence
gcagttagaaaagcagcagt

SEQ ID NO: 529871 - DNA, 20 bp, Artificial
  CRISPR gRNA sequence
cagttagaaaagcagcagtg

SEQ ID NO: 529872 - DNA, 20 bp, Artificial
  CRISPR gRNA sequence
agaaaagcagcagtggggct

SEQ ID NO: 529873 - DNA, 20 bp, Artificial
  CRISPR gRNA sequence
gaaaagcagcagtggggctc

SEQ ID NO: 529874 - DNA, 20 bp, Artificial
  CRISPR gRNA sequence
agcagcagtggggctcgggt

SEQ ID NO: 529875 - DNA, 20 bp, Artificial
  CRISPR gRNA sequence
gcagcagtggggctcgggtc

SEQ ID NO: 529876 - DNA, 20 bp, Artificial
  CRISPR gRNA sequence
cagcagtggggctcgggtca

SEQ ID NO: 529877 - DNA, 20 bp, Artificial
  CRISPR gRNA sequence
agcagtggggctcgggtcag

SEQ ID NO: 529878 - DNA, 20 bp, Artificial
  CRISPR gRNA sequence
gtggggctcgggtcagggga

SEQ ID NO: 529879 - DNA, 20 bp, Artificial
  CRISPR gRNA sequence
tggggctcgggtcaggggac

SEQ ID NO: 529880 - DNA, 20 bp, Artificial
  CRISPR gRNA sequence
ggggctcgggtcaggggacg

SEQ ID NO: 529881 - DNA, 20 bp, Artificial
  CRISPR gRNA sequence
tcaggggacggggtcatctg

SEQ ID NO: 529882 - DNA, 20 bp, Artificial
  CRISPR gRNA sequence
gggtcatctgaagaacaaac

SEQ ID NO: 529883 - DNA, 20 bp, Artificial
  CRISPR gRNA sequence
ctgaagaacaaactggaact

SEQ ID NO: 529884 - DNA, 20 bp, Artificial
  CRISPR gRNA sequence
gaacaaactggaacttggcc

SEQ ID NO: 529885 - DNA, 20 bp, Artificial
  CRISPR gRNA sequence
aacttggcccagcatcacaa

SEQ ID NO: 529886 - DNA, 20 bp, Artificial
  CRISPR gRNA sequence
tcacaaaagaaatgcttctc

SEQ ID NO: 529887 - DNA, 20 bp, Artificial
  CRISPR gRNA sequence
cacaaaagaaatgcttctcc

SEQ ID NO: 529888 - DNA, 20 bp, Artificial
  CRISPR gRNA sequence
ttctccaggcaaaaacatac

SEQ ID NO: 529889 - DNA, 20 bp, Artificial
  CRISPR gRNA sequence
tctccaggcaaaaacatacc

SEQ ID NO: 529890 - DNA, 20 bp, Artificial
  CRISPR gRNA sequence
ctccaggcaaaaacatacca

SEQ ID NO: 529891 - DNA, 20 bp, Artificial
  CRISPR gRNA sequence
ccaggcaaaaacataccagg

SEQ ID NO: 529892 - DNA, 20 bp, Artificial
  CRISPR gRNA sequence
gggagacactgttatacatg

SEQ ID NO: 529893 - DNA, 20 bp, Artificial
  CRISPR gRNA sequence
acactgttatacatgaagcc

SEQ ID NO: 529894 - DNA, 20 bp, Artificial
  CRISPR gRNA sequence
cactgttatacatgaagccc

SEQ ID NO: 529895 - DNA, 20 bp, Artificial
  CRISPR gRNA sequence
gttatacatgaagcccagga

SEQ ID NO: 529896 - DNA, 20 bp, Artificial
  CRISPR gRNA sequence
ttatacatgaagcccaggat

SEQ ID NO: 529897 - DNA, 20 bp, Artificial
  CRISPR gRNA sequence
tgaagcccaggatgggcccc

SEQ ID NO: 529898 - DNA, 20 bp, Artificial
  CRISPR gRNA sequence
gaagcccaggatgggcccca

SEQ ID NO: 529899 - DNA, 20 bp, Artificial
  CRISPR gRNA sequence
agcccaggatgggccccaag

SEQ ID NO: 529900 - DNA, 20 bp, Artificial
  CRISPR gRNA sequence
cccaggatgggccccaagga

SEQ ID NO: 529901 - DNA, 20 bp, Artificial
  CRISPR gRNA sequence
ccaggatgggccccaaggag

SEQ ID NO: 529902 - DNA, 20 bp, Artificial
  CRISPR gRNA sequence
caggatgggccccaaggaga

SEQ ID NO: 529903 - DNA, 20 bp, Artificial
  CRISPR gRNA sequence
atgggccccaaggagagggt

SEQ ID NO: 529904 - DNA, 20 bp, Artificial
  CRISPR gRNA sequence
gggccccaaggagagggtca

SEQ ID NO: 529905 - DNA, 20 bp, Artificial
  CRISPR gRNA sequence
ggccccaaggagagggtcag

SEQ ID NO: 529906 - DNA, 20 bp, Artificial
  CRISPR gRNA sequence
caaggagagggtcagaggct

SEQ ID NO: 529907 - DNA, 20 bp, Artificial
  CRISPR gRNA sequence
gggtcagaggctcagaaacc

SEQ ID NO: 529908 - DNA, 20 bp, Artificial
  CRISPR gRNA sequence
ggctcagaaaccaagtttaa

SEQ ID NO: 529909 - DNA, 20 bp, Artificial
  CRISPR gRNA sequence
tttaacagatcatcaaactg

SEQ ID NO: 529910 - DNA, 20 bp, Artificial
  CRISPR gRNA sequence
aacagatcatcaaactgtgg

SEQ ID NO: 529911 - DNA, 20 bp, Artificial
  CRISPR gRNA sequence
ctgtggtggtttattcatct

SEQ ID NO: 529912 - DNA, 20 bp, Artificial
  CRISPR gRNA sequence
catcttggctttctttcctc

SEQ ID NO: 529913 - DNA, 20 bp, Artificial
  CRISPR gRNA sequence
ctgacccattctttgcctgc

SEQ ID NO: 529914 - DNA, 20 bp, Artificial
  CRISPR gRNA sequence
tgccagttacacaactctct

SEQ ID NO: 529915 - DNA, 20 bp, Artificial
  CRISPR gRNA sequence
ctctctaagctctactgatg

SEQ ID NO: 529916 - DNA, 20 bp, Artificial
  CRISPR gRNA sequence
ctctaagctctactgatgaa

SEQ ID NO: 529917 - DNA, 20 bp, Artificial
  CRISPR gRNA sequence
tctaagctctactgatgaag

SEQ ID NO: 529918 - DNA, 20 bp, Artificial
  CRISPR gRNA sequence
actgatgaagaggcctccac

SEQ ID NO: 529919 - DNA, 20 bp, Artificial
  CRISPR gRNA sequence
tgatgaagaggcctccacca

SEQ ID NO: 529920 - DNA, 20 bp, Artificial
  CRISPR gRNA sequence
tgaagaggcctccaccagag

SEQ ID NO: 529921 - DNA, 20 bp, Artificial
  CRISPR gRNA sequence
agaggcctccaccagagaag

SEQ ID NO: 529922 - DNA, 20 bp, Artificial
  CRISPR gRNA sequence
taatcttaaaccattgaaat

SEQ ID NO: 529923 - DNA, 20 bp, Artificial
  CRISPR gRNA sequence
aatcttaaaccattgaaatt

SEQ ID NO: 529924 - DNA, 20 bp, Artificial
  CRISPR gRNA sequence
ttaaaccattgaaattgggt

SEQ ID NO: 529925 - DNA, 20 bp, Artificial
  CRISPR gRNA sequence
ccattgaaattgggtcagta

SEQ ID NO: 529926 - DNA, 20 bp, Artificial
  CRISPR gRNA sequence
cattgaaattgggtcagtaa

SEQ ID NO: 529927 - DNA, 20 bp, Artificial
  CRISPR gRNA sequence
aattgggtcagtaaaggatt

SEQ ID NO: 529928 - DNA, 20 bp, Artificial
  CRISPR gRNA sequence
attgggtcagtaaaggattc

SEQ ID NO: 529929 - DNA, 20 bp, Artificial
  CRISPR gRNA sequence
ttgggtcagtaaaggattca

SEQ ID NO: 529930 - DNA, 20 bp, Artificial
  CRISPR gRNA sequence
gtaaaggattcagggccctt

SEQ ID NO: 529931 - DNA, 20 bp, Artificial
  CRISPR gRNA sequence
taaaggattcagggcccttt

SEQ ID NO: 529932 - DNA, 20 bp, Artificial
  CRISPR gRNA sequence
cagggccctttaggccctgc

SEQ ID NO: 529933 - DNA, 20 bp, Artificial
  CRISPR gRNA sequence
ccctttaggccctgctggct

SEQ ID NO: 529934 - DNA, 20 bp, Artificial
  CRISPR gRNA sequence
taggccctgctggcttggac

SEQ ID NO: 529935 - DNA, 20 bp, Artificial
  CRISPR gRNA sequence
aggccctgctggcttggacg

SEQ ID NO: 529936 - DNA, 20 bp, Artificial
  CRISPR gRNA sequence
ggccctgctggcttggacga

SEQ ID NO: 529937 - DNA, 20 bp, Artificial
  CRISPR gRNA sequence
gccctgctggcttggacgag

SEQ ID NO: 529938 - DNA, 20 bp, Artificial
  CRISPR gRNA sequence
ctgctggcttggacgagggg

SEQ ID NO: 529939 - DNA, 20 bp, Artificial
  CRISPR gRNA sequence
tgctggcttggacgaggggc

SEQ ID NO: 529940 - DNA, 20 bp, Artificial
  CRISPR gRNA sequence
ctggcttggacgaggggcag

SEQ ID NO: 529941 - DNA, 20 bp, Artificial
  CRISPR gRNA sequence
ggacgaggggcaggagatac

SEQ ID NO: 529942 - DNA, 20 bp, Artificial
  CRISPR gRNA sequence
acgaggggcaggagatacca

SEQ ID NO: 529943 - DNA, 20 bp, Artificial
  CRISPR gRNA sequence
cgaggggcaggagataccag

SEQ ID NO: 529944 - DNA, 20 bp, Artificial
  CRISPR gRNA sequence
accagaggccacttcctgct

SEQ ID NO: 529945 - DNA, 20 bp, Artificial
  CRISPR gRNA sequence
ggccacttcctgctgagctt

SEQ ID NO: 529946 - DNA, 20 bp, Artificial
  CRISPR gRNA sequence
tgctgagcttgagaactttt

SEQ ID NO: 529947 - DNA, 20 bp, Artificial
  CRISPR gRNA sequence
agaacttttcagatttgacc

SEQ ID NO: 529948 - DNA, 20 bp, Artificial
  CRISPR gRNA sequence
gaacttttcagatttgaccc

SEQ ID NO: 529949 - DNA, 20 bp, Artificial
  CRISPR gRNA sequence
aacttttcagatttgacccg

SEQ ID NO: 529950 - DNA, 20 bp, Artificial
  CRISPR gRNA sequence
ttttcagatttgacccgggg

SEQ ID NO: 529951 - DNA, 20 bp, Artificial
  CRISPR gRNA sequence
tttcagatttgacccggggt

SEQ ID NO: 529952 - DNA, 20 bp, Artificial
  CRISPR gRNA sequence
ttcagatttgacccggggtg

SEQ ID NO: 529953 - DNA, 20 bp, Artificial
  CRISPR gRNA sequence
agatttgacccggggtgggg

SEQ ID NO: 529954 - DNA, 20 bp, Artificial
  CRISPR gRNA sequence
gatttgacccggggtggggc

SEQ ID NO: 529955 - DNA, 20 bp, Artificial
  CRISPR gRNA sequence
atttgacccggggtggggca

SEQ ID NO: 529956 - DNA, 20 bp, Artificial
  CRISPR gRNA sequence
tgacccggggtggggcaggg

SEQ ID NO: 529957 - DNA, 20 bp, Artificial
  CRISPR gRNA sequence
gacccggggtggggcagggc

SEQ ID NO: 529958 - DNA, 20 bp, Artificial
  CRISPR gRNA sequence
agggcaggcctgaaatgctt

SEQ ID NO: 529959 - DNA, 20 bp, Artificial
  CRISPR gRNA sequence
gggcaggcctgaaatgcttt

SEQ ID NO: 529960 - DNA, 20 bp, Artificial
  CRISPR gRNA sequence
ggcaggcctgaaatgctttg

SEQ ID NO: 529961 - DNA, 20 bp, Artificial
  CRISPR gRNA sequence
caggcctgaaatgctttggg

SEQ ID NO: 529962 - DNA, 20 bp, Artificial
  CRISPR gRNA sequence
gaaatgctttggggagcaca

SEQ ID NO: 529963 - DNA, 20 bp, Artificial
  CRISPR gRNA sequence
gctttggggagcacatggct

SEQ ID NO: 529964 - DNA, 20 bp, Artificial
  CRISPR gRNA sequence
gagcacatggctaagtcatg

SEQ ID NO: 529965 - DNA, 20 bp, Artificial
  CRISPR gRNA sequence
tggctaagtcatgcagccac

SEQ ID NO: 529966 - DNA, 20 bp, Artificial
  CRISPR gRNA sequence
accagctccatcttccctcc

SEQ ID NO: 529967 - DNA, 20 bp, Artificial
  CRISPR gRNA sequence
ccatcttccctccaagtcat

SEQ ID NO: 529968 - DNA, 20 bp, Artificial
  CRISPR gRNA sequence
catcttccctccaagtcatc

SEQ ID NO: 529969 - DNA, 20 bp, Artificial
  CRISPR gRNA sequence
cttccctccaagtcatcggg

SEQ ID NO: 529970 - DNA, 20 bp, Artificial
  CRISPR gRNA sequence
ttccctccaagtcatcgggt

SEQ ID NO: 529971 - DNA, 20 bp, Artificial
  CRISPR gRNA sequence
tccctccaagtcatcgggta

SEQ ID NO: 529972 - DNA, 20 bp, Artificial
  CRISPR gRNA sequence
ctccaagtcatcgggtaggg

SEQ ID NO: 529973 - DNA, 20 bp, Artificial
  CRISPR gRNA sequence
gggtggccacaattttatct

SEQ ID NO: 529974 - DNA, 20 bp, Artificial
  CRISPR gRNA sequence
ggtggccacaattttatctt

SEQ ID NO: 529975 - DNA, 20 bp, Artificial
  CRISPR gRNA sequence
aattttatcttgggcacatg

SEQ ID NO: 529976 - DNA, 20 bp, Artificial
  CRISPR gRNA sequence
attttatcttgggcacatgc

SEQ ID NO: 529977 - DNA, 20 bp, Artificial
  CRISPR gRNA sequence
cttgggcacatgcaggaatg

SEQ ID NO: 529978 - DNA, 20 bp, Artificial
  CRISPR gRNA sequence
ttgggcacatgcaggaatgt

SEQ ID NO: 529979 - DNA, 20 bp, Artificial
  CRISPR gRNA sequence
aatgtaggcaatgccttaca

SEQ ID NO: 529980 - DNA, 20 bp, Artificial
  CRISPR gRNA sequence
gccttacacagcctgctctc

SEQ ID NO: 529981 - DNA, 20 bp, Artificial
  CRISPR gRNA sequence
agcctgctctccagtttgtc

SEQ ID NO: 529982 - DNA, 20 bp, Artificial
  CRISPR gRNA sequence
gcctgctctccagtttgtcc

SEQ ID NO: 529983 - DNA, 20 bp, Artificial
  CRISPR gRNA sequence
cctgctctccagtttgtcca

SEQ ID NO: 529984 - DNA, 20 bp, Artificial
  CRISPR gRNA sequence
gctctccagtttgtccaggg

SEQ ID NO: 529985 - DNA, 20 bp, Artificial
  CRISPR gRNA sequence
gtttgtccagggtggtgccc

SEQ ID NO: 529986 - DNA, 20 bp, Artificial
  CRISPR gRNA sequence
tttgtccagggtggtgccct

SEQ ID NO: 529987 - DNA, 20 bp, Artificial
  CRISPR gRNA sequence
ttgtccagggtggtgccctg

SEQ ID NO: 529988 - DNA, 20 bp, Artificial
  CRISPR gRNA sequence
gggtggtgccctggggcacc

SEQ ID NO: 529989 - DNA, 20 bp, Artificial
  CRISPR gRNA sequence
tggtgccctggggcacctgg

SEQ ID NO: 529990 - DNA, 20 bp, Artificial
  CRISPR gRNA sequence
ggggcacctggtagtacttt

SEQ ID NO: 529991 - DNA, 20 bp, Artificial
  CRISPR gRNA sequence
gcacctggtagtacttttgg

SEQ ID NO: 529992 - DNA, 20 bp, Artificial
  CRISPR gRNA sequence
cacctggtagtacttttggt

SEQ ID NO: 529993 - DNA, 20 bp, Artificial
  CRISPR gRNA sequence
acctggtagtacttttggtg

SEQ ID NO: 529994 - DNA, 20 bp, Artificial
  CRISPR gRNA sequence
gggaatgttccatcatgttt

SEQ ID NO: 529995 - DNA, 20 bp, Artificial
  CRISPR gRNA sequence
aatgttccatcatgtttcag

SEQ ID NO: 529996 - DNA, 20 bp, Artificial
  CRISPR gRNA sequence
gttccatcatgtttcagaag

SEQ ID NO: 529997 - DNA, 20 bp, Artificial
  CRISPR gRNA sequence
ccatcatgtttcagaagcag

SEQ ID NO: 529998 - DNA, 20 bp, Artificial
  CRISPR gRNA sequence
tcatgtttcagaagcagcgg

SEQ ID NO: 529999 - DNA, 20 bp, Artificial
  CRISPR gRNA sequence
agaagcagcggtggcactgt

SEQ ID NO: 530000 - DNA, 20 bp, Artificial
  CRISPR gRNA sequence
cagtcaaaaatatgccctcc

SEQ ID NO: 530001 - DNA, 20 bp, Artificial
  CRISPR gRNA sequence
gccctcccagttcctaaatc

SEQ ID NO: 530002 - DNA, 20 bp, Artificial
  CRISPR gRNA sequence
ccctcccagttcctaaatcc

SEQ ID NO: 530003 - DNA, 20 bp, Artificial
  CRISPR gRNA sequence
ccaggcatactatcttccaa

SEQ ID NO: 530004 - DNA, 20 bp, Artificial
  CRISPR gRNA sequence
tatcttccaacagtatctct

SEQ ID NO: 530005 - DNA, 20 bp, Artificial
  CRISPR gRNA sequence
tcttccaacagtatctcttg

SEQ ID NO: 530006 - DNA, 20 bp, Artificial
  CRISPR gRNA sequence
cttggagatcacatgcccat

SEQ ID NO: 530007 - DNA, 20 bp, Artificial
  CRISPR gRNA sequence
ctgaatctgttccttcctcc

SEQ ID NO: 530008 - DNA, 20 bp, Artificial
  CRISPR gRNA sequence
cctcctagtattttgatttt

SEQ ID NO: 530009 - DNA, 20 bp, Artificial
  CRISPR gRNA sequence
tgtaaacactcacctaatct

SEQ ID NO: 530010 - DNA, 20 bp, Artificial
  CRISPR gRNA sequence
ctcacctaatctgagccaaa

SEQ ID NO: 530011 - DNA, 20 bp, Artificial
  CRISPR gRNA sequence
cctaatctgagccaaatggt

SEQ ID NO: 530012 - DNA, 20 bp, Artificial
  CRISPR gRNA sequence
accattgctcctctctgcct

SEQ ID NO: 530013 - DNA, 20 bp, Artificial
  CRISPR gRNA sequence
tcctctctgccttggccttt

SEQ ID NO: 530014 - DNA, 20 bp, Artificial
  CRISPR gRNA sequence
aaaacttccaaatccctttt

SEQ ID NO: 530015 - DNA, 20 bp, Artificial
  CRISPR gRNA sequence
aaacttccaaatcccttttc

SEQ ID NO: 530016 - DNA, 20 bp, Artificial
  CRISPR gRNA sequence
aaatcccttttcgggtcttc

SEQ ID NO: 530017 - DNA, 20 bp, Artificial
  CRISPR gRNA sequence
atcccttttcgggtcttcaa

SEQ ID NO: 530018 - DNA, 20 bp, Artificial
  CRISPR gRNA sequence
ccttttcgggtcttcaagag

SEQ ID NO: 530019 - DNA, 20 bp, Artificial
  CRISPR gRNA sequence
cctccaccctaatctctccc

SEQ ID NO: 530020 - DNA, 20 bp, Artificial
  CRISPR gRNA sequence
ctccaccctaatctctcccc

SEQ ID NO: 530021 - DNA, 20 bp, Artificial
  CRISPR gRNA sequence
aggtattcttcccatctccc

SEQ ID NO: 530022 - DNA, 20 bp, Artificial
  CRISPR gRNA sequence
tattcttcccatctccctag

SEQ ID NO: 530023 - DNA, 20 bp, Artificial
  CRISPR gRNA sequence
ctagtggtccttctcgcaat

SEQ ID NO: 530024 - DNA, 20 bp, Artificial
  CRISPR gRNA sequence
tgagcttctgctctgcacca

SEQ ID NO: 530025 - DNA, 20 bp, Artificial
  CRISPR gRNA sequence
agcttctgctctgcaccata

SEQ ID NO: 530026 - DNA, 20 bp, Artificial
  CRISPR gRNA sequence
tctgctctgcaccatagagt

SEQ ID NO: 530027 - DNA, 20 bp, Artificial
  CRISPR gRNA sequence
ctgctctgcaccatagagta

SEQ ID NO: 530028 - DNA, 20 bp, Artificial
  CRISPR gRNA sequence
tgctctgcaccatagagtaa

SEQ ID NO: 530029 - DNA, 20 bp, Artificial
  CRISPR gRNA sequence
caccatagagtaagggacat

SEQ ID NO: 530030 - DNA, 20 bp, Artificial
  CRISPR gRNA sequence
agtaagggacataagtgttc

SEQ ID NO: 530031 - DNA, 20 bp, Artificial
  CRISPR gRNA sequence
gtgttccagccttcaaacct

SEQ ID NO: 530032 - DNA, 20 bp, Artificial
  CRISPR gRNA sequence
ttcaaaccttggctgctccc

SEQ ID NO: 530033 - DNA, 20 bp, Artificial
  CRISPR gRNA sequence
tcaaaccttggctgctccca

SEQ ID NO: 530034 - DNA, 20 bp, Artificial
  CRISPR gRNA sequence
cacacacatatttatacttg

SEQ ID NO: 530035 - DNA, 20 bp, Artificial
  CRISPR gRNA sequence
acacacatatttatacttgt

SEQ ID NO: 530036 - DNA, 20 bp, Artificial
  CRISPR gRNA sequence
atatttatacttgtgggctc

SEQ ID NO: 530037 - DNA, 20 bp, Artificial
  CRISPR gRNA sequence
ccagttaaaataaacatgaa

SEQ ID NO: 530038 - DNA, 20 bp, Artificial
  CRISPR gRNA sequence
gttaaaataaacatgaaaag

SEQ ID NO: 530039 - DNA, 20 bp, Artificial
  CRISPR gRNA sequence
ttaaaataaacatgaaaagt

SEQ ID NO: 530040 - DNA, 20 bp, Artificial
  CRISPR gRNA sequence
taaaataaacatgaaaagta

SEQ ID NO: 530041 - DNA, 20 bp, Artificial
  CRISPR gRNA sequence
aacatgaaaagtagggttgc

SEQ ID NO: 530042 - DNA, 20 bp, Artificial
  CRISPR gRNA sequence
cagatataatgcaaaacacc

SEQ ID NO: 530043 - DNA, 20 bp, Artificial
  CRISPR gRNA sequence
acccagttaaatttgaattt

SEQ ID NO: 530044 - DNA, 20 bp, Artificial
  CRISPR gRNA sequence
caatgaaaaatttcttgcat

SEQ ID NO: 530045 - DNA, 20 bp, Artificial
  CRISPR gRNA sequence
gtatttttatttgctatatc

SEQ ID NO: 530046 - DNA, 20 bp, Artificial
  CRISPR gRNA sequence
atatctggcaactctaatca

SEQ ID NO: 530047 - DNA, 20 bp, Artificial
  CRISPR gRNA sequence
actctaatcaaagatctccc

SEQ ID NO: 530048 - DNA, 20 bp, Artificial
  CRISPR gRNA sequence
ctctaatcaaagatctcccg

SEQ ID NO: 530049 - DNA, 20 bp, Artificial
  CRISPR gRNA sequence
aagatctcccgaggccactg

SEQ ID NO: 530050 - DNA, 20 bp, Artificial
  CRISPR gRNA sequence
gtgactcatgcctataatcc

SEQ ID NO: 530051 - DNA, 20 bp, Artificial
  CRISPR gRNA sequence
tgcctataatcccagcactt

SEQ ID NO: 530052 - DNA, 20 bp, Artificial
  CRISPR gRNA sequence
gcctataatcccagcacttt

SEQ ID NO: 530053 - DNA, 20 bp, Artificial
  CRISPR gRNA sequence
ctataatcccagcactttgg

SEQ ID NO: 530054 - DNA, 20 bp, Artificial
  CRISPR gRNA sequence
tataatcccagcactttggg

SEQ ID NO: 530055 - DNA, 20 bp, Artificial
  CRISPR gRNA sequence
tcccagcactttgggaggct

SEQ ID NO: 530056 - DNA, 20 bp, Artificial
  CRISPR gRNA sequence
cccagcactttgggaggctg

SEQ ID NO: 530057 - DNA, 20 bp, Artificial
  CRISPR gRNA sequence
agcactttgggaggctgagg

SEQ ID NO: 530058 - DNA, 20 bp, Artificial
  CRISPR gRNA sequence
gcactttgggaggctgaggt

SEQ ID NO: 530059 - DNA, 20 bp, Artificial
  CRISPR gRNA sequence
actttgggaggctgaggtgg

SEQ ID NO: 530060 - DNA, 20 bp, Artificial
  CRISPR gRNA sequence
ctttgggaggctgaggtggg

SEQ ID NO: 530061 - DNA, 20 bp, Artificial
  CRISPR gRNA sequence
gggaggctgaggtgggagga

SEQ ID NO: 530062 - DNA, 20 bp, Artificial
  CRISPR gRNA sequence
ctgaggtgggaggatagttt

SEQ ID NO: 530063 - DNA, 20 bp, Artificial
  CRISPR gRNA sequence
gtgggaggatagtttgagca

SEQ ID NO: 530064 - DNA, 20 bp, Artificial
  CRISPR gRNA sequence
tgggaggatagtttgagcac

SEQ ID NO: 530065 - DNA, 20 bp, Artificial
  CRISPR gRNA sequence
ggaggatagtttgagcacag

SEQ ID NO: 530066 - DNA, 20 bp, Artificial
  CRISPR gRNA sequence
tagtttgagcacaggagttc

SEQ ID NO: 530067 - DNA, 20 bp, Artificial
  CRISPR gRNA sequence
tgagcacaggagttcgagac

SEQ ID NO: 530068 - DNA, 20 bp, Artificial
  CRISPR gRNA sequence
acaggagttcgagaccagcc

SEQ ID NO: 530069 - DNA, 20 bp, Artificial
  CRISPR gRNA sequence
caggagttcgagaccagcct

SEQ ID NO: 530070 - DNA, 20 bp, Artificial
  CRISPR gRNA sequence
ttcgagaccagcctgggcaa

SEQ ID NO: 530071 - DNA, 20 bp, Artificial
  CRISPR gRNA sequence
cgagaccagcctgggcaaca

SEQ ID NO: 530072 - DNA, 20 bp, Artificial
  CRISPR gRNA sequence
accagcctgggcaacagagt

SEQ ID NO: 530073 - DNA, 20 bp, Artificial
  CRISPR gRNA sequence
ctctacaaaattttaaaaat

SEQ ID NO: 530074 - DNA, 20 bp, Artificial
  CRISPR gRNA sequence
acaaaattttaaaaattagc

SEQ ID NO: 530075 - DNA, 20 bp, Artificial
  CRISPR gRNA sequence
caaaattttaaaaattagct

SEQ ID NO: 530076 - DNA, 20 bp, Artificial
  CRISPR gRNA sequence
ttttaaaaattagctgggtg

SEQ ID NO: 530077 - DNA, 20 bp, Artificial
  CRISPR gRNA sequence
taaaaattagctgggtgtgg

SEQ ID NO: 530078 - DNA, 20 bp, Artificial
  CRISPR gRNA sequence
gtggcatgctcctgtaatct

SEQ ID NO: 530079 - DNA, 20 bp, Artificial
  CRISPR gRNA sequence
gctcctgtaatctcagctac

SEQ ID NO: 530080 - DNA, 20 bp, Artificial
  CRISPR gRNA sequence
ctcctgtaatctcagctact

SEQ ID NO: 530081 - DNA, 20 bp, Artificial
  CRISPR gRNA sequence
tcctgtaatctcagctactg

SEQ ID NO: 530082 - DNA, 20 bp, Artificial
  CRISPR gRNA sequence
ctgtaatctcagctactggg

SEQ ID NO: 530083 - DNA, 20 bp, Artificial
  CRISPR gRNA sequence
tgtaatctcagctactgggg

SEQ ID NO: 530084 - DNA, 20 bp, Artificial
  CRISPR gRNA sequence
tctcagctactggggaggct

SEQ ID NO: 530085 - DNA, 20 bp, Artificial
  CRISPR gRNA sequence
ctcagctactggggaggctg

SEQ ID NO: 530086 - DNA, 20 bp, Artificial
  CRISPR gRNA sequence
agctactggggaggctgagg

SEQ ID NO: 530087 - DNA, 20 bp, Artificial
  CRISPR gRNA sequence
gctactggggaggctgaggt

SEQ ID NO: 530088 - DNA, 20 bp, Artificial
  CRISPR gRNA sequence
tactggggaggctgaggtgg

SEQ ID NO: 530089 - DNA, 20 bp, Artificial
  CRISPR gRNA sequence
actggggaggctgaggtggg

SEQ ID NO: 530090 - DNA, 20 bp, Artificial
  CRISPR gRNA sequence
ctgaggtgggaggattgctt

SEQ ID NO: 530091 - DNA, 20 bp, Artificial
  CRISPR gRNA sequence
gtgggaggattgcttgagcc

SEQ ID NO: 530092 - DNA, 20 bp, Artificial
  CRISPR gRNA sequence
tgggaggattgcttgagcct

SEQ ID NO: 530093 - DNA, 20 bp, Artificial
  CRISPR gRNA sequence
ggaggattgcttgagcctgg

SEQ ID NO: 530094 - DNA, 20 bp, Artificial
  CRISPR gRNA sequence
gaggattgcttgagcctggg

SEQ ID NO: 530095 - DNA, 20 bp, Artificial
  CRISPR gRNA sequence
gattgcttgagcctgggagg

SEQ ID NO: 530096 - DNA, 20 bp, Artificial
  CRISPR gRNA sequence
ttgcttgagcctgggaggtg

SEQ ID NO: 530097 - DNA, 20 bp, Artificial
  CRISPR gRNA sequence
tgcttgagcctgggaggtgg

SEQ ID NO: 530098 - DNA, 20 bp, Artificial
  CRISPR gRNA sequence
cctgggaggtggaggctgct

SEQ ID NO: 530099 - DNA, 20 bp, Artificial
  CRISPR gRNA sequence
tgggaggtggaggctgctga

SEQ ID NO: 530100 - DNA, 20 bp, Artificial
  CRISPR gRNA sequence
atgatcatactaccacactc

SEQ ID NO: 530101 - DNA, 20 bp, Artificial
  CRISPR gRNA sequence
atactaccacactccagcct

SEQ ID NO: 530102 - DNA, 20 bp, Artificial
  CRISPR gRNA sequence
ccacactccagccttggcaa

SEQ ID NO: 530103 - DNA, 20 bp, Artificial
  CRISPR gRNA sequence
acactccagccttggcaaca

SEQ ID NO: 530104 - DNA, 20 bp, Artificial
  CRISPR gRNA sequence
gcaaaaccctgtctcaaaaa

SEQ ID NO: 530105 - DNA, 20 bp, Artificial
  CRISPR gRNA sequence
ctgtctcaaaaaaagttgcg

SEQ ID NO: 530106 - DNA, 20 bp, Artificial
  CRISPR gRNA sequence
tcaaaaaaagttgcgaagtc

SEQ ID NO: 530107 - DNA, 20 bp, Artificial
  CRISPR gRNA sequence
caaaaaaagttgcgaagtca

SEQ ID NO: 530108 - DNA, 20 bp, Artificial
  CRISPR gRNA sequence
aaaaaagttgcgaagtcaag

SEQ ID NO: 530109 - DNA, 20 bp, Artificial
  CRISPR gRNA sequence
aaaagttgcgaagtcaagga

SEQ ID NO: 530110 - DNA, 20 bp, Artificial
  CRISPR gRNA sequence
aaagttgcgaagtcaaggag

SEQ ID NO: 530111 - DNA, 20 bp, Artificial
  CRISPR gRNA sequence
caacttcacttactgtgcct

SEQ ID NO: 530112 - DNA, 20 bp, Artificial
  CRISPR gRNA sequence
cacttactgtgccttagtga

SEQ ID NO: 530113 - DNA, 20 bp, Artificial
  CRISPR gRNA sequence
acttactgtgccttagtgat

SEQ ID NO: 530114 - DNA, 20 bp, Artificial
  CRISPR gRNA sequence
cttactgtgccttagtgatg

SEQ ID NO: 530115 - DNA, 20 bp, Artificial
  CRISPR gRNA sequence
ttactgtgccttagtgatgg

SEQ ID NO: 530116 - DNA, 20 bp, Artificial
  CRISPR gRNA sequence
gccttagtgatgggggaatg

SEQ ID NO: 530117 - DNA, 20 bp, Artificial
  CRISPR gRNA sequence
ccttagtgatgggggaatgt

SEQ ID NO: 530118 - DNA, 20 bp, Artificial
  CRISPR gRNA sequence
ttagtgatgggggaatgtgg

SEQ ID NO: 530119 - DNA, 20 bp, Artificial
  CRISPR gRNA sequence
tagtgatgggggaatgtggg

SEQ ID NO: 530120 - DNA, 20 bp, Artificial
  CRISPR gRNA sequence
ggggaatgtgggaggatgac

SEQ ID NO: 530121 - DNA, 20 bp, Artificial
  CRISPR gRNA sequence
gaatgtgggaggatgactgg

SEQ ID NO: 530122 - DNA, 20 bp, Artificial
  CRISPR gRNA sequence
aatgtgggaggatgactggt

SEQ ID NO: 530123 - DNA, 20 bp, Artificial
  CRISPR gRNA sequence
aggatgactggtgggaaaac

SEQ ID NO: 530124 - DNA, 20 bp, Artificial
  CRISPR gRNA sequence
ggatgactggtgggaaaacc

SEQ ID NO: 530125 - DNA, 20 bp, Artificial
  CRISPR gRNA sequence
gatgactggtgggaaaaccg

SEQ ID NO: 530126 - DNA, 20 bp, Artificial
  CRISPR gRNA sequence
atgactggtgggaaaaccgg

SEQ ID NO: 530127 - DNA, 20 bp, Artificial
  CRISPR gRNA sequence
tggtgggaaaaccgggggtg

SEQ ID NO: 530128 - DNA, 20 bp, Artificial
  CRISPR gRNA sequence
aaccgggggtgaagtgatgc

SEQ ID NO: 530129 - DNA, 20 bp, Artificial
  CRISPR gRNA sequence
ggggtgaagtgatgctggtc

SEQ ID NO: 530130 - DNA, 20 bp, Artificial
  CRISPR gRNA sequence
tgaagtgatgctggtcaagt

SEQ ID NO: 530131 - DNA, 20 bp, Artificial
  CRISPR gRNA sequence
atgctggtcaagttggtgat

SEQ ID NO: 530132 - DNA, 20 bp, Artificial
  CRISPR gRNA sequence
ctggtcaagttggtgattgg

SEQ ID NO: 530133 - DNA, 20 bp, Artificial
  CRISPR gRNA sequence
gttggtgattggcagactct

SEQ ID NO: 530134 - DNA, 20 bp, Artificial
  CRISPR gRNA sequence
cttcaatgacccctgcttcc

SEQ ID NO: 530135 - DNA, 20 bp, Artificial
  CRISPR gRNA sequence
caatcccctctgattgaatg

SEQ ID NO: 530136 - DNA, 20 bp, Artificial
  CRISPR gRNA sequence
aatcccctctgattgaatgt

SEQ ID NO: 530137 - DNA, 20 bp, Artificial
  CRISPR gRNA sequence
ccctctgattgaatgtgggc

SEQ ID NO: 530138 - DNA, 20 bp, Artificial
  CRISPR gRNA sequence
attaacttgcttctaatgaa

SEQ ID NO: 530139 - DNA, 20 bp, Artificial
  CRISPR gRNA sequence
tgcttctaatgaacagaaca

SEQ ID NO: 530140 - DNA, 20 bp, Artificial
  CRISPR gRNA sequence
ttctaatgaacagaacacag

SEQ ID NO: 530141 - DNA, 20 bp, Artificial
  CRISPR gRNA sequence
taatgaacagaacacagcag

SEQ ID NO: 530142 - DNA, 20 bp, Artificial
  CRISPR gRNA sequence
cagaacacagcagaagtgat

SEQ ID NO: 530143 - DNA, 20 bp, Artificial
  CRISPR gRNA sequence
agaacacagcagaagtgatt

SEQ ID NO: 530144 - DNA, 20 bp, Artificial
  CRISPR gRNA sequence
gtgattgggatattactcct

SEQ ID NO: 530145 - DNA, 20 bp, Artificial
  CRISPR gRNA sequence
gggatattactcctgagatt

SEQ ID NO: 530146 - DNA, 20 bp, Artificial
  CRISPR gRNA sequence
tcctgagattaagttacaaa

SEQ ID NO: 530147 - DNA, 20 bp, Artificial
  CRISPR gRNA sequence
aaagaccacgacttttgtcc

SEQ ID NO: 530148 - DNA, 20 bp, Artificial
  CRISPR gRNA sequence
aagaccacgacttttgtcct

SEQ ID NO: 530149 - DNA, 20 bp, Artificial
  CRISPR gRNA sequence
cacttattcctgctctttct

SEQ ID NO: 530150 - DNA, 20 bp, Artificial
  CRISPR gRNA sequence
cttattcctgctctttctta

SEQ ID NO: 530151 - DNA, 20 bp, Artificial
  CRISPR gRNA sequence
ttattcctgctctttcttag

SEQ ID NO: 530152 - DNA, 20 bp, Artificial
  CRISPR gRNA sequence
tattcctgctctttcttaga

SEQ ID NO: 530153 - DNA, 20 bp, Artificial
  CRISPR gRNA sequence
gctctttcttagagggctct

SEQ ID NO: 530154 - DNA, 20 bp, Artificial
  CRISPR gRNA sequence
ctctttcttagagggctctg

SEQ ID NO: 530155 - DNA, 20 bp, Artificial
  CRISPR gRNA sequence
tctttcttagagggctctga

SEQ ID NO: 530156 - DNA, 20 bp, Artificial
  CRISPR gRNA sequence
ttcttagagggctctgaggg

SEQ ID NO: 530157 - DNA, 20 bp, Artificial
  CRISPR gRNA sequence
tagagggctctgagggaagc

SEQ ID NO: 530158 - DNA, 20 bp, Artificial
  CRISPR gRNA sequence
gaagctagctgccatattgt

SEQ ID NO: 530159 - DNA, 20 bp, Artificial
  CRISPR gRNA sequence
aagctagctgccatattgtg

SEQ ID NO: 530160 - DNA, 20 bp, Artificial
  CRISPR gRNA sequence
ctagctgccatattgtgagg

SEQ ID NO: 530161 - DNA, 20 bp, Artificial
  CRISPR gRNA sequence
catattgtgaggcagcccaa

SEQ ID NO: 530162 - DNA, 20 bp, Artificial
  CRISPR gRNA sequence
acggcccacatgaatgaact

SEQ ID NO: 530163 - DNA, 20 bp, Artificial
  CRISPR gRNA sequence
gcccacatgaatgaacttgg

SEQ ID NO: 530164 - DNA, 20 bp, Artificial
  CRISPR gRNA sequence
cacatgaatgaacttggaag

SEQ ID NO: 530165 - DNA, 20 bp, Artificial
  CRISPR gRNA sequence
atgaacttggaagtggatcc

SEQ ID NO: 530166 - DNA, 20 bp, Artificial
  CRISPR gRNA sequence
gaacttggaagtggatccaa

SEQ ID NO: 530167 - DNA, 20 bp, Artificial
  CRISPR gRNA sequence
ccaagagcctactcatctaa

SEQ ID NO: 530168 - DNA, 20 bp, Artificial
  CRISPR gRNA sequence
catctaatagtctgtgaaca

SEQ ID NO: 530169 - DNA, 20 bp, Artificial
  CRISPR gRNA sequence
catggtgcttattttctttg

SEQ ID NO: 530170 - DNA, 20 bp, Artificial
  CRISPR gRNA sequence
atggtgcttattttctttgt

SEQ ID NO: 530171 - DNA, 20 bp, Artificial
  CRISPR gRNA sequence
tgcttattttctttgtgggc

SEQ ID NO: 530172 - DNA, 20 bp, Artificial
  CRISPR gRNA sequence
gcttattttctttgtgggcc

SEQ ID NO: 530173 - DNA, 20 bp, Artificial
  CRISPR gRNA sequence
tattttctttgtgggccagg

SEQ ID NO: 530174 - DNA, 20 bp, Artificial
  CRISPR gRNA sequence
ctttgtgggccaggaagctg

SEQ ID NO: 530175 - DNA, 20 bp, Artificial
  CRISPR gRNA sequence
tgggccaggaagctgaagcc

SEQ ID NO: 530176 - DNA, 20 bp, Artificial
  CRISPR gRNA sequence
ggccaggaagctgaagccta

SEQ ID NO: 530177 - DNA, 20 bp, Artificial
  CRISPR gRNA sequence
ccaggaagctgaagcctaga

SEQ ID NO: 530178 - DNA, 20 bp, Artificial
  CRISPR gRNA sequence
caggaagctgaagcctagag

SEQ ID NO: 530179 - DNA, 20 bp, Artificial
  CRISPR gRNA sequence
aggaagctgaagcctagaga

SEQ ID NO: 530180 - DNA, 20 bp, Artificial
  CRISPR gRNA sequence
ggaagctgaagcctagagag

SEQ ID NO: 530181 - DNA, 20 bp, Artificial
  CRISPR gRNA sequence
agctgaagcctagagagggg

SEQ ID NO: 530182 - DNA, 20 bp, Artificial
  CRISPR gRNA sequence
agaggggaagaaactctgtc

SEQ ID NO: 530183 - DNA, 20 bp, Artificial
  CRISPR gRNA sequence
gaaactctgtcaagattctc

SEQ ID NO: 530184 - DNA, 20 bp, Artificial
  CRISPR gRNA sequence
caagattctctggctaaatt

SEQ ID NO: 530185 - DNA, 20 bp, Artificial
  CRISPR gRNA sequence
attctctggctaaatttgga

SEQ ID NO: 530186 - DNA, 20 bp, Artificial
  CRISPR gRNA sequence
aaatttggacagacccaaac

SEQ ID NO: 530187 - DNA, 20 bp, Artificial
  CRISPR gRNA sequence
tttggacagacccaaactag

SEQ ID NO: 530188 - DNA, 20 bp, Artificial
  CRISPR gRNA sequence
acagacccaaactagaagtc

SEQ ID NO: 530189 - DNA, 20 bp, Artificial
  CRISPR gRNA sequence
gaagtccagacctctactcc

SEQ ID NO: 530190 - DNA, 20 bp, Artificial
  CRISPR gRNA sequence
aagtccagacctctactccc

SEQ ID NO: 530191 - DNA, 20 bp, Artificial
  CRISPR gRNA sequence
ccagacctctactcccaggc

SEQ ID NO: 530192 - DNA, 20 bp, Artificial
  CRISPR gRNA sequence
agacctctactcccaggcga

SEQ ID NO: 530193 - DNA, 20 bp, Artificial
  CRISPR gRNA sequence
tctactcccaggcgagagct

SEQ ID NO: 530194 - DNA, 20 bp, Artificial
  CRISPR gRNA sequence
ctactcccaggcgagagctt

SEQ ID NO: 530195 - DNA, 20 bp, Artificial
  CRISPR gRNA sequence
aggcgagagcttgggcacta

SEQ ID NO: 530196 - DNA, 20 bp, Artificial
  CRISPR gRNA sequence
cgagagcttgggcactatag

SEQ ID NO: 530197 - DNA, 20 bp, Artificial
  CRISPR gRNA sequence
gagagcttgggcactataga

SEQ ID NO: 530198 - DNA, 20 bp, Artificial
  CRISPR gRNA sequence
cactatagaaggctgcctct

SEQ ID NO: 530199 - DNA, 20 bp, Artificial
  CRISPR gRNA sequence
ctgcctctcagaaatacttc

SEQ ID NO: 530200 - DNA, 20 bp, Artificial
  CRISPR gRNA sequence
gcctctcagaaatacttctg

SEQ ID NO: 530201 - DNA, 20 bp, Artificial
  CRISPR gRNA sequence
cctctcagaaatacttctgg

SEQ ID NO: 530202 - DNA, 20 bp, Artificial
  CRISPR gRNA sequence
aatacttctggaggtcacat

SEQ ID NO: 530203 - DNA, 20 bp, Artificial
  CRISPR gRNA sequence
atacttctggaggtcacatc

SEQ ID NO: 530204 - DNA, 20 bp, Artificial
  CRISPR gRNA sequence
ttctggaggtcacatcaggc

SEQ ID NO: 530205 - DNA, 20 bp, Artificial
  CRISPR gRNA sequence
tctggaggtcacatcaggct

SEQ ID NO: 530206 - DNA, 20 bp, Artificial
  CRISPR gRNA sequence
gtcacatcaggctgggacac

SEQ ID NO: 530207 - DNA, 20 bp, Artificial
  CRISPR gRNA sequence
tcacatcaggctgggacact

SEQ ID NO: 530208 - DNA, 20 bp, Artificial
  CRISPR gRNA sequence
cacatcaggctgggacactg

SEQ ID NO: 530209 - DNA, 20 bp, Artificial
  CRISPR gRNA sequence
gggacactggggatccatta

SEQ ID NO: 530210 - DNA, 20 bp, Artificial
  CRISPR gRNA sequence
ctggggatccattatggtct

SEQ ID NO: 530211 - DNA, 20 bp, Artificial
  CRISPR gRNA sequence
ggggatccattatggtcttg

SEQ ID NO: 530212 - DNA, 20 bp, Artificial
  CRISPR gRNA sequence
cattatggtcttggagtttt

SEQ ID NO: 530213 - DNA, 20 bp, Artificial
  CRISPR gRNA sequence
cttggagttttgagattttc

SEQ ID NO: 530214 - DNA, 20 bp, Artificial
  CRISPR gRNA sequence
tggagttttgagattttctg

SEQ ID NO: 530215 - DNA, 20 bp, Artificial
  CRISPR gRNA sequence
gttttgagattttctggagc

SEQ ID NO: 530216 - DNA, 20 bp, Artificial
  CRISPR gRNA sequence
attttctggagctagtcccc

SEQ ID NO: 530217 - DNA, 20 bp, Artificial
  CRISPR gRNA sequence
cttgccgtcctgttgtgtgc

SEQ ID NO: 530218 - DNA, 20 bp, Artificial
  CRISPR gRNA sequence
ttgccgtcctgttgtgtgcc

SEQ ID NO: 530219 - DNA, 20 bp, Artificial
  CRISPR gRNA sequence
gccgtcctgttgtgtgccag

SEQ ID NO: 530220 - DNA, 20 bp, Artificial
  CRISPR gRNA sequence
gagtgttgccttgctgtcca

SEQ ID NO: 530221 - DNA, 20 bp, Artificial
  CRISPR gRNA sequence
ttgctgtccacagtcctctt

SEQ ID NO: 530222 - DNA, 20 bp, Artificial
  CRISPR gRNA sequence
ccacagtcctctttggcctc

SEQ ID NO: 530223 - DNA, 20 bp, Artificial
  CRISPR gRNA sequence
cacagtcctctttggcctca

SEQ ID NO: 530224 - DNA, 20 bp, Artificial
  CRISPR gRNA sequence
acagtcctctttggcctcaa

SEQ ID NO: 530225 - DNA, 20 bp, Artificial
  CRISPR gRNA sequence
tcccccatgaccctgccccc

SEQ ID NO: 530226 - DNA, 20 bp, Artificial
  CRISPR gRNA sequence
cccccatgaccctgcccccc

SEQ ID NO: 530227 - DNA, 20 bp, Artificial
  CRISPR gRNA sequence
ccccatgaccctgcccccca

SEQ ID NO: 530228 - DNA, 20 bp, Artificial
  CRISPR gRNA sequence
cctgccccccagggtttctg

SEQ ID NO: 530229 - DNA, 20 bp, Artificial
  CRISPR gRNA sequence
ctttctacctttactcctga

SEQ ID NO: 530230 - DNA, 20 bp, Artificial
  CRISPR gRNA sequence
tttctacctttactcctgat

SEQ ID NO: 530231 - DNA, 20 bp, Artificial
  CRISPR gRNA sequence
tctacctttactcctgatgg

SEQ ID NO: 530232 - DNA, 20 bp, Artificial
  CRISPR gRNA sequence
ctacctttactcctgatggg

SEQ ID NO: 530233 - DNA, 20 bp, Artificial
  CRISPR gRNA sequence
tgctgaccactaaccatctt

SEQ ID NO: 530234 - DNA, 20 bp, Artificial
  CRISPR gRNA sequence
gctgaccactaaccatcttt

SEQ ID NO: 530235 - DNA, 20 bp, Artificial
  CRISPR gRNA sequence
ctgaccactaaccatcttta

SEQ ID NO: 530236 - DNA, 20 bp, Artificial
  CRISPR gRNA sequence
tgaccactaaccatctttag

SEQ ID NO: 530237 - DNA, 20 bp, Artificial
  CRISPR gRNA sequence
accactaaccatctttaggg

SEQ ID NO: 530238 - DNA, 20 bp, Artificial
  CRISPR gRNA sequence
actaaccatctttaggggag

SEQ ID NO: 530239 - DNA, 20 bp, Artificial
  CRISPR gRNA sequence
accatctttaggggagcagt

SEQ ID NO: 530240 - DNA, 20 bp, Artificial
  CRISPR gRNA sequence
gttggaatcatgtcactaac

SEQ ID NO: 530241 - DNA, 20 bp, Artificial
  CRISPR gRNA sequence
aatcatgtcactaactagcc

SEQ ID NO: 530242 - DNA, 20 bp, Artificial
  CRISPR gRNA sequence
atcatgtcactaactagcca

SEQ ID NO: 530243 - DNA, 20 bp, Artificial
  CRISPR gRNA sequence
tcatgtcactaactagccaa

SEQ ID NO: 530244 - DNA, 20 bp, Artificial
  CRISPR gRNA sequence
actaactagccaagggacct

SEQ ID NO: 530245 - DNA, 20 bp, Artificial
  CRISPR gRNA sequence
ctaactagccaagggacctt

SEQ ID NO: 530246 - DNA, 20 bp, Artificial
  CRISPR gRNA sequence
ctagccaagggaccttgggc

SEQ ID NO: 530247 - DNA, 20 bp, Artificial
  CRISPR gRNA sequence
ccaagggaccttgggcaagt

SEQ ID NO: 530248 - DNA, 20 bp, Artificial
  CRISPR gRNA sequence
ggcaagtcagtttccctctc

SEQ ID NO: 530249 - DNA, 20 bp, Artificial
  CRISPR gRNA sequence
cagtttccctctctggaaaa

SEQ ID NO: 530250 - DNA, 20 bp, Artificial
  CRISPR gRNA sequence
agtttccctctctggaaaat

SEQ ID NO: 530251 - DNA, 20 bp, Artificial
  CRISPR gRNA sequence
gtttccctctctggaaaatg

SEQ ID NO: 530252 - DNA, 20 bp, Artificial
  CRISPR gRNA sequence
tggaaaatggggctttgcat

SEQ ID NO: 530253 - DNA, 20 bp, Artificial
  CRISPR gRNA sequence
tttgcatgagatactctcta

SEQ ID NO: 530254 - DNA, 20 bp, Artificial
  CRISPR gRNA sequence
ctctacagctcctccttctt

SEQ ID NO: 530255 - DNA, 20 bp, Artificial
  CRISPR gRNA sequence
agttttgcaattctttctcc

SEQ ID NO: 530256 - DNA, 20 bp, Artificial
  CRISPR gRNA sequence
tttgcaattctttctcctag

SEQ ID NO: 530257 - DNA, 20 bp, Artificial
  CRISPR gRNA sequence
tgcaattctttctcctagaa

SEQ ID NO: 530258 - DNA, 20 bp, Artificial
  CRISPR gRNA sequence
gcaattctttctcctagaag

SEQ ID NO: 530259 - DNA, 20 bp, Artificial
  CRISPR gRNA sequence
aggatctttaaaatttcttg

SEQ ID NO: 530260 - DNA, 20 bp, Artificial
  CRISPR gRNA sequence
tcttgtggtcaaattgtgct

SEQ ID NO: 530261 - DNA, 20 bp, Artificial
  CRISPR gRNA sequence
tgtggtcaaattgtgctcag

SEQ ID NO: 530262 - DNA, 20 bp, Artificial
  CRISPR gRNA sequence
gtggtcaaattgtgctcagt

SEQ ID NO: 530263 - DNA, 20 bp, Artificial
  CRISPR gRNA sequence
ggtcaaattgtgctcagtgg

SEQ ID NO: 530264 - DNA, 20 bp, Artificial
  CRISPR gRNA sequence
gtcaaattgtgctcagtggg

SEQ ID NO: 530265 - DNA, 20 bp, Artificial
  CRISPR gRNA sequence
gtgctcagtgggaggactcc

SEQ ID NO: 530266 - DNA, 20 bp, Artificial
  CRISPR gRNA sequence
tgctcagtgggaggactccc

SEQ ID NO: 530267 - DNA, 20 bp, Artificial
  CRISPR gRNA sequence
cagtgggaggactcccagga

SEQ ID NO: 530268 - DNA, 20 bp, Artificial
  CRISPR gRNA sequence
actcccaggatggaaaacca

SEQ ID NO: 530269 - DNA, 20 bp, Artificial
  CRISPR gRNA sequence
ctcccctgatgcttcccttg

SEQ ID NO: 530270 - DNA, 20 bp, Artificial
  CRISPR gRNA sequence
tcccctgatgcttcccttga

SEQ ID NO: 530271 - DNA, 20 bp, Artificial
  CRISPR gRNA sequence
atgcttcccttgaaggtttc

SEQ ID NO: 530272 - DNA, 20 bp, Artificial
  CRISPR gRNA sequence
tgcttcccttgaaggtttcc

SEQ ID NO: 530273 - DNA, 20 bp, Artificial
  CRISPR gRNA sequence
cttcccttgaaggtttccag

SEQ ID NO: 530274 - DNA, 20 bp, Artificial
  CRISPR gRNA sequence
ttcccttgaaggtttccagg

SEQ ID NO: 530275 - DNA, 20 bp, Artificial
  CRISPR gRNA sequence
ccttgaaggtttccaggagg

SEQ ID NO: 530276 - DNA, 20 bp, Artificial
  CRISPR gRNA sequence
ttgaaggtttccaggaggaa

SEQ ID NO: 530277 - DNA, 20 bp, Artificial
  CRISPR gRNA sequence
atgctttcatgcctcatcct

SEQ ID NO: 530278 - DNA, 20 bp, Artificial
  CRISPR gRNA sequence
tttcatgcctcatcctgagc

SEQ ID NO: 530279 - DNA, 20 bp, Artificial
  CRISPR gRNA sequence
ttcatgcctcatcctgagcc

SEQ ID NO: 530280 - DNA, 20 bp, Artificial
  CRISPR gRNA sequence
tcatgcctcatcctgagcca

SEQ ID NO: 530281 - DNA, 20 bp, Artificial
  CRISPR gRNA sequence
cctgagccagggctgcctcc

SEQ ID NO: 530282 - DNA, 20 bp, Artificial
  CRISPR gRNA sequence
ccagggctgcctcccagcat

SEQ ID NO: 530283 - DNA, 20 bp, Artificial
  CRISPR gRNA sequence
cagcatgagcacctgtgacc

SEQ ID NO: 530284 - DNA, 20 bp, Artificial
  CRISPR gRNA sequence
gcatgagcacctgtgacctg

SEQ ID NO: 530285 - DNA, 20 bp, Artificial
  CRISPR gRNA sequence
tgagcacctgtgacctggag

SEQ ID NO: 530286 - DNA, 20 bp, Artificial
  CRISPR gRNA sequence
gcagcatgcctctgcctact

SEQ ID NO: 530287 - DNA, 20 bp, Artificial
  CRISPR gRNA sequence
cagcatgcctctgcctactg

SEQ ID NO: 530288 - DNA, 20 bp, Artificial
  CRISPR gRNA sequence
agcatgcctctgcctactga

SEQ ID NO: 530289 - DNA, 20 bp, Artificial
  CRISPR gRNA sequence
gcctctgcctactgagggcc

SEQ ID NO: 530290 - DNA, 20 bp, Artificial
  CRISPR gRNA sequence
tctgcctactgagggcctgg

SEQ ID NO: 530291 - DNA, 20 bp, Artificial
  CRISPR gRNA sequence
ctgcctactgagggcctggc

SEQ ID NO: 530292 - DNA, 20 bp, Artificial
  CRISPR gRNA sequence
cctggcaggctgtgtttgtg

SEQ ID NO: 530293 - DNA, 20 bp, Artificial
  CRISPR gRNA sequence
agtgatgcccgccacgcacc

SEQ ID NO: 530294 - DNA, 20 bp, Artificial
  CRISPR gRNA sequence
atgcccgccacgcacctgga

SEQ ID NO: 530295 - DNA, 20 bp, Artificial
  CRISPR gRNA sequence
ccacgcacctggacagctga

SEQ ID NO: 530296 - DNA, 20 bp, Artificial
  CRISPR gRNA sequence
cacgcacctggacagctgac

SEQ ID NO: 530297 - DNA, 20 bp, Artificial
  CRISPR gRNA sequence
acagctgacaggctcgacac

SEQ ID NO: 530298 - DNA, 20 bp, Artificial
  CRISPR gRNA sequence
gtgcacttgaattttgcact

SEQ ID NO: 530299 - DNA, 20 bp, Artificial
  CRISPR gRNA sequence
tgcacttgaattttgcactc

SEQ ID NO: 530300 - DNA, 20 bp, Artificial
  CRISPR gRNA sequence
cttgaattttgcactcaggc

SEQ ID NO: 530301 - DNA, 20 bp, Artificial
  CRISPR gRNA sequence
gaattttgcactcaggctgg

SEQ ID NO: 530302 - DNA, 20 bp, Artificial
  CRISPR gRNA sequence
cttgtgtgtgatgaccctct

SEQ ID NO: 530303 - DNA, 20 bp, Artificial
  CRISPR gRNA sequence
tgtgtgatgaccctctgaga

SEQ ID NO: 530304 - DNA, 20 bp, Artificial
  CRISPR gRNA sequence
atgaccctctgagaaagttt

SEQ ID NO: 530305 - DNA, 20 bp, Artificial
  CRISPR gRNA sequence
agatgtttcccatcttgata

SEQ ID NO: 530306 - DNA, 20 bp, Artificial
  CRISPR gRNA sequence
gatgtttcccatcttgatac

SEQ ID NO: 530307 - DNA, 20 bp, Artificial
  CRISPR gRNA sequence
atcttgatacaggtttaatt

SEQ ID NO: 530308 - DNA, 20 bp, Artificial
  CRISPR gRNA sequence
tcttgatacaggtttaattc

SEQ ID NO: 530309 - DNA, 20 bp, Artificial
  CRISPR gRNA sequence
cttgatacaggtttaattcg

SEQ ID NO: 530310 - DNA, 20 bp, Artificial
  CRISPR gRNA sequence
atacaggtttaattcggggt

SEQ ID NO: 530311 - DNA, 20 bp, Artificial
  CRISPR gRNA sequence
cagttccattcattacctca

SEQ ID NO: 530312 - DNA, 20 bp, Artificial
  CRISPR gRNA sequence
agttccattcattacctcac

SEQ ID NO: 530313 - DNA, 20 bp, Artificial
  CRISPR gRNA sequence
ccattcattacctcacaggt

SEQ ID NO: 530314 - DNA, 20 bp, Artificial
  CRISPR gRNA sequence
cattcattacctcacaggtc

SEQ ID NO: 530315 - DNA, 20 bp, Artificial
  CRISPR gRNA sequence
attcattacctcacaggtca

SEQ ID NO: 530316 - DNA, 20 bp, Artificial
  CRISPR gRNA sequence
ggtcagggttgtgttgatac

SEQ ID NO: 530317 - DNA, 20 bp, Artificial
  CRISPR gRNA sequence
gggttgtgttgatacaagtc

SEQ ID NO: 530318 - DNA, 20 bp, Artificial
  CRISPR gRNA sequence
ggttgtgttgatacaagtcc

SEQ ID NO: 530319 - DNA, 20 bp, Artificial
  CRISPR gRNA sequence
ttgtgttgatacaagtccag

SEQ ID NO: 530320 - DNA, 20 bp, Artificial
  CRISPR gRNA sequence
atacaagtccaggagatctt

SEQ ID NO: 530321 - DNA, 20 bp, Artificial
  CRISPR gRNA sequence
tccaggagatctttggtttt

SEQ ID NO: 530322 - DNA, 20 bp, Artificial
  CRISPR gRNA sequence
gttttgagaccctctctaaa

SEQ ID NO: 530323 - DNA, 20 bp, Artificial
  CRISPR gRNA sequence
tgagaccctctctaaaaaga

SEQ ID NO: 530324 - DNA, 20 bp, Artificial
  CRISPR gRNA sequence
ccctctctaaaaagaaagta

SEQ ID NO: 530325 - DNA, 20 bp, Artificial
  CRISPR gRNA sequence
ctaaaaagaaagtaaagatt

SEQ ID NO: 530326 - DNA, 20 bp, Artificial
  CRISPR gRNA sequence
agtaaagattcagttcaatt

SEQ ID NO: 530327 - DNA, 20 bp, Artificial
  CRISPR gRNA sequence
gtaaagattcagttcaattt

SEQ ID NO: 530328 - DNA, 20 bp, Artificial
  CRISPR gRNA sequence
aataaacatatctatttata

SEQ ID NO: 530329 - DNA, 20 bp, Artificial
  CRISPR gRNA sequence
aaacatatctatttatacag

SEQ ID NO: 530330 - DNA, 20 bp, Artificial
  CRISPR gRNA sequence
aacatatctatttatacagt

SEQ ID NO: 530331 - DNA, 20 bp, Artificial
  CRISPR gRNA sequence
acatatctatttatacagtg

SEQ ID NO: 530332 - DNA, 20 bp, Artificial
  CRISPR gRNA sequence
catatctatttatacagtgg

SEQ ID NO: 530333 - DNA, 20 bp, Artificial
  CRISPR gRNA sequence
tctatttatacagtggggga

SEQ ID NO: 530334 - DNA, 20 bp, Artificial
  CRISPR gRNA sequence
tatttatacagtgggggatg

SEQ ID NO: 530335 - DNA, 20 bp, Artificial
  CRISPR gRNA sequence
tatacagtgggggatggagt

SEQ ID NO: 530336 - DNA, 20 bp, Artificial
  CRISPR gRNA sequence
cagtgggggatggagtcagt

SEQ ID NO: 530337 - DNA, 20 bp, Artificial
  CRISPR gRNA sequence
agtgggggatggagtcagtt

SEQ ID NO: 530338 - DNA, 20 bp, Artificial
  CRISPR gRNA sequence
gtgggggatggagtcagtta

SEQ ID NO: 530339 - DNA, 20 bp, Artificial
  CRISPR gRNA sequence
ggatggagtcagttagggac

SEQ ID NO: 530340 - DNA, 20 bp, Artificial
  CRISPR gRNA sequence
gatggagtcagttagggaca

SEQ ID NO: 530341 - DNA, 20 bp, Artificial
  CRISPR gRNA sequence
atggagtcagttagggacaa

SEQ ID NO: 530342 - DNA, 20 bp, Artificial
  CRISPR gRNA sequence
gggacaagggaacaatgtca

SEQ ID NO: 530343 - DNA, 20 bp, Artificial
  CRISPR gRNA sequence
ggaacaatgtcaaagacctc

SEQ ID NO: 530344 - DNA, 20 bp, Artificial
  CRISPR gRNA sequence
caaagacctctagcaacttt

SEQ ID NO: 530345 - DNA, 20 bp, Artificial
  CRISPR gRNA sequence
tttattttattttatttaca

SEQ ID NO: 530346 - DNA, 20 bp, Artificial
  CRISPR gRNA sequence
tattttattttatttacaaa

SEQ ID NO: 530347 - DNA, 20 bp, Artificial
  CRISPR gRNA sequence
ttttatttacaaagagcatt

SEQ ID NO: 530348 - DNA, 20 bp, Artificial
  CRISPR gRNA sequence
attatttctgatgacattca

SEQ ID NO: 530349 - DNA, 20 bp, Artificial
  CRISPR gRNA sequence
agatacattatgccactaaa

SEQ ID NO: 530350 - DNA, 20 bp, Artificial
  CRISPR gRNA sequence
atgacatcacttaaccctaa

SEQ ID NO: 530351 - DNA, 20 bp, Artificial
  CRISPR gRNA sequence
catcacttaaccctaacaga

SEQ ID NO: 530352 - DNA, 20 bp, Artificial
  CRISPR gRNA sequence
atcacttaaccctaacagac

SEQ ID NO: 530353 - DNA, 20 bp, Artificial
  CRISPR gRNA sequence
gatgtttttcttcccattta

SEQ ID NO: 530354 - DNA, 20 bp, Artificial
  CRISPR gRNA sequence
catttacagacaaaatgttc

SEQ ID NO: 530355 - DNA, 20 bp, Artificial
  CRISPR gRNA sequence
atttacagacaaaatgttca

SEQ ID NO: 530356 - DNA, 20 bp, Artificial
  CRISPR gRNA sequence
gacaaaatgttcaaggctct

SEQ ID NO: 530357 - DNA, 20 bp, Artificial
  CRISPR gRNA sequence
caaaatgttcaaggctctga

SEQ ID NO: 530358 - DNA, 20 bp, Artificial
  CRISPR gRNA sequence
aaaatgttcaaggctctgag

SEQ ID NO: 530359 - DNA, 20 bp, Artificial
  CRISPR gRNA sequence
gttcaaggctctgagaggtc

SEQ ID NO: 530360 - DNA, 20 bp, Artificial
  CRISPR gRNA sequence
caaggctctgagaggtccag

SEQ ID NO: 530361 - DNA, 20 bp, Artificial
  CRISPR gRNA sequence
aaggctctgagaggtccagt

SEQ ID NO: 530362 - DNA, 20 bp, Artificial
  CRISPR gRNA sequence
gctctgagaggtccagtagg

SEQ ID NO: 530363 - DNA, 20 bp, Artificial
  CRISPR gRNA sequence
agaggtccagtaggtggtct

SEQ ID NO: 530364 - DNA, 20 bp, Artificial
  CRISPR gRNA sequence
gaggtccagtaggtggtctt

SEQ ID NO: 530365 - DNA, 20 bp, Artificial
  CRISPR gRNA sequence
aggtccagtaggtggtcttg

SEQ ID NO: 530366 - DNA, 20 bp, Artificial
  CRISPR gRNA sequence
ttggggcaccacctaaaaca

SEQ ID NO: 530367 - DNA, 20 bp, Artificial
  CRISPR gRNA sequence
gggcaccacctaaaacatgg

SEQ ID NO: 530368 - DNA, 20 bp, Artificial
  CRISPR gRNA sequence
accacctaaaacatggcagt

SEQ ID NO: 530369 - DNA, 20 bp, Artificial
  CRISPR gRNA sequence
ccacctaaaacatggcagtc

SEQ ID NO: 530370 - DNA, 20 bp, Artificial
  CRISPR gRNA sequence
cacctaaaacatggcagtca

SEQ ID NO: 530371 - DNA, 20 bp, Artificial
  CRISPR gRNA sequence
aaaacatggcagtcagggtt

SEQ ID NO: 530372 - DNA, 20 bp, Artificial
  CRISPR gRNA sequence
aaacatggcagtcagggttt

SEQ ID NO: 530373 - DNA, 20 bp, Artificial
  CRISPR gRNA sequence
acatggcagtcagggtttag

SEQ ID NO: 530374 - DNA, 20 bp, Artificial
  CRISPR gRNA sequence
gcagtcagggtttaggagta

SEQ ID NO: 530375 - DNA, 20 bp, Artificial
  CRISPR gRNA sequence
cagtcagggtttaggagtat

SEQ ID NO: 530376 - DNA, 20 bp, Artificial
  CRISPR gRNA sequence
cagggtttaggagtatgggt

SEQ ID NO: 530377 - DNA, 20 bp, Artificial
  CRISPR gRNA sequence
gtttaggagtatgggtaaga

SEQ ID NO: 530378 - DNA, 20 bp, Artificial
  CRISPR gRNA sequence
tatgggtaagaaagtgcctc

SEQ ID NO: 530379 - DNA, 20 bp, Artificial
  CRISPR gRNA sequence
tgggtaagaaagtgcctcca

SEQ ID NO: 530380 - DNA, 20 bp, Artificial
  CRISPR gRNA sequence
agaaagtgcctccagagttt

SEQ ID NO: 530381 - DNA, 20 bp, Artificial
  CRISPR gRNA sequence
agtgcctccagagtttgaga

SEQ ID NO: 530382 - DNA, 20 bp, Artificial
  CRISPR gRNA sequence
gtgcctccagagtttgagaa

SEQ ID NO: 530383 - DNA, 20 bp, Artificial
  CRISPR gRNA sequence
tgagaaaggcaatgctttaa

SEQ ID NO: 530384 - DNA, 20 bp, Artificial
  CRISPR gRNA sequence
gaaaggcaatgctttaacag

SEQ ID NO: 530385 - DNA, 20 bp, Artificial
  CRISPR gRNA sequence
ggcaatgctttaacagcagc

SEQ ID NO: 530386 - DNA, 20 bp, Artificial
  CRISPR gRNA sequence
gcaatgctttaacagcagcc

SEQ ID NO: 530387 - DNA, 20 bp, Artificial
  CRISPR gRNA sequence
agcagccaggaaccccatcc

SEQ ID NO: 530388 - DNA, 20 bp, Artificial
  CRISPR gRNA sequence
cagccaggaaccccatcctg

SEQ ID NO: 530389 - DNA, 20 bp, Artificial
  CRISPR gRNA sequence
agccaggaaccccatcctgg

SEQ ID NO: 530390 - DNA, 20 bp, Artificial
  CRISPR gRNA sequence
tcaccacattgacatgtgac

SEQ ID NO: 530391 - DNA, 20 bp, Artificial
  CRISPR gRNA sequence
caccacattgacatgtgact

SEQ ID NO: 530392 - DNA, 20 bp, Artificial
  CRISPR gRNA sequence
accacattgacatgtgactg

SEQ ID NO: 530393 - DNA, 20 bp, Artificial
  CRISPR gRNA sequence
tgacatgtgactggggacct

SEQ ID NO: 530394 - DNA, 20 bp, Artificial
  CRISPR gRNA sequence
tggatacctctgcccccacc

SEQ ID NO: 530395 - DNA, 20 bp, Artificial
  CRISPR gRNA sequence
ctctgcccccaccaagttcc

SEQ ID NO: 530396 - DNA, 20 bp, Artificial
  CRISPR gRNA sequence
ctgcccccaccaagttcctg

SEQ ID NO: 530397 - DNA, 20 bp, Artificial
  CRISPR gRNA sequence
cccccaccaagttcctggag

SEQ ID NO: 530398 - DNA, 20 bp, Artificial
  CRISPR gRNA sequence
ccaccaagttcctggagcag

SEQ ID NO: 530399 - DNA, 20 bp, Artificial
  CRISPR gRNA sequence
caccaagttcctggagcagt

SEQ ID NO: 530400 - DNA, 20 bp, Artificial
  CRISPR gRNA sequence
aagttcctggagcagtgggc

SEQ ID NO: 530401 - DNA, 20 bp, Artificial
  CRISPR gRNA sequence
agttcctggagcagtgggcc

SEQ ID NO: 530402 - DNA, 20 bp, Artificial
  CRISPR gRNA sequence
tcctggagcagtgggccagg

SEQ ID NO: 530403 - DNA, 20 bp, Artificial
  CRISPR gRNA sequence
cctggagcagtgggccaggt

SEQ ID NO: 530404 - DNA, 20 bp, Artificial
  CRISPR gRNA sequence
tgggccaggtgggtatatgt

SEQ ID NO: 530405 - DNA, 20 bp, Artificial
  CRISPR gRNA sequence
ggtgggtatatgtgagtgtg

SEQ ID NO: 530406 - DNA, 20 bp, Artificial
  CRISPR gRNA sequence
gtgggtatatgtgagtgtgt

SEQ ID NO: 530407 - DNA, 20 bp, Artificial
  CRISPR gRNA sequence
atgtgagtgtgtgggtgtcc

SEQ ID NO: 530408 - DNA, 20 bp, Artificial
  CRISPR gRNA sequence
tgtgagtgtgtgggtgtcca

SEQ ID NO: 530409 - DNA, 20 bp, Artificial
  CRISPR gRNA sequence
tgagtgtgtgggtgtccaag

SEQ ID NO: 530410 - DNA, 20 bp, Artificial
  CRISPR gRNA sequence
gtgggtgtccaaggagctca

SEQ ID NO: 530411 - DNA, 20 bp, Artificial
  CRISPR gRNA sequence
gtccaaggagctcaaagctc

SEQ ID NO: 530412 - DNA, 20 bp, Artificial
  CRISPR gRNA sequence
tccaaggagctcaaagctct

SEQ ID NO: 530413 - DNA, 20 bp, Artificial
  CRISPR gRNA sequence
ccaaggagctcaaagctcta

SEQ ID NO: 530414 - DNA, 20 bp, Artificial
  CRISPR gRNA sequence
agctcaaagctctagggaaa

SEQ ID NO: 530415 - DNA, 20 bp, Artificial
  CRISPR gRNA sequence
ctcaaagctctagggaaaaa

SEQ ID NO: 530416 - DNA, 20 bp, Artificial
  CRISPR gRNA sequence
agggaaaaagagcacctgcc

SEQ ID NO: 530417 - DNA, 20 bp, Artificial
  CRISPR gRNA sequence
gggaaaaagagcacctgcct

SEQ ID NO: 530418 - DNA, 20 bp, Artificial
  CRISPR gRNA sequence
aagagcacctgcctgggaac

SEQ ID NO: 530419 - DNA, 20 bp, Artificial
  CRISPR gRNA sequence
gagcacctgcctgggaacca

SEQ ID NO: 530420 - DNA, 20 bp, Artificial
  CRISPR gRNA sequence
gacttgattctgccttttcc

SEQ ID NO: 530421 - DNA, 20 bp, Artificial
  CRISPR gRNA sequence
gattctgccttttcccagcc

SEQ ID NO: 530422 - DNA, 20 bp, Artificial
  CRISPR gRNA sequence
ttctgccttttcccagccca

SEQ ID NO: 530423 - DNA, 20 bp, Artificial
  CRISPR gRNA sequence
tttcccagcccagagctgct

SEQ ID NO: 530424 - DNA, 20 bp, Artificial
  CRISPR gRNA sequence
cagagctgctcagttgctca

SEQ ID NO: 530425 - DNA, 20 bp, Artificial
  CRISPR gRNA sequence
agagctgctcagttgctcac

SEQ ID NO: 530426 - DNA, 20 bp, Artificial
  CRISPR gRNA sequence
gagctgctcagttgctcaca

SEQ ID NO: 530427 - DNA, 20 bp, Artificial
  CRISPR gRNA sequence
gttgctcacagggtctacgc

SEQ ID NO: 530428 - DNA, 20 bp, Artificial
  CRISPR gRNA sequence
gggtctacgctggccctcct

SEQ ID NO: 530429 - DNA, 20 bp, Artificial
  CRISPR gRNA sequence
gtctacgctggccctcctca

SEQ ID NO: 530430 - DNA, 20 bp, Artificial
  CRISPR gRNA sequence
gctggccctcctcagagcat

SEQ ID NO: 530431 - DNA, 20 bp, Artificial
  CRISPR gRNA sequence
ccctcctcagagcatcagaa

SEQ ID NO: 530432 - DNA, 20 bp, Artificial
  CRISPR gRNA sequence
cctcctcagagcatcagaaa

SEQ ID NO: 530433 - DNA, 20 bp, Artificial
  CRISPR gRNA sequence
tcagagcatcagaaaaggat

SEQ ID NO: 530434 - DNA, 20 bp, Artificial
  CRISPR gRNA sequence
acataccctacctgtcacaa

SEQ ID NO: 530435 - DNA, 20 bp, Artificial
  CRISPR gRNA sequence
cataccctacctgtcacaaa

SEQ ID NO: 530436 - DNA, 20 bp, Artificial
  CRISPR gRNA sequence
taccctacctgtcacaaaag

SEQ ID NO: 530437 - DNA, 20 bp, Artificial
  CRISPR gRNA sequence
gtcacaaaaggagcaacatg

SEQ ID NO: 530438 - DNA, 20 bp, Artificial
  CRISPR gRNA sequence
aaaaggagcaacatgtggca

SEQ ID NO: 530439 - DNA, 20 bp, Artificial
  CRISPR gRNA sequence
agcaacatgtggcaaagccc

SEQ ID NO: 530440 - DNA, 20 bp, Artificial
  CRISPR gRNA sequence
gcaacatgtggcaaagccct

SEQ ID NO: 530441 - DNA, 20 bp, Artificial
  CRISPR gRNA sequence
acatgtggcaaagccctggg

SEQ ID NO: 530442 - DNA, 20 bp, Artificial
  CRISPR gRNA sequence
caaagccctgggcagatcgt

SEQ ID NO: 530443 - DNA, 20 bp, Artificial
  CRISPR gRNA sequence
aaagccctgggcagatcgtt

SEQ ID NO: 530444 - DNA, 20 bp, Artificial
  CRISPR gRNA sequence
tcgttaggcactgacattat

SEQ ID NO: 530445 - DNA, 20 bp, Artificial
  CRISPR gRNA sequence
ttaggcactgacattattag

SEQ ID NO: 530446 - DNA, 20 bp, Artificial
  CRISPR gRNA sequence
aacctcttgcctctcccgca

SEQ ID NO: 530447 - DNA, 20 bp, Artificial
  CRISPR gRNA sequence
cctcttgcctctcccgcaca

SEQ ID NO: 530448 - DNA, 20 bp, Artificial
  CRISPR gRNA sequence
gcacagagattgcaccacaa

SEQ ID NO: 530449 - DNA, 20 bp, Artificial
  CRISPR gRNA sequence
cacagagattgcaccacaaa

SEQ ID NO: 530450 - DNA, 20 bp, Artificial
  CRISPR gRNA sequence
caccacaaaaggaaaatgcc

SEQ ID NO: 530451 - DNA, 20 bp, Artificial
  CRISPR gRNA sequence
accacaaaaggaaaatgcct

SEQ ID NO: 530452 - DNA, 20 bp, Artificial
  CRISPR gRNA sequence
aaaaggaaaatgcctaggcc

SEQ ID NO: 530453 - DNA, 20 bp, Artificial
  CRISPR gRNA sequence
aaaatgcctaggcctagcat

SEQ ID NO: 530454 - DNA, 20 bp, Artificial
  CRISPR gRNA sequence
tgcctaggcctagcattaga

SEQ ID NO: 530455 - DNA, 20 bp, Artificial
  CRISPR gRNA sequence
aggcctagcattagatggct

SEQ ID NO: 530456 - DNA, 20 bp, Artificial
  CRISPR gRNA sequence
ggcctagcattagatggctc

SEQ ID NO: 530457 - DNA, 20 bp, Artificial
  CRISPR gRNA sequence
gatggctcaggtctacatct

SEQ ID NO: 530458 - DNA, 20 bp, Artificial
  CRISPR gRNA sequence
atcttagccccatcacttcc

SEQ ID NO: 530459 - DNA, 20 bp, Artificial
  CRISPR gRNA sequence
attctttactttgttccccc

SEQ ID NO: 530460 - DNA, 20 bp, Artificial
  CRISPR gRNA sequence
gacttgccacttttccctct

SEQ ID NO: 530461 - DNA, 20 bp, Artificial
  CRISPR gRNA sequence
gtttctctccattcataata

SEQ ID NO: 530462 - DNA, 20 bp, Artificial
  CRISPR gRNA sequence
ctctccattcataatataga

SEQ ID NO: 530463 - DNA, 20 bp, Artificial
  CRISPR gRNA sequence
cattcataatatagatggac

SEQ ID NO: 530464 - DNA, 20 bp, Artificial
  CRISPR gRNA sequence
ttccctcccactctgacttc

SEQ ID NO: 530465 - DNA, 20 bp, Artificial
  CRISPR gRNA sequence
agacaccaatattttcccca

SEQ ID NO: 530466 - DNA, 20 bp, Artificial
  CRISPR gRNA sequence
attttccccatggaacacca

SEQ ID NO: 530467 - DNA, 20 bp, Artificial
  CRISPR gRNA sequence
catttatgtcccgatatata

SEQ ID NO: 530468 - DNA, 20 bp, Artificial
  CRISPR gRNA sequence
atttatgtcccgatatatat

SEQ ID NO: 530469 - DNA, 20 bp, Artificial
  CRISPR gRNA sequence
tcccgatatatataggcatg

SEQ ID NO: 530470 - DNA, 20 bp, Artificial
  CRISPR gRNA sequence
gcatgcagaaattaaattaa

SEQ ID NO: 530471 - DNA, 20 bp, Artificial
  CRISPR gRNA sequence
aaaagttttcttctcatccc

SEQ ID NO: 530472 - DNA, 20 bp, Artificial
  CRISPR gRNA sequence
tcccaagattctgcgttact

SEQ ID NO: 530473 - DNA, 20 bp, Artificial
  CRISPR gRNA sequence
caagattctgcgttactgag

SEQ ID NO: 530474 - DNA, 20 bp, Artificial
  CRISPR gRNA sequence
aagattctgcgttactgaga

SEQ ID NO: 530475 - DNA, 20 bp, Artificial
  CRISPR gRNA sequence
attctgcgttactgagaagg

SEQ ID NO: 530476 - DNA, 20 bp, Artificial
  CRISPR gRNA sequence
gttactgagaaggaagaaaa

SEQ ID NO: 530477 - DNA, 20 bp, Artificial
  CRISPR gRNA sequence
aaatggaaattatcaacatt

SEQ ID NO: 530478 - DNA, 20 bp, Artificial
  CRISPR gRNA sequence
aaattatcaacattcagcaa

SEQ ID NO: 530479 - DNA, 20 bp, Artificial
  CRISPR gRNA sequence
attatcaacattcagcaaca

SEQ ID NO: 530480 - DNA, 20 bp, Artificial
  CRISPR gRNA sequence
tcaacattcagcaacagagt

SEQ ID NO: 530481 - DNA, 20 bp, Artificial
  CRISPR gRNA sequence
tcagcaacagagttagtaca

SEQ ID NO: 530482 - DNA, 20 bp, Artificial
  CRISPR gRNA sequence
aacagagttagtacatagtc

SEQ ID NO: 530483 - DNA, 20 bp, Artificial
  CRISPR gRNA sequence
cagagttagtacatagtcta

SEQ ID NO: 530484 - DNA, 20 bp, Artificial
  CRISPR gRNA sequence
agagttagtacatagtctag

SEQ ID NO: 530485 - DNA, 20 bp, Artificial
  CRISPR gRNA sequence
ttagtacatagtctagaggt

SEQ ID NO: 530486 - DNA, 20 bp, Artificial
  CRISPR gRNA sequence
tagtacatagtctagaggtt

SEQ ID NO: 530487 - DNA, 20 bp, Artificial
  CRISPR gRNA sequence
agtctagaggttgggtcacg

SEQ ID NO: 530488 - DNA, 20 bp, Artificial
  CRISPR gRNA sequence
acgaagtttgcccgtctctt

SEQ ID NO: 530489 - DNA, 20 bp, Artificial
  CRISPR gRNA sequence
gtttgcccgtctcttcagaa

SEQ ID NO: 530490 - DNA, 20 bp, Artificial
  CRISPR gRNA sequence
tattttttttctacttataa

SEQ ID NO: 530491 - DNA, 20 bp, Artificial
  CRISPR gRNA sequence
ttctacttataacagcaaca

SEQ ID NO: 530492 - DNA, 20 bp, Artificial
  CRISPR gRNA sequence
gcaacacagtaacatgattg

SEQ ID NO: 530493 - DNA, 20 bp, Artificial
  CRISPR gRNA sequence
cagtaacatgattgtggtga

SEQ ID NO: 530494 - DNA, 20 bp, Artificial
  CRISPR gRNA sequence
gcaaaactctgaatatacta

SEQ ID NO: 530495 - DNA, 20 bp, Artificial
  CRISPR gRNA sequence
caaaactctgaatatactaa

SEQ ID NO: 530496 - DNA, 20 bp, Artificial
  CRISPR gRNA sequence
gaatatactaaaggccgttt

SEQ ID NO: 530497 - DNA, 20 bp, Artificial
  CRISPR gRNA sequence
ctaaaggccgttttagtgta

SEQ ID NO: 530498 - DNA, 20 bp, Artificial
  CRISPR gRNA sequence
tgtatggacaaattgaatga

SEQ ID NO: 530499 - DNA, 20 bp, Artificial
  CRISPR gRNA sequence
gtatggacaaattgaatgat

SEQ ID NO: 530500 - DNA, 20 bp, Artificial
  CRISPR gRNA sequence
ataggtgaattatctcaatg

SEQ ID NO: 530501 - DNA, 20 bp, Artificial
  CRISPR gRNA sequence
attatctcaatgaagctgtt

SEQ ID NO: 530502 - DNA, 20 bp, Artificial
  CRISPR gRNA sequence
atgaagctgtttagaaaaaa

SEQ ID NO: 530503 - DNA, 20 bp, Artificial
  CRISPR gRNA sequence
gctgtttagaaaaaaaagaa

SEQ ID NO: 530504 - DNA, 20 bp, Artificial
  CRISPR gRNA sequence
ctgtttagaaaaaaaagaaa

SEQ ID NO: 530505 - DNA, 20 bp, Artificial
  CRISPR gRNA sequence
aggtcatcatccttgccaaa

SEQ ID NO: 530506 - DNA, 20 bp, Artificial
  CRISPR gRNA sequence
tccttgccaaaaagacctct

SEQ ID NO: 530507 - DNA, 20 bp, Artificial
  CRISPR gRNA sequence
atcctgactttgctcctgtc

SEQ ID NO: 530508 - DNA, 20 bp, Artificial
  CRISPR gRNA sequence
ctttgctcctgtcaagcaat

SEQ ID NO: 530509 - DNA, 20 bp, Artificial
  CRISPR gRNA sequence
cctgtcaagcaatgagacct

SEQ ID NO: 530510 - DNA, 20 bp, Artificial
  CRISPR gRNA sequence
caagcaatgagaccttggac

SEQ ID NO: 530511 - DNA, 20 bp, Artificial
  CRISPR gRNA sequence
ttggacaagctgcttctgac

SEQ ID NO: 530512 - DNA, 20 bp, Artificial
  CRISPR gRNA sequence
tggacaagctgcttctgact

SEQ ID NO: 530513 - DNA, 20 bp, Artificial
  CRISPR gRNA sequence
tctgttttcttatatataac

SEQ ID NO: 530514 - DNA, 20 bp, Artificial
  CRISPR gRNA sequence
ctgttttcttatatataaca

SEQ ID NO: 530515 - DNA, 20 bp, Artificial
  CRISPR gRNA sequence
gttttcttatatataacaag

SEQ ID NO: 530516 - DNA, 20 bp, Artificial
  CRISPR gRNA sequence
aacaaggagataataacaac

SEQ ID NO: 530517 - DNA, 20 bp, Artificial
  CRISPR gRNA sequence
acaaggagataataacaact

SEQ ID NO: 530518 - DNA, 20 bp, Artificial
  CRISPR gRNA sequence
agataataacaactaggtct

SEQ ID NO: 530519 - DNA, 20 bp, Artificial
  CRISPR gRNA sequence
caactaggtctcagtattgt

SEQ ID NO: 530520 - DNA, 20 bp, Artificial
  CRISPR gRNA sequence
aactaggtctcagtattgtt

SEQ ID NO: 530521 - DNA, 20 bp, Artificial
  CRISPR gRNA sequence
tattgttgggcgctttaaat

SEQ ID NO: 530522 - DNA, 20 bp, Artificial
  CRISPR gRNA sequence
cgctttaaataagatcatgt

SEQ ID NO: 530523 - DNA, 20 bp, Artificial
  CRISPR gRNA sequence
ttaaataagatcatgtaagc

SEQ ID NO: 530524 - DNA, 20 bp, Artificial
  CRISPR gRNA sequence
gcaagcacttgacccctaac

SEQ ID NO: 530525 - DNA, 20 bp, Artificial
  CRISPR gRNA sequence
agcacttgacccctaactgg

SEQ ID NO: 530526 - DNA, 20 bp, Artificial
  CRISPR gRNA sequence
caaatgtgaaaacaccaaca

SEQ ID NO: 530527 - DNA, 20 bp, Artificial
  CRISPR gRNA sequence
caccaacatggtcccccatg

SEQ ID NO: 530528 - DNA, 20 bp, Artificial
  CRISPR gRNA sequence
accaacatggtcccccatgt

SEQ ID NO: 530529 - DNA, 20 bp, Artificial
  CRISPR gRNA sequence
ccaacatggtcccccatgta

SEQ ID NO: 530530 - DNA, 20 bp, Artificial
  CRISPR gRNA sequence
tgtagggctcacactcaaaa

SEQ ID NO: 530531 - DNA, 20 bp, Artificial
  CRISPR gRNA sequence
gtagggctcacactcaaaac

SEQ ID NO: 530532 - DNA, 20 bp, Artificial
  CRISPR gRNA sequence
acactcaaaacaggacactc

SEQ ID NO: 530533 - DNA, 20 bp, Artificial
  CRISPR gRNA sequence
cactcgagttctgtgctgtt

SEQ ID NO: 530534 - DNA, 20 bp, Artificial
  CRISPR gRNA sequence
ctcgagttctgtgctgtttg

SEQ ID NO: 530535 - DNA, 20 bp, Artificial
  CRISPR gRNA sequence
tctgtgctgtttggagtcct

SEQ ID NO: 530536 - DNA, 20 bp, Artificial
  CRISPR gRNA sequence
gtttggagtcctgagatctg

SEQ ID NO: 530537 - DNA, 20 bp, Artificial
  CRISPR gRNA sequence
gtcctgagatctgtggtttc

SEQ ID NO: 530538 - DNA, 20 bp, Artificial
  CRISPR gRNA sequence
cctgagatctgtggtttcca

SEQ ID NO: 530539 - DNA, 20 bp, Artificial
  CRISPR gRNA sequence
tggtttccagagcccataat

SEQ ID NO: 530540 - DNA, 20 bp, Artificial
  CRISPR gRNA sequence
gtttccagagcccataatca

SEQ ID NO: 530541 - DNA, 20 bp, Artificial
  CRISPR gRNA sequence
tttccagagcccataatcag

SEQ ID NO: 530542 - DNA, 20 bp, Artificial
  CRISPR gRNA sequence
ccataatcagaggctctttt

SEQ ID NO: 530543 - DNA, 20 bp, Artificial
  CRISPR gRNA sequence
caaccccactacatttctac

SEQ ID NO: 530544 - DNA, 20 bp, Artificial
  CRISPR gRNA sequence
aaccccactacatttctaca

SEQ ID NO: 530545 - DNA, 20 bp, Artificial
  CRISPR gRNA sequence
ctacaaggtgctctccactc

SEQ ID NO: 530546 - DNA, 20 bp, Artificial
  CRISPR gRNA sequence
tacaaggtgctctccactca

SEQ ID NO: 530547 - DNA, 20 bp, Artificial
  CRISPR gRNA sequence
gtgctctccactcaaggttg

SEQ ID NO: 530548 - DNA, 20 bp, Artificial
  CRISPR gRNA sequence
tgctctccactcaaggttgc

SEQ ID NO: 530549 - DNA, 20 bp, Artificial
  CRISPR gRNA sequence
tccactcaaggttgcaggac

SEQ ID NO: 530550 - DNA, 20 bp, Artificial
  CRISPR gRNA sequence
ccactcaaggttgcaggact

SEQ ID NO: 530551 - DNA, 20 bp, Artificial
  CRISPR gRNA sequence
cactcaaggttgcaggacta

SEQ ID NO: 530552 - DNA, 20 bp, Artificial
  CRISPR gRNA sequence
aaggttgcaggactagggtg

SEQ ID NO: 530553 - DNA, 20 bp, Artificial
  CRISPR gRNA sequence
ttgcaggactagggtgtgga

SEQ ID NO: 530554 - DNA, 20 bp, Artificial
  CRISPR gRNA sequence
ggtgtggaaagttgtcactt

SEQ ID NO: 530555 - DNA, 20 bp, Artificial
  CRISPR gRNA sequence
gtgtggaaagttgtcacttc

SEQ ID NO: 530556 - DNA, 20 bp, Artificial
  CRISPR gRNA sequence
tgtggaaagttgtcacttca

SEQ ID NO: 530557 - DNA, 20 bp, Artificial
  CRISPR gRNA sequence
gtggaaagttgtcacttcag

SEQ ID NO: 530558 - DNA, 20 bp, Artificial
  CRISPR gRNA sequence
ggaaagttgtcacttcaggg

SEQ ID NO: 530559 - DNA, 20 bp, Artificial
  CRISPR gRNA sequence
tgtcacttcaggggagctga

SEQ ID NO: 530560 - DNA, 20 bp, Artificial
  CRISPR gRNA sequence
tcaggggagctgacagtgtc

SEQ ID NO: 530561 - DNA, 20 bp, Artificial
  CRISPR gRNA sequence
caggggagctgacagtgtct

SEQ ID NO: 530562 - DNA, 20 bp, Artificial
  CRISPR gRNA sequence
ctgacagtgtctgggattgc

SEQ ID NO: 530563 - DNA, 20 bp, Artificial
  CRISPR gRNA sequence
gacagtgtctgggattgctg

SEQ ID NO: 530564 - DNA, 20 bp, Artificial
  CRISPR gRNA sequence
agtgtctgggattgctggag

SEQ ID NO: 530565 - DNA, 20 bp, Artificial
  CRISPR gRNA sequence
gtgtctgggattgctggagt

SEQ ID NO: 530566 - DNA, 20 bp, Artificial
  CRISPR gRNA sequence
gtgggcaatctgacactatc

SEQ ID NO: 530567 - DNA, 20 bp, Artificial
  CRISPR gRNA sequence
tgggcaatctgacactatct

SEQ ID NO: 530568 - DNA, 20 bp, Artificial
  CRISPR gRNA sequence
ctgacactatctgggattgc

SEQ ID NO: 530569 - DNA, 20 bp, Artificial
  CRISPR gRNA sequence
acactatctgggattgctgg

SEQ ID NO: 530570 - DNA, 20 bp, Artificial
  CRISPR gRNA sequence
cactatctgggattgctggt

SEQ ID NO: 530571 - DNA, 20 bp, Artificial
  CRISPR gRNA sequence
tctgggattgctggtaggcc

SEQ ID NO: 530572 - DNA, 20 bp, Artificial
  CRISPR gRNA sequence
ctgggattgctggtaggccc

SEQ ID NO: 530573 - DNA, 20 bp, Artificial
  CRISPR gRNA sequence
gctggtaggcccaggtgctg

SEQ ID NO: 530574 - DNA, 20 bp, Artificial
  CRISPR gRNA sequence
gtaggcccaggtgctgaaga

SEQ ID NO: 530575 - DNA, 20 bp, Artificial
  CRISPR gRNA sequence
taggcccaggtgctgaagat

SEQ ID NO: 530576 - DNA, 20 bp, Artificial
  CRISPR gRNA sequence
aggcccaggtgctgaagatg

SEQ ID NO: 530577 - DNA, 20 bp, Artificial
  CRISPR gRNA sequence
ccaggtgctgaagatggggc

SEQ ID NO: 530578 - DNA, 20 bp, Artificial
  CRISPR gRNA sequence
aggtgctgaagatggggctg

SEQ ID NO: 530579 - DNA, 20 bp, Artificial
  CRISPR gRNA sequence
gctgaagatggggctggaga

SEQ ID NO: 530580 - DNA, 20 bp, Artificial
  CRISPR gRNA sequence
tgaagatggggctggagaca

SEQ ID NO: 530581 - DNA, 20 bp, Artificial
  CRISPR gRNA sequence
aagatggggctggagacaga

SEQ ID NO: 530582 - DNA, 20 bp, Artificial
  CRISPR gRNA sequence
agatggggctggagacagag

SEQ ID NO: 530583 - DNA, 20 bp, Artificial
  CRISPR gRNA sequence
tggggctggagacagagagg

SEQ ID NO: 530584 - DNA, 20 bp, Artificial
  CRISPR gRNA sequence
ggctggagacagagaggaag

SEQ ID NO: 530585 - DNA, 20 bp, Artificial
  CRISPR gRNA sequence
gctggagacagagaggaaga

SEQ ID NO: 530586 - DNA, 20 bp, Artificial
  CRISPR gRNA sequence
ggagacagagaggaagaagg

SEQ ID NO: 530587 - DNA, 20 bp, Artificial
  CRISPR gRNA sequence
gagacagagaggaagaaggt

SEQ ID NO: 530588 - DNA, 20 bp, Artificial
  CRISPR gRNA sequence
agacagagaggaagaaggtg

SEQ ID NO: 530589 - DNA, 20 bp, Artificial
  CRISPR gRNA sequence
gaaggtggggtccctgcttc

SEQ ID NO: 530590 - DNA, 20 bp, Artificial
  CRISPR gRNA sequence
ctggcgacattttctgtgtg

SEQ ID NO: 530591 - DNA, 20 bp, Artificial
  CRISPR gRNA sequence
gacattttctgtgtgaagca

SEQ ID NO: 530592 - DNA, 20 bp, Artificial
  CRISPR gRNA sequence
atgcttatttgctcactgaa

SEQ ID NO: 530593 - DNA, 20 bp, Artificial
  CRISPR gRNA sequence
ttatttgctcactgaatggc

SEQ ID NO: 530594 - DNA, 20 bp, Artificial
  CRISPR gRNA sequence
tggctggcctgtgctcatgc

SEQ ID NO: 530595 - DNA, 20 bp, Artificial
  CRISPR gRNA sequence
ggctggcctgtgctcatgct

SEQ ID NO: 530596 - DNA, 20 bp, Artificial
  CRISPR gRNA sequence
gctggcctgtgctcatgctg

SEQ ID NO: 530597 - DNA, 20 bp, Artificial
  CRISPR gRNA sequence
gggttcctgtcttcctcccc

SEQ ID NO: 530598 - DNA, 20 bp, Artificial
  CRISPR gRNA sequence
tcctgtcttcctccccaagc

SEQ ID NO: 530599 - DNA, 20 bp, Artificial
  CRISPR gRNA sequence
ccttcttatcactccctgcc

SEQ ID NO: 530600 - DNA, 20 bp, Artificial
  CRISPR gRNA sequence
cactccctgcccagcatccg

SEQ ID NO: 530601 - DNA, 20 bp, Artificial
  CRISPR gRNA sequence
actccctgcccagcatccgt

SEQ ID NO: 530602 - DNA, 20 bp, Artificial
  CRISPR gRNA sequence
ttcaactccaatcattgtac

SEQ ID NO: 530603 - DNA, 20 bp, Artificial
  CRISPR gRNA sequence
agctgataaaatatttttaa

SEQ ID NO: 530604 - DNA, 20 bp, Artificial
  CRISPR gRNA sequence
aaaatatttttaaaagttta

SEQ ID NO: 530605 - DNA, 20 bp, Artificial
  CRISPR gRNA sequence
atatttttaaaagtttaaag

SEQ ID NO: 530606 - DNA, 20 bp, Artificial
  CRISPR gRNA sequence
acccacaacgccaccactca

SEQ ID NO: 530607 - DNA, 20 bp, Artificial
  CRISPR gRNA sequence
aatattttcatgtatatctt

SEQ ID NO: 530608 - DNA, 20 bp, Artificial
  CRISPR gRNA sequence
attttcatgtatatctttag

SEQ ID NO: 530609 - DNA, 20 bp, Artificial
  CRISPR gRNA sequence
atataaataatataatattt

SEQ ID NO: 530610 - DNA, 20 bp, Artificial
  CRISPR gRNA sequence
aaataatataatatttcagc

SEQ ID NO: 530611 - DNA, 20 bp, Artificial
  CRISPR gRNA sequence
aataatataatatttcagct

SEQ ID NO: 530612 - DNA, 20 bp, Artificial
  CRISPR gRNA sequence
taatataatatttcagctgg

SEQ ID NO: 530613 - DNA, 20 bp, Artificial
  CRISPR gRNA sequence
atataatatttcagctggga

SEQ ID NO: 530614 - DNA, 20 bp, Artificial
  CRISPR gRNA sequence
tataatatttcagctgggag

SEQ ID NO: 530615 - DNA, 20 bp, Artificial
  CRISPR gRNA sequence
aatatttcagctgggagagg

SEQ ID NO: 530616 - DNA, 20 bp, Artificial
  CRISPR gRNA sequence
ggtggctcatgcctgtaatc

SEQ ID NO: 530617 - DNA, 20 bp, Artificial
  CRISPR gRNA sequence
atgcctgtaatccagcactt

SEQ ID NO: 530618 - DNA, 20 bp, Artificial
  CRISPR gRNA sequence
tgcctgtaatccagcacttt

SEQ ID NO: 530619 - DNA, 20 bp, Artificial
  CRISPR gRNA sequence
cctgtaatccagcactttgg

SEQ ID NO: 530620 - DNA, 20 bp, Artificial
  CRISPR gRNA sequence
ctgtaatccagcactttggg

SEQ ID NO: 530621 - DNA, 20 bp, Artificial
  CRISPR gRNA sequence
atccagcactttgggaggct

SEQ ID NO: 530622 - DNA, 20 bp, Artificial
  CRISPR gRNA sequence
tccagcactttgggaggcta

SEQ ID NO: 530623 - DNA, 20 bp, Artificial
  CRISPR gRNA sequence
agcactttgggaggctaagg

SEQ ID NO: 530624 - DNA, 20 bp, Artificial
  CRISPR gRNA sequence
gcactttgggaggctaaggt

SEQ ID NO: 530625 - DNA, 20 bp, Artificial
  CRISPR gRNA sequence
ctttgggaggctaaggtggg

SEQ ID NO: 530626 - DNA, 20 bp, Artificial
  CRISPR gRNA sequence
ctaaggtgggcggatctctt

SEQ ID NO: 530627 - DNA, 20 bp, Artificial
  CRISPR gRNA sequence
taaggtgggcggatctcttg

SEQ ID NO: 530628 - DNA, 20 bp, Artificial
  CRISPR gRNA sequence
gtgggcggatctcttgaggc

SEQ ID NO: 530629 - DNA, 20 bp, Artificial
  CRISPR gRNA sequence
tgggcggatctcttgaggcc

SEQ ID NO: 530630 - DNA, 20 bp, Artificial
  CRISPR gRNA sequence
ggcggatctcttgaggccag

SEQ ID NO: 530631 - DNA, 20 bp, Artificial
  CRISPR gRNA sequence
tctcttgaggccaggagttc

SEQ ID NO: 530632 - DNA, 20 bp, Artificial
  CRISPR gRNA sequence
tcttgaggccaggagttcaa

SEQ ID NO: 530633 - DNA, 20 bp, Artificial
  CRISPR gRNA sequence
tgaggccaggagttcaagag

SEQ ID NO: 530634 - DNA, 20 bp, Artificial
  CRISPR gRNA sequence
ccaggagttcaagagtagcc

SEQ ID NO: 530635 - DNA, 20 bp, Artificial
  CRISPR gRNA sequence
caagagtagcctggccaaca

SEQ ID NO: 530636 - DNA, 20 bp, Artificial
  CRISPR gRNA sequence
acatctctactaaaaatatg

SEQ ID NO: 530637 - DNA, 20 bp, Artificial
  CRISPR gRNA sequence
tctactaaaaatatgaagat

SEQ ID NO: 530638 - DNA, 20 bp, Artificial
  CRISPR gRNA sequence
ctaaaaatatgaagattagc

SEQ ID NO: 530639 - DNA, 20 bp, Artificial
  CRISPR gRNA sequence
taaaaatatgaagattagcc

SEQ ID NO: 530640 - DNA, 20 bp, Artificial
  CRISPR gRNA sequence
tgaagattagccaggtgtgt

SEQ ID NO: 530641 - DNA, 20 bp, Artificial
  CRISPR gRNA sequence
cgcctctaatccaaactact

SEQ ID NO: 530642 - DNA, 20 bp, Artificial
  CRISPR gRNA sequence
gcctctaatccaaactactc

SEQ ID NO: 530643 - DNA, 20 bp, Artificial
  CRISPR gRNA sequence
ctctaatccaaactactcag

SEQ ID NO: 530644 - DNA, 20 bp, Artificial
  CRISPR gRNA sequence
tctaatccaaactactcagg

SEQ ID NO: 530645 - DNA, 20 bp, Artificial
  CRISPR gRNA sequence
tccaaactactcaggaggct

SEQ ID NO: 530646 - DNA, 20 bp, Artificial
  CRISPR gRNA sequence
ccaaactactcaggaggctg

SEQ ID NO: 530647 - DNA, 20 bp, Artificial
  CRISPR gRNA sequence
tactcaggaggctgaggcat

SEQ ID NO: 530648 - DNA, 20 bp, Artificial
  CRISPR gRNA sequence
catgagaattgcttgaaccc

SEQ ID NO: 530649 - DNA, 20 bp, Artificial
  CRISPR gRNA sequence
tgagaattgcttgaacccaa

SEQ ID NO: 530650 - DNA, 20 bp, Artificial
  CRISPR gRNA sequence
gagaattgcttgaacccaag

SEQ ID NO: 530651 - DNA, 20 bp, Artificial
  CRISPR gRNA sequence
aattgcttgaacccaagagg

SEQ ID NO: 530652 - DNA, 20 bp, Artificial
  CRISPR gRNA sequence
ttgcttgaacccaagaggca

SEQ ID NO: 530653 - DNA, 20 bp, Artificial
  CRISPR gRNA sequence
tgcttgaacccaagaggcag

SEQ ID NO: 530654 - DNA, 20 bp, Artificial
  CRISPR gRNA sequence
aacccaagaggcagaggctg

SEQ ID NO: 530655 - DNA, 20 bp, Artificial
  CRISPR gRNA sequence
caagaggcagaggctgcagt

SEQ ID NO: 530656 - DNA, 20 bp, Artificial
  CRISPR gRNA sequence
aatatttcaccactgcactc

SEQ ID NO: 530657 - DNA, 20 bp, Artificial
  CRISPR gRNA sequence
atatttcaccactgcactcc

SEQ ID NO: 530658 - DNA, 20 bp, Artificial
  CRISPR gRNA sequence
ttcaccactgcactccaggc

SEQ ID NO: 530659 - DNA, 20 bp, Artificial
  CRISPR gRNA sequence
ctgcactccaggctggacga

SEQ ID NO: 530660 - DNA, 20 bp, Artificial
  CRISPR gRNA sequence
gcactccaggctggacgaca

SEQ ID NO: 530661 - DNA, 20 bp, Artificial
  CRISPR gRNA sequence
tccaggctggacgacagagt

SEQ ID NO: 530662 - DNA, 20 bp, Artificial
  CRISPR gRNA sequence
aactaatttatgtgatctta

SEQ ID NO: 530663 - DNA, 20 bp, Artificial
  CRISPR gRNA sequence
tattgtgaaattatattatg

SEQ ID NO: 530664 - DNA, 20 bp, Artificial
  CRISPR gRNA sequence
tgcatatatgcatcttttta

SEQ ID NO: 530665 - DNA, 20 bp, Artificial
  CRISPR gRNA sequence
gcatatatgcatctttttaa

SEQ ID NO: 530666 - DNA, 20 bp, Artificial
  CRISPR gRNA sequence
tcttaatttaactgattaat

SEQ ID NO: 530667 - DNA, 20 bp, Artificial
  CRISPR gRNA sequence
tttctaactgctgactgttc

SEQ ID NO: 530668 - DNA, 20 bp, Artificial
  CRISPR gRNA sequence
tttcgctaacatgaataatg

SEQ ID NO: 530669 - DNA, 20 bp, Artificial
  CRISPR gRNA sequence
taacatgaataatgcagtga

SEQ ID NO: 530670 - DNA, 20 bp, Artificial
  CRISPR gRNA sequence
aacatgaataatgcagtgat

SEQ ID NO: 530671 - DNA, 20 bp, Artificial
  CRISPR gRNA sequence
tgcagtgatgggcacccttg

SEQ ID NO: 530672 - DNA, 20 bp, Artificial
  CRISPR gRNA sequence
cagtgatgggcacccttgtg

SEQ ID NO: 530673 - DNA, 20 bp, Artificial
  CRISPR gRNA sequence
tgatgggcacccttgtggag

SEQ ID NO: 530674 - DNA, 20 bp, Artificial
  CRISPR gRNA sequence
tacctccgtatacattcact

SEQ ID NO: 530675 - DNA, 20 bp, Artificial
  CRISPR gRNA sequence
tccgtatacattcactaaga

SEQ ID NO: 530676 - DNA, 20 bp, Artificial
  CRISPR gRNA sequence
cattcactaagatagcgtct

SEQ ID NO: 530677 - DNA, 20 bp, Artificial
  CRISPR gRNA sequence
tcttagaactgatccaacct

SEQ ID NO: 530678 - DNA, 20 bp, Artificial
  CRISPR gRNA sequence
cttagaactgatccaaccta

SEQ ID NO: 530679 - DNA, 20 bp, Artificial
  CRISPR gRNA sequence
atccaacctaaggccttcca

SEQ ID NO: 530680 - DNA, 20 bp, Artificial
  CRISPR gRNA sequence
acctaaggccttccatggat

SEQ ID NO: 530681 - DNA, 20 bp, Artificial
  CRISPR gRNA sequence
gatgagaactccttaattct

SEQ ID NO: 530682 - DNA, 20 bp, Artificial
  CRISPR gRNA sequence
actccttaattctgagttgc

SEQ ID NO: 530683 - DNA, 20 bp, Artificial
  CRISPR gRNA sequence
ctccttaattctgagttgct

SEQ ID NO: 530684 - DNA, 20 bp, Artificial
  CRISPR gRNA sequence
gggattaaccccttccctac

SEQ ID NO: 530685 - DNA, 20 bp, Artificial
  CRISPR gRNA sequence
ccctactagcatctgcttct

SEQ ID NO: 530686 - DNA, 20 bp, Artificial
  CRISPR gRNA sequence
cctactagcatctgcttcta

SEQ ID NO: 530687 - DNA, 20 bp, Artificial
  CRISPR gRNA sequence
ctactagcatctgcttctaa

SEQ ID NO: 530688 - DNA, 20 bp, Artificial
  CRISPR gRNA sequence
tactagcatctgcttctaag

SEQ ID NO: 530689 - DNA, 20 bp, Artificial
  CRISPR gRNA sequence
ggggccctccattgcctctt

SEQ ID NO: 530690 - DNA, 20 bp, Artificial
  CRISPR gRNA sequence
tccattgcctcttcagcctg

SEQ ID NO: 530691 - DNA, 20 bp, Artificial
  CRISPR gRNA sequence
attgcctcttcagcctgcag

SEQ ID NO: 530692 - DNA, 20 bp, Artificial
  CRISPR gRNA sequence
gcagcagcaactccctcatg

SEQ ID NO: 530693 - DNA, 20 bp, Artificial
  CRISPR gRNA sequence
cagcagcaactccctcatga

SEQ ID NO: 530694 - DNA, 20 bp, Artificial
  CRISPR gRNA sequence
actccctcatgaaggaaatg

SEQ ID NO: 530695 - DNA, 20 bp, Artificial
  CRISPR gRNA sequence
ctccctcatgaaggaaatgc

SEQ ID NO: 530696 - DNA, 20 bp, Artificial
  CRISPR gRNA sequence
ggaaatgcaggcacaactac

SEQ ID NO: 530697 - DNA, 20 bp, Artificial
  CRISPR gRNA sequence
aaatgcaggcacaactactg

SEQ ID NO: 530698 - DNA, 20 bp, Artificial
  CRISPR gRNA sequence
aggcacaactactggagttt

SEQ ID NO: 530699 - DNA, 20 bp, Artificial
  CRISPR gRNA sequence
cacaactactggagtttgag

SEQ ID NO: 530700 - DNA, 20 bp, Artificial
  CRISPR gRNA sequence
ctactggagtttgagaagtt

SEQ ID NO: 530701 - DNA, 20 bp, Artificial
  CRISPR gRNA sequence
actggagtttgagaagtttg

SEQ ID NO: 530702 - DNA, 20 bp, Artificial
  CRISPR gRNA sequence
ctggagtttgagaagtttgg

SEQ ID NO: 530703 - DNA, 20 bp, Artificial
  CRISPR gRNA sequence
agtttgagaagtttggaggc

SEQ ID NO: 530704 - DNA, 20 bp, Artificial
  CRISPR gRNA sequence
gtttgagaagtttggaggcc

SEQ ID NO: 530705 - DNA, 20 bp, Artificial
  CRISPR gRNA sequence
aagtttggaggccgggtgcg

SEQ ID NO: 530706 - DNA, 20 bp, Artificial
  CRISPR gRNA sequence
gtggttcacacctgtaatcc

SEQ ID NO: 530707 - DNA, 20 bp, Artificial
  CRISPR gRNA sequence
cacctgtaatcccagcactt

SEQ ID NO: 530708 - DNA, 20 bp, Artificial
  CRISPR gRNA sequence
acctgtaatcccagcacttt

SEQ ID NO: 530709 - DNA, 20 bp, Artificial
  CRISPR gRNA sequence
ctgtaatcccagcactttgg

SEQ ID NO: 530710 - DNA, 20 bp, Artificial
  CRISPR gRNA sequence
tgtaatcccagcactttggg

SEQ ID NO: 530711 - DNA, 20 bp, Artificial
  CRISPR gRNA sequence
agcactttgggaggccgatg

SEQ ID NO: 530712 - DNA, 20 bp, Artificial
  CRISPR gRNA sequence
gcactttgggaggccgatgc

SEQ ID NO: 530713 - DNA, 20 bp, Artificial
  CRISPR gRNA sequence
ctttgggaggccgatgcagg

SEQ ID NO: 530714 - DNA, 20 bp, Artificial
  CRISPR gRNA sequence
ccgatgcaggcggatcccct

SEQ ID NO: 530715 - DNA, 20 bp, Artificial
  CRISPR gRNA sequence
cgatgcaggcggatcccctg

SEQ ID NO: 530716 - DNA, 20 bp, Artificial
  CRISPR gRNA sequence
gcaggcggatcccctgaggt

SEQ ID NO: 530717 - DNA, 20 bp, Artificial
  CRISPR gRNA sequence
caggcggatcccctgaggtc

SEQ ID NO: 530718 - DNA, 20 bp, Artificial
  CRISPR gRNA sequence
ggcggatcccctgaggtcag

SEQ ID NO: 530719 - DNA, 20 bp, Artificial
  CRISPR gRNA sequence
tcccctgaggtcaggagttt

SEQ ID NO: 530720 - DNA, 20 bp, Artificial
  CRISPR gRNA sequence
tgaggtcaggagtttgagac

SEQ ID NO: 530721 - DNA, 20 bp, Artificial
  CRISPR gRNA sequence
tgagaccagcctgaccaaca

SEQ ID NO: 530722 - DNA, 20 bp, Artificial
  CRISPR gRNA sequence
tctactaaaaatacaaaaat

SEQ ID NO: 530723 - DNA, 20 bp, Artificial
  CRISPR gRNA sequence
ctaaaaatacaaaaattagc

SEQ ID NO: 530724 - DNA, 20 bp, Artificial
  CRISPR gRNA sequence
atacaaaaattagccggacg

SEQ ID NO: 530725 - DNA, 20 bp, Artificial
  CRISPR gRNA sequence
caaaaattagccggacgtgg

SEQ ID NO: 530726 - DNA, 20 bp, Artificial
  CRISPR gRNA sequence
gtggtacatgcctgtaatcc

SEQ ID NO: 530727 - DNA, 20 bp, Artificial
  CRISPR gRNA sequence
tgcctgtaatcccagctact

SEQ ID NO: 530728 - DNA, 20 bp, Artificial
  CRISPR gRNA sequence
gcctgtaatcccagctactt

SEQ ID NO: 530729 - DNA, 20 bp, Artificial
  CRISPR gRNA sequence
ctgtaatcccagctacttgg

SEQ ID NO: 530730 - DNA, 20 bp, Artificial
  CRISPR gRNA sequence
tgtaatcccagctacttggg

SEQ ID NO: 530731 - DNA, 20 bp, Artificial
  CRISPR gRNA sequence
tcccagctacttgggaggct

SEQ ID NO: 530732 - DNA, 20 bp, Artificial
  CRISPR gRNA sequence
cccagctacttgggaggctg

SEQ ID NO: 530733 - DNA, 20 bp, Artificial
  CRISPR gRNA sequence
agctacttgggaggctgagg

SEQ ID NO: 530734 - DNA, 20 bp, Artificial
  CRISPR gRNA sequence
gctacttgggaggctgaggc

SEQ ID NO: 530735 - DNA, 20 bp, Artificial
  CRISPR gRNA sequence
tacttgggaggctgaggcag

SEQ ID NO: 530736 - DNA, 20 bp, Artificial
  CRISPR gRNA sequence
gcaggagaatcgcttgaacc

SEQ ID NO: 530737 - DNA, 20 bp, Artificial
  CRISPR gRNA sequence
caggagaatcgcttgaacct

SEQ ID NO: 530738 - DNA, 20 bp, Artificial
  CRISPR gRNA sequence
ggagaatcgcttgaacctgg

SEQ ID NO: 530739 - DNA, 20 bp, Artificial
  CRISPR gRNA sequence
gagaatcgcttgaacctggg

SEQ ID NO: 530740 - DNA, 20 bp, Artificial
  CRISPR gRNA sequence
aatcgcttgaacctgggagg

SEQ ID NO: 530741 - DNA, 20 bp, Artificial
  CRISPR gRNA sequence
tcgcttgaacctgggaggca

SEQ ID NO: 530742 - DNA, 20 bp, Artificial
  CRISPR gRNA sequence
cgcttgaacctgggaggcag

SEQ ID NO: 530743 - DNA, 20 bp, Artificial
  CRISPR gRNA sequence
aacctgggaggcagaggctg

SEQ ID NO: 530744 - DNA, 20 bp, Artificial
  CRISPR gRNA sequence
tgggaggcagaggctgcagt

SEQ ID NO: 530745 - DNA, 20 bp, Artificial
  CRISPR gRNA sequence
ggcagaggctgcagtgagct

SEQ ID NO: 530746 - DNA, 20 bp, Artificial
  CRISPR gRNA sequence
gcagtgagctgagatcatgc

SEQ ID NO: 530747 - DNA, 20 bp, Artificial
  CRISPR gRNA sequence
gagatcatgccagtgcactc

SEQ ID NO: 530748 - DNA, 20 bp, Artificial
  CRISPR gRNA sequence
catgccagtgcactccagcc

SEQ ID NO: 530749 - DNA, 20 bp, Artificial
  CRISPR gRNA sequence
atgccagtgcactccagcct

SEQ ID NO: 530750 - DNA, 20 bp, Artificial
  CRISPR gRNA sequence
gtgcactccagcctgggcaa

SEQ ID NO: 530751 - DNA, 20 bp, Artificial
  CRISPR gRNA sequence
gcactccagcctgggcaaca

SEQ ID NO: 530752 - DNA, 20 bp, Artificial
  CRISPR gRNA sequence
tccagcctgggcaacagagc

SEQ ID NO: 530753 - DNA, 20 bp, Artificial
  CRISPR gRNA sequence
attaaaaaaaaaaaaaaaaa

SEQ ID NO: 530754 - DNA, 20 bp, Artificial
  CRISPR gRNA sequence
taaaaaaaaaaaaaaaaaaa

SEQ ID NO: 530755 - DNA, 20 bp, Artificial
  CRISPR gRNA sequence
aaaaaaaaaaaaaaaaagag

SEQ ID NO: 530756 - DNA, 20 bp, Artificial
  CRISPR gRNA sequence
aaaaaaaaaaaagagaagct

SEQ ID NO: 530757 - DNA, 20 bp, Artificial
  CRISPR gRNA sequence
aaaaaaaaaagagaagcttg

SEQ ID NO: 530758 - DNA, 20 bp, Artificial
  CRISPR gRNA sequence
aagagaagcttggagaaaca

SEQ ID NO: 530759 - DNA, 20 bp, Artificial
  CRISPR gRNA sequence
gagaagcttggagaaacaaa

SEQ ID NO: 530760 - DNA, 20 bp, Artificial
  CRISPR gRNA sequence
cttggagaaacaaagagatg

SEQ ID NO: 530761 - DNA, 20 bp, Artificial
  CRISPR gRNA sequence
ttggagaaacaaagagatgt

SEQ ID NO: 530762 - DNA, 20 bp, Artificial
  CRISPR gRNA sequence
ggagaaacaaagagatgtgg

SEQ ID NO: 530763 - DNA, 20 bp, Artificial
  CRISPR gRNA sequence
gagaaacaaagagatgtggg

SEQ ID NO: 530764 - DNA, 20 bp, Artificial
  CRISPR gRNA sequence
agaaacaaagagatgtggga

SEQ ID NO: 530765 - DNA, 20 bp, Artificial
  CRISPR gRNA sequence
aaagagatgtgggagggcat

SEQ ID NO: 530766 - DNA, 20 bp, Artificial
  CRISPR gRNA sequence
tgtgggagggcattagcact

SEQ ID NO: 530767 - DNA, 20 bp, Artificial
  CRISPR gRNA sequence
gggcattagcactgagaaaa

SEQ ID NO: 530768 - DNA, 20 bp, Artificial
  CRISPR gRNA sequence
ggcattagcactgagaaaac

SEQ ID NO: 530769 - DNA, 20 bp, Artificial
  CRISPR gRNA sequence
agaaaacaggcattgtgccc

SEQ ID NO: 530770 - DNA, 20 bp, Artificial
  CRISPR gRNA sequence
gaaaacaggcattgtgcccc

SEQ ID NO: 530771 - DNA, 20 bp, Artificial
  CRISPR gRNA sequence
gcattgtgccccaggcactg

SEQ ID NO: 530772 - DNA, 20 bp, Artificial
  CRISPR gRNA sequence
cattgtgccccaggcactgc

SEQ ID NO: 530773 - DNA, 20 bp, Artificial
  CRISPR gRNA sequence
gtctcactgaatatcccttg

SEQ ID NO: 530774 - DNA, 20 bp, Artificial
  CRISPR gRNA sequence
atatcccttgaagttgtcat

SEQ ID NO: 530775 - DNA, 20 bp, Artificial
  CRISPR gRNA sequence
ccttgaagttgtcattggaa

SEQ ID NO: 530776 - DNA, 20 bp, Artificial
  CRISPR gRNA sequence
tgaagttgtcattggaaaag

SEQ ID NO: 530777 - DNA, 20 bp, Artificial
  CRISPR gRNA sequence
tcattggaaaagcagactca

SEQ ID NO: 530778 - DNA, 20 bp, Artificial
  CRISPR gRNA sequence
ttggaaaagcagactcacag

SEQ ID NO: 530779 - DNA, 20 bp, Artificial
  CRISPR gRNA sequence
aaaagcagactcacagcaga

SEQ ID NO: 530780 - DNA, 20 bp, Artificial
  CRISPR gRNA sequence
aaagcagactcacagcagat

SEQ ID NO: 530781 - DNA, 20 bp, Artificial
  CRISPR gRNA sequence
aagcagactcacagcagata

SEQ ID NO: 530782 - DNA, 20 bp, Artificial
  CRISPR gRNA sequence
agcagatagggaatttgccc

SEQ ID NO: 530783 - DNA, 20 bp, Artificial
  CRISPR gRNA sequence
gcagatagggaatttgccca

SEQ ID NO: 530784 - DNA, 20 bp, Artificial
  CRISPR gRNA sequence
agggaatttgcccaaggcca

SEQ ID NO: 530785 - DNA, 20 bp, Artificial
  CRISPR gRNA sequence
cccaaggccatggtcacctt

SEQ ID NO: 530786 - DNA, 20 bp, Artificial
  CRISPR gRNA sequence
ggccatggtcaccttaagtc

SEQ ID NO: 530787 - DNA, 20 bp, Artificial
  CRISPR gRNA sequence
ggtcaccttaagtctggtaa

SEQ ID NO: 530788 - DNA, 20 bp, Artificial
  CRISPR gRNA sequence
tggtaatagtgaccaactac

SEQ ID NO: 530789 - DNA, 20 bp, Artificial
  CRISPR gRNA sequence
gaccaactacaagttgaatc

SEQ ID NO: 530790 - DNA, 20 bp, Artificial
  CRISPR gRNA sequence
cattgacgtgcacacacata

SEQ ID NO: 530791 - DNA, 20 bp, Artificial
  CRISPR gRNA sequence
gacgtgcacacacataaagc

SEQ ID NO: 530792 - DNA, 20 bp, Artificial
  CRISPR gRNA sequence
taaagcaagtcactgtcttt

SEQ ID NO: 530793 - DNA, 20 bp, Artificial
  CRISPR gRNA sequence
aagtcactgtctttcggcta

SEQ ID NO: 530794 - DNA, 20 bp, Artificial
  CRISPR gRNA sequence
agtcactgtctttcggctaa

SEQ ID NO: 530795 - DNA, 20 bp, Artificial
  CRISPR gRNA sequence
gtcactgtctttcggctaaa

SEQ ID NO: 530796 - DNA, 20 bp, Artificial
  CRISPR gRNA sequence
tgtctttcggctaaagggtg

SEQ ID NO: 530797 - DNA, 20 bp, Artificial
  CRISPR gRNA sequence
gtctttcggctaaagggtga

SEQ ID NO: 530798 - DNA, 20 bp, Artificial
  CRISPR gRNA sequence
tctttcggctaaagggtgaa

SEQ ID NO: 530799 - DNA, 20 bp, Artificial
  CRISPR gRNA sequence
aagggtgaagggtttctttt

SEQ ID NO: 530800 - DNA, 20 bp, Artificial
  CRISPR gRNA sequence
agggtgaagggtttcttttt

SEQ ID NO: 530801 - DNA, 20 bp, Artificial
  CRISPR gRNA sequence
gggtgaagggtttctttttg

SEQ ID NO: 530802 - DNA, 20 bp, Artificial
  CRISPR gRNA sequence
ggcaatgaaaatgttgattg

SEQ ID NO: 530803 - DNA, 20 bp, Artificial
  CRISPR gRNA sequence
gaaaatgttgattgtggtga

SEQ ID NO: 530804 - DNA, 20 bp, Artificial
  CRISPR gRNA sequence
acaaaactctgaatatactg

SEQ ID NO: 530805 - DNA, 20 bp, Artificial
  CRISPR gRNA sequence
caaaactctgaatatactga

SEQ ID NO: 530806 - DNA, 20 bp, Artificial
  CRISPR gRNA sequence
gaatatactgaaggccattt

SEQ ID NO: 530807 - DNA, 20 bp, Artificial
  CRISPR gRNA sequence
ctgaaggccattttagtata

SEQ ID NO: 530808 - DNA, 20 bp, Artificial
  CRISPR gRNA sequence
tagtatatggacaaattgaa

SEQ ID NO: 530809 - DNA, 20 bp, Artificial
  CRISPR gRNA sequence
tatatggacaaattgaatgg

SEQ ID NO: 530810 - DNA, 20 bp, Artificial
  CRISPR gRNA sequence
gtagatgaattatctcaatg

SEQ ID NO: 530811 - DNA, 20 bp, Artificial
  CRISPR gRNA sequence
attatctcaatgaagctgct

SEQ ID NO: 530812 - DNA, 20 bp, Artificial
  CRISPR gRNA sequence
tgaagctgcttggaaaaaaa

SEQ ID NO: 530813 - DNA, 20 bp, Artificial
  CRISPR gRNA sequence
ctgcttggaaaaaaaaagaa

SEQ ID NO: 530814 - DNA, 20 bp, Artificial
  CRISPR gRNA sequence
tgcttggaaaaaaaaagaaa

SEQ ID NO: 530815 - DNA, 20 bp, Artificial
  CRISPR gRNA sequence
aggtcgtcattcttgccaaa

SEQ ID NO: 530816 - DNA, 20 bp, Artificial
  CRISPR gRNA sequence
ttcttgccaaaaagacctct

SEQ ID NO: 530817 - DNA, 20 bp, Artificial
  CRISPR gRNA sequence
atcctgactttgctcctgtc

SEQ ID NO: 530818 - DNA, 20 bp, Artificial
  CRISPR gRNA sequence
ctttgctcctgtcaagcaat

SEQ ID NO: 530819 - DNA, 20 bp, Artificial
  CRISPR gRNA sequence
cctgtcaagcaatgagacct

SEQ ID NO: 530820 - DNA, 20 bp, Artificial
  CRISPR gRNA sequence
caagcaatgagaccttggac

SEQ ID NO: 530821 - DNA, 20 bp, Artificial
  CRISPR gRNA sequence
ttggacaagctgcttctgac

SEQ ID NO: 530822 - DNA, 20 bp, Artificial
  CRISPR gRNA sequence
tggacaagctgcttctgact

SEQ ID NO: 530823 - DNA, 20 bp, Artificial
  CRISPR gRNA sequence
tctgttttcttatatataac

SEQ ID NO: 530824 - DNA, 20 bp, Artificial
  CRISPR gRNA sequence
ctgttttcttatatataaca

SEQ ID NO: 530825 - DNA, 20 bp, Artificial
  CRISPR gRNA sequence
gttttcttatatataacaag

SEQ ID NO: 530826 - DNA, 20 bp, Artificial
  CRISPR gRNA sequence
aacaaggagataataacaac

SEQ ID NO: 530827 - DNA, 20 bp, Artificial
  CRISPR gRNA sequence
acaaggagataataacaact

SEQ ID NO: 530828 - DNA, 20 bp, Artificial
  CRISPR gRNA sequence
agataataacaactaggtct

SEQ ID NO: 530829 - DNA, 20 bp, Artificial
  CRISPR gRNA sequence
caactaggtctcagtattgt

SEQ ID NO: 530830 - DNA, 20 bp, Artificial
  CRISPR gRNA sequence
aactaggtctcagtattgtt

SEQ ID NO: 530831 - DNA, 20 bp, Artificial
  CRISPR gRNA sequence
tattgttgggcgctttaaat

SEQ ID NO: 530832 - DNA, 20 bp, Artificial
  CRISPR gRNA sequence
cgctttaaataagatcatgt

SEQ ID NO: 530833 - DNA, 20 bp, Artificial
  CRISPR gRNA sequence
ttaaataagatcatgtaagc

SEQ ID NO: 530834 - DNA, 20 bp, Artificial
  CRISPR gRNA sequence
gcaagcacttgacccctaac

SEQ ID NO: 530835 - DNA, 20 bp, Artificial
  CRISPR gRNA sequence
agcacttgacccctaactgg

SEQ ID NO: 530836 - DNA, 20 bp, Artificial
  CRISPR gRNA sequence
cgacccaaatgtgaaaacac

SEQ ID NO: 530837 - DNA, 20 bp, Artificial
  CRISPR gRNA sequence
caaatgtgaaaacaccagca

SEQ ID NO: 530838 - DNA, 20 bp, Artificial
  CRISPR gRNA sequence
caccagcatggtcccccgcg

SEQ ID NO: 530839 - DNA, 20 bp, Artificial
  CRISPR gRNA sequence
accagcatggtcccccgcgt

SEQ ID NO: 530840 - DNA, 20 bp, Artificial
  CRISPR gRNA sequence
ccagcatggtcccccgcgta

SEQ ID NO: 530841 - DNA, 20 bp, Artificial
  CRISPR gRNA sequence
cgtagggctcacactcaaaa

SEQ ID NO: 530842 - DNA, 20 bp, Artificial
  CRISPR gRNA sequence
gtagggctcacactcaaaac

SEQ ID NO: 530843 - DNA, 20 bp, Artificial
  CRISPR gRNA sequence
acactcaaaacaggacactc

SEQ ID NO: 530844 - DNA, 20 bp, Artificial
  CRISPR gRNA sequence
cactcgagttttgtgctgtt

SEQ ID NO: 530845 - DNA, 20 bp, Artificial
  CRISPR gRNA sequence
ctcgagttttgtgctgtttg

SEQ ID NO: 530846 - DNA, 20 bp, Artificial
  CRISPR gRNA sequence
tttgtgctgtttggagtcct

SEQ ID NO: 530847 - DNA, 20 bp, Artificial
  CRISPR gRNA sequence
gtttggagtcctgagatctg

SEQ ID NO: 530848 - DNA, 20 bp, Artificial
  CRISPR gRNA sequence
gtcctgagatctgtggtttc

SEQ ID NO: 530849 - DNA, 20 bp, Artificial
  CRISPR gRNA sequence
cctgagatctgtggtttcca

SEQ ID NO: 530850 - DNA, 20 bp, Artificial
  CRISPR gRNA sequence
tggtttccagagcccataat

SEQ ID NO: 530851 - DNA, 20 bp, Artificial
  CRISPR gRNA sequence
gtttccagagcccataatca

SEQ ID NO: 530852 - DNA, 20 bp, Artificial
  CRISPR gRNA sequence
tttccagagcccataatcag

SEQ ID NO: 530853 - DNA, 20 bp, Artificial
  CRISPR gRNA sequence
ccataatcagaggccctttt

SEQ ID NO: 530854 - DNA, 20 bp, Artificial
  CRISPR gRNA sequence
caaccccactacatttctac

SEQ ID NO: 530855 - DNA, 20 bp, Artificial
  CRISPR gRNA sequence
aaccccactacatttctaca

SEQ ID NO: 530856 - DNA, 20 bp, Artificial
  CRISPR gRNA sequence
ctacaaggtgctctccactc

SEQ ID NO: 530857 - DNA, 20 bp, Artificial
  CRISPR gRNA sequence
tacaaggtgctctccactca

SEQ ID NO: 530858 - DNA, 20 bp, Artificial
  CRISPR gRNA sequence
gtgctctccactcaaggttg

SEQ ID NO: 530859 - DNA, 20 bp, Artificial
  CRISPR gRNA sequence
tgctctccactcaaggttgc

SEQ ID NO: 530860 - DNA, 20 bp, Artificial
  CRISPR gRNA sequence
tccactcaaggttgcaggac

SEQ ID NO: 530861 - DNA, 20 bp, Artificial
  CRISPR gRNA sequence
ccactcaaggttgcaggact

SEQ ID NO: 530862 - DNA, 20 bp, Artificial
  CRISPR gRNA sequence
cactcaaggttgcaggacta

SEQ ID NO: 530863 - DNA, 20 bp, Artificial
  CRISPR gRNA sequence
aaggttgcaggactagggtg

SEQ ID NO: 530864 - DNA, 20 bp, Artificial
  CRISPR gRNA sequence
ttgcaggactagggtgtgga

SEQ ID NO: 530865 - DNA, 20 bp, Artificial
  CRISPR gRNA sequence
ggtgtggaaagttgtcactt

SEQ ID NO: 530866 - DNA, 20 bp, Artificial
  CRISPR gRNA sequence
gtgtggaaagttgtcacttc

SEQ ID NO: 530867 - DNA, 20 bp, Artificial
  CRISPR gRNA sequence
tgtggaaagttgtcacttca

SEQ ID NO: 530868 - DNA, 20 bp, Artificial
  CRISPR gRNA sequence
gtggaaagttgtcacttcag

SEQ ID NO: 530869 - DNA, 20 bp, Artificial
  CRISPR gRNA sequence
ggaaagttgtcacttcaggg

SEQ ID NO: 530870 - DNA, 20 bp, Artificial
  CRISPR gRNA sequence
tgtcacttcaggggagctga

SEQ ID NO: 530871 - DNA, 20 bp, Artificial
  CRISPR gRNA sequence
tcaggggagctgacagtgtc

SEQ ID NO: 530872 - DNA, 20 bp, Artificial
  CRISPR gRNA sequence
caggggagctgacagtgtct

SEQ ID NO: 530873 - DNA, 20 bp, Artificial
  CRISPR gRNA sequence
ctgacagtgtctgggattgc

SEQ ID NO: 530874 - DNA, 20 bp, Artificial
  CRISPR gRNA sequence
gacagtgtctgggattgctg

SEQ ID NO: 530875 - DNA, 20 bp, Artificial
  CRISPR gRNA sequence
agtgtctgggattgctggag

SEQ ID NO: 530876 - DNA, 20 bp, Artificial
  CRISPR gRNA sequence
gtgtctgggattgctggagt

SEQ ID NO: 530877 - DNA, 20 bp, Artificial
  CRISPR gRNA sequence
gtgggcaatctgacactatc

SEQ ID NO: 530878 - DNA, 20 bp, Artificial
  CRISPR gRNA sequence
tgggcaatctgacactatct

SEQ ID NO: 530879 - DNA, 20 bp, Artificial
  CRISPR gRNA sequence
ctgacactatctgggattgc

SEQ ID NO: 530880 - DNA, 20 bp, Artificial
  CRISPR gRNA sequence
acactatctgggattgctgg

SEQ ID NO: 530881 - DNA, 20 bp, Artificial
  CRISPR gRNA sequence
cactatctgggattgctggt

SEQ ID NO: 530882 - DNA, 20 bp, Artificial
  CRISPR gRNA sequence
tctgggattgctggtaggcc

SEQ ID NO: 530883 - DNA, 20 bp, Artificial
  CRISPR gRNA sequence
ctgggattgctggtaggccc

SEQ ID NO: 530884 - DNA, 20 bp, Artificial
  CRISPR gRNA sequence
gctggtaggcccaggtgctg

SEQ ID NO: 530885 - DNA, 20 bp, Artificial
  CRISPR gRNA sequence
gtaggcccaggtgctgaaga

SEQ ID NO: 530886 - DNA, 20 bp, Artificial
  CRISPR gRNA sequence
taggcccaggtgctgaagat

SEQ ID NO: 530887 - DNA, 20 bp, Artificial
  CRISPR gRNA sequence
aggcccaggtgctgaagatg

SEQ ID NO: 530888 - DNA, 20 bp, Artificial
  CRISPR gRNA sequence
ccaggtgctgaagatggggc

SEQ ID NO: 530889 - DNA, 20 bp, Artificial
  CRISPR gRNA sequence
aggtgctgaagatggggctg

SEQ ID NO: 530890 - DNA, 20 bp, Artificial
  CRISPR gRNA sequence
gctgaagatggggctggaga

SEQ ID NO: 530891 - DNA, 20 bp, Artificial
  CRISPR gRNA sequence
tgaagatggggctggagaca

SEQ ID NO: 530892 - DNA, 20 bp, Artificial
  CRISPR gRNA sequence
aagatggggctggagacaga

SEQ ID NO: 530893 - DNA, 20 bp, Artificial
  CRISPR gRNA sequence
agatggggctggagacagag

SEQ ID NO: 530894 - DNA, 20 bp, Artificial
  CRISPR gRNA sequence
tggggctggagacagagagg

SEQ ID NO: 530895 - DNA, 20 bp, Artificial
  CRISPR gRNA sequence
ggctggagacagagaggaag

SEQ ID NO: 530896 - DNA, 20 bp, Artificial
  CRISPR gRNA sequence
gctggagacagagaggaaga

SEQ ID NO: 530897 - DNA, 20 bp, Artificial
  CRISPR gRNA sequence
ggagacagagaggaagaagg

SEQ ID NO: 530898 - DNA, 20 bp, Artificial
  CRISPR gRNA sequence
gagacagagaggaagaaggt

SEQ ID NO: 530899 - DNA, 20 bp, Artificial
  CRISPR gRNA sequence
agacagagaggaagaaggtg

SEQ ID NO: 530900 - DNA, 20 bp, Artificial
  CRISPR gRNA sequence
gaaggtggggtccctgcttc

SEQ ID NO: 530901 - DNA, 20 bp, Artificial
  CRISPR gRNA sequence
ctggtgatattttctgtgtg

SEQ ID NO: 530902 - DNA, 20 bp, Artificial
  CRISPR gRNA sequence
gatattttctgtgtgaagca

SEQ ID NO: 530903 - DNA, 20 bp, Artificial
  CRISPR gRNA sequence
atgcttatttgctcactgaa

SEQ ID NO: 530904 - DNA, 20 bp, Artificial
  CRISPR gRNA sequence
ttatttgctcactgaatggc

SEQ ID NO: 530905 - DNA, 20 bp, Artificial
  CRISPR gRNA sequence
tggctggcctgtgctcatgc

SEQ ID NO: 530906 - DNA, 20 bp, Artificial
  CRISPR gRNA sequence
ggctggcctgtgctcatgct

SEQ ID NO: 530907 - DNA, 20 bp, Artificial
  CRISPR gRNA sequence
gctggcctgtgctcatgctg

SEQ ID NO: 530908 - DNA, 20 bp, Artificial
  CRISPR gRNA sequence
gggttcctgtctgcctcccc

SEQ ID NO: 530909 - DNA, 20 bp, Artificial
  CRISPR gRNA sequence
cctgtctgcctccccaagtc

SEQ ID NO: 530910 - DNA, 20 bp, Artificial
  CRISPR gRNA sequence
ctgcctccccaagtcaagcg

SEQ ID NO: 530911 - DNA, 20 bp, Artificial
  CRISPR gRNA sequence
ccttcttgtcactacttccc

SEQ ID NO: 530912 - DNA, 20 bp, Artificial
  CRISPR gRNA sequence
ctacttccccagcatccccc

SEQ ID NO: 530913 - DNA, 20 bp, Artificial
  CRISPR gRNA sequence
tacttccccagcatcccccc

SEQ ID NO: 530914 - DNA, 20 bp, Artificial
  CRISPR gRNA sequence
ccccgggctttcaacttcaa

SEQ ID NO: 530915 - DNA, 20 bp, Artificial
  CRISPR gRNA sequence
ctaccttctctcccttgcct

SEQ ID NO: 530916 - DNA, 20 bp, Artificial
  CRISPR gRNA sequence
tatcctcattcttcctattt

SEQ ID NO: 530917 - DNA, 20 bp, Artificial
  CRISPR gRNA sequence
tcctcattcttcctatttta

SEQ ID NO: 530918 - DNA, 20 bp, Artificial
  CRISPR gRNA sequence
cctcattcttcctattttag

SEQ ID NO: 530919 - DNA, 20 bp, Artificial
  CRISPR gRNA sequence
cctattttagaggcaccctt

SEQ ID NO: 530920 - DNA, 20 bp, Artificial
  CRISPR gRNA sequence
tttagaggcaccctttggtc

SEQ ID NO: 530921 - DNA, 20 bp, Artificial
  CRISPR gRNA sequence
ttagaggcaccctttggtct

SEQ ID NO: 530922 - DNA, 20 bp, Artificial
  CRISPR gRNA sequence
aggcaccctttggtctaggc

SEQ ID NO: 530923 - DNA, 20 bp, Artificial
  CRISPR gRNA sequence
caccctttggtctaggccag

SEQ ID NO: 530924 - DNA, 20 bp, Artificial
  CRISPR gRNA sequence
aggccagtggcgattgactt

SEQ ID NO: 530925 - DNA, 20 bp, Artificial
  CRISPR gRNA sequence
ccagtggcgattgactttgg

SEQ ID NO: 530926 - DNA, 20 bp, Artificial
  CRISPR gRNA sequence
gattgactttggcagctcat

SEQ ID NO: 530927 - DNA, 20 bp, Artificial
  CRISPR gRNA sequence
ggcagctcattagaatcccc

SEQ ID NO: 530928 - DNA, 20 bp, Artificial
  CRISPR gRNA sequence
gcagctcattagaatccccc

SEQ ID NO: 530929 - DNA, 20 bp, Artificial
  CRISPR gRNA sequence
cagctcattagaatccccca

SEQ ID NO: 530930 - DNA, 20 bp, Artificial
  CRISPR gRNA sequence
gctcattagaatcccccagg

SEQ ID NO: 530931 - DNA, 20 bp, Artificial
  CRISPR gRNA sequence
tagaatcccccagggagctt

SEQ ID NO: 530932 - DNA, 20 bp, Artificial
  CRISPR gRNA sequence
ctttagaacctaatgatacc

SEQ ID NO: 530933 - DNA, 20 bp, Artificial
  CRISPR gRNA sequence
tttagaacctaatgataccc

SEQ ID NO: 530934 - DNA, 20 bp, Artificial
  CRISPR gRNA sequence
caaaaaaaatctgatttaat

SEQ ID NO: 530935 - DNA, 20 bp, Artificial
  CRISPR gRNA sequence
taattggtcctcactccact

SEQ ID NO: 530936 - DNA, 20 bp, Artificial
  CRISPR gRNA sequence
tcctcactccacttggatta

SEQ ID NO: 530937 - DNA, 20 bp, Artificial
  CRISPR gRNA sequence
tcactccacttggattacag

SEQ ID NO: 530938 - DNA, 20 bp, Artificial
  CRISPR gRNA sequence
ctccacttggattacagcag

SEQ ID NO: 530939 - DNA, 20 bp, Artificial
  CRISPR gRNA sequence
tacagcagcagctttctaac

SEQ ID NO: 530940 - DNA, 20 bp, Artificial
  CRISPR gRNA sequence
aatatccactcctgtcctcc

SEQ ID NO: 530941 - DNA, 20 bp, Artificial
  CRISPR gRNA sequence
ccactcctgtcctcccagta

SEQ ID NO: 530942 - DNA, 20 bp, Artificial
  CRISPR gRNA sequence
cactcctgtcctcccagtac

SEQ ID NO: 530943 - DNA, 20 bp, Artificial
  CRISPR gRNA sequence
tcctgtcctcccagtacagg

SEQ ID NO: 530944 - DNA, 20 bp, Artificial
  CRISPR gRNA sequence
ctgtcctcccagtacaggca

SEQ ID NO: 530945 - DNA, 20 bp, Artificial
  CRISPR gRNA sequence
agtacaggcagagatataca

SEQ ID NO: 530946 - DNA, 20 bp, Artificial
  CRISPR gRNA sequence
tgtgcatcttctacacatat

SEQ ID NO: 530947 - DNA, 20 bp, Artificial
  CRISPR gRNA sequence
ccaccttgtatcactctgac

SEQ ID NO: 530948 - DNA, 20 bp, Artificial
  CRISPR gRNA sequence
ccttgtatcactctgacaag

SEQ ID NO: 530949 - DNA, 20 bp, Artificial
  CRISPR gRNA sequence
ctgacaagcagatccaaaat

SEQ ID NO: 530950 - DNA, 20 bp, Artificial
  CRISPR gRNA sequence
tgacaagcagatccaaaata

SEQ ID NO: 530951 - DNA, 20 bp, Artificial
  CRISPR gRNA sequence
gacaagcagatccaaaataa

SEQ ID NO: 530952 - DNA, 20 bp, Artificial
  CRISPR gRNA sequence
atccttaaatatgttgtttc

SEQ ID NO: 530953 - DNA, 20 bp, Artificial
  CRISPR gRNA sequence
ctgccatataactcctcctt

SEQ ID NO: 530954 - DNA, 20 bp, Artificial
  CRISPR gRNA sequence
tgccatataactcctccttc

SEQ ID NO: 530955 - DNA, 20 bp, Artificial
  CRISPR gRNA sequence
gccatataactcctccttca

SEQ ID NO: 530956 - DNA, 20 bp, Artificial
  CRISPR gRNA sequence
atataactcctccttcaggg

SEQ ID NO: 530957 - DNA, 20 bp, Artificial
  CRISPR gRNA sequence
actcctccttcagggcagcc

SEQ ID NO: 530958 - DNA, 20 bp, Artificial
  CRISPR gRNA sequence
cagggcagcctggcttgaaa

SEQ ID NO: 530959 - DNA, 20 bp, Artificial
  CRISPR gRNA sequence
agggcagcctggcttgaaat

SEQ ID NO: 530960 - DNA, 20 bp, Artificial
  CRISPR gRNA sequence
gaaatgggctctgtcgatga

SEQ ID NO: 530961 - DNA, 20 bp, Artificial
  CRISPR gRNA sequence
aaatgggctctgtcgatgaa

SEQ ID NO: 530962 - DNA, 20 bp, Artificial
  CRISPR gRNA sequence
atgaaaggcccgctgctctc

SEQ ID NO: 530963 - DNA, 20 bp, Artificial
  CRISPR gRNA sequence
aaggcccgctgctctccagt

SEQ ID NO: 530964 - DNA, 20 bp, Artificial
  CRISPR gRNA sequence
tcttcttctcgccccactct

SEQ ID NO: 530965 - DNA, 20 bp, Artificial
  CRISPR gRNA sequence
ctcttagctcgccgattcat

SEQ ID NO: 530966 - DNA, 20 bp, Artificial
  CRISPR gRNA sequence
tcgccgattcatcagcaacc

SEQ ID NO: 530967 - DNA, 20 bp, Artificial
  CRISPR gRNA sequence
gattcatcagcaacctggaa

SEQ ID NO: 530968 - DNA, 20 bp, Artificial
  CRISPR gRNA sequence
ggaacagttgccttttccct

SEQ ID NO: 530969 - DNA, 20 bp, Artificial
  CRISPR gRNA sequence
cgattaatgccaccttaatc

SEQ ID NO: 530970 - DNA, 20 bp, Artificial
  CRISPR gRNA sequence
gattaatgccaccttaatcc

SEQ ID NO: 530971 - DNA, 20 bp, Artificial
  CRISPR gRNA sequence
cacattcctgtaaccacctg

SEQ ID NO: 530972 - DNA, 20 bp, Artificial
  CRISPR gRNA sequence
ttcctgtaaccacctgaaga

SEQ ID NO: 530973 - DNA, 20 bp, Artificial
  CRISPR gRNA sequence
cctgtaaccacctgaagaca

SEQ ID NO: 530974 - DNA, 20 bp, Artificial
  CRISPR gRNA sequence
accacctgaagacagagttg

SEQ ID NO: 530975 - DNA, 20 bp, Artificial
  CRISPR gRNA sequence
ccacctgaagacagagttgt

SEQ ID NO: 530976 - DNA, 20 bp, Artificial
  CRISPR gRNA sequence
cctgaagacagagttgtagg

SEQ ID NO: 530977 - DNA, 20 bp, Artificial
  CRISPR gRNA sequence
ctgaagacagagttgtaggc

SEQ ID NO: 530978 - DNA, 20 bp, Artificial
  CRISPR gRNA sequence
aagacagagttgtaggcagg

SEQ ID NO: 530979 - DNA, 20 bp, Artificial
  CRISPR gRNA sequence
agttgtaggcaggtagactt

SEQ ID NO: 530980 - DNA, 20 bp, Artificial
  CRISPR gRNA sequence
gttgtaggcaggtagacttg

SEQ ID NO: 530981 - DNA, 20 bp, Artificial
  CRISPR gRNA sequence
ttgtaggcaggtagacttga

SEQ ID NO: 530982 - DNA, 20 bp, Artificial
  CRISPR gRNA sequence
aggtagacttgagggtctat

SEQ ID NO: 530983 - DNA, 20 bp, Artificial
  CRISPR gRNA sequence
ttgagggtctatcagatgtg

SEQ ID NO: 530984 - DNA, 20 bp, Artificial
  CRISPR gRNA sequence
tgtggatcccattcccgcat

SEQ ID NO: 530985 - DNA, 20 bp, Artificial
  CRISPR gRNA sequence
cccattcccgcattggacca

SEQ ID NO: 530986 - DNA, 20 bp, Artificial
  CRISPR gRNA sequence
cattggaccacagtctccac

SEQ ID NO: 530987 - DNA, 20 bp, Artificial
  CRISPR gRNA sequence
attggaccacagtctccact

SEQ ID NO: 530988 - DNA, 20 bp, Artificial
  CRISPR gRNA sequence
ttggaccacagtctccactg

SEQ ID NO: 530989 - DNA, 20 bp, Artificial
  CRISPR gRNA sequence
gaccacagtctccactgggg

SEQ ID NO: 530990 - DNA, 20 bp, Artificial
  CRISPR gRNA sequence
accacagtctccactggggc

SEQ ID NO: 530991 - DNA, 20 bp, Artificial
  CRISPR gRNA sequence
cacagtctccactggggcag

SEQ ID NO: 530992 - DNA, 20 bp, Artificial
  CRISPR gRNA sequence
tggggcaggagacatgcatc

SEQ ID NO: 530993 - DNA, 20 bp, Artificial
  CRISPR gRNA sequence
catgcatctggtttcctgta

SEQ ID NO: 530994 - DNA, 20 bp, Artificial
  CRISPR gRNA sequence
ggtttcctgtatagcccccc

SEQ ID NO: 530995 - DNA, 20 bp, Artificial
  CRISPR gRNA sequence
tttcctgtatagcccccctg

SEQ ID NO: 530996 - DNA, 20 bp, Artificial
  CRISPR gRNA sequence
ttcctgtatagcccccctgg

SEQ ID NO: 530997 - DNA, 20 bp, Artificial
  CRISPR gRNA sequence
ctgtatagcccccctggagg

SEQ ID NO: 530998 - DNA, 20 bp, Artificial
  CRISPR gRNA sequence
gtatagcccccctggaggca

SEQ ID NO: 530999 - DNA, 20 bp, Artificial
  CRISPR gRNA sequence
tatagcccccctggaggcag

SEQ ID NO: 531000 - DNA, 20 bp, Artificial
  CRISPR gRNA sequence
gcccccctggaggcagaggt

SEQ ID NO: 531001 - DNA, 20 bp, Artificial
  CRISPR gRNA sequence
ctggaggcagaggtcagcgc

SEQ ID NO: 531002 - DNA, 20 bp, Artificial
  CRISPR gRNA sequence
tggaggcagaggtcagcgct

SEQ ID NO: 531003 - DNA, 20 bp, Artificial
  CRISPR gRNA sequence
ggaggcagaggtcagcgctg

SEQ ID NO: 531004 - DNA, 20 bp, Artificial
  CRISPR gRNA sequence
aggtcagcgctggggaatat

SEQ ID NO: 531005 - DNA, 20 bp, Artificial
  CRISPR gRNA sequence
ctattttccaacttgccaaa

SEQ ID NO: 531006 - DNA, 20 bp, Artificial
  CRISPR gRNA sequence
atagcacccacactgaaata

SEQ ID NO: 531007 - DNA, 20 bp, Artificial
  CRISPR gRNA sequence
cacactgaaataaagcaatt

SEQ ID NO: 531008 - DNA, 20 bp, Artificial
  CRISPR gRNA sequence
acactgaaataaagcaatta

SEQ ID NO: 531009 - DNA, 20 bp, Artificial
  CRISPR gRNA sequence
cactgaaataaagcaattaa

SEQ ID NO: 531010 - DNA, 20 bp, Artificial
  CRISPR gRNA sequence
tatcatatattgataccttg

SEQ ID NO: 531011 - DNA, 20 bp, Artificial
  CRISPR gRNA sequence
cttgtagatatcctgatcat

SEQ ID NO: 531012 - DNA, 20 bp, Artificial
  CRISPR gRNA sequence
atatcctgatcatcggtctt

SEQ ID NO: 531013 - DNA, 20 bp, Artificial
  CRISPR gRNA sequence
gtcttcagatgcttaatttt

SEQ ID NO: 531014 - DNA, 20 bp, Artificial
  CRISPR gRNA sequence
cttcagatgcttaattttca

SEQ ID NO: 531015 - DNA, 20 bp, Artificial
  CRISPR gRNA sequence
ttcagagttccatttttaaa

SEQ ID NO: 531016 - DNA, 20 bp, Artificial
  CRISPR gRNA sequence
atatgtatctttttccttga

SEQ ID NO: 531017 - DNA, 20 bp, Artificial
  CRISPR gRNA sequence
tgcaatctttttcttgtctg

SEQ ID NO: 531018 - DNA, 20 bp, Artificial
  CRISPR gRNA sequence
atcatcactcatttgaaaac

SEQ ID NO: 531019 - DNA, 20 bp, Artificial
  CRISPR gRNA sequence
tcatcactcatttgaaaact

SEQ ID NO: 531020 - DNA, 20 bp, Artificial
  CRISPR gRNA sequence
tttgaaaactaggaatgtcc

SEQ ID NO: 531021 - DNA, 20 bp, Artificial
  CRISPR gRNA sequence
ccaagttgatgtcctgaccc

SEQ ID NO: 531022 - DNA, 20 bp, Artificial
  CRISPR gRNA sequence
caagttgatgtcctgaccca

SEQ ID NO: 531023 - DNA, 20 bp, Artificial
  CRISPR gRNA sequence
tgtcctgacccaaggcaccc

SEQ ID NO: 531024 - DNA, 20 bp, Artificial
  CRISPR gRNA sequence
gtcctgacccaaggcacccc

SEQ ID NO: 531025 - DNA, 20 bp, Artificial
  CRISPR gRNA sequence
ccaaggcaccccaggtttcc

SEQ ID NO: 531026 - DNA, 20 bp, Artificial
  CRISPR gRNA sequence
caaggcaccccaggtttcca

SEQ ID NO: 531027 - DNA, 20 bp, Artificial
  CRISPR gRNA sequence
caaggcattcgtaatctctt

SEQ ID NO: 531028 - DNA, 20 bp, Artificial
  CRISPR gRNA sequence
aggcattcgtaatctctttg

SEQ ID NO: 531029 - DNA, 20 bp, Artificial
  CRISPR gRNA sequence
ttggagactgcacctataaa

SEQ ID NO: 531030 - DNA, 20 bp, Artificial
  CRISPR gRNA sequence
actgcacctataaaaagcaa

SEQ ID NO: 531031 - DNA, 20 bp, Artificial
  CRISPR gRNA sequence
tgcacctataaaaagcaaaa

SEQ ID NO: 531032 - DNA, 20 bp, Artificial
  CRISPR gRNA sequence
taaaaagcaaaagagttact

SEQ ID NO: 531033 - DNA, 20 bp, Artificial
  CRISPR gRNA sequence
aaaagcaaaagagttactga

SEQ ID NO: 531034 - DNA, 20 bp, Artificial
  CRISPR gRNA sequence
gagttactgagagtcacttt

SEQ ID NO: 531035 - DNA, 20 bp, Artificial
  CRISPR gRNA sequence
agttactgagagtcactttc

SEQ ID NO: 531036 - DNA, 20 bp, Artificial
  CRISPR gRNA sequence
gttactgagagtcactttca

SEQ ID NO: 531037 - DNA, 20 bp, Artificial
  CRISPR gRNA sequence
ctgagagtcactttcaggga

SEQ ID NO: 531038 - DNA, 20 bp, Artificial
  CRISPR gRNA sequence
gagtcactttcagggaaagc

SEQ ID NO: 531039 - DNA, 20 bp, Artificial
  CRISPR gRNA sequence
agtcactttcagggaaagct

SEQ ID NO: 531040 - DNA, 20 bp, Artificial
  CRISPR gRNA sequence
actttcagggaaagctgggt

SEQ ID NO: 531041 - DNA, 20 bp, Artificial
  CRISPR gRNA sequence
ctttcagggaaagctgggtt

SEQ ID NO: 531042 - DNA, 20 bp, Artificial
  CRISPR gRNA sequence
ttgactcttatgcttacctt

SEQ ID NO: 531043 - DNA, 20 bp, Artificial
  CRISPR gRNA sequence
actcttatgcttacctttgg

SEQ ID NO: 531044 - DNA, 20 bp, Artificial
  CRISPR gRNA sequence
ttggaagaaacattgaaaat

SEQ ID NO: 531045 - DNA, 20 bp, Artificial
  CRISPR gRNA sequence
gaagaaacattgaaaatcag

SEQ ID NO: 531046 - DNA, 20 bp, Artificial
  CRISPR gRNA sequence
aagaaacattgaaaatcaga

SEQ ID NO: 531047 - DNA, 20 bp, Artificial
  CRISPR gRNA sequence
aaacattgaaaatcagaagg

SEQ ID NO: 531048 - DNA, 20 bp, Artificial
  CRISPR gRNA sequence
attgaaaatcagaaggaagc

SEQ ID NO: 531049 - DNA, 20 bp, Artificial
  CRISPR gRNA sequence
aagctggctacaaatttaca

SEQ ID NO: 531050 - DNA, 20 bp, Artificial
  CRISPR gRNA sequence
tggctacaaatttacatgga

SEQ ID NO: 531051 - DNA, 20 bp, Artificial
  CRISPR gRNA sequence
tttacatggaaagctcatct

SEQ ID NO: 531052 - DNA, 20 bp, Artificial
  CRISPR gRNA sequence
ttacatggaaagctcatctt

SEQ ID NO: 531053 - DNA, 20 bp, Artificial
  CRISPR gRNA sequence
tacatggaaagctcatctta

SEQ ID NO: 531054 - DNA, 20 bp, Artificial
  CRISPR gRNA sequence
acatggaaagctcatcttag

SEQ ID NO: 531055 - DNA, 20 bp, Artificial
  CRISPR gRNA sequence
ggaaagctcatcttaggggt

SEQ ID NO: 531056 - DNA, 20 bp, Artificial
  CRISPR gRNA sequence
tggtttcctcttttgattct

SEQ ID NO: 531057 - DNA, 20 bp, Artificial
  CRISPR gRNA sequence
attctgagctcttcatgcaa

SEQ ID NO: 531058 - DNA, 20 bp, Artificial
  CRISPR gRNA sequence
ttctgagctcttcatgcaaa

SEQ ID NO: 531059 - DNA, 20 bp, Artificial
  CRISPR gRNA sequence
tcttcatgcaaaaggaactg

SEQ ID NO: 531060 - DNA, 20 bp, Artificial
  CRISPR gRNA sequence
catgcaaaaggaactgaagt

SEQ ID NO: 531061 - DNA, 20 bp, Artificial
  CRISPR gRNA sequence
aaaaggaactgaagtgagac

SEQ ID NO: 531062 - DNA, 20 bp, Artificial
  CRISPR gRNA sequence
aggaactgaagtgagactgg

SEQ ID NO: 531063 - DNA, 20 bp, Artificial
  CRISPR gRNA sequence
gaactgaagtgagactggtg

SEQ ID NO: 531064 - DNA, 20 bp, Artificial
  CRISPR gRNA sequence
actggtggagtccacacccc

SEQ ID NO: 531065 - DNA, 20 bp, Artificial
  CRISPR gRNA sequence
tggtggagtccacaccccga

SEQ ID NO: 531066 - DNA, 20 bp, Artificial
  CRISPR gRNA sequence
gcctctctttacatctttta

SEQ ID NO: 531067 - DNA, 20 bp, Artificial
  CRISPR gRNA sequence
gaggcacgtggttaagctct

SEQ ID NO: 531068 - DNA, 20 bp, Artificial
  CRISPR gRNA sequence
ttccttttgcatgaagagct

SEQ ID NO: 531069 - DNA, 20 bp, Artificial
  CRISPR gRNA sequence
tttcttccaaaggtaagcat

SEQ ID NO: 531070 - DNA, 20 bp, Artificial
  CRISPR gRNA sequence
gtgcagtctccaaagagatt

SEQ ID NO: 531071 - DNA, 20 bp, Artificial
  CRISPR gRNA sequence
ttacgaatgccttggaaacc

SEQ ID NO: 531072 - DNA, 20 bp, Artificial
  CRISPR gRNA sequence
ccttggaaacctggggtgcc

SEQ ID NO: 531073 - DNA, 20 bp, Artificial
  CRISPR gRNA sequence
tggacattcctagttttcaa

SEQ ID NO: 531074 - DNA, 20 bp, Artificial
  CRISPR gRNA sequence
agcatctgaagaccgatgat

SEQ ID NO: 531075 - DNA, 20 bp, Artificial
  CRISPR gRNA sequence
cttaattgctttatttcagt

SEQ ID NO: 531076 - DNA, 20 bp, Artificial
  CRISPR gRNA sequence
tggagactgtggtccaatgc

SEQ ID NO: 531077 - DNA, 20 bp, Artificial
  CRISPR gRNA sequence
actgtggtccaatgcgggaa

SEQ ID NO: 531078 - DNA, 20 bp, Artificial
  CRISPR gRNA sequence
ctctgtcttcaggtggttac

SEQ ID NO: 531079 - DNA, 20 bp, Artificial
  CRISPR gRNA sequence
ttcaggtggttacaggaatg

SEQ ID NO: 531080 - DNA, 20 bp, Artificial
  CRISPR gRNA sequence
gtggttacaggaatgtgggg

SEQ ID NO: 531081 - DNA, 20 bp, Artificial
  CRISPR gRNA sequence
tgtggggttgggtgaagaac

SEQ ID NO: 531082 - DNA, 20 bp, Artificial
  CRISPR gRNA sequence
gcaactgttccaggttgctg

SEQ ID NO: 531083 - DNA, 20 bp, Artificial
  CRISPR gRNA sequence
tgctgatgaatcggcgagct

SEQ ID NO: 531084 - DNA, 20 bp, Artificial
  CRISPR gRNA sequence
aagccaggctgccctgaagg

SEQ ID NO: 531085 - DNA, 20 bp, Artificial
  CRISPR gRNA sequence
gggctggaaacaacatattt

SEQ ID NO: 531086 - DNA, 20 bp, Artificial
  CRISPR gRNA sequence
aaggatgaacagcccttatt

SEQ ID NO: 531087 - DNA, 20 bp, Artificial
  CRISPR gRNA sequence
cttattttggatctgcttgt

SEQ ID NO: 531088 - DNA, 20 bp, Artificial
  CRISPR gRNA sequence
tctgcctgtactgggaggac

SEQ ID NO: 531089 - DNA, 20 bp, Artificial
  CRISPR gRNA sequence
cctgtactgggaggacagga

SEQ ID NO: 531090 - DNA, 20 bp, Artificial
  CRISPR gRNA sequence
ggaggacaggagtggatatt

SEQ ID NO: 531091 - DNA, 20 bp, Artificial
  CRISPR gRNA sequence
acaggagtggatattgagga

SEQ ID NO: 531092 - DNA, 20 bp, Artificial
  CRISPR gRNA sequence
agctgctgctgtaatccaag

SEQ ID NO: 531093 - DNA, 20 bp, Artificial
  CRISPR gRNA sequence
agattttttttgcatgcggc

SEQ ID NO: 531094 - DNA, 20 bp, Artificial
  CRISPR gRNA sequence
ttaggttctaaagctccctg

SEQ ID NO: 531095 - DNA, 20 bp, Artificial
  CRISPR gRNA sequence
atcgccactggcctagacca

SEQ ID NO: 531096 - DNA, 20 bp, Artificial
  CRISPR gRNA sequence
aagggtgcctctaaaatagg

SEQ ID NO: 531097 - DNA, 20 bp, Artificial
  CRISPR gRNA sequence
gcctctaaaataggaagaat

SEQ ID NO: 531098 - DNA, 20 bp, Artificial
  CRISPR gRNA sequence
ataggaagaatgaggataat

SEQ ID NO: 531099 - DNA, 20 bp, Artificial
  CRISPR gRNA sequence
gggagagaaggtagagaaag

SEQ ID NO: 531100 - DNA, 20 bp, Artificial
  CRISPR gRNA sequence
cattgaagttgaaagcccgg

SEQ ID NO: 531101 - DNA, 20 bp, Artificial
  CRISPR gRNA sequence
cacaccctagtcctgcaacc

SEQ ID NO: 531102 - DNA, 20 bp, Artificial
  CRISPR gRNA sequence
agcaccttgtagaaatgtag

SEQ ID NO: 531103 - DNA, 20 bp, Artificial
  CRISPR gRNA sequence
gactccaaacagcacaaaac

SEQ ID NO: 531104 - DNA, 20 bp, Artificial
  CRISPR gRNA sequence
caaaactcgagtgtcctgtt

SEQ ID NO: 531105 - DNA, 20 bp, Artificial
  CRISPR gRNA sequence
ccatgctggtgttttcacat

SEQ ID NO: 531106 - DNA, 20 bp, Artificial
  CRISPR gRNA sequence
ggaaataatggctaccagtt

SEQ ID NO: 531107 - DNA, 20 bp, Artificial
  CRISPR gRNA sequence
ttgcttgacaggagcaaagt

SEQ ID NO: 531108 - DNA, 20 bp, Artificial
  CRISPR gRNA sequence
aactcagaggtctttttggc

SEQ ID NO: 531109 - DNA, 20 bp, Artificial
  CRISPR gRNA sequence
aaaatggccttcagtatatt

SEQ ID NO: 531110 - DNA, 20 bp, Artificial
  CRISPR gRNA sequence
gggcaaattccctatctgct

SEQ ID NO: 531111 - DNA, 20 bp, Artificial
  CRISPR gRNA sequence
cttttccaatgacaacttca

SEQ ID NO: 531112 - DNA, 20 bp, Artificial
  CRISPR gRNA sequence
tcttgctctgttgcccaggc

SEQ ID NO: 531113 - DNA, 20 bp, Artificial
  CRISPR gRNA sequence
gcctcagcctcccaagtagc

SEQ ID NO: 531114 - DNA, 20 bp, Artificial
  CRISPR gRNA sequence
ttttgtatttttagtagaga

SEQ ID NO: 531115 - DNA, 20 bp, Artificial
  CRISPR gRNA sequence
gtctcaaactcctgacctca

SEQ ID NO: 531116 - DNA, 20 bp, Artificial
  CRISPR gRNA sequence
gcatcggcctcccaaagtgc

SEQ ID NO: 531117 - DNA, 20 bp, Artificial
  CRISPR gRNA sequence
tgcctgcatttccttcatga

SEQ ID NO: 531118 - DNA, 20 bp, Artificial
  CRISPR gRNA sequence
gaagcagatgctagtaggga

SEQ ID NO: 531119 - DNA, 20 bp, Artificial
  CRISPR gRNA sequence
aggggttaatcccagcaact

SEQ ID NO: 531120 - DNA, 20 bp, Artificial
  CRISPR gRNA sequence
atcccagcaactcagaatta

SEQ ID NO: 531121 - DNA, 20 bp, Artificial
  CRISPR gRNA sequence
catccatggaaggccttagg

SEQ ID NO: 531122 - DNA, 20 bp, Artificial
  CRISPR gRNA sequence
agttctaagacgctatctta

SEQ ID NO: 531123 - DNA, 20 bp, Artificial
  CRISPR gRNA sequence
atacggaggtactactccac

SEQ ID NO: 531124 - DNA, 20 bp, Artificial
  CRISPR gRNA sequence
acttattaatcagttaaatt

SEQ ID NO: 531125 - DNA, 20 bp, Artificial
  CRISPR gRNA sequence
gagaggcagacagaaagaga

SEQ ID NO: 531126 - DNA, 20 bp, Artificial
  CRISPR gRNA sequence
tctcactctgtcgtccagcc

SEQ ID NO: 531127 - DNA, 20 bp, Artificial
  CRISPR gRNA sequence
ctcactgcagcctctgcctc

SEQ ID NO: 531128 - DNA, 20 bp, Artificial
  CRISPR gRNA sequence
aattctcatgcctcagcctc

SEQ ID NO: 531129 - DNA, 20 bp, Artificial
  CRISPR gRNA sequence
gcctcagcctcctgagtagt

SEQ ID NO: 531130 - DNA, 20 bp, Artificial
  CRISPR gRNA sequence
caccttagcctcccaaagtg

SEQ ID NO: 531131 - DNA, 20 bp, Artificial
  CRISPR gRNA sequence
aatattattcattattgact

SEQ ID NO: 531132 - DNA, 20 bp, Artificial
  CRISPR gRNA sequence
tgactttgagtggtggcgtt

SEQ ID NO: 531133 - DNA, 20 bp, Artificial
  CRISPR gRNA sequence
ttatcagcttgtacaatgat

SEQ ID NO: 531134 - DNA, 20 bp, Artificial
  CRISPR gRNA sequence
atgattggagttgaaagccc

SEQ ID NO: 531135 - DNA, 20 bp, Artificial
  CRISPR gRNA sequence
aagcccacggatgctgggca

SEQ ID NO: 531136 - DNA, 20 bp, Artificial
  CRISPR gRNA sequence
cacaccctagtcctgcaacc

SEQ ID NO: 531137 - DNA, 20 bp, Artificial
  CRISPR gRNA sequence
agcaccttgtagaaatgtag

SEQ ID NO: 531138 - DNA, 20 bp, Artificial
  CRISPR gRNA sequence
gactccaaacagcacagaac

SEQ ID NO: 531139 - DNA, 20 bp, Artificial
  CRISPR gRNA sequence
cagaactcgagtgtcctgtt

SEQ ID NO: 531140 - DNA, 20 bp, Artificial
  CRISPR gRNA sequence
ccatgttggtgttttcacat

SEQ ID NO: 531141 - DNA, 20 bp, Artificial
  CRISPR gRNA sequence
ggaaataatggctaccagtt

SEQ ID NO: 531142 - DNA, 20 bp, Artificial
  CRISPR gRNA sequence
ttgcttgacaggagcaaagt

SEQ ID NO: 531143 - DNA, 20 bp, Artificial
  CRISPR gRNA sequence
aactcagaggtctttttggc

SEQ ID NO: 531144 - DNA, 20 bp, Artificial
  CRISPR gRNA sequence
aaaacggcctttagtatatt

SEQ ID NO: 531145 - DNA, 20 bp, Artificial
  CRISPR gRNA sequence
actatgtactaactctgttg

SEQ ID NO: 531146 - DNA, 20 bp, Artificial
  CRISPR gRNA sequence
tttcttccttctcagtaacg

SEQ ID NO: 531147 - DNA, 20 bp, Artificial
  CRISPR gRNA sequence
ttctcagtaacgcagaatct

SEQ ID NO: 531148 - DNA, 20 bp, Artificial
  CRISPR gRNA sequence
aaatattggtgtctggaagt

SEQ ID NO: 531149 - DNA, 20 bp, Artificial
  CRISPR gRNA sequence
gtctggaagtcagagtggga

SEQ ID NO: 531150 - DNA, 20 bp, Artificial
  CRISPR gRNA sequence
taagctagtccatctatatt

SEQ ID NO: 531151 - DNA, 20 bp, Artificial
  CRISPR gRNA sequence
agtctggggggaacaaagta

SEQ ID NO: 531152 - DNA, 20 bp, Artificial
  CRISPR gRNA sequence
aggcaagaggtttgtgatta

SEQ ID NO: 531153 - DNA, 20 bp, Artificial
  CRISPR gRNA sequence
ggtttgtgattatcgaatgc

SEQ ID NO: 531154 - DNA, 20 bp, Artificial
  CRISPR gRNA sequence
gttgctccttttgtgacagg

SEQ ID NO: 531155 - DNA, 20 bp, Artificial
  CRISPR gRNA sequence
agctctgggctgggaaaagg

SEQ ID NO: 531156 - DNA, 20 bp, Artificial
  CRISPR gRNA sequence
tgtcaatgtggtgattcctc

SEQ ID NO: 531157 - DNA, 20 bp, Artificial
  CRISPR gRNA sequence
atgtggtgattcctccagga

SEQ ID NO: 531158 - DNA, 20 bp, Artificial
  CRISPR gRNA sequence
aaaaacatcagcctgtctgt

SEQ ID NO: 531159 - DNA, 20 bp, Artificial
  CRISPR gRNA sequence
tttagtggcataatgtatct

SEQ ID NO: 531160 - DNA, 20 bp, Artificial
  CRISPR gRNA sequence
tcatcagaaataattttttt

SEQ ID NO: 531161 - DNA, 20 bp, Artificial
  CRISPR gRNA sequence
agaaaattgcctaaattgaa

SEQ ID NO: 531162 - DNA, 20 bp, Artificial
  CRISPR gRNA sequence
atctttactttctttttaga

SEQ ID NO: 531163 - DNA, 20 bp, Artificial
  CRISPR gRNA sequence
caaccctgacctgtgaggta

SEQ ID NO: 531164 - DNA, 20 bp, Artificial
  CRISPR gRNA sequence
ggtaatgaatggaactgacc

SEQ ID NO: 531165 - DNA, 20 bp, Artificial
  CRISPR gRNA sequence
aaacatctaaaactttctca

SEQ ID NO: 531166 - DNA, 20 bp, Artificial
  CRISPR gRNA sequence
cacacaagtggaccaccagc

SEQ ID NO: 531167 - DNA, 20 bp, Artificial
  CRISPR gRNA sequence
agcagggaacaaagtcagca

SEQ ID NO: 531168 - DNA, 20 bp, Artificial
  CRISPR gRNA sequence
gctgggaggcagccctggct

SEQ ID NO: 531169 - DNA, 20 bp, Artificial
  CRISPR gRNA sequence
gttctatggttttccatcct

SEQ ID NO: 531170 - DNA, 20 bp, Artificial
  CRISPR gRNA sequence
aaagatcctcttctaggaga

SEQ ID NO: 531171 - DNA, 20 bp, Artificial
  CRISPR gRNA sequence
ctgaagaaggaggagctgta

SEQ ID NO: 531172 - DNA, 20 bp, Artificial
  CRISPR gRNA sequence
agtggtcagcacctcccatc

SEQ ID NO: 531173 - DNA, 20 bp, Artificial
  CRISPR gRNA sequence
gctgcagaaaccctgggggg

SEQ ID NO: 531174 - DNA, 20 bp, Artificial
  CRISPR gRNA sequence
cctggggggcagggtcatgg

SEQ ID NO: 531175 - DNA, 20 bp, Artificial
  CRISPR gRNA sequence
ctcaaaactccaagaccata

SEQ ID NO: 531176 - DNA, 20 bp, Artificial
  CRISPR gRNA sequence
tagtgcccaagctctcgcct

SEQ ID NO: 531177 - DNA, 20 bp, Artificial
  CRISPR gRNA sequence
tagaggtctggacttctagt

SEQ ID NO: 531178 - DNA, 20 bp, Artificial
  CRISPR gRNA sequence
ggtctgtccaaatttagcca

SEQ ID NO: 531179 - DNA, 20 bp, Artificial
  CRISPR gRNA sequence
atttagccagagaatcttga

SEQ ID NO: 531180 - DNA, 20 bp, Artificial
  CRISPR gRNA sequence
ccatgttcacagactattag

SEQ ID NO: 531181 - DNA, 20 bp, Artificial
  CRISPR gRNA sequence
actattagatgagtaggctc

SEQ ID NO: 531182 - DNA, 20 bp, Artificial
  CRISPR gRNA sequence
agagccctctaagaaagagc

SEQ ID NO: 531183 - DNA, 20 bp, Artificial
  CRISPR gRNA sequence
tctttttgtaacttaatctc

SEQ ID NO: 531184 - DNA, 20 bp, Artificial
  CRISPR gRNA sequence
ctagcccacattcaatcaga

SEQ ID NO: 531185 - DNA, 20 bp, Artificial
  CRISPR gRNA sequence
agaggggattgcacataggt

SEQ ID NO: 531186 - DNA, 20 bp, Artificial
  CRISPR gRNA sequence
aggtgagaataccaggaagc

SEQ ID NO: 531187 - DNA, 20 bp, Artificial
  CRISPR gRNA sequence
aggggtcattgaaggcatct

SEQ ID NO: 531188 - DNA, 20 bp, Artificial
  CRISPR gRNA sequence
cttcgcaactttttttgaga

SEQ ID NO: 531189 - DNA, 20 bp, Artificial
  CRISPR gRNA sequence
ttttgctctgttgccaaggc

SEQ ID NO: 531190 - DNA, 20 bp, Artificial
  CRISPR gRNA sequence
acctcagcctcccaaagtgc

SEQ ID NO: 531191 - DNA, 20 bp, Artificial
  CRISPR gRNA sequence
aaagtgctgggattataggc

SEQ ID NO: 531192 - DNA, 20 bp, Artificial
  CRISPR gRNA sequence
ggcctcgggagatctttgat

SEQ ID NO: 531193 - DNA, 20 bp, Artificial
  CRISPR gRNA sequence
tatctgaaattcaaatttaa

SEQ ID NO: 531194 - DNA, 20 bp, Artificial
  CRISPR gRNA sequence
tataaatatgtgtgtgtatt

SEQ ID NO: 531195 - DNA, 20 bp, Artificial
  CRISPR gRNA sequence
aggaccactagggagatggg

SEQ ID NO: 531196 - DNA, 20 bp, Artificial
  CRISPR gRNA sequence
aagaatacctggggagagat

SEQ ID NO: 531197 - DNA, 20 bp, Artificial
  CRISPR gRNA sequence
ctgctcttgaagacccgaaa

SEQ ID NO: 531198 - DNA, 20 bp, Artificial
  CRISPR gRNA sequence
aggcagagaggagcaatggt

SEQ ID NO: 531199 - DNA, 20 bp, Artificial
  CRISPR gRNA sequence
gaccatttggctcagattag

SEQ ID NO: 531200 - DNA, 20 bp, Artificial
  CRISPR gRNA sequence
actgttggaagatagtatgc

SEQ ID NO: 531201 - DNA, 20 bp, Artificial
  CRISPR gRNA sequence
caggcctgccctgccccacc

SEQ ID NO: 531202 - DNA, 20 bp, Artificial
  CRISPR gRNA sequence
ccagcagggcctaaagggcc

SEQ ID NO: 531203 - DNA, 20 bp, Artificial
  CRISPR gRNA sequence
ctcttcatcagtagagctta

SEQ ID NO: 531204 - DNA, 20 bp, Artificial
  CRISPR gRNA sequence
agttgtgtaactggcaggca

SEQ ID NO: 531205 - DNA, 20 bp, Artificial
  CRISPR gRNA sequence
gtgtaactggcaggcaaaga

SEQ ID NO: 531206 - DNA, 20 bp, Artificial
  CRISPR gRNA sequence
ctcgaggaaagaaagccaag

SEQ ID NO: 531207 - DNA, 20 bp, Artificial
  CRISPR gRNA sequence
gttactaacgcactgtgcac

SEQ ID NO: 531208 - DNA, 20 bp, Artificial
  CRISPR gRNA sequence
gctccagggaaactctgtga

SEQ ID NO: 531209 - DNA, 20 bp, Artificial
  CRISPR gRNA sequence
gagggtgctggccgtgaggt

SEQ ID NO: 531210 - DNA, 20 bp, Artificial
  CRISPR gRNA sequence
ggacaagtgaaatatttacc

SEQ ID NO: 531211 - DNA, 20 bp, Artificial
  CRISPR gRNA sequence
gcctggtagagacagtgaga

SEQ ID NO: 531212 - DNA, 20 bp, Artificial
  CRISPR gRNA sequence
agaaggaatcatggtgcagt

SEQ ID NO: 531213 - DNA, 20 bp, Artificial
  CRISPR gRNA sequence
ggggtagccagagacgagag

SEQ ID NO: 531214 - DNA, 20 bp, Artificial
  CRISPR gRNA sequence
ttgaagctagaggttgcatt

SEQ ID NO: 531215 - DNA, 20 bp, Artificial
  CRISPR gRNA sequence
ttagagtatctctaagatcc

SEQ ID NO: 531216 - DNA, 20 bp, Artificial
  CRISPR gRNA sequence
gagggagcttcccaaggacc

SEQ ID NO: 531217 - DNA, 20 bp, Artificial
  CRISPR gRNA sequence
ccaaggaccttgggtccttc

SEQ ID NO: 531218 - DNA, 20 bp, Artificial
  CRISPR gRNA sequence
tcaccaccctctgtgagcct

SEQ ID NO: 531219 - DNA, 20 bp, Artificial
  CRISPR gRNA sequence
ctctgtgagcctgggagtta

SEQ ID NO: 531220 - DNA, 20 bp, Artificial
  CRISPR gRNA sequence
caggaggcagcatccttggc

SEQ ID NO: 531221 - DNA, 20 bp, Artificial
  CRISPR gRNA sequence
tcaccaaaaggaaaaaacag

SEQ ID NO: 531222 - DNA, 20 bp, Artificial
  CRISPR gRNA sequence
atccccatgaaacagctcat

SEQ ID NO: 531223 - DNA, 20 bp, Artificial
  CRISPR gRNA sequence
cagctcatggggatgacacc

SEQ ID NO: 531224 - DNA, 20 bp, Artificial
  CRISPR gRNA sequence
atgatggaaataggtagttt

SEQ ID NO: 531225 - DNA, 20 bp, Artificial
  CRISPR gRNA sequence
aataggtagtttcggaatgt

SEQ ID NO: 531226 - DNA, 20 bp, Artificial
  CRISPR gRNA sequence
aatgtgggagctttgagaca

SEQ ID NO: 531227 - DNA, 20 bp, Artificial
  CRISPR gRNA sequence
ctgaatccagttggcctcat

SEQ ID NO: 531228 - DNA, 20 bp, Artificial
  CRISPR gRNA sequence
caggctaatgtgaacatctt

SEQ ID NO: 531229 - DNA, 20 bp, Artificial
  CRISPR gRNA sequence
agctccaaaacaccgtttct

SEQ ID NO: 531230 - DNA, 20 bp, Artificial
  CRISPR gRNA sequence
taggaataaatgtcctatct

SEQ ID NO: 531231 - DNA, 20 bp, Artificial
  CRISPR gRNA sequence
ctatctatgggtggcccaag

SEQ ID NO: 531232 - DNA, 20 bp, Artificial
  CRISPR gRNA sequence
ggaaaacagctgttctaaag

SEQ ID NO: 531233 - DNA, 20 bp, Artificial
  CRISPR gRNA sequence
ctttgctaattctctgttcg

SEQ ID NO: 531234 - DNA, 20 bp, Artificial
  CRISPR gRNA sequence
tctctgttcgagggatgtgt

SEQ ID NO: 531235 - DNA, 20 bp, Artificial
  CRISPR gRNA sequence
tcgagggatgtgttagggtt

SEQ ID NO: 531236 - DNA, 20 bp, Artificial
  CRISPR gRNA sequence
acccaaggcagaacacttca

SEQ ID NO: 531237 - DNA, 20 bp, Artificial
  CRISPR gRNA sequence
acttcagagaatggccaacc

SEQ ID NO: 531238 - DNA, 20 bp, Artificial
  CRISPR gRNA sequence
tcactgtggggggcacagat

SEQ ID NO: 531239 - DNA, 20 bp, Artificial
  CRISPR gRNA sequence
gcagccaagggaacaggccc

SEQ ID NO: 531240 - DNA, 20 bp, Artificial
  CRISPR gRNA sequence
ggccttgggccccgtgccct

SEQ ID NO: 531241 - DNA, 20 bp, Artificial
  CRISPR gRNA sequence
cactttccaccacagcacag

SEQ ID NO: 531242 - DNA, 20 bp, Artificial
  CRISPR gRNA sequence
tctgccatcaccaggctgag

SEQ ID NO: 531243 - DNA, 20 bp, Artificial
  CRISPR gRNA sequence
ctattagtgcatccagcttt

SEQ ID NO: 531244 - DNA, 20 bp, Artificial
  CRISPR gRNA sequence
ctaggccgaggcaaggagcc

SEQ ID NO: 531245 - DNA, 20 bp, Artificial
  CRISPR gRNA sequence
ggagcccagaatttaaggca

SEQ ID NO: 531246 - DNA, 20 bp, Artificial
  CRISPR gRNA sequence
tgcctcattccagtcatgcc

SEQ ID NO: 531247 - DNA, 20 bp, Artificial
  CRISPR gRNA sequence
cattccagtcatgccctggg

SEQ ID NO: 531248 - DNA, 20 bp, Artificial
  CRISPR gRNA sequence
gagaaggacaatgagcctgg

SEQ ID NO: 531249 - DNA, 20 bp, Artificial
  CRISPR gRNA sequence
taggcgccagctgcagctgc

SEQ ID NO: 531250 - DNA, 20 bp, Artificial
  CRISPR gRNA sequence
cgccagctgcagctgctgga

SEQ ID NO: 531251 - DNA, 20 bp, Artificial
  CRISPR gRNA sequence
actgtcctgcttgaaccagg

SEQ ID NO: 531252 - DNA, 20 bp, Artificial
  CRISPR gRNA sequence
cacttaacacttggaagatg

SEQ ID NO: 531253 - DNA, 20 bp, Artificial
  CRISPR gRNA sequence
actttgggaggccgaggcag

SEQ ID NO: 531254 - DNA, 20 bp, Artificial
  CRISPR gRNA sequence
caggaggatcatttgagctc

SEQ ID NO: 531255 - DNA, 20 bp, Artificial
  CRISPR gRNA sequence
aaaaaaaacttaaaaattag

SEQ ID NO: 531256 - DNA, 20 bp, Artificial
  CRISPR gRNA sequence
cagctagtcaggaggctgag

SEQ ID NO: 531257 - DNA, 20 bp, Artificial
  CRISPR gRNA sequence
tagtcaggaggctgaggtgg

SEQ ID NO: 531258 - DNA, 20 bp, Artificial
  CRISPR gRNA sequence
tcatttcagcccgggagatc

SEQ ID NO: 531259 - DNA, 20 bp, Artificial
  CRISPR gRNA sequence
acaaataaaaaacaaaaata

SEQ ID NO: 531260 - DNA, 20 bp, Artificial
  CRISPR gRNA sequence
aaacaaaaatagtgggtgaa

SEQ ID NO: 531261 - DNA, 20 bp, Artificial
  CRISPR gRNA sequence
cataattcagaactagggcc

SEQ ID NO: 531262 - DNA, 20 bp, Artificial
  CRISPR gRNA sequence
agggcacggaagatggcata

SEQ ID NO: 531263 - DNA, 20 bp, Artificial
  CRISPR gRNA sequence
gtcagaggaggccatctggt

SEQ ID NO: 531264 - DNA, 20 bp, Artificial
  CRISPR gRNA sequence
gaatcaacatccggaagtta

SEQ ID NO: 531265 - DNA, 20 bp, Artificial
  CRISPR gRNA sequence
gtaagaggtaattatttcag

SEQ ID NO: 531266 - DNA, 20 bp, Artificial
  CRISPR gRNA sequence
ggcaggcagatcacctggtc

SEQ ID NO: 531267 - DNA, 20 bp, Artificial
  CRISPR gRNA sequence
tactcaggaggccgaggcag

SEQ ID NO: 531268 - DNA, 20 bp, Artificial
  CRISPR gRNA sequence
tgcactctagcctgggcaac

SEQ ID NO: 531269 - DNA, 20 bp, Artificial
  CRISPR gRNA sequence
gagccactgcaaagacggcc

SEQ ID NO: 531270 - DNA, 20 bp, Artificial
  CRISPR gRNA sequence
atacctaacttacagcctaa

SEQ ID NO: 531271 - DNA, 20 bp, Artificial
  CRISPR gRNA sequence
aaggagtccagaggggccag

SEQ ID NO: 531272 - DNA, 20 bp, Artificial
  CRISPR gRNA sequence
cacagattccctgtgatttt

SEQ ID NO: 531273 - DNA, 20 bp, Artificial
  CRISPR gRNA sequence
agtacaggaaaaactacatt

SEQ ID NO: 531274 - DNA, 20 bp, Artificial
  CRISPR gRNA sequence
acacaaagaagaaaatcctg

SEQ ID NO: 531275 - DNA, 20 bp, Artificial
  CRISPR gRNA sequence
tcctgaagggtgaggagagg

SEQ ID NO: 531276 - DNA, 20 bp, Artificial
  CRISPR gRNA sequence
taaggccaagaacataggtc

SEQ ID NO: 531277 - DNA, 20 bp, Artificial
  CRISPR gRNA sequence
aggtcttgaatttctgagaa

SEQ ID NO: 531278 - DNA, 20 bp, Artificial
  CRISPR gRNA sequence
ttccaacctcttgccggaag

SEQ ID NO: 531279 - DNA, 20 bp, Artificial
  CRISPR gRNA sequence
gaaggtggattgcatgacag

SEQ ID NO: 531280 - DNA, 20 bp, Artificial
  CRISPR gRNA sequence
taacatagaaatgcctcaga

SEQ ID NO: 531281 - DNA, 20 bp, Artificial
  CRISPR gRNA sequence
tttctaggtcagcacagagg

SEQ ID NO: 531282 - DNA, 20 bp, Artificial
  CRISPR gRNA sequence
gtcttcttcctgctgattcc

SEQ ID NO: 531283 - DNA, 20 bp, Artificial
  CRISPR gRNA sequence
ttctttctctcctacaagct

SEQ ID NO: 531284 - DNA, 20 bp, Artificial
  CRISPR gRNA sequence
gagctggagacaagagccca

SEQ ID NO: 531285 - DNA, 20 bp, Artificial
  CRISPR gRNA sequence
aaattccagcttcaacccct

SEQ ID NO: 531286 - DNA, 20 bp, Artificial
  CRISPR gRNA sequence
ggcccgcccctccccagacc

SEQ ID NO: 531287 - DNA, 20 bp, Artificial
  CRISPR gRNA sequence
ctttttcaataaaaagcact

SEQ ID NO: 531288 - DNA, 20 bp, Artificial
  CRISPR gRNA sequence
tcagccatgtggtcaacatc

SEQ ID NO: 531289 - DNA, 20 bp, Artificial
  CRISPR gRNA sequence
agcaatataagtgtgattgc

SEQ ID NO: 531290 - DNA, 20 bp, Artificial
  CRISPR gRNA sequence
aaatcaagtgattggtgtgc

SEQ ID NO: 531291 - DNA, 20 bp, Artificial
  CRISPR gRNA sequence
cctatctgcttaagagactc

SEQ ID NO: 531292 - DNA, 20 bp, Artificial
  CRISPR gRNA sequence
ggacacttgcccaccatcct

SEQ ID NO: 531293 - DNA, 20 bp, Artificial
  CRISPR gRNA sequence
ccgtgtctgctcattgtgtg

SEQ ID NO: 531294 - DNA, 20 bp, Artificial
  CRISPR gRNA sequence
gtgtcgaggagaggaagctg

SEQ ID NO: 531295 - DNA, 20 bp, Artificial
  CRISPR gRNA sequence
gagcctcgctggtgtgacag

SEQ ID NO: 531296 - DNA, 20 bp, Artificial
  CRISPR gRNA sequence
cagcttcctctcctcgacac

SEQ ID NO: 531297 - DNA, 20 bp, Artificial
  CRISPR gRNA sequence
ccttcacacaatgagcagac

SEQ ID NO: 531298 - DNA, 20 bp, Artificial
  CRISPR gRNA sequence
ttttatttcacttttactca

SEQ ID NO: 531299 - DNA, 20 bp, Artificial
  CRISPR gRNA sequence
ccagggcacataagaaactc

SEQ ID NO: 531300 - DNA, 20 bp, Artificial
  CRISPR gRNA sequence
tccagatgttgaccacatgg

SEQ ID NO: 531301 - DNA, 20 bp, Artificial
  CRISPR gRNA sequence
agaaaacacctcatggaagt

SEQ ID NO: 531302 - DNA, 20 bp, Artificial
  CRISPR gRNA sequence
ttaattagaggaaggggaca

SEQ ID NO: 531303 - DNA, 20 bp, Artificial
  CRISPR gRNA sequence
acgatgaccaggtggtggag

SEQ ID NO: 531304 - DNA, 20 bp, Artificial
  CRISPR gRNA sequence
aggaggatgttgggaagttg

SEQ ID NO: 531305 - DNA, 20 bp, Artificial
  CRISPR gRNA sequence
tgggaagttgctggattctg

SEQ ID NO: 531306 - DNA, 20 bp, Artificial
  CRISPR gRNA sequence
ggattctgaggggttgaagc

SEQ ID NO: 531307 - DNA, 20 bp, Artificial
  CRISPR gRNA sequence
ctgcaacaacaaaacctcaa

SEQ ID NO: 531308 - DNA, 20 bp, Artificial
  CRISPR gRNA sequence
aggtgaaatcaatgtaaata

SEQ ID NO: 531309 - DNA, 20 bp, Artificial
  CRISPR gRNA sequence
gcgccatgctagctgctttg

SEQ ID NO: 531310 - DNA, 20 bp, Artificial
  CRISPR gRNA sequence
aagaagtgctcaccataagg

SEQ ID NO: 531311 - DNA, 20 bp, Artificial
  CRISPR gRNA sequence
gcctaggacaagagaactca

SEQ ID NO: 531312 - DNA, 20 bp, Artificial
  CRISPR gRNA sequence
aatcagcaggaagaagacac

SEQ ID NO: 531313 - DNA, 20 bp, Artificial
  CRISPR gRNA sequence
catggttagagcgcatggga

SEQ ID NO: 531314 - DNA, 20 bp, Artificial
  CRISPR gRNA sequence
aggggttatgagcagtcatg

SEQ ID NO: 531315 - DNA, 20 bp, Artificial
  CRISPR gRNA sequence
ctcctcctctcctcaccctt

SEQ ID NO: 531316 - DNA, 20 bp, Artificial
  CRISPR gRNA sequence
cctgtactcttaaaatcaca

SEQ ID NO: 531317 - DNA, 20 bp, Artificial
  CRISPR gRNA sequence
taggaagagaagtttttccc

SEQ ID NO: 531318 - DNA, 20 bp, Artificial
  CRISPR gRNA sequence
acctcttttttttttttttt

SEQ ID NO: 531319 - DNA, 20 bp, Artificial
  CRISPR gRNA sequence
ttcactcttgttgcccaggc

SEQ ID NO: 531320 - DNA, 20 bp, Artificial
  CRISPR gRNA sequence
aattctcctgcctcggcctc

SEQ ID NO: 531321 - DNA, 20 bp, Artificial
  CRISPR gRNA sequence
gcctcggcctcctgagtagc

SEQ ID NO: 531322 - DNA, 20 bp, Artificial
  CRISPR gRNA sequence
gccttggcctcccaaagtgc

SEQ ID NO: 531323 - DNA, 20 bp, Artificial
  CRISPR gRNA sequence
taagcatcaccctgtaactt

SEQ ID NO: 531324 - DNA, 20 bp, Artificial
  CRISPR gRNA sequence
aatgtgagcatcagatggct

SEQ ID NO: 531325 - DNA, 20 bp, Artificial
  CRISPR gRNA sequence
gcatcagatggctttgagtg

SEQ ID NO: 531326 - DNA, 20 bp, Artificial
  CRISPR gRNA sequence
tctaacccctggccctagtt

SEQ ID NO: 531327 - DNA, 20 bp, Artificial
  CRISPR gRNA sequence
tagttctgaattatggggca

SEQ ID NO: 531328 - DNA, 20 bp, Artificial
  CRISPR gRNA sequence
ccttgctctgttgcccagac

SEQ ID NO: 531329 - DNA, 20 bp, Artificial
  CRISPR gRNA sequence
ggcacatgagctctggtagg

SEQ ID NO: 531330 - DNA, 20 bp, Artificial
  CRISPR gRNA sequence
atgagctctggtaggaggaa

SEQ ID NO: 531331 - DNA, 20 bp, Artificial
  CRISPR gRNA sequence
cacatggctgagactgcagg

SEQ ID NO: 531332 - DNA, 20 bp, Artificial
  CRISPR gRNA sequence
tgcctggttcaagcaggaca

SEQ ID NO: 531333 - DNA, 20 bp, Artificial
  CRISPR gRNA sequence
gcgcctaaatgtgtgctccc

SEQ ID NO: 531334 - DNA, 20 bp, Artificial
  CRISPR gRNA sequence
tactcaacccagggcatgac

SEQ ID NO: 531335 - DNA, 20 bp, Artificial
  CRISPR gRNA sequence
ctccttgcctcggcctaggc

SEQ ID NO: 531336 - DNA, 20 bp, Artificial
  CRISPR gRNA sequence
ctgagtcaacctactggcca

SEQ ID NO: 531337 - DNA, 20 bp, Artificial
  CRISPR gRNA sequence
tcctaagatcactctgaaag

SEQ ID NO: 531338 - DNA, 20 bp, Artificial
  CRISPR gRNA sequence
tggcagagattgccttgtct

SEQ ID NO: 531339 - DNA, 20 bp, Artificial
  CRISPR gRNA sequence
agccagagctgggcacagag

SEQ ID NO: 531340 - DNA, 20 bp, Artificial
  CRISPR gRNA sequence
tgtgggacagtcgtggtggg

SEQ ID NO: 531341 - DNA, 20 bp, Artificial
  CRISPR gRNA sequence
gggaagaatgggactaagtt

SEQ ID NO: 531342 - DNA, 20 bp, Artificial
  CRISPR gRNA sequence
gatgtttcggggcctgggct

SEQ ID NO: 531343 - DNA, 20 bp, Artificial
  CRISPR gRNA sequence
gaccaagtcctgctgtgaac

SEQ ID NO: 531344 - DNA, 20 bp, Artificial
  CRISPR gRNA sequence
ctgtgccccccacagtgacc

SEQ ID NO: 531345 - DNA, 20 bp, Artificial
  CRISPR gRNA sequence
attctctgaagtgttctgcc

SEQ ID NO: 531346 - DNA, 20 bp, Artificial
  CRISPR gRNA sequence
agtgttctgccttgggtggc

SEQ ID NO: 531347 - DNA, 20 bp, Artificial
  CRISPR gRNA sequence
cctaacacatccctcgaaca

SEQ ID NO: 531348 - DNA, 20 bp, Artificial
  CRISPR gRNA sequence
tcctgtgactacctgatgac

SEQ ID NO: 531349 - DNA, 20 bp, Artificial
  CRISPR gRNA sequence
tcaccaagtaggcctcagtg

SEQ ID NO: 531350 - DNA, 20 bp, Artificial
  CRISPR gRNA sequence
gtggattccaatgaggccaa

SEQ ID NO: 531351 - DNA, 20 bp, Artificial
  CRISPR gRNA sequence
gctcccacattgtcaccact

SEQ ID NO: 531352 - DNA, 20 bp, Artificial
  CRISPR gRNA sequence
atccccatgagctgtttcat

SEQ ID NO: 531353 - DNA, 20 bp, Artificial
  CRISPR gRNA sequence
ctctgcaaaaggaagagaag

SEQ ID NO: 531354 - DNA, 20 bp, Artificial
  CRISPR gRNA sequence
agagaagtgggatggctggg

SEQ ID NO: 531355 - DNA, 20 bp, Artificial
  CRISPR gRNA sequence
gagagcccattactctggcc

SEQ ID NO: 531356 - DNA, 20 bp, Artificial
  CRISPR gRNA sequence
ccataactcccaggctcaca

SEQ ID NO: 531357 - DNA, 20 bp, Artificial
  CRISPR gRNA sequence
tcccaggctcacagagggtg

SEQ ID NO: 531358 - DNA, 20 bp, Artificial
  CRISPR gRNA sequence
catcacgaaattttagatcc

SEQ ID NO: 531359 - DNA, 20 bp, Artificial
  CRISPR gRNA sequence
aaacatgaggccctgagagg

SEQ ID NO: 531360 - DNA, 20 bp, Artificial
  CRISPR gRNA sequence
atgaggccctgagagggaga

SEQ ID NO: 531361 - DNA, 20 bp, Artificial
  CRISPR gRNA sequence
ccaggcagtttccaaacact

SEQ ID NO: 531362 - DNA, 20 bp, Artificial
  CRISPR gRNA sequence
tcacggccagcaccctctca

SEQ ID NO: 531363 - DNA, 20 bp, Artificial
  CRISPR gRNA sequence
cctggagccacgagagaaac

SEQ ID NO: 531364 - DNA, 20 bp, Artificial
  CRISPR gRNA sequence
tgactttggtgttaagggaa

SEQ ID NO: 531365 - DNA, 20 bp, Artificial
  CRISPR gRNA sequence
caggagctgtgtgaactttg

SEQ ID NO: 531366 - DNA, 20 bp, Artificial
  CRISPR gRNA sequence
agataatgaaacctacatca

SEQ ID NO: 531367 - DNA, 20 bp, Artificial
  CRISPR gRNA sequence
tgttggaagtcaatcagata

SEQ ID NO: 531368 - DNA, 20 bp, Artificial
  CRISPR gRNA sequence
ccagcaacaggggaaacagg

SEQ ID NO: 531369 - DNA, 20 bp, Artificial
  CRISPR gRNA sequence
tctagggctgtctgcccttt

SEQ ID NO: 531370 - DNA, 20 bp, Artificial
  CRISPR gRNA sequence
tagaaaagcagcagtggggc

SEQ ID NO: 531371 - DNA, 20 bp, Artificial
  CRISPR gRNA sequence
gtggggctcgggtcagggga

SEQ ID NO: 531372 - DNA, 20 bp, Artificial
  CRISPR gRNA sequence
acactgttatacatgaagcc

SEQ ID NO: 531373 - DNA, 20 bp, Artificial
  CRISPR gRNA sequence
cccaggatgggccccaagga

SEQ ID NO: 531374 - DNA, 20 bp, Artificial
  CRISPR gRNA sequence
ttcatcttggctttctttcc

SEQ ID NO: 531375 - DNA, 20 bp, Artificial
  CRISPR gRNA sequence
ataatcttaaaccattgaaa

SEQ ID NO: 531376 - DNA, 20 bp, Artificial
  CRISPR gRNA sequence
ccattgaaattgggtcagta

SEQ ID NO: 531377 - DNA, 20 bp, Artificial
  CRISPR gRNA sequence
agaacttttcagatttgacc

SEQ ID NO: 531378 - DNA, 20 bp, Artificial
  CRISPR gRNA sequence
tccatcttccctccaagtca

SEQ ID NO: 531379 - DNA, 20 bp, Artificial
  CRISPR gRNA sequence
cttccctccaagtcatcggg

SEQ ID NO: 531380 - DNA, 20 bp, Artificial
  CRISPR gRNA sequence
attttatcttgggcacatgc

SEQ ID NO: 531381 - DNA, 20 bp, Artificial
  CRISPR gRNA sequence
agcctgctctccagtttgtc

SEQ ID NO: 531382 - DNA, 20 bp, Artificial
  CRISPR gRNA sequence
acctggtagtacttttggtg

SEQ ID NO: 531383 - DNA, 20 bp, Artificial
  CRISPR gRNA sequence
ctcttggagatcacatgccc

SEQ ID NO: 531384 - DNA, 20 bp, Artificial
  CRISPR gRNA sequence
gacaaattatttttgtgcat

SEQ ID NO: 531385 - DNA, 20 bp, Artificial
  CRISPR gRNA sequence
tcctctctgccttggccttt

SEQ ID NO: 531386 - DNA, 20 bp, Artificial
  CRISPR gRNA sequence
taaaacttccaaatcccttt

SEQ ID NO: 531387 - DNA, 20 bp, Artificial
  CRISPR gRNA sequence
tgagcttctgctctgcacca

SEQ ID NO: 531388 - DNA, 20 bp, Artificial
  CRISPR gRNA sequence
gttaaaataaacatgaaaag

SEQ ID NO: 531389 - DNA, 20 bp, Artificial
  CRISPR gRNA sequence
tgcaaaacacccagttaaat

SEQ ID NO: 531390 - DNA, 20 bp, Artificial
  CRISPR gRNA sequence
actttgggaggctgaggtgg

SEQ ID NO: 531391 - DNA, 20 bp, Artificial
  CRISPR gRNA sequence
tgggaggatagtttgagcac

SEQ ID NO: 531392 - DNA, 20 bp, Artificial
  CRISPR gRNA sequence
ttcgagaccagcctgggcaa

SEQ ID NO: 531393 - DNA, 20 bp, Artificial
  CRISPR gRNA sequence
tacaaaattttaaaaattag

SEQ ID NO: 531394 - DNA, 20 bp, Artificial
  CRISPR gRNA sequence
tactggggaggctgaggtgg

SEQ ID NO: 531395 - DNA, 20 bp, Artificial
  CRISPR gRNA sequence
ttactgtgccttagtgatgg

SEQ ID NO: 531396 - DNA, 20 bp, Artificial
  CRISPR gRNA sequence
ttagtgatgggggaatgtgg

SEQ ID NO: 531397 - DNA, 20 bp, Artificial
  CRISPR gRNA sequence
ggatgactggtgggaaaacc

SEQ ID NO: 531398 - DNA, 20 bp, Artificial
  CRISPR gRNA sequence
ctatgtgcaatcccctctga

SEQ ID NO: 531399 - DNA, 20 bp, Artificial
  CRISPR gRNA sequence
cagaacacagcagaagtgat

SEQ ID NO: 531400 - DNA, 20 bp, Artificial
  CRISPR gRNA sequence
gaggcagcccaacggcccac

SEQ ID NO: 531401 - DNA, 20 bp, Artificial
  CRISPR gRNA sequence
ccacatgaatgaacttggaa

SEQ ID NO: 531402 - DNA, 20 bp, Artificial
  CRISPR gRNA sequence
tcacatcaggctgggacact

SEQ ID NO: 531403 - DNA, 20 bp, Artificial
  CRISPR gRNA sequence
ctggggatccattatggtct

SEQ ID NO: 531404 - DNA, 20 bp, Artificial
  CRISPR gRNA sequence
ttgccgtcctgttgtgtgcc

SEQ ID NO: 531405 - DNA, 20 bp, Artificial
  CRISPR gRNA sequence
tcccccatgaccctgccccc

SEQ ID NO: 531406 - DNA, 20 bp, Artificial
  CRISPR gRNA sequence
accatctttaggggagcagt

SEQ ID NO: 531407 - DNA, 20 bp, Artificial
  CRISPR gRNA sequence
tgcaattctttctcctagaa

SEQ ID NO: 531408 - DNA, 20 bp, Artificial
  CRISPR gRNA sequence
gtgctcagtgggaggactcc

SEQ ID NO: 531409 - DNA, 20 bp, Artificial
  CRISPR gRNA sequence
gacagctgacaggctcgaca

SEQ ID NO: 531410 - DNA, 20 bp, Artificial
  CRISPR gRNA sequence
ctttgttccctgctgtgcac

SEQ ID NO: 531411 - DNA, 20 bp, Artificial
  CRISPR gRNA sequence
atcttgatacaggtttaatt

SEQ ID NO: 531412 - DNA, 20 bp, Artificial
  CRISPR gRNA sequence
ccattcattacctcacaggt

SEQ ID NO: 531413 - DNA, 20 bp, Artificial
  CRISPR gRNA sequence
acatatctatttatacagtg

SEQ ID NO: 531414 - DNA, 20 bp, Artificial
  CRISPR gRNA sequence
tctatttatacagtggggga

SEQ ID NO: 531415 - DNA, 20 bp, Artificial
  CRISPR gRNA sequence
accacctaaaacatggcagt

SEQ ID NO: 531416 - DNA, 20 bp, Artificial
  CRISPR gRNA sequence
aaacatggcagtcagggttt

SEQ ID NO: 531417 - DNA, 20 bp, Artificial
  CRISPR gRNA sequence
ggcagtcagggtttaggagt

SEQ ID NO: 531418 - DNA, 20 bp, Artificial
  CRISPR gRNA sequence
tatgggtaagaaagtgcctc

SEQ ID NO: 531419 - DNA, 20 bp, Artificial
  CRISPR gRNA sequence
agccaggaaccccatcctgg

SEQ ID NO: 531420 - DNA, 20 bp, Artificial
  CRISPR gRNA sequence
ttgacatgtgactggggacc

SEQ ID NO: 531421 - DNA, 20 bp, Artificial
  CRISPR gRNA sequence
ttcctggagcagtgggccag

SEQ ID NO: 531422 - DNA, 20 bp, Artificial
  CRISPR gRNA sequence
agtgggccaggtgggtatat

SEQ ID NO: 531423 - DNA, 20 bp, Artificial
  CRISPR gRNA sequence
aggtgggtatatgtgagtgt

SEQ ID NO: 531424 - DNA, 20 bp, Artificial
  CRISPR gRNA sequence
cagagctgctcagttgctca

SEQ ID NO: 531425 - DNA, 20 bp, Artificial
  CRISPR gRNA sequence
ccctcctcagagcatcagaa

SEQ ID NO: 531426 - DNA, 20 bp, Artificial
  CRISPR gRNA sequence
aaattatcaacattcagcaa

SEQ ID NO: 531427 - DNA, 20 bp, Artificial
  CRISPR gRNA sequence
gttagtacatagtctagagg

SEQ ID NO: 531428 - DNA, 20 bp, Artificial
  CRISPR gRNA sequence
acgaagtttgcccgtctctt

SEQ ID NO: 531429 - DNA, 20 bp, Artificial
  CRISPR gRNA sequence
gtggtgatggttgcaaaact

SEQ ID NO: 531430 - DNA, 20 bp, Artificial
  CRISPR gRNA sequence
cgttttagtgtatggacaaa

SEQ ID NO: 531431 - DNA, 20 bp, Artificial
  CRISPR gRNA sequence
atggacaaattgaatgatag

SEQ ID NO: 531432 - DNA, 20 bp, Artificial
  CRISPR gRNA sequence
catccttgccaaaaagacct

SEQ ID NO: 531433 - DNA, 20 bp, Artificial
  CRISPR gRNA sequence
tgccaaaaagacctctgagt

SEQ ID NO: 531434 - DNA, 20 bp, Artificial
  CRISPR gRNA sequence
tcacactcaaaacaggacac

SEQ ID NO: 531435 - DNA, 20 bp, Artificial
  CRISPR gRNA sequence
cactcgagttctgtgctgtt

SEQ ID NO: 531436 - DNA, 20 bp, Artificial
  CRISPR gRNA sequence
tccactcaaggttgcaggac

SEQ ID NO: 531437 - DNA, 20 bp, Artificial
  CRISPR gRNA sequence
tcaggggagctgacagtgtc

SEQ ID NO: 531438 - DNA, 20 bp, Artificial
  CRISPR gRNA sequence
ctgacagtgtctgggattgc

SEQ ID NO: 531439 - DNA, 20 bp, Artificial
  CRISPR gRNA sequence
gtgggcaatctgacactatc

SEQ ID NO: 531440 - DNA, 20 bp, Artificial
  CRISPR gRNA sequence
ggagacagagaggaagaagg

SEQ ID NO: 531441 - DNA, 20 bp, Artificial
  CRISPR gRNA sequence
cagaaatgcttatttgctca

SEQ ID NO: 531442 - DNA, 20 bp, Artificial
  CRISPR gRNA sequence
tggctggcctgtgctcatgc

SEQ ID NO: 531443 - DNA, 20 bp, Artificial
  CRISPR gRNA sequence
gccaccactcaaagtcaata

SEQ ID NO: 531444 - DNA, 20 bp, Artificial
  CRISPR gRNA sequence
actttgggaggctaaggtgg

SEQ ID NO: 531445 - DNA, 20 bp, Artificial
  CRISPR gRNA sequence
tgggcggatctcttgaggcc

SEQ ID NO: 531446 - DNA, 20 bp, Artificial
  CRISPR gRNA sequence
tctcttgaggccaggagttc

SEQ ID NO: 531447 - DNA, 20 bp, Artificial
  CRISPR gRNA sequence
tactcaggaggctgaggcat

SEQ ID NO: 531448 - DNA, 20 bp, Artificial
  CRISPR gRNA sequence
ctgcactccaggctggacga

SEQ ID NO: 531449 - DNA, 20 bp, Artificial
  CRISPR gRNA sequence
tgcatatatgcatcttttta

SEQ ID NO: 531450 - DNA, 20 bp, Artificial
  CRISPR gRNA sequence
tgttctagtatttcgctaac

SEQ ID NO: 531451 - DNA, 20 bp, Artificial
  CRISPR gRNA sequence
tgcagtgatgggcacccttg

SEQ ID NO: 531452 - DNA, 20 bp, Artificial
  CRISPR gRNA sequence
gatccaacctaaggccttcc

SEQ ID NO: 531453 - DNA, 20 bp, Artificial
  CRISPR gRNA sequence
tggatgagaactccttaatt

SEQ ID NO: 531454 - DNA, 20 bp, Artificial
  CRISPR gRNA sequence
actccttaattctgagttgc

SEQ ID NO: 531455 - DNA, 20 bp, Artificial
  CRISPR gRNA sequence
ggaaatgcaggcacaactac

SEQ ID NO: 531456 - DNA, 20 bp, Artificial
  CRISPR gRNA sequence
gagtttgagaagtttggagg

SEQ ID NO: 531457 - DNA, 20 bp, Artificial
  CRISPR gRNA sequence
actttgggaggccgatgcag

SEQ ID NO: 531458 - DNA, 20 bp, Artificial
  CRISPR gRNA sequence
caggcggatcccctgaggtc

SEQ ID NO: 531459 - DNA, 20 bp, Artificial
  CRISPR gRNA sequence
tacttgggaggctgaggcag

SEQ ID NO: 531460 - DNA, 20 bp, Artificial
  CRISPR gRNA sequence
cttgtacacaccttgtctca

SEQ ID NO: 531461 - DNA, 20 bp, Artificial
  CRISPR gRNA sequence
aagcagactcacagcagata

SEQ ID NO: 531462 - DNA, 20 bp, Artificial
  CRISPR gRNA sequence
taatagtgaccaactacaag

SEQ ID NO: 531463 - DNA, 20 bp, Artificial
  CRISPR gRNA sequence
aagtcactgtctttcggcta

SEQ ID NO: 531464 - DNA, 20 bp, Artificial
  CRISPR gRNA sequence
tgtctttcggctaaagggtg

SEQ ID NO: 531465 - DNA, 20 bp, Artificial
  CRISPR gRNA sequence
gtggtgatggttacaaaact

SEQ ID NO: 531466 - DNA, 20 bp, Artificial
  CRISPR gRNA sequence
cattttagtatatggacaaa

SEQ ID NO: 531467 - DNA, 20 bp, Artificial
  CRISPR gRNA sequence
atggacaaattgaatggtag

SEQ ID NO: 531468 - DNA, 20 bp, Artificial
  CRISPR gRNA sequence
cattcttgccaaaaagacct

SEQ ID NO: 531469 - DNA, 20 bp, Artificial
  CRISPR gRNA sequence
tgccaaaaagacctctgagt

SEQ ID NO: 531470 - DNA, 20 bp, Artificial
  CRISPR gRNA sequence
tcacactcaaaacaggacac

SEQ ID NO: 531471 - DNA, 20 bp, Artificial
  CRISPR gRNA sequence
cactcgagttttgtgctgtt

SEQ ID NO: 531472 - DNA, 20 bp, Artificial
  CRISPR gRNA sequence
tccactcaaggttgcaggac

SEQ ID NO: 531473 - DNA, 20 bp, Artificial
  CRISPR gRNA sequence
tcaggggagctgacagtgtc

SEQ ID NO: 531474 - DNA, 20 bp, Artificial
  CRISPR gRNA sequence
ctgacagtgtctgggattgc

SEQ ID NO: 531475 - DNA, 20 bp, Artificial
  CRISPR gRNA sequence
gtgggcaatctgacactatc

SEQ ID NO: 531476 - DNA, 20 bp, Artificial
  CRISPR gRNA sequence
ggagacagagaggaagaagg

SEQ ID NO: 531477 - DNA, 20 bp, Artificial
  CRISPR gRNA sequence
cagaaatgcttatttgctca

SEQ ID NO: 531478 - DNA, 20 bp, Artificial
  CRISPR gRNA sequence
tggctggcctgtgctcatgc

SEQ ID NO: 531479 - DNA, 20 bp, Artificial
  CRISPR gRNA sequence
gattgactttggcagctcat

SEQ ID NO: 531480 - DNA, 20 bp, Artificial
  CRISPR gRNA sequence
ttaattggtcctcactccac

SEQ ID NO: 531481 - DNA, 20 bp, Artificial
  CRISPR gRNA sequence
ttcctgtaaccacctgaaga

SEQ ID NO: 531482 - DNA, 20 bp, Artificial
  CRISPR gRNA sequence
agttgtaggcaggtagactt

SEQ ID NO: 531483 - DNA, 20 bp, Artificial
  CRISPR gRNA sequence
cttgagggtctatcagatgt

SEQ ID NO: 531484 - DNA, 20 bp, Artificial
  CRISPR gRNA sequence
ggaggcagaggtcagcgctg

SEQ ID NO: 531485 - DNA, 20 bp, Artificial
  CRISPR gRNA sequence
cactgaaataaagcaattaa

SEQ ID NO: 531486 - DNA, 20 bp, Artificial
  CRISPR gRNA sequence
taagggaatgaacacttacc

SEQ ID NO: 531487 - DNA, 20 bp, Artificial
  CRISPR gRNA sequence
gtcttcagatgcttaatttt

SEQ ID NO: 531488 - DNA, 20 bp, Artificial
  CRISPR gRNA sequence
tgaaagtctctttctctttt

SEQ ID NO: 531489 - DNA, 20 bp, Artificial
  CRISPR gRNA sequence
tcatcactcatttgaaaact

SEQ ID NO: 531490 - DNA, 20 bp, Artificial
  CRISPR gRNA sequence
actgcacctataaaaagcaa

SEQ ID NO: 531491 - DNA, 20 bp, Artificial
  CRISPR gRNA sequence
taaaaagcaaaagagttact

SEQ ID NO: 531492 - DNA, 20 bp, Artificial
  CRISPR gRNA sequence
agagtcactttcagggaaag

SEQ ID NO: 531493 - DNA, 20 bp, Artificial
  CRISPR gRNA sequence
ttacatggaaagctcatctt

SEQ ID NO: 531494 - DNA, 20 bp, Artificial
  CRISPR gRNA sequence
aggaactgaagtgagactgg

SEQ ID NO: 531495 - DNA, 20 bp, Artificial
  CRISPR gRNA sequence
agaggaaaccaacccctaag

SEQ ID NO: 531496 - DNA, 20 bp, Artificial
  CRISPR gRNA sequence
gctttccatgtaaatttgta

SEQ ID NO: 531497 - DNA, 20 bp, Artificial
  CRISPR gRNA sequence
taaatttgtagccagcttcc

SEQ ID NO: 531498 - DNA, 20 bp, Artificial
  CRISPR gRNA sequence
gccagcttccttctgatttt

SEQ ID NO: 531499 - DNA, 20 bp, Artificial
  CRISPR gRNA sequence
aagagtcaaagaagtcccaa

SEQ ID NO: 531500 - DNA, 20 bp, Artificial
  CRISPR gRNA sequence
aaagtgactctcagtaactc

SEQ ID NO: 531501 - DNA, 20 bp, Artificial
  CRISPR gRNA sequence
ttttataggtgcagtctcca

SEQ ID NO: 531502 - DNA, 20 bp, Artificial
  CRISPR gRNA sequence
aggacatcaacttggacatt

SEQ ID NO: 531503 - DNA, 20 bp, Artificial
  CRISPR gRNA sequence
ggaaaaaacttcagacaaga

SEQ ID NO: 531504 - DNA, 20 bp, Artificial
  CRISPR gRNA sequence
aaaaatgtgttggaaaaaat

SEQ ID NO: 531505 - DNA, 20 bp, Artificial
  CRISPR gRNA sequence
gttggaaaaaatatttgatt

SEQ ID NO: 531506 - DNA, 20 bp, Artificial
  CRISPR gRNA sequence
aggtaagtgttcattccctt

SEQ ID NO: 531507 - DNA, 20 bp, Artificial
  CRISPR gRNA sequence
atgtggggttgggtgaagaa

SEQ ID NO: 531508 - DNA, 20 bp, Artificial
  CRISPR gRNA sequence
atgaacagcccttattttgg

SEQ ID NO: 531509 - DNA, 20 bp, Artificial
  CRISPR gRNA sequence
tcagagtgatacaaggtggc

SEQ ID NO: 531510 - DNA, 20 bp, Artificial
  CRISPR gRNA sequence
tgtgtagaagatgcacaagg

SEQ ID NO: 531511 - DNA, 20 bp, Artificial
  CRISPR gRNA sequence
gtggagtgaggaccaattaa

SEQ ID NO: 531512 - DNA, 20 bp, Artificial
  CRISPR gRNA sequence
attaggttctaaagctccct

SEQ ID NO: 531513 - DNA, 20 bp, Artificial
  CRISPR gRNA sequence
aagggtcaggcatagagaaa

SEQ ID NO: 531514 - DNA, 20 bp, Artificial
  CRISPR gRNA sequence
caagaagggaaaagaagaag

SEQ ID NO: 531515 - DNA, 20 bp, Artificial
  CRISPR gRNA sequence
cagtgagcaaataagcattt

SEQ ID NO: 531516 - DNA, 20 bp, Artificial
  CRISPR gRNA sequence
taccagcaatcccagatagt

SEQ ID NO: 531517 - DNA, 20 bp, Artificial
  CRISPR gRNA sequence
agcatggcgctgaaaagggc

SEQ ID NO: 531518 - DNA, 20 bp, Artificial
  CRISPR gRNA sequence
aacagcacaaaactcgagtg

SEQ ID NO: 531519 - DNA, 20 bp, Artificial
  CRISPR gRNA sequence
ccctacgcgggggaccatgc

SEQ ID NO: 531520 - DNA, 20 bp, Artificial
  CRISPR gRNA sequence
atggctaccagttaggggtc

SEQ ID NO: 531521 - DNA, 20 bp, Artificial
  CRISPR gRNA sequence
ctaccagttaggggtcaagt

SEQ ID NO: 531522 - DNA, 20 bp, Artificial
  CRISPR gRNA sequence
aaaacagagacctagtcaga

SEQ ID NO: 531523 - DNA, 20 bp, Artificial
  CRISPR gRNA sequence
aagcagcttgtccaaggtct

SEQ ID NO: 531524 - DNA, 20 bp, Artificial
  CRISPR gRNA sequence
attgcttgacaggagcaaag

SEQ ID NO: 531525 - DNA, 20 bp, Artificial
  CRISPR gRNA sequence
accttttctttttttttcca

SEQ ID NO: 531526 - DNA, 20 bp, Artificial
  CRISPR gRNA sequence
aaaatggccttcagtatatt

SEQ ID NO: 531527 - DNA, 20 bp, Artificial
  CRISPR gRNA sequence
cctttagccgaaagacagtg

SEQ ID NO: 531528 - DNA, 20 bp, Artificial
  CRISPR gRNA sequence
cacgtcaatgtcatacaaca

SEQ ID NO: 531529 - DNA, 20 bp, Artificial
  CRISPR gRNA sequence
aaattccctatctgctgtga

SEQ ID NO: 531530 - DNA, 20 bp, Artificial
  CRISPR gRNA sequence
tgcagtgcctggggcacaat

SEQ ID NO: 531531 - DNA, 20 bp, Artificial
  CRISPR gRNA sequence
gctaatgccctcccacatct

SEQ ID NO: 531532 - DNA, 20 bp, Artificial
  CRISPR gRNA sequence
tcccacatctctttgtttct

SEQ ID NO: 531533 - DNA, 20 bp, Artificial
  CRISPR gRNA sequence
agcctctgcctcccaggttc

SEQ ID NO: 531534 - DNA, 20 bp, Artificial
  CRISPR gRNA sequence
tgcctcagcctcccaagtag

SEQ ID NO: 531535 - DNA, 20 bp, Artificial
  CRISPR gRNA sequence
ttttgtatttttagtagaga

SEQ ID NO: 531536 - DNA, 20 bp, Artificial
  CRISPR gRNA sequence
tgcatcggcctcccaaagtg

SEQ ID NO: 531537 - DNA, 20 bp, Artificial
  CRISPR gRNA sequence
cagactgtaagatcacataa

SEQ ID NO: 531538 - DNA, 20 bp, Artificial
  CRISPR gRNA sequence
tctcatgcctcagcctcctg

SEQ ID NO: 531539 - DNA, 20 bp, Artificial
  CRISPR gRNA sequence
tgcctcagcctcctgagtag

SEQ ID NO: 531540 - DNA, 20 bp, Artificial
  CRISPR gRNA sequence
ccaccttagcctcccaaagt

SEQ ID NO: 531541 - DNA, 20 bp, Artificial
  CRISPR gRNA sequence
ggcgttgtgggtaattttta

SEQ ID NO: 531542 - DNA, 20 bp, Artificial
  CRISPR gRNA sequence
taaacttttaaaaatatttt

SEQ ID NO: 531543 - DNA, 20 bp, Artificial
  CRISPR gRNA sequence
aaatattttatcagcttgta

SEQ ID NO: 531544 - DNA, 20 bp, Artificial
  CRISPR gRNA sequence
ataagaagggaaaagaggaa

SEQ ID NO: 531545 - DNA, 20 bp, Artificial
  CRISPR gRNA sequence
cagtgagcaaataagcattt

SEQ ID NO: 531546 - DNA, 20 bp, Artificial
  CRISPR gRNA sequence
taccagcaatcccagatagt

SEQ ID NO: 531547 - DNA, 20 bp, Artificial
  CRISPR gRNA sequence
agcatggcgctgaaaagagc

SEQ ID NO: 531548 - DNA, 20 bp, Artificial
  CRISPR gRNA sequence
aacagcacagaactcgagtg

SEQ ID NO: 531549 - DNA, 20 bp, Artificial
  CRISPR gRNA sequence
ccctacatgggggaccatgt

SEQ ID NO: 531550 - DNA, 20 bp, Artificial
  CRISPR gRNA sequence
atggctaccagttaggggtc

SEQ ID NO: 531551 - DNA, 20 bp, Artificial
  CRISPR gRNA sequence
ctaccagttaggggtcaagt

SEQ ID NO: 531552 - DNA, 20 bp, Artificial
  CRISPR gRNA sequence
aaaacagagacctagtcaga

SEQ ID NO: 531553 - DNA, 20 bp, Artificial
  CRISPR gRNA sequence
aagcagcttgtccaaggtct

SEQ ID NO: 531554 - DNA, 20 bp, Artificial
  CRISPR gRNA sequence
attgcttgacaggagcaaag

SEQ ID NO: 531555 - DNA, 20 bp, Artificial
  CRISPR gRNA sequence
gaccttttcttttttttcta

SEQ ID NO: 531556 - DNA, 20 bp, Artificial
  CRISPR gRNA sequence
aaaacggcctttagtatatt

SEQ ID NO: 531557 - DNA, 20 bp, Artificial
  CRISPR gRNA sequence
tatatatatcgggacataaa

SEQ ID NO: 531558 - DNA, 20 bp, Artificial
  CRISPR gRNA sequence
atctctgtgcgggagaggca

SEQ ID NO: 531559 - DNA, 20 bp, Artificial
  CRISPR gRNA sequence
gtgcgggagaggcaagaggt

SEQ ID NO: 531560 - DNA, 20 bp, Artificial
  CRISPR gRNA sequence
tcagtgcctaacgatctgcc

SEQ ID NO: 531561 - DNA, 20 bp, Artificial
  CRISPR gRNA sequence
ctccttttgtgacaggtagg

SEQ ID NO: 531562 - DNA, 20 bp, Artificial
  CRISPR gRNA sequence
aggcaggtgctctttttccc

SEQ ID NO: 531563 - DNA, 20 bp, Artificial
  CRISPR gRNA sequence
tccccagtcacatgtcaatg

SEQ ID NO: 531564 - DNA, 20 bp, Artificial
  CRISPR gRNA sequence
atactcctaaaccctgactg

SEQ ID NO: 531565 - DNA, 20 bp, Artificial
  CRISPR gRNA sequence
atcccccactgtataaatag

SEQ ID NO: 531566 - DNA, 20 bp, Artificial
  CRISPR gRNA sequence
catcaggggaggtggtgttc

SEQ ID NO: 531567 - DNA, 20 bp, Artificial
  CRISPR gRNA sequence
ggtcccttggctagttagtg

SEQ ID NO: 531568 - DNA, 20 bp, Artificial
  CRISPR gRNA sequence
cctggcacacaacaggacgg

SEQ ID NO: 531569 - DNA, 20 bp, Artificial
  CRISPR gRNA sequence
tgggagtagaggtctggact

SEQ ID NO: 531570 - DNA, 20 bp, Artificial
  CRISPR gRNA sequence
atttagccagagaatcttga

SEQ ID NO: 531571 - DNA, 20 bp, Artificial
  CRISPR gRNA sequence
gacagagtttcttcccctct

SEQ ID NO: 531572 - DNA, 20 bp, Artificial
  CRISPR gRNA sequence
gtttcttcccctctctaggc

SEQ ID NO: 531573 - DNA, 20 bp, Artificial
  CRISPR gRNA sequence
ggctgcctcacaatatggca

SEQ ID NO: 531574 - DNA, 20 bp, Artificial
  CRISPR gRNA sequence
tctagcccacattcaatcag

SEQ ID NO: 531575 - DNA, 20 bp, Artificial
  CRISPR gRNA sequence
ttgaccagcatcacttcacc

SEQ ID NO: 531576 - DNA, 20 bp, Artificial
  CRISPR gRNA sequence
cttcgcaactttttttgaga

SEQ ID NO: 531577 - DNA, 20 bp, Artificial
  CRISPR gRNA sequence
cacctcagcctccccagtag

SEQ ID NO: 531578 - DNA, 20 bp, Artificial
  CRISPR gRNA sequence
cacctcagcctcccaaagtg

SEQ ID NO: 531579 - DNA, 20 bp, Artificial
  CRISPR gRNA sequence
ctgcagtggcctcgggagat

SEQ ID NO: 531580 - DNA, 20 bp, Artificial
  CRISPR gRNA sequence
caaataaaaatacagcataa

SEQ ID NO: 531581 - DNA, 20 bp, Artificial
  CRISPR gRNA sequence
tacttatgcaagaaattttt

SEQ ID NO: 531582 - DNA, 20 bp, Artificial
  CRISPR gRNA sequence
tctgaaattcaaatttaact

SEQ ID NO: 531583 - DNA, 20 bp, Artificial
  CRISPR gRNA sequence
atatctggcaaccctacttt

SEQ ID NO: 531584 - DNA, 20 bp, Artificial
  CRISPR gRNA sequence
gggaggaccttgggagcagc

SEQ ID NO: 531585 - DNA, 20 bp, Artificial
  CRISPR gRNA sequence
agatgggaagaatacctggg

SEQ ID NO: 531586 - DNA, 20 bp, Artificial
  CRISPR gRNA sequence
gctgctcttgaagacccgaa

SEQ ID NO: 531587 - DNA, 20 bp, Artificial
  CRISPR gRNA sequence
gaagacccgaaaagggattt

SEQ ID NO: 531588 - DNA, 20 bp, Artificial
  CRISPR gRNA sequence
gtcagagtctgaccatttgg

SEQ ID NO: 531589 - DNA, 20 bp, Artificial
  CRISPR gRNA sequence
ccatttggctcagattaggt

SEQ ID NO: 531590 - DNA, 20 bp, Artificial
  CRISPR gRNA sequence
tcaaaatactaggaggaagg

SEQ ID NO: 531591 - DNA, 20 bp, Artificial
  CRISPR gRNA sequence
tactgttggaagatagtatg

SEQ ID NO: 531592 - DNA, 20 bp, Artificial
  CRISPR gRNA sequence
tttttgactgacagtgccac

SEQ ID NO: 531593 - DNA, 20 bp, Artificial
  CRISPR gRNA sequence
tcctttactgacccaatttc

SEQ ID NO: 531594 - DNA, 20 bp, Artificial
  CRISPR gRNA sequence
actgacccaatttcaatggt

SEQ ID NO: 531595 - DNA, 20 bp, Artificial
  CRISPR gRNA sequence
tttcaatggtttaagattat

SEQ ID NO: 531596 - DNA, 20 bp, Artificial
  CRISPR gRNA sequence
ggtggaggcctcttcatcag

SEQ ID NO: 531597 - DNA, 20 bp, Artificial
  CRISPR gRNA sequence
agccaagatgaataaaccac

SEQ ID NO: 531598 - DNA, 20 bp, Artificial
  CRISPR gRNA sequence
cagtttgatgatctgttaaa

SEQ ID NO: 531599 - DNA, 20 bp, Artificial
  CRISPR gRNA sequence
ccctctccttggggcccatc

SEQ ID NO: 531600 - DNA, 20 bp, Artificial
  CRISPR gRNA sequence
tgtataacagtgtctccctg

SEQ ID NO: 531601 - DNA, 20 bp, Artificial
  CRISPR gRNA sequence
tttgtgatgctgggccaagt

SEQ ID NO: 531602 - DNA, 20 bp, Artificial
  CRISPR gRNA sequence
tcccctgacccgagccccac

SEQ ID NO: 531603 - DNA, 20 bp, Artificial
  CRISPR gRNA sequence
gcagacagccctagaacccc

SEQ ID NO: 531604 - DNA, 20 bp, Artificial
  CRISPR gRNA sequence
agagcaagacctcacatttg

SEQ ID NO: 531605 - DNA, 20 bp, Artificial
  CRISPR gRNA sequence
acctcacatttgtgttgttt

SEQ ID NO: 531606 - DNA, 20 bp, Artificial
  CRISPR gRNA sequence
aaagcactttcatatccatt

SEQ ID NO: 531607 - DNA, 20 bp, Artificial
  CRISPR gRNA sequence
tccaacagccaccctatgat

SEQ ID NO: 531608 - DNA, 20 bp, Artificial
  CRISPR gRNA sequence
atttcccttaacaccaaagt

SEQ ID NO: 531609 - DNA, 20 bp, Artificial
  CRISPR gRNA sequence
gttactaacgcactgtgcac

SEQ ID NO: 531610 - DNA, 20 bp, Artificial
  CRISPR gRNA sequence
acaagtgaaatatttaccct

SEQ ID NO: 531611 - DNA, 20 bp, Artificial
  CRISPR gRNA sequence
gcagaaacaccgagacaagg

SEQ ID NO: 531612 - DNA, 20 bp, Artificial
  CRISPR gRNA sequence
atgctcaggaacagatattg

SEQ ID NO: 531613 - DNA, 20 bp, Artificial
  CRISPR gRNA sequence
tcattctccctctcagggcc

SEQ ID NO: 531614 - DNA, 20 bp, Artificial
  CRISPR gRNA sequence
tcctcggatctaaaatttcg

SEQ ID NO: 531615 - DNA, 20 bp, Artificial
  CRISPR gRNA sequence
aggcatttctagcccctgag

SEQ ID NO: 531616 - DNA, 20 bp, Artificial
  CRISPR gRNA sequence
tttcccaaagagcctgcaga

SEQ ID NO: 531617 - DNA, 20 bp, Artificial
  CRISPR gRNA sequence
aggtcccaacaagctcttct

SEQ ID NO: 531618 - DNA, 20 bp, Artificial
  CRISPR gRNA sequence
ttgatggtctttgtggcact

SEQ ID NO: 531619 - DNA, 20 bp, Artificial
  CRISPR gRNA sequence
cagagaaaatgatggaaata

SEQ ID NO: 531620 - DNA, 20 bp, Artificial
  CRISPR gRNA sequence
tcagggttgtagtcagcggt

SEQ ID NO: 531621 - DNA, 20 bp, Artificial
  CRISPR gRNA sequence
ggttgtagtcagcggttata

SEQ ID NO: 531622 - DNA, 20 bp, Artificial
  CRISPR gRNA sequence
atagcttgtttcattttgtg

SEQ ID NO: 531623 - DNA, 20 bp, Artificial
  CRISPR gRNA sequence
cttgtttcattttgtggtta

SEQ ID NO: 531624 - DNA, 20 bp, Artificial
  CRISPR gRNA sequence
attcttagtggtgacaatgt

SEQ ID NO: 531625 - DNA, 20 bp, Artificial
  CRISPR gRNA sequence
cagaaaggttagctccaaaa

SEQ ID NO: 531626 - DNA, 20 bp, Artificial
  CRISPR gRNA sequence
tcgagggatgtgttagggtt

SEQ ID NO: 531627 - DNA, 20 bp, Artificial
  CRISPR gRNA sequence
atctatcagcaatgaaaagg

SEQ ID NO: 531628 - DNA, 20 bp, Artificial
  CRISPR gRNA sequence
gttatgcttgcaagtgggga

SEQ ID NO: 531629 - DNA, 20 bp, Artificial
  CRISPR gRNA sequence
ccggcaggcacagccacacc

SEQ ID NO: 531630 - DNA, 20 bp, Artificial
  CRISPR gRNA sequence
tggccttgggccccgtgccc

SEQ ID NO: 531631 - DNA, 20 bp, Artificial
  CRISPR gRNA sequence
tgggccccgtgccctctgga

SEQ ID NO: 531632 - DNA, 20 bp, Artificial
  CRISPR gRNA sequence
tctggatttggcttctttac

SEQ ID NO: 531633 - DNA, 20 bp, Artificial
  CRISPR gRNA sequence
tggcagggcccttaggcatg

SEQ ID NO: 531634 - DNA, 20 bp, Artificial
  CRISPR gRNA sequence
gataaaaaagtcgttagtct

SEQ ID NO: 531635 - DNA, 20 bp, Artificial
  CRISPR gRNA sequence
gttttatgtctattagtgca

SEQ ID NO: 531636 - DNA, 20 bp, Artificial
  CRISPR gRNA sequence
atagataacaacacagatga

SEQ ID NO: 531637 - DNA, 20 bp, Artificial
  CRISPR gRNA sequence
ttaaactgcatgcctgtcag

SEQ ID NO: 531638 - DNA, 20 bp, Artificial
  CRISPR gRNA sequence
ggtaggctgaggacccactg

SEQ ID NO: 531639 - DNA, 20 bp, Artificial
  CRISPR gRNA sequence
gctcttcacagaaattgaca

SEQ ID NO: 531640 - DNA, 20 bp, Artificial
  CRISPR gRNA sequence
ttgacattgcgattttcagt

SEQ ID NO: 531641 - DNA, 20 bp, Artificial
  CRISPR gRNA sequence
tcagttcttgtttgcctctt

SEQ ID NO: 531642 - DNA, 20 bp, Artificial
  CRISPR gRNA sequence
tgtttgcctcttacttgatt

SEQ ID NO: 531643 - DNA, 20 bp, Artificial
  CRISPR gRNA sequence
caggaggatcatttgagctc

SEQ ID NO: 531644 - DNA, 20 bp, Artificial
  CRISPR gRNA sequence
gtagtaaaccaatggccagt

SEQ ID NO: 531645 - DNA, 20 bp, Artificial
  CRISPR gRNA sequence
cacggaagatggcatagagg

SEQ ID NO: 531646 - DNA, 20 bp, Artificial
  CRISPR gRNA sequence
ttctggaggccctttcctct

SEQ ID NO: 531647 - DNA, 20 bp, Artificial
  CRISPR gRNA sequence
catgtagtcagaggaggcca

SEQ ID NO: 531648 - DNA, 20 bp, Artificial
  CRISPR gRNA sequence
aacatccggaagttacaggg

SEQ ID NO: 531649 - DNA, 20 bp, Artificial
  CRISPR gRNA sequence
gttacagggtgatgcttaga

SEQ ID NO: 531650 - DNA, 20 bp, Artificial
  CRISPR gRNA sequence
gggtgatgcttagagagggc

SEQ ID NO: 531651 - DNA, 20 bp, Artificial
  CRISPR gRNA sequence
tcaggaggccgaggcaggag

SEQ ID NO: 531652 - DNA, 20 bp, Artificial
  CRISPR gRNA sequence
ctctagcagctgggcacctt

SEQ ID NO: 531653 - DNA, 20 bp, Artificial
  CRISPR gRNA sequence
tgggcaccttcacagattcc

SEQ ID NO: 531654 - DNA, 20 bp, Artificial
  CRISPR gRNA sequence
tacattacgagtagctgtag

SEQ ID NO: 531655 - DNA, 20 bp, Artificial
  CRISPR gRNA sequence
gttccaacctcttgccggaa

SEQ ID NO: 531656 - DNA, 20 bp, Artificial
  CRISPR gRNA sequence
ccacccatgtgtcttcttcc

SEQ ID NO: 531657 - DNA, 20 bp, Artificial
  CRISPR gRNA sequence
attccttgagttctcttgtc

SEQ ID NO: 531658 - DNA, 20 bp, Artificial
  CRISPR gRNA sequence
tgagcacttctttctctcct

SEQ ID NO: 531659 - DNA, 20 bp, Artificial
  CRISPR gRNA sequence
tctcagatagtaggggcaac

SEQ ID NO: 531660 - DNA, 20 bp, Artificial
  CRISPR gRNA sequence
taaaaggtactcaatattta

SEQ ID NO: 531661 - DNA, 20 bp, Artificial
  CRISPR gRNA sequence
ctggccaagatgaactctat

SEQ ID NO: 531662 - DNA, 20 bp, Artificial
  CRISPR gRNA sequence
ggccggaagccccaccaaat

SEQ ID NO: 531663 - DNA, 20 bp, Artificial
  CRISPR gRNA sequence
tctttttcaataaaaagcac

SEQ ID NO: 531664 - DNA, 20 bp, Artificial
  CRISPR gRNA sequence
tgcatatccgtacttccatg

SEQ ID NO: 531665 - DNA, 20 bp, Artificial
  CRISPR gRNA sequence
tcagccatgtggtcaacatc

SEQ ID NO: 531666 - DNA, 20 bp, Artificial
  CRISPR gRNA sequence
agtaaggagaagcaatataa

SEQ ID NO: 531667 - DNA, 20 bp, Artificial
  CRISPR gRNA sequence
aggaccgagcacagaaatct

SEQ ID NO: 531668 - DNA, 20 bp, Artificial
  CRISPR gRNA sequence
atgtgtagatgcgataaatc

SEQ ID NO: 531669 - DNA, 20 bp, Artificial
  CRISPR gRNA sequence
ggtctcactacaagcagcct

SEQ ID NO: 531670 - DNA, 20 bp, Artificial
  CRISPR gRNA sequence
cctatctgcttaagagactc

SEQ ID NO: 531671 - DNA, 20 bp, Artificial
  CRISPR gRNA sequence
cctgtgagtaaaagtgaaat

SEQ ID NO: 531672 - DNA, 20 bp, Artificial
  CRISPR gRNA sequence
agcgaggctctttcttattc

SEQ ID NO: 531673 - DNA, 20 bp, Artificial
  CRISPR gRNA sequence
tgagcagacacgggtctagt

SEQ ID NO: 531674 - DNA, 20 bp, Artificial
  CRISPR gRNA sequence
cagagtctcttaagcagata

SEQ ID NO: 531675 - DNA, 20 bp, Artificial
  CRISPR gRNA sequence
gagacccaggcacaccaatc

SEQ ID NO: 531676 - DNA, 20 bp, Artificial
  CRISPR gRNA sequence
tgagaggggacaagaaatct

SEQ ID NO: 531677 - DNA, 20 bp, Artificial
  CRISPR gRNA sequence
cattcttgcaatcacactta

SEQ ID NO: 531678 - DNA, 20 bp, Artificial
  CRISPR gRNA sequence
atcaggagggcagaaatcca

SEQ ID NO: 531679 - DNA, 20 bp, Artificial
  CRISPR gRNA sequence
cagtgctttttattgaaaaa

SEQ ID NO: 531680 - DNA, 20 bp, Artificial
  CRISPR gRNA sequence
ttaattagaggaaggggaca

SEQ ID NO: 531681 - DNA, 20 bp, Artificial
  CRISPR gRNA sequence
agttttctgctgccccatgg

SEQ ID NO: 531682 - DNA, 20 bp, Artificial
  CRISPR gRNA sequence
gaggaggatgttgggaagtt

SEQ ID NO: 531683 - DNA, 20 bp, Artificial
  CRISPR gRNA sequence
gggttgaagctggaatttgg

SEQ ID NO: 531684 - DNA, 20 bp, Artificial
  CRISPR gRNA sequence
tatatgcaaggcgccatgct

SEQ ID NO: 531685 - DNA, 20 bp, Artificial
  CRISPR gRNA sequence
gcccctactatctgagaact

SEQ ID NO: 531686 - DNA, 20 bp, Artificial
  CRISPR gRNA sequence
aggaagaagacacatgggtg

SEQ ID NO: 531687 - DNA, 20 bp, Artificial
  CRISPR gRNA sequence
ctttttgtccttagaaattt

SEQ ID NO: 531688 - DNA, 20 bp, Artificial
  CRISPR gRNA sequence
actcctcctctcctcaccct

SEQ ID NO: 531689 - DNA, 20 bp, Artificial
  CRISPR gRNA sequence
aggcctacagctactcgtaa

SEQ ID NO: 531690 - DNA, 20 bp, Artificial
  CRISPR gRNA sequence
ctccagagggaggtaggaag

SEQ ID NO: 531691 - DNA, 20 bp, Artificial
  CRISPR gRNA sequence
ttttttttttttttttgagt

SEQ ID NO: 531692 - DNA, 20 bp, Artificial
  CRISPR gRNA sequence
tgcctcggcctcctgagtag

SEQ ID NO: 531693 - DNA, 20 bp, Artificial
  CRISPR gRNA sequence
tattgtatttttagtagaga

SEQ ID NO: 531694 - DNA, 20 bp, Artificial
  CRISPR gRNA sequence
tgccttggcctcccaaagtg

SEQ ID NO: 531695 - DNA, 20 bp, Artificial
  CRISPR gRNA sequence
atcaccctgtaacttccgga

SEQ ID NO: 531696 - DNA, 20 bp, Artificial
  CRISPR gRNA sequence
tacatgaaatgtgagcatca

SEQ ID NO: 531697 - DNA, 20 bp, Artificial
  CRISPR gRNA sequence
tgtagagtcaaagttagaca

SEQ ID NO: 531698 - DNA, 20 bp, Artificial
  CRISPR gRNA sequence
catcttccgtgccctgcagt

SEQ ID NO: 531699 - DNA, 20 bp, Artificial
  CRISPR gRNA sequence
ccttcttcatctcctatgtg

SEQ ID NO: 531700 - DNA, 20 bp, Artificial
  CRISPR gRNA sequence
gtggcaagcttgcactggcc

SEQ ID NO: 531701 - DNA, 20 bp, Artificial
  CRISPR gRNA sequence
ctactctgttcacccactat

SEQ ID NO: 531702 - DNA, 20 bp, Artificial
  CRISPR gRNA sequence
acccactatttttgtttttt

SEQ ID NO: 531703 - DNA, 20 bp, Artificial
  CRISPR gRNA sequence
ctatttttgttttttatttg

SEQ ID NO: 531704 - DNA, 20 bp, Artificial
  CRISPR gRNA sequence
attcttgatctcccgggctg

SEQ ID NO: 531705 - DNA, 20 bp, Artificial
  CRISPR gRNA sequence
ccaatgcacccacctaattt

SEQ ID NO: 531706 - DNA, 20 bp, Artificial
  CRISPR gRNA sequence
tgcctcggcctcccaaagtg

SEQ ID NO: 531707 - DNA, 20 bp, Artificial
  CRISPR gRNA sequence
ccaggctcattgtccttctc

SEQ ID NO: 531708 - DNA, 20 bp, Artificial
  CRISPR gRNA sequence
gcaagcgaggctgacaggca

SEQ ID NO: 531709 - DNA, 20 bp, Artificial
  CRISPR gRNA sequence
cctgagtcaacctactggcc

SEQ ID NO: 531710 - DNA, 20 bp, Artificial
  CRISPR gRNA sequence
ataattgaacctcactgaac

SEQ ID NO: 531711 - DNA, 20 bp, Artificial
  CRISPR gRNA sequence
tcttctcagcctggtgatgg

SEQ ID NO: 531712 - DNA, 20 bp, Artificial
  CRISPR gRNA sequence
ggcatgcctaagggccctgc

SEQ ID NO: 531713 - DNA, 20 bp, Artificial
  CRISPR gRNA sequence
gaatgggactaagttcagga

SEQ ID NO: 531714 - DNA, 20 bp, Artificial
  CRISPR gRNA sequence
ccaaggccaccggtgcctgg

SEQ ID NO: 531715 - DNA, 20 bp, Artificial
  CRISPR gRNA sequence
agcataaccttttcattgct

SEQ ID NO: 531716 - DNA, 20 bp, Artificial
  CRISPR gRNA sequence
tagcaaagggggcacaggca

SEQ ID NO: 531717 - DNA, 20 bp, Artificial
  CRISPR gRNA sequence
caggcaccctgctttagaac

SEQ ID NO: 531718 - DNA, 20 bp, Artificial
  CRISPR gRNA sequence
ctgtgactacctgatgacct

SEQ ID NO: 531719 - DNA, 20 bp, Artificial
  CRISPR gRNA sequence
gatgacctgaatgattttcc

SEQ ID NO: 531720 - DNA, 20 bp, Artificial
  CRISPR gRNA sequence
atgattttccctgtgtttct

SEQ ID NO: 531721 - DNA, 20 bp, Artificial
  CRISPR gRNA sequence
aggacatttattcctagaaa

SEQ ID NO: 531722 - DNA, 20 bp, Artificial
  CRISPR gRNA sequence
gtcaccaagtaggcctcagt

SEQ ID NO: 531723 - DNA, 20 bp, Artificial
  CRISPR gRNA sequence
ggtggattccaatgaggcca

SEQ ID NO: 531724 - DNA, 20 bp, Artificial
  CRISPR gRNA sequence
ccacattgtcaccactaaga

SEQ ID NO: 531725 - DNA, 20 bp, Artificial
  CRISPR gRNA sequence
cctatttccatcattttctc

SEQ ID NO: 531726 - DNA, 20 bp, Artificial
  CRISPR gRNA sequence
ttcaaggtgtcatccccatg

SEQ ID NO: 531727 - DNA, 20 bp, Artificial
  CRISPR gRNA sequence
catccccatgagctgtttca

SEQ ID NO: 531728 - DNA, 20 bp, Artificial
  CRISPR gRNA sequence
ctgcggtgggacaaaagagg

SEQ ID NO: 531729 - DNA, 20 bp, Artificial
  CRISPR gRNA sequence
gcttaccatttctccgactc

SEQ ID NO: 531730 - DNA, 20 bp, Artificial
  CRISPR gRNA sequence
ctcctgcatcaagcagatag

SEQ ID NO: 531731 - DNA, 20 bp, Artificial
  CRISPR gRNA sequence
tgctctcaggggctagaaat

SEQ ID NO: 531732 - DNA, 20 bp, Artificial
  CRISPR gRNA sequence
gagatactctaaatgcaacc

SEQ ID NO: 531733 - DNA, 20 bp, Artificial
  CRISPR gRNA sequence
ccttaagcagccccttgtct

SEQ ID NO: 531734 - DNA, 20 bp, Artificial
  CRISPR gRNA sequence
ctctggctacccccactgca

SEQ ID NO: 531735 - DNA, 20 bp, Artificial
  CRISPR gRNA sequence
ccttctcactgtctctacca

SEQ ID NO: 531736 - DNA, 20 bp, Artificial
  CRISPR gRNA sequence
tcacggccagcaccctctca

SEQ ID NO: 531737 - DNA, 20 bp, Artificial
  CRISPR gRNA sequence
acagtgcgttagtaacagca

SEQ ID NO: 531738 - DNA, 20 bp, Artificial
  CRISPR gRNA sequence
tgactttggtgttaagggaa

SEQ ID NO: 531739 - DNA, 20 bp, Artificial
  CRISPR gRNA sequence
ttaagggaaatgggtttggt

SEQ ID NO: 531740 - DNA, 20 bp, Artificial
  CRISPR gRNA sequence
gagttacttcacctctctga

SEQ ID NO: 531741 - DNA, 20 bp, Artificial
  CRISPR gRNA sequence
caatcagataatggatatga

SEQ ID NO: 531742 - DNA, 20 bp, Artificial
  CRISPR gRNA sequence
tcttactagtgttctcgcac

SEQ ID NO: 531743 - DNA, 20 bp, Artificial
  CRISPR gRNA sequence
ctcgcactggtgtttctggg

SEQ ID NO: 531744 - DNA, 20 bp, Artificial
  CRISPR gRNA sequence
ttggcccagcatcacaaaag

SEQ ID NO: 531745 - DNA, 20 bp, Artificial
  CRISPR gRNA sequence
gagggtcagaggctcagaaa

SEQ ID NO: 531746 - DNA, 20 bp, Artificial
  CRISPR gRNA sequence
ttaacagatcatcaaactgt

SEQ ID NO: 531747 - DNA, 20 bp, Artificial
  CRISPR gRNA sequence
aactgtggtggtttattcat

SEQ ID NO: 531748 - DNA, 20 bp, Artificial
  CRISPR gRNA sequence
accattgaaattgggtcagt

SEQ ID NO: 531749 - DNA, 20 bp, Artificial
  CRISPR gRNA sequence
ttcagggccctttaggccct

SEQ ID NO: 531750 - DNA, 20 bp, Artificial
  CRISPR gRNA sequence
ataccagaggccacttcctg

SEQ ID NO: 531751 - DNA, 20 bp, Artificial
  CRISPR gRNA sequence
cctgctgagcttgagaactt

SEQ ID NO: 531752 - DNA, 20 bp, Artificial
  CRISPR gRNA sequence
ggtggggcagggcaggcctg

SEQ ID NO: 531753 - DNA, 20 bp, Artificial
  CRISPR gRNA sequence
atgccttacacagcctgctc

SEQ ID NO: 531754 - DNA, 20 bp, Artificial
  CRISPR gRNA sequence
ttttggtggggaatgttcca

SEQ ID NO: 531755 - DNA, 20 bp, Artificial
  CRISPR gRNA sequence
ctcttggagatcacatgccc

SEQ ID NO: 531756 - DNA, 20 bp, Artificial
  CRISPR gRNA sequence
tctgttccttcctcctagta

SEQ ID NO: 531757 - DNA, 20 bp, Artificial
  CRISPR gRNA sequence
ccctagtggtccttctcgca

SEQ ID NO: 531758 - DNA, 20 bp, Artificial
  CRISPR gRNA sequence
ttgggaggctgaggtgggag

SEQ ID NO: 531759 - DNA, 20 bp, Artificial
  CRISPR gRNA sequence
ctactggggaggctgaggtg

SEQ ID NO: 531760 - DNA, 20 bp, Artificial
  CRISPR gRNA sequence
tggggaggctgaggtgggag

SEQ ID NO: 531761 - DNA, 20 bp, Artificial
  CRISPR gRNA sequence
tgaagtgatgctggtcaagt

SEQ ID NO: 531762 - DNA, 20 bp, Artificial
  CRISPR gRNA sequence
tctcagatgccttcaatgac

SEQ ID NO: 531763 - DNA, 20 bp, Artificial
  CRISPR gRNA sequence
tctcacctatgtgcaatccc

SEQ ID NO: 531764 - DNA, 20 bp, Artificial
  CRISPR gRNA sequence
aatgtgggctagacttatta

SEQ ID NO: 531765 - DNA, 20 bp, Artificial
  CRISPR gRNA sequence
taatgaacagaacacagcag

SEQ ID NO: 531766 - DNA, 20 bp, Artificial
  CRISPR gRNA sequence
aagtgattgggatattactc

SEQ ID NO: 531767 - DNA, 20 bp, Artificial
  CRISPR gRNA sequence
catctaatagtctgtgaaca

SEQ ID NO: 531768 - DNA, 20 bp, Artificial
  CRISPR gRNA sequence
agagaggggaagaaactctg

SEQ ID NO: 531769 - DNA, 20 bp, Artificial
  CRISPR gRNA sequence
ccagacctctactcccaggc

SEQ ID NO: 531770 - DNA, 20 bp, Artificial
  CRISPR gRNA sequence
ctggggatccattatggtct

SEQ ID NO: 531771 - DNA, 20 bp, Artificial
  CRISPR gRNA sequence
tccattatggtcttggagtt

SEQ ID NO: 531772 - DNA, 20 bp, Artificial
  CRISPR gRNA sequence
tcccccatgaccctgccccc

SEQ ID NO: 531773 - DNA, 20 bp, Artificial
  CRISPR gRNA sequence
agccaagggaccttgggcaa

SEQ ID NO: 531774 - DNA, 20 bp, Artificial
  CRISPR gRNA sequence
cagtttccctctctggaaaa

SEQ ID NO: 531775 - DNA, 20 bp, Artificial
  CRISPR gRNA sequence
ctctctacagctcctccttc

SEQ ID NO: 531776 - DNA, 20 bp, Artificial
  CRISPR gRNA sequence
ccatagaacaccacctcccc

SEQ ID NO: 531777 - DNA, 20 bp, Artificial
  CRISPR gRNA sequence
cctcccctgatgcttccctt

SEQ ID NO: 531778 - DNA, 20 bp, Artificial
  CRISPR gRNA sequence
aaggtttccaggaggaagag

SEQ ID NO: 531779 - DNA, 20 bp, Artificial
  CRISPR gRNA sequence
cctactgagggcctggcagg

SEQ ID NO: 531780 - DNA, 20 bp, Artificial
  CRISPR gRNA sequence
ggacagctgacaggctcgac

SEQ ID NO: 531781 - DNA, 20 bp, Artificial
  CRISPR gRNA sequence
tgtgtgtgatgaccctctga

SEQ ID NO: 531782 - DNA, 20 bp, Artificial
  CRISPR gRNA sequence
tgaccctctgagaaagtttt

SEQ ID NO: 531783 - DNA, 20 bp, Artificial
  CRISPR gRNA sequence
tagatgtttcccatcttgat

SEQ ID NO: 531784 - DNA, 20 bp, Artificial
  CRISPR gRNA sequence
tgatacaagtccaggagatc

SEQ ID NO: 531785 - DNA, 20 bp, Artificial
  CRISPR gRNA sequence
gaccctctctaaaaagaaag

SEQ ID NO: 531786 - DNA, 20 bp, Artificial
  CRISPR gRNA sequence
tcagttcaatttaggcaatt

SEQ ID NO: 531787 - DNA, 20 bp, Artificial
  CRISPR gRNA sequence
actaaatagtgtatcatatg

SEQ ID NO: 531788 - DNA, 20 bp, Artificial
  CRISPR gRNA sequence
atatgctgtcttatacctta

SEQ ID NO: 531789 - DNA, 20 bp, Artificial
  CRISPR gRNA sequence
cttaaccctaacagacaggc

SEQ ID NO: 531790 - DNA, 20 bp, Artificial
  CRISPR gRNA sequence
accacctaaaacatggcagt

SEQ ID NO: 531791 - DNA, 20 bp, Artificial
  CRISPR gRNA sequence
tatgggtaagaaagtgcctc

SEQ ID NO: 531792 - DNA, 20 bp, Artificial
  CRISPR gRNA sequence
cctccagagtttgagaaagg

SEQ ID NO: 531793 - DNA, 20 bp, Artificial
  CRISPR gRNA sequence
cacctgcctgggaaccagag

SEQ ID NO: 531794 - DNA, 20 bp, Artificial
  CRISPR gRNA sequence
aacctcttgcctctcccgca

SEQ ID NO: 531795 - DNA, 20 bp, Artificial
  CRISPR gRNA sequence
aacttttccttttcctcgtc

SEQ ID NO: 531796 - DNA, 20 bp, Artificial
  CRISPR gRNA sequence
cagacttgccacttttccct

SEQ ID NO: 531797 - DNA, 20 bp, Artificial
  CRISPR gRNA sequence
tccattcataatatagatgg

SEQ ID NO: 531798 - DNA, 20 bp, Artificial
  CRISPR gRNA sequence
agatggactagcttattttt

SEQ ID NO: 531799 - DNA, 20 bp, Artificial
  CRISPR gRNA sequence
aggcatgcagaaattaaatt

SEQ ID NO: 531800 - DNA, 20 bp, Artificial
  CRISPR gRNA sequence
ttaaaagttttcttctcatc

SEQ ID NO: 531801 - DNA, 20 bp, Artificial
  CRISPR gRNA sequence
atagtctagaggttgggtca

SEQ ID NO: 531802 - DNA, 20 bp, Artificial
  CRISPR gRNA sequence
cttataacagcaacacagta

SEQ ID NO: 531803 - DNA, 20 bp, Artificial
  CRISPR gRNA sequence
aaaactctgaatatactaaa

SEQ ID NO: 531804 - DNA, 20 bp, Artificial
  CRISPR gRNA sequence
taggtgaattatctcaatga

SEQ ID NO: 531805 - DNA, 20 bp, Artificial
  CRISPR gRNA sequence
catccttgccaaaaagacct

SEQ ID NO: 531806 - DNA, 20 bp, Artificial
  CRISPR gRNA sequence
aagcaatgagaccttggaca

SEQ ID NO: 531807 - DNA, 20 bp, Artificial
  CRISPR gRNA sequence
caagctgcttctgactaggt

SEQ ID NO: 531808 - DNA, 20 bp, Artificial
  CRISPR gRNA sequence
aactaggtctcagtattgtt

SEQ ID NO: 531809 - DNA, 20 bp, Artificial
  CRISPR gRNA sequence
aacaggacactcgagttctg

SEQ ID NO: 531810 - DNA, 20 bp, Artificial
  CRISPR gRNA sequence
ctgtttggagtcctgagatc

SEQ ID NO: 531811 - DNA, 20 bp, Artificial
  CRISPR gRNA sequence
ttcaggggagctgacagtgt

SEQ ID NO: 531812 - DNA, 20 bp, Artificial
  CRISPR gRNA sequence
agtgggcaatctgacactat

SEQ ID NO: 531813 - DNA, 20 bp, Artificial
  CRISPR gRNA sequence
agagaggaagaaggtggggt

SEQ ID NO: 531814 - DNA, 20 bp, Artificial
  CRISPR gRNA sequence
attttctgtgtgaagcacag

SEQ ID NO: 531815 - DNA, 20 bp, Artificial
  CRISPR gRNA sequence
gttcctgtcttcctccccaa

SEQ ID NO: 531816 - DNA, 20 bp, Artificial
  CRISPR gRNA sequence
tcactccctgcccagcatcc

SEQ ID NO: 531817 - DNA, 20 bp, Artificial
  CRISPR gRNA sequence
caagctgataaaatattttt

SEQ ID NO: 531818 - DNA, 20 bp, Artificial
  CRISPR gRNA sequence
aaatatttttaaaagtttaa

SEQ ID NO: 531819 - DNA, 20 bp, Artificial
  CRISPR gRNA sequence
atacatctctactaaaaata

SEQ ID NO: 531820 - DNA, 20 bp, Artificial
  CRISPR gRNA sequence
tcaggaggctgaggcatgag

SEQ ID NO: 531821 - DNA, 20 bp, Artificial
  CRISPR gRNA sequence
aaaggatgcattcttaattt

SEQ ID NO: 531822 - DNA, 20 bp, Artificial
  CRISPR gRNA sequence
attcttaatttaactgatta

SEQ ID NO: 531823 - DNA, 20 bp, Artificial
  CRISPR gRNA sequence
aactccttaattctgagttg

SEQ ID NO: 531824 - DNA, 20 bp, Artificial
  CRISPR gRNA sequence
ttaaccccttccctactagc

SEQ ID NO: 531825 - DNA, 20 bp, Artificial
  CRISPR gRNA sequence
ggaaatgcaggcacaactac

SEQ ID NO: 531826 - DNA, 20 bp, Artificial
  CRISPR gRNA sequence
ggcacaactactggagtttg

SEQ ID NO: 531827 - DNA, 20 bp, Artificial
  CRISPR gRNA sequence
caggcggatcccctgaggtc

SEQ ID NO: 531828 - DNA, 20 bp, Artificial
  CRISPR gRNA sequence
ttgggaggctgaggcaggag

SEQ ID NO: 531829 - DNA, 20 bp, Artificial
  CRISPR gRNA sequence
aaaaaaaaaaaaaaaaaaag

SEQ ID NO: 531830 - DNA, 20 bp, Artificial
  CRISPR gRNA sequence
tgtctttcggctaaagggtg

SEQ ID NO: 531831 - DNA, 20 bp, Artificial
  CRISPR gRNA sequence
tctttttggggcaatgaaaa

SEQ ID NO: 531832 - DNA, 20 bp, Artificial
  CRISPR gRNA sequence
tagatgaattatctcaatga

SEQ ID NO: 531833 - DNA, 20 bp, Artificial
  CRISPR gRNA sequence
cattcttgccaaaaagacct

SEQ ID NO: 531834 - DNA, 20 bp, Artificial
  CRISPR gRNA sequence
aagcaatgagaccttggaca

SEQ ID NO: 531835 - DNA, 20 bp, Artificial
  CRISPR gRNA sequence
caagctgcttctgactaggt

SEQ ID NO: 531836 - DNA, 20 bp, Artificial
  CRISPR gRNA sequence
aactaggtctcagtattgtt

SEQ ID NO: 531837 - DNA, 20 bp, Artificial
  CRISPR gRNA sequence
tcacactcaaaacaggacac

SEQ ID NO: 531838 - DNA, 20 bp, Artificial
  CRISPR gRNA sequence
aacaggacactcgagttttg

SEQ ID NO: 531839 - DNA, 20 bp, Artificial
  CRISPR gRNA sequence
ctgtttggagtcctgagatc

SEQ ID NO: 531840 - DNA, 20 bp, Artificial
  CRISPR gRNA sequence
ttcaggggagctgacagtgt

SEQ ID NO: 531841 - DNA, 20 bp, Artificial
  CRISPR gRNA sequence
agtgggcaatctgacactat

SEQ ID NO: 531842 - DNA, 20 bp, Artificial
  CRISPR gRNA sequence
agagaggaagaaggtggggt

SEQ ID NO: 531843 - DNA, 20 bp, Artificial
  CRISPR gRNA sequence
attttctgtgtgaagcacag

SEQ ID NO: 531844 - DNA, 20 bp, Artificial
  CRISPR gRNA sequence
gtctgcctccccaagtcaag

SEQ ID NO: 531845 - DNA, 20 bp, Artificial
  CRISPR gRNA sequence
actacttccccagcatcccc

SEQ ID NO: 531846 - DNA, 20 bp, Artificial
  CRISPR gRNA sequence
ggctttcaacttcaatggca

SEQ ID NO: 531847 - DNA, 20 bp, Artificial
  CRISPR gRNA sequence
caccctttggtctaggccag

SEQ ID NO: 531848 - DNA, 20 bp, Artificial
  CRISPR gRNA sequence
cagctcattagaatccccca

SEQ ID NO: 531849 - DNA, 20 bp, Artificial
  CRISPR gRNA sequence
ccaggccgcatgcaaaaaaa

SEQ ID NO: 531850 - DNA, 20 bp, Artificial
  CRISPR gRNA sequence
tttaattggtcctcactcca

SEQ ID NO: 531851 - DNA, 20 bp, Artificial
  CRISPR gRNA sequence
cactccacttggattacagc

SEQ ID NO: 531852 - DNA, 20 bp, Artificial
  CRISPR gRNA sequence
gggctgttcatccttaaata

SEQ ID NO: 531853 - DNA, 20 bp, Artificial
  CRISPR gRNA sequence
taactcctccttcagggcag

SEQ ID NO: 531854 - DNA, 20 bp, Artificial
  CRISPR gRNA sequence
ttctcgccccactcttagct

SEQ ID NO: 531855 - DNA, 20 bp, Artificial
  CRISPR gRNA sequence
tcggcctacctgtgtccccc

SEQ ID NO: 531856 - DNA, 20 bp, Artificial
  CRISPR gRNA sequence
actggggcaggagacatgca

SEQ ID NO: 531857 - DNA, 20 bp, Artificial
  CRISPR gRNA sequence
tatcctgatcatcggtcttc

SEQ ID NO: 531858 - DNA, 20 bp, Artificial
  CRISPR gRNA sequence
ttttcagagttccattttta

SEQ ID NO: 531859 - DNA, 20 bp, Artificial
  CRISPR gRNA sequence
tgtgcaatctttttcttgtc

SEQ ID NO: 531860 - DNA, 20 bp, Artificial
  CRISPR gRNA sequence
atgtcctgacccaaggcacc

SEQ ID NO: 531861 - DNA, 20 bp, Artificial
  CRISPR gRNA sequence
ggttgggacttctttgactc

SEQ ID NO: 531862 - DNA, 20 bp, Artificial
  CRISPR gRNA sequence
atggaaagctcatcttaggg

SEQ ID NO: 531863 - DNA, 20 bp, Artificial
  CRISPR gRNA sequence
tcttaggggttggtttcctc

SEQ ID NO: 531864 - DNA, 20 bp, Artificial
  CRISPR gRNA sequence
actggtggagtccacacccc

SEQ ID NO: 531865 - DNA, 20 bp, Artificial
  CRISPR gRNA sequence
gttccttttgcatgaagagc

SEQ ID NO: 531866 - DNA, 20 bp, Artificial
  CRISPR gRNA sequence
aaatgggaaaaaacttcaga

SEQ ID NO: 531867 - DNA, 20 bp, Artificial
  CRISPR gRNA sequence
caagaaaaagattgcacaat

SEQ ID NO: 531868 - DNA, 20 bp, Artificial
  CRISPR gRNA sequence
aagattgcacaattcagaaa

SEQ ID NO: 531869 - DNA, 20 bp, Artificial
  CRISPR gRNA sequence
cctgaaggaggagttatatg

SEQ ID NO: 531870 - DNA, 20 bp, Artificial
  CRISPR gRNA sequence
gatggggttagggagactag

SEQ ID NO: 531871 - DNA, 20 bp, Artificial
  CRISPR gRNA sequence
aaagggtgcctctaaaatag

SEQ ID NO: 531872 - DNA, 20 bp, Artificial
  CRISPR gRNA sequence
ggataataagggtcaggcat

SEQ ID NO: 531873 - DNA, 20 bp, Artificial
  CRISPR gRNA sequence
ttaggcaagggagagaaggt

SEQ ID NO: 531874 - DNA, 20 bp, Artificial
  CRISPR gRNA sequence
taagcatttctgtgcttcac

SEQ ID NO: 531875 - DNA, 20 bp, Artificial
  CRISPR gRNA sequence
ccttgagtggagagcacctt

SEQ ID NO: 531876 - DNA, 20 bp, Artificial
  CRISPR gRNA sequence
tattatctccttgttatata

SEQ ID NO: 531877 - DNA, 20 bp, Artificial
  CRISPR gRNA sequence
aaactcagaggtctttttgg

SEQ ID NO: 531878 - DNA, 20 bp, Artificial
  CRISPR gRNA sequence
caacattttcattgccccaa

SEQ ID NO: 531879 - DNA, 20 bp, Artificial
  CRISPR gRNA sequence
aaggggttaatcccagcaac

SEQ ID NO: 531880 - DNA, 20 bp, Artificial
  CRISPR gRNA sequence
aatactagaacagtcagcag

SEQ ID NO: 531881 - DNA, 20 bp, Artificial
  CRISPR gRNA sequence
aacttattaatcagttaaat

SEQ ID NO: 531882 - DNA, 20 bp, Artificial
  CRISPR gRNA sequence
atgcatttattgatgttcat

SEQ ID NO: 531883 - DNA, 20 bp, Artificial
  CRISPR gRNA sequence
agagagagagagagaggcag

SEQ ID NO: 531884 - DNA, 20 bp, Artificial
  CRISPR gRNA sequence
atttatatatatacatataa

SEQ ID NO: 531885 - DNA, 20 bp, Artificial
  CRISPR gRNA sequence
taagcatttctgtgcttcac

SEQ ID NO: 531886 - DNA, 20 bp, Artificial
  CRISPR gRNA sequence
ccttgagtggagagcacctt

SEQ ID NO: 531887 - DNA, 20 bp, Artificial
  CRISPR gRNA sequence
tattatctccttgttatata

SEQ ID NO: 531888 - DNA, 20 bp, Artificial
  CRISPR gRNA sequence
ttactgtgttgctgttataa

SEQ ID NO: 531889 - DNA, 20 bp, Artificial
  CRISPR gRNA sequence
ttttcttccttctcagtaac

SEQ ID NO: 531890 - DNA, 20 bp, Artificial
  CRISPR gRNA sequence
aacgcagaatcttgggatga

SEQ ID NO: 531891 - DNA, 20 bp, Artificial
  CRISPR gRNA sequence
tccatctatattatgaatgg

SEQ ID NO: 531892 - DNA, 20 bp, Artificial
  CRISPR gRNA sequence
aagtctggggggaacaaagt

SEQ ID NO: 531893 - DNA, 20 bp, Artificial
  CRISPR gRNA sequence
ggggggaacaaagtaaagaa

SEQ ID NO: 531894 - DNA, 20 bp, Artificial
  CRISPR gRNA sequence
cagctctgggctgggaaaag

SEQ ID NO: 531895 - DNA, 20 bp, Artificial
  CRISPR gRNA sequence
aacattttgtctgtaaatgg

SEQ ID NO: 531896 - DNA, 20 bp, Artificial
  CRISPR gRNA sequence
taatgtatctgtgaatgtca

SEQ ID NO: 531897 - DNA, 20 bp, Artificial
  CRISPR gRNA sequence
aatagatatgtttattaaaa

SEQ ID NO: 531898 - DNA, 20 bp, Artificial
  CRISPR gRNA sequence
cactgagcacaatttgacca

SEQ ID NO: 531899 - DNA, 20 bp, Artificial
  CRISPR gRNA sequence
attttaaagatcctcttcta

SEQ ID NO: 531900 - DNA, 20 bp, Artificial
  CRISPR gRNA sequence
taaagatcctcttctaggag

SEQ ID NO: 531901 - DNA, 20 bp, Artificial
  CRISPR gRNA sequence
acctcccatcaggagtaaag

SEQ ID NO: 531902 - DNA, 20 bp, Artificial
  CRISPR gRNA sequence
ggagtaaaggtagaaaggct

SEQ ID NO: 531903 - DNA, 20 bp, Artificial
  CRISPR gRNA sequence
gcaaggcttggggactagct

SEQ ID NO: 531904 - DNA, 20 bp, Artificial
  CRISPR gRNA sequence
gggtctgtccaaatttagcc

SEQ ID NO: 531905 - DNA, 20 bp, Artificial
  CRISPR gRNA sequence
gcttcagcttcctggcccac

SEQ ID NO: 531906 - DNA, 20 bp, Artificial
  CRISPR gRNA sequence
tagcttccctcagagccctc

SEQ ID NO: 531907 - DNA, 20 bp, Artificial
  CRISPR gRNA sequence
cagaggggattgcacatagg

SEQ ID NO: 531908 - DNA, 20 bp, Artificial
  CRISPR gRNA sequence
ttgcatggaacatacttatg

SEQ ID NO: 531909 - DNA, 20 bp, Artificial
  CRISPR gRNA sequence
aaggaccactagggagatgg

SEQ ID NO: 531910 - DNA, 20 bp, Artificial
  CRISPR gRNA sequence
gagttgtgtaactggcaggc

SEQ ID NO: 531911 - DNA, 20 bp, Artificial
  CRISPR gRNA sequence
ggtcagagagagactcgagg

SEQ ID NO: 531912 - DNA, 20 bp, Artificial
  CRISPR gRNA sequence
ctgttgctgggaaacagctc

SEQ ID NO: 531913 - DNA, 20 bp, Artificial
  CRISPR gRNA sequence
acgagagcaggatcaacagt

SEQ ID NO: 531914 - DNA, 20 bp, Artificial
  CRISPR gRNA sequence
cccacttctcttccttttgc

SEQ ID NO: 531915 - DNA, 20 bp, Artificial
  CRISPR gRNA sequence
aaggaaaaaacagaggagtc

SEQ ID NO: 531916 - DNA, 20 bp, Artificial
  CRISPR gRNA sequence
ggatgacaccttgaatctgc

SEQ ID NO: 531917 - DNA, 20 bp, Artificial
  CRISPR gRNA sequence
agccacacttctctacatag

SEQ ID NO: 531918 - DNA, 20 bp, Artificial
  CRISPR gRNA sequence
gtgagttcaggaccaagctc

SEQ ID NO: 531919 - DNA, 20 bp, Artificial
  CRISPR gRNA sequence
cacccaaggcagaacacttc

SEQ ID NO: 531920 - DNA, 20 bp, Artificial
  CRISPR gRNA sequence
acactttccaccacagcaca

SEQ ID NO: 531921 - DNA, 20 bp, Artificial
  CRISPR gRNA sequence
ctctgccatcaccaggctga

SEQ ID NO: 531922 - DNA, 20 bp, Artificial
  CRISPR gRNA sequence
cctaggccgaggcaaggagc

SEQ ID NO: 531923 - DNA, 20 bp, Artificial
  CRISPR gRNA sequence
aggagcccagaatttaaggc

SEQ ID NO: 531924 - DNA, 20 bp, Artificial
  CRISPR gRNA sequence
ctggtggccctgggctcttc

SEQ ID NO: 531925 - DNA, 20 bp, Artificial
  CRISPR gRNA sequence
atcatttcagcccgggagat

SEQ ID NO: 531926 - DNA, 20 bp, Artificial
  CRISPR gRNA sequence
gagaccagcctgaccaacat

SEQ ID NO: 531927 - DNA, 20 bp, Artificial
  CRISPR gRNA sequence
ctactcaggaggccgaggca

SEQ ID NO: 531928 - DNA, 20 bp, Artificial
  CRISPR gRNA sequence
atggactgaagtcacacaaa

SEQ ID NO: 531929 - DNA, 20 bp, Artificial
  CRISPR gRNA sequence
ggaaggtggattgcatgaca

SEQ ID NO: 531930 - DNA, 20 bp, Artificial
  CRISPR gRNA sequence
gggggaaaggcagatctaac

SEQ ID NO: 531931 - DNA, 20 bp, Artificial
  CRISPR gRNA sequence
gagcccacagagtagctact

SEQ ID NO: 531932 - DNA, 20 bp, Artificial
  CRISPR gRNA sequence
caaattccagcttcaacccc

SEQ ID NO: 531933 - DNA, 20 bp, Artificial
  CRISPR gRNA sequence
tcgggcacacaagttcacca

SEQ ID NO: 531934 - DNA, 20 bp, Artificial
  CRISPR gRNA sequence
caaaacctccccatggggca

SEQ ID NO: 531935 - DNA, 20 bp, Artificial
  CRISPR gRNA sequence
ccttcctctaattaaaaaag

SEQ ID NO: 531936 - DNA, 20 bp, Artificial
  CRISPR gRNA sequence
aagcaatataagtgtgattg

SEQ ID NO: 531937 - DNA, 20 bp, Artificial
  CRISPR gRNA sequence
agaatggtagaggaccgagc

SEQ ID NO: 531938 - DNA, 20 bp, Artificial
  CRISPR gRNA sequence
gaggagaggaagctgccgaa

SEQ ID NO: 531939 - DNA, 20 bp, Artificial
  CRISPR gRNA sequence
caagtgtccaccagggcaca

SEQ ID NO: 531940 - DNA, 20 bp, Artificial
  CRISPR gRNA sequence
acacatgacctgagagggga

SEQ ID NO: 531941 - DNA, 20 bp, Artificial
  CRISPR gRNA sequence
gaggtgacaatgttctgcac

SEQ ID NO: 531942 - DNA, 20 bp, Artificial
  CRISPR gRNA sequence
cggatatgcacatcaggagg

SEQ ID NO: 531943 - DNA, 20 bp, Artificial
  CRISPR gRNA sequence
gagaactctaagcttgtagg

SEQ ID NO: 531944 - DNA, 20 bp, Artificial
  CRISPR gRNA sequence
aaccctacctctgtgctgac

SEQ ID NO: 531945 - DNA, 20 bp, Artificial
  CRISPR gRNA sequence
atgcaaggaactttttgtcc

SEQ ID NO: 531946 - DNA, 20 bp, Artificial
  CRISPR gRNA sequence
cttagaaatttactcgcttc

SEQ ID NO: 531947 - DNA, 20 bp, Artificial
  CRISPR gRNA sequence
gcacaaagaggaaagggcct

SEQ ID NO: 531948 - DNA, 20 bp, Artificial
  CRISPR gRNA sequence
ctgtgaagagcccagggcca

SEQ ID NO: 531949 - DNA, 20 bp, Artificial
  CRISPR gRNA sequence
gtgtgggacagtcgtggtgg

SEQ ID NO: 531950 - DNA, 20 bp, Artificial
  CRISPR gRNA sequence
gaggcagaaggagaactgag

SEQ ID NO: 531951 - DNA, 20 bp, Artificial
  CRISPR gRNA sequence
ccctaacacatccctcgaac

SEQ ID NO: 531952 - DNA, 20 bp, Artificial
  CRISPR gRNA sequence
catagataggacatttattc

SEQ ID NO: 531953 - DNA, 20 bp, Artificial
  CRISPR gRNA sequence
agctcccacattgtcaccac

SEQ ID NO: 531954 - DNA, 20 bp, Artificial
  CRISPR gRNA sequence
tgttttttccttttggtgat

SEQ ID NO: 531955 - DNA, 20 bp, Artificial
  CRISPR gRNA sequence
tgggaaactgctctcagggg

SEQ ID NO: 531956 - DNA, 20 bp, Artificial
  CRISPR gRNA sequence
caaacatgaggccctgagag

SEQ ID NO: 531957 - DNA, 20 bp, Artificial
  CRISPR gRNA sequence
agagtttccctggagccacg

SEQ ID NO: 531958 - DNA, 20 bp, Artificial
  CRISPR gRNA sequence
cctttgtgagtcaatagcag

SEQ ID NO: 531959 - DNA, 20 bp, Artificial
  CRISPR gRNA sequence
gaacttggcccagcatcaca

SEQ ID NO: 531960 - DNA, 20 bp, Artificial
  CRISPR gRNA sequence
ccaaggagagggtcagaggc

SEQ ID NO: 531961 - DNA, 20 bp, Artificial
  CRISPR gRNA sequence
ctcctctctgccttggcctt

SEQ ID NO: 531962 - DNA, 20 bp, Artificial
  CRISPR gRNA sequence
aagctgaagcctagagaggg

SEQ ID NO: 531963 - DNA, 20 bp, Artificial
  CRISPR gRNA sequence
gcactatagaaggctgcctc

SEQ ID NO: 531964 - DNA, 20 bp, Artificial
  CRISPR gRNA sequence
acttgtgtgtgatgaccctc

SEQ ID NO: 531965 - DNA, 20 bp, Artificial
  CRISPR gRNA sequence
ggttttgagaccctctctaa

SEQ ID NO: 531966 - DNA, 20 bp, Artificial
  CRISPR gRNA sequence
attttatttacaaagagcat

SEQ ID NO: 531967 - DNA, 20 bp, Artificial
  CRISPR gRNA sequence
tcagggtttaggagtatggg

SEQ ID NO: 531968 - DNA, 20 bp, Artificial
  CRISPR gRNA sequence
aagaaagtgcctccagagtt

SEQ ID NO: 531969 - DNA, 20 bp, Artificial
  CRISPR gRNA sequence
cgctggccctcctcagagca

SEQ ID NO: 531970 - DNA, 20 bp, Artificial
  CRISPR gRNA sequence
ctcagagcatcagaaaagga

SEQ ID NO: 531971 - DNA, 20 bp, Artificial
  CRISPR gRNA sequence
gtcccgatatatataggcat

SEQ ID NO: 531972 - DNA, 20 bp, Artificial
  CRISPR gRNA sequence
gattctgcgttactgagaag

SEQ ID NO: 531973 - DNA, 20 bp, Artificial
  CRISPR gRNA sequence
cacgaagtttgcccgtctct

SEQ ID NO: 531974 - DNA, 20 bp, Artificial
  CRISPR gRNA sequence
aattatctcaatgaagctgt

SEQ ID NO: 531975 - DNA, 20 bp, Artificial
  CRISPR gRNA sequence
aatgaagctgtttagaaaaa

SEQ ID NO: 531976 - DNA, 20 bp, Artificial
  CRISPR gRNA sequence
cgacattttctgtgtgaagc

SEQ ID NO: 531977 - DNA, 20 bp, Artificial
  CRISPR gRNA sequence
ctactcaggaggctgaggca

SEQ ID NO: 531978 - DNA, 20 bp, Artificial
  CRISPR gRNA sequence
ctacttgggaggctgaggca

SEQ ID NO: 531979 - DNA, 20 bp, Artificial
  CRISPR gRNA sequence
aaaaaaaaaaagagaagctt

SEQ ID NO: 531980 - DNA, 20 bp, Artificial
  CRISPR gRNA sequence
atgtgggagggcattagcac

SEQ ID NO: 531981 - DNA, 20 bp, Artificial
  CRISPR gRNA sequence
atgaagctgcttggaaaaaa

SEQ ID NO: 531982 - DNA, 20 bp, Artificial
  CRISPR gRNA sequence
tgatattttctgtgtgaagc

SEQ ID NO: 531983 - DNA, 20 bp, Artificial
  CRISPR gRNA sequence
cgattgactttggcagctca

SEQ ID NO: 531984 - DNA, 20 bp, Artificial
  CRISPR gRNA sequence
gaggtcagcgctggggaata

SEQ ID NO: 531985 - DNA, 20 bp, Artificial
  CRISPR gRNA sequence
gactcttatgcttacctttg

SEQ ID NO: 531986 - DNA, 20 bp, Artificial
  CRISPR gRNA sequence
attgacgatataaaatggga

SEQ ID NO: 531987 - DNA, 20 bp, Artificial
  CRISPR gRNA sequence
tctcaggactccaaacagca

SEQ ID NO: 531988 - DNA, 20 bp, Artificial
  CRISPR gRNA sequence
tatctccttgttatatataa

SEQ ID NO: 531989 - DNA, 20 bp, Artificial
  CRISPR gRNA sequence
tatctccttgttatatataa

SEQ ID NO: 531990 - DNA, 20 bp, Artificial
  CRISPR gRNA sequence
cattcaatttgtccatacac

SEQ ID NO: 531991 - DNA, 20 bp, Artificial
  CRISPR gRNA sequence
gcagaatcttgggatgagaa

SEQ ID NO: 531992 - DNA, 20 bp, Artificial
  CRISPR gRNA sequence
agtaaagaatgagaaaaaaa

SEQ ID NO: 531993 - DNA, 20 bp, Artificial
  CRISPR gRNA sequence
ttttgtctgtaaatgggaag

SEQ ID NO: 531994 - DNA, 20 bp, Artificial
  CRISPR gRNA sequence
tttctttttagagagggtct

SEQ ID NO: 531995 - DNA, 20 bp, Artificial
  CRISPR gRNA sequence
gtatcaagatgggaaacatc

SEQ ID NO: 531996 - DNA, 20 bp, Artificial
  CRISPR gRNA sequence
tcttctaggagaaagaattg

SEQ ID NO: 531997 - DNA, 20 bp, Artificial
  CRISPR gRNA sequence
ggactagctccagaaaatct

SEQ ID NO: 531998 - DNA, 20 bp, Artificial
  CRISPR gRNA sequence
tttctatatcaccaaaagga

SEQ ID NO: 531999 - DNA, 20 bp, Artificial
  CRISPR gRNA sequence
tgtggttagcttgatttttg

SEQ ID NO: 532000 - DNA, 20 bp, Artificial
  CRISPR gRNA sequence
ataggcagaaaggttagctc

SEQ ID NO: 532001 - DNA, 20 bp, Artificial
  CRISPR gRNA sequence
aggtcatcaggtagtcacag

SEQ ID NO: 532002 - DNA, 20 bp, Artificial
  CRISPR gRNA sequence
cctggtctctactttaaaaa

SEQ ID NO: 532003 - DNA, 20 bp, Artificial
  CRISPR gRNA sequence
agagcaaggccctgtctcaa

SEQ ID NO: 532004 - DNA, 20 bp, Artificial
  CRISPR gRNA sequence
aaggccctgtctcaaaaaaa

SEQ ID NO: 532005 - DNA, 20 bp, Artificial
  CRISPR gRNA sequence
tcaaaaaaacaaaacaaata

SEQ ID NO: 532006 - DNA, 20 bp, Artificial
  CRISPR gRNA sequence
gtaattatttcaccccaggg

SEQ ID NO: 532007 - DNA, 20 bp, Artificial
  CRISPR gRNA sequence
tgtgattttaagagtacagg

SEQ ID NO: 532008 - DNA, 20 bp, Artificial
  CRISPR gRNA sequence
ccccagacctcgagttcagc

SEQ ID NO: 532009 - DNA, 20 bp, Artificial
  CRISPR gRNA sequence
aacctccccatggggcagca

SEQ ID NO: 532010 - DNA, 20 bp, Artificial
  CRISPR gRNA sequence
tggagctctctgaggagacc

SEQ ID NO: 532011 - DNA, 20 bp, Artificial
  CRISPR gRNA sequence
gtgacaatgttctgcacaca

SEQ ID NO: 532012 - DNA, 20 bp, Artificial
  CRISPR gRNA sequence
cagctcctcatctgcaacaa

SEQ ID NO: 532013 - DNA, 20 bp, Artificial
  CRISPR gRNA sequence
gaaagggcctccagaaagga

SEQ ID NO: 532014 - DNA, 20 bp, Artificial
  CRISPR gRNA sequence
gctggatgcactaatagaca

SEQ ID NO: 532015 - DNA, 20 bp, Artificial
  CRISPR gRNA sequence
cagacaggcctgatctgagg

SEQ ID NO: 532016 - DNA, 20 bp, Artificial
  CRISPR gRNA sequence
tttttccttttggtgatata

SEQ ID NO: 532017 - DNA, 20 bp, Artificial
  CRISPR gRNA sequence
agtcactgtaatgcaatgag

SEQ ID NO: 532018 - DNA, 20 bp, Artificial
  CRISPR gRNA sequence
tgaaagtgctttgtaaactg

SEQ ID NO: 532019 - DNA, 20 bp, Artificial
  CRISPR gRNA sequence
aaagaaatgcttctccaggc

SEQ ID NO: 532020 - DNA, 20 bp, Artificial
  CRISPR gRNA sequence
tctgccttggcctttcagaa

SEQ ID NO: 532021 - DNA, 20 bp, Artificial
  CRISPR gRNA sequence
tagggttgccagatataatg

SEQ ID NO: 532022 - DNA, 20 bp, Artificial
  CRISPR gRNA sequence
ctccagccttggcaacagag

SEQ ID NO: 532023 - DNA, 20 bp, Artificial
  CRISPR gRNA sequence
tgtgggaggatgactggtgg

SEQ ID NO: 532024 - DNA, 20 bp, Artificial
  CRISPR gRNA sequence
gtgggaggactcccaggatg

SEQ ID NO: 532025 - DNA, 20 bp, Artificial
  CRISPR gRNA sequence
ggtggtcttggggcaccacc

SEQ ID NO: 532026 - DNA, 20 bp, Artificial
  CRISPR gRNA sequence
gagcatcagaaaaggatcag

SEQ ID NO: 532027 - DNA, 20 bp, Artificial
  CRISPR gRNA sequence
catgattgtggtgatggttg

SEQ ID NO: 532028 - DNA, 20 bp, Artificial
  CRISPR gRNA sequence
gctaaatgtgacccaaatgt

SEQ ID NO: 532029 - DNA, 20 bp, Artificial
  CRISPR gRNA sequence
ccccatgtagggctcacact

SEQ ID NO: 532030 - DNA, 20 bp, Artificial
  CRISPR gRNA sequence
atatgtaatattttaaaaat

SEQ ID NO: 532031 - DNA, 20 bp, Artificial
  CRISPR gRNA sequence
tgggagggcattagcactga

SEQ ID NO: 532032 - DNA, 20 bp, Artificial
  CRISPR gRNA sequence
gttgattgtggtgatggtta

SEQ ID NO: 532033 - DNA, 20 bp, Artificial
  CRISPR gRNA sequence
gctaaatgcgacccaaatgt

SEQ ID NO: 532034 - DNA, 20 bp, Artificial
  CRISPR gRNA sequence
ccccgcgtagggctcacact

SEQ ID NO: 532035 - DNA, 20 bp, Artificial
  CRISPR gRNA sequence
gtcaatatcatcactcattt

SEQ ID NO: 532036 - DNA, 20 bp, Artificial
  CRISPR gRNA sequence
tatgttactgtaaaagatgt

SEQ ID NO: 532037 - DNA, 20 bp, Artificial
  CRISPR gRNA sequence
atgttactgtaaaagatgta

SEQ ID NO: 532038 - DNA, 20 bp, Artificial
  CRISPR gRNA sequence
tgttactgtaaaagatgtaa

SEQ ID NO: 532039 - DNA, 20 bp, Artificial
  CRISPR gRNA sequence
ctgtaaaagatgtaaagaga

SEQ ID NO: 532040 - DNA, 20 bp, Artificial
  CRISPR gRNA sequence
taaaagatgtaaagagaggc

SEQ ID NO: 532041 - DNA, 20 bp, Artificial
  CRISPR gRNA sequence
agctctcggggtgtggactc

SEQ ID NO: 532042 - DNA, 20 bp, Artificial
  CRISPR gRNA sequence
tcggggtgtggactccacca

SEQ ID NO: 532043 - DNA, 20 bp, Artificial
  CRISPR gRNA sequence
ggggtgtggactccaccagt

SEQ ID NO: 532044 - DNA, 20 bp, Artificial
  CRISPR gRNA sequence
caccagtctcacttcagttc

SEQ ID NO: 532045 - DNA, 20 bp, Artificial
  CRISPR gRNA sequence
acttcagttccttttgcatg

SEQ ID NO: 532046 - DNA, 20 bp, Artificial
  CRISPR gRNA sequence
cagttccttttgcatgaaga

SEQ ID NO: 532047 - DNA, 20 bp, Artificial
  CRISPR gRNA sequence
agttccttttgcatgaagag

SEQ ID NO: 532048 - DNA, 20 bp, Artificial
  CRISPR gRNA sequence
cttttgcatgaagagctcag

SEQ ID NO: 532049 - DNA, 20 bp, Artificial
  CRISPR gRNA sequence
ttgcatgaagagctcagaat

SEQ ID NO: 532050 - DNA, 20 bp, Artificial
  CRISPR gRNA sequence
tgcatgaagagctcagaatc

SEQ ID NO: 532051 - DNA, 20 bp, Artificial
  CRISPR gRNA sequence
gcatgaagagctcagaatca

SEQ ID NO: 532052 - DNA, 20 bp, Artificial
  CRISPR gRNA sequence
catgaagagctcagaatcaa

SEQ ID NO: 532053 - DNA, 20 bp, Artificial
  CRISPR gRNA sequence
agaatcaaaagaggaaacca

SEQ ID NO: 532054 - DNA, 20 bp, Artificial
  CRISPR gRNA sequence
agatgagctttccatgtaaa

SEQ ID NO: 532055 - DNA, 20 bp, Artificial
  CRISPR gRNA sequence
tccatgtaaatttgtagcca

SEQ ID NO: 532056 - DNA, 20 bp, Artificial
  CRISPR gRNA sequence
ccatgtaaatttgtagccag

SEQ ID NO: 532057 - DNA, 20 bp, Artificial
  CRISPR gRNA sequence
catgtaaatttgtagccagc

SEQ ID NO: 532058 - DNA, 20 bp, Artificial
  CRISPR gRNA sequence
gtagccagcttccttctgat

SEQ ID NO: 532059 - DNA, 20 bp, Artificial
  CRISPR gRNA sequence
tagccagcttccttctgatt

SEQ ID NO: 532060 - DNA, 20 bp, Artificial
  CRISPR gRNA sequence
ccttctgattttcaatgttt

SEQ ID NO: 532061 - DNA, 20 bp, Artificial
  CRISPR gRNA sequence
cttctgattttcaatgtttc

SEQ ID NO: 532062 - DNA, 20 bp, Artificial
  CRISPR gRNA sequence
ctgattttcaatgtttcttc

SEQ ID NO: 532063 - DNA, 20 bp, Artificial
  CRISPR gRNA sequence
tgattttcaatgtttcttcc

SEQ ID NO: 532064 - DNA, 20 bp, Artificial
  CRISPR gRNA sequence
attttcaatgtttcttccaa

SEQ ID NO: 532065 - DNA, 20 bp, Artificial
  CRISPR gRNA sequence
tcaatgtttcttccaaaggt

SEQ ID NO: 532066 - DNA, 20 bp, Artificial
  CRISPR gRNA sequence
caatgtttcttccaaaggta

SEQ ID NO: 532067 - DNA, 20 bp, Artificial
  CRISPR gRNA sequence
aatgtttcttccaaaggtaa

SEQ ID NO: 532068 - DNA, 20 bp, Artificial
  CRISPR gRNA sequence
cttccaaaggtaagcataag

SEQ ID NO: 532069 - DNA, 20 bp, Artificial
  CRISPR gRNA sequence
ttccaaaggtaagcataaga

SEQ ID NO: 532070 - DNA, 20 bp, Artificial
  CRISPR gRNA sequence
ccaaaggtaagcataagagt

SEQ ID NO: 532071 - DNA, 20 bp, Artificial
  CRISPR gRNA sequence
caaaggtaagcataagagtc

SEQ ID NO: 532072 - DNA, 20 bp, Artificial
  CRISPR gRNA sequence
tccctgaaagtgactctcag

SEQ ID NO: 532073 - DNA, 20 bp, Artificial
  CRISPR gRNA sequence
ccctgaaagtgactctcagt

SEQ ID NO: 532074 - DNA, 20 bp, Artificial
  CRISPR gRNA sequence
cctgaaagtgactctcagta

SEQ ID NO: 532075 - DNA, 20 bp, Artificial
  CRISPR gRNA sequence
aaagtgactctcagtaactc

SEQ ID NO: 532076 - DNA, 20 bp, Artificial
  CRISPR gRNA sequence
tcagtaactcttttgctttt

SEQ ID NO: 532077 - DNA, 20 bp, Artificial
  CRISPR gRNA sequence
agtaactcttttgcttttta

SEQ ID NO: 532078 - DNA, 20 bp, Artificial
  CRISPR gRNA sequence
ttttgctttttataggtgca

SEQ ID NO: 532079 - DNA, 20 bp, Artificial
  CRISPR gRNA sequence
ttgctttttataggtgcagt

SEQ ID NO: 532080 - DNA, 20 bp, Artificial
  CRISPR gRNA sequence
tgctttttataggtgcagtc

SEQ ID NO: 532081 - DNA, 20 bp, Artificial
  CRISPR gRNA sequence
gctttttataggtgcagtct

SEQ ID NO: 532082 - DNA, 20 bp, Artificial
  CRISPR gRNA sequence
ctttttataggtgcagtctc

SEQ ID NO: 532083 - DNA, 20 bp, Artificial
  CRISPR gRNA sequence
tttataggtgcagtctccaa

SEQ ID NO: 532084 - DNA, 20 bp, Artificial
  CRISPR gRNA sequence
ttataggtgcagtctccaaa

SEQ ID NO: 532085 - DNA, 20 bp, Artificial
  CRISPR gRNA sequence
tataggtgcagtctccaaag

SEQ ID NO: 532086 - DNA, 20 bp, Artificial
  CRISPR gRNA sequence
ataggtgcagtctccaaaga

SEQ ID NO: 532087 - DNA, 20 bp, Artificial
  CRISPR gRNA sequence
taggtgcagtctccaaagag

SEQ ID NO: 532088 - DNA, 20 bp, Artificial
  CRISPR gRNA sequence
caaagagattacgaatgcct

SEQ ID NO: 532089 - DNA, 20 bp, Artificial
  CRISPR gRNA sequence
cgaatgccttggaaacctgg

SEQ ID NO: 532090 - DNA, 20 bp, Artificial
  CRISPR gRNA sequence
ggaaacctggggtgccttgg

SEQ ID NO: 532091 - DNA, 20 bp, Artificial
  CRISPR gRNA sequence
gaaacctggggtgccttggg

SEQ ID NO: 532092 - DNA, 20 bp, Artificial
  CRISPR gRNA sequence
gggtgccttgggtcaggaca

SEQ ID NO: 532093 - DNA, 20 bp, Artificial
  CRISPR gRNA sequence
gggtcaggacatcaacttgg

SEQ ID NO: 532094 - DNA, 20 bp, Artificial
  CRISPR gRNA sequence
ggtcaggacatcaacttgga

SEQ ID NO: 532095 - DNA, 20 bp, Artificial
  CRISPR gRNA sequence
ggacattcctagttttcaaa

SEQ ID NO: 532096 - DNA, 20 bp, Artificial
  CRISPR gRNA sequence
gacattcctagttttcaaat

SEQ ID NO: 532097 - DNA, 20 bp, Artificial
  CRISPR gRNA sequence
ctagttttcaaatgagtgat

SEQ ID NO: 532098 - DNA, 20 bp, Artificial
  CRISPR gRNA sequence
gttttcaaatgagtgatgat

SEQ ID NO: 532099 - DNA, 20 bp, Artificial
  CRISPR gRNA sequence
tcaaatgagtgatgatattg

SEQ ID NO: 532100 - DNA, 20 bp, Artificial
  CRISPR gRNA sequence
caaatgagtgatgatattga

SEQ ID NO: 532101 - DNA, 20 bp, Artificial
  CRISPR gRNA sequence
aaatgagtgatgatattgac

SEQ ID NO: 532102 - DNA, 20 bp, Artificial
  CRISPR gRNA sequence
acgatataaaatgggaaaaa

SEQ ID NO: 532103 - DNA, 20 bp, Artificial
  CRISPR gRNA sequence
cagacaagaaaaagattgca

SEQ ID NO: 532104 - DNA, 20 bp, Artificial
  CRISPR gRNA sequence
agacaagaaaaagattgcac

SEQ ID NO: 532105 - DNA, 20 bp, Artificial
  CRISPR gRNA sequence
cacaattcagaaaagagaaa

SEQ ID NO: 532106 - DNA, 20 bp, Artificial
  CRISPR gRNA sequence
agaaaagagaaagagacttt

SEQ ID NO: 532107 - DNA, 20 bp, Artificial
  CRISPR gRNA sequence
tcaaggaaaaagatacatat

SEQ ID NO: 532108 - DNA, 20 bp, Artificial
  CRISPR gRNA sequence
caaggaaaaagatacatata

SEQ ID NO: 532109 - DNA, 20 bp, Artificial
  CRISPR gRNA sequence
aaggaaaaagatacatataa

SEQ ID NO: 532110 - DNA, 20 bp, Artificial
  CRISPR gRNA sequence
tttaaaaatggaactctgaa

SEQ ID NO: 532111 - DNA, 20 bp, Artificial
  CRISPR gRNA sequence
aaaaatggaactctgaaaat

SEQ ID NO: 532112 - DNA, 20 bp, Artificial
  CRISPR gRNA sequence
aaaatggaactctgaaaatt

SEQ ID NO: 532113 - DNA, 20 bp, Artificial
  CRISPR gRNA sequence
tgaaaattaagcatctgaag

SEQ ID NO: 532114 - DNA, 20 bp, Artificial
  CRISPR gRNA sequence
aaaattaagcatctgaagac

SEQ ID NO: 532115 - DNA, 20 bp, Artificial
  CRISPR gRNA sequence
agcatctgaagaccgatgat

SEQ ID NO: 532116 - DNA, 20 bp, Artificial
  CRISPR gRNA sequence
aagaccgatgatcaggatat

SEQ ID NO: 532117 - DNA, 20 bp, Artificial
  CRISPR gRNA sequence
caaggtatcaatatatgata

SEQ ID NO: 532118 - DNA, 20 bp, Artificial
  CRISPR gRNA sequence
gaaaaaatatttgatttgaa

SEQ ID NO: 532119 - DNA, 20 bp, Artificial
  CRISPR gRNA sequence
gatttgaagattcaaggtaa

SEQ ID NO: 532120 - DNA, 20 bp, Artificial
  CRISPR gRNA sequence
atttgaagattcaaggtaag

SEQ ID NO: 532121 - DNA, 20 bp, Artificial
  CRISPR gRNA sequence
gaagattcaaggtaagtgtt

SEQ ID NO: 532122 - DNA, 20 bp, Artificial
  CRISPR gRNA sequence
aagattcaaggtaagtgttc

SEQ ID NO: 532123 - DNA, 20 bp, Artificial
  CRISPR gRNA sequence
aaggtaagtgttcattccct

SEQ ID NO: 532124 - DNA, 20 bp, Artificial
  CRISPR gRNA sequence
attcccttaattgctttatt

SEQ ID NO: 532125 - DNA, 20 bp, Artificial
  CRISPR gRNA sequence
ccttaattgctttatttcag

SEQ ID NO: 532126 - DNA, 20 bp, Artificial
  CRISPR gRNA sequence
aattgctttatttcagtgtg

SEQ ID NO: 532127 - DNA, 20 bp, Artificial
  CRISPR gRNA sequence
attgctttatttcagtgtgg

SEQ ID NO: 532128 - DNA, 20 bp, Artificial
  CRISPR gRNA sequence
ctttatttcagtgtgggtgc

SEQ ID NO: 532129 - DNA, 20 bp, Artificial
  CRISPR gRNA sequence
tatttcagtgtgggtgctat

SEQ ID NO: 532130 - DNA, 20 bp, Artificial
  CRISPR gRNA sequence
atttcagtgtgggtgctatt

SEQ ID NO: 532131 - DNA, 20 bp, Artificial
  CRISPR gRNA sequence
tttcagtgtgggtgctattt

SEQ ID NO: 532132 - DNA, 20 bp, Artificial
  CRISPR gRNA sequence
cagtgtgggtgctatttggc

SEQ ID NO: 532133 - DNA, 20 bp, Artificial
  CRISPR gRNA sequence
agtgtgggtgctatttggca

SEQ ID NO: 532134 - DNA, 20 bp, Artificial
  CRISPR gRNA sequence
tttggcaagttggaaaatag

SEQ ID NO: 532135 - DNA, 20 bp, Artificial
  CRISPR gRNA sequence
ggcaagttggaaaatagcat

SEQ ID NO: 532136 - DNA, 20 bp, Artificial
  CRISPR gRNA sequence
gcaagttggaaaatagcatt

SEQ ID NO: 532137 - DNA, 20 bp, Artificial
  CRISPR gRNA sequence
gaaaatagcatttctaatat

SEQ ID NO: 532138 - DNA, 20 bp, Artificial
  CRISPR gRNA sequence
ctaatattccccagcgctga

SEQ ID NO: 532139 - DNA, 20 bp, Artificial
  CRISPR gRNA sequence
taatattccccagcgctgac

SEQ ID NO: 532140 - DNA, 20 bp, Artificial
  CRISPR gRNA sequence
atattccccagcgctgacct

SEQ ID NO: 532141 - DNA, 20 bp, Artificial
  CRISPR gRNA sequence
cccagcgctgacctctgcct

SEQ ID NO: 532142 - DNA, 20 bp, Artificial
  CRISPR gRNA sequence
acctctgcctccaggggggc

SEQ ID NO: 532143 - DNA, 20 bp, Artificial
  CRISPR gRNA sequence
tgcctccaggggggctatac

SEQ ID NO: 532144 - DNA, 20 bp, Artificial
  CRISPR gRNA sequence
cctccaggggggctatacag

SEQ ID NO: 532145 - DNA, 20 bp, Artificial
  CRISPR gRNA sequence
caggggggctatacaggaaa

SEQ ID NO: 532146 - DNA, 20 bp, Artificial
  CRISPR gRNA sequence
tacaggaaaccagatgcatg

SEQ ID NO: 532147 - DNA, 20 bp, Artificial
  CRISPR gRNA sequence
ctgccccagtggagactgtg

SEQ ID NO: 532148 - DNA, 20 bp, Artificial
  CRISPR gRNA sequence
ccccagtggagactgtggtc

SEQ ID NO: 532149 - DNA, 20 bp, Artificial
  CRISPR gRNA sequence
tggtccaatgcgggaatggg

SEQ ID NO: 532150 - DNA, 20 bp, Artificial
  CRISPR gRNA sequence
atagaccctcaagtctacct

SEQ ID NO: 532151 - DNA, 20 bp, Artificial
  CRISPR gRNA sequence
aagtctacctgcctacaact

SEQ ID NO: 532152 - DNA, 20 bp, Artificial
  CRISPR gRNA sequence
cctgcctacaactctgtctt

SEQ ID NO: 532153 - DNA, 20 bp, Artificial
  CRISPR gRNA sequence
cctacaactctgtcttcagg

SEQ ID NO: 532154 - DNA, 20 bp, Artificial
  CRISPR gRNA sequence
caactctgtcttcaggtggt

SEQ ID NO: 532155 - DNA, 20 bp, Artificial
  CRISPR gRNA sequence
tgtcttcaggtggttacagg

SEQ ID NO: 532156 - DNA, 20 bp, Artificial
  CRISPR gRNA sequence
tcttcaggtggttacaggaa

SEQ ID NO: 532157 - DNA, 20 bp, Artificial
  CRISPR gRNA sequence
caggtggttacaggaatgtg

SEQ ID NO: 532158 - DNA, 20 bp, Artificial
  CRISPR gRNA sequence
aggtggttacaggaatgtgg

SEQ ID NO: 532159 - DNA, 20 bp, Artificial
  CRISPR gRNA sequence
caggaatgtggggttgggtg

SEQ ID NO: 532160 - DNA, 20 bp, Artificial
  CRISPR gRNA sequence
ggtgaagaacctggattaag

SEQ ID NO: 532161 - DNA, 20 bp, Artificial
  CRISPR gRNA sequence
gattaaggtggcattaatcg

SEQ ID NO: 532162 - DNA, 20 bp, Artificial
  CRISPR gRNA sequence
aggtggcattaatcgggagg

SEQ ID NO: 532163 - DNA, 20 bp, Artificial
  CRISPR gRNA sequence
atcgggagggggacacaggt

SEQ ID NO: 532164 - DNA, 20 bp, Artificial
  CRISPR gRNA sequence
ttccaggttgctgatgaatc

SEQ ID NO: 532165 - DNA, 20 bp, Artificial
  CRISPR gRNA sequence
caggttgctgatgaatcggc

SEQ ID NO: 532166 - DNA, 20 bp, Artificial
  CRISPR gRNA sequence
ctgatgaatcggcgagctaa

SEQ ID NO: 532167 - DNA, 20 bp, Artificial
  CRISPR gRNA sequence
atgaatcggcgagctaagag

SEQ ID NO: 532168 - DNA, 20 bp, Artificial
  CRISPR gRNA sequence
agagtggggcgagaagaaga

SEQ ID NO: 532169 - DNA, 20 bp, Artificial
  CRISPR gRNA sequence
actggagagcagcgggcctt

SEQ ID NO: 532170 - DNA, 20 bp, Artificial
  CRISPR gRNA sequence
gagagcagcgggcctttcat

SEQ ID NO: 532171 - DNA, 20 bp, Artificial
  CRISPR gRNA sequence
tcatcgacagagcccatttc

SEQ ID NO: 532172 - DNA, 20 bp, Artificial
  CRISPR gRNA sequence
catcgacagagcccatttca

SEQ ID NO: 532173 - DNA, 20 bp, Artificial
  CRISPR gRNA sequence
atcgacagagcccatttcaa

SEQ ID NO: 532174 - DNA, 20 bp, Artificial
  CRISPR gRNA sequence
caagccaggctgccctgaag

SEQ ID NO: 532175 - DNA, 20 bp, Artificial
  CRISPR gRNA sequence
aagccaggctgccctgaagg

SEQ ID NO: 532176 - DNA, 20 bp, Artificial
  CRISPR gRNA sequence
ccctgaaggaggagttatat

SEQ ID NO: 532177 - DNA, 20 bp, Artificial
  CRISPR gRNA sequence
aaggaggagttatatggcag

SEQ ID NO: 532178 - DNA, 20 bp, Artificial
  CRISPR gRNA sequence
tatggcagaaaagggctgga

SEQ ID NO: 532179 - DNA, 20 bp, Artificial
  CRISPR gRNA sequence
gaaacaacatatttaaggat

SEQ ID NO: 532180 - DNA, 20 bp, Artificial
  CRISPR gRNA sequence
aaggatgaacagcccttatt

SEQ ID NO: 532181 - DNA, 20 bp, Artificial
  CRISPR gRNA sequence
aggatgaacagcccttattt

SEQ ID NO: 532182 - DNA, 20 bp, Artificial
  CRISPR gRNA sequence
attttggatctgcttgtcag

SEQ ID NO: 532183 - DNA, 20 bp, Artificial
  CRISPR gRNA sequence
ttttggatctgcttgtcaga

SEQ ID NO: 532184 - DNA, 20 bp, Artificial
  CRISPR gRNA sequence
tggatctgcttgtcagagtg

SEQ ID NO: 532185 - DNA, 20 bp, Artificial
  CRISPR gRNA sequence
ggatctgcttgtcagagtga

SEQ ID NO: 532186 - DNA, 20 bp, Artificial
  CRISPR gRNA sequence
gatctgcttgtcagagtgat

SEQ ID NO: 532187 - DNA, 20 bp, Artificial
  CRISPR gRNA sequence
cttgtcagagtgatacaagg

SEQ ID NO: 532188 - DNA, 20 bp, Artificial
  CRISPR gRNA sequence
gtcagagtgatacaaggtgg

SEQ ID NO: 532189 - DNA, 20 bp, Artificial
  CRISPR gRNA sequence
tcagagtgatacaaggtggc

SEQ ID NO: 532190 - DNA, 20 bp, Artificial
  CRISPR gRNA sequence
ttgctgatatgtgtagaaga

SEQ ID NO: 532191 - DNA, 20 bp, Artificial
  CRISPR gRNA sequence
tgctgatatgtgtagaagat

SEQ ID NO: 532192 - DNA, 20 bp, Artificial
  CRISPR gRNA sequence
gctgatatgtgtagaagatg

SEQ ID NO: 532193 - DNA, 20 bp, Artificial
  CRISPR gRNA sequence
ctgatatgtgtagaagatgc

SEQ ID NO: 532194 - DNA, 20 bp, Artificial
  CRISPR gRNA sequence
atatgtgtagaagatgcaca

SEQ ID NO: 532195 - DNA, 20 bp, Artificial
  CRISPR gRNA sequence
tgtatatctctgcctgtact

SEQ ID NO: 532196 - DNA, 20 bp, Artificial
  CRISPR gRNA sequence
gtatatctctgcctgtactg

SEQ ID NO: 532197 - DNA, 20 bp, Artificial
  CRISPR gRNA sequence
tatatctctgcctgtactgg

SEQ ID NO: 532198 - DNA, 20 bp, Artificial
  CRISPR gRNA sequence
tgcctgtactgggaggacag

SEQ ID NO: 532199 - DNA, 20 bp, Artificial
  CRISPR gRNA sequence
cctgtactgggaggacagga

SEQ ID NO: 532200 - DNA, 20 bp, Artificial
  CRISPR gRNA sequence
tactgggaggacaggagtgg

SEQ ID NO: 532201 - DNA, 20 bp, Artificial
  CRISPR gRNA sequence
ggaggacaggagtggatatt

SEQ ID NO: 532202 - DNA, 20 bp, Artificial
  CRISPR gRNA sequence
aggatggggttagggagact

SEQ ID NO: 532203 - DNA, 20 bp, Artificial
  CRISPR gRNA sequence
gggagactagttagaaagct

SEQ ID NO: 532204 - DNA, 20 bp, Artificial
  CRISPR gRNA sequence
gttagaaagctgctgctgta

SEQ ID NO: 532205 - DNA, 20 bp, Artificial
  CRISPR gRNA sequence
gaaagctgctgctgtaatcc

SEQ ID NO: 532206 - DNA, 20 bp, Artificial
  CRISPR gRNA sequence
ctgctgtaatccaagtggag

SEQ ID NO: 532207 - DNA, 20 bp, Artificial
  CRISPR gRNA sequence
ctgtaatccaagtggagtga

SEQ ID NO: 532208 - DNA, 20 bp, Artificial
  CRISPR gRNA sequence
taatccaagtggagtgagga

SEQ ID NO: 532209 - DNA, 20 bp, Artificial
  CRISPR gRNA sequence
aatcagattttttttgcatg

SEQ ID NO: 532210 - DNA, 20 bp, Artificial
  CRISPR gRNA sequence
tttttgcatgcggcctgggt

SEQ ID NO: 532211 - DNA, 20 bp, Artificial
  CRISPR gRNA sequence
ttttgcatgcggcctgggta

SEQ ID NO: 532212 - DNA, 20 bp, Artificial
  CRISPR gRNA sequence
tttgcatgcggcctgggtat

SEQ ID NO: 532213 - DNA, 20 bp, Artificial
  CRISPR gRNA sequence
ttgcatgcggcctgggtatc

SEQ ID NO: 532214 - DNA, 20 bp, Artificial
  CRISPR gRNA sequence
tgcatgcggcctgggtatca

SEQ ID NO: 532215 - DNA, 20 bp, Artificial
  CRISPR gRNA sequence
gcatgcggcctgggtatcat

SEQ ID NO: 532216 - DNA, 20 bp, Artificial
  CRISPR gRNA sequence
catgcggcctgggtatcatt

SEQ ID NO: 532217 - DNA, 20 bp, Artificial
  CRISPR gRNA sequence
ggtatcattaggttctaaag

SEQ ID NO: 532218 - DNA, 20 bp, Artificial
  CRISPR gRNA sequence
ggttctaaagctccctgggg

SEQ ID NO: 532219 - DNA, 20 bp, Artificial
  CRISPR gRNA sequence
taaagctccctgggggattc

SEQ ID NO: 532220 - DNA, 20 bp, Artificial
  CRISPR gRNA sequence
aagctccctgggggattcta

SEQ ID NO: 532221 - DNA, 20 bp, Artificial
  CRISPR gRNA sequence
cctgggggattctaatgagc

SEQ ID NO: 532222 - DNA, 20 bp, Artificial
  CRISPR gRNA sequence
ggggattctaatgagctgcc

SEQ ID NO: 532223 - DNA, 20 bp, Artificial
  CRISPR gRNA sequence
taatgagctgccaaagtcaa

SEQ ID NO: 532224 - DNA, 20 bp, Artificial
  CRISPR gRNA sequence
atgagctgccaaagtcaatc

SEQ ID NO: 532225 - DNA, 20 bp, Artificial
  CRISPR gRNA sequence
ccaaagtcaatcgccactgg

SEQ ID NO: 532226 - DNA, 20 bp, Artificial
  CRISPR gRNA sequence
gcctagaccaaagggtgcct

SEQ ID NO: 532227 - DNA, 20 bp, Artificial
  CRISPR gRNA sequence
gaccaaagggtgcctctaaa

SEQ ID NO: 532228 - DNA, 20 bp, Artificial
  CRISPR gRNA sequence
taaaataggaagaatgagga

SEQ ID NO: 532229 - DNA, 20 bp, Artificial
  CRISPR gRNA sequence
aaataggaagaatgaggata

SEQ ID NO: 532230 - DNA, 20 bp, Artificial
  CRISPR gRNA sequence
aggcaagggagagaaggtag

SEQ ID NO: 532231 - DNA, 20 bp, Artificial
  CRISPR gRNA sequence
ggcaagggagagaaggtaga

SEQ ID NO: 532232 - DNA, 20 bp, Artificial
  CRISPR gRNA sequence
aagttgaaagcccgggggga

SEQ ID NO: 532233 - DNA, 20 bp, Artificial
  CRISPR gRNA sequence
aaagcccggggggatgctgg

SEQ ID NO: 532234 - DNA, 20 bp, Artificial
  CRISPR gRNA sequence
gggaagtagtgacaagaagg

SEQ ID NO: 532235 - DNA, 20 bp, Artificial
  CRISPR gRNA sequence
cgcttgacttggggaggcag

SEQ ID NO: 532236 - DNA, 20 bp, Artificial
  CRISPR gRNA sequence
gacttggggaggcagacagg

SEQ ID NO: 532237 - DNA, 20 bp, Artificial
  CRISPR gRNA sequence
acttggggaggcagacagga

SEQ ID NO: 532238 - DNA, 20 bp, Artificial
  CRISPR gRNA sequence
ggggaggcagacaggaaccc

SEQ ID NO: 532239 - DNA, 20 bp, Artificial
  CRISPR gRNA sequence
gggaggcagacaggaacccc

SEQ ID NO: 532240 - DNA, 20 bp, Artificial
  CRISPR gRNA sequence
agtgagcaaataagcatttc

SEQ ID NO: 532241 - DNA, 20 bp, Artificial
  CRISPR gRNA sequence
ctgtgcttcacacagaaaat

SEQ ID NO: 532242 - DNA, 20 bp, Artificial
  CRISPR gRNA sequence
tgtgcttcacacagaaaata

SEQ ID NO: 532243 - DNA, 20 bp, Artificial
  CRISPR gRNA sequence
tgcttcacacagaaaatatc

SEQ ID NO: 532244 - DNA, 20 bp, Artificial
  CRISPR gRNA sequence
cacacagaaaatatcaccag

SEQ ID NO: 532245 - DNA, 20 bp, Artificial
  CRISPR gRNA sequence
acacagaaaatatcaccaga

SEQ ID NO: 532246 - DNA, 20 bp, Artificial
  CRISPR gRNA sequence
cttcctctctgtctccagcc

SEQ ID NO: 532247 - DNA, 20 bp, Artificial
  CRISPR gRNA sequence
ttcctctctgtctccagccc

SEQ ID NO: 532248 - DNA, 20 bp, Artificial
  CRISPR gRNA sequence
cctctctgtctccagcccca

SEQ ID NO: 532249 - DNA, 20 bp, Artificial
  CRISPR gRNA sequence
ctctctgtctccagccccat

SEQ ID NO: 532250 - DNA, 20 bp, Artificial
  CRISPR gRNA sequence
tctgtctccagccccatctt

SEQ ID NO: 532251 - DNA, 20 bp, Artificial
  CRISPR gRNA sequence
tgtctccagccccatcttca

SEQ ID NO: 532252 - DNA, 20 bp, Artificial
  CRISPR gRNA sequence
tctccagccccatcttcagc

SEQ ID NO: 532253 - DNA, 20 bp, Artificial
  CRISPR gRNA sequence
cagccccatcttcagcacct

SEQ ID NO: 532254 - DNA, 20 bp, Artificial
  CRISPR gRNA sequence
cagcacctgggcctaccagc

SEQ ID NO: 532255 - DNA, 20 bp, Artificial
  CRISPR gRNA sequence
agcacctgggcctaccagca

SEQ ID NO: 532256 - DNA, 20 bp, Artificial
  CRISPR gRNA sequence
ggcctaccagcaatcccaga

SEQ ID NO: 532257 - DNA, 20 bp, Artificial
  CRISPR gRNA sequence
ccagcaatcccagatagtgt

SEQ ID NO: 532258 - DNA, 20 bp, Artificial
  CRISPR gRNA sequence
cccactccagcaatcccaga

SEQ ID NO: 532259 - DNA, 20 bp, Artificial
  CRISPR gRNA sequence
cagcaatcccagacactgtc

SEQ ID NO: 532260 - DNA, 20 bp, Artificial
  CRISPR gRNA sequence
tcagctcccctgaagtgaca

SEQ ID NO: 532261 - DNA, 20 bp, Artificial
  CRISPR gRNA sequence
ccctgaagtgacaactttcc

SEQ ID NO: 532262 - DNA, 20 bp, Artificial
  CRISPR gRNA sequence
aagtgacaactttccacacc

SEQ ID NO: 532263 - DNA, 20 bp, Artificial
  CRISPR gRNA sequence
tccacaccctagtcctgcaa

SEQ ID NO: 532264 - DNA, 20 bp, Artificial
  CRISPR gRNA sequence
ccacaccctagtcctgcaac

SEQ ID NO: 532265 - DNA, 20 bp, Artificial
  CRISPR gRNA sequence
cacaccctagtcctgcaacc

SEQ ID NO: 532266 - DNA, 20 bp, Artificial
  CRISPR gRNA sequence
gtcctgcaaccttgagtgga

SEQ ID NO: 532267 - DNA, 20 bp, Artificial
  CRISPR gRNA sequence
caaccttgagtggagagcac

SEQ ID NO: 532268 - DNA, 20 bp, Artificial
  CRISPR gRNA sequence
gagtggagagcaccttgtag

SEQ ID NO: 532269 - DNA, 20 bp, Artificial
  CRISPR gRNA sequence
agtggagagcaccttgtaga

SEQ ID NO: 532270 - DNA, 20 bp, Artificial
  CRISPR gRNA sequence
gtagaaatgtagtggggttg

SEQ ID NO: 532271 - DNA, 20 bp, Artificial
  CRISPR gRNA sequence
tagaaatgtagtggggttga

SEQ ID NO: 532272 - DNA, 20 bp, Artificial
  CRISPR gRNA sequence
agcatggcgctgaaaagggc

SEQ ID NO: 532273 - DNA, 20 bp, Artificial
  CRISPR gRNA sequence
aaaagggcctctgattatgg

SEQ ID NO: 532274 - DNA, 20 bp, Artificial
  CRISPR gRNA sequence
tgattatgggctctggaaac

SEQ ID NO: 532275 - DNA, 20 bp, Artificial
  CRISPR gRNA sequence
attatgggctctggaaacca

SEQ ID NO: 532276 - DNA, 20 bp, Artificial
  CRISPR gRNA sequence
tgggctctggaaaccacaga

SEQ ID NO: 532277 - DNA, 20 bp, Artificial
  CRISPR gRNA sequence
tggaaaccacagatctcagg

SEQ ID NO: 532278 - DNA, 20 bp, Artificial
  CRISPR gRNA sequence
gaaaccacagatctcaggac

SEQ ID NO: 532279 - DNA, 20 bp, Artificial
  CRISPR gRNA sequence
aggactccaaacagcacaaa

SEQ ID NO: 532280 - DNA, 20 bp, Artificial
  CRISPR gRNA sequence
caaacagcacaaaactcgag

SEQ ID NO: 532281 - DNA, 20 bp, Artificial
  CRISPR gRNA sequence
gagtgtcctgttttgagtgt

SEQ ID NO: 532282 - DNA, 20 bp, Artificial
  CRISPR gRNA sequence
ttttgagtgtgagccctacg

SEQ ID NO: 532283 - DNA, 20 bp, Artificial
  CRISPR gRNA sequence
tgagtgtgagccctacgcgg

SEQ ID NO: 532284 - DNA, 20 bp, Artificial
  CRISPR gRNA sequence
gagtgtgagccctacgcggg

SEQ ID NO: 532285 - DNA, 20 bp, Artificial
  CRISPR gRNA sequence
agtgtgagccctacgcgggg

SEQ ID NO: 532286 - DNA, 20 bp, Artificial
  CRISPR gRNA sequence
cgcgggggaccatgctggtg

SEQ ID NO: 532287 - DNA, 20 bp, Artificial
  CRISPR gRNA sequence
gtgttttcacatttgggtcg

SEQ ID NO: 532288 - DNA, 20 bp, Artificial
  CRISPR gRNA sequence
tcacatttgggtcgcattta

SEQ ID NO: 532289 - DNA, 20 bp, Artificial
  CRISPR gRNA sequence
cacatttgggtcgcatttag

SEQ ID NO: 532290 - DNA, 20 bp, Artificial
  CRISPR gRNA sequence
acatttgggtcgcatttagc

SEQ ID NO: 532291 - DNA, 20 bp, Artificial
  CRISPR gRNA sequence
gggtcgcatttagcattgcg

SEQ ID NO: 532292 - DNA, 20 bp, Artificial
  CRISPR gRNA sequence
ggtcgcatttagcattgcgg

SEQ ID NO: 532293 - DNA, 20 bp, Artificial
  CRISPR gRNA sequence
agcattgcggcggaaataat

SEQ ID NO: 532294 - DNA, 20 bp, Artificial
  CRISPR gRNA sequence
gcattgcggcggaaataatg

SEQ ID NO: 532295 - DNA, 20 bp, Artificial
  CRISPR gRNA sequence
cggcggaaataatggctacc

SEQ ID NO: 532296 - DNA, 20 bp, Artificial
  CRISPR gRNA sequence
ccagttaggggtcaagtgct

SEQ ID NO: 532297 - DNA, 20 bp, Artificial
  CRISPR gRNA sequence
ggggtcaagtgcttgcttac

SEQ ID NO: 532298 - DNA, 20 bp, Artificial
  CRISPR gRNA sequence
gcttacatgatcttatttaa

SEQ ID NO: 532299 - DNA, 20 bp, Artificial
  CRISPR gRNA sequence
cttacatgatcttatttaaa

SEQ ID NO: 532300 - DNA, 20 bp, Artificial
  CRISPR gRNA sequence
acatgatcttatttaaagcg

SEQ ID NO: 532301 - DNA, 20 bp, Artificial
  CRISPR gRNA sequence
catgatcttatttaaagcgc

SEQ ID NO: 532302 - DNA, 20 bp, Artificial
  CRISPR gRNA sequence
atttaaagcgcccaacaata

SEQ ID NO: 532303 - DNA, 20 bp, Artificial
  CRISPR gRNA sequence
tttaaagcgcccaacaatac

SEQ ID NO: 532304 - DNA, 20 bp, Artificial
  CRISPR gRNA sequence
aaagcgcccaacaatactga

SEQ ID NO: 532305 - DNA, 20 bp, Artificial
  CRISPR gRNA sequence
aagcgcccaacaatactgag

SEQ ID NO: 532306 - DNA, 20 bp, Artificial
  CRISPR gRNA sequence
agacctagttgttattatct

SEQ ID NO: 532307 - DNA, 20 bp, Artificial
  CRISPR gRNA sequence
gttgttattatctccttgtt

SEQ ID NO: 532308 - DNA, 20 bp, Artificial
  CRISPR gRNA sequence
ttattatctccttgttatat

SEQ ID NO: 532309 - DNA, 20 bp, Artificial
  CRISPR gRNA sequence
ttatctccttgttatatata

SEQ ID NO: 532310 - DNA, 20 bp, Artificial
  CRISPR gRNA sequence
tctccttgttatatataaga

SEQ ID NO: 532311 - DNA, 20 bp, Artificial
  CRISPR gRNA sequence
cttgttatatataagaaaac

SEQ ID NO: 532312 - DNA, 20 bp, Artificial
  CRISPR gRNA sequence
gttatatataagaaaacaga

SEQ ID NO: 532313 - DNA, 20 bp, Artificial
  CRISPR gRNA sequence
ttatatataagaaaacagag

SEQ ID NO: 532314 - DNA, 20 bp, Artificial
  CRISPR gRNA sequence
tatataagaaaacagagacc

SEQ ID NO: 532315 - DNA, 20 bp, Artificial
  CRISPR gRNA sequence
gtcagaagcagcttgtccaa

SEQ ID NO: 532316 - DNA, 20 bp, Artificial
  CRISPR gRNA sequence
gtccaaggtctcattgcttg

SEQ ID NO: 532317 - DNA, 20 bp, Artificial
  CRISPR gRNA sequence
tccaaggtctcattgcttga

SEQ ID NO: 532318 - DNA, 20 bp, Artificial
  CRISPR gRNA sequence
attgcttgacaggagcaaag

SEQ ID NO: 532319 - DNA, 20 bp, Artificial
  CRISPR gRNA sequence
cttgacaggagcaaagtcag

SEQ ID NO: 532320 - DNA, 20 bp, Artificial
  CRISPR gRNA sequence
gacaggagcaaagtcaggat

SEQ ID NO: 532321 - DNA, 20 bp, Artificial
  CRISPR gRNA sequence
acaggagcaaagtcaggatt

SEQ ID NO: 532322 - DNA, 20 bp, Artificial
  CRISPR gRNA sequence
aaactcagaggtctttttgg

SEQ ID NO: 532323 - DNA, 20 bp, Artificial
  CRISPR gRNA sequence
agaggtctttttggcaagaa

SEQ ID NO: 532324 - DNA, 20 bp, Artificial
  CRISPR gRNA sequence
tttggcaagaatgacgacct

SEQ ID NO: 532325 - DNA, 20 bp, Artificial
  CRISPR gRNA sequence
ttggcaagaatgacgacctt

SEQ ID NO: 532326 - DNA, 20 bp, Artificial
  CRISPR gRNA sequence
tggcaagaatgacgaccttt

SEQ ID NO: 532327 - DNA, 20 bp, Artificial
  CRISPR gRNA sequence
ggcaagaatgacgacctttt

SEQ ID NO: 532328 - DNA, 20 bp, Artificial
  CRISPR gRNA sequence
gcaagaatgacgaccttttc

SEQ ID NO: 532329 - DNA, 20 bp, Artificial
  CRISPR gRNA sequence
ttctttttttttccaagcag

SEQ ID NO: 532330 - DNA, 20 bp, Artificial
  CRISPR gRNA sequence
tctttttttttccaagcagc

SEQ ID NO: 532331 - DNA, 20 bp, Artificial
  CRISPR gRNA sequence
ctttttttttccaagcagct

SEQ ID NO: 532332 - DNA, 20 bp, Artificial
  CRISPR gRNA sequence
tttttttttccaagcagctt

SEQ ID NO: 532333 - DNA, 20 bp, Artificial
  CRISPR gRNA sequence
tttttttccaagcagcttca

SEQ ID NO: 532334 - DNA, 20 bp, Artificial
  CRISPR gRNA sequence
ttttttccaagcagcttcat

SEQ ID NO: 532335 - DNA, 20 bp, Artificial
  CRISPR gRNA sequence
tttttccaagcagcttcatt

SEQ ID NO: 532336 - DNA, 20 bp, Artificial
  CRISPR gRNA sequence
ttttccaagcagcttcattg

SEQ ID NO: 532337 - DNA, 20 bp, Artificial
  CRISPR gRNA sequence
tttccaagcagcttcattga

SEQ ID NO: 532338 - DNA, 20 bp, Artificial
  CRISPR gRNA sequence
ttccaagcagcttcattgag

SEQ ID NO: 532339 - DNA, 20 bp, Artificial
  CRISPR gRNA sequence
tccaagcagcttcattgaga

SEQ ID NO: 532340 - DNA, 20 bp, Artificial
  CRISPR gRNA sequence
ccaagcagcttcattgagat

SEQ ID NO: 532341 - DNA, 20 bp, Artificial
  CRISPR gRNA sequence
caagcagcttcattgagata

SEQ ID NO: 532342 - DNA, 20 bp, Artificial
  CRISPR gRNA sequence
cattgagataattcatctac

SEQ ID NO: 532343 - DNA, 20 bp, Artificial
  CRISPR gRNA sequence
attgagataattcatctacc

SEQ ID NO: 532344 - DNA, 20 bp, Artificial
  CRISPR gRNA sequence
agataattcatctaccattc

SEQ ID NO: 532345 - DNA, 20 bp, Artificial
  CRISPR gRNA sequence
atctaccattcaatttgtcc

SEQ ID NO: 532346 - DNA, 20 bp, Artificial
  CRISPR gRNA sequence
ccattcaatttgtccatata

SEQ ID NO: 532347 - DNA, 20 bp, Artificial
  CRISPR gRNA sequence
aatttgtccatatactaaaa

SEQ ID NO: 532348 - DNA, 20 bp, Artificial
  CRISPR gRNA sequence
gtccatatactaaaatggcc

SEQ ID NO: 532349 - DNA, 20 bp, Artificial
  CRISPR gRNA sequence
tccatatactaaaatggcct

SEQ ID NO: 532350 - DNA, 20 bp, Artificial
  CRISPR gRNA sequence
aaatggccttcagtatattc

SEQ ID NO: 532351 - DNA, 20 bp, Artificial
  CRISPR gRNA sequence
cagtatattcagagttttgt

SEQ ID NO: 532352 - DNA, 20 bp, Artificial
  CRISPR gRNA sequence
agtatattcagagttttgta

SEQ ID NO: 532353 - DNA, 20 bp, Artificial
  CRISPR gRNA sequence
agagttttgtaaccatcacc

SEQ ID NO: 532354 - DNA, 20 bp, Artificial
  CRISPR gRNA sequence
tgtaaccatcaccacaatca

SEQ ID NO: 532355 - DNA, 20 bp, Artificial
  CRISPR gRNA sequence
gtaaccatcaccacaatcaa

SEQ ID NO: 532356 - DNA, 20 bp, Artificial
  CRISPR gRNA sequence
taaccatcaccacaatcaac

SEQ ID NO: 532357 - DNA, 20 bp, Artificial
  CRISPR gRNA sequence
tcattgccccaaaaagaaac

SEQ ID NO: 532358 - DNA, 20 bp, Artificial
  CRISPR gRNA sequence
cattgccccaaaaagaaacc

SEQ ID NO: 532359 - DNA, 20 bp, Artificial
  CRISPR gRNA sequence
attgccccaaaaagaaaccc

SEQ ID NO: 532360 - DNA, 20 bp, Artificial
  CRISPR gRNA sequence
ccccaaaaagaaacccttca

SEQ ID NO: 532361 - DNA, 20 bp, Artificial
  CRISPR gRNA sequence
caccctttagccgaaagaca

SEQ ID NO: 532362 - DNA, 20 bp, Artificial
  CRISPR gRNA sequence
accctttagccgaaagacag

SEQ ID NO: 532363 - DNA, 20 bp, Artificial
  CRISPR gRNA sequence
tagccgaaagacagtgactt

SEQ ID NO: 532364 - DNA, 20 bp, Artificial
  CRISPR gRNA sequence
agccgaaagacagtgacttg

SEQ ID NO: 532365 - DNA, 20 bp, Artificial
  CRISPR gRNA sequence
gccgaaagacagtgacttgc

SEQ ID NO: 532366 - DNA, 20 bp, Artificial
  CRISPR gRNA sequence
gctttatgtgtgtgcacgtc

SEQ ID NO: 532367 - DNA, 20 bp, Artificial
  CRISPR gRNA sequence
ctttatgtgtgtgcacgtca

SEQ ID NO: 532368 - DNA, 20 bp, Artificial
  CRISPR gRNA sequence
tatgtgtgtgcacgtcaatg

SEQ ID NO: 532369 - DNA, 20 bp, Artificial
  CRISPR gRNA sequence
atgtgtgtgcacgtcaatgt

SEQ ID NO: 532370 - DNA, 20 bp, Artificial
  CRISPR gRNA sequence
tgtgtgtgcacgtcaatgtc

SEQ ID NO: 532371 - DNA, 20 bp, Artificial
  CRISPR gRNA sequence
gattcaacttgtagttggtc

SEQ ID NO: 532372 - DNA, 20 bp, Artificial
  CRISPR gRNA sequence
attcaacttgtagttggtca

SEQ ID NO: 532373 - DNA, 20 bp, Artificial
  CRISPR gRNA sequence
aacttgtagttggtcactat

SEQ ID NO: 532374 - DNA, 20 bp, Artificial
  CRISPR gRNA sequence
gtagttggtcactattacca

SEQ ID NO: 532375 - DNA, 20 bp, Artificial
  CRISPR gRNA sequence
tagttggtcactattaccag

SEQ ID NO: 532376 - DNA, 20 bp, Artificial
  CRISPR gRNA sequence
gtcactattaccagacttaa

SEQ ID NO: 532377 - DNA, 20 bp, Artificial
  CRISPR gRNA sequence
ttaccagacttaaggtgacc

SEQ ID NO: 532378 - DNA, 20 bp, Artificial
  CRISPR gRNA sequence
ccagacttaaggtgaccatg

SEQ ID NO: 532379 - DNA, 20 bp, Artificial
  CRISPR gRNA sequence
aaggtgaccatggccttggg

SEQ ID NO: 532380 - DNA, 20 bp, Artificial
  CRISPR gRNA sequence
aggtgaccatggccttgggc

SEQ ID NO: 532381 - DNA, 20 bp, Artificial
  CRISPR gRNA sequence
gggcaaattccctatctgct

SEQ ID NO: 532382 - DNA, 20 bp, Artificial
  CRISPR gRNA sequence
ggcaaattccctatctgctg

SEQ ID NO: 532383 - DNA, 20 bp, Artificial
  CRISPR gRNA sequence
cctatctgctgtgagtctgc

SEQ ID NO: 532384 - DNA, 20 bp, Artificial
  CRISPR gRNA sequence
tctgctgtgagtctgctttt

SEQ ID NO: 532385 - DNA, 20 bp, Artificial
  CRISPR gRNA sequence
ctgtgagtctgcttttccaa

SEQ ID NO: 532386 - DNA, 20 bp, Artificial
  CRISPR gRNA sequence
tgagtctgcttttccaatga

SEQ ID NO: 532387 - DNA, 20 bp, Artificial
  CRISPR gRNA sequence
cttttccaatgacaacttca

SEQ ID NO: 532388 - DNA, 20 bp, Artificial
  CRISPR gRNA sequence
ttccaatgacaacttcaagg

SEQ ID NO: 532389 - DNA, 20 bp, Artificial
  CRISPR gRNA sequence
tccaatgacaacttcaaggg

SEQ ID NO: 532390 - DNA, 20 bp, Artificial
  CRISPR gRNA sequence
ccaatgacaacttcaaggga

SEQ ID NO: 532391 - DNA, 20 bp, Artificial
  CRISPR gRNA sequence
caatgacaacttcaagggat

SEQ ID NO: 532392 - DNA, 20 bp, Artificial
  CRISPR gRNA sequence
caagggatattcagtgagac

SEQ ID NO: 532393 - DNA, 20 bp, Artificial
  CRISPR gRNA sequence
aagggatattcagtgagaca

SEQ ID NO: 532394 - DNA, 20 bp, Artificial
  CRISPR gRNA sequence
agtgagacaaggtgtgtaca

SEQ ID NO: 532395 - DNA, 20 bp, Artificial
  CRISPR gRNA sequence
cagtgcctggggcacaatgc

SEQ ID NO: 532396 - DNA, 20 bp, Artificial
  CRISPR gRNA sequence
gggcacaatgcctgttttct

SEQ ID NO: 532397 - DNA, 20 bp, Artificial
  CRISPR gRNA sequence
ttttctcagtgctaatgccc

SEQ ID NO: 532398 - DNA, 20 bp, Artificial
  CRISPR gRNA sequence
tctcagtgctaatgccctcc

SEQ ID NO: 532399 - DNA, 20 bp, Artificial
  CRISPR gRNA sequence
ctcagtgctaatgccctccc

SEQ ID NO: 532400 - DNA, 20 bp, Artificial
  CRISPR gRNA sequence
tcagtgctaatgccctccca

SEQ ID NO: 532401 - DNA, 20 bp, Artificial
  CRISPR gRNA sequence
agtgctaatgccctcccaca

SEQ ID NO: 532402 - DNA, 20 bp, Artificial
  CRISPR gRNA sequence
atgccctcccacatctcttt

SEQ ID NO: 532403 - DNA, 20 bp, Artificial
  CRISPR gRNA sequence
ccacatctctttgtttctcc

SEQ ID NO: 532404 - DNA, 20 bp, Artificial
  CRISPR gRNA sequence
tttgtttctccaagcttctc

SEQ ID NO: 532405 - DNA, 20 bp, Artificial
  CRISPR gRNA sequence
tgtttctccaagcttctctt

SEQ ID NO: 532406 - DNA, 20 bp, Artificial
  CRISPR gRNA sequence
gtttctccaagcttctcttt

SEQ ID NO: 532407 - DNA, 20 bp, Artificial
  CRISPR gRNA sequence
tttctccaagcttctctttt

SEQ ID NO: 532408 - DNA, 20 bp, Artificial
  CRISPR gRNA sequence
ctccaagcttctcttttttt

SEQ ID NO: 532409 - DNA, 20 bp, Artificial
  CRISPR gRNA sequence
tccaagcttctctttttttt

SEQ ID NO: 532410 - DNA, 20 bp, Artificial
  CRISPR gRNA sequence
caagcttctctttttttttt

SEQ ID NO: 532411 - DNA, 20 bp, Artificial
  CRISPR gRNA sequence
ctcttttttttttttttttt

SEQ ID NO: 532412 - DNA, 20 bp, Artificial
  CRISPR gRNA sequence
tctttttttttttttttttt

SEQ ID NO: 532413 - DNA, 20 bp, Artificial
  CRISPR gRNA sequence
ttttttttttttttttttta

SEQ ID NO: 532414 - DNA, 20 bp, Artificial
  CRISPR gRNA sequence
tttttttttttttttttaat

SEQ ID NO: 532415 - DNA, 20 bp, Artificial
  CRISPR gRNA sequence
ttttttttttttttttaatt

SEQ ID NO: 532416 - DNA, 20 bp, Artificial
  CRISPR gRNA sequence
tttttttttttttttaattg

SEQ ID NO: 532417 - DNA, 20 bp, Artificial
  CRISPR gRNA sequence
ttttttttttttttaattga

SEQ ID NO: 532418 - DNA, 20 bp, Artificial
  CRISPR gRNA sequence
tttttttttttttaattgag

SEQ ID NO: 532419 - DNA, 20 bp, Artificial
  CRISPR gRNA sequence
ttttttttttttaattgaga

SEQ ID NO: 532420 - DNA, 20 bp, Artificial
  CRISPR gRNA sequence
tttttttttttaattgagat

SEQ ID NO: 532421 - DNA, 20 bp, Artificial
  CRISPR gRNA sequence
ttttttttttaattgagatg

SEQ ID NO: 532422 - DNA, 20 bp, Artificial
  CRISPR gRNA sequence
tttttttttaattgagatgg

SEQ ID NO: 532423 - DNA, 20 bp, Artificial
  CRISPR gRNA sequence
ttttttttaattgagatggc

SEQ ID NO: 532424 - DNA, 20 bp, Artificial
  CRISPR gRNA sequence
tttttttaattgagatggca

SEQ ID NO: 532425 - DNA, 20 bp, Artificial
  CRISPR gRNA sequence
ttttttaattgagatggcat

SEQ ID NO: 532426 - DNA, 20 bp, Artificial
  CRISPR gRNA sequence
tttttaattgagatggcatc

SEQ ID NO: 532427 - DNA, 20 bp, Artificial
  CRISPR gRNA sequence
ttttaattgagatggcatct

SEQ ID NO: 532428 - DNA, 20 bp, Artificial
  CRISPR gRNA sequence
tttaattgagatggcatctt

SEQ ID NO: 532429 - DNA, 20 bp, Artificial
  CRISPR gRNA sequence
ttaattgagatggcatcttg

SEQ ID NO: 532430 - DNA, 20 bp, Artificial
  CRISPR gRNA sequence
taattgagatggcatcttgc

SEQ ID NO: 532431 - DNA, 20 bp, Artificial
  CRISPR gRNA sequence
aattgagatggcatcttgct

SEQ ID NO: 532432 - DNA, 20 bp, Artificial
  CRISPR gRNA sequence
attgagatggcatcttgctc

SEQ ID NO: 532433 - DNA, 20 bp, Artificial
  CRISPR gRNA sequence
agatggcatcttgctctgtt

SEQ ID NO: 532434 - DNA, 20 bp, Artificial
  CRISPR gRNA sequence
gctctgttgcccaggctgga

SEQ ID NO: 532435 - DNA, 20 bp, Artificial
  CRISPR gRNA sequence
ctctgttgcccaggctggag

SEQ ID NO: 532436 - DNA, 20 bp, Artificial
  CRISPR gRNA sequence
tgttgcccaggctggagtgc

SEQ ID NO: 532437 - DNA, 20 bp, Artificial
  CRISPR gRNA sequence
ttgcccaggctggagtgcac

SEQ ID NO: 532438 - DNA, 20 bp, Artificial
  CRISPR gRNA sequence
cccaggctggagtgcactgg

SEQ ID NO: 532439 - DNA, 20 bp, Artificial
  CRISPR gRNA sequence
gagtgcactggcatgatctc

SEQ ID NO: 532440 - DNA, 20 bp, Artificial
  CRISPR gRNA sequence
gcatgatctcagctcactgc

SEQ ID NO: 532441 - DNA, 20 bp, Artificial
  CRISPR gRNA sequence
agctcactgcagcctctgcc

SEQ ID NO: 532442 - DNA, 20 bp, Artificial
  CRISPR gRNA sequence
actgcagcctctgcctccca

SEQ ID NO: 532443 - DNA, 20 bp, Artificial
  CRISPR gRNA sequence
cagcctctgcctcccaggtt

SEQ ID NO: 532444 - DNA, 20 bp, Artificial
  CRISPR gRNA sequence
tgcctcccaggttcaagcga

SEQ ID NO: 532445 - DNA, 20 bp, Artificial
  CRISPR gRNA sequence
cctcccaggttcaagcgatt

SEQ ID NO: 532446 - DNA, 20 bp, Artificial
  CRISPR gRNA sequence
ccaggttcaagcgattctcc

SEQ ID NO: 532447 - DNA, 20 bp, Artificial
  CRISPR gRNA sequence
aagcgattctcctgcctcag

SEQ ID NO: 532448 - DNA, 20 bp, Artificial
  CRISPR gRNA sequence
tcctgcctcagcctcccaag

SEQ ID NO: 532449 - DNA, 20 bp, Artificial
  CRISPR gRNA sequence
ctgcctcagcctcccaagta

SEQ ID NO: 532450 - DNA, 20 bp, Artificial
  CRISPR gRNA sequence
cctcagcctcccaagtagct

SEQ ID NO: 532451 - DNA, 20 bp, Artificial
  CRISPR gRNA sequence
agcctcccaagtagctggga

SEQ ID NO: 532452 - DNA, 20 bp, Artificial
  CRISPR gRNA sequence
ccaagtagctgggattacag

SEQ ID NO: 532453 - DNA, 20 bp, Artificial
  CRISPR gRNA sequence
ggattacaggcatgtaccac

SEQ ID NO: 532454 - DNA, 20 bp, Artificial
  CRISPR gRNA sequence
caggcatgtaccaccacgtc

SEQ ID NO: 532455 - DNA, 20 bp, Artificial
  CRISPR gRNA sequence
atttttgtatttttagtaga

SEQ ID NO: 532456 - DNA, 20 bp, Artificial
  CRISPR gRNA sequence
ttgtatttttagtagagacg

SEQ ID NO: 532457 - DNA, 20 bp, Artificial
  CRISPR gRNA sequence
tgtatttttagtagagacgg

SEQ ID NO: 532458 - DNA, 20 bp, Artificial
  CRISPR gRNA sequence
gtatttttagtagagacggg

SEQ ID NO: 532459 - DNA, 20 bp, Artificial
  CRISPR gRNA sequence
tatttttagtagagacgggg

SEQ ID NO: 532460 - DNA, 20 bp, Artificial
  CRISPR gRNA sequence
ttagtagagacggggtttcg

SEQ ID NO: 532461 - DNA, 20 bp, Artificial
  CRISPR gRNA sequence
tagtagagacggggtttcgc

SEQ ID NO: 532462 - DNA, 20 bp, Artificial
  CRISPR gRNA sequence
agtagagacggggtttcgcc

SEQ ID NO: 532463 - DNA, 20 bp, Artificial
  CRISPR gRNA sequence
gtagagacggggtttcgcca

SEQ ID NO: 532464 - DNA, 20 bp, Artificial
  CRISPR gRNA sequence
cgccatgttggtcaggctgg

SEQ ID NO: 532465 - DNA, 20 bp, Artificial
  CRISPR gRNA sequence
gccatgttggtcaggctggt

SEQ ID NO: 532466 - DNA, 20 bp, Artificial
  CRISPR gRNA sequence
gtcaggctggtctcaaactc

SEQ ID NO: 532467 - DNA, 20 bp, Artificial
  CRISPR gRNA sequence
gtctcaaactcctgacctca

SEQ ID NO: 532468 - DNA, 20 bp, Artificial
  CRISPR gRNA sequence
aaactcctgacctcagggga

SEQ ID NO: 532469 - DNA, 20 bp, Artificial
  CRISPR gRNA sequence
ctgacctcaggggatccgcc

SEQ ID NO: 532470 - DNA, 20 bp, Artificial
  CRISPR gRNA sequence
acctcaggggatccgcctgc

SEQ ID NO: 532471 - DNA, 20 bp, Artificial
  CRISPR gRNA sequence
aggggatccgcctgcatcgg

SEQ ID NO: 532472 - DNA, 20 bp, Artificial
  CRISPR gRNA sequence
catcggcctcccaaagtgct

SEQ ID NO: 532473 - DNA, 20 bp, Artificial
  CRISPR gRNA sequence
ccaaagtgctgggattacag

SEQ ID NO: 532474 - DNA, 20 bp, Artificial
  CRISPR gRNA sequence
ggattacaggtgtgaaccac

SEQ ID NO: 532475 - DNA, 20 bp, Artificial
  CRISPR gRNA sequence
caggtgtgaaccacgcaccc

SEQ ID NO: 532476 - DNA, 20 bp, Artificial
  CRISPR gRNA sequence
caaacttctcaaactccagt

SEQ ID NO: 532477 - DNA, 20 bp, Artificial
  CRISPR gRNA sequence
ctcaaactccagtagttgtg

SEQ ID NO: 532478 - DNA, 20 bp, Artificial
  CRISPR gRNA sequence
tcaaactccagtagttgtgc

SEQ ID NO: 532479 - DNA, 20 bp, Artificial
  CRISPR gRNA sequence
aaactccagtagttgtgcct

SEQ ID NO: 532480 - DNA, 20 bp, Artificial
  CRISPR gRNA sequence
cagtagttgtgcctgcattt

SEQ ID NO: 532481 - DNA, 20 bp, Artificial
  CRISPR gRNA sequence
tgcctgcatttccttcatga

SEQ ID NO: 532482 - DNA, 20 bp, Artificial
  CRISPR gRNA sequence
catttccttcatgagggagt

SEQ ID NO: 532483 - DNA, 20 bp, Artificial
  CRISPR gRNA sequence
ccttcatgagggagttgctg

SEQ ID NO: 532484 - DNA, 20 bp, Artificial
  CRISPR gRNA sequence
cttcatgagggagttgctgc

SEQ ID NO: 532485 - DNA, 20 bp, Artificial
  CRISPR gRNA sequence
catgagggagttgctgctgc

SEQ ID NO: 532486 - DNA, 20 bp, Artificial
  CRISPR gRNA sequence
atgagggagttgctgctgca

SEQ ID NO: 532487 - DNA, 20 bp, Artificial
  CRISPR gRNA sequence
ctgctgcaggctgaagaggc

SEQ ID NO: 532488 - DNA, 20 bp, Artificial
  CRISPR gRNA sequence
ctgcaggctgaagaggcaat

SEQ ID NO: 532489 - DNA, 20 bp, Artificial
  CRISPR gRNA sequence
caggctgaagaggcaatgga

SEQ ID NO: 532490 - DNA, 20 bp, Artificial
  CRISPR gRNA sequence
aagaggcaatggagggcccc

SEQ ID NO: 532491 - DNA, 20 bp, Artificial
  CRISPR gRNA sequence
agaagcagatgctagtaggg

SEQ ID NO: 532492 - DNA, 20 bp, Artificial
  CRISPR gRNA sequence
gaagcagatgctagtaggga

SEQ ID NO: 532493 - DNA, 20 bp, Artificial
  CRISPR gRNA sequence
gtagggaaggggttaatccc

SEQ ID NO: 532494 - DNA, 20 bp, Artificial
  CRISPR gRNA sequence
atcccagcaactcagaatta

SEQ ID NO: 532495 - DNA, 20 bp, Artificial
  CRISPR gRNA sequence
agaattaaggagttctcatc

SEQ ID NO: 532496 - DNA, 20 bp, Artificial
  CRISPR gRNA sequence
aggagttctcatccatggaa

SEQ ID NO: 532497 - DNA, 20 bp, Artificial
  CRISPR gRNA sequence
tcatccatggaaggccttag

SEQ ID NO: 532498 - DNA, 20 bp, Artificial
  CRISPR gRNA sequence
atccatggaaggccttaggt

SEQ ID NO: 532499 - DNA, 20 bp, Artificial
  CRISPR gRNA sequence
aggttggatcagttctaaga

SEQ ID NO: 532500 - DNA, 20 bp, Artificial
  CRISPR gRNA sequence
ggttggatcagttctaagac

SEQ ID NO: 532501 - DNA, 20 bp, Artificial
  CRISPR gRNA sequence
gatcagttctaagacgctat

SEQ ID NO: 532502 - DNA, 20 bp, Artificial
  CRISPR gRNA sequence
taagacgctatcttagtgaa

SEQ ID NO: 532503 - DNA, 20 bp, Artificial
  CRISPR gRNA sequence
agacgctatcttagtgaatg

SEQ ID NO: 532504 - DNA, 20 bp, Artificial
  CRISPR gRNA sequence
tcttagtgaatgtatacgga

SEQ ID NO: 532505 - DNA, 20 bp, Artificial
  CRISPR gRNA sequence
agtgaatgtatacggaggta

SEQ ID NO: 532506 - DNA, 20 bp, Artificial
  CRISPR gRNA sequence
gtgaatgtatacggaggtac

SEQ ID NO: 532507 - DNA, 20 bp, Artificial
  CRISPR gRNA sequence
ctccacaagggtgcccatca

SEQ ID NO: 532508 - DNA, 20 bp, Artificial
  CRISPR gRNA sequence
cacaagggtgcccatcactg

SEQ ID NO: 532509 - DNA, 20 bp, Artificial
  CRISPR gRNA sequence
cattattcatgttagcgaaa

SEQ ID NO: 532510 - DNA, 20 bp, Artificial
  CRISPR gRNA sequence
ttcatgttagcgaaatacta

SEQ ID NO: 532511 - DNA, 20 bp, Artificial
  CRISPR gRNA sequence
atgttagcgaaatactagaa

SEQ ID NO: 532512 - DNA, 20 bp, Artificial
  CRISPR gRNA sequence
gcgaaatactagaacagtca

SEQ ID NO: 532513 - DNA, 20 bp, Artificial
  CRISPR gRNA sequence
gaacagtcagcagttagaaa

SEQ ID NO: 532514 - DNA, 20 bp, Artificial
  CRISPR gRNA sequence
gaaacttattaatcagttaa

SEQ ID NO: 532515 - DNA, 20 bp, Artificial
  CRISPR gRNA sequence
attaatcagttaaattaaga

SEQ ID NO: 532516 - DNA, 20 bp, Artificial
  CRISPR gRNA sequence
ttaatcagttaaattaagaa

SEQ ID NO: 532517 - DNA, 20 bp, Artificial
  CRISPR gRNA sequence
atcagttaaattaagaatgc

SEQ ID NO: 532518 - DNA, 20 bp, Artificial
  CRISPR gRNA sequence
aattaagaatgcatccttta

SEQ ID NO: 532519 - DNA, 20 bp, Artificial
  CRISPR gRNA sequence
agaatgcatcctttaaaaag

SEQ ID NO: 532520 - DNA, 20 bp, Artificial
  CRISPR gRNA sequence
taaaaagatgcatatatgca

SEQ ID NO: 532521 - DNA, 20 bp, Artificial
  CRISPR gRNA sequence
aaaaagatgcatatatgcat

SEQ ID NO: 532522 - DNA, 20 bp, Artificial
  CRISPR gRNA sequence
aaaagatgcatatatgcatt

SEQ ID NO: 532523 - DNA, 20 bp, Artificial
  CRISPR gRNA sequence
attgatgttcattaagaaaa

SEQ ID NO: 532524 - DNA, 20 bp, Artificial
  CRISPR gRNA sequence
ttgatgttcattaagaaaag

SEQ ID NO: 532525 - DNA, 20 bp, Artificial
  CRISPR gRNA sequence
atgttcattaagaaaagaac

SEQ ID NO: 532526 - DNA, 20 bp, Artificial
  CRISPR gRNA sequence
attaagaaaagaacttcata

SEQ ID NO: 532527 - DNA, 20 bp, Artificial
  CRISPR gRNA sequence
agaaaagaacttcataatat

SEQ ID NO: 532528 - DNA, 20 bp, Artificial
  CRISPR gRNA sequence
cataatataatttcacaata

SEQ ID NO: 532529 - DNA, 20 bp, Artificial
  CRISPR gRNA sequence
ataatataatttcacaataa

SEQ ID NO: 532530 - DNA, 20 bp, Artificial
  CRISPR gRNA sequence
cacaataaaggggaaaaggc

SEQ ID NO: 532531 - DNA, 20 bp, Artificial
  CRISPR gRNA sequence
acaataaaggggaaaaggca

SEQ ID NO: 532532 - DNA, 20 bp, Artificial
  CRISPR gRNA sequence
taagatcacataaattagtt

SEQ ID NO: 532533 - DNA, 20 bp, Artificial
  CRISPR gRNA sequence
gttttaatttttaaaatatt

SEQ ID NO: 532534 - DNA, 20 bp, Artificial
  CRISPR gRNA sequence
taatttttaaaatattacat

SEQ ID NO: 532535 - DNA, 20 bp, Artificial
  CRISPR gRNA sequence
aatttttaaaatattacata

SEQ ID NO: 532536 - DNA, 20 bp, Artificial
  CRISPR gRNA sequence
atttttaaaatattacatat

SEQ ID NO: 532537 - DNA, 20 bp, Artificial
  CRISPR gRNA sequence
ttaaaatattacatatatat

SEQ ID NO: 532538 - DNA, 20 bp, Artificial
  CRISPR gRNA sequence
taaaatattacatatatata

SEQ ID NO: 532539 - DNA, 20 bp, Artificial
  CRISPR gRNA sequence
aaaatattacatatatatat

SEQ ID NO: 532540 - DNA, 20 bp, Artificial
  CRISPR gRNA sequence
aaatattacatatatatata

SEQ ID NO: 532541 - DNA, 20 bp, Artificial
  CRISPR gRNA sequence
catatatatatatagagaga

SEQ ID NO: 532542 - DNA, 20 bp, Artificial
  CRISPR gRNA sequence
actctgtcgtccagcctgga

SEQ ID NO: 532543 - DNA, 20 bp, Artificial
  CRISPR gRNA sequence
tgtcgtccagcctggagtgc

SEQ ID NO: 532544 - DNA, 20 bp, Artificial
  CRISPR gRNA sequence
tcgtccagcctggagtgcag

SEQ ID NO: 532545 - DNA, 20 bp, Artificial
  CRISPR gRNA sequence
gagtgcagtggtgaaatatt

SEQ ID NO: 532546 - DNA, 20 bp, Artificial
  CRISPR gRNA sequence
gctcactgcagcctctgcct

SEQ ID NO: 532547 - DNA, 20 bp, Artificial
  CRISPR gRNA sequence
actgcagcctctgcctcttg

SEQ ID NO: 532548 - DNA, 20 bp, Artificial
  CRISPR gRNA sequence
cagcctctgcctcttgggtt

SEQ ID NO: 532549 - DNA, 20 bp, Artificial
  CRISPR gRNA sequence
tgcctcttgggttcaagcaa

SEQ ID NO: 532550 - DNA, 20 bp, Artificial
  CRISPR gRNA sequence
cctcttgggttcaagcaatt

SEQ ID NO: 532551 - DNA, 20 bp, Artificial
  CRISPR gRNA sequence
ttgggttcaagcaattctca

SEQ ID NO: 532552 - DNA, 20 bp, Artificial
  CRISPR gRNA sequence
gggttcaagcaattctcatg

SEQ ID NO: 532553 - DNA, 20 bp, Artificial
  CRISPR gRNA sequence
ggttcaagcaattctcatgc

SEQ ID NO: 532554 - DNA, 20 bp, Artificial
  CRISPR gRNA sequence
aagcaattctcatgcctcag

SEQ ID NO: 532555 - DNA, 20 bp, Artificial
  CRISPR gRNA sequence
tcatgcctcagcctcctgag

SEQ ID NO: 532556 - DNA, 20 bp, Artificial
  CRISPR gRNA sequence
atgcctcagcctcctgagta

SEQ ID NO: 532557 - DNA, 20 bp, Artificial
  CRISPR gRNA sequence
agcctcctgagtagtttgga

SEQ ID NO: 532558 - DNA, 20 bp, Artificial
  CRISPR gRNA sequence
ctgagtagtttggattagag

SEQ ID NO: 532559 - DNA, 20 bp, Artificial
  CRISPR gRNA sequence
agtagtttggattagaggcg

SEQ ID NO: 532560 - DNA, 20 bp, Artificial
  CRISPR gRNA sequence
ggattagaggcgcatgccaa

SEQ ID NO: 532561 - DNA, 20 bp, Artificial
  CRISPR gRNA sequence
gattagaggcgcatgccaac

SEQ ID NO: 532562 - DNA, 20 bp, Artificial
  CRISPR gRNA sequence
gaggcgcatgccaacacacc

SEQ ID NO: 532563 - DNA, 20 bp, Artificial
  CRISPR gRNA sequence
gctaatcttcatatttttag

SEQ ID NO: 532564 - DNA, 20 bp, Artificial
  CRISPR gRNA sequence
atcttcatatttttagtaga

SEQ ID NO: 532565 - DNA, 20 bp, Artificial
  CRISPR gRNA sequence
catatttttagtagagatgt

SEQ ID NO: 532566 - DNA, 20 bp, Artificial
  CRISPR gRNA sequence
atatttttagtagagatgta

SEQ ID NO: 532567 - DNA, 20 bp, Artificial
  CRISPR gRNA sequence
ttagtagagatgtatttcac

SEQ ID NO: 532568 - DNA, 20 bp, Artificial
  CRISPR gRNA sequence
tagtagagatgtatttcacc

SEQ ID NO: 532569 - DNA, 20 bp, Artificial
  CRISPR gRNA sequence
agtagagatgtatttcacca

SEQ ID NO: 532570 - DNA, 20 bp, Artificial
  CRISPR gRNA sequence
gtagagatgtatttcaccat

SEQ ID NO: 532571 - DNA, 20 bp, Artificial
  CRISPR gRNA sequence
caccatgttggccaggctac

SEQ ID NO: 532572 - DNA, 20 bp, Artificial
  CRISPR gRNA sequence
accatgttggccaggctact

SEQ ID NO: 532573 - DNA, 20 bp, Artificial
  CRISPR gRNA sequence
gccaggctactcttgaactc

SEQ ID NO: 532574 - DNA, 20 bp, Artificial
  CRISPR gRNA sequence
ctcttgaactcctggcctca

SEQ ID NO: 532575 - DNA, 20 bp, Artificial
  CRISPR gRNA sequence
ttgaactcctggcctcaaga

SEQ ID NO: 532576 - DNA, 20 bp, Artificial
  CRISPR gRNA sequence
gaactcctggcctcaagaga

SEQ ID NO: 532577 - DNA, 20 bp, Artificial
  CRISPR gRNA sequence
aactcctggcctcaagagat

SEQ ID NO: 532578 - DNA, 20 bp, Artificial
  CRISPR gRNA sequence
ctggcctcaagagatccgcc

SEQ ID NO: 532579 - DNA, 20 bp, Artificial
  CRISPR gRNA sequence
gcctcaagagatccgcccac

SEQ ID NO: 532580 - DNA, 20 bp, Artificial
  CRISPR gRNA sequence
aagagatccgcccaccttag

SEQ ID NO: 532581 - DNA, 20 bp, Artificial
  CRISPR gRNA sequence
agcctcccaaagtgctggat

SEQ ID NO: 532582 - DNA, 20 bp, Artificial
  CRISPR gRNA sequence
gcctcccaaagtgctggatt

SEQ ID NO: 532583 - DNA, 20 bp, Artificial
  CRISPR gRNA sequence
ccaaagtgctggattacagg

SEQ ID NO: 532584 - DNA, 20 bp, Artificial
  CRISPR gRNA sequence
gattacaggcatgagccacc

SEQ ID NO: 532585 - DNA, 20 bp, Artificial
  CRISPR gRNA sequence
caggcatgagccacctctcc

SEQ ID NO: 532586 - DNA, 20 bp, Artificial
  CRISPR gRNA sequence
tcccagctgaaatattatat

SEQ ID NO: 532587 - DNA, 20 bp, Artificial
  CRISPR gRNA sequence
ccagctgaaatattatatta

SEQ ID NO: 532588 - DNA, 20 bp, Artificial
  CRISPR gRNA sequence
aaatattatattatttatat

SEQ ID NO: 532589 - DNA, 20 bp, Artificial
  CRISPR gRNA sequence
tattatttatatatatacat

SEQ ID NO: 532590 - DNA, 20 bp, Artificial
  CRISPR gRNA sequence
tttatatatatacatataaa

SEQ ID NO: 532591 - DNA, 20 bp, Artificial
  CRISPR gRNA sequence
atatatatacatataaatag

SEQ ID NO: 532592 - DNA, 20 bp, Artificial
  CRISPR gRNA sequence
tatatatacatataaataga

SEQ ID NO: 532593 - DNA, 20 bp, Artificial
  CRISPR gRNA sequence
ctaaagatatacatgaaaat

SEQ ID NO: 532594 - DNA, 20 bp, Artificial
  CRISPR gRNA sequence
aagatatacatgaaaatatt

SEQ ID NO: 532595 - DNA, 20 bp, Artificial
  CRISPR gRNA sequence
ttcattattgactttgagtg

SEQ ID NO: 532596 - DNA, 20 bp, Artificial
  CRISPR gRNA sequence
attattgactttgagtggtg

SEQ ID NO: 532597 - DNA, 20 bp, Artificial
  CRISPR gRNA sequence
ttgactttgagtggtggcgt

SEQ ID NO: 532598 - DNA, 20 bp, Artificial
  CRISPR gRNA sequence
actttgagtggtggcgttgt

SEQ ID NO: 532599 - DNA, 20 bp, Artificial
  CRISPR gRNA sequence
tgagtggtggcgttgtgggt

SEQ ID NO: 532600 - DNA, 20 bp, Artificial
  CRISPR gRNA sequence
gagtggtggcgttgtgggta

SEQ ID NO: 532601 - DNA, 20 bp, Artificial
  CRISPR gRNA sequence
agtggtggcgttgtgggtaa

SEQ ID NO: 532602 - DNA, 20 bp, Artificial
  CRISPR gRNA sequence
tgggtaatttttaatctgct

SEQ ID NO: 532603 - DNA, 20 bp, Artificial
  CRISPR gRNA sequence
ttaatctgctttaaactttt

SEQ ID NO: 532604 - DNA, 20 bp, Artificial
  CRISPR gRNA sequence
taatctgctttaaactttta

SEQ ID NO: 532605 - DNA, 20 bp, Artificial
  CRISPR gRNA sequence
aatctgctttaaacttttaa

SEQ ID NO: 532606 - DNA, 20 bp, Artificial
  CRISPR gRNA sequence
atctgctttaaacttttaaa

SEQ ID NO: 532607 - DNA, 20 bp, Artificial
  CRISPR gRNA sequence
ctttaaacttttaaaaatat

SEQ ID NO: 532608 - DNA, 20 bp, Artificial
  CRISPR gRNA sequence
taaacttttaaaaatatttt

SEQ ID NO: 532609 - DNA, 20 bp, Artificial
  CRISPR gRNA sequence
aaacttttaaaaatatttta

SEQ ID NO: 532610 - DNA, 20 bp, Artificial
  CRISPR gRNA sequence
aacttttaaaaatattttat

SEQ ID NO: 532611 - DNA, 20 bp, Artificial
  CRISPR gRNA sequence
ttaaaaatattttatcagct

SEQ ID NO: 532612 - DNA, 20 bp, Artificial
  CRISPR gRNA sequence
taaaaatattttatcagctt

SEQ ID NO: 532613 - DNA, 20 bp, Artificial
  CRISPR gRNA sequence
aaaaatattttatcagcttg

SEQ ID NO: 532614 - DNA, 20 bp, Artificial
  CRISPR gRNA sequence
aaaatattttatcagcttgt

SEQ ID NO: 532615 - DNA, 20 bp, Artificial
  CRISPR gRNA sequence
tatcagcttgtacaatgatt

SEQ ID NO: 532616 - DNA, 20 bp, Artificial
  CRISPR gRNA sequence
atcagcttgtacaatgattg

SEQ ID NO: 532617 - DNA, 20 bp, Artificial
  CRISPR gRNA sequence
tcagcttgtacaatgattgg

SEQ ID NO: 532618 - DNA, 20 bp, Artificial
  CRISPR gRNA sequence
gtacaatgattggagttgaa

SEQ ID NO: 532619 - DNA, 20 bp, Artificial
  CRISPR gRNA sequence
tacaatgattggagttgaaa

SEQ ID NO: 532620 - DNA, 20 bp, Artificial
  CRISPR gRNA sequence
gagttgaaagcccacggatg

SEQ ID NO: 532621 - DNA, 20 bp, Artificial
  CRISPR gRNA sequence
aaagcccacggatgctgggc

SEQ ID NO: 532622 - DNA, 20 bp, Artificial
  CRISPR gRNA sequence
ggcagggagtgataagaagg

SEQ ID NO: 532623 - DNA, 20 bp, Artificial
  CRISPR gRNA sequence
gcttggggaggaagacagga

SEQ ID NO: 532624 - DNA, 20 bp, Artificial
  CRISPR gRNA sequence
ggggaggaagacaggaaccc

SEQ ID NO: 532625 - DNA, 20 bp, Artificial
  CRISPR gRNA sequence
gggaggaagacaggaacccc

SEQ ID NO: 532626 - DNA, 20 bp, Artificial
  CRISPR gRNA sequence
agtgagcaaataagcatttc

SEQ ID NO: 532627 - DNA, 20 bp, Artificial
  CRISPR gRNA sequence
ctgtgcttcacacagaaaat

SEQ ID NO: 532628 - DNA, 20 bp, Artificial
  CRISPR gRNA sequence
tgtgcttcacacagaaaatg

SEQ ID NO: 532629 - DNA, 20 bp, Artificial
  CRISPR gRNA sequence
tgcttcacacagaaaatgtc

SEQ ID NO: 532630 - DNA, 20 bp, Artificial
  CRISPR gRNA sequence
cacacagaaaatgtcgccag

SEQ ID NO: 532631 - DNA, 20 bp, Artificial
  CRISPR gRNA sequence
acacagaaaatgtcgccaga

SEQ ID NO: 532632 - DNA, 20 bp, Artificial
  CRISPR gRNA sequence
cttcctctctgtctccagcc

SEQ ID NO: 532633 - DNA, 20 bp, Artificial
  CRISPR gRNA sequence
ttcctctctgtctccagccc

SEQ ID NO: 532634 - DNA, 20 bp, Artificial
  CRISPR gRNA sequence
cctctctgtctccagcccca

SEQ ID NO: 532635 - DNA, 20 bp, Artificial
  CRISPR gRNA sequence
ctctctgtctccagccccat

SEQ ID NO: 532636 - DNA, 20 bp, Artificial
  CRISPR gRNA sequence
tctgtctccagccccatctt

SEQ ID NO: 532637 - DNA, 20 bp, Artificial
  CRISPR gRNA sequence
tgtctccagccccatcttca

SEQ ID NO: 532638 - DNA, 20 bp, Artificial
  CRISPR gRNA sequence
tctccagccccatcttcagc

SEQ ID NO: 532639 - DNA, 20 bp, Artificial
  CRISPR gRNA sequence
cagccccatcttcagcacct

SEQ ID NO: 532640 - DNA, 20 bp, Artificial
  CRISPR gRNA sequence
cagcacctgggcctaccagc

SEQ ID NO: 532641 - DNA, 20 bp, Artificial
  CRISPR gRNA sequence
agcacctgggcctaccagca

SEQ ID NO: 532642 - DNA, 20 bp, Artificial
  CRISPR gRNA sequence
ggcctaccagcaatcccaga

SEQ ID NO: 532643 - DNA, 20 bp, Artificial
  CRISPR gRNA sequence
ccagcaatcccagatagtgt

SEQ ID NO: 532644 - DNA, 20 bp, Artificial
  CRISPR gRNA sequence
cccactccagcaatcccaga

SEQ ID NO: 532645 - DNA, 20 bp, Artificial
  CRISPR gRNA sequence
cagcaatcccagacactgtc

SEQ ID NO: 532646 - DNA, 20 bp, Artificial
  CRISPR gRNA sequence
tcagctcccctgaagtgaca

SEQ ID NO: 532647 - DNA, 20 bp, Artificial
  CRISPR gRNA sequence
ccctgaagtgacaactttcc

SEQ ID NO: 532648 - DNA, 20 bp, Artificial
  CRISPR gRNA sequence
aagtgacaactttccacacc

SEQ ID NO: 532649 - DNA, 20 bp, Artificial
  CRISPR gRNA sequence
tccacaccctagtcctgcaa

SEQ ID NO: 532650 - DNA, 20 bp, Artificial
  CRISPR gRNA sequence
ccacaccctagtcctgcaac

SEQ ID NO: 532651 - DNA, 20 bp, Artificial
  CRISPR gRNA sequence
cacaccctagtcctgcaacc

SEQ ID NO: 532652 - DNA, 20 bp, Artificial
  CRISPR gRNA sequence
gtcctgcaaccttgagtgga

SEQ ID NO: 532653 - DNA, 20 bp, Artificial
  CRISPR gRNA sequence
caaccttgagtggagagcac

SEQ ID NO: 532654 - DNA, 20 bp, Artificial
  CRISPR gRNA sequence
gagtggagagcaccttgtag

SEQ ID NO: 532655 - DNA, 20 bp, Artificial
  CRISPR gRNA sequence
agtggagagcaccttgtaga

SEQ ID NO: 532656 - DNA, 20 bp, Artificial
  CRISPR gRNA sequence
gtagaaatgtagtggggttg

SEQ ID NO: 532657 - DNA, 20 bp, Artificial
  CRISPR gRNA sequence
tagaaatgtagtggggttga

SEQ ID NO: 532658 - DNA, 20 bp, Artificial
  CRISPR gRNA sequence
agcatggcgctgaaaagagc

SEQ ID NO: 532659 - DNA, 20 bp, Artificial
  CRISPR gRNA sequence
aaaagagcctctgattatgg

SEQ ID NO: 532660 - DNA, 20 bp, Artificial
  CRISPR gRNA sequence
tgattatgggctctggaaac

SEQ ID NO: 532661 - DNA, 20 bp, Artificial
  CRISPR gRNA sequence
attatgggctctggaaacca

SEQ ID NO: 532662 - DNA, 20 bp, Artificial
  CRISPR gRNA sequence
tgggctctggaaaccacaga

SEQ ID NO: 532663 - DNA, 20 bp, Artificial
  CRISPR gRNA sequence
tggaaaccacagatctcagg

SEQ ID NO: 532664 - DNA, 20 bp, Artificial
  CRISPR gRNA sequence
gaaaccacagatctcaggac

SEQ ID NO: 532665 - DNA, 20 bp, Artificial
  CRISPR gRNA sequence
aggactccaaacagcacaga

SEQ ID NO: 532666 - DNA, 20 bp, Artificial
  CRISPR gRNA sequence
caaacagcacagaactcgag

SEQ ID NO: 532667 - DNA, 20 bp, Artificial
  CRISPR gRNA sequence
gagtgtcctgttttgagtgt

SEQ ID NO: 532668 - DNA, 20 bp, Artificial
  CRISPR gRNA sequence
ttttgagtgtgagccctaca

SEQ ID NO: 532669 - DNA, 20 bp, Artificial
  CRISPR gRNA sequence
tgagtgtgagccctacatgg

SEQ ID NO: 532670 - DNA, 20 bp, Artificial
  CRISPR gRNA sequence
gagtgtgagccctacatggg

SEQ ID NO: 532671 - DNA, 20 bp, Artificial
  CRISPR gRNA sequence
agtgtgagccctacatgggg

SEQ ID NO: 532672 - DNA, 20 bp, Artificial
  CRISPR gRNA sequence
catgggggaccatgttggtg

SEQ ID NO: 532673 - DNA, 20 bp, Artificial
  CRISPR gRNA sequence
gtgttttcacatttgggtca

SEQ ID NO: 532674 - DNA, 20 bp, Artificial
  CRISPR gRNA sequence
tcacatttgggtcacattta

SEQ ID NO: 532675 - DNA, 20 bp, Artificial
  CRISPR gRNA sequence
cacatttgggtcacatttag

SEQ ID NO: 532676 - DNA, 20 bp, Artificial
  CRISPR gRNA sequence
acatttgggtcacatttagc

SEQ ID NO: 532677 - DNA, 20 bp, Artificial
  CRISPR gRNA sequence
gggtcacatttagcattgcg

SEQ ID NO: 532678 - DNA, 20 bp, Artificial
  CRISPR gRNA sequence
ggtcacatttagcattgcgg

SEQ ID NO: 532679 - DNA, 20 bp, Artificial
  CRISPR gRNA sequence
agcattgcggcggaaataat

SEQ ID NO: 532680 - DNA, 20 bp, Artificial
  CRISPR gRNA sequence
gcattgcggcggaaataatg

SEQ ID NO: 532681 - DNA, 20 bp, Artificial
  CRISPR gRNA sequence
cggcggaaataatggctacc

SEQ ID NO: 532682 - DNA, 20 bp, Artificial
  CRISPR gRNA sequence
ccagttaggggtcaagtgct

SEQ ID NO: 532683 - DNA, 20 bp, Artificial
  CRISPR gRNA sequence
ggggtcaagtgcttgcttac

SEQ ID NO: 532684 - DNA, 20 bp, Artificial
  CRISPR gRNA sequence
gcttacatgatcttatttaa

SEQ ID NO: 532685 - DNA, 20 bp, Artificial
  CRISPR gRNA sequence
cttacatgatcttatttaaa

SEQ ID NO: 532686 - DNA, 20 bp, Artificial
  CRISPR gRNA sequence
acatgatcttatttaaagcg

SEQ ID NO: 532687 - DNA, 20 bp, Artificial
  CRISPR gRNA sequence
catgatcttatttaaagcgc

SEQ ID NO: 532688 - DNA, 20 bp, Artificial
  CRISPR gRNA sequence
atttaaagcgcccaacaata

SEQ ID NO: 532689 - DNA, 20 bp, Artificial
  CRISPR gRNA sequence
tttaaagcgcccaacaatac

SEQ ID NO: 532690 - DNA, 20 bp, Artificial
  CRISPR gRNA sequence
aaagcgcccaacaatactga

SEQ ID NO: 532691 - DNA, 20 bp, Artificial
  CRISPR gRNA sequence
aagcgcccaacaatactgag

SEQ ID NO: 532692 - DNA, 20 bp, Artificial
  CRISPR gRNA sequence
agacctagttgttattatct

SEQ ID NO: 532693 - DNA, 20 bp, Artificial
  CRISPR gRNA sequence
gttgttattatctccttgtt

SEQ ID NO: 532694 - DNA, 20 bp, Artificial
  CRISPR gRNA sequence
ttattatctccttgttatat

SEQ ID NO: 532695 - DNA, 20 bp, Artificial
  CRISPR gRNA sequence
ttatctccttgttatatata

SEQ ID NO: 532696 - DNA, 20 bp, Artificial
  CRISPR gRNA sequence
tctccttgttatatataaga

SEQ ID NO: 532697 - DNA, 20 bp, Artificial
  CRISPR gRNA sequence
cttgttatatataagaaaac

SEQ ID NO: 532698 - DNA, 20 bp, Artificial
  CRISPR gRNA sequence
gttatatataagaaaacaga

SEQ ID NO: 532699 - DNA, 20 bp, Artificial
  CRISPR gRNA sequence
ttatatataagaaaacagag

SEQ ID NO: 532700 - DNA, 20 bp, Artificial
  CRISPR gRNA sequence
tatataagaaaacagagacc

SEQ ID NO: 532701 - DNA, 20 bp, Artificial
  CRISPR gRNA sequence
gtcagaagcagcttgtccaa

SEQ ID NO: 532702 - DNA, 20 bp, Artificial
  CRISPR gRNA sequence
gtccaaggtctcattgcttg

SEQ ID NO: 532703 - DNA, 20 bp, Artificial
  CRISPR gRNA sequence
tccaaggtctcattgcttga

SEQ ID NO: 532704 - DNA, 20 bp, Artificial
  CRISPR gRNA sequence
attgcttgacaggagcaaag

SEQ ID NO: 532705 - DNA, 20 bp, Artificial
  CRISPR gRNA sequence
cttgacaggagcaaagtcag

SEQ ID NO: 532706 - DNA, 20 bp, Artificial
  CRISPR gRNA sequence
gacaggagcaaagtcaggat

SEQ ID NO: 532707 - DNA, 20 bp, Artificial
  CRISPR gRNA sequence
acaggagcaaagtcaggatt

SEQ ID NO: 532708 - DNA, 20 bp, Artificial
  CRISPR gRNA sequence
aaactcagaggtctttttgg

SEQ ID NO: 532709 - DNA, 20 bp, Artificial
  CRISPR gRNA sequence
agaggtctttttggcaagga

SEQ ID NO: 532710 - DNA, 20 bp, Artificial
  CRISPR gRNA sequence
tttggcaaggatgatgacct

SEQ ID NO: 532711 - DNA, 20 bp, Artificial
  CRISPR gRNA sequence
ttggcaaggatgatgacctt

SEQ ID NO: 532712 - DNA, 20 bp, Artificial
  CRISPR gRNA sequence
tggcaaggatgatgaccttt

SEQ ID NO: 532713 - DNA, 20 bp, Artificial
  CRISPR gRNA sequence
ggcaaggatgatgacctttt

SEQ ID NO: 532714 - DNA, 20 bp, Artificial
  CRISPR gRNA sequence
gcaaggatgatgaccttttc

SEQ ID NO: 532715 - DNA, 20 bp, Artificial
  CRISPR gRNA sequence
ttcttttttttctaaacagc

SEQ ID NO: 532716 - DNA, 20 bp, Artificial
  CRISPR gRNA sequence
tcttttttttctaaacagct

SEQ ID NO: 532717 - DNA, 20 bp, Artificial
  CRISPR gRNA sequence
cttttttttctaaacagctt

SEQ ID NO: 532718 - DNA, 20 bp, Artificial
  CRISPR gRNA sequence
ttttttttctaaacagcttc

SEQ ID NO: 532719 - DNA, 20 bp, Artificial
  CRISPR gRNA sequence
ttttttctaaacagcttcat

SEQ ID NO: 532720 - DNA, 20 bp, Artificial
  CRISPR gRNA sequence
tttttctaaacagcttcatt

SEQ ID NO: 532721 - DNA, 20 bp, Artificial
  CRISPR gRNA sequence
ttttctaaacagcttcattg

SEQ ID NO: 532722 - DNA, 20 bp, Artificial
  CRISPR gRNA sequence
tttctaaacagcttcattga

SEQ ID NO: 532723 - DNA, 20 bp, Artificial
  CRISPR gRNA sequence
ttctaaacagcttcattgag

SEQ ID NO: 532724 - DNA, 20 bp, Artificial
  CRISPR gRNA sequence
tctaaacagcttcattgaga

SEQ ID NO: 532725 - DNA, 20 bp, Artificial
  CRISPR gRNA sequence
ctaaacagcttcattgagat

SEQ ID NO: 532726 - DNA, 20 bp, Artificial
  CRISPR gRNA sequence
taaacagcttcattgagata

SEQ ID NO: 532727 - DNA, 20 bp, Artificial
  CRISPR gRNA sequence
aacagcttcattgagataat

SEQ ID NO: 532728 - DNA, 20 bp, Artificial
  CRISPR gRNA sequence
cattgagataattcacctat

SEQ ID NO: 532729 - DNA, 20 bp, Artificial
  CRISPR gRNA sequence
attgagataattcacctatc

SEQ ID NO: 532730 - DNA, 20 bp, Artificial
  CRISPR gRNA sequence
agataattcacctatcattc

SEQ ID NO: 532731 - DNA, 20 bp, Artificial
  CRISPR gRNA sequence
acctatcattcaatttgtcc

SEQ ID NO: 532732 - DNA, 20 bp, Artificial
  CRISPR gRNA sequence
tcattcaatttgtccataca

SEQ ID NO: 532733 - DNA, 20 bp, Artificial
  CRISPR gRNA sequence
aatttgtccatacactaaaa

SEQ ID NO: 532734 - DNA, 20 bp, Artificial
  CRISPR gRNA sequence
gtccatacactaaaacggcc

SEQ ID NO: 532735 - DNA, 20 bp, Artificial
  CRISPR gRNA sequence
tccatacactaaaacggcct

SEQ ID NO: 532736 - DNA, 20 bp, Artificial
  CRISPR gRNA sequence
aaacggcctttagtatattc

SEQ ID NO: 532737 - DNA, 20 bp, Artificial
  CRISPR gRNA sequence
tagtatattcagagttttgc

SEQ ID NO: 532738 - DNA, 20 bp, Artificial
  CRISPR gRNA sequence
agtatattcagagttttgca

SEQ ID NO: 532739 - DNA, 20 bp, Artificial
  CRISPR gRNA sequence
gtatattcagagttttgcaa

SEQ ID NO: 532740 - DNA, 20 bp, Artificial
  CRISPR gRNA sequence
agagttttgcaaccatcacc

SEQ ID NO: 532741 - DNA, 20 bp, Artificial
  CRISPR gRNA sequence
tgcaaccatcaccacaatca

SEQ ID NO: 532742 - DNA, 20 bp, Artificial
  CRISPR gRNA sequence
gcaaccatcaccacaatcat

SEQ ID NO: 532743 - DNA, 20 bp, Artificial
  CRISPR gRNA sequence
caaccatcaccacaatcatg

SEQ ID NO: 532744 - DNA, 20 bp, Artificial
  CRISPR gRNA sequence
ctgtgttgctgttataagta

SEQ ID NO: 532745 - DNA, 20 bp, Artificial
  CRISPR gRNA sequence
tgttgctgttataagtagaa

SEQ ID NO: 532746 - DNA, 20 bp, Artificial
  CRISPR gRNA sequence
ctgttataagtagaaaaaaa

SEQ ID NO: 532747 - DNA, 20 bp, Artificial
  CRISPR gRNA sequence
ttataagtagaaaaaaaata

SEQ ID NO: 532748 - DNA, 20 bp, Artificial
  CRISPR gRNA sequence
taagtagaaaaaaaatattt

SEQ ID NO: 532749 - DNA, 20 bp, Artificial
  CRISPR gRNA sequence
ccattctgaagagacgggca

SEQ ID NO: 532750 - DNA, 20 bp, Artificial
  CRISPR gRNA sequence
cattctgaagagacgggcaa

SEQ ID NO: 532751 - DNA, 20 bp, Artificial
  CRISPR gRNA sequence
tgaagagacgggcaaacttc

SEQ ID NO: 532752 - DNA, 20 bp, Artificial
  CRISPR gRNA sequence
aagagacgggcaaacttcgt

SEQ ID NO: 532753 - DNA, 20 bp, Artificial
  CRISPR gRNA sequence
cgtgacccaacctctagact

SEQ ID NO: 532754 - DNA, 20 bp, Artificial
  CRISPR gRNA sequence
gtgacccaacctctagacta

SEQ ID NO: 532755 - DNA, 20 bp, Artificial
  CRISPR gRNA sequence
tagactatgtactaactctg

SEQ ID NO: 532756 - DNA, 20 bp, Artificial
  CRISPR gRNA sequence
gactatgtactaactctgtt

SEQ ID NO: 532757 - DNA, 20 bp, Artificial
  CRISPR gRNA sequence
tgtactaactctgttgctga

SEQ ID NO: 532758 - DNA, 20 bp, Artificial
  CRISPR gRNA sequence
actctgttgctgaatgttga

SEQ ID NO: 532759 - DNA, 20 bp, Artificial
  CRISPR gRNA sequence
tgttgctgaatgttgataat

SEQ ID NO: 532760 - DNA, 20 bp, Artificial
  CRISPR gRNA sequence
ttgctgaatgttgataattt

SEQ ID NO: 532761 - DNA, 20 bp, Artificial
  CRISPR gRNA sequence
ctgaatgttgataatttcca

SEQ ID NO: 532762 - DNA, 20 bp, Artificial
  CRISPR gRNA sequence
aatgttgataatttccattt

SEQ ID NO: 532763 - DNA, 20 bp, Artificial
  CRISPR gRNA sequence
ataatttccattttcttcct

SEQ ID NO: 532764 - DNA, 20 bp, Artificial
  CRISPR gRNA sequence
ccattttcttccttctcagt

SEQ ID NO: 532765 - DNA, 20 bp, Artificial
  CRISPR gRNA sequence
cattttcttccttctcagta

SEQ ID NO: 532766 - DNA, 20 bp, Artificial
  CRISPR gRNA sequence
tcttccttctcagtaacgca

SEQ ID NO: 532767 - DNA, 20 bp, Artificial
  CRISPR gRNA sequence
cttccttctcagtaacgcag

SEQ ID NO: 532768 - DNA, 20 bp, Artificial
  CRISPR gRNA sequence
ttccttctcagtaacgcaga

SEQ ID NO: 532769 - DNA, 20 bp, Artificial
  CRISPR gRNA sequence
ccttctcagtaacgcagaat

SEQ ID NO: 532770 - DNA, 20 bp, Artificial
  CRISPR gRNA sequence
cttctcagtaacgcagaatc

SEQ ID NO: 532771 - DNA, 20 bp, Artificial
  CRISPR gRNA sequence
ctcagtaacgcagaatcttg

SEQ ID NO: 532772 - DNA, 20 bp, Artificial
  CRISPR gRNA sequence
tcagtaacgcagaatcttgg

SEQ ID NO: 532773 - DNA, 20 bp, Artificial
  CRISPR gRNA sequence
agtaacgcagaatcttggga

SEQ ID NO: 532774 - DNA, 20 bp, Artificial
  CRISPR gRNA sequence
gggatgagaagaaaactttt

SEQ ID NO: 532775 - DNA, 20 bp, Artificial
  CRISPR gRNA sequence
ggatgagaagaaaactttta

SEQ ID NO: 532776 - DNA, 20 bp, Artificial
  CRISPR gRNA sequence
ttaatttaatttctgcatgc

SEQ ID NO: 532777 - DNA, 20 bp, Artificial
  CRISPR gRNA sequence
taatttaatttctgcatgcc

SEQ ID NO: 532778 - DNA, 20 bp, Artificial
  CRISPR gRNA sequence
aatttaatttctgcatgcct

SEQ ID NO: 532779 - DNA, 20 bp, Artificial
  CRISPR gRNA sequence
atttaatttctgcatgccta

SEQ ID NO: 532780 - DNA, 20 bp, Artificial
  CRISPR gRNA sequence
aatttctgcatgcctatata

SEQ ID NO: 532781 - DNA, 20 bp, Artificial
  CRISPR gRNA sequence
atttctgcatgcctatatat

SEQ ID NO: 532782 - DNA, 20 bp, Artificial
  CRISPR gRNA sequence
ctgcatgcctatatatatcg

SEQ ID NO: 532783 - DNA, 20 bp, Artificial
  CRISPR gRNA sequence
tgcatgcctatatatatcgg

SEQ ID NO: 532784 - DNA, 20 bp, Artificial
  CRISPR gRNA sequence
catgcctatatatatcggga

SEQ ID NO: 532785 - DNA, 20 bp, Artificial
  CRISPR gRNA sequence
tatatatcgggacataaatg

SEQ ID NO: 532786 - DNA, 20 bp, Artificial
  CRISPR gRNA sequence
gactatggtgttccatgggg

SEQ ID NO: 532787 - DNA, 20 bp, Artificial
  CRISPR gRNA sequence
actatggtgttccatgggga

SEQ ID NO: 532788 - DNA, 20 bp, Artificial
  CRISPR gRNA sequence
tggtgttccatggggaaaat

SEQ ID NO: 532789 - DNA, 20 bp, Artificial
  CRISPR gRNA sequence
catggggaaaatattggtgt

SEQ ID NO: 532790 - DNA, 20 bp, Artificial
  CRISPR gRNA sequence
gtgtctggaagtcagagtgg

SEQ ID NO: 532791 - DNA, 20 bp, Artificial
  CRISPR gRNA sequence
gaagtcagagtgggagggaa

SEQ ID NO: 532792 - DNA, 20 bp, Artificial
  CRISPR gRNA sequence
aaaaataagctagtccatct

SEQ ID NO: 532793 - DNA, 20 bp, Artificial
  CRISPR gRNA sequence
gtccatctatattatgaatg

SEQ ID NO: 532794 - DNA, 20 bp, Artificial
  CRISPR gRNA sequence
tattatgaatggagagaaac

SEQ ID NO: 532795 - DNA, 20 bp, Artificial
  CRISPR gRNA sequence
tgaatggagagaaactgaga

SEQ ID NO: 532796 - DNA, 20 bp, Artificial
  CRISPR gRNA sequence
agagggaaaagtggcaagtc

SEQ ID NO: 532797 - DNA, 20 bp, Artificial
  CRISPR gRNA sequence
gggggaacaaagtaaagaat

SEQ ID NO: 532798 - DNA, 20 bp, Artificial
  CRISPR gRNA sequence
acacagctaggaagtgatgg

SEQ ID NO: 532799 - DNA, 20 bp, Artificial
  CRISPR gRNA sequence
ggaagtgatggggctaagat

SEQ ID NO: 532800 - DNA, 20 bp, Artificial
  CRISPR gRNA sequence
agatgtagacctgagccatc

SEQ ID NO: 532801 - DNA, 20 bp, Artificial
  CRISPR gRNA sequence
agccatctaatgctaggcct

SEQ ID NO: 532802 - DNA, 20 bp, Artificial
  CRISPR gRNA sequence
atgctaggcctaggcatttt

SEQ ID NO: 532803 - DNA, 20 bp, Artificial
  CRISPR gRNA sequence
ggcctaggcattttcctttt

SEQ ID NO: 532804 - DNA, 20 bp, Artificial
  CRISPR gRNA sequence
ggcattttccttttgtggtg

SEQ ID NO: 532805 - DNA, 20 bp, Artificial
  CRISPR gRNA sequence
tccttttgtggtgcaatctc

SEQ ID NO: 532806 - DNA, 20 bp, Artificial
  CRISPR gRNA sequence
ccttttgtggtgcaatctct

SEQ ID NO: 532807 - DNA, 20 bp, Artificial
  CRISPR gRNA sequence
cttttgtggtgcaatctctg

SEQ ID NO: 532808 - DNA, 20 bp, Artificial
  CRISPR gRNA sequence
ttgtggtgcaatctctgtgc

SEQ ID NO: 532809 - DNA, 20 bp, Artificial
  CRISPR gRNA sequence
tgtggtgcaatctctgtgcg

SEQ ID NO: 532810 - DNA, 20 bp, Artificial
  CRISPR gRNA sequence
gtggtgcaatctctgtgcgg

SEQ ID NO: 532811 - DNA, 20 bp, Artificial
  CRISPR gRNA sequence
tggtgcaatctctgtgcggg

SEQ ID NO: 532812 - DNA, 20 bp, Artificial
  CRISPR gRNA sequence
tgtgcgggagaggcaagagg

SEQ ID NO: 532813 - DNA, 20 bp, Artificial
  CRISPR gRNA sequence
tgcgggagaggcaagaggtt

SEQ ID NO: 532814 - DNA, 20 bp, Artificial
  CRISPR gRNA sequence
gtgattatcgaatgcatgaa

SEQ ID NO: 532815 - DNA, 20 bp, Artificial
  CRISPR gRNA sequence
tgattatcgaatgcatgaat

SEQ ID NO: 532816 - DNA, 20 bp, Artificial
  CRISPR gRNA sequence
tcgaatgcatgaattaccac

SEQ ID NO: 532817 - DNA, 20 bp, Artificial
  CRISPR gRNA sequence
ccactaataatgtcagtgcc

SEQ ID NO: 532818 - DNA, 20 bp, Artificial
  CRISPR gRNA sequence
ataatgtcagtgcctaacga

SEQ ID NO: 532819 - DNA, 20 bp, Artificial
  CRISPR gRNA sequence
acgatctgcccagggctttg

SEQ ID NO: 532820 - DNA, 20 bp, Artificial
  CRISPR gRNA sequence
cccagggctttgccacatgt

SEQ ID NO: 532821 - DNA, 20 bp, Artificial
  CRISPR gRNA sequence
tgccacatgttgctcctttt

SEQ ID NO: 532822 - DNA, 20 bp, Artificial
  CRISPR gRNA sequence
gccacatgttgctccttttg

SEQ ID NO: 532823 - DNA, 20 bp, Artificial
  CRISPR gRNA sequence
ccacatgttgctccttttgt

SEQ ID NO: 532824 - DNA, 20 bp, Artificial
  CRISPR gRNA sequence
ctccttttgtgacaggtagg

SEQ ID NO: 532825 - DNA, 20 bp, Artificial
  CRISPR gRNA sequence
cttttgtgacaggtagggta

SEQ ID NO: 532826 - DNA, 20 bp, Artificial
  CRISPR gRNA sequence
ttgtgacaggtagggtatgt

SEQ ID NO: 532827 - DNA, 20 bp, Artificial
  CRISPR gRNA sequence
tgtgacaggtagggtatgtt

SEQ ID NO: 532828 - DNA, 20 bp, Artificial
  CRISPR gRNA sequence
gtgacaggtagggtatgttt

SEQ ID NO: 532829 - DNA, 20 bp, Artificial
  CRISPR gRNA sequence
tgacaggtagggtatgtttt

SEQ ID NO: 532830 - DNA, 20 bp, Artificial
  CRISPR gRNA sequence
ttctgatccttttctgatgc

SEQ ID NO: 532831 - DNA, 20 bp, Artificial
  CRISPR gRNA sequence
tctgatccttttctgatgct

SEQ ID NO: 532832 - DNA, 20 bp, Artificial
  CRISPR gRNA sequence
ctgatccttttctgatgctc

SEQ ID NO: 532833 - DNA, 20 bp, Artificial
  CRISPR gRNA sequence
tgatccttttctgatgctct

SEQ ID NO: 532834 - DNA, 20 bp, Artificial
  CRISPR gRNA sequence
atccttttctgatgctctga

SEQ ID NO: 532835 - DNA, 20 bp, Artificial
  CRISPR gRNA sequence
ttctgatgctctgaggaggg

SEQ ID NO: 532836 - DNA, 20 bp, Artificial
  CRISPR gRNA sequence
tctgatgctctgaggagggc

SEQ ID NO: 532837 - DNA, 20 bp, Artificial
  CRISPR gRNA sequence
ctgatgctctgaggagggcc

SEQ ID NO: 532838 - DNA, 20 bp, Artificial
  CRISPR gRNA sequence
tgatgctctgaggagggcca

SEQ ID NO: 532839 - DNA, 20 bp, Artificial
  CRISPR gRNA sequence
atgctctgaggagggccagc

SEQ ID NO: 532840 - DNA, 20 bp, Artificial
  CRISPR gRNA sequence
tgaggagggccagcgtagac

SEQ ID NO: 532841 - DNA, 20 bp, Artificial
  CRISPR gRNA sequence
aggagggccagcgtagaccc

SEQ ID NO: 532842 - DNA, 20 bp, Artificial
  CRISPR gRNA sequence
tgagcaactgagcagctctg

SEQ ID NO: 532843 - DNA, 20 bp, Artificial
  CRISPR gRNA sequence
agcagctctgggctgggaaa

SEQ ID NO: 532844 - DNA, 20 bp, Artificial
  CRISPR gRNA sequence
tgggctgggaaaaggcagaa

SEQ ID NO: 532845 - DNA, 20 bp, Artificial
  CRISPR gRNA sequence
ggctgggaaaaggcagaatc

SEQ ID NO: 532846 - DNA, 20 bp, Artificial
  CRISPR gRNA sequence
ggaaaaggcagaatcaagtc

SEQ ID NO: 532847 - DNA, 20 bp, Artificial
  CRISPR gRNA sequence
tggttcccaggcaggtgctc

SEQ ID NO: 532848 - DNA, 20 bp, Artificial
  CRISPR gRNA sequence
gttcccaggcaggtgctctt

SEQ ID NO: 532849 - DNA, 20 bp, Artificial
  CRISPR gRNA sequence
ccaggcaggtgctctttttc

SEQ ID NO: 532850 - DNA, 20 bp, Artificial
  CRISPR gRNA sequence
tttttccctagagctttgag

SEQ ID NO: 532851 - DNA, 20 bp, Artificial
  CRISPR gRNA sequence
tttccctagagctttgagct

SEQ ID NO: 532852 - DNA, 20 bp, Artificial
  CRISPR gRNA sequence
ttccctagagctttgagctc

SEQ ID NO: 532853 - DNA, 20 bp, Artificial
  CRISPR gRNA sequence
tccctagagctttgagctcc

SEQ ID NO: 532854 - DNA, 20 bp, Artificial
  CRISPR gRNA sequence
ccctagagctttgagctcct

SEQ ID NO: 532855 - DNA, 20 bp, Artificial
  CRISPR gRNA sequence
cctagagctttgagctcctt

SEQ ID NO: 532856 - DNA, 20 bp, Artificial
  CRISPR gRNA sequence
gagctttgagctccttggac

SEQ ID NO: 532857 - DNA, 20 bp, Artificial
  CRISPR gRNA sequence
tgagctccttggacacccac

SEQ ID NO: 532858 - DNA, 20 bp, Artificial
  CRISPR gRNA sequence
gagctccttggacacccaca

SEQ ID NO: 532859 - DNA, 20 bp, Artificial
  CRISPR gRNA sequence
agctccttggacacccacac

SEQ ID NO: 532860 - DNA, 20 bp, Artificial
  CRISPR gRNA sequence
cttggacacccacacactca

SEQ ID NO: 532861 - DNA, 20 bp, Artificial
  CRISPR gRNA sequence
ggacacccacacactcacat

SEQ ID NO: 532862 - DNA, 20 bp, Artificial
  CRISPR gRNA sequence
gacacccacacactcacata

SEQ ID NO: 532863 - DNA, 20 bp, Artificial
  CRISPR gRNA sequence
acatatacccacctggccca

SEQ ID NO: 532864 - DNA, 20 bp, Artificial
  CRISPR gRNA sequence
gcccactgctccaggaactt

SEQ ID NO: 532865 - DNA, 20 bp, Artificial
  CRISPR gRNA sequence
ctccaggaacttggtggggg

SEQ ID NO: 532866 - DNA, 20 bp, Artificial
  CRISPR gRNA sequence
caggaacttggtgggggcag

SEQ ID NO: 532867 - DNA, 20 bp, Artificial
  CRISPR gRNA sequence
ggtgggggcagaggtatcca

SEQ ID NO: 532868 - DNA, 20 bp, Artificial
  CRISPR gRNA sequence
gtgggggcagaggtatccaa

SEQ ID NO: 532869 - DNA, 20 bp, Artificial
  CRISPR gRNA sequence
ctccaggatggggttcctgg

SEQ ID NO: 532870 - DNA, 20 bp, Artificial
  CRISPR gRNA sequence
caggatggggttcctggctg

SEQ ID NO: 532871 - DNA, 20 bp, Artificial
  CRISPR gRNA sequence
ctggctgctgttaaagcatt

SEQ ID NO: 532872 - DNA, 20 bp, Artificial
  CRISPR gRNA sequence
gctgctgttaaagcattgcc

SEQ ID NO: 532873 - DNA, 20 bp, Artificial
  CRISPR gRNA sequence
ctgttaaagcattgcctttc

SEQ ID NO: 532874 - DNA, 20 bp, Artificial
  CRISPR gRNA sequence
ttaaagcattgcctttctca

SEQ ID NO: 532875 - DNA, 20 bp, Artificial
  CRISPR gRNA sequence
aagcattgcctttctcaaac

SEQ ID NO: 532876 - DNA, 20 bp, Artificial
  CRISPR gRNA sequence
cctttctcaaactctggagg

SEQ ID NO: 532877 - DNA, 20 bp, Artificial
  CRISPR gRNA sequence
tctcaaactctggaggcact

SEQ ID NO: 532878 - DNA, 20 bp, Artificial
  CRISPR gRNA sequence
ctcaaactctggaggcactt

SEQ ID NO: 532879 - DNA, 20 bp, Artificial
  CRISPR gRNA sequence
tcaaactctggaggcacttt

SEQ ID NO: 532880 - DNA, 20 bp, Artificial
  CRISPR gRNA sequence
aaactctggaggcactttct

SEQ ID NO: 532881 - DNA, 20 bp, Artificial
  CRISPR gRNA sequence
tggaggcactttcttaccca

SEQ ID NO: 532882 - DNA, 20 bp, Artificial
  CRISPR gRNA sequence
gaggcactttcttacccata

SEQ ID NO: 532883 - DNA, 20 bp, Artificial
  CRISPR gRNA sequence
tcttacccatactcctaaac

SEQ ID NO: 532884 - DNA, 20 bp, Artificial
  CRISPR gRNA sequence
cttacccatactcctaaacc

SEQ ID NO: 532885 - DNA, 20 bp, Artificial
  CRISPR gRNA sequence
ttacccatactcctaaaccc

SEQ ID NO: 532886 - DNA, 20 bp, Artificial
  CRISPR gRNA sequence
acccatactcctaaaccctg

SEQ ID NO: 532887 - DNA, 20 bp, Artificial
  CRISPR gRNA sequence
cccatactcctaaaccctga

SEQ ID NO: 532888 - DNA, 20 bp, Artificial
  CRISPR gRNA sequence
ctaaaccctgactgccatgt

SEQ ID NO: 532889 - DNA, 20 bp, Artificial
  CRISPR gRNA sequence
aaccctgactgccatgtttt

SEQ ID NO: 532890 - DNA, 20 bp, Artificial
  CRISPR gRNA sequence
actgccatgttttaggtggt

SEQ ID NO: 532891 - DNA, 20 bp, Artificial
  CRISPR gRNA sequence
ccatgttttaggtggtgccc

SEQ ID NO: 532892 - DNA, 20 bp, Artificial
  CRISPR gRNA sequence
taggtggtgccccaagacca

SEQ ID NO: 532893 - DNA, 20 bp, Artificial
  CRISPR gRNA sequence
aggtggtgccccaagaccac

SEQ ID NO: 532894 - DNA, 20 bp, Artificial
  CRISPR gRNA sequence
ggtggtgccccaagaccacc

SEQ ID NO: 532895 - DNA, 20 bp, Artificial
  CRISPR gRNA sequence
ctggacctctcagagccttg

SEQ ID NO: 532896 - DNA, 20 bp, Artificial
  CRISPR gRNA sequence
gacctctcagagccttgaac

SEQ ID NO: 532897 - DNA, 20 bp, Artificial
  CRISPR gRNA sequence
tcagagccttgaacattttg

SEQ ID NO: 532898 - DNA, 20 bp, Artificial
  CRISPR gRNA sequence
agagccttgaacattttgtc

SEQ ID NO: 532899 - DNA, 20 bp, Artificial
  CRISPR gRNA sequence
gaacattttgtctgtaaatg

SEQ ID NO: 532900 - DNA, 20 bp, Artificial
  CRISPR gRNA sequence
aacattttgtctgtaaatgg

SEQ ID NO: 532901 - DNA, 20 bp, Artificial
  CRISPR gRNA sequence
tgtctgtaaatgggaagaaa

SEQ ID NO: 532902 - DNA, 20 bp, Artificial
  CRISPR gRNA sequence
gtctgtaaatgggaagaaaa

SEQ ID NO: 532903 - DNA, 20 bp, Artificial
  CRISPR gRNA sequence
tctgtaaatgggaagaaaaa

SEQ ID NO: 532904 - DNA, 20 bp, Artificial
  CRISPR gRNA sequence
taaatgggaagaaaaacatc

SEQ ID NO: 532905 - DNA, 20 bp, Artificial
  CRISPR gRNA sequence
tctgttagggttaagtgatg

SEQ ID NO: 532906 - DNA, 20 bp, Artificial
  CRISPR gRNA sequence
ttagggttaagtgatgtcat

SEQ ID NO: 532907 - DNA, 20 bp, Artificial
  CRISPR gRNA sequence
gggttaagtgatgtcatata

SEQ ID NO: 532908 - DNA, 20 bp, Artificial
  CRISPR gRNA sequence
agtgatgtcatatatgtgaa

SEQ ID NO: 532909 - DNA, 20 bp, Artificial
  CRISPR gRNA sequence
taaggtataagacagcatat

SEQ ID NO: 532910 - DNA, 20 bp, Artificial
  CRISPR gRNA sequence
aaggtataagacagcatata

SEQ ID NO: 532911 - DNA, 20 bp, Artificial
  CRISPR gRNA sequence
aggtataagacagcatataa

SEQ ID NO: 532912 - DNA, 20 bp, Artificial
  CRISPR gRNA sequence
catatgatacactatttagt

SEQ ID NO: 532913 - DNA, 20 bp, Artificial
  CRISPR gRNA sequence
tttagtggcataatgtatct

SEQ ID NO: 532914 - DNA, 20 bp, Artificial
  CRISPR gRNA sequence
agtggcataatgtatctgtg

SEQ ID NO: 532915 - DNA, 20 bp, Artificial
  CRISPR gRNA sequence
gtggcataatgtatctgtga

SEQ ID NO: 532916 - DNA, 20 bp, Artificial
  CRISPR gRNA sequence
tgaatgtcatcagaaataat

SEQ ID NO: 532917 - DNA, 20 bp, Artificial
  CRISPR gRNA sequence
ttttctgaatgctctttgta

SEQ ID NO: 532918 - DNA, 20 bp, Artificial
  CRISPR gRNA sequence
tttctgaatgctctttgtaa

SEQ ID NO: 532919 - DNA, 20 bp, Artificial
  CRISPR gRNA sequence
ttctgaatgctctttgtaaa

SEQ ID NO: 532920 - DNA, 20 bp, Artificial
  CRISPR gRNA sequence
tctgaatgctctttgtaaat

SEQ ID NO: 532921 - DNA, 20 bp, Artificial
  CRISPR gRNA sequence
ctgaatgctctttgtaaata

SEQ ID NO: 532922 - DNA, 20 bp, Artificial
  CRISPR gRNA sequence
tgaatgctctttgtaaataa

SEQ ID NO: 532923 - DNA, 20 bp, Artificial
  CRISPR gRNA sequence
aatgctctttgtaaataaaa

SEQ ID NO: 532924 - DNA, 20 bp, Artificial
  CRISPR gRNA sequence
tttgtaaataaaataaaata

SEQ ID NO: 532925 - DNA, 20 bp, Artificial
  CRISPR gRNA sequence
tgtaaataaaataaaataaa

SEQ ID NO: 532926 - DNA, 20 bp, Artificial
  CRISPR gRNA sequence
gtaaataaaataaaataaaa

SEQ ID NO: 532927 - DNA, 20 bp, Artificial
  CRISPR gRNA sequence
taaataaaataaaataaaat

SEQ ID NO: 532928 - DNA, 20 bp, Artificial
  CRISPR gRNA sequence
ccaaaagttgctagaggtct

SEQ ID NO: 532929 - DNA, 20 bp, Artificial
  CRISPR gRNA sequence
caaaagttgctagaggtctt

SEQ ID NO: 532930 - DNA, 20 bp, Artificial
  CRISPR gRNA sequence
ctagaggtctttgacattgt

SEQ ID NO: 532931 - DNA, 20 bp, Artificial
  CRISPR gRNA sequence
gaggtctttgacattgttcc

SEQ ID NO: 532932 - DNA, 20 bp, Artificial
  CRISPR gRNA sequence
tgacattgttcccttgtccc

SEQ ID NO: 532933 - DNA, 20 bp, Artificial
  CRISPR gRNA sequence
gacattgttcccttgtccct

SEQ ID NO: 532934 - DNA, 20 bp, Artificial
  CRISPR gRNA sequence
acattgttcccttgtcccta

SEQ ID NO: 532935 - DNA, 20 bp, Artificial
  CRISPR gRNA sequence
ttcccttgtccctaactgac

SEQ ID NO: 532936 - DNA, 20 bp, Artificial
  CRISPR gRNA sequence
ccttgtccctaactgactcc

SEQ ID NO: 532937 - DNA, 20 bp, Artificial
  CRISPR gRNA sequence
gtccctaactgactccatcc

SEQ ID NO: 532938 - DNA, 20 bp, Artificial
  CRISPR gRNA sequence
tccctaactgactccatccc

SEQ ID NO: 532939 - DNA, 20 bp, Artificial
  CRISPR gRNA sequence
actgactccatcccccactg

SEQ ID NO: 532940 - DNA, 20 bp, Artificial
  CRISPR gRNA sequence
actccatcccccactgtata

SEQ ID NO: 532941 - DNA, 20 bp, Artificial
  CRISPR gRNA sequence
catcccccactgtataaata

SEQ ID NO: 532942 - DNA, 20 bp, Artificial
  CRISPR gRNA sequence
tataaatagatatgtttatt

SEQ ID NO: 532943 - DNA, 20 bp, Artificial
  CRISPR gRNA sequence
attaaaatcagaaaattgcc

SEQ ID NO: 532944 - DNA, 20 bp, Artificial
  CRISPR gRNA sequence
ttaaaatcagaaaattgcct

SEQ ID NO: 532945 - DNA, 20 bp, Artificial
  CRISPR gRNA sequence
aaatcagaaaattgcctaaa

SEQ ID NO: 532946 - DNA, 20 bp, Artificial
  CRISPR gRNA sequence
cctaaattgaactgaatctt

SEQ ID NO: 532947 - DNA, 20 bp, Artificial
  CRISPR gRNA sequence
aattgaactgaatctttact

SEQ ID NO: 532948 - DNA, 20 bp, Artificial
  CRISPR gRNA sequence
aactgaatctttactttctt

SEQ ID NO: 532949 - DNA, 20 bp, Artificial
  CRISPR gRNA sequence
aatctttactttctttttag

SEQ ID NO: 532950 - DNA, 20 bp, Artificial
  CRISPR gRNA sequence
tactttctttttagagaggg

SEQ ID NO: 532951 - DNA, 20 bp, Artificial
  CRISPR gRNA sequence
actttctttttagagagggt

SEQ ID NO: 532952 - DNA, 20 bp, Artificial
  CRISPR gRNA sequence
ctttctttttagagagggtc

SEQ ID NO: 532953 - DNA, 20 bp, Artificial
  CRISPR gRNA sequence
tctttttagagagggtctca

SEQ ID NO: 532954 - DNA, 20 bp, Artificial
  CRISPR gRNA sequence
ctttttagagagggtctcaa

SEQ ID NO: 532955 - DNA, 20 bp, Artificial
  CRISPR gRNA sequence
tttttagagagggtctcaaa

SEQ ID NO: 532956 - DNA, 20 bp, Artificial
  CRISPR gRNA sequence
tttagagagggtctcaaaac

SEQ ID NO: 532957 - DNA, 20 bp, Artificial
  CRISPR gRNA sequence
ttagagagggtctcaaaacc

SEQ ID NO: 532958 - DNA, 20 bp, Artificial
  CRISPR gRNA sequence
tagagagggtctcaaaacca

SEQ ID NO: 532959 - DNA, 20 bp, Artificial
  CRISPR gRNA sequence
agagagggtctcaaaaccaa

SEQ ID NO: 532960 - DNA, 20 bp, Artificial
  CRISPR gRNA sequence
gagagggtctcaaaaccaaa

SEQ ID NO: 532961 - DNA, 20 bp, Artificial
  CRISPR gRNA sequence
aaaaccaaagatctcctgga

SEQ ID NO: 532962 - DNA, 20 bp, Artificial
  CRISPR gRNA sequence
ctggacttgtatcaacacaa

SEQ ID NO: 532963 - DNA, 20 bp, Artificial
  CRISPR gRNA sequence
gacttgtatcaacacaaccc

SEQ ID NO: 532964 - DNA, 20 bp, Artificial
  CRISPR gRNA sequence
gtatcaacacaaccctgacc

SEQ ID NO: 532965 - DNA, 20 bp, Artificial
  CRISPR gRNA sequence
tatcaacacaaccctgacct

SEQ ID NO: 532966 - DNA, 20 bp, Artificial
  CRISPR gRNA sequence
acctgtgaggtaatgaatgg

SEQ ID NO: 532967 - DNA, 20 bp, Artificial
  CRISPR gRNA sequence
tgaggtaatgaatggaactg

SEQ ID NO: 532968 - DNA, 20 bp, Artificial
  CRISPR gRNA sequence
accccgaattaaacctgtat

SEQ ID NO: 532969 - DNA, 20 bp, Artificial
  CRISPR gRNA sequence
aacctgtatcaagatgggaa

SEQ ID NO: 532970 - DNA, 20 bp, Artificial
  CRISPR gRNA sequence
tatcaagatgggaaacatct

SEQ ID NO: 532971 - DNA, 20 bp, Artificial
  CRISPR gRNA sequence
aaactttctcagagggtcat

SEQ ID NO: 532972 - DNA, 20 bp, Artificial
  CRISPR gRNA sequence
tctcagagggtcatcacaca

SEQ ID NO: 532973 - DNA, 20 bp, Artificial
  CRISPR gRNA sequence
ctcagagggtcatcacacac

SEQ ID NO: 532974 - DNA, 20 bp, Artificial
  CRISPR gRNA sequence
tcagagggtcatcacacaca

SEQ ID NO: 532975 - DNA, 20 bp, Artificial
  CRISPR gRNA sequence
agagggtcatcacacacaag

SEQ ID NO: 532976 - DNA, 20 bp, Artificial
  CRISPR gRNA sequence
agtgcaaaattcaagtgcac

SEQ ID NO: 532977 - DNA, 20 bp, Artificial
  CRISPR gRNA sequence
aagtgcacagcagggaacaa

SEQ ID NO: 532978 - DNA, 20 bp, Artificial
  CRISPR gRNA sequence
tcagctgtccaggtgcgtgg

SEQ ID NO: 532979 - DNA, 20 bp, Artificial
  CRISPR gRNA sequence
tccaggtgcgtggcgggcat

SEQ ID NO: 532980 - DNA, 20 bp, Artificial
  CRISPR gRNA sequence
cacaaacacagcctgccagg

SEQ ID NO: 532981 - DNA, 20 bp, Artificial
  CRISPR gRNA sequence
acaaacacagcctgccaggc

SEQ ID NO: 532982 - DNA, 20 bp, Artificial
  CRISPR gRNA sequence
ccaggccctcagtaggcaga

SEQ ID NO: 532983 - DNA, 20 bp, Artificial
  CRISPR gRNA sequence
agtaggcagaggcatgctgc

SEQ ID NO: 532984 - DNA, 20 bp, Artificial
  CRISPR gRNA sequence
ctccaggtcacaggtgctca

SEQ ID NO: 532985 - DNA, 20 bp, Artificial
  CRISPR gRNA sequence
caggtcacaggtgctcatgc

SEQ ID NO: 532986 - DNA, 20 bp, Artificial
  CRISPR gRNA sequence
atgctgggaggcagccctgg

SEQ ID NO: 532987 - DNA, 20 bp, Artificial
  CRISPR gRNA sequence
ggaggcagccctggctcagg

SEQ ID NO: 532988 - DNA, 20 bp, Artificial
  CRISPR gRNA sequence
gctcaggatgaggcatgaaa

SEQ ID NO: 532989 - DNA, 20 bp, Artificial
  CRISPR gRNA sequence
aggatgaggcatgaaagcat

SEQ ID NO: 532990 - DNA, 20 bp, Artificial
  CRISPR gRNA sequence
ttcctcctggaaaccttcaa

SEQ ID NO: 532991 - DNA, 20 bp, Artificial
  CRISPR gRNA sequence
cctcctggaaaccttcaagg

SEQ ID NO: 532992 - DNA, 20 bp, Artificial
  CRISPR gRNA sequence
ctcctggaaaccttcaaggg

SEQ ID NO: 532993 - DNA, 20 bp, Artificial
  CRISPR gRNA sequence
ctggaaaccttcaagggaag

SEQ ID NO: 532994 - DNA, 20 bp, Artificial
  CRISPR gRNA sequence
gaaaccttcaagggaagcat

SEQ ID NO: 532995 - DNA, 20 bp, Artificial
  CRISPR gRNA sequence
caagggaagcatcaggggag

SEQ ID NO: 532996 - DNA, 20 bp, Artificial
  CRISPR gRNA sequence
aagggaagcatcaggggagg

SEQ ID NO: 532997 - DNA, 20 bp, Artificial
  CRISPR gRNA sequence
tatggttttccatcctggga

SEQ ID NO: 532998 - DNA, 20 bp, Artificial
  CRISPR gRNA sequence
tggttttccatcctgggagt

SEQ ID NO: 532999 - DNA, 20 bp, Artificial
  CRISPR gRNA sequence
tccatcctgggagtcctccc

SEQ ID NO: 533000 - DNA, 20 bp, Artificial
  CRISPR gRNA sequence
ccatcctgggagtcctccca

SEQ ID NO: 533001 - DNA, 20 bp, Artificial
  CRISPR gRNA sequence
catcctgggagtcctcccac

SEQ ID NO: 533002 - DNA, 20 bp, Artificial
  CRISPR gRNA sequence
ggagtcctcccactgagcac

SEQ ID NO: 533003 - DNA, 20 bp, Artificial
  CRISPR gRNA sequence
ccactgagcacaatttgacc

SEQ ID NO: 533004 - DNA, 20 bp, Artificial
  CRISPR gRNA sequence
agcacaatttgaccacaaga

SEQ ID NO: 533005 - DNA, 20 bp, Artificial
  CRISPR gRNA sequence
gaccacaagaaattttaaag

SEQ ID NO: 533006 - DNA, 20 bp, Artificial
  CRISPR gRNA sequence
accacaagaaattttaaaga

SEQ ID NO: 533007 - DNA, 20 bp, Artificial
  CRISPR gRNA sequence
taaagatcctcttctaggag

SEQ ID NO: 533008 - DNA, 20 bp, Artificial
  CRISPR gRNA sequence
aaagatcctcttctaggaga

SEQ ID NO: 533009 - DNA, 20 bp, Artificial
  CRISPR gRNA sequence
aagatcctcttctaggagaa

SEQ ID NO: 533010 - DNA, 20 bp, Artificial
  CRISPR gRNA sequence
ttctaggagaaagaattgca

SEQ ID NO: 533011 - DNA, 20 bp, Artificial
  CRISPR gRNA sequence
ctaggagaaagaattgcaaa

SEQ ID NO: 533012 - DNA, 20 bp, Artificial
  CRISPR gRNA sequence
taggagaaagaattgcaaaa

SEQ ID NO: 533013 - DNA, 20 bp, Artificial
  CRISPR gRNA sequence
ggagaaagaattgcaaaact

SEQ ID NO: 533014 - DNA, 20 bp, Artificial
  CRISPR gRNA sequence
caaaactgaagaaggaggag

SEQ ID NO: 533015 - DNA, 20 bp, Artificial
  CRISPR gRNA sequence
aagaaggaggagctgtagag

SEQ ID NO: 533016 - DNA, 20 bp, Artificial
  CRISPR gRNA sequence
tagagagtatctcatgcaaa

SEQ ID NO: 533017 - DNA, 20 bp, Artificial
  CRISPR gRNA sequence
atgcaaagccccattttcca

SEQ ID NO: 533018 - DNA, 20 bp, Artificial
  CRISPR gRNA sequence
tccagagagggaaactgact

SEQ ID NO: 533019 - DNA, 20 bp, Artificial
  CRISPR gRNA sequence
ccagagagggaaactgactt

SEQ ID NO: 533020 - DNA, 20 bp, Artificial
  CRISPR gRNA sequence
cagagagggaaactgacttg

SEQ ID NO: 533021 - DNA, 20 bp, Artificial
  CRISPR gRNA sequence
acttgcccaaggtcccttgg

SEQ ID NO: 533022 - DNA, 20 bp, Artificial
  CRISPR gRNA sequence
gcccaaggtcccttggctag

SEQ ID NO: 533023 - DNA, 20 bp, Artificial
  CRISPR gRNA sequence
cccaaggtcccttggctagt

SEQ ID NO: 533024 - DNA, 20 bp, Artificial
  CRISPR gRNA sequence
ggctagttagtgacatgatt

SEQ ID NO: 533025 - DNA, 20 bp, Artificial
  CRISPR gRNA sequence
gctagttagtgacatgattc

SEQ ID NO: 533026 - DNA, 20 bp, Artificial
  CRISPR gRNA sequence
gttagtgacatgattccaac

SEQ ID NO: 533027 - DNA, 20 bp, Artificial
  CRISPR gRNA sequence
gtgacatgattccaactgct

SEQ ID NO: 533028 - DNA, 20 bp, Artificial
  CRISPR gRNA sequence
caactgctcccctaaagatg

SEQ ID NO: 533029 - DNA, 20 bp, Artificial
  CRISPR gRNA sequence
ctcccctaaagatggttagt

SEQ ID NO: 533030 - DNA, 20 bp, Artificial
  CRISPR gRNA sequence
ccctaaagatggttagtggt

SEQ ID NO: 533031 - DNA, 20 bp, Artificial
  CRISPR gRNA sequence
aagatggttagtggtcagca

SEQ ID NO: 533032 - DNA, 20 bp, Artificial
  CRISPR gRNA sequence
gtggtcagcacctcccatca

SEQ ID NO: 533033 - DNA, 20 bp, Artificial
  CRISPR gRNA sequence
ccatcaggagtaaaggtaga

SEQ ID NO: 533034 - DNA, 20 bp, Artificial
  CRISPR gRNA sequence
cagaaaccctggggggcagg

SEQ ID NO: 533035 - DNA, 20 bp, Artificial
  CRISPR gRNA sequence
gggggcagggtcatggggga

SEQ ID NO: 533036 - DNA, 20 bp, Artificial
  CRISPR gRNA sequence
gaggccaaagaggactgtgg

SEQ ID NO: 533037 - DNA, 20 bp, Artificial
  CRISPR gRNA sequence
aggccaaagaggactgtgga

SEQ ID NO: 533038 - DNA, 20 bp, Artificial
  CRISPR gRNA sequence
tggacagcaaggcaacactc

SEQ ID NO: 533039 - DNA, 20 bp, Artificial
  CRISPR gRNA sequence
ctggcacacaacaggacggc

SEQ ID NO: 533040 - DNA, 20 bp, Artificial
  CRISPR gRNA sequence
gcacacaacaggacggcaag

SEQ ID NO: 533041 - DNA, 20 bp, Artificial
  CRISPR gRNA sequence
ggggactagctccagaaaat

SEQ ID NO: 533042 - DNA, 20 bp, Artificial
  CRISPR gRNA sequence
gggactagctccagaaaatc

SEQ ID NO: 533043 - DNA, 20 bp, Artificial
  CRISPR gRNA sequence
gctccagaaaatctcaaaac

SEQ ID NO: 533044 - DNA, 20 bp, Artificial
  CRISPR gRNA sequence
cagaaaatctcaaaactcca

SEQ ID NO: 533045 - DNA, 20 bp, Artificial
  CRISPR gRNA sequence
aaaactccaagaccataatg

SEQ ID NO: 533046 - DNA, 20 bp, Artificial
  CRISPR gRNA sequence
caagaccataatggatcccc

SEQ ID NO: 533047 - DNA, 20 bp, Artificial
  CRISPR gRNA sequence
atgtgacctccagaagtatt

SEQ ID NO: 533048 - DNA, 20 bp, Artificial
  CRISPR gRNA sequence
cagaagtatttctgagaggc

SEQ ID NO: 533049 - DNA, 20 bp, Artificial
  CRISPR gRNA sequence
ctgagaggcagccttctata

SEQ ID NO: 533050 - DNA, 20 bp, Artificial
  CRISPR gRNA sequence
tgagaggcagccttctatag

SEQ ID NO: 533051 - DNA, 20 bp, Artificial
  CRISPR gRNA sequence
agaggcagccttctatagtg

SEQ ID NO: 533052 - DNA, 20 bp, Artificial
  CRISPR gRNA sequence
ctatagtgcccaagctctcg

SEQ ID NO: 533053 - DNA, 20 bp, Artificial
  CRISPR gRNA sequence
tatagtgcccaagctctcgc

SEQ ID NO: 533054 - DNA, 20 bp, Artificial
  CRISPR gRNA sequence
tagtgcccaagctctcgcct

SEQ ID NO: 533055 - DNA, 20 bp, Artificial
  CRISPR gRNA sequence
tcgcctgggagtagaggtct

SEQ ID NO: 533056 - DNA, 20 bp, Artificial
  CRISPR gRNA sequence
gcctgggagtagaggtctgg

SEQ ID NO: 533057 - DNA, 20 bp, Artificial
  CRISPR gRNA sequence
ggagtagaggtctggacttc

SEQ ID NO: 533058 - DNA, 20 bp, Artificial
  CRISPR gRNA sequence
gacttctagtttgggtctgt

SEQ ID NO: 533059 - DNA, 20 bp, Artificial
  CRISPR gRNA sequence
ctagtttgggtctgtccaaa

SEQ ID NO: 533060 - DNA, 20 bp, Artificial
  CRISPR gRNA sequence
tagtttgggtctgtccaaat

SEQ ID NO: 533061 - DNA, 20 bp, Artificial
  CRISPR gRNA sequence
gtttgggtctgtccaaattt

SEQ ID NO: 533062 - DNA, 20 bp, Artificial
  CRISPR gRNA sequence
gggtctgtccaaatttagcc

SEQ ID NO: 533063 - DNA, 20 bp, Artificial
  CRISPR gRNA sequence
ggtctgtccaaatttagcca

SEQ ID NO: 533064 - DNA, 20 bp, Artificial
  CRISPR gRNA sequence
tccaaatttagccagagaat

SEQ ID NO: 533065 - DNA, 20 bp, Artificial
  CRISPR gRNA sequence
agccagagaatcttgacaga

SEQ ID NO: 533066 - DNA, 20 bp, Artificial
  CRISPR gRNA sequence
gccagagaatcttgacagag

SEQ ID NO: 533067 - DNA, 20 bp, Artificial
  CRISPR gRNA sequence
gacagagtttcttcccctct

SEQ ID NO: 533068 - DNA, 20 bp, Artificial
  CRISPR gRNA sequence
acagagtttcttcccctctc

SEQ ID NO: 533069 - DNA, 20 bp, Artificial
  CRISPR gRNA sequence
cttcccctctctaggcttca

SEQ ID NO: 533070 - DNA, 20 bp, Artificial
  CRISPR gRNA sequence
ttcccctctctaggcttcag

SEQ ID NO: 533071 - DNA, 20 bp, Artificial
  CRISPR gRNA sequence
cccctctctaggcttcagct

SEQ ID NO: 533072 - DNA, 20 bp, Artificial
  CRISPR gRNA sequence
ccctctctaggcttcagctt

SEQ ID NO: 533073 - DNA, 20 bp, Artificial
  CRISPR gRNA sequence
tctaggcttcagcttcctgg

SEQ ID NO: 533074 - DNA, 20 bp, Artificial
  CRISPR gRNA sequence
taggcttcagcttcctggcc

SEQ ID NO: 533075 - DNA, 20 bp, Artificial
  CRISPR gRNA sequence
ggcttcagcttcctggccca

SEQ ID NO: 533076 - DNA, 20 bp, Artificial
  CRISPR gRNA sequence
cagcttcctggcccacaaag

SEQ ID NO: 533077 - DNA, 20 bp, Artificial
  CRISPR gRNA sequence
agcttcctggcccacaaaga

SEQ ID NO: 533078 - DNA, 20 bp, Artificial
  CRISPR gRNA sequence
cctggcccacaaagaaaata

SEQ ID NO: 533079 - DNA, 20 bp, Artificial
  CRISPR gRNA sequence
ctggcccacaaagaaaataa

SEQ ID NO: 533080 - DNA, 20 bp, Artificial
  CRISPR gRNA sequence
gcccacaaagaaaataagca

SEQ ID NO: 533081 - DNA, 20 bp, Artificial
  CRISPR gRNA sequence
acagactattagatgagtag

SEQ ID NO: 533082 - DNA, 20 bp, Artificial
  CRISPR gRNA sequence
ttagatgagtaggctcttgg

SEQ ID NO: 533083 - DNA, 20 bp, Artificial
  CRISPR gRNA sequence
gatgagtaggctcttggatc

SEQ ID NO: 533084 - DNA, 20 bp, Artificial
  CRISPR gRNA sequence
ttggatccacttccaagttc

SEQ ID NO: 533085 - DNA, 20 bp, Artificial
  CRISPR gRNA sequence
ggatccacttccaagttcat

SEQ ID NO: 533086 - DNA, 20 bp, Artificial
  CRISPR gRNA sequence
gatccacttccaagttcatt

SEQ ID NO: 533087 - DNA, 20 bp, Artificial
  CRISPR gRNA sequence
ccaagttcattcatgtgggc

SEQ ID NO: 533088 - DNA, 20 bp, Artificial
  CRISPR gRNA sequence
caagttcattcatgtgggcc

SEQ ID NO: 533089 - DNA, 20 bp, Artificial
  CRISPR gRNA sequence
attcatgtgggccgttgggc

SEQ ID NO: 533090 - DNA, 20 bp, Artificial
  CRISPR gRNA sequence
atgtgggccgttgggctgcc

SEQ ID NO: 533091 - DNA, 20 bp, Artificial
  CRISPR gRNA sequence
ggctgcctcacaatatggca

SEQ ID NO: 533092 - DNA, 20 bp, Artificial
  CRISPR gRNA sequence
cctcacaatatggcagctag

SEQ ID NO: 533093 - DNA, 20 bp, Artificial
  CRISPR gRNA sequence
acaatatggcagctagcttc

SEQ ID NO: 533094 - DNA, 20 bp, Artificial
  CRISPR gRNA sequence
gcttccctcagagccctcta

SEQ ID NO: 533095 - DNA, 20 bp, Artificial
  CRISPR gRNA sequence
ccctcagagccctctaagaa

SEQ ID NO: 533096 - DNA, 20 bp, Artificial
  CRISPR gRNA sequence
cctcagagccctctaagaaa

SEQ ID NO: 533097 - DNA, 20 bp, Artificial
  CRISPR gRNA sequence
agagccctctaagaaagagc

SEQ ID NO: 533098 - DNA, 20 bp, Artificial
  CRISPR gRNA sequence
taagaaagagcaggaataag

SEQ ID NO: 533099 - DNA, 20 bp, Artificial
  CRISPR gRNA sequence
agaaagagcaggaataagtg

SEQ ID NO: 533100 - DNA, 20 bp, Artificial
  CRISPR gRNA sequence
tttgtaacttaatctcagga

SEQ ID NO: 533101 - DNA, 20 bp, Artificial
  CRISPR gRNA sequence
ttgtaacttaatctcaggag

SEQ ID NO: 533102 - DNA, 20 bp, Artificial
  CRISPR gRNA sequence
tgtaacttaatctcaggagt

SEQ ID NO: 533103 - DNA, 20 bp, Artificial
  CRISPR gRNA sequence
gtaacttaatctcaggagta

SEQ ID NO: 533104 - DNA, 20 bp, Artificial
  CRISPR gRNA sequence
taacttaatctcaggagtaa

SEQ ID NO: 533105 - DNA, 20 bp, Artificial
  CRISPR gRNA sequence
aatctcaggagtaatatccc

SEQ ID NO: 533106 - DNA, 20 bp, Artificial
  CRISPR gRNA sequence
atctcaggagtaatatccca

SEQ ID NO: 533107 - DNA, 20 bp, Artificial
  CRISPR gRNA sequence
aggagtaatatcccaatcac

SEQ ID NO: 533108 - DNA, 20 bp, Artificial
  CRISPR gRNA sequence
ctgctgtgttctgttcatta

SEQ ID NO: 533109 - DNA, 20 bp, Artificial
  CRISPR gRNA sequence
tgctgtgttctgttcattag

SEQ ID NO: 533110 - DNA, 20 bp, Artificial
  CRISPR gRNA sequence
ctgtgttctgttcattagaa

SEQ ID NO: 533111 - DNA, 20 bp, Artificial
  CRISPR gRNA sequence
tgttctgttcattagaagca

SEQ ID NO: 533112 - DNA, 20 bp, Artificial
  CRISPR gRNA sequence
tgttcattagaagcaagtta

SEQ ID NO: 533113 - DNA, 20 bp, Artificial
  CRISPR gRNA sequence
ttcattagaagcaagttaat

SEQ ID NO: 533114 - DNA, 20 bp, Artificial
  CRISPR gRNA sequence
attagaagcaagttaataag

SEQ ID NO: 533115 - DNA, 20 bp, Artificial
  CRISPR gRNA sequence
gaagcaagttaataagtcta

SEQ ID NO: 533116 - DNA, 20 bp, Artificial
  CRISPR gRNA sequence
ataagtctagcccacattca

SEQ ID NO: 533117 - DNA, 20 bp, Artificial
  CRISPR gRNA sequence
gcccacattcaatcagaggg

SEQ ID NO: 533118 - DNA, 20 bp, Artificial
  CRISPR gRNA sequence
aatcagaggggattgcacat

SEQ ID NO: 533119 - DNA, 20 bp, Artificial
  CRISPR gRNA sequence
cacataggtgagaataccag

SEQ ID NO: 533120 - DNA, 20 bp, Artificial
  CRISPR gRNA sequence
aaggcatctgagagtctgcc

SEQ ID NO: 533121 - DNA, 20 bp, Artificial
  CRISPR gRNA sequence
agagtctgccaatcaccaac

SEQ ID NO: 533122 - DNA, 20 bp, Artificial
  CRISPR gRNA sequence
ccaatcaccaacttgaccag

SEQ ID NO: 533123 - DNA, 20 bp, Artificial
  CRISPR gRNA sequence
gaccagcatcacttcacccc

SEQ ID NO: 533124 - DNA, 20 bp, Artificial
  CRISPR gRNA sequence
accagcatcacttcaccccc

SEQ ID NO: 533125 - DNA, 20 bp, Artificial
  CRISPR gRNA sequence
cacccccggttttcccacca

SEQ ID NO: 533126 - DNA, 20 bp, Artificial
  CRISPR gRNA sequence
acccccggttttcccaccag

SEQ ID NO: 533127 - DNA, 20 bp, Artificial
  CRISPR gRNA sequence
tcccaccagtcatcctccca

SEQ ID NO: 533128 - DNA, 20 bp, Artificial
  CRISPR gRNA sequence
cccaccagtcatcctcccac

SEQ ID NO: 533129 - DNA, 20 bp, Artificial
  CRISPR gRNA sequence
ccaccagtcatcctcccaca

SEQ ID NO: 533130 - DNA, 20 bp, Artificial
  CRISPR gRNA sequence
ccacattcccccatcactaa

SEQ ID NO: 533131 - DNA, 20 bp, Artificial
  CRISPR gRNA sequence
ccccatcactaaggcacagt

SEQ ID NO: 533132 - DNA, 20 bp, Artificial
  CRISPR gRNA sequence
aggcacagtaagtgaagttg

SEQ ID NO: 533133 - DNA, 20 bp, Artificial
  CRISPR gRNA sequence
cctctccttgacttcgcaac

SEQ ID NO: 533134 - DNA, 20 bp, Artificial
  CRISPR gRNA sequence
tccttgacttcgcaactttt

SEQ ID NO: 533135 - DNA, 20 bp, Artificial
  CRISPR gRNA sequence
cttgacttcgcaactttttt

SEQ ID NO: 533136 - DNA, 20 bp, Artificial
  CRISPR gRNA sequence
gacttcgcaactttttttga

SEQ ID NO: 533137 - DNA, 20 bp, Artificial
  CRISPR gRNA sequence
acttcgcaactttttttgag

SEQ ID NO: 533138 - DNA, 20 bp, Artificial
  CRISPR gRNA sequence
cgcaactttttttgagacag

SEQ ID NO: 533139 - DNA, 20 bp, Artificial
  CRISPR gRNA sequence
gcaactttttttgagacagg

SEQ ID NO: 533140 - DNA, 20 bp, Artificial
  CRISPR gRNA sequence
tttttgagacagggttttgc

SEQ ID NO: 533141 - DNA, 20 bp, Artificial
  CRISPR gRNA sequence
ttttgagacagggttttgct

SEQ ID NO: 533142 - DNA, 20 bp, Artificial
  CRISPR gRNA sequence
tttgagacagggttttgctc

SEQ ID NO: 533143 - DNA, 20 bp, Artificial
  CRISPR gRNA sequence
ttgagacagggttttgctct

SEQ ID NO: 533144 - DNA, 20 bp, Artificial
  CRISPR gRNA sequence
tgagacagggttttgctctg

SEQ ID NO: 533145 - DNA, 20 bp, Artificial
  CRISPR gRNA sequence
gagacagggttttgctctgt

SEQ ID NO: 533146 - DNA, 20 bp, Artificial
  CRISPR gRNA sequence
agacagggttttgctctgtt

SEQ ID NO: 533147 - DNA, 20 bp, Artificial
  CRISPR gRNA sequence
tgctctgttgccaaggctgg

SEQ ID NO: 533148 - DNA, 20 bp, Artificial
  CRISPR gRNA sequence
gctctgttgccaaggctgga

SEQ ID NO: 533149 - DNA, 20 bp, Artificial
  CRISPR gRNA sequence
ctctgttgccaaggctggag

SEQ ID NO: 533150 - DNA, 20 bp, Artificial
  CRISPR gRNA sequence
tgttgccaaggctggagtgt

SEQ ID NO: 533151 - DNA, 20 bp, Artificial
  CRISPR gRNA sequence
ttgccaaggctggagtgtgg

SEQ ID NO: 533152 - DNA, 20 bp, Artificial
  CRISPR gRNA sequence
ccaaggctggagtgtggtag

SEQ ID NO: 533153 - DNA, 20 bp, Artificial
  CRISPR gRNA sequence
gagtgtggtagtatgatcat

SEQ ID NO: 533154 - DNA, 20 bp, Artificial
  CRISPR gRNA sequence
tcagcagcctccacctccca

SEQ ID NO: 533155 - DNA, 20 bp, Artificial
  CRISPR gRNA sequence
agcagcctccacctcccagg

SEQ ID NO: 533156 - DNA, 20 bp, Artificial
  CRISPR gRNA sequence
cacctcccaggctcaagcaa

SEQ ID NO: 533157 - DNA, 20 bp, Artificial
  CRISPR gRNA sequence
ccaggctcaagcaatcctcc

SEQ ID NO: 533158 - DNA, 20 bp, Artificial
  CRISPR gRNA sequence
aagcaatcctcccacctcag

SEQ ID NO: 533159 - DNA, 20 bp, Artificial
  CRISPR gRNA sequence
ccacctcagcctccccagta

SEQ ID NO: 533160 - DNA, 20 bp, Artificial
  CRISPR gRNA sequence
agcctccccagtagctgaga

SEQ ID NO: 533161 - DNA, 20 bp, Artificial
  CRISPR gRNA sequence
cccagtagctgagattacag

SEQ ID NO: 533162 - DNA, 20 bp, Artificial
  CRISPR gRNA sequence
agattacaggagcatgccac

SEQ ID NO: 533163 - DNA, 20 bp, Artificial
  CRISPR gRNA sequence
caggagcatgccaccacacc

SEQ ID NO: 533164 - DNA, 20 bp, Artificial
  CRISPR gRNA sequence
atttttaaaattttgtagag

SEQ ID NO: 533165 - DNA, 20 bp, Artificial
  CRISPR gRNA sequence
ttaaaattttgtagagataa

SEQ ID NO: 533166 - DNA, 20 bp, Artificial
  CRISPR gRNA sequence
taaaattttgtagagataag

SEQ ID NO: 533167 - DNA, 20 bp, Artificial
  CRISPR gRNA sequence
aaaattttgtagagataagg

SEQ ID NO: 533168 - DNA, 20 bp, Artificial
  CRISPR gRNA sequence
aaattttgtagagataaggt

SEQ ID NO: 533169 - DNA, 20 bp, Artificial
  CRISPR gRNA sequence
tgtagagataaggtctcact

SEQ ID NO: 533170 - DNA, 20 bp, Artificial
  CRISPR gRNA sequence
gtagagataaggtctcactc

SEQ ID NO: 533171 - DNA, 20 bp, Artificial
  CRISPR gRNA sequence
tagagataaggtctcactct

SEQ ID NO: 533172 - DNA, 20 bp, Artificial
  CRISPR gRNA sequence
actctgttgcccaggctggt

SEQ ID NO: 533173 - DNA, 20 bp, Artificial
  CRISPR gRNA sequence
tgttgcccaggctggtctcg

SEQ ID NO: 533174 - DNA, 20 bp, Artificial
  CRISPR gRNA sequence
ttgcccaggctggtctcgaa

SEQ ID NO: 533175 - DNA, 20 bp, Artificial
  CRISPR gRNA sequence
cccaggctggtctcgaactc

SEQ ID NO: 533176 - DNA, 20 bp, Artificial
  CRISPR gRNA sequence
gtctcgaactcctgtgctca

SEQ ID NO: 533177 - DNA, 20 bp, Artificial
  CRISPR gRNA sequence
gaactcctgtgctcaaacta

SEQ ID NO: 533178 - DNA, 20 bp, Artificial
  CRISPR gRNA sequence
ctgtgctcaaactatcctcc

SEQ ID NO: 533179 - DNA, 20 bp, Artificial
  CRISPR gRNA sequence
tgctcaaactatcctcccac

SEQ ID NO: 533180 - DNA, 20 bp, Artificial
  CRISPR gRNA sequence
aaactatcctcccacctcag

SEQ ID NO: 533181 - DNA, 20 bp, Artificial
  CRISPR gRNA sequence
tcctcccacctcagcctccc

SEQ ID NO: 533182 - DNA, 20 bp, Artificial
  CRISPR gRNA sequence
ccacctcagcctcccaaagt

SEQ ID NO: 533183 - DNA, 20 bp, Artificial
  CRISPR gRNA sequence
agcctcccaaagtgctggga

SEQ ID NO: 533184 - DNA, 20 bp, Artificial
  CRISPR gRNA sequence
ccaaagtgctgggattatag

SEQ ID NO: 533185 - DNA, 20 bp, Artificial
  CRISPR gRNA sequence
ggattataggcatgagtcac

SEQ ID NO: 533186 - DNA, 20 bp, Artificial
  CRISPR gRNA sequence
taggcatgagtcactgcagt

SEQ ID NO: 533187 - DNA, 20 bp, Artificial
  CRISPR gRNA sequence
cagtggcctcgggagatctt

SEQ ID NO: 533188 - DNA, 20 bp, Artificial
  CRISPR gRNA sequence
gggagatctttgattagagt

SEQ ID NO: 533189 - DNA, 20 bp, Artificial
  CRISPR gRNA sequence
tgattagagttgccagatat

SEQ ID NO: 533190 - DNA, 20 bp, Artificial
  CRISPR gRNA sequence
gattagagttgccagatata

SEQ ID NO: 533191 - DNA, 20 bp, Artificial
  CRISPR gRNA sequence
attagagttgccagatatag

SEQ ID NO: 533192 - DNA, 20 bp, Artificial
  CRISPR gRNA sequence
gagttgccagatatagcaaa

SEQ ID NO: 533193 - DNA, 20 bp, Artificial
  CRISPR gRNA sequence
ccagatatagcaaataaaaa

SEQ ID NO: 533194 - DNA, 20 bp, Artificial
  CRISPR gRNA sequence
cagatattgcatggaacata

SEQ ID NO: 533195 - DNA, 20 bp, Artificial
  CRISPR gRNA sequence
agatattgcatggaacatac

SEQ ID NO: 533196 - DNA, 20 bp, Artificial
  CRISPR gRNA sequence
catggaacatacttatgcaa

SEQ ID NO: 533197 - DNA, 20 bp, Artificial
  CRISPR gRNA sequence
atgcaagaaatttttcattg

SEQ ID NO: 533198 - DNA, 20 bp, Artificial
  CRISPR gRNA sequence
tgcaagaaatttttcattgt

SEQ ID NO: 533199 - DNA, 20 bp, Artificial
  CRISPR gRNA sequence
ttcattgtttatctgaaatt

SEQ ID NO: 533200 - DNA, 20 bp, Artificial
  CRISPR gRNA sequence
tcattgtttatctgaaattc

SEQ ID NO: 533201 - DNA, 20 bp, Artificial
  CRISPR gRNA sequence
cattgtttatctgaaattca

SEQ ID NO: 533202 - DNA, 20 bp, Artificial
  CRISPR gRNA sequence
attgtttatctgaaattcaa

SEQ ID NO: 533203 - DNA, 20 bp, Artificial
  CRISPR gRNA sequence
tttatctgaaattcaaattt

SEQ ID NO: 533204 - DNA, 20 bp, Artificial
  CRISPR gRNA sequence
atctgaaattcaaatttaac

SEQ ID NO: 533205 - DNA, 20 bp, Artificial
  CRISPR gRNA sequence
tctgaaattcaaatttaact

SEQ ID NO: 533206 - DNA, 20 bp, Artificial
  CRISPR gRNA sequence
aaattcaaatttaactgggt

SEQ ID NO: 533207 - DNA, 20 bp, Artificial
  CRISPR gRNA sequence
aaatttaactgggtgttttg

SEQ ID NO: 533208 - DNA, 20 bp, Artificial
  CRISPR gRNA sequence
aactgggtgttttgcattat

SEQ ID NO: 533209 - DNA, 20 bp, Artificial
  CRISPR gRNA sequence
actgggtgttttgcattata

SEQ ID NO: 533210 - DNA, 20 bp, Artificial
  CRISPR gRNA sequence
ggtgttttgcattatatctg

SEQ ID NO: 533211 - DNA, 20 bp, Artificial
  CRISPR gRNA sequence
tgcattatatctggcaaccc

SEQ ID NO: 533212 - DNA, 20 bp, Artificial
  CRISPR gRNA sequence
gcattatatctggcaaccct

SEQ ID NO: 533213 - DNA, 20 bp, Artificial
  CRISPR gRNA sequence
cattatatctggcaacccta

SEQ ID NO: 533214 - DNA, 20 bp, Artificial
  CRISPR gRNA sequence
tatctggcaaccctactttt

SEQ ID NO: 533215 - DNA, 20 bp, Artificial
  CRISPR gRNA sequence
gcaaccctacttttcatgtt

SEQ ID NO: 533216 - DNA, 20 bp, Artificial
  CRISPR gRNA sequence
cttttcatgtttattttaac

SEQ ID NO: 533217 - DNA, 20 bp, Artificial
  CRISPR gRNA sequence
ttcatgtttattttaactgg

SEQ ID NO: 533218 - DNA, 20 bp, Artificial
  CRISPR gRNA sequence
tcatgtttattttaactgga

SEQ ID NO: 533219 - DNA, 20 bp, Artificial
  CRISPR gRNA sequence
catgtttattttaactggag

SEQ ID NO: 533220 - DNA, 20 bp, Artificial
  CRISPR gRNA sequence
atgtttattttaactggagc

SEQ ID NO: 533221 - DNA, 20 bp, Artificial
  CRISPR gRNA sequence
attttaactggagcccacaa

SEQ ID NO: 533222 - DNA, 20 bp, Artificial
  CRISPR gRNA sequence
ttttaactggagcccacaag

SEQ ID NO: 533223 - DNA, 20 bp, Artificial
  CRISPR gRNA sequence
taactggagcccacaagtat

SEQ ID NO: 533224 - DNA, 20 bp, Artificial
  CRISPR gRNA sequence
aactggagcccacaagtata

SEQ ID NO: 533225 - DNA, 20 bp, Artificial
  CRISPR gRNA sequence
actggagcccacaagtataa

SEQ ID NO: 533226 - DNA, 20 bp, Artificial
  CRISPR gRNA sequence
gagcccacaagtataaatat

SEQ ID NO: 533227 - DNA, 20 bp, Artificial
  CRISPR gRNA sequence
gggatggaaggagggagaga

SEQ ID NO: 533228 - DNA, 20 bp, Artificial
  CRISPR gRNA sequence
gggagcagccaaggtttgaa

SEQ ID NO: 533229 - DNA, 20 bp, Artificial
  CRISPR gRNA sequence
ggagcagccaaggtttgaag

SEQ ID NO: 533230 - DNA, 20 bp, Artificial
  CRISPR gRNA sequence
gaaggctggaacacttatgt

SEQ ID NO: 533231 - DNA, 20 bp, Artificial
  CRISPR gRNA sequence
aaggctggaacacttatgtc

SEQ ID NO: 533232 - DNA, 20 bp, Artificial
  CRISPR gRNA sequence
gaacacttatgtcccttact

SEQ ID NO: 533233 - DNA, 20 bp, Artificial
  CRISPR gRNA sequence
atgtcccttactctatggtg

SEQ ID NO: 533234 - DNA, 20 bp, Artificial
  CRISPR gRNA sequence
tgtcccttactctatggtgc

SEQ ID NO: 533235 - DNA, 20 bp, Artificial
  CRISPR gRNA sequence
actctatggtgcagagcaga

SEQ ID NO: 533236 - DNA, 20 bp, Artificial
  CRISPR gRNA sequence
ctctatggtgcagagcagaa

SEQ ID NO: 533237 - DNA, 20 bp, Artificial
  CRISPR gRNA sequence
tatggtgcagagcagaagct

SEQ ID NO: 533238 - DNA, 20 bp, Artificial
  CRISPR gRNA sequence
tggtgcagagcagaagctca

SEQ ID NO: 533239 - DNA, 20 bp, Artificial
  CRISPR gRNA sequence
attgcgagaaggaccactag

SEQ ID NO: 533240 - DNA, 20 bp, Artificial
  CRISPR gRNA sequence
cgagaaggaccactagggag

SEQ ID NO: 533241 - DNA, 20 bp, Artificial
  CRISPR gRNA sequence
gggagatgggaagaatacct

SEQ ID NO: 533242 - DNA, 20 bp, Artificial
  CRISPR gRNA sequence
gggagagattagggtggagg

SEQ ID NO: 533243 - DNA, 20 bp, Artificial
  CRISPR gRNA sequence
gggtggaggagctgctcttg

SEQ ID NO: 533244 - DNA, 20 bp, Artificial
  CRISPR gRNA sequence
ctcttgaagacccgaaaagg

SEQ ID NO: 533245 - DNA, 20 bp, Artificial
  CRISPR gRNA sequence
ttgaagacccgaaaagggat

SEQ ID NO: 533246 - DNA, 20 bp, Artificial
  CRISPR gRNA sequence
gaagacccgaaaagggattt

SEQ ID NO: 533247 - DNA, 20 bp, Artificial
  CRISPR gRNA sequence
aagacccgaaaagggatttg

SEQ ID NO: 533248 - DNA, 20 bp, Artificial
  CRISPR gRNA sequence
ggaagttttattctgaaagg

SEQ ID NO: 533249 - DNA, 20 bp, Artificial
  CRISPR gRNA sequence
gaagttttattctgaaaggc

SEQ ID NO: 533250 - DNA, 20 bp, Artificial
  CRISPR gRNA sequence
tattctgaaaggccaaggca

SEQ ID NO: 533251 - DNA, 20 bp, Artificial
  CRISPR gRNA sequence
attctgaaaggccaaggcag

SEQ ID NO: 533252 - DNA, 20 bp, Artificial
  CRISPR gRNA sequence
ttctgaaaggccaaggcaga

SEQ ID NO: 533253 - DNA, 20 bp, Artificial
  CRISPR gRNA sequence
tgaaaggccaaggcagagag

SEQ ID NO: 533254 - DNA, 20 bp, Artificial
  CRISPR gRNA sequence
aaaggccaaggcagagagga

SEQ ID NO: 533255 - DNA, 20 bp, Artificial
  CRISPR gRNA sequence
accatttggctcagattagg

SEQ ID NO: 533256 - DNA, 20 bp, Artificial
  CRISPR gRNA sequence
ggctcagattaggtgagtgt

SEQ ID NO: 533257 - DNA, 20 bp, Artificial
  CRISPR gRNA sequence
gctcagattaggtgagtgtt

SEQ ID NO: 533258 - DNA, 20 bp, Artificial
  CRISPR gRNA sequence
agattaggtgagtgtttaca

SEQ ID NO: 533259 - DNA, 20 bp, Artificial
  CRISPR gRNA sequence
ggtgagtgtttacatactta

SEQ ID NO: 533260 - DNA, 20 bp, Artificial
  CRISPR gRNA sequence
acatacttaaaatcaaaata

SEQ ID NO: 533261 - DNA, 20 bp, Artificial
  CRISPR gRNA sequence
catacttaaaatcaaaatac

SEQ ID NO: 533262 - DNA, 20 bp, Artificial
  CRISPR gRNA sequence
aaaatcaaaatactaggagg

SEQ ID NO: 533263 - DNA, 20 bp, Artificial
  CRISPR gRNA sequence
aaatcaaaatactaggagga

SEQ ID NO: 533264 - DNA, 20 bp, Artificial
  CRISPR gRNA sequence
ggaggaaggaacagattcag

SEQ ID NO: 533265 - DNA, 20 bp, Artificial
  CRISPR gRNA sequence
agatgcacaaaaataatttg

SEQ ID NO: 533266 - DNA, 20 bp, Artificial
  CRISPR gRNA sequence
gtcacataaactcatgggca

SEQ ID NO: 533267 - DNA, 20 bp, Artificial
  CRISPR gRNA sequence
tcacataaactcatgggcat

SEQ ID NO: 533268 - DNA, 20 bp, Artificial
  CRISPR gRNA sequence
atgggcatgtgatctccaag

SEQ ID NO: 533269 - DNA, 20 bp, Artificial
  CRISPR gRNA sequence
caagagatactgttggaaga

SEQ ID NO: 533270 - DNA, 20 bp, Artificial
  CRISPR gRNA sequence
ttggaagatagtatgcctgg

SEQ ID NO: 533271 - DNA, 20 bp, Artificial
  CRISPR gRNA sequence
gaagatagtatgcctggatt

SEQ ID NO: 533272 - DNA, 20 bp, Artificial
  CRISPR gRNA sequence
gatttaggaactgggagggc

SEQ ID NO: 533273 - DNA, 20 bp, Artificial
  CRISPR gRNA sequence
aggaactgggagggcatatt

SEQ ID NO: 533274 - DNA, 20 bp, Artificial
  CRISPR gRNA sequence
ggaactgggagggcatattt

SEQ ID NO: 533275 - DNA, 20 bp, Artificial
  CRISPR gRNA sequence
ggagggcatatttttgactg

SEQ ID NO: 533276 - DNA, 20 bp, Artificial
  CRISPR gRNA sequence
ttgactgacagtgccaccgc

SEQ ID NO: 533277 - DNA, 20 bp, Artificial
  CRISPR gRNA sequence
tgactgacagtgccaccgct

SEQ ID NO: 533278 - DNA, 20 bp, Artificial
  CRISPR gRNA sequence
gactgacagtgccaccgctg

SEQ ID NO: 533279 - DNA, 20 bp, Artificial
  CRISPR gRNA sequence
actgacagtgccaccgctgc

SEQ ID NO: 533280 - DNA, 20 bp, Artificial
  CRISPR gRNA sequence
acagtgccaccgctgcttct

SEQ ID NO: 533281 - DNA, 20 bp, Artificial
  CRISPR gRNA sequence
cttctgaaacatgatggaac

SEQ ID NO: 533282 - DNA, 20 bp, Artificial
  CRISPR gRNA sequence
ctgaaacatgatggaacatt

SEQ ID NO: 533283 - DNA, 20 bp, Artificial
  CRISPR gRNA sequence
tgaaacatgatggaacattc

SEQ ID NO: 533284 - DNA, 20 bp, Artificial
  CRISPR gRNA sequence
aaacatgatggaacattccc

SEQ ID NO: 533285 - DNA, 20 bp, Artificial
  CRISPR gRNA sequence
cccaccaaaagtactaccag

SEQ ID NO: 533286 - DNA, 20 bp, Artificial
  CRISPR gRNA sequence
ccaggtgccccagggcacca

SEQ ID NO: 533287 - DNA, 20 bp, Artificial
  CRISPR gRNA sequence
gacaaactggagagcaggct

SEQ ID NO: 533288 - DNA, 20 bp, Artificial
  CRISPR gRNA sequence
gagagcaggctgtgtaaggc

SEQ ID NO: 533289 - DNA, 20 bp, Artificial
  CRISPR gRNA sequence
tgtaaggcattgcctacatt

SEQ ID NO: 533290 - DNA, 20 bp, Artificial
  CRISPR gRNA sequence
cctacattcctgcatgtgcc

SEQ ID NO: 533291 - DNA, 20 bp, Artificial
  CRISPR gRNA sequence
cattcctgcatgtgcccaag

SEQ ID NO: 533292 - DNA, 20 bp, Artificial
  CRISPR gRNA sequence
ctgcatgtgcccaagataaa

SEQ ID NO: 533293 - DNA, 20 bp, Artificial
  CRISPR gRNA sequence
catgtgcccaagataaaatt

SEQ ID NO: 533294 - DNA, 20 bp, Artificial
  CRISPR gRNA sequence
tggccaccctacccgatgac

SEQ ID NO: 533295 - DNA, 20 bp, Artificial
  CRISPR gRNA sequence
cccgatgacttggagggaag

SEQ ID NO: 533296 - DNA, 20 bp, Artificial
  CRISPR gRNA sequence
ggagggaagatggagctggt

SEQ ID NO: 533297 - DNA, 20 bp, Artificial
  CRISPR gRNA sequence
gagggaagatggagctggtg

SEQ ID NO: 533298 - DNA, 20 bp, Artificial
  CRISPR gRNA sequence
gtggctgcatgacttagcca

SEQ ID NO: 533299 - DNA, 20 bp, Artificial
  CRISPR gRNA sequence
catgacttagccatgtgctc

SEQ ID NO: 533300 - DNA, 20 bp, Artificial
  CRISPR gRNA sequence
agccatgtgctccccaaagc

SEQ ID NO: 533301 - DNA, 20 bp, Artificial
  CRISPR gRNA sequence
gccatgtgctccccaaagca

SEQ ID NO: 533302 - DNA, 20 bp, Artificial
  CRISPR gRNA sequence
cccaaagcatttcaggcctg

SEQ ID NO: 533303 - DNA, 20 bp, Artificial
  CRISPR gRNA sequence
caggcctgccctgccccacc

SEQ ID NO: 533304 - DNA, 20 bp, Artificial
  CRISPR gRNA sequence
aggcctgccctgccccaccc

SEQ ID NO: 533305 - DNA, 20 bp, Artificial
  CRISPR gRNA sequence
ccctgccccaccccgggtca

SEQ ID NO: 533306 - DNA, 20 bp, Artificial
  CRISPR gRNA sequence
ccccaccccgggtcaaatct

SEQ ID NO: 533307 - DNA, 20 bp, Artificial
  CRISPR gRNA sequence
aaaagttctcaagctcagca

SEQ ID NO: 533308 - DNA, 20 bp, Artificial
  CRISPR gRNA sequence
tcaagctcagcaggaagtgg

SEQ ID NO: 533309 - DNA, 20 bp, Artificial
  CRISPR gRNA sequence
aagctcagcaggaagtggcc

SEQ ID NO: 533310 - DNA, 20 bp, Artificial
  CRISPR gRNA sequence
agcaggaagtggcctctggt

SEQ ID NO: 533311 - DNA, 20 bp, Artificial
  CRISPR gRNA sequence
tggtatctcctgcccctcgt

SEQ ID NO: 533312 - DNA, 20 bp, Artificial
  CRISPR gRNA sequence
gtatctcctgcccctcgtcc

SEQ ID NO: 533313 - DNA, 20 bp, Artificial
  CRISPR gRNA sequence
ctgcccctcgtccaagccag

SEQ ID NO: 533314 - DNA, 20 bp, Artificial
  CRISPR gRNA sequence
cccctcgtccaagccagcag

SEQ ID NO: 533315 - DNA, 20 bp, Artificial
  CRISPR gRNA sequence
gtccaagccagcagggccta

SEQ ID NO: 533316 - DNA, 20 bp, Artificial
  CRISPR gRNA sequence
aagggccctgaatcctttac

SEQ ID NO: 533317 - DNA, 20 bp, Artificial
  CRISPR gRNA sequence
aatcctttactgacccaatt

SEQ ID NO: 533318 - DNA, 20 bp, Artificial
  CRISPR gRNA sequence
tactgacccaatttcaatgg

SEQ ID NO: 533319 - DNA, 20 bp, Artificial
  CRISPR gRNA sequence
actgacccaatttcaatggt

SEQ ID NO: 533320 - DNA, 20 bp, Artificial
  CRISPR gRNA sequence
ctgacccaatttcaatggtt

SEQ ID NO: 533321 - DNA, 20 bp, Artificial
  CRISPR gRNA sequence
acccaatttcaatggtttaa

SEQ ID NO: 533322 - DNA, 20 bp, Artificial
  CRISPR gRNA sequence
caatggtttaagattatgtc

SEQ ID NO: 533323 - DNA, 20 bp, Artificial
  CRISPR gRNA sequence
aatggtttaagattatgtct

SEQ ID NO: 533324 - DNA, 20 bp, Artificial
  CRISPR gRNA sequence
aagattatgtctgcttctct

SEQ ID NO: 533325 - DNA, 20 bp, Artificial
  CRISPR gRNA sequence
agattatgtctgcttctctg

SEQ ID NO: 533326 - DNA, 20 bp, Artificial
  CRISPR gRNA sequence
tgtctgcttctctggtggag

SEQ ID NO: 533327 - DNA, 20 bp, Artificial
  CRISPR gRNA sequence
cttctctggtggaggcctct

SEQ ID NO: 533328 - DNA, 20 bp, Artificial
  CRISPR gRNA sequence
ctctggtggaggcctcttca

SEQ ID NO: 533329 - DNA, 20 bp, Artificial
  CRISPR gRNA sequence
tctggtggaggcctcttcat

SEQ ID NO: 533330 - DNA, 20 bp, Artificial
  CRISPR gRNA sequence
tggtggaggcctcttcatca

SEQ ID NO: 533331 - DNA, 20 bp, Artificial
  CRISPR gRNA sequence
gtggaggcctcttcatcagt

SEQ ID NO: 533332 - DNA, 20 bp, Artificial
  CRISPR gRNA sequence
ttcatcagtagagcttagag

SEQ ID NO: 533333 - DNA, 20 bp, Artificial
  CRISPR gRNA sequence
catcagtagagcttagagag

SEQ ID NO: 533334 - DNA, 20 bp, Artificial
  CRISPR gRNA sequence
atcagtagagcttagagagt

SEQ ID NO: 533335 - DNA, 20 bp, Artificial
  CRISPR gRNA sequence
agagagttgtgtaactggca

SEQ ID NO: 533336 - DNA, 20 bp, Artificial
  CRISPR gRNA sequence
gagagttgtgtaactggcag

SEQ ID NO: 533337 - DNA, 20 bp, Artificial
  CRISPR gRNA sequence
tgtaactggcaggcaaagaa

SEQ ID NO: 533338 - DNA, 20 bp, Artificial
  CRISPR gRNA sequence
gcaggcaaagaatgggtcag

SEQ ID NO: 533339 - DNA, 20 bp, Artificial
  CRISPR gRNA sequence
gaggaaagaaagccaagatg

SEQ ID NO: 533340 - DNA, 20 bp, Artificial
  CRISPR gRNA sequence
gatgatctgttaaacttggt

SEQ ID NO: 533341 - DNA, 20 bp, Artificial
  CRISPR gRNA sequence
atgatctgttaaacttggtt

SEQ ID NO: 533342 - DNA, 20 bp, Artificial
  CRISPR gRNA sequence
ttaaacttggtttctgagcc

SEQ ID NO: 533343 - DNA, 20 bp, Artificial
  CRISPR gRNA sequence
aacttggtttctgagcctct

SEQ ID NO: 533344 - DNA, 20 bp, Artificial
  CRISPR gRNA sequence
ggtttctgagcctctgaccc

SEQ ID NO: 533345 - DNA, 20 bp, Artificial
  CRISPR gRNA sequence
gtttctgagcctctgaccct

SEQ ID NO: 533346 - DNA, 20 bp, Artificial
  CRISPR gRNA sequence
ctgagcctctgaccctctcc

SEQ ID NO: 533347 - DNA, 20 bp, Artificial
  CRISPR gRNA sequence
tgagcctctgaccctctcct

SEQ ID NO: 533348 - DNA, 20 bp, Artificial
  CRISPR gRNA sequence
agcctctgaccctctccttg

SEQ ID NO: 533349 - DNA, 20 bp, Artificial
  CRISPR gRNA sequence
tgaccctctccttggggccc

SEQ ID NO: 533350 - DNA, 20 bp, Artificial
  CRISPR gRNA sequence
accctctccttggggcccat

SEQ ID NO: 533351 - DNA, 20 bp, Artificial
  CRISPR gRNA sequence
tccttggggcccatcctggg

SEQ ID NO: 533352 - DNA, 20 bp, Artificial
  CRISPR gRNA sequence
cttggggcccatcctgggct

SEQ ID NO: 533353 - DNA, 20 bp, Artificial
  CRISPR gRNA sequence
ggggcccatcctgggcttca

SEQ ID NO: 533354 - DNA, 20 bp, Artificial
  CRISPR gRNA sequence
gggcccatcctgggcttcat

SEQ ID NO: 533355 - DNA, 20 bp, Artificial
  CRISPR gRNA sequence
ggcttcatgtataacagtgt

SEQ ID NO: 533356 - DNA, 20 bp, Artificial
  CRISPR gRNA sequence
catgtataacagtgtctccc

SEQ ID NO: 533357 - DNA, 20 bp, Artificial
  CRISPR gRNA sequence
atgtataacagtgtctccct

SEQ ID NO: 533358 - DNA, 20 bp, Artificial
  CRISPR gRNA sequence
cctggtatgtttttgcctgg

SEQ ID NO: 533359 - DNA, 20 bp, Artificial
  CRISPR gRNA sequence
gtatgtttttgcctggagaa

SEQ ID NO: 533360 - DNA, 20 bp, Artificial
  CRISPR gRNA sequence
ttgcctggagaagcatttct

SEQ ID NO: 533361 - DNA, 20 bp, Artificial
  CRISPR gRNA sequence
tgcctggagaagcatttctt

SEQ ID NO: 533362 - DNA, 20 bp, Artificial
  CRISPR gRNA sequence
gcctggagaagcatttcttt

SEQ ID NO: 533363 - DNA, 20 bp, Artificial
  CRISPR gRNA sequence
cctggagaagcatttctttt

SEQ ID NO: 533364 - DNA, 20 bp, Artificial
  CRISPR gRNA sequence
gagaagcatttcttttgtga

SEQ ID NO: 533365 - DNA, 20 bp, Artificial
  CRISPR gRNA sequence
cttttgtgatgctgggccaa

SEQ ID NO: 533366 - DNA, 20 bp, Artificial
  CRISPR gRNA sequence
ttttgtgatgctgggccaag

SEQ ID NO: 533367 - DNA, 20 bp, Artificial
  CRISPR gRNA sequence
ttgtgatgctgggccaagtt

SEQ ID NO: 533368 - DNA, 20 bp, Artificial
  CRISPR gRNA sequence
tgtgatgctgggccaagttc

SEQ ID NO: 533369 - DNA, 20 bp, Artificial
  CRISPR gRNA sequence
gtgatgctgggccaagttcc

SEQ ID NO: 533370 - DNA, 20 bp, Artificial
  CRISPR gRNA sequence
tgatgctgggccaagttcca

SEQ ID NO: 533371 - DNA, 20 bp, Artificial
  CRISPR gRNA sequence
ggccaagttccagtttgttc

SEQ ID NO: 533372 - DNA, 20 bp, Artificial
  CRISPR gRNA sequence
cagtttgttcttcagatgac

SEQ ID NO: 533373 - DNA, 20 bp, Artificial
  CRISPR gRNA sequence
gttcttcagatgaccccgtc

SEQ ID NO: 533374 - DNA, 20 bp, Artificial
  CRISPR gRNA sequence
ttcttcagatgaccccgtcc

SEQ ID NO: 533375 - DNA, 20 bp, Artificial
  CRISPR gRNA sequence
ttcagatgaccccgtcccct

SEQ ID NO: 533376 - DNA, 20 bp, Artificial
  CRISPR gRNA sequence
cagatgaccccgtcccctga

SEQ ID NO: 533377 - DNA, 20 bp, Artificial
  CRISPR gRNA sequence
agatgaccccgtcccctgac

SEQ ID NO: 533378 - DNA, 20 bp, Artificial
  CRISPR gRNA sequence
acccgagccccactgctgct

SEQ ID NO: 533379 - DNA, 20 bp, Artificial
  CRISPR gRNA sequence
ctgcttttctaactgctatt

SEQ ID NO: 533380 - DNA, 20 bp, Artificial
  CRISPR gRNA sequence
cttttctaactgctattgac

SEQ ID NO: 533381 - DNA, 20 bp, Artificial
  CRISPR gRNA sequence
ttctaactgctattgactca

SEQ ID NO: 533382 - DNA, 20 bp, Artificial
  CRISPR gRNA sequence
tctaactgctattgactcac

SEQ ID NO: 533383 - DNA, 20 bp, Artificial
  CRISPR gRNA sequence
ctaactgctattgactcaca

SEQ ID NO: 533384 - DNA, 20 bp, Artificial
  CRISPR gRNA sequence
taactgctattgactcacaa

SEQ ID NO: 533385 - DNA, 20 bp, Artificial
  CRISPR gRNA sequence
actgctattgactcacaaag

SEQ ID NO: 533386 - DNA, 20 bp, Artificial
  CRISPR gRNA sequence
ctattgactcacaaagggca

SEQ ID NO: 533387 - DNA, 20 bp, Artificial
  CRISPR gRNA sequence
ttgactcacaaagggcagac

SEQ ID NO: 533388 - DNA, 20 bp, Artificial
  CRISPR gRNA sequence
actcacaaagggcagacagc

SEQ ID NO: 533389 - DNA, 20 bp, Artificial
  CRISPR gRNA sequence
acaaagggcagacagcccta

SEQ ID NO: 533390 - DNA, 20 bp, Artificial
  CRISPR gRNA sequence
gaacccctcctgtttcccct

SEQ ID NO: 533391 - DNA, 20 bp, Artificial
  CRISPR gRNA sequence
ctgtttcccctgttgctggg

SEQ ID NO: 533392 - DNA, 20 bp, Artificial
  CRISPR gRNA sequence
tttcccctgttgctgggaaa

SEQ ID NO: 533393 - DNA, 20 bp, Artificial
  CRISPR gRNA sequence
cccctgttgctgggaaacag

SEQ ID NO: 533394 - DNA, 20 bp, Artificial
  CRISPR gRNA sequence
ccctgttgctgggaaacagc

SEQ ID NO: 533395 - DNA, 20 bp, Artificial
  CRISPR gRNA sequence
ttgctgggaaacagctccca

SEQ ID NO: 533396 - DNA, 20 bp, Artificial
  CRISPR gRNA sequence
ctgggaaacagctcccagaa

SEQ ID NO: 533397 - DNA, 20 bp, Artificial
  CRISPR gRNA sequence
ggaaacagctcccagaaaca

SEQ ID NO: 533398 - DNA, 20 bp, Artificial
  CRISPR gRNA sequence
ccagaaacaccagtgcgaga

SEQ ID NO: 533399 - DNA, 20 bp, Artificial
  CRISPR gRNA sequence
gtaagagcaagacctcacat

SEQ ID NO: 533400 - DNA, 20 bp, Artificial
  CRISPR gRNA sequence
acatttgtgttgttttacag

SEQ ID NO: 533401 - DNA, 20 bp, Artificial
  CRISPR gRNA sequence
gtgttgttttacagtttaca

SEQ ID NO: 533402 - DNA, 20 bp, Artificial
  CRISPR gRNA sequence
tgttgttttacagtttacaa

SEQ ID NO: 533403 - DNA, 20 bp, Artificial
  CRISPR gRNA sequence
ttttacagtttacaaagcac

SEQ ID NO: 533404 - DNA, 20 bp, Artificial
  CRISPR gRNA sequence
tacagtttacaaagcacttt

SEQ ID NO: 533405 - DNA, 20 bp, Artificial
  CRISPR gRNA sequence
acagtttacaaagcactttc

SEQ ID NO: 533406 - DNA, 20 bp, Artificial
  CRISPR gRNA sequence
cagtttacaaagcactttca

SEQ ID NO: 533407 - DNA, 20 bp, Artificial
  CRISPR gRNA sequence
acaaagcactttcatatcca

SEQ ID NO: 533408 - DNA, 20 bp, Artificial
  CRISPR gRNA sequence
caaagcactttcatatccat

SEQ ID NO: 533409 - DNA, 20 bp, Artificial
  CRISPR gRNA sequence
tcatatccattatctgattg

SEQ ID NO: 533410 - DNA, 20 bp, Artificial
  CRISPR gRNA sequence
catatccattatctgattga

SEQ ID NO: 533411 - DNA, 20 bp, Artificial
  CRISPR gRNA sequence
atatccattatctgattgac

SEQ ID NO: 533412 - DNA, 20 bp, Artificial
  CRISPR gRNA sequence
tctgattgacttccaacagc

SEQ ID NO: 533413 - DNA, 20 bp, Artificial
  CRISPR gRNA sequence
attgacttccaacagccacc

SEQ ID NO: 533414 - DNA, 20 bp, Artificial
  CRISPR gRNA sequence
acttccaacagccaccctat

SEQ ID NO: 533415 - DNA, 20 bp, Artificial
  CRISPR gRNA sequence
ccaacagccaccctatgatg

SEQ ID NO: 533416 - DNA, 20 bp, Artificial
  CRISPR gRNA sequence
caacagccaccctatgatgt

SEQ ID NO: 533417 - DNA, 20 bp, Artificial
  CRISPR gRNA sequence
tgatgtaggtttcattatct

SEQ ID NO: 533418 - DNA, 20 bp, Artificial
  CRISPR gRNA sequence
cattatctccactttacaaa

SEQ ID NO: 533419 - DNA, 20 bp, Artificial
  CRISPR gRNA sequence
attatctccactttacaaag

SEQ ID NO: 533420 - DNA, 20 bp, Artificial
  CRISPR gRNA sequence
tctccactttacaaagaagg

SEQ ID NO: 533421 - DNA, 20 bp, Artificial
  CRISPR gRNA sequence
cactttacaaagaaggaaac

SEQ ID NO: 533422 - DNA, 20 bp, Artificial
  CRISPR gRNA sequence
tacaaagaaggaaacaggct

SEQ ID NO: 533423 - DNA, 20 bp, Artificial
  CRISPR gRNA sequence
acaaagaaggaaacaggctc

SEQ ID NO: 533424 - DNA, 20 bp, Artificial
  CRISPR gRNA sequence
caaagaaggaaacaggctca

SEQ ID NO: 533425 - DNA, 20 bp, Artificial
  CRISPR gRNA sequence
agagaggtgaagtaactctc

SEQ ID NO: 533426 - DNA, 20 bp, Artificial
  CRISPR gRNA sequence
tccaaagttcacacagctcc

SEQ ID NO: 533427 - DNA, 20 bp, Artificial
  CRISPR gRNA sequence
caaagttcacacagctcctg

SEQ ID NO: 533428 - DNA, 20 bp, Artificial
  CRISPR gRNA sequence
acacagctcctgcctaaaaa

SEQ ID NO: 533429 - DNA, 20 bp, Artificial
  CRISPR gRNA sequence
ctgcctaaaaaagcctagac

SEQ ID NO: 533430 - DNA, 20 bp, Artificial
  CRISPR gRNA sequence
cctaaaaaagcctagaccaa

SEQ ID NO: 533431 - DNA, 20 bp, Artificial
  CRISPR gRNA sequence
aaaaagcctagaccaaaccc

SEQ ID NO: 533432 - DNA, 20 bp, Artificial
  CRISPR gRNA sequence
gaccaaacccatttccctta

SEQ ID NO: 533433 - DNA, 20 bp, Artificial
  CRISPR gRNA sequence
cccttaacaccaaagtcact

SEQ ID NO: 533434 - DNA, 20 bp, Artificial
  CRISPR gRNA sequence
ccttaacaccaaagtcactg

SEQ ID NO: 533435 - DNA, 20 bp, Artificial
  CRISPR gRNA sequence
aacaccaaagtcactgtttt

SEQ ID NO: 533436 - DNA, 20 bp, Artificial
  CRISPR gRNA sequence
acaccaaagtcactgttttc

SEQ ID NO: 533437 - DNA, 20 bp, Artificial
  CRISPR gRNA sequence
ttttcctcattgcattacag

SEQ ID NO: 533438 - DNA, 20 bp, Artificial
  CRISPR gRNA sequence
tcctcattgcattacagtga

SEQ ID NO: 533439 - DNA, 20 bp, Artificial
  CRISPR gRNA sequence
cctcattgcattacagtgac

SEQ ID NO: 533440 - DNA, 20 bp, Artificial
  CRISPR gRNA sequence
ctcattgcattacagtgact

SEQ ID NO: 533441 - DNA, 20 bp, Artificial
  CRISPR gRNA sequence
attgcattacagtgactgaa

SEQ ID NO: 533442 - DNA, 20 bp, Artificial
  CRISPR gRNA sequence
cattacagtgactgaaggtc

SEQ ID NO: 533443 - DNA, 20 bp, Artificial
  CRISPR gRNA sequence
cagtgactgaaggtccagca

SEQ ID NO: 533444 - DNA, 20 bp, Artificial
  CRISPR gRNA sequence
aaggtccagcaactgaagac

SEQ ID NO: 533445 - DNA, 20 bp, Artificial
  CRISPR gRNA sequence
aagactaagcccactgctgt

SEQ ID NO: 533446 - DNA, 20 bp, Artificial
  CRISPR gRNA sequence
agcccactgctgttactaac

SEQ ID NO: 533447 - DNA, 20 bp, Artificial
  CRISPR gRNA sequence
ctgttactaacgcactgtgc

SEQ ID NO: 533448 - DNA, 20 bp, Artificial
  CRISPR gRNA sequence
ttactaacgcactgtgcacc

SEQ ID NO: 533449 - DNA, 20 bp, Artificial
  CRISPR gRNA sequence
ctaacgcactgtgcacccgg

SEQ ID NO: 533450 - DNA, 20 bp, Artificial
  CRISPR gRNA sequence
acgcactgtgcacccgggtt

SEQ ID NO: 533451 - DNA, 20 bp, Artificial
  CRISPR gRNA sequence
tgcacccgggtttctctcgt

SEQ ID NO: 533452 - DNA, 20 bp, Artificial
  CRISPR gRNA sequence
ctctcgtggctccagggaaa

SEQ ID NO: 533453 - DNA, 20 bp, Artificial
  CRISPR gRNA sequence
tctcgtggctccagggaaac

SEQ ID NO: 533454 - DNA, 20 bp, Artificial
  CRISPR gRNA sequence
tcgtggctccagggaaactc

SEQ ID NO: 533455 - DNA, 20 bp, Artificial
  CRISPR gRNA sequence
gtggctccagggaaactctg

SEQ ID NO: 533456 - DNA, 20 bp, Artificial
  CRISPR gRNA sequence
cagggaaactctgtgagagg

SEQ ID NO: 533457 - DNA, 20 bp, Artificial
  CRISPR gRNA sequence
tgtgagagggtgctggccgt

SEQ ID NO: 533458 - DNA, 20 bp, Artificial
  CRISPR gRNA sequence
tgagagggtgctggccgtga

SEQ ID NO: 533459 - DNA, 20 bp, Artificial
  CRISPR gRNA sequence
gccgtgaggtcagagtgctg

SEQ ID NO: 533460 - DNA, 20 bp, Artificial
  CRISPR gRNA sequence
ggctggacaagtgaaatatt

SEQ ID NO: 533461 - DNA, 20 bp, Artificial
  CRISPR gRNA sequence
gacaagtgaaatatttaccc

SEQ ID NO: 533462 - DNA, 20 bp, Artificial
  CRISPR gRNA sequence
accctgagtgtttggaaact

SEQ ID NO: 533463 - DNA, 20 bp, Artificial
  CRISPR gRNA sequence
ccctgagtgtttggaaactg

SEQ ID NO: 533464 - DNA, 20 bp, Artificial
  CRISPR gRNA sequence
agtgtttggaaactgcctgg

SEQ ID NO: 533465 - DNA, 20 bp, Artificial
  CRISPR gRNA sequence
ggaaactgcctggtagagac

SEQ ID NO: 533466 - DNA, 20 bp, Artificial
  CRISPR gRNA sequence
gaaactgcctggtagagaca

SEQ ID NO: 533467 - DNA, 20 bp, Artificial
  CRISPR gRNA sequence
cctggtagagacagtgagaa

SEQ ID NO: 533468 - DNA, 20 bp, Artificial
  CRISPR gRNA sequence
gtagagacagtgagaaggaa

SEQ ID NO: 533469 - DNA, 20 bp, Artificial
  CRISPR gRNA sequence
cttaagggaaatgctcagga

SEQ ID NO: 533470 - DNA, 20 bp, Artificial
  CRISPR gRNA sequence
aagggaaatgctcaggaaca

SEQ ID NO: 533471 - DNA, 20 bp, Artificial
  CRISPR gRNA sequence
agggaaatgctcaggaacag

SEQ ID NO: 533472 - DNA, 20 bp, Artificial
  CRISPR gRNA sequence
aggaacagatattgtgtggc

SEQ ID NO: 533473 - DNA, 20 bp, Artificial
  CRISPR gRNA sequence
tgtggcttcgggcaactcat

SEQ ID NO: 533474 - DNA, 20 bp, Artificial
  CRISPR gRNA sequence
cgggcaactcattctccctc

SEQ ID NO: 533475 - DNA, 20 bp, Artificial
  CRISPR gRNA sequence
gggcaactcattctccctct

SEQ ID NO: 533476 - DNA, 20 bp, Artificial
  CRISPR gRNA sequence
attctccctctcagggcctc

SEQ ID NO: 533477 - DNA, 20 bp, Artificial
  CRISPR gRNA sequence
tccctctcagggcctcatgt

SEQ ID NO: 533478 - DNA, 20 bp, Artificial
  CRISPR gRNA sequence
cctctcagggcctcatgttt

SEQ ID NO: 533479 - DNA, 20 bp, Artificial
  CRISPR gRNA sequence
tcagggcctcatgtttgaag

SEQ ID NO: 533480 - DNA, 20 bp, Artificial
  CRISPR gRNA sequence
agggcctcatgtttgaagct

SEQ ID NO: 533481 - DNA, 20 bp, Artificial
  CRISPR gRNA sequence
atgtttgaagctagaggttg

SEQ ID NO: 533482 - DNA, 20 bp, Artificial
  CRISPR gRNA sequence
gaagctagaggttgcattta

SEQ ID NO: 533483 - DNA, 20 bp, Artificial
  CRISPR gRNA sequence
aagctagaggttgcatttag

SEQ ID NO: 533484 - DNA, 20 bp, Artificial
  CRISPR gRNA sequence
gaggttgcatttagagtatc

SEQ ID NO: 533485 - DNA, 20 bp, Artificial
  CRISPR gRNA sequence
catttagagtatctctaaga

SEQ ID NO: 533486 - DNA, 20 bp, Artificial
  CRISPR gRNA sequence
agagtatctctaagatcctc

SEQ ID NO: 533487 - DNA, 20 bp, Artificial
  CRISPR gRNA sequence
gagtatctctaagatcctcg

SEQ ID NO: 533488 - DNA, 20 bp, Artificial
  CRISPR gRNA sequence
taagatcctcggatctaaaa

SEQ ID NO: 533489 - DNA, 20 bp, Artificial
  CRISPR gRNA sequence
agatcctcggatctaaaatt

SEQ ID NO: 533490 - DNA, 20 bp, Artificial
  CRISPR gRNA sequence
ggatctaaaatttcgtgatg

SEQ ID NO: 533491 - DNA, 20 bp, Artificial
  CRISPR gRNA sequence
aaatttcgtgatgctttcca

SEQ ID NO: 533492 - DNA, 20 bp, Artificial
  CRISPR gRNA sequence
cgtgatgctttccatgacgg

SEQ ID NO: 533493 - DNA, 20 bp, Artificial
  CRISPR gRNA sequence
gtgatgctttccatgacggg

SEQ ID NO: 533494 - DNA, 20 bp, Artificial
  CRISPR gRNA sequence
tccatgacgggggcagtggg

SEQ ID NO: 533495 - DNA, 20 bp, Artificial
  CRISPR gRNA sequence
ccatgacgggggcagtgggc

SEQ ID NO: 533496 - DNA, 20 bp, Artificial
  CRISPR gRNA sequence
catgacgggggcagtgggca

SEQ ID NO: 533497 - DNA, 20 bp, Artificial
  CRISPR gRNA sequence
ggtgcatgaacaatcaggca

SEQ ID NO: 533498 - DNA, 20 bp, Artificial
  CRISPR gRNA sequence
gtgcatgaacaatcaggcat

SEQ ID NO: 533499 - DNA, 20 bp, Artificial
  CRISPR gRNA sequence
ctagcccctgagagcagttt

SEQ ID NO: 533500 - DNA, 20 bp, Artificial
  CRISPR gRNA sequence
tagcccctgagagcagtttc

SEQ ID NO: 533501 - DNA, 20 bp, Artificial
  CRISPR gRNA sequence
gcccctgagagcagtttccc

SEQ ID NO: 533502 - DNA, 20 bp, Artificial
  CRISPR gRNA sequence
agagcagtttcccaaagagc

SEQ ID NO: 533503 - DNA, 20 bp, Artificial
  CRISPR gRNA sequence
cccaaagagcctgcagaggg

SEQ ID NO: 533504 - DNA, 20 bp, Artificial
  CRISPR gRNA sequence
ccaaagagcctgcagaggga

SEQ ID NO: 533505 - DNA, 20 bp, Artificial
  CRISPR gRNA sequence
cagagggagcttcccaagga

SEQ ID NO: 533506 - DNA, 20 bp, Artificial
  CRISPR gRNA sequence
cccaaggaccttgggtcctt

SEQ ID NO: 533507 - DNA, 20 bp, Artificial
  CRISPR gRNA sequence
ccaaggaccttgggtccttc

SEQ ID NO: 533508 - DNA, 20 bp, Artificial
  CRISPR gRNA sequence
gggtccttccagggttgaca

SEQ ID NO: 533509 - DNA, 20 bp, Artificial
  CRISPR gRNA sequence
ggtccttccagggttgacac

SEQ ID NO: 533510 - DNA, 20 bp, Artificial
  CRISPR gRNA sequence
ccagggttgacaccactcac

SEQ ID NO: 533511 - DNA, 20 bp, Artificial
  CRISPR gRNA sequence
cagggttgacaccactcacc

SEQ ID NO: 533512 - DNA, 20 bp, Artificial
  CRISPR gRNA sequence
acaccactcaccaccctctg

SEQ ID NO: 533513 - DNA, 20 bp, Artificial
  CRISPR gRNA sequence
accaccctctgtgagcctgg

SEQ ID NO: 533514 - DNA, 20 bp, Artificial
  CRISPR gRNA sequence
tgtgagcctgggagttatgg

SEQ ID NO: 533515 - DNA, 20 bp, Artificial
  CRISPR gRNA sequence
tgagcctgggagttatgggg

SEQ ID NO: 533516 - DNA, 20 bp, Artificial
  CRISPR gRNA sequence
ggagttatggggtgaaaggt

SEQ ID NO: 533517 - DNA, 20 bp, Artificial
  CRISPR gRNA sequence
tggggtgaaaggtcccaaca

SEQ ID NO: 533518 - DNA, 20 bp, Artificial
  CRISPR gRNA sequence
ttctatctgcttgatgcagg

SEQ ID NO: 533519 - DNA, 20 bp, Artificial
  CRISPR gRNA sequence
ctatctgcttgatgcaggag

SEQ ID NO: 533520 - DNA, 20 bp, Artificial
  CRISPR gRNA sequence
tatctgcttgatgcaggagg

SEQ ID NO: 533521 - DNA, 20 bp, Artificial
  CRISPR gRNA sequence
tctgcttgatgcaggaggca

SEQ ID NO: 533522 - DNA, 20 bp, Artificial
  CRISPR gRNA sequence
cttgatgcaggaggcagcat

SEQ ID NO: 533523 - DNA, 20 bp, Artificial
  CRISPR gRNA sequence
gatgcaggaggcagcatcct

SEQ ID NO: 533524 - DNA, 20 bp, Artificial
  CRISPR gRNA sequence
atgcaggaggcagcatcctt

SEQ ID NO: 533525 - DNA, 20 bp, Artificial
  CRISPR gRNA sequence
ggccagagtaatgggctctc

SEQ ID NO: 533526 - DNA, 20 bp, Artificial
  CRISPR gRNA sequence
gccagagtaatgggctctct

SEQ ID NO: 533527 - DNA, 20 bp, Artificial
  CRISPR gRNA sequence
tctgcctggacccctcccag

SEQ ID NO: 533528 - DNA, 20 bp, Artificial
  CRISPR gRNA sequence
tgcctggacccctcccagcc

SEQ ID NO: 533529 - DNA, 20 bp, Artificial
  CRISPR gRNA sequence
cctggacccctcccagccat

SEQ ID NO: 533530 - DNA, 20 bp, Artificial
  CRISPR gRNA sequence
gacccctcccagccatccca

SEQ ID NO: 533531 - DNA, 20 bp, Artificial
  CRISPR gRNA sequence
ccagccatcccacttctctt

SEQ ID NO: 533532 - DNA, 20 bp, Artificial
  CRISPR gRNA sequence
ctcttccttttgcagagaaa

SEQ ID NO: 533533 - DNA, 20 bp, Artificial
  CRISPR gRNA sequence
tcttccttttgcagagaaag

SEQ ID NO: 533534 - DNA, 20 bp, Artificial
  CRISPR gRNA sequence
ttccttttgcagagaaaggt

SEQ ID NO: 533535 - DNA, 20 bp, Artificial
  CRISPR gRNA sequence
ccttttgcagagaaaggtct

SEQ ID NO: 533536 - DNA, 20 bp, Artificial
  CRISPR gRNA sequence
cttttgcagagaaaggtctg

SEQ ID NO: 533537 - DNA, 20 bp, Artificial
  CRISPR gRNA sequence
ttgcagagaaaggtctggac

SEQ ID NO: 533538 - DNA, 20 bp, Artificial
  CRISPR gRNA sequence
tgcagagaaaggtctggaca

SEQ ID NO: 533539 - DNA, 20 bp, Artificial
  CRISPR gRNA sequence
gcagagaaaggtctggacat

SEQ ID NO: 533540 - DNA, 20 bp, Artificial
  CRISPR gRNA sequence
cagagaaaggtctggacatc

SEQ ID NO: 533541 - DNA, 20 bp, Artificial
  CRISPR gRNA sequence
gacatctatctcatcattgg

SEQ ID NO: 533542 - DNA, 20 bp, Artificial
  CRISPR gRNA sequence
tctcatcattggcatatgtg

SEQ ID NO: 533543 - DNA, 20 bp, Artificial
  CRISPR gRNA sequence
atcattggcatatgtggagg

SEQ ID NO: 533544 - DNA, 20 bp, Artificial
  CRISPR gRNA sequence
gcatatgtggaggaggcagc

SEQ ID NO: 533545 - DNA, 20 bp, Artificial
  CRISPR gRNA sequence
ttgatggtctttgtggcact

SEQ ID NO: 533546 - DNA, 20 bp, Artificial
  CRISPR gRNA sequence
gatggtctttgtggcactgc

SEQ ID NO: 533547 - DNA, 20 bp, Artificial
  CRISPR gRNA sequence
atggtctttgtggcactgct

SEQ ID NO: 533548 - DNA, 20 bp, Artificial
  CRISPR gRNA sequence
tgtggcactgctcgttttct

SEQ ID NO: 533549 - DNA, 20 bp, Artificial
  CRISPR gRNA sequence
gtggcactgctcgttttcta

SEQ ID NO: 533550 - DNA, 20 bp, Artificial
  CRISPR gRNA sequence
tggcactgctcgttttctat

SEQ ID NO: 533551 - DNA, 20 bp, Artificial
  CRISPR gRNA sequence
ctcgttttctatatcaccaa

SEQ ID NO: 533552 - DNA, 20 bp, Artificial
  CRISPR gRNA sequence
gttttctatatcaccaaaag

SEQ ID NO: 533553 - DNA, 20 bp, Artificial
  CRISPR gRNA sequence
tctatatcaccaaaaggaaa

SEQ ID NO: 533554 - DNA, 20 bp, Artificial
  CRISPR gRNA sequence
ctatatcaccaaaaggaaaa

SEQ ID NO: 533555 - DNA, 20 bp, Artificial
  CRISPR gRNA sequence
tatatcaccaaaaggaaaaa

SEQ ID NO: 533556 - DNA, 20 bp, Artificial
  CRISPR gRNA sequence
tatcaccaaaaggaaaaaac

SEQ ID NO: 533557 - DNA, 20 bp, Artificial
  CRISPR gRNA sequence
cccctcttttgtcccaccgc

SEQ ID NO: 533558 - DNA, 20 bp, Artificial
  CRISPR gRNA sequence
ttttgtcccaccgcaggccc

SEQ ID NO: 533559 - DNA, 20 bp, Artificial
  CRISPR gRNA sequence
ttgtcccaccgcaggcccca

SEQ ID NO: 533560 - DNA, 20 bp, Artificial
  CRISPR gRNA sequence
tgtcccaccgcaggccccag

SEQ ID NO: 533561 - DNA, 20 bp, Artificial
  CRISPR gRNA sequence
gtcccaccgcaggccccagc

SEQ ID NO: 533562 - DNA, 20 bp, Artificial
  CRISPR gRNA sequence
tcccaccgcaggccccagca

SEQ ID NO: 533563 - DNA, 20 bp, Artificial
  CRISPR gRNA sequence
atggggatgacaccttgaat

SEQ ID NO: 533564 - DNA, 20 bp, Artificial
  CRISPR gRNA sequence
gaatctgcagagaaaatgat

SEQ ID NO: 533565 - DNA, 20 bp, Artificial
  CRISPR gRNA sequence
aatctgcagagaaaatgatg

SEQ ID NO: 533566 - DNA, 20 bp, Artificial
  CRISPR gRNA sequence
cagagaaaatgatggaaata

SEQ ID NO: 533567 - DNA, 20 bp, Artificial
  CRISPR gRNA sequence
cggaatgtcagggttgtagt

SEQ ID NO: 533568 - DNA, 20 bp, Artificial
  CRISPR gRNA sequence
ggaatgtcagggttgtagtc

SEQ ID NO: 533569 - DNA, 20 bp, Artificial
  CRISPR gRNA sequence
tagtcagcggttatagcttg

SEQ ID NO: 533570 - DNA, 20 bp, Artificial
  CRISPR gRNA sequence
tagcttgtttcattttgtgg

SEQ ID NO: 533571 - DNA, 20 bp, Artificial
  CRISPR gRNA sequence
gtttcattttgtggttagct

SEQ ID NO: 533572 - DNA, 20 bp, Artificial
  CRISPR gRNA sequence
tttcattttgtggttagctt

SEQ ID NO: 533573 - DNA, 20 bp, Artificial
  CRISPR gRNA sequence
cattttgtggttagcttgat

SEQ ID NO: 533574 - DNA, 20 bp, Artificial
  CRISPR gRNA sequence
attttgtggttagcttgatt

SEQ ID NO: 533575 - DNA, 20 bp, Artificial
  CRISPR gRNA sequence
tgtggttagcttgatttttg

SEQ ID NO: 533576 - DNA, 20 bp, Artificial
  CRISPR gRNA sequence
gtggttagcttgatttttga

SEQ ID NO: 533577 - DNA, 20 bp, Artificial
  CRISPR gRNA sequence
tggttagcttgatttttgaa

SEQ ID NO: 533578 - DNA, 20 bp, Artificial
  CRISPR gRNA sequence
gcttgatttttgaaaaacaa

SEQ ID NO: 533579 - DNA, 20 bp, Artificial
  CRISPR gRNA sequence
gatttttgaaaaacaaattc

SEQ ID NO: 533580 - DNA, 20 bp, Artificial
  CRISPR gRNA sequence
atttttgaaaaacaaattct

SEQ ID NO: 533581 - DNA, 20 bp, Artificial
  CRISPR gRNA sequence
ttgaaaaacaaattcttagt

SEQ ID NO: 533582 - DNA, 20 bp, Artificial
  CRISPR gRNA sequence
tgaaaaacaaattcttagtg

SEQ ID NO: 533583 - DNA, 20 bp, Artificial
  CRISPR gRNA sequence
gaaaaacaaattcttagtgg

SEQ ID NO: 533584 - DNA, 20 bp, Artificial
  CRISPR gRNA sequence
aaaaacaaattcttagtggt

SEQ ID NO: 533585 - DNA, 20 bp, Artificial
  CRISPR gRNA sequence
ttagtggtgacaatgtggga

SEQ ID NO: 533586 - DNA, 20 bp, Artificial
  CRISPR gRNA sequence
agtggtgacaatgtgggagc

SEQ ID NO: 533587 - DNA, 20 bp, Artificial
  CRISPR gRNA sequence
gtggtgacaatgtgggagct

SEQ ID NO: 533588 - DNA, 20 bp, Artificial
  CRISPR gRNA sequence
tgagacactgaatccagttg

SEQ ID NO: 533589 - DNA, 20 bp, Artificial
  CRISPR gRNA sequence
gagacactgaatccagttgg

SEQ ID NO: 533590 - DNA, 20 bp, Artificial
  CRISPR gRNA sequence
agacactgaatccagttggc

SEQ ID NO: 533591 - DNA, 20 bp, Artificial
  CRISPR gRNA sequence
aatccagttggcctcattgg

SEQ ID NO: 533592 - DNA, 20 bp, Artificial
  CRISPR gRNA sequence
gcctcattggaatccaccac

SEQ ID NO: 533593 - DNA, 20 bp, Artificial
  CRISPR gRNA sequence
attggaatccaccactgagg

SEQ ID NO: 533594 - DNA, 20 bp, Artificial
  CRISPR gRNA sequence
gaatccaccactgaggccta

SEQ ID NO: 533595 - DNA, 20 bp, Artificial
  CRISPR gRNA sequence
aggcctacttggtgacaggc

SEQ ID NO: 533596 - DNA, 20 bp, Artificial
  CRISPR gRNA sequence
cttggtgacaggctaatgtg

SEQ ID NO: 533597 - DNA, 20 bp, Artificial
  CRISPR gRNA sequence
ggtgacaggctaatgtgaac

SEQ ID NO: 533598 - DNA, 20 bp, Artificial
  CRISPR gRNA sequence
gtgacaggctaatgtgaaca

SEQ ID NO: 533599 - DNA, 20 bp, Artificial
  CRISPR gRNA sequence
atgtgaacatcttttgaatg

SEQ ID NO: 533600 - DNA, 20 bp, Artificial
  CRISPR gRNA sequence
ttgaatgagccacacttctc

SEQ ID NO: 533601 - DNA, 20 bp, Artificial
  CRISPR gRNA sequence
tgaatgagccacacttctct

SEQ ID NO: 533602 - DNA, 20 bp, Artificial
  CRISPR gRNA sequence
gaatgagccacacttctcta

SEQ ID NO: 533603 - DNA, 20 bp, Artificial
  CRISPR gRNA sequence
aatgagccacacttctctac

SEQ ID NO: 533604 - DNA, 20 bp, Artificial
  CRISPR gRNA sequence
ctctacataggcagaaaggt

SEQ ID NO: 533605 - DNA, 20 bp, Artificial
  CRISPR gRNA sequence
tctacataggcagaaaggtt

SEQ ID NO: 533606 - DNA, 20 bp, Artificial
  CRISPR gRNA sequence
tacataggcagaaaggttag

SEQ ID NO: 533607 - DNA, 20 bp, Artificial
  CRISPR gRNA sequence
cataggcagaaaggttagct

SEQ ID NO: 533608 - DNA, 20 bp, Artificial
  CRISPR gRNA sequence
gctccaaaacaccgtttcta

SEQ ID NO: 533609 - DNA, 20 bp, Artificial
  CRISPR gRNA sequence
caaaacaccgtttctaggaa

SEQ ID NO: 533610 - DNA, 20 bp, Artificial
  CRISPR gRNA sequence
ctaggaataaatgtcctatc

SEQ ID NO: 533611 - DNA, 20 bp, Artificial
  CRISPR gRNA sequence
taggaataaatgtcctatct

SEQ ID NO: 533612 - DNA, 20 bp, Artificial
  CRISPR gRNA sequence
ggaataaatgtcctatctat

SEQ ID NO: 533613 - DNA, 20 bp, Artificial
  CRISPR gRNA sequence
tctatgggtggcccaaggtg

SEQ ID NO: 533614 - DNA, 20 bp, Artificial
  CRISPR gRNA sequence
tgggtggcccaaggtgagtt

SEQ ID NO: 533615 - DNA, 20 bp, Artificial
  CRISPR gRNA sequence
aggaccaagctcctagaaac

SEQ ID NO: 533616 - DNA, 20 bp, Artificial
  CRISPR gRNA sequence
ctagaaacacagggaaaatc

SEQ ID NO: 533617 - DNA, 20 bp, Artificial
  CRISPR gRNA sequence
gaaacacagggaaaatcatt

SEQ ID NO: 533618 - DNA, 20 bp, Artificial
  CRISPR gRNA sequence
aggtcatcaggtagtcacag

SEQ ID NO: 533619 - DNA, 20 bp, Artificial
  CRISPR gRNA sequence
ttctaaagcagggtgcctgt

SEQ ID NO: 533620 - DNA, 20 bp, Artificial
  CRISPR gRNA sequence
taaagcagggtgcctgtgcc

SEQ ID NO: 533621 - DNA, 20 bp, Artificial
  CRISPR gRNA sequence
aagcagggtgcctgtgcccc

SEQ ID NO: 533622 - DNA, 20 bp, Artificial
  CRISPR gRNA sequence
tgccccctttgctaattctc

SEQ ID NO: 533623 - DNA, 20 bp, Artificial
  CRISPR gRNA sequence
tgctaattctctgttcgagg

SEQ ID NO: 533624 - DNA, 20 bp, Artificial
  CRISPR gRNA sequence
gctaattctctgttcgaggg

SEQ ID NO: 533625 - DNA, 20 bp, Artificial
  CRISPR gRNA sequence
ctaattctctgttcgaggga

SEQ ID NO: 533626 - DNA, 20 bp, Artificial
  CRISPR gRNA sequence
attctctgttcgagggatgt

SEQ ID NO: 533627 - DNA, 20 bp, Artificial
  CRISPR gRNA sequence
tctgttcgagggatgtgtta

SEQ ID NO: 533628 - DNA, 20 bp, Artificial
  CRISPR gRNA sequence
tgttcgagggatgtgttagg

SEQ ID NO: 533629 - DNA, 20 bp, Artificial
  CRISPR gRNA sequence
ttcgagggatgtgttagggt

SEQ ID NO: 533630 - DNA, 20 bp, Artificial
  CRISPR gRNA sequence
gagggatgtgttagggttga

SEQ ID NO: 533631 - DNA, 20 bp, Artificial
  CRISPR gRNA sequence
gggttgagagtttttcctca

SEQ ID NO: 533632 - DNA, 20 bp, Artificial
  CRISPR gRNA sequence
agagtttttcctcagatcag

SEQ ID NO: 533633 - DNA, 20 bp, Artificial
  CRISPR gRNA sequence
ttcctcagatcaggcctgtc

SEQ ID NO: 533634 - DNA, 20 bp, Artificial
  CRISPR gRNA sequence
tcctcagatcaggcctgtct

SEQ ID NO: 533635 - DNA, 20 bp, Artificial
  CRISPR gRNA sequence
cctcagatcaggcctgtctg

SEQ ID NO: 533636 - DNA, 20 bp, Artificial
  CRISPR gRNA sequence
ctcagatcaggcctgtctga

SEQ ID NO: 533637 - DNA, 20 bp, Artificial
  CRISPR gRNA sequence
agatcaggcctgtctgacaa

SEQ ID NO: 533638 - DNA, 20 bp, Artificial
  CRISPR gRNA sequence
tctgacaatctatcagcaat

SEQ ID NO: 533639 - DNA, 20 bp, Artificial
  CRISPR gRNA sequence
acaatctatcagcaatgaaa

SEQ ID NO: 533640 - DNA, 20 bp, Artificial
  CRISPR gRNA sequence
tcagcaatgaaaaggttatg

SEQ ID NO: 533641 - DNA, 20 bp, Artificial
  CRISPR gRNA sequence
tgcttgcaagtggggagccg

SEQ ID NO: 533642 - DNA, 20 bp, Artificial
  CRISPR gRNA sequence
gcaagtggggagccggctta

SEQ ID NO: 533643 - DNA, 20 bp, Artificial
  CRISPR gRNA sequence
caagtggggagccggcttag

SEQ ID NO: 533644 - DNA, 20 bp, Artificial
  CRISPR gRNA sequence
agggagcatccaggccaccc

SEQ ID NO: 533645 - DNA, 20 bp, Artificial
  CRISPR gRNA sequence
gggagcatccaggccaccca

SEQ ID NO: 533646 - DNA, 20 bp, Artificial
  CRISPR gRNA sequence
cagagaatggccaacccggg

SEQ ID NO: 533647 - DNA, 20 bp, Artificial
  CRISPR gRNA sequence
agagaatggccaacccgggg

SEQ ID NO: 533648 - DNA, 20 bp, Artificial
  CRISPR gRNA sequence
tggggggcacagatgagggt

SEQ ID NO: 533649 - DNA, 20 bp, Artificial
  CRISPR gRNA sequence
gcgggacttgcagccaaggg

SEQ ID NO: 533650 - DNA, 20 bp, Artificial
  CRISPR gRNA sequence
gcagccaagggaacaggccc

SEQ ID NO: 533651 - DNA, 20 bp, Artificial
  CRISPR gRNA sequence
cagccaagggaacaggccct

SEQ ID NO: 533652 - DNA, 20 bp, Artificial
  CRISPR gRNA sequence
gggttctctgcaattcacgt

SEQ ID NO: 533653 - DNA, 20 bp, Artificial
  CRISPR gRNA sequence
tctgcaattcacgttcacag

SEQ ID NO: 533654 - DNA, 20 bp, Artificial
  CRISPR gRNA sequence
tgcaattcacgttcacagca

SEQ ID NO: 533655 - DNA, 20 bp, Artificial
  CRISPR gRNA sequence
caattcacgttcacagcagg

SEQ ID NO: 533656 - DNA, 20 bp, Artificial
  CRISPR gRNA sequence
acgttcacagcaggacttgg

SEQ ID NO: 533657 - DNA, 20 bp, Artificial
  CRISPR gRNA sequence
acagcaggacttggtctctc

SEQ ID NO: 533658 - DNA, 20 bp, Artificial
  CRISPR gRNA sequence
ggtctctccctagaaccggc

SEQ ID NO: 533659 - DNA, 20 bp, Artificial
  CRISPR gRNA sequence
gtctctccctagaaccggca

SEQ ID NO: 533660 - DNA, 20 bp, Artificial
  CRISPR gRNA sequence
tccctagaaccggcaggcac

SEQ ID NO: 533661 - DNA, 20 bp, Artificial
  CRISPR gRNA sequence
cctagaaccggcaggcacag

SEQ ID NO: 533662 - DNA, 20 bp, Artificial
  CRISPR gRNA sequence
gaaccggcaggcacagccac

SEQ ID NO: 533663 - DNA, 20 bp, Artificial
  CRISPR gRNA sequence
cttccagtgctgcccaggga

SEQ ID NO: 533664 - DNA, 20 bp, Artificial
  CRISPR gRNA sequence
ccagtgctgcccagggaggt

SEQ ID NO: 533665 - DNA, 20 bp, Artificial
  CRISPR gRNA sequence
cagtgctgcccagggaggtg

SEQ ID NO: 533666 - DNA, 20 bp, Artificial
  CRISPR gRNA sequence
cccagggaggtggtccaaac

SEQ ID NO: 533667 - DNA, 20 bp, Artificial
  CRISPR gRNA sequence
ccccaggcaccggtggcctt

SEQ ID NO: 533668 - DNA, 20 bp, Artificial
  CRISPR gRNA sequence
cccaggcaccggtggccttg

SEQ ID NO: 533669 - DNA, 20 bp, Artificial
  CRISPR gRNA sequence
gggccccgtgccctctggat

SEQ ID NO: 533670 - DNA, 20 bp, Artificial
  CRISPR gRNA sequence
ggccccgtgccctctggatt

SEQ ID NO: 533671 - DNA, 20 bp, Artificial
  CRISPR gRNA sequence
tggatttggcttctttacct

SEQ ID NO: 533672 - DNA, 20 bp, Artificial
  CRISPR gRNA sequence
gatttggcttctttacctca

SEQ ID NO: 533673 - DNA, 20 bp, Artificial
  CRISPR gRNA sequence
ggcttctttacctcagattt

SEQ ID NO: 533674 - DNA, 20 bp, Artificial
  CRISPR gRNA sequence
gcttctttacctcagatttc

SEQ ID NO: 533675 - DNA, 20 bp, Artificial
  CRISPR gRNA sequence
ctttacctcagatttcttcc

SEQ ID NO: 533676 - DNA, 20 bp, Artificial
  CRISPR gRNA sequence
tttacctcagatttcttcct

SEQ ID NO: 533677 - DNA, 20 bp, Artificial
  CRISPR gRNA sequence
tacctcagatttcttcctca

SEQ ID NO: 533678 - DNA, 20 bp, Artificial
  CRISPR gRNA sequence
acctcagatttcttcctcag

SEQ ID NO: 533679 - DNA, 20 bp, Artificial
  CRISPR gRNA sequence
cctcagatttcttcctcagt

SEQ ID NO: 533680 - DNA, 20 bp, Artificial
  CRISPR gRNA sequence
agatttcttcctcagttctc

SEQ ID NO: 533681 - DNA, 20 bp, Artificial
  CRISPR gRNA sequence
cttcctcagttctccttctg

SEQ ID NO: 533682 - DNA, 20 bp, Artificial
  CRISPR gRNA sequence
ttcctcagttctccttctgc

SEQ ID NO: 533683 - DNA, 20 bp, Artificial
  CRISPR gRNA sequence
cctcagttctccttctgcct

SEQ ID NO: 533684 - DNA, 20 bp, Artificial
  CRISPR gRNA sequence
ctcagttctccttctgcctc

SEQ ID NO: 533685 - DNA, 20 bp, Artificial
  CRISPR gRNA sequence
agttctccttctgcctcccc

SEQ ID NO: 533686 - DNA, 20 bp, Artificial
  CRISPR gRNA sequence
tccttctgcctccccatcag

SEQ ID NO: 533687 - DNA, 20 bp, Artificial
  CRISPR gRNA sequence
cttctgcctccccatcaggc

SEQ ID NO: 533688 - DNA, 20 bp, Artificial
  CRISPR gRNA sequence
ctgcctccccatcaggctgc

SEQ ID NO: 533689 - DNA, 20 bp, Artificial
  CRISPR gRNA sequence
tgcctccccatcaggctgcg

SEQ ID NO: 533690 - DNA, 20 bp, Artificial
  CRISPR gRNA sequence
cctccccatcaggctgcggt

SEQ ID NO: 533691 - DNA, 20 bp, Artificial
  CRISPR gRNA sequence
cccatcaggctgcggtccct

SEQ ID NO: 533692 - DNA, 20 bp, Artificial
  CRISPR gRNA sequence
cggtccctcagccccacgtc

SEQ ID NO: 533693 - DNA, 20 bp, Artificial
  CRISPR gRNA sequence
agccccacgtcccatcacgt

SEQ ID NO: 533694 - DNA, 20 bp, Artificial
  CRISPR gRNA sequence
cccccagcccaggccccgaa

SEQ ID NO: 533695 - DNA, 20 bp, Artificial
  CRISPR gRNA sequence
aacttagtcccattcttccc

SEQ ID NO: 533696 - DNA, 20 bp, Artificial
  CRISPR gRNA sequence
agtcccattcttcccaccac

SEQ ID NO: 533697 - DNA, 20 bp, Artificial
  CRISPR gRNA sequence
gtcccattcttcccaccacg

SEQ ID NO: 533698 - DNA, 20 bp, Artificial
  CRISPR gRNA sequence
ttcccaccacgactgtccca

SEQ ID NO: 533699 - DNA, 20 bp, Artificial
  CRISPR gRNA sequence
cccaccacgactgtcccaca

SEQ ID NO: 533700 - DNA, 20 bp, Artificial
  CRISPR gRNA sequence
ccaccacgactgtcccacac

SEQ ID NO: 533701 - DNA, 20 bp, Artificial
  CRISPR gRNA sequence
tcccacactttccaccacag

SEQ ID NO: 533702 - DNA, 20 bp, Artificial
  CRISPR gRNA sequence
tccaccacagcacagcagaa

SEQ ID NO: 533703 - DNA, 20 bp, Artificial
  CRISPR gRNA sequence
ccaccacagcacagcagaat

SEQ ID NO: 533704 - DNA, 20 bp, Artificial
  CRISPR gRNA sequence
caccacagcacagcagaatc

SEQ ID NO: 533705 - DNA, 20 bp, Artificial
  CRISPR gRNA sequence
gcagggcccttaggcatgcc

SEQ ID NO: 533706 - DNA, 20 bp, Artificial
  CRISPR gRNA sequence
aggcatgcctggcttatcct

SEQ ID NO: 533707 - DNA, 20 bp, Artificial
  CRISPR gRNA sequence
ggcatgcctggcttatcctc

SEQ ID NO: 533708 - DNA, 20 bp, Artificial
  CRISPR gRNA sequence
gcttatcctcctctgtgccc

SEQ ID NO: 533709 - DNA, 20 bp, Artificial
  CRISPR gRNA sequence
atcctcctctgtgcccagct

SEQ ID NO: 533710 - DNA, 20 bp, Artificial
  CRISPR gRNA sequence
tcctcctctgtgcccagctc

SEQ ID NO: 533711 - DNA, 20 bp, Artificial
  CRISPR gRNA sequence
ctctgtgcccagctctggct

SEQ ID NO: 533712 - DNA, 20 bp, Artificial
  CRISPR gRNA sequence
tgtgcccagctctggctgtt

SEQ ID NO: 533713 - DNA, 20 bp, Artificial
  CRISPR gRNA sequence
tgcccagctctggctgttct

SEQ ID NO: 533714 - DNA, 20 bp, Artificial
  CRISPR gRNA sequence
tggctgttctccatgctcct

SEQ ID NO: 533715 - DNA, 20 bp, Artificial
  CRISPR gRNA sequence
gctgttctccatgctcctct

SEQ ID NO: 533716 - DNA, 20 bp, Artificial
  CRISPR gRNA sequence
ttctccatgctcctctccat

SEQ ID NO: 533717 - DNA, 20 bp, Artificial
  CRISPR gRNA sequence
tccatgctcctctccatgct

SEQ ID NO: 533718 - DNA, 20 bp, Artificial
  CRISPR gRNA sequence
catgctcctctccatgctcc

SEQ ID NO: 533719 - DNA, 20 bp, Artificial
  CRISPR gRNA sequence
ctctccatgctccttctcca

SEQ ID NO: 533720 - DNA, 20 bp, Artificial
  CRISPR gRNA sequence
tccatgctccttctccattg

SEQ ID NO: 533721 - DNA, 20 bp, Artificial
  CRISPR gRNA sequence
catgctccttctccattgac

SEQ ID NO: 533722 - DNA, 20 bp, Artificial
  CRISPR gRNA sequence
cttctccattgactaatggt

SEQ ID NO: 533723 - DNA, 20 bp, Artificial
  CRISPR gRNA sequence
ctccattgactaatggtcaa

SEQ ID NO: 533724 - DNA, 20 bp, Artificial
  CRISPR gRNA sequence
tccattgactaatggtcaaa

SEQ ID NO: 533725 - DNA, 20 bp, Artificial
  CRISPR gRNA sequence
cattgactaatggtcaaaga

SEQ ID NO: 533726 - DNA, 20 bp, Artificial
  CRISPR gRNA sequence
actaatggtcaaagaccata

SEQ ID NO: 533727 - DNA, 20 bp, Artificial
  CRISPR gRNA sequence
atggtcaaagaccatatctt

SEQ ID NO: 533728 - DNA, 20 bp, Artificial
  CRISPR gRNA sequence
cttccaaggtggacctcact

SEQ ID NO: 533729 - DNA, 20 bp, Artificial
  CRISPR gRNA sequence
ttccaaggtggacctcactt

SEQ ID NO: 533730 - DNA, 20 bp, Artificial
  CRISPR gRNA sequence
ccaaggtggacctcacttgt

SEQ ID NO: 533731 - DNA, 20 bp, Artificial
  CRISPR gRNA sequence
caaggtggacctcacttgtc

SEQ ID NO: 533732 - DNA, 20 bp, Artificial
  CRISPR gRNA sequence
acttgtcaccccaagacaag

SEQ ID NO: 533733 - DNA, 20 bp, Artificial
  CRISPR gRNA sequence
gtcaccccaagacaaggcaa

SEQ ID NO: 533734 - DNA, 20 bp, Artificial
  CRISPR gRNA sequence
tcaccccaagacaaggcaat

SEQ ID NO: 533735 - DNA, 20 bp, Artificial
  CRISPR gRNA sequence
tgccatcaccaggctgagaa

SEQ ID NO: 533736 - DNA, 20 bp, Artificial
  CRISPR gRNA sequence
ccatcaccaggctgagaaga

SEQ ID NO: 533737 - DNA, 20 bp, Artificial
  CRISPR gRNA sequence
agaagaatgatggttagctc

SEQ ID NO: 533738 - DNA, 20 bp, Artificial
  CRISPR gRNA sequence
gctcatgctgataaaaaagt

SEQ ID NO: 533739 - DNA, 20 bp, Artificial
  CRISPR gRNA sequence
atgctgataaaaaagtcgtt

SEQ ID NO: 533740 - DNA, 20 bp, Artificial
  CRISPR gRNA sequence
ataaaaaagtcgttagtctc

SEQ ID NO: 533741 - DNA, 20 bp, Artificial
  CRISPR gRNA sequence
gtctctgtgttttatgtcta

SEQ ID NO: 533742 - DNA, 20 bp, Artificial
  CRISPR gRNA sequence
tgtgttttatgtctattagt

SEQ ID NO: 533743 - DNA, 20 bp, Artificial
  CRISPR gRNA sequence
tgttttatgtctattagtgc

SEQ ID NO: 533744 - DNA, 20 bp, Artificial
  CRISPR gRNA sequence
tatgtctattagtgcatcca

SEQ ID NO: 533745 - DNA, 20 bp, Artificial
  CRISPR gRNA sequence
atgtctattagtgcatccag

SEQ ID NO: 533746 - DNA, 20 bp, Artificial
  CRISPR gRNA sequence
tgtctattagtgcatccagc

SEQ ID NO: 533747 - DNA, 20 bp, Artificial
  CRISPR gRNA sequence
ttagtgcatccagctttcag

SEQ ID NO: 533748 - DNA, 20 bp, Artificial
  CRISPR gRNA sequence
gtgcatccagctttcagagt

SEQ ID NO: 533749 - DNA, 20 bp, Artificial
  CRISPR gRNA sequence
tcagagtgatcttaggagat

SEQ ID NO: 533750 - DNA, 20 bp, Artificial
  CRISPR gRNA sequence
cagagtgatcttaggagata

SEQ ID NO: 533751 - DNA, 20 bp, Artificial
  CRISPR gRNA sequence
agagtgatcttaggagatag

SEQ ID NO: 533752 - DNA, 20 bp, Artificial
  CRISPR gRNA sequence
aggagatagataacaacaca

SEQ ID NO: 533753 - DNA, 20 bp, Artificial
  CRISPR gRNA sequence
ggagatagataacaacacag

SEQ ID NO: 533754 - DNA, 20 bp, Artificial
  CRISPR gRNA sequence
aagttcagtgaggttcaatt

SEQ ID NO: 533755 - DNA, 20 bp, Artificial
  CRISPR gRNA sequence
agttcagtgaggttcaatta

SEQ ID NO: 533756 - DNA, 20 bp, Artificial
  CRISPR gRNA sequence
agtgaggttcaattatttgc

SEQ ID NO: 533757 - DNA, 20 bp, Artificial
  CRISPR gRNA sequence
aattatttgccttaaatcct

SEQ ID NO: 533758 - DNA, 20 bp, Artificial
  CRISPR gRNA sequence
tttgccttaaatcctatggc

SEQ ID NO: 533759 - DNA, 20 bp, Artificial
  CRISPR gRNA sequence
gccttaaatcctatggccag

SEQ ID NO: 533760 - DNA, 20 bp, Artificial
  CRISPR gRNA sequence
ccttaaatcctatggccagt

SEQ ID NO: 533761 - DNA, 20 bp, Artificial
  CRISPR gRNA sequence
aaatcctatggccagtaggt

SEQ ID NO: 533762 - DNA, 20 bp, Artificial
  CRISPR gRNA sequence
aatcctatggccagtaggtt

SEQ ID NO: 533763 - DNA, 20 bp, Artificial
  CRISPR gRNA sequence
tggccagtaggttgactcag

SEQ ID NO: 533764 - DNA, 20 bp, Artificial
  CRISPR gRNA sequence
actcaggcctaggccgaggc

SEQ ID NO: 533765 - DNA, 20 bp, Artificial
  CRISPR gRNA sequence
aggcctaggccgaggcaagg

SEQ ID NO: 533766 - DNA, 20 bp, Artificial
  CRISPR gRNA sequence
ggccgaggcaaggagcccag

SEQ ID NO: 533767 - DNA, 20 bp, Artificial
  CRISPR gRNA sequence
aaggcatagaatttaaggag

SEQ ID NO: 533768 - DNA, 20 bp, Artificial
  CRISPR gRNA sequence
aggcatagaatttaaggagg

SEQ ID NO: 533769 - DNA, 20 bp, Artificial
  CRISPR gRNA sequence
aaggaggctggcctgccctt

SEQ ID NO: 533770 - DNA, 20 bp, Artificial
  CRISPR gRNA sequence
aggaggctggcctgcccttg

SEQ ID NO: 533771 - DNA, 20 bp, Artificial
  CRISPR gRNA sequence
gcctgcccttgcacaacctg

SEQ ID NO: 533772 - DNA, 20 bp, Artificial
  CRISPR gRNA sequence
cccttgcacaacctgaaagt

SEQ ID NO: 533773 - DNA, 20 bp, Artificial
  CRISPR gRNA sequence
gcacaacctgaaagttggtg

SEQ ID NO: 533774 - DNA, 20 bp, Artificial
  CRISPR gRNA sequence
cacaacctgaaagttggtgt

SEQ ID NO: 533775 - DNA, 20 bp, Artificial
  CRISPR gRNA sequence
aaagttggtgtgtctttaaa

SEQ ID NO: 533776 - DNA, 20 bp, Artificial
  CRISPR gRNA sequence
gtgtgtctttaaactgcatg

SEQ ID NO: 533777 - DNA, 20 bp, Artificial
  CRISPR gRNA sequence
taaactgcatgcctgtcagc

SEQ ID NO: 533778 - DNA, 20 bp, Artificial
  CRISPR gRNA sequence
aaactgcatgcctgtcagcc

SEQ ID NO: 533779 - DNA, 20 bp, Artificial
  CRISPR gRNA sequence
aactgcatgcctgtcagcct

SEQ ID NO: 533780 - DNA, 20 bp, Artificial
  CRISPR gRNA sequence
catgcctgtcagcctcgctt

SEQ ID NO: 533781 - DNA, 20 bp, Artificial
  CRISPR gRNA sequence
tcagcctcgcttgcctcatt

SEQ ID NO: 533782 - DNA, 20 bp, Artificial
  CRISPR gRNA sequence
gcttgcctcattccagtcat

SEQ ID NO: 533783 - DNA, 20 bp, Artificial
  CRISPR gRNA sequence
gcctcattccagtcatgccc

SEQ ID NO: 533784 - DNA, 20 bp, Artificial
  CRISPR gRNA sequence
cctcattccagtcatgccct

SEQ ID NO: 533785 - DNA, 20 bp, Artificial
  CRISPR gRNA sequence
attccagtcatgccctgggt

SEQ ID NO: 533786 - DNA, 20 bp, Artificial
  CRISPR gRNA sequence
cagtcatgccctgggttgag

SEQ ID NO: 533787 - DNA, 20 bp, Artificial
  CRISPR gRNA sequence
ggttgagtaaccaggagatg

SEQ ID NO: 533788 - DNA, 20 bp, Artificial
  CRISPR gRNA sequence
agtaaccaggagatgcaaac

SEQ ID NO: 533789 - DNA, 20 bp, Artificial
  CRISPR gRNA sequence
gaggaattcctgggagcaca

SEQ ID NO: 533790 - DNA, 20 bp, Artificial
  CRISPR gRNA sequence
ctgggagcacacatttaggc

SEQ ID NO: 533791 - DNA, 20 bp, Artificial
  CRISPR gRNA sequence
ggagcacacatttaggcgcc

SEQ ID NO: 533792 - DNA, 20 bp, Artificial
  CRISPR gRNA sequence
aggcgccagctgcagctgct

SEQ ID NO: 533793 - DNA, 20 bp, Artificial
  CRISPR gRNA sequence
ggcgccagctgcagctgctg

SEQ ID NO: 533794 - DNA, 20 bp, Artificial
  CRISPR gRNA sequence
cagctgctggagtgggtagg

SEQ ID NO: 533795 - DNA, 20 bp, Artificial
  CRISPR gRNA sequence
ctggagtgggtaggctgagg

SEQ ID NO: 533796 - DNA, 20 bp, Artificial
  CRISPR gRNA sequence
gagtgggtaggctgaggacc

SEQ ID NO: 533797 - DNA, 20 bp, Artificial
  CRISPR gRNA sequence
aggacccactgtcctgcttg

SEQ ID NO: 533798 - DNA, 20 bp, Artificial
  CRISPR gRNA sequence
tcctgcttgaaccaggcagg

SEQ ID NO: 533799 - DNA, 20 bp, Artificial
  CRISPR gRNA sequence
cttgaaccaggcagggtgca

SEQ ID NO: 533800 - DNA, 20 bp, Artificial
  CRISPR gRNA sequence
gaaccaggcagggtgcacag

SEQ ID NO: 533801 - DNA, 20 bp, Artificial
  CRISPR gRNA sequence
aaccaggcagggtgcacaga

SEQ ID NO: 533802 - DNA, 20 bp, Artificial
  CRISPR gRNA sequence
gtctgtccaaccctgcctgc

SEQ ID NO: 533803 - DNA, 20 bp, Artificial
  CRISPR gRNA sequence
tctgtccaaccctgcctgca

SEQ ID NO: 533804 - DNA, 20 bp, Artificial
  CRISPR gRNA sequence
tccaaccctgcctgcagtct

SEQ ID NO: 533805 - DNA, 20 bp, Artificial
  CRISPR gRNA sequence
cctgcagtctcagccatgtg

SEQ ID NO: 533806 - DNA, 20 bp, Artificial
  CRISPR gRNA sequence
cagtctcagccatgtggcta

SEQ ID NO: 533807 - DNA, 20 bp, Artificial
  CRISPR gRNA sequence
agccatgtggctacacccca

SEQ ID NO: 533808 - DNA, 20 bp, Artificial
  CRISPR gRNA sequence
caccccattcctcctaccag

SEQ ID NO: 533809 - DNA, 20 bp, Artificial
  CRISPR gRNA sequence
ctcctaccagagctcatgtg

SEQ ID NO: 533810 - DNA, 20 bp, Artificial
  CRISPR gRNA sequence
ctaccagagctcatgtgcct

SEQ ID NO: 533811 - DNA, 20 bp, Artificial
  CRISPR gRNA sequence
ccagagctcatgtgcctctg

SEQ ID NO: 533812 - DNA, 20 bp, Artificial
  CRISPR gRNA sequence
atgtgcctctgtctacactt

SEQ ID NO: 533813 - DNA, 20 bp, Artificial
  CRISPR gRNA sequence
tgtctacactttctggtggc

SEQ ID NO: 533814 - DNA, 20 bp, Artificial
  CRISPR gRNA sequence
tctacactttctggtggccc

SEQ ID NO: 533815 - DNA, 20 bp, Artificial
  CRISPR gRNA sequence
cactttctggtggccctggg

SEQ ID NO: 533816 - DNA, 20 bp, Artificial
  CRISPR gRNA sequence
tctggtggccctgggctctt

SEQ ID NO: 533817 - DNA, 20 bp, Artificial
  CRISPR gRNA sequence
ctggtggccctgggctcttc

SEQ ID NO: 533818 - DNA, 20 bp, Artificial
  CRISPR gRNA sequence
tggtggccctgggctcttca

SEQ ID NO: 533819 - DNA, 20 bp, Artificial
  CRISPR gRNA sequence
gtggccctgggctcttcaca

SEQ ID NO: 533820 - DNA, 20 bp, Artificial
  CRISPR gRNA sequence
ggctcttcacagaaattgac

SEQ ID NO: 533821 - DNA, 20 bp, Artificial
  CRISPR gRNA sequence
ttcacagaaattgacattgc

SEQ ID NO: 533822 - DNA, 20 bp, Artificial
  CRISPR gRNA sequence
cacagaaattgacattgcga

SEQ ID NO: 533823 - DNA, 20 bp, Artificial
  CRISPR gRNA sequence
acagaaattgacattgcgat

SEQ ID NO: 533824 - DNA, 20 bp, Artificial
  CRISPR gRNA sequence
acattgcgattttcagttct

SEQ ID NO: 533825 - DNA, 20 bp, Artificial
  CRISPR gRNA sequence
cgattttcagttcttgtttg

SEQ ID NO: 533826 - DNA, 20 bp, Artificial
  CRISPR gRNA sequence
tcagttcttgtttgcctctt

SEQ ID NO: 533827 - DNA, 20 bp, Artificial
  CRISPR gRNA sequence
cagttcttgtttgcctctta

SEQ ID NO: 533828 - DNA, 20 bp, Artificial
  CRISPR gRNA sequence
agttcttgtttgcctcttac

SEQ ID NO: 533829 - DNA, 20 bp, Artificial
  CRISPR gRNA sequence
ttgtttgcctcttacttgat

SEQ ID NO: 533830 - DNA, 20 bp, Artificial
  CRISPR gRNA sequence
gtttgcctcttacttgattt

SEQ ID NO: 533831 - DNA, 20 bp, Artificial
  CRISPR gRNA sequence
tttgcctcttacttgatttt

SEQ ID NO: 533832 - DNA, 20 bp, Artificial
  CRISPR gRNA sequence
gcctcttacttgattttagg

SEQ ID NO: 533833 - DNA, 20 bp, Artificial
  CRISPR gRNA sequence
cctcttacttgattttaggc

SEQ ID NO: 533834 - DNA, 20 bp, Artificial
  CRISPR gRNA sequence
ttacttgattttaggcttcc

SEQ ID NO: 533835 - DNA, 20 bp, Artificial
  CRISPR gRNA sequence
acttgattttaggcttcctg

SEQ ID NO: 533836 - DNA, 20 bp, Artificial
  CRISPR gRNA sequence
cttgattttaggcttcctga

SEQ ID NO: 533837 - DNA, 20 bp, Artificial
  CRISPR gRNA sequence
gattttaggcttcctgagga

SEQ ID NO: 533838 - DNA, 20 bp, Artificial
  CRISPR gRNA sequence
attttaggcttcctgaggac

SEQ ID NO: 533839 - DNA, 20 bp, Artificial
  CRISPR gRNA sequence
taggcttcctgaggacaatt

SEQ ID NO: 533840 - DNA, 20 bp, Artificial
  CRISPR gRNA sequence
aggcttcctgaggacaattt

SEQ ID NO: 533841 - DNA, 20 bp, Artificial
  CRISPR gRNA sequence
ggcttcctgaggacaatttg

SEQ ID NO: 533842 - DNA, 20 bp, Artificial
  CRISPR gRNA sequence
cctgaggacaatttgtgtct

SEQ ID NO: 533843 - DNA, 20 bp, Artificial
  CRISPR gRNA sequence
ctgaggacaatttgtgtcta

SEQ ID NO: 533844 - DNA, 20 bp, Artificial
  CRISPR gRNA sequence
aggacaatttgtgtctaagt

SEQ ID NO: 533845 - DNA, 20 bp, Artificial
  CRISPR gRNA sequence
gtgtctaagtcacaatgaca

SEQ ID NO: 533846 - DNA, 20 bp, Artificial
  CRISPR gRNA sequence
tgtctaagtcacaatgacac

SEQ ID NO: 533847 - DNA, 20 bp, Artificial
  CRISPR gRNA sequence
agtcacaatgacacttaaca

SEQ ID NO: 533848 - DNA, 20 bp, Artificial
  CRISPR gRNA sequence
aacacttggaagatgaggaa

SEQ ID NO: 533849 - DNA, 20 bp, Artificial
  CRISPR gRNA sequence
acacttggaagatgaggaat

SEQ ID NO: 533850 - DNA, 20 bp, Artificial
  CRISPR gRNA sequence
ggaagatgaggaataaatgt

SEQ ID NO: 533851 - DNA, 20 bp, Artificial
  CRISPR gRNA sequence
gaagatgaggaataaatgtt

SEQ ID NO: 533852 - DNA, 20 bp, Artificial
  CRISPR gRNA sequence
gaaggacaaatgaaccaaat

SEQ ID NO: 533853 - DNA, 20 bp, Artificial
  CRISPR gRNA sequence
atatctgtaatctcagcact

SEQ ID NO: 533854 - DNA, 20 bp, Artificial
  CRISPR gRNA sequence
taatctcagcactttgggag

SEQ ID NO: 533855 - DNA, 20 bp, Artificial
  CRISPR gRNA sequence
agcactttgggaggccgagg

SEQ ID NO: 533856 - DNA, 20 bp, Artificial
  CRISPR gRNA sequence
tgggaggccgaggcaggagg

SEQ ID NO: 533857 - DNA, 20 bp, Artificial
  CRISPR gRNA sequence
gggaggccgaggcaggagga

SEQ ID NO: 533858 - DNA, 20 bp, Artificial
  CRISPR gRNA sequence
ggaggccgaggcaggaggat

SEQ ID NO: 533859 - DNA, 20 bp, Artificial
  CRISPR gRNA sequence
gagctcaggagtttgggacc

SEQ ID NO: 533860 - DNA, 20 bp, Artificial
  CRISPR gRNA sequence
agctcaggagtttgggacca

SEQ ID NO: 533861 - DNA, 20 bp, Artificial
  CRISPR gRNA sequence
aggagtttgggaccagcctg

SEQ ID NO: 533862 - DNA, 20 bp, Artificial
  CRISPR gRNA sequence
gggaccagcctgggcaatat

SEQ ID NO: 533863 - DNA, 20 bp, Artificial
  CRISPR gRNA sequence
ggaccagcctgggcaatata

SEQ ID NO: 533864 - DNA, 20 bp, Artificial
  CRISPR gRNA sequence
ggcaatatagtgagacctgg

SEQ ID NO: 533865 - DNA, 20 bp, Artificial
  CRISPR gRNA sequence
gtctctactttaaaaaaaaa

SEQ ID NO: 533866 - DNA, 20 bp, Artificial
  CRISPR gRNA sequence
tactttaaaaaaaaaactta

SEQ ID NO: 533867 - DNA, 20 bp, Artificial
  CRISPR gRNA sequence
ctttaaaaaaaaaacttaaa

SEQ ID NO: 533868 - DNA, 20 bp, Artificial
  CRISPR gRNA sequence
taaaaaaaaaacttaaaaat

SEQ ID NO: 533869 - DNA, 20 bp, Artificial
  CRISPR gRNA sequence
aaaaaaaaaacttaaaaatt

SEQ ID NO: 533870 - DNA, 20 bp, Artificial
  CRISPR gRNA sequence
aaaaaaaaacttaaaaatta

SEQ ID NO: 533871 - DNA, 20 bp, Artificial
  CRISPR gRNA sequence
aaaaattaggtgggtgcatt

SEQ ID NO: 533872 - DNA, 20 bp, Artificial
  CRISPR gRNA sequence
aaaattaggtgggtgcattg

SEQ ID NO: 533873 - DNA, 20 bp, Artificial
  CRISPR gRNA sequence
ggtgggtgcattggtgtatg

SEQ ID NO: 533874 - DNA, 20 bp, Artificial
  CRISPR gRNA sequence
gtgtatgcctgtagtcccag

SEQ ID NO: 533875 - DNA, 20 bp, Artificial
  CRISPR gRNA sequence
tagtcccagctagtcaggag

SEQ ID NO: 533876 - DNA, 20 bp, Artificial
  CRISPR gRNA sequence
gtcaggaggctgaggtgggt

SEQ ID NO: 533877 - DNA, 20 bp, Artificial
  CRISPR gRNA sequence
aggtgggtgaatcatttcag

SEQ ID NO: 533878 - DNA, 20 bp, Artificial
  CRISPR gRNA sequence
cagcccgggagatcaagaat

SEQ ID NO: 533879 - DNA, 20 bp, Artificial
  CRISPR gRNA sequence
agcccgggagatcaagaatg

SEQ ID NO: 533880 - DNA, 20 bp, Artificial
  CRISPR gRNA sequence
cactccagtctgggcaacag

SEQ ID NO: 533881 - DNA, 20 bp, Artificial
  CRISPR gRNA sequence
cagtctgggcaacagagcaa

SEQ ID NO: 533882 - DNA, 20 bp, Artificial
  CRISPR gRNA sequence
ggcaacagagcaaggccctg

SEQ ID NO: 533883 - DNA, 20 bp, Artificial
  CRISPR gRNA sequence
tctcaaaaaaacaaaacaaa

SEQ ID NO: 533884 - DNA, 20 bp, Artificial
  CRISPR gRNA sequence
aaaaaaacaaaacaaataaa

SEQ ID NO: 533885 - DNA, 20 bp, Artificial
  CRISPR gRNA sequence
gccacataggagatgaagaa

SEQ ID NO: 533886 - DNA, 20 bp, Artificial
  CRISPR gRNA sequence
ccacataggagatgaagaag

SEQ ID NO: 533887 - DNA, 20 bp, Artificial
  CRISPR gRNA sequence
ccccataattcagaactagg

SEQ ID NO: 533888 - DNA, 20 bp, Artificial
  CRISPR gRNA sequence
agaactagggccaggggtta

SEQ ID NO: 533889 - DNA, 20 bp, Artificial
  CRISPR gRNA sequence
gggccaggggttagagccct

SEQ ID NO: 533890 - DNA, 20 bp, Artificial
  CRISPR gRNA sequence
gagccctctccacagtctac

SEQ ID NO: 533891 - DNA, 20 bp, Artificial
  CRISPR gRNA sequence
tccacagtctactggacata

SEQ ID NO: 533892 - DNA, 20 bp, Artificial
  CRISPR gRNA sequence
cacagtctactggacataac

SEQ ID NO: 533893 - DNA, 20 bp, Artificial
  CRISPR gRNA sequence
ctggacataacctaagcaat

SEQ ID NO: 533894 - DNA, 20 bp, Artificial
  CRISPR gRNA sequence
gacataacctaagcaatgac

SEQ ID NO: 533895 - DNA, 20 bp, Artificial
  CRISPR gRNA sequence
agcaatgactgcagggcacg

SEQ ID NO: 533896 - DNA, 20 bp, Artificial
  CRISPR gRNA sequence
cagggcacggaagatggcat

SEQ ID NO: 533897 - DNA, 20 bp, Artificial
  CRISPR gRNA sequence
tgtcctttctggaggccctt

SEQ ID NO: 533898 - DNA, 20 bp, Artificial
  CRISPR gRNA sequence
gtcctttctggaggcccttt

SEQ ID NO: 533899 - DNA, 20 bp, Artificial
  CRISPR gRNA sequence
tcctttctggaggccctttc

SEQ ID NO: 533900 - DNA, 20 bp, Artificial
  CRISPR gRNA sequence
tctggaggccctttcctctt

SEQ ID NO: 533901 - DNA, 20 bp, Artificial
  CRISPR gRNA sequence
ctggaggccctttcctcttt

SEQ ID NO: 533902 - DNA, 20 bp, Artificial
  CRISPR gRNA sequence
tggaggccctttcctctttg

SEQ ID NO: 533903 - DNA, 20 bp, Artificial
  CRISPR gRNA sequence
gaggccctttcctctttgtg

SEQ ID NO: 533904 - DNA, 20 bp, Artificial
  CRISPR gRNA sequence
tcctctttgtgcttagagca

SEQ ID NO: 533905 - DNA, 20 bp, Artificial
  CRISPR gRNA sequence
cctctttgtgcttagagcac

SEQ ID NO: 533906 - DNA, 20 bp, Artificial
  CRISPR gRNA sequence
ctctttgtgcttagagcaca

SEQ ID NO: 533907 - DNA, 20 bp, Artificial
  CRISPR gRNA sequence
tttgtgcttagagcacacga

SEQ ID NO: 533908 - DNA, 20 bp, Artificial
  CRISPR gRNA sequence
tgtgcttagagcacacgagc

SEQ ID NO: 533909 - DNA, 20 bp, Artificial
  CRISPR gRNA sequence
gtgcttagagcacacgagcc

SEQ ID NO: 533910 - DNA, 20 bp, Artificial
  CRISPR gRNA sequence
tgcttagagcacacgagcca

SEQ ID NO: 533911 - DNA, 20 bp, Artificial
  CRISPR gRNA sequence
agagcacacgagccatttag

SEQ ID NO: 533912 - DNA, 20 bp, Artificial
  CRISPR gRNA sequence
gagcacacgagccatttagg

SEQ ID NO: 533913 - DNA, 20 bp, Artificial
  CRISPR gRNA sequence
aggtatcaaaatcacattgt

SEQ ID NO: 533914 - DNA, 20 bp, Artificial
  CRISPR gRNA sequence
ggtatcaaaatcacattgtc

SEQ ID NO: 533915 - DNA, 20 bp, Artificial
  CRISPR gRNA sequence
tctaactttgactctacact

SEQ ID NO: 533916 - DNA, 20 bp, Artificial
  CRISPR gRNA sequence
actttgactctacactcaaa

SEQ ID NO: 533917 - DNA, 20 bp, Artificial
  CRISPR gRNA sequence
tgactctacactcaaagcca

SEQ ID NO: 533918 - DNA, 20 bp, Artificial
  CRISPR gRNA sequence
gactctacactcaaagccat

SEQ ID NO: 533919 - DNA, 20 bp, Artificial
  CRISPR gRNA sequence
actctacactcaaagccatc

SEQ ID NO: 533920 - DNA, 20 bp, Artificial
  CRISPR gRNA sequence
tacactcaaagccatctgat

SEQ ID NO: 533921 - DNA, 20 bp, Artificial
  CRISPR gRNA sequence
cactcaaagccatctgatgc

SEQ ID NO: 533922 - DNA, 20 bp, Artificial
  CRISPR gRNA sequence
aaagccatctgatgctcaca

SEQ ID NO: 533923 - DNA, 20 bp, Artificial
  CRISPR gRNA sequence
atgctcacatttcatgtagt

SEQ ID NO: 533924 - DNA, 20 bp, Artificial
  CRISPR gRNA sequence
acatttcatgtagtcagagg

SEQ ID NO: 533925 - DNA, 20 bp, Artificial
  CRISPR gRNA sequence
catgtagtcagaggaggcca

SEQ ID NO: 533926 - DNA, 20 bp, Artificial
  CRISPR gRNA sequence
atgtagtcagaggaggccat

SEQ ID NO: 533927 - DNA, 20 bp, Artificial
  CRISPR gRNA sequence
gtttgaatcaacatccggaa

SEQ ID NO: 533928 - DNA, 20 bp, Artificial
  CRISPR gRNA sequence
gaatcaacatccggaagtta

SEQ ID NO: 533929 - DNA, 20 bp, Artificial
  CRISPR gRNA sequence
aatcaacatccggaagttac

SEQ ID NO: 533930 - DNA, 20 bp, Artificial
  CRISPR gRNA sequence
cagggtgatgcttagagagg

SEQ ID NO: 533931 - DNA, 20 bp, Artificial
  CRISPR gRNA sequence
agagagggcttgtgcttccc

SEQ ID NO: 533932 - DNA, 20 bp, Artificial
  CRISPR gRNA sequence
gagagggcttgtgcttcccc

SEQ ID NO: 533933 - DNA, 20 bp, Artificial
  CRISPR gRNA sequence
gtgcttccccagccacacat

SEQ ID NO: 533934 - DNA, 20 bp, Artificial
  CRISPR gRNA sequence
tgcttccccagccacacatc

SEQ ID NO: 533935 - DNA, 20 bp, Artificial
  CRISPR gRNA sequence
ccccagccacacatctccat

SEQ ID NO: 533936 - DNA, 20 bp, Artificial
  CRISPR gRNA sequence
cccagccacacatctccata

SEQ ID NO: 533937 - DNA, 20 bp, Artificial
  CRISPR gRNA sequence
cataaagatgtaagaggtaa

SEQ ID NO: 533938 - DNA, 20 bp, Artificial
  CRISPR gRNA sequence
tttcagctgggtgcggtggc

SEQ ID NO: 533939 - DNA, 20 bp, Artificial
  CRISPR gRNA sequence
cagctgggtgcggtggctca

SEQ ID NO: 533940 - DNA, 20 bp, Artificial
  CRISPR gRNA sequence
agctgggtgcggtggctcat

SEQ ID NO: 533941 - DNA, 20 bp, Artificial
  CRISPR gRNA sequence
ggtgcggtggctcatacctg

SEQ ID NO: 533942 - DNA, 20 bp, Artificial
  CRISPR gRNA sequence
atacctgtaatcccagcact

SEQ ID NO: 533943 - DNA, 20 bp, Artificial
  CRISPR gRNA sequence
taatcccagcactttgggag

SEQ ID NO: 533944 - DNA, 20 bp, Artificial
  CRISPR gRNA sequence
tgggaggccaaggcaggcag

SEQ ID NO: 533945 - DNA, 20 bp, Artificial
  CRISPR gRNA sequence
gggaggccaaggcaggcaga

SEQ ID NO: 533946 - DNA, 20 bp, Artificial
  CRISPR gRNA sequence
ggaggccaaggcaggcagat

SEQ ID NO: 533947 - DNA, 20 bp, Artificial
  CRISPR gRNA sequence
gtcgggagttcgagaccagc

SEQ ID NO: 533948 - DNA, 20 bp, Artificial
  CRISPR gRNA sequence
gagaccagcctgaccaacat

SEQ ID NO: 533949 - DNA, 20 bp, Artificial
  CRISPR gRNA sequence
accaacatggagaaacgcca

SEQ ID NO: 533950 - DNA, 20 bp, Artificial
  CRISPR gRNA sequence
tactaaaaatacaatattag

SEQ ID NO: 533951 - DNA, 20 bp, Artificial
  CRISPR gRNA sequence
ctaaaaatacaatattagcc

SEQ ID NO: 533952 - DNA, 20 bp, Artificial
  CRISPR gRNA sequence
aaaatacaatattagccggg

SEQ ID NO: 533953 - DNA, 20 bp, Artificial
  CRISPR gRNA sequence
gccgggcgtggtggtgaacg

SEQ ID NO: 533954 - DNA, 20 bp, Artificial
  CRISPR gRNA sequence
taatcccagctactcaggag

SEQ ID NO: 533955 - DNA, 20 bp, Artificial
  CRISPR gRNA sequence
ctcaggaggccgaggcagga

SEQ ID NO: 533956 - DNA, 20 bp, Artificial
  CRISPR gRNA sequence
aggaggccgaggcaggagaa

SEQ ID NO: 533957 - DNA, 20 bp, Artificial
  CRISPR gRNA sequence
tttgaacctgggaggcagag

SEQ ID NO: 533958 - DNA, 20 bp, Artificial
  CRISPR gRNA sequence
gaacctgggaggcagaggct

SEQ ID NO: 533959 - DNA, 20 bp, Artificial
  CRISPR gRNA sequence
aacctgggaggcagaggctg

SEQ ID NO: 533960 - DNA, 20 bp, Artificial
  CRISPR gRNA sequence
ggaggcagaggctgcagtga

SEQ ID NO: 533961 - DNA, 20 bp, Artificial
  CRISPR gRNA sequence
cagtgagccaagatcgcacc

SEQ ID NO: 533962 - DNA, 20 bp, Artificial
  CRISPR gRNA sequence
cactctagcctgggcaacaa

SEQ ID NO: 533963 - DNA, 20 bp, Artificial
  CRISPR gRNA sequence
tagcctgggcaacaagagtg

SEQ ID NO: 533964 - DNA, 20 bp, Artificial
  CRISPR gRNA sequence
gcctgggcaacaagagtgaa

SEQ ID NO: 533965 - DNA, 20 bp, Artificial
  CRISPR gRNA sequence
ggcaacaagagtgaaacttc

SEQ ID NO: 533966 - DNA, 20 bp, Artificial
  CRISPR gRNA sequence
caactcaaaaaaaaaaaaaa

SEQ ID NO: 533967 - DNA, 20 bp, Artificial
  CRISPR gRNA sequence
aactcaaaaaaaaaaaaaaa

SEQ ID NO: 533968 - DNA, 20 bp, Artificial
  CRISPR gRNA sequence
aaaaaaaaaaaaaaaaagag

SEQ ID NO: 533969 - DNA, 20 bp, Artificial
  CRISPR gRNA sequence
tttcaccccagggaaaaact

SEQ ID NO: 533970 - DNA, 20 bp, Artificial
  CRISPR gRNA sequence
caccccagggaaaaacttct

SEQ ID NO: 533971 - DNA, 20 bp, Artificial
  CRISPR gRNA sequence
accccagggaaaaacttctc

SEQ ID NO: 533972 - DNA, 20 bp, Artificial
  CRISPR gRNA sequence
ctcttcctacctccctctgg

SEQ ID NO: 533973 - DNA, 20 bp, Artificial
  CRISPR gRNA sequence
tcttcctacctccctctgga

SEQ ID NO: 533974 - DNA, 20 bp, Artificial
  CRISPR gRNA sequence
ttcctacctccctctggagc

SEQ ID NO: 533975 - DNA, 20 bp, Artificial
  CRISPR gRNA sequence
cctacctccctctggagcca

SEQ ID NO: 533976 - DNA, 20 bp, Artificial
  CRISPR gRNA sequence
ctacctccctctggagccac

SEQ ID NO: 533977 - DNA, 20 bp, Artificial
  CRISPR gRNA sequence
cctccctctggagccactgc

SEQ ID NO: 533978 - DNA, 20 bp, Artificial
  CRISPR gRNA sequence
cctctggagccactgcaaag

SEQ ID NO: 533979 - DNA, 20 bp, Artificial
  CRISPR gRNA sequence
tggagccactgcaaagacgg

SEQ ID NO: 533980 - DNA, 20 bp, Artificial
  CRISPR gRNA sequence
gagccactgcaaagacggcc

SEQ ID NO: 533981 - DNA, 20 bp, Artificial
  CRISPR gRNA sequence
caaagacggccttgggtgca

SEQ ID NO: 533982 - DNA, 20 bp, Artificial
  CRISPR gRNA sequence
gggtgcagggactgaaatac

SEQ ID NO: 533983 - DNA, 20 bp, Artificial
  CRISPR gRNA sequence
ggtgcagggactgaaatacc

SEQ ID NO: 533984 - DNA, 20 bp, Artificial
  CRISPR gRNA sequence
aaatacctaacttacagcct

SEQ ID NO: 533985 - DNA, 20 bp, Artificial
  CRISPR gRNA sequence
acttacagcctaaaggagtc

SEQ ID NO: 533986 - DNA, 20 bp, Artificial
  CRISPR gRNA sequence
acagcctaaaggagtccaga

SEQ ID NO: 533987 - DNA, 20 bp, Artificial
  CRISPR gRNA sequence
cagcctaaaggagtccagag

SEQ ID NO: 533988 - DNA, 20 bp, Artificial
  CRISPR gRNA sequence
aaggagtccagaggggccag

SEQ ID NO: 533989 - DNA, 20 bp, Artificial
  CRISPR gRNA sequence
caggcctctagcagctgggc

SEQ ID NO: 533990 - DNA, 20 bp, Artificial
  CRISPR gRNA sequence
tagcagctgggcaccttcac

SEQ ID NO: 533991 - DNA, 20 bp, Artificial
  CRISPR gRNA sequence
gcagctgggcaccttcacag

SEQ ID NO: 533992 - DNA, 20 bp, Artificial
  CRISPR gRNA sequence
ggcaccttcacagattccct

SEQ ID NO: 533993 - DNA, 20 bp, Artificial
  CRISPR gRNA sequence
cacagattccctgtgatttt

SEQ ID NO: 533994 - DNA, 20 bp, Artificial
  CRISPR gRNA sequence
acagattccctgtgatttta

SEQ ID NO: 533995 - DNA, 20 bp, Artificial
  CRISPR gRNA sequence
cctgtgattttaagagtaca

SEQ ID NO: 533996 - DNA, 20 bp, Artificial
  CRISPR gRNA sequence
tgattttaagagtacaggaa

SEQ ID NO: 533997 - DNA, 20 bp, Artificial
  CRISPR gRNA sequence
taagagtacaggaaaaacta

SEQ ID NO: 533998 - DNA, 20 bp, Artificial
  CRISPR gRNA sequence
aagagtacaggaaaaactac

SEQ ID NO: 533999 - DNA, 20 bp, Artificial
  CRISPR gRNA sequence
agagtacaggaaaaactaca

SEQ ID NO: 534000 - DNA, 20 bp, Artificial
  CRISPR gRNA sequence
cattacgagtagctgtaggc

SEQ ID NO: 534001 - DNA, 20 bp, Artificial
  CRISPR gRNA sequence
cgagtagctgtaggcctgct

SEQ ID NO: 534002 - DNA, 20 bp, Artificial
  CRISPR gRNA sequence
taggcctgctttcatggact

SEQ ID NO: 534003 - DNA, 20 bp, Artificial
  CRISPR gRNA sequence
ctttcatggactgaagtcac

SEQ ID NO: 534004 - DNA, 20 bp, Artificial
  CRISPR gRNA sequence
tcatggactgaagtcacaca

SEQ ID NO: 534005 - DNA, 20 bp, Artificial
  CRISPR gRNA sequence
catggactgaagtcacacaa

SEQ ID NO: 534006 - DNA, 20 bp, Artificial
  CRISPR gRNA sequence
atggactgaagtcacacaaa

SEQ ID NO: 534007 - DNA, 20 bp, Artificial
  CRISPR gRNA sequence
aagtcacacaaagaagaaaa

SEQ ID NO: 534008 - DNA, 20 bp, Artificial
  CRISPR gRNA sequence
aagggtgaggagaggaggag

SEQ ID NO: 534009 - DNA, 20 bp, Artificial
  CRISPR gRNA sequence
tttccctcctaaggccaaga

SEQ ID NO: 534010 - DNA, 20 bp, Artificial
  CRISPR gRNA sequence
tccctcctaaggccaagaac

SEQ ID NO: 534011 - DNA, 20 bp, Artificial
  CRISPR gRNA sequence
ccctcctaaggccaagaaca

SEQ ID NO: 534012 - DNA, 20 bp, Artificial
  CRISPR gRNA sequence
cctcctaaggccaagaacat

SEQ ID NO: 534013 - DNA, 20 bp, Artificial
  CRISPR gRNA sequence
ctaaggccaagaacataggt

SEQ ID NO: 534014 - DNA, 20 bp, Artificial
  CRISPR gRNA sequence
aggccaagaacataggtctt

SEQ ID NO: 534015 - DNA, 20 bp, Artificial
  CRISPR gRNA sequence
gaatttctgagaagcgagta

SEQ ID NO: 534016 - DNA, 20 bp, Artificial
  CRISPR gRNA sequence
aatttctgagaagcgagtaa

SEQ ID NO: 534017 - DNA, 20 bp, Artificial
  CRISPR gRNA sequence
ctgagaagcgagtaaatttc

SEQ ID NO: 534018 - DNA, 20 bp, Artificial
  CRISPR gRNA sequence
tgagaagcgagtaaatttct

SEQ ID NO: 534019 - DNA, 20 bp, Artificial
  CRISPR gRNA sequence
agaagcgagtaaatttctaa

SEQ ID NO: 534020 - DNA, 20 bp, Artificial
  CRISPR gRNA sequence
ctaaggacaaaaagttcctt

SEQ ID NO: 534021 - DNA, 20 bp, Artificial
  CRISPR gRNA sequence
taaggacaaaaagttccttg

SEQ ID NO: 534022 - DNA, 20 bp, Artificial
  CRISPR gRNA sequence
aggacaaaaagttccttgca

SEQ ID NO: 534023 - DNA, 20 bp, Artificial
  CRISPR gRNA sequence
cttgcatgtgttccaacctc

SEQ ID NO: 534024 - DNA, 20 bp, Artificial
  CRISPR gRNA sequence
gcatgtgttccaacctcttg

SEQ ID NO: 534025 - DNA, 20 bp, Artificial
  CRISPR gRNA sequence
catgtgttccaacctcttgc

SEQ ID NO: 534026 - DNA, 20 bp, Artificial
  CRISPR gRNA sequence
caacctcttgccggaaggtg

SEQ ID NO: 534027 - DNA, 20 bp, Artificial
  CRISPR gRNA sequence
ttgccggaaggtggattgca

SEQ ID NO: 534028 - DNA, 20 bp, Artificial
  CRISPR gRNA sequence
gccggaaggtggattgcatg

SEQ ID NO: 534029 - DNA, 20 bp, Artificial
  CRISPR gRNA sequence
ccggaaggtggattgcatga

SEQ ID NO: 534030 - DNA, 20 bp, Artificial
  CRISPR gRNA sequence
catgacagtagaattggggg

SEQ ID NO: 534031 - DNA, 20 bp, Artificial
  CRISPR gRNA sequence
ggggaaaggcagatctaaca

SEQ ID NO: 534032 - DNA, 20 bp, Artificial
  CRISPR gRNA sequence
acatagaaatgcctcagaag

SEQ ID NO: 534033 - DNA, 20 bp, Artificial
  CRISPR gRNA sequence
agaaggaatgtagttactaa

SEQ ID NO: 534034 - DNA, 20 bp, Artificial
  CRISPR gRNA sequence
ctaatatcctccatgactgc

SEQ ID NO: 534035 - DNA, 20 bp, Artificial
  CRISPR gRNA sequence
atatcctccatgactgctca

SEQ ID NO: 534036 - DNA, 20 bp, Artificial
  CRISPR gRNA sequence
catgactgctcataacccct

SEQ ID NO: 534037 - DNA, 20 bp, Artificial
  CRISPR gRNA sequence
ctcataaccccttcccatgc

SEQ ID NO: 534038 - DNA, 20 bp, Artificial
  CRISPR gRNA sequence
ataaccccttcccatgcgct

SEQ ID NO: 534039 - DNA, 20 bp, Artificial
  CRISPR gRNA sequence
cccatgcgctctaaccatga

SEQ ID NO: 534040 - DNA, 20 bp, Artificial
  CRISPR gRNA sequence
ccatgcgctctaaccatgag

SEQ ID NO: 534041 - DNA, 20 bp, Artificial
  CRISPR gRNA sequence
taaccatgaggttcttgctc

SEQ ID NO: 534042 - DNA, 20 bp, Artificial
  CRISPR gRNA sequence
accatgaggttcttgctctc

SEQ ID NO: 534043 - DNA, 20 bp, Artificial
  CRISPR gRNA sequence
ttgctctcagggaacaattt

SEQ ID NO: 534044 - DNA, 20 bp, Artificial
  CRISPR gRNA sequence
gctctcagggaacaatttct

SEQ ID NO: 534045 - DNA, 20 bp, Artificial
  CRISPR gRNA sequence
ctctcagggaacaatttcta

SEQ ID NO: 534046 - DNA, 20 bp, Artificial
  CRISPR gRNA sequence
tcagggaacaatttctaggt

SEQ ID NO: 534047 - DNA, 20 bp, Artificial
  CRISPR gRNA sequence
agggaacaatttctaggtca

SEQ ID NO: 534048 - DNA, 20 bp, Artificial
  CRISPR gRNA sequence
ctaggtcagcacagaggtag

SEQ ID NO: 534049 - DNA, 20 bp, Artificial
  CRISPR gRNA sequence
taggtcagcacagaggtagg

SEQ ID NO: 534050 - DNA, 20 bp, Artificial
  CRISPR gRNA sequence
ggtcagcacagaggtagggt

SEQ ID NO: 534051 - DNA, 20 bp, Artificial
  CRISPR gRNA sequence
caggtctgcgtgctctctct

SEQ ID NO: 534052 - DNA, 20 bp, Artificial
  CRISPR gRNA sequence
cgtgctctctctgatcatgg

SEQ ID NO: 534053 - DNA, 20 bp, Artificial
  CRISPR gRNA sequence
tctctgatcatgggagcccc

SEQ ID NO: 534054 - DNA, 20 bp, Artificial
  CRISPR gRNA sequence
tctgatcatgggagccccag

SEQ ID NO: 534055 - DNA, 20 bp, Artificial
  CRISPR gRNA sequence
tgatcatgggagccccaggc

SEQ ID NO: 534056 - DNA, 20 bp, Artificial
  CRISPR gRNA sequence
atcatgggagccccaggcac

SEQ ID NO: 534057 - DNA, 20 bp, Artificial
  CRISPR gRNA sequence
cacccatgtgtcttcttcct

SEQ ID NO: 534058 - DNA, 20 bp, Artificial
  CRISPR gRNA sequence
cttcctgctgattccttgag

SEQ ID NO: 534059 - DNA, 20 bp, Artificial
  CRISPR gRNA sequence
ttcctgctgattccttgagt

SEQ ID NO: 534060 - DNA, 20 bp, Artificial
  CRISPR gRNA sequence
cctgctgattccttgagttc

SEQ ID NO: 534061 - DNA, 20 bp, Artificial
  CRISPR gRNA sequence
ctgctgattccttgagttct

SEQ ID NO: 534062 - DNA, 20 bp, Artificial
  CRISPR gRNA sequence
ctgattccttgagttctctt

SEQ ID NO: 534063 - DNA, 20 bp, Artificial
  CRISPR gRNA sequence
attccttgagttctcttgtc

SEQ ID NO: 534064 - DNA, 20 bp, Artificial
  CRISPR gRNA sequence
cttgagttctcttgtcctag

SEQ ID NO: 534065 - DNA, 20 bp, Artificial
  CRISPR gRNA sequence
gagttctcttgtcctaggct

SEQ ID NO: 534066 - DNA, 20 bp, Artificial
  CRISPR gRNA sequence
agttctcttgtcctaggctt

SEQ ID NO: 534067 - DNA, 20 bp, Artificial
  CRISPR gRNA sequence
tcttgtcctaggctttcact

SEQ ID NO: 534068 - DNA, 20 bp, Artificial
  CRISPR gRNA sequence
ttgtcctaggctttcactct

SEQ ID NO: 534069 - DNA, 20 bp, Artificial
  CRISPR gRNA sequence
gtcctaggctttcactctac

SEQ ID NO: 534070 - DNA, 20 bp, Artificial
  CRISPR gRNA sequence
tcctaggctttcactctacc

SEQ ID NO: 534071 - DNA, 20 bp, Artificial
  CRISPR gRNA sequence
ggctttcactctaccttatg

SEQ ID NO: 534072 - DNA, 20 bp, Artificial
  CRISPR gRNA sequence
tcactctaccttatggtgag

SEQ ID NO: 534073 - DNA, 20 bp, Artificial
  CRISPR gRNA sequence
cactctaccttatggtgagc

SEQ ID NO: 534074 - DNA, 20 bp, Artificial
  CRISPR gRNA sequence
actctaccttatggtgagca

SEQ ID NO: 534075 - DNA, 20 bp, Artificial
  CRISPR gRNA sequence
taccttatggtgagcacttc

SEQ ID NO: 534076 - DNA, 20 bp, Artificial
  CRISPR gRNA sequence
ccttatggtgagcacttctt

SEQ ID NO: 534077 - DNA, 20 bp, Artificial
  CRISPR gRNA sequence
atggtgagcacttctttctc

SEQ ID NO: 534078 - DNA, 20 bp, Artificial
  CRISPR gRNA sequence
tggtgagcacttctttctct

SEQ ID NO: 534079 - DNA, 20 bp, Artificial
  CRISPR gRNA sequence
ctttctctcctacaagctta

SEQ ID NO: 534080 - DNA, 20 bp, Artificial
  CRISPR gRNA sequence
tttctctcctacaagcttag

SEQ ID NO: 534081 - DNA, 20 bp, Artificial
  CRISPR gRNA sequence
tctctcctacaagcttagag

SEQ ID NO: 534082 - DNA, 20 bp, Artificial
  CRISPR gRNA sequence
ctctcctacaagcttagagt

SEQ ID NO: 534083 - DNA, 20 bp, Artificial
  CRISPR gRNA sequence
tctcctacaagcttagagtt

SEQ ID NO: 534084 - DNA, 20 bp, Artificial
  CRISPR gRNA sequence
tcctacaagcttagagttct

SEQ ID NO: 534085 - DNA, 20 bp, Artificial
  CRISPR gRNA sequence
ctacaagcttagagttctca

SEQ ID NO: 534086 - DNA, 20 bp, Artificial
  CRISPR gRNA sequence
caagcttagagttctcagat

SEQ ID NO: 534087 - DNA, 20 bp, Artificial
  CRISPR gRNA sequence
agagttctcagatagtaggg

SEQ ID NO: 534088 - DNA, 20 bp, Artificial
  CRISPR gRNA sequence
gagttctcagatagtagggg

SEQ ID NO: 534089 - DNA, 20 bp, Artificial
  CRISPR gRNA sequence
tcagatagtaggggcaactt

SEQ ID NO: 534090 - DNA, 20 bp, Artificial
  CRISPR gRNA sequence
agatagtaggggcaacttct

SEQ ID NO: 534091 - DNA, 20 bp, Artificial
  CRISPR gRNA sequence
ctgcttcctcattgcatccc

SEQ ID NO: 534092 - DNA, 20 bp, Artificial
  CRISPR gRNA sequence
tgcttcctcattgcatcccc

SEQ ID NO: 534093 - DNA, 20 bp, Artificial
  CRISPR gRNA sequence
cttcctcattgcatccccca

SEQ ID NO: 534094 - DNA, 20 bp, Artificial
  CRISPR gRNA sequence
cctcattgcatcccccaaag

SEQ ID NO: 534095 - DNA, 20 bp, Artificial
  CRISPR gRNA sequence
ctcattgcatcccccaaagc

SEQ ID NO: 534096 - DNA, 20 bp, Artificial
  CRISPR gRNA sequence
attgcatcccccaaagcagc

SEQ ID NO: 534097 - DNA, 20 bp, Artificial
  CRISPR gRNA sequence
catcccccaaagcagctagc

SEQ ID NO: 534098 - DNA, 20 bp, Artificial
  CRISPR gRNA sequence
gcatggcgccttgcatataa

SEQ ID NO: 534099 - DNA, 20 bp, Artificial
  CRISPR gRNA sequence
gcatataaaaggtactcaat

SEQ ID NO: 534100 - DNA, 20 bp, Artificial
  CRISPR gRNA sequence
catataaaaggtactcaata

SEQ ID NO: 534101 - DNA, 20 bp, Artificial
  CRISPR gRNA sequence
aatatttacattgatttcac

SEQ ID NO: 534102 - DNA, 20 bp, Artificial
  CRISPR gRNA sequence
acattgatttcacctggcca

SEQ ID NO: 534103 - DNA, 20 bp, Artificial
  CRISPR gRNA sequence
cattgatttcacctggccaa

SEQ ID NO: 534104 - DNA, 20 bp, Artificial
  CRISPR gRNA sequence
atttcacctggccaagatga

SEQ ID NO: 534105 - DNA, 20 bp, Artificial
  CRISPR gRNA sequence
cacctggccaagatgaactc

SEQ ID NO: 534106 - DNA, 20 bp, Artificial
  CRISPR gRNA sequence
acctggccaagatgaactct

SEQ ID NO: 534107 - DNA, 20 bp, Artificial
  CRISPR gRNA sequence
gccaagatgaactctattga

SEQ ID NO: 534108 - DNA, 20 bp, Artificial
  CRISPR gRNA sequence
tattgaggttttgttgttgc

SEQ ID NO: 534109 - DNA, 20 bp, Artificial
  CRISPR gRNA sequence
ttgaggttttgttgttgcag

SEQ ID NO: 534110 - DNA, 20 bp, Artificial
  CRISPR gRNA sequence
aggttttgttgttgcagatg

SEQ ID NO: 534111 - DNA, 20 bp, Artificial
  CRISPR gRNA sequence
tgttgttgcagatgaggagc

SEQ ID NO: 534112 - DNA, 20 bp, Artificial
  CRISPR gRNA sequence
gttgttgcagatgaggagct

SEQ ID NO: 534113 - DNA, 20 bp, Artificial
  CRISPR gRNA sequence
ttgttgcagatgaggagctg

SEQ ID NO: 534114 - DNA, 20 bp, Artificial
  CRISPR gRNA sequence
ttgcagatgaggagctggag

SEQ ID NO: 534115 - DNA, 20 bp, Artificial
  CRISPR gRNA sequence
cagatgaggagctggagaca

SEQ ID NO: 534116 - DNA, 20 bp, Artificial
  CRISPR gRNA sequence
gagacaagagcccacagagt

SEQ ID NO: 534117 - DNA, 20 bp, Artificial
  CRISPR gRNA sequence
ctgaagaaaggggccggaag

SEQ ID NO: 534118 - DNA, 20 bp, Artificial
  CRISPR gRNA sequence
aagaaaggggccggaagccc

SEQ ID NO: 534119 - DNA, 20 bp, Artificial
  CRISPR gRNA sequence
cagcttcaacccctcagaat

SEQ ID NO: 534120 - DNA, 20 bp, Artificial
  CRISPR gRNA sequence
caacccctcagaatccagca

SEQ ID NO: 534121 - DNA, 20 bp, Artificial
  CRISPR gRNA sequence
aacccctcagaatccagcaa

SEQ ID NO: 534122 - DNA, 20 bp, Artificial
  CRISPR gRNA sequence
agaatccagcaacttcccaa

SEQ ID NO: 534123 - DNA, 20 bp, Artificial
  CRISPR gRNA sequence
cccaacatcctcctccacca

SEQ ID NO: 534124 - DNA, 20 bp, Artificial
  CRISPR gRNA sequence
ccaacatcctcctccaccac

SEQ ID NO: 534125 - DNA, 20 bp, Artificial
  CRISPR gRNA sequence
ctccaccacctggtcatcgt

SEQ ID NO: 534126 - DNA, 20 bp, Artificial
  CRISPR gRNA sequence
caccacctggtcatcgttcc

SEQ ID NO: 534127 - DNA, 20 bp, Artificial
  CRISPR gRNA sequence
gtcatcgttcccaggcacct

SEQ ID NO: 534128 - DNA, 20 bp, Artificial
  CRISPR gRNA sequence
ccaggcacctagtcatcgtc

SEQ ID NO: 534129 - DNA, 20 bp, Artificial
  CRISPR gRNA sequence
gtcatcgtcccccgcctcct

SEQ ID NO: 534130 - DNA, 20 bp, Artificial
  CRISPR gRNA sequence
ctggacaccgtgttcagcac

SEQ ID NO: 534131 - DNA, 20 bp, Artificial
  CRISPR gRNA sequence
gacaccgtgttcagcaccag

SEQ ID NO: 534132 - DNA, 20 bp, Artificial
  CRISPR gRNA sequence
agcaccagcctcagaagagg

SEQ ID NO: 534133 - DNA, 20 bp, Artificial
  CRISPR gRNA sequence
agaagaggcctcctgctccg

SEQ ID NO: 534134 - DNA, 20 bp, Artificial
  CRISPR gRNA sequence
ctgctccgtcgggcacacaa

SEQ ID NO: 534135 - DNA, 20 bp, Artificial
  CRISPR gRNA sequence
ctccgtcgggcacacaagtt

SEQ ID NO: 534136 - DNA, 20 bp, Artificial
  CRISPR gRNA sequence
cgtcgggcacacaagttcac

SEQ ID NO: 534137 - DNA, 20 bp, Artificial
  CRISPR gRNA sequence
accagcagaaaggcccgccc

SEQ ID NO: 534138 - DNA, 20 bp, Artificial
  CRISPR gRNA sequence
cccagacctcgagttcagcc

SEQ ID NO: 534139 - DNA, 20 bp, Artificial
  CRISPR gRNA sequence
gagttcagccaaaacctccc

SEQ ID NO: 534140 - DNA, 20 bp, Artificial
  CRISPR gRNA sequence
agccaaaacctccccatggg

SEQ ID NO: 534141 - DNA, 20 bp, Artificial
  CRISPR gRNA sequence
cccatggggcagcagaaaac

SEQ ID NO: 534142 - DNA, 20 bp, Artificial
  CRISPR gRNA sequence
attgtccccttcctctaatt

SEQ ID NO: 534143 - DNA, 20 bp, Artificial
  CRISPR gRNA sequence
tccccttcctctaattaaaa

SEQ ID NO: 534144 - DNA, 20 bp, Artificial
  CRISPR gRNA sequence
cctctaattaaaaaagatag

SEQ ID NO: 534145 - DNA, 20 bp, Artificial
  CRISPR gRNA sequence
ctctaattaaaaaagataga

SEQ ID NO: 534146 - DNA, 20 bp, Artificial
  CRISPR gRNA sequence
taattaaaaaagatagaaac

SEQ ID NO: 534147 - DNA, 20 bp, Artificial
  CRISPR gRNA sequence
attaaaaaagatagaaactg

SEQ ID NO: 534148 - DNA, 20 bp, Artificial
  CRISPR gRNA sequence
aaaaagatagaaactgtctt

SEQ ID NO: 534149 - DNA, 20 bp, Artificial
  CRISPR gRNA sequence
tctttttcaataaaaagcac

SEQ ID NO: 534150 - DNA, 20 bp, Artificial
  CRISPR gRNA sequence
tttcaataaaaagcactgtg

SEQ ID NO: 534151 - DNA, 20 bp, Artificial
  CRISPR gRNA sequence
ttcaataaaaagcactgtgg

SEQ ID NO: 534152 - DNA, 20 bp, Artificial
  CRISPR gRNA sequence
tcaataaaaagcactgtgga

SEQ ID NO: 534153 - DNA, 20 bp, Artificial
  CRISPR gRNA sequence
caataaaaagcactgtggat

SEQ ID NO: 534154 - DNA, 20 bp, Artificial
  CRISPR gRNA sequence
aataaaaagcactgtggatt

SEQ ID NO: 534155 - DNA, 20 bp, Artificial
  CRISPR gRNA sequence
tggatttctgccctcctgat

SEQ ID NO: 534156 - DNA, 20 bp, Artificial
  CRISPR gRNA sequence
ctgccctcctgatgtgcata

SEQ ID NO: 534157 - DNA, 20 bp, Artificial
  CRISPR gRNA sequence
tgccctcctgatgtgcatat

SEQ ID NO: 534158 - DNA, 20 bp, Artificial
  CRISPR gRNA sequence
ccctcctgatgtgcatatcc

SEQ ID NO: 534159 - DNA, 20 bp, Artificial
  CRISPR gRNA sequence
ctgatgtgcatatccgtact

SEQ ID NO: 534160 - DNA, 20 bp, Artificial
  CRISPR gRNA sequence
atgtgcatatccgtacttcc

SEQ ID NO: 534161 - DNA, 20 bp, Artificial
  CRISPR gRNA sequence
ccatgaggtgttttctgtgt

SEQ ID NO: 534162 - DNA, 20 bp, Artificial
  CRISPR gRNA sequence
catgaggtgttttctgtgtg

SEQ ID NO: 534163 - DNA, 20 bp, Artificial
  CRISPR gRNA sequence
tctgtgtgcagaacattgtc

SEQ ID NO: 534164 - DNA, 20 bp, Artificial
  CRISPR gRNA sequence
ctgtgtgcagaacattgtca

SEQ ID NO: 534165 - DNA, 20 bp, Artificial
  CRISPR gRNA sequence
tgtgtgcagaacattgtcac

SEQ ID NO: 534166 - DNA, 20 bp, Artificial
  CRISPR gRNA sequence
tgtgcagaacattgtcacct

SEQ ID NO: 534167 - DNA, 20 bp, Artificial
  CRISPR gRNA sequence
tcacctcctgaggctgtggg

SEQ ID NO: 534168 - DNA, 20 bp, Artificial
  CRISPR gRNA sequence
ctgaggctgtgggccacagc

SEQ ID NO: 534169 - DNA, 20 bp, Artificial
  CRISPR gRNA sequence
aggctgtgggccacagccac

SEQ ID NO: 534170 - DNA, 20 bp, Artificial
  CRISPR gRNA sequence
tgggccacagccacctctgc

SEQ ID NO: 534171 - DNA, 20 bp, Artificial
  CRISPR gRNA sequence
tgcatcttcgaactcagcca

SEQ ID NO: 534172 - DNA, 20 bp, Artificial
  CRISPR gRNA sequence
catcttcgaactcagccatg

SEQ ID NO: 534173 - DNA, 20 bp, Artificial
  CRISPR gRNA sequence
cgaactcagccatgtggtca

SEQ ID NO: 534174 - DNA, 20 bp, Artificial
  CRISPR gRNA sequence
gaactcagccatgtggtcaa

SEQ ID NO: 534175 - DNA, 20 bp, Artificial
  CRISPR gRNA sequence
agccatgtggtcaacatctg

SEQ ID NO: 534176 - DNA, 20 bp, Artificial
  CRISPR gRNA sequence
gagtttttggtctcctcaga

SEQ ID NO: 534177 - DNA, 20 bp, Artificial
  CRISPR gRNA sequence
ttggtctcctcagagagctc

SEQ ID NO: 534178 - DNA, 20 bp, Artificial
  CRISPR gRNA sequence
tggtctcctcagagagctcc

SEQ ID NO: 534179 - DNA, 20 bp, Artificial
  CRISPR gRNA sequence
ggtctcctcagagagctcca

SEQ ID NO: 534180 - DNA, 20 bp, Artificial
  CRISPR gRNA sequence
gtctcctcagagagctccat

SEQ ID NO: 534181 - DNA, 20 bp, Artificial
  CRISPR gRNA sequence
ctcagagagctccatcacac

SEQ ID NO: 534182 - DNA, 20 bp, Artificial
  CRISPR gRNA sequence
agagagctccatcacaccag

SEQ ID NO: 534183 - DNA, 20 bp, Artificial
  CRISPR gRNA sequence
catcacaccagtaaggagaa

SEQ ID NO: 534184 - DNA, 20 bp, Artificial
  CRISPR gRNA sequence
caagaatggtagaggaccga

SEQ ID NO: 534185 - DNA, 20 bp, Artificial
  CRISPR gRNA sequence
agagatttcttgtcccctct

SEQ ID NO: 534186 - DNA, 20 bp, Artificial
  CRISPR gRNA sequence
gagatttcttgtcccctctc

SEQ ID NO: 534187 - DNA, 20 bp, Artificial
  CRISPR gRNA sequence
cttgtcccctctcaggtcat

SEQ ID NO: 534188 - DNA, 20 bp, Artificial
  CRISPR gRNA sequence
ttgtcccctctcaggtcatg

SEQ ID NO: 534189 - DNA, 20 bp, Artificial
  CRISPR gRNA sequence
gtcccctctcaggtcatgtg

SEQ ID NO: 534190 - DNA, 20 bp, Artificial
  CRISPR gRNA sequence
tcccctctcaggtcatgtgt

SEQ ID NO: 534191 - DNA, 20 bp, Artificial
  CRISPR gRNA sequence
tcaggtcatgtgtagatgcg

SEQ ID NO: 534192 - DNA, 20 bp, Artificial
  CRISPR gRNA sequence
aggtcatgtgtagatgcgat

SEQ ID NO: 534193 - DNA, 20 bp, Artificial
  CRISPR gRNA sequence
gtgtgcctgggtctcactac

SEQ ID NO: 534194 - DNA, 20 bp, Artificial
  CRISPR gRNA sequence
ggtctcactacaagcagcct

SEQ ID NO: 534195 - DNA, 20 bp, Artificial
  CRISPR gRNA sequence
actacaagcagcctatctgc

SEQ ID NO: 534196 - DNA, 20 bp, Artificial
  CRISPR gRNA sequence
caagcagcctatctgcttaa

SEQ ID NO: 534197 - DNA, 20 bp, Artificial
  CRISPR gRNA sequence
tctgcttaagagactctgga

SEQ ID NO: 534198 - DNA, 20 bp, Artificial
  CRISPR gRNA sequence
cttaagagactctggagttt

SEQ ID NO: 534199 - DNA, 20 bp, Artificial
  CRISPR gRNA sequence
aagagactctggagtttctt

SEQ ID NO: 534200 - DNA, 20 bp, Artificial
  CRISPR gRNA sequence
agagactctggagtttctta

SEQ ID NO: 534201 - DNA, 20 bp, Artificial
  CRISPR gRNA sequence
tggagtttcttatgtgccct

SEQ ID NO: 534202 - DNA, 20 bp, Artificial
  CRISPR gRNA sequence
gagtttcttatgtgccctgg

SEQ ID NO: 534203 - DNA, 20 bp, Artificial
  CRISPR gRNA sequence
cttatgtgccctggtggaca

SEQ ID NO: 534204 - DNA, 20 bp, Artificial
  CRISPR gRNA sequence
ttatgtgccctggtggacac

SEQ ID NO: 534205 - DNA, 20 bp, Artificial
  CRISPR gRNA sequence
atgtgccctggtggacactt

SEQ ID NO: 534206 - DNA, 20 bp, Artificial
  CRISPR gRNA sequence
tgtgccctggtggacacttg

SEQ ID NO: 534207 - DNA, 20 bp, Artificial
  CRISPR gRNA sequence
gtggacacttgcccaccatc

SEQ ID NO: 534208 - DNA, 20 bp, Artificial
  CRISPR gRNA sequence
gcccaccatcctgtgagtaa

SEQ ID NO: 534209 - DNA, 20 bp, Artificial
  CRISPR gRNA sequence
cccaccatcctgtgagtaaa

SEQ ID NO: 534210 - DNA, 20 bp, Artificial
  CRISPR gRNA sequence
tgagtaaaagtgaaataaaa

SEQ ID NO: 534211 - DNA, 20 bp, Artificial
  CRISPR gRNA sequence
tgactagacccgtgtctgct

SEQ ID NO: 534212 - DNA, 20 bp, Artificial
  CRISPR gRNA sequence
gactagacccgtgtctgctc

SEQ ID NO: 534213 - DNA, 20 bp, Artificial
  CRISPR gRNA sequence
actagacccgtgtctgctca

SEQ ID NO: 534214 - DNA, 20 bp, Artificial
  CRISPR gRNA sequence
gacccgtgtctgctcattgt

SEQ ID NO: 534215 - DNA, 20 bp, Artificial
  CRISPR gRNA sequence
ctcattgtgtgaaggatccc

SEQ ID NO: 534216 - DNA, 20 bp, Artificial
  CRISPR gRNA sequence
attgtgtgaaggatcccagt

SEQ ID NO: 534217 - DNA, 20 bp, Artificial
  CRISPR gRNA sequence
tgtgaaggatcccagtgtcg

SEQ ID NO: 534218 - DNA, 20 bp, Artificial
  CRISPR gRNA sequence
ccgaataagaaagagcctcg

SEQ ID NO: 534219 - DNA, 20 bp, Artificial
  CRISPR gRNA sequence
gctggtgtgacagcaggatc

SEQ ID NO: 534220 - DNA, 20 bp, Artificial
  CRISPR gRNA sequence
gtgtgacagcaggatcaaat

SEQ ID NO: 534221 - DNA, 20 bp, Artificial
  CRISPR gRNA sequence
aatttgatcctgctgtcaca

SEQ ID NO: 534222 - DNA, 20 bp, Artificial
  CRISPR gRNA sequence
gatcctgctgtcacaccagc

SEQ ID NO: 534223 - DNA, 20 bp, Artificial
  CRISPR gRNA sequence
atcctgctgtcacaccagcg

SEQ ID NO: 534224 - DNA, 20 bp, Artificial
  CRISPR gRNA sequence
ctgtcacaccagcgaggctc

SEQ ID NO: 534225 - DNA, 20 bp, Artificial
  CRISPR gRNA sequence
tcacaccagcgaggctcttt

SEQ ID NO: 534226 - DNA, 20 bp, Artificial
  CRISPR gRNA sequence
tttcttattcggcagcttcc

SEQ ID NO: 534227 - DNA, 20 bp, Artificial
  CRISPR gRNA sequence
tcttattcggcagcttcctc

SEQ ID NO: 534228 - DNA, 20 bp, Artificial
  CRISPR gRNA sequence
cttattcggcagcttcctct

SEQ ID NO: 534229 - DNA, 20 bp, Artificial
  CRISPR gRNA sequence
ttattcggcagcttcctctc

SEQ ID NO: 534230 - DNA, 20 bp, Artificial
  CRISPR gRNA sequence
attcggcagcttcctctcct

SEQ ID NO: 534231 - DNA, 20 bp, Artificial
  CRISPR gRNA sequence
ttcggcagcttcctctcctc

SEQ ID NO: 534232 - DNA, 20 bp, Artificial
  CRISPR gRNA sequence
ggcagcttcctctcctcgac

SEQ ID NO: 534233 - DNA, 20 bp, Artificial
  CRISPR gRNA sequence
cctctcctcgacactgggat

SEQ ID NO: 534234 - DNA, 20 bp, Artificial
  CRISPR gRNA sequence
ctctcctcgacactgggatc

SEQ ID NO: 534235 - DNA, 20 bp, Artificial
  CRISPR gRNA sequence
tcctcgacactgggatcctt

SEQ ID NO: 534236 - DNA, 20 bp, Artificial
  CRISPR gRNA sequence
ctcgacactgggatccttca

SEQ ID NO: 534237 - DNA, 20 bp, Artificial
  CRISPR gRNA sequence
gacactgggatccttcacac

SEQ ID NO: 534238 - DNA, 20 bp, Artificial
  CRISPR gRNA sequence
ggatccttcacacaatgagc

SEQ ID NO: 534239 - DNA, 20 bp, Artificial
  CRISPR gRNA sequence
cacacaatgagcagacacgg

SEQ ID NO: 534240 - DNA, 20 bp, Artificial
  CRISPR gRNA sequence
acacaatgagcagacacggg

SEQ ID NO: 534241 - DNA, 20 bp, Artificial
  CRISPR gRNA sequence
gtcaaagcttttatttcact

SEQ ID NO: 534242 - DNA, 20 bp, Artificial
  CRISPR gRNA sequence
ttatttcacttttactcaca

SEQ ID NO: 534243 - DNA, 20 bp, Artificial
  CRISPR gRNA sequence
tatttcacttttactcacag

SEQ ID NO: 534244 - DNA, 20 bp, Artificial
  CRISPR gRNA sequence
atttcacttttactcacagg

SEQ ID NO: 534245 - DNA, 20 bp, Artificial
  CRISPR gRNA sequence
tttcacttttactcacagga

SEQ ID NO: 534246 - DNA, 20 bp, Artificial
  CRISPR gRNA sequence
cacttttactcacaggatgg

SEQ ID NO: 534247 - DNA, 20 bp, Artificial
  CRISPR gRNA sequence
acttttactcacaggatggt

SEQ ID NO: 534248 - DNA, 20 bp, Artificial
  CRISPR gRNA sequence
ttactcacaggatggtgggc

SEQ ID NO: 534249 - DNA, 20 bp, Artificial
  CRISPR gRNA sequence
tactcacaggatggtgggca

SEQ ID NO: 534250 - DNA, 20 bp, Artificial
  CRISPR gRNA sequence
actcacaggatggtgggcaa

SEQ ID NO: 534251 - DNA, 20 bp, Artificial
  CRISPR gRNA sequence
ctcacaggatggtgggcaag

SEQ ID NO: 534252 - DNA, 20 bp, Artificial
  CRISPR gRNA sequence
acaggatggtgggcaagtgt

SEQ ID NO: 534253 - DNA, 20 bp, Artificial
  CRISPR gRNA sequence
cagagtctcttaagcagata

SEQ ID NO: 534254 - DNA, 20 bp, Artificial
  CRISPR gRNA sequence
ttaagcagataggctgcttg

SEQ ID NO: 534255 - DNA, 20 bp, Artificial
  CRISPR gRNA sequence
aagcagataggctgcttgta

SEQ ID NO: 534256 - DNA, 20 bp, Artificial
  CRISPR gRNA sequence
agcagataggctgcttgtag

SEQ ID NO: 534257 - DNA, 20 bp, Artificial
  CRISPR gRNA sequence
cttgtagtgagacccaggca

SEQ ID NO: 534258 - DNA, 20 bp, Artificial
  CRISPR gRNA sequence
gtagtgagacccaggcacac

SEQ ID NO: 534259 - DNA, 20 bp, Artificial
  CRISPR gRNA sequence
tagtgagacccaggcacacc

SEQ ID NO: 534260 - DNA, 20 bp, Artificial
  CRISPR gRNA sequence
gatttatcgcatctacacat

SEQ ID NO: 534261 - DNA, 20 bp, Artificial
  CRISPR gRNA sequence
atttatcgcatctacacatg

SEQ ID NO: 534262 - DNA, 20 bp, Artificial
  CRISPR gRNA sequence
atcgcatctacacatgacct

SEQ ID NO: 534263 - DNA, 20 bp, Artificial
  CRISPR gRNA sequence
tcgcatctacacatgacctg

SEQ ID NO: 534264 - DNA, 20 bp, Artificial
  CRISPR gRNA sequence
cacatgacctgagaggggac

SEQ ID NO: 534265 - DNA, 20 bp, Artificial
  CRISPR gRNA sequence
agaggggacaagaaatctct

SEQ ID NO: 534266 - DNA, 20 bp, Artificial
  CRISPR gRNA sequence
taagatttctgtgctcggtc

SEQ ID NO: 534267 - DNA, 20 bp, Artificial
  CRISPR gRNA sequence
agatttctgtgctcggtcct

SEQ ID NO: 534268 - DNA, 20 bp, Artificial
  CRISPR gRNA sequence
ctgtgctcggtcctctacca

SEQ ID NO: 534269 - DNA, 20 bp, Artificial
  CRISPR gRNA sequence
tgtgctcggtcctctaccat

SEQ ID NO: 534270 - DNA, 20 bp, Artificial
  CRISPR gRNA sequence
tgctcggtcctctaccattc

SEQ ID NO: 534271 - DNA, 20 bp, Artificial
  CRISPR gRNA sequence
ggtcctctaccattcttgca

SEQ ID NO: 534272 - DNA, 20 bp, Artificial
  CRISPR gRNA sequence
taccattcttgcaatcacac

SEQ ID NO: 534273 - DNA, 20 bp, Artificial
  CRISPR gRNA sequence
ccattcttgcaatcacactt

SEQ ID NO: 534274 - DNA, 20 bp, Artificial
  CRISPR gRNA sequence
ttgcaatcacacttatattg

SEQ ID NO: 534275 - DNA, 20 bp, Artificial
  CRISPR gRNA sequence
gcaatcacacttatattgct

SEQ ID NO: 534276 - DNA, 20 bp, Artificial
  CRISPR gRNA sequence
caatcacacttatattgctt

SEQ ID NO: 534277 - DNA, 20 bp, Artificial
  CRISPR gRNA sequence
atattgcttctccttactgg

SEQ ID NO: 534278 - DNA, 20 bp, Artificial
  CRISPR gRNA sequence
tattgcttctccttactggt

SEQ ID NO: 534279 - DNA, 20 bp, Artificial
  CRISPR gRNA sequence
cttctccttactggtgtgat

SEQ ID NO: 534280 - DNA, 20 bp, Artificial
  CRISPR gRNA sequence
ctccttactggtgtgatgga

SEQ ID NO: 534281 - DNA, 20 bp, Artificial
  CRISPR gRNA sequence
tccttactggtgtgatggag

SEQ ID NO: 534282 - DNA, 20 bp, Artificial
  CRISPR gRNA sequence
cttactggtgtgatggagct

SEQ ID NO: 534283 - DNA, 20 bp, Artificial
  CRISPR gRNA sequence
actggtgtgatggagctctc

SEQ ID NO: 534284 - DNA, 20 bp, Artificial
  CRISPR gRNA sequence
ctggtgtgatggagctctct

SEQ ID NO: 534285 - DNA, 20 bp, Artificial
  CRISPR gRNA sequence
gtgtgatggagctctctgag

SEQ ID NO: 534286 - DNA, 20 bp, Artificial
  CRISPR gRNA sequence
tctgaggagaccaaaaactc

SEQ ID NO: 534287 - DNA, 20 bp, Artificial
  CRISPR gRNA sequence
tgaggagaccaaaaactcca

SEQ ID NO: 534288 - DNA, 20 bp, Artificial
  CRISPR gRNA sequence
aggagaccaaaaactccaga

SEQ ID NO: 534289 - DNA, 20 bp, Artificial
  CRISPR gRNA sequence
cagatgttgaccacatggct

SEQ ID NO: 534290 - DNA, 20 bp, Artificial
  CRISPR gRNA sequence
accacatggctgagttcgaa

SEQ ID NO: 534291 - DNA, 20 bp, Artificial
  CRISPR gRNA sequence
agttcgaagatgcagaggtg

SEQ ID NO: 534292 - DNA, 20 bp, Artificial
  CRISPR gRNA sequence
gaagatgcagaggtggctgt

SEQ ID NO: 534293 - DNA, 20 bp, Artificial
  CRISPR gRNA sequence
tggcccacagcctcaggagg

SEQ ID NO: 534294 - DNA, 20 bp, Artificial
  CRISPR gRNA sequence
aggaggtgacaatgttctgc

SEQ ID NO: 534295 - DNA, 20 bp, Artificial
  CRISPR gRNA sequence
tgcacacagaaaacacctca

SEQ ID NO: 534296 - DNA, 20 bp, Artificial
  CRISPR gRNA sequence
cacacagaaaacacctcatg

SEQ ID NO: 534297 - DNA, 20 bp, Artificial
  CRISPR gRNA sequence
atggaagtacggatatgcac

SEQ ID NO: 534298 - DNA, 20 bp, Artificial
  CRISPR gRNA sequence
tttattgaaaaagacagttt

SEQ ID NO: 534299 - DNA, 20 bp, Artificial
  CRISPR gRNA sequence
ttattgaaaaagacagtttc

SEQ ID NO: 534300 - DNA, 20 bp, Artificial
  CRISPR gRNA sequence
tattgaaaaagacagtttct

SEQ ID NO: 534301 - DNA, 20 bp, Artificial
  CRISPR gRNA sequence
attgaaaaagacagtttcta

SEQ ID NO: 534302 - DNA, 20 bp, Artificial
  CRISPR gRNA sequence
ttgaaaaagacagtttctat

SEQ ID NO: 534303 - DNA, 20 bp, Artificial
  CRISPR gRNA sequence
aaaaagacagtttctatctt

SEQ ID NO: 534304 - DNA, 20 bp, Artificial
  CRISPR gRNA sequence
ctatcttttttaattagagg

SEQ ID NO: 534305 - DNA, 20 bp, Artificial
  CRISPR gRNA sequence
tatcttttttaattagagga

SEQ ID NO: 534306 - DNA, 20 bp, Artificial
  CRISPR gRNA sequence
tcttttttaattagaggaag

SEQ ID NO: 534307 - DNA, 20 bp, Artificial
  CRISPR gRNA sequence
ttttaattagaggaagggga

SEQ ID NO: 534308 - DNA, 20 bp, Artificial
  CRISPR gRNA sequence
tttaattagaggaaggggac

SEQ ID NO: 534309 - DNA, 20 bp, Artificial
  CRISPR gRNA sequence
ttaattagaggaaggggaca

SEQ ID NO: 534310 - DNA, 20 bp, Artificial
  CRISPR gRNA sequence
taattagaggaaggggacaa

SEQ ID NO: 534311 - DNA, 20 bp, Artificial
  CRISPR gRNA sequence
aattagaggaaggggacaat

SEQ ID NO: 534312 - DNA, 20 bp, Artificial
  CRISPR gRNA sequence
attagaggaaggggacaatg

SEQ ID NO: 534313 - DNA, 20 bp, Artificial
  CRISPR gRNA sequence
gaggaaggggacaatgagtt

SEQ ID NO: 534314 - DNA, 20 bp, Artificial
  CRISPR gRNA sequence
tctgctgccccatggggagg

SEQ ID NO: 534315 - DNA, 20 bp, Artificial
  CRISPR gRNA sequence
ctgctgccccatggggaggt

SEQ ID NO: 534316 - DNA, 20 bp, Artificial
  CRISPR gRNA sequence
tgctgccccatggggaggtt

SEQ ID NO: 534317 - DNA, 20 bp, Artificial
  CRISPR gRNA sequence
ctgccccatggggaggtttt

SEQ ID NO: 534318 - DNA, 20 bp, Artificial
  CRISPR gRNA sequence
ccccatggggaggttttggc

SEQ ID NO: 534319 - DNA, 20 bp, Artificial
  CRISPR gRNA sequence
tggctgaactcgaggtctgg

SEQ ID NO: 534320 - DNA, 20 bp, Artificial
  CRISPR gRNA sequence
ggctgaactcgaggtctggg

SEQ ID NO: 534321 - DNA, 20 bp, Artificial
  CRISPR gRNA sequence
gctgaactcgaggtctgggg

SEQ ID NO: 534322 - DNA, 20 bp, Artificial
  CRISPR gRNA sequence
aactcgaggtctggggaggg

SEQ ID NO: 534323 - DNA, 20 bp, Artificial
  CRISPR gRNA sequence
gaggtctggggaggggcggg

SEQ ID NO: 534324 - DNA, 20 bp, Artificial
  CRISPR gRNA sequence
gggaggggcgggcctttctg

SEQ ID NO: 534325 - DNA, 20 bp, Artificial
  CRISPR gRNA sequence
tctgctggtgaacttgtgtg

SEQ ID NO: 534326 - DNA, 20 bp, Artificial
  CRISPR gRNA sequence
ctgctggtgaacttgtgtgc

SEQ ID NO: 534327 - DNA, 20 bp, Artificial
  CRISPR gRNA sequence
tgctggtgaacttgtgtgcc

SEQ ID NO: 534328 - DNA, 20 bp, Artificial
  CRISPR gRNA sequence
ctggtgaacttgtgtgcccg

SEQ ID NO: 534329 - DNA, 20 bp, Artificial
  CRISPR gRNA sequence
gtgaacttgtgtgcccgacg

SEQ ID NO: 534330 - DNA, 20 bp, Artificial
  CRISPR gRNA sequence
gtgtgcccgacggagcagga

SEQ ID NO: 534331 - DNA, 20 bp, Artificial
  CRISPR gRNA sequence
tgtgcccgacggagcaggag

SEQ ID NO: 534332 - DNA, 20 bp, Artificial
  CRISPR gRNA sequence
ttctgaggctggtgctgaac

SEQ ID NO: 534333 - DNA, 20 bp, Artificial
  CRISPR gRNA sequence
ctgaggctggtgctgaacac

SEQ ID NO: 534334 - DNA, 20 bp, Artificial
  CRISPR gRNA sequence
tgaggctggtgctgaacacg

SEQ ID NO: 534335 - DNA, 20 bp, Artificial
  CRISPR gRNA sequence
aggctggtgctgaacacggt

SEQ ID NO: 534336 - DNA, 20 bp, Artificial
  CRISPR gRNA sequence
gtgctgaacacggtgtccag

SEQ ID NO: 534337 - DNA, 20 bp, Artificial
  CRISPR gRNA sequence
aacacggtgtccaggaggcg

SEQ ID NO: 534338 - DNA, 20 bp, Artificial
  CRISPR gRNA sequence
ggtgcctgggaacgatgacc

SEQ ID NO: 534339 - DNA, 20 bp, Artificial
  CRISPR gRNA sequence
ggaacgatgaccaggtggtg

SEQ ID NO: 534340 - DNA, 20 bp, Artificial
  CRISPR gRNA sequence
ggaagttgctggattctgag

SEQ ID NO: 534341 - DNA, 20 bp, Artificial
  CRISPR gRNA sequence
ctggattctgaggggttgaa

SEQ ID NO: 534342 - DNA, 20 bp, Artificial
  CRISPR gRNA sequence
gattctgaggggttgaagct

SEQ ID NO: 534343 - DNA, 20 bp, Artificial
  CRISPR gRNA sequence
tgaggggttgaagctggaat

SEQ ID NO: 534344 - DNA, 20 bp, Artificial
  CRISPR gRNA sequence
aggggttgaagctggaattt

SEQ ID NO: 534345 - DNA, 20 bp, Artificial
  CRISPR gRNA sequence
aagctggaatttggtggggc

SEQ ID NO: 534346 - DNA, 20 bp, Artificial
  CRISPR gRNA sequence
gaatttggtggggcttccgg

SEQ ID NO: 534347 - DNA, 20 bp, Artificial
  CRISPR gRNA sequence
ggtggggcttccggcccctt

SEQ ID NO: 534348 - DNA, 20 bp, Artificial
  CRISPR gRNA sequence
gtggggcttccggccccttt

SEQ ID NO: 534349 - DNA, 20 bp, Artificial
  CRISPR gRNA sequence
ccggcccctttcttcagtag

SEQ ID NO: 534350 - DNA, 20 bp, Artificial
  CRISPR gRNA sequence
cggcccctttcttcagtagc

SEQ ID NO: 534351 - DNA, 20 bp, Artificial
  CRISPR gRNA sequence
tcttcagtagctactctgtg

SEQ ID NO: 534352 - DNA, 20 bp, Artificial
  CRISPR gRNA sequence
cttcagtagctactctgtgg

SEQ ID NO: 534353 - DNA, 20 bp, Artificial
  CRISPR gRNA sequence
ttcagtagctactctgtggg

SEQ ID NO: 534354 - DNA, 20 bp, Artificial
  CRISPR gRNA sequence
cagtagctactctgtgggct

SEQ ID NO: 534355 - DNA, 20 bp, Artificial
  CRISPR gRNA sequence
agtagctactctgtgggctc

SEQ ID NO: 534356 - DNA, 20 bp, Artificial
  CRISPR gRNA sequence
ctctgtgggctcttgtctcc

SEQ ID NO: 534357 - DNA, 20 bp, Artificial
  CRISPR gRNA sequence
tgtgggctcttgtctccagc

SEQ ID NO: 534358 - DNA, 20 bp, Artificial
  CRISPR gRNA sequence
tgggctcttgtctccagctc

SEQ ID NO: 534359 - DNA, 20 bp, Artificial
  CRISPR gRNA sequence
ttgtctccagctcctcatct

SEQ ID NO: 534360 - DNA, 20 bp, Artificial
  CRISPR gRNA sequence
gtctccagctcctcatctgc

SEQ ID NO: 534361 - DNA, 20 bp, Artificial
  CRISPR gRNA sequence
tctccagctcctcatctgca

SEQ ID NO: 534362 - DNA, 20 bp, Artificial
  CRISPR gRNA sequence
cagctcctcatctgcaacaa

SEQ ID NO: 534363 - DNA, 20 bp, Artificial
  CRISPR gRNA sequence
ctcatctgcaacaacaaaac

SEQ ID NO: 534364 - DNA, 20 bp, Artificial
  CRISPR gRNA sequence
atctgcaacaacaaaacctc

SEQ ID NO: 534365 - DNA, 20 bp, Artificial
  CRISPR gRNA sequence
caacaacaaaacctcaatag

SEQ ID NO: 534366 - DNA, 20 bp, Artificial
  CRISPR gRNA sequence
aatagagttcatcttggcca

SEQ ID NO: 534367 - DNA, 20 bp, Artificial
  CRISPR gRNA sequence
atcttggccaggtgaaatca

SEQ ID NO: 534368 - DNA, 20 bp, Artificial
  CRISPR gRNA sequence
ggccaggtgaaatcaatgta

SEQ ID NO: 534369 - DNA, 20 bp, Artificial
  CRISPR gRNA sequence
gccaggtgaaatcaatgtaa

SEQ ID NO: 534370 - DNA, 20 bp, Artificial
  CRISPR gRNA sequence
agtaccttttatatgcaagg

SEQ ID NO: 534371 - DNA, 20 bp, Artificial
  CRISPR gRNA sequence
ttatatgcaaggcgccatgc

SEQ ID NO: 534372 - DNA, 20 bp, Artificial
  CRISPR gRNA sequence
tatatgcaaggcgccatgct

SEQ ID NO: 534373 - DNA, 20 bp, Artificial
  CRISPR gRNA sequence
atatgcaaggcgccatgcta

SEQ ID NO: 534374 - DNA, 20 bp, Artificial
  CRISPR gRNA sequence
tatgcaaggcgccatgctag

SEQ ID NO: 534375 - DNA, 20 bp, Artificial
  CRISPR gRNA sequence
gctgctttgggggatgcaat

SEQ ID NO: 534376 - DNA, 20 bp, Artificial
  CRISPR gRNA sequence
ctttgggggatgcaatgagg

SEQ ID NO: 534377 - DNA, 20 bp, Artificial
  CRISPR gRNA sequence
tgggggatgcaatgaggaag

SEQ ID NO: 534378 - DNA, 20 bp, Artificial
  CRISPR gRNA sequence
gggggatgcaatgaggaagc

SEQ ID NO: 534379 - DNA, 20 bp, Artificial
  CRISPR gRNA sequence
ggggatgcaatgaggaagca

SEQ ID NO: 534380 - DNA, 20 bp, Artificial
  CRISPR gRNA sequence
cccctactatctgagaactc

SEQ ID NO: 534381 - DNA, 20 bp, Artificial
  CRISPR gRNA sequence
ctatctgagaactctaagct

SEQ ID NO: 534382 - DNA, 20 bp, Artificial
  CRISPR gRNA sequence
tctgagaactctaagcttgt

SEQ ID NO: 534383 - DNA, 20 bp, Artificial
  CRISPR gRNA sequence
agaactctaagcttgtagga

SEQ ID NO: 534384 - DNA, 20 bp, Artificial
  CRISPR gRNA sequence
taagcttgtaggagagaaag

SEQ ID NO: 534385 - DNA, 20 bp, Artificial
  CRISPR gRNA sequence
agcttgtaggagagaaagaa

SEQ ID NO: 534386 - DNA, 20 bp, Artificial
  CRISPR gRNA sequence
gtaggagagaaagaagtgct

SEQ ID NO: 534387 - DNA, 20 bp, Artificial
  CRISPR gRNA sequence
taggagagaaagaagtgctc

SEQ ID NO: 534388 - DNA, 20 bp, Artificial
  CRISPR gRNA sequence
accataaggtagagtgaaag

SEQ ID NO: 534389 - DNA, 20 bp, Artificial
  CRISPR gRNA sequence
ggacaagagaactcaaggaa

SEQ ID NO: 534390 - DNA, 20 bp, Artificial
  CRISPR gRNA sequence
aaggaatcagcaggaagaag

SEQ ID NO: 534391 - DNA, 20 bp, Artificial
  CRISPR gRNA sequence
tgtgcctggggctcccatga

SEQ ID NO: 534392 - DNA, 20 bp, Artificial
  CRISPR gRNA sequence
gtgcctggggctcccatgat

SEQ ID NO: 534393 - DNA, 20 bp, Artificial
  CRISPR gRNA sequence
tgcctggggctcccatgatc

SEQ ID NO: 534394 - DNA, 20 bp, Artificial
  CRISPR gRNA sequence
gggctcccatgatcagagag

SEQ ID NO: 534395 - DNA, 20 bp, Artificial
  CRISPR gRNA sequence
ccatgatcagagagagcacg

SEQ ID NO: 534396 - DNA, 20 bp, Artificial
  CRISPR gRNA sequence
gaaccctacctctgtgctga

SEQ ID NO: 534397 - DNA, 20 bp, Artificial
  CRISPR gRNA sequence
cctctgtgctgacctagaaa

SEQ ID NO: 534398 - DNA, 20 bp, Artificial
  CRISPR gRNA sequence
tgtgctgacctagaaattgt

SEQ ID NO: 534399 - DNA, 20 bp, Artificial
  CRISPR gRNA sequence
tgctgacctagaaattgttc

SEQ ID NO: 534400 - DNA, 20 bp, Artificial
  CRISPR gRNA sequence
acctagaaattgttccctga

SEQ ID NO: 534401 - DNA, 20 bp, Artificial
  CRISPR gRNA sequence
gaaattgttccctgagagca

SEQ ID NO: 534402 - DNA, 20 bp, Artificial
  CRISPR gRNA sequence
ttccctgagagcaagaacct

SEQ ID NO: 534403 - DNA, 20 bp, Artificial
  CRISPR gRNA sequence
cctgagagcaagaacctcat

SEQ ID NO: 534404 - DNA, 20 bp, Artificial
  CRISPR gRNA sequence
agagcaagaacctcatggtt

SEQ ID NO: 534405 - DNA, 20 bp, Artificial
  CRISPR gRNA sequence
atggttagagcgcatgggaa

SEQ ID NO: 534406 - DNA, 20 bp, Artificial
  CRISPR gRNA sequence
gagcgcatgggaaggggtta

SEQ ID NO: 534407 - DNA, 20 bp, Artificial
  CRISPR gRNA sequence
tgagcagtcatggaggatat

SEQ ID NO: 534408 - DNA, 20 bp, Artificial
  CRISPR gRNA sequence
gtaactacattccttctgag

SEQ ID NO: 534409 - DNA, 20 bp, Artificial
  CRISPR gRNA sequence
cattccttctgaggcatttc

SEQ ID NO: 534410 - DNA, 20 bp, Artificial
  CRISPR gRNA sequence
cttctgaggcatttctatgt

SEQ ID NO: 534411 - DNA, 20 bp, Artificial
  CRISPR gRNA sequence
ctgaggcatttctatgttag

SEQ ID NO: 534412 - DNA, 20 bp, Artificial
  CRISPR gRNA sequence
tgaggcatttctatgttaga

SEQ ID NO: 534413 - DNA, 20 bp, Artificial
  CRISPR gRNA sequence
aggcatttctatgttagatc

SEQ ID NO: 534414 - DNA, 20 bp, Artificial
  CRISPR gRNA sequence
ctatgttagatctgcctttc

SEQ ID NO: 534415 - DNA, 20 bp, Artificial
  CRISPR gRNA sequence
tatgttagatctgcctttcc

SEQ ID NO: 534416 - DNA, 20 bp, Artificial
  CRISPR gRNA sequence
tgttagatctgcctttcccc

SEQ ID NO: 534417 - DNA, 20 bp, Artificial
  CRISPR gRNA sequence
gatctgcctttcccccaatt

SEQ ID NO: 534418 - DNA, 20 bp, Artificial
  CRISPR gRNA sequence
cctttcccccaattctactg

SEQ ID NO: 534419 - DNA, 20 bp, Artificial
  CRISPR gRNA sequence
tcccccaattctactgtcat

SEQ ID NO: 534420 - DNA, 20 bp, Artificial
  CRISPR gRNA sequence
cccccaattctactgtcatg

SEQ ID NO: 534421 - DNA, 20 bp, Artificial
  CRISPR gRNA sequence
ccccaattctactgtcatgc

SEQ ID NO: 534422 - DNA, 20 bp, Artificial
  CRISPR gRNA sequence
tactgtcatgcaatccacct

SEQ ID NO: 534423 - DNA, 20 bp, Artificial
  CRISPR gRNA sequence
ctgtcatgcaatccaccttc

SEQ ID NO: 534424 - DNA, 20 bp, Artificial
  CRISPR gRNA sequence
tcatgcaatccaccttccgg

SEQ ID NO: 534425 - DNA, 20 bp, Artificial
  CRISPR gRNA sequence
ccggcaagaggttggaacac

SEQ ID NO: 534426 - DNA, 20 bp, Artificial
  CRISPR gRNA sequence
cggcaagaggttggaacaca

SEQ ID NO: 534427 - DNA, 20 bp, Artificial
  CRISPR gRNA sequence
gaacacatgcaaggaacttt

SEQ ID NO: 534428 - DNA, 20 bp, Artificial
  CRISPR gRNA sequence
tttgtccttagaaatttact

SEQ ID NO: 534429 - DNA, 20 bp, Artificial
  CRISPR gRNA sequence
ttgtccttagaaatttactc

SEQ ID NO: 534430 - DNA, 20 bp, Artificial
  CRISPR gRNA sequence
tgtccttagaaatttactcg

SEQ ID NO: 534431 - DNA, 20 bp, Artificial
  CRISPR gRNA sequence
gtccttagaaatttactcgc

SEQ ID NO: 534432 - DNA, 20 bp, Artificial
  CRISPR gRNA sequence
tccttagaaatttactcgct

SEQ ID NO: 534433 - DNA, 20 bp, Artificial
  CRISPR gRNA sequence
agaaatttactcgcttctca

SEQ ID NO: 534434 - DNA, 20 bp, Artificial
  CRISPR gRNA sequence
gaaatttactcgcttctcag

SEQ ID NO: 534435 - DNA, 20 bp, Artificial
  CRISPR gRNA sequence
actcgcttctcagaaattca

SEQ ID NO: 534436 - DNA, 20 bp, Artificial
  CRISPR gRNA sequence
ctcgcttctcagaaattcaa

SEQ ID NO: 534437 - DNA, 20 bp, Artificial
  CRISPR gRNA sequence
gcttctcagaaattcaagac

SEQ ID NO: 534438 - DNA, 20 bp, Artificial
  CRISPR gRNA sequence
ctcagaaattcaagacctat

SEQ ID NO: 534439 - DNA, 20 bp, Artificial
  CRISPR gRNA sequence
tcagaaattcaagacctatg

SEQ ID NO: 534440 - DNA, 20 bp, Artificial
  CRISPR gRNA sequence
agaaattcaagacctatgtt

SEQ ID NO: 534441 - DNA, 20 bp, Artificial
  CRISPR gRNA sequence
aagacctatgttcttggcct

SEQ ID NO: 534442 - DNA, 20 bp, Artificial
  CRISPR gRNA sequence
tgttcttggccttaggaggg

SEQ ID NO: 534443 - DNA, 20 bp, Artificial
  CRISPR gRNA sequence
ttggccttaggagggaaaga

SEQ ID NO: 534444 - DNA, 20 bp, Artificial
  CRISPR gRNA sequence
ggccttaggagggaaagaac

SEQ ID NO: 534445 - DNA, 20 bp, Artificial
  CRISPR gRNA sequence
gccttaggagggaaagaact

SEQ ID NO: 534446 - DNA, 20 bp, Artificial
  CRISPR gRNA sequence
aggagggaaagaactcctcc

SEQ ID NO: 534447 - DNA, 20 bp, Artificial
  CRISPR gRNA sequence
ggagggaaagaactcctcct

SEQ ID NO: 534448 - DNA, 20 bp, Artificial
  CRISPR gRNA sequence
ctcctctcctcacccttcag

SEQ ID NO: 534449 - DNA, 20 bp, Artificial
  CRISPR gRNA sequence
ctctcctcacccttcaggat

SEQ ID NO: 534450 - DNA, 20 bp, Artificial
  CRISPR gRNA sequence
tcctcacccttcaggatttt

SEQ ID NO: 534451 - DNA, 20 bp, Artificial
  CRISPR gRNA sequence
ctcacccttcaggattttct

SEQ ID NO: 534452 - DNA, 20 bp, Artificial
  CRISPR gRNA sequence
acccttcaggattttcttct

SEQ ID NO: 534453 - DNA, 20 bp, Artificial
  CRISPR gRNA sequence
caggattttcttctttgtgt

SEQ ID NO: 534454 - DNA, 20 bp, Artificial
  CRISPR gRNA sequence
aggattttcttctttgtgtg

SEQ ID NO: 534455 - DNA, 20 bp, Artificial
  CRISPR gRNA sequence
tcttctttgtgtgacttcag

SEQ ID NO: 534456 - DNA, 20 bp, Artificial
  CRISPR gRNA sequence
cttctttgtgtgacttcagt

SEQ ID NO: 534457 - DNA, 20 bp, Artificial
  CRISPR gRNA sequence
ttctttgtgtgacttcagtc

SEQ ID NO: 534458 - DNA, 20 bp, Artificial
  CRISPR gRNA sequence
ctttgtgtgacttcagtcca

SEQ ID NO: 534459 - DNA, 20 bp, Artificial
  CRISPR gRNA sequence
tttgtgtgacttcagtccat

SEQ ID NO: 534460 - DNA, 20 bp, Artificial
  CRISPR gRNA sequence
tgtgtgacttcagtccatga

SEQ ID NO: 534461 - DNA, 20 bp, Artificial
  CRISPR gRNA sequence
gtgtgacttcagtccatgaa

SEQ ID NO: 534462 - DNA, 20 bp, Artificial
  CRISPR gRNA sequence
tgtgacttcagtccatgaaa

SEQ ID NO: 534463 - DNA, 20 bp, Artificial
  CRISPR gRNA sequence
cagtccatgaaagcaggcct

SEQ ID NO: 534464 - DNA, 20 bp, Artificial
  CRISPR gRNA sequence
agtccatgaaagcaggccta

SEQ ID NO: 534465 - DNA, 20 bp, Artificial
  CRISPR gRNA sequence
cagctactcgtaatgtagtt

SEQ ID NO: 534466 - DNA, 20 bp, Artificial
  CRISPR gRNA sequence
ctcgtaatgtagtttttcct

SEQ ID NO: 534467 - DNA, 20 bp, Artificial
  CRISPR gRNA sequence
gtaatgtagtttttcctgta

SEQ ID NO: 534468 - DNA, 20 bp, Artificial
  CRISPR gRNA sequence
ttcctgtactcttaaaatca

SEQ ID NO: 534469 - DNA, 20 bp, Artificial
  CRISPR gRNA sequence
tcctgtactcttaaaatcac

SEQ ID NO: 534470 - DNA, 20 bp, Artificial
  CRISPR gRNA sequence
cctgtactcttaaaatcaca

SEQ ID NO: 534471 - DNA, 20 bp, Artificial
  CRISPR gRNA sequence
ctgtactcttaaaatcacag

SEQ ID NO: 534472 - DNA, 20 bp, Artificial
  CRISPR gRNA sequence
tactcttaaaatcacaggga

SEQ ID NO: 534473 - DNA, 20 bp, Artificial
  CRISPR gRNA sequence
ttaaaatcacagggaatctg

SEQ ID NO: 534474 - DNA, 20 bp, Artificial
  CRISPR gRNA sequence
aaaatcacagggaatctgtg

SEQ ID NO: 534475 - DNA, 20 bp, Artificial
  CRISPR gRNA sequence
aaatcacagggaatctgtga

SEQ ID NO: 534476 - DNA, 20 bp, Artificial
  CRISPR gRNA sequence
tgaaggtgcccagctgctag

SEQ ID NO: 534477 - DNA, 20 bp, Artificial
  CRISPR gRNA sequence
ctagaggcctggagcaccct

SEQ ID NO: 534478 - DNA, 20 bp, Artificial
  CRISPR gRNA sequence
gaggcctggagcaccctgct

SEQ ID NO: 534479 - DNA, 20 bp, Artificial
  CRISPR gRNA sequence
gagcaccctgctggcccctc

SEQ ID NO: 534480 - DNA, 20 bp, Artificial
  CRISPR gRNA sequence
ctggcccctctggactcctt

SEQ ID NO: 534481 - DNA, 20 bp, Artificial
  CRISPR gRNA sequence
gcccctctggactcctttag

SEQ ID NO: 534482 - DNA, 20 bp, Artificial
  CRISPR gRNA sequence
tggactcctttaggctgtaa

SEQ ID NO: 534483 - DNA, 20 bp, Artificial
  CRISPR gRNA sequence
gactcctttaggctgtaagt

SEQ ID NO: 534484 - DNA, 20 bp, Artificial
  CRISPR gRNA sequence
ctttaggctgtaagttaggt

SEQ ID NO: 534485 - DNA, 20 bp, Artificial
  CRISPR gRNA sequence
taggctgtaagttaggtatt

SEQ ID NO: 534486 - DNA, 20 bp, Artificial
  CRISPR gRNA sequence
aggctgtaagttaggtattt

SEQ ID NO: 534487 - DNA, 20 bp, Artificial
  CRISPR gRNA sequence
ggctgtaagttaggtatttc

SEQ ID NO: 534488 - DNA, 20 bp, Artificial
  CRISPR gRNA sequence
taagttaggtatttcagtcc

SEQ ID NO: 534489 - DNA, 20 bp, Artificial
  CRISPR gRNA sequence
ggtatttcagtccctgcacc

SEQ ID NO: 534490 - DNA, 20 bp, Artificial
  CRISPR gRNA sequence
cagtccctgcacccaaggcc

SEQ ID NO: 534491 - DNA, 20 bp, Artificial
  CRISPR gRNA sequence
agtccctgcacccaaggccg

SEQ ID NO: 534492 - DNA, 20 bp, Artificial
  CRISPR gRNA sequence
cacccaaggccgtctttgca

SEQ ID NO: 534493 - DNA, 20 bp, Artificial
  CRISPR gRNA sequence
tgcagtggctccagagggag

SEQ ID NO: 534494 - DNA, 20 bp, Artificial
  CRISPR gRNA sequence
gcagtggctccagagggagg

SEQ ID NO: 534495 - DNA, 20 bp, Artificial
  CRISPR gRNA sequence
cagtggctccagagggaggt

SEQ ID NO: 534496 - DNA, 20 bp, Artificial
  CRISPR gRNA sequence
cagagggaggtaggaagaga

SEQ ID NO: 534497 - DNA, 20 bp, Artificial
  CRISPR gRNA sequence
ttccctggggtgaaataatt

SEQ ID NO: 534498 - DNA, 20 bp, Artificial
  CRISPR gRNA sequence
tccctggggtgaaataatta

SEQ ID NO: 534499 - DNA, 20 bp, Artificial
  CRISPR gRNA sequence
ccctggggtgaaataattac

SEQ ID NO: 534500 - DNA, 20 bp, Artificial
  CRISPR gRNA sequence
cctggggtgaaataattacc

SEQ ID NO: 534501 - DNA, 20 bp, Artificial
  CRISPR gRNA sequence
gggtgaaataattacctctt

SEQ ID NO: 534502 - DNA, 20 bp, Artificial
  CRISPR gRNA sequence
cctctttttttttttttttt

SEQ ID NO: 534503 - DNA, 20 bp, Artificial
  CRISPR gRNA sequence
tttttttttttttttttgag

SEQ ID NO: 534504 - DNA, 20 bp, Artificial
  CRISPR gRNA sequence
tttttttttttttttgagtt

SEQ ID NO: 534505 - DNA, 20 bp, Artificial
  CRISPR gRNA sequence
ttttttttttttttgagttg

SEQ ID NO: 534506 - DNA, 20 bp, Artificial
  CRISPR gRNA sequence
tttttttttttttgagttga

SEQ ID NO: 534507 - DNA, 20 bp, Artificial
  CRISPR gRNA sequence
ttttttttttttgagttgaa

SEQ ID NO: 534508 - DNA, 20 bp, Artificial
  CRISPR gRNA sequence
tttttttttttgagttgaag

SEQ ID NO: 534509 - DNA, 20 bp, Artificial
  CRISPR gRNA sequence
ttttttttttgagttgaagt

SEQ ID NO: 534510 - DNA, 20 bp, Artificial
  CRISPR gRNA sequence
tttttttttgagttgaagtt

SEQ ID NO: 534511 - DNA, 20 bp, Artificial
  CRISPR gRNA sequence
ttttttttgagttgaagttt

SEQ ID NO: 534512 - DNA, 20 bp, Artificial
  CRISPR gRNA sequence
tttttttgagttgaagtttc

SEQ ID NO: 534513 - DNA, 20 bp, Artificial
  CRISPR gRNA sequence
ttttttgagttgaagtttca

SEQ ID NO: 534514 - DNA, 20 bp, Artificial
  CRISPR gRNA sequence
tttttgagttgaagtttcac

SEQ ID NO: 534515 - DNA, 20 bp, Artificial
  CRISPR gRNA sequence
ttttgagttgaagtttcact

SEQ ID NO: 534516 - DNA, 20 bp, Artificial
  CRISPR gRNA sequence
tttgagttgaagtttcactc

SEQ ID NO: 534517 - DNA, 20 bp, Artificial
  CRISPR gRNA sequence
ttgagttgaagtttcactct

SEQ ID NO: 534518 - DNA, 20 bp, Artificial
  CRISPR gRNA sequence
tgagttgaagtttcactctt

SEQ ID NO: 534519 - DNA, 20 bp, Artificial
  CRISPR gRNA sequence
gagttgaagtttcactcttg

SEQ ID NO: 534520 - DNA, 20 bp, Artificial
  CRISPR gRNA sequence
agttgaagtttcactcttgt

SEQ ID NO: 534521 - DNA, 20 bp, Artificial
  CRISPR gRNA sequence
aagtttcactcttgttgccc

SEQ ID NO: 534522 - DNA, 20 bp, Artificial
  CRISPR gRNA sequence
cactcttgttgcccaggcta

SEQ ID NO: 534523 - DNA, 20 bp, Artificial
  CRISPR gRNA sequence
actcttgttgcccaggctag

SEQ ID NO: 534524 - DNA, 20 bp, Artificial
  CRISPR gRNA sequence
ttgttgcccaggctagagtg

SEQ ID NO: 534525 - DNA, 20 bp, Artificial
  CRISPR gRNA sequence
gttgcccaggctagagtgca

SEQ ID NO: 534526 - DNA, 20 bp, Artificial
  CRISPR gRNA sequence
ttgcccaggctagagtgcaa

SEQ ID NO: 534527 - DNA, 20 bp, Artificial
  CRISPR gRNA sequence
cccaggctagagtgcaatgg

SEQ ID NO: 534528 - DNA, 20 bp, Artificial
  CRISPR gRNA sequence
gagtgcaatggtgcgatctt

SEQ ID NO: 534529 - DNA, 20 bp, Artificial
  CRISPR gRNA sequence
ggctcactgcagcctctgcc

SEQ ID NO: 534530 - DNA, 20 bp, Artificial
  CRISPR gRNA sequence
gctcactgcagcctctgcct

SEQ ID NO: 534531 - DNA, 20 bp, Artificial
  CRISPR gRNA sequence
actgcagcctctgcctccca

SEQ ID NO: 534532 - DNA, 20 bp, Artificial
  CRISPR gRNA sequence
cagcctctgcctcccaggtt

SEQ ID NO: 534533 - DNA, 20 bp, Artificial
  CRISPR gRNA sequence
tgcctcccaggttcaaacaa

SEQ ID NO: 534534 - DNA, 20 bp, Artificial
  CRISPR gRNA sequence
cctcccaggttcaaacaatt

SEQ ID NO: 534535 - DNA, 20 bp, Artificial
  CRISPR gRNA sequence
ccaggttcaaacaattctcc

SEQ ID NO: 534536 - DNA, 20 bp, Artificial
  CRISPR gRNA sequence
aaacaattctcctgcctcgg

SEQ ID NO: 534537 - DNA, 20 bp, Artificial
  CRISPR gRNA sequence
tcctgcctcggcctcctgag

SEQ ID NO: 534538 - DNA, 20 bp, Artificial
  CRISPR gRNA sequence
ctgcctcggcctcctgagta

SEQ ID NO: 534539 - DNA, 20 bp, Artificial
  CRISPR gRNA sequence
cctcggcctcctgagtagct

SEQ ID NO: 534540 - DNA, 20 bp, Artificial
  CRISPR gRNA sequence
ggcctcctgagtagctggga

SEQ ID NO: 534541 - DNA, 20 bp, Artificial
  CRISPR gRNA sequence
ctgagtagctgggattacag

SEQ ID NO: 534542 - DNA, 20 bp, Artificial
  CRISPR gRNA sequence
agtagctgggattacaggcg

SEQ ID NO: 534543 - DNA, 20 bp, Artificial
  CRISPR gRNA sequence
ggattacaggcgttcaccac

SEQ ID NO: 534544 - DNA, 20 bp, Artificial
  CRISPR gRNA sequence
caggcgttcaccaccacgcc

SEQ ID NO: 534545 - DNA, 20 bp, Artificial
  CRISPR gRNA sequence
accaccacgcccggctaata

SEQ ID NO: 534546 - DNA, 20 bp, Artificial
  CRISPR gRNA sequence
atattgtatttttagtagag

SEQ ID NO: 534547 - DNA, 20 bp, Artificial
  CRISPR gRNA sequence
tatttttagtagagatggcg

SEQ ID NO: 534548 - DNA, 20 bp, Artificial
  CRISPR gRNA sequence
ttagtagagatggcgtttct

SEQ ID NO: 534549 - DNA, 20 bp, Artificial
  CRISPR gRNA sequence
tagtagagatggcgtttctc

SEQ ID NO: 534550 - DNA, 20 bp, Artificial
  CRISPR gRNA sequence
agtagagatggcgtttctcc

SEQ ID NO: 534551 - DNA, 20 bp, Artificial
  CRISPR gRNA sequence
gtagagatggcgtttctcca

SEQ ID NO: 534552 - DNA, 20 bp, Artificial
  CRISPR gRNA sequence
ctccatgttggtcaggctgg

SEQ ID NO: 534553 - DNA, 20 bp, Artificial
  CRISPR gRNA sequence
tccatgttggtcaggctggt

SEQ ID NO: 534554 - DNA, 20 bp, Artificial
  CRISPR gRNA sequence
catgttggtcaggctggtct

SEQ ID NO: 534555 - DNA, 20 bp, Artificial
  CRISPR gRNA sequence
gtcaggctggtctcgaactc

SEQ ID NO: 534556 - DNA, 20 bp, Artificial
  CRISPR gRNA sequence
gtctcgaactcccgaccagg

SEQ ID NO: 534557 - DNA, 20 bp, Artificial
  CRISPR gRNA sequence
gaactcccgaccaggtgatc

SEQ ID NO: 534558 - DNA, 20 bp, Artificial
  CRISPR gRNA sequence
ccgaccaggtgatctgcctg

SEQ ID NO: 534559 - DNA, 20 bp, Artificial
  CRISPR gRNA sequence
cctgccttggcctcccaaag

SEQ ID NO: 534560 - DNA, 20 bp, Artificial
  CRISPR gRNA sequence
ccttggcctcccaaagtgct

SEQ ID NO: 534561 - DNA, 20 bp, Artificial
  CRISPR gRNA sequence
ggcctcccaaagtgctggga

SEQ ID NO: 534562 - DNA, 20 bp, Artificial
  CRISPR gRNA sequence
gcctcccaaagtgctgggat

SEQ ID NO: 534563 - DNA, 20 bp, Artificial
  CRISPR gRNA sequence
ccaaagtgctgggattacag

SEQ ID NO: 534564 - DNA, 20 bp, Artificial
  CRISPR gRNA sequence
ggattacaggtatgagccac

SEQ ID NO: 534565 - DNA, 20 bp, Artificial
  CRISPR gRNA sequence
caggtatgagccaccgcacc

SEQ ID NO: 534566 - DNA, 20 bp, Artificial
  CRISPR gRNA sequence
aaataattacctcttacatc

SEQ ID NO: 534567 - DNA, 20 bp, Artificial
  CRISPR gRNA sequence
cctcttacatctttatggag

SEQ ID NO: 534568 - DNA, 20 bp, Artificial
  CRISPR gRNA sequence
ttacatctttatggagatgt

SEQ ID NO: 534569 - DNA, 20 bp, Artificial
  CRISPR gRNA sequence
acatctttatggagatgtgt

SEQ ID NO: 534570 - DNA, 20 bp, Artificial
  CRISPR gRNA sequence
catctttatggagatgtgtg

SEQ ID NO: 534571 - DNA, 20 bp, Artificial
  CRISPR gRNA sequence
tatggagatgtgtggctggg

SEQ ID NO: 534572 - DNA, 20 bp, Artificial
  CRISPR gRNA sequence
atggagatgtgtggctgggg

SEQ ID NO: 534573 - DNA, 20 bp, Artificial
  CRISPR gRNA sequence
tggagatgtgtggctgggga

SEQ ID NO: 534574 - DNA, 20 bp, Artificial
  CRISPR gRNA sequence
gggaagcacaagccctctct

SEQ ID NO: 534575 - DNA, 20 bp, Artificial
  CRISPR gRNA sequence
tctaagcatcaccctgtaac

SEQ ID NO: 534576 - DNA, 20 bp, Artificial
  CRISPR gRNA sequence
taagcatcaccctgtaactt

SEQ ID NO: 534577 - DNA, 20 bp, Artificial
  CRISPR gRNA sequence
agcatcaccctgtaacttcc

SEQ ID NO: 534578 - DNA, 20 bp, Artificial
  CRISPR gRNA sequence
taacttccggatgttgattc

SEQ ID NO: 534579 - DNA, 20 bp, Artificial
  CRISPR gRNA sequence
ccggatgttgattcaaacca

SEQ ID NO: 534580 - DNA, 20 bp, Artificial
  CRISPR gRNA sequence
cggatgttgattcaaaccag

SEQ ID NO: 534581 - DNA, 20 bp, Artificial
  CRISPR gRNA sequence
attcaaaccagatggcctcc

SEQ ID NO: 534582 - DNA, 20 bp, Artificial
  CRISPR gRNA sequence
aaaccagatggcctcctctg

SEQ ID NO: 534583 - DNA, 20 bp, Artificial
  CRISPR gRNA sequence
ctctgactacatgaaatgtg

SEQ ID NO: 534584 - DNA, 20 bp, Artificial
  CRISPR gRNA sequence
tgactacatgaaatgtgagc

SEQ ID NO: 534585 - DNA, 20 bp, Artificial
  CRISPR gRNA sequence
actacatgaaatgtgagcat

SEQ ID NO: 534586 - DNA, 20 bp, Artificial
  CRISPR gRNA sequence
catgaaatgtgagcatcaga

SEQ ID NO: 534587 - DNA, 20 bp, Artificial
  CRISPR gRNA sequence
tgagtgtagagtcaaagtta

SEQ ID NO: 534588 - DNA, 20 bp, Artificial
  CRISPR gRNA sequence
gagtgtagagtcaaagttag

SEQ ID NO: 534589 - DNA, 20 bp, Artificial
  CRISPR gRNA sequence
agtgtagagtcaaagttaga

SEQ ID NO: 534590 - DNA, 20 bp, Artificial
  CRISPR gRNA sequence
gacaatgtgattttgatacc

SEQ ID NO: 534591 - DNA, 20 bp, Artificial
  CRISPR gRNA sequence
tgatacctaaatggctcgtg

SEQ ID NO: 534592 - DNA, 20 bp, Artificial
  CRISPR gRNA sequence
gatacctaaatggctcgtgt

SEQ ID NO: 534593 - DNA, 20 bp, Artificial
  CRISPR gRNA sequence
atacctaaatggctcgtgtg

SEQ ID NO: 534594 - DNA, 20 bp, Artificial
  CRISPR gRNA sequence
aatggctcgtgtgctctaag

SEQ ID NO: 534595 - DNA, 20 bp, Artificial
  CRISPR gRNA sequence
gtgtgctctaagcacaaaga

SEQ ID NO: 534596 - DNA, 20 bp, Artificial
  CRISPR gRNA sequence
taagcacaaagaggaaaggg

SEQ ID NO: 534597 - DNA, 20 bp, Artificial
  CRISPR gRNA sequence
agcacaaagaggaaagggcc

SEQ ID NO: 534598 - DNA, 20 bp, Artificial
  CRISPR gRNA sequence
cagaaaggacaaaacacatc

SEQ ID NO: 534599 - DNA, 20 bp, Artificial
  CRISPR gRNA sequence
tatgccatcttccgtgccct

SEQ ID NO: 534600 - DNA, 20 bp, Artificial
  CRISPR gRNA sequence
tgccatcttccgtgccctgc

SEQ ID NO: 534601 - DNA, 20 bp, Artificial
  CRISPR gRNA sequence
ccgtgccctgcagtcattgc

SEQ ID NO: 534602 - DNA, 20 bp, Artificial
  CRISPR gRNA sequence
cgtgccctgcagtcattgct

SEQ ID NO: 534603 - DNA, 20 bp, Artificial
  CRISPR gRNA sequence
cagtcattgcttaggttatg

SEQ ID NO: 534604 - DNA, 20 bp, Artificial
  CRISPR gRNA sequence
cttaggttatgtccagtaga

SEQ ID NO: 534605 - DNA, 20 bp, Artificial
  CRISPR gRNA sequence
aggttatgtccagtagactg

SEQ ID NO: 534606 - DNA, 20 bp, Artificial
  CRISPR gRNA sequence
ggttatgtccagtagactgt

SEQ ID NO: 534607 - DNA, 20 bp, Artificial
  CRISPR gRNA sequence
tgtccagtagactgtggaga

SEQ ID NO: 534608 - DNA, 20 bp, Artificial
  CRISPR gRNA sequence
tggagagggctctaacccct

SEQ ID NO: 534609 - DNA, 20 bp, Artificial
  CRISPR gRNA sequence
taacccctggccctagttct

SEQ ID NO: 534610 - DNA, 20 bp, Artificial
  CRISPR gRNA sequence
acccctggccctagttctga

SEQ ID NO: 534611 - DNA, 20 bp, Artificial
  CRISPR gRNA sequence
gccctagttctgaattatgg

SEQ ID NO: 534612 - DNA, 20 bp, Artificial
  CRISPR gRNA sequence
gttctgaattatggggcagt

SEQ ID NO: 534613 - DNA, 20 bp, Artificial
  CRISPR gRNA sequence
tgaattatggggcagtgggt

SEQ ID NO: 534614 - DNA, 20 bp, Artificial
  CRISPR gRNA sequence
aattatggggcagtgggtgg

SEQ ID NO: 534615 - DNA, 20 bp, Artificial
  CRISPR gRNA sequence
tggggcagtgggtggtcctt

SEQ ID NO: 534616 - DNA, 20 bp, Artificial
  CRISPR gRNA sequence
cttcatctcctatgtggcaa

SEQ ID NO: 534617 - DNA, 20 bp, Artificial
  CRISPR gRNA sequence
ttcatctcctatgtggcaag

SEQ ID NO: 534618 - DNA, 20 bp, Artificial
  CRISPR gRNA sequence
catctcctatgtggcaagct

SEQ ID NO: 534619 - DNA, 20 bp, Artificial
  CRISPR gRNA sequence
atctcctatgtggcaagctt

SEQ ID NO: 534620 - DNA, 20 bp, Artificial
  CRISPR gRNA sequence
ctatgtggcaagcttgcact

SEQ ID NO: 534621 - DNA, 20 bp, Artificial
  CRISPR gRNA sequence
tgtggcaagcttgcactggc

SEQ ID NO: 534622 - DNA, 20 bp, Artificial
  CRISPR gRNA sequence
gcactggccattggtttact

SEQ ID NO: 534623 - DNA, 20 bp, Artificial
  CRISPR gRNA sequence
cactggccattggtttacta

SEQ ID NO: 534624 - DNA, 20 bp, Artificial
  CRISPR gRNA sequence
gccattggtttactactctg

SEQ ID NO: 534625 - DNA, 20 bp, Artificial
  CRISPR gRNA sequence
gtttactactctgttcaccc

SEQ ID NO: 534626 - DNA, 20 bp, Artificial
  CRISPR gRNA sequence
actactctgttcacccacta

SEQ ID NO: 534627 - DNA, 20 bp, Artificial
  CRISPR gRNA sequence
ctactctgttcacccactat

SEQ ID NO: 534628 - DNA, 20 bp, Artificial
  CRISPR gRNA sequence
ctctgttcacccactatttt

SEQ ID NO: 534629 - DNA, 20 bp, Artificial
  CRISPR gRNA sequence
tgttcacccactatttttgt

SEQ ID NO: 534630 - DNA, 20 bp, Artificial
  CRISPR gRNA sequence
ttcacccactatttttgttt

SEQ ID NO: 534631 - DNA, 20 bp, Artificial
  CRISPR gRNA sequence
acccactatttttgtttttt

SEQ ID NO: 534632 - DNA, 20 bp, Artificial
  CRISPR gRNA sequence
tttttgttttttatttgttt

SEQ ID NO: 534633 - DNA, 20 bp, Artificial
  CRISPR gRNA sequence
ttgttttttatttgttttgt

SEQ ID NO: 534634 - DNA, 20 bp, Artificial
  CRISPR gRNA sequence
tgttttttatttgttttgtt

SEQ ID NO: 534635 - DNA, 20 bp, Artificial
  CRISPR gRNA sequence
gttttttatttgttttgttt

SEQ ID NO: 534636 - DNA, 20 bp, Artificial
  CRISPR gRNA sequence
ttttttatttgttttgtttt

SEQ ID NO: 534637 - DNA, 20 bp, Artificial
  CRISPR gRNA sequence
tttatttgttttgttttttt

SEQ ID NO: 534638 - DNA, 20 bp, Artificial
  CRISPR gRNA sequence
ttatttgttttgtttttttg

SEQ ID NO: 534639 - DNA, 20 bp, Artificial
  CRISPR gRNA sequence
tatttgttttgtttttttga

SEQ ID NO: 534640 - DNA, 20 bp, Artificial
  CRISPR gRNA sequence
atttgttttgtttttttgag

SEQ ID NO: 534641 - DNA, 20 bp, Artificial
  CRISPR gRNA sequence
tttgttttgtttttttgaga

SEQ ID NO: 534642 - DNA, 20 bp, Artificial
  CRISPR gRNA sequence
gttttgtttttttgagacag

SEQ ID NO: 534643 - DNA, 20 bp, Artificial
  CRISPR gRNA sequence
ttttgtttttttgagacagg

SEQ ID NO: 534644 - DNA, 20 bp, Artificial
  CRISPR gRNA sequence
tgtttttttgagacagggcc

SEQ ID NO: 534645 - DNA, 20 bp, Artificial
  CRISPR gRNA sequence
gtttttttgagacagggcct

SEQ ID NO: 534646 - DNA, 20 bp, Artificial
  CRISPR gRNA sequence
tttttttgagacagggcctt

SEQ ID NO: 534647 - DNA, 20 bp, Artificial
  CRISPR gRNA sequence
ttttgagacagggccttgct

SEQ ID NO: 534648 - DNA, 20 bp, Artificial
  CRISPR gRNA sequence
tttgagacagggccttgctc

SEQ ID NO: 534649 - DNA, 20 bp, Artificial
  CRISPR gRNA sequence
ttgagacagggccttgctct

SEQ ID NO: 534650 - DNA, 20 bp, Artificial
  CRISPR gRNA sequence
tgagacagggccttgctctg

SEQ ID NO: 534651 - DNA, 20 bp, Artificial
  CRISPR gRNA sequence
gagacagggccttgctctgt

SEQ ID NO: 534652 - DNA, 20 bp, Artificial
  CRISPR gRNA sequence
agacagggccttgctctgtt

SEQ ID NO: 534653 - DNA, 20 bp, Artificial
  CRISPR gRNA sequence
gctctgttgcccagactgga

SEQ ID NO: 534654 - DNA, 20 bp, Artificial
  CRISPR gRNA sequence
ctctgttgcccagactggag

SEQ ID NO: 534655 - DNA, 20 bp, Artificial
  CRISPR gRNA sequence
tgttgcccagactggagtgc

SEQ ID NO: 534656 - DNA, 20 bp, Artificial
  CRISPR gRNA sequence
ttgcccagactggagtgcag

SEQ ID NO: 534657 - DNA, 20 bp, Artificial
  CRISPR gRNA sequence
cccagactggagtgcagtgt

SEQ ID NO: 534658 - DNA, 20 bp, Artificial
  CRISPR gRNA sequence
gagtgcagtgtgtgatcgta

SEQ ID NO: 534659 - DNA, 20 bp, Artificial
  CRISPR gRNA sequence
actgcattcttgatctcccg

SEQ ID NO: 534660 - DNA, 20 bp, Artificial
  CRISPR gRNA sequence
cattcttgatctcccgggct

SEQ ID NO: 534661 - DNA, 20 bp, Artificial
  CRISPR gRNA sequence
ttgatctcccgggctgaaat

SEQ ID NO: 534662 - DNA, 20 bp, Artificial
  CRISPR gRNA sequence
gatctcccgggctgaaatga

SEQ ID NO: 534663 - DNA, 20 bp, Artificial
  CRISPR gRNA sequence
atctcccgggctgaaatgat

SEQ ID NO: 534664 - DNA, 20 bp, Artificial
  CRISPR gRNA sequence
ccgggctgaaatgattcacc

SEQ ID NO: 534665 - DNA, 20 bp, Artificial
  CRISPR gRNA sequence
aaatgattcacccacctcag

SEQ ID NO: 534666 - DNA, 20 bp, Artificial
  CRISPR gRNA sequence
acccacctcagcctcctgac

SEQ ID NO: 534667 - DNA, 20 bp, Artificial
  CRISPR gRNA sequence
agcctcctgactagctggga

SEQ ID NO: 534668 - DNA, 20 bp, Artificial
  CRISPR gRNA sequence
ctgactagctgggactacag

SEQ ID NO: 534669 - DNA, 20 bp, Artificial
  CRISPR gRNA sequence
actagctgggactacaggca

SEQ ID NO: 534670 - DNA, 20 bp, Artificial
  CRISPR gRNA sequence
gctgggactacaggcataca

SEQ ID NO: 534671 - DNA, 20 bp, Artificial
  CRISPR gRNA sequence
ggactacaggcatacaccaa

SEQ ID NO: 534672 - DNA, 20 bp, Artificial
  CRISPR gRNA sequence
caggcatacaccaatgcacc

SEQ ID NO: 534673 - DNA, 20 bp, Artificial
  CRISPR gRNA sequence
atttttaagtttttttttta

SEQ ID NO: 534674 - DNA, 20 bp, Artificial
  CRISPR gRNA sequence
ttaagttttttttttaaagt

SEQ ID NO: 534675 - DNA, 20 bp, Artificial
  CRISPR gRNA sequence
taagttttttttttaaagta

SEQ ID NO: 534676 - DNA, 20 bp, Artificial
  CRISPR gRNA sequence
aagttttttttttaaagtag

SEQ ID NO: 534677 - DNA, 20 bp, Artificial
  CRISPR gRNA sequence
agttttttttttaaagtaga

SEQ ID NO: 534678 - DNA, 20 bp, Artificial
  CRISPR gRNA sequence
tttttttaaagtagagacca

SEQ ID NO: 534679 - DNA, 20 bp, Artificial
  CRISPR gRNA sequence
ttttttaaagtagagaccag

SEQ ID NO: 534680 - DNA, 20 bp, Artificial
  CRISPR gRNA sequence
tttttaaagtagagaccagg

SEQ ID NO: 534681 - DNA, 20 bp, Artificial
  CRISPR gRNA sequence
ttttaaagtagagaccaggt

SEQ ID NO: 534682 - DNA, 20 bp, Artificial
  CRISPR gRNA sequence
tttaaagtagagaccaggtc

SEQ ID NO: 534683 - DNA, 20 bp, Artificial
  CRISPR gRNA sequence
ttaaagtagagaccaggtct

SEQ ID NO: 534684 - DNA, 20 bp, Artificial
  CRISPR gRNA sequence
taaagtagagaccaggtctc

SEQ ID NO: 534685 - DNA, 20 bp, Artificial
  CRISPR gRNA sequence
aaagtagagaccaggtctca

SEQ ID NO: 534686 - DNA, 20 bp, Artificial
  CRISPR gRNA sequence
aagtagagaccaggtctcac

SEQ ID NO: 534687 - DNA, 20 bp, Artificial
  CRISPR gRNA sequence
actatattgcccaggctggt

SEQ ID NO: 534688 - DNA, 20 bp, Artificial
  CRISPR gRNA sequence
tattgcccaggctggtccca

SEQ ID NO: 534689 - DNA, 20 bp, Artificial
  CRISPR gRNA sequence
cccaggctggtcccaaactc

SEQ ID NO: 534690 - DNA, 20 bp, Artificial
  CRISPR gRNA sequence
gtcccaaactcctgagctca

SEQ ID NO: 534691 - DNA, 20 bp, Artificial
  CRISPR gRNA sequence
ctgagctcaaatgatcctcc

SEQ ID NO: 534692 - DNA, 20 bp, Artificial
  CRISPR gRNA sequence
agctcaaatgatcctcctgc

SEQ ID NO: 534693 - DNA, 20 bp, Artificial
  CRISPR gRNA sequence
aaatgatcctcctgcctcgg

SEQ ID NO: 534694 - DNA, 20 bp, Artificial
  CRISPR gRNA sequence
ctgcctcggcctcccaaagt

SEQ ID NO: 534695 - DNA, 20 bp, Artificial
  CRISPR gRNA sequence
cctcggcctcccaaagtgct

SEQ ID NO: 534696 - DNA, 20 bp, Artificial
  CRISPR gRNA sequence
ggcctcccaaagtgctgaga

SEQ ID NO: 534697 - DNA, 20 bp, Artificial
  CRISPR gRNA sequence
ccaaagtgctgagattacag

SEQ ID NO: 534698 - DNA, 20 bp, Artificial
  CRISPR gRNA sequence
agattacagatatgagccac

SEQ ID NO: 534699 - DNA, 20 bp, Artificial
  CRISPR gRNA sequence
cagatatgagccaccacact

SEQ ID NO: 534700 - DNA, 20 bp, Artificial
  CRISPR gRNA sequence
ggcccatacaccatttggtt

SEQ ID NO: 534701 - DNA, 20 bp, Artificial
  CRISPR gRNA sequence
gcccatacaccatttggttc

SEQ ID NO: 534702 - DNA, 20 bp, Artificial
  CRISPR gRNA sequence
ggttcatttgtccttccaac

SEQ ID NO: 534703 - DNA, 20 bp, Artificial
  CRISPR gRNA sequence
gttcatttgtccttccaaca

SEQ ID NO: 534704 - DNA, 20 bp, Artificial
  CRISPR gRNA sequence
atttgtccttccaacattta

SEQ ID NO: 534705 - DNA, 20 bp, Artificial
  CRISPR gRNA sequence
gtccttccaacatttattcc

SEQ ID NO: 534706 - DNA, 20 bp, Artificial
  CRISPR gRNA sequence
tccttccaacatttattcct

SEQ ID NO: 534707 - DNA, 20 bp, Artificial
  CRISPR gRNA sequence
ccaacatttattcctcatct

SEQ ID NO: 534708 - DNA, 20 bp, Artificial
  CRISPR gRNA sequence
caacatttattcctcatctt

SEQ ID NO: 534709 - DNA, 20 bp, Artificial
  CRISPR gRNA sequence
attcctcatcttccaagtgt

SEQ ID NO: 534710 - DNA, 20 bp, Artificial
  CRISPR gRNA sequence
ttcctcatcttccaagtgtt

SEQ ID NO: 534711 - DNA, 20 bp, Artificial
  CRISPR gRNA sequence
ctcatcttccaagtgttaag

SEQ ID NO: 534712 - DNA, 20 bp, Artificial
  CRISPR gRNA sequence
atcttccaagtgttaagtgt

SEQ ID NO: 534713 - DNA, 20 bp, Artificial
  CRISPR gRNA sequence
ccaagtgttaagtgtcattg

SEQ ID NO: 534714 - DNA, 20 bp, Artificial
  CRISPR gRNA sequence
caagtgttaagtgtcattgt

SEQ ID NO: 534715 - DNA, 20 bp, Artificial
  CRISPR gRNA sequence
agtgtcattgtgacttagac

SEQ ID NO: 534716 - DNA, 20 bp, Artificial
  CRISPR gRNA sequence
tgacttagacacaaattgtc

SEQ ID NO: 534717 - DNA, 20 bp, Artificial
  CRISPR gRNA sequence
agacacaaattgtcctcagg

SEQ ID NO: 534718 - DNA, 20 bp, Artificial
  CRISPR gRNA sequence
gacacaaattgtcctcagga

SEQ ID NO: 534719 - DNA, 20 bp, Artificial
  CRISPR gRNA sequence
tcctcaggaagcctaaaatc

SEQ ID NO: 534720 - DNA, 20 bp, Artificial
  CRISPR gRNA sequence
aggaagcctaaaatcaagta

SEQ ID NO: 534721 - DNA, 20 bp, Artificial
  CRISPR gRNA sequence
aaatcaagtaagaggcaaac

SEQ ID NO: 534722 - DNA, 20 bp, Artificial
  CRISPR gRNA sequence
aaaatcgcaatgtcaatttc

SEQ ID NO: 534723 - DNA, 20 bp, Artificial
  CRISPR gRNA sequence
ctgtgaagagcccagggcca

SEQ ID NO: 534724 - DNA, 20 bp, Artificial
  CRISPR gRNA sequence
tgtgaagagcccagggccac

SEQ ID NO: 534725 - DNA, 20 bp, Artificial
  CRISPR gRNA sequence
tgaagagcccagggccacca

SEQ ID NO: 534726 - DNA, 20 bp, Artificial
  CRISPR gRNA sequence
tggtaggaggaatggggtgt

SEQ ID NO: 534727 - DNA, 20 bp, Artificial
  CRISPR gRNA sequence
gtaggaggaatggggtgtag

SEQ ID NO: 534728 - DNA, 20 bp, Artificial
  CRISPR gRNA sequence
agactgcaggcagggttgga

SEQ ID NO: 534729 - DNA, 20 bp, Artificial
  CRISPR gRNA sequence
caggcagggttggacagaca

SEQ ID NO: 534730 - DNA, 20 bp, Artificial
  CRISPR gRNA sequence
gacagacaaggttggctacg

SEQ ID NO: 534731 - DNA, 20 bp, Artificial
  CRISPR gRNA sequence
gctacggctctgtgcaccct

SEQ ID NO: 534732 - DNA, 20 bp, Artificial
  CRISPR gRNA sequence
cggctctgtgcaccctgcct

SEQ ID NO: 534733 - DNA, 20 bp, Artificial
  CRISPR gRNA sequence
tgtgcaccctgcctggttca

SEQ ID NO: 534734 - DNA, 20 bp, Artificial
  CRISPR gRNA sequence
tgcaccctgcctggttcaag

SEQ ID NO: 534735 - DNA, 20 bp, Artificial
  CRISPR gRNA sequence
cctggttcaagcaggacagt

SEQ ID NO: 534736 - DNA, 20 bp, Artificial
  CRISPR gRNA sequence
gttcaagcaggacagtgggt

SEQ ID NO: 534737 - DNA, 20 bp, Artificial
  CRISPR gRNA sequence
aagcaggacagtgggtcctc

SEQ ID NO: 534738 - DNA, 20 bp, Artificial
  CRISPR gRNA sequence
agcctacccactccagcagc

SEQ ID NO: 534739 - DNA, 20 bp, Artificial
  CRISPR gRNA sequence
cccactccagcagctgcagc

SEQ ID NO: 534740 - DNA, 20 bp, Artificial
  CRISPR gRNA sequence
cagcagctgcagctggcgcc

SEQ ID NO: 534741 - DNA, 20 bp, Artificial
  CRISPR gRNA sequence
cagctggcgcctaaatgtgt

SEQ ID NO: 534742 - DNA, 20 bp, Artificial
  CRISPR gRNA sequence
gcgcctaaatgtgtgctccc

SEQ ID NO: 534743 - DNA, 20 bp, Artificial
  CRISPR gRNA sequence
aatgtgtgctcccaggaatt

SEQ ID NO: 534744 - DNA, 20 bp, Artificial
  CRISPR gRNA sequence
ccaggaattcctccaggctc

SEQ ID NO: 534745 - DNA, 20 bp, Artificial
  CRISPR gRNA sequence
ctccaggctcattgtccttc

SEQ ID NO: 534746 - DNA, 20 bp, Artificial
  CRISPR gRNA sequence
caggctcattgtccttctcc

SEQ ID NO: 534747 - DNA, 20 bp, Artificial
  CRISPR gRNA sequence
attgtccttctcccttgttt

SEQ ID NO: 534748 - DNA, 20 bp, Artificial
  CRISPR gRNA sequence
tccttctcccttgtttgcat

SEQ ID NO: 534749 - DNA, 20 bp, Artificial
  CRISPR gRNA sequence
ctcccttgtttgcatctcct

SEQ ID NO: 534750 - DNA, 20 bp, Artificial
  CRISPR gRNA sequence
tcccttgtttgcatctcctg

SEQ ID NO: 534751 - DNA, 20 bp, Artificial
  CRISPR gRNA sequence
ccttgtttgcatctcctggt

SEQ ID NO: 534752 - DNA, 20 bp, Artificial
  CRISPR gRNA sequence
gtttgcatctcctggttact

SEQ ID NO: 534753 - DNA, 20 bp, Artificial
  CRISPR gRNA sequence
tttgcatctcctggttactc

SEQ ID NO: 534754 - DNA, 20 bp, Artificial
  CRISPR gRNA sequence
gcatctcctggttactcaac

SEQ ID NO: 534755 - DNA, 20 bp, Artificial
  CRISPR gRNA sequence
catctcctggttactcaacc

SEQ ID NO: 534756 - DNA, 20 bp, Artificial
  CRISPR gRNA sequence
ctggttactcaacccagggc

SEQ ID NO: 534757 - DNA, 20 bp, Artificial
  CRISPR gRNA sequence
gttactcaacccagggcatg

SEQ ID NO: 534758 - DNA, 20 bp, Artificial
  CRISPR gRNA sequence
ctcaacccagggcatgactg

SEQ ID NO: 534759 - DNA, 20 bp, Artificial
  CRISPR gRNA sequence
aacccagggcatgactggaa

SEQ ID NO: 534760 - DNA, 20 bp, Artificial
  CRISPR gRNA sequence
gaatgaggcaagcgaggctg

SEQ ID NO: 534761 - DNA, 20 bp, Artificial
  CRISPR gRNA sequence
acaggcatgcagtttaaaga

SEQ ID NO: 534762 - DNA, 20 bp, Artificial
  CRISPR gRNA sequence
aaagacacaccaactttcag

SEQ ID NO: 534763 - DNA, 20 bp, Artificial
  CRISPR gRNA sequence
aagacacaccaactttcagg

SEQ ID NO: 534764 - DNA, 20 bp, Artificial
  CRISPR gRNA sequence
tcaggttgtgcaagggcagg

SEQ ID NO: 534765 - DNA, 20 bp, Artificial
  CRISPR gRNA sequence
caggttgtgcaagggcaggc

SEQ ID NO: 534766 - DNA, 20 bp, Artificial
  CRISPR gRNA sequence
aggttgtgcaagggcaggcc

SEQ ID NO: 534767 - DNA, 20 bp, Artificial
  CRISPR gRNA sequence
tgcaagggcaggccagcctc

SEQ ID NO: 534768 - DNA, 20 bp, Artificial
  CRISPR gRNA sequence
cttaaattctatgccttaaa

SEQ ID NO: 534769 - DNA, 20 bp, Artificial
  CRISPR gRNA sequence
aaattctatgccttaaattc

SEQ ID NO: 534770 - DNA, 20 bp, Artificial
  CRISPR gRNA sequence
aattctatgccttaaattct

SEQ ID NO: 534771 - DNA, 20 bp, Artificial
  CRISPR gRNA sequence
tatgccttaaattctgggct

SEQ ID NO: 534772 - DNA, 20 bp, Artificial
  CRISPR gRNA sequence
tgccttaaattctgggctcc

SEQ ID NO: 534773 - DNA, 20 bp, Artificial
  CRISPR gRNA sequence
aaattctgggctccttgcct

SEQ ID NO: 534774 - DNA, 20 bp, Artificial
  CRISPR gRNA sequence
aattctgggctccttgcctc

SEQ ID NO: 534775 - DNA, 20 bp, Artificial
  CRISPR gRNA sequence
tgggctccttgcctcggcct

SEQ ID NO: 534776 - DNA, 20 bp, Artificial
  CRISPR gRNA sequence
ggctccttgcctcggcctag

SEQ ID NO: 534777 - DNA, 20 bp, Artificial
  CRISPR gRNA sequence
cttgcctcggcctaggcctg

SEQ ID NO: 534778 - DNA, 20 bp, Artificial
  CRISPR gRNA sequence
gcctcggcctaggcctgagt

SEQ ID NO: 534779 - DNA, 20 bp, Artificial
  CRISPR gRNA sequence
cctcggcctaggcctgagtc

SEQ ID NO: 534780 - DNA, 20 bp, Artificial
  CRISPR gRNA sequence
ggcctaggcctgagtcaacc

SEQ ID NO: 534781 - DNA, 20 bp, Artificial
  CRISPR gRNA sequence
ggcctgagtcaacctactgg

SEQ ID NO: 534782 - DNA, 20 bp, Artificial
  CRISPR gRNA sequence
agtcaacctactggccatag

SEQ ID NO: 534783 - DNA, 20 bp, Artificial
  CRISPR gRNA sequence
ctggccataggatttaaggc

SEQ ID NO: 534784 - DNA, 20 bp, Artificial
  CRISPR gRNA sequence
gccataggatttaaggcaaa

SEQ ID NO: 534785 - DNA, 20 bp, Artificial
  CRISPR gRNA sequence
aaggcaaataattgaacctc

SEQ ID NO: 534786 - DNA, 20 bp, Artificial
  CRISPR gRNA sequence
aggcaaataattgaacctca

SEQ ID NO: 534787 - DNA, 20 bp, Artificial
  CRISPR gRNA sequence
aacctcactgaacttaagct

SEQ ID NO: 534788 - DNA, 20 bp, Artificial
  CRISPR gRNA sequence
actgaacttaagcttcctca

SEQ ID NO: 534789 - DNA, 20 bp, Artificial
  CRISPR gRNA sequence
aacttaagcttcctcatctg

SEQ ID NO: 534790 - DNA, 20 bp, Artificial
  CRISPR gRNA sequence
aagcttcctcatctgtgttg

SEQ ID NO: 534791 - DNA, 20 bp, Artificial
  CRISPR gRNA sequence
agcttcctcatctgtgttgt

SEQ ID NO: 534792 - DNA, 20 bp, Artificial
  CRISPR gRNA sequence
cctcatctgtgttgttatct

SEQ ID NO: 534793 - DNA, 20 bp, Artificial
  CRISPR gRNA sequence
ctcatctgtgttgttatcta

SEQ ID NO: 534794 - DNA, 20 bp, Artificial
  CRISPR gRNA sequence
atctgtgttgttatctatct

SEQ ID NO: 534795 - DNA, 20 bp, Artificial
  CRISPR gRNA sequence
tgttgttatctatctcctaa

SEQ ID NO: 534796 - DNA, 20 bp, Artificial
  CRISPR gRNA sequence
ttatctatctcctaagatca

SEQ ID NO: 534797 - DNA, 20 bp, Artificial
  CRISPR gRNA sequence
tctatctcctaagatcactc

SEQ ID NO: 534798 - DNA, 20 bp, Artificial
  CRISPR gRNA sequence
tctcctaagatcactctgaa

SEQ ID NO: 534799 - DNA, 20 bp, Artificial
  CRISPR gRNA sequence
ctaagatcactctgaaagct

SEQ ID NO: 534800 - DNA, 20 bp, Artificial
  CRISPR gRNA sequence
agatcactctgaaagctgga

SEQ ID NO: 534801 - DNA, 20 bp, Artificial
  CRISPR gRNA sequence
tgaaagctggatgcactaat

SEQ ID NO: 534802 - DNA, 20 bp, Artificial
  CRISPR gRNA sequence
aaagctggatgcactaatag

SEQ ID NO: 534803 - DNA, 20 bp, Artificial
  CRISPR gRNA sequence
gatgcactaatagacataaa

SEQ ID NO: 534804 - DNA, 20 bp, Artificial
  CRISPR gRNA sequence
atagacataaaacacagaga

SEQ ID NO: 534805 - DNA, 20 bp, Artificial
  CRISPR gRNA sequence
acgacttttttatcagcatg

SEQ ID NO: 534806 - DNA, 20 bp, Artificial
  CRISPR gRNA sequence
ttttatcagcatgagctaac

SEQ ID NO: 534807 - DNA, 20 bp, Artificial
  CRISPR gRNA sequence
tttatcagcatgagctaacc

SEQ ID NO: 534808 - DNA, 20 bp, Artificial
  CRISPR gRNA sequence
ttatcagcatgagctaacca

SEQ ID NO: 534809 - DNA, 20 bp, Artificial
  CRISPR gRNA sequence
tatcagcatgagctaaccat

SEQ ID NO: 534810 - DNA, 20 bp, Artificial
  CRISPR gRNA sequence
atcagcatgagctaaccatc

SEQ ID NO: 534811 - DNA, 20 bp, Artificial
  CRISPR gRNA sequence
tcagcatgagctaaccatca

SEQ ID NO: 534812 - DNA, 20 bp, Artificial
  CRISPR gRNA sequence
accatcattcttctcagcct

SEQ ID NO: 534813 - DNA, 20 bp, Artificial
  CRISPR gRNA sequence
ttctcagcctggtgatggca

SEQ ID NO: 534814 - DNA, 20 bp, Artificial
  CRISPR gRNA sequence
ctcagcctggtgatggcaga

SEQ ID NO: 534815 - DNA, 20 bp, Artificial
  CRISPR gRNA sequence
tcagcctggtgatggcagag

SEQ ID NO: 534816 - DNA, 20 bp, Artificial
  CRISPR gRNA sequence
agcctggtgatggcagagat

SEQ ID NO: 534817 - DNA, 20 bp, Artificial
  CRISPR gRNA sequence
gtgatggcagagattgcctt

SEQ ID NO: 534818 - DNA, 20 bp, Artificial
  CRISPR gRNA sequence
ccttgtcttggggtgacaag

SEQ ID NO: 534819 - DNA, 20 bp, Artificial
  CRISPR gRNA sequence
gtcttggggtgacaagtgag

SEQ ID NO: 534820 - DNA, 20 bp, Artificial
  CRISPR gRNA sequence
tcttggggtgacaagtgagg

SEQ ID NO: 534821 - DNA, 20 bp, Artificial
  CRISPR gRNA sequence
ggggtgacaagtgaggtcca

SEQ ID NO: 534822 - DNA, 20 bp, Artificial
  CRISPR gRNA sequence
gggtgacaagtgaggtccac

SEQ ID NO: 534823 - DNA, 20 bp, Artificial
  CRISPR gRNA sequence
ggaagaagatatggtctttg

SEQ ID NO: 534824 - DNA, 20 bp, Artificial
  CRISPR gRNA sequence
gaagaagatatggtctttga

SEQ ID NO: 534825 - DNA, 20 bp, Artificial
  CRISPR gRNA sequence
tgaccattagtcaatggaga

SEQ ID NO: 534826 - DNA, 20 bp, Artificial
  CRISPR gRNA sequence
gaccattagtcaatggagaa

SEQ ID NO: 534827 - DNA, 20 bp, Artificial
  CRISPR gRNA sequence
accattagtcaatggagaag

SEQ ID NO: 534828 - DNA, 20 bp, Artificial
  CRISPR gRNA sequence
gtcaatggagaaggagcatg

SEQ ID NO: 534829 - DNA, 20 bp, Artificial
  CRISPR gRNA sequence
ggcacagaggaggataagcc

SEQ ID NO: 534830 - DNA, 20 bp, Artificial
  CRISPR gRNA sequence
agggccctgccagcgattct

SEQ ID NO: 534831 - DNA, 20 bp, Artificial
  CRISPR gRNA sequence
ccagcgattctgctgtgctg

SEQ ID NO: 534832 - DNA, 20 bp, Artificial
  CRISPR gRNA sequence
tgctgtgctgtggtggaaag

SEQ ID NO: 534833 - DNA, 20 bp, Artificial
  CRISPR gRNA sequence
ctgtgctgtggtggaaagtg

SEQ ID NO: 534834 - DNA, 20 bp, Artificial
  CRISPR gRNA sequence
tgctgtggtggaaagtgtgg

SEQ ID NO: 534835 - DNA, 20 bp, Artificial
  CRISPR gRNA sequence
tggtggaaagtgtgggacag

SEQ ID NO: 534836 - DNA, 20 bp, Artificial
  CRISPR gRNA sequence
agttcaggatgatgtttcgg

SEQ ID NO: 534837 - DNA, 20 bp, Artificial
  CRISPR gRNA sequence
aggatgatgtttcggggcct

SEQ ID NO: 534838 - DNA, 20 bp, Artificial
  CRISPR gRNA sequence
cggggcctgggctgggggta

SEQ ID NO: 534839 - DNA, 20 bp, Artificial
  CRISPR gRNA sequence
ggggcctgggctgggggtag

SEQ ID NO: 534840 - DNA, 20 bp, Artificial
  CRISPR gRNA sequence
ggctgggggtagtgacgtga

SEQ ID NO: 534841 - DNA, 20 bp, Artificial
  CRISPR gRNA sequence
ggggtagtgacgtgatggga

SEQ ID NO: 534842 - DNA, 20 bp, Artificial
  CRISPR gRNA sequence
agggaccgcagcctgatggg

SEQ ID NO: 534843 - DNA, 20 bp, Artificial
  CRISPR gRNA sequence
atggggaggcagaaggagaa

SEQ ID NO: 534844 - DNA, 20 bp, Artificial
  CRISPR gRNA sequence
aggaagaaatctgaggtaaa

SEQ ID NO: 534845 - DNA, 20 bp, Artificial
  CRISPR gRNA sequence
aggtaaagaagccaaatcca

SEQ ID NO: 534846 - DNA, 20 bp, Artificial
  CRISPR gRNA sequence
gggaagtttggaccacctcc

SEQ ID NO: 534847 - DNA, 20 bp, Artificial
  CRISPR gRNA sequence
ggaccacctccctgggcagc

SEQ ID NO: 534848 - DNA, 20 bp, Artificial
  CRISPR gRNA sequence
gaccacctccctgggcagca

SEQ ID NO: 534849 - DNA, 20 bp, Artificial
  CRISPR gRNA sequence
cctgggcagcactggaagca

SEQ ID NO: 534850 - DNA, 20 bp, Artificial
  CRISPR gRNA sequence
ggcagcactggaagcagctg

SEQ ID NO: 534851 - DNA, 20 bp, Artificial
  CRISPR gRNA sequence
gaagcagctggtgtggctgt

SEQ ID NO: 534852 - DNA, 20 bp, Artificial
  CRISPR gRNA sequence
gtgtggctgtgcctgccggt

SEQ ID NO: 534853 - DNA, 20 bp, Artificial
  CRISPR gRNA sequence
tgcctgccggttctagggag

SEQ ID NO: 534854 - DNA, 20 bp, Artificial
  CRISPR gRNA sequence
ccggttctagggagagacca

SEQ ID NO: 534855 - DNA, 20 bp, Artificial
  CRISPR gRNA sequence
tagggagagaccaagtcctg

SEQ ID NO: 534856 - DNA, 20 bp, Artificial
  CRISPR gRNA sequence
gggagagaccaagtcctgct

SEQ ID NO: 534857 - DNA, 20 bp, Artificial
  CRISPR gRNA sequence
ctgtgaacgtgaattgcaga

SEQ ID NO: 534858 - DNA, 20 bp, Artificial
  CRISPR gRNA sequence
tgaacgtgaattgcagagaa

SEQ ID NO: 534859 - DNA, 20 bp, Artificial
  CRISPR gRNA sequence
cagagaaccccagggcctgt

SEQ ID NO: 534860 - DNA, 20 bp, Artificial
  CRISPR gRNA sequence
ttcccttggctgcaagtccc

SEQ ID NO: 534861 - DNA, 20 bp, Artificial
  CRISPR gRNA sequence
ccttggctgcaagtcccgcc

SEQ ID NO: 534862 - DNA, 20 bp, Artificial
  CRISPR gRNA sequence
ggctgcaagtcccgccaatg

SEQ ID NO: 534863 - DNA, 20 bp, Artificial
  CRISPR gRNA sequence
gctgcaagtcccgccaatgg

SEQ ID NO: 534864 - DNA, 20 bp, Artificial
  CRISPR gRNA sequence
caagtcccgccaatggctga

SEQ ID NO: 534865 - DNA, 20 bp, Artificial
  CRISPR gRNA sequence
acaccctcatctgtgccccc

SEQ ID NO: 534866 - DNA, 20 bp, Artificial
  CRISPR gRNA sequence
atctgtgccccccacagtga

SEQ ID NO: 534867 - DNA, 20 bp, Artificial
  CRISPR gRNA sequence
tgccccccacagtgaccccg

SEQ ID NO: 534868 - DNA, 20 bp, Artificial
  CRISPR gRNA sequence
gccattctctgaagtgttct

SEQ ID NO: 534869 - DNA, 20 bp, Artificial
  CRISPR gRNA sequence
tctgaagtgttctgccttgg

SEQ ID NO: 534870 - DNA, 20 bp, Artificial
  CRISPR gRNA sequence
tgaagtgttctgccttgggt

SEQ ID NO: 534871 - DNA, 20 bp, Artificial
  CRISPR gRNA sequence
aagtgttctgccttgggtgg

SEQ ID NO: 534872 - DNA, 20 bp, Artificial
  CRISPR gRNA sequence
tgccttgggtggcctggatg

SEQ ID NO: 534873 - DNA, 20 bp, Artificial
  CRISPR gRNA sequence
ccttgggtggcctggatgct

SEQ ID NO: 534874 - DNA, 20 bp, Artificial
  CRISPR gRNA sequence
gggtggcctggatgctccct

SEQ ID NO: 534875 - DNA, 20 bp, Artificial
  CRISPR gRNA sequence
ggtggcctggatgctcccta

SEQ ID NO: 534876 - DNA, 20 bp, Artificial
  CRISPR gRNA sequence
gatgctccctaagccggctc

SEQ ID NO: 534877 - DNA, 20 bp, Artificial
  CRISPR gRNA sequence
cctaagccggctccccactt

SEQ ID NO: 534878 - DNA, 20 bp, Artificial
  CRISPR gRNA sequence
agccggctccccacttgcaa

SEQ ID NO: 534879 - DNA, 20 bp, Artificial
  CRISPR gRNA sequence
cccacttgcaagcataacct

SEQ ID NO: 534880 - DNA, 20 bp, Artificial
  CRISPR gRNA sequence
gcaagcataaccttttcatt

SEQ ID NO: 534881 - DNA, 20 bp, Artificial
  CRISPR gRNA sequence
caagcataaccttttcattg

SEQ ID NO: 534882 - DNA, 20 bp, Artificial
  CRISPR gRNA sequence
ttcattgctgatagattgtc

SEQ ID NO: 534883 - DNA, 20 bp, Artificial
  CRISPR gRNA sequence
tcattgctgatagattgtca

SEQ ID NO: 534884 - DNA, 20 bp, Artificial
  CRISPR gRNA sequence
cattgctgatagattgtcag

SEQ ID NO: 534885 - DNA, 20 bp, Artificial
  CRISPR gRNA sequence
attgctgatagattgtcaga

SEQ ID NO: 534886 - DNA, 20 bp, Artificial
  CRISPR gRNA sequence
ctgatagattgtcagacagg

SEQ ID NO: 534887 - DNA, 20 bp, Artificial
  CRISPR gRNA sequence
atagattgtcagacaggcct

SEQ ID NO: 534888 - DNA, 20 bp, Artificial
  CRISPR gRNA sequence
tcagacaggcctgatctgag

SEQ ID NO: 534889 - DNA, 20 bp, Artificial
  CRISPR gRNA sequence
atctgaggaaaaactctcaa

SEQ ID NO: 534890 - DNA, 20 bp, Artificial
  CRISPR gRNA sequence
aggaaaaactctcaacccta

SEQ ID NO: 534891 - DNA, 20 bp, Artificial
  CRISPR gRNA sequence
tcaaccctaacacatccctc

SEQ ID NO: 534892 - DNA, 20 bp, Artificial
  CRISPR gRNA sequence
aaccctaacacatccctcga

SEQ ID NO: 534893 - DNA, 20 bp, Artificial
  CRISPR gRNA sequence
acacatccctcgaacagaga

SEQ ID NO: 534894 - DNA, 20 bp, Artificial
  CRISPR gRNA sequence
gaacagagaattagcaaagg

SEQ ID NO: 534895 - DNA, 20 bp, Artificial
  CRISPR gRNA sequence
gcaaagggggcacaggcacc

SEQ ID NO: 534896 - DNA, 20 bp, Artificial
  CRISPR gRNA sequence
ctttagaacagctgttttcc

SEQ ID NO: 534897 - DNA, 20 bp, Artificial
  CRISPR gRNA sequence
tagaacagctgttttcctgt

SEQ ID NO: 534898 - DNA, 20 bp, Artificial
  CRISPR gRNA sequence
agaacagctgttttcctgtg

SEQ ID NO: 534899 - DNA, 20 bp, Artificial
  CRISPR gRNA sequence
gaacagctgttttcctgtga

SEQ ID NO: 534900 - DNA, 20 bp, Artificial
  CRISPR gRNA sequence
ttttcctgtgactacctgat

SEQ ID NO: 534901 - DNA, 20 bp, Artificial
  CRISPR gRNA sequence
tcctgtgactacctgatgac

SEQ ID NO: 534902 - DNA, 20 bp, Artificial
  CRISPR gRNA sequence
cctgtgactacctgatgacc

SEQ ID NO: 534903 - DNA, 20 bp, Artificial
  CRISPR gRNA sequence
ctgtgactacctgatgacct

SEQ ID NO: 534904 - DNA, 20 bp, Artificial
  CRISPR gRNA sequence
tgactacctgatgacctgaa

SEQ ID NO: 534905 - DNA, 20 bp, Artificial
  CRISPR gRNA sequence
cctgatgacctgaatgattt

SEQ ID NO: 534906 - DNA, 20 bp, Artificial
  CRISPR gRNA sequence
atgacctgaatgattttccc

SEQ ID NO: 534907 - DNA, 20 bp, Artificial
  CRISPR gRNA sequence
aatgattttccctgtgtttc

SEQ ID NO: 534908 - DNA, 20 bp, Artificial
  CRISPR gRNA sequence
tccctgtgtttctaggagct

SEQ ID NO: 534909 - DNA, 20 bp, Artificial
  CRISPR gRNA sequence
ccctgtgtttctaggagctt

SEQ ID NO: 534910 - DNA, 20 bp, Artificial
  CRISPR gRNA sequence
cctgtgtttctaggagcttg

SEQ ID NO: 534911 - DNA, 20 bp, Artificial
  CRISPR gRNA sequence
tgtttctaggagcttggtcc

SEQ ID NO: 534912 - DNA, 20 bp, Artificial
  CRISPR gRNA sequence
ctaggagcttggtcctgaac

SEQ ID NO: 534913 - DNA, 20 bp, Artificial
  CRISPR gRNA sequence
taggagcttggtcctgaact

SEQ ID NO: 534914 - DNA, 20 bp, Artificial
  CRISPR gRNA sequence
ggagcttggtcctgaactca

SEQ ID NO: 534915 - DNA, 20 bp, Artificial
  CRISPR gRNA sequence
ggtcctgaactcaccttggg

SEQ ID NO: 534916 - DNA, 20 bp, Artificial
  CRISPR gRNA sequence
gtcctgaactcaccttgggc

SEQ ID NO: 534917 - DNA, 20 bp, Artificial
  CRISPR gRNA sequence
aactcaccttgggccaccca

SEQ ID NO: 534918 - DNA, 20 bp, Artificial
  CRISPR gRNA sequence
accttgggccacccatagat

SEQ ID NO: 534919 - DNA, 20 bp, Artificial
  CRISPR gRNA sequence
gggccacccatagataggac

SEQ ID NO: 534920 - DNA, 20 bp, Artificial
  CRISPR gRNA sequence
ggccacccatagataggaca

SEQ ID NO: 534921 - DNA, 20 bp, Artificial
  CRISPR gRNA sequence
attcctagaaacggtgtttt

SEQ ID NO: 534922 - DNA, 20 bp, Artificial
  CRISPR gRNA sequence
ttcctagaaacggtgttttg

SEQ ID NO: 534923 - DNA, 20 bp, Artificial
  CRISPR gRNA sequence
ctagaaacggtgttttggag

SEQ ID NO: 534924 - DNA, 20 bp, Artificial
  CRISPR gRNA sequence
gaaacggtgttttggagcta

SEQ ID NO: 534925 - DNA, 20 bp, Artificial
  CRISPR gRNA sequence
tggagctaacctttctgcct

SEQ ID NO: 534926 - DNA, 20 bp, Artificial
  CRISPR gRNA sequence
ggagctaacctttctgccta

SEQ ID NO: 534927 - DNA, 20 bp, Artificial
  CRISPR gRNA sequence
gagctaacctttctgcctat

SEQ ID NO: 534928 - DNA, 20 bp, Artificial
  CRISPR gRNA sequence
acctttctgcctatgtagag

SEQ ID NO: 534929 - DNA, 20 bp, Artificial
  CRISPR gRNA sequence
tctgcctatgtagagaagtg

SEQ ID NO: 534930 - DNA, 20 bp, Artificial
  CRISPR gRNA sequence
ctgcctatgtagagaagtgt

SEQ ID NO: 534931 - DNA, 20 bp, Artificial
  CRISPR gRNA sequence
tgcctatgtagagaagtgtg

SEQ ID NO: 534932 - DNA, 20 bp, Artificial
  CRISPR gRNA sequence
cctatgtagagaagtgtggc

SEQ ID NO: 534933 - DNA, 20 bp, Artificial
  CRISPR gRNA sequence
tgtagagaagtgtggctcat

SEQ ID NO: 534934 - DNA, 20 bp, Artificial
  CRISPR gRNA sequence
attcaaaagatgttcacatt

SEQ ID NO: 534935 - DNA, 20 bp, Artificial
  CRISPR gRNA sequence
aaaagatgttcacattagcc

SEQ ID NO: 534936 - DNA, 20 bp, Artificial
  CRISPR gRNA sequence
acattagcctgtcaccaagt

SEQ ID NO: 534937 - DNA, 20 bp, Artificial
  CRISPR gRNA sequence
gcctgtcaccaagtaggcct

SEQ ID NO: 534938 - DNA, 20 bp, Artificial
  CRISPR gRNA sequence
tcaccaagtaggcctcagtg

SEQ ID NO: 534939 - DNA, 20 bp, Artificial
  CRISPR gRNA sequence
agtggtggattccaatgagg

SEQ ID NO: 534940 - DNA, 20 bp, Artificial
  CRISPR gRNA sequence
caatgaggccaactggattc

SEQ ID NO: 534941 - DNA, 20 bp, Artificial
  CRISPR gRNA sequence
gattcagtgtctcaaagctc

SEQ ID NO: 534942 - DNA, 20 bp, Artificial
  CRISPR gRNA sequence
agtgtctcaaagctcccaca

SEQ ID NO: 534943 - DNA, 20 bp, Artificial
  CRISPR gRNA sequence
aaagctcccacattgtcacc

SEQ ID NO: 534944 - DNA, 20 bp, Artificial
  CRISPR gRNA sequence
ccacattgtcaccactaaga

SEQ ID NO: 534945 - DNA, 20 bp, Artificial
  CRISPR gRNA sequence
tcaccactaagaatttgttt

SEQ ID NO: 534946 - DNA, 20 bp, Artificial
  CRISPR gRNA sequence
agaatttgtttttcaaaaat

SEQ ID NO: 534947 - DNA, 20 bp, Artificial
  CRISPR gRNA sequence
gtttttcaaaaatcaagcta

SEQ ID NO: 534948 - DNA, 20 bp, Artificial
  CRISPR gRNA sequence
tttttcaaaaatcaagctaa

SEQ ID NO: 534949 - DNA, 20 bp, Artificial
  CRISPR gRNA sequence
ttcaaaaatcaagctaacca

SEQ ID NO: 534950 - DNA, 20 bp, Artificial
  CRISPR gRNA sequence
tcaaaaatcaagctaaccac

SEQ ID NO: 534951 - DNA, 20 bp, Artificial
  CRISPR gRNA sequence
caaaaatcaagctaaccaca

SEQ ID NO: 534952 - DNA, 20 bp, Artificial
  CRISPR gRNA sequence
aaaaatcaagctaaccacaa

SEQ ID NO: 534953 - DNA, 20 bp, Artificial
  CRISPR gRNA sequence
accacaaaatgaaacaagct

SEQ ID NO: 534954 - DNA, 20 bp, Artificial
  CRISPR gRNA sequence
taaccgctgactacaaccct

SEQ ID NO: 534955 - DNA, 20 bp, Artificial
  CRISPR gRNA sequence
actacaaccctgacattccg

SEQ ID NO: 534956 - DNA, 20 bp, Artificial
  CRISPR gRNA sequence
caaccctgacattccgaaac

SEQ ID NO: 534957 - DNA, 20 bp, Artificial
  CRISPR gRNA sequence
acattccgaaactacctatt

SEQ ID NO: 534958 - DNA, 20 bp, Artificial
  CRISPR gRNA sequence
cgaaactacctatttccatc

SEQ ID NO: 534959 - DNA, 20 bp, Artificial
  CRISPR gRNA sequence
cctatttccatcattttctc

SEQ ID NO: 534960 - DNA, 20 bp, Artificial
  CRISPR gRNA sequence
tttccatcattttctctgca

SEQ ID NO: 534961 - DNA, 20 bp, Artificial
  CRISPR gRNA sequence
ccatcattttctctgcagat

SEQ ID NO: 534962 - DNA, 20 bp, Artificial
  CRISPR gRNA sequence
catcattttctctgcagatt

SEQ ID NO: 534963 - DNA, 20 bp, Artificial
  CRISPR gRNA sequence
tctctgcagattcaaggtgt

SEQ ID NO: 534964 - DNA, 20 bp, Artificial
  CRISPR gRNA sequence
ctctgcagattcaaggtgtc

SEQ ID NO: 534965 - DNA, 20 bp, Artificial
  CRISPR gRNA sequence
tctgcagattcaaggtgtca

SEQ ID NO: 534966 - DNA, 20 bp, Artificial
  CRISPR gRNA sequence
tgcagattcaaggtgtcatc

SEQ ID NO: 534967 - DNA, 20 bp, Artificial
  CRISPR gRNA sequence
cagattcaaggtgtcatccc

SEQ ID NO: 534968 - DNA, 20 bp, Artificial
  CRISPR gRNA sequence
aaggtgtcatccccatgagc

SEQ ID NO: 534969 - DNA, 20 bp, Artificial
  CRISPR gRNA sequence
tttcatggggattttgctgg

SEQ ID NO: 534970 - DNA, 20 bp, Artificial
  CRISPR gRNA sequence
catggggattttgctggggc

SEQ ID NO: 534971 - DNA, 20 bp, Artificial
  CRISPR gRNA sequence
atggggattttgctggggcc

SEQ ID NO: 534972 - DNA, 20 bp, Artificial
  CRISPR gRNA sequence
tgctggggcctgcggtggga

SEQ ID NO: 534973 - DNA, 20 bp, Artificial
  CRISPR gRNA sequence
gctggggcctgcggtgggac

SEQ ID NO: 534974 - DNA, 20 bp, Artificial
  CRISPR gRNA sequence
ctggggcctgcggtgggaca

SEQ ID NO: 534975 - DNA, 20 bp, Artificial
  CRISPR gRNA sequence
gggcctgcggtgggacaaaa

SEQ ID NO: 534976 - DNA, 20 bp, Artificial
  CRISPR gRNA sequence
cggtgggacaaaagaggggg

SEQ ID NO: 534977 - DNA, 20 bp, Artificial
  CRISPR gRNA sequence
accatttctccgactcctct

SEQ ID NO: 534978 - DNA, 20 bp, Artificial
  CRISPR gRNA sequence
ccatttctccgactcctctg

SEQ ID NO: 534979 - DNA, 20 bp, Artificial
  CRISPR gRNA sequence
ctccgactcctctgtttttt

SEQ ID NO: 534980 - DNA, 20 bp, Artificial
  CRISPR gRNA sequence
tccgactcctctgttttttc

SEQ ID NO: 534981 - DNA, 20 bp, Artificial
  CRISPR gRNA sequence
cgactcctctgttttttcct

SEQ ID NO: 534982 - DNA, 20 bp, Artificial
  CRISPR gRNA sequence
ctctgttttttccttttggt

SEQ ID NO: 534983 - DNA, 20 bp, Artificial
  CRISPR gRNA sequence
tgttttttccttttggtgat

SEQ ID NO: 534984 - DNA, 20 bp, Artificial
  CRISPR gRNA sequence
ttttttccttttggtgatat

SEQ ID NO: 534985 - DNA, 20 bp, Artificial
  CRISPR gRNA sequence
tttccttttggtgatataga

SEQ ID NO: 534986 - DNA, 20 bp, Artificial
  CRISPR gRNA sequence
ttccttttggtgatatagaa

SEQ ID NO: 534987 - DNA, 20 bp, Artificial
  CRISPR gRNA sequence
tccttttggtgatatagaaa

SEQ ID NO: 534988 - DNA, 20 bp, Artificial
  CRISPR gRNA sequence
ccttttggtgatatagaaaa

SEQ ID NO: 534989 - DNA, 20 bp, Artificial
  CRISPR gRNA sequence
cttttggtgatatagaaaac

SEQ ID NO: 534990 - DNA, 20 bp, Artificial
  CRISPR gRNA sequence
ttggtgatatagaaaacgag

SEQ ID NO: 534991 - DNA, 20 bp, Artificial
  CRISPR gRNA sequence
tggtgatatagaaaacgagc

SEQ ID NO: 534992 - DNA, 20 bp, Artificial
  CRISPR gRNA sequence
ggtgatatagaaaacgagca

SEQ ID NO: 534993 - DNA, 20 bp, Artificial
  CRISPR gRNA sequence
gtgatatagaaaacgagcag

SEQ ID NO: 534994 - DNA, 20 bp, Artificial
  CRISPR gRNA sequence
cctcctccacatatgccaat

SEQ ID NO: 534995 - DNA, 20 bp, Artificial
  CRISPR gRNA sequence
ctccacatatgccaatgatg

SEQ ID NO: 534996 - DNA, 20 bp, Artificial
  CRISPR gRNA sequence
cacatatgccaatgatgaga

SEQ ID NO: 534997 - DNA, 20 bp, Artificial
  CRISPR gRNA sequence
tctctgcaaaaggaagagaa

SEQ ID NO: 534998 - DNA, 20 bp, Artificial
  CRISPR gRNA sequence
ctctgcaaaaggaagagaag

SEQ ID NO: 534999 - DNA, 20 bp, Artificial
  CRISPR gRNA sequence
tctgcaaaaggaagagaagt

SEQ ID NO: 535000 - DNA, 20 bp, Artificial
  CRISPR gRNA sequence
tgcaaaaggaagagaagtgg

SEQ ID NO: 535001 - DNA, 20 bp, Artificial
  CRISPR gRNA sequence
caaaaggaagagaagtggga

SEQ ID NO: 535002 - DNA, 20 bp, Artificial
  CRISPR gRNA sequence
ggaggggtccaggcagagag

SEQ ID NO: 535003 - DNA, 20 bp, Artificial
  CRISPR gRNA sequence
ctctggccaaggatgctgcc

SEQ ID NO: 535004 - DNA, 20 bp, Artificial
  CRISPR gRNA sequence
tggccaaggatgctgcctcc

SEQ ID NO: 535005 - DNA, 20 bp, Artificial
  CRISPR gRNA sequence
gccaaggatgctgcctcctg

SEQ ID NO: 535006 - DNA, 20 bp, Artificial
  CRISPR gRNA sequence
cctcctgcatcaagcagata

SEQ ID NO: 535007 - DNA, 20 bp, Artificial
  CRISPR gRNA sequence
ctgcatcaagcagatagaag

SEQ ID NO: 535008 - DNA, 20 bp, Artificial
  CRISPR gRNA sequence
catcaagcagatagaagagc

SEQ ID NO: 535009 - DNA, 20 bp, Artificial
  CRISPR gRNA sequence
gttgggacctttcaccccat

SEQ ID NO: 535010 - DNA, 20 bp, Artificial
  CRISPR gRNA sequence
ttgggacctttcaccccata

SEQ ID NO: 535011 - DNA, 20 bp, Artificial
  CRISPR gRNA sequence
ggacctttcaccccataact

SEQ ID NO: 535012 - DNA, 20 bp, Artificial
  CRISPR gRNA sequence
tcaccccataactcccaggc

SEQ ID NO: 535013 - DNA, 20 bp, Artificial
  CRISPR gRNA sequence
caccccataactcccaggct

SEQ ID NO: 535014 - DNA, 20 bp, Artificial
  CRISPR gRNA sequence
accccataactcccaggctc

SEQ ID NO: 535015 - DNA, 20 bp, Artificial
  CRISPR gRNA sequence
ccaggctcacagagggtggt

SEQ ID NO: 535016 - DNA, 20 bp, Artificial
  CRISPR gRNA sequence
acagagggtggtgagtggtg

SEQ ID NO: 535017 - DNA, 20 bp, Artificial
  CRISPR gRNA sequence
gaaggacccaaggtccttgg

SEQ ID NO: 535018 - DNA, 20 bp, Artificial
  CRISPR gRNA sequence
gggaagctccctctgcaggc

SEQ ID NO: 535019 - DNA, 20 bp, Artificial
  CRISPR gRNA sequence
ggaagctccctctgcaggct

SEQ ID NO: 535020 - DNA, 20 bp, Artificial
  CRISPR gRNA sequence
cctctgcaggctctttggga

SEQ ID NO: 535021 - DNA, 20 bp, Artificial
  CRISPR gRNA sequence
tgcaggctctttgggaaact

SEQ ID NO: 535022 - DNA, 20 bp, Artificial
  CRISPR gRNA sequence
caggctctttgggaaactgc

SEQ ID NO: 535023 - DNA, 20 bp, Artificial
  CRISPR gRNA sequence
tttgggaaactgctctcagg

SEQ ID NO: 535024 - DNA, 20 bp, Artificial
  CRISPR gRNA sequence
tgggaaactgctctcagggg

SEQ ID NO: 535025 - DNA, 20 bp, Artificial
  CRISPR gRNA sequence
gggaaactgctctcaggggc

SEQ ID NO: 535026 - DNA, 20 bp, Artificial
  CRISPR gRNA sequence
ggaaactgctctcaggggct

SEQ ID NO: 535027 - DNA, 20 bp, Artificial
  CRISPR gRNA sequence
ctctcaggggctagaaatgc

SEQ ID NO: 535028 - DNA, 20 bp, Artificial
  CRISPR gRNA sequence
tcaggggctagaaatgcctg

SEQ ID NO: 535029 - DNA, 20 bp, Artificial
  CRISPR gRNA sequence
aggggctagaaatgcctgat

SEQ ID NO: 535030 - DNA, 20 bp, Artificial
  CRISPR gRNA sequence
gaaatgcctgattgttcatg

SEQ ID NO: 535031 - DNA, 20 bp, Artificial
  CRISPR gRNA sequence
attgttcatgcaccaaggcc

SEQ ID NO: 535032 - DNA, 20 bp, Artificial
  CRISPR gRNA sequence
ttcatgcaccaaggccggcc

SEQ ID NO: 535033 - DNA, 20 bp, Artificial
  CRISPR gRNA sequence
atgcaccaaggccggcctgc

SEQ ID NO: 535034 - DNA, 20 bp, Artificial
  CRISPR gRNA sequence
cccactgcccccgtcatgga

SEQ ID NO: 535035 - DNA, 20 bp, Artificial
  CRISPR gRNA sequence
cccccgtcatggaaagcatc

SEQ ID NO: 535036 - DNA, 20 bp, Artificial
  CRISPR gRNA sequence
tagatccgaggatcttagag

SEQ ID NO: 535037 - DNA, 20 bp, Artificial
  CRISPR gRNA sequence
agatccgaggatcttagaga

SEQ ID NO: 535038 - DNA, 20 bp, Artificial
  CRISPR gRNA sequence
gatccgaggatcttagagat

SEQ ID NO: 535039 - DNA, 20 bp, Artificial
  CRISPR gRNA sequence
agagatactctaaatgcaac

SEQ ID NO: 535040 - DNA, 20 bp, Artificial
  CRISPR gRNA sequence
gagatactctaaatgcaacc

SEQ ID NO: 535041 - DNA, 20 bp, Artificial
  CRISPR gRNA sequence
taaatgcaacctctagcttc

SEQ ID NO: 535042 - DNA, 20 bp, Artificial
  CRISPR gRNA sequence
aatgcaacctctagcttcaa

SEQ ID NO: 535043 - DNA, 20 bp, Artificial
  CRISPR gRNA sequence
tagcttcaaacatgaggccc

SEQ ID NO: 535044 - DNA, 20 bp, Artificial
  CRISPR gRNA sequence
gcttcaaacatgaggccctg

SEQ ID NO: 535045 - DNA, 20 bp, Artificial
  CRISPR gRNA sequence
caaacatgaggccctgagag

SEQ ID NO: 535046 - DNA, 20 bp, Artificial
  CRISPR gRNA sequence
aaacatgaggccctgagagg

SEQ ID NO: 535047 - DNA, 20 bp, Artificial
  CRISPR gRNA sequence
agagggagaatgagttgccc

SEQ ID NO: 535048 - DNA, 20 bp, Artificial
  CRISPR gRNA sequence
cccgaagccacacaatatct

SEQ ID NO: 535049 - DNA, 20 bp, Artificial
  CRISPR gRNA sequence
ttcctgagcatttcccttaa

SEQ ID NO: 535050 - DNA, 20 bp, Artificial
  CRISPR gRNA sequence
ctgagcatttcccttaagca

SEQ ID NO: 535051 - DNA, 20 bp, Artificial
  CRISPR gRNA sequence
agcatttcccttaagcagcc

SEQ ID NO: 535052 - DNA, 20 bp, Artificial
  CRISPR gRNA sequence
cccttaagcagccccttgtc

SEQ ID NO: 535053 - DNA, 20 bp, Artificial
  CRISPR gRNA sequence
ccttaagcagccccttgtct

SEQ ID NO: 535054 - DNA, 20 bp, Artificial
  CRISPR gRNA sequence
aagcagccccttgtctcggt

SEQ ID NO: 535055 - DNA, 20 bp, Artificial
  CRISPR gRNA sequence
agcagccccttgtctcggtg

SEQ ID NO: 535056 - DNA, 20 bp, Artificial
  CRISPR gRNA sequence
gtctcggtgtttctgcactg

SEQ ID NO: 535057 - DNA, 20 bp, Artificial
  CRISPR gRNA sequence
tctcggtgtttctgcactgt

SEQ ID NO: 535058 - DNA, 20 bp, Artificial
  CRISPR gRNA sequence
ggtgtttctgcactgttgat

SEQ ID NO: 535059 - DNA, 20 bp, Artificial
  CRISPR gRNA sequence
ctgcactgttgatcctgctc

SEQ ID NO: 535060 - DNA, 20 bp, Artificial
  CRISPR gRNA sequence
tgcactgttgatcctgctct

SEQ ID NO: 535061 - DNA, 20 bp, Artificial
  CRISPR gRNA sequence
cactgttgatcctgctctcg

SEQ ID NO: 535062 - DNA, 20 bp, Artificial
  CRISPR gRNA sequence
ttgatcctgctctcgtctct

SEQ ID NO: 535063 - DNA, 20 bp, Artificial
  CRISPR gRNA sequence
atcctgctctcgtctctggc

SEQ ID NO: 535064 - DNA, 20 bp, Artificial
  CRISPR gRNA sequence
ctctcgtctctggctacccc

SEQ ID NO: 535065 - DNA, 20 bp, Artificial
  CRISPR gRNA sequence
tcgtctctggctacccccac

SEQ ID NO: 535066 - DNA, 20 bp, Artificial
  CRISPR gRNA sequence
gtctctggctacccccactg

SEQ ID NO: 535067 - DNA, 20 bp, Artificial
  CRISPR gRNA sequence
tggctacccccactgcacca

SEQ ID NO: 535068 - DNA, 20 bp, Artificial
  CRISPR gRNA sequence
gctacccccactgcaccatg

SEQ ID NO: 535069 - DNA, 20 bp, Artificial
  CRISPR gRNA sequence
cccccactgcaccatgattc

SEQ ID NO: 535070 - DNA, 20 bp, Artificial
  CRISPR gRNA sequence
caccatgattccttctcact

SEQ ID NO: 535071 - DNA, 20 bp, Artificial
  CRISPR gRNA sequence
cttctcactgtctctaccag

SEQ ID NO: 535072 - DNA, 20 bp, Artificial
  CRISPR gRNA sequence
ctcactgtctctaccaggca

SEQ ID NO: 535073 - DNA, 20 bp, Artificial
  CRISPR gRNA sequence
tcactgtctctaccaggcag

SEQ ID NO: 535074 - DNA, 20 bp, Artificial
  CRISPR gRNA sequence
actgtctctaccaggcagtt

SEQ ID NO: 535075 - DNA, 20 bp, Artificial
  CRISPR gRNA sequence
tctctaccaggcagtttcca

SEQ ID NO: 535076 - DNA, 20 bp, Artificial
  CRISPR gRNA sequence
taccaggcagtttccaaaca

SEQ ID NO: 535077 - DNA, 20 bp, Artificial
  CRISPR gRNA sequence
ccaggcagtttccaaacact

SEQ ID NO: 535078 - DNA, 20 bp, Artificial
  CRISPR gRNA sequence
ccaaacactcagggtaaata

SEQ ID NO: 535079 - DNA, 20 bp, Artificial
  CRISPR gRNA sequence
caaacactcagggtaaatat

SEQ ID NO: 535080 - DNA, 20 bp, Artificial
  CRISPR gRNA sequence
agggtaaatatttcacttgt

SEQ ID NO: 535081 - DNA, 20 bp, Artificial
  CRISPR gRNA sequence
cacttgtccagcccagcact

SEQ ID NO: 535082 - DNA, 20 bp, Artificial
  CRISPR gRNA sequence
acttgtccagcccagcactc

SEQ ID NO: 535083 - DNA, 20 bp, Artificial
  CRISPR gRNA sequence
gtccagcccagcactctgac

SEQ ID NO: 535084 - DNA, 20 bp, Artificial
  CRISPR gRNA sequence
tccagcccagcactctgacc

SEQ ID NO: 535085 - DNA, 20 bp, Artificial
  CRISPR gRNA sequence
tgacctcacggccagcaccc

SEQ ID NO: 535086 - DNA, 20 bp, Artificial
  CRISPR gRNA sequence
acctcacggccagcaccctc

SEQ ID NO: 535087 - DNA, 20 bp, Artificial
  CRISPR gRNA sequence
acggccagcaccctctcaca

SEQ ID NO: 535088 - DNA, 20 bp, Artificial
  CRISPR gRNA sequence
tcacagagtttccctggagc

SEQ ID NO: 535089 - DNA, 20 bp, Artificial
  CRISPR gRNA sequence
acagagtttccctggagcca

SEQ ID NO: 535090 - DNA, 20 bp, Artificial
  CRISPR gRNA sequence
ccctggagccacgagagaaa

SEQ ID NO: 535091 - DNA, 20 bp, Artificial
  CRISPR gRNA sequence
cctggagccacgagagaaac

SEQ ID NO: 535092 - DNA, 20 bp, Artificial
  CRISPR gRNA sequence
gagccacgagagaaacccgg

SEQ ID NO: 535093 - DNA, 20 bp, Artificial
  CRISPR gRNA sequence
gtaacagcagtgggcttagt

SEQ ID NO: 535094 - DNA, 20 bp, Artificial
  CRISPR gRNA sequence
agtcttcagttgctggacct

SEQ ID NO: 535095 - DNA, 20 bp, Artificial
  CRISPR gRNA sequence
gtcttcagttgctggacctt

SEQ ID NO: 535096 - DNA, 20 bp, Artificial
  CRISPR gRNA sequence
cagttgctggaccttcagtc

SEQ ID NO: 535097 - DNA, 20 bp, Artificial
  CRISPR gRNA sequence
agttgctggaccttcagtca

SEQ ID NO: 535098 - DNA, 20 bp, Artificial
  CRISPR gRNA sequence
ctggaccttcagtcactgta

SEQ ID NO: 535099 - DNA, 20 bp, Artificial
  CRISPR gRNA sequence
gaccttcagtcactgtaatg

SEQ ID NO: 535100 - DNA, 20 bp, Artificial
  CRISPR gRNA sequence
cagtcactgtaatgcaatga

SEQ ID NO: 535101 - DNA, 20 bp, Artificial
  CRISPR gRNA sequence
agtcactgtaatgcaatgag

SEQ ID NO: 535102 - DNA, 20 bp, Artificial
  CRISPR gRNA sequence
taatgcaatgaggaaaacag

SEQ ID NO: 535103 - DNA, 20 bp, Artificial
  CRISPR gRNA sequence
tggtgttaagggaaatgggt

SEQ ID NO: 535104 - DNA, 20 bp, Artificial
  CRISPR gRNA sequence
ggtgttaagggaaatgggtt

SEQ ID NO: 535105 - DNA, 20 bp, Artificial
  CRISPR gRNA sequence
gtgttaagggaaatgggttt

SEQ ID NO: 535106 - DNA, 20 bp, Artificial
  CRISPR gRNA sequence
agggaaatgggtttggtcta

SEQ ID NO: 535107 - DNA, 20 bp, Artificial
  CRISPR gRNA sequence
ggtctaggcttttttaggca

SEQ ID NO: 535108 - DNA, 20 bp, Artificial
  CRISPR gRNA sequence
gtctaggcttttttaggcag

SEQ ID NO: 535109 - DNA, 20 bp, Artificial
  CRISPR gRNA sequence
ggcttttttaggcaggagct

SEQ ID NO: 535110 - DNA, 20 bp, Artificial
  CRISPR gRNA sequence
ttttaggcaggagctgtgtg

SEQ ID NO: 535111 - DNA, 20 bp, Artificial
  CRISPR gRNA sequence
tttaggcaggagctgtgtga

SEQ ID NO: 535112 - DNA, 20 bp, Artificial
  CRISPR gRNA sequence
ttaggcaggagctgtgtgaa

SEQ ID NO: 535113 - DNA, 20 bp, Artificial
  CRISPR gRNA sequence
taggcaggagctgtgtgaac

SEQ ID NO: 535114 - DNA, 20 bp, Artificial
  CRISPR gRNA sequence
aggcaggagctgtgtgaact

SEQ ID NO: 535115 - DNA, 20 bp, Artificial
  CRISPR gRNA sequence
ggcaggagctgtgtgaactt

SEQ ID NO: 535116 - DNA, 20 bp, Artificial
  CRISPR gRNA sequence
tgtgaactttggagagttac

SEQ ID NO: 535117 - DNA, 20 bp, Artificial
  CRISPR gRNA sequence
tggagagttacttcacctct

SEQ ID NO: 535118 - DNA, 20 bp, Artificial
  CRISPR gRNA sequence
ggagagttacttcacctctc

SEQ ID NO: 535119 - DNA, 20 bp, Artificial
  CRISPR gRNA sequence
gagagttacttcacctctct

SEQ ID NO: 535120 - DNA, 20 bp, Artificial
  CRISPR gRNA sequence
cttcacctctctgagcctgt

SEQ ID NO: 535121 - DNA, 20 bp, Artificial
  CRISPR gRNA sequence
cacctctctgagcctgtttc

SEQ ID NO: 535122 - DNA, 20 bp, Artificial
  CRISPR gRNA sequence
acctctctgagcctgtttcc

SEQ ID NO: 535123 - DNA, 20 bp, Artificial
  CRISPR gRNA sequence
tctgagcctgtttccttctt

SEQ ID NO: 535124 - DNA, 20 bp, Artificial
  CRISPR gRNA sequence
tgagcctgtttccttctttg

SEQ ID NO: 535125 - DNA, 20 bp, Artificial
  CRISPR gRNA sequence
agcctgtttccttctttgta

SEQ ID NO: 535126 - DNA, 20 bp, Artificial
  CRISPR gRNA sequence
tttccttctttgtaaagtgg

SEQ ID NO: 535127 - DNA, 20 bp, Artificial
  CRISPR gRNA sequence
ccttctttgtaaagtggaga

SEQ ID NO: 535128 - DNA, 20 bp, Artificial
  CRISPR gRNA sequence
cttctttgtaaagtggagat

SEQ ID NO: 535129 - DNA, 20 bp, Artificial
  CRISPR gRNA sequence
ctttgtaaagtggagataat

SEQ ID NO: 535130 - DNA, 20 bp, Artificial
  CRISPR gRNA sequence
tttgtaaagtggagataatg

SEQ ID NO: 535131 - DNA, 20 bp, Artificial
  CRISPR gRNA sequence
tgtaaagtggagataatgaa

SEQ ID NO: 535132 - DNA, 20 bp, Artificial
  CRISPR gRNA sequence
gtaaagtggagataatgaaa

SEQ ID NO: 535133 - DNA, 20 bp, Artificial
  CRISPR gRNA sequence
taaagtggagataatgaaac

SEQ ID NO: 535134 - DNA, 20 bp, Artificial
  CRISPR gRNA sequence
catcatagggtggctgttgg

SEQ ID NO: 535135 - DNA, 20 bp, Artificial
  CRISPR gRNA sequence
ttggaagtcaatcagataat

SEQ ID NO: 535136 - DNA, 20 bp, Artificial
  CRISPR gRNA sequence
gaagtcaatcagataatgga

SEQ ID NO: 535137 - DNA, 20 bp, Artificial
  CRISPR gRNA sequence
tgtaaactgtaaaacaacac

SEQ ID NO: 535138 - DNA, 20 bp, Artificial
  CRISPR gRNA sequence
gtaaactgtaaaacaacaca

SEQ ID NO: 535139 - DNA, 20 bp, Artificial
  CRISPR gRNA sequence
taaactgtaaaacaacacaa

SEQ ID NO: 535140 - DNA, 20 bp, Artificial
  CRISPR gRNA sequence
taaaacaacacaaatgtgag

SEQ ID NO: 535141 - DNA, 20 bp, Artificial
  CRISPR gRNA sequence
gctcttactagtgttctcgc

SEQ ID NO: 535142 - DNA, 20 bp, Artificial
  CRISPR gRNA sequence
ctcttactagtgttctcgca

SEQ ID NO: 535143 - DNA, 20 bp, Artificial
  CRISPR gRNA sequence
ttactagtgttctcgcactg

SEQ ID NO: 535144 - DNA, 20 bp, Artificial
  CRISPR gRNA sequence
actagtgttctcgcactggt

SEQ ID NO: 535145 - DNA, 20 bp, Artificial
  CRISPR gRNA sequence
ctagtgttctcgcactggtg

SEQ ID NO: 535146 - DNA, 20 bp, Artificial
  CRISPR gRNA sequence
gtgttctcgcactggtgttt

SEQ ID NO: 535147 - DNA, 20 bp, Artificial
  CRISPR gRNA sequence
tcgcactggtgtttctggga

SEQ ID NO: 535148 - DNA, 20 bp, Artificial
  CRISPR gRNA sequence
gcactggtgtttctgggagc

SEQ ID NO: 535149 - DNA, 20 bp, Artificial
  CRISPR gRNA sequence
gtgtttctgggagctgtttc

SEQ ID NO: 535150 - DNA, 20 bp, Artificial
  CRISPR gRNA sequence
ctgggagctgtttcccagca

SEQ ID NO: 535151 - DNA, 20 bp, Artificial
  CRISPR gRNA sequence
tgggagctgtttcccagcaa

SEQ ID NO: 535152 - DNA, 20 bp, Artificial
  CRISPR gRNA sequence
ggagctgtttcccagcaaca

SEQ ID NO: 535153 - DNA, 20 bp, Artificial
  CRISPR gRNA sequence
tttcccagcaacaggggaaa

SEQ ID NO: 535154 - DNA, 20 bp, Artificial
  CRISPR gRNA sequence
cccagcaacaggggaaacag

SEQ ID NO: 535155 - DNA, 20 bp, Artificial
  CRISPR gRNA sequence
ccagcaacaggggaaacagg

SEQ ID NO: 535156 - DNA, 20 bp, Artificial
  CRISPR gRNA sequence
tagggctgtctgccctttgt

SEQ ID NO: 535157 - DNA, 20 bp, Artificial
  CRISPR gRNA sequence
gggctgtctgccctttgtga

SEQ ID NO: 535158 - DNA, 20 bp, Artificial
  CRISPR gRNA sequence
tctgccctttgtgagtcaat

SEQ ID NO: 535159 - DNA, 20 bp, Artificial
  CRISPR gRNA sequence
ccctttgtgagtcaatagca

SEQ ID NO: 535160 - DNA, 20 bp, Artificial
  CRISPR gRNA sequence
tgtgagtcaatagcagttag

SEQ ID NO: 535161 - DNA, 20 bp, Artificial
  CRISPR gRNA sequence
gtgagtcaatagcagttaga

SEQ ID NO: 535162 - DNA, 20 bp, Artificial
  CRISPR gRNA sequence
tgagtcaatagcagttagaa

SEQ ID NO: 535163 - DNA, 20 bp, Artificial
  CRISPR gRNA sequence
gaaaagcagcagtggggctc

SEQ ID NO: 535164 - DNA, 20 bp, Artificial
  CRISPR gRNA sequence
gggtcaggggacggggtcat

SEQ ID NO: 535165 - DNA, 20 bp, Artificial
  CRISPR gRNA sequence
aagaacaaactggaacttgg

SEQ ID NO: 535166 - DNA, 20 bp, Artificial
  CRISPR gRNA sequence
gaacttggcccagcatcaca

SEQ ID NO: 535167 - DNA, 20 bp, Artificial
  CRISPR gRNA sequence
ggcccagcatcacaaaagaa

SEQ ID NO: 535168 - DNA, 20 bp, Artificial
  CRISPR gRNA sequence
gcccagcatcacaaaagaaa

SEQ ID NO: 535169 - DNA, 20 bp, Artificial
  CRISPR gRNA sequence
ctccaggcaaaaacatacca

SEQ ID NO: 535170 - DNA, 20 bp, Artificial
  CRISPR gRNA sequence
tccaggcaaaaacataccag

SEQ ID NO: 535171 - DNA, 20 bp, Artificial
  CRISPR gRNA sequence
caggcaaaaacataccaggg

SEQ ID NO: 535172 - DNA, 20 bp, Artificial
  CRISPR gRNA sequence
ttatacatgaagcccaggat

SEQ ID NO: 535173 - DNA, 20 bp, Artificial
  CRISPR gRNA sequence
tacatgaagcccaggatggg

SEQ ID NO: 535174 - DNA, 20 bp, Artificial
  CRISPR gRNA sequence
agaaaccaagtttaacagat

SEQ ID NO: 535175 - DNA, 20 bp, Artificial
  CRISPR gRNA sequence
aacagatcatcaaactgtgg

SEQ ID NO: 535176 - DNA, 20 bp, Artificial
  CRISPR gRNA sequence
acagatcatcaaactgtggt

SEQ ID NO: 535177 - DNA, 20 bp, Artificial
  CRISPR gRNA sequence
tggtggtttattcatcttgg

SEQ ID NO: 535178 - DNA, 20 bp, Artificial
  CRISPR gRNA sequence
attcatcttggctttctttc

SEQ ID NO: 535179 - DNA, 20 bp, Artificial
  CRISPR gRNA sequence
ttcatcttggctttctttcc

SEQ ID NO: 535180 - DNA, 20 bp, Artificial
  CRISPR gRNA sequence
atcttggctttctttcctcg

SEQ ID NO: 535181 - DNA, 20 bp, Artificial
  CRISPR gRNA sequence
ggctttctttcctcgagtct

SEQ ID NO: 535182 - DNA, 20 bp, Artificial
  CRISPR gRNA sequence
gctttctttcctcgagtctc

SEQ ID NO: 535183 - DNA, 20 bp, Artificial
  CRISPR gRNA sequence
tctttcctcgagtctctctc

SEQ ID NO: 535184 - DNA, 20 bp, Artificial
  CRISPR gRNA sequence
ctttcctcgagtctctctct

SEQ ID NO: 535185 - DNA, 20 bp, Artificial
  CRISPR gRNA sequence
tttcctcgagtctctctctg

SEQ ID NO: 535186 - DNA, 20 bp, Artificial
  CRISPR gRNA sequence
tcctcgagtctctctctgac

SEQ ID NO: 535187 - DNA, 20 bp, Artificial
  CRISPR gRNA sequence
cctcgagtctctctctgacc

SEQ ID NO: 535188 - DNA, 20 bp, Artificial
  CRISPR gRNA sequence
ctcgagtctctctctgaccc

SEQ ID NO: 535189 - DNA, 20 bp, Artificial
  CRISPR gRNA sequence
gagtctctctctgacccatt

SEQ ID NO: 535190 - DNA, 20 bp, Artificial
  CRISPR gRNA sequence
tctctgacccattctttgcc

SEQ ID NO: 535191 - DNA, 20 bp, Artificial
  CRISPR gRNA sequence
tctgacccattctttgcctg

SEQ ID NO: 535192 - DNA, 20 bp, Artificial
  CRISPR gRNA sequence
tgacccattctttgcctgcc

SEQ ID NO: 535193 - DNA, 20 bp, Artificial
  CRISPR gRNA sequence
acccattctttgcctgccag

SEQ ID NO: 535194 - DNA, 20 bp, Artificial
  CRISPR gRNA sequence
tttgcctgccagttacacaa

SEQ ID NO: 535195 - DNA, 20 bp, Artificial
  CRISPR gRNA sequence
tgcctgccagttacacaact

SEQ ID NO: 535196 - DNA, 20 bp, Artificial
  CRISPR gRNA sequence
gcctgccagttacacaactc

SEQ ID NO: 535197 - DNA, 20 bp, Artificial
  CRISPR gRNA sequence
cctgccagttacacaactct

SEQ ID NO: 535198 - DNA, 20 bp, Artificial
  CRISPR gRNA sequence
ccagttacacaactctctaa

SEQ ID NO: 535199 - DNA, 20 bp, Artificial
  CRISPR gRNA sequence
cacaactctctaagctctac

SEQ ID NO: 535200 - DNA, 20 bp, Artificial
  CRISPR gRNA sequence
tctaagctctactgatgaag

SEQ ID NO: 535201 - DNA, 20 bp, Artificial
  CRISPR gRNA sequence
taagctctactgatgaagag

SEQ ID NO: 535202 - DNA, 20 bp, Artificial
  CRISPR gRNA sequence
agctctactgatgaagaggc

SEQ ID NO: 535203 - DNA, 20 bp, Artificial
  CRISPR gRNA sequence
tactgatgaagaggcctcca

SEQ ID NO: 535204 - DNA, 20 bp, Artificial
  CRISPR gRNA sequence
ctgatgaagaggcctccacc

SEQ ID NO: 535205 - DNA, 20 bp, Artificial
  CRISPR gRNA sequence
atgaagaggcctccaccaga

SEQ ID NO: 535206 - DNA, 20 bp, Artificial
  CRISPR gRNA sequence
caccagagaagcagacataa

SEQ ID NO: 535207 - DNA, 20 bp, Artificial
  CRISPR gRNA sequence
aaaccattgaaattgggtca

SEQ ID NO: 535208 - DNA, 20 bp, Artificial
  CRISPR gRNA sequence
aaccattgaaattgggtcag

SEQ ID NO: 535209 - DNA, 20 bp, Artificial
  CRISPR gRNA sequence
aaattgggtcagtaaaggat

SEQ ID NO: 535210 - DNA, 20 bp, Artificial
  CRISPR gRNA sequence
ggtcagtaaaggattcaggg

SEQ ID NO: 535211 - DNA, 20 bp, Artificial
  CRISPR gRNA sequence
agggccctttaggccctgct

SEQ ID NO: 535212 - DNA, 20 bp, Artificial
  CRISPR gRNA sequence
taggccctgctggcttggac

SEQ ID NO: 535213 - DNA, 20 bp, Artificial
  CRISPR gRNA sequence
aggccctgctggcttggacg

SEQ ID NO: 535214 - DNA, 20 bp, Artificial
  CRISPR gRNA sequence
ggccctgctggcttggacga

SEQ ID NO: 535215 - DNA, 20 bp, Artificial
  CRISPR gRNA sequence
ctggcttggacgaggggcag

SEQ ID NO: 535216 - DNA, 20 bp, Artificial
  CRISPR gRNA sequence
gcttggacgaggggcaggag

SEQ ID NO: 535217 - DNA, 20 bp, Artificial
  CRISPR gRNA sequence
ggacgaggggcaggagatac

SEQ ID NO: 535218 - DNA, 20 bp, Artificial
  CRISPR gRNA sequence
gacgaggggcaggagatacc

SEQ ID NO: 535219 - DNA, 20 bp, Artificial
  CRISPR gRNA sequence
cctgctgagcttgagaactt

SEQ ID NO: 535220 - DNA, 20 bp, Artificial
  CRISPR gRNA sequence
ctgctgagcttgagaacttt

SEQ ID NO: 535221 - DNA, 20 bp, Artificial
  CRISPR gRNA sequence
ctgagcttgagaacttttca

SEQ ID NO: 535222 - DNA, 20 bp, Artificial
  CRISPR gRNA sequence
agcttgagaacttttcagat

SEQ ID NO: 535223 - DNA, 20 bp, Artificial
  CRISPR gRNA sequence
gagaacttttcagatttgac

SEQ ID NO: 535224 - DNA, 20 bp, Artificial
  CRISPR gRNA sequence
agaacttttcagatttgacc

SEQ ID NO: 535225 - DNA, 20 bp, Artificial
  CRISPR gRNA sequence
ttcagatttgacccggggtg

SEQ ID NO: 535226 - DNA, 20 bp, Artificial
  CRISPR gRNA sequence
tcagatttgacccggggtgg

SEQ ID NO: 535227 - DNA, 20 bp, Artificial
  CRISPR gRNA sequence
cagatttgacccggggtggg

SEQ ID NO: 535228 - DNA, 20 bp, Artificial
  CRISPR gRNA sequence
agatttgacccggggtgggg

SEQ ID NO: 535229 - DNA, 20 bp, Artificial
  CRISPR gRNA sequence
gacccggggtggggcagggc

SEQ ID NO: 535230 - DNA, 20 bp, Artificial
  CRISPR gRNA sequence
acccggggtggggcagggca

SEQ ID NO: 535231 - DNA, 20 bp, Artificial
  CRISPR gRNA sequence
aaatgctttggggagcacat

SEQ ID NO: 535232 - DNA, 20 bp, Artificial
  CRISPR gRNA sequence
tggggagcacatggctaagt

SEQ ID NO: 535233 - DNA, 20 bp, Artificial
  CRISPR gRNA sequence
ggggagcacatggctaagtc

SEQ ID NO: 535234 - DNA, 20 bp, Artificial
  CRISPR gRNA sequence
gggagcacatggctaagtca

SEQ ID NO: 535235 - DNA, 20 bp, Artificial
  CRISPR gRNA sequence
agtcatgcagccaccagctc

SEQ ID NO: 535236 - DNA, 20 bp, Artificial
  CRISPR gRNA sequence
catcttccctccaagtcatc

SEQ ID NO: 535237 - DNA, 20 bp, Artificial
  CRISPR gRNA sequence
ccctccaagtcatcgggtag

SEQ ID NO: 535238 - DNA, 20 bp, Artificial
  CRISPR gRNA sequence
cctccaagtcatcgggtagg

SEQ ID NO: 535239 - DNA, 20 bp, Artificial
  CRISPR gRNA sequence
caagtcatcgggtagggtgg

SEQ ID NO: 535240 - DNA, 20 bp, Artificial
  CRISPR gRNA sequence
tatcttgggcacatgcagga

SEQ ID NO: 535241 - DNA, 20 bp, Artificial
  CRISPR gRNA sequence
atcttgggcacatgcaggaa

SEQ ID NO: 535242 - DNA, 20 bp, Artificial
  CRISPR gRNA sequence
tcttgggcacatgcaggaat

SEQ ID NO: 535243 - DNA, 20 bp, Artificial
  CRISPR gRNA sequence
gggcacatgcaggaatgtag

SEQ ID NO: 535244 - DNA, 20 bp, Artificial
  CRISPR gRNA sequence
ggcacatgcaggaatgtagg

SEQ ID NO: 535245 - DNA, 20 bp, Artificial
  CRISPR gRNA sequence
acacagcctgctctccagtt

SEQ ID NO: 535246 - DNA, 20 bp, Artificial
  CRISPR gRNA sequence
cacagcctgctctccagttt

SEQ ID NO: 535247 - DNA, 20 bp, Artificial
  CRISPR gRNA sequence
ctctccagtttgtccagggt

SEQ ID NO: 535248 - DNA, 20 bp, Artificial
  CRISPR gRNA sequence
tccagtttgtccagggtggt

SEQ ID NO: 535249 - DNA, 20 bp, Artificial
  CRISPR gRNA sequence
cagtttgtccagggtggtgc

SEQ ID NO: 535250 - DNA, 20 bp, Artificial
  CRISPR gRNA sequence
gtccagggtggtgccctggg

SEQ ID NO: 535251 - DNA, 20 bp, Artificial
  CRISPR gRNA sequence
tccagggtggtgccctgggg

SEQ ID NO: 535252 - DNA, 20 bp, Artificial
  CRISPR gRNA sequence
gggcacctggtagtactttt

SEQ ID NO: 535253 - DNA, 20 bp, Artificial
  CRISPR gRNA sequence
gtagtacttttggtggggaa

SEQ ID NO: 535254 - DNA, 20 bp, Artificial
  CRISPR gRNA sequence
ttggtggggaatgttccatc

SEQ ID NO: 535255 - DNA, 20 bp, Artificial
  CRISPR gRNA sequence
tggtggggaatgttccatca

SEQ ID NO: 535256 - DNA, 20 bp, Artificial
  CRISPR gRNA sequence
ggtggggaatgttccatcat

SEQ ID NO: 535257 - DNA, 20 bp, Artificial
  CRISPR gRNA sequence
gtggggaatgttccatcatg

SEQ ID NO: 535258 - DNA, 20 bp, Artificial
  CRISPR gRNA sequence
catcatgtttcagaagcagc

SEQ ID NO: 535259 - DNA, 20 bp, Artificial
  CRISPR gRNA sequence
cagaagcagcggtggcactg

SEQ ID NO: 535260 - DNA, 20 bp, Artificial
  CRISPR gRNA sequence
agaagcagcggtggcactgt

SEQ ID NO: 535261 - DNA, 20 bp, Artificial
  CRISPR gRNA sequence
tcagtcaaaaatatgccctc

SEQ ID NO: 535262 - DNA, 20 bp, Artificial
  CRISPR gRNA sequence
ccagttcctaaatccaggca

SEQ ID NO: 535263 - DNA, 20 bp, Artificial
  CRISPR gRNA sequence
ctaaatccaggcatactatc

SEQ ID NO: 535264 - DNA, 20 bp, Artificial
  CRISPR gRNA sequence
aatccaggcatactatcttc

SEQ ID NO: 535265 - DNA, 20 bp, Artificial
  CRISPR gRNA sequence
tcttccaacagtatctcttg

SEQ ID NO: 535266 - DNA, 20 bp, Artificial
  CRISPR gRNA sequence
ccaacagtatctcttggaga

SEQ ID NO: 535267 - DNA, 20 bp, Artificial
  CRISPR gRNA sequence
caacagtatctcttggagat

SEQ ID NO: 535268 - DNA, 20 bp, Artificial
  CRISPR gRNA sequence
ttggagatcacatgcccatg

SEQ ID NO: 535269 - DNA, 20 bp, Artificial
  CRISPR gRNA sequence
ggagatcacatgcccatgag

SEQ ID NO: 535270 - DNA, 20 bp, Artificial
  CRISPR gRNA sequence
gagatcacatgcccatgagt

SEQ ID NO: 535271 - DNA, 20 bp, Artificial
  CRISPR gRNA sequence
atgtgacaaattatttttgt

SEQ ID NO: 535272 - DNA, 20 bp, Artificial
  CRISPR gRNA sequence
tgtgacaaattatttttgtg

SEQ ID NO: 535273 - DNA, 20 bp, Artificial
  CRISPR gRNA sequence
tttttgtgcatctgaatctg

SEQ ID NO: 535274 - DNA, 20 bp, Artificial
  CRISPR gRNA sequence
ttgtgcatctgaatctgttc

SEQ ID NO: 535275 - DNA, 20 bp, Artificial
  CRISPR gRNA sequence
tgtgcatctgaatctgttcc

SEQ ID NO: 535276 - DNA, 20 bp, Artificial
  CRISPR gRNA sequence
gtgcatctgaatctgttcct

SEQ ID NO: 535277 - DNA, 20 bp, Artificial
  CRISPR gRNA sequence
tgcatctgaatctgttcctt

SEQ ID NO: 535278 - DNA, 20 bp, Artificial
  CRISPR gRNA sequence
aatctgttccttcctcctag

SEQ ID NO: 535279 - DNA, 20 bp, Artificial
  CRISPR gRNA sequence
ttccttcctcctagtatttt

SEQ ID NO: 535280 - DNA, 20 bp, Artificial
  CRISPR gRNA sequence
cttcctcctagtattttgat

SEQ ID NO: 535281 - DNA, 20 bp, Artificial
  CRISPR gRNA sequence
cctcctagtattttgatttt

SEQ ID NO: 535282 - DNA, 20 bp, Artificial
  CRISPR gRNA sequence
ctcctagtattttgatttta

SEQ ID NO: 535283 - DNA, 20 bp, Artificial
  CRISPR gRNA sequence
ctagtattttgattttaagt

SEQ ID NO: 535284 - DNA, 20 bp, Artificial
  CRISPR gRNA sequence
gtattttgattttaagtatg

SEQ ID NO: 535285 - DNA, 20 bp, Artificial
  CRISPR gRNA sequence
tgattttaagtatgtaaaca

SEQ ID NO: 535286 - DNA, 20 bp, Artificial
  CRISPR gRNA sequence
gattttaagtatgtaaacac

SEQ ID NO: 535287 - DNA, 20 bp, Artificial
  CRISPR gRNA sequence
attttaagtatgtaaacact

SEQ ID NO: 535288 - DNA, 20 bp, Artificial
  CRISPR gRNA sequence
taagtatgtaaacactcacc

SEQ ID NO: 535289 - DNA, 20 bp, Artificial
  CRISPR gRNA sequence
aagtatgtaaacactcacct

SEQ ID NO: 535290 - DNA, 20 bp, Artificial
  CRISPR gRNA sequence
agtatgtaaacactcaccta

SEQ ID NO: 535291 - DNA, 20 bp, Artificial
  CRISPR gRNA sequence
acctaatctgagccaaatgg

SEQ ID NO: 535292 - DNA, 20 bp, Artificial
  CRISPR gRNA sequence
atctgagccaaatggtcaga

SEQ ID NO: 535293 - DNA, 20 bp, Artificial
  CRISPR gRNA sequence
agccaaatggtcagactctg

SEQ ID NO: 535294 - DNA, 20 bp, Artificial
  CRISPR gRNA sequence
tgaccattgctcctctctgc

SEQ ID NO: 535295 - DNA, 20 bp, Artificial
  CRISPR gRNA sequence
accattgctcctctctgcct

SEQ ID NO: 535296 - DNA, 20 bp, Artificial
  CRISPR gRNA sequence
ctcctctctgccttggcctt

SEQ ID NO: 535297 - DNA, 20 bp, Artificial
  CRISPR gRNA sequence
ctctctgccttggcctttca

SEQ ID NO: 535298 - DNA, 20 bp, Artificial
  CRISPR gRNA sequence
tctgccttggcctttcagaa

SEQ ID NO: 535299 - DNA, 20 bp, Artificial
  CRISPR gRNA sequence
tgccttggcctttcagaata

SEQ ID NO: 535300 - DNA, 20 bp, Artificial
  CRISPR gRNA sequence
ccttggcctttcagaataaa

SEQ ID NO: 535301 - DNA, 20 bp, Artificial
  CRISPR gRNA sequence
ggcctttcagaataaaactt

SEQ ID NO: 535302 - DNA, 20 bp, Artificial
  CRISPR gRNA sequence
gcctttcagaataaaacttc

SEQ ID NO: 535303 - DNA, 20 bp, Artificial
  CRISPR gRNA sequence
tcagaataaaacttccaaat

SEQ ID NO: 535304 - DNA, 20 bp, Artificial
  CRISPR gRNA sequence
cagaataaaacttccaaatc

SEQ ID NO: 535305 - DNA, 20 bp, Artificial
  CRISPR gRNA sequence
agaataaaacttccaaatcc

SEQ ID NO: 535306 - DNA, 20 bp, Artificial
  CRISPR gRNA sequence
ccaaatcccttttcgggtct

SEQ ID NO: 535307 - DNA, 20 bp, Artificial
  CRISPR gRNA sequence
caaatcccttttcgggtctt

SEQ ID NO: 535308 - DNA, 20 bp, Artificial
  CRISPR gRNA sequence
ttcgggtcttcaagagcagc

SEQ ID NO: 535309 - DNA, 20 bp, Artificial
  CRISPR gRNA sequence
tcgggtcttcaagagcagct

SEQ ID NO: 535310 - DNA, 20 bp, Artificial
  CRISPR gRNA sequence
cgggtcttcaagagcagctc

SEQ ID NO: 535311 - DNA, 20 bp, Artificial
  CRISPR gRNA sequence
gggtcttcaagagcagctcc

SEQ ID NO: 535312 - DNA, 20 bp, Artificial
  CRISPR gRNA sequence
caagagcagctcctccaccc

SEQ ID NO: 535313 - DNA, 20 bp, Artificial
  CRISPR gRNA sequence
aagagcagctcctccaccct

SEQ ID NO: 535314 - DNA, 20 bp, Artificial
  CRISPR gRNA sequence
ctccaccctaatctctcccc

SEQ ID NO: 535315 - DNA, 20 bp, Artificial
  CRISPR gRNA sequence
caccctaatctctccccagg

SEQ ID NO: 535316 - DNA, 20 bp, Artificial
  CRISPR gRNA sequence
atctctccccaggtattctt

SEQ ID NO: 535317 - DNA, 20 bp, Artificial
  CRISPR gRNA sequence
tccccaggtattcttcccat

SEQ ID NO: 535318 - DNA, 20 bp, Artificial
  CRISPR gRNA sequence
cccaggtattcttcccatct

SEQ ID NO: 535319 - DNA, 20 bp, Artificial
  CRISPR gRNA sequence
ttcccatctccctagtggtc

SEQ ID NO: 535320 - DNA, 20 bp, Artificial
  CRISPR gRNA sequence
cccatctccctagtggtcct

SEQ ID NO: 535321 - DNA, 20 bp, Artificial
  CRISPR gRNA sequence
ccatctccctagtggtcctt

SEQ ID NO: 535322 - DNA, 20 bp, Artificial
  CRISPR gRNA sequence
cctagtggtccttctcgcaa

SEQ ID NO: 535323 - DNA, 20 bp, Artificial
  CRISPR gRNA sequence
gtggtccttctcgcaatgag

SEQ ID NO: 535324 - DNA, 20 bp, Artificial
  CRISPR gRNA sequence
ctcgcaatgagcttctgctc

SEQ ID NO: 535325 - DNA, 20 bp, Artificial
  CRISPR gRNA sequence
tcgcaatgagcttctgctct

SEQ ID NO: 535326 - DNA, 20 bp, Artificial
  CRISPR gRNA sequence
gcaatgagcttctgctctgc

SEQ ID NO: 535327 - DNA, 20 bp, Artificial
  CRISPR gRNA sequence
ctgctctgcaccatagagta

SEQ ID NO: 535328 - DNA, 20 bp, Artificial
  CRISPR gRNA sequence
tgctctgcaccatagagtaa

SEQ ID NO: 535329 - DNA, 20 bp, Artificial
  CRISPR gRNA sequence
ctctgcaccatagagtaagg

SEQ ID NO: 535330 - DNA, 20 bp, Artificial
  CRISPR gRNA sequence
tgcaccatagagtaagggac

SEQ ID NO: 535331 - DNA, 20 bp, Artificial
  CRISPR gRNA sequence
caccatagagtaagggacat

SEQ ID NO: 535332 - DNA, 20 bp, Artificial
  CRISPR gRNA sequence
cagccttcaaaccttggctg

SEQ ID NO: 535333 - DNA, 20 bp, Artificial
  CRISPR gRNA sequence
caaaccttggctgctcccaa

SEQ ID NO: 535334 - DNA, 20 bp, Artificial
  CRISPR gRNA sequence
aaaccttggctgctcccaag

SEQ ID NO: 535335 - DNA, 20 bp, Artificial
  CRISPR gRNA sequence
ggctgctcccaaggtcctcc

SEQ ID NO: 535336 - DNA, 20 bp, Artificial
  CRISPR gRNA sequence
gctgctcccaaggtcctccc

SEQ ID NO: 535337 - DNA, 20 bp, Artificial
  CRISPR gRNA sequence
ctcccaaggtcctccctctc

SEQ ID NO: 535338 - DNA, 20 bp, Artificial
  CRISPR gRNA sequence
ccaaggtcctccctctctcc

SEQ ID NO: 535339 - DNA, 20 bp, Artificial
  CRISPR gRNA sequence
cctctctccctccttccatc

SEQ ID NO: 535340 - DNA, 20 bp, Artificial
  CRISPR gRNA sequence
tctccctccttccatcccta

SEQ ID NO: 535341 - DNA, 20 bp, Artificial
  CRISPR gRNA sequence
tccctccttccatccctaat

SEQ ID NO: 535342 - DNA, 20 bp, Artificial
  CRISPR gRNA sequence
cctccttccatccctaatac

SEQ ID NO: 535343 - DNA, 20 bp, Artificial
  CRISPR gRNA sequence
cttccatccctaatacacac

SEQ ID NO: 535344 - DNA, 20 bp, Artificial
  CRISPR gRNA sequence
ccatccctaatacacacaca

SEQ ID NO: 535345 - DNA, 20 bp, Artificial
  CRISPR gRNA sequence
catccctaatacacacacat

SEQ ID NO: 535346 - DNA, 20 bp, Artificial
  CRISPR gRNA sequence
atacacacacatatttatac

SEQ ID NO: 535347 - DNA, 20 bp, Artificial
  CRISPR gRNA sequence
atacttgtgggctccagtta

SEQ ID NO: 535348 - DNA, 20 bp, Artificial
  CRISPR gRNA sequence
tacttgtgggctccagttaa

SEQ ID NO: 535349 - DNA, 20 bp, Artificial
  CRISPR gRNA sequence
gtgggctccagttaaaataa

SEQ ID NO: 535350 - DNA, 20 bp, Artificial
  CRISPR gRNA sequence
tgggctccagttaaaataaa

SEQ ID NO: 535351 - DNA, 20 bp, Artificial
  CRISPR gRNA sequence
cagttaaaataaacatgaaa

SEQ ID NO: 535352 - DNA, 20 bp, Artificial
  CRISPR gRNA sequence
aaataaacatgaaaagtagg

SEQ ID NO: 535353 - DNA, 20 bp, Artificial
  CRISPR gRNA sequence
ccagatataatgcaaaacac

SEQ ID NO: 535354 - DNA, 20 bp, Artificial
  CRISPR gRNA sequence
aatttgaatttcagataaac

SEQ ID NO: 535355 - DNA, 20 bp, Artificial
  CRISPR gRNA sequence
gaatttcagataaacaatga

SEQ ID NO: 535356 - DNA, 20 bp, Artificial
  CRISPR gRNA sequence
aatttcagataaacaatgaa

SEQ ID NO: 535357 - DNA, 20 bp, Artificial
  CRISPR gRNA sequence
cagataaacaatgaaaaatt

SEQ ID NO: 535358 - DNA, 20 bp, Artificial
  CRISPR gRNA sequence
agataaacaatgaaaaattt

SEQ ID NO: 535359 - DNA, 20 bp, Artificial
  CRISPR gRNA sequence
cttgcataagtatgttccat

SEQ ID NO: 535360 - DNA, 20 bp, Artificial
  CRISPR gRNA sequence
ttgcataagtatgttccatg

SEQ ID NO: 535361 - DNA, 20 bp, Artificial
  CRISPR gRNA sequence
gcataagtatgttccatgca

SEQ ID NO: 535362 - DNA, 20 bp, Artificial
  CRISPR gRNA sequence
cataagtatgttccatgcaa

SEQ ID NO: 535363 - DNA, 20 bp, Artificial
  CRISPR gRNA sequence
catgcaatatctgaaacgta

SEQ ID NO: 535364 - DNA, 20 bp, Artificial
  CRISPR gRNA sequence
aaacgtacttatgctgtatt

SEQ ID NO: 535365 - DNA, 20 bp, Artificial
  CRISPR gRNA sequence
atgctgtatttttatttgct

SEQ ID NO: 535366 - DNA, 20 bp, Artificial
  CRISPR gRNA sequence
tgctgtatttttatttgcta

SEQ ID NO: 535367 - DNA, 20 bp, Artificial
  CRISPR gRNA sequence
tatttttatttgctatatct

SEQ ID NO: 535368 - DNA, 20 bp, Artificial
  CRISPR gRNA sequence
ttatttgctatatctggcaa

SEQ ID NO: 535369 - DNA, 20 bp, Artificial
  CRISPR gRNA sequence
tatttgctatatctggcaac

SEQ ID NO: 535370 - DNA, 20 bp, Artificial
  CRISPR gRNA sequence
atttgctatatctggcaact

SEQ ID NO: 535371 - DNA, 20 bp, Artificial
  CRISPR gRNA sequence
tttgctatatctggcaactc

SEQ ID NO: 535372 - DNA, 20 bp, Artificial
  CRISPR gRNA sequence
gctatatctggcaactctaa

SEQ ID NO: 535373 - DNA, 20 bp, Artificial
  CRISPR gRNA sequence
ctatatctggcaactctaat

SEQ ID NO: 535374 - DNA, 20 bp, Artificial
  CRISPR gRNA sequence
tatctggcaactctaatcaa

SEQ ID NO: 535375 - DNA, 20 bp, Artificial
  CRISPR gRNA sequence
gcaactctaatcaaagatct

SEQ ID NO: 535376 - DNA, 20 bp, Artificial
  CRISPR gRNA sequence
taatcaaagatctcccgagg

SEQ ID NO: 535377 - DNA, 20 bp, Artificial
  CRISPR gRNA sequence
atcaaagatctcccgaggcc

SEQ ID NO: 535378 - DNA, 20 bp, Artificial
  CRISPR gRNA sequence
ccgaggccactgcagtgact

SEQ ID NO: 535379 - DNA, 20 bp, Artificial
  CRISPR gRNA sequence
cagtgactcatgcctataat

SEQ ID NO: 535380 - DNA, 20 bp, Artificial
  CRISPR gRNA sequence
atgcctataatcccagcact

SEQ ID NO: 535381 - DNA, 20 bp, Artificial
  CRISPR gRNA sequence
taatcccagcactttgggag

SEQ ID NO: 535382 - DNA, 20 bp, Artificial
  CRISPR gRNA sequence
tgggaggctgaggtgggagg

SEQ ID NO: 535383 - DNA, 20 bp, Artificial
  CRISPR gRNA sequence
gggaggctgaggtgggagga

SEQ ID NO: 535384 - DNA, 20 bp, Artificial
  CRISPR gRNA sequence
ggaggctgaggtgggaggat

SEQ ID NO: 535385 - DNA, 20 bp, Artificial
  CRISPR gRNA sequence
aggtgggaggatagtttgag

SEQ ID NO: 535386 - DNA, 20 bp, Artificial
  CRISPR gRNA sequence
gagcacaggagttcgagacc

SEQ ID NO: 535387 - DNA, 20 bp, Artificial
  CRISPR gRNA sequence
agcacaggagttcgagacca

SEQ ID NO: 535388 - DNA, 20 bp, Artificial
  CRISPR gRNA sequence
gagaccagcctgggcaacag

SEQ ID NO: 535389 - DNA, 20 bp, Artificial
  CRISPR gRNA sequence
ggcaacagagtgagacctta

SEQ ID NO: 535390 - DNA, 20 bp, Artificial
  CRISPR gRNA sequence
atctctacaaaattttaaaa

SEQ ID NO: 535391 - DNA, 20 bp, Artificial
  CRISPR gRNA sequence
tctctacaaaattttaaaaa

SEQ ID NO: 535392 - DNA, 20 bp, Artificial
  CRISPR gRNA sequence
tacaaaattttaaaaattag

SEQ ID NO: 535393 - DNA, 20 bp, Artificial
  CRISPR gRNA sequence
caaaattttaaaaattagct

SEQ ID NO: 535394 - DNA, 20 bp, Artificial
  CRISPR gRNA sequence
taaaaattagctgggtgtgg

SEQ ID NO: 535395 - DNA, 20 bp, Artificial
  CRISPR gRNA sequence
aaaaattagctgggtgtggt

SEQ ID NO: 535396 - DNA, 20 bp, Artificial
  CRISPR gRNA sequence
aaaattagctgggtgtggtg

SEQ ID NO: 535397 - DNA, 20 bp, Artificial
  CRISPR gRNA sequence
gctgggtgtggtggcatgct

SEQ ID NO: 535398 - DNA, 20 bp, Artificial
  CRISPR gRNA sequence
ggtgtggtggcatgctcctg

SEQ ID NO: 535399 - DNA, 20 bp, Artificial
  CRISPR gRNA sequence
ctgtaatctcagctactggg

SEQ ID NO: 535400 - DNA, 20 bp, Artificial
  CRISPR gRNA sequence
taatctcagctactggggag

SEQ ID NO: 535401 - DNA, 20 bp, Artificial
  CRISPR gRNA sequence
agctactggggaggctgagg

SEQ ID NO: 535402 - DNA, 20 bp, Artificial
  CRISPR gRNA sequence
ctggggaggctgaggtggga

SEQ ID NO: 535403 - DNA, 20 bp, Artificial
  CRISPR gRNA sequence
gggaggctgaggtgggagga

SEQ ID NO: 535404 - DNA, 20 bp, Artificial
  CRISPR gRNA sequence
aggtgggaggattgcttgag

SEQ ID NO: 535405 - DNA, 20 bp, Artificial
  CRISPR gRNA sequence
cttgagcctgggaggtggag

SEQ ID NO: 535406 - DNA, 20 bp, Artificial
  CRISPR gRNA sequence
gagcctgggaggtggaggct

SEQ ID NO: 535407 - DNA, 20 bp, Artificial
  CRISPR gRNA sequence
agcctgggaggtggaggctg

SEQ ID NO: 535408 - DNA, 20 bp, Artificial
  CRISPR gRNA sequence
ggaggtggaggctgctgaga

SEQ ID NO: 535409 - DNA, 20 bp, Artificial
  CRISPR gRNA sequence
ctgagagctatgatcatact

SEQ ID NO: 535410 - DNA, 20 bp, Artificial
  CRISPR gRNA sequence
agagctatgatcatactacc

SEQ ID NO: 535411 - DNA, 20 bp, Artificial
  CRISPR gRNA sequence
tgatcatactaccacactcc

SEQ ID NO: 535412 - DNA, 20 bp, Artificial
  CRISPR gRNA sequence
ccacactccagccttggcaa

SEQ ID NO: 535413 - DNA, 20 bp, Artificial
  CRISPR gRNA sequence
cagccttggcaacagagcaa

SEQ ID NO: 535414 - DNA, 20 bp, Artificial
  CRISPR gRNA sequence
ggcaacagagcaaaaccctg

SEQ ID NO: 535415 - DNA, 20 bp, Artificial
  CRISPR gRNA sequence
gcaacagagcaaaaccctgt

SEQ ID NO: 535416 - DNA, 20 bp, Artificial
  CRISPR gRNA sequence
tctcaaaaaaagttgcgaag

SEQ ID NO: 535417 - DNA, 20 bp, Artificial
  CRISPR gRNA sequence
aaaaaaagttgcgaagtcaa

SEQ ID NO: 535418 - DNA, 20 bp, Artificial
  CRISPR gRNA sequence
cgaagtcaaggagaggcaac

SEQ ID NO: 535419 - DNA, 20 bp, Artificial
  CRISPR gRNA sequence
cacttactgtgccttagtga

SEQ ID NO: 535420 - DNA, 20 bp, Artificial
  CRISPR gRNA sequence
acttactgtgccttagtgat

SEQ ID NO: 535421 - DNA, 20 bp, Artificial
  CRISPR gRNA sequence
actgtgccttagtgatgggg

SEQ ID NO: 535422 - DNA, 20 bp, Artificial
  CRISPR gRNA sequence
ctgtgccttagtgatggggg

SEQ ID NO: 535423 - DNA, 20 bp, Artificial
  CRISPR gRNA sequence
tgccttagtgatgggggaat

SEQ ID NO: 535424 - DNA, 20 bp, Artificial
  CRISPR gRNA sequence
agtgatgggggaatgtggga

SEQ ID NO: 535425 - DNA, 20 bp, Artificial
  CRISPR gRNA sequence
gtgatgggggaatgtgggag

SEQ ID NO: 535426 - DNA, 20 bp, Artificial
  CRISPR gRNA sequence
gtgggaaaaccgggggtgaa

SEQ ID NO: 535427 - DNA, 20 bp, Artificial
  CRISPR gRNA sequence
gtcaagttggtgattggcag

SEQ ID NO: 535428 - DNA, 20 bp, Artificial
  CRISPR gRNA sequence
gtgattggcagactctcaga

SEQ ID NO: 535429 - DNA, 20 bp, Artificial
  CRISPR gRNA sequence
gcagactctcagatgccttc

SEQ ID NO: 535430 - DNA, 20 bp, Artificial
  CRISPR gRNA sequence
tcagatgccttcaatgaccc

SEQ ID NO: 535431 - DNA, 20 bp, Artificial
  CRISPR gRNA sequence
agatgccttcaatgacccct

SEQ ID NO: 535432 - DNA, 20 bp, Artificial
  CRISPR gRNA sequence
caatgacccctgcttcctgg

SEQ ID NO: 535433 - DNA, 20 bp, Artificial
  CRISPR gRNA sequence
aatgacccctgcttcctggt

SEQ ID NO: 535434 - DNA, 20 bp, Artificial
  CRISPR gRNA sequence
cttcctggtattctcaccta

SEQ ID NO: 535435 - DNA, 20 bp, Artificial
  CRISPR gRNA sequence
cctggtattctcacctatgt

SEQ ID NO: 535436 - DNA, 20 bp, Artificial
  CRISPR gRNA sequence
ctggtattctcacctatgtg

SEQ ID NO: 535437 - DNA, 20 bp, Artificial
  CRISPR gRNA sequence
gtattctcacctatgtgcaa

SEQ ID NO: 535438 - DNA, 20 bp, Artificial
  CRISPR gRNA sequence
tcacctatgtgcaatcccct

SEQ ID NO: 535439 - DNA, 20 bp, Artificial
  CRISPR gRNA sequence
acctatgtgcaatcccctct

SEQ ID NO: 535440 - DNA, 20 bp, Artificial
  CRISPR gRNA sequence
tgtgcaatcccctctgattg

SEQ ID NO: 535441 - DNA, 20 bp, Artificial
  CRISPR gRNA sequence
tgattgaatgtgggctagac

SEQ ID NO: 535442 - DNA, 20 bp, Artificial
  CRISPR gRNA sequence
attgaatgtgggctagactt

SEQ ID NO: 535443 - DNA, 20 bp, Artificial
  CRISPR gRNA sequence
aatgtgggctagacttatta

SEQ ID NO: 535444 - DNA, 20 bp, Artificial
  CRISPR gRNA sequence
gacttattaacttgcttcta

SEQ ID NO: 535445 - DNA, 20 bp, Artificial
  CRISPR gRNA sequence
attaacttgcttctaatgaa

SEQ ID NO: 535446 - DNA, 20 bp, Artificial
  CRISPR gRNA sequence
ttaacttgcttctaatgaac

SEQ ID NO: 535447 - DNA, 20 bp, Artificial
  CRISPR gRNA sequence
acttgcttctaatgaacaga

SEQ ID NO: 535448 - DNA, 20 bp, Artificial
  CRISPR gRNA sequence
gcttctaatgaacagaacac

SEQ ID NO: 535449 - DNA, 20 bp, Artificial
  CRISPR gRNA sequence
cttctaatgaacagaacaca

SEQ ID NO: 535450 - DNA, 20 bp, Artificial
  CRISPR gRNA sequence
ctaatgaacagaacacagca

SEQ ID NO: 535451 - DNA, 20 bp, Artificial
  CRISPR gRNA sequence
taatgaacagaacacagcag

SEQ ID NO: 535452 - DNA, 20 bp, Artificial
  CRISPR gRNA sequence
atgaacagaacacagcagaa

SEQ ID NO: 535453 - DNA, 20 bp, Artificial
  CRISPR gRNA sequence
ggatattactcctgagatta

SEQ ID NO: 535454 - DNA, 20 bp, Artificial
  CRISPR gRNA sequence
ctcctgagattaagttacaa

SEQ ID NO: 535455 - DNA, 20 bp, Artificial
  CRISPR gRNA sequence
ctgagattaagttacaaaaa

SEQ ID NO: 535456 - DNA, 20 bp, Artificial
  CRISPR gRNA sequence
agattaagttacaaaaagac

SEQ ID NO: 535457 - DNA, 20 bp, Artificial
  CRISPR gRNA sequence
agttacaaaaagaccacgac

SEQ ID NO: 535458 - DNA, 20 bp, Artificial
  CRISPR gRNA sequence
caaaaagaccacgacttttg

SEQ ID NO: 535459 - DNA, 20 bp, Artificial
  CRISPR gRNA sequence
ttgtcctgggcacttattcc

SEQ ID NO: 535460 - DNA, 20 bp, Artificial
  CRISPR gRNA sequence
tgtcctgggcacttattcct

SEQ ID NO: 535461 - DNA, 20 bp, Artificial
  CRISPR gRNA sequence
gtcctgggcacttattcctg

SEQ ID NO: 535462 - DNA, 20 bp, Artificial
  CRISPR gRNA sequence
tcctgggcacttattcctgc

SEQ ID NO: 535463 - DNA, 20 bp, Artificial
  CRISPR gRNA sequence
ggcacttattcctgctcttt

SEQ ID NO: 535464 - DNA, 20 bp, Artificial
  CRISPR gRNA sequence
attcctgctctttcttagag

SEQ ID NO: 535465 - DNA, 20 bp, Artificial
  CRISPR gRNA sequence
ttcctgctctttcttagagg

SEQ ID NO: 535466 - DNA, 20 bp, Artificial
  CRISPR gRNA sequence
ctgctctttcttagagggct

SEQ ID NO: 535467 - DNA, 20 bp, Artificial
  CRISPR gRNA sequence
ctctttcttagagggctctg

SEQ ID NO: 535468 - DNA, 20 bp, Artificial
  CRISPR gRNA sequence
tttcttagagggctctgagg

SEQ ID NO: 535469 - DNA, 20 bp, Artificial
  CRISPR gRNA sequence
tcttagagggctctgaggga

SEQ ID NO: 535470 - DNA, 20 bp, Artificial
  CRISPR gRNA sequence
cttagagggctctgagggaa

SEQ ID NO: 535471 - DNA, 20 bp, Artificial
  CRISPR gRNA sequence
ttagagggctctgagggaag

SEQ ID NO: 535472 - DNA, 20 bp, Artificial
  CRISPR gRNA sequence
agagggctctgagggaagct

SEQ ID NO: 535473 - DNA, 20 bp, Artificial
  CRISPR gRNA sequence
gagggctctgagggaagcta

SEQ ID NO: 535474 - DNA, 20 bp, Artificial
  CRISPR gRNA sequence
tgagggaagctagctgccat

SEQ ID NO: 535475 - DNA, 20 bp, Artificial
  CRISPR gRNA sequence
agggaagctagctgccatat

SEQ ID NO: 535476 - DNA, 20 bp, Artificial
  CRISPR gRNA sequence
gctgccatattgtgaggcag

SEQ ID NO: 535477 - DNA, 20 bp, Artificial
  CRISPR gRNA sequence
ccatattgtgaggcagccca

SEQ ID NO: 535478 - DNA, 20 bp, Artificial
  CRISPR gRNA sequence
tgaggcagcccaacggccca

SEQ ID NO: 535479 - DNA, 20 bp, Artificial
  CRISPR gRNA sequence
ggaagtggatccaagagcct

SEQ ID NO: 535480 - DNA, 20 bp, Artificial
  CRISPR gRNA sequence
gaagtggatccaagagccta

SEQ ID NO: 535481 - DNA, 20 bp, Artificial
  CRISPR gRNA sequence
ctcatctaatagtctgtgaa

SEQ ID NO: 535482 - DNA, 20 bp, Artificial
  CRISPR gRNA sequence
atctaatagtctgtgaacat

SEQ ID NO: 535483 - DNA, 20 bp, Artificial
  CRISPR gRNA sequence
atagtctgtgaacatggtgc

SEQ ID NO: 535484 - DNA, 20 bp, Artificial
  CRISPR gRNA sequence
tgaacatggtgcttattttc

SEQ ID NO: 535485 - DNA, 20 bp, Artificial
  CRISPR gRNA sequence
attttctttgtgggccagga

SEQ ID NO: 535486 - DNA, 20 bp, Artificial
  CRISPR gRNA sequence
ttttctttgtgggccaggaa

SEQ ID NO: 535487 - DNA, 20 bp, Artificial
  CRISPR gRNA sequence
tctttgtgggccaggaagct

SEQ ID NO: 535488 - DNA, 20 bp, Artificial
  CRISPR gRNA sequence
ctttgtgggccaggaagctg

SEQ ID NO: 535489 - DNA, 20 bp, Artificial
  CRISPR gRNA sequence
tttgtgggccaggaagctga

SEQ ID NO: 535490 - DNA, 20 bp, Artificial
  CRISPR gRNA sequence
tgtgggccaggaagctgaag

SEQ ID NO: 535491 - DNA, 20 bp, Artificial
  CRISPR gRNA sequence
gtgggccaggaagctgaagc

SEQ ID NO: 535492 - DNA, 20 bp, Artificial
  CRISPR gRNA sequence
tgggccaggaagctgaagcc

SEQ ID NO: 535493 - DNA, 20 bp, Artificial
  CRISPR gRNA sequence
aagcctagagaggggaagaa

SEQ ID NO: 535494 - DNA, 20 bp, Artificial
  CRISPR gRNA sequence
gagaggggaagaaactctgt

SEQ ID NO: 535495 - DNA, 20 bp, Artificial
  CRISPR gRNA sequence
tgtcaagattctctggctaa

SEQ ID NO: 535496 - DNA, 20 bp, Artificial
  CRISPR gRNA sequence
tcaagattctctggctaaat

SEQ ID NO: 535497 - DNA, 20 bp, Artificial
  CRISPR gRNA sequence
tctggctaaatttggacaga

SEQ ID NO: 535498 - DNA, 20 bp, Artificial
  CRISPR gRNA sequence
tggctaaatttggacagacc

SEQ ID NO: 535499 - DNA, 20 bp, Artificial
  CRISPR gRNA sequence
gctaaatttggacagaccca

SEQ ID NO: 535500 - DNA, 20 bp, Artificial
  CRISPR gRNA sequence
aatttggacagacccaaact

SEQ ID NO: 535501 - DNA, 20 bp, Artificial
  CRISPR gRNA sequence
ggacagacccaaactagaag

SEQ ID NO: 535502 - DNA, 20 bp, Artificial
  CRISPR gRNA sequence
gacagacccaaactagaagt

SEQ ID NO: 535503 - DNA, 20 bp, Artificial
  CRISPR gRNA sequence
gaagtccagacctctactcc

SEQ ID NO: 535504 - DNA, 20 bp, Artificial
  CRISPR gRNA sequence
tactcccaggcgagagcttg

SEQ ID NO: 535505 - DNA, 20 bp, Artificial
  CRISPR gRNA sequence
ctcccaggcgagagcttggg

SEQ ID NO: 535506 - DNA, 20 bp, Artificial
  CRISPR gRNA sequence
ccaggcgagagcttgggcac

SEQ ID NO: 535507 - DNA, 20 bp, Artificial
  CRISPR gRNA sequence
gggcactatagaaggctgcc

SEQ ID NO: 535508 - DNA, 20 bp, Artificial
  CRISPR gRNA sequence
ggcactatagaaggctgcct

SEQ ID NO: 535509 - DNA, 20 bp, Artificial
  CRISPR gRNA sequence
tagaaggctgcctctcagaa

SEQ ID NO: 535510 - DNA, 20 bp, Artificial
  CRISPR gRNA sequence
cctctcagaaatacttctgg

SEQ ID NO: 535511 - DNA, 20 bp, Artificial
  CRISPR gRNA sequence
tcagaaatacttctggaggt

SEQ ID NO: 535512 - DNA, 20 bp, Artificial
  CRISPR gRNA sequence
agaaatacttctggaggtca

SEQ ID NO: 535513 - DNA, 20 bp, Artificial
  CRISPR gRNA sequence
ctggaggtcacatcaggctg

SEQ ID NO: 535514 - DNA, 20 bp, Artificial
  CRISPR gRNA sequence
tggaggtcacatcaggctgg

SEQ ID NO: 535515 - DNA, 20 bp, Artificial
  CRISPR gRNA sequence
gaggtcacatcaggctggga

SEQ ID NO: 535516 - DNA, 20 bp, Artificial
  CRISPR gRNA sequence
ggacactggggatccattat

SEQ ID NO: 535517 - DNA, 20 bp, Artificial
  CRISPR gRNA sequence
gggatccattatggtcttgg

SEQ ID NO: 535518 - DNA, 20 bp, Artificial
  CRISPR gRNA sequence
tggtcttggagttttgagat

SEQ ID NO: 535519 - DNA, 20 bp, Artificial
  CRISPR gRNA sequence
ggagttttgagattttctgg

SEQ ID NO: 535520 - DNA, 20 bp, Artificial
  CRISPR gRNA sequence
gagttttgagattttctgga

SEQ ID NO: 535521 - DNA, 20 bp, Artificial
  CRISPR gRNA sequence
tgagattttctggagctagt

SEQ ID NO: 535522 - DNA, 20 bp, Artificial
  CRISPR gRNA sequence
gagattttctggagctagtc

SEQ ID NO: 535523 - DNA, 20 bp, Artificial
  CRISPR gRNA sequence
agattttctggagctagtcc

SEQ ID NO: 535524 - DNA, 20 bp, Artificial
  CRISPR gRNA sequence
tctggagctagtccccaagc

SEQ ID NO: 535525 - DNA, 20 bp, Artificial
  CRISPR gRNA sequence
ctggagctagtccccaagcc

SEQ ID NO: 535526 - DNA, 20 bp, Artificial
  CRISPR gRNA sequence
tggagctagtccccaagcct

SEQ ID NO: 535527 - DNA, 20 bp, Artificial
  CRISPR gRNA sequence
gagctagtccccaagccttg

SEQ ID NO: 535528 - DNA, 20 bp, Artificial
  CRISPR gRNA sequence
gtccccaagccttgccgtcc

SEQ ID NO: 535529 - DNA, 20 bp, Artificial
  CRISPR gRNA sequence
gccgtcctgttgtgtgccag

SEQ ID NO: 535530 - DNA, 20 bp, Artificial
  CRISPR gRNA sequence
ccgtcctgttgtgtgccagg

SEQ ID NO: 535531 - DNA, 20 bp, Artificial
  CRISPR gRNA sequence
ttgtgtgccaggagtgttgc

SEQ ID NO: 535532 - DNA, 20 bp, Artificial
  CRISPR gRNA sequence
tgtgccaggagtgttgcctt

SEQ ID NO: 535533 - DNA, 20 bp, Artificial
  CRISPR gRNA sequence
ccttgctgtccacagtcctc

SEQ ID NO: 535534 - DNA, 20 bp, Artificial
  CRISPR gRNA sequence
gctgtccacagtcctctttg

SEQ ID NO: 535535 - DNA, 20 bp, Artificial
  CRISPR gRNA sequence
ctgtccacagtcctctttgg

SEQ ID NO: 535536 - DNA, 20 bp, Artificial
  CRISPR gRNA sequence
tccacagtcctctttggcct

SEQ ID NO: 535537 - DNA, 20 bp, Artificial
  CRISPR gRNA sequence
tttggcctcaagggctccat

SEQ ID NO: 535538 - DNA, 20 bp, Artificial
  CRISPR gRNA sequence
tggcctcaagggctccattc

SEQ ID NO: 535539 - DNA, 20 bp, Artificial
  CRISPR gRNA sequence
ggcctcaagggctccattcc

SEQ ID NO: 535540 - DNA, 20 bp, Artificial
  CRISPR gRNA sequence
gcctcaagggctccattccc

SEQ ID NO: 535541 - DNA, 20 bp, Artificial
  CRISPR gRNA sequence
aagggctccattcccccatg

SEQ ID NO: 535542 - DNA, 20 bp, Artificial
  CRISPR gRNA sequence
cattcccccatgaccctgcc

SEQ ID NO: 535543 - DNA, 20 bp, Artificial
  CRISPR gRNA sequence
ccccatgaccctgcccccca

SEQ ID NO: 535544 - DNA, 20 bp, Artificial
  CRISPR gRNA sequence
ccccccagggtttctgcagc

SEQ ID NO: 535545 - DNA, 20 bp, Artificial
  CRISPR gRNA sequence
ctgcagcctttctaccttta

SEQ ID NO: 535546 - DNA, 20 bp, Artificial
  CRISPR gRNA sequence
tgcagcctttctacctttac

SEQ ID NO: 535547 - DNA, 20 bp, Artificial
  CRISPR gRNA sequence
cagcctttctacctttactc

SEQ ID NO: 535548 - DNA, 20 bp, Artificial
  CRISPR gRNA sequence
tctacctttactcctgatgg

SEQ ID NO: 535549 - DNA, 20 bp, Artificial
  CRISPR gRNA sequence
ctacctttactcctgatggg

SEQ ID NO: 535550 - DNA, 20 bp, Artificial
  CRISPR gRNA sequence
tacctttactcctgatggga

SEQ ID NO: 535551 - DNA, 20 bp, Artificial
  CRISPR gRNA sequence
cctttactcctgatgggagg

SEQ ID NO: 535552 - DNA, 20 bp, Artificial
  CRISPR gRNA sequence
tactcctgatgggaggtgct

SEQ ID NO: 535553 - DNA, 20 bp, Artificial
  CRISPR gRNA sequence
actcctgatgggaggtgctg

SEQ ID NO: 535554 - DNA, 20 bp, Artificial
  CRISPR gRNA sequence
ctcctgatgggaggtgctga

SEQ ID NO: 535555 - DNA, 20 bp, Artificial
  CRISPR gRNA sequence
ctgatgggaggtgctgacca

SEQ ID NO: 535556 - DNA, 20 bp, Artificial
  CRISPR gRNA sequence
atgggaggtgctgaccacta

SEQ ID NO: 535557 - DNA, 20 bp, Artificial
  CRISPR gRNA sequence
accactaaccatctttaggg

SEQ ID NO: 535558 - DNA, 20 bp, Artificial
  CRISPR gRNA sequence
accatctttaggggagcagt

SEQ ID NO: 535559 - DNA, 20 bp, Artificial
  CRISPR gRNA sequence
taggggagcagttggaatca

SEQ ID NO: 535560 - DNA, 20 bp, Artificial
  CRISPR gRNA sequence
aggggagcagttggaatcat

SEQ ID NO: 535561 - DNA, 20 bp, Artificial
  CRISPR gRNA sequence
ggggagcagttggaatcatg

SEQ ID NO: 535562 - DNA, 20 bp, Artificial
  CRISPR gRNA sequence
gaatcatgtcactaactagc

SEQ ID NO: 535563 - DNA, 20 bp, Artificial
  CRISPR gRNA sequence
actagccaagggaccttggg

SEQ ID NO: 535564 - DNA, 20 bp, Artificial
  CRISPR gRNA sequence
gccaagggaccttgggcaag

SEQ ID NO: 535565 - DNA, 20 bp, Artificial
  CRISPR gRNA sequence
gggcaagtcagtttccctct

SEQ ID NO: 535566 - DNA, 20 bp, Artificial
  CRISPR gRNA sequence
ggcaagtcagtttccctctc

SEQ ID NO: 535567 - DNA, 20 bp, Artificial
  CRISPR gRNA sequence
ccctctctggaaaatggggc

SEQ ID NO: 535568 - DNA, 20 bp, Artificial
  CRISPR gRNA sequence
cctctctggaaaatggggct

SEQ ID NO: 535569 - DNA, 20 bp, Artificial
  CRISPR gRNA sequence
tctggaaaatggggctttgc

SEQ ID NO: 535570 - DNA, 20 bp, Artificial
  CRISPR gRNA sequence
tggaaaatggggctttgcat

SEQ ID NO: 535571 - DNA, 20 bp, Artificial
  CRISPR gRNA sequence
gaaaatggggctttgcatga

SEQ ID NO: 535572 - DNA, 20 bp, Artificial
  CRISPR gRNA sequence
tgcatgagatactctctaca

SEQ ID NO: 535573 - DNA, 20 bp, Artificial
  CRISPR gRNA sequence
gcatgagatactctctacag

SEQ ID NO: 535574 - DNA, 20 bp, Artificial
  CRISPR gRNA sequence
catgagatactctctacagc

SEQ ID NO: 535575 - DNA, 20 bp, Artificial
  CRISPR gRNA sequence
tctacagctcctccttcttc

SEQ ID NO: 535576 - DNA, 20 bp, Artificial
  CRISPR gRNA sequence
tacagctcctccttcttcag

SEQ ID NO: 535577 - DNA, 20 bp, Artificial
  CRISPR gRNA sequence
cagctcctccttcttcagtt

SEQ ID NO: 535578 - DNA, 20 bp, Artificial
  CRISPR gRNA sequence
ctccttcttcagttttgcaa

SEQ ID NO: 535579 - DNA, 20 bp, Artificial
  CRISPR gRNA sequence
cttcttcagttttgcaattc

SEQ ID NO: 535580 - DNA, 20 bp, Artificial
  CRISPR gRNA sequence
cttcagttttgcaattcttt

SEQ ID NO: 535581 - DNA, 20 bp, Artificial
  CRISPR gRNA sequence
ttcagttttgcaattctttc

SEQ ID NO: 535582 - DNA, 20 bp, Artificial
  CRISPR gRNA sequence
cagttttgcaattctttctc

SEQ ID NO: 535583 - DNA, 20 bp, Artificial
  CRISPR gRNA sequence
agttttgcaattctttctcc

SEQ ID NO: 535584 - DNA, 20 bp, Artificial
  CRISPR gRNA sequence
tgcaattctttctcctagaa

SEQ ID NO: 535585 - DNA, 20 bp, Artificial
  CRISPR gRNA sequence
gcaattctttctcctagaag

SEQ ID NO: 535586 - DNA, 20 bp, Artificial
  CRISPR gRNA sequence
caattctttctcctagaaga

SEQ ID NO: 535587 - DNA, 20 bp, Artificial
  CRISPR gRNA sequence
tttctcctagaagaggatct

SEQ ID NO: 535588 - DNA, 20 bp, Artificial
  CRISPR gRNA sequence
tctcctagaagaggatcttt

SEQ ID NO: 535589 - DNA, 20 bp, Artificial
  CRISPR gRNA sequence
ctcctagaagaggatcttta

SEQ ID NO: 535590 - DNA, 20 bp, Artificial
  CRISPR gRNA sequence
tcctagaagaggatctttaa

SEQ ID NO: 535591 - DNA, 20 bp, Artificial
  CRISPR gRNA sequence
ctagaagaggatctttaaaa

SEQ ID NO: 535592 - DNA, 20 bp, Artificial
  CRISPR gRNA sequence
gaagaggatctttaaaattt

SEQ ID NO: 535593 - DNA, 20 bp, Artificial
  CRISPR gRNA sequence
taaaatttcttgtggtcaaa

SEQ ID NO: 535594 - DNA, 20 bp, Artificial
  CRISPR gRNA sequence
aaaatttcttgtggtcaaat

SEQ ID NO: 535595 - DNA, 20 bp, Artificial
  CRISPR gRNA sequence
aaatttcttgtggtcaaatt

SEQ ID NO: 535596 - DNA, 20 bp, Artificial
  CRISPR gRNA sequence
cttgtggtcaaattgtgctc

SEQ ID NO: 535597 - DNA, 20 bp, Artificial
  CRISPR gRNA sequence
ttgtggtcaaattgtgctca

SEQ ID NO: 535598 - DNA, 20 bp, Artificial
  CRISPR gRNA sequence
gtggtcaaattgtgctcagt

SEQ ID NO: 535599 - DNA, 20 bp, Artificial
  CRISPR gRNA sequence
tggtcaaattgtgctcagtg

SEQ ID NO: 535600 - DNA, 20 bp, Artificial
  CRISPR gRNA sequence
tgctcagtgggaggactccc

SEQ ID NO: 535601 - DNA, 20 bp, Artificial
  CRISPR gRNA sequence
agtgggaggactcccaggat

SEQ ID NO: 535602 - DNA, 20 bp, Artificial
  CRISPR gRNA sequence
ccaggatggaaaaccataga

SEQ ID NO: 535603 - DNA, 20 bp, Artificial
  CRISPR gRNA sequence
ccctgatgcttcccttgaag

SEQ ID NO: 535604 - DNA, 20 bp, Artificial
  CRISPR gRNA sequence
atgcttcccttgaaggtttc

SEQ ID NO: 535605 - DNA, 20 bp, Artificial
  CRISPR gRNA sequence
cccttgaaggtttccaggag

SEQ ID NO: 535606 - DNA, 20 bp, Artificial
  CRISPR gRNA sequence
ccttgaaggtttccaggagg

SEQ ID NO: 535607 - DNA, 20 bp, Artificial
  CRISPR gRNA sequence
gaaggtttccaggaggaaga

SEQ ID NO: 535608 - DNA, 20 bp, Artificial
  CRISPR gRNA sequence
aaggtttccaggaggaagag

SEQ ID NO: 535609 - DNA, 20 bp, Artificial
  CRISPR gRNA sequence
ccaggaggaagagatatgct

SEQ ID NO: 535610 - DNA, 20 bp, Artificial
  CRISPR gRNA sequence
caggaggaagagatatgctt

SEQ ID NO: 535611 - DNA, 20 bp, Artificial
  CRISPR gRNA sequence
tcatgcctcatcctgagcca

SEQ ID NO: 535612 - DNA, 20 bp, Artificial
  CRISPR gRNA sequence
catgcctcatcctgagccag

SEQ ID NO: 535613 - DNA, 20 bp, Artificial
  CRISPR gRNA sequence
atgcctcatcctgagccagg

SEQ ID NO: 535614 - DNA, 20 bp, Artificial
  CRISPR gRNA sequence
atcctgagccagggctgcct

SEQ ID NO: 535615 - DNA, 20 bp, Artificial
  CRISPR gRNA sequence
agccagggctgcctcccagc

SEQ ID NO: 535616 - DNA, 20 bp, Artificial
  CRISPR gRNA sequence
cctcccagcatgagcacctg

SEQ ID NO: 535617 - DNA, 20 bp, Artificial
  CRISPR gRNA sequence
ccagcatgagcacctgtgac

SEQ ID NO: 535618 - DNA, 20 bp, Artificial
  CRISPR gRNA sequence
tgacctggagcagcatgcct

SEQ ID NO: 535619 - DNA, 20 bp, Artificial
  CRISPR gRNA sequence
gagcagcatgcctctgccta

SEQ ID NO: 535620 - DNA, 20 bp, Artificial
  CRISPR gRNA sequence
tgcctactgagggcctggca

SEQ ID NO: 535621 - DNA, 20 bp, Artificial
  CRISPR gRNA sequence
cctactgagggcctggcagg

SEQ ID NO: 535622 - DNA, 20 bp, Artificial
  CRISPR gRNA sequence
ctgagggcctggcaggctgt

SEQ ID NO: 535623 - DNA, 20 bp, Artificial
  CRISPR gRNA sequence
agggcctggcaggctgtgtt

SEQ ID NO: 535624 - DNA, 20 bp, Artificial
  CRISPR gRNA sequence
gcaggctgtgtttgtgaagt

SEQ ID NO: 535625 - DNA, 20 bp, Artificial
  CRISPR gRNA sequence
tgtttgtgaagtgatgcccg

SEQ ID NO: 535626 - DNA, 20 bp, Artificial
  CRISPR gRNA sequence
gtgaagtgatgcccgccacg

SEQ ID NO: 535627 - DNA, 20 bp, Artificial
  CRISPR gRNA sequence
tgaagtgatgcccgccacgc

SEQ ID NO: 535628 - DNA, 20 bp, Artificial
  CRISPR gRNA sequence
gacagctgacaggctcgaca

SEQ ID NO: 535629 - DNA, 20 bp, Artificial
  CRISPR gRNA sequence
acaggctcgacactggattc

SEQ ID NO: 535630 - DNA, 20 bp, Artificial
  CRISPR gRNA sequence
gacactggattccttgctga

SEQ ID NO: 535631 - DNA, 20 bp, Artificial
  CRISPR gRNA sequence
gattccttgctgactttgtt

SEQ ID NO: 535632 - DNA, 20 bp, Artificial
  CRISPR gRNA sequence
cttgctgactttgttccctg

SEQ ID NO: 535633 - DNA, 20 bp, Artificial
  CRISPR gRNA sequence
gctgactttgttccctgctg

SEQ ID NO: 535634 - DNA, 20 bp, Artificial
  CRISPR gRNA sequence
ctgactttgttccctgctgt

SEQ ID NO: 535635 - DNA, 20 bp, Artificial
  CRISPR gRNA sequence
actttgttccctgctgtgca

SEQ ID NO: 535636 - DNA, 20 bp, Artificial
  CRISPR gRNA sequence
tgttccctgctgtgcacttg

SEQ ID NO: 535637 - DNA, 20 bp, Artificial
  CRISPR gRNA sequence
gttccctgctgtgcacttga

SEQ ID NO: 535638 - DNA, 20 bp, Artificial
  CRISPR gRNA sequence
ttccctgctgtgcacttgaa

SEQ ID NO: 535639 - DNA, 20 bp, Artificial
  CRISPR gRNA sequence
cctgctgtgcacttgaattt

SEQ ID NO: 535640 - DNA, 20 bp, Artificial
  CRISPR gRNA sequence
ctgtgcacttgaattttgca

SEQ ID NO: 535641 - DNA, 20 bp, Artificial
  CRISPR gRNA sequence
tgcacttgaattttgcactc

SEQ ID NO: 535642 - DNA, 20 bp, Artificial
  CRISPR gRNA sequence
gaattttgcactcaggctgg

SEQ ID NO: 535643 - DNA, 20 bp, Artificial
  CRISPR gRNA sequence
aattttgcactcaggctggt

SEQ ID NO: 535644 - DNA, 20 bp, Artificial
  CRISPR gRNA sequence
tgcactcaggctggtggtcc

SEQ ID NO: 535645 - DNA, 20 bp, Artificial
  CRISPR gRNA sequence
gcactcaggctggtggtcca

SEQ ID NO: 535646 - DNA, 20 bp, Artificial
  CRISPR gRNA sequence
cactcaggctggtggtccac

SEQ ID NO: 535647 - DNA, 20 bp, Artificial
  CRISPR gRNA sequence
aggctggtggtccacttgtg

SEQ ID NO: 535648 - DNA, 20 bp, Artificial
  CRISPR gRNA sequence
gtggtccacttgtgtgtgat

SEQ ID NO: 535649 - DNA, 20 bp, Artificial
  CRISPR gRNA sequence
gtgtgtgatgaccctctgag

SEQ ID NO: 535650 - DNA, 20 bp, Artificial
  CRISPR gRNA sequence
tgtgtgatgaccctctgaga

SEQ ID NO: 535651 - DNA, 20 bp, Artificial
  CRISPR gRNA sequence
tgagaaagttttagatgttt

SEQ ID NO: 535652 - DNA, 20 bp, Artificial
  CRISPR gRNA sequence
agaaagttttagatgtttcc

SEQ ID NO: 535653 - DNA, 20 bp, Artificial
  CRISPR gRNA sequence
tagatgtttcccatcttgat

SEQ ID NO: 535654 - DNA, 20 bp, Artificial
  CRISPR gRNA sequence
agatgtttcccatcttgata

SEQ ID NO: 535655 - DNA, 20 bp, Artificial
  CRISPR gRNA sequence
gatgtttcccatcttgatac

SEQ ID NO: 535656 - DNA, 20 bp, Artificial
  CRISPR gRNA sequence
cccatcttgatacaggttta

SEQ ID NO: 535657 - DNA, 20 bp, Artificial
  CRISPR gRNA sequence
ccatcttgatacaggtttaa

SEQ ID NO: 535658 - DNA, 20 bp, Artificial
  CRISPR gRNA sequence
gatacaggtttaattcgggg

SEQ ID NO: 535659 - DNA, 20 bp, Artificial
  CRISPR gRNA sequence
atacaggtttaattcggggt

SEQ ID NO: 535660 - DNA, 20 bp, Artificial
  CRISPR gRNA sequence
aattcggggtcagttccatt

SEQ ID NO: 535661 - DNA, 20 bp, Artificial
  CRISPR gRNA sequence
attcggggtcagttccattc

SEQ ID NO: 535662 - DNA, 20 bp, Artificial
  CRISPR gRNA sequence
ggggtcagttccattcatta

SEQ ID NO: 535663 - DNA, 20 bp, Artificial
  CRISPR gRNA sequence
cattcattacctcacaggtc

SEQ ID NO: 535664 - DNA, 20 bp, Artificial
  CRISPR gRNA sequence
attacctcacaggtcagggt

SEQ ID NO: 535665 - DNA, 20 bp, Artificial
  CRISPR gRNA sequence
cctcacaggtcagggttgtg

SEQ ID NO: 535666 - DNA, 20 bp, Artificial
  CRISPR gRNA sequence
acaggtcagggttgtgttga

SEQ ID NO: 535667 - DNA, 20 bp, Artificial
  CRISPR gRNA sequence
tgttgatacaagtccaggag

SEQ ID NO: 535668 - DNA, 20 bp, Artificial
  CRISPR gRNA sequence
atacaagtccaggagatctt

SEQ ID NO: 535669 - DNA, 20 bp, Artificial
  CRISPR gRNA sequence
tggttttgagaccctctcta

SEQ ID NO: 535670 - DNA, 20 bp, Artificial
  CRISPR gRNA sequence
ggttttgagaccctctctaa

SEQ ID NO: 535671 - DNA, 20 bp, Artificial
  CRISPR gRNA sequence
gttttgagaccctctctaaa

SEQ ID NO: 535672 - DNA, 20 bp, Artificial
  CRISPR gRNA sequence
tgagaccctctctaaaaaga

SEQ ID NO: 535673 - DNA, 20 bp, Artificial
  CRISPR gRNA sequence
gagaccctctctaaaaagaa

SEQ ID NO: 535674 - DNA, 20 bp, Artificial
  CRISPR gRNA sequence
agaccctctctaaaaagaaa

SEQ ID NO: 535675 - DNA, 20 bp, Artificial
  CRISPR gRNA sequence
tctaaaaagaaagtaaagat

SEQ ID NO: 535676 - DNA, 20 bp, Artificial
  CRISPR gRNA sequence
taaaaagaaagtaaagattc

SEQ ID NO: 535677 - DNA, 20 bp, Artificial
  CRISPR gRNA sequence
aaaagaaagtaaagattcag

SEQ ID NO: 535678 - DNA, 20 bp, Artificial
  CRISPR gRNA sequence
agttcaatttaggcaatttt

SEQ ID NO: 535679 - DNA, 20 bp, Artificial
  CRISPR gRNA sequence
aatttaggcaattttctgat

SEQ ID NO: 535680 - DNA, 20 bp, Artificial
  CRISPR gRNA sequence
aggcaattttctgattttaa

SEQ ID NO: 535681 - DNA, 20 bp, Artificial
  CRISPR gRNA sequence
ggcaattttctgattttaat

SEQ ID NO: 535682 - DNA, 20 bp, Artificial
  CRISPR gRNA sequence
tctgattttaataaacatat

SEQ ID NO: 535683 - DNA, 20 bp, Artificial
  CRISPR gRNA sequence
ctgattttaataaacatatc

SEQ ID NO: 535684 - DNA, 20 bp, Artificial
  CRISPR gRNA sequence
tgattttaataaacatatct

SEQ ID NO: 535685 - DNA, 20 bp, Artificial
  CRISPR gRNA sequence
attttaataaacatatctat

SEQ ID NO: 535686 - DNA, 20 bp, Artificial
  CRISPR gRNA sequence
taataaacatatctatttat

SEQ ID NO: 535687 - DNA, 20 bp, Artificial
  CRISPR gRNA sequence
aataaacatatctatttata

SEQ ID NO: 535688 - DNA, 20 bp, Artificial
  CRISPR gRNA sequence
ataaacatatctatttatac

SEQ ID NO: 535689 - DNA, 20 bp, Artificial
  CRISPR gRNA sequence
tttatacagtgggggatgga

SEQ ID NO: 535690 - DNA, 20 bp, Artificial
  CRISPR gRNA sequence
atacagtgggggatggagtc

SEQ ID NO: 535691 - DNA, 20 bp, Artificial
  CRISPR gRNA sequence
tacagtgggggatggagtca

SEQ ID NO: 535692 - DNA, 20 bp, Artificial
  CRISPR gRNA sequence
gggacaagggaacaatgtca

SEQ ID NO: 535693 - DNA, 20 bp, Artificial
  CRISPR gRNA sequence
tagcaacttttggaaattat

SEQ ID NO: 535694 - DNA, 20 bp, Artificial
  CRISPR gRNA sequence
gcaacttttggaaattattt

SEQ ID NO: 535695 - DNA, 20 bp, Artificial
  CRISPR gRNA sequence
ttggaaattattttatttta

SEQ ID NO: 535696 - DNA, 20 bp, Artificial
  CRISPR gRNA sequence
tggaaattattttattttat

SEQ ID NO: 535697 - DNA, 20 bp, Artificial
  CRISPR gRNA sequence
ggaaattattttattttatt

SEQ ID NO: 535698 - DNA, 20 bp, Artificial
  CRISPR gRNA sequence
gaaattattttattttattt

SEQ ID NO: 535699 - DNA, 20 bp, Artificial
  CRISPR gRNA sequence
ttttattttattttatttac

SEQ ID NO: 535700 - DNA, 20 bp, Artificial
  CRISPR gRNA sequence
tattttattttatttacaaa

SEQ ID NO: 535701 - DNA, 20 bp, Artificial
  CRISPR gRNA sequence
attttattttatttacaaag

SEQ ID NO: 535702 - DNA, 20 bp, Artificial
  CRISPR gRNA sequence
ttttattttatttacaaaga

SEQ ID NO: 535703 - DNA, 20 bp, Artificial
  CRISPR gRNA sequence
tattttatttacaaagagca

SEQ ID NO: 535704 - DNA, 20 bp, Artificial
  CRISPR gRNA sequence
attttatttacaaagagcat

SEQ ID NO: 535705 - DNA, 20 bp, Artificial
  CRISPR gRNA sequence
ttttatttacaaagagcatt

SEQ ID NO: 535706 - DNA, 20 bp, Artificial
  CRISPR gRNA sequence
tatttacaaagagcattcag

SEQ ID NO: 535707 - DNA, 20 bp, Artificial
  CRISPR gRNA sequence
atttacaaagagcattcaga

SEQ ID NO: 535708 - DNA, 20 bp, Artificial
  CRISPR gRNA sequence
tttacaaagagcattcagaa

SEQ ID NO: 535709 - DNA, 20 bp, Artificial
  CRISPR gRNA sequence
acaaagagcattcagaaaaa

SEQ ID NO: 535710 - DNA, 20 bp, Artificial
  CRISPR gRNA sequence
caaagagcattcagaaaaaa

SEQ ID NO: 535711 - DNA, 20 bp, Artificial
  CRISPR gRNA sequence
agaaaaaaattatttctgat

SEQ ID NO: 535712 - DNA, 20 bp, Artificial
  CRISPR gRNA sequence
tttctgatgacattcacaga

SEQ ID NO: 535713 - DNA, 20 bp, Artificial
  CRISPR gRNA sequence
ctgatgacattcacagatac

SEQ ID NO: 535714 - DNA, 20 bp, Artificial
  CRISPR gRNA sequence
tgatgacattcacagataca

SEQ ID NO: 535715 - DNA, 20 bp, Artificial
  CRISPR gRNA sequence
atgacattcacagatacatt

SEQ ID NO: 535716 - DNA, 20 bp, Artificial
  CRISPR gRNA sequence
acagatacattatgccacta

SEQ ID NO: 535717 - DNA, 20 bp, Artificial
  CRISPR gRNA sequence
tgccactaaatagtgtatca

SEQ ID NO: 535718 - DNA, 20 bp, Artificial
  CRISPR gRNA sequence
aatagtgtatcatatgtaat

SEQ ID NO: 535719 - DNA, 20 bp, Artificial
  CRISPR gRNA sequence
atatgctgtcttatacctta

SEQ ID NO: 535720 - DNA, 20 bp, Artificial
  CRISPR gRNA sequence
tatgctgtcttataccttaa

SEQ ID NO: 535721 - DNA, 20 bp, Artificial
  CRISPR gRNA sequence
tcttataccttaaaatgctt

SEQ ID NO: 535722 - DNA, 20 bp, Artificial
  CRISPR gRNA sequence
ataccttaaaatgctttcac

SEQ ID NO: 535723 - DNA, 20 bp, Artificial
  CRISPR gRNA sequence
taccttaaaatgctttcaca

SEQ ID NO: 535724 - DNA, 20 bp, Artificial
  CRISPR gRNA sequence
aaaatgctttcacatatatg

SEQ ID NO: 535725 - DNA, 20 bp, Artificial
  CRISPR gRNA sequence
aaatgctttcacatatatga

SEQ ID NO: 535726 - DNA, 20 bp, Artificial
  CRISPR gRNA sequence
tcacatatatgacatcactt

SEQ ID NO: 535727 - DNA, 20 bp, Artificial
  CRISPR gRNA sequence
cacatatatgacatcactta

SEQ ID NO: 535728 - DNA, 20 bp, Artificial
  CRISPR gRNA sequence
acatatatgacatcacttaa

SEQ ID NO: 535729 - DNA, 20 bp, Artificial
  CRISPR gRNA sequence
aaccctaacagacaggctga

SEQ ID NO: 535730 - DNA, 20 bp, Artificial
  CRISPR gRNA sequence
accctaacagacaggctgat

SEQ ID NO: 535731 - DNA, 20 bp, Artificial
  CRISPR gRNA sequence
acagacaggctgatgttttt

SEQ ID NO: 535732 - DNA, 20 bp, Artificial
  CRISPR gRNA sequence
atgtttttcttcccatttac

SEQ ID NO: 535733 - DNA, 20 bp, Artificial
  CRISPR gRNA sequence
ttcttcccatttacagacaa

SEQ ID NO: 535734 - DNA, 20 bp, Artificial
  CRISPR gRNA sequence
tcttcccatttacagacaaa

SEQ ID NO: 535735 - DNA, 20 bp, Artificial
  CRISPR gRNA sequence
cttcccatttacagacaaaa

SEQ ID NO: 535736 - DNA, 20 bp, Artificial
  CRISPR gRNA sequence
ttcccatttacagacaaaat

SEQ ID NO: 535737 - DNA, 20 bp, Artificial
  CRISPR gRNA sequence
cccatttacagacaaaatgt

SEQ ID NO: 535738 - DNA, 20 bp, Artificial
  CRISPR gRNA sequence
ccatttacagacaaaatgtt

SEQ ID NO: 535739 - DNA, 20 bp, Artificial
  CRISPR gRNA sequence
acagacaaaatgttcaaggc

SEQ ID NO: 535740 - DNA, 20 bp, Artificial
  CRISPR gRNA sequence
cagacaaaatgttcaaggct

SEQ ID NO: 535741 - DNA, 20 bp, Artificial
  CRISPR gRNA sequence
aaggctctgagaggtccagt

SEQ ID NO: 535742 - DNA, 20 bp, Artificial
  CRISPR gRNA sequence
tgagaggtccagtaggtggt

SEQ ID NO: 535743 - DNA, 20 bp, Artificial
  CRISPR gRNA sequence
agaggtccagtaggtggtct

SEQ ID NO: 535744 - DNA, 20 bp, Artificial
  CRISPR gRNA sequence
ggggcaccacctaaaacatg

SEQ ID NO: 535745 - DNA, 20 bp, Artificial
  CRISPR gRNA sequence
gggcaccacctaaaacatgg

SEQ ID NO: 535746 - DNA, 20 bp, Artificial
  CRISPR gRNA sequence
aaacatggcagtcagggttt

SEQ ID NO: 535747 - DNA, 20 bp, Artificial
  CRISPR gRNA sequence
aggagtatgggtaagaaagt

SEQ ID NO: 535748 - DNA, 20 bp, Artificial
  CRISPR gRNA sequence
ggagtatgggtaagaaagtg

SEQ ID NO: 535749 - DNA, 20 bp, Artificial
  CRISPR gRNA sequence
cagagtttgagaaaggcaat

SEQ ID NO: 535750 - DNA, 20 bp, Artificial
  CRISPR gRNA sequence
gagaaaggcaatgctttaac

SEQ ID NO: 535751 - DNA, 20 bp, Artificial
  CRISPR gRNA sequence
agaaaggcaatgctttaaca

SEQ ID NO: 535752 - DNA, 20 bp, Artificial
  CRISPR gRNA sequence
taacagcagccaggaacccc

SEQ ID NO: 535753 - DNA, 20 bp, Artificial
  CRISPR gRNA sequence
aacagcagccaggaacccca

SEQ ID NO: 535754 - DNA, 20 bp, Artificial
  CRISPR gRNA sequence
acagcagccaggaaccccat

SEQ ID NO: 535755 - DNA, 20 bp, Artificial
  CRISPR gRNA sequence
gaggaatcaccacattgaca

SEQ ID NO: 535756 - DNA, 20 bp, Artificial
  CRISPR gRNA sequence
acatgtgactggggaccttg

SEQ ID NO: 535757 - DNA, 20 bp, Artificial
  CRISPR gRNA sequence
gggaccttggatacctctgc

SEQ ID NO: 535758 - DNA, 20 bp, Artificial
  CRISPR gRNA sequence
ggatacctctgcccccacca

SEQ ID NO: 535759 - DNA, 20 bp, Artificial
  CRISPR gRNA sequence
gatacctctgcccccaccaa

SEQ ID NO: 535760 - DNA, 20 bp, Artificial
  CRISPR gRNA sequence
tgcccccaccaagttcctgg

SEQ ID NO: 535761 - DNA, 20 bp, Artificial
  CRISPR gRNA sequence
cccccaccaagttcctggag

SEQ ID NO: 535762 - DNA, 20 bp, Artificial
  CRISPR gRNA sequence
ctggagcagtgggccaggtg

SEQ ID NO: 535763 - DNA, 20 bp, Artificial
  CRISPR gRNA sequence
gagcagtgggccaggtgggt

SEQ ID NO: 535764 - DNA, 20 bp, Artificial
  CRISPR gRNA sequence
aaagctctagggaaaaagag

SEQ ID NO: 535765 - DNA, 20 bp, Artificial
  CRISPR gRNA sequence
tagggaaaaagagcacctgc

SEQ ID NO: 535766 - DNA, 20 bp, Artificial
  CRISPR gRNA sequence
gggaaaaagagcacctgcct

SEQ ID NO: 535767 - DNA, 20 bp, Artificial
  CRISPR gRNA sequence
cctgggaaccagagacttga

SEQ ID NO: 535768 - DNA, 20 bp, Artificial
  CRISPR gRNA sequence
ggaaccagagacttgattct

SEQ ID NO: 535769 - DNA, 20 bp, Artificial
  CRISPR gRNA sequence
gattctgccttttcccagcc

SEQ ID NO: 535770 - DNA, 20 bp, Artificial
  CRISPR gRNA sequence
attctgccttttcccagccc

SEQ ID NO: 535771 - DNA, 20 bp, Artificial
  CRISPR gRNA sequence
tgccttttcccagcccagag

SEQ ID NO: 535772 - DNA, 20 bp, Artificial
  CRISPR gRNA sequence
ccttttcccagcccagagct

SEQ ID NO: 535773 - DNA, 20 bp, Artificial
  CRISPR gRNA sequence
ttcccagcccagagctgctc

SEQ ID NO: 535774 - DNA, 20 bp, Artificial
  CRISPR gRNA sequence
tcccagcccagagctgctca

SEQ ID NO: 535775 - DNA, 20 bp, Artificial
  CRISPR gRNA sequence
cccagcccagagctgctcag

SEQ ID NO: 535776 - DNA, 20 bp, Artificial
  CRISPR gRNA sequence
ccagcccagagctgctcagt

SEQ ID NO: 535777 - DNA, 20 bp, Artificial
  CRISPR gRNA sequence
ctcagttgctcacagggtct

SEQ ID NO: 535778 - DNA, 20 bp, Artificial
  CRISPR gRNA sequence
agttgctcacagggtctacg

SEQ ID NO: 535779 - DNA, 20 bp, Artificial
  CRISPR gRNA sequence
ctcacagggtctacgctggc

SEQ ID NO: 535780 - DNA, 20 bp, Artificial
  CRISPR gRNA sequence
acagggtctacgctggccct

SEQ ID NO: 535781 - DNA, 20 bp, Artificial
  CRISPR gRNA sequence
cgctggccctcctcagagca

SEQ ID NO: 535782 - DNA, 20 bp, Artificial
  CRISPR gRNA sequence
gccctcctcagagcatcaga

SEQ ID NO: 535783 - DNA, 20 bp, Artificial
  CRISPR gRNA sequence
ctcagagcatcagaaaagga

SEQ ID NO: 535784 - DNA, 20 bp, Artificial
  CRISPR gRNA sequence
agagcatcagaaaaggatca

SEQ ID NO: 535785 - DNA, 20 bp, Artificial
  CRISPR gRNA sequence
cctgtcacaaaaggagcaac

SEQ ID NO: 535786 - DNA, 20 bp, Artificial
  CRISPR gRNA sequence
tcacaaaaggagcaacatgt

SEQ ID NO: 535787 - DNA, 20 bp, Artificial
  CRISPR gRNA sequence
ggcagatcgttaggcactga

SEQ ID NO: 535788 - DNA, 20 bp, Artificial
  CRISPR gRNA sequence
ggcactgacattattagtgg

SEQ ID NO: 535789 - DNA, 20 bp, Artificial
  CRISPR gRNA sequence
acattattagtggtaattca

SEQ ID NO: 535790 - DNA, 20 bp, Artificial
  CRISPR gRNA sequence
ttagtggtaattcatgcatt

SEQ ID NO: 535791 - DNA, 20 bp, Artificial
  CRISPR gRNA sequence
gtggtaattcatgcattcga

SEQ ID NO: 535792 - DNA, 20 bp, Artificial
  CRISPR gRNA sequence
atgcattcgataatcacaaa

SEQ ID NO: 535793 - DNA, 20 bp, Artificial
  CRISPR gRNA sequence
gataatcacaaacctcttgc

SEQ ID NO: 535794 - DNA, 20 bp, Artificial
  CRISPR gRNA sequence
ttgcctctcccgcacagaga

SEQ ID NO: 535795 - DNA, 20 bp, Artificial
  CRISPR gRNA sequence
gcctctcccgcacagagatt

SEQ ID NO: 535796 - DNA, 20 bp, Artificial
  CRISPR gRNA sequence
cctctcccgcacagagattg

SEQ ID NO: 535797 - DNA, 20 bp, Artificial
  CRISPR gRNA sequence
tcccgcacagagattgcacc

SEQ ID NO: 535798 - DNA, 20 bp, Artificial
  CRISPR gRNA sequence
ccgcacagagattgcaccac

SEQ ID NO: 535799 - DNA, 20 bp, Artificial
  CRISPR gRNA sequence
caccacaaaaggaaaatgcc

SEQ ID NO: 535800 - DNA, 20 bp, Artificial
  CRISPR gRNA sequence
ggcctagcattagatggctc

SEQ ID NO: 535801 - DNA, 20 bp, Artificial
  CRISPR gRNA sequence
gcattagatggctcaggtct

SEQ ID NO: 535802 - DNA, 20 bp, Artificial
  CRISPR gRNA sequence
gatggctcaggtctacatct

SEQ ID NO: 535803 - DNA, 20 bp, Artificial
  CRISPR gRNA sequence
aggtctacatcttagcccca

SEQ ID NO: 535804 - DNA, 20 bp, Artificial
  CRISPR gRNA sequence
catcttagccccatcacttc

SEQ ID NO: 535805 - DNA, 20 bp, Artificial
  CRISPR gRNA sequence
agccccatcacttcctagct

SEQ ID NO: 535806 - DNA, 20 bp, Artificial
  CRISPR gRNA sequence
gccccatcacttcctagctg

SEQ ID NO: 535807 - DNA, 20 bp, Artificial
  CRISPR gRNA sequence
cctagctgtgtgaacttttc

SEQ ID NO: 535808 - DNA, 20 bp, Artificial
  CRISPR gRNA sequence
ctagctgtgtgaacttttcc

SEQ ID NO: 535809 - DNA, 20 bp, Artificial
  CRISPR gRNA sequence
gctgtgtgaacttttccttt

SEQ ID NO: 535810 - DNA, 20 bp, Artificial
  CRISPR gRNA sequence
tgtgaacttttccttttcct

SEQ ID NO: 535811 - DNA, 20 bp, Artificial
  CRISPR gRNA sequence
ttccttttcctcgtcttctg

SEQ ID NO: 535812 - DNA, 20 bp, Artificial
  CRISPR gRNA sequence
tccttttcctcgtcttctgt

SEQ ID NO: 535813 - DNA, 20 bp, Artificial
  CRISPR gRNA sequence
ccttttcctcgtcttctgtt

SEQ ID NO: 535814 - DNA, 20 bp, Artificial
  CRISPR gRNA sequence
cttttcctcgtcttctgttt

SEQ ID NO: 535815 - DNA, 20 bp, Artificial
  CRISPR gRNA sequence
ttcctcgtcttctgtttttt

SEQ ID NO: 535816 - DNA, 20 bp, Artificial
  CRISPR gRNA sequence
tcctcgtcttctgttttttt

SEQ ID NO: 535817 - DNA, 20 bp, Artificial
  CRISPR gRNA sequence
cctcgtcttctgtttttttt

SEQ ID NO: 535818 - DNA, 20 bp, Artificial
  CRISPR gRNA sequence
ctcgtcttctgttttttttt

SEQ ID NO: 535819 - DNA, 20 bp, Artificial
  CRISPR gRNA sequence
gtcttctgtttttttttttt

SEQ ID NO: 535820 - DNA, 20 bp, Artificial
  CRISPR gRNA sequence
ctgttttttttttttctcat

SEQ ID NO: 535821 - DNA, 20 bp, Artificial
  CRISPR gRNA sequence
tgttttttttttttctcatt

SEQ ID NO: 535822 - DNA, 20 bp, Artificial
  CRISPR gRNA sequence
ttttttttttttctcattct

SEQ ID NO: 535823 - DNA, 20 bp, Artificial
  CRISPR gRNA sequence
tttttttttctcattcttta

SEQ ID NO: 535824 - DNA, 20 bp, Artificial
  CRISPR gRNA sequence
ttttttttctcattctttac

SEQ ID NO: 535825 - DNA, 20 bp, Artificial
  CRISPR gRNA sequence
tttttttctcattctttact

SEQ ID NO: 535826 - DNA, 20 bp, Artificial
  CRISPR gRNA sequence
ttttttctcattctttactt

SEQ ID NO: 535827 - DNA, 20 bp, Artificial
  CRISPR gRNA sequence
tttttctcattctttacttt

SEQ ID NO: 535828 - DNA, 20 bp, Artificial
  CRISPR gRNA sequence
ttttctcattctttactttg

SEQ ID NO: 535829 - DNA, 20 bp, Artificial
  CRISPR gRNA sequence
tttctcattctttactttgt

SEQ ID NO: 535830 - DNA, 20 bp, Artificial
  CRISPR gRNA sequence
ttctcattctttactttgtt

SEQ ID NO: 535831 - DNA, 20 bp, Artificial
  CRISPR gRNA sequence
tctcattctttactttgttc

SEQ ID NO: 535832 - DNA, 20 bp, Artificial
  CRISPR gRNA sequence
ctcattctttactttgttcc

SEQ ID NO: 535833 - DNA, 20 bp, Artificial
  CRISPR gRNA sequence
tcattctttactttgttccc

SEQ ID NO: 535834 - DNA, 20 bp, Artificial
  CRISPR gRNA sequence
attctttactttgttccccc

SEQ ID NO: 535835 - DNA, 20 bp, Artificial
  CRISPR gRNA sequence
tttactttgttccccccaga

SEQ ID NO: 535836 - DNA, 20 bp, Artificial
  CRISPR gRNA sequence
tactttgttccccccagact

SEQ ID NO: 535837 - DNA, 20 bp, Artificial
  CRISPR gRNA sequence
actttgttccccccagactt

SEQ ID NO: 535838 - DNA, 20 bp, Artificial
  CRISPR gRNA sequence
ctttgttccccccagacttg

SEQ ID NO: 535839 - DNA, 20 bp, Artificial
  CRISPR gRNA sequence
tgttccccccagacttgcca

SEQ ID NO: 535840 - DNA, 20 bp, Artificial
  CRISPR gRNA sequence
gttccccccagacttgccac

SEQ ID NO: 535841 - DNA, 20 bp, Artificial
  CRISPR gRNA sequence
ttccccccagacttgccact

SEQ ID NO: 535842 - DNA, 20 bp, Artificial
  CRISPR gRNA sequence
cccccagacttgccactttt

SEQ ID NO: 535843 - DNA, 20 bp, Artificial
  CRISPR gRNA sequence
gccacttttccctctcagtt

SEQ ID NO: 535844 - DNA, 20 bp, Artificial
  CRISPR gRNA sequence
ccacttttccctctcagttt

SEQ ID NO: 535845 - DNA, 20 bp, Artificial
  CRISPR gRNA sequence
ttccctctcagtttctctcc

SEQ ID NO: 535846 - DNA, 20 bp, Artificial
  CRISPR gRNA sequence
tccctctcagtttctctcca

SEQ ID NO: 535847 - DNA, 20 bp, Artificial
  CRISPR gRNA sequence
ccctctcagtttctctccat

SEQ ID NO: 535848 - DNA, 20 bp, Artificial
  CRISPR gRNA sequence
cctctcagtttctctccatt

SEQ ID NO: 535849 - DNA, 20 bp, Artificial
  CRISPR gRNA sequence
tcagtttctctccattcata

SEQ ID NO: 535850 - DNA, 20 bp, Artificial
  CRISPR gRNA sequence
agtttctctccattcataat

SEQ ID NO: 535851 - DNA, 20 bp, Artificial
  CRISPR gRNA sequence
ctctccattcataatataga

SEQ ID NO: 535852 - DNA, 20 bp, Artificial
  CRISPR gRNA sequence
tctccattcataatatagat

SEQ ID NO: 535853 - DNA, 20 bp, Artificial
  CRISPR gRNA sequence
tccattcataatatagatgg

SEQ ID NO: 535854 - DNA, 20 bp, Artificial
  CRISPR gRNA sequence
cattcataatatagatggac

SEQ ID NO: 535855 - DNA, 20 bp, Artificial
  CRISPR gRNA sequence
ataatatagatggactagct

SEQ ID NO: 535856 - DNA, 20 bp, Artificial
  CRISPR gRNA sequence
gcttatttttcaatgattcc

SEQ ID NO: 535857 - DNA, 20 bp, Artificial
  CRISPR gRNA sequence
atttttcaatgattccctcc

SEQ ID NO: 535858 - DNA, 20 bp, Artificial
  CRISPR gRNA sequence
tttttcaatgattccctccc

SEQ ID NO: 535859 - DNA, 20 bp, Artificial
  CRISPR gRNA sequence
ttcaatgattccctcccact

SEQ ID NO: 535860 - DNA, 20 bp, Artificial
  CRISPR gRNA sequence
tcaatgattccctcccactc

SEQ ID NO: 535861 - DNA, 20 bp, Artificial
  CRISPR gRNA sequence
caatgattccctcccactct

SEQ ID NO: 535862 - DNA, 20 bp, Artificial
  CRISPR gRNA sequence
aatgattccctcccactctg

SEQ ID NO: 535863 - DNA, 20 bp, Artificial
  CRISPR gRNA sequence
cctcccactctgacttccag

SEQ ID NO: 535864 - DNA, 20 bp, Artificial
  CRISPR gRNA sequence
ccactctgacttccagacac

SEQ ID NO: 535865 - DNA, 20 bp, Artificial
  CRISPR gRNA sequence
tgacttccagacaccaatat

SEQ ID NO: 535866 - DNA, 20 bp, Artificial
  CRISPR gRNA sequence
acttccagacaccaatattt

SEQ ID NO: 535867 - DNA, 20 bp, Artificial
  CRISPR gRNA sequence
ccagacaccaatattttccc

SEQ ID NO: 535868 - DNA, 20 bp, Artificial
  CRISPR gRNA sequence
cagacaccaatattttcccc

SEQ ID NO: 535869 - DNA, 20 bp, Artificial
  CRISPR gRNA sequence
tccccatggaacaccatagt

SEQ ID NO: 535870 - DNA, 20 bp, Artificial
  CRISPR gRNA sequence
ccccatggaacaccatagtc

SEQ ID NO: 535871 - DNA, 20 bp, Artificial
  CRISPR gRNA sequence
cccatggaacaccatagtca

SEQ ID NO: 535872 - DNA, 20 bp, Artificial
  CRISPR gRNA sequence
catttatgtcccgatatata

SEQ ID NO: 535873 - DNA, 20 bp, Artificial
  CRISPR gRNA sequence
atttatgtcccgatatatat

SEQ ID NO: 535874 - DNA, 20 bp, Artificial
  CRISPR gRNA sequence
atgtcccgatatatataggc

SEQ ID NO: 535875 - DNA, 20 bp, Artificial
  CRISPR gRNA sequence
tgtcccgatatatataggca

SEQ ID NO: 535876 - DNA, 20 bp, Artificial
  CRISPR gRNA sequence
aattaaaagttttcttctca

SEQ ID NO: 535877 - DNA, 20 bp, Artificial
  CRISPR gRNA sequence
aaagttttcttctcatccca

SEQ ID NO: 535878 - DNA, 20 bp, Artificial
  CRISPR gRNA sequence
tcttctcatcccaagattct

SEQ ID NO: 535879 - DNA, 20 bp, Artificial
  CRISPR gRNA sequence
cttctcatcccaagattctg

SEQ ID NO: 535880 - DNA, 20 bp, Artificial
  CRISPR gRNA sequence
ttctcatcccaagattctgc

SEQ ID NO: 535881 - DNA, 20 bp, Artificial
  CRISPR gRNA sequence
ctcatcccaagattctgcgt

SEQ ID NO: 535882 - DNA, 20 bp, Artificial
  CRISPR gRNA sequence
tcatcccaagattctgcgtt

SEQ ID NO: 535883 - DNA, 20 bp, Artificial
  CRISPR gRNA sequence
atcccaagattctgcgttac

SEQ ID NO: 535884 - DNA, 20 bp, Artificial
  CRISPR gRNA sequence
tgcgttactgagaaggaaga

SEQ ID NO: 535885 - DNA, 20 bp, Artificial
  CRISPR gRNA sequence
cgttactgagaaggaagaaa

SEQ ID NO: 535886 - DNA, 20 bp, Artificial
  CRISPR gRNA sequence
ctgagaaggaagaaaatgga

SEQ ID NO: 535887 - DNA, 20 bp, Artificial
  CRISPR gRNA sequence
agaaggaagaaaatggaaat

SEQ ID NO: 535888 - DNA, 20 bp, Artificial
  CRISPR gRNA sequence
tcaacattcagcaacagagt

SEQ ID NO: 535889 - DNA, 20 bp, Artificial
  CRISPR gRNA sequence
agcaacagagttagtacata

SEQ ID NO: 535890 - DNA, 20 bp, Artificial
  CRISPR gRNA sequence
gtacatagtctagaggttgg

SEQ ID NO: 535891 - DNA, 20 bp, Artificial
  CRISPR gRNA sequence
gaggttgggtcacgaagttt

SEQ ID NO: 535892 - DNA, 20 bp, Artificial
  CRISPR gRNA sequence
ggtcacgaagtttgcccgtc

SEQ ID NO: 535893 - DNA, 20 bp, Artificial
  CRISPR gRNA sequence
gcccgtctcttcagaatgga

SEQ ID NO: 535894 - DNA, 20 bp, Artificial
  CRISPR gRNA sequence
cccgtctcttcagaatggaa

SEQ ID NO: 535895 - DNA, 20 bp, Artificial
  CRISPR gRNA sequence
ttcagaatggaaatattttt

SEQ ID NO: 535896 - DNA, 20 bp, Artificial
  CRISPR gRNA sequence
cagaatggaaatattttttt

SEQ ID NO: 535897 - DNA, 20 bp, Artificial
  CRISPR gRNA sequence
agaatggaaatatttttttt

SEQ ID NO: 535898 - DNA, 20 bp, Artificial
  CRISPR gRNA sequence
tttttctacttataacagca

SEQ ID NO: 535899 - DNA, 20 bp, Artificial
  CRISPR gRNA sequence
ttttctacttataacagcaa

SEQ ID NO: 535900 - DNA, 20 bp, Artificial
  CRISPR gRNA sequence
tttctacttataacagcaac

SEQ ID NO: 535901 - DNA, 20 bp, Artificial
  CRISPR gRNA sequence
ttctacttataacagcaaca

SEQ ID NO: 535902 - DNA, 20 bp, Artificial
  CRISPR gRNA sequence
tctacttataacagcaacac

SEQ ID NO: 535903 - DNA, 20 bp, Artificial
  CRISPR gRNA sequence
ctacttataacagcaacaca

SEQ ID NO: 535904 - DNA, 20 bp, Artificial
  CRISPR gRNA sequence
tacttataacagcaacacag

SEQ ID NO: 535905 - DNA, 20 bp, Artificial
  CRISPR gRNA sequence
cttataacagcaacacagta

SEQ ID NO: 535906 - DNA, 20 bp, Artificial
  CRISPR gRNA sequence
ataacagcaacacagtaaca

SEQ ID NO: 535907 - DNA, 20 bp, Artificial
  CRISPR gRNA sequence
taacagcaacacagtaacat

SEQ ID NO: 535908 - DNA, 20 bp, Artificial
  CRISPR gRNA sequence
tggtgatggttgcaaaactc

SEQ ID NO: 535909 - DNA, 20 bp, Artificial
  CRISPR gRNA sequence
caaaactctgaatatactaa

SEQ ID NO: 535910 - DNA, 20 bp, Artificial
  CRISPR gRNA sequence
tgaatatactaaaggccgtt

SEQ ID NO: 535911 - DNA, 20 bp, Artificial
  CRISPR gRNA sequence
aatatactaaaggccgtttt

SEQ ID NO: 535912 - DNA, 20 bp, Artificial
  CRISPR gRNA sequence
aaggccgttttagtgtatgg

SEQ ID NO: 535913 - DNA, 20 bp, Artificial
  CRISPR gRNA sequence
tagtgtatggacaaattgaa

SEQ ID NO: 535914 - DNA, 20 bp, Artificial
  CRISPR gRNA sequence
agtgtatggacaaattgaat

SEQ ID NO: 535915 - DNA, 20 bp, Artificial
  CRISPR gRNA sequence
gtgtatggacaaattgaatg

SEQ ID NO: 535916 - DNA, 20 bp, Artificial
  CRISPR gRNA sequence
aatgataggtgaattatctc

SEQ ID NO: 535917 - DNA, 20 bp, Artificial
  CRISPR gRNA sequence
tctcaatgaagctgtttaga

SEQ ID NO: 535918 - DNA, 20 bp, Artificial
  CRISPR gRNA sequence
aatgaagctgtttagaaaaa

SEQ ID NO: 535919 - DNA, 20 bp, Artificial
  CRISPR gRNA sequence
tttagaaaaaaaagaaaagg

SEQ ID NO: 535920 - DNA, 20 bp, Artificial
  CRISPR gRNA sequence
agaaaaaaaagaaaaggtca

SEQ ID NO: 535921 - DNA, 20 bp, Artificial
  CRISPR gRNA sequence
gaaaaaaaagaaaaggtcat

SEQ ID NO: 535922 - DNA, 20 bp, Artificial
  CRISPR gRNA sequence
gccaaaaagacctctgagtt

SEQ ID NO: 535923 - DNA, 20 bp, Artificial
  CRISPR gRNA sequence
ccaaaaagacctctgagttt

SEQ ID NO: 535924 - DNA, 20 bp, Artificial
  CRISPR gRNA sequence
tgagtttgaatcctgacttt

SEQ ID NO: 535925 - DNA, 20 bp, Artificial
  CRISPR gRNA sequence
agtttgaatcctgactttgc

SEQ ID NO: 535926 - DNA, 20 bp, Artificial
  CRISPR gRNA sequence
gaatcctgactttgctcctg

SEQ ID NO: 535927 - DNA, 20 bp, Artificial
  CRISPR gRNA sequence
aatcctgactttgctcctgt

SEQ ID NO: 535928 - DNA, 20 bp, Artificial
  CRISPR gRNA sequence
actttgctcctgtcaagcaa

SEQ ID NO: 535929 - DNA, 20 bp, Artificial
  CRISPR gRNA sequence
tgctcctgtcaagcaatgag

SEQ ID NO: 535930 - DNA, 20 bp, Artificial
  CRISPR gRNA sequence
gctcctgtcaagcaatgaga

SEQ ID NO: 535931 - DNA, 20 bp, Artificial
  CRISPR gRNA sequence
ctcctgtcaagcaatgagac

SEQ ID NO: 535932 - DNA, 20 bp, Artificial
  CRISPR gRNA sequence
ctgtcaagcaatgagacctt

SEQ ID NO: 535933 - DNA, 20 bp, Artificial
  CRISPR gRNA sequence
tcaagcaatgagaccttgga

SEQ ID NO: 535934 - DNA, 20 bp, Artificial
  CRISPR gRNA sequence
ggacaagctgcttctgacta

SEQ ID NO: 535935 - DNA, 20 bp, Artificial
  CRISPR gRNA sequence
gacaagctgcttctgactag

SEQ ID NO: 535936 - DNA, 20 bp, Artificial
  CRISPR gRNA sequence
cttctgactaggtctctgtt

SEQ ID NO: 535937 - DNA, 20 bp, Artificial
  CRISPR gRNA sequence
ctgactaggtctctgttttc

SEQ ID NO: 535938 - DNA, 20 bp, Artificial
  CRISPR gRNA sequence
tgactaggtctctgttttct

SEQ ID NO: 535939 - DNA, 20 bp, Artificial
  CRISPR gRNA sequence
actaggtctctgttttctta

SEQ ID NO: 535940 - DNA, 20 bp, Artificial
  CRISPR gRNA sequence
ggtctctgttttcttatata

SEQ ID NO: 535941 - DNA, 20 bp, Artificial
  CRISPR gRNA sequence
tgttttcttatatataacaa

SEQ ID NO: 535942 - DNA, 20 bp, Artificial
  CRISPR gRNA sequence
ttttcttatatataacaagg

SEQ ID NO: 535943 - DNA, 20 bp, Artificial
  CRISPR gRNA sequence
tcttatatataacaaggaga

SEQ ID NO: 535944 - DNA, 20 bp, Artificial
  CRISPR gRNA sequence
cttatatataacaaggagat

SEQ ID NO: 535945 - DNA, 20 bp, Artificial
  CRISPR gRNA sequence
ttatatataacaaggagata

SEQ ID NO: 535946 - DNA, 20 bp, Artificial
  CRISPR gRNA sequence
atatataacaaggagataat

SEQ ID NO: 535947 - DNA, 20 bp, Artificial
  CRISPR gRNA sequence
tatataacaaggagataata

SEQ ID NO: 535948 - DNA, 20 bp, Artificial
  CRISPR gRNA sequence
ggtctcagtattgttgggcg

SEQ ID NO: 535949 - DNA, 20 bp, Artificial
  CRISPR gRNA sequence
agtattgttgggcgctttaa

SEQ ID NO: 535950 - DNA, 20 bp, Artificial
  CRISPR gRNA sequence
ttgggcgctttaaataagat

SEQ ID NO: 535951 - DNA, 20 bp, Artificial
  CRISPR gRNA sequence
ggcgctttaaataagatcat

SEQ ID NO: 535952 - DNA, 20 bp, Artificial
  CRISPR gRNA sequence
taaataagatcatgtaagca

SEQ ID NO: 535953 - DNA, 20 bp, Artificial
  CRISPR gRNA sequence
aaataagatcatgtaagcaa

SEQ ID NO: 535954 - DNA, 20 bp, Artificial
  CRISPR gRNA sequence
aataagatcatgtaagcaag

SEQ ID NO: 535955 - DNA, 20 bp, Artificial
  CRISPR gRNA sequence
gacccctaactggtagccat

SEQ ID NO: 535956 - DNA, 20 bp, Artificial
  CRISPR gRNA sequence
acccctaactggtagccatt

SEQ ID NO: 535957 - DNA, 20 bp, Artificial
  CRISPR gRNA sequence
actggtagccattatttccg

SEQ ID NO: 535958 - DNA, 20 bp, Artificial
  CRISPR gRNA sequence
gtagccattatttccgccgc

SEQ ID NO: 535959 - DNA, 20 bp, Artificial
  CRISPR gRNA sequence
tttccgccgcaatgctaaat

SEQ ID NO: 535960 - DNA, 20 bp, Artificial
  CRISPR gRNA sequence
ccgccgcaatgctaaatgtg

SEQ ID NO: 535961 - DNA, 20 bp, Artificial
  CRISPR gRNA sequence
cgccgcaatgctaaatgtga

SEQ ID NO: 535962 - DNA, 20 bp, Artificial
  CRISPR gRNA sequence
aatgtgacccaaatgtgaaa

SEQ ID NO: 535963 - DNA, 20 bp, Artificial
  CRISPR gRNA sequence
acactcaaaacaggacactc

SEQ ID NO: 535964 - DNA, 20 bp, Artificial
  CRISPR gRNA sequence
aaaacaggacactcgagttc

SEQ ID NO: 535965 - DNA, 20 bp, Artificial
  CRISPR gRNA sequence
gagttctgtgctgtttggag

SEQ ID NO: 535966 - DNA, 20 bp, Artificial
  CRISPR gRNA sequence
tgtgctgtttggagtcctga

SEQ ID NO: 535967 - DNA, 20 bp, Artificial
  CRISPR gRNA sequence
tgctgtttggagtcctgaga

SEQ ID NO: 535968 - DNA, 20 bp, Artificial
  CRISPR gRNA sequence
tttggagtcctgagatctgt

SEQ ID NO: 535969 - DNA, 20 bp, Artificial
  CRISPR gRNA sequence
ggagtcctgagatctgtggt

SEQ ID NO: 535970 - DNA, 20 bp, Artificial
  CRISPR gRNA sequence
gagtcctgagatctgtggtt

SEQ ID NO: 535971 - DNA, 20 bp, Artificial
  CRISPR gRNA sequence
agatctgtggtttccagagc

SEQ ID NO: 535972 - DNA, 20 bp, Artificial
  CRISPR gRNA sequence
tggtttccagagcccataat

SEQ ID NO: 535973 - DNA, 20 bp, Artificial
  CRISPR gRNA sequence
ccagagcccataatcagagg

SEQ ID NO: 535974 - DNA, 20 bp, Artificial
  CRISPR gRNA sequence
cagagcccataatcagaggc

SEQ ID NO: 535975 - DNA, 20 bp, Artificial
  CRISPR gRNA sequence
ttttcagcgccatgctcaac

SEQ ID NO: 535976 - DNA, 20 bp, Artificial
  CRISPR gRNA sequence
ttcagcgccatgctcaaccc

SEQ ID NO: 535977 - DNA, 20 bp, Artificial
  CRISPR gRNA sequence
tcagcgccatgctcaacccc

SEQ ID NO: 535978 - DNA, 20 bp, Artificial
  CRISPR gRNA sequence
cagcgccatgctcaacccca

SEQ ID NO: 535979 - DNA, 20 bp, Artificial
  CRISPR gRNA sequence
agcgccatgctcaaccccac

SEQ ID NO: 535980 - DNA, 20 bp, Artificial
  CRISPR gRNA sequence
aaccccactacatttctaca

SEQ ID NO: 535981 - DNA, 20 bp, Artificial
  CRISPR gRNA sequence
catttctacaaggtgctctc

SEQ ID NO: 535982 - DNA, 20 bp, Artificial
  CRISPR gRNA sequence
ctacaaggtgctctccactc

SEQ ID NO: 535983 - DNA, 20 bp, Artificial
  CRISPR gRNA sequence
tacaaggtgctctccactca

SEQ ID NO: 535984 - DNA, 20 bp, Artificial
  CRISPR gRNA sequence
caaggtgctctccactcaag

SEQ ID NO: 535985 - DNA, 20 bp, Artificial
  CRISPR gRNA sequence
tccactcaaggttgcaggac

SEQ ID NO: 535986 - DNA, 20 bp, Artificial
  CRISPR gRNA sequence
cactcaaggttgcaggacta

SEQ ID NO: 535987 - DNA, 20 bp, Artificial
  CRISPR gRNA sequence
aaggttgcaggactagggtg

SEQ ID NO: 535988 - DNA, 20 bp, Artificial
  CRISPR gRNA sequence
caggactagggtgtggaaag

SEQ ID NO: 535989 - DNA, 20 bp, Artificial
  CRISPR gRNA sequence
gggtgtggaaagttgtcact

SEQ ID NO: 535990 - DNA, 20 bp, Artificial
  CRISPR gRNA sequence
tcacttcaggggagctgaca

SEQ ID NO: 535991 - DNA, 20 bp, Artificial
  CRISPR gRNA sequence
caggggagctgacagtgtct

SEQ ID NO: 535992 - DNA, 20 bp, Artificial
  CRISPR gRNA sequence
aggggagctgacagtgtctg

SEQ ID NO: 535993 - DNA, 20 bp, Artificial
  CRISPR gRNA sequence
acagtgtctgggattgctgg

SEQ ID NO: 535994 - DNA, 20 bp, Artificial
  CRISPR gRNA sequence
ggattgctggagtgggcaat

SEQ ID NO: 535995 - DNA, 20 bp, Artificial
  CRISPR gRNA sequence
ctggagtgggcaatctgaca

SEQ ID NO: 535996 - DNA, 20 bp, Artificial
  CRISPR gRNA sequence
gagtgggcaatctgacacta

SEQ ID NO: 535997 - DNA, 20 bp, Artificial
  CRISPR gRNA sequence
acactatctgggattgctgg

SEQ ID NO: 535998 - DNA, 20 bp, Artificial
  CRISPR gRNA sequence
tctgggattgctggtaggcc

SEQ ID NO: 535999 - DNA, 20 bp, Artificial
  CRISPR gRNA sequence
ggattgctggtaggcccagg

SEQ ID NO: 536000 - DNA, 20 bp, Artificial
  CRISPR gRNA sequence
ctggtaggcccaggtgctga

SEQ ID NO: 536001 - DNA, 20 bp, Artificial
  CRISPR gRNA sequence
gtaggcccaggtgctgaaga

SEQ ID NO: 536002 - DNA, 20 bp, Artificial
  CRISPR gRNA sequence
aagatggggctggagacaga

SEQ ID NO: 536003 - DNA, 20 bp, Artificial
  CRISPR gRNA sequence
gagacagagaggaagaaggt

SEQ ID NO: 536004 - DNA, 20 bp, Artificial
  CRISPR gRNA sequence
cttctggcgacattttctgt

SEQ ID NO: 536005 - DNA, 20 bp, Artificial
  CRISPR gRNA sequence
ctggcgacattttctgtgtg

SEQ ID NO: 536006 - DNA, 20 bp, Artificial
  CRISPR gRNA sequence
tggcgacattttctgtgtga

SEQ ID NO: 536007 - DNA, 20 bp, Artificial
  CRISPR gRNA sequence
gcgacattttctgtgtgaag

SEQ ID NO: 536008 - DNA, 20 bp, Artificial
  CRISPR gRNA sequence
tctgtgtgaagcacagaaat

SEQ ID NO: 536009 - DNA, 20 bp, Artificial
  CRISPR gRNA sequence
ctgtgtgaagcacagaaatg

SEQ ID NO: 536010 - DNA, 20 bp, Artificial
  CRISPR gRNA sequence
tgtgtgaagcacagaaatgc

SEQ ID NO: 536011 - DNA, 20 bp, Artificial
  CRISPR gRNA sequence
tgtgaagcacagaaatgctt

SEQ ID NO: 536012 - DNA, 20 bp, Artificial
  CRISPR gRNA sequence
atttgctcactgaatggctg

SEQ ID NO: 536013 - DNA, 20 bp, Artificial
  CRISPR gRNA sequence
tttgctcactgaatggctgg

SEQ ID NO: 536014 - DNA, 20 bp, Artificial
  CRISPR gRNA sequence
gctcactgaatggctggcct

SEQ ID NO: 536015 - DNA, 20 bp, Artificial
  CRISPR gRNA sequence
ctcactgaatggctggcctg

SEQ ID NO: 536016 - DNA, 20 bp, Artificial
  CRISPR gRNA sequence
actgaatggctggcctgtgc

SEQ ID NO: 536017 - DNA, 20 bp, Artificial
  CRISPR gRNA sequence
aatggctggcctgtgctcat

SEQ ID NO: 536018 - DNA, 20 bp, Artificial
  CRISPR gRNA sequence
gcctgtgctcatgctggggt

SEQ ID NO: 536019 - DNA, 20 bp, Artificial
  CRISPR gRNA sequence
tgctcatgctggggttcctg

SEQ ID NO: 536020 - DNA, 20 bp, Artificial
  CRISPR gRNA sequence
atgctggggttcctgtcttc

SEQ ID NO: 536021 - DNA, 20 bp, Artificial
  CRISPR gRNA sequence
gggttcctgtcttcctcccc

SEQ ID NO: 536022 - DNA, 20 bp, Artificial
  CRISPR gRNA sequence
ctgtcttcctccccaagcca

SEQ ID NO: 536023 - DNA, 20 bp, Artificial
  CRISPR gRNA sequence
tcttcctccccaagccagct

SEQ ID NO: 536024 - DNA, 20 bp, Artificial
  CRISPR gRNA sequence
cctccccaagccagcttcct

SEQ ID NO: 536025 - DNA, 20 bp, Artificial
  CRISPR gRNA sequence
ctccccaagccagcttcctc

SEQ ID NO: 536026 - DNA, 20 bp, Artificial
  CRISPR gRNA sequence
cccaagccagcttcctcttt

SEQ ID NO: 536027 - DNA, 20 bp, Artificial
  CRISPR gRNA sequence
cctcttttcccttcttatca

SEQ ID NO: 536028 - DNA, 20 bp, Artificial
  CRISPR gRNA sequence
ctcttttcccttcttatcac

SEQ ID NO: 536029 - DNA, 20 bp, Artificial
  CRISPR gRNA sequence
ttttcccttcttatcactcc

SEQ ID NO: 536030 - DNA, 20 bp, Artificial
  CRISPR gRNA sequence
ttcccttcttatcactccct

SEQ ID NO: 536031 - DNA, 20 bp, Artificial
  CRISPR gRNA sequence
tcccttcttatcactccctg

SEQ ID NO: 536032 - DNA, 20 bp, Artificial
  CRISPR gRNA sequence
cccttcttatcactccctgc

SEQ ID NO: 536033 - DNA, 20 bp, Artificial
  CRISPR gRNA sequence
ccttcttatcactccctgcc

SEQ ID NO: 536034 - DNA, 20 bp, Artificial
  CRISPR gRNA sequence
cttatcactccctgcccagc

SEQ ID NO: 536035 - DNA, 20 bp, Artificial
  CRISPR gRNA sequence
ttatcactccctgcccagca

SEQ ID NO: 536036 - DNA, 20 bp, Artificial
  CRISPR gRNA sequence
atcactccctgcccagcatc

SEQ ID NO: 536037 - DNA, 20 bp, Artificial
  CRISPR gRNA sequence
tcactccctgcccagcatcc

SEQ ID NO: 536038 - DNA, 20 bp, Artificial
  CRISPR gRNA sequence
cctgcccagcatccgtgggc

SEQ ID NO: 536039 - DNA, 20 bp, Artificial
  CRISPR gRNA sequence
cccagcatccgtgggctttc

SEQ ID NO: 536040 - DNA, 20 bp, Artificial
  CRISPR gRNA sequence
tcaactccaatcattgtaca

SEQ ID NO: 536041 - DNA, 20 bp, Artificial
  CRISPR gRNA sequence
caactccaatcattgtacaa

SEQ ID NO: 536042 - DNA, 20 bp, Artificial
  CRISPR gRNA sequence
aactccaatcattgtacaag

SEQ ID NO: 536043 - DNA, 20 bp, Artificial
  CRISPR gRNA sequence
caatcattgtacaagctgat

SEQ ID NO: 536044 - DNA, 20 bp, Artificial
  CRISPR gRNA sequence
tacaagctgataaaatattt

SEQ ID NO: 536045 - DNA, 20 bp, Artificial
  CRISPR gRNA sequence
ataaaatatttttaaaagtt

SEQ ID NO: 536046 - DNA, 20 bp, Artificial
  CRISPR gRNA sequence
ttaaaagtttaaagcagatt

SEQ ID NO: 536047 - DNA, 20 bp, Artificial
  CRISPR gRNA sequence
taaaagtttaaagcagatta

SEQ ID NO: 536048 - DNA, 20 bp, Artificial
  CRISPR gRNA sequence
aaaagtttaaagcagattaa

SEQ ID NO: 536049 - DNA, 20 bp, Artificial
  CRISPR gRNA sequence
aaagtttaaagcagattaaa

SEQ ID NO: 536050 - DNA, 20 bp, Artificial
  CRISPR gRNA sequence
aaagcagattaaaaattacc

SEQ ID NO: 536051 - DNA, 20 bp, Artificial
  CRISPR gRNA sequence
aagcagattaaaaattaccc

SEQ ID NO: 536052 - DNA, 20 bp, Artificial
  CRISPR gRNA sequence
aaaattacccacaacgccac

SEQ ID NO: 536053 - DNA, 20 bp, Artificial
  CRISPR gRNA sequence
cccacaacgccaccactcaa

SEQ ID NO: 536054 - DNA, 20 bp, Artificial
  CRISPR gRNA sequence
aaagtcaataatgaataata

SEQ ID NO: 536055 - DNA, 20 bp, Artificial
  CRISPR gRNA sequence
tcatgtatatctttagcaga

SEQ ID NO: 536056 - DNA, 20 bp, Artificial
  CRISPR gRNA sequence
catgtatatctttagcagat

SEQ ID NO: 536057 - DNA, 20 bp, Artificial
  CRISPR gRNA sequence
atgtatatctttagcagata

SEQ ID NO: 536058 - DNA, 20 bp, Artificial
  CRISPR gRNA sequence
tagcagatattttctattta

SEQ ID NO: 536059 - DNA, 20 bp, Artificial
  CRISPR gRNA sequence
agcagatattttctatttat

SEQ ID NO: 536060 - DNA, 20 bp, Artificial
  CRISPR gRNA sequence
gcagatattttctatttata

SEQ ID NO: 536061 - DNA, 20 bp, Artificial
  CRISPR gRNA sequence
tctatttatatgtatatata

SEQ ID NO: 536062 - DNA, 20 bp, Artificial
  CRISPR gRNA sequence
ctatttatatgtatatatat

SEQ ID NO: 536063 - DNA, 20 bp, Artificial
  CRISPR gRNA sequence
tatttatatgtatatatata

SEQ ID NO: 536064 - DNA, 20 bp, Artificial
  CRISPR gRNA sequence
tttatatgtatatatataaa

SEQ ID NO: 536065 - DNA, 20 bp, Artificial
  CRISPR gRNA sequence
atatgtatatatataaataa

SEQ ID NO: 536066 - DNA, 20 bp, Artificial
  CRISPR gRNA sequence
tatgtatatatataaataat

SEQ ID NO: 536067 - DNA, 20 bp, Artificial
  CRISPR gRNA sequence
cagctgggagaggtggctca

SEQ ID NO: 536068 - DNA, 20 bp, Artificial
  CRISPR gRNA sequence
agctgggagaggtggctcat

SEQ ID NO: 536069 - DNA, 20 bp, Artificial
  CRISPR gRNA sequence
ggagaggtggctcatgcctg

SEQ ID NO: 536070 - DNA, 20 bp, Artificial
  CRISPR gRNA sequence
atgcctgtaatccagcactt

SEQ ID NO: 536071 - DNA, 20 bp, Artificial
  CRISPR gRNA sequence
taatccagcactttgggagg

SEQ ID NO: 536072 - DNA, 20 bp, Artificial
  CRISPR gRNA sequence
tgggaggctaaggtgggcgg

SEQ ID NO: 536073 - DNA, 20 bp, Artificial
  CRISPR gRNA sequence
gggaggctaaggtgggcgga

SEQ ID NO: 536074 - DNA, 20 bp, Artificial
  CRISPR gRNA sequence
ggaggctaaggtgggcggat

SEQ ID NO: 536075 - DNA, 20 bp, Artificial
  CRISPR gRNA sequence
aggtgggcggatctcttgag

SEQ ID NO: 536076 - DNA, 20 bp, Artificial
  CRISPR gRNA sequence
ttgaggccaggagttcaaga

SEQ ID NO: 536077 - DNA, 20 bp, Artificial
  CRISPR gRNA sequence
gaggccaggagttcaagagt

SEQ ID NO: 536078 - DNA, 20 bp, Artificial
  CRISPR gRNA sequence
aggccaggagttcaagagta

SEQ ID NO: 536079 - DNA, 20 bp, Artificial
  CRISPR gRNA sequence
aagagtagcctggccaacat

SEQ ID NO: 536080 - DNA, 20 bp, Artificial
  CRISPR gRNA sequence
gccaacatggtgaaatacat

SEQ ID NO: 536081 - DNA, 20 bp, Artificial
  CRISPR gRNA sequence
tactaaaaatatgaagatta

SEQ ID NO: 536082 - DNA, 20 bp, Artificial
  CRISPR gRNA sequence
ctaaaaatatgaagattagc

SEQ ID NO: 536083 - DNA, 20 bp, Artificial
  CRISPR gRNA sequence
aaaatatgaagattagccag

SEQ ID NO: 536084 - DNA, 20 bp, Artificial
  CRISPR gRNA sequence
gccaggtgtgttggcatgcg

SEQ ID NO: 536085 - DNA, 20 bp, Artificial
  CRISPR gRNA sequence
gcatgcgcctctaatccaaa

SEQ ID NO: 536086 - DNA, 20 bp, Artificial
  CRISPR gRNA sequence
taatccaaactactcaggag

SEQ ID NO: 536087 - DNA, 20 bp, Artificial
  CRISPR gRNA sequence
atccaaactactcaggaggc

SEQ ID NO: 536088 - DNA, 20 bp, Artificial
  CRISPR gRNA sequence
ctcaggaggctgaggcatga

SEQ ID NO: 536089 - DNA, 20 bp, Artificial
  CRISPR gRNA sequence
aggaggctgaggcatgagaa

SEQ ID NO: 536090 - DNA, 20 bp, Artificial
  CRISPR gRNA sequence
aggcatgagaattgcttgaa

SEQ ID NO: 536091 - DNA, 20 bp, Artificial
  CRISPR gRNA sequence
cttgaacccaagaggcagag

SEQ ID NO: 536092 - DNA, 20 bp, Artificial
  CRISPR gRNA sequence
gaacccaagaggcagaggct

SEQ ID NO: 536093 - DNA, 20 bp, Artificial
  CRISPR gRNA sequence
aacccaagaggcagaggctg

SEQ ID NO: 536094 - DNA, 20 bp, Artificial
  CRISPR gRNA sequence
cagtgagccaatatttcacc

SEQ ID NO: 536095 - DNA, 20 bp, Artificial
  CRISPR gRNA sequence
caccactgcactccaggctg

SEQ ID NO: 536096 - DNA, 20 bp, Artificial
  CRISPR gRNA sequence
accactgcactccaggctgg

SEQ ID NO: 536097 - DNA, 20 bp, Artificial
  CRISPR gRNA sequence
cactccaggctggacgacag

SEQ ID NO: 536098 - DNA, 20 bp, Artificial
  CRISPR gRNA sequence
caggctggacgacagagtga

SEQ ID NO: 536099 - DNA, 20 bp, Artificial
  CRISPR gRNA sequence
gacgacagagtgagaccctg

SEQ ID NO: 536100 - DNA, 20 bp, Artificial
  CRISPR gRNA sequence
tctctttctgtctgcctctc

SEQ ID NO: 536101 - DNA, 20 bp, Artificial
  CRISPR gRNA sequence
tttctgtctgcctctctctc

SEQ ID NO: 536102 - DNA, 20 bp, Artificial
  CRISPR gRNA sequence
tctgtctgcctctctctctc

SEQ ID NO: 536103 - DNA, 20 bp, Artificial
  CRISPR gRNA sequence
ctgtctgcctctctctctct

SEQ ID NO: 536104 - DNA, 20 bp, Artificial
  CRISPR gRNA sequence
tgtctgcctctctctctctc

SEQ ID NO: 536105 - DNA, 20 bp, Artificial
  CRISPR gRNA sequence
tctgcctctctctctctctc

SEQ ID NO: 536106 - DNA, 20 bp, Artificial
  CRISPR gRNA sequence
cctctctctctctctctctc

SEQ ID NO: 536107 - DNA, 20 bp, Artificial
  CRISPR gRNA sequence
tctctctctctctctctctc

SEQ ID NO: 536108 - DNA, 20 bp, Artificial
  CRISPR gRNA sequence
tctctctctctctctctcta

SEQ ID NO: 536109 - DNA, 20 bp, Artificial
  CRISPR gRNA sequence
tctctctctctctctctata

SEQ ID NO: 536110 - DNA, 20 bp, Artificial
  CRISPR gRNA sequence
tctctctctctctctatata

SEQ ID NO: 536111 - DNA, 20 bp, Artificial
  CRISPR gRNA sequence
tctctctctctctatatata

SEQ ID NO: 536112 - DNA, 20 bp, Artificial
  CRISPR gRNA sequence
tctctctctctatatatata

SEQ ID NO: 536113 - DNA, 20 bp, Artificial
  CRISPR gRNA sequence
tctctctctatatatatata

SEQ ID NO: 536114 - DNA, 20 bp, Artificial
  CRISPR gRNA sequence
tctctctatatatatatatg

SEQ ID NO: 536115 - DNA, 20 bp, Artificial
  CRISPR gRNA sequence
tctctatatatatatatgta

SEQ ID NO: 536116 - DNA, 20 bp, Artificial
  CRISPR gRNA sequence
tctatatatatatatgtaat

SEQ ID NO: 536117 - DNA, 20 bp, Artificial
  CRISPR gRNA sequence
tatatatatatatgtaatat

SEQ ID NO: 536118 - DNA, 20 bp, Artificial
  CRISPR gRNA sequence
tatatatatatgtaatattt

SEQ ID NO: 536119 - DNA, 20 bp, Artificial
  CRISPR gRNA sequence
taaaaattaaaactaattta

SEQ ID NO: 536120 - DNA, 20 bp, Artificial
  CRISPR gRNA sequence
aaaaattaaaactaatttat

SEQ ID NO: 536121 - DNA, 20 bp, Artificial
  CRISPR gRNA sequence
aaaattaaaactaatttatg

SEQ ID NO: 536122 - DNA, 20 bp, Artificial
  CRISPR gRNA sequence
aaactaatttatgtgatctt

SEQ ID NO: 536123 - DNA, 20 bp, Artificial
  CRISPR gRNA sequence
atttatgtgatcttacagtc

SEQ ID NO: 536124 - DNA, 20 bp, Artificial
  CRISPR gRNA sequence
atgtgatcttacagtctgcc

SEQ ID NO: 536125 - DNA, 20 bp, Artificial
  CRISPR gRNA sequence
tgtgatcttacagtctgcct

SEQ ID NO: 536126 - DNA, 20 bp, Artificial
  CRISPR gRNA sequence
acagtctgccttttcccctt

SEQ ID NO: 536127 - DNA, 20 bp, Artificial
  CRISPR gRNA sequence
cagtctgccttttccccttt

SEQ ID NO: 536128 - DNA, 20 bp, Artificial
  CRISPR gRNA sequence
ccttttcccctttattgtga

SEQ ID NO: 536129 - DNA, 20 bp, Artificial
  CRISPR gRNA sequence
ttcccctttattgtgaaatt

SEQ ID NO: 536130 - DNA, 20 bp, Artificial
  CRISPR gRNA sequence
tcccctttattgtgaaatta

SEQ ID NO: 536131 - DNA, 20 bp, Artificial
  CRISPR gRNA sequence
cccctttattgtgaaattat

SEQ ID NO: 536132 - DNA, 20 bp, Artificial
  CRISPR gRNA sequence
ccctttattgtgaaattata

SEQ ID NO: 536133 - DNA, 20 bp, Artificial
  CRISPR gRNA sequence
tattgtgaaattatattatg

SEQ ID NO: 536134 - DNA, 20 bp, Artificial
  CRISPR gRNA sequence
attgtgaaattatattatga

SEQ ID NO: 536135 - DNA, 20 bp, Artificial
  CRISPR gRNA sequence
ttgtgaaattatattatgaa

SEQ ID NO: 536136 - DNA, 20 bp, Artificial
  CRISPR gRNA sequence
tgaaattatattatgaagtt

SEQ ID NO: 536137 - DNA, 20 bp, Artificial
  CRISPR gRNA sequence
tattatgaagttcttttctt

SEQ ID NO: 536138 - DNA, 20 bp, Artificial
  CRISPR gRNA sequence
tgaagttcttttcttaatga

SEQ ID NO: 536139 - DNA, 20 bp, Artificial
  CRISPR gRNA sequence
ttttcttaatgaacatcaat

SEQ ID NO: 536140 - DNA, 20 bp, Artificial
  CRISPR gRNA sequence
ttcttaatgaacatcaataa

SEQ ID NO: 536141 - DNA, 20 bp, Artificial
  CRISPR gRNA sequence
tcttaatgaacatcaataaa

SEQ ID NO: 536142 - DNA, 20 bp, Artificial
  CRISPR gRNA sequence
cttaatgaacatcaataaat

SEQ ID NO: 536143 - DNA, 20 bp, Artificial
  CRISPR gRNA sequence
ttaatgaacatcaataaatg

SEQ ID NO: 536144 - DNA, 20 bp, Artificial
  CRISPR gRNA sequence
aatgaacatcaataaatgca

SEQ ID NO: 536145 - DNA, 20 bp, Artificial
  CRISPR gRNA sequence
atgaacatcaataaatgcat

SEQ ID NO: 536146 - DNA, 20 bp, Artificial
  CRISPR gRNA sequence
tttaaaggatgcattcttaa

SEQ ID NO: 536147 - DNA, 20 bp, Artificial
  CRISPR gRNA sequence
ttaaaggatgcattcttaat

SEQ ID NO: 536148 - DNA, 20 bp, Artificial
  CRISPR gRNA sequence
taaaggatgcattcttaatt

SEQ ID NO: 536149 - DNA, 20 bp, Artificial
  CRISPR gRNA sequence
aaaggatgcattcttaattt

SEQ ID NO: 536150 - DNA, 20 bp, Artificial
  CRISPR gRNA sequence
aaggatgcattcttaattta

SEQ ID NO: 536151 - DNA, 20 bp, Artificial
  CRISPR gRNA sequence
ttaatttaactgattaataa

SEQ ID NO: 536152 - DNA, 20 bp, Artificial
  CRISPR gRNA sequence
aatttaactgattaataagt

SEQ ID NO: 536153 - DNA, 20 bp, Artificial
  CRISPR gRNA sequence
atttaactgattaataagtt

SEQ ID NO: 536154 - DNA, 20 bp, Artificial
  CRISPR gRNA sequence
aactgattaataagtttcta

SEQ ID NO: 536155 - DNA, 20 bp, Artificial
  CRISPR gRNA sequence
actgattaataagtttctaa

SEQ ID NO: 536156 - DNA, 20 bp, Artificial
  CRISPR gRNA sequence
attaataagtttctaactgc

SEQ ID NO: 536157 - DNA, 20 bp, Artificial
  CRISPR gRNA sequence
ataagtttctaactgctgac

SEQ ID NO: 536158 - DNA, 20 bp, Artificial
  CRISPR gRNA sequence
ctaactgctgactgttctag

SEQ ID NO: 536159 - DNA, 20 bp, Artificial
  CRISPR gRNA sequence
taactgctgactgttctagt

SEQ ID NO: 536160 - DNA, 20 bp, Artificial
  CRISPR gRNA sequence
actgctgactgttctagtat

SEQ ID NO: 536161 - DNA, 20 bp, Artificial
  CRISPR gRNA sequence
ctgactgttctagtatttcg

SEQ ID NO: 536162 - DNA, 20 bp, Artificial
  CRISPR gRNA sequence
actgttctagtatttcgcta

SEQ ID NO: 536163 - DNA, 20 bp, Artificial
  CRISPR gRNA sequence
ttctagtatttcgctaacat

SEQ ID NO: 536164 - DNA, 20 bp, Artificial
  CRISPR gRNA sequence
tagtatttcgctaacatgaa

SEQ ID NO: 536165 - DNA, 20 bp, Artificial
  CRISPR gRNA sequence
gtatttcgctaacatgaata

SEQ ID NO: 536166 - DNA, 20 bp, Artificial
  CRISPR gRNA sequence
cgctaacatgaataatgcag

SEQ ID NO: 536167 - DNA, 20 bp, Artificial
  CRISPR gRNA sequence
gctaacatgaataatgcagt

SEQ ID NO: 536168 - DNA, 20 bp, Artificial
  CRISPR gRNA sequence
acatgaataatgcagtgatg

SEQ ID NO: 536169 - DNA, 20 bp, Artificial
  CRISPR gRNA sequence
gtggagtagtacctccgtat

SEQ ID NO: 536170 - DNA, 20 bp, Artificial
  CRISPR gRNA sequence
tggagtagtacctccgtata

SEQ ID NO: 536171 - DNA, 20 bp, Artificial
  CRISPR gRNA sequence
cgtatacattcactaagata

SEQ ID NO: 536172 - DNA, 20 bp, Artificial
  CRISPR gRNA sequence
actaagatagcgtcttagaa

SEQ ID NO: 536173 - DNA, 20 bp, Artificial
  CRISPR gRNA sequence
agatagcgtcttagaactga

SEQ ID NO: 536174 - DNA, 20 bp, Artificial
  CRISPR gRNA sequence
agaactgatccaacctaagg

SEQ ID NO: 536175 - DNA, 20 bp, Artificial
  CRISPR gRNA sequence
gaactgatccaacctaaggc

SEQ ID NO: 536176 - DNA, 20 bp, Artificial
  CRISPR gRNA sequence
atccaacctaaggccttcca

SEQ ID NO: 536177 - DNA, 20 bp, Artificial
  CRISPR gRNA sequence
aggccttccatggatgagaa

SEQ ID NO: 536178 - DNA, 20 bp, Artificial
  CRISPR gRNA sequence
ccatggatgagaactcctta

SEQ ID NO: 536179 - DNA, 20 bp, Artificial
  CRISPR gRNA sequence
catggatgagaactccttaa

SEQ ID NO: 536180 - DNA, 20 bp, Artificial
  CRISPR gRNA sequence
cttaattctgagttgctggg

SEQ ID NO: 536181 - DNA, 20 bp, Artificial
  CRISPR gRNA sequence
aattctgagttgctgggatt

SEQ ID NO: 536182 - DNA, 20 bp, Artificial
  CRISPR gRNA sequence
attctgagttgctgggatta

SEQ ID NO: 536183 - DNA, 20 bp, Artificial
  CRISPR gRNA sequence
tgagttgctgggattaaccc

SEQ ID NO: 536184 - DNA, 20 bp, Artificial
  CRISPR gRNA sequence
agttgctgggattaacccct

SEQ ID NO: 536185 - DNA, 20 bp, Artificial
  CRISPR gRNA sequence
ctgggattaaccccttccct

SEQ ID NO: 536186 - DNA, 20 bp, Artificial
  CRISPR gRNA sequence
ggattaaccccttccctact

SEQ ID NO: 536187 - DNA, 20 bp, Artificial
  CRISPR gRNA sequence
accccttccctactagcatc

SEQ ID NO: 536188 - DNA, 20 bp, Artificial
  CRISPR gRNA sequence
ccctactagcatctgcttct

SEQ ID NO: 536189 - DNA, 20 bp, Artificial
  CRISPR gRNA sequence
cctactagcatctgcttcta

SEQ ID NO: 536190 - DNA, 20 bp, Artificial
  CRISPR gRNA sequence
ctagcatctgcttctaaggg

SEQ ID NO: 536191 - DNA, 20 bp, Artificial
  CRISPR gRNA sequence
gcatctgcttctaaggggcc

SEQ ID NO: 536192 - DNA, 20 bp, Artificial
  CRISPR gRNA sequence
cttctaaggggccctccatt

SEQ ID NO: 536193 - DNA, 20 bp, Artificial
  CRISPR gRNA sequence
ctaaggggccctccattgcc

SEQ ID NO: 536194 - DNA, 20 bp, Artificial
  CRISPR gRNA sequence
taaggggccctccattgcct

SEQ ID NO: 536195 - DNA, 20 bp, Artificial
  CRISPR gRNA sequence
aggggccctccattgcctct

SEQ ID NO: 536196 - DNA, 20 bp, Artificial
  CRISPR gRNA sequence
cattgcctcttcagcctgca

SEQ ID NO: 536197 - DNA, 20 bp, Artificial
  CRISPR gRNA sequence
cctcttcagcctgcagcagc

SEQ ID NO: 536198 - DNA, 20 bp, Artificial
  CRISPR gRNA sequence
ttcagcctgcagcagcaact

SEQ ID NO: 536199 - DNA, 20 bp, Artificial
  CRISPR gRNA sequence
cagcctgcagcagcaactcc

SEQ ID NO: 536200 - DNA, 20 bp, Artificial
  CRISPR gRNA sequence
agcctgcagcagcaactccc

SEQ ID NO: 536201 - DNA, 20 bp, Artificial
  CRISPR gRNA sequence
cagcagcaactccctcatga

SEQ ID NO: 536202 - DNA, 20 bp, Artificial
  CRISPR gRNA sequence
cctcatgaaggaaatgcagg

SEQ ID NO: 536203 - DNA, 20 bp, Artificial
  CRISPR gRNA sequence
atgaaggaaatgcaggcaca

SEQ ID NO: 536204 - DNA, 20 bp, Artificial
  CRISPR gRNA sequence
ctggagtttgagaagtttgg

SEQ ID NO: 536205 - DNA, 20 bp, Artificial
  CRISPR gRNA sequence
gagtttgagaagtttggagg

SEQ ID NO: 536206 - DNA, 20 bp, Artificial
  CRISPR gRNA sequence
gagaagtttggaggccgggt

SEQ ID NO: 536207 - DNA, 20 bp, Artificial
  CRISPR gRNA sequence
agaagtttggaggccgggtg

SEQ ID NO: 536208 - DNA, 20 bp, Artificial
  CRISPR gRNA sequence
ggaggccgggtgcgtggttc

SEQ ID NO: 536209 - DNA, 20 bp, Artificial
  CRISPR gRNA sequence
gaggccgggtgcgtggttca

SEQ ID NO: 536210 - DNA, 20 bp, Artificial
  CRISPR gRNA sequence
acacctgtaatcccagcact

SEQ ID NO: 536211 - DNA, 20 bp, Artificial
  CRISPR gRNA sequence
taatcccagcactttgggag

SEQ ID NO: 536212 - DNA, 20 bp, Artificial
  CRISPR gRNA sequence
tgggaggccgatgcaggcgg

SEQ ID NO: 536213 - DNA, 20 bp, Artificial
  CRISPR gRNA sequence
gggaggccgatgcaggcgga

SEQ ID NO: 536214 - DNA, 20 bp, Artificial
  CRISPR gRNA sequence
ggaggccgatgcaggcggat

SEQ ID NO: 536215 - DNA, 20 bp, Artificial
  CRISPR gRNA sequence
aggtcaggagtttgagacca

SEQ ID NO: 536216 - DNA, 20 bp, Artificial
  CRISPR gRNA sequence
gagaccagcctgaccaacat

SEQ ID NO: 536217 - DNA, 20 bp, Artificial
  CRISPR gRNA sequence
agaccagcctgaccaacatg

SEQ ID NO: 536218 - DNA, 20 bp, Artificial
  CRISPR gRNA sequence
accaacatggcgaaaccccg

SEQ ID NO: 536219 - DNA, 20 bp, Artificial
  CRISPR gRNA sequence
tactaaaaatacaaaaatta

SEQ ID NO: 536220 - DNA, 20 bp, Artificial
  CRISPR gRNA sequence
ctaaaaatacaaaaattagc

SEQ ID NO: 536221 - DNA, 20 bp, Artificial
  CRISPR gRNA sequence
aaaatacaaaaattagccgg

SEQ ID NO: 536222 - DNA, 20 bp, Artificial
  CRISPR gRNA sequence
gccggacgtggtggtacatg

SEQ ID NO: 536223 - DNA, 20 bp, Artificial
  CRISPR gRNA sequence
taatcccagctacttgggag

SEQ ID NO: 536224 - DNA, 20 bp, Artificial
  CRISPR gRNA sequence
cttgggaggctgaggcagga

SEQ ID NO: 536225 - DNA, 20 bp, Artificial
  CRISPR gRNA sequence
gggaggctgaggcaggagaa

SEQ ID NO: 536226 - DNA, 20 bp, Artificial
  CRISPR gRNA sequence
ggaggctgaggcaggagaat

SEQ ID NO: 536227 - DNA, 20 bp, Artificial
  CRISPR gRNA sequence
aggcaggagaatcgcttgaa

SEQ ID NO: 536228 - DNA, 20 bp, Artificial
  CRISPR gRNA sequence
gaacctgggaggcagaggct

SEQ ID NO: 536229 - DNA, 20 bp, Artificial
  CRISPR gRNA sequence
aacctgggaggcagaggctg

SEQ ID NO: 536230 - DNA, 20 bp, Artificial
  CRISPR gRNA sequence
ggaggcagaggctgcagtga

SEQ ID NO: 536231 - DNA, 20 bp, Artificial
  CRISPR gRNA sequence
cagtgagctgagatcatgcc

SEQ ID NO: 536232 - DNA, 20 bp, Artificial
  CRISPR gRNA sequence
agatcatgccagtgcactcc

SEQ ID NO: 536233 - DNA, 20 bp, Artificial
  CRISPR gRNA sequence
cagcctgggcaacagagcaa

SEQ ID NO: 536234 - DNA, 20 bp, Artificial
  CRISPR gRNA sequence
ggcaacagagcaagatgcca

SEQ ID NO: 536235 - DNA, 20 bp, Artificial
  CRISPR gRNA sequence
aattaaaaaaaaaaaaaaaa

SEQ ID NO: 536236 - DNA, 20 bp, Artificial
  CRISPR gRNA sequence
aaaaaaaaaaaaaaaaaaga

SEQ ID NO: 536237 - DNA, 20 bp, Artificial
  CRISPR gRNA sequence
ggagaaacaaagagatgtgg

SEQ ID NO: 536238 - DNA, 20 bp, Artificial
  CRISPR gRNA sequence
gagaaacaaagagatgtggg

SEQ ID NO: 536239 - DNA, 20 bp, Artificial
  CRISPR gRNA sequence
gcactgagaaaacaggcatt

SEQ ID NO: 536240 - DNA, 20 bp, Artificial
  CRISPR gRNA sequence
agaaaacaggcattgtgccc

SEQ ID NO: 536241 - DNA, 20 bp, Artificial
  CRISPR gRNA sequence
tgccccaggcactgcaggac

SEQ ID NO: 536242 - DNA, 20 bp, Artificial
  CRISPR gRNA sequence
caggacacttgtacacacct

SEQ ID NO: 536243 - DNA, 20 bp, Artificial
  CRISPR gRNA sequence
gtacacaccttgtctcactg

SEQ ID NO: 536244 - DNA, 20 bp, Artificial
  CRISPR gRNA sequence
tacacaccttgtctcactga

SEQ ID NO: 536245 - DNA, 20 bp, Artificial
  CRISPR gRNA sequence
gtctcactgaatatcccttg

SEQ ID NO: 536246 - DNA, 20 bp, Artificial
  CRISPR gRNA sequence
tctcactgaatatcccttga

SEQ ID NO: 536247 - DNA, 20 bp, Artificial
  CRISPR gRNA sequence
actgaatatcccttgaagtt

SEQ ID NO: 536248 - DNA, 20 bp, Artificial
  CRISPR gRNA sequence
aatatcccttgaagttgtca

SEQ ID NO: 536249 - DNA, 20 bp, Artificial
  CRISPR gRNA sequence
gaagttgtcattggaaaagc

SEQ ID NO: 536250 - DNA, 20 bp, Artificial
  CRISPR gRNA sequence
aagttgtcattggaaaagca

SEQ ID NO: 536251 - DNA, 20 bp, Artificial
  CRISPR gRNA sequence
tcattggaaaagcagactca

SEQ ID NO: 536252 - DNA, 20 bp, Artificial
  CRISPR gRNA sequence
gaaaagcagactcacagcag

SEQ ID NO: 536253 - DNA, 20 bp, Artificial
  CRISPR gRNA sequence
acagcagatagggaatttgc

SEQ ID NO: 536254 - DNA, 20 bp, Artificial
  CRISPR gRNA sequence
gcccaaggccatggtcacct

SEQ ID NO: 536255 - DNA, 20 bp, Artificial
  CRISPR gRNA sequence
cccaaggccatggtcacctt

SEQ ID NO: 536256 - DNA, 20 bp, Artificial
  CRISPR gRNA sequence
aagtctggtaatagtgacca

SEQ ID NO: 536257 - DNA, 20 bp, Artificial
  CRISPR gRNA sequence
agtctggtaatagtgaccaa

SEQ ID NO: 536258 - DNA, 20 bp, Artificial
  CRISPR gRNA sequence
gtaatagtgaccaactacaa

SEQ ID NO: 536259 - DNA, 20 bp, Artificial
  CRISPR gRNA sequence
caagttgaatcaagatgttg

SEQ ID NO: 536260 - DNA, 20 bp, Artificial
  CRISPR gRNA sequence
aatcaagatgttgtatgaca

SEQ ID NO: 536261 - DNA, 20 bp, Artificial
  CRISPR gRNA sequence
tatgacattgacgtgcacac

SEQ ID NO: 536262 - DNA, 20 bp, Artificial
  CRISPR gRNA sequence
acgtgcacacacataaagca

SEQ ID NO: 536263 - DNA, 20 bp, Artificial
  CRISPR gRNA sequence
tctttcggctaaagggtgaa

SEQ ID NO: 536264 - DNA, 20 bp, Artificial
  CRISPR gRNA sequence
tcggctaaagggtgaagggt

SEQ ID NO: 536265 - DNA, 20 bp, Artificial
  CRISPR gRNA sequence
cggctaaagggtgaagggtt

SEQ ID NO: 536266 - DNA, 20 bp, Artificial
  CRISPR gRNA sequence
ggctaaagggtgaagggttt

SEQ ID NO: 536267 - DNA, 20 bp, Artificial
  CRISPR gRNA sequence
aagggtgaagggtttctttt

SEQ ID NO: 536268 - DNA, 20 bp, Artificial
  CRISPR gRNA sequence
ctttttggggcaatgaaaat

SEQ ID NO: 536269 - DNA, 20 bp, Artificial
  CRISPR gRNA sequence
tttttggggcaatgaaaatg

SEQ ID NO: 536270 - DNA, 20 bp, Artificial
  CRISPR gRNA sequence
tttggggcaatgaaaatgtt

SEQ ID NO: 536271 - DNA, 20 bp, Artificial
  CRISPR gRNA sequence
ttggggcaatgaaaatgttg

SEQ ID NO: 536272 - DNA, 20 bp, Artificial
  CRISPR gRNA sequence
tggggcaatgaaaatgttga

SEQ ID NO: 536273 - DNA, 20 bp, Artificial
  CRISPR gRNA sequence
ggggcaatgaaaatgttgat

SEQ ID NO: 536274 - DNA, 20 bp, Artificial
  CRISPR gRNA sequence
gggcaatgaaaatgttgatt

SEQ ID NO: 536275 - DNA, 20 bp, Artificial
  CRISPR gRNA sequence
attgtggtgatggttacaaa

SEQ ID NO: 536276 - DNA, 20 bp, Artificial
  CRISPR gRNA sequence
tggtgatggttacaaaactc

SEQ ID NO: 536277 - DNA, 20 bp, Artificial
  CRISPR gRNA sequence
caaaactctgaatatactga

SEQ ID NO: 536278 - DNA, 20 bp, Artificial
  CRISPR gRNA sequence
tgaatatactgaaggccatt

SEQ ID NO: 536279 - DNA, 20 bp, Artificial
  CRISPR gRNA sequence
aatatactgaaggccatttt

SEQ ID NO: 536280 - DNA, 20 bp, Artificial
  CRISPR gRNA sequence
aaggccattttagtatatgg

SEQ ID NO: 536281 - DNA, 20 bp, Artificial
  CRISPR gRNA sequence
tagtatatggacaaattgaa

SEQ ID NO: 536282 - DNA, 20 bp, Artificial
  CRISPR gRNA sequence
agtatatggacaaattgaat

SEQ ID NO: 536283 - DNA, 20 bp, Artificial
  CRISPR gRNA sequence
gtatatggacaaattgaatg

SEQ ID NO: 536284 - DNA, 20 bp, Artificial
  CRISPR gRNA sequence
aatggtagatgaattatctc

SEQ ID NO: 536285 - DNA, 20 bp, Artificial
  CRISPR gRNA sequence
tctcaatgaagctgcttgga

SEQ ID NO: 536286 - DNA, 20 bp, Artificial
  CRISPR gRNA sequence
aatgaagctgcttggaaaaa

SEQ ID NO: 536287 - DNA, 20 bp, Artificial
  CRISPR gRNA sequence
cttggaaaaaaaaagaaaag

SEQ ID NO: 536288 - DNA, 20 bp, Artificial
  CRISPR gRNA sequence
ggaaaaaaaaagaaaaggtc

SEQ ID NO: 536289 - DNA, 20 bp, Artificial
  CRISPR gRNA sequence
gaaaaaaaaagaaaaggtcg

SEQ ID NO: 536290 - DNA, 20 bp, Artificial
  CRISPR gRNA sequence
ttgccaaaaagacctctgag

SEQ ID NO: 536291 - DNA, 20 bp, Artificial
  CRISPR gRNA sequence
gccaaaaagacctctgagtt

SEQ ID NO: 536292 - DNA, 20 bp, Artificial
  CRISPR gRNA sequence
ccaaaaagacctctgagttt

SEQ ID NO: 536293 - DNA, 20 bp, Artificial
  CRISPR gRNA sequence
tgagtttgaatcctgacttt

SEQ ID NO: 536294 - DNA, 20 bp, Artificial
  CRISPR gRNA sequence
agtttgaatcctgactttgc

SEQ ID NO: 536295 - DNA, 20 bp, Artificial
  CRISPR gRNA sequence
gaatcctgactttgctcctg

SEQ ID NO: 536296 - DNA, 20 bp, Artificial
  CRISPR gRNA sequence
aatcctgactttgctcctgt

SEQ ID NO: 536297 - DNA, 20 bp, Artificial
  CRISPR gRNA sequence
actttgctcctgtcaagcaa

SEQ ID NO: 536298 - DNA, 20 bp, Artificial
  CRISPR gRNA sequence
tgctcctgtcaagcaatgag

SEQ ID NO: 536299 - DNA, 20 bp, Artificial
  CRISPR gRNA sequence
gctcctgtcaagcaatgaga

SEQ ID NO: 536300 - DNA, 20 bp, Artificial
  CRISPR gRNA sequence
ctcctgtcaagcaatgagac

SEQ ID NO: 536301 - DNA, 20 bp, Artificial
  CRISPR gRNA sequence
ctgtcaagcaatgagacctt

SEQ ID NO: 536302 - DNA, 20 bp, Artificial
  CRISPR gRNA sequence
tcaagcaatgagaccttgga

SEQ ID NO: 536303 - DNA, 20 bp, Artificial
  CRISPR gRNA sequence
ggacaagctgcttctgacta

SEQ ID NO: 536304 - DNA, 20 bp, Artificial
  CRISPR gRNA sequence
gacaagctgcttctgactag

SEQ ID NO: 536305 - DNA, 20 bp, Artificial
  CRISPR gRNA sequence
cttctgactaggtctctgtt

SEQ ID NO: 536306 - DNA, 20 bp, Artificial
  CRISPR gRNA sequence
ctgactaggtctctgttttc

SEQ ID NO: 536307 - DNA, 20 bp, Artificial
  CRISPR gRNA sequence
tgactaggtctctgttttct

SEQ ID NO: 536308 - DNA, 20 bp, Artificial
  CRISPR gRNA sequence
actaggtctctgttttctta

SEQ ID NO: 536309 - DNA, 20 bp, Artificial
  CRISPR gRNA sequence
ggtctctgttttcttatata

SEQ ID NO: 536310 - DNA, 20 bp, Artificial
  CRISPR gRNA sequence
tgttttcttatatataacaa

SEQ ID NO: 536311 - DNA, 20 bp, Artificial
  CRISPR gRNA sequence
ttttcttatatataacaagg

SEQ ID NO: 536312 - DNA, 20 bp, Artificial
  CRISPR gRNA sequence
tcttatatataacaaggaga

SEQ ID NO: 536313 - DNA, 20 bp, Artificial
  CRISPR gRNA sequence
cttatatataacaaggagat

SEQ ID NO: 536314 - DNA, 20 bp, Artificial
  CRISPR gRNA sequence
ttatatataacaaggagata

SEQ ID NO: 536315 - DNA, 20 bp, Artificial
  CRISPR gRNA sequence
atatataacaaggagataat

SEQ ID NO: 536316 - DNA, 20 bp, Artificial
  CRISPR gRNA sequence
tatataacaaggagataata

SEQ ID NO: 536317 - DNA, 20 bp, Artificial
  CRISPR gRNA sequence
ggtctcagtattgttgggcg

SEQ ID NO: 536318 - DNA, 20 bp, Artificial
  CRISPR gRNA sequence
agtattgttgggcgctttaa

SEQ ID NO: 536319 - DNA, 20 bp, Artificial
  CRISPR gRNA sequence
ttgggcgctttaaataagat

SEQ ID NO: 536320 - DNA, 20 bp, Artificial
  CRISPR gRNA sequence
ggcgctttaaataagatcat

SEQ ID NO: 536321 - DNA, 20 bp, Artificial
  CRISPR gRNA sequence
taaataagatcatgtaagca

SEQ ID NO: 536322 - DNA, 20 bp, Artificial
  CRISPR gRNA sequence
aaataagatcatgtaagcaa

SEQ ID NO: 536323 - DNA, 20 bp, Artificial
  CRISPR gRNA sequence
aataagatcatgtaagcaag

SEQ ID NO: 536324 - DNA, 20 bp, Artificial
  CRISPR gRNA sequence
gacccctaactggtagccat

SEQ ID NO: 536325 - DNA, 20 bp, Artificial
  CRISPR gRNA sequence
acccctaactggtagccatt

SEQ ID NO: 536326 - DNA, 20 bp, Artificial
  CRISPR gRNA sequence
actggtagccattatttccg

SEQ ID NO: 536327 - DNA, 20 bp, Artificial
  CRISPR gRNA sequence
gtagccattatttccgccgc

SEQ ID NO: 536328 - DNA, 20 bp, Artificial
  CRISPR gRNA sequence
tttccgccgcaatgctaaat

SEQ ID NO: 536329 - DNA, 20 bp, Artificial
  CRISPR gRNA sequence
ccgccgcaatgctaaatgcg

SEQ ID NO: 536330 - DNA, 20 bp, Artificial
  CRISPR gRNA sequence
cgccgcaatgctaaatgcga

SEQ ID NO: 536331 - DNA, 20 bp, Artificial
  CRISPR gRNA sequence
aatgcgacccaaatgtgaaa

SEQ ID NO: 536332 - DNA, 20 bp, Artificial
  CRISPR gRNA sequence
acactcaaaacaggacactc

SEQ ID NO: 536333 - DNA, 20 bp, Artificial
  CRISPR gRNA sequence
aaaacaggacactcgagttt

SEQ ID NO: 536334 - DNA, 20 bp, Artificial
  CRISPR gRNA sequence
gagttttgtgctgtttggag

SEQ ID NO: 536335 - DNA, 20 bp, Artificial
  CRISPR gRNA sequence
tgtgctgtttggagtcctga

SEQ ID NO: 536336 - DNA, 20 bp, Artificial
  CRISPR gRNA sequence
gtgctgtttggagtcctgag

SEQ ID NO: 536337 - DNA, 20 bp, Artificial
  CRISPR gRNA sequence
tgctgtttggagtcctgaga

SEQ ID NO: 536338 - DNA, 20 bp, Artificial
  CRISPR gRNA sequence
tttggagtcctgagatctgt

SEQ ID NO: 536339 - DNA, 20 bp, Artificial
  CRISPR gRNA sequence
ggagtcctgagatctgtggt

SEQ ID NO: 536340 - DNA, 20 bp, Artificial
  CRISPR gRNA sequence
gagtcctgagatctgtggtt

SEQ ID NO: 536341 - DNA, 20 bp, Artificial
  CRISPR gRNA sequence
agatctgtggtttccagagc

SEQ ID NO: 536342 - DNA, 20 bp, Artificial
  CRISPR gRNA sequence
tggtttccagagcccataat

SEQ ID NO: 536343 - DNA, 20 bp, Artificial
  CRISPR gRNA sequence
ccagagcccataatcagagg

SEQ ID NO: 536344 - DNA, 20 bp, Artificial
  CRISPR gRNA sequence
cagagcccataatcagaggc

SEQ ID NO: 536345 - DNA, 20 bp, Artificial
  CRISPR gRNA sequence
ttcagcgccatgctcaaccc

SEQ ID NO: 536346 - DNA, 20 bp, Artificial
  CRISPR gRNA sequence
tcagcgccatgctcaacccc

SEQ ID NO: 536347 - DNA, 20 bp, Artificial
  CRISPR gRNA sequence
cagcgccatgctcaacccca

SEQ ID NO: 536348 - DNA, 20 bp, Artificial
  CRISPR gRNA sequence
agcgccatgctcaaccccac

SEQ ID NO: 536349 - DNA, 20 bp, Artificial
  CRISPR gRNA sequence
aaccccactacatttctaca

SEQ ID NO: 536350 - DNA, 20 bp, Artificial
  CRISPR gRNA sequence
catttctacaaggtgctctc

SEQ ID NO: 536351 - DNA, 20 bp, Artificial
  CRISPR gRNA sequence
ctacaaggtgctctccactc

SEQ ID NO: 536352 - DNA, 20 bp, Artificial
  CRISPR gRNA sequence
tacaaggtgctctccactca

SEQ ID NO: 536353 - DNA, 20 bp, Artificial
  CRISPR gRNA sequence
caaggtgctctccactcaag

SEQ ID NO: 536354 - DNA, 20 bp, Artificial
  CRISPR gRNA sequence
tccactcaaggttgcaggac

SEQ ID NO: 536355 - DNA, 20 bp, Artificial
  CRISPR gRNA sequence
cactcaaggttgcaggacta

SEQ ID NO: 536356 - DNA, 20 bp, Artificial
  CRISPR gRNA sequence
aaggttgcaggactagggtg

SEQ ID NO: 536357 - DNA, 20 bp, Artificial
  CRISPR gRNA sequence
caggactagggtgtggaaag

SEQ ID NO: 536358 - DNA, 20 bp, Artificial
  CRISPR gRNA sequence
gggtgtggaaagttgtcact

SEQ ID NO: 536359 - DNA, 20 bp, Artificial
  CRISPR gRNA sequence
tcacttcaggggagctgaca

SEQ ID NO: 536360 - DNA, 20 bp, Artificial
  CRISPR gRNA sequence
caggggagctgacagtgtct

SEQ ID NO: 536361 - DNA, 20 bp, Artificial
  CRISPR gRNA sequence
aggggagctgacagtgtctg

SEQ ID NO: 536362 - DNA, 20 bp, Artificial
  CRISPR gRNA sequence
acagtgtctgggattgctgg

SEQ ID NO: 536363 - DNA, 20 bp, Artificial
  CRISPR gRNA sequence
ggattgctggagtgggcaat

SEQ ID NO: 536364 - DNA, 20 bp, Artificial
  CRISPR gRNA sequence
ctggagtgggcaatctgaca

SEQ ID NO: 536365 - DNA, 20 bp, Artificial
  CRISPR gRNA sequence
gagtgggcaatctgacacta

SEQ ID NO: 536366 - DNA, 20 bp, Artificial
  CRISPR gRNA sequence
acactatctgggattgctgg

SEQ ID NO: 536367 - DNA, 20 bp, Artificial
  CRISPR gRNA sequence
tctgggattgctggtaggcc

SEQ ID NO: 536368 - DNA, 20 bp, Artificial
  CRISPR gRNA sequence
ggattgctggtaggcccagg

SEQ ID NO: 536369 - DNA, 20 bp, Artificial
  CRISPR gRNA sequence
ctggtaggcccaggtgctga

SEQ ID NO: 536370 - DNA, 20 bp, Artificial
  CRISPR gRNA sequence
gtaggcccaggtgctgaaga

SEQ ID NO: 536371 - DNA, 20 bp, Artificial
  CRISPR gRNA sequence
aagatggggctggagacaga

SEQ ID NO: 536372 - DNA, 20 bp, Artificial
  CRISPR gRNA sequence
gagacagagaggaagaaggt

SEQ ID NO: 536373 - DNA, 20 bp, Artificial
  CRISPR gRNA sequence
cttctggtgatattttctgt

SEQ ID NO: 536374 - DNA, 20 bp, Artificial
  CRISPR gRNA sequence
ctggtgatattttctgtgtg

SEQ ID NO: 536375 - DNA, 20 bp, Artificial
  CRISPR gRNA sequence
tggtgatattttctgtgtga

SEQ ID NO: 536376 - DNA, 20 bp, Artificial
  CRISPR gRNA sequence
gtgatattttctgtgtgaag

SEQ ID NO: 536377 - DNA, 20 bp, Artificial
  CRISPR gRNA sequence
tctgtgtgaagcacagaaat

SEQ ID NO: 536378 - DNA, 20 bp, Artificial
  CRISPR gRNA sequence
ctgtgtgaagcacagaaatg

SEQ ID NO: 536379 - DNA, 20 bp, Artificial
  CRISPR gRNA sequence
tgtgtgaagcacagaaatgc

SEQ ID NO: 536380 - DNA, 20 bp, Artificial
  CRISPR gRNA sequence
tgtgaagcacagaaatgctt

SEQ ID NO: 536381 - DNA, 20 bp, Artificial
  CRISPR gRNA sequence
atttgctcactgaatggctg

SEQ ID NO: 536382 - DNA, 20 bp, Artificial
  CRISPR gRNA sequence
tttgctcactgaatggctgg

SEQ ID NO: 536383 - DNA, 20 bp, Artificial
  CRISPR gRNA sequence
gctcactgaatggctggcct

SEQ ID NO: 536384 - DNA, 20 bp, Artificial
  CRISPR gRNA sequence
ctcactgaatggctggcctg

SEQ ID NO: 536385 - DNA, 20 bp, Artificial
  CRISPR gRNA sequence
actgaatggctggcctgtgc

SEQ ID NO: 536386 - DNA, 20 bp, Artificial
  CRISPR gRNA sequence
aatggctggcctgtgctcat

SEQ ID NO: 536387 - DNA, 20 bp, Artificial
  CRISPR gRNA sequence
gcctgtgctcatgctggggt

SEQ ID NO: 536388 - DNA, 20 bp, Artificial
  CRISPR gRNA sequence
tgctcatgctggggttcctg

SEQ ID NO: 536389 - DNA, 20 bp, Artificial
  CRISPR gRNA sequence
atgctggggttcctgtctgc

SEQ ID NO: 536390 - DNA, 20 bp, Artificial
  CRISPR gRNA sequence
gggttcctgtctgcctcccc

SEQ ID NO: 536391 - DNA, 20 bp, Artificial
  CRISPR gRNA sequence
ctgtctgcctccccaagtca

SEQ ID NO: 536392 - DNA, 20 bp, Artificial
  CRISPR gRNA sequence
tctgcctccccaagtcaagc

SEQ ID NO: 536393 - DNA, 20 bp, Artificial
  CRISPR gRNA sequence
cctccccaagtcaagcgcag

SEQ ID NO: 536394 - DNA, 20 bp, Artificial
  CRISPR gRNA sequence
cccaagtcaagcgcagcttc

SEQ ID NO: 536395 - DNA, 20 bp, Artificial
  CRISPR gRNA sequence
cttcttttcccttcttgtca

SEQ ID NO: 536396 - DNA, 20 bp, Artificial
  CRISPR gRNA sequence
ttcttttcccttcttgtcac

SEQ ID NO: 536397 - DNA, 20 bp, Artificial
  CRISPR gRNA sequence
cttttcccttcttgtcacta

SEQ ID NO: 536398 - DNA, 20 bp, Artificial
  CRISPR gRNA sequence
ttttcccttcttgtcactac

SEQ ID NO: 536399 - DNA, 20 bp, Artificial
  CRISPR gRNA sequence
ttcccttcttgtcactactt

SEQ ID NO: 536400 - DNA, 20 bp, Artificial
  CRISPR gRNA sequence
tcccttcttgtcactacttc

SEQ ID NO: 536401 - DNA, 20 bp, Artificial
  CRISPR gRNA sequence
cccttcttgtcactacttcc

SEQ ID NO: 536402 - DNA, 20 bp, Artificial
  CRISPR gRNA sequence
ccttcttgtcactacttccc

SEQ ID NO: 536403 - DNA, 20 bp, Artificial
  CRISPR gRNA sequence
cttgtcactacttccccagc

SEQ ID NO: 536404 - DNA, 20 bp, Artificial
  CRISPR gRNA sequence
ttgtcactacttccccagca

SEQ ID NO: 536405 - DNA, 20 bp, Artificial
  CRISPR gRNA sequence
gtcactacttccccagcatc

SEQ ID NO: 536406 - DNA, 20 bp, Artificial
  CRISPR gRNA sequence
tcactacttccccagcatcc

SEQ ID NO: 536407 - DNA, 20 bp, Artificial
  CRISPR gRNA sequence
cttccccagcatccccccgg

SEQ ID NO: 536408 - DNA, 20 bp, Artificial
  CRISPR gRNA sequence
ccccagcatccccccgggct

SEQ ID NO: 536409 - DNA, 20 bp, Artificial
  CRISPR gRNA sequence
cccagcatccccccgggctt

SEQ ID NO: 536410 - DNA, 20 bp, Artificial
  CRISPR gRNA sequence
tcaacttcaatggcatttcg

SEQ ID NO: 536411 - DNA, 20 bp, Artificial
  CRISPR gRNA sequence
caacttcaatggcatttcga

SEQ ID NO: 536412 - DNA, 20 bp, Artificial
  CRISPR gRNA sequence
aacttcaatggcatttcgat

SEQ ID NO: 536413 - DNA, 20 bp, Artificial
  CRISPR gRNA sequence
caatggcatttcgattccac

SEQ ID NO: 536414 - DNA, 20 bp, Artificial
  CRISPR gRNA sequence
aatggcatttcgattccact

SEQ ID NO: 536415 - DNA, 20 bp, Artificial
  CRISPR gRNA sequence
cgattccactttctctacct

SEQ ID NO: 536416 - DNA, 20 bp, Artificial
  CRISPR gRNA sequence
gattccactttctctacctt

SEQ ID NO: 536417 - DNA, 20 bp, Artificial
  CRISPR gRNA sequence
cactttctctaccttctctc

SEQ ID NO: 536418 - DNA, 20 bp, Artificial
  CRISPR gRNA sequence
tctctaccttctctcccttg

SEQ ID NO: 536419 - DNA, 20 bp, Artificial
  CRISPR gRNA sequence
ctctaccttctctcccttgc

SEQ ID NO: 536420 - DNA, 20 bp, Artificial
  CRISPR gRNA sequence
tctaccttctctcccttgcc

SEQ ID NO: 536421 - DNA, 20 bp, Artificial
  CRISPR gRNA sequence
taccttctctcccttgccta

SEQ ID NO: 536422 - DNA, 20 bp, Artificial
  CRISPR gRNA sequence
ccttctctcccttgcctaag

SEQ ID NO: 536423 - DNA, 20 bp, Artificial
  CRISPR gRNA sequence
ctctcccttgcctaagccac

SEQ ID NO: 536424 - DNA, 20 bp, Artificial
  CRISPR gRNA sequence
tctcccttgcctaagccacc

SEQ ID NO: 536425 - DNA, 20 bp, Artificial
  CRISPR gRNA sequence
tcccttgcctaagccacctt

SEQ ID NO: 536426 - DNA, 20 bp, Artificial
  CRISPR gRNA sequence
ccttgcctaagccacctttc

SEQ ID NO: 536427 - DNA, 20 bp, Artificial
  CRISPR gRNA sequence
gcctaagccacctttctcta

SEQ ID NO: 536428 - DNA, 20 bp, Artificial
  CRISPR gRNA sequence
cctaagccacctttctctat

SEQ ID NO: 536429 - DNA, 20 bp, Artificial
  CRISPR gRNA sequence
agccacctttctctatgcct

SEQ ID NO: 536430 - DNA, 20 bp, Artificial
  CRISPR gRNA sequence
tctctatgcctgacccttat

SEQ ID NO: 536431 - DNA, 20 bp, Artificial
  CRISPR gRNA sequence
ctctatgcctgacccttatt

SEQ ID NO: 536432 - DNA, 20 bp, Artificial
  CRISPR gRNA sequence
tctatgcctgacccttatta

SEQ ID NO: 536433 - DNA, 20 bp, Artificial
  CRISPR gRNA sequence
tatgcctgacccttattatc

SEQ ID NO: 536434 - DNA, 20 bp, Artificial
  CRISPR gRNA sequence
tgcctgacccttattatcct

SEQ ID NO: 536435 - DNA, 20 bp, Artificial
  CRISPR gRNA sequence
acccttattatcctcattct

SEQ ID NO: 536436 - DNA, 20 bp, Artificial
  CRISPR gRNA sequence
attatcctcattcttcctat

SEQ ID NO: 536437 - DNA, 20 bp, Artificial
  CRISPR gRNA sequence
ttatcctcattcttcctatt

SEQ ID NO: 536438 - DNA, 20 bp, Artificial
  CRISPR gRNA sequence
tcctcattcttcctatttta

SEQ ID NO: 536439 - DNA, 20 bp, Artificial
  CRISPR gRNA sequence
attcttcctattttagaggc

SEQ ID NO: 536440 - DNA, 20 bp, Artificial
  CRISPR gRNA sequence
ttcctattttagaggcaccc

SEQ ID NO: 536441 - DNA, 20 bp, Artificial
  CRISPR gRNA sequence
cctattttagaggcaccctt

SEQ ID NO: 536442 - DNA, 20 bp, Artificial
  CRISPR gRNA sequence
ctattttagaggcacccttt

SEQ ID NO: 536443 - DNA, 20 bp, Artificial
  CRISPR gRNA sequence
ttttagaggcaccctttggt

SEQ ID NO: 536444 - DNA, 20 bp, Artificial
  CRISPR gRNA sequence
tagaggcaccctttggtcta

SEQ ID NO: 536445 - DNA, 20 bp, Artificial
  CRISPR gRNA sequence
agaggcaccctttggtctag

SEQ ID NO: 536446 - DNA, 20 bp, Artificial
  CRISPR gRNA sequence
gaggcaccctttggtctagg

SEQ ID NO: 536447 - DNA, 20 bp, Artificial
  CRISPR gRNA sequence
tggtctaggccagtggcgat

SEQ ID NO: 536448 - DNA, 20 bp, Artificial
  CRISPR gRNA sequence
ggtctaggccagtggcgatt

SEQ ID NO: 536449 - DNA, 20 bp, Artificial
  CRISPR gRNA sequence
gtctaggccagtggcgattg

SEQ ID NO: 536450 - DNA, 20 bp, Artificial
  CRISPR gRNA sequence
ggccagtggcgattgacttt

SEQ ID NO: 536451 - DNA, 20 bp, Artificial
  CRISPR gRNA sequence
actttggcagctcattagaa

SEQ ID NO: 536452 - DNA, 20 bp, Artificial
  CRISPR gRNA sequence
tggcagctcattagaatccc

SEQ ID NO: 536453 - DNA, 20 bp, Artificial
  CRISPR gRNA sequence
ggcagctcattagaatcccc

SEQ ID NO: 536454 - DNA, 20 bp, Artificial
  CRISPR gRNA sequence
gcagctcattagaatccccc

SEQ ID NO: 536455 - DNA, 20 bp, Artificial
  CRISPR gRNA sequence
attagaatcccccagggagc

SEQ ID NO: 536456 - DNA, 20 bp, Artificial
  CRISPR gRNA sequence
gaatcccccagggagcttta

SEQ ID NO: 536457 - DNA, 20 bp, Artificial
  CRISPR gRNA sequence
tagaacctaatgatacccag

SEQ ID NO: 536458 - DNA, 20 bp, Artificial
  CRISPR gRNA sequence
agaacctaatgatacccagg

SEQ ID NO: 536459 - DNA, 20 bp, Artificial
  CRISPR gRNA sequence
gaacctaatgatacccaggc

SEQ ID NO: 536460 - DNA, 20 bp, Artificial
  CRISPR gRNA sequence
atgatacccaggccgcatgc

SEQ ID NO: 536461 - DNA, 20 bp, Artificial
  CRISPR gRNA sequence
atttaattggtcctcactcc

SEQ ID NO: 536462 - DNA, 20 bp, Artificial
  CRISPR gRNA sequence
aattggtcctcactccactt

SEQ ID NO: 536463 - DNA, 20 bp, Artificial
  CRISPR gRNA sequence
attggtcctcactccacttg

SEQ ID NO: 536464 - DNA, 20 bp, Artificial
  CRISPR gRNA sequence
gtcctcactccacttggatt

SEQ ID NO: 536465 - DNA, 20 bp, Artificial
  CRISPR gRNA sequence
actccacttggattacagca

SEQ ID NO: 536466 - DNA, 20 bp, Artificial
  CRISPR gRNA sequence
cacttggattacagcagcag

SEQ ID NO: 536467 - DNA, 20 bp, Artificial
  CRISPR gRNA sequence
ggattacagcagcagctttc

SEQ ID NO: 536468 - DNA, 20 bp, Artificial
  CRISPR gRNA sequence
gattacagcagcagctttct

SEQ ID NO: 536469 - DNA, 20 bp, Artificial
  CRISPR gRNA sequence
cagcagcagctttctaacta

SEQ ID NO: 536470 - DNA, 20 bp, Artificial
  CRISPR gRNA sequence
tctaactagtctccctaacc

SEQ ID NO: 536471 - DNA, 20 bp, Artificial
  CRISPR gRNA sequence
ctaactagtctccctaaccc

SEQ ID NO: 536472 - DNA, 20 bp, Artificial
  CRISPR gRNA sequence
taactagtctccctaacccc

SEQ ID NO: 536473 - DNA, 20 bp, Artificial
  CRISPR gRNA sequence
actagtctccctaaccccat

SEQ ID NO: 536474 - DNA, 20 bp, Artificial
  CRISPR gRNA sequence
gtctccctaaccccatcctc

SEQ ID NO: 536475 - DNA, 20 bp, Artificial
  CRISPR gRNA sequence
cctaaccccatcctcaatat

SEQ ID NO: 536476 - DNA, 20 bp, Artificial
  CRISPR gRNA sequence
accccatcctcaatatccac

SEQ ID NO: 536477 - DNA, 20 bp, Artificial
  CRISPR gRNA sequence
aatatccactcctgtcctcc

SEQ ID NO: 536478 - DNA, 20 bp, Artificial
  CRISPR gRNA sequence
ctgtcctcccagtacaggca

SEQ ID NO: 536479 - DNA, 20 bp, Artificial
  CRISPR gRNA sequence
tcctcccagtacaggcagag

SEQ ID NO: 536480 - DNA, 20 bp, Artificial
  CRISPR gRNA sequence
ccagtacaggcagagatata

SEQ ID NO: 536481 - DNA, 20 bp, Artificial
  CRISPR gRNA sequence
gtgcatcttctacacatatc

SEQ ID NO: 536482 - DNA, 20 bp, Artificial
  CRISPR gRNA sequence
tgcatcttctacacatatca

SEQ ID NO: 536483 - DNA, 20 bp, Artificial
  CRISPR gRNA sequence
ctacacatatcagcaaaaat

SEQ ID NO: 536484 - DNA, 20 bp, Artificial
  CRISPR gRNA sequence
tacacatatcagcaaaaatc

SEQ ID NO: 536485 - DNA, 20 bp, Artificial
  CRISPR gRNA sequence
cacatatcagcaaaaatcac

SEQ ID NO: 536486 - DNA, 20 bp, Artificial
  CRISPR gRNA sequence
ccaccttgtatcactctgac

SEQ ID NO: 536487 - DNA, 20 bp, Artificial
  CRISPR gRNA sequence
gtatcactctgacaagcaga

SEQ ID NO: 536488 - DNA, 20 bp, Artificial
  CRISPR gRNA sequence
tatcactctgacaagcagat

SEQ ID NO: 536489 - DNA, 20 bp, Artificial
  CRISPR gRNA sequence
tgacaagcagatccaaaata

SEQ ID NO: 536490 - DNA, 20 bp, Artificial
  CRISPR gRNA sequence
acaagcagatccaaaataag

SEQ ID NO: 536491 - DNA, 20 bp, Artificial
  CRISPR gRNA sequence
ttcatccttaaatatgttgt

SEQ ID NO: 536492 - DNA, 20 bp, Artificial
  CRISPR gRNA sequence
atccttaaatatgttgtttc

SEQ ID NO: 536493 - DNA, 20 bp, Artificial
  CRISPR gRNA sequence
aaatatgttgtttccagccc

SEQ ID NO: 536494 - DNA, 20 bp, Artificial
  CRISPR gRNA sequence
aatatgttgtttccagccct

SEQ ID NO: 536495 - DNA, 20 bp, Artificial
  CRISPR gRNA sequence
tttccagcccttttctgcca

SEQ ID NO: 536496 - DNA, 20 bp, Artificial
  CRISPR gRNA sequence
ccagcccttttctgccatat

SEQ ID NO: 536497 - DNA, 20 bp, Artificial
  CRISPR gRNA sequence
cagcccttttctgccatata

SEQ ID NO: 536498 - DNA, 20 bp, Artificial
  CRISPR gRNA sequence
ttctgccatataactcctcc

SEQ ID NO: 536499 - DNA, 20 bp, Artificial
  CRISPR gRNA sequence
tctgccatataactcctcct

SEQ ID NO: 536500 - DNA, 20 bp, Artificial
  CRISPR gRNA sequence
ctgccatataactcctcctt

SEQ ID NO: 536501 - DNA, 20 bp, Artificial
  CRISPR gRNA sequence
tgccatataactcctccttc

SEQ ID NO: 536502 - DNA, 20 bp, Artificial
  CRISPR gRNA sequence
ccatataactcctccttcag

SEQ ID NO: 536503 - DNA, 20 bp, Artificial
  CRISPR gRNA sequence
ctccttcagggcagcctggc

SEQ ID NO: 536504 - DNA, 20 bp, Artificial
  CRISPR gRNA sequence
cttcagggcagcctggcttg

SEQ ID NO: 536505 - DNA, 20 bp, Artificial
  CRISPR gRNA sequence
cagggcagcctggcttgaaa

SEQ ID NO: 536506 - DNA, 20 bp, Artificial
  CRISPR gRNA sequence
agggcagcctggcttgaaat

SEQ ID NO: 536507 - DNA, 20 bp, Artificial
  CRISPR gRNA sequence
gcttgaaatgggctctgtcg

SEQ ID NO: 536508 - DNA, 20 bp, Artificial
  CRISPR gRNA sequence
gaaatgggctctgtcgatga

SEQ ID NO: 536509 - DNA, 20 bp, Artificial
  CRISPR gRNA sequence
aaatgggctctgtcgatgaa

SEQ ID NO: 536510 - DNA, 20 bp, Artificial
  CRISPR gRNA sequence
tgtcgatgaaaggcccgctg

SEQ ID NO: 536511 - DNA, 20 bp, Artificial
  CRISPR gRNA sequence
tcgatgaaaggcccgctgct

SEQ ID NO: 536512 - DNA, 20 bp, Artificial
  CRISPR gRNA sequence
ctctccagtcagcctcttct

SEQ ID NO: 536513 - DNA, 20 bp, Artificial
  CRISPR gRNA sequence
tccagtcagcctcttcttct

SEQ ID NO: 536514 - DNA, 20 bp, Artificial
  CRISPR gRNA sequence
cagtcagcctcttcttctcg

SEQ ID NO: 536515 - DNA, 20 bp, Artificial
  CRISPR gRNA sequence
ttcttctcgccccactctta

SEQ ID NO: 536516 - DNA, 20 bp, Artificial
  CRISPR gRNA sequence
cttctcgccccactcttagc

SEQ ID NO: 536517 - DNA, 20 bp, Artificial
  CRISPR gRNA sequence
ttctcgccccactcttagct

SEQ ID NO: 536518 - DNA, 20 bp, Artificial
  CRISPR gRNA sequence
ctcgccccactcttagctcg

SEQ ID NO: 536519 - DNA, 20 bp, Artificial
  CRISPR gRNA sequence
tcgccccactcttagctcgc

SEQ ID NO: 536520 - DNA, 20 bp, Artificial
  CRISPR gRNA sequence
gccccactcttagctcgccg

SEQ ID NO: 536521 - DNA, 20 bp, Artificial
  CRISPR gRNA sequence
ttagctcgccgattcatcag

SEQ ID NO: 536522 - DNA, 20 bp, Artificial
  CRISPR gRNA sequence
agctcgccgattcatcagca

SEQ ID NO: 536523 - DNA, 20 bp, Artificial
  CRISPR gRNA sequence
gctcgccgattcatcagcaa

SEQ ID NO: 536524 - DNA, 20 bp, Artificial
  CRISPR gRNA sequence
gccgattcatcagcaacctg

SEQ ID NO: 536525 - DNA, 20 bp, Artificial
  CRISPR gRNA sequence
atcagcaacctggaacagtt

SEQ ID NO: 536526 - DNA, 20 bp, Artificial
  CRISPR gRNA sequence
gaacagttgccttttccctc

SEQ ID NO: 536527 - DNA, 20 bp, Artificial
  CRISPR gRNA sequence
ccttttccctcggcctacct

SEQ ID NO: 536528 - DNA, 20 bp, Artificial
  CRISPR gRNA sequence
ttccctcggcctacctgtgt

SEQ ID NO: 536529 - DNA, 20 bp, Artificial
  CRISPR gRNA sequence
tccctcggcctacctgtgtc

SEQ ID NO: 536530 - DNA, 20 bp, Artificial
  CRISPR gRNA sequence
ccctcggcctacctgtgtcc

SEQ ID NO: 536531 - DNA, 20 bp, Artificial
  CRISPR gRNA sequence
cctcggcctacctgtgtccc

SEQ ID NO: 536532 - DNA, 20 bp, Artificial
  CRISPR gRNA sequence
ggcctacctgtgtccccctc

SEQ ID NO: 536533 - DNA, 20 bp, Artificial
  CRISPR gRNA sequence
cctgtgtccccctcccgatt

SEQ ID NO: 536534 - DNA, 20 bp, Artificial
  CRISPR gRNA sequence
tgtccccctcccgattaatg

SEQ ID NO: 536535 - DNA, 20 bp, Artificial
  CRISPR gRNA sequence
ccgattaatgccaccttaat

SEQ ID NO: 536536 - DNA, 20 bp, Artificial
  CRISPR gRNA sequence
atgccaccttaatccaggtt

SEQ ID NO: 536537 - DNA, 20 bp, Artificial
  CRISPR gRNA sequence
aatccaggttcttcacccaa

SEQ ID NO: 536538 - DNA, 20 bp, Artificial
  CRISPR gRNA sequence
atccaggttcttcacccaac

SEQ ID NO: 536539 - DNA, 20 bp, Artificial
  CRISPR gRNA sequence
ttcacccaaccccacattcc

SEQ ID NO: 536540 - DNA, 20 bp, Artificial
  CRISPR gRNA sequence
cacccaaccccacattcctg

SEQ ID NO: 536541 - DNA, 20 bp, Artificial
  CRISPR gRNA sequence
acccaaccccacattcctgt

SEQ ID NO: 536542 - DNA, 20 bp, Artificial
  CRISPR gRNA sequence
ctgtaaccacctgaagacag

SEQ ID NO: 536543 - DNA, 20 bp, Artificial
  CRISPR gRNA sequence
taaccacctgaagacagagt

SEQ ID NO: 536544 - DNA, 20 bp, Artificial
  CRISPR gRNA sequence
aagacagagttgtaggcagg

SEQ ID NO: 536545 - DNA, 20 bp, Artificial
  CRISPR gRNA sequence
taggcaggtagacttgaggg

SEQ ID NO: 536546 - DNA, 20 bp, Artificial
  CRISPR gRNA sequence
gagggtctatcagatgtgtg

SEQ ID NO: 536547 - DNA, 20 bp, Artificial
  CRISPR gRNA sequence
agggtctatcagatgtgtgg

SEQ ID NO: 536548 - DNA, 20 bp, Artificial
  CRISPR gRNA sequence
tcagatgtgtggatcccatt

SEQ ID NO: 536549 - DNA, 20 bp, Artificial
  CRISPR gRNA sequence
ccgcattggaccacagtctc

SEQ ID NO: 536550 - DNA, 20 bp, Artificial
  CRISPR gRNA sequence
gaccacagtctccactgggg

SEQ ID NO: 536551 - DNA, 20 bp, Artificial
  CRISPR gRNA sequence
cactggggcaggagacatgc

SEQ ID NO: 536552 - DNA, 20 bp, Artificial
  CRISPR gRNA sequence
gggcaggagacatgcatctg

SEQ ID NO: 536553 - DNA, 20 bp, Artificial
  CRISPR gRNA sequence
gtttcctgtatagcccccct

SEQ ID NO: 536554 - DNA, 20 bp, Artificial
  CRISPR gRNA sequence
cctgtatagcccccctggag

SEQ ID NO: 536555 - DNA, 20 bp, Artificial
  CRISPR gRNA sequence
ctgtatagcccccctggagg

SEQ ID NO: 536556 - DNA, 20 bp, Artificial
  CRISPR gRNA sequence
tatagcccccctggaggcag

SEQ ID NO: 536557 - DNA, 20 bp, Artificial
  CRISPR gRNA sequence
gaggcagaggtcagcgctgg

SEQ ID NO: 536558 - DNA, 20 bp, Artificial
  CRISPR gRNA sequence
gggaatattagaaatgctat

SEQ ID NO: 536559 - DNA, 20 bp, Artificial
  CRISPR gRNA sequence
gaaatgctattttccaactt

SEQ ID NO: 536560 - DNA, 20 bp, Artificial
  CRISPR gRNA sequence
ttttccaacttgccaaatag

SEQ ID NO: 536561 - DNA, 20 bp, Artificial
  CRISPR gRNA sequence
tccaacttgccaaatagcac

SEQ ID NO: 536562 - DNA, 20 bp, Artificial
  CRISPR gRNA sequence
ccaacttgccaaatagcacc

SEQ ID NO: 536563 - DNA, 20 bp, Artificial
  CRISPR gRNA sequence
caacttgccaaatagcaccc

SEQ ID NO: 536564 - DNA, 20 bp, Artificial
  CRISPR gRNA sequence
gccaaatagcacccacactg

SEQ ID NO: 536565 - DNA, 20 bp, Artificial
  CRISPR gRNA sequence
ccaaatagcacccacactga

SEQ ID NO: 536566 - DNA, 20 bp, Artificial
  CRISPR gRNA sequence
aaataaagcaattaagggaa

SEQ ID NO: 536567 - DNA, 20 bp, Artificial
  CRISPR gRNA sequence
agggaatgaacacttacctt

SEQ ID NO: 536568 - DNA, 20 bp, Artificial
  CRISPR gRNA sequence
accttgaatcttcaaatcaa

SEQ ID NO: 536569 - DNA, 20 bp, Artificial
  CRISPR gRNA sequence
ccttgaatcttcaaatcaaa

SEQ ID NO: 536570 - DNA, 20 bp, Artificial
  CRISPR gRNA sequence
gaatcttcaaatcaaatatt

SEQ ID NO: 536571 - DNA, 20 bp, Artificial
  CRISPR gRNA sequence
aatcttcaaatcaaatattt

SEQ ID NO: 536572 - DNA, 20 bp, Artificial
  CRISPR gRNA sequence
caaatcaaatattttttcca

SEQ ID NO: 536573 - DNA, 20 bp, Artificial
  CRISPR gRNA sequence
aaatcaaatattttttccaa

SEQ ID NO: 536574 - DNA, 20 bp, Artificial
  CRISPR gRNA sequence
tttccaacacattttttcct

SEQ ID NO: 536575 - DNA, 20 bp, Artificial
  CRISPR gRNA sequence
ttccaacacattttttcctt

SEQ ID NO: 536576 - DNA, 20 bp, Artificial
  CRISPR gRNA sequence
tccaacacattttttccttt

SEQ ID NO: 536577 - DNA, 20 bp, Artificial
  CRISPR gRNA sequence
ccaacacattttttcctttt

SEQ ID NO: 536578 - DNA, 20 bp, Artificial
  CRISPR gRNA sequence
caacacattttttccttttg

SEQ ID NO: 536579 - DNA, 20 bp, Artificial
  CRISPR gRNA sequence
tttccttttgtatcatatat

SEQ ID NO: 536580 - DNA, 20 bp, Artificial
  CRISPR gRNA sequence
ttccttttgtatcatatatt

SEQ ID NO: 536581 - DNA, 20 bp, Artificial
  CRISPR gRNA sequence
tccttttgtatcatatattg

SEQ ID NO: 536582 - DNA, 20 bp, Artificial
  CRISPR gRNA sequence
ccttttgtatcatatattga

SEQ ID NO: 536583 - DNA, 20 bp, Artificial
  CRISPR gRNA sequence
cttttgtatcatatattgat

SEQ ID NO: 536584 - DNA, 20 bp, Artificial
  CRISPR gRNA sequence
ttgtatcatatattgatacc

SEQ ID NO: 536585 - DNA, 20 bp, Artificial
  CRISPR gRNA sequence
tgtatcatatattgatacct

SEQ ID NO: 536586 - DNA, 20 bp, Artificial
  CRISPR gRNA sequence
gtatcatatattgatacctt

SEQ ID NO: 536587 - DNA, 20 bp, Artificial
  CRISPR gRNA sequence
tatcatatattgataccttg

SEQ ID NO: 536588 - DNA, 20 bp, Artificial
  CRISPR gRNA sequence
ataccttgtagatatcctga

SEQ ID NO: 536589 - DNA, 20 bp, Artificial
  CRISPR gRNA sequence
gtagatatcctgatcatcgg

SEQ ID NO: 536590 - DNA, 20 bp, Artificial
  CRISPR gRNA sequence
tagatatcctgatcatcggt

SEQ ID NO: 536591 - DNA, 20 bp, Artificial
  CRISPR gRNA sequence
atcatcggtcttcagatgct

SEQ ID NO: 536592 - DNA, 20 bp, Artificial
  CRISPR gRNA sequence
cagatgcttaattttcagag

SEQ ID NO: 536593 - DNA, 20 bp, Artificial
  CRISPR gRNA sequence
agatgcttaattttcagagt

SEQ ID NO: 536594 - DNA, 20 bp, Artificial
  CRISPR gRNA sequence
aattttcagagttccatttt

SEQ ID NO: 536595 - DNA, 20 bp, Artificial
  CRISPR gRNA sequence
attttcagagttccattttt

SEQ ID NO: 536596 - DNA, 20 bp, Artificial
  CRISPR gRNA sequence
tcagagttccatttttaaat

SEQ ID NO: 536597 - DNA, 20 bp, Artificial
  CRISPR gRNA sequence
cagagttccatttttaaata

SEQ ID NO: 536598 - DNA, 20 bp, Artificial
  CRISPR gRNA sequence
agagttccatttttaaatag

SEQ ID NO: 536599 - DNA, 20 bp, Artificial
  CRISPR gRNA sequence
catttttaaatagcttatat

SEQ ID NO: 536600 - DNA, 20 bp, Artificial
  CRISPR gRNA sequence
ttaaatagcttatatgtatc

SEQ ID NO: 536601 - DNA, 20 bp, Artificial
  CRISPR gRNA sequence
taaatagcttatatgtatct

SEQ ID NO: 536602 - DNA, 20 bp, Artificial
  CRISPR gRNA sequence
aaatagcttatatgtatctt

SEQ ID NO: 536603 - DNA, 20 bp, Artificial
  CRISPR gRNA sequence
aatagcttatatgtatcttt

SEQ ID NO: 536604 - DNA, 20 bp, Artificial
  CRISPR gRNA sequence
atatgtatctttttccttga

SEQ ID NO: 536605 - DNA, 20 bp, Artificial
  CRISPR gRNA sequence
tatgtatctttttccttgaa

SEQ ID NO: 536606 - DNA, 20 bp, Artificial
  CRISPR gRNA sequence
tttccttgaaagtctctttc

SEQ ID NO: 536607 - DNA, 20 bp, Artificial
  CRISPR gRNA sequence
ttccttgaaagtctctttct

SEQ ID NO: 536608 - DNA, 20 bp, Artificial
  CRISPR gRNA sequence
tccttgaaagtctctttctc

SEQ ID NO: 536609 - DNA, 20 bp, Artificial
  CRISPR gRNA sequence
ccttgaaagtctctttctct

SEQ ID NO: 536610 - DNA, 20 bp, Artificial
  CRISPR gRNA sequence
cttgaaagtctctttctctt

SEQ ID NO: 536611 - DNA, 20 bp, Artificial
  CRISPR gRNA sequence
gaaagtctctttctcttttc

SEQ ID NO: 536612 - DNA, 20 bp, Artificial
  CRISPR gRNA sequence
aaagtctctttctcttttct

SEQ ID NO: 536613 - DNA, 20 bp, Artificial
  CRISPR gRNA sequence
tttctcttttctgaattgtg

SEQ ID NO: 536614 - DNA, 20 bp, Artificial
  CRISPR gRNA sequence
tctcttttctgaattgtgca

SEQ ID NO: 536615 - DNA, 20 bp, Artificial
  CRISPR gRNA sequence
ctcttttctgaattgtgcaa

SEQ ID NO: 536616 - DNA, 20 bp, Artificial
  CRISPR gRNA sequence
tcttttctgaattgtgcaat

SEQ ID NO: 536617 - DNA, 20 bp, Artificial
  CRISPR gRNA sequence
ttttctgaattgtgcaatct

SEQ ID NO: 536618 - DNA, 20 bp, Artificial
  CRISPR gRNA sequence
ttctgaattgtgcaatcttt

SEQ ID NO: 536619 - DNA, 20 bp, Artificial
  CRISPR gRNA sequence
tctgaattgtgcaatctttt

SEQ ID NO: 536620 - DNA, 20 bp, Artificial
  CRISPR gRNA sequence
ctgaattgtgcaatcttttt

SEQ ID NO: 536621 - DNA, 20 bp, Artificial
  CRISPR gRNA sequence
tgaattgtgcaatctttttc

SEQ ID NO: 536622 - DNA, 20 bp, Artificial
  CRISPR gRNA sequence
aattgtgcaatctttttctt

SEQ ID NO: 536623 - DNA, 20 bp, Artificial
  CRISPR gRNA sequence
tgcaatctttttcttgtctg

SEQ ID NO: 536624 - DNA, 20 bp, Artificial
  CRISPR gRNA sequence
tttcttgtctgaagtttttt

SEQ ID NO: 536625 - DNA, 20 bp, Artificial
  CRISPR gRNA sequence
ttcttgtctgaagttttttc

SEQ ID NO: 536626 - DNA, 20 bp, Artificial
  CRISPR gRNA sequence
tcttgtctgaagttttttcc

SEQ ID NO: 536627 - DNA, 20 bp, Artificial
  CRISPR gRNA sequence
cttgtctgaagttttttccc

SEQ ID NO: 536628 - DNA, 20 bp, Artificial
  CRISPR gRNA sequence
ttgtctgaagttttttccca

SEQ ID NO: 536629 - DNA, 20 bp, Artificial
  CRISPR gRNA sequence
gtctgaagttttttcccatt

SEQ ID NO: 536630 - DNA, 20 bp, Artificial
  CRISPR gRNA sequence
tctgaagttttttcccattt

SEQ ID NO: 536631 - DNA, 20 bp, Artificial
  CRISPR gRNA sequence
aagttttttcccattttata

SEQ ID NO: 536632 - DNA, 20 bp, Artificial
  CRISPR gRNA sequence
tttcccattttatatcgtca

SEQ ID NO: 536633 - DNA, 20 bp, Artificial
  CRISPR gRNA sequence
ttcccattttatatcgtcaa

SEQ ID NO: 536634 - DNA, 20 bp, Artificial
  CRISPR gRNA sequence
tcccattttatatcgtcaat

SEQ ID NO: 536635 - DNA, 20 bp, Artificial
  CRISPR gRNA sequence
cccattttatatcgtcaata

SEQ ID NO: 536636 - DNA, 20 bp, Artificial
  CRISPR gRNA sequence
ccattttatatcgtcaatat

SEQ ID NO: 536637 - DNA, 20 bp, Artificial
  CRISPR gRNA sequence
tatatcgtcaatatcatcac

SEQ ID NO: 536638 - DNA, 20 bp, Artificial
  CRISPR gRNA sequence
atatcgtcaatatcatcact

SEQ ID NO: 536639 - DNA, 20 bp, Artificial
  CRISPR gRNA sequence
tatcgtcaatatcatcactc

SEQ ID NO: 536640 - DNA, 20 bp, Artificial
  CRISPR gRNA sequence
atttgaaaactaggaatgtc

SEQ ID NO: 536641 - DNA, 20 bp, Artificial
  CRISPR gRNA sequence
gaaaactaggaatgtccaag

SEQ ID NO: 536642 - DNA, 20 bp, Artificial
  CRISPR gRNA sequence
aaaactaggaatgtccaagt

SEQ ID NO: 536643 - DNA, 20 bp, Artificial
  CRISPR gRNA sequence
ggaatgtccaagttgatgtc

SEQ ID NO: 536644 - DNA, 20 bp, Artificial
  CRISPR gRNA sequence
atgtcctgacccaaggcacc

SEQ ID NO: 536645 - DNA, 20 bp, Artificial
  CRISPR gRNA sequence
acccaaggcaccccaggttt

SEQ ID NO: 536646 - DNA, 20 bp, Artificial
  CRISPR gRNA sequence
ccaaggcattcgtaatctct

SEQ ID NO: 536647 - DNA, 20 bp, Artificial
  CRISPR gRNA sequence
caaggcattcgtaatctctt

SEQ ID NO: 536648 - DNA, 20 bp, Artificial
  CRISPR gRNA sequence
gtaatctctttggagactgc

SEQ ID NO: 536649 - DNA, 20 bp, Artificial
  CRISPR gRNA sequence
tttggagactgcacctataa

SEQ ID NO: 536650 - DNA, 20 bp, Artificial
  CRISPR gRNA sequence
tggagactgcacctataaaa

SEQ ID NO: 536651 - DNA, 20 bp, Artificial
  CRISPR gRNA sequence
ggagactgcacctataaaaa

SEQ ID NO: 536652 - DNA, 20 bp, Artificial
  CRISPR gRNA sequence
gagactgcacctataaaaag

SEQ ID NO: 536653 - DNA, 20 bp, Artificial
  CRISPR gRNA sequence
cacctataaaaagcaaaaga

SEQ ID NO: 536654 - DNA, 20 bp, Artificial
  CRISPR gRNA sequence
taaaaagcaaaagagttact

SEQ ID NO: 536655 - DNA, 20 bp, Artificial
  CRISPR gRNA sequence
ctgagagtcactttcaggga

SEQ ID NO: 536656 - DNA, 20 bp, Artificial
  CRISPR gRNA sequence
agagtcactttcagggaaag

SEQ ID NO: 536657 - DNA, 20 bp, Artificial
  CRISPR gRNA sequence
tcagggaaagctgggttggg

SEQ ID NO: 536658 - DNA, 20 bp, Artificial
  CRISPR gRNA sequence
cagggaaagctgggttggga

SEQ ID NO: 536659 - DNA, 20 bp, Artificial
  CRISPR gRNA sequence
agggaaagctgggttgggac

SEQ ID NO: 536660 - DNA, 20 bp, Artificial
  CRISPR gRNA sequence
ggttgggacttctttgactc

SEQ ID NO: 536661 - DNA, 20 bp, Artificial
  CRISPR gRNA sequence
ggacttctttgactcttatg

SEQ ID NO: 536662 - DNA, 20 bp, Artificial
  CRISPR gRNA sequence
ctttgactcttatgcttacc

SEQ ID NO: 536663 - DNA, 20 bp, Artificial
  CRISPR gRNA sequence
tttgactcttatgcttacct

SEQ ID NO: 536664 - DNA, 20 bp, Artificial
  CRISPR gRNA sequence
tgactcttatgcttaccttt

SEQ ID NO: 536665 - DNA, 20 bp, Artificial
  CRISPR gRNA sequence
gactcttatgcttacctttg

SEQ ID NO: 536666 - DNA, 20 bp, Artificial
  CRISPR gRNA sequence
actcttatgcttacctttgg

SEQ ID NO: 536667 - DNA, 20 bp, Artificial
  CRISPR gRNA sequence
ttatgcttacctttggaaga

SEQ ID NO: 536668 - DNA, 20 bp, Artificial
  CRISPR gRNA sequence
atgcttacctttggaagaaa

SEQ ID NO: 536669 - DNA, 20 bp, Artificial
  CRISPR gRNA sequence
tgcttacctttggaagaaac

SEQ ID NO: 536670 - DNA, 20 bp, Artificial
  CRISPR gRNA sequence
acctttggaagaaacattga

SEQ ID NO: 536671 - DNA, 20 bp, Artificial
  CRISPR gRNA sequence
cctttggaagaaacattgaa

SEQ ID NO: 536672 - DNA, 20 bp, Artificial
  CRISPR gRNA sequence
tggaagaaacattgaaaatc

SEQ ID NO: 536673 - DNA, 20 bp, Artificial
  CRISPR gRNA sequence
ggaagaaacattgaaaatca

SEQ ID NO: 536674 - DNA, 20 bp, Artificial
  CRISPR gRNA sequence
gaagaaacattgaaaatcag

SEQ ID NO: 536675 - DNA, 20 bp, Artificial
  CRISPR gRNA sequence
aaaatcagaaggaagctggc

SEQ ID NO: 536676 - DNA, 20 bp, Artificial
  CRISPR gRNA sequence
gctacaaatttacatggaaa

SEQ ID NO: 536677 - DNA, 20 bp, Artificial
  CRISPR gRNA sequence
caaatttacatggaaagctc

SEQ ID NO: 536678 - DNA, 20 bp, Artificial
  CRISPR gRNA sequence
acatggaaagctcatcttag

SEQ ID NO: 536679 - DNA, 20 bp, Artificial
  CRISPR gRNA sequence
catggaaagctcatcttagg

SEQ ID NO: 536680 - DNA, 20 bp, Artificial
  CRISPR gRNA sequence
atcttaggggttggtttcct

SEQ ID NO: 536681 - DNA, 20 bp, Artificial
  CRISPR gRNA sequence
aggggttggtttcctctttt

SEQ ID NO: 536682 - DNA, 20 bp, Artificial
  CRISPR gRNA sequence
ggggttggtttcctcttttg

SEQ ID NO: 536683 - DNA, 20 bp, Artificial
  CRISPR gRNA sequence
gtttcctcttttgattctga

SEQ ID NO: 536684 - DNA, 20 bp, Artificial
  CRISPR gRNA sequence
cctcttttgattctgagctc

SEQ ID NO: 536685 - DNA, 20 bp, Artificial
  CRISPR gRNA sequence
ctcttttgattctgagctct

SEQ ID NO: 536686 - DNA, 20 bp, Artificial
  CRISPR gRNA sequence
ttttgattctgagctcttca

SEQ ID NO: 536687 - DNA, 20 bp, Artificial
  CRISPR gRNA sequence
ttgattctgagctcttcatg

SEQ ID NO: 536688 - DNA, 20 bp, Artificial
  CRISPR gRNA sequence
tgattctgagctcttcatgc

SEQ ID NO: 536689 - DNA, 20 bp, Artificial
  CRISPR gRNA sequence
gattctgagctcttcatgca

SEQ ID NO: 536690 - DNA, 20 bp, Artificial
  CRISPR gRNA sequence
attctgagctcttcatgcaa

SEQ ID NO: 536691 - DNA, 20 bp, Artificial
  CRISPR gRNA sequence
tgagctcttcatgcaaaagg

SEQ ID NO: 536692 - DNA, 20 bp, Artificial
  CRISPR gRNA sequence
agctcttcatgcaaaaggaa

SEQ ID NO: 536693 - DNA, 20 bp, Artificial
  CRISPR gRNA sequence
ttcatgcaaaaggaactgaa

SEQ ID NO: 536694 - DNA, 20 bp, Artificial
  CRISPR gRNA sequence
catgcaaaaggaactgaagt

SEQ ID NO: 536695 - DNA, 20 bp, Artificial
  CRISPR gRNA sequence
atgcaaaaggaactgaagtg

SEQ ID NO: 536696 - DNA, 20 bp, Artificial
  CRISPR gRNA sequence
aagtgagactggtggagtcc

SEQ ID NO: 536697 - DNA, 20 bp, Artificial
  CRISPR gRNA sequence
gtggagtccacaccccgaga

SEQ ID NO: 536698 - DNA, 20 bp, Artificial
  CRISPR gRNA sequence
aaccacgtgcctctctttac

SEQ ID NO: 536699 - DNA, 20 bp, Artificial
  CRISPR gRNA sequence
accacgtgcctctctttaca

SEQ ID NO: 536700 - DNA, 20 bp, Artificial
  CRISPR gRNA sequence
tctttacatcttttacagta

SEQ ID NO: 536701 - DNA, 20 bp, Artificial
  CRISPR gRNA sequence
tttacatcttttacagtaac

SEQ ID NO: 536702 - DNA, 20 bp, Artificial
  CRISPR gRNA sequence
tacatcttttacagtaacat

SEQ ID NO: 536703 - DNA, 20 bp, Artificial
  CRISPR gRNA sequence
acatcttttacagtaacata

SEQ ID NO: 536704 - DNA, 20 bp, Artificial
  CRISPR gRNA sequence
catcttttacagtaacataa

SEQ ID NO: 536705 - DNA, 20 bp, Artificial
  CRISPR gRNA sequence
tcccctcatccctcaacacc

SEQ ID NO: 536706 - DNA, 20 bp, Artificial
  CRISPR gRNA sequence
tgcctctgcctcctgaccac

SEQ ID NO: 536707 - DNA, 20 bp, Artificial
  CRISPR gRNA sequence
ctctgcctcctgaccaccag

SEQ ID NO: 536708 - DNA, 20 bp, Artificial
  CRISPR gRNA sequence
tctgcctcctgaccaccagt

SEQ ID NO: 536709 - DNA, 20 bp, Artificial
  CRISPR gRNA sequence
tgaccaccagtgggatctgc

SEQ ID NO: 536710 - DNA, 20 bp, Artificial
  CRISPR gRNA sequence
gaccaccagtgggatctgcc

SEQ ID NO: 536711 - DNA, 20 bp, Artificial
  CRISPR gRNA sequence
ccaccagtgggatctgccag

SEQ ID NO: 536712 - DNA, 20 bp, Artificial
  CRISPR gRNA sequence
caccagtgggatctgccagg

SEQ ID NO: 536713 - DNA, 20 bp, Artificial
  CRISPR gRNA sequence
accagtgggatctgccagga

SEQ ID NO: 536714 - DNA, 20 bp, Artificial
  CRISPR gRNA sequence
ccagtgggatctgccaggag

SEQ ID NO: 536715 - DNA, 20 bp, Artificial
  CRISPR gRNA sequence
cagtgggatctgccaggagg

SEQ ID NO: 536716 - DNA, 20 bp, Artificial
  CRISPR gRNA sequence
tctgccaggagggggcctct

SEQ ID NO: 536717 - DNA, 20 bp, Artificial
  CRISPR gRNA sequence
tgccaggagggggcctcttg

SEQ ID NO: 536718 - DNA, 20 bp, Artificial
  CRISPR gRNA sequence
gggcctcttggagcacccta

SEQ ID NO: 536719 - DNA, 20 bp, Artificial
  CRISPR gRNA sequence
cctcttggagcaccctacgg

SEQ ID NO: 536720 - DNA, 20 bp, Artificial
  CRISPR gRNA sequence
ctatcttttatatgtgacta

SEQ ID NO: 536721 - DNA, 20 bp, Artificial
  CRISPR gRNA sequence
tatcttttatatgtgactac

SEQ ID NO: 536722 - DNA, 20 bp, Artificial
  CRISPR gRNA sequence
tttatatgtgactacaggcc

SEQ ID NO: 536723 - DNA, 20 bp, Artificial
  CRISPR gRNA sequence
tacaggcccagctctgaccc

SEQ ID NO: 536724 - DNA, 20 bp, Artificial
  CRISPR gRNA sequence
agctctgaccctggctcctg

SEQ ID NO: 536725 - DNA, 20 bp, Artificial
  CRISPR gRNA sequence
atccctgatccaactttttc

SEQ ID NO: 536726 - DNA, 20 bp, Artificial
  CRISPR gRNA sequence
tccctgatccaactttttct

SEQ ID NO: 536727 - DNA, 20 bp, Artificial
  CRISPR gRNA sequence
tgatccaactttttctggga

SEQ ID NO: 536728 - DNA, 20 bp, Artificial
  CRISPR gRNA sequence
gatccaactttttctgggat

SEQ ID NO: 536729 - DNA, 20 bp, Artificial
  CRISPR gRNA sequence
tccaactttttctgggatgg

SEQ ID NO: 536730 - DNA, 20 bp, Artificial
  CRISPR gRNA sequence
ccaactttttctgggatggg

SEQ ID NO: 536731 - DNA, 20 bp, Artificial
  CRISPR gRNA sequence
actttttctgggatgggagg

SEQ ID NO: 536732 - DNA, 20 bp, Artificial
  CRISPR gRNA sequence
tttttctgggatgggaggtg

SEQ ID NO: 536733 - DNA, 20 bp, Artificial
  CRISPR gRNA sequence
ttttctgggatgggaggtgg

SEQ ID NO: 536734 - DNA, 20 bp, Artificial
  CRISPR gRNA sequence
tttctgggatgggaggtgga

SEQ ID NO: 536735 - DNA, 20 bp, Artificial
  CRISPR gRNA sequence
tctgggatgggaggtggagg

SEQ ID NO: 536736 - DNA, 20 bp, Artificial
  CRISPR gRNA sequence
gaggtggagggagtgtattg

SEQ ID NO: 536737 - DNA, 20 bp, Artificial
  CRISPR gRNA sequence
gtggagggagtgtattgtag

SEQ ID NO: 536738 - DNA, 20 bp, Artificial
  CRISPR gRNA sequence
gagtgtattgtagtggttaa

SEQ ID NO: 536739 - DNA, 20 bp, Artificial
  CRISPR gRNA sequence
gtggttaacagtataactct

SEQ ID NO: 536740 - DNA, 20 bp, Artificial
  CRISPR gRNA sequence
ggttaacagtataactcttg

SEQ ID NO: 536741 - DNA, 20 bp, Artificial
  CRISPR gRNA sequence
agtataactcttggagtcca

SEQ ID NO: 536742 - DNA, 20 bp, Artificial
  CRISPR gRNA sequence
actcttggagtccaaagacc

SEQ ID NO: 536743 - DNA, 20 bp, Artificial
  CRISPR gRNA sequence
aaagacctagatttaaatcc

SEQ ID NO: 536744 - DNA, 20 bp, Artificial
  CRISPR gRNA sequence
aatcccagcccatcacttac

SEQ ID NO: 536745 - DNA, 20 bp, Artificial
  CRISPR gRNA sequence
atctcatatgcgctgtctct

SEQ ID NO: 536746 - DNA, 20 bp, Artificial
  CRISPR gRNA sequence
catatgcgctgtctctaagc

SEQ ID NO: 536747 - DNA, 20 bp, Artificial
  CRISPR gRNA sequence
atatgcgctgtctctaagca

SEQ ID NO: 536748 - DNA, 20 bp, Artificial
  CRISPR gRNA sequence
tatgcgctgtctctaagcaa

SEQ ID NO: 536749 - DNA, 20 bp, Artificial
  CRISPR gRNA sequence
atgcgctgtctctaagcaag

SEQ ID NO: 536750 - DNA, 20 bp, Artificial
  CRISPR gRNA sequence
gggtatgatactcctcctgc

SEQ ID NO: 536751 - DNA, 20 bp, Artificial
  CRISPR gRNA sequence
ggtatgatactcctcctgca

SEQ ID NO: 536752 - DNA, 20 bp, Artificial
  CRISPR gRNA sequence
ctcctcctgcaaggctcatt

SEQ ID NO: 536753 - DNA, 20 bp, Artificial
  CRISPR gRNA sequence
cctcctgcaaggctcattga

SEQ ID NO: 536754 - DNA, 20 bp, Artificial
  CRISPR gRNA sequence
ctcctgcaaggctcattgag

SEQ ID NO: 536755 - DNA, 20 bp, Artificial
  CRISPR gRNA sequence
tcctgcaaggctcattgaga

SEQ ID NO: 536756 - DNA, 20 bp, Artificial
  CRISPR gRNA sequence
aaggctcattgagagggttc

SEQ ID NO: 536757 - DNA, 20 bp, Artificial
  CRISPR gRNA sequence
aggctcattgagagggttcc

SEQ ID NO: 536758 - DNA, 20 bp, Artificial
  CRISPR gRNA sequence
gggttccaggaaacgatatg

SEQ ID NO: 536759 - DNA, 20 bp, Artificial
  CRISPR gRNA sequence
gttccaggaaacgatatgca

SEQ ID NO: 536760 - DNA, 20 bp, Artificial
  CRISPR gRNA sequence
tccaggaaacgatatgcaga

SEQ ID NO: 536761 - DNA, 20 bp, Artificial
  CRISPR gRNA sequence
aggaaacgatatgcagagag

SEQ ID NO: 536762 - DNA, 20 bp, Artificial
  CRISPR gRNA sequence
aacgatatgcagagagtggc

SEQ ID NO: 536763 - DNA, 20 bp, Artificial
  CRISPR gRNA sequence
tatgcagagagtggctagtg

SEQ ID NO: 536764 - DNA, 20 bp, Artificial
  CRISPR gRNA sequence
agagtggctagtgcagtgca

SEQ ID NO: 536765 - DNA, 20 bp, Artificial
  CRISPR gRNA sequence
ctagtgcagtgcatggcaca

SEQ ID NO: 536766 - DNA, 20 bp, Artificial
  CRISPR gRNA sequence
tgcagtgcatggcacacagt

SEQ ID NO: 536767 - DNA, 20 bp, Artificial
  CRISPR gRNA sequence
agttggtacttaatacacta

SEQ ID NO: 536768 - DNA, 20 bp, Artificial
  CRISPR gRNA sequence
ggtacttaatacactatggt

SEQ ID NO: 536769 - DNA, 20 bp, Artificial
  CRISPR gRNA sequence
gttacttcttattactgtac

SEQ ID NO: 536770 - DNA, 20 bp, Artificial
  CRISPR gRNA sequence
ttacttcttattactgtaca

SEQ ID NO: 536771 - DNA, 20 bp, Artificial
  CRISPR gRNA sequence
ttactgtacaaggcaaccaa

SEQ ID NO: 536772 - DNA, 20 bp, Artificial
  CRISPR gRNA sequence
gtacaaggcaaccaacagat

SEQ ID NO: 536773 - DNA, 20 bp, Artificial
  CRISPR gRNA sequence
accaacagatgagtacaatc

SEQ ID NO: 536774 - DNA, 20 bp, Artificial
  CRISPR gRNA sequence
tgagtacaatctggcttccc

SEQ ID NO: 536775 - DNA, 20 bp, Artificial
  CRISPR gRNA sequence
caatctggcttcccaagtaa

SEQ ID NO: 536776 - DNA, 20 bp, Artificial
  CRISPR gRNA sequence
aatctggcttcccaagtaat

SEQ ID NO: 536777 - DNA, 20 bp, Artificial
  CRISPR gRNA sequence
tcccaagtaatgggcatcta

SEQ ID NO: 536778 - DNA, 20 bp, Artificial
  CRISPR gRNA sequence
caagtaatgggcatctacag

SEQ ID NO: 536779 - DNA, 20 bp, Artificial
  CRISPR gRNA sequence
aagtaatgggcatctacagc

SEQ ID NO: 536780 - DNA, 20 bp, Artificial
  CRISPR gRNA sequence
agtaatgggcatctacagca

SEQ ID NO: 536781 - DNA, 20 bp, Artificial
  CRISPR gRNA sequence
cagcagggctgctgttgttc

SEQ ID NO: 536782 - DNA, 20 bp, Artificial
  CRISPR gRNA sequence
gggctgctgttgttctggca

SEQ ID NO: 536783 - DNA, 20 bp, Artificial
  CRISPR gRNA sequence
gctgctgttgttctggcaca

SEQ ID NO: 536784 - DNA, 20 bp, Artificial
  CRISPR gRNA sequence
ttgttctggcacagagtgca

SEQ ID NO: 536785 - DNA, 20 bp, Artificial
  CRISPR gRNA sequence
ggcacagagtgcacagcctg

SEQ ID NO: 536786 - DNA, 20 bp, Artificial
  CRISPR gRNA sequence
cagcctgcagtgtacttact

SEQ ID NO: 536787 - DNA, 20 bp, Artificial
  CRISPR gRNA sequence
tgtacttacttggttctgtc

SEQ ID NO: 536788 - DNA, 20 bp, Artificial
  CRISPR gRNA sequence
tctggttttctgtcacattt

SEQ ID NO: 536789 - DNA, 20 bp, Artificial
  CRISPR gRNA sequence
tttcagaatacctaaaaatg

SEQ ID NO: 536790 - DNA, 20 bp, Artificial
  CRISPR gRNA sequence
agaaattgtcttctcaatta

SEQ ID NO: 536791 - DNA, 20 bp, Artificial
  CRISPR gRNA sequence
ttctcaattaaagaactgaa

SEQ ID NO: 536792 - DNA, 20 bp, Artificial
  CRISPR gRNA sequence
aattaaagaactgaaaagaa

SEQ ID NO: 536793 - DNA, 20 bp, Artificial
  CRISPR gRNA sequence
attaaagaactgaaaagaaa

SEQ ID NO: 536794 - DNA, 20 bp, Artificial
  CRISPR gRNA sequence
tgaaaagaaaaggtgaaatg

SEQ ID NO: 536795 - DNA, 20 bp, Artificial
  CRISPR gRNA sequence
aaaagaaaaggtgaaatgtg

SEQ ID NO: 536796 - DNA, 20 bp, Artificial
  CRISPR gRNA sequence
tggagttactgactgcctat

SEQ ID NO: 536797 - DNA, 20 bp, Artificial
  CRISPR gRNA sequence
gagttactgactgcctatta

SEQ ID NO: 536798 - DNA, 20 bp, Artificial
  CRISPR gRNA sequence
agttactgactgcctattag

SEQ ID NO: 536799 - DNA, 20 bp, Artificial
  CRISPR gRNA sequence
gcctattagaggcctaaata

SEQ ID NO: 536800 - DNA, 20 bp, Artificial
  CRISPR gRNA sequence
aggcctaaatatggaaaact

SEQ ID NO: 536801 - DNA, 20 bp, Artificial
  CRISPR gRNA sequence
ctaaatatggaaaactaagc

SEQ ID NO: 536802 - DNA, 20 bp, Artificial
  CRISPR gRNA sequence
aaatatggaaaactaagcca

SEQ ID NO: 536803 - DNA, 20 bp, Artificial
  CRISPR gRNA sequence
aagccagagccccatcaccc

SEQ ID NO: 536804 - DNA, 20 bp, Artificial
  CRISPR gRNA sequence
agccagagccccatcaccct

SEQ ID NO: 536805 - DNA, 20 bp, Artificial
  CRISPR gRNA sequence
ctatatgctttaaatcaaat

SEQ ID NO: 536806 - DNA, 20 bp, Artificial
  CRISPR gRNA sequence
gctttaaatcaaatcggcta

SEQ ID NO: 536807 - DNA, 20 bp, Artificial
  CRISPR gRNA sequence
tttaaatcaaatcggctaca

SEQ ID NO: 536808 - DNA, 20 bp, Artificial
  CRISPR gRNA sequence
aatcaaatcggctacagagc

SEQ ID NO: 536809 - DNA, 20 bp, Artificial
  CRISPR gRNA sequence
tcggctacagagctggtcca

SEQ ID NO: 536810 - DNA, 20 bp, Artificial
  CRISPR gRNA sequence
ggctacagagctggtccaaa

SEQ ID NO: 536811 - DNA, 20 bp, Artificial
  CRISPR gRNA sequence
ccaaagagttgttcaaaaat

SEQ ID NO: 536812 - DNA, 20 bp, Artificial
  CRISPR gRNA sequence
agagttgttcaaaaattggt

SEQ ID NO: 536813 - DNA, 20 bp, Artificial
  CRISPR gRNA sequence
aaaaattggtcagaacatga

SEQ ID NO: 536814 - DNA, 20 bp, Artificial
  CRISPR gRNA sequence
tgcaaaaactgttgacaaaa

SEQ ID NO: 536815 - DNA, 20 bp, Artificial
  CRISPR gRNA sequence
gctaattttacctcgtgcat

SEQ ID NO: 536816 - DNA, 20 bp, Artificial
  CRISPR gRNA sequence
ctaattttacctcgtgcata

SEQ ID NO: 536817 - DNA, 20 bp, Artificial
  CRISPR gRNA sequence
ttacctcgtgcataaggctg

SEQ ID NO: 536818 - DNA, 20 bp, Artificial
  CRISPR gRNA sequence
cgtgcataaggctgaagatg

SEQ ID NO: 536819 - DNA, 20 bp, Artificial
  CRISPR gRNA sequence
gtgcataaggctgaagatgc

SEQ ID NO: 536820 - DNA, 20 bp, Artificial
  CRISPR gRNA sequence
tgcataaggctgaagatgca

SEQ ID NO: 536821 - DNA, 20 bp, Artificial
  CRISPR gRNA sequence
ataaggctgaagatgcaggg

SEQ ID NO: 536822 - DNA, 20 bp, Artificial
  CRISPR gRNA sequence
taaggctgaagatgcaggga

SEQ ID NO: 536823 - DNA, 20 bp, Artificial
  CRISPR gRNA sequence
gctgaagatgcagggaaggc

SEQ ID NO: 536824 - DNA, 20 bp, Artificial
  CRISPR gRNA sequence
agatgcagggaaggctagaa

SEQ ID NO: 536825 - DNA, 20 bp, Artificial
  CRISPR gRNA sequence
cagggaaggctagaatagtt

SEQ ID NO: 536826 - DNA, 20 bp, Artificial
  CRISPR gRNA sequence
aaggctagaatagtttggac

SEQ ID NO: 536827 - DNA, 20 bp, Artificial
  CRISPR gRNA sequence
tttggaccagtgctgtccaa

SEQ ID NO: 536828 - DNA, 20 bp, Artificial
  CRISPR gRNA sequence
gtccaatagaaatataatgc

SEQ ID NO: 536829 - DNA, 20 bp, Artificial
  CRISPR gRNA sequence
aaatataatgcaagccacat

SEQ ID NO: 536830 - DNA, 20 bp, Artificial
  CRISPR gRNA sequence
cataagtaatttaaaatttt

SEQ ID NO: 536831 - DNA, 20 bp, Artificial
  CRISPR gRNA sequence
tttttggtatccacattaca

SEQ ID NO: 536832 - DNA, 20 bp, Artificial
  CRISPR gRNA sequence
caatataaacattttttaat

SEQ ID NO: 536833 - DNA, 20 bp, Artificial
  CRISPR gRNA sequence
attttatattctttcacaca

SEQ ID NO: 536834 - DNA, 20 bp, Artificial
  CRISPR gRNA sequence
tattctttcacacacggtct

SEQ ID NO: 536835 - DNA, 20 bp, Artificial
  CRISPR gRNA sequence
aacatattattttacactca

SEQ ID NO: 536836 - DNA, 20 bp, Artificial
  CRISPR gRNA sequence
actcacagcacatgataatt

SEQ ID NO: 536837 - DNA, 20 bp, Artificial
  CRISPR gRNA sequence
aatttggactcccacatttc

SEQ ID NO: 536838 - DNA, 20 bp, Artificial
  CRISPR gRNA sequence
cccacatttcaagtgctcca

SEQ ID NO: 536839 - DNA, 20 bp, Artificial
  CRISPR gRNA sequence
aagtgctccatagccacatg

SEQ ID NO: 536840 - DNA, 20 bp, Artificial
  CRISPR gRNA sequence
ccatagccacatgtagctca

SEQ ID NO: 536841 - DNA, 20 bp, Artificial
  CRISPR gRNA sequence
gtagctcatggctactattt

SEQ ID NO: 536842 - DNA, 20 bp, Artificial
  CRISPR gRNA sequence
tggctactatttcagacatt

SEQ ID NO: 536843 - DNA, 20 bp, Artificial
  CRISPR gRNA sequence
atgcatcactttcctgccca

SEQ ID NO: 536844 - DNA, 20 bp, Artificial
  CRISPR gRNA sequence
catcactttcctgcccacag

SEQ ID NO: 536845 - DNA, 20 bp, Artificial
  CRISPR gRNA sequence
atcactttcctgcccacagt

SEQ ID NO: 536846 - DNA, 20 bp, Artificial
  CRISPR gRNA sequence
agtaggcatccgcctgaccc

SEQ ID NO: 536847 - DNA, 20 bp, Artificial
  CRISPR gRNA sequence
gcctgaccctagaactatgc

SEQ ID NO: 536848 - DNA, 20 bp, Artificial
  CRISPR gRNA sequence
tgaccctagaactatgctag

SEQ ID NO: 536849 - DNA, 20 bp, Artificial
  CRISPR gRNA sequence
ctagaactatgctagtggtt

SEQ ID NO: 536850 - DNA, 20 bp, Artificial
  CRISPR gRNA sequence
gaactatgctagtggttcag

SEQ ID NO: 536851 - DNA, 20 bp, Artificial
  CRISPR gRNA sequence
atgctagtggttcagaagct

SEQ ID NO: 536852 - DNA, 20 bp, Artificial
  CRISPR gRNA sequence
tggttcagaagcttagtcaa

SEQ ID NO: 536853 - DNA, 20 bp, Artificial
  CRISPR gRNA sequence
ggttcagaagcttagtcaat

SEQ ID NO: 536854 - DNA, 20 bp, Artificial
  CRISPR gRNA sequence
gttcagaagcttagtcaata

SEQ ID NO: 536855 - DNA, 20 bp, Artificial
  CRISPR gRNA sequence
gcttagtcaatagggttgac

SEQ ID NO: 536856 - DNA, 20 bp, Artificial
  CRISPR gRNA sequence
ttagtcaatagggttgacta

SEQ ID NO: 536857 - DNA, 20 bp, Artificial
  CRISPR gRNA sequence
agggttgactagagcttata

SEQ ID NO: 536858 - DNA, 20 bp, Artificial
  CRISPR gRNA sequence
agttgtctgtcaactacaac

SEQ ID NO: 536859 - DNA, 20 bp, Artificial
  CRISPR gRNA sequence
gttgtctgtcaactacaact

SEQ ID NO: 536860 - DNA, 20 bp, Artificial
  CRISPR gRNA sequence
gtctgtcaactacaactagg

SEQ ID NO: 536861 - DNA, 20 bp, Artificial
  CRISPR gRNA sequence
gtcaactacaactaggcagc

SEQ ID NO: 536862 - DNA, 20 bp, Artificial
  CRISPR gRNA sequence
caactacaactaggcagctg

SEQ ID NO: 536863 - DNA, 20 bp, Artificial
  CRISPR gRNA sequence
ttcaactctttcctcttctg

SEQ ID NO: 536864 - DNA, 20 bp, Artificial
  CRISPR gRNA sequence
atttcccaattaatgacttt

SEQ ID NO: 536865 - DNA, 20 bp, Artificial
  CRISPR gRNA sequence
tttcccaattaatgacttta

SEQ ID NO: 536866 - DNA, 20 bp, Artificial
  CRISPR gRNA sequence
aatgactttaaggttgctta

SEQ ID NO: 536867 - DNA, 20 bp, Artificial
  CRISPR gRNA sequence
atgactttaaggttgcttaa

SEQ ID NO: 536868 - DNA, 20 bp, Artificial
  CRISPR gRNA sequence
tttaaggttgcttaaaggtt

SEQ ID NO: 536869 - DNA, 20 bp, Artificial
  CRISPR gRNA sequence
taaaggttgagatgcttgct

SEQ ID NO: 536870 - DNA, 20 bp, Artificial
  CRISPR gRNA sequence
tttttgtttgtttgtttttt

SEQ ID NO: 536871 - DNA, 20 bp, Artificial
  CRISPR gRNA sequence
tgtttgtttgttttttgaga

SEQ ID NO: 536872 - DNA, 20 bp, Artificial
  CRISPR gRNA sequence
gtttgtttgttttttgagac

SEQ ID NO: 536873 - DNA, 20 bp, Artificial
  CRISPR gRNA sequence
tttgtttgttttttgagaca

SEQ ID NO: 536874 - DNA, 20 bp, Artificial
  CRISPR gRNA sequence
cagggtctcactccatcacc

SEQ ID NO: 536875 - DNA, 20 bp, Artificial
  CRISPR gRNA sequence
agggtctcactccatcaccc

SEQ ID NO: 536876 - DNA, 20 bp, Artificial
  CRISPR gRNA sequence
tctcactccatcacccaggc

SEQ ID NO: 536877 - DNA, 20 bp, Artificial
  CRISPR gRNA sequence
tcactccatcacccaggctg

SEQ ID NO: 536878 - DNA, 20 bp, Artificial
  CRISPR gRNA sequence
ccatcacccaggctggagtg

SEQ ID NO: 536879 - DNA, 20 bp, Artificial
  CRISPR gRNA sequence
tcacccaggctggagtgcag

SEQ ID NO: 536880 - DNA, 20 bp, Artificial
  CRISPR gRNA sequence
ggagtgcagtggcacaatct

SEQ ID NO: 536881 - DNA, 20 bp, Artificial
  CRISPR gRNA sequence
catctgcctccctcccgcct

SEQ ID NO: 536882 - DNA, 20 bp, Artificial
  CRISPR gRNA sequence
ccctcccgcctcagcctcct

SEQ ID NO: 536883 - DNA, 20 bp, Artificial
  CRISPR gRNA sequence
tcccgcctcagcctcctgag

SEQ ID NO: 536884 - DNA, 20 bp, Artificial
  CRISPR gRNA sequence
gcctcagcctcctgagtagc

SEQ ID NO: 536885 - DNA, 20 bp, Artificial
  CRISPR gRNA sequence
cctcagcctcctgagtagct

SEQ ID NO: 536886 - DNA, 20 bp, Artificial
  CRISPR gRNA sequence
ctcctgagtagctgggacta

SEQ ID NO: 536887 - DNA, 20 bp, Artificial
  CRISPR gRNA sequence
tcctgagtagctgggactac

SEQ ID NO: 536888 - DNA, 20 bp, Artificial
  CRISPR gRNA sequence
caggcatgcaccaccatgcc

SEQ ID NO: 536889 - DNA, 20 bp, Artificial
  CRISPR gRNA sequence
ctaatttttgtatttttttg

SEQ ID NO: 536890 - DNA, 20 bp, Artificial
  CRISPR gRNA sequence
aatttttgtatttttttgta

SEQ ID NO: 536891 - DNA, 20 bp, Artificial
  CRISPR gRNA sequence
tttgtatttttttgtagaga

SEQ ID NO: 536892 - DNA, 20 bp, Artificial
  CRISPR gRNA sequence
tagtgtttcaccatgttgtc

SEQ ID NO: 536893 - DNA, 20 bp, Artificial
  CRISPR gRNA sequence
agtgtttcaccatgttgtcc

SEQ ID NO: 536894 - DNA, 20 bp, Artificial
  CRISPR gRNA sequence
tttcaccatgttgtccaggc

SEQ ID NO: 536895 - DNA, 20 bp, Artificial
  CRISPR gRNA sequence
ccaggctggtctcaaactcc

SEQ ID NO: 536896 - DNA, 20 bp, Artificial
  CRISPR gRNA sequence
caggctggtctcaaactcct

SEQ ID NO: 536897 - DNA, 20 bp, Artificial
  CRISPR gRNA sequence
ggtctcaaactcctgggctc

SEQ ID NO: 536898 - DNA, 20 bp, Artificial
  CRISPR gRNA sequence
aactcgacctctcaatgtgc

SEQ ID NO: 536899 - DNA, 20 bp, Artificial
  CRISPR gRNA sequence
actcgacctctcaatgtgct

SEQ ID NO: 536900 - DNA, 20 bp, Artificial
  CRISPR gRNA sequence
ctctcaatgtgctgggatta

SEQ ID NO: 536901 - DNA, 20 bp, Artificial
  CRISPR gRNA sequence
tctcaatgtgctgggattac

SEQ ID NO: 536902 - DNA, 20 bp, Artificial
  CRISPR gRNA sequence
tgtgctgggattacaggcat

SEQ ID NO: 536903 - DNA, 20 bp, Artificial
  CRISPR gRNA sequence
caggcatgagccaccatgcc

SEQ ID NO: 536904 - DNA, 20 bp, Artificial
  CRISPR gRNA sequence
ccaaattgtttttttttttt

SEQ ID NO: 536905 - DNA, 20 bp, Artificial
  CRISPR gRNA sequence
tttttaagaacaaatttttt

SEQ ID NO: 536906 - DNA, 20 bp, Artificial
  CRISPR gRNA sequence
acaaattttttcagattatc

SEQ ID NO: 536907 - DNA, 20 bp, Artificial
  CRISPR gRNA sequence
caaattttttcagattatct

SEQ ID NO: 536908 - DNA, 20 bp, Artificial
  CRISPR gRNA sequence
aaattttttcagattatctg

SEQ ID NO: 536909 - DNA, 20 bp, Artificial
  CRISPR gRNA sequence
ttcagattatctggggctaa

SEQ ID NO: 536910 - DNA, 20 bp, Artificial
  CRISPR gRNA sequence
ctggggctaacagtactgac

SEQ ID NO: 536911 - DNA, 20 bp, Artificial
  CRISPR gRNA sequence
tggggctaacagtactgacc

SEQ ID NO: 536912 - DNA, 20 bp, Artificial
  CRISPR gRNA sequence
ggggctaacagtactgacca

SEQ ID NO: 536913 - DNA, 20 bp, Artificial
  CRISPR gRNA sequence
gggctaacagtactgaccag

SEQ ID NO: 536914 - DNA, 20 bp, Artificial
  CRISPR gRNA sequence
gctaacagtactgaccaggg

SEQ ID NO: 536915 - DNA, 20 bp, Artificial
  CRISPR gRNA sequence
tgactttttttttttttttt

SEQ ID NO: 536916 - DNA, 20 bp, Artificial
  CRISPR gRNA sequence
gaaatcaaccaattgttttg

SEQ ID NO: 536917 - DNA, 20 bp, Artificial
  CRISPR gRNA sequence
ccaattgttttgaagttcta

SEQ ID NO: 536918 - DNA, 20 bp, Artificial
  CRISPR gRNA sequence
tttgaagttctatggaaact

SEQ ID NO: 536919 - DNA, 20 bp, Artificial
  CRISPR gRNA sequence
aactcagtgccacctctctt

SEQ ID NO: 536920 - DNA, 20 bp, Artificial
  CRISPR gRNA sequence
agtgccacctctctttagtt

SEQ ID NO: 536921 - DNA, 20 bp, Artificial
  CRISPR gRNA sequence
gtgccacctctctttagttc

SEQ ID NO: 536922 - DNA, 20 bp, Artificial
  CRISPR gRNA sequence
tctctttagttcaggtatcc

SEQ ID NO: 536923 - DNA, 20 bp, Artificial
  CRISPR gRNA sequence
ctctttagttcaggtatcct

SEQ ID NO: 536924 - DNA, 20 bp, Artificial
  CRISPR gRNA sequence
ttagttcaggtatcctgggt

SEQ ID NO: 536925 - DNA, 20 bp, Artificial
  CRISPR gRNA sequence
cctgggttagttctttaatt

SEQ ID NO: 536926 - DNA, 20 bp, Artificial
  CRISPR gRNA sequence
ttgagatctacaacaacact

SEQ ID NO: 536927 - DNA, 20 bp, Artificial
  CRISPR gRNA sequence
agatctacaacaacactgag

SEQ ID NO: 536928 - DNA, 20 bp, Artificial
  CRISPR gRNA sequence
cactgagtggaaaatgattt

SEQ ID NO: 536929 - DNA, 20 bp, Artificial
  CRISPR gRNA sequence
tggaaaatgattttggtttc

SEQ ID NO: 536930 - DNA, 20 bp, Artificial
  CRISPR gRNA sequence
ggaaaatgattttggtttct

SEQ ID NO: 536931 - DNA, 20 bp, Artificial
  CRISPR gRNA sequence
tttctgggaaccaacctgtt

SEQ ID NO: 536932 - DNA, 20 bp, Artificial
  CRISPR gRNA sequence
ttctgggaaccaacctgttc

SEQ ID NO: 536933 - DNA, 20 bp, Artificial
  CRISPR gRNA sequence
ctgggaaccaacctgttcag

SEQ ID NO: 536934 - DNA, 20 bp, Artificial
  CRISPR gRNA sequence
ttaactattatactgctatt

SEQ ID NO: 536935 - DNA, 20 bp, Artificial
  CRISPR gRNA sequence
taactattatactgctattt

SEQ ID NO: 536936 - DNA, 20 bp, Artificial
  CRISPR gRNA sequence
aactattatactgctatttg

SEQ ID NO: 536937 - DNA, 20 bp, Artificial
  CRISPR gRNA sequence
ctgctatttggggattaaaa

SEQ ID NO: 536938 - DNA, 20 bp, Artificial
  CRISPR gRNA sequence
aatagatttttaaaaaattt

SEQ ID NO: 536939 - DNA, 20 bp, Artificial
  CRISPR gRNA sequence
tcccaaaatattttatgcat

SEQ ID NO: 536940 - DNA, 20 bp, Artificial
  CRISPR gRNA sequence
cccaaaatattttatgcatt

SEQ ID NO: 536941 - DNA, 20 bp, Artificial
  CRISPR gRNA sequence
atattttatgcattgggcaa

SEQ ID NO: 536942 - DNA, 20 bp, Artificial
  CRISPR gRNA sequence
caatagctgaaaactttctt

SEQ ID NO: 536943 - DNA, 20 bp, Artificial
  CRISPR gRNA sequence
ctgatcgttataatactgtt

SEQ ID NO: 536944 - DNA, 20 bp, Artificial
  CRISPR gRNA sequence
atcgttataatactgtttag

SEQ ID NO: 536945 - DNA, 20 bp, Artificial
  CRISPR gRNA sequence
cgttataatactgtttagtg

SEQ ID NO: 536946 - DNA, 20 bp, Artificial
  CRISPR gRNA sequence
ttataatactgtttagtgga

SEQ ID NO: 536947 - DNA, 20 bp, Artificial
  CRISPR gRNA sequence
ctgactgataatctattact

SEQ ID NO: 536948 - DNA, 20 bp, Artificial
  CRISPR gRNA sequence
tgactgataatctattactt

SEQ ID NO: 536949 - DNA, 20 bp, Artificial
  CRISPR gRNA sequence
gactgataatctattactta

SEQ ID NO: 536950 - DNA, 20 bp, Artificial
  CRISPR gRNA sequence
gataatctattacttaggga

SEQ ID NO: 536951 - DNA, 20 bp, Artificial
  CRISPR gRNA sequence
tacttagggatggattttca

SEQ ID NO: 536952 - DNA, 20 bp, Artificial
  CRISPR gRNA sequence
taatatgaaaatgttatcat

SEQ ID NO: 536953 - DNA, 20 bp, Artificial
  CRISPR gRNA sequence
aatatgaaaatgttatcatc

SEQ ID NO: 536954 - DNA, 20 bp, Artificial
  CRISPR gRNA sequence
tatcatcaggaaattatatt

SEQ ID NO: 536955 - DNA, 20 bp, Artificial
  CRISPR gRNA sequence
ttagcactgatatcgcaaaa

SEQ ID NO: 536956 - DNA, 20 bp, Artificial
  CRISPR gRNA sequence
actgatatcgcaaaatagtc

SEQ ID NO: 536957 - DNA, 20 bp, Artificial
  CRISPR gRNA sequence
agtctagttctgcactgacc

SEQ ID NO: 536958 - DNA, 20 bp, Artificial
  CRISPR gRNA sequence
aagaaaactttctgcaatga

SEQ ID NO: 536959 - DNA, 20 bp, Artificial
  CRISPR gRNA sequence
agaaaactttctgcaatgat

SEQ ID NO: 536960 - DNA, 20 bp, Artificial
  CRISPR gRNA sequence
tgataggattattccttatc

SEQ ID NO: 536961 - DNA, 20 bp, Artificial
  CRISPR gRNA sequence
gataggattattccttatct

SEQ ID NO: 536962 - DNA, 20 bp, Artificial
  CRISPR gRNA sequence
tattccttatctgggctatc

SEQ ID NO: 536963 - DNA, 20 bp, Artificial
  CRISPR gRNA sequence
cttatctgggctatccagta

SEQ ID NO: 536964 - DNA, 20 bp, Artificial
  CRISPR gRNA sequence
atctgggctatccagtatgg

SEQ ID NO: 536965 - DNA, 20 bp, Artificial
  CRISPR gRNA sequence
ctatccagtatggtagccac

SEQ ID NO: 536966 - DNA, 20 bp, Artificial
  CRISPR gRNA sequence
ccagtatggtagccactagc

SEQ ID NO: 536967 - DNA, 20 bp, Artificial
  CRISPR gRNA sequence
tggtagccactagccagatg

SEQ ID NO: 536968 - DNA, 20 bp, Artificial
  CRISPR gRNA sequence
ggtagccactagccagatgt

SEQ ID NO: 536969 - DNA, 20 bp, Artificial
  CRISPR gRNA sequence
actagccagatgtaggtatt

SEQ ID NO: 536970 - DNA, 20 bp, Artificial
  CRISPR gRNA sequence
tgtaggtattgagcacttga

SEQ ID NO: 536971 - DNA, 20 bp, Artificial
  CRISPR gRNA sequence
gtaggtattgagcacttgaa

SEQ ID NO: 536972 - DNA, 20 bp, Artificial
  CRISPR gRNA sequence
ggtattgagcacttgaaagg

SEQ ID NO: 536973 - DNA, 20 bp, Artificial
  CRISPR gRNA sequence
ttgagcacttgaaaggtggt

SEQ ID NO: 536974 - DNA, 20 bp, Artificial
  CRISPR gRNA sequence
gaaaggtggttagtgtaact

SEQ ID NO: 536975 - DNA, 20 bp, Artificial
  CRISPR gRNA sequence
aaaggtggttagtgtaactg

SEQ ID NO: 536976 - DNA, 20 bp, Artificial
  CRISPR gRNA sequence
ggaatgaatcttaaatttaa

SEQ ID NO: 536977 - DNA, 20 bp, Artificial
  CRISPR gRNA sequence
tatatttaaataatcatatg

SEQ ID NO: 536978 - DNA, 20 bp, Artificial
  CRISPR gRNA sequence
aataatcatatgtggctaat

SEQ ID NO: 536979 - DNA, 20 bp, Artificial
  CRISPR gRNA sequence
taattggctactatactaaa

SEQ ID NO: 536980 - DNA, 20 bp, Artificial
  CRISPR gRNA sequence
ggctactatactaaacagtg

SEQ ID NO: 536981 - DNA, 20 bp, Artificial
  CRISPR gRNA sequence
gctactatactaaacagtgc

SEQ ID NO: 536982 - DNA, 20 bp, Artificial
  CRISPR gRNA sequence
atactaaacagtgcaggtct

SEQ ID NO: 536983 - DNA, 20 bp, Artificial
  CRISPR gRNA sequence
tactaaacagtgcaggtcta

SEQ ID NO: 536984 - DNA, 20 bp, Artificial
  CRISPR gRNA sequence
ggtctaaggaaactgaaatc

SEQ ID NO: 536985 - DNA, 20 bp, Artificial
  CRISPR gRNA sequence
aaacttgattcatgacacaa

SEQ ID NO: 536986 - DNA, 20 bp, Artificial
  CRISPR gRNA sequence
attcatgacacaatggatcc

SEQ ID NO: 536987 - DNA, 20 bp, Artificial
  CRISPR gRNA sequence
atcctagatactatcacttg

SEQ ID NO: 536988 - DNA, 20 bp, Artificial
  CRISPR gRNA sequence
tagatactatcacttgtaga

SEQ ID NO: 536989 - DNA, 20 bp, Artificial
  CRISPR gRNA sequence
cttgtagaaagtttactctt

SEQ ID NO: 536990 - DNA, 20 bp, Artificial
  CRISPR gRNA sequence
actcttcggcattccctgtc

SEQ ID NO: 536991 - DNA, 20 bp, Artificial
  CRISPR gRNA sequence
ctgtctggcatatttccttt

SEQ ID NO: 536992 - DNA, 20 bp, Artificial
  CRISPR gRNA sequence
tggcatatttccttttggtg

SEQ ID NO: 536993 - DNA, 20 bp, Artificial
  CRISPR gRNA sequence
ggcatatttccttttggtga

SEQ ID NO: 536994 - DNA, 20 bp, Artificial
  CRISPR gRNA sequence
tatttccttttggtgaaggc

SEQ ID NO: 536995 - DNA, 20 bp, Artificial
  CRISPR gRNA sequence
ccttttggtgaaggctggta

SEQ ID NO: 536996 - DNA, 20 bp, Artificial
  CRISPR gRNA sequence
ggctggtatggaaactgctg

SEQ ID NO: 536997 - DNA, 20 bp, Artificial
  CRISPR gRNA sequence
atggaaactgctgtggcatc

SEQ ID NO: 536998 - DNA, 20 bp, Artificial
  CRISPR gRNA sequence
catcaagaatatccactctt

SEQ ID NO: 536999 - DNA, 20 bp, Artificial
  CRISPR gRNA sequence
atatccactcttcagaatta

SEQ ID NO: 537000 - DNA, 20 bp, Artificial
  CRISPR gRNA sequence
acagcctgctccctgtcctt

SEQ ID NO: 537001 - DNA, 20 bp, Artificial
  CRISPR gRNA sequence
cagcctgctccctgtccttt

SEQ ID NO: 537002 - DNA, 20 bp, Artificial
  CRISPR gRNA sequence
ctccctgtcctttgggattt

SEQ ID NO: 537003 - DNA, 20 bp, Artificial
  CRISPR gRNA sequence
ccctgtcctttgggatttga

SEQ ID NO: 537004 - DNA, 20 bp, Artificial
  CRISPR gRNA sequence
cctgtcctttgggatttgag

SEQ ID NO: 537005 - DNA, 20 bp, Artificial
  CRISPR gRNA sequence
ctgtcctttgggatttgaga

SEQ ID NO: 537006 - DNA, 20 bp, Artificial
  CRISPR gRNA sequence
tgagagggattactcattac

SEQ ID NO: 537007 - DNA, 20 bp, Artificial
  CRISPR gRNA sequence
gagagggattactcattacc

SEQ ID NO: 537008 - DNA, 20 bp, Artificial
  CRISPR gRNA sequence
tactcattaccaggaatgaa

SEQ ID NO: 537009 - DNA, 20 bp, Artificial
  CRISPR gRNA sequence
actcattaccaggaatgaac

SEQ ID NO: 537010 - DNA, 20 bp, Artificial
  CRISPR gRNA sequence
attaccaggaatgaacaggc

SEQ ID NO: 537011 - DNA, 20 bp, Artificial
  CRISPR gRNA sequence
ttaccaggaatgaacaggct

SEQ ID NO: 537012 - DNA, 20 bp, Artificial
  CRISPR gRNA sequence
aggctgggaacaaattctcc

SEQ ID NO: 537013 - DNA, 20 bp, Artificial
  CRISPR gRNA sequence
gaacaaattctccaagtcat

SEQ ID NO: 537014 - DNA, 20 bp, Artificial
  CRISPR gRNA sequence
ctccaagtcatcagttctcc

SEQ ID NO: 537015 - DNA, 20 bp, Artificial
  CRISPR gRNA sequence
tccaagctgtatgactgccc

SEQ ID NO: 537016 - DNA, 20 bp, Artificial
  CRISPR gRNA sequence
gtatgactgcccaagattgc

SEQ ID NO: 537017 - DNA, 20 bp, Artificial
  CRISPR gRNA sequence
tatgactgcccaagattgct

SEQ ID NO: 537018 - DNA, 20 bp, Artificial
  CRISPR gRNA sequence
atgactgcccaagattgcta

SEQ ID NO: 537019 - DNA, 20 bp, Artificial
  CRISPR gRNA sequence
tgactgcccaagattgctag

SEQ ID NO: 537020 - DNA, 20 bp, Artificial
  CRISPR gRNA sequence
cccaagattgctaggggact

SEQ ID NO: 537021 - DNA, 20 bp, Artificial
  CRISPR gRNA sequence
aagattgctaggggactgag

SEQ ID NO: 537022 - DNA, 20 bp, Artificial
  CRISPR gRNA sequence
agattgctaggggactgaga

SEQ ID NO: 537023 - DNA, 20 bp, Artificial
  CRISPR gRNA sequence
gctaggggactgagaaggct

SEQ ID NO: 537024 - DNA, 20 bp, Artificial
  CRISPR gRNA sequence
ctaggggactgagaaggctc

SEQ ID NO: 537025 - DNA, 20 bp, Artificial
  CRISPR gRNA sequence
ggggactgagaaggctcagg

SEQ ID NO: 537026 - DNA, 20 bp, Artificial
  CRISPR gRNA sequence
gaaggctcaggaagtaatac

SEQ ID NO: 537027 - DNA, 20 bp, Artificial
  CRISPR gRNA sequence
cacaattacttgtattacgt

SEQ ID NO: 537028 - DNA, 20 bp, Artificial
  CRISPR gRNA sequence
accaaaactcccttcctacc

SEQ ID NO: 537029 - DNA, 20 bp, Artificial
  CRISPR gRNA sequence
ccaaaactcccttcctacct

SEQ ID NO: 537030 - DNA, 20 bp, Artificial
  CRISPR gRNA sequence
aaaactcccttcctacctgg

SEQ ID NO: 537031 - DNA, 20 bp, Artificial
  CRISPR gRNA sequence
gttatatgacatgaaaatta

SEQ ID NO: 537032 - DNA, 20 bp, Artificial
  CRISPR gRNA sequence
tatatgacatgaaaattaca

SEQ ID NO: 537033 - DNA, 20 bp, Artificial
  CRISPR gRNA sequence
atatgacatgaaaattacag

SEQ ID NO: 537034 - DNA, 20 bp, Artificial
  CRISPR gRNA sequence
tgacatgaaaattacagagg

SEQ ID NO: 537035 - DNA, 20 bp, Artificial
  CRISPR gRNA sequence
catgaaaattacagaggtgg

SEQ ID NO: 537036 - DNA, 20 bp, Artificial
  CRISPR gRNA sequence
attacagaggtggcagccta

SEQ ID NO: 537037 - DNA, 20 bp, Artificial
  CRISPR gRNA sequence
tacagaggtggcagcctaaa

SEQ ID NO: 537038 - DNA, 20 bp, Artificial
  CRISPR gRNA sequence
acagaggtggcagcctaaag

SEQ ID NO: 537039 - DNA, 20 bp, Artificial
  CRISPR gRNA sequence
tggcagcctaaagaggtctt

SEQ ID NO: 537040 - DNA, 20 bp, Artificial
  CRISPR gRNA sequence
gtctttagcaaactctgact

SEQ ID NO: 537041 - DNA, 20 bp, Artificial
  CRISPR gRNA sequence
ctttagcaaactctgacttg

SEQ ID NO: 537042 - DNA, 20 bp, Artificial
  CRISPR gRNA sequence
gcaaactctgacttggagac

SEQ ID NO: 537043 - DNA, 20 bp, Artificial
  CRISPR gRNA sequence
aactctgacttggagaccag

SEQ ID NO: 537044 - DNA, 20 bp, Artificial
  CRISPR gRNA sequence
agaagtttaactatattttg

SEQ ID NO: 537045 - DNA, 20 bp, Artificial
  CRISPR gRNA sequence
agtttaactatattttgaag

SEQ ID NO: 537046 - DNA, 20 bp, Artificial
  CRISPR gRNA sequence
ctatattttgaagcagatca

SEQ ID NO: 537047 - DNA, 20 bp, Artificial
  CRISPR gRNA sequence
tatattttgaagcagatcac

SEQ ID NO: 537048 - DNA, 20 bp, Artificial
  CRISPR gRNA sequence
ttgaagcagatcacaggtaa

SEQ ID NO: 537049 - DNA, 20 bp, Artificial
  CRISPR gRNA sequence
tgaagcagatcacaggtaaa

SEQ ID NO: 537050 - DNA, 20 bp, Artificial
  CRISPR gRNA sequence
aagcagatcacaggtaaaag

SEQ ID NO: 537051 - DNA, 20 bp, Artificial
  CRISPR gRNA sequence
agcagatcacaggtaaaagg

SEQ ID NO: 537052 - DNA, 20 bp, Artificial
  CRISPR gRNA sequence
ggtaaaaggaggctatgcaa

SEQ ID NO: 537053 - DNA, 20 bp, Artificial
  CRISPR gRNA sequence
gtaaaaggaggctatgcaac

SEQ ID NO: 537054 - DNA, 20 bp, Artificial
  CRISPR gRNA sequence
aggaggctatgcaacaggtc

SEQ ID NO: 537055 - DNA, 20 bp, Artificial
  CRISPR gRNA sequence
ggaggctatgcaacaggtcc

SEQ ID NO: 537056 - DNA, 20 bp, Artificial
  CRISPR gRNA sequence
acaggtccaggctgtgttcc

SEQ ID NO: 537057 - DNA, 20 bp, Artificial
  CRISPR gRNA sequence
caggtccaggctgtgttccc

SEQ ID NO: 537058 - DNA, 20 bp, Artificial
  CRISPR gRNA sequence
gctgtgttcccaggcctgta

SEQ ID NO: 537059 - DNA, 20 bp, Artificial
  CRISPR gRNA sequence
caggcctgtaaagctctctg

SEQ ID NO: 537060 - DNA, 20 bp, Artificial
  CRISPR gRNA sequence
tgtaaagctctctgtggcct

SEQ ID NO: 537061 - DNA, 20 bp, Artificial
  CRISPR gRNA sequence
gtaaagctctctgtggccta

SEQ ID NO: 537062 - DNA, 20 bp, Artificial
  CRISPR gRNA sequence
ctaaggattcattctacctt

SEQ ID NO: 537063 - DNA, 20 bp, Artificial
  CRISPR gRNA sequence
cattctaccttgagataatg

SEQ ID NO: 537064 - DNA, 20 bp, Artificial
  CRISPR gRNA sequence
cttgagataatgtggatctt

SEQ ID NO: 537065 - DNA, 20 bp, Artificial
  CRISPR gRNA sequence
tgagataatgtggatctttg

SEQ ID NO: 537066 - DNA, 20 bp, Artificial
  CRISPR gRNA sequence
gagataatgtggatctttgg

SEQ ID NO: 537067 - DNA, 20 bp, Artificial
  CRISPR gRNA sequence
tgtggatctttggaggaacc

SEQ ID NO: 537068 - DNA, 20 bp, Artificial
  CRISPR gRNA sequence
ttggaggaacctagcatgct

SEQ ID NO: 537069 - DNA, 20 bp, Artificial
  CRISPR gRNA sequence
gaggaacctagcatgctcag

SEQ ID NO: 537070 - DNA, 20 bp, Artificial
  CRISPR gRNA sequence
tcagcagtcccacacacgta

SEQ ID NO: 537071 - DNA, 20 bp, Artificial
  CRISPR gRNA sequence
cccacacacgtaaagcaaaa

SEQ ID NO: 537072 - DNA, 20 bp, Artificial
  CRISPR gRNA sequence
ttaaactattttctgacctt

SEQ ID NO: 537073 - DNA, 20 bp, Artificial
  CRISPR gRNA sequence
tgacctttggaaaacaatgc

SEQ ID NO: 537074 - DNA, 20 bp, Artificial
  CRISPR gRNA sequence
tcaaactattttgttttaaa

SEQ ID NO: 537075 - DNA, 20 bp, Artificial
  CRISPR gRNA sequence
gcatacataccattcatata

SEQ ID NO: 537076 - DNA, 20 bp, Artificial
  CRISPR gRNA sequence
catgttgtaattactgctaa

SEQ ID NO: 537077 - DNA, 20 bp, Artificial
  CRISPR gRNA sequence
tgtaattactgctaatggta

SEQ ID NO: 537078 - DNA, 20 bp, Artificial
  CRISPR gRNA sequence
gtaattactgctaatggtat

SEQ ID NO: 537079 - DNA, 20 bp, Artificial
  CRISPR gRNA sequence
actgctaatggtatgggtat

SEQ ID NO: 537080 - DNA, 20 bp, Artificial
  CRISPR gRNA sequence
gtcttgaatgacctataaaa

SEQ ID NO: 537081 - DNA, 20 bp, Artificial
  CRISPR gRNA sequence
gaatgacctataaaaaagaa

SEQ ID NO: 537082 - DNA, 20 bp, Artificial
  CRISPR gRNA sequence
acctataaaaaagaaaagaa

SEQ ID NO: 537083 - DNA, 20 bp, Artificial
  CRISPR gRNA sequence
gaaaagaaaagaaattcaac

SEQ ID NO: 537084 - DNA, 20 bp, Artificial
  CRISPR gRNA sequence
actagttgaactgatcaaaa

SEQ ID NO: 537085 - DNA, 20 bp, Artificial
  CRISPR gRNA sequence
aaatggatcctcattatttg

SEQ ID NO: 537086 - DNA, 20 bp, Artificial
  CRISPR gRNA sequence
tatttgcagattccaccttg

SEQ ID NO: 537087 - DNA, 20 bp, Artificial
  CRISPR gRNA sequence
aatccacaaatcaataccca

SEQ ID NO: 537088 - DNA, 20 bp, Artificial
  CRISPR gRNA sequence
ccacaaatcaatacccaaag

SEQ ID NO: 537089 - DNA, 20 bp, Artificial
  CRISPR gRNA sequence
atacccaaagcagtcattct

SEQ ID NO: 537090 - DNA, 20 bp, Artificial
  CRISPR gRNA sequence
aagcagtcattctcagacat

SEQ ID NO: 537091 - DNA, 20 bp, Artificial
  CRISPR gRNA sequence
gtcattctcagacataagaa

SEQ ID NO: 537092 - DNA, 20 bp, Artificial
  CRISPR gRNA sequence
agaacagtgatgaaaacttt

SEQ ID NO: 537093 - DNA, 20 bp, Artificial
  CRISPR gRNA sequence
aaaactttgagtcacccaat

SEQ ID NO: 537094 - DNA, 20 bp, Artificial
  CRISPR gRNA sequence
actttgagtcacccaataag

SEQ ID NO: 537095 - DNA, 20 bp, Artificial
  CRISPR gRNA sequence
tcacccaataagcagattcc

SEQ ID NO: 537096 - DNA, 20 bp, Artificial
  CRISPR gRNA sequence
cccaataagcagattcccag

SEQ ID NO: 537097 - DNA, 20 bp, Artificial
  CRISPR gRNA sequence
caataagcagattcccagca

SEQ ID NO: 537098 - DNA, 20 bp, Artificial
  CRISPR gRNA sequence
aataagcagattcccagcag

SEQ ID NO: 537099 - DNA, 20 bp, Artificial
  CRISPR gRNA sequence
aagcagattcccagcagagg

SEQ ID NO: 537100 - DNA, 20 bp, Artificial
  CRISPR gRNA sequence
attcccagcagaggtggaaa

SEQ ID NO: 537101 - DNA, 20 bp, Artificial
  CRISPR gRNA sequence
ttcccagcagaggtggaaaa

SEQ ID NO: 537102 - DNA, 20 bp, Artificial
  CRISPR gRNA sequence
agcagaggtggaaaaaggta

SEQ ID NO: 537103 - DNA, 20 bp, Artificial
  CRISPR gRNA sequence
aagctctgccttcttgtttc

SEQ ID NO: 537104 - DNA, 20 bp, Artificial
  CRISPR gRNA sequence
caagttcttacactgttaac

SEQ ID NO: 537105 - DNA, 20 bp, Artificial
  CRISPR gRNA sequence
gttaacaagtgtcctatttg

SEQ ID NO: 537106 - DNA, 20 bp, Artificial
  CRISPR gRNA sequence
tgtcctatttgcagtctatt

SEQ ID NO: 537107 - DNA, 20 bp, Artificial
  CRISPR gRNA sequence
gcatttttgtgcttttttgt

SEQ ID NO: 537108 - DNA, 20 bp, Artificial
  CRISPR gRNA sequence
gttggtgatttcactatttt

SEQ ID NO: 537109 - DNA, 20 bp, Artificial
  CRISPR gRNA sequence
ggtgatttcactattttaag

SEQ ID NO: 537110 - DNA, 20 bp, Artificial
  CRISPR gRNA sequence
cactattttaagtggtccca

SEQ ID NO: 537111 - DNA, 20 bp, Artificial
  CRISPR gRNA sequence
ttttaagtggtcccaaagta

SEQ ID NO: 537112 - DNA, 20 bp, Artificial
  CRISPR gRNA sequence
ggtcccaaagtatagtgttg

SEQ ID NO: 537113 - DNA, 20 bp, Artificial
  CRISPR gRNA sequence
gtcccaaagtatagtgttga

SEQ ID NO: 537114 - DNA, 20 bp, Artificial
  CRISPR gRNA sequence
tcccaaagtatagtgttgaa

SEQ ID NO: 537115 - DNA, 20 bp, Artificial
  CRISPR gRNA sequence
tatagtgttgaagggctgac

SEQ ID NO: 537116 - DNA, 20 bp, Artificial
  CRISPR gRNA sequence
tagtgttgaagggctgacaa

SEQ ID NO: 537117 - DNA, 20 bp, Artificial
  CRISPR gRNA sequence
aagggctgacaagagttcct

SEQ ID NO: 537118 - DNA, 20 bp, Artificial
  CRISPR gRNA sequence
tgacaagagttcctaagtgc

SEQ ID NO: 537119 - DNA, 20 bp, Artificial
  CRISPR gRNA sequence
caagagttcctaagtgcaag

SEQ ID NO: 537120 - DNA, 20 bp, Artificial
  CRISPR gRNA sequence
aagagttcctaagtgcaaga

SEQ ID NO: 537121 - DNA, 20 bp, Artificial
  CRISPR gRNA sequence
gaaggctgcgatgtgccttg

SEQ ID NO: 537122 - DNA, 20 bp, Artificial
  CRISPR gRNA sequence
aggctgcgatgtgccttgca

SEQ ID NO: 537123 - DNA, 20 bp, Artificial
  CRISPR gRNA sequence
gatgtgccttgcagagaaaa

SEQ ID NO: 537124 - DNA, 20 bp, Artificial
  CRISPR gRNA sequence
atgtgccttgcagagaaaat

SEQ ID NO: 537125 - DNA, 20 bp, Artificial
  CRISPR gRNA sequence
tgcagagaaaataggtgtat

SEQ ID NO: 537126 - DNA, 20 bp, Artificial
  CRISPR gRNA sequence
agaaaataggtgtattagat

SEQ ID NO: 537127 - DNA, 20 bp, Artificial
  CRISPR gRNA sequence
tgtattagataagcttcact

SEQ ID NO: 537128 - DNA, 20 bp, Artificial
  CRISPR gRNA sequence
gtattagataagcttcactt
